United States Patent 7,888,497 (BIOINFORMATICALLY DETECTABLE GROUP OF NOVEL REGULATORY OLIGONUCLEOTIDES AND USES THEREOF) - sequence listing, part 34

SEQ ID NO: 1413436 - DNA, 16 bp, Homo sapiens
atttaagatacaaata

SEQ ID NO: 1413437 - DNA, 11 bp, Homo sapiens
atttaatcttg

SEQ ID NO: 1413438 - DNA, 14 bp, Homo sapiens
atttaattatttgt

SEQ ID NO: 1413439 - DNA, 20 bp, Homo sapiens
atttaccacaggatgcatat

SEQ ID NO: 1413440 - DNA, 22 bp, Homo sapiens
atttatctaaggtccccagcag

SEQ ID NO: 1413441 - DNA, 23 bp, Homo sapiens
atttatctaaggtccccagcaga

SEQ ID NO: 1413442 - DNA, 18 bp, Homo sapiens
atttcaaaaacatgcttt

SEQ ID NO: 1413443 - DNA, 22 bp, Homo sapiens
atttcaaaaacatgcttttcca

SEQ ID NO: 1413444 - DNA, 14 bp, Homo sapiens
atttctaagccttt

SEQ ID NO: 1413445 - DNA, 16 bp, Homo sapiens
atttctagaacaatta

SEQ ID NO: 1413446 - DNA, 18 bp, Homo sapiens
atttctagaacaattaca

SEQ ID NO: 1413447 - DNA, 18 bp, Homo sapiens
atttctgtatctgacata

SEQ ID NO: 1413448 - DNA, 14 bp, Homo sapiens
atttgccaagtctc

SEQ ID NO: 1413449 - DNA, 15 bp, Homo sapiens
atttggcctcttgta

SEQ ID NO: 1413450 - DNA, 19 bp, Homo sapiens
atttgtagccaaagaaatt

SEQ ID NO: 1413451 - DNA, 12 bp, Homo sapiens
attttacacatt

SEQ ID NO: 1413452 - DNA, 16 bp, Homo sapiens
attttatttatctttg

SEQ ID NO: 1413453 - DNA, 16 bp, Homo sapiens
attttcaattatactg

SEQ ID NO: 1413454 - DNA, 17 bp, Homo sapiens
attttcctttatgtgat

SEQ ID NO: 1413455 - DNA, 18 bp, Homo sapiens
attttgcagctatggaca

SEQ ID NO: 1413456 - DNA, 19 bp, Homo sapiens
atttttggcaaagccagaa

SEQ ID NO: 1413457 - DNA, 20 bp, Homo sapiens
caaaaatagctcttgctttg

SEQ ID NO: 1413458 - DNA, 13 bp, Homo sapiens
caaaacccagctg

SEQ ID NO: 1413459 - DNA, 17 bp, Homo sapiens
caaaatcagaatggaat

SEQ ID NO: 1413460 - DNA, 17 bp, Homo sapiens
caaaatgagatatgcaa

SEQ ID NO: 1413461 - DNA, 19 bp, Homo sapiens
caaaatgagatatgcaata

SEQ ID NO: 1413462 - DNA, 22 bp, Homo sapiens
caaaatgagatatgcaataaat

SEQ ID NO: 1413463 - DNA, 16 bp, Homo sapiens
caaagatcaaatgaaa

SEQ ID NO: 1413464 - DNA, 11 bp, Homo sapiens
caaatacacat

SEQ ID NO: 1413465 - DNA, 12 bp, Homo sapiens
caaatacacata

SEQ ID NO: 1413466 - DNA, 20 bp, Homo sapiens
caaatacacatacatatata

SEQ ID NO: 1413467 - DNA, 17 bp, Homo sapiens
caaatagccagtgctag

SEQ ID NO: 1413468 - DNA, 19 bp, Homo sapiens
caaatgaaacctacaggaa

SEQ ID NO: 1413469 - DNA, 14 bp, Homo sapiens
caaatgcctgccaa

SEQ ID NO: 1413470 - DNA, 17 bp, Homo sapiens
caaatgcctgccaaatt

SEQ ID NO: 1413471 - DNA, 22 bp, Homo sapiens
caaatggctacatctccaaata

SEQ ID NO: 1413472 - DNA, 15 bp, Homo sapiens
caacaagttgaagaa

SEQ ID NO: 1413473 - DNA, 18 bp, Homo sapiens
caacaagttgaagaagct

SEQ ID NO: 1413474 - DNA, 19 bp, Homo sapiens
caacataatttttattttt

SEQ ID NO: 1413475 - DNA, 21 bp, Homo sapiens
caaccgggatgggagccgggc

SEQ ID NO: 1413476 - DNA, 16 bp, Homo sapiens
caacctgacagcaaac

SEQ ID NO: 1413477 - DNA, 21 bp, Homo sapiens
caacctgacagcaaacacagt

SEQ ID NO: 1413478 - DNA, 19 bp, Homo sapiens
caagcaaatgcctgccaaa

SEQ ID NO: 1413479 - DNA, 20 bp, Homo sapiens
caagcaaatgcctgccaaat

SEQ ID NO: 1413480 - DNA, 16 bp, Homo sapiens
caagcagacacacaca

SEQ ID NO: 1413481 - DNA, 12 bp, Homo sapiens
caaggagataag

SEQ ID NO: 1413482 - DNA, 14 bp, Homo sapiens
gaaagggacaagta

SEQ ID NO: 1413483 - DNA, 19 bp, Homo sapiens
gaaatattactctgcctgt

SEQ ID NO: 1413484 - DNA, 23 bp, Homo sapiens
gaaatgcattttgctagacagtt

SEQ ID NO: 1413485 - DNA, 13 bp, Homo sapiens
gaacacagtgaca

SEQ ID NO: 1413486 - DNA, 18 bp, Homo sapiens
gaacatgacccgtacaca

SEQ ID NO: 1413487 - DNA, 12 bp, Homo sapiens
gaacttgctgcc

SEQ ID NO: 1413488 - DNA, 13 bp, Homo sapiens
gaacttgctgcct

SEQ ID NO: 1413489 - DNA, 14 bp, Homo sapiens
gaacttgctgcctc

SEQ ID NO: 1413490 - DNA, 18 bp, Homo sapiens
gaagacaaatacacatac

SEQ ID NO: 1413491 - DNA, 20 bp, Homo sapiens
gaagaggtggccccatatta

SEQ ID NO: 1413492 - DNA, 15 bp, Homo sapiens
gaagatggatgtaat

SEQ ID NO: 1413493 - DNA, 15 bp, Homo sapiens
gaagtaaagtgaaga

SEQ ID NO: 1413494 - DNA, 15 bp, Homo sapiens
gaagtctgatccctg

SEQ ID NO: 1413495 - DNA, 21 bp, Homo sapiens
gaagtctgatccctgccaaaa

SEQ ID NO: 1413496 - DNA, 18 bp, Homo sapiens
gaataatagcacatgatt

SEQ ID NO: 1413497 - DNA, 17 bp, Homo sapiens
gaatgccacccacatct

SEQ ID NO: 1413498 - DNA, 24 bp, Homo sapiens
gaattgacagttgaacagagctag

SEQ ID NO: 1413499 - DNA, 13 bp, Homo sapiens
gacaaatacacat

SEQ ID NO: 1413500 - DNA, 18 bp, Homo sapiens
gacaaatacacatacata

SEQ ID NO: 1413501 - DNA, 14 bp, Homo sapiens
gacaatttaccaca

SEQ ID NO: 1413502 - DNA, 13 bp, Homo sapiens
gacacacacatat

SEQ ID NO: 1413503 - DNA, 17 bp, Homo sapiens
gacacacacatatatac

SEQ ID NO: 1413504 - DNA, 18 bp, Homo sapiens
gacaccaggcaagaaaag

SEQ ID NO: 1413505 - DNA, 15 bp, Homo sapiens
gacagcaaacacagt

SEQ ID NO: 1413506 - DNA, 23 bp, Homo sapiens
gacccaaccacagaggatgctga

SEQ ID NO: 1413507 - DNA, 19 bp, Homo sapiens
gacccagggaacagccact

SEQ ID NO: 1413508 - DNA, 22 bp, Homo sapiens
gacccagggaacagccactccc

SEQ ID NO: 1413509 - DNA, 20 bp, Homo sapiens
gactagagcacaacataatt

SEQ ID NO: 1413510 - DNA, 15 bp, Homo sapiens
gactagccagccagg

SEQ ID NO: 1413511 - DNA, 19 bp, Homo sapiens
gagagcccagagtcccccc

SEQ ID NO: 1413512 - DNA, 12 bp, Homo sapiens
gagataagaaag

SEQ ID NO: 1413513 - DNA, 13 bp, Homo sapiens
gagatatgcaata

SEQ ID NO: 1413514 - DNA, 21 bp, Homo sapiens
gagatgaaccctggcatttgg

SEQ ID NO: 1413515 - DNA, 18 bp, Homo sapiens
gagcccagagtcccccca

SEQ ID NO: 1413516 - DNA, 12 bp, Homo sapiens
gagccttcagca

SEQ ID NO: 1413517 - DNA, 21 bp, Homo sapiens
gagctccatacacacgctgcc

SEQ ID NO: 1413518 - DNA, 19 bp, Homo sapiens
gaggaggggcccccctgcc

SEQ ID NO: 1413519 - DNA, 21 bp, Homo sapiens
gaggaggggcccccctgccct

SEQ ID NO: 1413520 - DNA, 12 bp, Homo sapiens
gaggatgtatgt

SEQ ID NO: 1413521 - DNA, 13 bp, Homo sapiens
gaggatgtatgtg

SEQ ID NO: 1413522 - DNA, 16 bp, Homo sapiens
gaggccatctggagag

SEQ ID NO: 1413523 - DNA, 19 bp, Homo sapiens
gaggccatctggagagccc

SEQ ID NO: 1413524 - DNA, 17 bp, Homo sapiens
gagtaacagtcatcatt

SEQ ID NO: 1413525 - DNA, 18 bp, Homo sapiens
gatcacgatgtaaattat

SEQ ID NO: 1413526 - DNA, 20 bp, Homo sapiens
gatgaaccctggcatttggc

SEQ ID NO: 1413527 - DNA, 12 bp, Homo sapiens
gatgcatattaa

SEQ ID NO: 1413528 - DNA, 14 bp, Homo sapiens
gatgcatattaaag

SEQ ID NO: 1413529 - DNA, 15 bp, Homo sapiens
gatgcatattaaaga

SEQ ID NO: 1413530 - DNA, 10 bp, Homo sapiens
gatgcatttt

SEQ ID NO: 1413531 - DNA, 16 bp, Homo sapiens
gatgtgttgcaaaggt

SEQ ID NO: 1413532 - DNA, 16 bp, Homo sapiens
gattccccactcagcc

SEQ ID NO: 1413533 - DNA, 17 bp, Homo sapiens
gattccccactcagcct

SEQ ID NO: 1413534 - DNA, 19 bp, Homo sapiens
gatttatctaaggtcccca

SEQ ID NO: 1413535 - DNA, 21 bp, Homo sapiens
gatttatctaaggtccccagc

SEQ ID NO: 1413536 - DNA, 23 bp, Homo sapiens
gatttgctcaatacctggcctca

SEQ ID NO: 1413537 - DNA, 23 bp, Homo sapiens
gcaaactggccgcgggggcaggg

SEQ ID NO: 1413538 - DNA, 12 bp, Homo sapiens
gcaaagccagaa

SEQ ID NO: 1413539 - DNA, 16 bp, Homo sapiens
gcaagaaaagcgcaga

SEQ ID NO: 1413540 - DNA, 14 bp, Homo sapiens
gcaccagtccctgt

SEQ ID NO: 1413541 - DNA, 23 bp, Homo sapiens
gcaccccttcctgggcacacgct

SEQ ID NO: 1413542 - DNA, 14 bp, Homo sapiens
gcaccgccagccgc

SEQ ID NO: 1413543 - DNA, 14 bp, Homo sapiens
gcaccgcctcttcc

SEQ ID NO: 1413544 - DNA, 13 bp, Homo sapiens
gcacctgcagcca

SEQ ID NO: 1413545 - DNA, 19 bp, Homo sapiens
gcacctgcagccaagcaaa

SEQ ID NO: 1413546 - DNA, 19 bp, Homo sapiens
gcaccttccccctccccca

SEQ ID NO: 1413547 - DNA, 14 bp, Homo sapiens
gcactctggcagca

SEQ ID NO: 1413548 - DNA, 18 bp, Homo sapiens
gcagacacacacatatat

SEQ ID NO: 1413549 - DNA, 19 bp, Homo sapiens
gcagaggagaacttgctgc

SEQ ID NO: 1413550 - DNA, 16 bp, Homo sapiens
gcagcaccgcctcttc

SEQ ID NO: 1413551 - DNA, 14 bp, Homo sapiens
gcagctatggacaa

SEQ ID NO: 1413552 - DNA, 14 bp, Homo sapiens
gcaggcccatggga

SEQ ID NO: 1413553 - DNA, 17 bp, Homo sapiens
gcaggggaggccatctg

SEQ ID NO: 1413554 - DNA, 19 bp, Homo sapiens
gcaggggaggccatctgga

SEQ ID NO: 1413555 - DNA, 22 bp, Homo sapiens
gcatatatataaaatacacgtg

SEQ ID NO: 1413556 - DNA, 14 bp, Homo sapiens
gcattttacacatt

SEQ ID NO: 1413557 - DNA, 16 bp, Homo sapiens
gccaaaacccagctgc

SEQ ID NO: 1413558 - DNA, 22 bp, Homo sapiens
gccaaattttagatttaccttg

SEQ ID NO: 1413559 - DNA, 18 bp, Homo sapiens
gccagaaaaagatctttc

SEQ ID NO: 1413560 - DNA, 17 bp, Homo sapiens
gccagccgattcctcca

SEQ ID NO: 1413561 - DNA, 14 bp, Homo sapiens
gccagcctggctgg

SEQ ID NO: 1413562 - DNA, 13 bp, Homo sapiens
gccatctctgctc

SEQ ID NO: 1413563 - DNA, 15 bp, Homo sapiens
gccatctctgctcca

SEQ ID NO: 1413564 - DNA, 19 bp, Homo sapiens
gccatctggagagcccaga

SEQ ID NO: 1413565 - DNA, 15 bp, Homo sapiens
gccatgtctcctgca

SEQ ID NO: 1413566 - DNA, 11 bp, Homo sapiens
gcccactggcc

SEQ ID NO: 1413567 - DNA, 18 bp, Homo sapiens
gcccagagtccccccact

SEQ ID NO: 1413568 - DNA, 19 bp, Homo sapiens
gcccatttgggcagagagg

SEQ ID NO: 1413569 - DNA, 15 bp, Homo sapiens
gcccctccctctcca

SEQ ID NO: 1413570 - DNA, 23 bp, Homo sapiens
gcccctccctctccagcaggccc

SEQ ID NO: 1413571 - DNA, 18 bp, Homo sapiens
gccgattcctccagccct

SEQ ID NO: 1413572 - DNA, 19 bp, Homo sapiens
gccgattcctccagccctg

SEQ ID NO: 1413573 - DNA, 16 bp, Homo sapiens
gccggctttcaggagc

SEQ ID NO: 1413574 - DNA, 16 bp, Homo sapiens
gccgggcaaactggcc

SEQ ID NO: 1413575 - DNA, 20 bp, Homo sapiens
gcctcatcagtatttggact

SEQ ID NO: 1413576 - DNA, 17 bp, Homo sapiens
gcctcggatccccttcc

SEQ ID NO: 1413577 - DNA, 16 bp, Homo sapiens
gcctcttgtagtcttg

SEQ ID NO: 1413578 - DNA, 14 bp, Homo sapiens
gcctgatcagcagg

SEQ ID NO: 1413579 - DNA, 20 bp, Homo sapiens
gcctgctatgtatttgcaag

SEQ ID NO: 1413580 - DNA, 19 bp, Homo sapiens
gccttgggatccaggcccc

SEQ ID NO: 1413581 - DNA, 17 bp, Homo sapiens
gcctttgggtgctgttt

SEQ ID NO: 1413582 - DNA, 22 bp, Homo sapiens
gcctttgggtgctgttttgcca

SEQ ID NO: 1413583 - DNA, 22 bp, Homo sapiens
gccttttgggaataatagcaca

SEQ ID NO: 1413584 - DNA, 12 bp, Homo sapiens
gcgcagagaaat

SEQ ID NO: 1413585 - DNA, 13 bp, Homo sapiens
gcgggagggggcg

SEQ ID NO: 1413586 - DNA, 14 bp, Homo sapiens
gcgtgaaacacaat

SEQ ID NO: 1413587 - DNA, 14 bp, Homo sapiens
gctatggacaattt

SEQ ID NO: 1413588 - DNA, 22 bp, Homo sapiens
gctcaatacctggcctcattta

SEQ ID NO: 1413589 - DNA, 19 bp, Homo sapiens
gctccctcccaggactctg

SEQ ID NO: 1413590 - DNA, 21 bp, Homo sapiens
gctccctcccaggactctgac

SEQ ID NO: 1413591 - DNA, 12 bp, Homo sapiens
gctccctgactg

SEQ ID NO: 1413592 - DNA, 15 bp, Homo sapiens
gctctcatagctcat

SEQ ID NO: 1413593 - DNA, 13 bp, Homo sapiens
gctctgccccagc

SEQ ID NO: 1413594 - DNA, 22 bp, Homo sapiens
gctctgccccagcttgggcaga

SEQ ID NO: 1413595 - DNA, 22 bp, Homo sapiens
gctgaagggtaatatggactca

SEQ ID NO: 1413596 - DNA, 19 bp, Homo sapiens
gctgcaccccttcctgggc

SEQ ID NO: 1413597 - DNA, 20 bp, Homo sapiens
gctgcctcggatccccttcc

SEQ ID NO: 1413598 - DNA, 21 bp, Homo sapiens
gctgccttcggtacccaccac

SEQ ID NO: 1413599 - DNA, 12 bp, Homo sapiens
gctgctctgccc

SEQ ID NO: 1413600 - DNA, 23 bp, Homo sapiens
gctgtctttcttgctccctgact

SEQ ID NO: 1413601 - DNA, 22 bp, Homo sapiens
gctgtcttttctttgccatctc

SEQ ID NO: 1413602 - DNA, 13 bp, Homo sapiens
gctttcatgtaat

SEQ ID NO: 1413603 - DNA, 18 bp, Homo sapiens
ggaaactgagggcagaga

SEQ ID NO: 1413604 - DNA, 19 bp, Homo sapiens
ggaacacaaagatcaaatg

SEQ ID NO: 1413605 - DNA, 21 bp, Homo sapiens
ggaagttagtttttaatctct

SEQ ID NO: 1413606 - DNA, 19 bp, Homo sapiens
tcggtgtccccaccatctg

SEQ ID NO: 1413607 - DNA, 21 bp, Homo sapiens
tctaacgcaaaaatagctctt

SEQ ID NO: 1413608 - DNA, 23 bp, Homo sapiens
tctagaacaattacatgtaaaca

SEQ ID NO: 1413609 - DNA, 14 bp, Homo sapiens
tctcaatttaagat

SEQ ID NO: 1413610 - DNA, 23 bp, Homo sapiens
tctcactctgcccccccccccca

SEQ ID NO: 1413611 - DNA, 13 bp, Homo sapiens
tctccaccttcca

SEQ ID NO: 1413612 - DNA, 15 bp, Homo sapiens
tctccaccttccaaa

SEQ ID NO: 1413613 - DNA, 16 bp, Homo sapiens
tctccaccttccaaag

SEQ ID NO: 1413614 - DNA, 10 bp, Homo sapiens
tctcctcagg

SEQ ID NO: 1413615 - DNA, 18 bp, Homo sapiens
tctcctgcatagcttttc

SEQ ID NO: 1413616 - DNA, 16 bp, Homo sapiens
tctcgctccctcccag

SEQ ID NO: 1413617 - DNA, 12 bp, Homo sapiens
tctgagcacaga

SEQ ID NO: 1413618 - DNA, 16 bp, Homo sapiens
tctgcctgtcaagttt

SEQ ID NO: 1413619 - DNA, 13 bp, Homo sapiens
tctggtctatata

SEQ ID NO: 1413620 - DNA, 20 bp, Homo sapiens
tcttagttaatctttgaaaa

SEQ ID NO: 1413621 - DNA, 14 bp, Homo sapiens
tcttgtagtcttgg

SEQ ID NO: 1413622 - DNA, 16 bp, Homo sapiens
tcttgtattatcataa

SEQ ID NO: 1413623 - DNA, 16 bp, Homo sapiens
tctttgccatctctgc

SEQ ID NO: 1413624 - DNA, 17 bp, Homo sapiens
tctttgccatctctgct

SEQ ID NO: 1413625 - DNA, 20 bp, Homo sapiens
tctttgccatctctgctcca

SEQ ID NO: 1413626 - DNA, 13 bp, Homo sapiens
tgaaccctggcat

SEQ ID NO: 1413627 - DNA, 22 bp, Homo sapiens
tgaaccctggcatttggcctct

SEQ ID NO: 1413628 - DNA, 15 bp, Homo sapiens
tgaagctaaaacact

SEQ ID NO: 1413629 - DNA, 16 bp, Homo sapiens
tgacaccaggcaagaa

SEQ ID NO: 1413630 - DNA, 18 bp, Homo sapiens
tgaccagatatatagaag

SEQ ID NO: 1413631 - DNA, 20 bp, Homo sapiens
tgactgtacttgatttttca

SEQ ID NO: 1413632 - DNA, 21 bp, Homo sapiens
tgactgtacttgatttttcaa

SEQ ID NO: 1413633 - DNA, 22 bp, Homo sapiens
tgaggaggggcccccctgccct

SEQ ID NO: 1413634 - DNA, 22 bp, Homo sapiens
tgaggatgtatgtgtatatgtt

SEQ ID NO: 1413635 - DNA, 21 bp, Homo sapiens
tgatatgtctagggtgtgatt

SEQ ID NO: 1413636 - DNA, 13 bp, Homo sapiens
tgattatatttca

SEQ ID NO: 1413637 - DNA, 18 bp, Homo sapiens
tgatttgggctctagaat

SEQ ID NO: 1413638 - DNA, 18 bp, Homo sapiens
tgcaataaatattatttg

SEQ ID NO: 1413639 - DNA, 16 bp, Homo sapiens
tgcacctgcagccaag

SEQ ID NO: 1413640 - DNA, 17 bp, Homo sapiens
tgcacctgcagccaagc

SEQ ID NO: 1413641 - DNA, 15 bp, Homo sapiens
tgcaggaacatgacc

SEQ ID NO: 1413642 - DNA, 22 bp, Homo sapiens
tgcataatatgcatatatatgt

SEQ ID NO: 1413643 - DNA, 13 bp, Homo sapiens
tgcatatatatgt

SEQ ID NO: 1413644 - DNA, 13 bp, Homo sapiens
tgcatttgtggga

SEQ ID NO: 1413645 - DNA, 15 bp, Homo sapiens
tgccagcccatttgg

SEQ ID NO: 1413646 - DNA, 14 bp, Homo sapiens
tgcctgccaaattt

SEQ ID NO: 1413647 - DNA, 19 bp, Homo sapiens
tgccttcggtacccaccac

SEQ ID NO: 1413648 - DNA, 14 bp, Homo sapiens
tgccttgagaatga

SEQ ID NO: 1413649 - DNA, 16 bp, Homo sapiens
tgctaagcattagctt

SEQ ID NO: 1413650 - DNA, 16 bp, Homo sapiens
tgctcccctgctcggc

SEQ ID NO: 1413651 - DNA, 21 bp, Homo sapiens
tgctccctgactgggggcaga

SEQ ID NO: 1413652 - DNA, 15 bp, Homo sapiens
tgctctgccccagct

SEQ ID NO: 1413653 - DNA, 23 bp, Homo sapiens
tgctctgccccagcttgggcaga

SEQ ID NO: 1413654 - DNA, 14 bp, Homo sapiens
tgctgacatcattt

SEQ ID NO: 1413655 - DNA, 19 bp, Homo sapiens
tgctgcctcggatcccctt

SEQ ID NO: 1413656 - DNA, 20 bp, Homo sapiens
tgctgcctcggatccccttc

SEQ ID NO: 1413657 - DNA, 22 bp, Homo sapiens
tgctgtcttttctttgccatct

SEQ ID NO: 1413658 - DNA, 12 bp, Homo sapiens
tgctgtgcccct

SEQ ID NO: 1413659 - DNA, 16 bp, Homo sapiens
tgctgttttgccagcc

SEQ ID NO: 1413660 - DNA, 22 bp, Homo sapiens
tgctgttttgccagcccatttg

SEQ ID NO: 1413661 - DNA, 17 bp, Homo sapiens
tggaagacaaatacaca

SEQ ID NO: 1413662 - DNA, 16 bp, Homo sapiens
tggacccagggaacag

SEQ ID NO: 1413663 - DNA, 12 bp, Homo sapiens
tggactcagcct

SEQ ID NO: 1413664 - DNA, 19 bp, Homo sapiens
tggactcagccttgcaaat

SEQ ID NO: 1413665 - DNA, 16 bp, Homo sapiens
tggagagcccagagtc

SEQ ID NO: 1413666 - DNA, 21 bp, Homo sapiens
tggagatcccacatatttcaa

SEQ ID NO: 1413667 - DNA, 14 bp, Homo sapiens
tggatttcttttgt

SEQ ID NO: 1413668 - DNA, 17 bp, Homo sapiens
tggcactcaggtgctga

SEQ ID NO: 1413669 - DNA, 18 bp, Homo sapiens
tggccagtgacatttcaa

SEQ ID NO: 1413670 - DNA, 18 bp, Homo sapiens
tggcctcttgtagtcttg

SEQ ID NO: 1413671 - DNA, 21 bp, Homo sapiens
tggccttgggatccaggcccc

SEQ ID NO: 1413672 - DNA, 17 bp, Homo sapiens
tggctacatctccaaat

SEQ ID NO: 1413673 - DNA, 22 bp, Homo sapiens
tggctgcggggcgggcacacct

SEQ ID NO: 1413674 - DNA, 18 bp, Homo sapiens
tggctgggactgggaaca

SEQ ID NO: 1413675 - DNA, 15 bp, Homo sapiens
tgggaggctggagtt

SEQ ID NO: 1413676 - DNA, 15 bp, Homo sapiens
tgggatccaggcccc

SEQ ID NO: 1413677 - DNA, 15 bp, Homo sapiens
tgggcacacgctgct

SEQ ID NO: 1413678 - DNA, 17 bp, Homo sapiens
tgggcacacgctgctct

SEQ ID NO: 1413679 - DNA, 21 bp, Homo sapiens
tgggcacacgctgctctgccc

SEQ ID NO: 1413680 - DNA, 21 bp, Homo sapiens
tgggccagccgattcctccag

SEQ ID NO: 1413681 - DNA, 17 bp, Homo sapiens
tggggcagaggagaact

SEQ ID NO: 1413682 - DNA, 17 bp, Homo sapiens
tggtggggtctcctcag

SEQ ID NO: 1413683 - DNA, 23 bp, Homo sapiens
tggttccttctgatccacagcct

SEQ ID NO: 1413684 - DNA, 21 bp, Homo sapiens
tgtacacacacagacacacaa

SEQ ID NO: 1413685 - DNA, 22 bp, Homo sapiens
tgtagaagaaaatttaattatt

SEQ ID NO: 1413686 - DNA, 16 bp, Homo sapiens
tgtagccaaagaaatt

SEQ ID NO: 1413687 - DNA, 21 bp, Homo sapiens
tgtagtcttggctaaggaaat

SEQ ID NO: 1413688 - DNA, 21 bp, Homo sapiens
tgtagttttgtgatgcatttt

SEQ ID NO: 1413689 - DNA, 15 bp, Homo sapiens
tgtatatatatgtga

SEQ ID NO: 1413690 - DNA, 19 bp, Homo sapiens
tgtatctgacatatttcat

SEQ ID NO: 1413691 - DNA, 17 bp, Homo sapiens
tgtatggaagacaaata

SEQ ID NO: 1413692 - DNA, 23 bp, Homo sapiens
tgtatggaagacaaatacacata

SEQ ID NO: 1413693 - DNA, 19 bp, Homo sapiens
tgtattatgttccaaggct

SEQ ID NO: 1413694 - DNA, 16 bp, Homo sapiens
tgtcccctcccagagc

SEQ ID NO: 1413695 - DNA, 20 bp, Homo sapiens
tgtcttttctttgccatctc

SEQ ID NO: 1413696 - DNA, 21 bp, Homo sapiens
tgtgaactttctcagcatata

SEQ ID NO: 1413697 - DNA, 14 bp, Homo sapiens
tgtgatgcatttta

SEQ ID NO: 1413698 - DNA, 16 bp, Homo sapiens
tgtgatttaggtcagt

SEQ ID NO: 1413699 - DNA, 16 bp, Homo sapiens
tgtgtcttgtattatc

SEQ ID NO: 1413700 - DNA, 19 bp, Homo sapiens
tgttagaagaggtggcccc

SEQ ID NO: 1413701 - DNA, 14 bp, Homo sapiens
tgttcaatttcaga

SEQ ID NO: 1413702 - DNA, 21 bp, Homo sapiens
tgtttataatgtcaaatgaaa

SEQ ID NO: 1413703 - DNA, 17 bp, Homo sapiens
ttaaaatgaaatgcatt

SEQ ID NO: 1413704 - DNA, 20 bp, Homo sapiens
ttaaaatgaaatgcattttg

SEQ ID NO: 1413705 - DNA, 19 bp, Homo sapiens
ttaacaaattgcatttgtg

SEQ ID NO: 1413706 - DNA, 23 bp, Homo sapiens
ttaacactgagtgaaatattact

SEQ ID NO: 1413707 - DNA, 12 bp, Homo sapiens
ttaagattgaag

SEQ ID NO: 1413708 - DNA, 11 bp, Homo sapiens
ttaattgaaag

SEQ ID NO: 1413709 - DNA, 18 bp, Homo sapiens
ttacaatgtaatagaagc

SEQ ID NO: 1413710 - DNA, 20 bp, Homo sapiens
ttagtactcttctagcattt

SEQ ID NO: 1413711 - DNA, 18 bp, Homo sapiens
ttataacattgtatgtta

SEQ ID NO: 1413712 - DNA, 19 bp, Homo sapiens
ttataacattgtatgttaa

SEQ ID NO: 1413713 - DNA, 12 bp, Homo sapiens
ttatacacacag

SEQ ID NO: 1413714 - DNA, 18 bp, Homo sapiens
ttatacatttaaagattt

SEQ ID NO: 1413715 - DNA, 19 bp, Homo sapiens
ttatatttcacccatctct

SEQ ID NO: 1413716 - DNA, 18 bp, Homo sapiens
ttatcatcacaaatggct

SEQ ID NO: 1413717 - DNA, 13 bp, Homo sapiens
ttatgtgatgtaa

SEQ ID NO: 1413718 - DNA, 20 bp, Homo sapiens
ttattgccaaaacccagctg

SEQ ID NO: 1413719 - DNA, 15 bp, Homo sapiens
ttatttctgtatctg

SEQ ID NO: 1413720 - DNA, 15 bp, Homo sapiens
ttcaaaaacatgctt

SEQ ID NO: 1413721 - DNA, 23 bp, Homo sapiens
ttcaaaaacatgcttttccaaac

SEQ ID NO: 1413722 - DNA, 18 bp, Homo sapiens
ttcaaagacttcatttaa

SEQ ID NO: 1413723 - DNA, 15 bp, Homo sapiens
ttcaagtattatatt

SEQ ID NO: 1413724 - DNA, 22 bp, Homo sapiens
ttcatagacgcaaccttaactt

SEQ ID NO: 1413725 - DNA, 12 bp, Homo sapiens
ttcatgtaatta

SEQ ID NO: 1413726 - DNA, 14 bp, Homo sapiens
ttcatgtaattatc

SEQ ID NO: 1413727 - DNA, 13 bp, Homo sapiens
ttcatttaacact

SEQ ID NO: 1413728 - DNA, 21 bp, Homo sapiens
ttcatttaacactgagtgaaa

SEQ ID NO: 1413729 - DNA, 15 bp, Homo sapiens
ttccaaacccaggct

SEQ ID NO: 1413730 - DNA, 15 bp, Homo sapiens
aaaaattagccgggc

SEQ ID NO: 1413731 - DNA, 15 bp, Homo sapiens
aacctgggaggcaga

SEQ ID NO: 1413732 - DNA, 21 bp, Homo sapiens
aagctttgggggagtgggcgc

SEQ ID NO: 1413733 - DNA, 14 bp, Homo sapiens
aatcttatggggcc

SEQ ID NO: 1413734 - DNA, 16 bp, Homo sapiens
aatgtcagggccaggt

SEQ ID NO: 1413735 - DNA, 20 bp, Homo sapiens
acctctgtgggcactggtgg

SEQ ID NO: 1413736 - DNA, 16 bp, Homo sapiens
agagatcgagaccatc

SEQ ID NO: 1413737 - DNA, 17 bp, Homo sapiens
aggaatgtcagggccag

SEQ ID NO: 1413738 - DNA, 17 bp, Homo sapiens
aggctacctcacctggg

SEQ ID NO: 1413739 - DNA, 19 bp, Homo sapiens
agggatgatggcagagcca

SEQ ID NO: 1413740 - DNA, 13 bp, Homo sapiens
agtaactgtgact

SEQ ID NO: 1413741 - DNA, 14 bp, Homo sapiens
agtaactgtgactg

SEQ ID NO: 1413742 - DNA, 23 bp, Homo sapiens
agtcccttaatcttatggggccg

SEQ ID NO: 1413743 - DNA, 14 bp, Homo sapiens
agtcttctcctcca

SEQ ID NO: 1413744 - DNA, 16 bp, Homo sapiens
agtggctcacacctgt

SEQ ID NO: 1413745 - DNA, 13 bp, Homo sapiens
atggcagagccag

SEQ ID NO: 1413746 - DNA, 15 bp, Homo sapiens
atggcagagccaggc

SEQ ID NO: 1413747 - DNA, 16 bp, Homo sapiens
atggcagagccaggct

SEQ ID NO: 1413748 - DNA, 22 bp, Homo sapiens
atggcagagccaggctgttgga

SEQ ID NO: 1413749 - DNA, 21 bp, Homo sapiens
atggtggcacacgcctgtagt

SEQ ID NO: 1413750 - DNA, 23 bp, Homo sapiens
attgtaaaaccccatctctacta

SEQ ID NO: 1413751 - DNA, 15 bp, Homo sapiens
caaaaattagccggg

SEQ ID NO: 1413752 - DNA, 19 bp, Homo sapiens
cagggatgatggcagagcc

SEQ ID NO: 1413753 - DNA, 16 bp, Homo sapiens
caggtgcagaccttgg

SEQ ID NO: 1413754 - DNA, 17 bp, Homo sapiens
caggtgcagaccttggg

SEQ ID NO: 1413755 - DNA, 21 bp, Homo sapiens
caggtgcagaccttgggggaa

SEQ ID NO: 1413756 - DNA, 19 bp, Homo sapiens
catacaaaaattagccggg

SEQ ID NO: 1413757 - DNA, 15 bp, Homo sapiens
catccgcctgtgggc

SEQ ID NO: 1413758 - DNA, 23 bp, Homo sapiens
ccacctctgtgggcactggtggg

SEQ ID NO: 1413759 - DNA, 24 bp, Homo sapiens
ccagcactttgggaggccgaggtg

SEQ ID NO: 1413760 - DNA, 14 bp, Homo sapiens
ccaggtgcagacct

SEQ ID NO: 1413761 - DNA, 18 bp, Homo sapiens
ccaggtgcagaccttggg

SEQ ID NO: 1413762 - DNA, 16 bp, Homo sapiens
gcaccacctctgtggg

SEQ ID NO: 1413763 - DNA, 19 bp, Homo sapiens
gcagggatgatggcagagc

SEQ ID NO: 1413764 - DNA, 14 bp, Homo sapiens
gccaggtgcagacc

SEQ ID NO: 1413765 - DNA, 15 bp, Homo sapiens
gctacctcacctggg

SEQ ID NO: 1413766 - DNA, 17 bp, Homo sapiens
gctactcaggaggctga

SEQ ID NO: 1413767 - DNA, 23 bp, Homo sapiens
gctactcaggaggctgaggcagg

SEQ ID NO: 1413768 - DNA, 19 bp, Homo sapiens
gcttgaacctgggaggcag

SEQ ID NO: 1413769 - DNA, 16 bp, Homo sapiens
ggaatgtcagggccag

SEQ ID NO: 1413770 - DNA, 18 bp, Homo sapiens
ggaatgtcagggccaggt

SEQ ID NO: 1413771 - DNA, 16 bp, Homo sapiens
ggactgagctggggga

SEQ ID NO: 1413772 - DNA, 16 bp, Homo sapiens
ggccaggtgcagacct

SEQ ID NO: 1413773 - DNA, 21 bp, Homo sapiens
ggcctgaagtcttctcctcca

SEQ ID NO: 1413774 - DNA, 12 bp, Homo sapiens
ggctgaggcagg

SEQ ID NO: 1413775 - DNA, 20 bp, Homo sapiens
gggaggcagaggttgcagtg

SEQ ID NO: 1413776 - DNA, 18 bp, Homo sapiens
gggaggccgaggtgggca

SEQ ID NO: 1413777 - DNA, 19 bp, Homo sapiens
gggcagggatgatggcaga

SEQ ID NO: 1413778 - DNA, 20 bp, Homo sapiens
ggtgggcagatcatgggtca

SEQ ID NO: 1413779 - DNA, 16 bp, Homo sapiens
tacagtaactgtgact

SEQ ID NO: 1413780 - DNA, 16 bp, Homo sapiens
tcaggaggctgaggca

SEQ ID NO: 1413781 - DNA, 18 bp, Homo sapiens
tcaggaggctgaggcagg

SEQ ID NO: 1413782 - DNA, 14 bp, Homo sapiens
tcatccgcctgtgg

SEQ ID NO: 1413783 - DNA, 15 bp, Homo sapiens
tcatccgcctgtggg

SEQ ID NO: 1413784 - DNA, 20 bp, Homo sapiens
tcccagctactcaggaggct

SEQ ID NO: 1413785 - DNA, 14 bp, Homo sapiens
tctagcctggcaac

SEQ ID NO: 1413786 - DNA, 21 bp, Homo sapiens
tctagcctggcaacagagcga

SEQ ID NO: 1413787 - DNA, 14 bp, Homo sapiens
tgatggcagagcca

SEQ ID NO: 1413788 - DNA, 17 bp, Homo sapiens
tggcacacgcctgtagt

SEQ ID NO: 1413789 - DNA, 12 bp, Homo sapiens
tggcagagccag

SEQ ID NO: 1413790 - DNA, 14 bp, Homo sapiens
tggcagagccaggc

SEQ ID NO: 1413791 - DNA, 20 bp, Homo sapiens
tgggaggcagaggttgcagt

SEQ ID NO: 1413792 - DNA, 17 bp, Homo sapiens
tgggcactggtgggcca

SEQ ID NO: 1413793 - DNA, 20 bp, Homo sapiens
ttatcctgagtcccttaatc

SEQ ID NO: 1413794 - DNA, 18 bp, Homo sapiens
aagagatcgagaccatcc

SEQ ID NO: 1413795 - DNA, 21 bp, Homo sapiens
acatacaaaaattagccgggc

SEQ ID NO: 1413796 - DNA, 15 bp, Homo sapiens
accacctctgtgggc

SEQ ID NO: 1413797 - DNA, 21 bp, Homo sapiens
accattgcactctagcctggc

SEQ ID NO: 1413798 - DNA, 21 bp, Homo sapiens
acctctgtgggcactggtggg

SEQ ID NO: 1413799 - DNA, 23 bp, Homo sapiens
actctagcctggcaacagagcga

SEQ ID NO: 1413800 - DNA, 15 bp, Homo sapiens
actgagctgggggaa

SEQ ID NO: 1413801 - DNA, 21 bp, Homo sapiens
agaagggatatctactgtggt

SEQ ID NO: 1413802 - DNA, 15 bp, Homo sapiens
agagatcgagaccat

SEQ ID NO: 1413803 - DNA, 23 bp, Homo sapiens
agagatcgagaccatcctggcca

SEQ ID NO: 1413804 - DNA, 13 bp, Homo sapiens
agatcgagaccat

SEQ ID NO: 1413805 - DNA, 16 bp, Homo sapiens
agcactttgggaggcc

SEQ ID NO: 1413806 - DNA, 19 bp, Homo sapiens
aggaatgtcagggccaggt

SEQ ID NO: 1413807 - DNA, 16 bp, Homo sapiens
aggaggctgaggcagg

SEQ ID NO: 1413808 - DNA, 16 bp, Homo sapiens
aggccgaggtgggcag

SEQ ID NO: 1413809 - DNA, 17 bp, Homo sapiens
aggccgaggtgggcaga

SEQ ID NO: 1413810 - DNA, 21 bp, Homo sapiens
agggatatctactgtggtctg

SEQ ID NO: 1413811 - DNA, 18 bp, Homo sapiens
agggccaggtgcagacct

SEQ ID NO: 1413812 - DNA, 16 bp, Homo sapiens
aggtgcagaccttggg

SEQ ID NO: 1413813 - DNA, 14 bp, Homo sapiens
atcatgggtcaaga

SEQ ID NO: 1413814 - DNA, 14 bp, Homo sapiens
atccgcctgtgggc

SEQ ID NO: 1413815 - DNA, 15 bp, Homo sapiens
atgatggcagagcca

SEQ ID NO: 1413816 - DNA, 16 bp, Homo sapiens
atgatggcagagccag

SEQ ID NO: 1413817 - DNA, 18 bp, Homo sapiens
atggtggcacacgcctgt

SEQ ID NO: 1413818 - DNA, 16 bp, Homo sapiens
atgtcagggccaggtg

SEQ ID NO: 1413819 - DNA, 18 bp, Homo sapiens
attgcactctagcctggc

SEQ ID NO: 1413820 - DNA, 16 bp, Homo sapiens
cactctagcctggcaa

SEQ ID NO: 1413821 - DNA, 23 bp, Homo sapiens
cagggatgatggcagagccaggc

SEQ ID NO: 1413822 - DNA, 21 bp, Homo sapiens
catcatggactgagctggggg

SEQ ID NO: 1413823 - DNA, 20 bp, Homo sapiens
ccagctactcaggaggctga

SEQ ID NO: 1413824 - DNA, 13 bp, Homo sapiens
ccgaggtgggcag

SEQ ID NO: 1413825 - DNA, 11 bp, Homo sapiens
ccgcctgtggg

SEQ ID NO: 1413826 - DNA, 12 bp, Homo sapiens
cctcacctgggc

SEQ ID NO: 1413827 - DNA, 14 bp, Homo sapiens
cctgtgggcgcata

SEQ ID NO: 1413828 - DNA, 17 bp, Homo sapiens
ccttcatccgcctgtgg

SEQ ID NO: 1413829 - DNA, 18 bp, Homo sapiens
ccttcatccgcctgtggg

SEQ ID NO: 1413830 - DNA, 23 bp, Homo sapiens
ctactcaggaggctgaggcagga

SEQ ID NO: 1413831 - DNA, 19 bp, Homo sapiens
ctcaggaggctgaggcagg

SEQ ID NO: 1413832 - DNA, 17 bp, Homo sapiens
ctgagctgggggaagaa

SEQ ID NO: 1413833 - DNA, 15 bp, Homo sapiens
gaacctgggaggcag

SEQ ID NO: 1413834 - DNA, 17 bp, Homo sapiens
gaacctgggaggcagag

SEQ ID NO: 1413835 - DNA, 23 bp, Homo sapiens
gaatgtcagggccaggtgcagac

SEQ ID NO: 1413836 - DNA, 16 bp, Homo sapiens
gaggctacctcacctg

SEQ ID NO: 1413837 - DNA, 22 bp, Homo sapiens
gaggctacctcacctgggcagg

SEQ ID NO: 1413838 - DNA, 13 bp, Homo sapiens
gaggctgaggcag

SEQ ID NO: 1413839 - DNA, 17 bp, Homo sapiens
gagtgggcgcagtggct

SEQ ID NO: 1413840 - DNA, 17 bp, Homo sapiens
gatgatggcagagccag

SEQ ID NO: 1413841 - DNA, 13 bp, Homo sapiens
gatggcagagcca

SEQ ID NO: 1413842 - DNA, 14 bp, Homo sapiens
gatggcagagccag

SEQ ID NO: 1413843 - DNA, 16 bp, Homo sapiens
gatggcagagccaggc

SEQ ID NO: 1413844 - DNA, 23 bp, Homo sapiens
gatggcagagccaggctgttgga

SEQ ID NO: 1413845 - DNA, 15 bp, Homo sapiens
gcactctagcctggc

SEQ ID NO: 1413846 - DNA, 12 bp, Homo sapiens
gcagagccaggc

SEQ ID NO: 1413847 - DNA, 21 bp, Homo sapiens
gcagggatgatggcagagcca

SEQ ID NO: 1413848 - DNA, 15 bp, Homo sapiens
gccaggtgcagacct

SEQ ID NO: 1413849 - DNA, 22 bp, Homo sapiens
gccggaaggaatgtcagggcca

SEQ ID NO: 1413850 - DNA, 15 bp, Homo sapiens
gcctggcaacagagc

SEQ ID NO: 1413851 - DNA, 19 bp, Homo sapiens
gcctggcaacagagcgaga

SEQ ID NO: 1413852 - DNA, 22 bp, Homo sapiens
gcctgtagtcccagctactcag

SEQ ID NO: 1413853 - DNA, 13 bp, Homo sapiens
ggaggctgaggca

SEQ ID NO: 1413854 - DNA, 14 bp, Homo sapiens
ggcactggtgggcc

SEQ ID NO: 1413855 - DNA, 13 bp, Homo sapiens
ggcagagccaggc

SEQ ID NO: 1413856 - DNA, 15 bp, Homo sapiens
ggcagagccaggctg

SEQ ID NO: 1413857 - DNA, 22 bp, Homo sapiens
ggcagggatgatggcagagcca

SEQ ID NO: 1413858 - DNA, 19 bp, Homo sapiens
gtcaagagatcgagaccat

SEQ ID NO: 1413859 - DNA, 23 bp, Homo sapiens
gtctgggcaccacctctgtgggc

SEQ ID NO: 1413860 - DNA, 18 bp, Homo sapiens
tcatccgcctgtgggcgc

SEQ ID NO: 1413861 - DNA, 12 bp, Homo sapiens
tccgcctgtggg

SEQ ID NO: 1413862 - DNA, 20 bp, Homo sapiens
tcgagaccatcctggccaac

SEQ ID NO: 1413863 - DNA, 22 bp, Homo sapiens
tctagcctggcaacagagcgag

SEQ ID NO: 1413864 - DNA, 21 bp, Homo sapiens
tctgggcaccacctctgtggg

SEQ ID NO: 1413865 - DNA, 17 bp, Homo sapiens
tgaacctgggaggcaga

SEQ ID NO: 1413866 - DNA, 18 bp, Homo sapiens
tgaacctgggaggcagag

SEQ ID NO: 1413867 - DNA, 15 bp, Homo sapiens
tgatggcagagccag

SEQ ID NO: 1413868 - DNA, 17 bp, Homo sapiens
tggactgagctggggga

SEQ ID NO: 1413869 - DNA, 14 bp, Homo sapiens
tgggaggcagaggt

SEQ ID NO: 1413870 - DNA, 14 bp, Homo sapiens
tgggcactggtggg

SEQ ID NO: 1413871 - DNA, 14 bp, Homo sapiens
tgggcgcagtggct

SEQ ID NO: 1413872 - DNA, 17 bp, Homo sapiens
tgggcgcagtggctcac

SEQ ID NO: 1413873 - DNA, 18 bp, Homo sapiens
ttagccgggcatggtggc

SEQ ID NO: 1413874 - DNA, 18 bp, Homo sapiens
ttgaacctgggaggcaga

SEQ ID NO: 1413875 - DNA, 13 bp, Homo sapiens
cccgatggggcat

SEQ ID NO: 1413876 - DNA, 20 bp, Homo sapiens
cccttcatccgcctgtgggc

SEQ ID NO: 1413877 - DNA, 21 bp, Homo sapiens
ccggaaggaatgtcagggcca

SEQ ID NO: 1413878 - DNA, 22 bp, Homo sapiens
ccggaaggaatgtcagggccag

SEQ ID NO: 1413879 - DNA, 13 bp, Homo sapiens
cctgggaggcaga

SEQ ID NO: 1413880 - DNA, 21 bp, Homo sapiens
cgcttgaacctgggaggcaga

SEQ ID NO: 1413881 - DNA, 20 bp, Homo sapiens
cggaaggaatgtcagggcca

SEQ ID NO: 1413882 - DNA, 23 bp, Homo sapiens
cggaaggaatgtcagggccaggt

SEQ ID NO: 1413883 - DNA, 20 bp, Homo sapiens
ctgggcaccacctctgtggg

SEQ ID NO: 1413884 - DNA, 16 bp, Homo sapiens
ctgtgggcactggtgg

SEQ ID NO: 1413885 - DNA, 17 bp, Homo sapiens
ctgtgggcactggtggg

SEQ ID NO: 1413886 - DNA, 16 bp, Homo sapiens
cttcatccgcctgtgg

SEQ ID NO: 1413887 - DNA, 17 bp, Homo sapiens
cttccaggcctgaagtc

SEQ ID NO: 1413888 - DNA, 23 bp, Homo sapiens
gagccccttcatccgcctgtggg

SEQ ID NO: 1413889 - DNA, 18 bp, Homo sapiens
gaggccgaggtgggcaga

SEQ ID NO: 1413890 - DNA, 14 bp, Homo sapiens
gaggctgaggcagg

SEQ ID NO: 1413891 - DNA, 15 bp, Homo sapiens
gaggctgaggcagga

SEQ ID NO: 1413892 - DNA, 21 bp, Homo sapiens
gagtcccttaatcttatgggg

SEQ ID NO: 1413893 - DNA, 20 bp, Homo sapiens
gatcgagaccatcctggcca

SEQ ID NO: 1413894 - DNA, 16 bp, Homo sapiens
gatgatggcagagcca

SEQ ID NO: 1413895 - DNA, 19 bp, Homo sapiens
gatgatggcagagccaggc

SEQ ID NO: 1413896 - DNA, 23 bp, Homo sapiens
gcaccattgcactctagcctggc

SEQ ID NO: 1413897 - DNA, 19 bp, Homo sapiens
gcagagccaggctgttgga

SEQ ID NO: 1413898 - DNA, 20 bp, Homo sapiens
gcagggatgatggcagagcc

SEQ ID NO: 1413899 - DNA, 14 bp, Homo sapiens
gccaggctgttgga

SEQ ID NO: 1413900 - DNA, 19 bp, Homo sapiens
gccaggtgcagaccttggg

SEQ ID NO: 1413901 - DNA, 20 bp, Homo sapiens
gcctgaagtcttctcctcca

SEQ ID NO: 1413902 - DNA, 21 bp, Homo sapiens
gcctgtgggcgcatactacag

SEQ ID NO: 1413903 - DNA, 22 bp, Homo sapiens
gctactcaggaggctgaggcag

SEQ ID NO: 1413904 - DNA, 20 bp, Homo sapiens
gcttgaacctgggaggcaga

SEQ ID NO: 1413905 - DNA, 20 bp, Homo sapiens
ggaaggaatgtcagggccag

SEQ ID NO: 1413906 - DNA, 19 bp, Homo sapiens
ggaatgtcagggccaggtg

SEQ ID NO: 1413907 - DNA, 18 bp, Homo sapiens
ggaggccgaggtgggcag

SEQ ID NO: 1413908 - DNA, 19 bp, Homo sapiens
ggaggctacctcacctggg

SEQ ID NO: 1413909 - DNA, 15 bp, Homo sapiens
ggaggctgaggcagg

SEQ ID NO: 1413910 - DNA, 17 bp, Homo sapiens
ggatgatggcagagcca

SEQ ID NO: 1413911 - DNA, 18 bp, Homo sapiens
ggatgatggcagagccag

SEQ ID NO: 1413912 - DNA, 20 bp, Homo sapiens
ggcacacgcctgtagtccca

SEQ ID NO: 1413913 - DNA, 23 bp, Homo sapiens
ggccggaaggaatgtcagggcca

SEQ ID NO: 1413914 - DNA, 19 bp, Homo sapiens
ggctacctcacctgggcag

SEQ ID NO: 1413915 - DNA, 19 bp, Homo sapiens
gggaggccgaggtgggcag

SEQ ID NO: 1413916 - DNA, 18 bp, Homo sapiens
gggatgatggcagagcca

SEQ ID NO: 1413917 - DNA, 13 bp, Homo sapiens
gggggagtgggcg

SEQ ID NO: 1413918 - DNA, 15 bp, Homo sapiens
gtgggcactggtggg

SEQ ID NO: 1413919 - DNA, 17 bp, Homo sapiens
tacaaaaattagccggg

SEQ ID NO: 1413920 - DNA, 21 bp, Homo sapiens
tactcaggaggctgaggcagg

SEQ ID NO: 1413921 - DNA, 20 bp, Homo sapiens
tcagggccaggtgcagacct

SEQ ID NO: 1413922 - DNA, 15 bp, Homo sapiens
tcatgggtcaagaga

SEQ ID NO: 1413923 - DNA, 13 bp, Homo sapiens
tccgcctgtgggc

SEQ ID NO: 1413924 - DNA, 17 bp, Homo sapiens
tctgtgggcactggtgg

SEQ ID NO: 1413925 - DNA, 22 bp, Homo sapiens
tggaggctacctcacctgggca

SEQ ID NO: 1413926 - DNA, 11 bp, Homo sapiens
tggcagagcca

SEQ ID NO: 1413927 - DNA, 23 bp, Homo sapiens
tgggggaagactttaaaccacct

SEQ ID NO: 1413928 - DNA, 18 bp, Homo sapiens
tggtggcacacgcctgta

SEQ ID NO: 1413929 - DNA, 15 bp, Homo sapiens
ttcatccgcctgtgg

SEQ ID NO: 1413930 - DNA, 22 bp, Homo sapiens
ttccaggcctgaagtcttctcc

SEQ ID NO: 1413931 - DNA, 21 bp, Homo sapiens
actcaggaggctgaggcagga

SEQ ID NO: 1413932 - DNA, 12 bp, Homo sapiens
actggtgggcca

SEQ ID NO: 1413933 - DNA, 11 bp, Homo sapiens
agatcatgggt

SEQ ID NO: 1413934 - DNA, 20 bp, Homo sapiens
aggaatgtcagggccaggtg

SEQ ID NO: 1413935 - DNA, 21 bp, Homo sapiens
aggctacctcacctgggcagg

SEQ ID NO: 1413936 - DNA, 18 bp, Homo sapiens
agggatgatggcagagcc

SEQ ID NO: 1413937 - DNA, 20 bp, Homo sapiens
agggatgatggcagagccag

SEQ ID NO: 1413938 - DNA, 22 bp, Homo sapiens
agggatgatggcagagccaggc

SEQ ID NO: 1413939 - DNA, 15 bp, Homo sapiens
agggccaggtgcaga

SEQ ID NO: 1413940 - DNA, 19 bp, Homo sapiens
atacaaaaattagccgggc

SEQ ID NO: 1413941 - DNA, 13 bp, Homo sapiens
atccgcctgtggg

SEQ ID NO: 1413942 - DNA, 12 bp, Homo sapiens
atcctggccaac

SEQ ID NO: 1413943 - DNA, 21 bp, Homo sapiens
atgatggcagagccaggctgt

SEQ ID NO: 1413944 - DNA, 12 bp, Homo sapiens
atggcagagcca

SEQ ID NO: 1413945 - DNA, 19 bp, Homo sapiens
attgcactctagcctggca

SEQ ID NO: 1413946 - DNA, 14 bp, Homo sapiens
cacacgcctgtagt

SEQ ID NO: 1413947 - DNA, 16 bp, Homo sapiens
caccacctctgtgggc

SEQ ID NO: 1413948 - DNA, 23 bp, Homo sapiens
cacctctgtgggcactggtgggc

SEQ ID NO: 1413949 - DNA, 23 bp, Homo sapiens
cacctgggcagggatgatggcag

SEQ ID NO: 1413950 - DNA, 14 bp, Homo sapiens
cactctagcctggc

SEQ ID NO: 1413951 - DNA, 11 bp, Homo sapiens
cagagccaggc

SEQ ID NO: 1413952 - DNA, 18 bp, Homo sapiens
cagagccaggctgttgga

SEQ ID NO: 1413953 - DNA, 22 bp, Homo sapiens
caggagaatcgcttgaacctgg

SEQ ID NO: 1413954 - DNA, 23 bp, Homo sapiens
caggagaatcgcttgaacctggg

SEQ ID NO: 1413955 - DNA, 18 bp, Homo sapiens
caggaggctgaggcagga

SEQ ID NO: 1413956 - DNA, 19 bp, Homo sapiens
caggcctgaagtcttctcc

SEQ ID NO: 1413957 - DNA, 17 bp, Homo sapiens
cagggatgatggcagag

SEQ ID NO: 1413958 - DNA, 19 bp, Homo sapiens
cagggccaggtgcagacct

SEQ ID NO: 1413959 - DNA, 20 bp, Homo sapiens
cagggccaggtgcagacctt

SEQ ID NO: 1413960 - DNA, 23 bp, Homo sapiens
cagggccaggtgcagaccttggg

SEQ ID NO: 1413961 - DNA, 15 bp, Homo sapiens
catggactgagctgg

SEQ ID NO: 1413962 - DNA, 19 bp, Homo sapiens
catggactgagctggggga

SEQ ID NO: 1413963 - DNA, 20 bp, Homo sapiens
ccagcactttgggaggccga

SEQ ID NO: 1413964 - DNA, 14 bp, Homo sapiens
ccgcctgtgggcgc

SEQ ID NO: 1413965 - DNA, 14 bp, Homo sapiens
ccgggcatggtggc

SEQ ID NO: 1413966 - DNA, 15 bp, Homo sapiens
cctgcttccaggcct

SEQ ID NO: 1413967 - DNA, 17 bp, Homo sapiens
cctggcaacagagcgag

SEQ ID NO: 1413968 - DNA, 20 bp, Homo sapiens
cctgggaggcagaggttgca

SEQ ID NO: 1413969 - DNA, 22 bp, Homo sapiens
cctgggcagggatgatggcaga

SEQ ID NO: 1413970 - DNA, 17 bp, Homo sapiens
cgagaccatcctggcca

SEQ ID NO: 1413971 - DNA, 15 bp, Homo sapiens
ctacctcacctgggc

SEQ ID NO: 1413972 - DNA, 16 bp, Homo sapiens
ctacctcacctgggca

SEQ ID NO: 1413973 - DNA, 20 bp, Homo sapiens
ctcacctgggcagggatgat

SEQ ID NO: 1413974 - DNA, 18 bp, Homo sapiens
ctcaggaggctgaggcag

SEQ ID NO: 1413975 - DNA, 22 bp, Homo sapiens
ctctagcctggcaacagagcga

SEQ ID NO: 1413976 - DNA, 12 bp, Homo sapiens
ctgggaggcaga

SEQ ID NO: 1413977 - DNA, 13 bp, Homo sapiens
ctgggaggcagag

SEQ ID NO: 1413978 - DNA, 20 bp, Homo sapiens
ctgggcagggatgatggcag

SEQ ID NO: 1413979 - DNA, 19 bp, Homo sapiens
cttgaacctgggaggcaga

SEQ ID NO: 1413980 - DNA, 16 bp, Homo sapiens
gaacctgggaggcaga

SEQ ID NO: 1413981 - DNA, 20 bp, Homo sapiens
gaagactttaaaccacctag

SEQ ID NO: 1413982 - DNA, 19 bp, Homo sapiens
gaaggaatgtcagggccag

SEQ ID NO: 1413983 - DNA, 19 bp, Homo sapiens
gaatcgcttgaacctggga

SEQ ID NO: 1413984 - DNA, 15 bp, Homo sapiens
gaatgtcagggccag

SEQ ID NO: 1413985 - DNA, 19 bp, Homo sapiens
gactttatcctgagtccct

SEQ ID NO: 1413986 - DNA, 17 bp, Homo sapiens
gcaccacctctgtgggc

SEQ ID NO: 1413987 - DNA, 11 bp, Homo sapiens
gcactggtggg

SEQ ID NO: 1413988 - DNA, 22 bp, Homo sapiens
gcagggatgatggcagagccag

SEQ ID NO: 1413989 - DNA, 20 bp, Homo sapiens
gccccttcatccgcctgtgg

SEQ ID NO: 1413990 - DNA, 15 bp, Homo sapiens
gccgaggtgggcaga

SEQ ID NO: 1413991 - DNA, 23 bp, Homo sapiens
gccggaaggaatgtcagggccag

SEQ ID NO: 1413992 - DNA, 17 bp, Homo sapiens
gcctggcaacagagcga

SEQ ID NO: 1413993 - DNA, 18 bp, Homo sapiens
gcctggcaacagagcgag

SEQ ID NO: 1413994 - DNA, 23 bp, Homo sapiens
gctttgggggagtgggcgcagtg

SEQ ID NO: 1413995 - DNA, 23 bp, Homo sapiens
ggaaggaatgtcagggccaggtg

SEQ ID NO: 1413996 - DNA, 15 bp, Homo sapiens
ggaatgtcagggcca

SEQ ID NO: 1413997 - DNA, 20 bp, Homo sapiens
ggaggctacctcacctgggc

SEQ ID NO: 1413998 - DNA, 16 bp, Homo sapiens
ggatatctactgtggt

SEQ ID NO: 1413999 - DNA, 20 bp, Homo sapiens
ggatgatggcagagccaggc

SEQ ID NO: 1414000 - DNA, 12 bp, Homo sapiens
ggcactggtggg

SEQ ID NO: 1414001 - DNA, 23 bp, Homo sapiens
ggcatggtggcacacgcctgtag

SEQ ID NO: 1414002 - DNA, 15 bp, Homo sapiens
ggccgaggtgggcag

SEQ ID NO: 1414003 - DNA, 22 bp, Homo sapiens
gggatgatggcagagccaggct

SEQ ID NO: 1414004 - DNA, 23 bp, Homo sapiens
gggcagggatgatggcagagcca

SEQ ID NO: 1414005 - DNA, 17 bp, Homo sapiens
gggccaggtgcagacct

SEQ ID NO: 1414006 - DNA, 17 bp, Homo sapiens
ggtggcacacgcctgta

SEQ ID NO: 1414007 - DNA, 14 bp, Homo sapiens
gtcagggccaggtg

SEQ ID NO: 1414008 - DNA, 19 bp, Homo sapiens
tagcctggcaacagagcga

SEQ ID NO: 1414009 - DNA, 19 bp, Homo sapiens
tcaggaggctgaggcagga

SEQ ID NO: 1414010 - DNA, 17 bp, Homo sapiens
tcagggccaggtgcaga

SEQ ID NO: 1414011 - DNA, 23 bp, Homo sapiens
tcagggccaggtgcagaccttgg

SEQ ID NO: 1414012 - DNA, 23 bp, Homo sapiens
tctgggcaccacctctgtgggca

SEQ ID NO: 1414013 - DNA, 23 bp, Homo sapiens
tgagccccttcatccgcctgtgg

SEQ ID NO: 1414014 - DNA, 16 bp, Homo sapiens
tgcactctagcctggc

SEQ ID NO: 1414015 - DNA, 14 bp, Homo sapiens
tggcaacagagcga

SEQ ID NO: 1414016 - DNA, 16 bp, Homo sapiens
tggcagagccaggctg

SEQ ID NO: 1414017 - DNA, 22 bp, Homo sapiens
tggccaacattgtaaaacccca

SEQ ID NO: 1414018 - DNA, 22 bp, Homo sapiens
tgggcaccacctctgtgggcac

SEQ ID NO: 1414019 - DNA, 20 bp, Homo sapiens
tggtggcacacgcctgtagt

SEQ ID NO: 1414020 - DNA, 15 bp, Homo sapiens
tgtcagggccaggtg

SEQ ID NO: 1414021 - DNA, 22 bp, Homo sapiens
tgtcagggccaggtgcagacct

SEQ ID NO: 1414022 - DNA, 16 bp, Homo sapiens
ttcatccgcctgtggg

SEQ ID NO: 1414023 - DNA, 12 bp, Homo sapiens
ttgaacctggga

SEQ ID NO: 1414024 - DNA, 20 bp, Homo sapiens
ttgcactctagcctggcaac

SEQ ID NO: 1414025 - DNA, 23 bp, Homo sapiens
aatgagccccttcatccgcctgt

SEQ ID NO: 1414026 - DNA, 22 bp, Homo sapiens
acatcatggactgagctggggg

SEQ ID NO: 1414027 - DNA, 22 bp, Homo sapiens
actcaaatgagccccttcatcc

SEQ ID NO: 1414028 - DNA, 19 bp, Homo sapiens
actcaggaggctgaggcag

SEQ ID NO: 1414029 - DNA, 19 bp, Homo sapiens
agaccttgggggaagactt

SEQ ID NO: 1414030 - DNA, 22 bp, Homo sapiens
agcactttgggaggccgaggtg

SEQ ID NO: 1414031 - DNA, 21 bp, Homo sapiens
agccccttcatccgcctgtgg

SEQ ID NO: 1414032 - DNA, 18 bp, Homo sapiens
agcctggcaacagagcga

SEQ ID NO: 1414033 - DNA, 19 bp, Homo sapiens
agcctggcaacagagcgag

SEQ ID NO: 1414034 - DNA, 15 bp, Homo sapiens
aggaatgtcagggcc

SEQ ID NO: 1414035 - DNA, 16 bp, Homo sapiens
aggaatgtcagggcca

SEQ ID NO: 1414036 - DNA, 20 bp, Homo sapiens
aggagaatcgcttgaacctg

SEQ ID NO: 1414037 - DNA, 22 bp, Homo sapiens
aggagaatcgcttgaacctggg

SEQ ID NO: 1414038 - DNA, 17 bp, Homo sapiens
aggaggctgaggcagga

SEQ ID NO: 1414039 - DNA, 14 bp, Homo sapiens
aggcctgaagtctt

SEQ ID NO: 1414040 - DNA, 14 bp, Homo sapiens
aggctgaggcagga

SEQ ID NO: 1414041 - DNA, 23 bp, Homo sapiens
aggctgttggaaaatccagaact

SEQ ID NO: 1414042 - DNA, 22 bp, Homo sapiens
agggccaggtgcagaccttggg

SEQ ID NO: 1414043 - DNA, 23 bp, Homo sapiens
agtcttctcctccatgaacatca

SEQ ID NO: 1414044 - DNA, 12 bp, Homo sapiens
agtgggcgcagt

SEQ ID NO: 1414045 - DNA, 22 bp, Homo sapiens
atccgcctgtgggcgcatacta

SEQ ID NO: 1414046 - DNA, 17 bp, Homo sapiens
atcgagaccatcctggc

SEQ ID NO: 1414047 - DNA, 16 bp, Homo sapiens
atcgcttgaacctggg

SEQ ID NO: 1414048 - DNA, 17 bp, Homo sapiens
atgaacatcatggactg

SEQ ID NO: 1414049 - DNA, 16 bp, Homo sapiens
atgagccccttcatcc

SEQ ID NO: 1414050 - DNA, 18 bp, Homo sapiens
atgatggcagagccaggc

SEQ ID NO: 1414051 - DNA, 20 bp, Homo sapiens
atgtcagggccaggtgcaga

SEQ ID NO: 1414052 - DNA, 21 bp, Homo sapiens
cacctagttctccccgatggg

SEQ ID NO: 1414053 - DNA, 12 bp, Homo sapiens
cacctctgtggg

SEQ ID NO: 1414054 - DNA, 18 bp, Homo sapiens
cagaccttgggggaagac

SEQ ID NO: 1414055 - DNA, 19 bp, Homo sapiens
cagagccaggctgttggaa

SEQ ID NO: 1414056 - DNA, 19 bp, Homo sapiens
cagatcatgggtcaagaga

SEQ ID NO: 1414057 - DNA, 17 bp, Homo sapiens
caggaggctgaggcagg

SEQ ID NO: 1414058 - DNA, 22 bp, Homo sapiens
caggctgttggaaaatccagaa

SEQ ID NO: 1414059 - DNA, 20 bp, Homo sapiens
cagggatgatggcagagcca

SEQ ID NO: 1414060 - DNA, 12 bp, Homo sapiens
cagggccaggtg

SEQ ID NO: 1414061 - DNA, 13 bp, Homo sapiens
caggtgcagacct

SEQ ID NO: 1414062 - DNA, 12 bp, Homo sapiens
catcctggccaa

SEQ ID NO: 1414063 - DNA, 13 bp, Homo sapiens
catcctggccaac

SEQ ID NO: 1414064 - DNA, 14 bp, Homo sapiens
catgggtcaagaga

SEQ ID NO: 1414065 - DNA, 20 bp, Homo sapiens
catggtggcacacgcctgta

SEQ ID NO: 1414066 - DNA, 23 bp, Homo sapiens
cattgcactctagcctggcaaca

SEQ ID NO: 1414067 - DNA, 13 bp, Homo sapiens
ccacctctgtggg

SEQ ID NO: 1414068 - DNA, 14 bp, Homo sapiens
ccacctctgtgggc

SEQ ID NO: 1414069 - DNA, 20 bp, Homo sapiens
ccattgcactctagcctggc

SEQ ID NO: 1414070 - DNA, 18 bp, Homo sapiens
cccttcatccgcctgtgg

SEQ ID NO: 1414071 - DNA, 16 bp, Homo sapiens
cctggcaacagagcga

SEQ ID NO: 1414072 - DNA, 23 bp, Homo sapiens
cctggcaacagagcgagattcca

SEQ ID NO: 1414073 - DNA, 20 bp, Homo sapiens
ctcaggaggctgaggcagga

SEQ ID NO: 1414074 - DNA, 23 bp, Homo sapiens
ctctagcctggcaacagagcgag

SEQ ID NO: 1414075 - DNA, 18 bp, Homo sapiens
ctgaagtcttctcctcca

SEQ ID NO: 1414076 - DNA, 15 bp, Homo sapiens
ctggcaacagagcga

SEQ ID NO: 1414077 - DNA, 22 bp, Homo sapiens
ctgggaggcagaggttgcagtg

SEQ ID NO: 1414078 - DNA, 22 bp, Homo sapiens
ctgggcaccacctctgtgggca

SEQ ID NO: 1414079 - DNA, 17 bp, Homo sapiens
cttcatccgcctgtggg

SEQ ID NO: 1414080 - DNA, 18 bp, Homo sapiens
ctttgggggagtgggcgc

SEQ ID NO: 1414081 - DNA, 22 bp, Homo sapiens
ctttgggggagtgggcgcagtg

SEQ ID NO: 1414082 - DNA, 15 bp, Homo sapiens
gactgagctggggga

SEQ ID NO: 1414083 - DNA, 16 bp, Homo sapiens
gagaccatcctggcca

SEQ ID NO: 1414084 - DNA, 18 bp, Homo sapiens
gaggctacctcacctggg

SEQ ID NO: 1414085 - DNA, 12 bp, Homo sapiens
aaaaaaaaagca

SEQ ID NO: 1414086 - DNA, 13 bp, Homo sapiens
aaaaaaaaagtca

SEQ ID NO: 1414087 - DNA, 11 bp, Homo sapiens
aaaaaaaacaa

SEQ ID NO: 1414088 - DNA, 11 bp, Homo sapiens
aaaaaaaatgg

SEQ ID NO: 1414089 - DNA, 11 bp, Homo sapiens
aaaaaaaatgt

SEQ ID NO: 1414090 - DNA, 18 bp, Homo sapiens
aaaaaaacagtggatcac

SEQ ID NO: 1414091 - DNA, 11 bp, Homo sapiens
aaaaaaagaaa

SEQ ID NO: 1414092 - DNA, 12 bp, Homo sapiens
aaaaaaagatga

SEQ ID NO: 1414093 - DNA, 11 bp, Homo sapiens
aaaaaaagcaa

SEQ ID NO: 1414094 - DNA, 13 bp, Homo sapiens
aaaaaaagcctcc

SEQ ID NO: 1414095 - DNA, 14 bp, Homo sapiens
aaaaaaagcctcca

SEQ ID NO: 1414096 - DNA, 11 bp, Homo sapiens
aaaaaaagtta

SEQ ID NO: 1414097 - DNA, 10 bp, Homo sapiens
aaaaaaataa

SEQ ID NO: 1414098 - DNA, 12 bp, Homo sapiens
aaaaaaataaaa

SEQ ID NO: 1414099 - DNA, 12 bp, Homo sapiens
aaaaaaataaca

SEQ ID NO: 1414100 - DNA, 11 bp, Homo sapiens
aaaaaaatagt

SEQ ID NO: 1414101 - DNA, 12 bp, Homo sapiens
aaaaaaatgaca

SEQ ID NO: 1414102 - DNA, 13 bp, Homo sapiens
aaaaaaattctgt

SEQ ID NO: 1414103 - DNA, 12 bp, Homo sapiens
aaaaaaattttt

SEQ ID NO: 1414104 - DNA, 12 bp, Homo sapiens
aaaaaacaaagc

SEQ ID NO: 1414105 - DNA, 22 bp, Homo sapiens
aaaaaacagccaccgtttcttc

SEQ ID NO: 1414106 - DNA, 15 bp, Homo sapiens
aaaaaactctttggt

SEQ ID NO: 1414107 - DNA, 13 bp, Homo sapiens
aaaaaagaaccaa

SEQ ID NO: 1414108 - DNA, 12 bp, Homo sapiens
aaaaaagcaaaa

SEQ ID NO: 1414109 - DNA, 11 bp, Homo sapiens
aaaaaagcatg

SEQ ID NO: 1414110 - DNA, 13 bp, Homo sapiens
aaaaaagcctcca

SEQ ID NO: 1414111 - DNA, 13 bp, Homo sapiens
aaaaaaggaaaaa

SEQ ID NO: 1414112 - DNA, 19 bp, Homo sapiens
aaaaaaggacaatttcaaa

SEQ ID NO: 1414113 - DNA, 22 bp, Homo sapiens
aaaaaagtacaattcattgttt

SEQ ID NO: 1414114 - DNA, 16 bp, Homo sapiens
aaaaaagtcaccaaat

SEQ ID NO: 1414115 - DNA, 12 bp, Homo sapiens
aaaaaagtttta

SEQ ID NO: 1414116 - DNA, 21 bp, Homo sapiens
aaaaaagtttttaatttgatg

SEQ ID NO: 1414117 - DNA, 17 bp, Homo sapiens
aaaaaagtttttgcttc

SEQ ID NO: 1414118 - DNA, 13 bp, Homo sapiens
aaaacaaaacaaa

SEQ ID NO: 1414119 - DNA, 13 bp, Homo sapiens
aaaacaaaaccaa

SEQ ID NO: 1414120 - DNA, 15 bp, Homo sapiens
aaaacaaaattttat

SEQ ID NO: 1414121 - DNA, 19 bp, Homo sapiens
aaaacaacttggcatttct

SEQ ID NO: 1414122 - DNA, 20 bp, Homo sapiens
aaaacaacttggcatttcta

SEQ ID NO: 1414123 - DNA, 12 bp, Homo sapiens
aaaacaacttta

SEQ ID NO: 1414124 - DNA, 15 bp, Homo sapiens
aaaacaagaatgaaa

SEQ ID NO: 1414125 - DNA, 15 bp, Homo sapiens
aaaacaataatgcaa

SEQ ID NO: 1414126 - DNA, 19 bp, Homo sapiens
aaaacaatattactttgtc

SEQ ID NO: 1414127 - DNA, 21 bp, Homo sapiens
aaaacaatattactttgtctt

SEQ ID NO: 1414128 - DNA, 15 bp, Homo sapiens
aaaacaatattgttt

SEQ ID NO: 1414129 - DNA, 13 bp, Homo sapiens
aaaacaatgccat

SEQ ID NO: 1414130 - DNA, 22 bp, Homo sapiens
aaaacaatgccatgaacaaatt

SEQ ID NO: 1414131 - DNA, 23 bp, Homo sapiens
aaaacaatgccatgaacaaattc

SEQ ID NO: 1414132 - DNA, 16 bp, Homo sapiens
aaaacaatttcttttt

SEQ ID NO: 1414133 - DNA, 15 bp, Homo sapiens
aaaacacaagcaaaa

SEQ ID NO: 1414134 - DNA, 21 bp, Homo sapiens
aaaacaccatggagatgaaat

SEQ ID NO: 1414135 - DNA, 14 bp, Homo sapiens
aaaacactagtttt

SEQ ID NO: 1414136 - DNA, 19 bp, Homo sapiens
aaaacacttggcatacaaa

SEQ ID NO: 1414137 - DNA, 21 bp, Homo sapiens
aaaacagaacatcattagaac

SEQ ID NO: 1414138 - DNA, 16 bp, Homo sapiens
aaaacagaatttgaga

SEQ ID NO: 1414139 - DNA, 19 bp, Homo sapiens
aaaacagctgcattagaaa

SEQ ID NO: 1414140 - DNA, 19 bp, Homo sapiens
aaaacaggcaaagttttac

SEQ ID NO: 1414141 - DNA, 19 bp, Homo sapiens
aaaacagtggatcacaaag

SEQ ID NO: 1414142 - DNA, 16 bp, Homo sapiens
aaaacatagcatctca

SEQ ID NO: 1414143 - DNA, 16 bp, Homo sapiens
aaaacatctattctct

SEQ ID NO: 1414144 - DNA, 21 bp, Homo sapiens
aaaacatgcttgaataactga

SEQ ID NO: 1414145 - DNA, 12 bp, Homo sapiens
aaaacatgtcat

SEQ ID NO: 1414146 - DNA, 14 bp, Homo sapiens
aaaacatgtcatgt

SEQ ID NO: 1414147 - DNA, 20 bp, Homo sapiens
aaaacatgtttaaatagcct

SEQ ID NO: 1414148 - DNA, 12 bp, Homo sapiens
aaaacatttaat

SEQ ID NO: 1414149 - DNA, 17 bp, Homo sapiens
aaaacatttactgacca

SEQ ID NO: 1414150 - DNA, 13 bp, Homo sapiens
aaaacatttgctg

SEQ ID NO: 1414151 - DNA, 14 bp, Homo sapiens
aaaacattttttag

SEQ ID NO: 1414152 - DNA, 14 bp, Homo sapiens
aaaaccacagcagt

SEQ ID NO: 1414153 - DNA, 17 bp, Homo sapiens
aaaaccactagaactct

SEQ ID NO: 1414154 - DNA, 19 bp, Homo sapiens
aaaaccatcagatatttct

SEQ ID NO: 1414155 - DNA, 20 bp, Homo sapiens
aaaaccatgcctggtatttt

SEQ ID NO: 1414156 - DNA, 19 bp, Homo sapiens
aaaacccttgggccagaag

SEQ ID NO: 1414157 - DNA, 20 bp, Homo sapiens
aaaacccttgggccagaagt

SEQ ID NO: 1414158 - DNA, 21 bp, Homo sapiens
aaaacctaagtcctttatgtg

SEQ ID NO: 1414159 - DNA, 20 bp, Homo sapiens
aaaacctccagtagtggaca

SEQ ID NO: 1414160 - DNA, 22 bp, Homo sapiens
aaaacctgcctaaattaaattg

SEQ ID NO: 1414161 - DNA, 18 bp, Homo sapiens
aaaacctgggattatata

SEQ ID NO: 1414162 - DNA, 22 bp, Homo sapiens
aaaaccttgtaaaaaaagcaaa

SEQ ID NO: 1414163 - DNA, 17 bp, Homo sapiens
aaaaccttgtgtaagag

SEQ ID NO: 1414164 - DNA, 22 bp, Homo sapiens
aaaacgatctaaaggtaggcag

SEQ ID NO: 1414165 - DNA, 19 bp, Homo sapiens
aaaacgatgaagttatgct

SEQ ID NO: 1414166 - DNA, 20 bp, Homo sapiens
aaaactaagctctttgagaa

SEQ ID NO: 1414167 - DNA, 13 bp, Homo sapiens
aaaactcattttt

SEQ ID NO: 1414168 - DNA, 12 bp, Homo sapiens
aaaaaatggaaa

SEQ ID NO: 1414169 - DNA, 13 bp, Homo sapiens
aaaaaatgtaaca

SEQ ID NO: 1414170 - DNA, 16 bp, Homo sapiens
aaaaacaaatgttcat

SEQ ID NO: 1414171 - DNA, 20 bp, Homo sapiens
aaaaacaacatcattccaaa

SEQ ID NO: 1414172 - DNA, 15 bp, Homo sapiens
aaaaacaatcttatt

SEQ ID NO: 1414173 - DNA, 12 bp, Homo sapiens
aaaaacacagca

SEQ ID NO: 1414174 - DNA, 14 bp, Homo sapiens
aaaaacagaggcca

SEQ ID NO: 1414175 - DNA, 17 bp, Homo sapiens
aaaaacagcattgcttt

SEQ ID NO: 1414176 - DNA, 19 bp, Homo sapiens
aaaaacagcattgctttct

SEQ ID NO: 1414177 - DNA, 18 bp, Homo sapiens
aaaaacagccaccgtttc

SEQ ID NO: 1414178 - DNA, 19 bp, Homo sapiens
aaaaacagcctcacagaag

SEQ ID NO: 1414179 - DNA, 19 bp, Homo sapiens
aaaaacaggtatatacttt

SEQ ID NO: 1414180 - DNA, 15 bp, Homo sapiens
aaaaacatattcttg

SEQ ID NO: 1414181 - DNA, 13 bp, Homo sapiens
aaaaacatgtcat

SEQ ID NO: 1414182 - DNA, 19 bp, Homo sapiens
aaaaacccagcaacagaaa

SEQ ID NO: 1414183 - DNA, 11 bp, Homo sapiens
aaaaacctgcc

SEQ ID NO: 1414184 - DNA, 22 bp, Homo sapiens
aaaaactagaaggcttctctcc

SEQ ID NO: 1414185 - DNA, 12 bp, Homo sapiens
aaaaactgaatg

SEQ ID NO: 1414186 - DNA, 18 bp, Homo sapiens
aaaaactggatatttcaa

SEQ ID NO: 1414187 - DNA, 15 bp, Homo sapiens
aaaaactgtctttaa

SEQ ID NO: 1414188 - DNA, 15 bp, Homo sapiens
aaaaacttgtactat

SEQ ID NO: 1414189 - DNA, 14 bp, Homo sapiens
aaaaagaaaagata

SEQ ID NO: 1414190 - DNA, 14 bp, Homo sapiens
aaaaagaagtaggg

SEQ ID NO: 1414191 - DNA, 17 bp, Homo sapiens
aaaaagaatgaagcctc

SEQ ID NO: 1414192 - DNA, 22 bp, Homo sapiens
aaaaagactgaacatgtttaca

SEQ ID NO: 1414193 - DNA, 23 bp, Homo sapiens
aaaaagactgaacatgtttacag

SEQ ID NO: 1414194 - DNA, 19 bp, Homo sapiens
aaaaagactttaaaagtga

SEQ ID NO: 1414195 - DNA, 10 bp, Homo sapiens
aaaaagagaa

SEQ ID NO: 1414196 - DNA, 12 bp, Homo sapiens
aaaaagagaaac

SEQ ID NO: 1414197 - DNA, 17 bp, Homo sapiens
aaaaagagtaatttcat

SEQ ID NO: 1414198 - DNA, 22 bp, Homo sapiens
aaaaagcagagtggactgcatt

SEQ ID NO: 1414199 - DNA, 13 bp, Homo sapiens
aaaaagcagctac

SEQ ID NO: 1414200 - DNA, 21 bp, Homo sapiens
aaaaagcagctaccaggtgtt

SEQ ID NO: 1414201 - DNA, 14 bp, Homo sapiens
aaaaagcagtcctc

SEQ ID NO: 1414202 - DNA, 14 bp, Homo sapiens
aaaaagcagttctt

SEQ ID NO: 1414203 - DNA, 20 bp, Homo sapiens
aaaaagcataaaaacatttt

SEQ ID NO: 1414204 - DNA, 23 bp, Homo sapiens
aaaaagccagtttgggtaaaata

SEQ ID NO: 1414205 - DNA, 16 bp, Homo sapiens
aaaaagcctacattct

SEQ ID NO: 1414206 - DNA, 12 bp, Homo sapiens
aaaaagcctcca

SEQ ID NO: 1414207 - DNA, 20 bp, Homo sapiens
aaaaagcctccaagggtttc

SEQ ID NO: 1414208 - DNA, 12 bp, Homo sapiens
aaaaagccttcc

SEQ ID NO: 1414209 - DNA, 22 bp, Homo sapiens
aaaaagctaatccctaaaatag

SEQ ID NO: 1414210 - DNA, 14 bp, Homo sapiens
aaaaaggaaaaata

SEQ ID NO: 1414211 - DNA, 17 bp, Homo sapiens
aaaaaggaaacttcctt

SEQ ID NO: 1414212 - DNA, 15 bp, Homo sapiens
aaaaaggaaatttgt

SEQ ID NO: 1414213 - DNA, 22 bp, Homo sapiens
aaaaaggaccaactggcttctg

SEQ ID NO: 1414214 - DNA, 14 bp, Homo sapiens
aaaaaggcaaataa

SEQ ID NO: 1414215 - DNA, 17 bp, Homo sapiens
aaaaaggcattgtttga

SEQ ID NO: 1414216 - DNA, 14 bp, Homo sapiens
aaaaaggctgaaaa

SEQ ID NO: 1414217 - DNA, 21 bp, Homo sapiens
aaaaagggatccgtacattca

SEQ ID NO: 1414218 - DNA, 19 bp, Homo sapiens
aaaaagggctgtccatgta

SEQ ID NO: 1414219 - DNA, 23 bp, Homo sapiens
aaaaagtaatgacttagaaactg

SEQ ID NO: 1414220 - DNA, 19 bp, Homo sapiens
aaaaagtaatgatttcttg

SEQ ID NO: 1414221 - DNA, 17 bp, Homo sapiens
aaaaagtgacacagcag

SEQ ID NO: 1414222 - DNA, 22 bp, Homo sapiens
aaacctactttttatgtgctat

SEQ ID NO: 1414223 - DNA, 17 bp, Homo sapiens
aaacctcaaatatagta

SEQ ID NO: 1414224 - DNA, 23 bp, Homo sapiens
aaacctcactgagaggcctggag

SEQ ID NO: 1414225 - DNA, 18 bp, Homo sapiens
aaacctcatgacagccag

SEQ ID NO: 1414226 - DNA, 12 bp, Homo sapiens
aaacctccagcc

SEQ ID NO: 1414227 - DNA, 16 bp, Homo sapiens
aaacctgacttcagtg

SEQ ID NO: 1414228 - DNA, 18 bp, Homo sapiens
aaacctgggattcaggaa

SEQ ID NO: 1414229 - DNA, 12 bp, Homo sapiens
aaacctggttca

SEQ ID NO: 1414230 - DNA, 21 bp, Homo sapiens
aaacctggttcatatttatac

SEQ ID NO: 1414231 - DNA, 22 bp, Homo sapiens
aaacctggttcatatttatact

SEQ ID NO: 1414232 - DNA, 14 bp, Homo sapiens
aaacctgtgccagg

SEQ ID NO: 1414233 - DNA, 17 bp, Homo sapiens
aaacctgttaaaacaac

SEQ ID NO: 1414234 - DNA, 19 bp, Homo sapiens
aaacctgttgaagattatt

SEQ ID NO: 1414235 - DNA, 21 bp, Homo sapiens
aaacctgttgaagattatttc

SEQ ID NO: 1414236 - DNA, 20 bp, Homo sapiens
aaacctgtttttttttcatt

SEQ ID NO: 1414237 - DNA, 18 bp, Homo sapiens
aaaccttattgtacctct

SEQ ID NO: 1414238 - DNA, 16 bp, Homo sapiens
aaaccttgctctcctc

SEQ ID NO: 1414239 - DNA, 19 bp, Homo sapiens
aaaccttgtaaaaaaagca

SEQ ID NO: 1414240 - DNA, 21 bp, Homo sapiens
aaaccttgtaaaaaaagcaaa

SEQ ID NO: 1414241 - DNA, 13 bp, Homo sapiens
aaaccttttattt

SEQ ID NO: 1414242 - DNA, 15 bp, Homo sapiens
aaacgaataaagata

SEQ ID NO: 1414243 - DNA, 16 bp, Homo sapiens
aaacgagatttgccaa

SEQ ID NO: 1414244 - DNA, 12 bp, Homo sapiens
aaacgctacctc

SEQ ID NO: 1414245 - DNA, 18 bp, Homo sapiens
aaacgctacctctctgtc

SEQ ID NO: 1414246 - DNA, 12 bp, Homo sapiens
aaacggcagcct

SEQ ID NO: 1414247 - DNA, 23 bp, Homo sapiens
aaacggtttttttctttggctgc

SEQ ID NO: 1414248 - DNA, 19 bp, Homo sapiens
aaacgtcccacactttgaa

SEQ ID NO: 1414249 - DNA, 14 bp, Homo sapiens
aaacgtcctcttta

SEQ ID NO: 1414250 - DNA, 15 bp, Homo sapiens
aaacgtctattttgt

SEQ ID NO: 1414251 - DNA, 19 bp, Homo sapiens
aaactaaaaaaaaaaaggc

SEQ ID NO: 1414252 - DNA, 20 bp, Homo sapiens
aaactaaaaaaaaaaaggcc

SEQ ID NO: 1414253 - DNA, 13 bp, Homo sapiens
aaactaaatttca

SEQ ID NO: 1414254 - DNA, 20 bp, Homo sapiens
aaactaacagataagcaaga

SEQ ID NO: 1414255 - DNA, 15 bp, Homo sapiens
aaactaaccttgaat

SEQ ID NO: 1414256 - DNA, 17 bp, Homo sapiens
aaactaaccttgaataa

SEQ ID NO: 1414257 - DNA, 20 bp, Homo sapiens
aaactaaccttgaataaggc

SEQ ID NO: 1414258 - DNA, 12 bp, Homo sapiens
aaactaagagaa

SEQ ID NO: 1414259 - DNA, 13 bp, Homo sapiens
aaactaagagaaa

SEQ ID NO: 1414260 - DNA, 16 bp, Homo sapiens
aaactaatattttatg

SEQ ID NO: 1414261 - DNA, 16 bp, Homo sapiens
aaactacaaagtaaaa

SEQ ID NO: 1414262 - DNA, 20 bp, Homo sapiens
aaactacaaagtaaaatgaa

SEQ ID NO: 1414263 - DNA, 15 bp, Homo sapiens
aaactacatattgta

SEQ ID NO: 1414264 - DNA, 16 bp, Homo sapiens
aaactacattttgcaa

SEQ ID NO: 1414265 - DNA, 14 bp, Homo sapiens
aaactacctctgga

SEQ ID NO: 1414266 - DNA, 16 bp, Homo sapiens
aaactactgaatgaag

SEQ ID NO: 1414267 - DNA, 20 bp, Homo sapiens
aaactactgaatgaagcagt

SEQ ID NO: 1414268 - DNA, 17 bp, Homo sapiens
aaactaggaaatttttt

SEQ ID NO: 1414269 - DNA, 17 bp, Homo sapiens
aaactagtttccagtgg

SEQ ID NO: 1414270 - DNA, 14 bp, Homo sapiens
aaactatcttgtgt

SEQ ID NO: 1414271 - DNA, 16 bp, Homo sapiens
aaactatggttcccaa

SEQ ID NO: 1414272 - DNA, 14 bp, Homo sapiens
aaactatgttccta

SEQ ID NO: 1414273 - DNA, 18 bp, Homo sapiens
aaactatttatatcacac

SEQ ID NO: 1414274 - DNA, 13 bp, Homo sapiens
aaactatttatct

SEQ ID NO: 1414275 - DNA, 15 bp, Homo sapiens
aaactatttgcgact

SEQ ID NO: 1414276 - DNA, 22 bp, Homo sapiens
aaactcaaccatgtcatctttt

SEQ ID NO: 1414277 - DNA, 21 bp, Homo sapiens
aaactcactcagtaaaacata

SEQ ID NO: 1414278 - DNA, 17 bp, Homo sapiens
aaactcagttaaaatgt

SEQ ID NO: 1414279 - DNA, 20 bp, Homo sapiens
aaactcagttcaaaccattt

SEQ ID NO: 1414280 - DNA, 22 bp, Homo sapiens
aaactcatttcctatgtaactg

SEQ ID NO: 1414281 - DNA, 20 bp, Homo sapiens
aaactccatctcaaaacaaa

SEQ ID NO: 1414282 - DNA, 11 bp, Homo sapiens
aaactcctgac

SEQ ID NO: 1414283 - DNA, 14 bp, Homo sapiens
aaactccttcctgg

SEQ ID NO: 1414284 - DNA, 19 bp, Homo sapiens
aaactccttttgctgtctt

SEQ ID NO: 1414285 - DNA, 21 bp, Homo sapiens
aaactctcatttatattgcag

SEQ ID NO: 1414286 - DNA, 18 bp, Homo sapiens
aaactctgaaggagagga

SEQ ID NO: 1414287 - DNA, 22 bp, Homo sapiens
aaactctggacactctatatgt

SEQ ID NO: 1414288 - DNA, 11 bp, Homo sapiens
aaactcttcag

SEQ ID NO: 1414289 - DNA, 18 bp, Homo sapiens
aaactgaagcagcctctc

SEQ ID NO: 1414290 - DNA, 14 bp, Homo sapiens
aaactgaagccaga

SEQ ID NO: 1414291 - DNA, 23 bp, Homo sapiens
aaactgaatacctaagatttctg

SEQ ID NO: 1414292 - DNA, 11 bp, Homo sapiens
aaactgagcct

SEQ ID NO: 1414293 - DNA, 18 bp, Homo sapiens
aaactgaggaattttctt

SEQ ID NO: 1414294 - DNA, 16 bp, Homo sapiens
aaactgcaatagagac

SEQ ID NO: 1414295 - DNA, 22 bp, Homo sapiens
aaactgcaatagagactgtaga

SEQ ID NO: 1414296 - DNA, 14 bp, Homo sapiens
aaactgcattagaa

SEQ ID NO: 1414297 - DNA, 15 bp, Homo sapiens
aaactggatatttca

SEQ ID NO: 1414298 - DNA, 17 bp, Homo sapiens
aaactggatatttcaat

SEQ ID NO: 1414299 - DNA, 18 bp, Homo sapiens
aaactggatatttcaatc

SEQ ID NO: 1414300 - DNA, 19 bp, Homo sapiens
aaactggatatttcaatct

SEQ ID NO: 1414301 - DNA, 20 bp, Homo sapiens
aaactggcatctgacacaaa

SEQ ID NO: 1414302 - DNA, 21 bp, Homo sapiens
aaactggctggcccagagttt

SEQ ID NO: 1414303 - DNA, 12 bp, Homo sapiens
aaactgggaaac

SEQ ID NO: 1414304 - DNA, 17 bp, Homo sapiens
aaactgggaaactgggt

SEQ ID NO: 1414305 - DNA, 22 bp, Homo sapiens
aaactggtattttatctttgat

SEQ ID NO: 1414306 - DNA, 17 bp, Homo sapiens
aaactgtaaataaaatg

SEQ ID NO: 1414307 - DNA, 21 bp, Homo sapiens
aaactgtaaataaaatgtgta

SEQ ID NO: 1414308 - DNA, 14 bp, Homo sapiens
aaactgtactgtgt

SEQ ID NO: 1414309 - DNA, 16 bp, Homo sapiens
aaactgtagtctcagg

SEQ ID NO: 1414310 - DNA, 21 bp, Homo sapiens
aaactgtatcaaatctgtata

SEQ ID NO: 1414311 - DNA, 19 bp, Homo sapiens
aaactgtctttaaaagaga

SEQ ID NO: 1414312 - DNA, 16 bp, Homo sapiens
aaactgtgaaaatagt

SEQ ID NO: 1414313 - DNA, 22 bp, Homo sapiens
aaactgtgaaaatagtgtaaga

SEQ ID NO: 1414314 - DNA, 14 bp, Homo sapiens
aaactgtgcaatcc

SEQ ID NO: 1414315 - DNA, 16 bp, Homo sapiens
aaactgtgtattccaa

SEQ ID NO: 1414316 - DNA, 18 bp, Homo sapiens
aaactgtgtattccaaga

SEQ ID NO: 1414317 - DNA, 12 bp, Homo sapiens
aaactgtttgtt

SEQ ID NO: 1414318 - DNA, 14 bp, Homo sapiens
aaacttaaaaacaa

SEQ ID NO: 1414319 - DNA, 17 bp, Homo sapiens
aaacttaaatgttatta

SEQ ID NO: 1414320 - DNA, 15 bp, Homo sapiens
aaacttaagggcaag

SEQ ID NO: 1414321 - DNA, 15 bp, Homo sapiens
aaacttactattttg

SEQ ID NO: 1414322 - DNA, 17 bp, Homo sapiens
aaacttagaggaaaagg

SEQ ID NO: 1414323 - DNA, 21 bp, Homo sapiens
aaacttagtgcggacaagttt

SEQ ID NO: 1414324 - DNA, 23 bp, Homo sapiens
aaacttatgctagtttattggaa

SEQ ID NO: 1414325 - DNA, 20 bp, Homo sapiens
aaacttcagtttcacagaaa

SEQ ID NO: 1414326 - DNA, 21 bp, Homo sapiens
aaacttcatgtaattttattt

SEQ ID NO: 1414327 - DNA, 20 bp, Homo sapiens
aaacttccacaagagtgaat

SEQ ID NO: 1414328 - DNA, 23 bp, Homo sapiens
aaacttccatgaggccaaacgtt

SEQ ID NO: 1414329 - DNA, 21 bp, Homo sapiens
aaacttccctttctgcttgtg

SEQ ID NO: 1414330 - DNA, 21 bp, Homo sapiens
aaacttctttttaatcttaag

SEQ ID NO: 1414331 - DNA, 22 bp, Homo sapiens
aaacttgaaagaagttttatgc

SEQ ID NO: 1414332 - DNA, 15 bp, Homo sapiens
aaacttgaaatatat

SEQ ID NO: 1414333 - DNA, 19 bp, Homo sapiens
aaacttgactccatttcat

SEQ ID NO: 1414334 - DNA, 21 bp, Homo sapiens
aaacttgagttggagtactat

SEQ ID NO: 1414335 - DNA, 22 bp, Homo sapiens
aaacttgatgtgttatctctta

SEQ ID NO: 1414336 - DNA, 15 bp, Homo sapiens
aaacttgattatatt

SEQ ID NO: 1414337 - DNA, 15 bp, Homo sapiens
aaacttggattctct

SEQ ID NO: 1414338 - DNA, 20 bp, Homo sapiens
aaaagctatttaaagcatct

SEQ ID NO: 1414339 - DNA, 15 bp, Homo sapiens
aaaagctcctggggc

SEQ ID NO: 1414340 - DNA, 13 bp, Homo sapiens
aaaagctctttta

SEQ ID NO: 1414341 - DNA, 15 bp, Homo sapiens
aaaagctcttttaat

SEQ ID NO: 1414342 - DNA, 19 bp, Homo sapiens
aaaagctgaacacatttct

SEQ ID NO: 1414343 - DNA, 18 bp, Homo sapiens
aaaagcttaatgattctg

SEQ ID NO: 1414344 - DNA, 13 bp, Homo sapiens
aaaagctttcatg

SEQ ID NO: 1414345 - DNA, 11 bp, Homo sapiens
aaaaggaaaaa

SEQ ID NO: 1414346 - DNA, 14 bp, Homo sapiens
aaaaggaaaaataa

SEQ ID NO: 1414347 - DNA, 16 bp, Homo sapiens
aaaaggaaaagttaaa

SEQ ID NO: 1414348 - DNA, 11 bp, Homo sapiens
aaaaggaaagc

SEQ ID NO: 1414349 - DNA, 13 bp, Homo sapiens
aaaaggaaagctg

SEQ ID NO: 1414350 - DNA, 22 bp, Homo sapiens
aaaaggaaatattctttctcat

SEQ ID NO: 1414351 - DNA, 12 bp, Homo sapiens
aaaaggaaattt

SEQ ID NO: 1414352 - DNA, 13 bp, Homo sapiens
aaaaggaaatttg

SEQ ID NO: 1414353 - DNA, 16 bp, Homo sapiens
aaaaggaacaaataaa

SEQ ID NO: 1414354 - DNA, 13 bp, Homo sapiens
aaaaggaagacta

SEQ ID NO: 1414355 - DNA, 15 bp, Homo sapiens
aaaaggaagactaga

SEQ ID NO: 1414356 - DNA, 18 bp, Homo sapiens
aaaaggagagaagaaagt

SEQ ID NO: 1414357 - DNA, 14 bp, Homo sapiens
aaaaggataagtga

SEQ ID NO: 1414358 - DNA, 15 bp, Homo sapiens
aaaaggatttaagca

SEQ ID NO: 1414359 - DNA, 17 bp, Homo sapiens
aaaaggcattgtttgag

SEQ ID NO: 1414360 - DNA, 15 bp, Homo sapiens
aaaaggccaaagata

SEQ ID NO: 1414361 - DNA, 17 bp, Homo sapiens
aaaaggccaaagataaa

SEQ ID NO: 1414362 - DNA, 14 bp, Homo sapiens
aaaaggcccatgta

SEQ ID NO: 1414363 - DNA, 13 bp, Homo sapiens
aaaaggctgaaaa

SEQ ID NO: 1414364 - DNA, 15 bp, Homo sapiens
aaaaggctgagaagg

SEQ ID NO: 1414365 - DNA, 17 bp, Homo sapiens
aaaaggctgagaaggaa

SEQ ID NO: 1414366 - DNA, 14 bp, Homo sapiens
aaaaggcttgaagc

SEQ ID NO: 1414367 - DNA, 15 bp, Homo sapiens
aaaagggtgtatagt

SEQ ID NO: 1414368 - DNA, 19 bp, Homo sapiens
aaaaggtatgcaatcaaat

SEQ ID NO: 1414369 - DNA, 20 bp, Homo sapiens
aaaaggtgtccttttccttt

SEQ ID NO: 1414370 - DNA, 15 bp, Homo sapiens
aaaaggttgaataat

SEQ ID NO: 1414371 - DNA, 16 bp, Homo sapiens
aaaaggttgccaaatt

SEQ ID NO: 1414372 - DNA, 20 bp, Homo sapiens
aaaaggttgcctgaaaaatg

SEQ ID NO: 1414373 - DNA, 22 bp, Homo sapiens
aaaaggtttctttttttttcct

SEQ ID NO: 1414374 - DNA, 23 bp, Homo sapiens
aaaaggtttctttttttttcctt

SEQ ID NO: 1414375 - DNA, 20 bp, Homo sapiens
aaaagtaacaaggtgtcttt

SEQ ID NO: 1414376 - DNA, 23 bp, Homo sapiens
aaaagtaagtaccactcaggcca

SEQ ID NO: 1414377 - DNA, 22 bp, Homo sapiens
aaaagtaatgacttagaaactg

SEQ ID NO: 1414378 - DNA, 14 bp, Homo sapiens
aaaagtagagaaat

SEQ ID NO: 1414379 - DNA, 22 bp, Homo sapiens
aaaagtatagatacaaaacctt

SEQ ID NO: 1414380 - DNA, 13 bp, Homo sapiens
aaaagtatatgtt

SEQ ID NO: 1414381 - DNA, 14 bp, Homo sapiens
aaaagtatatgtta

SEQ ID NO: 1414382 - DNA, 13 bp, Homo sapiens
aaaagtattatca

SEQ ID NO: 1414383 - DNA, 13 bp, Homo sapiens
aaaagtcacagtt

SEQ ID NO: 1414384 - DNA, 15 bp, Homo sapiens
aaaagtgacacagca

SEQ ID NO: 1414385 - DNA, 20 bp, Homo sapiens
aaaattgtattgaaaacact

SEQ ID NO: 1414386 - DNA, 13 bp, Homo sapiens
aaaattgtgatca

SEQ ID NO: 1414387 - DNA, 15 bp, Homo sapiens
aaaattgtttcttga

SEQ ID NO: 1414388 - DNA, 17 bp, Homo sapiens
aaaattgtttcttgaca

SEQ ID NO: 1414389 - DNA, 21 bp, Homo sapiens
aaaattgtttcttgacaagct

SEQ ID NO: 1414390 - DNA, 13 bp, Homo sapiens
aaaattgttttca

SEQ ID NO: 1414391 - DNA, 15 bp, Homo sapiens
aaaattgttttcact

SEQ ID NO: 1414392 - DNA, 21 bp, Homo sapiens
aaaattgttttcacttgtatt

SEQ ID NO: 1414393 - DNA, 14 bp, Homo sapiens
aaaatttacattta

SEQ ID NO: 1414394 - DNA, 18 bp, Homo sapiens
aaaatttattttataaga

SEQ ID NO: 1414395 - DNA, 23 bp, Homo sapiens
aaaatttccagtacctttgtcac

SEQ ID NO: 1414396 - DNA, 19 bp, Homo sapiens
aaaatttgactaattttac

SEQ ID NO: 1414397 - DNA, 23 bp, Homo sapiens
aaaatttgtaatatttttgtcat

SEQ ID NO: 1414398 - DNA, 16 bp, Homo sapiens
aaaatttgttcttgta

SEQ ID NO: 1414399 - DNA, 12 bp, Homo sapiens
aaaattttactt

SEQ ID NO: 1414400 - DNA, 18 bp, Homo sapiens
aaaattttagaacagtcc

SEQ ID NO: 1414401 - DNA, 19 bp, Homo sapiens
aaaattttaggcaagtttt

SEQ ID NO: 1414402 - DNA, 17 bp, Homo sapiens
aaaattttgcttttaat

SEQ ID NO: 1414403 - DNA, 12 bp, Homo sapiens
aaaattttgtaa

SEQ ID NO: 1414404 - DNA, 18 bp, Homo sapiens
aaaattttgtatgttaaa

SEQ ID NO: 1414405 - DNA, 22 bp, Homo sapiens
aaaattttgtatgttaaagaga

SEQ ID NO: 1414406 - DNA, 20 bp, Homo sapiens
aaaattttgtattaatttct

SEQ ID NO: 1414407 - DNA, 22 bp, Homo sapiens
aaaattttgtattaatttctga

SEQ ID NO: 1414408 - DNA, 15 bp, Homo sapiens
aaaatttttgcaaat

SEQ ID NO: 1414409 - DNA, 13 bp, Homo sapiens
aaacaaaaacact

SEQ ID NO: 1414410 - DNA, 18 bp, Homo sapiens
aaacaaaaacagaatttg

SEQ ID NO: 1414411 - DNA, 16 bp, Homo sapiens
aaacaaaacaaacaaa

SEQ ID NO: 1414412 - DNA, 19 bp, Homo sapiens
aaacaaaaccaagccttgg

SEQ ID NO: 1414413 - DNA, 12 bp, Homo sapiens
aaacaaaaccag

SEQ ID NO: 1414414 - DNA, 21 bp, Homo sapiens
aaacaaaacccctaagagact

SEQ ID NO: 1414415 - DNA, 19 bp, Homo sapiens
aaacaaaagggtgtatagt

SEQ ID NO: 1414416 - DNA, 15 bp, Homo sapiens
aaacaaaatttctat

SEQ ID NO: 1414417 - DNA, 12 bp, Homo sapiens
aaacaaaatttg

SEQ ID NO: 1414418 - DNA, 15 bp, Homo sapiens
aaacaaaatttgact

SEQ ID NO: 1414419 - DNA, 17 bp, Homo sapiens
aaacaaaatttgactaa

SEQ ID NO: 1414420 - DNA, 16 bp, Homo sapiens
aaacaaagttctattt

SEQ ID NO: 1414421 - DNA, 15 bp, Homo sapiens
aaacaaagtttcaga

SEQ ID NO: 1414422 - DNA, 23 bp, Homo sapiens
aaacaaagtttcagagtatattg

SEQ ID NO: 1414423 - DNA, 17 bp, Homo sapiens
aaacaaatctttccata

SEQ ID NO: 1414424 - DNA, 13 bp, Homo sapiens
aaacaacatcatt

SEQ ID NO: 1414425 - DNA, 17 bp, Homo sapiens
aaacaaccagttaaagc

SEQ ID NO: 1414426 - DNA, 17 bp, Homo sapiens
aaacaaccatgtcattt

SEQ ID NO: 1414427 - DNA, 19 bp, Homo sapiens
aaacaacgcattgccacgg

SEQ ID NO: 1414428 - DNA, 17 bp, Homo sapiens
aaacaacgtgtatagtg

SEQ ID NO: 1414429 - DNA, 17 bp, Homo sapiens
aaacaacttggcatttc

SEQ ID NO: 1414430 - DNA, 19 bp, Homo sapiens
aaacaacttggcatttcta

SEQ ID NO: 1414431 - DNA, 20 bp, Homo sapiens
aaacaacttggcatttctat

SEQ ID NO: 1414432 - DNA, 12 bp, Homo sapiens
aaacaagaaatc

SEQ ID NO: 1414433 - DNA, 12 bp, Homo sapiens
aaacaagaatga

SEQ ID NO: 1414434 - DNA, 23 bp, Homo sapiens
aaacaagaatgaaggtttttgta

SEQ ID NO: 1414435 - DNA, 19 bp, Homo sapiens
aaacaagcaagttctgaga

SEQ ID NO: 1414436 - DNA, 15 bp, Homo sapiens
aaacaagctgtgcag

SEQ ID NO: 1414437 - DNA, 16 bp, Homo sapiens
aaacaagtaaatatat

SEQ ID NO: 1414438 - DNA, 16 bp, Homo sapiens
aaacaataaatgtgca

SEQ ID NO: 1414439 - DNA, 14 bp, Homo sapiens
aaacaatattgttt

SEQ ID NO: 1414440 - DNA, 15 bp, Homo sapiens
aaacaatattgtttc

SEQ ID NO: 1414441 - DNA, 13 bp, Homo sapiens
aaacaatcctgtt

SEQ ID NO: 1414442 - DNA, 17 bp, Homo sapiens
aaacaatgaagaattat

SEQ ID NO: 1414443 - DNA, 14 bp, Homo sapiens
aaacaatgccatga

SEQ ID NO: 1414444 - DNA, 20 bp, Homo sapiens
aaacaatgtataaagattgt

SEQ ID NO: 1414445 - DNA, 21 bp, Homo sapiens
aaacaatgtataaagattgta

SEQ ID NO: 1414446 - DNA, 14 bp, Homo sapiens
aaacaatttctttt

SEQ ID NO: 1414447 - DNA, 20 bp, Homo sapiens
aaacaattttctgtaatctt

SEQ ID NO: 1414448 - DNA, 14 bp, Homo sapiens
aaacacaaatgcag

SEQ ID NO: 1414449 - DNA, 14 bp, Homo sapiens
aaacacaatatttt

SEQ ID NO: 1414450 - DNA, 14 bp, Homo sapiens
aaacacacgagcaa

SEQ ID NO: 1414451 - DNA, 13 bp, Homo sapiens
aaacacagctgtt

SEQ ID NO: 1414452 - DNA, 11 bp, Homo sapiens
aaacacagctt

SEQ ID NO: 1414453 - DNA, 19 bp, Homo sapiens
aaacacaggcaggtactgt

SEQ ID NO: 1414454 - DNA, 18 bp, Homo sapiens
aaacacaggctgtcctta

SEQ ID NO: 1414455 - DNA, 14 bp, Homo sapiens
aaacacagggaaag

SEQ ID NO: 1414456 - DNA, 21 bp, Homo sapiens
aaacacagtccagactcaaac

SEQ ID NO: 1414457 - DNA, 18 bp, Homo sapiens
aaacacagttacacttgt

SEQ ID NO: 1414458 - DNA, 22 bp, Homo sapiens
aaacaccagtcacctcgtctcc

SEQ ID NO: 1414459 - DNA, 13 bp, Homo sapiens
aaacaccattttt

SEQ ID NO: 1414460 - DNA, 22 bp, Homo sapiens
aaacaccttccagctcctgtaa

SEQ ID NO: 1414461 - DNA, 22 bp, Homo sapiens
aaacacgccttgttcctgctct

SEQ ID NO: 1414462 - DNA, 21 bp, Homo sapiens
aaacacgtgtctataatggaa

SEQ ID NO: 1414463 - DNA, 17 bp, Homo sapiens
aaacactacacatttga

SEQ ID NO: 1414464 - DNA, 20 bp, Homo sapiens
aaacactcagtccactgttg

SEQ ID NO: 1414465 - DNA, 18 bp, Homo sapiens
aaccgggagaaggcatga

SEQ ID NO: 1414466 - DNA, 18 bp, Homo sapiens
aaccgtctgttatgctgt

SEQ ID NO: 1414467 - DNA, 18 bp, Homo sapiens
aacctaacttgcgcagaa

SEQ ID NO: 1414468 - DNA, 18 bp, Homo sapiens
aacctaatatcacttaaa

SEQ ID NO: 1414469 - DNA, 20 bp, Homo sapiens
aacctaatcaccatgtaagc

SEQ ID NO: 1414470 - DNA, 14 bp, Homo sapiens
aacctaccctggtc

SEQ ID NO: 1414471 - DNA, 22 bp, Homo sapiens
aacctacctcccacactcccaa

SEQ ID NO: 1414472 - DNA, 21 bp, Homo sapiens
aacctacgcacataccttcat

SEQ ID NO: 1414473 - DNA, 14 bp, Homo sapiens
aacctactgcccac

SEQ ID NO: 1414474 - DNA, 14 bp, Homo sapiens
aacctagaatgtca

SEQ ID NO: 1414475 - DNA, 15 bp, Homo sapiens
aacctagatgtttaa

SEQ ID NO: 1414476 - DNA, 18 bp, Homo sapiens
aacctagtactctctgct

SEQ ID NO: 1414477 - DNA, 20 bp, Homo sapiens
aacctagtactctctgctct

SEQ ID NO: 1414478 - DNA, 21 bp, Homo sapiens
aacctagttaaagaaaggaaa

SEQ ID NO: 1414479 - DNA, 11 bp, Homo sapiens
aacctattttc

SEQ ID NO: 1414480 - DNA, 17 bp, Homo sapiens
aacctattttcatttgt

SEQ ID NO: 1414481 - DNA, 19 bp, Homo sapiens
aacctattttcatttgtac

SEQ ID NO: 1414482 - DNA, 22 bp, Homo sapiens
aacctattttcatttgtacaag

SEQ ID NO: 1414483 - DNA, 17 bp, Homo sapiens
aacctcaaaatgtctaa

SEQ ID NO: 1414484 - DNA, 12 bp, Homo sapiens
aacctcaaatat

SEQ ID NO: 1414485 - DNA, 18 bp, Homo sapiens
aacctcaaatatagtata

SEQ ID NO: 1414486 - DNA, 18 bp, Homo sapiens
aacctcaactgcctactc

SEQ ID NO: 1414487 - DNA, 15 bp, Homo sapiens
aacctcaatgccctg

SEQ ID NO: 1414488 - DNA, 18 bp, Homo sapiens
aacctcacctcccgggtt

SEQ ID NO: 1414489 - DNA, 13 bp, Homo sapiens
aacctcagcctgg

SEQ ID NO: 1414490 - DNA, 13 bp, Homo sapiens
aacctcagtgtca

SEQ ID NO: 1414491 - DNA, 18 bp, Homo sapiens
aacctcagtgtcatttat

SEQ ID NO: 1414492 - DNA, 14 bp, Homo sapiens
aacctcattcccca

SEQ ID NO: 1414493 - DNA, 23 bp, Homo sapiens
aacctccagcctccctgtctcca

SEQ ID NO: 1414494 - DNA, 13 bp, Homo sapiens
aacctccatctcc

SEQ ID NO: 1414495 - DNA, 11 bp, Homo sapiens
aacctcctgct

SEQ ID NO: 1414496 - DNA, 21 bp, Homo sapiens
aacctctcctgacccctgcct

SEQ ID NO: 1414497 - DNA, 14 bp, Homo sapiens
aacctctctatttt

SEQ ID NO: 1414498 - DNA, 23 bp, Homo sapiens
aacctctctgatcttgtgctcag

SEQ ID NO: 1414499 - DNA, 12 bp, Homo sapiens
aacctcttcccc

SEQ ID NO: 1414500 - DNA, 17 bp, Homo sapiens
aacctcttctggctcaa

SEQ ID NO: 1414501 - DNA, 20 bp, Homo sapiens
aacctgaaatttattcacat

SEQ ID NO: 1414502 - DNA, 15 bp, Homo sapiens
aacctgaagtttttt

SEQ ID NO: 1414503 - DNA, 19 bp, Homo sapiens
aacctgacaaaaaaaaagt

SEQ ID NO: 1414504 - DNA, 20 bp, Homo sapiens
aacctgactcaattatttgc

SEQ ID NO: 1414505 - DNA, 20 bp, Homo sapiens
aacctgacttcagtgaatat

SEQ ID NO: 1414506 - DNA, 17 bp, Homo sapiens
aacctgatgttaaaatt

SEQ ID NO: 1414507 - DNA, 18 bp, Homo sapiens
aacctgatgttaaaattc

SEQ ID NO: 1414508 - DNA, 21 bp, Homo sapiens
aacctgcagagtagttagaga

SEQ ID NO: 1414509 - DNA, 15 bp, Homo sapiens
aacctgccctgcctg

SEQ ID NO: 1414510 - DNA, 17 bp, Homo sapiens
aacctgccctgcctgag

SEQ ID NO: 1414511 - DNA, 19 bp, Homo sapiens
aacctgccctgcctgaggg

SEQ ID NO: 1414512 - DNA, 22 bp, Homo sapiens
aacctgcctaaattaaattggg

SEQ ID NO: 1414513 - DNA, 12 bp, Homo sapiens
aacctgcttcct

SEQ ID NO: 1414514 - DNA, 19 bp, Homo sapiens
aacctggaaaaattccaga

SEQ ID NO: 1414515 - DNA, 12 bp, Homo sapiens
aacctggacttc

SEQ ID NO: 1414516 - DNA, 16 bp, Homo sapiens
aacctggacttcctgt

SEQ ID NO: 1414517 - DNA, 20 bp, Homo sapiens
aacctggagatgcagctact

SEQ ID NO: 1414518 - DNA, 17 bp, Homo sapiens
aacctggatccagcact

SEQ ID NO: 1414519 - DNA, 16 bp, Homo sapiens
aacctgggaaagagat

SEQ ID NO: 1414520 - DNA, 15 bp, Homo sapiens
aacctgggaggcaga

SEQ ID NO: 1414521 - DNA, 20 bp, Homo sapiens
aacctgggattcaggaatgt

SEQ ID NO: 1414522 - DNA, 21 bp, Homo sapiens
aacctgggattcaggaatgtg

SEQ ID NO: 1414523 - DNA, 13 bp, Homo sapiens
aacctgggttagg

SEQ ID NO: 1414524 - DNA, 21 bp, Homo sapiens
aacctggtattttaagagaaa

SEQ ID NO: 1414525 - DNA, 22 bp, Homo sapiens
aacctgtattactgaataatat

SEQ ID NO: 1414526 - DNA, 17 bp, Homo sapiens
aacctgtgccaggctga

SEQ ID NO: 1414527 - DNA, 24 bp, Homo sapiens
aacctgttacctactttgactttt

SEQ ID NO: 1414528 - DNA, 19 bp, Homo sapiens
aacctgtttttttttcatt

SEQ ID NO: 1414529 - DNA, 19 bp, Homo sapiens
aaccttagggacaggtgga

SEQ ID NO: 1414530 - DNA, 15 bp, Homo sapiens
aaccttattgtacct

SEQ ID NO: 1414531 - DNA, 17 bp, Homo sapiens
aaccttattgtacctct

SEQ ID NO: 1414532 - DNA, 18 bp, Homo sapiens
aaccttattgtacctctc

SEQ ID NO: 1414533 - DNA, 19 bp, Homo sapiens
aaccttattgtacctctct

SEQ ID NO: 1414534 - DNA, 14 bp, Homo sapiens
aaccttcaacccag

SEQ ID NO: 1414535 - DNA, 19 bp, Homo sapiens
aaccttccatctcgccacc

SEQ ID NO: 1414536 - DNA, 16 bp, Homo sapiens
aaccttcggctccggg

SEQ ID NO: 1414537 - DNA, 17 bp, Homo sapiens
aaccttgaaaaaaaaca

SEQ ID NO: 1414538 - DNA, 13 bp, Homo sapiens
aaccttgaatgct

SEQ ID NO: 1414539 - DNA, 18 bp, Homo sapiens
aaccttgaatgctgccag

SEQ ID NO: 1414540 - DNA, 19 bp, Homo sapiens
aaccttgaatgctgccagt

SEQ ID NO: 1414541 - DNA, 17 bp, Homo sapiens
aaccttggagaggagag

SEQ ID NO: 1414542 - DNA, 21 bp, Homo sapiens
aaccttggagaggagagtggc

SEQ ID NO: 1414543 - DNA, 20 bp, Homo sapiens
aaccttggcataagacagag

SEQ ID NO: 1414544 - DNA, 23 bp, Homo sapiens
aaccttgtctctatgccagctca

SEQ ID NO: 1414545 - DNA, 13 bp, Homo sapiens
aaccttgttttgg

SEQ ID NO: 1414546 - DNA, 15 bp, Homo sapiens
aaccttgttttggac

SEQ ID NO: 1414547 - DNA, 23 bp, Homo sapiens
aacctttacagttagcagggatg

SEQ ID NO: 1414548 - DNA, 15 bp, Homo sapiens
aacctttagggcagc

SEQ ID NO: 1414549 - DNA, 16 bp, Homo sapiens
aacctttagggcagct

SEQ ID NO: 1414550 - DNA, 14 bp, Homo sapiens
aacctttctgtagc

SEQ ID NO: 1414551 - DNA, 19 bp, Homo sapiens
aacctttgctatgtaaggg

SEQ ID NO: 1414552 - DNA, 11 bp, Homo sapiens
aacctttttct

SEQ ID NO: 1414553 - DNA, 22 bp, Homo sapiens
aacctttttcttgatcttaaag

SEQ ID NO: 1414554 - DNA, 16 bp, Homo sapiens
aacgaaaatgaaagct

SEQ ID NO: 1414555 - DNA, 12 bp, Homo sapiens
aacgaagaaaaa

SEQ ID NO: 1414556 - DNA, 14 bp, Homo sapiens
aacgaagaaaaaaa

SEQ ID NO: 1414557 - DNA, 16 bp, Homo sapiens
aacgaagagttccctt

SEQ ID NO: 1414558 - DNA, 14 bp, Homo sapiens
aacgaataaagata

SEQ ID NO: 1414559 - DNA, 13 bp, Homo sapiens
aacgaataaaggt

SEQ ID NO: 1414560 - DNA, 18 bp, Homo sapiens
aacgaatggtctttgctc

SEQ ID NO: 1414561 - DNA, 24 bp, Homo sapiens
aacgagcagcccagggcctagagg

SEQ ID NO: 1414562 - DNA, 23 bp, Homo sapiens
aacgagggctgatggaggaaaaa

SEQ ID NO: 1414563 - DNA, 16 bp, Homo sapiens
aacgagtcaatcccct

SEQ ID NO: 1414564 - DNA, 17 bp, Homo sapiens
aacgatgatgcttgtaa

SEQ ID NO: 1414565 - DNA, 21 bp, Homo sapiens
aacgatgtgcaatacattttt

SEQ ID NO: 1414566 - DNA, 13 bp, Homo sapiens
aacgatttagaaa

SEQ ID NO: 1414567 - DNA, 15 bp, Homo sapiens
aacgcagacactgag

SEQ ID NO: 1414568 - DNA, 20 bp, Homo sapiens
aacgcaggcccccaggtgcc

SEQ ID NO: 1414569 - DNA, 15 bp, Homo sapiens
aacgcattgccacgg

SEQ ID NO: 1414570 - DNA, 20 bp, Homo sapiens
aacgcattgccacggaaaca

SEQ ID NO: 1414571 - DNA, 17 bp, Homo sapiens
aacgccagtctcccagg

SEQ ID NO: 1414572 - DNA, 20 bp, Homo sapiens
aacgccagtctcccaggccc

SEQ ID NO: 1414573 - DNA, 20 bp, Homo sapiens
aacgcccctccaaacctcca

SEQ ID NO: 1414574 - DNA, 21 bp, Homo sapiens
aacgcccctccaaacctccag

SEQ ID NO: 1414575 - DNA, 14 bp, Homo sapiens
aacgcccctgtggc

SEQ ID NO: 1414576 - DNA, 16 bp, Homo sapiens
aacgccgagtgcactg

SEQ ID NO: 1414577 - DNA, 18 bp, Homo sapiens
aacgcctcccctgcccca

SEQ ID NO: 1414578 - DNA, 14 bp, Homo sapiens
aacgctcctttgtg

SEQ ID NO: 1414579 - DNA, 16 bp, Homo sapiens
aacgctcctttgtgtg

SEQ ID NO: 1414580 - DNA, 22 bp, Homo sapiens
aacgcttgtagaactcactctg

SEQ ID NO: 1414581 - DNA, 17 bp, Homo sapiens
aacggaacgttggactt

SEQ ID NO: 1414582 - DNA, 15 bp, Homo sapiens
aacaaaatttctatt

SEQ ID NO: 1414583 - DNA, 12 bp, Homo sapiens
aacaaacaaaaa

SEQ ID NO: 1414584 - DNA, 13 bp, Homo sapiens
aacaaacaaaact

SEQ ID NO: 1414585 - DNA, 17 bp, Homo sapiens
aacaaaccacagcagga

SEQ ID NO: 1414586 - DNA, 11 bp, Homo sapiens
aacaaaccatc

SEQ ID NO: 1414587 - DNA, 14 bp, Homo sapiens
aacaaactatttct

SEQ ID NO: 1414588 - DNA, 15 bp, Homo sapiens
aacaaactatttctt

SEQ ID NO: 1414589 - DNA, 19 bp, Homo sapiens
aacaaacttactgtcagag

SEQ ID NO: 1414590 - DNA, 11 bp, Homo sapiens
aacaaagaaac

SEQ ID NO: 1414591 - DNA, 19 bp, Homo sapiens
aacaaagagaaaaaataca

SEQ ID NO: 1414592 - DNA, 20 bp, Homo sapiens
aacaaagtttacattgtcct

SEQ ID NO: 1414593 - DNA, 19 bp, Homo sapiens
aacaaataaaaaagctctt

SEQ ID NO: 1414594 - DNA, 15 bp, Homo sapiens
aacaaatcactgtat

SEQ ID NO: 1414595 - DNA, 19 bp, Homo sapiens
aacaaatgaacgatatgta

SEQ ID NO: 1414596 - DNA, 10 bp, Homo sapiens
aacaaatgag

SEQ ID NO: 1414597 - DNA, 11 bp, Homo sapiens
aacaaatgagc

SEQ ID NO: 1414598 - DNA, 14 bp, Homo sapiens
aacaaatgatttcc

SEQ ID NO: 1414599 - DNA, 19 bp, Homo sapiens
aacaaatgtgtttttctat

SEQ ID NO: 1414600 - DNA, 20 bp, Homo sapiens
aacaaattatgttacatctg

SEQ ID NO: 1414601 - DNA, 20 bp, Homo sapiens
aacaaattctttagtactca

SEQ ID NO: 1414602 - DNA, 18 bp, Homo sapiens
aacaaattggacagctac

SEQ ID NO: 1414603 - DNA, 17 bp, Homo sapiens
aacaacaacaataataa

SEQ ID NO: 1414604 - DNA, 14 bp, Homo sapiens
aacaacatatacaa

SEQ ID NO: 1414605 - DNA, 19 bp, Homo sapiens
aacaaccagttaaagccac

SEQ ID NO: 1414606 - DNA, 18 bp, Homo sapiens
aacaaccttttacattgt

SEQ ID NO: 1414607 - DNA, 15 bp, Homo sapiens
aacaacgtgagagaa

SEQ ID NO: 1414608 - DNA, 16 bp, Homo sapiens
aacaactaggcttcag

SEQ ID NO: 1414609 - DNA, 12 bp, Homo sapiens
aacaagaaaaca

SEQ ID NO: 1414610 - DNA, 14 bp, Homo sapiens
aacaagaaaacata

SEQ ID NO: 1414611 - DNA, 15 bp, Homo sapiens
aacaagaagagtaaa

SEQ ID NO: 1414612 - DNA, 12 bp, Homo sapiens
aacaagaatgca

SEQ ID NO: 1414613 - DNA, 12 bp, Homo sapiens
aacaagaattgg

SEQ ID NO: 1414614 - DNA, 15 bp, Homo sapiens
aacaagactgccagg

SEQ ID NO: 1414615 - DNA, 22 bp, Homo sapiens
aacaagagaaaagaaaaatcaa

SEQ ID NO: 1414616 - DNA, 22 bp, Homo sapiens
aacaagatgctggatgtctgcc

SEQ ID NO: 1414617 - DNA, 12 bp, Homo sapiens
aacaagatttcc

SEQ ID NO: 1414618 - DNA, 20 bp, Homo sapiens
aacaagattttaaagacatg

SEQ ID NO: 1414619 - DNA, 21 bp, Homo sapiens
aacaagccaaacattcttatt

SEQ ID NO: 1414620 - DNA, 15 bp, Homo sapiens
aacaaggaagccaaa

SEQ ID NO: 1414621 - DNA, 12 bp, Homo sapiens
aacaaggaatgc

SEQ ID NO: 1414622 - DNA, 17 bp, Homo sapiens
aacaaggagctcaccct

SEQ ID NO: 1414623 - DNA, 21 bp, Homo sapiens
aacaaggagctcaccctgccc

SEQ ID NO: 1414624 - DNA, 16 bp, Homo sapiens
aacaaggtagttttta

SEQ ID NO: 1414625 - DNA, 22 bp, Homo sapiens
aacaaggtgccctttagccaga

SEQ ID NO: 1414626 - DNA, 17 bp, Homo sapiens
aacaagtaagaaaaata

SEQ ID NO: 1414627 - DNA, 13 bp, Homo sapiens
aacaagtaatgta

SEQ ID NO: 1414628 - DNA, 14 bp, Homo sapiens
aacaagtaatgtat

SEQ ID NO: 1414629 - DNA, 17 bp, Homo sapiens
aacaagtcacagctgca

SEQ ID NO: 1414630 - DNA, 20 bp, Homo sapiens
aacaagtcatttttgtattt

SEQ ID NO: 1414631 - DNA, 20 bp, Homo sapiens
aacaagtgcctcctggactg

SEQ ID NO: 1414632 - DNA, 13 bp, Homo sapiens
aacaataaaaaca

SEQ ID NO: 1414633 - DNA, 14 bp, Homo sapiens
aacaataaaatttt

SEQ ID NO: 1414634 - DNA, 12 bp, Homo sapiens
aacaataaacag

SEQ ID NO: 1414635 - DNA, 11 bp, Homo sapiens
aacaataataa

SEQ ID NO: 1414636 - DNA, 14 bp, Homo sapiens
aacaatacaaatgg

SEQ ID NO: 1414637 - DNA, 17 bp, Homo sapiens
aacaatacaaatggatt

SEQ ID NO: 1414638 - DNA, 18 bp, Homo sapiens
aacaataggctgttccca

SEQ ID NO: 1414639 - DNA, 15 bp, Homo sapiens
aacaatattactttg

SEQ ID NO: 1414640 - DNA, 12 bp, Homo sapiens
aacaatcctgtt

SEQ ID NO: 1414641 - DNA, 22 bp, Homo sapiens
aacaatcttattccgagcattc

SEQ ID NO: 1414642 - DNA, 14 bp, Homo sapiens
aacaatctttgctg

SEQ ID NO: 1414643 - DNA, 15 bp, Homo sapiens
aacaatgaagtgaaa

SEQ ID NO: 1414644 - DNA, 13 bp, Homo sapiens
aacaatgccatga

SEQ ID NO: 1414645 - DNA, 20 bp, Homo sapiens
aacaatgccatgaacaaatt

SEQ ID NO: 1414646 - DNA, 21 bp, Homo sapiens
aacaatgccatgaacaaattc

SEQ ID NO: 1414647 - DNA, 23 bp, Homo sapiens
aacaatgccatgaacaaattctt

SEQ ID NO: 1414648 - DNA, 17 bp, Homo sapiens
aacaatgtataaagatt

SEQ ID NO: 1414649 - DNA, 21 bp, Homo sapiens
aacaatgtataaagattgtac

SEQ ID NO: 1414650 - DNA, 21 bp, Homo sapiens
aacaatgttgtccaacaataa

SEQ ID NO: 1414651 - DNA, 16 bp, Homo sapiens
aacaattgtgtgaatt

SEQ ID NO: 1414652 - DNA, 20 bp, Homo sapiens
aacaattttctgtaatcttt

SEQ ID NO: 1414653 - DNA, 15 bp, Homo sapiens
aacacaaaccacaac

SEQ ID NO: 1414654 - DNA, 19 bp, Homo sapiens
aacacaaagcggggggagg

SEQ ID NO: 1414655 - DNA, 20 bp, Homo sapiens
aacacaaatgcagggattgc

SEQ ID NO: 1414656 - DNA, 12 bp, Homo sapiens
aacacaagcaaa

SEQ ID NO: 1414657 - DNA, 17 bp, Homo sapiens
aacacaagggatataaa

SEQ ID NO: 1414658 - DNA, 18 bp, Homo sapiens
aacacaagggatataaaa

SEQ ID NO: 1414659 - DNA, 12 bp, Homo sapiens
aacacacaacag

SEQ ID NO: 1414660 - DNA, 22 bp, Homo sapiens
aacacacacgctccctggaagc

SEQ ID NO: 1414661 - DNA, 21 bp, Homo sapiens
aacacacagactttctgtgac

SEQ ID NO: 1414662 - DNA, 13 bp, Homo sapiens
aacacacctctgc

SEQ ID NO: 1414663 - DNA, 13 bp, Homo sapiens
aacacactgtgtc

SEQ ID NO: 1414664 - DNA, 19 bp, Homo sapiens
aacacactgtgtcctggtg

SEQ ID NO: 1414665 - DNA, 16 bp, Homo sapiens
aacacagcatgtgcca

SEQ ID NO: 1414666 - DNA, 17 bp, Homo sapiens
aacacagcatgtgccaa

SEQ ID NO: 1414667 - DNA, 19 bp, Homo sapiens
aacacagcatgtgccaaga

SEQ ID NO: 1414668 - DNA, 18 bp, Homo sapiens
aacacagcatgtgtattt

SEQ ID NO: 1414669 - DNA, 14 bp, Homo sapiens
aacacagcctgggc

SEQ ID NO: 1414670 - DNA, 22 bp, Homo sapiens
aacacagctacaaccctaccct

SEQ ID NO: 1414671 - DNA, 11 bp, Homo sapiens
aacacagctgt

SEQ ID NO: 1414672 - DNA, 22 bp, Homo sapiens
aacacagctttacaacttccat

SEQ ID NO: 1414673 - DNA, 22 bp, Homo sapiens
aacacaggcaaaatccttgctt

SEQ ID NO: 1414674 - DNA, 13 bp, Homo sapiens
aacacagggaaag

SEQ ID NO: 1414675 - DNA, 18 bp, Homo sapiens
aacacattcttattgaca

SEQ ID NO: 1414676 - DNA, 13 bp, Homo sapiens
aacacattttaaa

SEQ ID NO: 1414677 - DNA, 14 bp, Homo sapiens
aacacattttaaat

SEQ ID NO: 1414678 - DNA, 16 bp, Homo sapiens
aacaccaaaaaatatc

SEQ ID NO: 1414679 - DNA, 23 bp, Homo sapiens
aacaccacagacacacacacgca

SEQ ID NO: 1414680 - DNA, 14 bp, Homo sapiens
aacaccaggactta

SEQ ID NO: 1414681 - DNA, 22 bp, Homo sapiens
aacaccaggacttaagacaaat

SEQ ID NO: 1414682 - DNA, 15 bp, Homo sapiens
aacaccattgaaggc

SEQ ID NO: 1414683 - DNA, 17 bp, Homo sapiens
aacaccattgaaggctt

SEQ ID NO: 1414684 - DNA, 19 bp, Homo sapiens
aacacccccatccctcggg

SEQ ID NO: 1414685 - DNA, 17 bp, Homo sapiens
aacaccccgcctgcctc

SEQ ID NO: 1414686 - DNA, 15 bp, Homo sapiens
aacacccctctgtct

SEQ ID NO: 1414687 - DNA, 16 bp, Homo sapiens
aacaccctatattttg

SEQ ID NO: 1414688 - DNA, 13 bp, Homo sapiens
aacacccttagaa

SEQ ID NO: 1414689 - DNA, 17 bp, Homo sapiens
aacatttgtttccccca

SEQ ID NO: 1414690 - DNA, 19 bp, Homo sapiens
aacattttatcattaaaaa

SEQ ID NO: 1414691 - DNA, 14 bp, Homo sapiens
aacattttctctta

SEQ ID NO: 1414692 - DNA, 17 bp, Homo sapiens
aacattttctcttagaa

SEQ ID NO: 1414693 - DNA, 14 bp, Homo sapiens
aacattttgtggag

SEQ ID NO: 1414694 - DNA, 23 bp, Homo sapiens
aacattttgtggagtttgtattt

SEQ ID NO: 1414695 - DNA, 19 bp, Homo sapiens
aacatttttgataaagcct

SEQ ID NO: 1414696 - DNA, 15 bp, Homo sapiens
aacattttttaagaa

SEQ ID NO: 1414697 - DNA, 20 bp, Homo sapiens
aacattttttaagaaaacat

SEQ ID NO: 1414698 - DNA, 22 bp, Homo sapiens
aacattttttaagaaaacattt

SEQ ID NO: 1414699 - DNA, 14 bp, Homo sapiens
aaccaaaacttcca

SEQ ID NO: 1414700 - DNA, 22 bp, Homo sapiens
aaccaaaacttccaaggccctg

SEQ ID NO: 1414701 - DNA, 20 bp, Homo sapiens
aaccaaaagttattaaaatt

SEQ ID NO: 1414702 - DNA, 22 bp, Homo sapiens
aaccaaaagttattaaaattgt

SEQ ID NO: 1414703 - DNA, 16 bp, Homo sapiens
aaccaaagcctcttca

SEQ ID NO: 1414704 - DNA, 14 bp, Homo sapiens
aaccaaatacctca

SEQ ID NO: 1414705 - DNA, 20 bp, Homo sapiens
aaccaacccccatctcccta

SEQ ID NO: 1414706 - DNA, 14 bp, Homo sapiens
aaccaagagctttt

SEQ ID NO: 1414707 - DNA, 11 bp, Homo sapiens
aaccaagctgt

SEQ ID NO: 1414708 - DNA, 18 bp, Homo sapiens
aaccaagcttcagagcct

SEQ ID NO: 1414709 - DNA, 16 bp, Homo sapiens
aaccaaggaatttaaa

SEQ ID NO: 1414710 - DNA, 11 bp, Homo sapiens
aaattcctgta

SEQ ID NO: 1414711 - DNA, 16 bp, Homo sapiens
aaattctagtctctga

SEQ ID NO: 1414712 - DNA, 19 bp, Homo sapiens
aaattctagtctctgattt

SEQ ID NO: 1414713 - DNA, 19 bp, Homo sapiens
aaattctataggaacatat

SEQ ID NO: 1414714 - DNA, 23 bp, Homo sapiens
aaattctataggaacatatgaaa

SEQ ID NO: 1414715 - DNA, 13 bp, Homo sapiens
aaattctatggaa

SEQ ID NO: 1414716 - DNA, 21 bp, Homo sapiens
aaattctattctgatcttatt

SEQ ID NO: 1414717 - DNA, 11 bp, Homo sapiens
aaattctcaga

SEQ ID NO: 1414718 - DNA, 12 bp, Homo sapiens
aaattctcagag

SEQ ID NO: 1414719 - DNA, 20 bp, Homo sapiens
aaattctcagtcagtaattg

SEQ ID NO: 1414720 - DNA, 13 bp, Homo sapiens
aaattctcctgga

SEQ ID NO: 1414721 - DNA, 16 bp, Homo sapiens
aaattctcctggaggt

SEQ ID NO: 1414722 - DNA, 21 bp, Homo sapiens
aaattctgaaaactgaatgtc

SEQ ID NO: 1414723 - DNA, 15 bp, Homo sapiens
aaattctgatgtttc

SEQ ID NO: 1414724 - DNA, 17 bp, Homo sapiens
aaattctgatgtttctg

SEQ ID NO: 1414725 - DNA, 18 bp, Homo sapiens
aaattctggcccagccaa

SEQ ID NO: 1414726 - DNA, 18 bp, Homo sapiens
aaattctgttgttccatt

SEQ ID NO: 1414727 - DNA, 13 bp, Homo sapiens
aaattctgtttct

SEQ ID NO: 1414728 - DNA, 22 bp, Homo sapiens
aaattctgtttttaaaaattag

SEQ ID NO: 1414729 - DNA, 16 bp, Homo sapiens
aaattcttactctgga

SEQ ID NO: 1414730 - DNA, 17 bp, Homo sapiens
aaattcttgaagttcat

SEQ ID NO: 1414731 - DNA, 15 bp, Homo sapiens
aaattgaaataaata

SEQ ID NO: 1414732 - DNA, 16 bp, Homo sapiens
aaattgaacaaaaatg

SEQ ID NO: 1414733 - DNA, 20 bp, Homo sapiens
aaattgaatgtggctgaagt

SEQ ID NO: 1414734 - DNA, 15 bp, Homo sapiens
aaattgacattgctt

SEQ ID NO: 1414735 - DNA, 22 bp, Homo sapiens
aaattgaggtttggaagagtga

SEQ ID NO: 1414736 - DNA, 22 bp, Homo sapiens
aaattgagtgcactaaacaaat

SEQ ID NO: 1414737 - DNA, 12 bp, Homo sapiens
aaattgcacaat

SEQ ID NO: 1414738 - DNA, 20 bp, Homo sapiens
aaattgcacacactcagtgc

SEQ ID NO: 1414739 - DNA, 15 bp, Homo sapiens
aaattgcatactttg

SEQ ID NO: 1414740 - DNA, 18 bp, Homo sapiens
aaattgcatttcctgaca

SEQ ID NO: 1414741 - DNA, 19 bp, Homo sapiens
aaattgccctatgctgtgc

SEQ ID NO: 1414742 - DNA, 14 bp, Homo sapiens
aaattgccttcagc

SEQ ID NO: 1414743 - DNA, 19 bp, Homo sapiens
aaattgcctttctgtgttt

SEQ ID NO: 1414744 - DNA, 20 bp, Homo sapiens
aaattgcctttctgtgttta

SEQ ID NO: 1414745 - DNA, 19 bp, Homo sapiens
aaattgctattttatttgt

SEQ ID NO: 1414746 - DNA, 18 bp, Homo sapiens
aaattgctcacagttatt

SEQ ID NO: 1414747 - DNA, 20 bp, Homo sapiens
aaattgctgcatatttgtgc

SEQ ID NO: 1414748 - DNA, 15 bp, Homo sapiens
aaattgctgcttgga

SEQ ID NO: 1414749 - DNA, 18 bp, Homo sapiens
aaattgcttctaaaacaa

SEQ ID NO: 1414750 - DNA, 21 bp, Homo sapiens
aaattgcttctaaaacaataa

SEQ ID NO: 1414751 - DNA, 13 bp, Homo sapiens
aaattgcttttga

SEQ ID NO: 1414752 - DNA, 13 bp, Homo sapiens
aaattgcttttgt

SEQ ID NO: 1414753 - DNA, 19 bp, Homo sapiens
aaattggaacagaatgttt

SEQ ID NO: 1414754 - DNA, 17 bp, Homo sapiens
aaattggattattttct

SEQ ID NO: 1414755 - DNA, 20 bp, Homo sapiens
aaattgggcttcaatcactg

SEQ ID NO: 1414756 - DNA, 19 bp, Homo sapiens
aaattggggaggagggggc

SEQ ID NO: 1414757 - DNA, 18 bp, Homo sapiens
aaattgtatacattttgt

SEQ ID NO: 1414758 - DNA, 20 bp, Homo sapiens
aaattgtatacattttgtta

SEQ ID NO: 1414759 - DNA, 19 bp, Homo sapiens
aaattgtatattgtaattt

SEQ ID NO: 1414760 - DNA, 14 bp, Homo sapiens
aaattgtatgaaaa

SEQ ID NO: 1414761 - DNA, 21 bp, Homo sapiens
aaattgtattgaaaacactta

SEQ ID NO: 1414762 - DNA, 18 bp, Homo sapiens
aaattgtcgggggagaga

SEQ ID NO: 1414763 - DNA, 19 bp, Homo sapiens
aaattgtcgggggagagag

SEQ ID NO: 1414764 - DNA, 22 bp, Homo sapiens
aaattgtttaagtgttgtaaat

SEQ ID NO: 1414765 - DNA, 13 bp, Homo sapiens
aaattgtttagtg

SEQ ID NO: 1414766 - DNA, 15 bp, Homo sapiens
aaattgtttagtgat

SEQ ID NO: 1414767 - DNA, 12 bp, Homo sapiens
aaattgttttca

SEQ ID NO: 1414768 - DNA, 15 bp, Homo sapiens
aaattgttttcactt

SEQ ID NO: 1414769 - DNA, 20 bp, Homo sapiens
aaattgttttcacttgtatt

SEQ ID NO: 1414770 - DNA, 21 bp, Homo sapiens
aaattgttttcacttgtattg

SEQ ID NO: 1414771 - DNA, 22 bp, Homo sapiens
aaattgttttcacttgtattga

SEQ ID NO: 1414772 - DNA, 14 bp, Homo sapiens
aaatttaaaatgtt

SEQ ID NO: 1414773 - DNA, 12 bp, Homo sapiens
aaatttaaaatt

SEQ ID NO: 1414774 - DNA, 13 bp, Homo sapiens
aaatttaatgctg

SEQ ID NO: 1414775 - DNA, 11 bp, Homo sapiens
aaatttatgca

SEQ ID NO: 1414776 - DNA, 13 bp, Homo sapiens
aaatttatgcatt

SEQ ID NO: 1414777 - DNA, 20 bp, Homo sapiens
aaatttatgcatttcattca

SEQ ID NO: 1414778 - DNA, 12 bp, Homo sapiens
aaatttatgtga

SEQ ID NO: 1414779 - DNA, 23 bp, Homo sapiens
aaatttccagtacctttgtcaca

SEQ ID NO: 1414780 - DNA, 18 bp, Homo sapiens
aaatttccttcaggtttt

SEQ ID NO: 1414781 - DNA, 18 bp, Homo sapiens
aaatttcgttgtccaatt

SEQ ID NO: 1414782 - DNA, 20 bp, Homo sapiens
aaatttcgttgtccaatttg

SEQ ID NO: 1414783 - DNA, 19 bp, Homo sapiens
aaatttcttggcaaatttt

SEQ ID NO: 1414784 - DNA, 18 bp, Homo sapiens
aaatttctttgtttaaca

SEQ ID NO: 1414785 - DNA, 18 bp, Homo sapiens
aaatttgacttttctgta

SEQ ID NO: 1414786 - DNA, 18 bp, Homo sapiens
aaatttgatggactaatt

SEQ ID NO: 1414787 - DNA, 18 bp, Homo sapiens
aaatttgatttccatctt

SEQ ID NO: 1414788 - DNA, 17 bp, Homo sapiens
aaatttggccttaagaa

SEQ ID NO: 1414789 - DNA, 18 bp, Homo sapiens
aaatttggccttaagaac

SEQ ID NO: 1414790 - DNA, 19 bp, Homo sapiens
aaatttggccttaagaact

SEQ ID NO: 1414791 - DNA, 13 bp, Homo sapiens
aaatttgtactat

SEQ ID NO: 1414792 - DNA, 17 bp, Homo sapiens
aaatttgtactatttaa

SEQ ID NO: 1414793 - DNA, 19 bp, Homo sapiens
aaatttgtactatttaact

SEQ ID NO: 1414794 - DNA, 20 bp, Homo sapiens
aaatttgtactatttaactg

SEQ ID NO: 1414795 - DNA, 18 bp, Homo sapiens
aaatttgttcttgtattt

SEQ ID NO: 1414796 - DNA, 13 bp, Homo sapiens
aaatttgtttgta

SEQ ID NO: 1414797 - DNA, 13 bp, Homo sapiens
aaattttaaaaaa

SEQ ID NO: 1414798 - DNA, 14 bp, Homo sapiens
aaattttaaaaaag

SEQ ID NO: 1414799 - DNA, 19 bp, Homo sapiens
aaattttaaaaaggaattt

SEQ ID NO: 1414800 - DNA, 12 bp, Homo sapiens
aaattttaaagc

SEQ ID NO: 1414801 - DNA, 15 bp, Homo sapiens
aaattttaaatgttt

SEQ ID NO: 1414802 - DNA, 23 bp, Homo sapiens
aaattttaaggccacggccttgt

SEQ ID NO: 1414803 - DNA, 14 bp, Homo sapiens
aaattttaatttat

SEQ ID NO: 1414804 - DNA, 20 bp, Homo sapiens
aaattttactttctctcacc

SEQ ID NO: 1414805 - DNA, 15 bp, Homo sapiens
aaattttagaaatat

SEQ ID NO: 1414806 - DNA, 12 bp, Homo sapiens
aaattttattcc

SEQ ID NO: 1414807 - DNA, 16 bp, Homo sapiens
aaattttattttgtgc

SEQ ID NO: 1414808 - DNA, 21 bp, Homo sapiens
aaattttgctatcaacaataa

SEQ ID NO: 1414809 - DNA, 12 bp, Homo sapiens
aaattttggcca

SEQ ID NO: 1414810 - DNA, 18 bp, Homo sapiens
aaattttggccaaagtgt

SEQ ID NO: 1414811 - DNA, 12 bp, Homo sapiens
aaattttgtaag

SEQ ID NO: 1414812 - DNA, 13 bp, Homo sapiens
aaatttttatgta

SEQ ID NO: 1414813 - DNA, 18 bp, Homo sapiens
aaatttttcagatgcttc

SEQ ID NO: 1414814 - DNA, 13 bp, Homo sapiens
aaatttttgaaaa

SEQ ID NO: 1414815 - DNA, 12 bp, Homo sapiens
aaattttttgac

SEQ ID NO: 1414816 - DNA, 13 bp, Homo sapiens
aaattttttgact

SEQ ID NO: 1414817 - DNA, 13 bp, Homo sapiens
aaattttttgtga

SEQ ID NO: 1414818 - DNA, 13 bp, Homo sapiens
aacaaaaacagaa

SEQ ID NO: 1414819 - DNA, 11 bp, Homo sapiens
aacaaaaccag

SEQ ID NO: 1414820 - DNA, 16 bp, Homo sapiens
aacaaaaccagctgct

SEQ ID NO: 1414821 - DNA, 20 bp, Homo sapiens
aaagattcatttttaatcat

SEQ ID NO: 1414822 - DNA, 19 bp, Homo sapiens
aaagattctatagttctag

SEQ ID NO: 1414823 - DNA, 21 bp, Homo sapiens
aaagattctatagttctagac

SEQ ID NO: 1414824 - DNA, 18 bp, Homo sapiens
aaagattgaacttaaatg

SEQ ID NO: 1414825 - DNA, 21 bp, Homo sapiens
aaagattgctgaaattttata

SEQ ID NO: 1414826 - DNA, 18 bp, Homo sapiens
aaagattgtacttagcca

SEQ ID NO: 1414827 - DNA, 14 bp, Homo sapiens
aaagatttattgta

SEQ ID NO: 1414828 - DNA, 17 bp, Homo sapiens
aaagatttattgtaagc

SEQ ID NO: 1414829 - DNA, 17 bp, Homo sapiens
aaagatttcaaataaag

SEQ ID NO: 1414830 - DNA, 13 bp, Homo sapiens
aaagatttctgtt

SEQ ID NO: 1414831 - DNA, 21 bp, Homo sapiens
aaagatttgtgaactggaaga

SEQ ID NO: 1414832 - DNA, 14 bp, Homo sapiens
aaagattttcagaa

SEQ ID NO: 1414833 - DNA, 21 bp, Homo sapiens
aaagattttcagaaaatatta

SEQ ID NO: 1414834 - DNA, 16 bp, Homo sapiens
aaagattttgatctca

SEQ ID NO: 1414835 - DNA, 14 bp, Homo sapiens
aaagcaaaaatgac

SEQ ID NO: 1414836 - DNA, 16 bp, Homo sapiens
aaagcaaaaatgacaa

SEQ ID NO: 1414837 - DNA, 12 bp, Homo sapiens
aaagcaaaacat

SEQ ID NO: 1414838 - DNA, 21 bp, Homo sapiens
aaagcaaacttaagaaacact

SEQ ID NO: 1414839 - DNA, 15 bp, Homo sapiens
aaagcaaagaaaata

SEQ ID NO: 1414840 - DNA, 15 bp, Homo sapiens
aaagcaaagatgcat

SEQ ID NO: 1414841 - DNA, 13 bp, Homo sapiens
aaagcaaatgaga

SEQ ID NO: 1414842 - DNA, 23 bp, Homo sapiens
aaagcaacaaagattgagaagcc

SEQ ID NO: 1414843 - DNA, 18 bp, Homo sapiens
aagatagaaagctggact

SEQ ID NO: 1414844 - DNA, 19 bp, Homo sapiens
aagatagaaagctggactg

SEQ ID NO: 1414845 - DNA, 16 bp, Homo sapiens
aagatagacaggtcct

SEQ ID NO: 1414846 - DNA, 17 bp, Homo sapiens
aagatagacaggtcctg

SEQ ID NO: 1414847 - DNA, 14 bp, Homo sapiens
aagatagcagggca

SEQ ID NO: 1414848 - DNA, 20 bp, Homo sapiens
aagataggacgtatttataa

SEQ ID NO: 1414849 - DNA, 22 bp, Homo sapiens
aagataggacgtatttataata

SEQ ID NO: 1414850 - DNA, 23 bp, Homo sapiens
aagataggacgtatttataatag

SEQ ID NO: 1414851 - DNA, 15 bp, Homo sapiens
aagataggctctgca

SEQ ID NO: 1414852 - DNA, 18 bp, Homo sapiens
aagataggctctgcacag

SEQ ID NO: 1414853 - DNA, 16 bp, Homo sapiens
aagatatacttgtttt

SEQ ID NO: 1414854 - DNA, 20 bp, Homo sapiens
aagatatcagagctcttaat

SEQ ID NO: 1414855 - DNA, 13 bp, Homo sapiens
aagatatttatat

SEQ ID NO: 1414856 - DNA, 19 bp, Homo sapiens
aagatatttttatctttat

SEQ ID NO: 1414857 - DNA, 22 bp, Homo sapiens
aagatcaaaagcttattcatct

SEQ ID NO: 1414858 - DNA, 22 bp, Homo sapiens
aagatcaaaataaaaagtgaca

SEQ ID NO: 1414859 - DNA, 19 bp, Homo sapiens
aagatcacttgttgtttta

SEQ ID NO: 1414860 - DNA, 14 bp, Homo sapiens
aagatccaagaagg

SEQ ID NO: 1414861 - DNA, 16 bp, Homo sapiens
aagatcgaatttttca

SEQ ID NO: 1414862 - DNA, 16 bp, Homo sapiens
aagatcgttctctgcc

SEQ ID NO: 1414863 - DNA, 15 bp, Homo sapiens
aagatctaaactttt

SEQ ID NO: 1414864 - DNA, 16 bp, Homo sapiens
aagatctctagagttt

SEQ ID NO: 1414865 - DNA, 12 bp, Homo sapiens
aagatctgactg

SEQ ID NO: 1414866 - DNA, 13 bp, Homo sapiens
aagatctgactgc

SEQ ID NO: 1414867 - DNA, 15 bp, Homo sapiens
aagatctgactgcca

SEQ ID NO: 1414868 - DNA, 16 bp, Homo sapiens
aagatctgactgccaa

SEQ ID NO: 1414869 - DNA, 18 bp, Homo sapiens
aagatctgactgccaaat

SEQ ID NO: 1414870 - DNA, 17 bp, Homo sapiens
aagatcttagattctct

SEQ ID NO: 1414871 - DNA, 23 bp, Homo sapiens
aagatcttagattctctgtgtct

SEQ ID NO: 1414872 - DNA, 20 bp, Homo sapiens
aagatcttgagagctgctga

SEQ ID NO: 1414873 - DNA, 21 bp, Homo sapiens
aagatcttgagagctgctgag

SEQ ID NO: 1414874 - DNA, 15 bp, Homo sapiens
aagatcttgttaaag

SEQ ID NO: 1414875 - DNA, 20 bp, Homo sapiens
aagatcttttagaagtgaga

SEQ ID NO: 1414876 - DNA, 22 bp, Homo sapiens
aagatgaatggtctggcaatat

SEQ ID NO: 1414877 - DNA, 21 bp, Homo sapiens
aagatgaattttatcagccat

SEQ ID NO: 1414878 - DNA, 15 bp, Homo sapiens
aagatgacagctctt

SEQ ID NO: 1414879 - DNA, 19 bp, Homo sapiens
aagatgagaacagataaag

SEQ ID NO: 1414880 - DNA, 22 bp, Homo sapiens
aagatgagaacagataaagatt

SEQ ID NO: 1414881 - DNA, 22 bp, Homo sapiens
aagatgatttaagtatacagga

SEQ ID NO: 1414882 - DNA, 22 bp, Homo sapiens
aagatgcagagtaagtattatg

SEQ ID NO: 1414883 - DNA, 17 bp, Homo sapiens
aagatgctcttctgtgg

SEQ ID NO: 1414884 - DNA, 18 bp, Homo sapiens
aagatgctgcctgtattt

SEQ ID NO: 1414885 - DNA, 22 bp, Homo sapiens
aagatggaaattctgaaaactg

SEQ ID NO: 1414886 - DNA, 19 bp, Homo sapiens
aagatggacacgagccaca

SEQ ID NO: 1414887 - DNA, 21 bp, Homo sapiens
aagatggacacgagccacaag

SEQ ID NO: 1414888 - DNA, 19 bp, Homo sapiens
aagatggagacaccctctg

SEQ ID NO: 1414889 - DNA, 22 bp, Homo sapiens
aagatggagacaccctctgggg

SEQ ID NO: 1414890 - DNA, 15 bp, Homo sapiens
aagatggagtttcta

SEQ ID NO: 1414891 - DNA, 16 bp, Homo sapiens
aagatggagtttctaa

SEQ ID NO: 1414892 - DNA, 20 bp, Homo sapiens
aagatggagtttctaaggtc

SEQ ID NO: 1414893 - DNA, 18 bp, Homo sapiens
aagatggataaactgagc

SEQ ID NO: 1414894 - DNA, 20 bp, Homo sapiens
aagatggctcccaaggttcc

SEQ ID NO: 1414895 - DNA, 15 bp, Homo sapiens
aagatggctgctgcc

SEQ ID NO: 1414896 - DNA, 22 bp, Homo sapiens
aagatgggcatcttttgtatta

SEQ ID NO: 1414897 - DNA, 21 bp, Homo sapiens
aagatgggggcagggctgtgc

SEQ ID NO: 1414898 - DNA, 21 bp, Homo sapiens
aagatgggtccctggccacca

SEQ ID NO: 1414899 - DNA, 20 bp, Homo sapiens
aagatggtccatttgttcct

SEQ ID NO: 1414900 - DNA, 17 bp, Homo sapiens
aagatggttaaacattt

SEQ ID NO: 1414901 - DNA, 23 bp, Homo sapiens
aagatgtctcaggtttgttttgt

SEQ ID NO: 1414902 - DNA, 13 bp, Homo sapiens
aaccctgaagcca

SEQ ID NO: 1414903 - DNA, 23 bp, Homo sapiens
aaccctgctgaacacagtgtctg

SEQ ID NO: 1414904 - DNA, 12 bp, Homo sapiens
aaccctgcttct

SEQ ID NO: 1414905 - DNA, 21 bp, Homo sapiens
aaccctgcttctgctgccctg

SEQ ID NO: 1414906 - DNA, 15 bp, Homo sapiens
aaccctggagccatc

SEQ ID NO: 1414907 - DNA, 16 bp, Homo sapiens
aaccctggagccatcc

SEQ ID NO: 1414908 - DNA, 22 bp, Homo sapiens
aaccctggcttgcttgccgagc

SEQ ID NO: 1414909 - DNA, 21 bp, Homo sapiens
aaccctgggagtagctagttt

SEQ ID NO: 1414910 - DNA, 12 bp, Homo sapiens
aaccctgggctg

SEQ ID NO: 1414911 - DNA, 22 bp, Homo sapiens
aaccctgggctggggaggagga

SEQ ID NO: 1414912 - DNA, 19 bp, Homo sapiens
aaccctggggaaggagcca

SEQ ID NO: 1414913 - DNA, 18 bp, Homo sapiens
aaccctggggcctgactg

SEQ ID NO: 1414914 - DNA, 14 bp, Homo sapiens
aaccctgtgctggt

SEQ ID NO: 1414915 - DNA, 23 bp, Homo sapiens
aaccctgtgggcttatgtctctg

SEQ ID NO: 1414916 - DNA, 22 bp, Homo sapiens
aacccttcagtgctacattttg

SEQ ID NO: 1414917 - DNA, 19 bp, Homo sapiens
aacccttcatcttcctgtg

SEQ ID NO: 1414918 - DNA, 16 bp, Homo sapiens
aacccttgccaggtcc

SEQ ID NO: 1414919 - DNA, 15 bp, Homo sapiens
aacccttgggccaga

SEQ ID NO: 1414920 - DNA, 18 bp, Homo sapiens
aacccttgggccagaagt

SEQ ID NO: 1414921 - DNA, 22 bp, Homo sapiens
aaccgagcaaagatcaaaataa

SEQ ID NO: 1414922 - DNA, 14 bp, Homo sapiens
aaccgcaaacgtga

SEQ ID NO: 1414923 - DNA, 15 bp, Homo sapiens
aaccgcacagctcag

SEQ ID NO: 1414924 - DNA, 23 bp, Homo sapiens
aaccggaaggaggccaaccagcc

SEQ ID NO: 1414925 - DNA, 16 bp, Homo sapiens
aaccgggaagggtggc

SEQ ID NO: 1414926 - DNA, 17 bp, Homo sapiens
aaccgggaagggtggcc

SEQ ID NO: 1414927 - DNA, 21 bp, Homo sapiens
aactttattttttaaaaatga

SEQ ID NO: 1414928 - DNA, 23 bp, Homo sapiens
aactttcaaaagggaagagtttt

SEQ ID NO: 1414929 - DNA, 12 bp, Homo sapiens
aactttcacttt

SEQ ID NO: 1414930 - DNA, 14 bp, Homo sapiens
aactttcagaggca

SEQ ID NO: 1414931 - DNA, 11 bp, Homo sapiens
aactttcattt

SEQ ID NO: 1414932 - DNA, 14 bp, Homo sapiens
aactttcatttttt

SEQ ID NO: 1414933 - DNA, 16 bp, Homo sapiens
aactttcgaccgactt

SEQ ID NO: 1414934 - DNA, 21 bp, Homo sapiens
aactttcgaccgactttcccc

SEQ ID NO: 1414935 - DNA, 22 bp, Homo sapiens
aactttcgaccgactttcccca

SEQ ID NO: 1414936 - DNA, 16 bp, Homo sapiens
aactttctttctaaag

SEQ ID NO: 1414937 - DNA, 18 bp, Homo sapiens
aactttgagtacagatac

SEQ ID NO: 1414938 - DNA, 23 bp, Homo sapiens
aactttgagtacagatactgtga

SEQ ID NO: 1414939 - DNA, 24 bp, Homo sapiens
aactttggaaccagactcttgcct

SEQ ID NO: 1414940 - DNA, 16 bp, Homo sapiens
aactttgggaaaacat

SEQ ID NO: 1414941 - DNA, 21 bp, Homo sapiens
aactttgtaaaaatcttttga

SEQ ID NO: 1414942 - DNA, 18 bp, Homo sapiens
aacttttaaacatgagaa

SEQ ID NO: 1414943 - DNA, 14 bp, Homo sapiens
aacttttatctatt

SEQ ID NO: 1414944 - DNA, 21 bp, Homo sapiens
aacttttgagaatgtttgaaa

SEQ ID NO: 1414945 - DNA, 13 bp, Homo sapiens
aacttttgggagc

SEQ ID NO: 1414946 - DNA, 11 bp, Homo sapiens
aacttttgtaa

SEQ ID NO: 1414947 - DNA, 17 bp, Homo sapiens
aacttttgtactgaatt

SEQ ID NO: 1414948 - DNA, 20 bp, Homo sapiens
aacttttgtactgaattttt

SEQ ID NO: 1414949 - DNA, 18 bp, Homo sapiens
aacttttttgtgtatgta

SEQ ID NO: 1414950 - DNA, 22 bp, Homo sapiens
aacttttttgtgtatgtactta

SEQ ID NO: 1414951 - DNA, 21 bp, Homo sapiens
aactttttttctgtaccagtt

SEQ ID NO: 1414952 - DNA, 16 bp, Homo sapiens
aagaaaaaaaataaca

SEQ ID NO: 1414953 - DNA, 18 bp, Homo sapiens
aagaaaaaaaataacaca

SEQ ID NO: 1414954 - DNA, 14 bp, Homo sapiens
aagaaaaaaatact

SEQ ID NO: 1414955 - DNA, 17 bp, Homo sapiens
aagaaaaaaatggaaaa

SEQ ID NO: 1414956 - DNA, 16 bp, Homo sapiens
aagaaaaaagcttata

SEQ ID NO: 1414957 - DNA, 16 bp, Homo sapiens
aagaaaaacatgtcat

SEQ ID NO: 1414958 - DNA, 11 bp, Homo sapiens
aagaaaaactt

SEQ ID NO: 1414959 - DNA, 12 bp, Homo sapiens
aagaaaaacttt

SEQ ID NO: 1414960 - DNA, 12 bp, Homo sapiens
aagaaaaagatt

SEQ ID NO: 1414961 - DNA, 15 bp, Homo sapiens
aagaaaaagtacaat

SEQ ID NO: 1414962 - DNA, 20 bp, Homo sapiens
aagaaaaagtacaatgaact

SEQ ID NO: 1414963 - DNA, 9 bp, Homo sapiens
aagaaaaat

SEQ ID NO: 1414964 - DNA, 23 bp, Homo sapiens
aagaaaaataccatgtctctaag

SEQ ID NO: 1414965 - DNA, 11 bp, Homo sapiens
aagaaaaatat

SEQ ID NO: 1414966 - DNA, 14 bp, Homo sapiens
aagaaaaatatgat

SEQ ID NO: 1414967 - DNA, 12 bp, Homo sapiens
aagaaaaatatt

SEQ ID NO: 1414968 - DNA, 13 bp, Homo sapiens
aagaaaaatcatg

SEQ ID NO: 1414969 - DNA, 17 bp, Homo sapiens
aagaaaaatcatgtttg

SEQ ID NO: 1414970 - DNA, 19 bp, Homo sapiens
aagaaaaatcatgtttgct

SEQ ID NO: 1414971 - DNA, 19 bp, Homo sapiens
aagaaaacaaagttctatt

SEQ ID NO: 1414972 - DNA, 22 bp, Homo sapiens
aagaaaacagtacagaaggcaa

SEQ ID NO: 1414973 - DNA, 13 bp, Homo sapiens
aagaaaacatctt

SEQ ID NO: 1414974 - DNA, 17 bp, Homo sapiens
aagaaaacatctttaag

SEQ ID NO: 1414975 - DNA, 15 bp, Homo sapiens
aagaaaagataaaga

SEQ ID NO: 1414976 - DNA, 21 bp, Homo sapiens
aagaaaagcctgaactattta

SEQ ID NO: 1414977 - DNA, 17 bp, Homo sapiens
aagaaaaggggagagaa

SEQ ID NO: 1414978 - DNA, 16 bp, Homo sapiens
aagaaaagtggttgtt

SEQ ID NO: 1414979 - DNA, 16 bp, Homo sapiens
aagaaaatacaataaa

SEQ ID NO: 1414980 - DNA, 17 bp, Homo sapiens
aagaaaatacaataaac

SEQ ID NO: 1414981 - DNA, 13 bp, Homo sapiens
aagaaaatactta

SEQ ID NO: 1414982 - DNA, 16 bp, Homo sapiens
aagaaaatgaagggat

SEQ ID NO: 1414983 - DNA, 15 bp, Homo sapiens
aagaaacaagctgtg

SEQ ID NO: 1414984 - DNA, 20 bp, Homo sapiens
aagaaacaagctgtgcaggc

SEQ ID NO: 1414985 - DNA, 21 bp, Homo sapiens
aagaaacacatcaaataaact

SEQ ID NO: 1414986 - DNA, 20 bp, Homo sapiens
aagaaacactaagctctctg

SEQ ID NO: 1414987 - DNA, 12 bp, Homo sapiens
aagaaacactga

SEQ ID NO: 1414988 - DNA, 19 bp, Homo sapiens
aagaaacagatctcctggc

SEQ ID NO: 1414989 - DNA, 11 bp, Homo sapiens
aagaaacccaa

SEQ ID NO: 1414990 - DNA, 17 bp, Homo sapiens
aagaaacccttgctgct

SEQ ID NO: 1414991 - DNA, 18 bp, Homo sapiens
aagaaacccttgctgctt

SEQ ID NO: 1414992 - DNA, 15 bp, Homo sapiens
aagaaaccttgctct

SEQ ID NO: 1414993 - DNA, 17 bp, Homo sapiens
aagaaaccttgctctcc

SEQ ID NO: 1414994 - DNA, 21 bp, Homo sapiens
aagaaacgtctatgtgtacag

SEQ ID NO: 1414995 - DNA, 21 bp, Homo sapiens
aagaaactgaggaattttctt

SEQ ID NO: 1414996 - DNA, 14 bp, Homo sapiens
aagagaattctatt

SEQ ID NO: 1414997 - DNA, 18 bp, Homo sapiens
aagagacagagacaagta

SEQ ID NO: 1414998 - DNA, 17 bp, Homo sapiens
aagagacagttctctgt

SEQ ID NO: 1414999 - DNA, 13 bp, Homo sapiens
aagagaccagcac

SEQ ID NO: 1415000 - DNA, 19 bp, Homo sapiens
aagagagagagagaaaaaa

SEQ ID NO: 1415001 - DNA, 20 bp, Homo sapiens
aagagagagagagaaaaaaa

SEQ ID NO: 1415002 - DNA, 13 bp, Homo sapiens
aagagagggacag

SEQ ID NO: 1415003 - DNA, 20 bp, Homo sapiens
aagagagtcataaaccttaa

SEQ ID NO: 1415004 - DNA, 15 bp, Homo sapiens
aagagataagtcttt

SEQ ID NO: 1415005 - DNA, 21 bp, Homo sapiens
aagagatatgtagaaggcaca

SEQ ID NO: 1415006 - DNA, 19 bp, Homo sapiens
aagagatctacacatgttg

SEQ ID NO: 1415007 - DNA, 15 bp, Homo sapiens
aagagatgggacaag

SEQ ID NO: 1415008 - DNA, 21 bp, Homo sapiens
aagagatgtggcaaagtgctg

SEQ ID NO: 1415009 - DNA, 13 bp, Homo sapiens
aagagatttcaag

SEQ ID NO: 1415010 - DNA, 19 bp, Homo sapiens
aagagcagcctgatggcca

SEQ ID NO: 1415011 - DNA, 20 bp, Homo sapiens
aagagcagcctgatggccaa

SEQ ID NO: 1415012 - DNA, 23 bp, Homo sapiens
aagagcagcctgatggccaaggg

SEQ ID NO: 1415013 - DNA, 13 bp, Homo sapiens
aagagcagcctgt

SEQ ID NO: 1415014 - DNA, 16 bp, Homo sapiens
aagagcagctgggaac

SEQ ID NO: 1415015 - DNA, 12 bp, Homo sapiens
aagagccacctg

SEQ ID NO: 1415016 - DNA, 13 bp, Homo sapiens
aagagccacctgc

SEQ ID NO: 1415017 - DNA, 15 bp, Homo sapiens
aagagccacctgcaa

SEQ ID NO: 1415018 - DNA, 16 bp, Homo sapiens
aagagccacctgcaag

SEQ ID NO: 1415019 - DNA, 19 bp, Homo sapiens
aagagccatataagtttga

SEQ ID NO: 1415020 - DNA, 14 bp, Homo sapiens
aagagcccagtctg

SEQ ID NO: 1415021 - DNA, 22 bp, Homo sapiens
aagagcccgcagggccatgcag

SEQ ID NO: 1415022 - DNA, 13 bp, Homo sapiens
aagagcctcccac

SEQ ID NO: 1415023 - DNA, 13 bp, Homo sapiens
aagagcctcccct

SEQ ID NO: 1415024 - DNA, 14 bp, Homo sapiens
aagagcctttccaa

SEQ ID NO: 1415025 - DNA, 18 bp, Homo sapiens
aagagcgagagatcaaag

SEQ ID NO: 1415026 - DNA, 23 bp, Homo sapiens
aagagcgagagatcaaagatgaa

SEQ ID NO: 1415027 - DNA, 15 bp, Homo sapiens
aagagctaataaatc

SEQ ID NO: 1415028 - DNA, 19 bp, Homo sapiens
aagagctagcgctgccgca

SEQ ID NO: 1415029 - DNA, 19 bp, Homo sapiens
aagagctcccctccacagc

SEQ ID NO: 1415030 - DNA, 21 bp, Homo sapiens
aagagctcttcggtttctgag

SEQ ID NO: 1415031 - DNA, 12 bp, Homo sapiens
aagagctgcctg

SEQ ID NO: 1415032 - DNA, 16 bp, Homo sapiens
aagagctgcctggatg

SEQ ID NO: 1415033 - DNA, 17 bp, Homo sapiens
aagagctgcctggatga

SEQ ID NO: 1415034 - DNA, 12 bp, Homo sapiens
aagagctgctgt

SEQ ID NO: 1415035 - DNA, 15 bp, Homo sapiens
aagagcttgctccag

SEQ ID NO: 1415036 - DNA, 17 bp, Homo sapiens
aagagcttgctccagat

SEQ ID NO: 1415037 - DNA, 14 bp, Homo sapiens
aagaggaagcaaat

SEQ ID NO: 1415038 - DNA, 24 bp, Homo sapiens
aagaggaatctgtttctctgctgt

SEQ ID NO: 1415039 - DNA, 14 bp, Homo sapiens
aagaggagaccctg

SEQ ID NO: 1415040 - DNA, 13 bp, Homo sapiens
aagaggagcctca

SEQ ID NO: 1415041 - DNA, 15 bp, Homo sapiens
aagaggagcctcaga

SEQ ID NO: 1415042 - DNA, 21 bp, Homo sapiens
aagaggaggggaagaggcctg

SEQ ID NO: 1415043 - DNA, 22 bp, Homo sapiens
aagaggagtaggccctggttcc

SEQ ID NO: 1415044 - DNA, 22 bp, Homo sapiens
aagaggatgagcagagggagga

SEQ ID NO: 1415045 - DNA, 19 bp, Homo sapiens
aagaggcaagctgaaattt

SEQ ID NO: 1415046 - DNA, 13 bp, Homo sapiens
aagaggcagagtt

SEQ ID NO: 1415047 - DNA, 22 bp, Homo sapiens
aagaggcagagttctgtgaaga

SEQ ID NO: 1415048 - DNA, 23 bp, Homo sapiens
aagaggccagacatggtgtctca

SEQ ID NO: 1415049 - DNA, 18 bp, Homo sapiens
aagaggcgggccagccag

SEQ ID NO: 1415050 - DNA, 20 bp, Homo sapiens
aagaggcgggccagccaggc

SEQ ID NO: 1415051 - DNA, 21 bp, Homo sapiens
aagaggcgggccagccaggcg

SEQ ID NO: 1415052 - DNA, 23 bp, Homo sapiens
aacggaggcctgcgaccctgggg

SEQ ID NO: 1415053 - DNA, 12 bp, Homo sapiens
aacggagtcaaa

SEQ ID NO: 1415054 - DNA, 18 bp, Homo sapiens
aacggcaacgtagcctgg

SEQ ID NO: 1415055 - DNA, 19 bp, Homo sapiens
aacggcaacgtagcctggg

SEQ ID NO: 1415056 - DNA, 13 bp, Homo sapiens
aacggccagggtt

SEQ ID NO: 1415057 - DNA, 22 bp, Homo sapiens
aacggcttgctttcctgcatct

SEQ ID NO: 1415058 - DNA, 16 bp, Homo sapiens
aacgggaacatgcccc

SEQ ID NO: 1415059 - DNA, 16 bp, Homo sapiens
aacgggctccttcccc

SEQ ID NO: 1415060 - DNA, 15 bp, Homo sapiens
aacgggctgccctgc

SEQ ID NO: 1415061 - DNA, 12 bp, Homo sapiens
aacggggagaaa

SEQ ID NO: 1415062 - DNA, 18 bp, Homo sapiens
aacggggctcttctcatt

SEQ ID NO: 1415063 - DNA, 20 bp, Homo sapiens
aacggtgctgtgagggaggg

SEQ ID NO: 1415064 - DNA, 14 bp, Homo sapiens
aacgtaaactatga

SEQ ID NO: 1415065 - DNA, 19 bp, Homo sapiens
aacgtgaaattctattgaa

SEQ ID NO: 1415066 - DNA, 22 bp, Homo sapiens
aacgtgagagaaagagagaagc

SEQ ID NO: 1415067 - DNA, 19 bp, Homo sapiens
aacgtgcgtgtctctgcca

SEQ ID NO: 1415068 - DNA, 15 bp, Homo sapiens
aacgtgcttctttgt

SEQ ID NO: 1415069 - DNA, 13 bp, Homo sapiens
aacgttggacttt

SEQ ID NO: 1415070 - DNA, 14 bp, Homo sapiens
aacgttttcttctt

SEQ ID NO: 1415071 - DNA, 21 bp, Homo sapiens
aacgttttcttctttccctgg

SEQ ID NO: 1415072 - DNA, 22 bp, Homo sapiens
aacgttttcttctttccctgga

SEQ ID NO: 1415073 - DNA, 15 bp, Homo sapiens
aacgttttgaactaa

SEQ ID NO: 1415074 - DNA, 21 bp, Homo sapiens
aactaaaaatatatctgttgg

SEQ ID NO: 1415075 - DNA, 12 bp, Homo sapiens
aactaaaattaa

SEQ ID NO: 1415076 - DNA, 15 bp, Homo sapiens
aactaaaatttgaag

SEQ ID NO: 1415077 - DNA, 18 bp, Homo sapiens
aactaaactcatttataa

SEQ ID NO: 1415078 - DNA, 19 bp, Homo sapiens
aactaaagttgtactttaa

SEQ ID NO: 1415079 - DNA, 13 bp, Homo sapiens
aactaaatttcac

SEQ ID NO: 1415080 - DNA, 22 bp, Homo sapiens
aactaaatttcactactagatt

SEQ ID NO: 1415081 - DNA, 14 bp, Homo sapiens
aactaacatgtcct

SEQ ID NO: 1415082 - DNA, 15 bp, Homo sapiens
aactaaccagcattc

SEQ ID NO: 1415083 - DNA, 21 bp, Homo sapiens
aactaagagacagttctctgt

SEQ ID NO: 1415084 - DNA, 13 bp, Homo sapiens
aactaagccctcg

SEQ ID NO: 1415085 - DNA, 19 bp, Homo sapiens
aactaaggtgaagaatctt

SEQ ID NO: 1415086 - DNA, 18 bp, Homo sapiens
aactaatacgtgccagat

SEQ ID NO: 1415087 - DNA, 14 bp, Homo sapiens
aactaatttgtggt

SEQ ID NO: 1415088 - DNA, 12 bp, Homo sapiens
aactaattttgt

SEQ ID NO: 1415089 - DNA, 19 bp, Homo sapiens
aactaattttgttgaaaat

SEQ ID NO: 1415090 - DNA, 13 bp, Homo sapiens
aactaatttttgt

SEQ ID NO: 1415091 - DNA, 15 bp, Homo sapiens
aactacaaacaaaat

SEQ ID NO: 1415092 - DNA, 21 bp, Homo sapiens
aactacaaagctttgctacaa

SEQ ID NO: 1415093 - DNA, 14 bp, Homo sapiens
aactacagatcttt

SEQ ID NO: 1415094 - DNA, 17 bp, Homo sapiens
aactacataaaaataga

SEQ ID NO: 1415095 - DNA, 17 bp, Homo sapiens
aactacatatttgtgcc

SEQ ID NO: 1415096 - DNA, 22 bp, Homo sapiens
aactactactggtgatgcctaa

SEQ ID NO: 1415097 - DNA, 23 bp, Homo sapiens
aactactactggtgatgcctaat

SEQ ID NO: 1415098 - DNA, 21 bp, Homo sapiens
aactactgaatgaagcagtat

SEQ ID NO: 1415099 - DNA, 23 bp, Homo sapiens
aactactgaatgaagcagtattt

SEQ ID NO: 1415100 - DNA, 20 bp, Homo sapiens
aactacttgcatttgatttt

SEQ ID NO: 1415101 - DNA, 18 bp, Homo sapiens
aactactttttatactcc

SEQ ID NO: 1415102 - DNA, 13 bp, Homo sapiens
aactagaacaaat

SEQ ID NO: 1415103 - DNA, 20 bp, Homo sapiens
aactagaaggcttctctcca

SEQ ID NO: 1415104 - DNA, 13 bp, Homo sapiens
aactagaattagt

SEQ ID NO: 1415105 - DNA, 17 bp, Homo sapiens
aactagaatttattcaa

SEQ ID NO: 1415106 - DNA, 22 bp, Homo sapiens
aactagaatttattcaattcct

SEQ ID NO: 1415107 - DNA, 17 bp, Homo sapiens
aactagacaccaaagtt

SEQ ID NO: 1415108 - DNA, 13 bp, Homo sapiens
aactagatttgtc

SEQ ID NO: 1415109 - DNA, 17 bp, Homo sapiens
aactagatttgtccttt

SEQ ID NO: 1415110 - DNA, 15 bp, Homo sapiens
aactagcattgtaaa

SEQ ID NO: 1415111 - DNA, 18 bp, Homo sapiens
aactagccaaaccaggac

SEQ ID NO: 1415112 - DNA, 22 bp, Homo sapiens
aactagccagacaaaatttgag

SEQ ID NO: 1415113 - DNA, 16 bp, Homo sapiens
aactagcccctggggt

SEQ ID NO: 1415114 - DNA, 12 bp, Homo sapiens
aactagggctag

SEQ ID NO: 1415115 - DNA, 22 bp, Homo sapiens
aactagggctagtcttccctta

SEQ ID NO: 1415116 - DNA, 16 bp, Homo sapiens
aactagggctcatttt

SEQ ID NO: 1415117 - DNA, 14 bp, Homo sapiens
aactagtgtacatt

SEQ ID NO: 1415118 - DNA, 18 bp, Homo sapiens
aactagtttccagtggat

SEQ ID NO: 1415119 - DNA, 15 bp, Homo sapiens
aactataaagtttta

SEQ ID NO: 1415120 - DNA, 16 bp, Homo sapiens
aactataacaatcact

SEQ ID NO: 1415121 - DNA, 16 bp, Homo sapiens
aactatcggttcaagt

SEQ ID NO: 1415122 - DNA, 17 bp, Homo sapiens
aactatcggttcaagtt

SEQ ID NO: 1415123 - DNA, 18 bp, Homo sapiens
aactatcttggtgaattt

SEQ ID NO: 1415124 - DNA, 17 bp, Homo sapiens
aactatgcatggtgccc

SEQ ID NO: 1415125 - DNA, 22 bp, Homo sapiens
aactatgcatggtgccccagga

SEQ ID NO: 1415126 - DNA, 17 bp, Homo sapiens
aactatgtggctgaaaa

SEQ ID NO: 1415127 - DNA, 21 bp, Homo sapiens
aactattagagtatttccctt

SEQ ID NO: 1415128 - DNA, 22 bp, Homo sapiens
aactattagagtatttcccttc

SEQ ID NO: 1415129 - DNA, 23 bp, Homo sapiens
aactattaggaggaatgtgcttt

SEQ ID NO: 1415130 - DNA, 15 bp, Homo sapiens
aactattggaaagta

SEQ ID NO: 1415131 - DNA, 15 bp, Homo sapiens
aactattgggtgaat

SEQ ID NO: 1415132 - DNA, 20 bp, Homo sapiens
aactatttatctgtgttttt

SEQ ID NO: 1415133 - DNA, 23 bp, Homo sapiens
aactatttatctgtgtttttgaa

SEQ ID NO: 1415134 - DNA, 20 bp, Homo sapiens
aactatttattaaaaacatg

SEQ ID NO: 1415135 - DNA, 14 bp, Homo sapiens
aactatttcttcag

SEQ ID NO: 1415136 - DNA, 13 bp, Homo sapiens
aactcaaatacac

SEQ ID NO: 1415137 - DNA, 15 bp, Homo sapiens
aactcacagcttctc

SEQ ID NO: 1415138 - DNA, 17 bp, Homo sapiens
aactcacctctcaaggt

SEQ ID NO: 1415139 - DNA, 17 bp, Homo sapiens
aactcactaacagggag

SEQ ID NO: 1415140 - DNA, 12 bp, Homo sapiens
aactcactctgg

SEQ ID NO: 1415141 - DNA, 13 bp, Homo sapiens
aactcactctggg

SEQ ID NO: 1415142 - DNA, 16 bp, Homo sapiens
aactcactctgggctg

SEQ ID NO: 1415143 - DNA, 17 bp, Homo sapiens
aactcactctgggctgt

SEQ ID NO: 1415144 - DNA, 14 bp, Homo sapiens
aactcactgcctag

SEQ ID NO: 1415145 - DNA, 15 bp, Homo sapiens
aactcactgcctagg

SEQ ID NO: 1415146 - DNA, 21 bp, Homo sapiens
aactcactgctcaagaagaca

SEQ ID NO: 1415147 - DNA, 12 bp, Homo sapiens
aactcagatcca

SEQ ID NO: 1415148 - DNA, 23 bp, Homo sapiens
aactcagccgtagggtggcactg

SEQ ID NO: 1415149 - DNA, 15 bp, Homo sapiens
aactcagttcaaacc

SEQ ID NO: 1415150 - DNA, 24 bp, Homo sapiens
aactcatcctcttttaatggcatt

SEQ ID NO: 1415151 - DNA, 19 bp, Homo sapiens
aactcattcctgcctgtct

SEQ ID NO: 1415152 - DNA, 22 bp, Homo sapiens
aactcattctcttcttgctata

SEQ ID NO: 1415153 - DNA, 19 bp, Homo sapiens
aactccaccgaccaactgc

SEQ ID NO: 1415154 - DNA, 19 bp, Homo sapiens
aactccatacagcctctac

SEQ ID NO: 1415155 - DNA, 10 bp, Homo sapiens
aactccattt

SEQ ID NO: 1415156 - DNA, 17 bp, Homo sapiens
aactcccccattttaca

SEQ ID NO: 1415157 - DNA, 16 bp, Homo sapiens
aactccctccaccagc

SEQ ID NO: 1415158 - DNA, 18 bp, Homo sapiens
aactccctccaccagcct

SEQ ID NO: 1415159 - DNA, 19 bp, Homo sapiens
aactccctccaccagcctg

SEQ ID NO: 1415160 - DNA, 23 bp, Homo sapiens
aactcctgacgtctgaagcttga

SEQ ID NO: 1415161 - DNA, 17 bp, Homo sapiens
aactcctgattttgtag

SEQ ID NO: 1415162 - DNA, 18 bp, Homo sapiens
aactcctggaaatatcag

SEQ ID NO: 1415163 - DNA, 14 bp, Homo sapiens
aactcctggccttt

SEQ ID NO: 1415164 - DNA, 12 bp, Homo sapiens
aactcctgtccc

SEQ ID NO: 1415165 - DNA, 14 bp, Homo sapiens
aactcctgtccctt

SEQ ID NO: 1415166 - DNA, 17 bp, Homo sapiens
aactccttattttgtat

SEQ ID NO: 1415167 - DNA, 18 bp, Homo sapiens
aactcctttcagccacat

SEQ ID NO: 1415168 - DNA, 16 bp, Homo sapiens
aactcgaactgctttc

SEQ ID NO: 1415169 - DNA, 22 bp, Homo sapiens
aactggttaaacattaatattt

SEQ ID NO: 1415170 - DNA, 22 bp, Homo sapiens
aactgtaaataaaatgtgtaca

SEQ ID NO: 1415171 - DNA, 13 bp, Homo sapiens
aactgtaaatatt

SEQ ID NO: 1415172 - DNA, 13 bp, Homo sapiens
aactgtacattgt

SEQ ID NO: 1415173 - DNA, 16 bp, Homo sapiens
aactgtacattgtgag

SEQ ID NO: 1415174 - DNA, 18 bp, Homo sapiens
aactgtacatttaaaatt

SEQ ID NO: 1415175 - DNA, 14 bp, Homo sapiens
aactgtatatattc

SEQ ID NO: 1415176 - DNA, 20 bp, Homo sapiens
aactgtatcaaatctgtata

SEQ ID NO: 1415177 - DNA, 23 bp, Homo sapiens
aactgtcccacaaaatatttcta

SEQ ID NO: 1415178 - DNA, 13 bp, Homo sapiens
aactgtcccagct

SEQ ID NO: 1415179 - DNA, 19 bp, Homo sapiens
aactgtccctttgtttgaa

SEQ ID NO: 1415180 - DNA, 18 bp, Homo sapiens
aactgtccgtaagcagta

SEQ ID NO: 1415181 - DNA, 21 bp, Homo sapiens
aactgtccgtaagcagtatat

SEQ ID NO: 1415182 - DNA, 14 bp, Homo sapiens
aactgtcctgtcct

SEQ ID NO: 1415183 - DNA, 16 bp, Homo sapiens
aactgtcctgtcctgc

SEQ ID NO: 1415184 - DNA, 21 bp, Homo sapiens
aactgtctgaatattctagaa

SEQ ID NO: 1415185 - DNA, 14 bp, Homo sapiens
aactgtcttcctca

SEQ ID NO: 1415186 - DNA, 12 bp, Homo sapiens
aactgtcttgtt

SEQ ID NO: 1415187 - DNA, 16 bp, Homo sapiens
aactgtcttgtttcag

SEQ ID NO: 1415188 - DNA, 18 bp, Homo sapiens
aactgtcttgtttcagtg

SEQ ID NO: 1415189 - DNA, 18 bp, Homo sapiens
aactgtctttaaaagaga

SEQ ID NO: 1415190 - DNA, 17 bp, Homo sapiens
aactgtctttgtcacca

SEQ ID NO: 1415191 - DNA, 10 bp, Homo sapiens
aactgtgaaa

SEQ ID NO: 1415192 - DNA, 17 bp, Homo sapiens
aactgtgaaaatagtgt

SEQ ID NO: 1415193 - DNA, 15 bp, Homo sapiens
aactgtgaaatacca

SEQ ID NO: 1415194 - DNA, 22 bp, Homo sapiens
aactgtgaaataccacaagcct

SEQ ID NO: 1415195 - DNA, 20 bp, Homo sapiens
aactgtggccgttatctgga

SEQ ID NO: 1415196 - DNA, 16 bp, Homo sapiens
aactgtggtagctcca

SEQ ID NO: 1415197 - DNA, 17 bp, Homo sapiens
aactgtggtagctccag

SEQ ID NO: 1415198 - DNA, 15 bp, Homo sapiens
aactgtgtatgtaca

SEQ ID NO: 1415199 - DNA, 17 bp, Homo sapiens
aactgtgtatgtacata

SEQ ID NO: 1415200 - DNA, 22 bp, Homo sapiens
aactgttggagcccgaagctct

SEQ ID NO: 1415201 - DNA, 15 bp, Homo sapiens
aactgttggctgctc

SEQ ID NO: 1415202 - DNA, 18 bp, Homo sapiens
aactgttgtagaagacaa

SEQ ID NO: 1415203 - DNA, 15 bp, Homo sapiens
aactgtttccctgct

SEQ ID NO: 1415204 - DNA, 13 bp, Homo sapiens
aacttaaaaatgt

SEQ ID NO: 1415205 - DNA, 17 bp, Homo sapiens
aacttaaaaatgtaaat

SEQ ID NO: 1415206 - DNA, 14 bp, Homo sapiens
aacttaaaatattt

SEQ ID NO: 1415207 - DNA, 16 bp, Homo sapiens
aacttaaaatatttta

SEQ ID NO: 1415208 - DNA, 14 bp, Homo sapiens
aacttaaacaaaaa

SEQ ID NO: 1415209 - DNA, 15 bp, Homo sapiens
aacttaaacaaaaaa

SEQ ID NO: 1415210 - DNA, 15 bp, Homo sapiens
aacttaaatgttatt

SEQ ID NO: 1415211 - DNA, 21 bp, Homo sapiens
aacttaaatgttattatctgg

SEQ ID NO: 1415212 - DNA, 13 bp, Homo sapiens
aacttaacatgaa

SEQ ID NO: 1415213 - DNA, 14 bp, Homo sapiens
aacttaagcaaagg

SEQ ID NO: 1415214 - DNA, 21 bp, Homo sapiens
aacttaagcaaaggggacagc

SEQ ID NO: 1415215 - DNA, 20 bp, Homo sapiens
aacttaagggcaaggagttt

SEQ ID NO: 1415216 - DNA, 20 bp, Homo sapiens
aacttaatgttctgaataat

SEQ ID NO: 1415217 - DNA, 15 bp, Homo sapiens
aacttactagcttta

SEQ ID NO: 1415218 - DNA, 15 bp, Homo sapiens
aacttactgattatt

SEQ ID NO: 1415219 - DNA, 12 bp, Homo sapiens
aacttactgtat

SEQ ID NO: 1415220 - DNA, 17 bp, Homo sapiens
aacttactgtatatgta

SEQ ID NO: 1415221 - DNA, 19 bp, Homo sapiens
aacttactgtatatgtatt

SEQ ID NO: 1415222 - DNA, 20 bp, Homo sapiens
aacttactgtcagagaatat

SEQ ID NO: 1415223 - DNA, 20 bp, Homo sapiens
aacttagaactatgctaatt

SEQ ID NO: 1415224 - DNA, 16 bp, Homo sapiens
aacttagaggaaaagg

SEQ ID NO: 1415225 - DNA, 15 bp, Homo sapiens
aacttagaggaaaat

SEQ ID NO: 1415226 - DNA, 16 bp, Homo sapiens
aacttagaggaaaatg

SEQ ID NO: 1415227 - DNA, 15 bp, Homo sapiens
aacttagccagagtt

SEQ ID NO: 1415228 - DNA, 19 bp, Homo sapiens
aacttagctcaggtgcctt

SEQ ID NO: 1415229 - DNA, 23 bp, Homo sapiens
aacttagtgcggacaagttttaa

SEQ ID NO: 1415230 - DNA, 12 bp, Homo sapiens
aacttatattga

SEQ ID NO: 1415231 - DNA, 13 bp, Homo sapiens
aacttatattgaa

SEQ ID NO: 1415232 - DNA, 19 bp, Homo sapiens
aacttatattgaagacaat

SEQ ID NO: 1415233 - DNA, 13 bp, Homo sapiens
aacttcaagaagt

SEQ ID NO: 1415234 - DNA, 23 bp, Homo sapiens
aacttcaccaccccctgtcccat

SEQ ID NO: 1415235 - DNA, 14 bp, Homo sapiens
aacttcagaaagac

SEQ ID NO: 1415236 - DNA, 19 bp, Homo sapiens
aacttcagtttcacagaaa

SEQ ID NO: 1415237 - DNA, 20 bp, Homo sapiens
aacttcatatatgaggactt

SEQ ID NO: 1415238 - DNA, 22 bp, Homo sapiens
aacttcattctaaaccaaaaca

SEQ ID NO: 1415239 - DNA, 12 bp, Homo sapiens
aacttcatttga

SEQ ID NO: 1415240 - DNA, 14 bp, Homo sapiens
aacttcatttgatg

SEQ ID NO: 1415241 - DNA, 22 bp, Homo sapiens
aacttccaaggccctgcttttt

SEQ ID NO: 1415242 - DNA, 16 bp, Homo sapiens
agaggggtgcacccac

SEQ ID NO: 1415243 - DNA, 19 bp, Homo sapiens
agagggtgataatagaaga

SEQ ID NO: 1415244 - DNA, 23 bp, Homo sapiens
agagggttttaggtagaaaaaca

SEQ ID NO: 1415245 - DNA, 21 bp, Homo sapiens
agaggtaaccgttaggcggga

SEQ ID NO: 1415246 - DNA, 13 bp, Homo sapiens
agaggtagagaaa

SEQ ID NO: 1415247 - DNA, 14 bp, Homo sapiens
agaggtagagaaac

SEQ ID NO: 1415248 - DNA, 16 bp, Homo sapiens
agaggtattaaaacta

SEQ ID NO: 1415249 - DNA, 23 bp, Homo sapiens
agaggtcagaggggactctgacc

SEQ ID NO: 1415250 - DNA, 17 bp, Homo sapiens
agaggtcctctggagcc

SEQ ID NO: 1415251 - DNA, 18 bp, Homo sapiens
agaggtcgcagctaccct

SEQ ID NO: 1415252 - DNA, 23 bp, Homo sapiens
agaggtctccaaactgattaaat

SEQ ID NO: 1415253 - DNA, 16 bp, Homo sapiens
agaggtctgagccctg

SEQ ID NO: 1415254 - DNA, 14 bp, Homo sapiens
agaggtctgattgg

SEQ ID NO: 1415255 - DNA, 17 bp, Homo sapiens
agaggtctgattggctg

SEQ ID NO: 1415256 - DNA, 13 bp, Homo sapiens
agaggtctgtgct

SEQ ID NO: 1415257 - DNA, 21 bp, Homo sapiens
agaggtgaaattccagatgag

SEQ ID NO: 1415258 - DNA, 13 bp, Homo sapiens
agaggtgcttcac

SEQ ID NO: 1415259 - DNA, 20 bp, Homo sapiens
agaggtgcttctgcctgtgc

SEQ ID NO: 1415260 - DNA, 20 bp, Homo sapiens
agaggtggagaactgggatt

SEQ ID NO: 1415261 - DNA, 17 bp, Homo sapiens
agaggtgggagggccct

SEQ ID NO: 1415262 - DNA, 13 bp, Homo sapiens
agaggtgggcagc

SEQ ID NO: 1415263 - DNA, 17 bp, Homo sapiens
agaggtgggcagctggg

SEQ ID NO: 1415264 - DNA, 19 bp, Homo sapiens
agaggtgggcaggtggtgg

SEQ ID NO: 1415265 - DNA, 13 bp, Homo sapiens
agaggtgggccag

SEQ ID NO: 1415266 - DNA, 19 bp, Homo sapiens
agaggtggggatcctgcct

SEQ ID NO: 1415267 - DNA, 20 bp, Homo sapiens
agaggttaaggtgggtccag

SEQ ID NO: 1415268 - DNA, 22 bp, Homo sapiens
agaggttaaggtgggtccagga

SEQ ID NO: 1415269 - DNA, 16 bp, Homo sapiens
agaggttatctgcctg

SEQ ID NO: 1415270 - DNA, 17 bp, Homo sapiens
agaggttatctgcctgg

SEQ ID NO: 1415271 - DNA, 19 bp, Homo sapiens
agaggttatctgcctggcc

SEQ ID NO: 1415272 - DNA, 15 bp, Homo sapiens
agaggtttcttgaat

SEQ ID NO: 1415273 - DNA, 18 bp, Homo sapiens
agaggttttaaagtgatt

SEQ ID NO: 1415274 - DNA, 19 bp, Homo sapiens
agaggttttaaagtgatta

SEQ ID NO: 1415275 - DNA, 17 bp, Homo sapiens
agaggttttaatgtctg

SEQ ID NO: 1415276 - DNA, 18 bp, Homo sapiens
agaggttttaatgtctgt

SEQ ID NO: 1415277 - DNA, 17 bp, Homo sapiens
agagtacatttgcttta

SEQ ID NO: 1415278 - DNA, 23 bp, Homo sapiens
agagtagccagggtgtggccctg

SEQ ID NO: 1415279 - DNA, 21 bp, Homo sapiens
agagtatccttccttcagggt

SEQ ID NO: 1415280 - DNA, 14 bp, Homo sapiens
agagtatgaacacc

SEQ ID NO: 1415281 - DNA, 22 bp, Homo sapiens
agagtatgagtcttctgtaatt

SEQ ID NO: 1415282 - DNA, 15 bp, Homo sapiens
agagtatttcccttc

SEQ ID NO: 1415283 - DNA, 16 bp, Homo sapiens
agagtatttttaacac

SEQ ID NO: 1415284 - DNA, 18 bp, Homo sapiens
agagtcagccttccccct

SEQ ID NO: 1415285 - DNA, 17 bp, Homo sapiens
agagtcagctctctgcc

SEQ ID NO: 1415286 - DNA, 19 bp, Homo sapiens
agagtcagctctctgccct

SEQ ID NO: 1415287 - DNA, 14 bp, Homo sapiens
agagtcatctccat

SEQ ID NO: 1415288 - DNA, 23 bp, Homo sapiens
agagtcattgtaatgttgtgaat

SEQ ID NO: 1415289 - DNA, 19 bp, Homo sapiens
agagtccaaggtttaaaga

SEQ ID NO: 1415290 - DNA, 21 bp, Homo sapiens
agagtccaaggtttaaagagt

SEQ ID NO: 1415291 - DNA, 16 bp, Homo sapiens
agagtccggatttcta

SEQ ID NO: 1415292 - DNA, 20 bp, Homo sapiens
agagtccttaagacggaagt

SEQ ID NO: 1415293 - DNA, 13 bp, Homo sapiens
agagtctaaagat

SEQ ID NO: 1415294 - DNA, 22 bp, Homo sapiens
agagtctaaagatggagtttct

SEQ ID NO: 1415295 - DNA, 23 bp, Homo sapiens
agagtctaaagatggagtttcta

SEQ ID NO: 1415296 - DNA, 12 bp, Homo sapiens
agagtctagatt

SEQ ID NO: 1415297 - DNA, 14 bp, Homo sapiens
agagtctagattct

SEQ ID NO: 1415298 - DNA, 15 bp, Homo sapiens
agagtctagattctc

SEQ ID NO: 1415299 - DNA, 19 bp, Homo sapiens
agagtctgagcccccggct

SEQ ID NO: 1415300 - DNA, 23 bp, Homo sapiens
agagtctggtgaagctcacttct

SEQ ID NO: 1415301 - DNA, 12 bp, Homo sapiens
agagtctgtctc

SEQ ID NO: 1415302 - DNA, 14 bp, Homo sapiens
agagtgaaagggct

SEQ ID NO: 1415303 - DNA, 22 bp, Homo sapiens
agagtgaagggaagagacagcc

SEQ ID NO: 1415304 - DNA, 14 bp, Homo sapiens
agagtgagagggca

SEQ ID NO: 1415305 - DNA, 17 bp, Homo sapiens
agagtgagcatgagctc

SEQ ID NO: 1415306 - DNA, 17 bp, Homo sapiens
agagtgataatacaagt

SEQ ID NO: 1415307 - DNA, 14 bp, Homo sapiens
agagtgattctagt

SEQ ID NO: 1415308 - DNA, 15 bp, Homo sapiens
agagtgattgcagct

SEQ ID NO: 1415309 - DNA, 18 bp, Homo sapiens
agagtgattgcagcttta

SEQ ID NO: 1415310 - DNA, 19 bp, Homo sapiens
agagtgcaacccagtcaca

SEQ ID NO: 1415311 - DNA, 15 bp, Homo sapiens
agagtgcacagctgt

SEQ ID NO: 1415312 - DNA, 20 bp, Homo sapiens
agagtggactgaatgtgcct

SEQ ID NO: 1415313 - DNA, 12 bp, Homo sapiens
agagtggactgc

SEQ ID NO: 1415314 - DNA, 14 bp, Homo sapiens
agagtggcctccct

SEQ ID NO: 1415315 - DNA, 21 bp, Homo sapiens
agagtggcctccctgctgtgc

SEQ ID NO: 1415316 - DNA, 16 bp, Homo sapiens
agagtggcctggccag

SEQ ID NO: 1415317 - DNA, 17 bp, Homo sapiens
agagtggcctggccagg

SEQ ID NO: 1415318 - DNA, 19 bp, Homo sapiens
agagtggcctggccaggag

SEQ ID NO: 1415319 - DNA, 23 bp, Homo sapiens
agagtggctcctcccggtgccca

SEQ ID NO: 1415320 - DNA, 18 bp, Homo sapiens
agagtgggccccgggctg

SEQ ID NO: 1415321 - DNA, 18 bp, Homo sapiens
agagtggtatttgcagac

SEQ ID NO: 1415322 - DNA, 23 bp, Homo sapiens
agagtggtttctgcgtgtgtata

SEQ ID NO: 1415323 - DNA, 17 bp, Homo sapiens
agagtgtacatcatgtt

SEQ ID NO: 1415324 - DNA, 18 bp, Homo sapiens
agagtgtagactgtggct

SEQ ID NO: 1415325 - DNA, 13 bp, Homo sapiens
agagtgtagccta

SEQ ID NO: 1415326 - DNA, 23 bp, Homo sapiens
agagtgtagcctaaagggcaggg

SEQ ID NO: 1415327 - DNA, 16 bp, Homo sapiens
agagtgtagctgtaag

SEQ ID NO: 1415328 - DNA, 20 bp, Homo sapiens
agagtgtagctgtaagggca

SEQ ID NO: 1415329 - DNA, 15 bp, Homo sapiens
agagtgtggaggctg

SEQ ID NO: 1415330 - DNA, 20 bp, Homo sapiens
agagtgtgggaagggagagc

SEQ ID NO: 1415331 - DNA, 17 bp, Homo sapiens
agagtgtgtgggcaggg

SEQ ID NO: 1415332 - DNA, 16 bp, Homo sapiens
agagttaaaagcagca

SEQ ID NO: 1415333 - DNA, 18 bp, Homo sapiens
agagttaaaagcagcagc

SEQ ID NO: 1415334 - DNA, 16 bp, Homo sapiens
agagttaaaatgttta

SEQ ID NO: 1415335 - DNA, 16 bp, Homo sapiens
agagttaacaatgata

SEQ ID NO: 1415336 - DNA, 22 bp, Homo sapiens
agagttccaagttgaagggaaa

SEQ ID NO: 1415337 - DNA, 14 bp, Homo sapiens
agagttccttctca

SEQ ID NO: 1415338 - DNA, 15 bp, Homo sapiens
agagttctagacctc

SEQ ID NO: 1415339 - DNA, 15 bp, Homo sapiens
agagttctgtgaaga

SEQ ID NO: 1415340 - DNA, 16 bp, Homo sapiens
agagttcttctttctt

SEQ ID NO: 1415341 - DNA, 20 bp, Homo sapiens
agagttggaaatcagttgtg

SEQ ID NO: 1415342 - DNA, 14 bp, Homo sapiens
agagtttagtcctt

SEQ ID NO: 1415343 - DNA, 21 bp, Homo sapiens
agagtttatacagtgtacatg

SEQ ID NO: 1415344 - DNA, 13 bp, Homo sapiens
agagtttcaaaag

SEQ ID NO: 1415345 - DNA, 21 bp, Homo sapiens
agagtttcagtttgttggaaa

SEQ ID NO: 1415346 - DNA, 20 bp, Homo sapiens
agagtttcttgtaagccatc

SEQ ID NO: 1415347 - DNA, 23 bp, Homo sapiens
agagtttggggccgaaaatgttt

SEQ ID NO: 1415348 - DNA, 23 bp, Homo sapiens
agagtttgtgtgtatttgtatta

SEQ ID NO: 1415349 - DNA, 19 bp, Homo sapiens
agagtttgtgtgttgtctt

SEQ ID NO: 1415350 - DNA, 22 bp, Homo sapiens
agagtttgtgtgttgtcttgaa

SEQ ID NO: 1415351 - DNA, 22 bp, Homo sapiens
agagttttaacacttctagatc

SEQ ID NO: 1415352 - DNA, 23 bp, Homo sapiens
agagttttatagcctggactgct

SEQ ID NO: 1415353 - DNA, 12 bp, Homo sapiens
agagttttggtt

SEQ ID NO: 1415354 - DNA, 14 bp, Homo sapiens
agagttttgtcttg

SEQ ID NO: 1415355 - DNA, 16 bp, Homo sapiens
agagttttgtcttgaa

SEQ ID NO: 1415356 - DNA, 18 bp, Homo sapiens
agagtttttaaagccttc

SEQ ID NO: 1415357 - DNA, 21 bp, Homo sapiens
agataaaaagatggcctttgc

SEQ ID NO: 1415358 - DNA, 18 bp, Homo sapiens
agagctgttcacagccag

SEQ ID NO: 1415359 - DNA, 19 bp, Homo sapiens
agagctgttcacagccaga

SEQ ID NO: 1415360 - DNA, 13 bp, Homo sapiens
agagcttccaaat

SEQ ID NO: 1415361 - DNA, 21 bp, Homo sapiens
agagcttccaaatgtgtcaga

SEQ ID NO: 1415362 - DNA, 21 bp, Homo sapiens
agagcttctctgggctgaatg

SEQ ID NO: 1415363 - DNA, 16 bp, Homo sapiens
agagcttgctccagat

SEQ ID NO: 1415364 - DNA, 19 bp, Homo sapiens
agagcttggactacacaat

SEQ ID NO: 1415365 - DNA, 17 bp, Homo sapiens
agagcttgtcagcaaga

SEQ ID NO: 1415366 - DNA, 18 bp, Homo sapiens
agagcttgtgctcctctt

SEQ ID NO: 1415367 - DNA, 22 bp, Homo sapiens
agagctttctgtccttttggca

SEQ ID NO: 1415368 - DNA, 17 bp, Homo sapiens
agagctttgtcgtattt

SEQ ID NO: 1415369 - DNA, 15 bp, Homo sapiens
agagcttttaaaaat

SEQ ID NO: 1415370 - DNA, 23 bp, Homo sapiens
agaggaaaaatgggagccaggag

SEQ ID NO: 1415371 - DNA, 17 bp, Homo sapiens
agaggaaagtacatttt

SEQ ID NO: 1415372 - DNA, 23 bp, Homo sapiens
agaggaaataagaaaaatcatgt

SEQ ID NO: 1415373 - DNA, 15 bp, Homo sapiens
agaggaacaggtgga

SEQ ID NO: 1415374 - DNA, 15 bp, Homo sapiens
agaggaagaaattca

SEQ ID NO: 1415375 - DNA, 13 bp, Homo sapiens
agaggaaggctga

SEQ ID NO: 1415376 - DNA, 14 bp, Homo sapiens
agaggaataagaat

SEQ ID NO: 1415377 - DNA, 21 bp, Homo sapiens
agaggaatcctggcagcccag

SEQ ID NO: 1415378 - DNA, 20 bp, Homo sapiens
agaggaatctgtttctctgc

SEQ ID NO: 1415379 - DNA, 10 bp, Homo sapiens
agaggaatgt

SEQ ID NO: 1415380 - DNA, 19 bp, Homo sapiens
agaggaatgtagggcctgc

SEQ ID NO: 1415381 - DNA, 15 bp, Homo sapiens
agaggaccagggcct

SEQ ID NO: 1415382 - DNA, 17 bp, Homo sapiens
agaggaccagggccttt

SEQ ID NO: 1415383 - DNA, 11 bp, Homo sapiens
agaggagaaga

SEQ ID NO: 1415384 - DNA, 14 bp, Homo sapiens
agaggagcacctga

SEQ ID NO: 1415385 - DNA, 11 bp, Homo sapiens
agaggagcctt

SEQ ID NO: 1415386 - DNA, 15 bp, Homo sapiens
agaggagctgcttgt

SEQ ID NO: 1415387 - DNA, 17 bp, Homo sapiens
agaggagggatgctgcc

SEQ ID NO: 1415388 - DNA, 14 bp, Homo sapiens
agaggagtgcttgt

SEQ ID NO: 1415389 - DNA, 14 bp, Homo sapiens
agaggagtttctta

SEQ ID NO: 1415390 - DNA, 17 bp, Homo sapiens
agaggatcgtagtgtgt

SEQ ID NO: 1415391 - DNA, 17 bp, Homo sapiens
agaggatgccttttctg

SEQ ID NO: 1415392 - DNA, 18 bp, Homo sapiens
agaggatgctctttccca

SEQ ID NO: 1415393 - DNA, 21 bp, Homo sapiens
agaggatgctctttcccagga

SEQ ID NO: 1415394 - DNA, 16 bp, Homo sapiens
agaggcaagctgaaat

SEQ ID NO: 1415395 - DNA, 18 bp, Homo sapiens
agaggcaagctgaaattt

SEQ ID NO: 1415396 - DNA, 13 bp, Homo sapiens
agaggcaccagga

SEQ ID NO: 1415397 - DNA, 12 bp, Homo sapiens
agaggcagcatg

SEQ ID NO: 1415398 - DNA, 17 bp, Homo sapiens
agaggcagcatgcttgg

SEQ ID NO: 1415399 - DNA, 17 bp, Homo sapiens
agaggcagggaggggac

SEQ ID NO: 1415400 - DNA, 17 bp, Homo sapiens
agaggcagtgatgactt

SEQ ID NO: 1415401 - DNA, 21 bp, Homo sapiens
agaggcagtgatgacttgctg

SEQ ID NO: 1415402 - DNA, 15 bp, Homo sapiens
agaggcatcttttct

SEQ ID NO: 1415403 - DNA, 13 bp, Homo sapiens
agaggcatggctg

SEQ ID NO: 1415404 - DNA, 15 bp, Homo sapiens
agaggcattgttagt

SEQ ID NO: 1415405 - DNA, 17 bp, Homo sapiens
agaggccacctatgcca

SEQ ID NO: 1415406 - DNA, 17 bp, Homo sapiens
agaggccagacatggtg

SEQ ID NO: 1415407 - DNA, 23 bp, Homo sapiens
agaggccagccccacccaggagg

SEQ ID NO: 1415408 - DNA, 16 bp, Homo sapiens
agaggccatggcagaa

SEQ ID NO: 1415409 - DNA, 17 bp, Homo sapiens
agaggcccagccctcag

SEQ ID NO: 1415410 - DNA, 18 bp, Homo sapiens
agaggcccagccctcaga

SEQ ID NO: 1415411 - DNA, 13 bp, Homo sapiens
agaggcccaggca

SEQ ID NO: 1415412 - DNA, 16 bp, Homo sapiens
agaggcccaggcacca

SEQ ID NO: 1415413 - DNA, 20 bp, Homo sapiens
agaggcccaggcaccaccag

SEQ ID NO: 1415414 - DNA, 22 bp, Homo sapiens
agaggcccaggcaccaccagga

SEQ ID NO: 1415415 - DNA, 13 bp, Homo sapiens
agaggccccagcc

SEQ ID NO: 1415416 - DNA, 14 bp, Homo sapiens
agaggcccccagcc

SEQ ID NO: 1415417 - DNA, 17 bp, Homo sapiens
agaggcccccagcccag

SEQ ID NO: 1415418 - DNA, 20 bp, Homo sapiens
agaggcccccagcccagggc

SEQ ID NO: 1415419 - DNA, 13 bp, Homo sapiens
agaggccctggag

SEQ ID NO: 1415420 - DNA, 21 bp, Homo sapiens
agaggccgaaggtgcctcaga

SEQ ID NO: 1415421 - DNA, 21 bp, Homo sapiens
agaggccggggtccaggcccg

SEQ ID NO: 1415422 - DNA, 21 bp, Homo sapiens
agaggcctcccccagccagga

SEQ ID NO: 1415423 - DNA, 22 bp, Homo sapiens
agaggcctcccccagccaggac

SEQ ID NO: 1415424 - DNA, 13 bp, Homo sapiens
agaggcctgagga

SEQ ID NO: 1415425 - DNA, 14 bp, Homo sapiens
agaggcctggagcc

SEQ ID NO: 1415426 - DNA, 18 bp, Homo sapiens
agaggcctgggctgggaa

SEQ ID NO: 1415427 - DNA, 21 bp, Homo sapiens
agaggcctgggggacccctgg

SEQ ID NO: 1415428 - DNA, 14 bp, Homo sapiens
agaggcgggccagc

SEQ ID NO: 1415429 - DNA, 18 bp, Homo sapiens
agaggcgggccagccagg

SEQ ID NO: 1415430 - DNA, 19 bp, Homo sapiens
agaggcgtactacccagct

SEQ ID NO: 1415431 - DNA, 19 bp, Homo sapiens
agaggctgaaagaggccaa

SEQ ID NO: 1415432 - DNA, 16 bp, Homo sapiens
agaggctgacttttcc

SEQ ID NO: 1415433 - DNA, 19 bp, Homo sapiens
agaggctgacttttccaaa

SEQ ID NO: 1415434 - DNA, 19 bp, Homo sapiens
agaggctgaggcctggact

SEQ ID NO: 1415435 - DNA, 14 bp, Homo sapiens
agaggctgcctcag

SEQ ID NO: 1415436 - DNA, 16 bp, Homo sapiens
agaggctggaggcagg

SEQ ID NO: 1415437 - DNA, 16 bp, Homo sapiens
agaggcttctccgcca

SEQ ID NO: 1415438 - DNA, 22 bp, Homo sapiens
agaggcttctccgccagcctcc

SEQ ID NO: 1415439 - DNA, 14 bp, Homo sapiens
agaggcttgtttac

SEQ ID NO: 1415440 - DNA, 19 bp, Homo sapiens
agaggcttgtttacctttc

SEQ ID NO: 1415441 - DNA, 17 bp, Homo sapiens
agagggaagagtgcatt

SEQ ID NO: 1415442 - DNA, 16 bp, Homo sapiens
agagggaatgtgaaat

SEQ ID NO: 1415443 - DNA, 18 bp, Homo sapiens
agagggaatgtgaaattt

SEQ ID NO: 1415444 - DNA, 17 bp, Homo sapiens
agagggacactcctcct

SEQ ID NO: 1415445 - DNA, 12 bp, Homo sapiens
agagggacagat

SEQ ID NO: 1415446 - DNA, 15 bp, Homo sapiens
agagggacaggctga

SEQ ID NO: 1415447 - DNA, 17 bp, Homo sapiens
agagggaccagggtggg

SEQ ID NO: 1415448 - DNA, 16 bp, Homo sapiens
agagggagaagcatga

SEQ ID NO: 1415449 - DNA, 12 bp, Homo sapiens
agagggagagag

SEQ ID NO: 1415450 - DNA, 13 bp, Homo sapiens
agagggagagaga

SEQ ID NO: 1415451 - DNA, 20 bp, Homo sapiens
agagggaggtcactggaaag

SEQ ID NO: 1415452 - DNA, 14 bp, Homo sapiens
agagggcaaggaag

SEQ ID NO: 1415453 - DNA, 14 bp, Homo sapiens
agagggcagaggct

SEQ ID NO: 1415454 - DNA, 17 bp, Homo sapiens
agagggcaggggtgctg

SEQ ID NO: 1415455 - DNA, 15 bp, Homo sapiens
agagggcagtacctg

SEQ ID NO: 1415456 - DNA, 12 bp, Homo sapiens
agagggccagca

SEQ ID NO: 1415457 - DNA, 22 bp, Homo sapiens
agagggccattgaactctgaga

SEQ ID NO: 1415458 - DNA, 15 bp, Homo sapiens
agagggcccagccca

SEQ ID NO: 1415459 - DNA, 21 bp, Homo sapiens
agagggcccagcccagagcca

SEQ ID NO: 1415460 - DNA, 13 bp, Homo sapiens
agagggcccagct

SEQ ID NO: 1415461 - DNA, 14 bp, Homo sapiens
agagggcccaggca

SEQ ID NO: 1415462 - DNA, 15 bp, Homo sapiens
agagggcccatcagg

SEQ ID NO: 1415463 - DNA, 14 bp, Homo sapiens
agagggctagggag

SEQ ID NO: 1415464 - DNA, 22 bp, Homo sapiens
agagggctgttggacagctgct

SEQ ID NO: 1415465 - DNA, 23 bp, Homo sapiens
agagggctgttggacagctgctt

SEQ ID NO: 1415466 - DNA, 22 bp, Homo sapiens
agagggcttcctctagaagcca

SEQ ID NO: 1415467 - DNA, 19 bp, Homo sapiens
agaggggaataatagaaga

SEQ ID NO: 1415468 - DNA, 15 bp, Homo sapiens
agaggggaggggcct

SEQ ID NO: 1415469 - DNA, 13 bp, Homo sapiens
agaggggatgggg

SEQ ID NO: 1415470 - DNA, 23 bp, Homo sapiens
agaggggatggggatagaggaaa

SEQ ID NO: 1415471 - DNA, 16 bp, Homo sapiens
agaggggcaccttttc

SEQ ID NO: 1415472 - DNA, 12 bp, Homo sapiens
agaggggcagcc

SEQ ID NO: 1415473 - DNA, 15 bp, Homo sapiens
agaggggcagccctt

SEQ ID NO: 1415474 - DNA, 19 bp, Homo sapiens
agagggggcctgggacttc

SEQ ID NO: 1415475 - DNA, 19 bp, Homo sapiens
agagggggtggaggggtgt

SEQ ID NO: 1415476 - DNA, 22 bp, Homo sapiens
agagaggggaataatagaagaa

SEQ ID NO: 1415477 - DNA, 14 bp, Homo sapiens
agagaggggcctgc

SEQ ID NO: 1415478 - DNA, 15 bp, Homo sapiens
agagaggggcctgca

SEQ ID NO: 1415479 - DNA, 21 bp, Homo sapiens
agagaggggcctgcaggtgag

SEQ ID NO: 1415480 - DNA, 17 bp, Homo sapiens
agagaggtggagaactg

SEQ ID NO: 1415481 - DNA, 20 bp, Homo sapiens
agagaggtggagaactggga

SEQ ID NO: 1415482 - DNA, 22 bp, Homo sapiens
agagagtaatgggtttcatatt

SEQ ID NO: 1415483 - DNA, 15 bp, Homo sapiens
agagagttagcatgt

SEQ ID NO: 1415484 - DNA, 21 bp, Homo sapiens
agagataaaccaataaatcca

SEQ ID NO: 1415485 - DNA, 13 bp, Homo sapiens
agagataattgct

SEQ ID NO: 1415486 - DNA, 18 bp, Homo sapiens
agagataggaaactgaag

SEQ ID NO: 1415487 - DNA, 15 bp, Homo sapiens
agagatcgagaccat

SEQ ID NO: 1415488 - DNA, 23 bp, Homo sapiens
agagatcgagaccatcctggcca

SEQ ID NO: 1415489 - DNA, 13 bp, Homo sapiens
agagatctacaca

SEQ ID NO: 1415490 - DNA, 19 bp, Homo sapiens
agagatctgtgtggctcct

SEQ ID NO: 1415491 - DNA, 15 bp, Homo sapiens
agagatgagaaatga

SEQ ID NO: 1415492 - DNA, 14 bp, Homo sapiens
agagatgcaatgat

SEQ ID NO: 1415493 - DNA, 23 bp, Homo sapiens
agagatgcctccaccgctgccta

SEQ ID NO: 1415494 - DNA, 23 bp, Homo sapiens
agagatgctgtaacttaaaatag

SEQ ID NO: 1415495 - DNA, 23 bp, Homo sapiens
agagatggcttacaaaaagaaat

SEQ ID NO: 1415496 - DNA, 19 bp, Homo sapiens
agagatgggaatgaggtgg

SEQ ID NO: 1415497 - DNA, 16 bp, Homo sapiens
agagatgggacaagca

SEQ ID NO: 1415498 - DNA, 15 bp, Homo sapiens
agagatgtactgcaa

SEQ ID NO: 1415499 - DNA, 23 bp, Homo sapiens
agagatgtttacagtatgatgaa

SEQ ID NO: 1415500 - DNA, 14 bp, Homo sapiens
agagattaaaggta

SEQ ID NO: 1415501 - DNA, 21 bp, Homo sapiens
agagattctggatctcctgct

SEQ ID NO: 1415502 - DNA, 13 bp, Homo sapiens
agagattttacaa

SEQ ID NO: 1415503 - DNA, 13 bp, Homo sapiens
agagattttctct

SEQ ID NO: 1415504 - DNA, 21 bp, Homo sapiens
agagcaaaagcctcagaaagg

SEQ ID NO: 1415505 - DNA, 23 bp, Homo sapiens
agagcaaaatgctcttgtccctg

SEQ ID NO: 1415506 - DNA, 16 bp, Homo sapiens
agagcaaatgagggag

SEQ ID NO: 1415507 - DNA, 15 bp, Homo sapiens
agagcaaatgcaaaa

SEQ ID NO: 1415508 - DNA, 22 bp, Homo sapiens
agagcaacccctgtacccagct

SEQ ID NO: 1415509 - DNA, 13 bp, Homo sapiens
agagcaagaagga

SEQ ID NO: 1415510 - DNA, 20 bp, Homo sapiens
agagcaagagataagtcttt

SEQ ID NO: 1415511 - DNA, 23 bp, Homo sapiens
agagcaagatcctgtctttaagg

SEQ ID NO: 1415512 - DNA, 13 bp, Homo sapiens
agagcaaggaagc

SEQ ID NO: 1415513 - DNA, 17 bp, Homo sapiens
agagcaatggttgtatt

SEQ ID NO: 1415514 - DNA, 14 bp, Homo sapiens
agagcaattccagg

SEQ ID NO: 1415515 - DNA, 19 bp, Homo sapiens
agagcaattccaggctgag

SEQ ID NO: 1415516 - DNA, 21 bp, Homo sapiens
agagcaattccaggctgagcc

SEQ ID NO: 1415517 - DNA, 20 bp, Homo sapiens
agagcaccctcgagaagggt

SEQ ID NO: 1415518 - DNA, 23 bp, Homo sapiens
agagcaccctcgagaagggtgga

SEQ ID NO: 1415519 - DNA, 15 bp, Homo sapiens
agagcagaaattctg

SEQ ID NO: 1415520 - DNA, 17 bp, Homo sapiens
agagcagaaattctgtt

SEQ ID NO: 1415521 - DNA, 18 bp, Homo sapiens
agagcagagcaaatgagg

SEQ ID NO: 1415522 - DNA, 13 bp, Homo sapiens
agagcagatgcca

SEQ ID NO: 1415523 - DNA, 15 bp, Homo sapiens
agagcagcagcacca

SEQ ID NO: 1415524 - DNA, 16 bp, Homo sapiens
agagcagcaggtgctg

SEQ ID NO: 1415525 - DNA, 13 bp, Homo sapiens
agagcagcctgat

SEQ ID NO: 1415526 - DNA, 23 bp, Homo sapiens
agagcaggaagccgatgtgactg

SEQ ID NO: 1415527 - DNA, 14 bp, Homo sapiens
agagcaggaaggac

SEQ ID NO: 1415528 - DNA, 20 bp, Homo sapiens
agagcaggactccaggccca

SEQ ID NO: 1415529 - DNA, 21 bp, Homo sapiens
agagcaggactccaggcccaa

SEQ ID NO: 1415530 - DNA, 12 bp, Homo sapiens
agagcaggagcc

SEQ ID NO: 1415531 - DNA, 13 bp, Homo sapiens
agagcaggagccc

SEQ ID NO: 1415532 - DNA, 15 bp, Homo sapiens
agagcaggaggcccc

SEQ ID NO: 1415533 - DNA, 22 bp, Homo sapiens
agagcaggaggcccctggccca

SEQ ID NO: 1415534 - DNA, 17 bp, Homo sapiens
agagcaggccagcccgg

SEQ ID NO: 1415535 - DNA, 22 bp, Homo sapiens
agagcagggccaaagcacagct

SEQ ID NO: 1415536 - DNA, 20 bp, Homo sapiens
agagcaggtgactgtgctgt

SEQ ID NO: 1415537 - DNA, 14 bp, Homo sapiens
agagcagtgggcag

SEQ ID NO: 1415538 - DNA, 18 bp, Homo sapiens
agagcatacaacagaggg

SEQ ID NO: 1415539 - DNA, 22 bp, Homo sapiens
agagcatatttgccaataaagc

SEQ ID NO: 1415540 - DNA, 16 bp, Homo sapiens
agagcatctcaggagg

SEQ ID NO: 1415541 - DNA, 15 bp, Homo sapiens
acagtgatgaatgta

SEQ ID NO: 1415542 - DNA, 21 bp, Homo sapiens
acagtgatgaatgtactatgt

SEQ ID NO: 1415543 - DNA, 14 bp, Homo sapiens
acagtgatgcctgc

SEQ ID NO: 1415544 - DNA, 21 bp, Homo sapiens
acagtgatgcctgcccgcacc

SEQ ID NO: 1415545 - DNA, 13 bp, Homo sapiens
acagtgcagacag

SEQ ID NO: 1415546 - DNA, 17 bp, Homo sapiens
acagtgcagacaggcca

SEQ ID NO: 1415547 - DNA, 22 bp, Homo sapiens
acagtgcagagccttctcagaa

SEQ ID NO: 1415548 - DNA, 16 bp, Homo sapiens
acagtgcagaggctct

SEQ ID NO: 1415549 - DNA, 17 bp, Homo sapiens
acagtgcatctcagccc

SEQ ID NO: 1415550 - DNA, 18 bp, Homo sapiens
acagtgcatctcagccca

SEQ ID NO: 1415551 - DNA, 14 bp, Homo sapiens
acagtgccatcccc

SEQ ID NO: 1415552 - DNA, 21 bp, Homo sapiens
acagtgccatccccaccttca

SEQ ID NO: 1415553 - DNA, 11 bp, Homo sapiens
acagtgcctgc

SEQ ID NO: 1415554 - DNA, 17 bp, Homo sapiens
acagtgctactgaaagg

SEQ ID NO: 1415555 - DNA, 16 bp, Homo sapiens
acagtgctcttttctc

SEQ ID NO: 1415556 - DNA, 15 bp, Homo sapiens
acagtgctgcttctc

SEQ ID NO: 1415557 - DNA, 14 bp, Homo sapiens
acagtgctgggatt

SEQ ID NO: 1415558 - DNA, 14 bp, Homo sapiens
acagtgcttcagcc

SEQ ID NO: 1415559 - DNA, 15 bp, Homo sapiens
acagtgcttcagcct

SEQ ID NO: 1415560 - DNA, 21 bp, Homo sapiens
acagtgcttcagcctgaggct

SEQ ID NO: 1415561 - DNA, 16 bp, Homo sapiens
acagtggactcagcag

SEQ ID NO: 1415562 - DNA, 19 bp, Homo sapiens
acagtgggaactctgacaa

SEQ ID NO: 1415563 - DNA, 16 bp, Homo sapiens
acagtgggagccaggg

SEQ ID NO: 1415564 - DNA, 19 bp, Homo sapiens
acagtgggcctgtgtgtgt

SEQ ID NO: 1415565 - DNA, 23 bp, Homo sapiens
acagtggtggcaacattcattgc

SEQ ID NO: 1415566 - DNA, 18 bp, Homo sapiens
acagtggttttatactga

SEQ ID NO: 1415567 - DNA, 19 bp, Homo sapiens
acagtgtaatccaggggtg

SEQ ID NO: 1415568 - DNA, 15 bp, Homo sapiens
acagtgtacaaaact

SEQ ID NO: 1415569 - DNA, 15 bp, Homo sapiens
acagtgtacatgtac

SEQ ID NO: 1415570 - DNA, 17 bp, Homo sapiens
acagtgtacatgtacat

SEQ ID NO: 1415571 - DNA, 16 bp, Homo sapiens
acagtgtaccttttaa

SEQ ID NO: 1415572 - DNA, 16 bp, Homo sapiens
acagtgtagcttgccc

SEQ ID NO: 1415573 - DNA, 13 bp, Homo sapiens
acagtgtatgggg

SEQ ID NO: 1415574 - DNA, 24 bp, Homo sapiens
acagtgtcccccaggttccgaaga

SEQ ID NO: 1415575 - DNA, 23 bp, Homo sapiens
acagtgtctgtatcggagacagt

SEQ ID NO: 1415576 - DNA, 15 bp, Homo sapiens
acagtgtctgttcag

SEQ ID NO: 1415577 - DNA, 20 bp, Homo sapiens
acagtgtgggcgctctccct

SEQ ID NO: 1415578 - DNA, 21 bp, Homo sapiens
acagtgtgggcgctctcccta

SEQ ID NO: 1415579 - DNA, 19 bp, Homo sapiens
acagtgttgaaaatgttca

SEQ ID NO: 1415580 - DNA, 21 bp, Homo sapiens
acagtgttgcatatgagcctg

SEQ ID NO: 1415581 - DNA, 21 bp, Homo sapiens
acagtgttgtgccccttcact

SEQ ID NO: 1415582 - DNA, 18 bp, Homo sapiens
acagtgtttcccataatt

SEQ ID NO: 1415583 - DNA, 19 bp, Homo sapiens
acagtgtttcgacagctga

SEQ ID NO: 1415584 - DNA, 14 bp, Homo sapiens
acagttaactttca

SEQ ID NO: 1415585 - DNA, 18 bp, Homo sapiens
acagttaaggagaatcat

SEQ ID NO: 1415586 - DNA, 19 bp, Homo sapiens
acagttagggttttgcaat

SEQ ID NO: 1415587 - DNA, 11 bp, Homo sapiens
acagttatatt

SEQ ID NO: 1415588 - DNA, 22 bp, Homo sapiens
acagttatatttttgtgttttc

SEQ ID NO: 1415589 - DNA, 14 bp, Homo sapiens
acagttatgtgggt

SEQ ID NO: 1415590 - DNA, 15 bp, Homo sapiens
acagttattgtttga

SEQ ID NO: 1415591 - DNA, 19 bp, Homo sapiens
acagttatttcatctttta

SEQ ID NO: 1415592 - DNA, 20 bp, Homo sapiens
acagttcatgtttgcttcat

SEQ ID NO: 1415593 - DNA, 14 bp, Homo sapiens
acagttcctcgccc

SEQ ID NO: 1415594 - DNA, 15 bp, Homo sapiens
acagttcctcgccct

SEQ ID NO: 1415595 - DNA, 16 bp, Homo sapiens
acagttcctcgccctg

SEQ ID NO: 1415596 - DNA, 19 bp, Homo sapiens
acagttcctcgccctgggt

SEQ ID NO: 1415597 - DNA, 21 bp, Homo sapiens
acagttcctgggaacatcaca

SEQ ID NO: 1415598 - DNA, 16 bp, Homo sapiens
acagttctcactggga

SEQ ID NO: 1415599 - DNA, 13 bp, Homo sapiens
acagttctgaaga

SEQ ID NO: 1415600 - DNA, 13 bp, Homo sapiens
acagttctgagct

SEQ ID NO: 1415601 - DNA, 18 bp, Homo sapiens
acagttctgagctgtaat

SEQ ID NO: 1415602 - DNA, 21 bp, Homo sapiens
acagttctgagctgtaatttc

SEQ ID NO: 1415603 - DNA, 15 bp, Homo sapiens
acagttctttcctct

SEQ ID NO: 1415604 - DNA, 19 bp, Homo sapiens
acagttctttgggccagac

SEQ ID NO: 1415605 - DNA, 22 bp, Homo sapiens
acagttctttgggccagacatg

SEQ ID NO: 1415606 - DNA, 13 bp, Homo sapiens
acagttgatgttt

SEQ ID NO: 1415607 - DNA, 15 bp, Homo sapiens
acagttgatgtttgg

SEQ ID NO: 1415608 - DNA, 22 bp, Homo sapiens
acagttgctgtcataagaatga

SEQ ID NO: 1415609 - DNA, 14 bp, Homo sapiens
acagttggcagaga

SEQ ID NO: 1415610 - DNA, 16 bp, Homo sapiens
acagttggccttcaga

SEQ ID NO: 1415611 - DNA, 15 bp, Homo sapiens
acagttggtaacttt

SEQ ID NO: 1415612 - DNA, 22 bp, Homo sapiens
acagttgtctattctgagcctt

SEQ ID NO: 1415613 - DNA, 15 bp, Homo sapiens
acagttgttggcctc

SEQ ID NO: 1415614 - DNA, 22 bp, Homo sapiens
acagtttaccagttgcctttta

SEQ ID NO: 1415615 - DNA, 14 bp, Homo sapiens
acagtttccaaatt

SEQ ID NO: 1415616 - DNA, 23 bp, Homo sapiens
acagtttcttgcttggaagccag

SEQ ID NO: 1415617 - DNA, 21 bp, Homo sapiens
acagttttaactgtggatatt

SEQ ID NO: 1415618 - DNA, 12 bp, Homo sapiens
acagttttaata

SEQ ID NO: 1415619 - DNA, 20 bp, Homo sapiens
acagttttagaataaggagg

SEQ ID NO: 1415620 - DNA, 21 bp, Homo sapiens
acagttttagaataaggagga

SEQ ID NO: 1415621 - DNA, 22 bp, Homo sapiens
acagttttagaataaggaggag

SEQ ID NO: 1415622 - DNA, 13 bp, Homo sapiens
acagttttctagc

SEQ ID NO: 1415623 - DNA, 20 bp, Homo sapiens
acagttttctagcaattttc

SEQ ID NO: 1415624 - DNA, 20 bp, Homo sapiens
acagttttctgagaaagact

SEQ ID NO: 1415625 - DNA, 21 bp, Homo sapiens
acagttttctgagaaagacta

SEQ ID NO: 1415626 - DNA, 13 bp, Homo sapiens
acagttttgtgaa

SEQ ID NO: 1415627 - DNA, 21 bp, Homo sapiens
acagtttttgtaaccatatga

SEQ ID NO: 1415628 - DNA, 11 bp, Homo sapiens
acataaaaact

SEQ ID NO: 1415629 - DNA, 23 bp, Homo sapiens
acataaaaagcagaattttaatg

SEQ ID NO: 1415630 - DNA, 18 bp, Homo sapiens
acataaaacaaaaccaag

SEQ ID NO: 1415631 - DNA, 23 bp, Homo sapiens
acataaaacaaaaccaagccttg

SEQ ID NO: 1415632 - DNA, 14 bp, Homo sapiens
acataaaagaattt

SEQ ID NO: 1415633 - DNA, 21 bp, Homo sapiens
acataaaatccaatattgtaa

SEQ ID NO: 1415634 - DNA, 14 bp, Homo sapiens
acataaaatctgtg

SEQ ID NO: 1415635 - DNA, 18 bp, Homo sapiens
acataaaatttacattta

SEQ ID NO: 1415636 - DNA, 14 bp, Homo sapiens
acataaacttttgc

SEQ ID NO: 1415637 - DNA, 15 bp, Homo sapiens
acataaatctgtctg

SEQ ID NO: 1415638 - DNA, 13 bp, Homo sapiens
acataactgcttc

SEQ ID NO: 1415639 - DNA, 16 bp, Homo sapiens
acataactgcttcttg

SEQ ID NO: 1415640 - DNA, 18 bp, Homo sapiens
acataactgcttcttgga

SEQ ID NO: 1415641 - DNA, 15 bp, Homo sapiens
acataagaaggcaat

SEQ ID NO: 1415642 - DNA, 21 bp, Homo sapiens
acataagaaggcaattttagt

SEQ ID NO: 1415643 - DNA, 19 bp, Homo sapiens
acataagaccgtgtcccaa

SEQ ID NO: 1415644 - DNA, 21 bp, Homo sapiens
acataagagaaagaggccaga

SEQ ID NO: 1415645 - DNA, 22 bp, Homo sapiens
acataagcggcgtaagtttaaa

SEQ ID NO: 1415646 - DNA, 17 bp, Homo sapiens
acataagcttccatttt

SEQ ID NO: 1415647 - DNA, 23 bp, Homo sapiens
acataaggcttttcctgttctgg

SEQ ID NO: 1415648 - DNA, 14 bp, Homo sapiens
acataatacaatgt

SEQ ID NO: 1415649 - DNA, 20 bp, Homo sapiens
acataatatatgacttccta

SEQ ID NO: 1415650 - DNA, 16 bp, Homo sapiens
acataatcaaagctac

SEQ ID NO: 1415651 - DNA, 22 bp, Homo sapiens
acataatctagtttacagaaaa

SEQ ID NO: 1415652 - DNA, 23 bp, Homo sapiens
acataatcttctgccttctcatg

SEQ ID NO: 1415653 - DNA, 13 bp, Homo sapiens
acataattgtgac

SEQ ID NO: 1415654 - DNA, 14 bp, Homo sapiens
acataattgtgacc

SEQ ID NO: 1415655 - DNA, 19 bp, Homo sapiens
agacctggagcccctgggt

SEQ ID NO: 1415656 - DNA, 20 bp, Homo sapiens
agacctggagcccctgggtg

SEQ ID NO: 1415657 - DNA, 11 bp, Homo sapiens
agacctggcag

SEQ ID NO: 1415658 - DNA, 16 bp, Homo sapiens
agacctggcagctctg

SEQ ID NO: 1415659 - DNA, 18 bp, Homo sapiens
agacctggcagctctgga

SEQ ID NO: 1415660 - DNA, 17 bp, Homo sapiens
agacctggctccactct

SEQ ID NO: 1415661 - DNA, 18 bp, Homo sapiens
agacctggctctcagagg

SEQ ID NO: 1415662 - DNA, 15 bp, Homo sapiens
agacctgggatttga

SEQ ID NO: 1415663 - DNA, 17 bp, Homo sapiens
agacctgtcgtctctcc

SEQ ID NO: 1415664 - DNA, 21 bp, Homo sapiens
agacctgtcgtctctcccacc

SEQ ID NO: 1415665 - DNA, 18 bp, Homo sapiens
agacctgtcttccaagga

SEQ ID NO: 1415666 - DNA, 23 bp, Homo sapiens
agacctgtcttccaaggagacca

SEQ ID NO: 1415667 - DNA, 12 bp, Homo sapiens
agacctgtgtga

SEQ ID NO: 1415668 - DNA, 16 bp, Homo sapiens
agacctgtgtgaacta

SEQ ID NO: 1415669 - DNA, 18 bp, Homo sapiens
agaccttctccaaatgag

SEQ ID NO: 1415670 - DNA, 19 bp, Homo sapiens
agaccttctccaaatgaga

SEQ ID NO: 1415671 - DNA, 19 bp, Homo sapiens
agaccttgggggaagactt

SEQ ID NO: 1415672 - DNA, 18 bp, Homo sapiens
agaccttgttacttctga

SEQ ID NO: 1415673 - DNA, 22 bp, Homo sapiens
agacctttattcacccctgccc

SEQ ID NO: 1415674 - DNA, 13 bp, Homo sapiens
agacgaggcaggg

SEQ ID NO: 1415675 - DNA, 21 bp, Homo sapiens
agacgaggcaggggctctgct

SEQ ID NO: 1415676 - DNA, 20 bp, Homo sapiens
agacgcacacagctgagcac

SEQ ID NO: 1415677 - DNA, 12 bp, Homo sapiens
agacgcccctcc

SEQ ID NO: 1415678 - DNA, 16 bp, Homo sapiens
agacgccctatttcta

SEQ ID NO: 1415679 - DNA, 13 bp, Homo sapiens
agacgctcttttc

SEQ ID NO: 1415680 - DNA, 21 bp, Homo sapiens
agacggaagtaaattatgatg

SEQ ID NO: 1415681 - DNA, 21 bp, Homo sapiens
agacggaggaggggaaggggc

SEQ ID NO: 1415682 - DNA, 15 bp, Homo sapiens
agacggcggccaggc

SEQ ID NO: 1415683 - DNA, 11 bp, Homo sapiens
agacgggcaca

SEQ ID NO: 1415684 - DNA, 15 bp, Homo sapiens
agacgggcacagaca

SEQ ID NO: 1415685 - DNA, 21 bp, Homo sapiens
agacgggtattgttgggaaag

SEQ ID NO: 1415686 - DNA, 17 bp, Homo sapiens
agacgggtctgagactg

SEQ ID NO: 1415687 - DNA, 15 bp, Homo sapiens
agacggtgttgggag

SEQ ID NO: 1415688 - DNA, 19 bp, Homo sapiens
agacggttcaccagcctct

SEQ ID NO: 1415689 - DNA, 19 bp, Homo sapiens
agacggtttccagggaggg

SEQ ID NO: 1415690 - DNA, 15 bp, Homo sapiens
agacgtaaagaattt

SEQ ID NO: 1415691 - DNA, 17 bp, Homo sapiens
agacgtggactcctctt

SEQ ID NO: 1415692 - DNA, 16 bp, Homo sapiens
agacgtggtgggactc

SEQ ID NO: 1415693 - DNA, 16 bp, Homo sapiens
agacgtttataaacag

SEQ ID NO: 1415694 - DNA, 22 bp, Homo sapiens
agacgtttggactgatttgtgg

SEQ ID NO: 1415695 - DNA, 14 bp, Homo sapiens
agactaaaaataca

SEQ ID NO: 1415696 - DNA, 12 bp, Homo sapiens
agactaaatgaa

SEQ ID NO: 1415697 - DNA, 13 bp, Homo sapiens
agactaaatgaaa

SEQ ID NO: 1415698 - DNA, 19 bp, Homo sapiens
agactaaattcaatcacca

SEQ ID NO: 1415699 - DNA, 15 bp, Homo sapiens
agactaagccctgtc

SEQ ID NO: 1415700 - DNA, 23 bp, Homo sapiens
agactaagccctgtcgagacact

SEQ ID NO: 1415701 - DNA, 22 bp, Homo sapiens
agactactgttcagcttttatt

SEQ ID NO: 1415702 - DNA, 19 bp, Homo sapiens
agactagaattctagtgct

SEQ ID NO: 1415703 - DNA, 15 bp, Homo sapiens
agactagaggccagg

SEQ ID NO: 1415704 - DNA, 16 bp, Homo sapiens
agactagatggacctg

SEQ ID NO: 1415705 - DNA, 12 bp, Homo sapiens
agactagatgta

SEQ ID NO: 1415706 - DNA, 15 bp, Homo sapiens
agactagcctggcca

SEQ ID NO: 1415707 - DNA, 17 bp, Homo sapiens
agactatctaaatgttg

SEQ ID NO: 1415708 - DNA, 15 bp, Homo sapiens
agactatggagcctg

SEQ ID NO: 1415709 - DNA, 12 bp, Homo sapiens
agactattcaaa

SEQ ID NO: 1415710 - DNA, 20 bp, Homo sapiens
agactattcaaacagtctca

SEQ ID NO: 1415711 - DNA, 20 bp, Homo sapiens
agactattccttttctgtat

SEQ ID NO: 1415712 - DNA, 13 bp, Homo sapiens
agactatttcaaa

SEQ ID NO: 1415713 - DNA, 16 bp, Homo sapiens
agagaaaaagaaatgc

SEQ ID NO: 1415714 - DNA, 20 bp, Homo sapiens
agagaaaaagaaatgcaaaa

SEQ ID NO: 1415715 - DNA, 21 bp, Homo sapiens
agagaaaaagaaatgcaaaaa

SEQ ID NO: 1415716 - DNA, 18 bp, Homo sapiens
agagaaaaaggctgaaaa

SEQ ID NO: 1415717 - DNA, 19 bp, Homo sapiens
agagaaaaaggctgaaaag

SEQ ID NO: 1415718 - DNA, 18 bp, Homo sapiens
agagaaaagaaaaatcaa

SEQ ID NO: 1415719 - DNA, 17 bp, Homo sapiens
agagaaaatattactta

SEQ ID NO: 1415720 - DNA, 18 bp, Homo sapiens
agagaaaatgagaaagga

SEQ ID NO: 1415721 - DNA, 16 bp, Homo sapiens
agagaaaatgtaaata

SEQ ID NO: 1415722 - DNA, 17 bp, Homo sapiens
agagaaaatgtaaataa

SEQ ID NO: 1415723 - DNA, 22 bp, Homo sapiens
agagaaacactgaaaagaagga

SEQ ID NO: 1415724 - DNA, 16 bp, Homo sapiens
agagaaacagttggta

SEQ ID NO: 1415725 - DNA, 10 bp, Homo sapiens
agagaaactt

SEQ ID NO: 1415726 - DNA, 13 bp, Homo sapiens
agagaaagaaatt

SEQ ID NO: 1415727 - DNA, 16 bp, Homo sapiens
agagaaagagagaagc

SEQ ID NO: 1415728 - DNA, 14 bp, Homo sapiens
agagaaatatttta

SEQ ID NO: 1415729 - DNA, 14 bp, Homo sapiens
agagaaatgtcttt

SEQ ID NO: 1415730 - DNA, 22 bp, Homo sapiens
agagaaatttttatttttgaac

SEQ ID NO: 1415731 - DNA, 23 bp, Homo sapiens
agagaacactggacaacatttta

SEQ ID NO: 1415732 - DNA, 14 bp, Homo sapiens
agagaacctcagat

SEQ ID NO: 1415733 - DNA, 20 bp, Homo sapiens
agagaacctcagattcttca

SEQ ID NO: 1415734 - DNA, 13 bp, Homo sapiens
agagaagaaagtg

SEQ ID NO: 1415735 - DNA, 14 bp, Homo sapiens
agagaagaaagtgt

SEQ ID NO: 1415736 - DNA, 21 bp, Homo sapiens
agagaagagggcccagcccag

SEQ ID NO: 1415737 - DNA, 19 bp, Homo sapiens
agagaagccagccacagac

SEQ ID NO: 1415738 - DNA, 17 bp, Homo sapiens
agagaagctcctgctac

SEQ ID NO: 1415739 - DNA, 12 bp, Homo sapiens
agagaagctgaa

SEQ ID NO: 1415740 - DNA, 14 bp, Homo sapiens
agagaagctgctga

SEQ ID NO: 1415741 - DNA, 18 bp, Homo sapiens
agagaaggcctccctagc

SEQ ID NO: 1415742 - DNA, 22 bp, Homo sapiens
agagaagggggacgtttctgga

SEQ ID NO: 1415743 - DNA, 22 bp, Homo sapiens
agagaaggtggacctggcagtg

SEQ ID NO: 1415744 - DNA, 14 bp, Homo sapiens
agagaagtctcatt

SEQ ID NO: 1415745 - DNA, 17 bp, Homo sapiens
agagaagtttgtagcca

SEQ ID NO: 1415746 - DNA, 11 bp, Homo sapiens
agagaataaat

SEQ ID NO: 1415747 - DNA, 13 bp, Homo sapiens
agagaataaattg

SEQ ID NO: 1415748 - DNA, 19 bp, Homo sapiens
agagaataaattggattat

SEQ ID NO: 1415749 - DNA, 21 bp, Homo sapiens
agagaataaattggattattt

SEQ ID NO: 1415750 - DNA, 14 bp, Homo sapiens
agagaatagagctg

SEQ ID NO: 1415751 - DNA, 17 bp, Homo sapiens
agagaatagagctgcca

SEQ ID NO: 1415752 - DNA, 22 bp, Homo sapiens
agagaatcccacattagcttgt

SEQ ID NO: 1415753 - DNA, 20 bp, Homo sapiens
agagaatgagagcgacacag

SEQ ID NO: 1415754 - DNA, 23 bp, Homo sapiens
agagaatgagagcgacacagacg

SEQ ID NO: 1415755 - DNA, 15 bp, Homo sapiens
agagaatgcacctct

SEQ ID NO: 1415756 - DNA, 17 bp, Homo sapiens
agagaatggagacagag

SEQ ID NO: 1415757 - DNA, 17 bp, Homo sapiens
agagaatggctgggtca

SEQ ID NO: 1415758 - DNA, 17 bp, Homo sapiens
agagaatgtagatattg

SEQ ID NO: 1415759 - DNA, 18 bp, Homo sapiens
agagaatgtattttcata

SEQ ID NO: 1415760 - DNA, 22 bp, Homo sapiens
agagaatgtattttcatagatg

SEQ ID NO: 1415761 - DNA, 21 bp, Homo sapiens
agagaatgttcctactcacac

SEQ ID NO: 1415762 - DNA, 16 bp, Homo sapiens
agagaattatatattt

SEQ ID NO: 1415763 - DNA, 23 bp, Homo sapiens
agagaatttctaccatttcagag

SEQ ID NO: 1415764 - DNA, 19 bp, Homo sapiens
agagacaaacacctcccag

SEQ ID NO: 1415765 - DNA, 13 bp, Homo sapiens
agagacaaagatt

SEQ ID NO: 1415766 - DNA, 14 bp, Homo sapiens
agagacaagaagca

SEQ ID NO: 1415767 - DNA, 16 bp, Homo sapiens
agagacaagaagcaaa

SEQ ID NO: 1415768 - DNA, 15 bp, Homo sapiens
agagacaagtaattt

SEQ ID NO: 1415769 - DNA, 23 bp, Homo sapiens
agagacacatacagagtgggccc

SEQ ID NO: 1415770 - DNA, 21 bp, Homo sapiens
agagacacctgcacctccccc

SEQ ID NO: 1415771 - DNA, 23 bp, Homo sapiens
agagacaggaaaatcctctggct

SEQ ID NO: 1415772 - DNA, 16 bp, Homo sapiens
agagacagttctctgt

SEQ ID NO: 1415773 - DNA, 22 bp, Homo sapiens
agagacatacttgaagggccag

SEQ ID NO: 1415774 - DNA, 20 bp, Homo sapiens
agaattatgtaatatattgt

SEQ ID NO: 1415775 - DNA, 18 bp, Homo sapiens
agaattatttttaaaaag

SEQ ID NO: 1415776 - DNA, 14 bp, Homo sapiens
agaattcaaaagtg

SEQ ID NO: 1415777 - DNA, 20 bp, Homo sapiens
agaattcaaactggggcctc

SEQ ID NO: 1415778 - DNA, 18 bp, Homo sapiens
agaattcagaagacccct

SEQ ID NO: 1415779 - DNA, 20 bp, Homo sapiens
agaattcccttgaattgtgt

SEQ ID NO: 1415780 - DNA, 22 bp, Homo sapiens
agaattcccttgaattgtgtat

SEQ ID NO: 1415781 - DNA, 13 bp, Homo sapiens
agaattccttcga

SEQ ID NO: 1415782 - DNA, 20 bp, Homo sapiens
agaattctcagaatctcaaa

SEQ ID NO: 1415783 - DNA, 18 bp, Homo sapiens
agaattctgattgatttg

SEQ ID NO: 1415784 - DNA, 16 bp, Homo sapiens
agaattgaaaagtttt

SEQ ID NO: 1415785 - DNA, 19 bp, Homo sapiens
agaattgaaaagtttttgt

SEQ ID NO: 1415786 - DNA, 13 bp, Homo sapiens
agaattgaaaatg

SEQ ID NO: 1415787 - DNA, 16 bp, Homo sapiens
agaattgaaaatgcat

SEQ ID NO: 1415788 - DNA, 16 bp, Homo sapiens
agaattgaacccagga

SEQ ID NO: 1415789 - DNA, 17 bp, Homo sapiens
agaattgaacccaggag

SEQ ID NO: 1415790 - DNA, 19 bp, Homo sapiens
agaattgaacccaggaggt

SEQ ID NO: 1415791 - DNA, 22 bp, Homo sapiens
agaattgaacccaggaggtgga

SEQ ID NO: 1415792 - DNA, 18 bp, Homo sapiens
agaattgactgaagcaca

SEQ ID NO: 1415793 - DNA, 20 bp, Homo sapiens
agaattgatatacacggatg

SEQ ID NO: 1415794 - DNA, 21 bp, Homo sapiens
agaattgctggatgcattttt

SEQ ID NO: 1415795 - DNA, 20 bp, Homo sapiens
agaattggccatcttaaaaa

SEQ ID NO: 1415796 - DNA, 21 bp, Homo sapiens
agaattgttagcaaatgacag

SEQ ID NO: 1415797 - DNA, 16 bp, Homo sapiens
agaattgttgagatac

SEQ ID NO: 1415798 - DNA, 17 bp, Homo sapiens
agaattgtttttgaatt

SEQ ID NO: 1415799 - DNA, 18 bp, Homo sapiens
agaattgtttttgaattt

SEQ ID NO: 1415800 - DNA, 16 bp, Homo sapiens
agaatttagtattatc

SEQ ID NO: 1415801 - DNA, 19 bp, Homo sapiens
agaatttagtattatcaaa

SEQ ID NO: 1415802 - DNA, 21 bp, Homo sapiens
agaatttattagtttaaaatg

SEQ ID NO: 1415803 - DNA, 14 bp, Homo sapiens
agaatttctaagaa

SEQ ID NO: 1415804 - DNA, 21 bp, Homo sapiens
agaatttctaccatttcagag

SEQ ID NO: 1415805 - DNA, 15 bp, Homo sapiens
agaattttaaattat

SEQ ID NO: 1415806 - DNA, 14 bp, Homo sapiens
agaattttaagcct

SEQ ID NO: 1415807 - DNA, 16 bp, Homo sapiens
agaattttaagtgctt

SEQ ID NO: 1415808 - DNA, 21 bp, Homo sapiens
agaattttaagtgctttgtaa

SEQ ID NO: 1415809 - DNA, 20 bp, Homo sapiens
agaattttaggaacttcaga

SEQ ID NO: 1415810 - DNA, 22 bp, Homo sapiens
agaattttcatcccgtatcaca

SEQ ID NO: 1415811 - DNA, 13 bp, Homo sapiens
agaattttgtata

SEQ ID NO: 1415812 - DNA, 15 bp, Homo sapiens
agacaaaaagacaaa

SEQ ID NO: 1415813 - DNA, 23 bp, Homo sapiens
agacaaaaagtatattaaacaaa

SEQ ID NO: 1415814 - DNA, 12 bp, Homo sapiens
agacaaaaataa

SEQ ID NO: 1415815 - DNA, 18 bp, Homo sapiens
agacaaaatttgagaata

SEQ ID NO: 1415816 - DNA, 13 bp, Homo sapiens
agacaaacactgc

SEQ ID NO: 1415817 - DNA, 15 bp, Homo sapiens
agacaaacactgcca

SEQ ID NO: 1415818 - DNA, 16 bp, Homo sapiens
agacaaacactgccat

SEQ ID NO: 1415819 - DNA, 14 bp, Homo sapiens
agacaaagatttct

SEQ ID NO: 1415820 - DNA, 22 bp, Homo sapiens
actgtgaacctgggcactccgc

SEQ ID NO: 1415821 - DNA, 21 bp, Homo sapiens
actgtgaacttgactgggtga

SEQ ID NO: 1415822 - DNA, 22 bp, Homo sapiens
actgtgaacttgactgggtgag

SEQ ID NO: 1415823 - DNA, 15 bp, Homo sapiens
actgtgaagagctgg

SEQ ID NO: 1415824 - DNA, 18 bp, Homo sapiens
actgtgaatcctggcaag

SEQ ID NO: 1415825 - DNA, 17 bp, Homo sapiens
actgtgagaacccagtt

SEQ ID NO: 1415826 - DNA, 15 bp, Homo sapiens
actgtgagcttacat

SEQ ID NO: 1415827 - DNA, 16 bp, Homo sapiens
actgtgagcttacatt

SEQ ID NO: 1415828 - DNA, 22 bp, Homo sapiens
actgtgagcttacattgaaaac

SEQ ID NO: 1415829 - DNA, 19 bp, Homo sapiens
actgtgaggcggcagctgg

SEQ ID NO: 1415830 - DNA, 13 bp, Homo sapiens
actgtgatgccac

SEQ ID NO: 1415831 - DNA, 12 bp, Homo sapiens
actgtgattaga

SEQ ID NO: 1415832 - DNA, 17 bp, Homo sapiens
actgtgattagatcaca

SEQ ID NO: 1415833 - DNA, 13 bp, Homo sapiens
actgtgatttctg

SEQ ID NO: 1415834 - DNA, 13 bp, Homo sapiens
actgtgatttgaa

SEQ ID NO: 1415835 - DNA, 22 bp, Homo sapiens
actgtgattttatgtttaaaaa

SEQ ID NO: 1415836 - DNA, 12 bp, Homo sapiens
actgtgcagagt

SEQ ID NO: 1415837 - DNA, 12 bp, Homo sapiens
actgtgccacaa

SEQ ID NO: 1415838 - DNA, 12 bp, Homo sapiens
actgtgccactg

SEQ ID NO: 1415839 - DNA, 15 bp, Homo sapiens
actgtgccctggtgg

SEQ ID NO: 1415840 - DNA, 18 bp, Homo sapiens
actgtgcctcagagacca

SEQ ID NO: 1415841 - DNA, 22 bp, Homo sapiens
actgtgcctcagagaccagggc

SEQ ID NO: 1415842 - DNA, 16 bp, Homo sapiens
actgtgcctcaggcca

SEQ ID NO: 1415843 - DNA, 12 bp, Homo sapiens
actgtgctgtgc

SEQ ID NO: 1415844 - DNA, 14 bp, Homo sapiens
actgtggaaagaca

SEQ ID NO: 1415845 - DNA, 16 bp, Homo sapiens
actgtggagactttct

SEQ ID NO: 1415846 - DNA, 15 bp, Homo sapiens
actgtggatattgtt

SEQ ID NO: 1415847 - DNA, 22 bp, Homo sapiens
actgtggcacttgcctgggtca

SEQ ID NO: 1415848 - DNA, 15 bp, Homo sapiens
actgtggccagagct

SEQ ID NO: 1415849 - DNA, 17 bp, Homo sapiens
actgtggccagagctgg

SEQ ID NO: 1415850 - DNA, 20 bp, Homo sapiens
actgtggccgttatctggaa

SEQ ID NO: 1415851 - DNA, 20 bp, Homo sapiens
actgtggtaggggcagggag

SEQ ID NO: 1415852 - DNA, 19 bp, Homo sapiens
actgtggtaggtgtttgaa

SEQ ID NO: 1415853 - DNA, 16 bp, Homo sapiens
actgtgtacataactg

SEQ ID NO: 1415854 - DNA, 17 bp, Homo sapiens
actgtgtacataactga

SEQ ID NO: 1415855 - DNA, 12 bp, Homo sapiens
actgtgtataga

SEQ ID NO: 1415856 - DNA, 16 bp, Homo sapiens
actgtgtatgtacata

SEQ ID NO: 1415857 - DNA, 20 bp, Homo sapiens
actgtgtatgtacatatata

SEQ ID NO: 1415858 - DNA, 21 bp, Homo sapiens
actgtgtcctggtgctctctg

SEQ ID NO: 1415859 - DNA, 19 bp, Homo sapiens
actgtgtctggcgttctca

SEQ ID NO: 1415860 - DNA, 19 bp, Homo sapiens
actgtgtggactgtgatgc

SEQ ID NO: 1415861 - DNA, 14 bp, Homo sapiens
actgtgttactgct

SEQ ID NO: 1415862 - DNA, 23 bp, Homo sapiens
actgtgttactgctttgcaaaga

SEQ ID NO: 1415863 - DNA, 12 bp, Homo sapiens
actgtgtttgca

SEQ ID NO: 1415864 - DNA, 17 bp, Homo sapiens
actgtgttttataaaat

SEQ ID NO: 1415865 - DNA, 21 bp, Homo sapiens
actgttaaccaaattttgagc

SEQ ID NO: 1415866 - DNA, 17 bp, Homo sapiens
actgttaatacacagta

SEQ ID NO: 1415867 - DNA, 22 bp, Homo sapiens
actgttaatacacagtacttta

SEQ ID NO: 1415868 - DNA, 21 bp, Homo sapiens
actgttacaacttgtatttcc

SEQ ID NO: 1415869 - DNA, 16 bp, Homo sapiens
actgttactccacagc

SEQ ID NO: 1415870 - DNA, 17 bp, Homo sapiens
actgttactttggcaat

SEQ ID NO: 1415871 - DNA, 22 bp, Homo sapiens
actgttactttggcaatttcct

SEQ ID NO: 1415872 - DNA, 13 bp, Homo sapiens
actgttagaatgt

SEQ ID NO: 1415873 - DNA, 18 bp, Homo sapiens
actgttagaattctttta

SEQ ID NO: 1415874 - DNA, 18 bp, Homo sapiens
actgttagcttttacctt

SEQ ID NO: 1415875 - DNA, 18 bp, Homo sapiens
actgttattctttgcact

SEQ ID NO: 1415876 - DNA, 22 bp, Homo sapiens
actgttcaatgattatttgtat

SEQ ID NO: 1415877 - DNA, 15 bp, Homo sapiens
actgttcatttccac

SEQ ID NO: 1415878 - DNA, 13 bp, Homo sapiens
actgttctaaagc

SEQ ID NO: 1415879 - DNA, 14 bp, Homo sapiens
actgttctaaagct

SEQ ID NO: 1415880 - DNA, 18 bp, Homo sapiens
actgttctaaagctctga

SEQ ID NO: 1415881 - DNA, 15 bp, Homo sapiens
actgttctgaaagga

SEQ ID NO: 1415882 - DNA, 9 bp, Homo sapiens
actgttgaa

SEQ ID NO: 1415883 - DNA, 20 bp, Homo sapiens
actgttgaacttagaactat

SEQ ID NO: 1415884 - DNA, 13 bp, Homo sapiens
actgttgcagtgg

SEQ ID NO: 1415885 - DNA, 21 bp, Homo sapiens
actgttgcagtggcctggccg

SEQ ID NO: 1415886 - DNA, 20 bp, Homo sapiens
actgttgcatttacttttaa

SEQ ID NO: 1415887 - DNA, 17 bp, Homo sapiens
actgttgctttaatatg

SEQ ID NO: 1415888 - DNA, 21 bp, Homo sapiens
actgttgctttaatatgagct

SEQ ID NO: 1415889 - DNA, 21 bp, Homo sapiens
actgttgtaagaattctgatt

SEQ ID NO: 1415890 - DNA, 19 bp, Homo sapiens
actgtttaacaacatggct

SEQ ID NO: 1415891 - DNA, 17 bp, Homo sapiens
actgtttatacactgtg

SEQ ID NO: 1415892 - DNA, 14 bp, Homo sapiens
actgtttatttaag

SEQ ID NO: 1415893 - DNA, 15 bp, Homo sapiens
actgtttatttaagg

SEQ ID NO: 1415894 - DNA, 16 bp, Homo sapiens
actgtttatttaagga

SEQ ID NO: 1415895 - DNA, 17 bp, Homo sapiens
actgtttatttaaggat

SEQ ID NO: 1415896 - DNA, 20 bp, Homo sapiens
actgtttatttaaggatgga

SEQ ID NO: 1415897 - DNA, 21 bp, Homo sapiens
actgtttatttaaggatggat

SEQ ID NO: 1415898 - DNA, 13 bp, Homo sapiens
actgtttcagtgt

SEQ ID NO: 1415899 - DNA, 22 bp, Homo sapiens
actgtttcctatgacattactg

SEQ ID NO: 1415900 - DNA, 16 bp, Homo sapiens
actgtttctcttgagc

SEQ ID NO: 1415901 - DNA, 21 bp, Homo sapiens
actgtttctcttgagctggcc

SEQ ID NO: 1415902 - DNA, 22 bp, Homo sapiens
actgtttctcttgagctggcct

SEQ ID NO: 1415903 - DNA, 22 bp, Homo sapiens
actgtttgatataccaaattaa

SEQ ID NO: 1415904 - DNA, 22 bp, Homo sapiens
actgtttgccttctacttttaa

SEQ ID NO: 1415905 - DNA, 12 bp, Homo sapiens
actgtttgtaat

SEQ ID NO: 1415906 - DNA, 12 bp, Homo sapiens
actgtttgttat

SEQ ID NO: 1415907 - DNA, 15 bp, Homo sapiens
actgttttactgttt

SEQ ID NO: 1415908 - DNA, 14 bp, Homo sapiens
actgttttatagaa

SEQ ID NO: 1415909 - DNA, 14 bp, Homo sapiens
actgttttcatgtg

SEQ ID NO: 1415910 - DNA, 23 bp, Homo sapiens
actgttttctctcggctccccat

SEQ ID NO: 1415911 - DNA, 16 bp, Homo sapiens
actgttttgccaagaa

SEQ ID NO: 1415912 - DNA, 13 bp, Homo sapiens
actgttttgggcc

SEQ ID NO: 1415913 - DNA, 22 bp, Homo sapiens
actgttttgggcctccatgccc

SEQ ID NO: 1415914 - DNA, 15 bp, Homo sapiens
actgttttttaagtc

SEQ ID NO: 1415915 - DNA, 14 bp, Homo sapiens
acttaaaaaaatga

SEQ ID NO: 1415916 - DNA, 24 bp, Homo sapiens
acttaaaacatggtgcctatatct

SEQ ID NO: 1415917 - DNA, 13 bp, Homo sapiens
acttaaaagagct

SEQ ID NO: 1415918 - DNA, 22 bp, Homo sapiens
acttaaaagtcagtatcatatt

SEQ ID NO: 1415919 - DNA, 23 bp, Homo sapiens
acttaaaataggggatatttaag

SEQ ID NO: 1415920 - DNA, 14 bp, Homo sapiens
acttaaacaaaaaa

SEQ ID NO: 1415921 - DNA, 19 bp, Homo sapiens
acttaaacttgcatcactt

SEQ ID NO: 1415922 - DNA, 21 bp, Homo sapiens
acttaaagggcccaatgaatt

SEQ ID NO: 1415923 - DNA, 13 bp, Homo sapiens
acttaaatgaaag

SEQ ID NO: 1415924 - DNA, 22 bp, Homo sapiens
agaaccaaaccgcaaacgtgaa

SEQ ID NO: 1415925 - DNA, 17 bp, Homo sapiens
agaaccaaatacctcaa

SEQ ID NO: 1415926 - DNA, 13 bp, Homo sapiens
agaaccaaatctg

SEQ ID NO: 1415927 - DNA, 18 bp, Homo sapiens
agaaccaagcttcagagc

SEQ ID NO: 1415928 - DNA, 21 bp, Homo sapiens
agaaccaagcttcagagccta

SEQ ID NO: 1415929 - DNA, 12 bp, Homo sapiens
agaaccagaggg

SEQ ID NO: 1415930 - DNA, 16 bp, Homo sapiens
agaaccagagggcatg

SEQ ID NO: 1415931 - DNA, 18 bp, Homo sapiens
agaaccagtttcaggtgt

SEQ ID NO: 1415932 - DNA, 15 bp, Homo sapiens
agaacccaagtgcct

SEQ ID NO: 1415933 - DNA, 15 bp, Homo sapiens
agaaccgagcaaaga

SEQ ID NO: 1415934 - DNA, 13 bp, Homo sapiens
agaacctaacatg

SEQ ID NO: 1415935 - DNA, 23 bp, Homo sapiens
agaacctcaggtacggagaagaa

SEQ ID NO: 1415936 - DNA, 13 bp, Homo sapiens
agaacctcttccc

SEQ ID NO: 1415937 - DNA, 14 bp, Homo sapiens
agaacctcttcccc

SEQ ID NO: 1415938 - DNA, 21 bp, Homo sapiens
agaacctgcacacaggacagc

SEQ ID NO: 1415939 - DNA, 23 bp, Homo sapiens
agaacctggaaaaattccagaag

SEQ ID NO: 1415940 - DNA, 14 bp, Homo sapiens
agaacctgtccttg

SEQ ID NO: 1415941 - DNA, 21 bp, Homo sapiens
agaacctgtccttgcacactc

SEQ ID NO: 1415942 - DNA, 14 bp, Homo sapiens
agaaccttggacca

SEQ ID NO: 1415943 - DNA, 18 bp, Homo sapiens
agaacgaggattttaatt

SEQ ID NO: 1415944 - DNA, 14 bp, Homo sapiens
agaacggcttgctt

SEQ ID NO: 1415945 - DNA, 16 bp, Homo sapiens
agaacgttttttcctc

SEQ ID NO: 1415946 - DNA, 16 bp, Homo sapiens
agaactaaactcattt

SEQ ID NO: 1415947 - DNA, 22 bp, Homo sapiens
agaactaagaggcccagccctc

SEQ ID NO: 1415948 - DNA, 17 bp, Homo sapiens
agaactagccaaaccag

SEQ ID NO: 1415949 - DNA, 21 bp, Homo sapiens
agaactagccaaaccaggacc

SEQ ID NO: 1415950 - DNA, 17 bp, Homo sapiens
agaactattttattcta

SEQ ID NO: 1415951 - DNA, 19 bp, Homo sapiens
agaactcaaatggggccag

SEQ ID NO: 1415952 - DNA, 20 bp, Homo sapiens
agaactcaaatggggccaga

SEQ ID NO: 1415953 - DNA, 20 bp, Homo sapiens
agaactcactctgggctgta

SEQ ID NO: 1415954 - DNA, 14 bp, Homo sapiens
agaactcactgggg

SEQ ID NO: 1415955 - DNA, 16 bp, Homo sapiens
agaactcactggggcc

SEQ ID NO: 1415956 - DNA, 16 bp, Homo sapiens
agaactcagcagttga

SEQ ID NO: 1415957 - DNA, 16 bp, Homo sapiens
agaactccaggccctc

SEQ ID NO: 1415958 - DNA, 20 bp, Homo sapiens
agaactcgcgctcagtaaac

SEQ ID NO: 1415959 - DNA, 20 bp, Homo sapiens
agaactctaaccagtgtaca

SEQ ID NO: 1415960 - DNA, 16 bp, Homo sapiens
agaactctctccctgg

SEQ ID NO: 1415961 - DNA, 16 bp, Homo sapiens
agaactctctggaagc

SEQ ID NO: 1415962 - DNA, 14 bp, Homo sapiens
agaactctgggctg

SEQ ID NO: 1415963 - DNA, 21 bp, Homo sapiens
agaactgcatatgtttcgctg

SEQ ID NO: 1415964 - DNA, 15 bp, Homo sapiens
agaactggactcagg

SEQ ID NO: 1415965 - DNA, 16 bp, Homo sapiens
agaactggactcagga

SEQ ID NO: 1415966 - DNA, 14 bp, Homo sapiens
agaactgggatttg

SEQ ID NO: 1415967 - DNA, 15 bp, Homo sapiens
agaactgggatttga

SEQ ID NO: 1415968 - DNA, 21 bp, Homo sapiens
agaactggggttcaagcccag

SEQ ID NO: 1415969 - DNA, 12 bp, Homo sapiens
agaactgtacat

SEQ ID NO: 1415970 - DNA, 14 bp, Homo sapiens
agaactgtactgtt

SEQ ID NO: 1415971 - DNA, 19 bp, Homo sapiens
agaactgtactgttttctg

SEQ ID NO: 1415972 - DNA, 22 bp, Homo sapiens
agaactgtcccacaaaatattt

SEQ ID NO: 1415973 - DNA, 16 bp, Homo sapiens
agaactgtgataaaaa

SEQ ID NO: 1415974 - DNA, 20 bp, Homo sapiens
agaacttaagtctcgaatgt

SEQ ID NO: 1415975 - DNA, 15 bp, Homo sapiens
agaactttaaagctc

SEQ ID NO: 1415976 - DNA, 22 bp, Homo sapiens
agaactttattaagtaaaatcc

SEQ ID NO: 1415977 - DNA, 14 bp, Homo sapiens
agaactttcatttt

SEQ ID NO: 1415978 - DNA, 14 bp, Homo sapiens
agaagaaaactttt

SEQ ID NO: 1415979 - DNA, 12 bp, Homo sapiens
agaagaaacttt

SEQ ID NO: 1415980 - DNA, 13 bp, Homo sapiens
agaagaaagatgt

SEQ ID NO: 1415981 - DNA, 15 bp, Homo sapiens
agaagaaatagcaga

SEQ ID NO: 1415982 - DNA, 18 bp, Homo sapiens
agaagaaatagttctgtg

SEQ ID NO: 1415983 - DNA, 21 bp, Homo sapiens
agaagaacttgcatggagcag

SEQ ID NO: 1415984 - DNA, 15 bp, Homo sapiens
agaagaagaagaagg

SEQ ID NO: 1415985 - DNA, 18 bp, Homo sapiens
agaagaagaaggagagca

SEQ ID NO: 1415986 - DNA, 12 bp, Homo sapiens
agaagaagaatt

SEQ ID NO: 1415987 - DNA, 16 bp, Homo sapiens
agaagaatattcagga

SEQ ID NO: 1415988 - DNA, 13 bp, Homo sapiens
agaagaatgaaaa

SEQ ID NO: 1415989 - DNA, 12 bp, Homo sapiens
agaagacaaaat

SEQ ID NO: 1415990 - DNA, 23 bp, Homo sapiens
agaagacacaaggtgatttcaga

SEQ ID NO: 1415991 - DNA, 12 bp, Homo sapiens
agaagacactgc

SEQ ID NO: 1415992 - DNA, 12 bp, Homo sapiens
agaagacatgaa

SEQ ID NO: 1415993 - DNA, 14 bp, Homo sapiens
agaagacatggaga

SEQ ID NO: 1415994 - DNA, 19 bp, Homo sapiens
agaagacccacgtgctagg

SEQ ID NO: 1415995 - DNA, 18 bp, Homo sapiens
agaagactagaggccagg

SEQ ID NO: 1415996 - DNA, 17 bp, Homo sapiens
agaagagaagctgctga

SEQ ID NO: 1415997 - DNA, 22 bp, Homo sapiens
agaagagaatattagctttact

SEQ ID NO: 1415998 - DNA, 15 bp, Homo sapiens
agaagagaattcagt

SEQ ID NO: 1415999 - DNA, 21 bp, Homo sapiens
agaagagaattcagtattttt

SEQ ID NO: 1416000 - DNA, 13 bp, Homo sapiens
agaagagctgttc

SEQ ID NO: 1416001 - DNA, 22 bp, Homo sapiens
agaagaggaagaaattcaggta

SEQ ID NO: 1416002 - DNA, 17 bp, Homo sapiens
agaagaggagcctcaga

SEQ ID NO: 1416003 - DNA, 20 bp, Homo sapiens
agaagaggagcctcagaaga

SEQ ID NO: 1416004 - DNA, 18 bp, Homo sapiens
agaagagggcccagccca

SEQ ID NO: 1416005 - DNA, 14 bp, Homo sapiens
agaagagggcctgt

SEQ ID NO: 1416006 - DNA, 15 bp, Homo sapiens
agaagagggtgtgtt

SEQ ID NO: 1416007 - DNA, 13 bp, Homo sapiens
agaagatgaatac

SEQ ID NO: 1416008 - DNA, 19 bp, Homo sapiens
agaagatgaatacaaacaa

SEQ ID NO: 1416009 - DNA, 13 bp, Homo sapiens
agaagatgagcct

SEQ ID NO: 1416010 - DNA, 22 bp, Homo sapiens
agaagatgccagcttctctctc

SEQ ID NO: 1416011 - DNA, 13 bp, Homo sapiens
agaagattcaaga

SEQ ID NO: 1416012 - DNA, 18 bp, Homo sapiens
agaagattttgaaatttt

SEQ ID NO: 1416013 - DNA, 14 bp, Homo sapiens
agaagcaaatatag

SEQ ID NO: 1416014 - DNA, 16 bp, Homo sapiens
agaagcaagggcaaga

SEQ ID NO: 1416015 - DNA, 21 bp, Homo sapiens
agaagcacagaatatttttat

SEQ ID NO: 1416016 - DNA, 19 bp, Homo sapiens
agaagcacagctcctgcca

SEQ ID NO: 1416017 - DNA, 20 bp, Homo sapiens
agaagcacagctcctgccag

SEQ ID NO: 1416018 - DNA, 14 bp, Homo sapiens
agaagcacatgtgt

SEQ ID NO: 1416019 - DNA, 14 bp, Homo sapiens
agaagcagtgagcc

SEQ ID NO: 1416020 - DNA, 17 bp, Homo sapiens
agaagcagtgagccgca

SEQ ID NO: 1416021 - DNA, 19 bp, Homo sapiens
agaagcatattttgctggt

SEQ ID NO: 1416022 - DNA, 15 bp, Homo sapiens
agaagcattgcctgg

SEQ ID NO: 1416023 - DNA, 20 bp, Homo sapiens
agaagcattgcctggactga

SEQ ID NO: 1416024 - DNA, 11 bp, Homo sapiens
agaagccaagc

SEQ ID NO: 1416025 - DNA, 16 bp, Homo sapiens
agaagccaagggaaga

SEQ ID NO: 1416026 - DNA, 11 bp, Homo sapiens
agaagccacag

SEQ ID NO: 1416027 - DNA, 12 bp, Homo sapiens
agaagccacaga

SEQ ID NO: 1416028 - DNA, 14 bp, Homo sapiens
agaagccacagaaa

SEQ ID NO: 1416029 - DNA, 17 bp, Homo sapiens
agaagccacaggcctga

SEQ ID NO: 1416030 - DNA, 12 bp, Homo sapiens
agaagccagcca

SEQ ID NO: 1416031 - DNA, 13 bp, Homo sapiens
agaagccagccac

SEQ ID NO: 1416032 - DNA, 19 bp, Homo sapiens
agaagccagccacagaccc

SEQ ID NO: 1416033 - DNA, 20 bp, Homo sapiens
agaagccatgtactcaagta

SEQ ID NO: 1416034 - DNA, 14 bp, Homo sapiens
agaagcccccagct

SEQ ID NO: 1416035 - DNA, 24 bp, Homo sapiens
agaagcccccagctaagaacctgg

SEQ ID NO: 1416036 - DNA, 22 bp, Homo sapiens
agaagccgggaacagacaacag

SEQ ID NO: 1416037 - DNA, 14 bp, Homo sapiens
agaagcctctggct

SEQ ID NO: 1416038 - DNA, 18 bp, Homo sapiens
agaagcctgtaacactcc

SEQ ID NO: 1416039 - DNA, 21 bp, Homo sapiens
agaagccttaatttgcacagt

SEQ ID NO: 1416040 - DNA, 17 bp, Homo sapiens
agacagaacttgaatgt

SEQ ID NO: 1416041 - DNA, 20 bp, Homo sapiens
agacagaatctcagtctgtc

SEQ ID NO: 1416042 - DNA, 15 bp, Homo sapiens
agacagaatggtgga

SEQ ID NO: 1416043 - DNA, 16 bp, Homo sapiens
agacagacacacacac

SEQ ID NO: 1416044 - DNA, 14 bp, Homo sapiens
agacagaccctctg

SEQ ID NO: 1416045 - DNA, 14 bp, Homo sapiens
agacagagacaagt

SEQ ID NO: 1416046 - DNA, 17 bp, Homo sapiens
agacagagacaagtaat

SEQ ID NO: 1416047 - DNA, 18 bp, Homo sapiens
agacagagacgcaggaat

SEQ ID NO: 1416048 - DNA, 14 bp, Homo sapiens
agacagagccagga

SEQ ID NO: 1416049 - DNA, 21 bp, Homo sapiens
agacagagccaggagaagctc

SEQ ID NO: 1416050 - DNA, 19 bp, Homo sapiens
agacagagtcttactctgt

SEQ ID NO: 1416051 - DNA, 20 bp, Homo sapiens
agacagagtcttcctctgtc

SEQ ID NO: 1416052 - DNA, 21 bp, Homo sapiens
agacagatatttcaaacatca

SEQ ID NO: 1416053 - DNA, 16 bp, Homo sapiens
agacagatgttgggag

SEQ ID NO: 1416054 - DNA, 16 bp, Homo sapiens
agacagcagcctgtat

SEQ ID NO: 1416055 - DNA, 14 bp, Homo sapiens
agacagcagctcag

SEQ ID NO: 1416056 - DNA, 22 bp, Homo sapiens
agacagccttcacttttctgag

SEQ ID NO: 1416057 - DNA, 19 bp, Homo sapiens
agacagcttgactgctttt

SEQ ID NO: 1416058 - DNA, 18 bp, Homo sapiens
agacaggaaaatcctctg

SEQ ID NO: 1416059 - DNA, 19 bp, Homo sapiens
agacaggaaaatcctctgg

SEQ ID NO: 1416060 - DNA, 14 bp, Homo sapiens
agacaggagcctag

SEQ ID NO: 1416061 - DNA, 15 bp, Homo sapiens
agacaggcccaagag

SEQ ID NO: 1416062 - DNA, 18 bp, Homo sapiens
agacaggcccaagagatg

SEQ ID NO: 1416063 - DNA, 23 bp, Homo sapiens
agacaggcggggcccagcgctct

SEQ ID NO: 1416064 - DNA, 15 bp, Homo sapiens
agacaggctcttagc

SEQ ID NO: 1416065 - DNA, 20 bp, Homo sapiens
agacaggctcttagcagctt

SEQ ID NO: 1416066 - DNA, 16 bp, Homo sapiens
agacagggtaggaaag

SEQ ID NO: 1416067 - DNA, 15 bp, Homo sapiens
agacagtatatttat

SEQ ID NO: 1416068 - DNA, 17 bp, Homo sapiens
agacagtatatttatag

SEQ ID NO: 1416069 - DNA, 17 bp, Homo sapiens
agacagtccaaccttga

SEQ ID NO: 1416070 - DNA, 21 bp, Homo sapiens
agacagtctgttatgcactgt

SEQ ID NO: 1416071 - DNA, 22 bp, Homo sapiens
agacagtctgttatgcactgtg

SEQ ID NO: 1416072 - DNA, 19 bp, Homo sapiens
agacagtgaagtaaaattg

SEQ ID NO: 1416073 - DNA, 14 bp, Homo sapiens
agacagtgaatttg

SEQ ID NO: 1416074 - DNA, 18 bp, Homo sapiens
agacagtgatctccatat

SEQ ID NO: 1416075 - DNA, 20 bp, Homo sapiens
agacagtgatctccatatgt

SEQ ID NO: 1416076 - DNA, 16 bp, Homo sapiens
agacagtgatgcctgc

SEQ ID NO: 1416077 - DNA, 11 bp, Homo sapiens
agacagtgccc

SEQ ID NO: 1416078 - DNA, 13 bp, Homo sapiens
agacagtgtacaa

SEQ ID NO: 1416079 - DNA, 14 bp, Homo sapiens
agacagttcaagaa

SEQ ID NO: 1416080 - DNA, 19 bp, Homo sapiens
agacatacttgaagggcca

SEQ ID NO: 1416081 - DNA, 20 bp, Homo sapiens
agacatacttgaagggccag

SEQ ID NO: 1416082 - DNA, 18 bp, Homo sapiens
agacataggccatgaaaa

SEQ ID NO: 1416083 - DNA, 23 bp, Homo sapiens
agacatatgggatattcccaagc

SEQ ID NO: 1416084 - DNA, 21 bp, Homo sapiens
agacatcgatatacatttatt

SEQ ID NO: 1416085 - DNA, 16 bp, Homo sapiens
agacatctctgcaccc

SEQ ID NO: 1416086 - DNA, 18 bp, Homo sapiens
agacatctttaacatagt

SEQ ID NO: 1416087 - DNA, 19 bp, Homo sapiens
agacatggagactcctgcc

SEQ ID NO: 1416088 - DNA, 22 bp, Homo sapiens
agacatggagactcctgccctg

SEQ ID NO: 1416089 - DNA, 20 bp, Homo sapiens
agacatggaggttctaaggc

SEQ ID NO: 1416090 - DNA, 20 bp, Homo sapiens
agacatgtctgttctacata

SEQ ID NO: 1416091 - DNA, 15 bp, Homo sapiens
accttctgagtacag

SEQ ID NO: 1416092 - DNA, 12 bp, Homo sapiens
accttctgcctt

SEQ ID NO: 1416093 - DNA, 19 bp, Homo sapiens
accttctggttgcttcaga

SEQ ID NO: 1416094 - DNA, 12 bp, Homo sapiens
accttctgtggc

SEQ ID NO: 1416095 - DNA, 13 bp, Homo sapiens
accttctgtggct

SEQ ID NO: 1416096 - DNA, 18 bp, Homo sapiens
accttcttatttaatctt

SEQ ID NO: 1416097 - DNA, 19 bp, Homo sapiens
accttctttattctgtgtt

SEQ ID NO: 1416098 - DNA, 20 bp, Homo sapiens
accttctttattctgtgtta

SEQ ID NO: 1416099 - DNA, 23 bp, Homo sapiens
accttgaaaaaaaacagtggatc

SEQ ID NO: 1416100 - DNA, 17 bp, Homo sapiens
accttgaatgctgccag

SEQ ID NO: 1416101 - DNA, 18 bp, Homo sapiens
accttgaatgctgccagt

SEQ ID NO: 1416102 - DNA, 16 bp, Homo sapiens
accttgacagagcagc

SEQ ID NO: 1416103 - DNA, 20 bp, Homo sapiens
accttgaccatcgtccttcc

SEQ ID NO: 1416104 - DNA, 17 bp, Homo sapiens
accttgacttgattagt

SEQ ID NO: 1416105 - DNA, 18 bp, Homo sapiens
accttgcctgaacatcct

SEQ ID NO: 1416106 - DNA, 24 bp, Homo sapiens
accttgcctgaacatccttccttc

SEQ ID NO: 1416107 - DNA, 17 bp, Homo sapiens
accttgctctcctcatc

SEQ ID NO: 1416108 - DNA, 19 bp, Homo sapiens
accttgctctcctcatctc

SEQ ID NO: 1416109 - DNA, 20 bp, Homo sapiens
accttgctctcctcatctcc

SEQ ID NO: 1416110 - DNA, 22 bp, Homo sapiens
accttgctgcaagcacagccct

SEQ ID NO: 1416111 - DNA, 14 bp, Homo sapiens
accttggagaggag

SEQ ID NO: 1416112 - DNA, 18 bp, Homo sapiens
accttggcaccagacacc

SEQ ID NO: 1416113 - DNA, 19 bp, Homo sapiens
accttggcatcctgtgctt

SEQ ID NO: 1416114 - DNA, 21 bp, Homo sapiens
accttggcccaggagctctgc

SEQ ID NO: 1416115 - DNA, 13 bp, Homo sapiens
accttggcctccc

SEQ ID NO: 1416116 - DNA, 17 bp, Homo sapiens
accttggcctcccagaa

SEQ ID NO: 1416117 - DNA, 17 bp, Homo sapiens
accttgggcacatctgc

SEQ ID NO: 1416118 - DNA, 13 bp, Homo sapiens
accttgtgcccag

SEQ ID NO: 1416119 - DNA, 18 bp, Homo sapiens
accttgtgcccagggttt

SEQ ID NO: 1416120 - DNA, 22 bp, Homo sapiens
accttgtgggaccagtcccaca

SEQ ID NO: 1416121 - DNA, 21 bp, Homo sapiens
accttgtgtctgtacacgtgt

SEQ ID NO: 1416122 - DNA, 12 bp, Homo sapiens
accttgtgttta

SEQ ID NO: 1416123 - DNA, 15 bp, Homo sapiens
accttgttggagcct

SEQ ID NO: 1416124 - DNA, 14 bp, Homo sapiens
accttgttgtgttt

SEQ ID NO: 1416125 - DNA, 20 bp, Homo sapiens
accttgttgtgtttctatct

SEQ ID NO: 1416126 - DNA, 17 bp, Homo sapiens
acctttaaatgcaacag

SEQ ID NO: 1416127 - DNA, 12 bp, Homo sapiens
acctttactgtg

SEQ ID NO: 1416128 - DNA, 15 bp, Homo sapiens
acctttactgtgctt

SEQ ID NO: 1416129 - DNA, 21 bp, Homo sapiens
acctttagaaactcaaaaact

SEQ ID NO: 1416130 - DNA, 21 bp, Homo sapiens
acctttagggcagcttgcccc

SEQ ID NO: 1416131 - DNA, 15 bp, Homo sapiens
acctttattaaaatc

SEQ ID NO: 1416132 - DNA, 17 bp, Homo sapiens
acctttattcacccctg

SEQ ID NO: 1416133 - DNA, 23 bp, Homo sapiens
acctttccaaagttaacagattt

SEQ ID NO: 1416134 - DNA, 13 bp, Homo sapiens
acctttcccatct

SEQ ID NO: 1416135 - DNA, 15 bp, Homo sapiens
acctttccctaaaga

SEQ ID NO: 1416136 - DNA, 16 bp, Homo sapiens
acctttctccactggg

SEQ ID NO: 1416137 - DNA, 16 bp, Homo sapiens
acctttctgtagccta

SEQ ID NO: 1416138 - DNA, 18 bp, Homo sapiens
acctttggagcaaagctg

SEQ ID NO: 1416139 - DNA, 13 bp, Homo sapiens
acctttggctggt

SEQ ID NO: 1416140 - DNA, 17 bp, Homo sapiens
acctttggtgcagaggt

SEQ ID NO: 1416141 - DNA, 21 bp, Homo sapiens
acctttgtaagacatttgtat

SEQ ID NO: 1416142 - DNA, 17 bp, Homo sapiens
accttttacattgtgac

SEQ ID NO: 1416143 - DNA, 18 bp, Homo sapiens
accttttatgaatcaaat

SEQ ID NO: 1416144 - DNA, 11 bp, Homo sapiens
accttttcagg

SEQ ID NO: 1416145 - DNA, 14 bp, Homo sapiens
accttttccccagg

SEQ ID NO: 1416146 - DNA, 14 bp, Homo sapiens
accttttctctttt

SEQ ID NO: 1416147 - DNA, 16 bp, Homo sapiens
accttttctgttgtac

SEQ ID NO: 1416148 - DNA, 19 bp, Homo sapiens
acctttttaataaaaatac

SEQ ID NO: 1416149 - DNA, 19 bp, Homo sapiens
acctttttatttgcatgtg

SEQ ID NO: 1416150 - DNA, 14 bp, Homo sapiens
acctttttccttcc

SEQ ID NO: 1416151 - DNA, 17 bp, Homo sapiens
acctttttcttgatctt

SEQ ID NO: 1416152 - DNA, 22 bp, Homo sapiens
acctttttgcatgatatcttca

SEQ ID NO: 1416153 - DNA, 21 bp, Homo sapiens
acgaaactccatctcaaaaca

SEQ ID NO: 1416154 - DNA, 14 bp, Homo sapiens
acgaaagaaatgta

SEQ ID NO: 1416155 - DNA, 17 bp, Homo sapiens
acgaactggctacagta

SEQ ID NO: 1416156 - DNA, 11 bp, Homo sapiens
acgaataaagg

SEQ ID NO: 1416157 - DNA, 23 bp, Homo sapiens
acgaataaaggtcccatgctcca

SEQ ID NO: 1416158 - DNA, 21 bp, Homo sapiens
acgaatggtctttgctccaga

SEQ ID NO: 1416159 - DNA, 22 bp, Homo sapiens
acgacaaagccaaactctgcca

SEQ ID NO: 1416160 - DNA, 20 bp, Homo sapiens
acgacaacgatgatgcttgt

SEQ ID NO: 1416161 - DNA, 16 bp, Homo sapiens
acgacaatgttgagaa

SEQ ID NO: 1416162 - DNA, 18 bp, Homo sapiens
acgagacacattgccttc

SEQ ID NO: 1416163 - DNA, 12 bp, Homo sapiens
acgagaccccca

SEQ ID NO: 1416164 - DNA, 16 bp, Homo sapiens
acgagcactggccaga

SEQ ID NO: 1416165 - DNA, 18 bp, Homo sapiens
acgagcactggccagaga

SEQ ID NO: 1416166 - DNA, 13 bp, Homo sapiens
acgagcagcccag

SEQ ID NO: 1416167 - DNA, 14 bp, Homo sapiens
acgagcagcccagg

SEQ ID NO: 1416168 - DNA, 15 bp, Homo sapiens
acgagcagcccaggg

SEQ ID NO: 1416169 - DNA, 12 bp, Homo sapiens
acgagccacaag

SEQ ID NO: 1416170 - DNA, 17 bp, Homo sapiens
acgagccacaagctgca

SEQ ID NO: 1416171 - DNA, 21 bp, Homo sapiens
acgagcctttgtttttctcca

SEQ ID NO: 1416172 - DNA, 20 bp, Homo sapiens
acgaggaatctgtgggtctg

SEQ ID NO: 1416173 - DNA, 14 bp, Homo sapiens
acgagggctggctg

SEQ ID NO: 1416174 - DNA, 20 bp, Homo sapiens
acgaggtcaagagatcgaga

SEQ ID NO: 1416175 - DNA, 20 bp, Homo sapiens
acgaggtcaggagatcgaga

SEQ ID NO: 1416176 - DNA, 17 bp, Homo sapiens
acgagtcacctgcaagc

SEQ ID NO: 1416177 - DNA, 17 bp, Homo sapiens
acgagtgggaaggactt

SEQ ID NO: 1416178 - DNA, 23 bp, Homo sapiens
acgatacgctactataaagagaa

SEQ ID NO: 1416179 - DNA, 13 bp, Homo sapiens
acgatcccctccc

SEQ ID NO: 1416180 - DNA, 15 bp, Homo sapiens
acgatcggtttcata

SEQ ID NO: 1416181 - DNA, 20 bp, Homo sapiens
acgatgtgcaatacattttt

SEQ ID NO: 1416182 - DNA, 18 bp, Homo sapiens
acgatgtggccctggcct

SEQ ID NO: 1416183 - DNA, 12 bp, Homo sapiens
acgatttaaggt

SEQ ID NO: 1416184 - DNA, 22 bp, Homo sapiens
acgatttgcaggattcccttct

SEQ ID NO: 1416185 - DNA, 17 bp, Homo sapiens
acgcaaatacactccag

SEQ ID NO: 1416186 - DNA, 18 bp, Homo sapiens
acgcaagggcatcaggca

SEQ ID NO: 1416187 - DNA, 21 bp, Homo sapiens
acgcaattgtgggatgtcctc

SEQ ID NO: 1416188 - DNA, 13 bp, Homo sapiens
acgcacacacaca

SEQ ID NO: 1416189 - DNA, 14 bp, Homo sapiens
acgcacacacacaa

SEQ ID NO: 1416190 - DNA, 16 bp, Homo sapiens
acgcacacagctgagc

SEQ ID NO: 1416191 - DNA, 22 bp, Homo sapiens
acgcacacgtacttaaatgaaa

SEQ ID NO: 1416192 - DNA, 14 bp, Homo sapiens
acgcaccactgctt

SEQ ID NO: 1416193 - DNA, 15 bp, Homo sapiens
acgcaccactgcttc

SEQ ID NO: 1416194 - DNA, 14 bp, Homo sapiens
acgcacttgcctgt

SEQ ID NO: 1416195 - DNA, 22 bp, Homo sapiens
acgcacttgcctgttggctgct

SEQ ID NO: 1416196 - DNA, 13 bp, Homo sapiens
acgcagcaccctt

SEQ ID NO: 1416197 - DNA, 12 bp, Homo sapiens
acgcagcagctg

SEQ ID NO: 1416198 - DNA, 23 bp, Homo sapiens
acgcagcagctgggacccctccc

SEQ ID NO: 1416199 - DNA, 15 bp, Homo sapiens
acgcagccaggacac

SEQ ID NO: 1416200 - DNA, 12 bp, Homo sapiens
acgcagccctgc

SEQ ID NO: 1416201 - DNA, 18 bp, Homo sapiens
acgcagccggagggaggc

SEQ ID NO: 1416202 - DNA, 19 bp, Homo sapiens
acgcagccggagggaggca

SEQ ID NO: 1416203 - DNA, 14 bp, Homo sapiens
acgcagcctgctct

SEQ ID NO: 1416204 - DNA, 12 bp, Homo sapiens
acgcaggcacag

SEQ ID NO: 1416205 - DNA, 22 bp, Homo sapiens
acgcaggcccccaggtgccagt

SEQ ID NO: 1416206 - DNA, 15 bp, Homo sapiens
actatacctgcttca

SEQ ID NO: 1416207 - DNA, 19 bp, Homo sapiens
actatacttgatagtttgg

SEQ ID NO: 1416208 - DNA, 20 bp, Homo sapiens
actatagcttgcagaactgt

SEQ ID NO: 1416209 - DNA, 22 bp, Homo sapiens
actatatatataaatgtataaa

SEQ ID NO: 1416210 - DNA, 17 bp, Homo sapiens
actatatatatttctag

SEQ ID NO: 1416211 - DNA, 23 bp, Homo sapiens
actatatgtgaaacattttttct

SEQ ID NO: 1416212 - DNA, 18 bp, Homo sapiens
actatattatcatgcaaa

SEQ ID NO: 1416213 - DNA, 19 bp, Homo sapiens
actatattgattgtccttt

SEQ ID NO: 1416214 - DNA, 23 bp, Homo sapiens
actatatttgggcctgctccaga

SEQ ID NO: 1416215 - DNA, 14 bp, Homo sapiens
actatcacacatga

SEQ ID NO: 1416216 - DNA, 21 bp, Homo sapiens
actatcccaatcaaagaatta

SEQ ID NO: 1416217 - DNA, 19 bp, Homo sapiens
actatcctgtaaatatatc

SEQ ID NO: 1416218 - DNA, 14 bp, Homo sapiens
actatctgtctggt

SEQ ID NO: 1416219 - DNA, 15 bp, Homo sapiens
actatctgttgaaaa

SEQ ID NO: 1416220 - DNA, 13 bp, Homo sapiens
actatctttctga

SEQ ID NO: 1416221 - DNA, 15 bp, Homo sapiens
actatctttctgata

SEQ ID NO: 1416222 - DNA, 23 bp, Homo sapiens
actatctttctgataacagaatt

SEQ ID NO: 1416223 - DNA, 16 bp, Homo sapiens
actatgaaataaaaaa

SEQ ID NO: 1416224 - DNA, 18 bp, Homo sapiens
actatgaactacaaagct

SEQ ID NO: 1416225 - DNA, 22 bp, Homo sapiens
actatgaatctattatactgta

SEQ ID NO: 1416226 - DNA, 15 bp, Homo sapiens
actatgatcacagtg

SEQ ID NO: 1416227 - DNA, 16 bp, Homo sapiens
actatgatcacagtga

SEQ ID NO: 1416228 - DNA, 19 bp, Homo sapiens
actatgatgagaggccagc

SEQ ID NO: 1416229 - DNA, 15 bp, Homo sapiens
actatgattattaac

SEQ ID NO: 1416230 - DNA, 12 bp, Homo sapiens
actatgatttct

SEQ ID NO: 1416231 - DNA, 19 bp, Homo sapiens
actatgcacaacagagtaa

SEQ ID NO: 1416232 - DNA, 23 bp, Homo sapiens
actatgcatggtgccccaggacc

SEQ ID NO: 1416233 - DNA, 18 bp, Homo sapiens
actatggccagtctgccc

SEQ ID NO: 1416234 - DNA, 10 bp, Homo sapiens
actatggtgt

SEQ ID NO: 1416235 - DNA, 19 bp, Homo sapiens
actatggtgtgttgtatct

SEQ ID NO: 1416236 - DNA, 15 bp, Homo sapiens
actatggttcccaat

SEQ ID NO: 1416237 - DNA, 21 bp, Homo sapiens
actatggttcccaataaaagt

SEQ ID NO: 1416238 - DNA, 15 bp, Homo sapiens
actatgtatatacat

SEQ ID NO: 1416239 - DNA, 12 bp, Homo sapiens
actatgtatcaa

SEQ ID NO: 1416240 - DNA, 18 bp, Homo sapiens
actatgtgccagttcctg

SEQ ID NO: 1416241 - DNA, 23 bp, Homo sapiens
actatgtggctgaaaatgcaaag

SEQ ID NO: 1416242 - DNA, 13 bp, Homo sapiens
actatgttcctaa

SEQ ID NO: 1416243 - DNA, 14 bp, Homo sapiens
actattaagaggca

SEQ ID NO: 1416244 - DNA, 17 bp, Homo sapiens
actattaagcaagaatg

SEQ ID NO: 1416245 - DNA, 14 bp, Homo sapiens
actattaagcagta

SEQ ID NO: 1416246 - DNA, 22 bp, Homo sapiens
actattaagcagtaaaaactgt

SEQ ID NO: 1416247 - DNA, 21 bp, Homo sapiens
actattataatttaatgcatg

SEQ ID NO: 1416248 - DNA, 13 bp, Homo sapiens
actattcaaacag

SEQ ID NO: 1416249 - DNA, 14 bp, Homo sapiens
actattcaaacagt

SEQ ID NO: 1416250 - DNA, 18 bp, Homo sapiens
actattccttttctgtat

SEQ ID NO: 1416251 - DNA, 22 bp, Homo sapiens
actattgcagacctgtcaccct

SEQ ID NO: 1416252 - DNA, 21 bp, Homo sapiens
actattggaatctgatatact

SEQ ID NO: 1416253 - DNA, 15 bp, Homo sapiens
actattgggtgaata

SEQ ID NO: 1416254 - DNA, 21 bp, Homo sapiens
actattgtgccaactgccagg

SEQ ID NO: 1416255 - DNA, 20 bp, Homo sapiens
actatttaaagcctcctcat

SEQ ID NO: 1416256 - DNA, 17 bp, Homo sapiens
actatttaactgactat

SEQ ID NO: 1416257 - DNA, 17 bp, Homo sapiens
actatttaagatgtgaa

SEQ ID NO: 1416258 - DNA, 20 bp, Homo sapiens
actatttatatcacacaata

SEQ ID NO: 1416259 - DNA, 14 bp, Homo sapiens
actatttattaaaa

SEQ ID NO: 1416260 - DNA, 12 bp, Homo sapiens
actatttcacat

SEQ ID NO: 1416261 - DNA, 22 bp, Homo sapiens
actatttctgggtcttttgcta

SEQ ID NO: 1416262 - DNA, 14 bp, Homo sapiens
actatttcttcaga

SEQ ID NO: 1416263 - DNA, 15 bp, Homo sapiens
actatttcttcagag

SEQ ID NO: 1416264 - DNA, 16 bp, Homo sapiens
actatttcttcagagt

SEQ ID NO: 1416265 - DNA, 14 bp, Homo sapiens
actatttgaccccc

SEQ ID NO: 1416266 - DNA, 17 bp, Homo sapiens
actatttgctaatgtat

SEQ ID NO: 1416267 - DNA, 23 bp, Homo sapiens
actatttgcttatttaataaaga

SEQ ID NO: 1416268 - DNA, 15 bp, Homo sapiens
actattttaaataaa

SEQ ID NO: 1416269 - DNA, 13 bp, Homo sapiens
actattttatatg

SEQ ID NO: 1416270 - DNA, 14 bp, Homo sapiens
actattttctacaa

SEQ ID NO: 1416271 - DNA, 11 bp, Homo sapiens
actatttttgt

SEQ ID NO: 1416272 - DNA, 13 bp, Homo sapiens
actcaaaatctgt

SEQ ID NO: 1416273 - DNA, 17 bp, Homo sapiens
actcaaacgatgtgcaa

SEQ ID NO: 1416274 - DNA, 21 bp, Homo sapiens
actcaaactgaggaatttcac

SEQ ID NO: 1416275 - DNA, 14 bp, Homo sapiens
actcaaatcaagaa

SEQ ID NO: 1416276 - DNA, 22 bp, Homo sapiens
actcaaatcttaagaaataaat

SEQ ID NO: 1416277 - DNA, 19 bp, Homo sapiens
actcaaatgaatttgctaa

SEQ ID NO: 1416278 - DNA, 16 bp, Homo sapiens
actcaaatgagtaaca

SEQ ID NO: 1416279 - DNA, 17 bp, Homo sapiens
actcaaatggggccaga

SEQ ID NO: 1416280 - DNA, 21 bp, Homo sapiens
actcaaatggggccagatcca

SEQ ID NO: 1416281 - DNA, 18 bp, Homo sapiens
actcaaatgttctaagtt

SEQ ID NO: 1416282 - DNA, 22 bp, Homo sapiens
actcaaatgttctaagtttcta

SEQ ID NO: 1416283 - DNA, 15 bp, Homo sapiens
actcaacagagagga

SEQ ID NO: 1416284 - DNA, 20 bp, Homo sapiens
actcaacatgttactgacca

SEQ ID NO: 1416285 - DNA, 21 bp, Homo sapiens
actcaacatgttactgaccag

SEQ ID NO: 1416286 - DNA, 15 bp, Homo sapiens
actcaactctgagcc

SEQ ID NO: 1416287 - DNA, 17 bp, Homo sapiens
actcaagaagtgaagaa

SEQ ID NO: 1416288 - DNA, 23 bp, Homo sapiens
actcaagaagtgaagaatgcaca

SEQ ID NO: 1416289 - DNA, 21 bp, Homo sapiens
actcaagagaatttatgtgaa

SEQ ID NO: 1416290 - DNA, 15 bp, Homo sapiens
actcaagaggctgag

SEQ ID NO: 1416291 - DNA, 18 bp, Homo sapiens
actcaagaggctgaggca

SEQ ID NO: 1416292 - DNA, 22 bp, Homo sapiens
actcaagggaaaggcaagcttg

SEQ ID NO: 1416293 - DNA, 20 bp, Homo sapiens
actcaaggtttaaccttaaa

SEQ ID NO: 1416294 - DNA, 17 bp, Homo sapiens
actcaagtacccattct

SEQ ID NO: 1416295 - DNA, 14 bp, Homo sapiens
actcaatctccagg

SEQ ID NO: 1416296 - DNA, 17 bp, Homo sapiens
actcaatctccagggct

SEQ ID NO: 1416297 - DNA, 16 bp, Homo sapiens
actcaatggatttgat

SEQ ID NO: 1416298 - DNA, 21 bp, Homo sapiens
actcacacctgaactgaacac

SEQ ID NO: 1416299 - DNA, 14 bp, Homo sapiens
actcacactggcca

SEQ ID NO: 1416300 - DNA, 12 bp, Homo sapiens
actcacagagct

SEQ ID NO: 1416301 - DNA, 17 bp, Homo sapiens
actcacagagtcaaggc

SEQ ID NO: 1416302 - DNA, 22 bp, Homo sapiens
actcacagagtcaaggcctgct

SEQ ID NO: 1416303 - DNA, 15 bp, Homo sapiens
actcacagcttctcc

SEQ ID NO: 1416304 - DNA, 22 bp, Homo sapiens
actcacagcttctccaagcatc

SEQ ID NO: 1416305 - DNA, 18 bp, Homo sapiens
actcacatagccaactct

SEQ ID NO: 1416306 - DNA, 14 bp, Homo sapiens
actcacatataaca

SEQ ID NO: 1416307 - DNA, 14 bp, Homo sapiens
actcaccaaaatat

SEQ ID NO: 1416308 - DNA, 17 bp, Homo sapiens
actcaccaaaatatagt

SEQ ID NO: 1416309 - DNA, 19 bp, Homo sapiens
actcaccactaccagccag

SEQ ID NO: 1416310 - DNA, 14 bp, Homo sapiens
actcaccagcccca

SEQ ID NO: 1416311 - DNA, 13 bp, Homo sapiens
actcaccagccct

SEQ ID NO: 1416312 - DNA, 16 bp, Homo sapiens
actcaccctgggagcc

SEQ ID NO: 1416313 - DNA, 22 bp, Homo sapiens
actcaccctgggagccagtcct

SEQ ID NO: 1416314 - DNA, 16 bp, Homo sapiens
actcacctaatgttta

SEQ ID NO: 1416315 - DNA, 23 bp, Homo sapiens
actcacctaatgtttatgagcca

SEQ ID NO: 1416316 - DNA, 14 bp, Homo sapiens
actcacctctgcct

SEQ ID NO: 1416317 - DNA, 23 bp, Homo sapiens
actcacctttctccactgggtgc

SEQ ID NO: 1416318 - DNA, 23 bp, Homo sapiens
actcacgataaataatcggccca

SEQ ID NO: 1416319 - DNA, 19 bp, Homo sapiens
actcacgtgggtcctgagg

SEQ ID NO: 1416320 - DNA, 19 bp, Homo sapiens
actctagaaaacgcgacct

SEQ ID NO: 1416321 - DNA, 18 bp, Homo sapiens
actctagaacatgcacat

SEQ ID NO: 1416322 - DNA, 17 bp, Homo sapiens
actctagacaagatatt

SEQ ID NO: 1416323 - DNA, 20 bp, Homo sapiens
actctagagagccttaactt

SEQ ID NO: 1416324 - DNA, 23 bp, Homo sapiens
actctagcctggcaacagagcga

SEQ ID NO: 1416325 - DNA, 13 bp, Homo sapiens
actctagcctggg

SEQ ID NO: 1416326 - DNA, 17 bp, Homo sapiens
actctagcctgggccag

SEQ ID NO: 1416327 - DNA, 20 bp, Homo sapiens
actctagcctgggccagaga

SEQ ID NO: 1416328 - DNA, 15 bp, Homo sapiens
actctagttctagat

SEQ ID NO: 1416329 - DNA, 15 bp, Homo sapiens
actctatttacagtc

SEQ ID NO: 1416330 - DNA, 21 bp, Homo sapiens
actctcaccatgatgtgaaga

SEQ ID NO: 1416331 - DNA, 22 bp, Homo sapiens
actctcaggatcaagaaagtgt

SEQ ID NO: 1416332 - DNA, 22 bp, Homo sapiens
actctcagtgcttcttactatt

SEQ ID NO: 1416333 - DNA, 15 bp, Homo sapiens
actctcattccccag

SEQ ID NO: 1416334 - DNA, 13 bp, Homo sapiens
actctcattcttt

SEQ ID NO: 1416335 - DNA, 14 bp, Homo sapiens
actctccaacctgg

SEQ ID NO: 1416336 - DNA, 19 bp, Homo sapiens
actctccaatgttctatta

SEQ ID NO: 1416337 - DNA, 21 bp, Homo sapiens
actctccccaaaatattatat

SEQ ID NO: 1416338 - DNA, 11 bp, Homo sapiens
actctccccac

SEQ ID NO: 1416339 - DNA, 20 bp, Homo sapiens
actctccccacgagggctgg

SEQ ID NO: 1416340 - DNA, 22 bp, Homo sapiens
actctccccacgagggctggct

SEQ ID NO: 1416341 - DNA, 19 bp, Homo sapiens
actctccccagtgcctgcc

SEQ ID NO: 1416342 - DNA, 21 bp, Homo sapiens
actctccccagtgcctgccac

SEQ ID NO: 1416343 - DNA, 20 bp, Homo sapiens
actctcccccaccccctccc

SEQ ID NO: 1416344 - DNA, 22 bp, Homo sapiens
actctccccgctcaggggcctg

SEQ ID NO: 1416345 - DNA, 12 bp, Homo sapiens
actctcctcctc

SEQ ID NO: 1416346 - DNA, 20 bp, Homo sapiens
actctcctcggccccctcca

SEQ ID NO: 1416347 - DNA, 19 bp, Homo sapiens
actctcggggcccttgggg

SEQ ID NO: 1416348 - DNA, 18 bp, Homo sapiens
actctcgtgcatttcaac

SEQ ID NO: 1416349 - DNA, 18 bp, Homo sapiens
actctctaaatcttcctt

SEQ ID NO: 1416350 - DNA, 23 bp, Homo sapiens
actctctaaatcttccttgtgag

SEQ ID NO: 1416351 - DNA, 13 bp, Homo sapiens
actctctccaccc

SEQ ID NO: 1416352 - DNA, 12 bp, Homo sapiens
actctctgctct

SEQ ID NO: 1416353 - DNA, 15 bp, Homo sapiens
actctctgctctagc

SEQ ID NO: 1416354 - DNA, 17 bp, Homo sapiens
actctctgctctagcca

SEQ ID NO: 1416355 - DNA, 20 bp, Homo sapiens
actctctgctctagccagga

SEQ ID NO: 1416356 - DNA, 23 bp, Homo sapiens
actctctgctctagccaggagtc

SEQ ID NO: 1416357 - DNA, 13 bp, Homo sapiens
actctctgggact

SEQ ID NO: 1416358 - DNA, 13 bp, Homo sapiens
actctgaaaaaca

SEQ ID NO: 1416359 - DNA, 21 bp, Homo sapiens
actctgaagggcatcatgcat

SEQ ID NO: 1416360 - DNA, 18 bp, Homo sapiens
actctgaatttatctttg

SEQ ID NO: 1416361 - DNA, 19 bp, Homo sapiens
actctgaatttatctttga

SEQ ID NO: 1416362 - DNA, 21 bp, Homo sapiens
actctgacaagggctgacctg

SEQ ID NO: 1416363 - DNA, 17 bp, Homo sapiens
actctgagcccaggccg

SEQ ID NO: 1416364 - DNA, 13 bp, Homo sapiens
actctgagcccat

SEQ ID NO: 1416365 - DNA, 13 bp, Homo sapiens
actctgaggaagt

SEQ ID NO: 1416366 - DNA, 22 bp, Homo sapiens
actctgagtttaccatttgtaa

SEQ ID NO: 1416367 - DNA, 13 bp, Homo sapiens
actctgcacatgt

SEQ ID NO: 1416368 - DNA, 18 bp, Homo sapiens
actctgcacatgtcttgt

SEQ ID NO: 1416369 - DNA, 23 bp, Homo sapiens
actctgcactactcctctgcagt

SEQ ID NO: 1416370 - DNA, 18 bp, Homo sapiens
actctgcactccatggcc

SEQ ID NO: 1416371 - DNA, 11 bp, Homo sapiens
actctgccctc

SEQ ID NO: 1416372 - DNA, 14 bp, Homo sapiens
actctgcctctgcc

SEQ ID NO: 1416373 - DNA, 16 bp, Homo sapiens
actctgcctttatgat

SEQ ID NO: 1416374 - DNA, 19 bp, Homo sapiens
actctgcctttatgatgct

SEQ ID NO: 1416375 - DNA, 15 bp, Homo sapiens
actctgctatttctc

SEQ ID NO: 1416376 - DNA, 21 bp, Homo sapiens
actctgcttctctgacttctg

SEQ ID NO: 1416377 - DNA, 18 bp, Homo sapiens
actctgcttgatttttgc

SEQ ID NO: 1416378 - DNA, 23 bp, Homo sapiens
actctggagcaacctactgtcta

SEQ ID NO: 1416379 - DNA, 14 bp, Homo sapiens
actctggaggtcat

SEQ ID NO: 1416380 - DNA, 12 bp, Homo sapiens
actctggccctg

SEQ ID NO: 1416381 - DNA, 14 bp, Homo sapiens
actctggccctggc

SEQ ID NO: 1416382 - DNA, 17 bp, Homo sapiens
actctgggctgctaccc

SEQ ID NO: 1416383 - DNA, 23 bp, Homo sapiens
actctgggctgtaacgtggcact

SEQ ID NO: 1416384 - DNA, 13 bp, Homo sapiens
actctgtaattgc

SEQ ID NO: 1416385 - DNA, 14 bp, Homo sapiens
actctgtcagatgg

SEQ ID NO: 1416386 - DNA, 14 bp, Homo sapiens
actctgtccaggcc

SEQ ID NO: 1416387 - DNA, 15 bp, Homo sapiens
actctgtccaggcca

SEQ ID NO: 1416388 - DNA, 19 bp, Homo sapiens
actctgtccaggccactgt

SEQ ID NO: 1416389 - DNA, 21 bp, Homo sapiens
actctgtccaggccactgtgg

SEQ ID NO: 1416390 - DNA, 14 bp, Homo sapiens
actctgtcttaaat

SEQ ID NO: 1416391 - DNA, 16 bp, Homo sapiens
actctgtgcaggtgct

SEQ ID NO: 1416392 - DNA, 14 bp, Homo sapiens
actctgtgtaatct

SEQ ID NO: 1416393 - DNA, 15 bp, Homo sapiens
actctgttatttaga

SEQ ID NO: 1416394 - DNA, 17 bp, Homo sapiens
actctgttccttcacat

SEQ ID NO: 1416395 - DNA, 19 bp, Homo sapiens
actcttaggaagagaaacc

SEQ ID NO: 1416396 - DNA, 19 bp, Homo sapiens
actcttcagaacacacaga

SEQ ID NO: 1416397 - DNA, 16 bp, Homo sapiens
actcttcagagaaatc

SEQ ID NO: 1416398 - DNA, 20 bp, Homo sapiens
actcttcagtgactcctgct

SEQ ID NO: 1416399 - DNA, 21 bp, Homo sapiens
actcttcagtgactcctgctg

SEQ ID NO: 1416400 - DNA, 23 bp, Homo sapiens
actcttcagtgactcctgctggt

SEQ ID NO: 1416401 - DNA, 18 bp, Homo sapiens
actcttcagttaattctt

SEQ ID NO: 1416402 - DNA, 17 bp, Homo sapiens
actcttccctctcgctc

SEQ ID NO: 1416403 - DNA, 22 bp, Homo sapiens
actcttcctatttttgtagtga

SEQ ID NO: 1416404 - DNA, 19 bp, Homo sapiens
actcttcttaacttaaatt

SEQ ID NO: 1416405 - DNA, 16 bp, Homo sapiens
actcttcttgaaattt

SEQ ID NO: 1416406 - DNA, 21 bp, Homo sapiens
actcttgaagtccaggactgg

SEQ ID NO: 1416407 - DNA, 22 bp, Homo sapiens
actcttgcacagtcactgctct

SEQ ID NO: 1416408 - DNA, 14 bp, Homo sapiens
actcttgcctgttt

SEQ ID NO: 1416409 - DNA, 18 bp, Homo sapiens
actcttgcctgtttccca

SEQ ID NO: 1416410 - DNA, 15 bp, Homo sapiens
actcttgcggcaagc

SEQ ID NO: 1416411 - DNA, 19 bp, Homo sapiens
actcttggctattgaagat

SEQ ID NO: 1416412 - DNA, 20 bp, Homo sapiens
actcttggtcagcttttgtt

SEQ ID NO: 1416413 - DNA, 21 bp, Homo sapiens
actcttgtttgctttgaaaat

SEQ ID NO: 1416414 - DNA, 21 bp, Homo sapiens
actctttctattgttaaacaa

SEQ ID NO: 1416415 - DNA, 14 bp, Homo sapiens
acctctggactggc

SEQ ID NO: 1416416 - DNA, 20 bp, Homo sapiens
acctctggctagagccgagg

SEQ ID NO: 1416417 - DNA, 23 bp, Homo sapiens
acctctggtggctcctcctagga

SEQ ID NO: 1416418 - DNA, 15 bp, Homo sapiens
acctctgtaggcagc

SEQ ID NO: 1416419 - DNA, 12 bp, Homo sapiens
acctctgtgtgc

SEQ ID NO: 1416420 - DNA, 15 bp, Homo sapiens
acctctgtgtgctcc

SEQ ID NO: 1416421 - DNA, 16 bp, Homo sapiens
acctcttagagtcctt

SEQ ID NO: 1416422 - DNA, 11 bp, Homo sapiens
acctcttccac

SEQ ID NO: 1416423 - DNA, 22 bp, Homo sapiens
acctcttccccagaaaggagac

SEQ ID NO: 1416424 - DNA, 23 bp, Homo sapiens
acctcttccccagaaaggagact

SEQ ID NO: 1416425 - DNA, 17 bp, Homo sapiens
acctcttccctctgggc

SEQ ID NO: 1416426 - DNA, 20 bp, Homo sapiens
acctcttccctctgggcctg

SEQ ID NO: 1416427 - DNA, 16 bp, Homo sapiens
acctcttcctctggtt

SEQ ID NO: 1416428 - DNA, 14 bp, Homo sapiens
acctcttctatgca

SEQ ID NO: 1416429 - DNA, 15 bp, Homo sapiens
acctcttctattgct

SEQ ID NO: 1416430 - DNA, 16 bp, Homo sapiens
acctcttctggctcaa

SEQ ID NO: 1416431 - DNA, 21 bp, Homo sapiens
acctgaaataatatatttctt

SEQ ID NO: 1416432 - DNA, 22 bp, Homo sapiens
acctgaaattccaaagtctcta

SEQ ID NO: 1416433 - DNA, 12 bp, Homo sapiens
acctgaacagga

SEQ ID NO: 1416434 - DNA, 16 bp, Homo sapiens
acctgaaccccagagg

SEQ ID NO: 1416435 - DNA, 20 bp, Homo sapiens
acctgaaggtcccctggcag

SEQ ID NO: 1416436 - DNA, 19 bp, Homo sapiens
acctgaatgcttctgagag

SEQ ID NO: 1416437 - DNA, 20 bp, Homo sapiens
acctgaatgcttctgagagc

SEQ ID NO: 1416438 - DNA, 15 bp, Homo sapiens
acctgacacaagagg

SEQ ID NO: 1416439 - DNA, 16 bp, Homo sapiens
acctgacacaagagga

SEQ ID NO: 1416440 - DNA, 20 bp, Homo sapiens
acctgacaccgtccctcagt

SEQ ID NO: 1416441 - DNA, 12 bp, Homo sapiens
acctgacagatg

SEQ ID NO: 1416442 - DNA, 17 bp, Homo sapiens
acctgacccctgctcag

SEQ ID NO: 1416443 - DNA, 13 bp, Homo sapiens
acctgactctgaa

SEQ ID NO: 1416444 - DNA, 14 bp, Homo sapiens
acctgactctgaaa

SEQ ID NO: 1416445 - DNA, 23 bp, Homo sapiens
acctgagaccagttgggagcact

SEQ ID NO: 1416446 - DNA, 18 bp, Homo sapiens
acctgagaccctactgaa

SEQ ID NO: 1416447 - DNA, 22 bp, Homo sapiens
acctgagctaaataaagatatt

SEQ ID NO: 1416448 - DNA, 14 bp, Homo sapiens
acctgaggataact

SEQ ID NO: 1416449 - DNA, 21 bp, Homo sapiens
acctgaggccaggacgtctgg

SEQ ID NO: 1416450 - DNA, 14 bp, Homo sapiens
acctgaggctgtgg

SEQ ID NO: 1416451 - DNA, 19 bp, Homo sapiens
acctgaggtcaggagttca

SEQ ID NO: 1416452 - DNA, 13 bp, Homo sapiens
acctgaggtgggc

SEQ ID NO: 1416453 - DNA, 14 bp, Homo sapiens
acctgaggtgggcc

SEQ ID NO: 1416454 - DNA, 16 bp, Homo sapiens
acctgaggtgggccca

SEQ ID NO: 1416455 - DNA, 21 bp, Homo sapiens
acctgaggtgggctggggctg

SEQ ID NO: 1416456 - DNA, 15 bp, Homo sapiens
acctgagtatttttt

SEQ ID NO: 1416457 - DNA, 22 bp, Homo sapiens
acctgagtcaccctacctgtgc

SEQ ID NO: 1416458 - DNA, 21 bp, Homo sapiens
acctgagtcggccccacatgg

SEQ ID NO: 1416459 - DNA, 21 bp, Homo sapiens
acctgatgttaaaattccatc

SEQ ID NO: 1416460 - DNA, 20 bp, Homo sapiens
acctgattgatcacacagtg

SEQ ID NO: 1416461 - DNA, 21 bp, Homo sapiens
acctgattgatcacacagtgt

SEQ ID NO: 1416462 - DNA, 14 bp, Homo sapiens
acctgattgtattt

SEQ ID NO: 1416463 - DNA, 16 bp, Homo sapiens
acctgatttattgaaa

SEQ ID NO: 1416464 - DNA, 21 bp, Homo sapiens
acctgatttattgaaattttt

SEQ ID NO: 1416465 - DNA, 15 bp, Homo sapiens
acctgcaaaaatgag

SEQ ID NO: 1416466 - DNA, 16 bp, Homo sapiens
acctgcaaaaatgagt

SEQ ID NO: 1416467 - DNA, 19 bp, Homo sapiens
acctgcaaaaatgagttgt

SEQ ID NO: 1416468 - DNA, 22 bp, Homo sapiens
acctgcaaagatctgtcctcag

SEQ ID NO: 1416469 - DNA, 15 bp, Homo sapiens
acctgcaagcagaac

SEQ ID NO: 1416470 - DNA, 14 bp, Homo sapiens
acctgcaagcccca

SEQ ID NO: 1416471 - DNA, 15 bp, Homo sapiens
acctgcaagccccag

SEQ ID NO: 1416472 - DNA, 17 bp, Homo sapiens
acctgcaagccccaggg

SEQ ID NO: 1416473 - DNA, 19 bp, Homo sapiens
acctgcaagccccagggcc

SEQ ID NO: 1416474 - DNA, 20 bp, Homo sapiens
acctgcaagccccagggcct

SEQ ID NO: 1416475 - DNA, 21 bp, Homo sapiens
acctgcaagccccagggcctg

SEQ ID NO: 1416476 - DNA, 13 bp, Homo sapiens
acctgcaagcctt

SEQ ID NO: 1416477 - DNA, 14 bp, Homo sapiens
acctgcacacagga

SEQ ID NO: 1416478 - DNA, 19 bp, Homo sapiens
acctgcacacaggacagcg

SEQ ID NO: 1416479 - DNA, 21 bp, Homo sapiens
acctgcacacaggacagcggg

SEQ ID NO: 1416480 - DNA, 14 bp, Homo sapiens
acctgcacctcccc

SEQ ID NO: 1416481 - DNA, 18 bp, Homo sapiens
acctgcacctccccccac

SEQ ID NO: 1416482 - DNA, 20 bp, Homo sapiens
acctgcacctccccccactg

SEQ ID NO: 1416483 - DNA, 15 bp, Homo sapiens
acctgcaggccaaga

SEQ ID NO: 1416484 - DNA, 19 bp, Homo sapiens
acctgcaggccaagagcag

SEQ ID NO: 1416485 - DNA, 13 bp, Homo sapiens
acctgcaggctcc

SEQ ID NO: 1416486 - DNA, 12 bp, Homo sapiens
acctcagcctgc

SEQ ID NO: 1416487 - DNA, 23 bp, Homo sapiens
acctcagcctgcacagtgtcccc

SEQ ID NO: 1416488 - DNA, 14 bp, Homo sapiens
acctcagcctggcc

SEQ ID NO: 1416489 - DNA, 15 bp, Homo sapiens
acctcagcctggcca

SEQ ID NO: 1416490 - DNA, 12 bp, Homo sapiens
acctcagcctgt

SEQ ID NO: 1416491 - DNA, 17 bp, Homo sapiens
acctcagcctgtgctgc

SEQ ID NO: 1416492 - DNA, 12 bp, Homo sapiens
acctcagctgca

SEQ ID NO: 1416493 - DNA, 18 bp, Homo sapiens
acctcagctgcacattcc

SEQ ID NO: 1416494 - DNA, 19 bp, Homo sapiens
acctcagctgcacattcct

SEQ ID NO: 1416495 - DNA, 20 bp, Homo sapiens
acctcagctgcacattcctg

SEQ ID NO: 1416496 - DNA, 20 bp, Homo sapiens
acctcaggccaggtgcagtg

SEQ ID NO: 1416497 - DNA, 12 bp, Homo sapiens
acctcagggctc

SEQ ID NO: 1416498 - DNA, 16 bp, Homo sapiens
acctcagggctcccag

SEQ ID NO: 1416499 - DNA, 18 bp, Homo sapiens
acctcaggtacggagaag

SEQ ID NO: 1416500 - DNA, 23 bp, Homo sapiens
acctcagtgccttcctgtttttc

SEQ ID NO: 1416501 - DNA, 16 bp, Homo sapiens
acctcagttaaactgt

SEQ ID NO: 1416502 - DNA, 17 bp, Homo sapiens
acctcagttaaactgtg

SEQ ID NO: 1416503 - DNA, 22 bp, Homo sapiens
acctcagttattacatgtaatt

SEQ ID NO: 1416504 - DNA, 19 bp, Homo sapiens
acctcagttcccttggcct

SEQ ID NO: 1416505 - DNA, 14 bp, Homo sapiens
acctcatcactgga

SEQ ID NO: 1416506 - DNA, 16 bp, Homo sapiens
acctcatcattaataa

SEQ ID NO: 1416507 - DNA, 22 bp, Homo sapiens
acctcatcattaataagtgaag

SEQ ID NO: 1416508 - DNA, 15 bp, Homo sapiens
acctcatgacagcca

SEQ ID NO: 1416509 - DNA, 20 bp, Homo sapiens
acctcatgacagccagagcc

SEQ ID NO: 1416510 - DNA, 21 bp, Homo sapiens
acctcatgacagccagagcct

SEQ ID NO: 1416511 - DNA, 22 bp, Homo sapiens
acctcatgacagccagagcctg

SEQ ID NO: 1416512 - DNA, 22 bp, Homo sapiens
acctcatgcccaccccctgccc

SEQ ID NO: 1416513 - DNA, 23 bp, Homo sapiens
acctcatgcccaccccctgccct

SEQ ID NO: 1416514 - DNA, 20 bp, Homo sapiens
acctcatgcccagctctctg

SEQ ID NO: 1416515 - DNA, 15 bp, Homo sapiens
acctcattgctacca

SEQ ID NO: 1416516 - DNA, 16 bp, Homo sapiens
acctcattgctaccac

SEQ ID NO: 1416517 - DNA, 22 bp, Homo sapiens
acctccaaccaaataagacttc

SEQ ID NO: 1416518 - DNA, 12 bp, Homo sapiens
acctccaagcat

SEQ ID NO: 1416519 - DNA, 20 bp, Homo sapiens
acctccacccccgccacggc

SEQ ID NO: 1416520 - DNA, 22 bp, Homo sapiens
acctccacccccgccacggcca

SEQ ID NO: 1416521 - DNA, 13 bp, Homo sapiens
acctccactccac

SEQ ID NO: 1416522 - DNA, 23 bp, Homo sapiens
acctccactccacatctgcatca

SEQ ID NO: 1416523 - DNA, 23 bp, Homo sapiens
acctccagcctccctgtctccag

SEQ ID NO: 1416524 - DNA, 13 bp, Homo sapiens
acctccagcctga

SEQ ID NO: 1416525 - DNA, 14 bp, Homo sapiens
acctccaggcctgt

SEQ ID NO: 1416526 - DNA, 22 bp, Homo sapiens
acctccagtgagtacctgcaaa

SEQ ID NO: 1416527 - DNA, 22 bp, Homo sapiens
acctccatactcaagctgtctc

SEQ ID NO: 1416528 - DNA, 23 bp, Homo sapiens
acctccatactcaagctgtctct

SEQ ID NO: 1416529 - DNA, 17 bp, Homo sapiens
acctcccaccccactcc

SEQ ID NO: 1416530 - DNA, 18 bp, Homo sapiens
acctcccaccccactcca

SEQ ID NO: 1416531 - DNA, 20 bp, Homo sapiens
acctcccaccccactccagc

SEQ ID NO: 1416532 - DNA, 22 bp, Homo sapiens
acctcccaccccactccagccc

SEQ ID NO: 1416533 - DNA, 15 bp, Homo sapiens
acctcccactcctgc

SEQ ID NO: 1416534 - DNA, 21 bp, Homo sapiens
acctccccagcattccagccc

SEQ ID NO: 1416535 - DNA, 23 bp, Homo sapiens
acctccccagcattccagcccct

SEQ ID NO: 1416536 - DNA, 15 bp, Homo sapiens
acctccccccactgc

SEQ ID NO: 1416537 - DNA, 16 bp, Homo sapiens
acctccccccactgca

SEQ ID NO: 1416538 - DNA, 11 bp, Homo sapiens
acctccccctt

SEQ ID NO: 1416539 - DNA, 21 bp, Homo sapiens
acctccccctttcacactgga

SEQ ID NO: 1416540 - DNA, 20 bp, Homo sapiens
acctccccgctctccctgtc

SEQ ID NO: 1416541 - DNA, 21 bp, Homo sapiens
acctccccgctctccctgtca

SEQ ID NO: 1416542 - DNA, 17 bp, Homo sapiens
acctcccctatccaccc

SEQ ID NO: 1416543 - DNA, 23 bp, Homo sapiens
acctcccctatccacccagccca

SEQ ID NO: 1416544 - DNA, 14 bp, Homo sapiens
acctccctactccc

SEQ ID NO: 1416545 - DNA, 20 bp, Homo sapiens
acctccctgaaccatccctg

SEQ ID NO: 1416546 - DNA, 13 bp, Homo sapiens
acctccctgaccc

SEQ ID NO: 1416547 - DNA, 20 bp, Homo sapiens
acctcccttaagcagcaaca

SEQ ID NO: 1416548 - DNA, 21 bp, Homo sapiens
actggggagcccgtctcagtg

SEQ ID NO: 1416549 - DNA, 22 bp, Homo sapiens
actggggagggctgcagtcaca

SEQ ID NO: 1416550 - DNA, 15 bp, Homo sapiens
actggggagtctttg

SEQ ID NO: 1416551 - DNA, 15 bp, Homo sapiens
actggggcatcctgt

SEQ ID NO: 1416552 - DNA, 20 bp, Homo sapiens
actggggtcctggggcctcg

SEQ ID NO: 1416553 - DNA, 17 bp, Homo sapiens
actgggtaatttataaa

SEQ ID NO: 1416554 - DNA, 20 bp, Homo sapiens
actgggtgactggaggcctc

SEQ ID NO: 1416555 - DNA, 13 bp, Homo sapiens
actgggtgagaga

SEQ ID NO: 1416556 - DNA, 22 bp, Homo sapiens
actgggtggggtgaggaccact

SEQ ID NO: 1416557 - DNA, 22 bp, Homo sapiens
actgggtggtggcctggtccct

SEQ ID NO: 1416558 - DNA, 15 bp, Homo sapiens
actgggttaaatatt

SEQ ID NO: 1416559 - DNA, 21 bp, Homo sapiens
actgggttcttgttttatata

SEQ ID NO: 1416560 - DNA, 22 bp, Homo sapiens
actgggttcttgttttatatac

SEQ ID NO: 1416561 - DNA, 21 bp, Homo sapiens
actgggtttggaccccagctg

SEQ ID NO: 1416562 - DNA, 18 bp, Homo sapiens
actgggtttgtttttcaa

SEQ ID NO: 1416563 - DNA, 19 bp, Homo sapiens
actggtaagcgatttgaaa

SEQ ID NO: 1416564 - DNA, 15 bp, Homo sapiens
actggtaggaccaag

SEQ ID NO: 1416565 - DNA, 16 bp, Homo sapiens
actggtattctgttct

SEQ ID NO: 1416566 - DNA, 14 bp, Homo sapiens
actggtattttatc

SEQ ID NO: 1416567 - DNA, 15 bp, Homo sapiens
actggtccagctctg

SEQ ID NO: 1416568 - DNA, 17 bp, Homo sapiens
actggtccagctctgac

SEQ ID NO: 1416569 - DNA, 23 bp, Homo sapiens
actggtccagctctgacatccct

SEQ ID NO: 1416570 - DNA, 17 bp, Homo sapiens
actggtctcaggccaag

SEQ ID NO: 1416571 - DNA, 18 bp, Homo sapiens
actggtctcgaactcctg

SEQ ID NO: 1416572 - DNA, 21 bp, Homo sapiens
actggtctcgaactcctggcc

SEQ ID NO: 1416573 - DNA, 23 bp, Homo sapiens
actggtctgcttaaagcttccct

SEQ ID NO: 1416574 - DNA, 15 bp, Homo sapiens
actggtctgtaggga

SEQ ID NO: 1416575 - DNA, 22 bp, Homo sapiens
actggtgaactgagctgggcag

SEQ ID NO: 1416576 - DNA, 23 bp, Homo sapiens
actggtgatgcctaattatgaat

SEQ ID NO: 1416577 - DNA, 19 bp, Homo sapiens
actggtgcgaccccccacc

SEQ ID NO: 1416578 - DNA, 20 bp, Homo sapiens
actggtgcgaccccccaccc

SEQ ID NO: 1416579 - DNA, 11 bp, Homo sapiens
actggttaaac

SEQ ID NO: 1416580 - DNA, 23 bp, Homo sapiens
actggttatagttgatatgtaac

SEQ ID NO: 1416581 - DNA, 14 bp, Homo sapiens
actggttgctgtgt

SEQ ID NO: 1416582 - DNA, 22 bp, Homo sapiens
actggtttatccacccacaaca

SEQ ID NO: 1416583 - DNA, 13 bp, Homo sapiens
actggtttgcagt

SEQ ID NO: 1416584 - DNA, 16 bp, Homo sapiens
actgtaaaatgaaatt

SEQ ID NO: 1416585 - DNA, 12 bp, Homo sapiens
actgtaaaatgc

SEQ ID NO: 1416586 - DNA, 15 bp, Homo sapiens
actgtaaaatgcaaa

SEQ ID NO: 1416587 - DNA, 15 bp, Homo sapiens
actgtaacattcagg

SEQ ID NO: 1416588 - DNA, 16 bp, Homo sapiens
actgtaacctgattca

SEQ ID NO: 1416589 - DNA, 13 bp, Homo sapiens
actgtaagggatt

SEQ ID NO: 1416590 - DNA, 22 bp, Homo sapiens
actgtaatacgtagctctctta

SEQ ID NO: 1416591 - DNA, 17 bp, Homo sapiens
actgtaatcttaaaagt

SEQ ID NO: 1416592 - DNA, 15 bp, Homo sapiens
actgtacaaagtaga

SEQ ID NO: 1416593 - DNA, 22 bp, Homo sapiens
actgtacaaagtagaagtctta

SEQ ID NO: 1416594 - DNA, 14 bp, Homo sapiens
actgtacatttaaa

SEQ ID NO: 1416595 - DNA, 22 bp, Homo sapiens
actgtacatttaaaattgctat

SEQ ID NO: 1416596 - DNA, 19 bp, Homo sapiens
actgtaccatggtttgata

SEQ ID NO: 1416597 - DNA, 15 bp, Homo sapiens
actgtactcctccca

SEQ ID NO: 1416598 - DNA, 14 bp, Homo sapiens
actgtactgcatgt

SEQ ID NO: 1416599 - DNA, 12 bp, Homo sapiens
actgtactgtgt

SEQ ID NO: 1416600 - DNA, 15 bp, Homo sapiens
actgtacttcactgt

SEQ ID NO: 1416601 - DNA, 16 bp, Homo sapiens
actgtacttcactgtc

SEQ ID NO: 1416602 - DNA, 14 bp, Homo sapiens
actgtactttgcca

SEQ ID NO: 1416603 - DNA, 16 bp, Homo sapiens
actgtactttgccatt

SEQ ID NO: 1416604 - DNA, 15 bp, Homo sapiens
actgtagaaatgatg

SEQ ID NO: 1416605 - DNA, 16 bp, Homo sapiens
actgtagattgcttct

SEQ ID NO: 1416606 - DNA, 13 bp, Homo sapiens
actgtagggaggg

SEQ ID NO: 1416607 - DNA, 18 bp, Homo sapiens
actgtaggttatttaaaa

SEQ ID NO: 1416608 - DNA, 16 bp, Homo sapiens
actgtagttctaagac

SEQ ID NO: 1416609 - DNA, 19 bp, Homo sapiens
actgtagtttagttctgtt

SEQ ID NO: 1416610 - DNA, 16 bp, Homo sapiens
actgtagtttttgaaa

SEQ ID NO: 1416611 - DNA, 18 bp, Homo sapiens
actgtagtttttgaaaat

SEQ ID NO: 1416612 - DNA, 19 bp, Homo sapiens
actgtagtttttgaaaatt

SEQ ID NO: 1416613 - DNA, 20 bp, Homo sapiens
actgtagtttttgaaaatta

SEQ ID NO: 1416614 - DNA, 22 bp, Homo sapiens
actgtagtttttgaaaattatg

SEQ ID NO: 1416615 - DNA, 19 bp, Homo sapiens
actgtatatgtattccctt

SEQ ID NO: 1416616 - DNA, 14 bp, Homo sapiens
actgtatattcagg

SEQ ID NO: 1416617 - DNA, 16 bp, Homo sapiens
actgtatcattttctt

SEQ ID NO: 1416618 - DNA, 18 bp, Homo sapiens
actgtatctaaaaaataa

SEQ ID NO: 1416619 - DNA, 21 bp, Homo sapiens
actgtatctaaaaaataactg

SEQ ID NO: 1416620 - DNA, 13 bp, Homo sapiens
actgtatctgtgt

SEQ ID NO: 1416621 - DNA, 13 bp, Homo sapiens
actgtatgctgga

SEQ ID NO: 1416622 - DNA, 22 bp, Homo sapiens
actgtattagagcgccagctcc

SEQ ID NO: 1416623 - DNA, 17 bp, Homo sapiens
actgtatttttttaact

SEQ ID NO: 1416624 - DNA, 12 bp, Homo sapiens
actgtcaataaa

SEQ ID NO: 1416625 - DNA, 17 bp, Homo sapiens
actgtcaataaacagct

SEQ ID NO: 1416626 - DNA, 21 bp, Homo sapiens
actgtcaataaacagcttcat

SEQ ID NO: 1416627 - DNA, 21 bp, Homo sapiens
actgtcagctcccctcggaga

SEQ ID NO: 1416628 - DNA, 23 bp, Homo sapiens
actgtcagctcccctcggagaag

SEQ ID NO: 1416629 - DNA, 22 bp, Homo sapiens
actgtcagctgagcttgagctc

SEQ ID NO: 1416630 - DNA, 14 bp, Homo sapiens
actgtcaggaatgg

SEQ ID NO: 1416631 - DNA, 21 bp, Homo sapiens
actgtcatcctcaaagaaagt

SEQ ID NO: 1416632 - DNA, 15 bp, Homo sapiens
actgtcatgcttcat

SEQ ID NO: 1416633 - DNA, 13 bp, Homo sapiens
actgtcattgccc

SEQ ID NO: 1416634 - DNA, 16 bp, Homo sapiens
actgtcattgcccctc

SEQ ID NO: 1416635 - DNA, 14 bp, Homo sapiens
actgtccaggagct

SEQ ID NO: 1416636 - DNA, 23 bp, Homo sapiens
actgtccaggagctaatctgacc

SEQ ID NO: 1416637 - DNA, 16 bp, Homo sapiens
actgtcccacaaaata

SEQ ID NO: 1416638 - DNA, 23 bp, Homo sapiens
actgtcccacaaaatatttctaa

SEQ ID NO: 1416639 - DNA, 15 bp, Homo sapiens
actgtccctctcagt

SEQ ID NO: 1416640 - DNA, 21 bp, Homo sapiens
actgtccctctcagtgccttc

SEQ ID NO: 1416641 - DNA, 12 bp, Homo sapiens
actgtcctgagg

SEQ ID NO: 1416642 - DNA, 16 bp, Homo sapiens
actgtcctgggcctgc

SEQ ID NO: 1416643 - DNA, 13 bp, Homo sapiens
actgtcctgggcg

SEQ ID NO: 1416644 - DNA, 18 bp, Homo sapiens
actgtcctgggcgccctg

SEQ ID NO: 1416645 - DNA, 19 bp, Homo sapiens
actgtcctgggcgccctgg

SEQ ID NO: 1416646 - DNA, 20 bp, Homo sapiens
actgtcctgggcgccctgga

SEQ ID NO: 1416647 - DNA, 12 bp, Homo sapiens
actgtcctgtcc

SEQ ID NO: 1416648 - DNA, 13 bp, Homo sapiens
actgtcctgtcct

SEQ ID NO: 1416649 - DNA, 20 bp, Homo sapiens
actgtctatatcataactat

SEQ ID NO: 1416650 - DNA, 17 bp, Homo sapiens
actgtctattaaaattc

SEQ ID NO: 1416651 - DNA, 19 bp, Homo sapiens
actgtctgaatattctaga

SEQ ID NO: 1416652 - DNA, 20 bp, Homo sapiens
actgtctgaatattctagaa

SEQ ID NO: 1416653 - DNA, 13 bp, Homo sapiens
actgtctgggatt

SEQ ID NO: 1416654 - DNA, 23 bp, Homo sapiens
actgtcttcccgatgagggaagg

SEQ ID NO: 1416655 - DNA, 14 bp, Homo sapiens
actgtcttcctcaa

SEQ ID NO: 1416656 - DNA, 18 bp, Homo sapiens
actgtctttaaaagagag

SEQ ID NO: 1416657 - DNA, 19 bp, Homo sapiens
actgtctttattcttatta

SEQ ID NO: 1416658 - DNA, 15 bp, Homo sapiens
actgtgaaaatagtg

SEQ ID NO: 1416659 - DNA, 20 bp, Homo sapiens
actgtgaaaatagtgtaaga

SEQ ID NO: 1416660 - DNA, 13 bp, Homo sapiens
accagaagggaaa

SEQ ID NO: 1416661 - DNA, 16 bp, Homo sapiens
accagaattcccttga

SEQ ID NO: 1416662 - DNA, 14 bp, Homo sapiens
accagacacccagg

SEQ ID NO: 1416663 - DNA, 15 bp, Homo sapiens
accagacacccagga

SEQ ID NO: 1416664 - DNA, 16 bp, Homo sapiens
accagacacccaggac

SEQ ID NO: 1416665 - DNA, 17 bp, Homo sapiens
accagacacccaggact

SEQ ID NO: 1416666 - DNA, 19 bp, Homo sapiens
accagagagagcaaggaag

SEQ ID NO: 1416667 - DNA, 15 bp, Homo sapiens
accagagagagttgt

SEQ ID NO: 1416668 - DNA, 14 bp, Homo sapiens
accagagccgggag

SEQ ID NO: 1416669 - DNA, 16 bp, Homo sapiens
accagagccttcaagt

SEQ ID NO: 1416670 - DNA, 17 bp, Homo sapiens
accagagccttcaagtg

SEQ ID NO: 1416671 - DNA, 21 bp, Homo sapiens
accagagccttcaagtgccaa

SEQ ID NO: 1416672 - DNA, 23 bp, Homo sapiens
accagagccttcaagtgccaaac

SEQ ID NO: 1416673 - DNA, 15 bp, Homo sapiens
accagagctgtctga

SEQ ID NO: 1416674 - DNA, 16 bp, Homo sapiens
accagaggaagcccct

SEQ ID NO: 1416675 - DNA, 23 bp, Homo sapiens
accagaggccgaaggtgcctcag

SEQ ID NO: 1416676 - DNA, 21 bp, Homo sapiens
accagataagaatgctggttt

SEQ ID NO: 1416677 - DNA, 20 bp, Homo sapiens
accagatgaaataatgttct

SEQ ID NO: 1416678 - DNA, 22 bp, Homo sapiens
accagatgcgtcccaagatgtt

SEQ ID NO: 1416679 - DNA, 19 bp, Homo sapiens
accagcaacatctcgagcc

SEQ ID NO: 1416680 - DNA, 23 bp, Homo sapiens
accagcaacatctcgagccccct

SEQ ID NO: 1416681 - DNA, 13 bp, Homo sapiens
accagcacatcca

SEQ ID NO: 1416682 - DNA, 19 bp, Homo sapiens
accagcagacagagccagg

SEQ ID NO: 1416683 - DNA, 14 bp, Homo sapiens
accagcagcactgg

SEQ ID NO: 1416684 - DNA, 21 bp, Homo sapiens
accagcaggcaggtggactga

SEQ ID NO: 1416685 - DNA, 13 bp, Homo sapiens
accagcaggtgtg

SEQ ID NO: 1416686 - DNA, 22 bp, Homo sapiens
accagcaggtgtggtggctcat

SEQ ID NO: 1416687 - DNA, 18 bp, Homo sapiens
accagcagtctgcctgga

SEQ ID NO: 1416688 - DNA, 16 bp, Homo sapiens
accagcatcacctgcc

SEQ ID NO: 1416689 - DNA, 19 bp, Homo sapiens
accagcatcacctgcctgt

SEQ ID NO: 1416690 - DNA, 23 bp, Homo sapiens
accagcattccctacagcctagg

SEQ ID NO: 1416691 - DNA, 16 bp, Homo sapiens
accagccagcctcaga

SEQ ID NO: 1416692 - DNA, 20 bp, Homo sapiens
accagccccactgccagcag

SEQ ID NO: 1416693 - DNA, 23 bp, Homo sapiens
accagccccactgccagcagcag

SEQ ID NO: 1416694 - DNA, 19 bp, Homo sapiens
accagccccctggatgggc

SEQ ID NO: 1416695 - DNA, 19 bp, Homo sapiens
accagcccgacagtgccat

SEQ ID NO: 1416696 - DNA, 21 bp, Homo sapiens
accagcccggcctgctcccag

SEQ ID NO: 1416697 - DNA, 13 bp, Homo sapiens
accagccgctgca

SEQ ID NO: 1416698 - DNA, 18 bp, Homo sapiens
accagcctacaagctggc

SEQ ID NO: 1416699 - DNA, 21 bp, Homo sapiens
accagcctcctgtttgcaggc

SEQ ID NO: 1416700 - DNA, 20 bp, Homo sapiens
accagcctgaccaacatggt

SEQ ID NO: 1416701 - DNA, 15 bp, Homo sapiens
accagcctggccaac

SEQ ID NO: 1416702 - DNA, 16 bp, Homo sapiens
accagcctttctccca

SEQ ID NO: 1416703 - DNA, 22 bp, Homo sapiens
accagcctttgggtcctgggca

SEQ ID NO: 1416704 - DNA, 24 bp, Homo sapiens
accagcctttgggtcctgggcagg

SEQ ID NO: 1416705 - DNA, 20 bp, Homo sapiens
accagcgccaaatgttcatc

SEQ ID NO: 1416706 - DNA, 14 bp, Homo sapiens
accagcgcccccag

SEQ ID NO: 1416707 - DNA, 17 bp, Homo sapiens
accagcgcccgctgggc

SEQ ID NO: 1416708 - DNA, 18 bp, Homo sapiens
accagcgcccgctgggct

SEQ ID NO: 1416709 - DNA, 23 bp, Homo sapiens
accagcgcccgctgggctgagcc

SEQ ID NO: 1416710 - DNA, 16 bp, Homo sapiens
accagcggctgctcaa

SEQ ID NO: 1416711 - DNA, 23 bp, Homo sapiens
accagctcaggacagatgccaca

SEQ ID NO: 1416712 - DNA, 13 bp, Homo sapiens
accagctcccagg

SEQ ID NO: 1416713 - DNA, 12 bp, Homo sapiens
accagctctctt

SEQ ID NO: 1416714 - DNA, 15 bp, Homo sapiens
accagctctcttcct

SEQ ID NO: 1416715 - DNA, 17 bp, Homo sapiens
accagctctcttcctgt

SEQ ID NO: 1416716 - DNA, 17 bp, Homo sapiens
accagctctgtggcctg

SEQ ID NO: 1416717 - DNA, 22 bp, Homo sapiens
accagctgctccgaggacccag

SEQ ID NO: 1416718 - DNA, 16 bp, Homo sapiens
accagctgctctgccc

SEQ ID NO: 1416719 - DNA, 17 bp, Homo sapiens
accagctgctctgcccc

SEQ ID NO: 1416720 - DNA, 21 bp, Homo sapiens
accagctgctgtgccccacca

SEQ ID NO: 1416721 - DNA, 10 bp, Homo sapiens
accagctggg

SEQ ID NO: 1416722 - DNA, 11 bp, Homo sapiens
accagctgggg

SEQ ID NO: 1416723 - DNA, 23 bp, Homo sapiens
accagctggggcgtggggagggc

SEQ ID NO: 1416724 - DNA, 14 bp, Homo sapiens
accaggaaaggctt

SEQ ID NO: 1416725 - DNA, 18 bp, Homo sapiens
accaggaaaggcttggct

SEQ ID NO: 1416726 - DNA, 12 bp, Homo sapiens
accaggaagccg

SEQ ID NO: 1416727 - DNA, 20 bp, Homo sapiens
accaggaatgttaaagtcag

SEQ ID NO: 1416728 - DNA, 14 bp, Homo sapiens
accaggacaggacc

SEQ ID NO: 1416729 - DNA, 15 bp, Homo sapiens
accaggacaggacca

SEQ ID NO: 1416730 - DNA, 21 bp, Homo sapiens
accaggactccctcctcacct

SEQ ID NO: 1416731 - DNA, 14 bp, Homo sapiens
accaggagaaccac

SEQ ID NO: 1416732 - DNA, 21 bp, Homo sapiens
accaggagaagggctggggcc

SEQ ID NO: 1416733 - DNA, 11 bp, Homo sapiens
accaggagaca

SEQ ID NO: 1416734 - DNA, 13 bp, Homo sapiens
accaggagcagca

SEQ ID NO: 1416735 - DNA, 15 bp, Homo sapiens
accaggagcagcagc

SEQ ID NO: 1416736 - DNA, 19 bp, Homo sapiens
accaggagcagcagccagc

SEQ ID NO: 1416737 - DNA, 20 bp, Homo sapiens
accaggagctgatggcagct

SEQ ID NO: 1416738 - DNA, 17 bp, Homo sapiens
accaggagtccctggta

SEQ ID NO: 1416739 - DNA, 14 bp, Homo sapiens
accaggatttattt

SEQ ID NO: 1416740 - DNA, 14 bp, Homo sapiens
accaggcaacctcc

SEQ ID NO: 1416741 - DNA, 20 bp, Homo sapiens
accaggcacgaacccacctg

SEQ ID NO: 1416742 - DNA, 21 bp, Homo sapiens
accaggcacgaacccacctgc

SEQ ID NO: 1416743 - DNA, 15 bp, Homo sapiens
accaggccattctgc

SEQ ID NO: 1416744 - DNA, 19 bp, Homo sapiens
accaggccgtcctcccggg

SEQ ID NO: 1416745 - DNA, 12 bp, Homo sapiens
accaggcctggc

SEQ ID NO: 1416746 - DNA, 15 bp, Homo sapiens
accaggcctggcctc

SEQ ID NO: 1416747 - DNA, 17 bp, Homo sapiens
accaggcctggcctctg

SEQ ID NO: 1416748 - DNA, 20 bp, Homo sapiens
accaggcctggcctctgggc

SEQ ID NO: 1416749 - DNA, 17 bp, Homo sapiens
accaggctgcagcctcc

SEQ ID NO: 1416750 - DNA, 18 bp, Homo sapiens
accaggctgcagcctcca

SEQ ID NO: 1416751 - DNA, 20 bp, Homo sapiens
accaggctgcagcctccact

SEQ ID NO: 1416752 - DNA, 19 bp, Homo sapiens
accaggctggcgcagccaa

SEQ ID NO: 1416753 - DNA, 20 bp, Homo sapiens
accaggctggcgcagccaag

SEQ ID NO: 1416754 - DNA, 21 bp, Homo sapiens
accagggatgctgggctgggc

SEQ ID NO: 1416755 - DNA, 22 bp, Homo sapiens
accagggatgctgggctgggcc

SEQ ID NO: 1416756 - DNA, 10 bp, Homo sapiens
accagggcaa

SEQ ID NO: 1416757 - DNA, 14 bp, Homo sapiens
accagggccaccgc

SEQ ID NO: 1416758 - DNA, 18 bp, Homo sapiens
accaggggaaggaaggag

SEQ ID NO: 1416759 - DNA, 23 bp, Homo sapiens
accaggggaaggaaggagggcac

SEQ ID NO: 1416760 - DNA, 19 bp, Homo sapiens
accaggggaggagcctgtg

SEQ ID NO: 1416761 - DNA, 21 bp, Homo sapiens
accaggggtgctcacctctgc

SEQ ID NO: 1416762 - DNA, 17 bp, Homo sapiens
accaggggtttctcgca

SEQ ID NO: 1416763 - DNA, 23 bp, Homo sapiens
accagggtccgcaccagctgctc

SEQ ID NO: 1416764 - DNA, 16 bp, Homo sapiens
accaggtatcaaatca

SEQ ID NO: 1416765 - DNA, 14 bp, Homo sapiens
accaggtcctgctc

SEQ ID NO: 1416766 - DNA, 23 bp, Homo sapiens
accaggtcctgctccgctgcctg

SEQ ID NO: 1416767 - DNA, 20 bp, Homo sapiens
accaggtcctttctcctgat

SEQ ID NO: 1416768 - DNA, 14 bp, Homo sapiens
accagtatttagaa

SEQ ID NO: 1416769 - DNA, 18 bp, Homo sapiens
accagtatttagaagcca

SEQ ID NO: 1416770 - DNA, 15 bp, Homo sapiens
accagtcagggacag

SEQ ID NO: 1416771 - DNA, 21 bp, Homo sapiens
accagtctatttccactgaac

SEQ ID NO: 1416772 - DNA, 14 bp, Homo sapiens
accagtctctcaag

SEQ ID NO: 1416773 - DNA, 17 bp, Homo sapiens
accagtctctcaagtga

SEQ ID NO: 1416774 - DNA, 14 bp, Homo sapiens
accagtctgtctac

SEQ ID NO: 1416775 - DNA, 15 bp, Homo sapiens
accagtgaaagaagc

SEQ ID NO: 1416776 - DNA, 18 bp, Homo sapiens
accaagttgtgcttttct

SEQ ID NO: 1416777 - DNA, 17 bp, Homo sapiens
accaataaatttgtaac

SEQ ID NO: 1416778 - DNA, 24 bp, Homo sapiens
accaataacaaggagctcaccctg

SEQ ID NO: 1416779 - DNA, 17 bp, Homo sapiens
accaatagcctgaattt

SEQ ID NO: 1416780 - DNA, 23 bp, Homo sapiens
accaatagggctgagctctctgt

SEQ ID NO: 1416781 - DNA, 20 bp, Homo sapiens
accaatcattttaattatta

SEQ ID NO: 1416782 - DNA, 16 bp, Homo sapiens
accaatgaaaacatgt

SEQ ID NO: 1416783 - DNA, 17 bp, Homo sapiens
accaatgaaaacatgta

SEQ ID NO: 1416784 - DNA, 13 bp, Homo sapiens
accaatgagcctt

SEQ ID NO: 1416785 - DNA, 15 bp, Homo sapiens
accaatgccttttta

SEQ ID NO: 1416786 - DNA, 22 bp, Homo sapiens
accaatgcctttttagatgtat

SEQ ID NO: 1416787 - DNA, 20 bp, Homo sapiens
accaattacccataaacagc

SEQ ID NO: 1416788 - DNA, 16 bp, Homo sapiens
accaattgtgctgcca

SEQ ID NO: 1416789 - DNA, 22 bp, Homo sapiens
accaatttggtaaaaatgctgc

SEQ ID NO: 1416790 - DNA, 18 bp, Homo sapiens
accacaaacggagcccct

SEQ ID NO: 1416791 - DNA, 14 bp, Homo sapiens
accacaaatgcata

SEQ ID NO: 1416792 - DNA, 14 bp, Homo sapiens
accacaagactctt

SEQ ID NO: 1416793 - DNA, 16 bp, Homo sapiens
accacaccagcctcct

SEQ ID NO: 1416794 - DNA, 18 bp, Homo sapiens
accacaccagcctcctgg

SEQ ID NO: 1416795 - DNA, 21 bp, Homo sapiens
accacacccggctaatttttt

SEQ ID NO: 1416796 - DNA, 13 bp, Homo sapiens
accacaccctgta

SEQ ID NO: 1416797 - DNA, 17 bp, Homo sapiens
accacaccctgtactgt

SEQ ID NO: 1416798 - DNA, 15 bp, Homo sapiens
accacacctccctga

SEQ ID NO: 1416799 - DNA, 16 bp, Homo sapiens
accacacctccctgaa

SEQ ID NO: 1416800 - DNA, 22 bp, Homo sapiens
accacacctccctgaaccatcc

SEQ ID NO: 1416801 - DNA, 17 bp, Homo sapiens
accacaccttggccttc

SEQ ID NO: 1416802 - DNA, 23 bp, Homo sapiens
accacagaatacggaagagcagg

SEQ ID NO: 1416803 - DNA, 13 bp, Homo sapiens
accacagacacac

SEQ ID NO: 1416804 - DNA, 18 bp, Homo sapiens
accacagacacacacacg

SEQ ID NO: 1416805 - DNA, 13 bp, Homo sapiens
accacagacttgc

SEQ ID NO: 1416806 - DNA, 14 bp, Homo sapiens
accacagcaggatc

SEQ ID NO: 1416807 - DNA, 23 bp, Homo sapiens
accacagcatcgggagcacccag

SEQ ID NO: 1416808 - DNA, 18 bp, Homo sapiens
accacagcccgctctctg

SEQ ID NO: 1416809 - DNA, 12 bp, Homo sapiens
accacagctgct

SEQ ID NO: 1416810 - DNA, 14 bp, Homo sapiens
accacagctgggca

SEQ ID NO: 1416811 - DNA, 20 bp, Homo sapiens
accacagctgggcagggtga

SEQ ID NO: 1416812 - DNA, 23 bp, Homo sapiens
accacaggcatctacacagcctg

SEQ ID NO: 1416813 - DNA, 16 bp, Homo sapiens
accacaggcttgttac

SEQ ID NO: 1416814 - DNA, 22 bp, Homo sapiens
accacagggttcaaaatgtctg

SEQ ID NO: 1416815 - DNA, 22 bp, Homo sapiens
accacagtcagtggagcctggg

SEQ ID NO: 1416816 - DNA, 13 bp, Homo sapiens
accacagtgtctg

SEQ ID NO: 1416817 - DNA, 19 bp, Homo sapiens
accacatagcatgcttcct

SEQ ID NO: 1416818 - DNA, 17 bp, Homo sapiens
accacatcaaataagaa

SEQ ID NO: 1416819 - DNA, 14 bp, Homo sapiens
accacatctgctct

SEQ ID NO: 1416820 - DNA, 15 bp, Homo sapiens
accacatctgctcta

SEQ ID NO: 1416821 - DNA, 19 bp, Homo sapiens
accacatctgctctaggga

SEQ ID NO: 1416822 - DNA, 16 bp, Homo sapiens
accaccaagccaaggg

SEQ ID NO: 1416823 - DNA, 14 bp, Homo sapiens
accaccactggcca

SEQ ID NO: 1416824 - DNA, 12 bp, Homo sapiens
accaccaggagc

SEQ ID NO: 1416825 - DNA, 23 bp, Homo sapiens
accaccaggagcagcagccagca

SEQ ID NO: 1416826 - DNA, 20 bp, Homo sapiens
accaccctagtcccttcccc

SEQ ID NO: 1416827 - DNA, 11 bp, Homo sapiens
accaccctccc

SEQ ID NO: 1416828 - DNA, 13 bp, Homo sapiens
accaccctcccct

SEQ ID NO: 1416829 - DNA, 14 bp, Homo sapiens
accaccctcccctc

SEQ ID NO: 1416830 - DNA, 18 bp, Homo sapiens
accaccctcccctctctt

SEQ ID NO: 1416831 - DNA, 13 bp, Homo sapiens
accaccctgagcc

SEQ ID NO: 1416832 - DNA, 14 bp, Homo sapiens
accaccctgagccg

SEQ ID NO: 1416833 - DNA, 21 bp, Homo sapiens
accaccctgagccggccccag

SEQ ID NO: 1416834 - DNA, 21 bp, Homo sapiens
accaccgcgcccagccttttt

SEQ ID NO: 1416835 - DNA, 14 bp, Homo sapiens
accaccggccccct

SEQ ID NO: 1416836 - DNA, 17 bp, Homo sapiens
accaccgtctgtctcag

SEQ ID NO: 1416837 - DNA, 17 bp, Homo sapiens
accacctaggccactcc

SEQ ID NO: 1416838 - DNA, 21 bp, Homo sapiens
accacctaggccactcctcca

SEQ ID NO: 1416839 - DNA, 15 bp, Homo sapiens
accacctcagaaagg

SEQ ID NO: 1416840 - DNA, 12 bp, Homo sapiens
accaccttgcca

SEQ ID NO: 1416841 - DNA, 20 bp, Homo sapiens
accaccttgccaatggtgta

SEQ ID NO: 1416842 - DNA, 20 bp, Homo sapiens
accacctttactgtgcttat

SEQ ID NO: 1416843 - DNA, 18 bp, Homo sapiens
accacctttggctggtag

SEQ ID NO: 1416844 - DNA, 24 bp, Homo sapiens
accacgactggccagggccacgct

SEQ ID NO: 1416845 - DNA, 16 bp, Homo sapiens
accacgatgtggccct

SEQ ID NO: 1416846 - DNA, 18 bp, Homo sapiens
accacgatgtggccctgg

SEQ ID NO: 1416847 - DNA, 20 bp, Homo sapiens
accacgatgtggccctggcc

SEQ ID NO: 1416848 - DNA, 22 bp, Homo sapiens
accacgatgtggccctggcctg

SEQ ID NO: 1416849 - DNA, 21 bp, Homo sapiens
accacgcccgtcctgcctgtg

SEQ ID NO: 1416850 - DNA, 20 bp, Homo sapiens
accacggacgtttccatcag

SEQ ID NO: 1416851 - DNA, 21 bp, Homo sapiens
accacggacgtttccatcagg

SEQ ID NO: 1416852 - DNA, 20 bp, Homo sapiens
accacggccggctaattttt

SEQ ID NO: 1416853 - DNA, 14 bp, Homo sapiens
accacgtccagctg

SEQ ID NO: 1416854 - DNA, 13 bp, Homo sapiens
accacgtctgcca

SEQ ID NO: 1416855 - DNA, 16 bp, Homo sapiens
accacgtctgccaggc

SEQ ID NO: 1416856 - DNA, 22 bp, Homo sapiens
accacgtctgccaggcccatct

SEQ ID NO: 1416857 - DNA, 23 bp, Homo sapiens
accacgtctgccaggcccatctc

SEQ ID NO: 1416858 - DNA, 23 bp, Homo sapiens
accacgtctggctccctgcccct

SEQ ID NO: 1416859 - DNA, 13 bp, Homo sapiens
accacgtggggct

SEQ ID NO: 1416860 - DNA, 16 bp, Homo sapiens
accactaccagccagc

SEQ ID NO: 1416861 - DNA, 21 bp, Homo sapiens
accactatctccgttccatct

SEQ ID NO: 1416862 - DNA, 15 bp, Homo sapiens
accactatgaagcta

SEQ ID NO: 1416863 - DNA, 14 bp, Homo sapiens
accactatttaagt

SEQ ID NO: 1416864 - DNA, 16 bp, Homo sapiens
accactcctgtccctg

SEQ ID NO: 1416865 - DNA, 18 bp, Homo sapiens
accactcctgtccctgta

SEQ ID NO: 1416866 - DNA, 17 bp, Homo sapiens
accactgaaaaaatata

SEQ ID NO: 1416867 - DNA, 15 bp, Homo sapiens
accactgaattcact

SEQ ID NO: 1416868 - DNA, 16 bp, Homo sapiens
accactgaattcactc

SEQ ID NO: 1416869 - DNA, 17 bp, Homo sapiens
accactgaattcactcc

SEQ ID NO: 1416870 - DNA, 19 bp, Homo sapiens
accactgacgtttctgggc

SEQ ID NO: 1416871 - DNA, 18 bp, Homo sapiens
accactgcactccagcct

SEQ ID NO: 1416872 - DNA, 20 bp, Homo sapiens
accactgccattacccagtg

SEQ ID NO: 1416873 - DNA, 13 bp, Homo sapiens
accactgccctgc

SEQ ID NO: 1416874 - DNA, 14 bp, Homo sapiens
accactgccctgcc

SEQ ID NO: 1416875 - DNA, 16 bp, Homo sapiens
accactgccctgcctg

SEQ ID NO: 1416876 - DNA, 15 bp, Homo sapiens
accactgcttctctt

SEQ ID NO: 1416877 - DNA, 16 bp, Homo sapiens
accactgcttctcttt

SEQ ID NO: 1416878 - DNA, 19 bp, Homo sapiens
accactggccaccaggctg

SEQ ID NO: 1416879 - DNA, 23 bp, Homo sapiens
accactgggtacaagagatggga

SEQ ID NO: 1416880 - DNA, 16 bp, Homo sapiens
accactggttaaaata

SEQ ID NO: 1416881 - DNA, 20 bp, Homo sapiens
accactgtaaaatgaaatta

SEQ ID NO: 1416882 - DNA, 16 bp, Homo sapiens
accactgtaattgaca

SEQ ID NO: 1416883 - DNA, 21 bp, Homo sapiens
accactgtctgtccctgaact

SEQ ID NO: 1416884 - DNA, 14 bp, Homo sapiens
accactgtgccact

SEQ ID NO: 1416885 - DNA, 18 bp, Homo sapiens
accactgtgccactgact

SEQ ID NO: 1416886 - DNA, 15 bp, Homo sapiens
accacttcagggctt

SEQ ID NO: 1416887 - DNA, 15 bp, Homo sapiens
accacttcctgaggc

SEQ ID NO: 1416888 - DNA, 16 bp, Homo sapiens
accacttgaggcctga

SEQ ID NO: 1416889 - DNA, 14 bp, Homo sapiens
accagaaaagcaat

SEQ ID NO: 1416890 - DNA, 21 bp, Homo sapiens
accagaaacacccctctgtct

SEQ ID NO: 1416891 - DNA, 16 bp, Homo sapiens
accagaaatcaaaaag

SEQ ID NO: 1416892 - DNA, 14 bp, Homo sapiens
acatttctggattg

SEQ ID NO: 1416893 - DNA, 12 bp, Homo sapiens
acatttctgttc

SEQ ID NO: 1416894 - DNA, 13 bp, Homo sapiens
acatttctttctt

SEQ ID NO: 1416895 - DNA, 21 bp, Homo sapiens
acatttctttcttgctggctc

SEQ ID NO: 1416896 - DNA, 22 bp, Homo sapiens
acatttctttcttgctggctct

SEQ ID NO: 1416897 - DNA, 19 bp, Homo sapiens
acatttctttgtgctttgg

SEQ ID NO: 1416898 - DNA, 20 bp, Homo sapiens
acatttgagggcccagccag

SEQ ID NO: 1416899 - DNA, 11 bp, Homo sapiens
acatttgatat

SEQ ID NO: 1416900 - DNA, 14 bp, Homo sapiens
acatttgatatttt

SEQ ID NO: 1416901 - DNA, 13 bp, Homo sapiens
acatttgatgtac

SEQ ID NO: 1416902 - DNA, 16 bp, Homo sapiens
acatttgatgtacatg

SEQ ID NO: 1416903 - DNA, 17 bp, Homo sapiens
acatttgctactgttgt

SEQ ID NO: 1416904 - DNA, 22 bp, Homo sapiens
acatttgctgttttaaacatta

SEQ ID NO: 1416905 - DNA, 14 bp, Homo sapiens
acatttggagaggg

SEQ ID NO: 1416906 - DNA, 20 bp, Homo sapiens
acatttgggagtttttatga

SEQ ID NO: 1416907 - DNA, 21 bp, Homo sapiens
acatttgggagtttttatgag

SEQ ID NO: 1416908 - DNA, 13 bp, Homo sapiens
acatttgggctca

SEQ ID NO: 1416909 - DNA, 16 bp, Homo sapiens
acatttgtaagtgtaa

SEQ ID NO: 1416910 - DNA, 23 bp, Homo sapiens
acatttgtaagtgtaaaaaatgt

SEQ ID NO: 1416911 - DNA, 15 bp, Homo sapiens
acatttgtcacagaa

SEQ ID NO: 1416912 - DNA, 18 bp, Homo sapiens
acatttgtcacagaaatc

SEQ ID NO: 1416913 - DNA, 14 bp, Homo sapiens
acatttgtcactga

SEQ ID NO: 1416914 - DNA, 22 bp, Homo sapiens
acatttgtgctccattttttct

SEQ ID NO: 1416915 - DNA, 20 bp, Homo sapiens
acatttgtgtaatatgaaat

SEQ ID NO: 1416916 - DNA, 20 bp, Homo sapiens
acattttatatttttgtaca

SEQ ID NO: 1416917 - DNA, 21 bp, Homo sapiens
acattttatatttttgtacat

SEQ ID NO: 1416918 - DNA, 18 bp, Homo sapiens
acattttatcattaaaaa

SEQ ID NO: 1416919 - DNA, 17 bp, Homo sapiens
acattttattaaacaca

SEQ ID NO: 1416920 - DNA, 14 bp, Homo sapiens
acattttctaaata

SEQ ID NO: 1416921 - DNA, 22 bp, Homo sapiens
acattttctctcgttaattttc

SEQ ID NO: 1416922 - DNA, 16 bp, Homo sapiens
acattttctcttagaa

SEQ ID NO: 1416923 - DNA, 12 bp, Homo sapiens
acattttgtatg

SEQ ID NO: 1416924 - DNA, 22 bp, Homo sapiens
acattttgtatggagttaaata

SEQ ID NO: 1416925 - DNA, 18 bp, Homo sapiens
acattttgtggctgttga

SEQ ID NO: 1416926 - DNA, 17 bp, Homo sapiens
acattttgtgtgagact

SEQ ID NO: 1416927 - DNA, 21 bp, Homo sapiens
acattttgttatagaatactt

SEQ ID NO: 1416928 - DNA, 20 bp, Homo sapiens
acattttttaagaaaacatt

SEQ ID NO: 1416929 - DNA, 14 bp, Homo sapiens
acattttttaagct

SEQ ID NO: 1416930 - DNA, 13 bp, Homo sapiens
acattttttcttc

SEQ ID NO: 1416931 - DNA, 12 bp, Homo sapiens
accaaaacatgt

SEQ ID NO: 1416932 - DNA, 13 bp, Homo sapiens
accaaaactgctc

SEQ ID NO: 1416933 - DNA, 12 bp, Homo sapiens
accaaaactgtg

SEQ ID NO: 1416934 - DNA, 17 bp, Homo sapiens
accaaaagaatttgcac

SEQ ID NO: 1416935 - DNA, 13 bp, Homo sapiens
accaaaagggagg

SEQ ID NO: 1416936 - DNA, 18 bp, Homo sapiens
accaaaagttattaaaat

SEQ ID NO: 1416937 - DNA, 12 bp, Homo sapiens
accaaaatgaca

SEQ ID NO: 1416938 - DNA, 14 bp, Homo sapiens
accaaaattttaaa

SEQ ID NO: 1416939 - DNA, 18 bp, Homo sapiens
accaaaccctataaacct

SEQ ID NO: 1416940 - DNA, 20 bp, Homo sapiens
accaaaccgcaaacgtgaaa

SEQ ID NO: 1416941 - DNA, 23 bp, Homo sapiens
accaaaccgcaaacgtgaaattc

SEQ ID NO: 1416942 - DNA, 13 bp, Homo sapiens
accaaagacatca

SEQ ID NO: 1416943 - DNA, 19 bp, Homo sapiens
accaaagactatttcaaaa

SEQ ID NO: 1416944 - DNA, 19 bp, Homo sapiens
accaaagcaaagaaaataa

SEQ ID NO: 1416945 - DNA, 13 bp, Homo sapiens
accaaagctgccc

SEQ ID NO: 1416946 - DNA, 19 bp, Homo sapiens
accaaagctgcccactgtt

SEQ ID NO: 1416947 - DNA, 15 bp, Homo sapiens
accaaaggaaggaac

SEQ ID NO: 1416948 - DNA, 16 bp, Homo sapiens
accaaaggaaggaagc

SEQ ID NO: 1416949 - DNA, 20 bp, Homo sapiens
accaaagggaagtgaggccc

SEQ ID NO: 1416950 - DNA, 21 bp, Homo sapiens
accaaagggaagtgaggccca

SEQ ID NO: 1416951 - DNA, 21 bp, Homo sapiens
accaaagtgtcttttgacatt

SEQ ID NO: 1416952 - DNA, 11 bp, Homo sapiens
accaaagttct

SEQ ID NO: 1416953 - DNA, 21 bp, Homo sapiens
accaaagttctaataatttct

SEQ ID NO: 1416954 - DNA, 23 bp, Homo sapiens
accaaagttctaataatttctaa

SEQ ID NO: 1416955 - DNA, 15 bp, Homo sapiens
accaaatacctcaat

SEQ ID NO: 1416956 - DNA, 16 bp, Homo sapiens
accaaatattaaagat

SEQ ID NO: 1416957 - DNA, 17 bp, Homo sapiens
accaaatattaaagatt

SEQ ID NO: 1416958 - DNA, 17 bp, Homo sapiens
accaaatctcagttgtt

SEQ ID NO: 1416959 - DNA, 15 bp, Homo sapiens
accaaattaaaaaaa

SEQ ID NO: 1416960 - DNA, 16 bp, Homo sapiens
accaaattagcaggtg

SEQ ID NO: 1416961 - DNA, 14 bp, Homo sapiens
accaaattccttgg

SEQ ID NO: 1416962 - DNA, 17 bp, Homo sapiens
accaaattgctttacag

SEQ ID NO: 1416963 - DNA, 13 bp, Homo sapiens
accaaatttgtac

SEQ ID NO: 1416964 - DNA, 22 bp, Homo sapiens
accaacaataaatatgtattac

SEQ ID NO: 1416965 - DNA, 23 bp, Homo sapiens
accaacaggctgttctgcactga

SEQ ID NO: 1416966 - DNA, 14 bp, Homo sapiens
accaacataaaaca

SEQ ID NO: 1416967 - DNA, 21 bp, Homo sapiens
accaacataaaacaaaaccaa

SEQ ID NO: 1416968 - DNA, 22 bp, Homo sapiens
accaacatcccattgccctggt

SEQ ID NO: 1416969 - DNA, 15 bp, Homo sapiens
accaacatggagaaa

SEQ ID NO: 1416970 - DNA, 16 bp, Homo sapiens
accaacatggagaaac

SEQ ID NO: 1416971 - DNA, 13 bp, Homo sapiens
accaacccctgac

SEQ ID NO: 1416972 - DNA, 19 bp, Homo sapiens
accaaccctggggaaggag

SEQ ID NO: 1416973 - DNA, 23 bp, Homo sapiens
accaacgggaccccctggccctg

SEQ ID NO: 1416974 - DNA, 16 bp, Homo sapiens
accaactacaaccaag

SEQ ID NO: 1416975 - DNA, 23 bp, Homo sapiens
accaactctgcactccatggcca

SEQ ID NO: 1416976 - DNA, 13 bp, Homo sapiens
accaactgcccta

SEQ ID NO: 1416977 - DNA, 14 bp, Homo sapiens
accaactgggccca

SEQ ID NO: 1416978 - DNA, 15 bp, Homo sapiens
accaagaaagctcac

SEQ ID NO: 1416979 - DNA, 20 bp, Homo sapiens
accaagagagaaagaagtag

SEQ ID NO: 1416980 - DNA, 16 bp, Homo sapiens
accaagatgggtggca

SEQ ID NO: 1416981 - DNA, 14 bp, Homo sapiens
accaagcatcttgg

SEQ ID NO: 1416982 - DNA, 23 bp, Homo sapiens
accaagccaagggaacctgtgtc

SEQ ID NO: 1416983 - DNA, 16 bp, Homo sapiens
accaagccaatgttat

SEQ ID NO: 1416984 - DNA, 15 bp, Homo sapiens
accaagccgtggctt

SEQ ID NO: 1416985 - DNA, 18 bp, Homo sapiens
accaagccgtggcttccc

SEQ ID NO: 1416986 - DNA, 17 bp, Homo sapiens
accaagctcacagttcc

SEQ ID NO: 1416987 - DNA, 14 bp, Homo sapiens
accaagcttcagag

SEQ ID NO: 1416988 - DNA, 21 bp, Homo sapiens
accaagcttcagagcctagcc

SEQ ID NO: 1416989 - DNA, 23 bp, Homo sapiens
accaagcttcagagcctagccac

SEQ ID NO: 1416990 - DNA, 20 bp, Homo sapiens
accaaggaaacgctacctct

SEQ ID NO: 1416991 - DNA, 17 bp, Homo sapiens
accaaggaagcagcctc

SEQ ID NO: 1416992 - DNA, 19 bp, Homo sapiens
accaaggaatttaaaactg

SEQ ID NO: 1416993 - DNA, 15 bp, Homo sapiens
accaaggactgagca

SEQ ID NO: 1416994 - DNA, 17 bp, Homo sapiens
accaaggcaaggcaggt

SEQ ID NO: 1416995 - DNA, 19 bp, Homo sapiens
accaaggcaaggcaggtgc

SEQ ID NO: 1416996 - DNA, 12 bp, Homo sapiens
accaaggcagcc

SEQ ID NO: 1416997 - DNA, 21 bp, Homo sapiens
accaaggcagcctccagagcc

SEQ ID NO: 1416998 - DNA, 23 bp, Homo sapiens
accaaggctgagacagtgaattt

SEQ ID NO: 1416999 - DNA, 15 bp, Homo sapiens
accaagggacaggag

SEQ ID NO: 1417000 - DNA, 23 bp, Homo sapiens
accaaggtaccgatttctgctaa

SEQ ID NO: 1417001 - DNA, 24 bp, Homo sapiens
accaagtaaaacaaaaccactggg

SEQ ID NO: 1417002 - DNA, 17 bp, Homo sapiens
accaagtcagacaccaa

SEQ ID NO: 1417003 - DNA, 15 bp, Homo sapiens
accaagtcctggcta

SEQ ID NO: 1417004 - DNA, 16 bp, Homo sapiens
accaagtgctggccca

SEQ ID NO: 1417005 - DNA, 16 bp, Homo sapiens
accaagtggaccttga

SEQ ID NO: 1417006 - DNA, 23 bp, Homo sapiens
accaagtggctgggtgccctctc

SEQ ID NO: 1417007 - DNA, 23 bp, Homo sapiens
accaagttataaatcaatgtcac

SEQ ID NO: 1417008 - DNA, 21 bp, Homo sapiens
acatgtttatgtaaacaaatc

SEQ ID NO: 1417009 - DNA, 23 bp, Homo sapiens
acatgtttatgtaaacaaatctt

SEQ ID NO: 1417010 - DNA, 16 bp, Homo sapiens
acatgtttcctctagt

SEQ ID NO: 1417011 - DNA, 17 bp, Homo sapiens
acatgtttctgttttgt

SEQ ID NO: 1417012 - DNA, 22 bp, Homo sapiens
acatgtttctgttttgttgttt

SEQ ID NO: 1417013 - DNA, 19 bp, Homo sapiens
acatgtttttatacaaaat

SEQ ID NO: 1417014 - DNA, 20 bp, Homo sapiens
acattaaaatatagagacag

SEQ ID NO: 1417015 - DNA, 19 bp, Homo sapiens
acattaaacactgtaatct

SEQ ID NO: 1417016 - DNA, 21 bp, Homo sapiens
acattaaaggcataaatgact

SEQ ID NO: 1417017 - DNA, 17 bp, Homo sapiens
acattaaatctatgaag

SEQ ID NO: 1417018 - DNA, 14 bp, Homo sapiens
acattaacaaataa

SEQ ID NO: 1417019 - DNA, 22 bp, Homo sapiens
acattaactccctccaccagcc

SEQ ID NO: 1417020 - DNA, 16 bp, Homo sapiens
acattaagtaaatgct

SEQ ID NO: 1417021 - DNA, 19 bp, Homo sapiens
acattaatagcagcctttc

SEQ ID NO: 1417022 - DNA, 16 bp, Homo sapiens
acattaatatttacca

SEQ ID NO: 1417023 - DNA, 13 bp, Homo sapiens
acattaattttgt

SEQ ID NO: 1417024 - DNA, 15 bp, Homo sapiens
acattaattttgtgc

SEQ ID NO: 1417025 - DNA, 16 bp, Homo sapiens
acattaattttgtgca

SEQ ID NO: 1417026 - DNA, 21 bp, Homo sapiens
acattaattttgtgcattctt

SEQ ID NO: 1417027 - DNA, 21 bp, Homo sapiens
acattagataaattactataa

SEQ ID NO: 1417028 - DNA, 22 bp, Homo sapiens
acattagataaattactataaa

SEQ ID NO: 1417029 - DNA, 13 bp, Homo sapiens
acattaggctgtt

SEQ ID NO: 1417030 - DNA, 22 bp, Homo sapiens
acattagtcgttatatttgact

SEQ ID NO: 1417031 - DNA, 18 bp, Homo sapiens
acattataacaactattt

SEQ ID NO: 1417032 - DNA, 21 bp, Homo sapiens
acattatctcacttagtcctt

SEQ ID NO: 1417033 - DNA, 12 bp, Homo sapiens
acattatttcta

SEQ ID NO: 1417034 - DNA, 13 bp, Homo sapiens
acattatttctag

SEQ ID NO: 1417035 - DNA, 16 bp, Homo sapiens
acattatttctagtcc

SEQ ID NO: 1417036 - DNA, 16 bp, Homo sapiens
acattatttcttccca

SEQ ID NO: 1417037 - DNA, 18 bp, Homo sapiens
acattatttcttcccaga

SEQ ID NO: 1417038 - DNA, 13 bp, Homo sapiens
acattcaaggcat

SEQ ID NO: 1417039 - DNA, 20 bp, Homo sapiens
acattcacacagggctcttt

SEQ ID NO: 1417040 - DNA, 15 bp, Homo sapiens
acattcagattatat

SEQ ID NO: 1417041 - DNA, 17 bp, Homo sapiens
acattcagctctggaga

SEQ ID NO: 1417042 - DNA, 18 bp, Homo sapiens
acattcagctctggagaa

SEQ ID NO: 1417043 - DNA, 17 bp, Homo sapiens
acattccacagctgccc

SEQ ID NO: 1417044 - DNA, 19 bp, Homo sapiens
acattcctaactagaatta

SEQ ID NO: 1417045 - DNA, 20 bp, Homo sapiens
acattcctaagagtggagga

SEQ ID NO: 1417046 - DNA, 23 bp, Homo sapiens
acattcctaagagtggaggagga

SEQ ID NO: 1417047 - DNA, 15 bp, Homo sapiens
acattcctcagctgc

SEQ ID NO: 1417048 - DNA, 16 bp, Homo sapiens
acattcctcagctgcc

SEQ ID NO: 1417049 - DNA, 17 bp, Homo sapiens
acattcctcagctgcca

SEQ ID NO: 1417050 - DNA, 22 bp, Homo sapiens
acattcctcagctgccaagcac

SEQ ID NO: 1417051 - DNA, 19 bp, Homo sapiens
acattcctcatgaatgtaa

SEQ ID NO: 1417052 - DNA, 22 bp, Homo sapiens
acattcctcatgaatgtaaatt

SEQ ID NO: 1417053 - DNA, 15 bp, Homo sapiens
acattcctgcattca

SEQ ID NO: 1417054 - DNA, 16 bp, Homo sapiens
acattcgatctcattc

SEQ ID NO: 1417055 - DNA, 19 bp, Homo sapiens
acattcgatctcattcagt

SEQ ID NO: 1417056 - DNA, 21 bp, Homo sapiens
acattcgatctcattcagtat

SEQ ID NO: 1417057 - DNA, 15 bp, Homo sapiens
acattcgtgagctgg

SEQ ID NO: 1417058 - DNA, 17 bp, Homo sapiens
acattctagctgagaag

SEQ ID NO: 1417059 - DNA, 14 bp, Homo sapiens
acattctctttgat

SEQ ID NO: 1417060 - DNA, 22 bp, Homo sapiens
acattctctttgataacaaaaa

SEQ ID NO: 1417061 - DNA, 12 bp, Homo sapiens
acattctgcttt

SEQ ID NO: 1417062 - DNA, 15 bp, Homo sapiens
acattcttccatcat

SEQ ID NO: 1417063 - DNA, 22 bp, Homo sapiens
acattcttccatcatcactgta

SEQ ID NO: 1417064 - DNA, 18 bp, Homo sapiens
acattgaccaagaactgc

SEQ ID NO: 1417065 - DNA, 15 bp, Homo sapiens
acattgagcatttga

SEQ ID NO: 1417066 - DNA, 21 bp, Homo sapiens
acattgatgtaaggactgtaa

SEQ ID NO: 1417067 - DNA, 22 bp, Homo sapiens
acattgatgtaaggactgtaaa

SEQ ID NO: 1417068 - DNA, 18 bp, Homo sapiens
acattgcctgttctgctt

SEQ ID NO: 1417069 - DNA, 20 bp, Homo sapiens
acattgcctgttctgcttcg

SEQ ID NO: 1417070 - DNA, 15 bp, Homo sapiens
acattgctctatgtc

SEQ ID NO: 1417071 - DNA, 14 bp, Homo sapiens
acattgctctctgg

SEQ ID NO: 1417072 - DNA, 18 bp, Homo sapiens
acattgctgatgtagtat

SEQ ID NO: 1417073 - DNA, 13 bp, Homo sapiens
acattgctggctg

SEQ ID NO: 1417074 - DNA, 15 bp, Homo sapiens
acattgctggctgcc

SEQ ID NO: 1417075 - DNA, 13 bp, Homo sapiens
acattgctgtatt

SEQ ID NO: 1417076 - DNA, 17 bp, Homo sapiens
acattggaatgttctca

SEQ ID NO: 1417077 - DNA, 16 bp, Homo sapiens
acattggtaagaatga

SEQ ID NO: 1417078 - DNA, 19 bp, Homo sapiens
acattggtgaaggatccag

SEQ ID NO: 1417079 - DNA, 22 bp, Homo sapiens
acattggtgaaggatccaggaa

SEQ ID NO: 1417080 - DNA, 19 bp, Homo sapiens
acattgtaaatagtatttg

SEQ ID NO: 1417081 - DNA, 15 bp, Homo sapiens
acattgtactgttgc

SEQ ID NO: 1417082 - DNA, 17 bp, Homo sapiens
acattgtcatttatata

SEQ ID NO: 1417083 - DNA, 12 bp, Homo sapiens
acattgtctgcg

SEQ ID NO: 1417084 - DNA, 16 bp, Homo sapiens
acattgtcttgatgtt

SEQ ID NO: 1417085 - DNA, 16 bp, Homo sapiens
acattgtgactgtgtt

SEQ ID NO: 1417086 - DNA, 17 bp, Homo sapiens
acattgttcttattctg

SEQ ID NO: 1417087 - DNA, 14 bp, Homo sapiens
acattgttgttttt

SEQ ID NO: 1417088 - DNA, 18 bp, Homo sapiens
acattgtttgctgctatt

SEQ ID NO: 1417089 - DNA, 13 bp, Homo sapiens
acattgttttaaa

SEQ ID NO: 1417090 - DNA, 16 bp, Homo sapiens
acattgttttaaaaag

SEQ ID NO: 1417091 - DNA, 17 bp, Homo sapiens
acattgttttaaaaaga

SEQ ID NO: 1417092 - DNA, 10 bp, Homo sapiens
acatttaaaa

SEQ ID NO: 1417093 - DNA, 17 bp, Homo sapiens
acatttaaaattgctat

SEQ ID NO: 1417094 - DNA, 12 bp, Homo sapiens
acatttaaatgt

SEQ ID NO: 1417095 - DNA, 17 bp, Homo sapiens
acatttaaatgtaactt

SEQ ID NO: 1417096 - DNA, 13 bp, Homo sapiens
acatttaataaaa

SEQ ID NO: 1417097 - DNA, 13 bp, Homo sapiens
acatttaatacag

SEQ ID NO: 1417098 - DNA, 17 bp, Homo sapiens
acatttaatacagataa

SEQ ID NO: 1417099 - DNA, 16 bp, Homo sapiens
acatttaatacagcag

SEQ ID NO: 1417100 - DNA, 17 bp, Homo sapiens
acatttaatacagcagt

SEQ ID NO: 1417101 - DNA, 21 bp, Homo sapiens
acatttacatgtattatttca

SEQ ID NO: 1417102 - DNA, 14 bp, Homo sapiens
acatttactgacca

SEQ ID NO: 1417103 - DNA, 13 bp, Homo sapiens
acatttagaactt

SEQ ID NO: 1417104 - DNA, 14 bp, Homo sapiens
acatttagaacttt

SEQ ID NO: 1417105 - DNA, 15 bp, Homo sapiens
acatttagaagaaag

SEQ ID NO: 1417106 - DNA, 21 bp, Homo sapiens
acatttagagaactgtggccg

SEQ ID NO: 1417107 - DNA, 20 bp, Homo sapiens
acatttataatgtttgctat

SEQ ID NO: 1417108 - DNA, 16 bp, Homo sapiens
acatttatatatatat

SEQ ID NO: 1417109 - DNA, 18 bp, Homo sapiens
acatttatatatatatgt

SEQ ID NO: 1417110 - DNA, 19 bp, Homo sapiens
acatttatatatatatgta

SEQ ID NO: 1417111 - DNA, 12 bp, Homo sapiens
acatttatgacc

SEQ ID NO: 1417112 - DNA, 18 bp, Homo sapiens
acatttatttatccagaa

SEQ ID NO: 1417113 - DNA, 16 bp, Homo sapiens
acatttcaaagctgag

SEQ ID NO: 1417114 - DNA, 16 bp, Homo sapiens
acatttcaccatggcc

SEQ ID NO: 1417115 - DNA, 20 bp, Homo sapiens
acatttcaccatggccccct

SEQ ID NO: 1417116 - DNA, 20 bp, Homo sapiens
acatttcacctactttgtaa

SEQ ID NO: 1417117 - DNA, 24 bp, Homo sapiens
acatttcacctactttgtaagtga

SEQ ID NO: 1417118 - DNA, 13 bp, Homo sapiens
acatttcccaggg

SEQ ID NO: 1417119 - DNA, 13 bp, Homo sapiens
acatttctaaaat

SEQ ID NO: 1417120 - DNA, 15 bp, Homo sapiens
acatttctataaata

SEQ ID NO: 1417121 - DNA, 21 bp, Homo sapiens
acatttctctaactcctgcca

SEQ ID NO: 1417122 - DNA, 23 bp, Homo sapiens
acatttctctaactcctgccatt

SEQ ID NO: 1417123 - DNA, 14 bp, Homo sapiens
acatttctctccac

SEQ ID NO: 1417124 - DNA, 15 bp, Homo sapiens
acatttctggacagt

SEQ ID NO: 1417125 - DNA, 16 bp, Homo sapiens
acatgttactgaccag

SEQ ID NO: 1417126 - DNA, 15 bp, Homo sapiens
acatgttattcaatg

SEQ ID NO: 1417127 - DNA, 15 bp, Homo sapiens
acatgttctttgtac

SEQ ID NO: 1417128 - DNA, 20 bp, Homo sapiens
acatgtttaaatagcctaaa

SEQ ID NO: 1417129 - DNA, 13 bp, Homo sapiens
acatgtttataaa

SEQ ID NO: 1417130 - DNA, 14 bp, Homo sapiens
acatgtttatgtaa

SEQ ID NO: 1417131 - DNA, 17 bp, Homo sapiens
acaggaggcggcccggc

SEQ ID NO: 1417132 - DNA, 17 bp, Homo sapiens
acaggaggttgtggatg

SEQ ID NO: 1417133 - DNA, 20 bp, Homo sapiens
acaggagtcttcagacccag

SEQ ID NO: 1417134 - DNA, 23 bp, Homo sapiens
acaggatctataggcagcttcta

SEQ ID NO: 1417135 - DNA, 17 bp, Homo sapiens
acaggatgaaagttccc

SEQ ID NO: 1417136 - DNA, 16 bp, Homo sapiens
acaggatgaggacaga

SEQ ID NO: 1417137 - DNA, 19 bp, Homo sapiens
acaggatggggttctggaa

SEQ ID NO: 1417138 - DNA, 17 bp, Homo sapiens
acaggatggtgggcagg

SEQ ID NO: 1417139 - DNA, 14 bp, Homo sapiens
acaggattattgga

SEQ ID NO: 1417140 - DNA, 16 bp, Homo sapiens
acaggcaaagttttac

SEQ ID NO: 1417141 - DNA, 18 bp, Homo sapiens
acaggcaactgaggcaga

SEQ ID NO: 1417142 - DNA, 14 bp, Homo sapiens
acaggcaccgagaa

SEQ ID NO: 1417143 - DNA, 20 bp, Homo sapiens
acaggcaccgagaatgttgt

SEQ ID NO: 1417144 - DNA, 21 bp, Homo sapiens
acaggcaccgagaatgttgta

SEQ ID NO: 1417145 - DNA, 21 bp, Homo sapiens
acaggcactccaaacctgtct

SEQ ID NO: 1417146 - DNA, 17 bp, Homo sapiens
acaggcagcctcctttg

SEQ ID NO: 1417147 - DNA, 18 bp, Homo sapiens
acaggcagttaggtgctg

SEQ ID NO: 1417148 - DNA, 23 bp, Homo sapiens
acaggcagttaggtgctgaatga

SEQ ID NO: 1417149 - DNA, 13 bp, Homo sapiens
acaggcatcagga

SEQ ID NO: 1417150 - DNA, 18 bp, Homo sapiens
acaggcatctacacagcc

SEQ ID NO: 1417151 - DNA, 19 bp, Homo sapiens
acaggcatctacacagcct

SEQ ID NO: 1417152 - DNA, 12 bp, Homo sapiens
acaggcccagca

SEQ ID NO: 1417153 - DNA, 20 bp, Homo sapiens
acaggcccagcattgctggt

SEQ ID NO: 1417154 - DNA, 22 bp, Homo sapiens
acaggcccagcattgctggttc

SEQ ID NO: 1417155 - DNA, 24 bp, Homo sapiens
acaggccccccgcagcaccctgca

SEQ ID NO: 1417156 - DNA, 21 bp, Homo sapiens
acaggcccccttgagtggggt

SEQ ID NO: 1417157 - DNA, 21 bp, Homo sapiens
acaggccctccctgttcccca

SEQ ID NO: 1417158 - DNA, 13 bp, Homo sapiens
acaggcccttcct

SEQ ID NO: 1417159 - DNA, 23 bp, Homo sapiens
acaggcctctccatttgctcttc

SEQ ID NO: 1417160 - DNA, 14 bp, Homo sapiens
acaggcctctgcct

SEQ ID NO: 1417161 - DNA, 13 bp, Homo sapiens
acaggcgcctgcc

SEQ ID NO: 1417162 - DNA, 15 bp, Homo sapiens
acaggcggggcccag

SEQ ID NO: 1417163 - DNA, 18 bp, Homo sapiens
acaggctactctcctcgg

SEQ ID NO: 1417164 - DNA, 14 bp, Homo sapiens
acaggctgtaattc

SEQ ID NO: 1417165 - DNA, 23 bp, Homo sapiens
acaggctgtccttaacccacctc

SEQ ID NO: 1417166 - DNA, 21 bp, Homo sapiens
acaggctgttctgcactgaaa

SEQ ID NO: 1417167 - DNA, 22 bp, Homo sapiens
acaggctgttctgcactgaaaa

SEQ ID NO: 1417168 - DNA, 22 bp, Homo sapiens
acagggaaagcatttaggagaa

SEQ ID NO: 1417169 - DNA, 18 bp, Homo sapiens
acagggaaaggtcagccc

SEQ ID NO: 1417170 - DNA, 23 bp, Homo sapiens
acagggaagaaactttctggtgc

SEQ ID NO: 1417171 - DNA, 20 bp, Homo sapiens
acagggagactgcatctcaa

SEQ ID NO: 1417172 - DNA, 22 bp, Homo sapiens
acagggataaggcctgtggggg

SEQ ID NO: 1417173 - DNA, 17 bp, Homo sapiens
acagggcaccagaggcc

SEQ ID NO: 1417174 - DNA, 18 bp, Homo sapiens
acagggcactgactgata

SEQ ID NO: 1417175 - DNA, 16 bp, Homo sapiens
acagggcagagccggg

SEQ ID NO: 1417176 - DNA, 21 bp, Homo sapiens
acagggcccgcagtgctggga

SEQ ID NO: 1417177 - DNA, 20 bp, Homo sapiens
acagggccctgttgaatttt

SEQ ID NO: 1417178 - DNA, 22 bp, Homo sapiens
acagggctaagagctagcgctg

SEQ ID NO: 1417179 - DNA, 12 bp, Homo sapiens
acagggctcttt

SEQ ID NO: 1417180 - DNA, 14 bp, Homo sapiens
acagggctggctcc

SEQ ID NO: 1417181 - DNA, 21 bp, Homo sapiens
acagggctggctcctctgccc

SEQ ID NO: 1417182 - DNA, 19 bp, Homo sapiens
acaggggaggaaaaaagaa

SEQ ID NO: 1417183 - DNA, 16 bp, Homo sapiens
acaggggaggtgatag

SEQ ID NO: 1417184 - DNA, 20 bp, Homo sapiens
acaggggcaggcctgggacc

SEQ ID NO: 1417185 - DNA, 22 bp, Homo sapiens
acaggggccccagatctgcctg

SEQ ID NO: 1417186 - DNA, 19 bp, Homo sapiens
acaggggttagcctggact

SEQ ID NO: 1417187 - DNA, 17 bp, Homo sapiens
acagggtagcaggtacc

SEQ ID NO: 1417188 - DNA, 18 bp, Homo sapiens
acagggtccccgagtgcc

SEQ ID NO: 1417189 - DNA, 22 bp, Homo sapiens
acagggtctgctctttctctgc

SEQ ID NO: 1417190 - DNA, 15 bp, Homo sapiens
acagggtgggcctcg

SEQ ID NO: 1417191 - DNA, 14 bp, Homo sapiens
acagggttgggccc

SEQ ID NO: 1417192 - DNA, 15 bp, Homo sapiens
acaggtaaaacaggg

SEQ ID NO: 1417193 - DNA, 15 bp, Homo sapiens
acaggtacagcaaca

SEQ ID NO: 1417194 - DNA, 12 bp, Homo sapiens
acaggtcaataa

SEQ ID NO: 1417195 - DNA, 17 bp, Homo sapiens
acaggtcacccatcagg

SEQ ID NO: 1417196 - DNA, 19 bp, Homo sapiens
acaggtcacccatcaggac

SEQ ID NO: 1417197 - DNA, 18 bp, Homo sapiens
acaggtctcctcttaaaa

SEQ ID NO: 1417198 - DNA, 19 bp, Homo sapiens
acaggtgccgccagctgcc

SEQ ID NO: 1417199 - DNA, 20 bp, Homo sapiens
acaggtgccgccagctgccg

SEQ ID NO: 1417200 - DNA, 16 bp, Homo sapiens
acaggtggacacacaa

SEQ ID NO: 1417201 - DNA, 18 bp, Homo sapiens
acaggtggacacacaagg

SEQ ID NO: 1417202 - DNA, 22 bp, Homo sapiens
acaggtgggaggaaagggcctg

SEQ ID NO: 1417203 - DNA, 18 bp, Homo sapiens
acaggtgtggggacacag

SEQ ID NO: 1417204 - DNA, 19 bp, Homo sapiens
acaggtgtggggacacagc

SEQ ID NO: 1417205 - DNA, 17 bp, Homo sapiens
acagtaaaaacttgtac

SEQ ID NO: 1417206 - DNA, 12 bp, Homo sapiens
acagtaaacatt

SEQ ID NO: 1417207 - DNA, 22 bp, Homo sapiens
acagtaaaccactgaaaaaata

SEQ ID NO: 1417208 - DNA, 15 bp, Homo sapiens
acagtaagatatctc

SEQ ID NO: 1417209 - DNA, 18 bp, Homo sapiens
acagtaatctaggtgtgg

SEQ ID NO: 1417210 - DNA, 22 bp, Homo sapiens
acagtaatctaggtgtggctgt

SEQ ID NO: 1417211 - DNA, 15 bp, Homo sapiens
acagtacatatgtaa

SEQ ID NO: 1417212 - DNA, 16 bp, Homo sapiens
acagtacggatttgtc

SEQ ID NO: 1417213 - DNA, 14 bp, Homo sapiens
acagtactttattg

SEQ ID NO: 1417214 - DNA, 14 bp, Homo sapiens
acagtagagccagc

SEQ ID NO: 1417215 - DNA, 16 bp, Homo sapiens
acagtagagccagctt

SEQ ID NO: 1417216 - DNA, 21 bp, Homo sapiens
acagtaggtcccggccagctc

SEQ ID NO: 1417217 - DNA, 18 bp, Homo sapiens
acagtatgatgaaaataa

SEQ ID NO: 1417218 - DNA, 20 bp, Homo sapiens
acagtattatacgctggcaa

SEQ ID NO: 1417219 - DNA, 20 bp, Homo sapiens
acagtattatagacaaaaga

SEQ ID NO: 1417220 - DNA, 18 bp, Homo sapiens
acagtatttgtaattaaa

SEQ ID NO: 1417221 - DNA, 22 bp, Homo sapiens
acagtcagtggagagatgtttg

SEQ ID NO: 1417222 - DNA, 19 bp, Homo sapiens
acagtcataaatactgtca

SEQ ID NO: 1417223 - DNA, 21 bp, Homo sapiens
acagtcattctaggatgtgga

SEQ ID NO: 1417224 - DNA, 17 bp, Homo sapiens
acagtccaaccagaaac

SEQ ID NO: 1417225 - DNA, 20 bp, Homo sapiens
acagtccaaccagaaacacc

SEQ ID NO: 1417226 - DNA, 12 bp, Homo sapiens
acagtccacagg

SEQ ID NO: 1417227 - DNA, 18 bp, Homo sapiens
acagtccacaggggccac

SEQ ID NO: 1417228 - DNA, 14 bp, Homo sapiens
acagtctcattaca

SEQ ID NO: 1417229 - DNA, 18 bp, Homo sapiens
acagtctcattacagatt

SEQ ID NO: 1417230 - DNA, 20 bp, Homo sapiens
acagtctcattacagattta

SEQ ID NO: 1417231 - DNA, 19 bp, Homo sapiens
acagtctctttaatcttca

SEQ ID NO: 1417232 - DNA, 23 bp, Homo sapiens
acagtgaaaagagagaagggaga

SEQ ID NO: 1417233 - DNA, 23 bp, Homo sapiens
acagtgaaattttggtgaatgtg

SEQ ID NO: 1417234 - DNA, 13 bp, Homo sapiens
acagtgaagagta

SEQ ID NO: 1417235 - DNA, 20 bp, Homo sapiens
acagtgactttacaggaggt

SEQ ID NO: 1417236 - DNA, 18 bp, Homo sapiens
acagcctgggccccagct

SEQ ID NO: 1417237 - DNA, 22 bp, Homo sapiens
acagcctgtggcggtgcctggg

SEQ ID NO: 1417238 - DNA, 11 bp, Homo sapiens
acagccttcag

SEQ ID NO: 1417239 - DNA, 21 bp, Homo sapiens
acagccttcagcagcagctca

SEQ ID NO: 1417240 - DNA, 16 bp, Homo sapiens
acagccttgtccccct

SEQ ID NO: 1417241 - DNA, 22 bp, Homo sapiens
acagcctttgcccaaaactgtc

SEQ ID NO: 1417242 - DNA, 14 bp, Homo sapiens
acagcgagggcagc

SEQ ID NO: 1417243 - DNA, 16 bp, Homo sapiens
acagcgagggcagctg

SEQ ID NO: 1417244 - DNA, 19 bp, Homo sapiens
acagcgagggcagctgcta

SEQ ID NO: 1417245 - DNA, 23 bp, Homo sapiens
acagcgagggcagctgctattta

SEQ ID NO: 1417246 - DNA, 15 bp, Homo sapiens
acagcgcggaggagg

SEQ ID NO: 1417247 - DNA, 21 bp, Homo sapiens
acagcggaggagaccagctca

SEQ ID NO: 1417248 - DNA, 16 bp, Homo sapiens
acagcggaggtgtgga

SEQ ID NO: 1417249 - DNA, 18 bp, Homo sapiens
acagcggagtctgtcctg

SEQ ID NO: 1417250 - DNA, 19 bp, Homo sapiens
acagcgtccctagcagtga

SEQ ID NO: 1417251 - DNA, 15 bp, Homo sapiens
acagcgtccctggcg

SEQ ID NO: 1417252 - DNA, 14 bp, Homo sapiens
acagcgtctgctca

SEQ ID NO: 1417253 - DNA, 20 bp, Homo sapiens
acagctaatcagcattctca

SEQ ID NO: 1417254 - DNA, 22 bp, Homo sapiens
acagctaatcagcattctcact

SEQ ID NO: 1417255 - DNA, 14 bp, Homo sapiens
acagctacaaccct

SEQ ID NO: 1417256 - DNA, 23 bp, Homo sapiens
acagctacaaccctaccctggca

SEQ ID NO: 1417257 - DNA, 20 bp, Homo sapiens
acagctactcagtggggctg

SEQ ID NO: 1417258 - DNA, 23 bp, Homo sapiens
acagctactcagtggggctggca

SEQ ID NO: 1417259 - DNA, 14 bp, Homo sapiens
acagctactctccc

SEQ ID NO: 1417260 - DNA, 23 bp, Homo sapiens
acagctactctccccacgagggc

SEQ ID NO: 1417261 - DNA, 16 bp, Homo sapiens
acagctatgggagccc

SEQ ID NO: 1417262 - DNA, 20 bp, Homo sapiens
acagctcacctctgaaggca

SEQ ID NO: 1417263 - DNA, 13 bp, Homo sapiens
acagctcagccag

SEQ ID NO: 1417264 - DNA, 14 bp, Homo sapiens
acagctcagccagt

SEQ ID NO: 1417265 - DNA, 17 bp, Homo sapiens
acagctcagccagtggg

SEQ ID NO: 1417266 - DNA, 21 bp, Homo sapiens
acagctcagccagtggggatg

SEQ ID NO: 1417267 - DNA, 23 bp, Homo sapiens
acagctcagctgcccatcccagt

SEQ ID NO: 1417268 - DNA, 14 bp, Homo sapiens
acagctcattaaac

SEQ ID NO: 1417269 - DNA, 17 bp, Homo sapiens
acagctcattaaacttt

SEQ ID NO: 1417270 - DNA, 15 bp, Homo sapiens
acagctcccacccca

SEQ ID NO: 1417271 - DNA, 22 bp, Homo sapiens
acagctcccaccccaccccctt

SEQ ID NO: 1417272 - DNA, 17 bp, Homo sapiens
acagctccctctgcctg

SEQ ID NO: 1417273 - DNA, 20 bp, Homo sapiens
acagctccgagctgtaggag

SEQ ID NO: 1417274 - DNA, 12 bp, Homo sapiens
acagctcctccc

SEQ ID NO: 1417275 - DNA, 14 bp, Homo sapiens
acagctcctcccac

SEQ ID NO: 1417276 - DNA, 21 bp, Homo sapiens
acagctcctcctcttggagct

SEQ ID NO: 1417277 - DNA, 23 bp, Homo sapiens
acagctcctcttaccgtagcctc

SEQ ID NO: 1417278 - DNA, 15 bp, Homo sapiens
acagctcctgccagg

SEQ ID NO: 1417279 - DNA, 21 bp, Homo sapiens
acagctccttactctgaggaa

SEQ ID NO: 1417280 - DNA, 13 bp, Homo sapiens
acagctcttcatt

SEQ ID NO: 1417281 - DNA, 19 bp, Homo sapiens
acagctgaagtcaaaatat

SEQ ID NO: 1417282 - DNA, 14 bp, Homo sapiens
acagctgagcactt

SEQ ID NO: 1417283 - DNA, 16 bp, Homo sapiens
acagctgagcacttag

SEQ ID NO: 1417284 - DNA, 16 bp, Homo sapiens
acagctgaggtctctt

SEQ ID NO: 1417285 - DNA, 13 bp, Homo sapiens
acagctgcactga

SEQ ID NO: 1417286 - DNA, 23 bp, Homo sapiens
acagctgcactgaggcagcgacc

SEQ ID NO: 1417287 - DNA, 15 bp, Homo sapiens
acagctgcagctggg

SEQ ID NO: 1417288 - DNA, 16 bp, Homo sapiens
acagctgcagctgggc

SEQ ID NO: 1417289 - DNA, 16 bp, Homo sapiens
acagctgcccagacac

SEQ ID NO: 1417290 - DNA, 17 bp, Homo sapiens
acagctgcccagacaca

SEQ ID NO: 1417291 - DNA, 15 bp, Homo sapiens
acagctgccctagct

SEQ ID NO: 1417292 - DNA, 11 bp, Homo sapiens
acagctgctgg

SEQ ID NO: 1417293 - DNA, 17 bp, Homo sapiens
acagctgctgggaccca

SEQ ID NO: 1417294 - DNA, 11 bp, Homo sapiens
acagctgcttg

SEQ ID NO: 1417295 - DNA, 19 bp, Homo sapiens
acagctgcttgtcctgctc

SEQ ID NO: 1417296 - DNA, 22 bp, Homo sapiens
acagctgcttgtcctgctctct

SEQ ID NO: 1417297 - DNA, 18 bp, Homo sapiens
acagctggaaagttgggc

SEQ ID NO: 1417298 - DNA, 21 bp, Homo sapiens
acagctggaaagttgggcccc

SEQ ID NO: 1417299 - DNA, 12 bp, Homo sapiens
acagctggctgg

SEQ ID NO: 1417300 - DNA, 13 bp, Homo sapiens
acagctggctggg

SEQ ID NO: 1417301 - DNA, 18 bp, Homo sapiens
acagctgggcatgccatg

SEQ ID NO: 1417302 - DNA, 16 bp, Homo sapiens
acagctgggctggaac

SEQ ID NO: 1417303 - DNA, 13 bp, Homo sapiens
acagctggtgcca

SEQ ID NO: 1417304 - DNA, 19 bp, Homo sapiens
acagctgtattgtctgaac

SEQ ID NO: 1417305 - DNA, 20 bp, Homo sapiens
acagctgtattgtctgaact

SEQ ID NO: 1417306 - DNA, 10 bp, Homo sapiens
acagctgtgt

SEQ ID NO: 1417307 - DNA, 12 bp, Homo sapiens
acagctgtgtct

SEQ ID NO: 1417308 - DNA, 14 bp, Homo sapiens
acagctgtgtctgc

SEQ ID NO: 1417309 - DNA, 20 bp, Homo sapiens
acagcttacctagtcttgta

SEQ ID NO: 1417310 - DNA, 19 bp, Homo sapiens
acagcttatttttttctac

SEQ ID NO: 1417311 - DNA, 21 bp, Homo sapiens
acagcttcaccctgtcaagtt

SEQ ID NO: 1417312 - DNA, 17 bp, Homo sapiens
acagcttcagccaggag

SEQ ID NO: 1417313 - DNA, 21 bp, Homo sapiens
acagcttcagccaggagctgg

SEQ ID NO: 1417314 - DNA, 13 bp, Homo sapiens
acagcttcctcac

SEQ ID NO: 1417315 - DNA, 14 bp, Homo sapiens
acagcttcctcaca

SEQ ID NO: 1417316 - DNA, 16 bp, Homo sapiens
acagcttcctcacacc

SEQ ID NO: 1417317 - DNA, 21 bp, Homo sapiens
acagcttgacctgaggctgtg

SEQ ID NO: 1417318 - DNA, 16 bp, Homo sapiens
acagcttgactgcttt

SEQ ID NO: 1417319 - DNA, 22 bp, Homo sapiens
acagcttgccagggatgggcag

SEQ ID NO: 1417320 - DNA, 16 bp, Homo sapiens
acagcttgctgtcact

SEQ ID NO: 1417321 - DNA, 11 bp, Homo sapiens
acagcttgtct

SEQ ID NO: 1417322 - DNA, 15 bp, Homo sapiens
acagctttcaagtgc

SEQ ID NO: 1417323 - DNA, 12 bp, Homo sapiens
acagctttctgg

SEQ ID NO: 1417324 - DNA, 14 bp, Homo sapiens
acagctttctggga

SEQ ID NO: 1417325 - DNA, 15 bp, Homo sapiens
acagctttgctccgc

SEQ ID NO: 1417326 - DNA, 12 bp, Homo sapiens
acagcttttgca

SEQ ID NO: 1417327 - DNA, 19 bp, Homo sapiens
acaggaaaaaaaattctgt

SEQ ID NO: 1417328 - DNA, 20 bp, Homo sapiens
acaggaaaaaaaattctgtt

SEQ ID NO: 1417329 - DNA, 18 bp, Homo sapiens
acaggaaaatcctctggc

SEQ ID NO: 1417330 - DNA, 23 bp, Homo sapiens
acaggaaaatcctctggctggct

SEQ ID NO: 1417331 - DNA, 22 bp, Homo sapiens
acaggaacccttgcatccattg

SEQ ID NO: 1417332 - DNA, 15 bp, Homo sapiens
acaggaagcacccca

SEQ ID NO: 1417333 - DNA, 22 bp, Homo sapiens
acaggaagctcagccttctcct

SEQ ID NO: 1417334 - DNA, 15 bp, Homo sapiens
acaggaagctggcag

SEQ ID NO: 1417335 - DNA, 18 bp, Homo sapiens
acaggaagtagttctaaa

SEQ ID NO: 1417336 - DNA, 18 bp, Homo sapiens
acaggaattttattttgc

SEQ ID NO: 1417337 - DNA, 16 bp, Homo sapiens
acaggacacctggccg

SEQ ID NO: 1417338 - DNA, 21 bp, Homo sapiens
acagagattctggatctcctg

SEQ ID NO: 1417339 - DNA, 13 bp, Homo sapiens
acagagcacgcct

SEQ ID NO: 1417340 - DNA, 15 bp, Homo sapiens
acagagcacgcctgc

SEQ ID NO: 1417341 - DNA, 17 bp, Homo sapiens
acagagcacgcctgcca

SEQ ID NO: 1417342 - DNA, 19 bp, Homo sapiens
acagagcacgcctgccatc

SEQ ID NO: 1417343 - DNA, 17 bp, Homo sapiens
acagagccaagcactgc

SEQ ID NO: 1417344 - DNA, 22 bp, Homo sapiens
acagagccagcggctccaactc

SEQ ID NO: 1417345 - DNA, 17 bp, Homo sapiens
acagagcgagactccat

SEQ ID NO: 1417346 - DNA, 15 bp, Homo sapiens
acagagctactgaga

SEQ ID NO: 1417347 - DNA, 14 bp, Homo sapiens
acagagctctgggt

SEQ ID NO: 1417348 - DNA, 22 bp, Homo sapiens
acagagctgtggaggattgcta

SEQ ID NO: 1417349 - DNA, 14 bp, Homo sapiens
acagaggaagagca

SEQ ID NO: 1417350 - DNA, 17 bp, Homo sapiens
acagaggagagtcccag

SEQ ID NO: 1417351 - DNA, 20 bp, Homo sapiens
acagaggagggcgtgactca

SEQ ID NO: 1417352 - DNA, 20 bp, Homo sapiens
acagaggatgccttttctgt

SEQ ID NO: 1417353 - DNA, 13 bp, Homo sapiens
acagaggcagccc

SEQ ID NO: 1417354 - DNA, 17 bp, Homo sapiens
acagaggccatggcaga

SEQ ID NO: 1417355 - DNA, 12 bp, Homo sapiens
acagagggctgc

SEQ ID NO: 1417356 - DNA, 16 bp, Homo sapiens
acagaggttgtagtga

SEQ ID NO: 1417357 - DNA, 23 bp, Homo sapiens
acagagtatgaacacctgggctt

SEQ ID NO: 1417358 - DNA, 21 bp, Homo sapiens
acagagtcttcactaaccttt

SEQ ID NO: 1417359 - DNA, 16 bp, Homo sapiens
acagagtgagaccctg

SEQ ID NO: 1417360 - DNA, 20 bp, Homo sapiens
acagagtgagactccatctc

SEQ ID NO: 1417361 - DNA, 19 bp, Homo sapiens
acagagtgagccagtgagg

SEQ ID NO: 1417362 - DNA, 12 bp, Homo sapiens
acagagtggact

SEQ ID NO: 1417363 - DNA, 18 bp, Homo sapiens
acagagtggactcttccc

SEQ ID NO: 1417364 - DNA, 18 bp, Homo sapiens
acagagtggcctccctgc

SEQ ID NO: 1417365 - DNA, 19 bp, Homo sapiens
acagagtgggccccgggct

SEQ ID NO: 1417366 - DNA, 19 bp, Homo sapiens
acagagtggtctttctgga

SEQ ID NO: 1417367 - DNA, 18 bp, Homo sapiens
acagagtgtgctgctatt

SEQ ID NO: 1417368 - DNA, 18 bp, Homo sapiens
acagagtgtggactctgg

SEQ ID NO: 1417369 - DNA, 22 bp, Homo sapiens
acagataaatccttaacatttc

SEQ ID NO: 1417370 - DNA, 14 bp, Homo sapiens
acagataaatgatt

SEQ ID NO: 1417371 - DNA, 18 bp, Homo sapiens
acagataagtgttcttca

SEQ ID NO: 1417372 - DNA, 14 bp, Homo sapiens
acagataattcatt

SEQ ID NO: 1417373 - DNA, 18 bp, Homo sapiens
acagataattcatttgta

SEQ ID NO: 1417374 - DNA, 15 bp, Homo sapiens
acagatactgtgagc

SEQ ID NO: 1417375 - DNA, 16 bp, Homo sapiens
acagatactgtgagct

SEQ ID NO: 1417376 - DNA, 23 bp, Homo sapiens
acagatactgtgagcttacattg

SEQ ID NO: 1417377 - DNA, 17 bp, Homo sapiens
acagatataaatggctg

SEQ ID NO: 1417378 - DNA, 16 bp, Homo sapiens
acagatatcagtgtct

SEQ ID NO: 1417379 - DNA, 18 bp, Homo sapiens
acagatattacagcttat

SEQ ID NO: 1417380 - DNA, 14 bp, Homo sapiens
acagatatttcaaa

SEQ ID NO: 1417381 - DNA, 22 bp, Homo sapiens
acagatcaggaattctaaataa

SEQ ID NO: 1417382 - DNA, 22 bp, Homo sapiens
acagatcccctggaaacccacc

SEQ ID NO: 1417383 - DNA, 12 bp, Homo sapiens
acagatctggaa

SEQ ID NO: 1417384 - DNA, 16 bp, Homo sapiens
acagatctggaacctc

SEQ ID NO: 1417385 - DNA, 18 bp, Homo sapiens
acagatgccacacaagga

SEQ ID NO: 1417386 - DNA, 16 bp, Homo sapiens
acagatgccccagagc

SEQ ID NO: 1417387 - DNA, 21 bp, Homo sapiens
acagatgccccagagctgttt

SEQ ID NO: 1417388 - DNA, 18 bp, Homo sapiens
acagatgccttttttgta

SEQ ID NO: 1417389 - DNA, 22 bp, Homo sapiens
acagatgcgttcagcagactgg

SEQ ID NO: 1417390 - DNA, 21 bp, Homo sapiens
acagatggaaaaactgaggct

SEQ ID NO: 1417391 - DNA, 16 bp, Homo sapiens
acagatggatttgcct

SEQ ID NO: 1417392 - DNA, 23 bp, Homo sapiens
acagatgggtattaaacttgtca

SEQ ID NO: 1417393 - DNA, 12 bp, Homo sapiens
acagatgtaaat

SEQ ID NO: 1417394 - DNA, 20 bp, Homo sapiens
acagatgtcagccgagccgg

SEQ ID NO: 1417395 - DNA, 12 bp, Homo sapiens
acagatgttgaa

SEQ ID NO: 1417396 - DNA, 22 bp, Homo sapiens
acagattcaggccagcccagcc

SEQ ID NO: 1417397 - DNA, 21 bp, Homo sapiens
acagattctttcagttctttg

SEQ ID NO: 1417398 - DNA, 23 bp, Homo sapiens
acagattgacagggactttgctg

SEQ ID NO: 1417399 - DNA, 14 bp, Homo sapiens
acagattgcctcct

SEQ ID NO: 1417400 - DNA, 16 bp, Homo sapiens
acagattgcctcctta

SEQ ID NO: 1417401 - DNA, 14 bp, Homo sapiens
acagattttaccta

SEQ ID NO: 1417402 - DNA, 12 bp, Homo sapiens
acagattttatt

SEQ ID NO: 1417403 - DNA, 20 bp, Homo sapiens
acagattttggggttgtgtt

SEQ ID NO: 1417404 - DNA, 17 bp, Homo sapiens
acagatttttacaaatg

SEQ ID NO: 1417405 - DNA, 18 bp, Homo sapiens
acagcaaaatgttgaaga

SEQ ID NO: 1417406 - DNA, 16 bp, Homo sapiens
acagcaaatgcaaaaa

SEQ ID NO: 1417407 - DNA, 17 bp, Homo sapiens
acagcaacaatttatga

SEQ ID NO: 1417408 - DNA, 21 bp, Homo sapiens
acagcaacaggaatctcagag

SEQ ID NO: 1417409 - DNA, 18 bp, Homo sapiens
acagcaagggtgatggga

SEQ ID NO: 1417410 - DNA, 16 bp, Homo sapiens
acagcaagtgagcaga

SEQ ID NO: 1417411 - DNA, 20 bp, Homo sapiens
acagcacaaacacacctctg

SEQ ID NO: 1417412 - DNA, 19 bp, Homo sapiens
acagcacaccagccgctgc

SEQ ID NO: 1417413 - DNA, 19 bp, Homo sapiens
acagcaccgggggagaggg

SEQ ID NO: 1417414 - DNA, 13 bp, Homo sapiens
acagcactactct

SEQ ID NO: 1417415 - DNA, 15 bp, Homo sapiens
acagcactactctgt

SEQ ID NO: 1417416 - DNA, 19 bp, Homo sapiens
acagcactttggttttgct

SEQ ID NO: 1417417 - DNA, 22 bp, Homo sapiens
acagcagcagaacaagtgcctc

SEQ ID NO: 1417418 - DNA, 12 bp, Homo sapiens
acagcagcctgt

SEQ ID NO: 1417419 - DNA, 14 bp, Homo sapiens
acagcagctcaggc

SEQ ID NO: 1417420 - DNA, 16 bp, Homo sapiens
acagcagctgcagggg

SEQ ID NO: 1417421 - DNA, 18 bp, Homo sapiens
acagcagctggtgcccca

SEQ ID NO: 1417422 - DNA, 22 bp, Homo sapiens
acagcagcttcaccagagcatt

SEQ ID NO: 1417423 - DNA, 21 bp, Homo sapiens
acagcaggatcgaagggtttt

SEQ ID NO: 1417424 - DNA, 16 bp, Homo sapiens
acagcagtctccttca

SEQ ID NO: 1417425 - DNA, 23 bp, Homo sapiens
acagcagtgatctcagggcagac

SEQ ID NO: 1417426 - DNA, 15 bp, Homo sapiens
acagcagttgaaaag

SEQ ID NO: 1417427 - DNA, 21 bp, Homo sapiens
acagcagttgaaaagactcca

SEQ ID NO: 1417428 - DNA, 23 bp, Homo sapiens
acagcagttgaaaagactccaaa

SEQ ID NO: 1417429 - DNA, 15 bp, Homo sapiens
acagcataagggaat

SEQ ID NO: 1417430 - DNA, 18 bp, Homo sapiens
acagcatcgggagcaccc

SEQ ID NO: 1417431 - DNA, 20 bp, Homo sapiens
acagcatcgggagcacccag

SEQ ID NO: 1417432 - DNA, 22 bp, Homo sapiens
acagcatcgggagcacccagag

SEQ ID NO: 1417433 - DNA, 14 bp, Homo sapiens
acagcatgaataaa

SEQ ID NO: 1417434 - DNA, 16 bp, Homo sapiens
acagcatgaataaaac

SEQ ID NO: 1417435 - DNA, 23 bp, Homo sapiens
acagcatgaataaaacactcatc

SEQ ID NO: 1417436 - DNA, 18 bp, Homo sapiens
acagcatggactgtgtcc

SEQ ID NO: 1417437 - DNA, 12 bp, Homo sapiens
acagcattgctt

SEQ ID NO: 1417438 - DNA, 15 bp, Homo sapiens
acagcattgctttct

SEQ ID NO: 1417439 - DNA, 18 bp, Homo sapiens
acagcattgtctttgctg

SEQ ID NO: 1417440 - DNA, 17 bp, Homo sapiens
acagcatttgctttcct

SEQ ID NO: 1417441 - DNA, 21 bp, Homo sapiens
acagcatttgctttcctctga

SEQ ID NO: 1417442 - DNA, 18 bp, Homo sapiens
acagccaactagcccctg

SEQ ID NO: 1417443 - DNA, 19 bp, Homo sapiens
acagccaactagcccctgg

SEQ ID NO: 1417444 - DNA, 11 bp, Homo sapiens
acagccacccg

SEQ ID NO: 1417445 - DNA, 21 bp, Homo sapiens
acagccacccgtggggtgctg

SEQ ID NO: 1417446 - DNA, 14 bp, Homo sapiens
acagccagcaagag

SEQ ID NO: 1417447 - DNA, 22 bp, Homo sapiens
acagccatagacctacagacct

SEQ ID NO: 1417448 - DNA, 15 bp, Homo sapiens
acagccatgcgtggc

SEQ ID NO: 1417449 - DNA, 16 bp, Homo sapiens
acagcccaaaatttga

SEQ ID NO: 1417450 - DNA, 20 bp, Homo sapiens
acagcccacggtctggaggc

SEQ ID NO: 1417451 - DNA, 18 bp, Homo sapiens
acagcccagagcctggct

SEQ ID NO: 1417452 - DNA, 21 bp, Homo sapiens
acagcccaggatactggcaca

SEQ ID NO: 1417453 - DNA, 17 bp, Homo sapiens
acagcccccttgccctc

SEQ ID NO: 1417454 - DNA, 21 bp, Homo sapiens
acactttgaagcaaatacaat

SEQ ID NO: 1417455 - DNA, 17 bp, Homo sapiens
acactttgctttctgaa

SEQ ID NO: 1417456 - DNA, 15 bp, Homo sapiens
acactttggtttatg

SEQ ID NO: 1417457 - DNA, 23 bp, Homo sapiens
acactttggtttatgcggtgctg

SEQ ID NO: 1417458 - DNA, 16 bp, Homo sapiens
acagaaaaacaatctt

SEQ ID NO: 1417459 - DNA, 13 bp, Homo sapiens
acagaaaaagcat

SEQ ID NO: 1417460 - DNA, 13 bp, Homo sapiens
acagaaaacatgt

SEQ ID NO: 1417461 - DNA, 18 bp, Homo sapiens
acagaaaagtgcctgagc

SEQ ID NO: 1417462 - DNA, 19 bp, Homo sapiens
acagaaaagtgcctgagct

SEQ ID NO: 1417463 - DNA, 13 bp, Homo sapiens
acagaaaatatgt

SEQ ID NO: 1417464 - DNA, 15 bp, Homo sapiens
acagaaaatatgtat

SEQ ID NO: 1417465 - DNA, 17 bp, Homo sapiens
acagaaacaaaaacact

SEQ ID NO: 1417466 - DNA, 16 bp, Homo sapiens
acagaaacgagatttg

SEQ ID NO: 1417467 - DNA, 20 bp, Homo sapiens
acagaaagaaaaatgcatta

SEQ ID NO: 1417468 - DNA, 20 bp, Homo sapiens
acagaaagagactccgtctc

SEQ ID NO: 1417469 - DNA, 22 bp, Homo sapiens
acagaaagcctccgctgggctt

SEQ ID NO: 1417470 - DNA, 13 bp, Homo sapiens
acagaaagctgcc

SEQ ID NO: 1417471 - DNA, 18 bp, Homo sapiens
acagaaagttggaaagga

SEQ ID NO: 1417472 - DNA, 21 bp, Homo sapiens
acagaaatcagaggagagacg

SEQ ID NO: 1417473 - DNA, 15 bp, Homo sapiens
acagaaatgctgctg

SEQ ID NO: 1417474 - DNA, 21 bp, Homo sapiens
acagaaatgctgctggccaaa

SEQ ID NO: 1417475 - DNA, 19 bp, Homo sapiens
acagaaattgtatattgta

SEQ ID NO: 1417476 - DNA, 12 bp, Homo sapiens
acagaacactta

SEQ ID NO: 1417477 - DNA, 17 bp, Homo sapiens
acagaacatcattagaa

SEQ ID NO: 1417478 - DNA, 15 bp, Homo sapiens
acagaactacatatt

SEQ ID NO: 1417479 - DNA, 20 bp, Homo sapiens
acagaactgcttactagccc

SEQ ID NO: 1417480 - DNA, 18 bp, Homo sapiens
acagaacttcagaaagac

SEQ ID NO: 1417481 - DNA, 20 bp, Homo sapiens
acagaacttcagaaagactt

SEQ ID NO: 1417482 - DNA, 21 bp, Homo sapiens
acagaacttcagaaagacttg

SEQ ID NO: 1417483 - DNA, 17 bp, Homo sapiens
acagaacttgaatgtgt

SEQ ID NO: 1417484 - DNA, 19 bp, Homo sapiens
acagaacttgaatgtgtca

SEQ ID NO: 1417485 - DNA, 20 bp, Homo sapiens
acagaacttgaatgtgtcag

SEQ ID NO: 1417486 - DNA, 20 bp, Homo sapiens
acagaaggaatctgtgcaga

SEQ ID NO: 1417487 - DNA, 14 bp, Homo sapiens
acagaaggactggt

SEQ ID NO: 1417488 - DNA, 19 bp, Homo sapiens
acagaatatgtttcaaact

SEQ ID NO: 1417489 - DNA, 12 bp, Homo sapiens
acagaatatttc

SEQ ID NO: 1417490 - DNA, 15 bp, Homo sapiens
acagaatcttctggg

SEQ ID NO: 1417491 - DNA, 16 bp, Homo sapiens
acagaatcttgtattt

SEQ ID NO: 1417492 - DNA, 18 bp, Homo sapiens
acagaatcttgttttgaa

SEQ ID NO: 1417493 - DNA, 20 bp, Homo sapiens
acagaatgcaaccaagtcac

SEQ ID NO: 1417494 - DNA, 13 bp, Homo sapiens
acagaatgctcag

SEQ ID NO: 1417495 - DNA, 14 bp, Homo sapiens
acagaatgctcagg

SEQ ID NO: 1417496 - DNA, 22 bp, Homo sapiens
acagaatgctcagggtcactga

SEQ ID NO: 1417497 - DNA, 14 bp, Homo sapiens
acagaatgtgttct

SEQ ID NO: 1417498 - DNA, 20 bp, Homo sapiens
acagaatgttttactgtgaa

SEQ ID NO: 1417499 - DNA, 15 bp, Homo sapiens
acagaattctgctac

SEQ ID NO: 1417500 - DNA, 17 bp, Homo sapiens
acagaattctgctacct

SEQ ID NO: 1417501 - DNA, 13 bp, Homo sapiens
acagaatttgaat

SEQ ID NO: 1417502 - DNA, 15 bp, Homo sapiens
acagacaaaaacaag

SEQ ID NO: 1417503 - DNA, 19 bp, Homo sapiens
acagacaaaaacagcctca

SEQ ID NO: 1417504 - DNA, 15 bp, Homo sapiens
acagacaagcagccc

SEQ ID NO: 1417505 - DNA, 13 bp, Homo sapiens
acagacacacaca

SEQ ID NO: 1417506 - DNA, 15 bp, Homo sapiens
acagacacacacacg

SEQ ID NO: 1417507 - DNA, 17 bp, Homo sapiens
acagacacacacacgca

SEQ ID NO: 1417508 - DNA, 20 bp, Homo sapiens
acagacacgagccacctcac

SEQ ID NO: 1417509 - DNA, 20 bp, Homo sapiens
acagacactacatatctaaa

SEQ ID NO: 1417510 - DNA, 21 bp, Homo sapiens
acagacactcccacttggcat

SEQ ID NO: 1417511 - DNA, 14 bp, Homo sapiens
acagacactggcat

SEQ ID NO: 1417512 - DNA, 13 bp, Homo sapiens
acagacaggctct

SEQ ID NO: 1417513 - DNA, 22 bp, Homo sapiens
acagacatatatatatatatgc

SEQ ID NO: 1417514 - DNA, 16 bp, Homo sapiens
acagacattcaatgaa

SEQ ID NO: 1417515 - DNA, 17 bp, Homo sapiens
acagacattttgtgtga

SEQ ID NO: 1417516 - DNA, 19 bp, Homo sapiens
acagacattttgtgtgaga

SEQ ID NO: 1417517 - DNA, 21 bp, Homo sapiens
acagacattttgtgtgagact

SEQ ID NO: 1417518 - DNA, 16 bp, Homo sapiens
acagaccaatagacat

SEQ ID NO: 1417519 - DNA, 17 bp, Homo sapiens
acagaccaatagacatt

SEQ ID NO: 1417520 - DNA, 20 bp, Homo sapiens
acagaccacatctttatctg

SEQ ID NO: 1417521 - DNA, 22 bp, Homo sapiens
acagaccacatctttatctgtt

SEQ ID NO: 1417522 - DNA, 14 bp, Homo sapiens
acagaccacttgcc

SEQ ID NO: 1417523 - DNA, 20 bp, Homo sapiens
acagaccatattacctggat

SEQ ID NO: 1417524 - DNA, 15 bp, Homo sapiens
acagacccctgggag

SEQ ID NO: 1417525 - DNA, 16 bp, Homo sapiens
acagacccctgggagc

SEQ ID NO: 1417526 - DNA, 13 bp, Homo sapiens
acagacctggctc

SEQ ID NO: 1417527 - DNA, 19 bp, Homo sapiens
acagacctggctctcagag

SEQ ID NO: 1417528 - DNA, 18 bp, Homo sapiens
acagacgctgctgtcaca

SEQ ID NO: 1417529 - DNA, 14 bp, Homo sapiens
acagactattttta

SEQ ID NO: 1417530 - DNA, 17 bp, Homo sapiens
acagactatttttagat

SEQ ID NO: 1417531 - DNA, 23 bp, Homo sapiens
acagactgcgatttgtcccaggt

SEQ ID NO: 1417532 - DNA, 22 bp, Homo sapiens
acagactggagaaaacccctcc

SEQ ID NO: 1417533 - DNA, 21 bp, Homo sapiens
acagactgttttactgtttta

SEQ ID NO: 1417534 - DNA, 20 bp, Homo sapiens
acagacttctggaaggctgg

SEQ ID NO: 1417535 - DNA, 22 bp, Homo sapiens
acagacttctggaaggctggct

SEQ ID NO: 1417536 - DNA, 18 bp, Homo sapiens
acagacttgagaacttga

SEQ ID NO: 1417537 - DNA, 19 bp, Homo sapiens
acagacttgcactgaagcc

SEQ ID NO: 1417538 - DNA, 12 bp, Homo sapiens
acagactttctg

SEQ ID NO: 1417539 - DNA, 12 bp, Homo sapiens
acagagaaccaa

SEQ ID NO: 1417540 - DNA, 17 bp, Homo sapiens
acagagaagctcctgct

SEQ ID NO: 1417541 - DNA, 13 bp, Homo sapiens
acagagaaggcta

SEQ ID NO: 1417542 - DNA, 23 bp, Homo sapiens
acagagaagtttgtagccaggta

SEQ ID NO: 1417543 - DNA, 22 bp, Homo sapiens
acagagacccagatctcatgga

SEQ ID NO: 1417544 - DNA, 22 bp, Homo sapiens
acagagaggatacatttaataa

SEQ ID NO: 1417545 - DNA, 21 bp, Homo sapiens
aattccactgtcttgtgtttt

SEQ ID NO: 1417546 - DNA, 18 bp, Homo sapiens
aattccaggctgagccat

SEQ ID NO: 1417547 - DNA, 19 bp, Homo sapiens
aattccaggctgagccatg

SEQ ID NO: 1417548 - DNA, 19 bp, Homo sapiens
aattccatatgctccagga

SEQ ID NO: 1417549 - DNA, 23 bp, Homo sapiens
aattccatattgatgaagatgtt

SEQ ID NO: 1417550 - DNA, 21 bp, Homo sapiens
aattcccattttgcaaaattt

SEQ ID NO: 1417551 - DNA, 22 bp, Homo sapiens
aattccctatcttttagtttta

SEQ ID NO: 1417552 - DNA, 23 bp, Homo sapiens
aattccctatcttttagttttag

SEQ ID NO: 1417553 - DNA, 14 bp, Homo sapiens
aattcctacaactt

SEQ ID NO: 1417554 - DNA, 17 bp, Homo sapiens
aattcctacaacttaat

SEQ ID NO: 1417555 - DNA, 19 bp, Homo sapiens
aattcctctccaggccaga

SEQ ID NO: 1417556 - DNA, 14 bp, Homo sapiens
aattcctctttaac

SEQ ID NO: 1417557 - DNA, 22 bp, Homo sapiens
aattccttcgaaaggccttcag

SEQ ID NO: 1417558 - DNA, 20 bp, Homo sapiens
aattccttctcttttttcag

SEQ ID NO: 1417559 - DNA, 20 bp, Homo sapiens
aattctaaataaatttccca

SEQ ID NO: 1417560 - DNA, 21 bp, Homo sapiens
aattctaacccaagacatgac

SEQ ID NO: 1417561 - DNA, 17 bp, Homo sapiens
aattctaacccaggtat

SEQ ID NO: 1417562 - DNA, 16 bp, Homo sapiens
aattctactggaaaaa

SEQ ID NO: 1417563 - DNA, 18 bp, Homo sapiens
aattctactggaaaaaaa

SEQ ID NO: 1417564 - DNA, 14 bp, Homo sapiens
aattctagctgtat

SEQ ID NO: 1417565 - DNA, 15 bp, Homo sapiens
aattctagtctctga

SEQ ID NO: 1417566 - DNA, 17 bp, Homo sapiens
aattctagtctctgatt

SEQ ID NO: 1417567 - DNA, 17 bp, Homo sapiens
aattctagtgctgctga

SEQ ID NO: 1417568 - DNA, 23 bp, Homo sapiens
aattctattaaagtgctaaggtt

SEQ ID NO: 1417569 - DNA, 14 bp, Homo sapiens
aattctatttgctg

SEQ ID NO: 1417570 - DNA, 23 bp, Homo sapiens
aattctccaggattttaatttca

SEQ ID NO: 1417571 - DNA, 15 bp, Homo sapiens
aattctcccctccct

SEQ ID NO: 1417572 - DNA, 17 bp, Homo sapiens
aattctcccctccctcc

SEQ ID NO: 1417573 - DNA, 12 bp, Homo sapiens
aattctcctgga

SEQ ID NO: 1417574 - DNA, 20 bp, Homo sapiens
aattctctgtggaatgaata

SEQ ID NO: 1417575 - DNA, 15 bp, Homo sapiens
aattctcttatccaa

SEQ ID NO: 1417576 - DNA, 23 bp, Homo sapiens
aattctcttccaaccatttatct

SEQ ID NO: 1417577 - DNA, 22 bp, Homo sapiens
aattctgactgtccaggagcta

SEQ ID NO: 1417578 - DNA, 20 bp, Homo sapiens
aattctgcttgtgacattaa

SEQ ID NO: 1417579 - DNA, 16 bp, Homo sapiens
aattctggacagacag

SEQ ID NO: 1417580 - DNA, 20 bp, Homo sapiens
aattctgtcttgttcatttt

SEQ ID NO: 1417581 - DNA, 17 bp, Homo sapiens
aattctgtgatattttc

SEQ ID NO: 1417582 - DNA, 17 bp, Homo sapiens
aattctgttgttccatt

SEQ ID NO: 1417583 - DNA, 12 bp, Homo sapiens
aattctgtttct

SEQ ID NO: 1417584 - DNA, 13 bp, Homo sapiens
aattctgtttctt

SEQ ID NO: 1417585 - DNA, 16 bp, Homo sapiens
aattctgtttcttgag

SEQ ID NO: 1417586 - DNA, 12 bp, Homo sapiens
aattctgtttta

SEQ ID NO: 1417587 - DNA, 17 bp, Homo sapiens
aattctgtttttaaaaa

SEQ ID NO: 1417588 - DNA, 20 bp, Homo sapiens
aattctgtttttaaaaatta

SEQ ID NO: 1417589 - DNA, 22 bp, Homo sapiens
aattctgtttttaatgctattt

SEQ ID NO: 1417590 - DNA, 13 bp, Homo sapiens
aattcttacatgt

SEQ ID NO: 1417591 - DNA, 13 bp, Homo sapiens
aattcttactctg

SEQ ID NO: 1417592 - DNA, 19 bp, Homo sapiens
aattcttattttttaaaaa

SEQ ID NO: 1417593 - DNA, 23 bp, Homo sapiens
aattcttattttttaaaaagcta

SEQ ID NO: 1417594 - DNA, 22 bp, Homo sapiens
aattcttcacctaagtctctgt

SEQ ID NO: 1417595 - DNA, 16 bp, Homo sapiens
aattcttgaaggaaaa

SEQ ID NO: 1417596 - DNA, 13 bp, Homo sapiens
aattcttgaagtt

SEQ ID NO: 1417597 - DNA, 14 bp, Homo sapiens
aattcttgtatatt

SEQ ID NO: 1417598 - DNA, 19 bp, Homo sapiens
aattctttcaattcttcat

SEQ ID NO: 1417599 - DNA, 23 bp, Homo sapiens
aattctttctgtctcccttctct

SEQ ID NO: 1417600 - DNA, 17 bp, Homo sapiens
aattctttgcaaaaatc

SEQ ID NO: 1417601 - DNA, 14 bp, Homo sapiens
aattcttttctgag

SEQ ID NO: 1417602 - DNA, 14 bp, Homo sapiens
aattgaaagaactt

SEQ ID NO: 1417603 - DNA, 21 bp, Homo sapiens
aattgaaaggcattctctgaa

SEQ ID NO: 1417604 - DNA, 17 bp, Homo sapiens
aattgaagtgtataata

SEQ ID NO: 1417605 - DNA, 16 bp, Homo sapiens
aattgaagtttcaagt

SEQ ID NO: 1417606 - DNA, 14 bp, Homo sapiens
aattgacattgctt

SEQ ID NO: 1417607 - DNA, 16 bp, Homo sapiens
aattgagcagttcatg

SEQ ID NO: 1417608 - DNA, 16 bp, Homo sapiens
aattgagtaatggtgt

SEQ ID NO: 1417609 - DNA, 22 bp, Homo sapiens
aattgagtttaacaataataaa

SEQ ID NO: 1417610 - DNA, 14 bp, Homo sapiens
aattgatacttcag

SEQ ID NO: 1417611 - DNA, 14 bp, Homo sapiens
aattgatattatat

SEQ ID NO: 1417612 - DNA, 21 bp, Homo sapiens
aattgatattatattaaacat

SEQ ID NO: 1417613 - DNA, 15 bp, Homo sapiens
aatgtgaaaaaggaa

SEQ ID NO: 1417614 - DNA, 15 bp, Homo sapiens
aatgtgaatttttat

SEQ ID NO: 1417615 - DNA, 19 bp, Homo sapiens
aatgtgaggaactcacata

SEQ ID NO: 1417616 - DNA, 16 bp, Homo sapiens
aatgtgagtcccagag

SEQ ID NO: 1417617 - DNA, 18 bp, Homo sapiens
aatgtgatcaactgttca

SEQ ID NO: 1417618 - DNA, 16 bp, Homo sapiens
aatgtgatgttctaag

SEQ ID NO: 1417619 - DNA, 19 bp, Homo sapiens
aatgtgatgttctaaggct

SEQ ID NO: 1417620 - DNA, 17 bp, Homo sapiens
aatgtgcaatagaaggt

SEQ ID NO: 1417621 - DNA, 22 bp, Homo sapiens
aatgtgcagaaaatatttaata

SEQ ID NO: 1417622 - DNA, 16 bp, Homo sapiens
aatgtgcagggatatt

SEQ ID NO: 1417623 - DNA, 18 bp, Homo sapiens
aatgtgctatactgcata

SEQ ID NO: 1417624 - DNA, 23 bp, Homo sapiens
aatgtgctggtgaacactgtgac

SEQ ID NO: 1417625 - DNA, 15 bp, Homo sapiens
aatgtgcttttccat

SEQ ID NO: 1417626 - DNA, 22 bp, Homo sapiens
aatgtgcttttccatctaaaat

SEQ ID NO: 1417627 - DNA, 21 bp, Homo sapiens
aatgtggaataggataatata

SEQ ID NO: 1417628 - DNA, 17 bp, Homo sapiens
aatgtggccgaggactt

SEQ ID NO: 1417629 - DNA, 17 bp, Homo sapiens
aatgtggcctaaaaatg

SEQ ID NO: 1417630 - DNA, 14 bp, Homo sapiens
aatgtgtacagtga

SEQ ID NO: 1417631 - DNA, 18 bp, Homo sapiens
aatgtgtacagtgaattg

SEQ ID NO: 1417632 - DNA, 23 bp, Homo sapiens
aatgtgtacagtgaattgtcttt

SEQ ID NO: 1417633 - DNA, 13 bp, Homo sapiens
aatgtgtcagaat

SEQ ID NO: 1417634 - DNA, 12 bp, Homo sapiens
aatgtgtcattg

SEQ ID NO: 1417635 - DNA, 19 bp, Homo sapiens
aatgtgtcctatctatctt

SEQ ID NO: 1417636 - DNA, 19 bp, Homo sapiens
aatgtgtgaattcaataca

SEQ ID NO: 1417637 - DNA, 20 bp, Homo sapiens
aatgtgtgagtgcatgtact

SEQ ID NO: 1417638 - DNA, 19 bp, Homo sapiens
aatgtgtgtgtgtggcagg

SEQ ID NO: 1417639 - DNA, 20 bp, Homo sapiens
aatgtgttcttttctccttt

SEQ ID NO: 1417640 - DNA, 13 bp, Homo sapiens
aatgtgtttctgt

SEQ ID NO: 1417641 - DNA, 16 bp, Homo sapiens
aatgtgtttttctata

SEQ ID NO: 1417642 - DNA, 17 bp, Homo sapiens
aatgttaaacaccattt

SEQ ID NO: 1417643 - DNA, 15 bp, Homo sapiens
aatgttacattatta

SEQ ID NO: 1417644 - DNA, 15 bp, Homo sapiens
aatgttacattgttt

SEQ ID NO: 1417645 - DNA, 14 bp, Homo sapiens
aatgttacctaatt

SEQ ID NO: 1417646 - DNA, 23 bp, Homo sapiens
aatgttacggcatcacacttata

SEQ ID NO: 1417647 - DNA, 22 bp, Homo sapiens
aatgttatcttctcaagttcta

SEQ ID NO: 1417648 - DNA, 23 bp, Homo sapiens
aatgttatcttctcaagttctaa

SEQ ID NO: 1417649 - DNA, 22 bp, Homo sapiens
aatgttatgggatgtaaacaat

SEQ ID NO: 1417650 - DNA, 11 bp, Homo sapiens
aatgttccatt

SEQ ID NO: 1417651 - DNA, 20 bp, Homo sapiens
aatgttcccaagtaggcatt

SEQ ID NO: 1417652 - DNA, 14 bp, Homo sapiens
aatgttccctgcac

SEQ ID NO: 1417653 - DNA, 20 bp, Homo sapiens
aatgttccctgcaccctgga

SEQ ID NO: 1417654 - DNA, 15 bp, Homo sapiens
aatgttccttttgct

SEQ ID NO: 1417655 - DNA, 18 bp, Homo sapiens
aatgttccttttttgtat

SEQ ID NO: 1417656 - DNA, 17 bp, Homo sapiens
aatgttctaagtttcta

SEQ ID NO: 1417657 - DNA, 19 bp, Homo sapiens
aatgttctaagtttctaag

SEQ ID NO: 1417658 - DNA, 21 bp, Homo sapiens
aatgttctaagtttctaagat

SEQ ID NO: 1417659 - DNA, 22 bp, Homo sapiens
aatgttctaagtttctaagatt

SEQ ID NO: 1417660 - DNA, 23 bp, Homo sapiens
aatgttctaagtttctaagattc

SEQ ID NO: 1417661 - DNA, 13 bp, Homo sapiens
aatgttctattta

SEQ ID NO: 1417662 - DNA, 16 bp, Homo sapiens
aatgttgaacaaaata

SEQ ID NO: 1417663 - DNA, 12 bp, Homo sapiens
aatgttgagaag

SEQ ID NO: 1417664 - DNA, 23 bp, Homo sapiens
aatgttggtcattttatgttaag

SEQ ID NO: 1417665 - DNA, 23 bp, Homo sapiens
aatgttggtgtgaaacaaattaa

SEQ ID NO: 1417666 - DNA, 16 bp, Homo sapiens
aatgttgtacttgaaa

SEQ ID NO: 1417667 - DNA, 12 bp, Homo sapiens
aatgttgtccag

SEQ ID NO: 1417668 - DNA, 18 bp, Homo sapiens
aatgttgtgaataattac

SEQ ID NO: 1417669 - DNA, 21 bp, Homo sapiens
aatgttgtgaataattacagt

SEQ ID NO: 1417670 - DNA, 15 bp, Homo sapiens
aatgttgttatttaa

SEQ ID NO: 1417671 - DNA, 23 bp, Homo sapiens
aatgtttacactctttgtaagag

SEQ ID NO: 1417672 - DNA, 15 bp, Homo sapiens
aatgtttactgtaaa

SEQ ID NO: 1417673 - DNA, 18 bp, Homo sapiens
aatgtttactgtaaattt

SEQ ID NO: 1417674 - DNA, 15 bp, Homo sapiens
aatgtttatgagcca

SEQ ID NO: 1417675 - DNA, 21 bp, Homo sapiens
aatgtttatgcaaggaaggaa

SEQ ID NO: 1417676 - DNA, 12 bp, Homo sapiens
aatgtttctaag

SEQ ID NO: 1417677 - DNA, 13 bp, Homo sapiens
aatgtttctggac

SEQ ID NO: 1417678 - DNA, 16 bp, Homo sapiens
aatgtttctggacatt

SEQ ID NO: 1417679 - DNA, 19 bp, Homo sapiens
aatgtttctggacattctc

SEQ ID NO: 1417680 - DNA, 16 bp, Homo sapiens
aatgtttctggatttc

SEQ ID NO: 1417681 - DNA, 18 bp, Homo sapiens
aatgtttgaaaacaaaaa

SEQ ID NO: 1417682 - DNA, 21 bp, Homo sapiens
aatgtttggattctcttagct

SEQ ID NO: 1417683 - DNA, 20 bp, Homo sapiens
aatgtttgggatattaaaac

SEQ ID NO: 1417684 - DNA, 14 bp, Homo sapiens
aatgtttggtttca

SEQ ID NO: 1417685 - DNA, 22 bp, Homo sapiens
aatgtttgtgatattaaatttc

SEQ ID NO: 1417686 - DNA, 22 bp, Homo sapiens
aatgttttactgtgaaactggc

SEQ ID NO: 1417687 - DNA, 13 bp, Homo sapiens
aatgttttgtaca

SEQ ID NO: 1417688 - DNA, 22 bp, Homo sapiens
aattaaaaaatgaaattaaaaa

SEQ ID NO: 1417689 - DNA, 22 bp, Homo sapiens
aattaaaaagggccagaaaaat

SEQ ID NO: 1417690 - DNA, 14 bp, Homo sapiens
aattaaaacaaata

SEQ ID NO: 1417691 - DNA, 21 bp, Homo sapiens
aattaaaacaaatatacattt

SEQ ID NO: 1417692 - DNA, 20 bp, Homo sapiens
aattaaaagcaaatcatttg

SEQ ID NO: 1417693 - DNA, 19 bp, Homo sapiens
aattaaagatggtttatgc

SEQ ID NO: 1417694 - DNA, 14 bp, Homo sapiens
aattaaagcctttg

SEQ ID NO: 1417695 - DNA, 18 bp, Homo sapiens
aattaaatccaactttca

SEQ ID NO: 1417696 - DNA, 17 bp, Homo sapiens
aatttttatttttgaac

SEQ ID NO: 1417697 - DNA, 17 bp, Homo sapiens
aatttttcccagtattt

SEQ ID NO: 1417698 - DNA, 13 bp, Homo sapiens
aatttttcctgca

SEQ ID NO: 1417699 - DNA, 20 bp, Homo sapiens
aatttttctctaactcagaa

SEQ ID NO: 1417700 - DNA, 21 bp, Homo sapiens
aatttttcttatttcatttct

SEQ ID NO: 1417701 - DNA, 13 bp, Homo sapiens
aatttttgaaaag

SEQ ID NO: 1417702 - DNA, 17 bp, Homo sapiens
aatttttgtattatttt

SEQ ID NO: 1417703 - DNA, 14 bp, Homo sapiens
aatttttgtatttt

SEQ ID NO: 1417704 - DNA, 17 bp, Homo sapiens
aattttttataaaagtg

SEQ ID NO: 1417705 - DNA, 20 bp, Homo sapiens
aattttttatcatgcatgtc

SEQ ID NO: 1417706 - DNA, 19 bp, Homo sapiens
aatttttttcaatatttat

SEQ ID NO: 1417707 - DNA, 20 bp, Homo sapiens
aatttttttccttacctttt

SEQ ID NO: 1417708 - DNA, 16 bp, Homo sapiens
aatttttttgtaataa

SEQ ID NO: 1417709 - DNA, 16 bp, Homo sapiens
aatttttttgtcttta

SEQ ID NO: 1417710 - DNA, 19 bp, Homo sapiens
aattttttttaaaatagaa

SEQ ID NO: 1417711 - DNA, 19 bp, Homo sapiens
aattttttttaacattcct

SEQ ID NO: 1417712 - DNA, 20 bp, Homo sapiens
aattttttttagtatttatt

SEQ ID NO: 1417713 - DNA, 18 bp, Homo sapiens
aattttttttgttttttg

SEQ ID NO: 1417714 - DNA, 14 bp, Homo sapiens
aatttttttttcct

SEQ ID NO: 1417715 - DNA, 17 bp, Homo sapiens
acaaaaaaaaagtttta

SEQ ID NO: 1417716 - DNA, 21 bp, Homo sapiens
acaaaaaaaaagttttatttt

SEQ ID NO: 1417717 - DNA, 22 bp, Homo sapiens
acaaaaaaaaagttttattttt

SEQ ID NO: 1417718 - DNA, 17 bp, Homo sapiens
acaaaaaacgaatgaaa

SEQ ID NO: 1417719 - DNA, 12 bp, Homo sapiens
acaaaaaagaag

SEQ ID NO: 1417720 - DNA, 19 bp, Homo sapiens
acaaaaaataaaatgaaca

SEQ ID NO: 1417721 - DNA, 12 bp, Homo sapiens
acaaaaaatact

SEQ ID NO: 1417722 - DNA, 16 bp, Homo sapiens
acaaaaacacagcaag

SEQ ID NO: 1417723 - DNA, 18 bp, Homo sapiens
acaaaaacagaatttgag

SEQ ID NO: 1417724 - DNA, 20 bp, Homo sapiens
acaaaaacagaatttgagaa

SEQ ID NO: 1417725 - DNA, 22 bp, Homo sapiens
acaaaaacaggtatatactttg

SEQ ID NO: 1417726 - DNA, 14 bp, Homo sapiens
acaaaaaggcaaat

SEQ ID NO: 1417727 - DNA, 16 bp, Homo sapiens
acaaaaaggcaaatat

SEQ ID NO: 1417728 - DNA, 22 bp, Homo sapiens
acaaaaaggcaaatattgaagt

SEQ ID NO: 1417729 - DNA, 12 bp, Homo sapiens
acaaaaataaca

SEQ ID NO: 1417730 - DNA, 12 bp, Homo sapiens
acaaaaataata

SEQ ID NO: 1417731 - DNA, 20 bp, Homo sapiens
acaaaaatatttcagcaaac

SEQ ID NO: 1417732 - DNA, 10 bp, Homo sapiens
acaaaacaaa

SEQ ID NO: 1417733 - DNA, 12 bp, Homo sapiens
acaaaacaaaac

SEQ ID NO: 1417734 - DNA, 21 bp, Homo sapiens
acaaaaccagctgctactcat

SEQ ID NO: 1417735 - DNA, 21 bp, Homo sapiens
acaaaacctaacttgcgcaga

SEQ ID NO: 1417736 - DNA, 18 bp, Homo sapiens
acaaaactctgtataagt

SEQ ID NO: 1417737 - DNA, 14 bp, Homo sapiens
acaaaacttgaaag

SEQ ID NO: 1417738 - DNA, 17 bp, Homo sapiens
acaaaagaaaaaagcaa

SEQ ID NO: 1417739 - DNA, 21 bp, Homo sapiens
acaaaagaataacattttcta

SEQ ID NO: 1417740 - DNA, 14 bp, Homo sapiens
acaaaagagagaat

SEQ ID NO: 1417741 - DNA, 15 bp, Homo sapiens
acaaaagcaaagatg

SEQ ID NO: 1417742 - DNA, 12 bp, Homo sapiens
acaaaagcagat

SEQ ID NO: 1417743 - DNA, 22 bp, Homo sapiens
acaaaagctgaacacatttctt

SEQ ID NO: 1417744 - DNA, 22 bp, Homo sapiens
acaaaaggaaaataaatgaaca

SEQ ID NO: 1417745 - DNA, 15 bp, Homo sapiens
acaaaagggtgtata

SEQ ID NO: 1417746 - DNA, 19 bp, Homo sapiens
acaaaagggtgtatagtgt

SEQ ID NO: 1417747 - DNA, 20 bp, Homo sapiens
acaaaagggtgtatagtgtt

SEQ ID NO: 1417748 - DNA, 13 bp, Homo sapiens
acaaaatatttaa

SEQ ID NO: 1417749 - DNA, 14 bp, Homo sapiens
acaaaatctcctct

SEQ ID NO: 1417750 - DNA, 20 bp, Homo sapiens
acaaaatggggcagaagaga

SEQ ID NO: 1417751 - DNA, 18 bp, Homo sapiens
acaaaattagaaaggaca

SEQ ID NO: 1417752 - DNA, 13 bp, Homo sapiens
acaaaatttgact

SEQ ID NO: 1417753 - DNA, 13 bp, Homo sapiens
acaagccagctgg

SEQ ID NO: 1417754 - DNA, 14 bp, Homo sapiens
acaagcctcttctg

SEQ ID NO: 1417755 - DNA, 16 bp, Homo sapiens
acaagcctcttctgaa

SEQ ID NO: 1417756 - DNA, 17 bp, Homo sapiens
acaagcctgagaactga

SEQ ID NO: 1417757 - DNA, 15 bp, Homo sapiens
acaagctgacttggc

SEQ ID NO: 1417758 - DNA, 19 bp, Homo sapiens
acaaggaaaaggaggaggt

SEQ ID NO: 1417759 - DNA, 23 bp, Homo sapiens
acaaggaaggaaaagaaagaaga

SEQ ID NO: 1417760 - DNA, 13 bp, Homo sapiens
acaaggaataaat

SEQ ID NO: 1417761 - DNA, 14 bp, Homo sapiens
acaaggaataaatg

SEQ ID NO: 1417762 - DNA, 16 bp, Homo sapiens
acaaggaatgcctgtg

SEQ ID NO: 1417763 - DNA, 19 bp, Homo sapiens
acaaggaatgcctgtgcca

SEQ ID NO: 1417764 - DNA, 15 bp, Homo sapiens
acaaggacgctggct

SEQ ID NO: 1417765 - DNA, 19 bp, Homo sapiens
acaaggagctcaccctgcc

SEQ ID NO: 1417766 - DNA, 16 bp, Homo sapiens
acaaggatagatgctg

SEQ ID NO: 1417767 - DNA, 21 bp, Homo sapiens
acaaggatagatgctggccca

SEQ ID NO: 1417768 - DNA, 22 bp, Homo sapiens
acaaggatagatgctggcccag

SEQ ID NO: 1417769 - DNA, 19 bp, Homo sapiens
acaaggcagcctgaacact

SEQ ID NO: 1417770 - DNA, 16 bp, Homo sapiens
acaaggcccaggagac

SEQ ID NO: 1417771 - DNA, 14 bp, Homo sapiens
acaagggagaagac

SEQ ID NO: 1417772 - DNA, 19 bp, Homo sapiens
acaagggagcttgcttgca

SEQ ID NO: 1417773 - DNA, 14 bp, Homo sapiens
acaagggaggcagt

SEQ ID NO: 1417774 - DNA, 13 bp, Homo sapiens
acaagggattctg

SEQ ID NO: 1417775 - DNA, 14 bp, Homo sapiens
acaagggattctgg

SEQ ID NO: 1417776 - DNA, 20 bp, Homo sapiens
acaagggtctagggagagac

SEQ ID NO: 1417777 - DNA, 16 bp, Homo sapiens
acaaggtagtttttac

SEQ ID NO: 1417778 - DNA, 22 bp, Homo sapiens
acaaggtgccctttagccagat

SEQ ID NO: 1417779 - DNA, 19 bp, Homo sapiens
acaaggtgctaacatagat

SEQ ID NO: 1417780 - DNA, 22 bp, Homo sapiens
acaaggttcttcccttttacat

SEQ ID NO: 1417781 - DNA, 15 bp, Homo sapiens
acaagtaaaactgtg

SEQ ID NO: 1417782 - DNA, 16 bp, Homo sapiens
acaagtaatttcagtg

SEQ ID NO: 1417783 - DNA, 23 bp, Homo sapiens
acaagtatgaataaagacaccta

SEQ ID NO: 1417784 - DNA, 16 bp, Homo sapiens
acaagtcacagctgca

SEQ ID NO: 1417785 - DNA, 19 bp, Homo sapiens
acaagtcacagctgcagct

SEQ ID NO: 1417786 - DNA, 20 bp, Homo sapiens
acaagtcctggatgttgtgt

SEQ ID NO: 1417787 - DNA, 18 bp, Homo sapiens
acaagtgaaaaacatcca

SEQ ID NO: 1417788 - DNA, 22 bp, Homo sapiens
acaagtgaagaacactactgct

SEQ ID NO: 1417789 - DNA, 17 bp, Homo sapiens
acaagtgggcagcataa

SEQ ID NO: 1417790 - DNA, 15 bp, Homo sapiens
acaagtggtaatttt

SEQ ID NO: 1417791 - DNA, 15 bp, Homo sapiens
acaagtgttcttagg

SEQ ID NO: 1417792 - DNA, 15 bp, Homo sapiens
acaagttattctctt

SEQ ID NO: 1417793 - DNA, 22 bp, Homo sapiens
acaagttcgagtcaaagttgaa

SEQ ID NO: 1417794 - DNA, 16 bp, Homo sapiens
acaagttgttaaaaca

SEQ ID NO: 1417795 - DNA, 16 bp, Homo sapiens
acaagtttcagacagg

SEQ ID NO: 1417796 - DNA, 13 bp, Homo sapiens
acaataaaagctt

SEQ ID NO: 1417797 - DNA, 13 bp, Homo sapiens
acaataaacagga

SEQ ID NO: 1417798 - DNA, 10 bp, Homo sapiens
acaataaact

SEQ ID NO: 1417799 - DNA, 14 bp, Homo sapiens
acaataaataatct

SEQ ID NO: 1417800 - DNA, 17 bp, Homo sapiens
acaataaatatgtatta

SEQ ID NO: 1417801 - DNA, 13 bp, Homo sapiens
acaataaatattc

SEQ ID NO: 1417802 - DNA, 15 bp, Homo sapiens
acaataaatattctg

SEQ ID NO: 1417803 - DNA, 15 bp, Homo sapiens
acaataaatgaatga

SEQ ID NO: 1417804 - DNA, 20 bp, Homo sapiens
acaataaatgtattcaaata

SEQ ID NO: 1417805 - DNA, 15 bp, Homo sapiens
acaataaatgtgctt

SEQ ID NO: 1417806 - DNA, 14 bp, Homo sapiens
acaataaatttttt

SEQ ID NO: 1417807 - DNA, 15 bp, Homo sapiens
acaataatatttcaa

SEQ ID NO: 1417808 - DNA, 20 bp, Homo sapiens
acaataatctctatttgaga

SEQ ID NO: 1417809 - DNA, 14 bp, Homo sapiens
acaataatgagagc

SEQ ID NO: 1417810 - DNA, 12 bp, Homo sapiens
acaataatttca

SEQ ID NO: 1417811 - DNA, 14 bp, Homo sapiens
acaatacaatgtac

SEQ ID NO: 1417812 - DNA, 16 bp, Homo sapiens
acaatacagtattata

SEQ ID NO: 1417813 - DNA, 16 bp, Homo sapiens
acaatacatgctgcta

SEQ ID NO: 1417814 - DNA, 22 bp, Homo sapiens
acaataggagtggtgatttgaa

SEQ ID NO: 1417815 - DNA, 23 bp, Homo sapiens
acaataggagtggtgatttgaaa

SEQ ID NO: 1417816 - DNA, 15 bp, Homo sapiens
acaatagtatagaag

SEQ ID NO: 1417817 - DNA, 15 bp, Homo sapiens
acaatagtcagaaaa

SEQ ID NO: 1417818 - DNA, 16 bp, Homo sapiens
acaatagtcagaaaac

SEQ ID NO: 1417819 - DNA, 18 bp, Homo sapiens
acaatataaaactgtact

SEQ ID NO: 1417820 - DNA, 19 bp, Homo sapiens
acaatataaaactgtactt

SEQ ID NO: 1417821 - DNA, 11 bp, Homo sapiens
acaatatatat

SEQ ID NO: 1417822 - DNA, 20 bp, Homo sapiens
acaatatatattatatatat

SEQ ID NO: 1417823 - DNA, 15 bp, Homo sapiens
acaatatgaatacag

SEQ ID NO: 1417824 - DNA, 18 bp, Homo sapiens
acaatatgccctttctgg

SEQ ID NO: 1417825 - DNA, 17 bp, Homo sapiens
acaatatgtacatttct

SEQ ID NO: 1417826 - DNA, 17 bp, Homo sapiens
acaatattccagatctt

SEQ ID NO: 1417827 - DNA, 14 bp, Homo sapiens
acaatattgaactt

SEQ ID NO: 1417828 - DNA, 18 bp, Homo sapiens
acaatattgattgggaaa

SEQ ID NO: 1417829 - DNA, 14 bp, Homo sapiens
acaatcactgccaa

SEQ ID NO: 1417830 - DNA, 19 bp, Homo sapiens
acaatcagccacattctag

SEQ ID NO: 1417831 - DNA, 15 bp, Homo sapiens
acaatcagtcccctc

SEQ ID NO: 1417832 - DNA, 19 bp, Homo sapiens
acaatcatgaaatatgcat

SEQ ID NO: 1417833 - DNA, 21 bp, Homo sapiens
acaatcatggcggaaggtgaa

SEQ ID NO: 1417834 - DNA, 21 bp, Homo sapiens
acaatcatggtcaagttccca

SEQ ID NO: 1417835 - DNA, 19 bp, Homo sapiens
acaatcgtcttaagttttt

SEQ ID NO: 1417836 - DNA, 12 bp, Homo sapiens
acaatctaacaa

SEQ ID NO: 1417837 - DNA, 16 bp, Homo sapiens
acaatctaccaactgt

SEQ ID NO: 1417838 - DNA, 15 bp, Homo sapiens
acaatcttggggctg

SEQ ID NO: 1417839 - DNA, 19 bp, Homo sapiens
acaatcttggggctgatga

SEQ ID NO: 1417840 - DNA, 15 bp, Homo sapiens
acaatgacaagatgt

SEQ ID NO: 1417841 - DNA, 16 bp, Homo sapiens
acaatgacaagatgtt

SEQ ID NO: 1417842 - DNA, 17 bp, Homo sapiens
acaatgatgatgataat

SEQ ID NO: 1417843 - DNA, 21 bp, Homo sapiens
acaatgatgatgataatgatg

SEQ ID NO: 1417844 - DNA, 14 bp, Homo sapiens
acaatgccatgaac

SEQ ID NO: 1417845 - DNA, 15 bp, Homo sapiens
acaatgccatgaaca

SEQ ID NO: 1417846 - DNA, 18 bp, Homo sapiens
acaatgccatgaacaaat

SEQ ID NO: 1417847 - DNA, 20 bp, Homo sapiens
acaatgccatgaacaaattc

SEQ ID NO: 1417848 - DNA, 17 bp, Homo sapiens
acaatgcctacagctgt

SEQ ID NO: 1417849 - DNA, 19 bp, Homo sapiens
acaatggaaactgaatgct

SEQ ID NO: 1417850 - DNA, 13 bp, Homo sapiens
acaatggaataaa

SEQ ID NO: 1417851 - DNA, 12 bp, Homo sapiens
acaatggcagct

SEQ ID NO: 1417852 - DNA, 17 bp, Homo sapiens
acaatggggactttgtt

SEQ ID NO: 1417853 - DNA, 14 bp, Homo sapiens
acaatggttgaatg

SEQ ID NO: 1417854 - DNA, 19 bp, Homo sapiens
acaatggtttattcccaag

SEQ ID NO: 1417855 - DNA, 12 bp, Homo sapiens
acaatgtaaagt

SEQ ID NO: 1417856 - DNA, 19 bp, Homo sapiens
acaatgtaataaaaagcct

SEQ ID NO: 1417857 - DNA, 13 bp, Homo sapiens
acaatgtacaatt

SEQ ID NO: 1417858 - DNA, 14 bp, Homo sapiens
acaatgtacaatta

SEQ ID NO: 1417859 - DNA, 17 bp, Homo sapiens
acaatgtacaattatgt

SEQ ID NO: 1417860 - DNA, 19 bp, Homo sapiens
acaatgtataaagattgta

SEQ ID NO: 1417861 - DNA, 15 bp, Homo sapiens
acaatgtatctttat

SEQ ID NO: 1417862 - DNA, 20 bp, Homo sapiens
acaatgtatgtacaatacaa

SEQ ID NO: 1417863 - DNA, 21 bp, Homo sapiens
acaatgtatgtacaatacaat

SEQ ID NO: 1417864 - DNA, 11 bp, Homo sapiens
acaatgtattt

SEQ ID NO: 1417865 - DNA, 14 bp, Homo sapiens
acaatgtatttatt

SEQ ID NO: 1417866 - DNA, 17 bp, Homo sapiens
acaatgtatttatttaa

SEQ ID NO: 1417867 - DNA, 23 bp, Homo sapiens
acaatgttccttttttgtatatt

SEQ ID NO: 1417868 - DNA, 14 bp, Homo sapiens
acaatgttgagaag

SEQ ID NO: 1417869 - DNA, 16 bp, Homo sapiens
acaatgttgtccaaca

SEQ ID NO: 1417870 - DNA, 21 bp, Homo sapiens
acaatgttgtccaacaataaa

SEQ ID NO: 1417871 - DNA, 22 bp, Homo sapiens
acaaataaatgattatattcac

SEQ ID NO: 1417872 - DNA, 12 bp, Homo sapiens
acaaatacctcc

SEQ ID NO: 1417873 - DNA, 17 bp, Homo sapiens
acaaatactcttaggaa

SEQ ID NO: 1417874 - DNA, 16 bp, Homo sapiens
acaaatagaaaatggt

SEQ ID NO: 1417875 - DNA, 16 bp, Homo sapiens
acaaatatagttgaac

SEQ ID NO: 1417876 - DNA, 12 bp, Homo sapiens
acaaatatgcaa

SEQ ID NO: 1417877 - DNA, 23 bp, Homo sapiens
acaaatatttattttctttctgt

SEQ ID NO: 1417878 - DNA, 17 bp, Homo sapiens
acaaatcagttagtttt

SEQ ID NO: 1417879 - DNA, 22 bp, Homo sapiens
acaaatctaatctcttattcta

SEQ ID NO: 1417880 - DNA, 20 bp, Homo sapiens
acaaatggagctttctgtat

SEQ ID NO: 1417881 - DNA, 19 bp, Homo sapiens
acaaatgggactgatgtca

SEQ ID NO: 1417882 - DNA, 14 bp, Homo sapiens
acaaatgtcattgt

SEQ ID NO: 1417883 - DNA, 18 bp, Homo sapiens
acaaatgtcattgtctac

SEQ ID NO: 1417884 - DNA, 14 bp, Homo sapiens
acaaatgtctatca

SEQ ID NO: 1417885 - DNA, 15 bp, Homo sapiens
acaaatgtgaaacgg

SEQ ID NO: 1417886 - DNA, 22 bp, Homo sapiens
acaaatgtgtatcggatgcttt

SEQ ID NO: 1417887 - DNA, 20 bp, Homo sapiens
acaaatgtgtttttctatat

SEQ ID NO: 1417888 - DNA, 13 bp, Homo sapiens
acaaatgtttcta

SEQ ID NO: 1417889 - DNA, 18 bp, Homo sapiens
acaaattacaaaaggctc

SEQ ID NO: 1417890 - DNA, 20 bp, Homo sapiens
acaaattataatgtattcat

SEQ ID NO: 1417891 - DNA, 17 bp, Homo sapiens
acaaattcatattctgt

SEQ ID NO: 1417892 - DNA, 18 bp, Homo sapiens
acaaattctttagtactc

SEQ ID NO: 1417893 - DNA, 13 bp, Homo sapiens
acaaatttatgca

SEQ ID NO: 1417894 - DNA, 21 bp, Homo sapiens
acaaatttatgcatttcattc

SEQ ID NO: 1417895 - DNA, 17 bp, Homo sapiens
acaaatttggccttaag

SEQ ID NO: 1417896 - DNA, 19 bp, Homo sapiens
acaacaaaaaatacattat

SEQ ID NO: 1417897 - DNA, 13 bp, Homo sapiens
acaacaaaagaaa

SEQ ID NO: 1417898 - DNA, 13 bp, Homo sapiens
acaacaaagacat

SEQ ID NO: 1417899 - DNA, 14 bp, Homo sapiens
acaacaacaataat

SEQ ID NO: 1417900 - DNA, 15 bp, Homo sapiens
acaacaacaataata

SEQ ID NO: 1417901 - DNA, 19 bp, Homo sapiens
acaacaataataaagatgt

SEQ ID NO: 1417902 - DNA, 23 bp, Homo sapiens
acaacaataataaagatgtgaaa

SEQ ID NO: 1417903 - DNA, 14 bp, Homo sapiens
acaacacacacact

SEQ ID NO: 1417904 - DNA, 14 bp, Homo sapiens
acaacaccaggact

SEQ ID NO: 1417905 - DNA, 14 bp, Homo sapiens
acaacagaaaaaca

SEQ ID NO: 1417906 - DNA, 12 bp, Homo sapiens
acaacagaaaga

SEQ ID NO: 1417907 - DNA, 13 bp, Homo sapiens
acaacagaaagag

SEQ ID NO: 1417908 - DNA, 15 bp, Homo sapiens
acaacagcagtctcc

SEQ ID NO: 1417909 - DNA, 16 bp, Homo sapiens
acaacagctgaagcac

SEQ ID NO: 1417910 - DNA, 18 bp, Homo sapiens
acaacaggttttcaccat

SEQ ID NO: 1417911 - DNA, 18 bp, Homo sapiens
acaacagttctcttctag

SEQ ID NO: 1417912 - DNA, 22 bp, Homo sapiens
acaacagttctgagctgtaatt

SEQ ID NO: 1417913 - DNA, 22 bp, Homo sapiens
acaacatagcagatctgttttg

SEQ ID NO: 1417914 - DNA, 12 bp, Homo sapiens
acaacatcattc

SEQ ID NO: 1417915 - DNA, 17 bp, Homo sapiens
acaacatcccacagtgg

SEQ ID NO: 1417916 - DNA, 14 bp, Homo sapiens
acaacattatgatc

SEQ ID NO: 1417917 - DNA, 15 bp, Homo sapiens
acaaccctaccctgg

SEQ ID NO: 1417918 - DNA, 16 bp, Homo sapiens
acaaccctaccctggc

SEQ ID NO: 1417919 - DNA, 18 bp, Homo sapiens
acaaccctaccctggcag

SEQ ID NO: 1417920 - DNA, 13 bp, Homo sapiens
acaaccgttggaa

SEQ ID NO: 1417921 - DNA, 14 bp, Homo sapiens
acaacctagaatgt

SEQ ID NO: 1417922 - DNA, 15 bp, Homo sapiens
acaacctagaatgtc

SEQ ID NO: 1417923 - DNA, 15 bp, Homo sapiens
acaacctcaactgcc

SEQ ID NO: 1417924 - DNA, 16 bp, Homo sapiens
acaacctctctgatct

SEQ ID NO: 1417925 - DNA, 15 bp, Homo sapiens
acaacctgaaattta

SEQ ID NO: 1417926 - DNA, 12 bp, Homo sapiens
acaacctttctg

SEQ ID NO: 1417927 - DNA, 15 bp, Homo sapiens
acaaccttttacatt

SEQ ID NO: 1417928 - DNA, 14 bp, Homo sapiens
acaacgaatgaatg

SEQ ID NO: 1417929 - DNA, 23 bp, Homo sapiens
acaacgcattgccacggaaacat

SEQ ID NO: 1417930 - DNA, 22 bp, Homo sapiens
acaacggagtcaaaaattaaac

SEQ ID NO: 1417931 - DNA, 17 bp, Homo sapiens
acaactaacttgtttga

SEQ ID NO: 1417932 - DNA, 18 bp, Homo sapiens
acaactaacttgtttgag

SEQ ID NO: 1417933 - DNA, 23 bp, Homo sapiens
acaactagatttgtccttttatt

SEQ ID NO: 1417934 - DNA, 17 bp, Homo sapiens
acaactatgtaatttat

SEQ ID NO: 1417935 - DNA, 18 bp, Homo sapiens
acaactatgtaatttata

SEQ ID NO: 1417936 - DNA, 16 bp, Homo sapiens
acaactatttttccaa

SEQ ID NO: 1417937 - DNA, 14 bp, Homo sapiens
acaactatttttgt

SEQ ID NO: 1417938 - DNA, 13 bp, Homo sapiens
acaactctatttt

SEQ ID NO: 1417939 - DNA, 12 bp, Homo sapiens
acaactctgcct

SEQ ID NO: 1417940 - DNA, 16 bp, Homo sapiens
acaactctgcctttat

SEQ ID NO: 1417941 - DNA, 14 bp, Homo sapiens
acaactgacacagg

SEQ ID NO: 1417942 - DNA, 16 bp, Homo sapiens
acaactgacacaggaa

SEQ ID NO: 1417943 - DNA, 15 bp, Homo sapiens
acaactgcaaagaaa

SEQ ID NO: 1417944 - DNA, 18 bp, Homo sapiens
acaactgcacatgaaagt

SEQ ID NO: 1417945 - DNA, 14 bp, Homo sapiens
acaacttaaataat

SEQ ID NO: 1417946 - DNA, 15 bp, Homo sapiens
acaacttaatggaaa

SEQ ID NO: 1417947 - DNA, 21 bp, Homo sapiens
acaacttagctcaggtgcctt

SEQ ID NO: 1417948 - DNA, 16 bp, Homo sapiens
acaacttatttaaaaa

SEQ ID NO: 1417949 - DNA, 15 bp, Homo sapiens
acaacttggcatttc

SEQ ID NO: 1417950 - DNA, 17 bp, Homo sapiens
acaacttggcatttcta

SEQ ID NO: 1417951 - DNA, 16 bp, Homo sapiens
acaacttgtatttcca

SEQ ID NO: 1417952 - DNA, 13 bp, Homo sapiens
acaactttatacc

SEQ ID NO: 1417953 - DNA, 14 bp, Homo sapiens
acaactttcacttc

SEQ ID NO: 1417954 - DNA, 19 bp, Homo sapiens
acaactttcacttcttcct

SEQ ID NO: 1417955 - DNA, 20 bp, Homo sapiens
acaacttttaaagaaaaata

SEQ ID NO: 1417956 - DNA, 16 bp, Homo sapiens
acaagaaaggcagaca

SEQ ID NO: 1417957 - DNA, 18 bp, Homo sapiens
acaagaaaggcagacaca

SEQ ID NO: 1417958 - DNA, 11 bp, Homo sapiens
acaagaaatgg

SEQ ID NO: 1417959 - DNA, 18 bp, Homo sapiens
acaagaccgccccagggc

SEQ ID NO: 1417960 - DNA, 17 bp, Homo sapiens
acaagagatctacacat

SEQ ID NO: 1417961 - DNA, 19 bp, Homo sapiens
acaagagatctacacatgt

SEQ ID NO: 1417962 - DNA, 20 bp, Homo sapiens
acaagagatctacacatgtt

SEQ ID NO: 1417963 - DNA, 13 bp, Homo sapiens
acaagagatggga

SEQ ID NO: 1417964 - DNA, 14 bp, Homo sapiens
acaagagcagcctg

SEQ ID NO: 1417965 - DNA, 18 bp, Homo sapiens
acaagagcagcctgtggc

SEQ ID NO: 1417966 - DNA, 19 bp, Homo sapiens
acaagagcagcctgtggca

SEQ ID NO: 1417967 - DNA, 16 bp, Homo sapiens
acaagagcgaaactcc

SEQ ID NO: 1417968 - DNA, 15 bp, Homo sapiens
acaagagctgctgtc

SEQ ID NO: 1417969 - DNA, 20 bp, Homo sapiens
acaagaggaagagagagacc

SEQ ID NO: 1417970 - DNA, 18 bp, Homo sapiens
acaagatattgtacataa

SEQ ID NO: 1417971 - DNA, 16 bp, Homo sapiens
acaagatctttcagga

SEQ ID NO: 1417972 - DNA, 14 bp, Homo sapiens
acaagatgggacag

SEQ ID NO: 1417973 - DNA, 14 bp, Homo sapiens
acaagatggtccat

SEQ ID NO: 1417974 - DNA, 17 bp, Homo sapiens
acaagatggttctagca

SEQ ID NO: 1417975 - DNA, 14 bp, Homo sapiens
acaagattcccaga

SEQ ID NO: 1417976 - DNA, 15 bp, Homo sapiens
acaagattcccagag

SEQ ID NO: 1417977 - DNA, 17 bp, Homo sapiens
acaagattcccagagac

SEQ ID NO: 1417978 - DNA, 16 bp, Homo sapiens
acaagatttagaaaaa

SEQ ID NO: 1417979 - DNA, 18 bp, Homo sapiens
acaagatttccttgtgca

SEQ ID NO: 1417980 - DNA, 19 bp, Homo sapiens
acaagcacaaagctcaaga

SEQ ID NO: 1417981 - DNA, 21 bp, Homo sapiens
acaagcactattttatattta

SEQ ID NO: 1417982 - DNA, 21 bp, Homo sapiens
acaagcagagtgcacagctgt

SEQ ID NO: 1417983 - DNA, 22 bp, Homo sapiens
acaagcagagtgcacagctgtc

SEQ ID NO: 1417984 - DNA, 13 bp, Homo sapiens
acaagcagccctt

SEQ ID NO: 1417985 - DNA, 14 bp, Homo sapiens
acaagcagtccctt

SEQ ID NO: 1417986 - DNA, 19 bp, Homo sapiens
acaagcatgcagctttgca

SEQ ID NO: 1417987 - DNA, 14 bp, Homo sapiens
acaagcatgtctct

SEQ ID NO: 1417988 - DNA, 22 bp, Homo sapiens
acaagcatgtctctctgccaag

SEQ ID NO: 1417989 - DNA, 14 bp, Homo sapiens
aattacctgtggat

SEQ ID NO: 1417990 - DNA, 24 bp, Homo sapiens
aattactaaattgtatacattttg

SEQ ID NO: 1417991 - DNA, 17 bp, Homo sapiens
aattactacaaaatttg

SEQ ID NO: 1417992 - DNA, 13 bp, Homo sapiens
aattactcaggaa

SEQ ID NO: 1417993 - DNA, 14 bp, Homo sapiens
aattactcaggttt

SEQ ID NO: 1417994 - DNA, 18 bp, Homo sapiens
aattactgtatataaact

SEQ ID NO: 1417995 - DNA, 13 bp, Homo sapiens
aattactgtgtgt

SEQ ID NO: 1417996 - DNA, 22 bp, Homo sapiens
aattactttcagaatattttca

SEQ ID NO: 1417997 - DNA, 14 bp, Homo sapiens
aattactttggtag

SEQ ID NO: 1417998 - DNA, 16 bp, Homo sapiens
aattacttttaaatat

SEQ ID NO: 1417999 - DNA, 17 bp, Homo sapiens
aattacttttaaatatt

SEQ ID NO: 1418000 - DNA, 19 bp, Homo sapiens
aattagaatgaatttatct

SEQ ID NO: 1418001 - DNA, 18 bp, Homo sapiens
aattagagaagctgaaag

SEQ ID NO: 1418002 - DNA, 12 bp, Homo sapiens
aattagaggaga

SEQ ID NO: 1418003 - DNA, 12 bp, Homo sapiens
aattagatttgt

SEQ ID NO: 1418004 - DNA, 12 bp, Homo sapiens
aattagcaattg

SEQ ID NO: 1418005 - DNA, 15 bp, Homo sapiens
aattagcatgctgct

SEQ ID NO: 1418006 - DNA, 14 bp, Homo sapiens
aattagccgggcgt

SEQ ID NO: 1418007 - DNA, 19 bp, Homo sapiens
aattagcctaagatatact

SEQ ID NO: 1418008 - DNA, 22 bp, Homo sapiens
aattagcctaagatatacttgt

SEQ ID NO: 1418009 - DNA, 14 bp, Homo sapiens
aattagctgggcgt

SEQ ID NO: 1418010 - DNA, 17 bp, Homo sapiens
aattaggctgtaactac

SEQ ID NO: 1418011 - DNA, 19 bp, Homo sapiens
aattaggctgtaactactt

SEQ ID NO: 1418012 - DNA, 17 bp, Homo sapiens
aattaggggttgctaag

SEQ ID NO: 1418013 - DNA, 16 bp, Homo sapiens
aattaggtagcacagc

SEQ ID NO: 1418014 - DNA, 17 bp, Homo sapiens
aattagtatgtctgttt

SEQ ID NO: 1418015 - DNA, 18 bp, Homo sapiens
aattagtcttttgtaata

SEQ ID NO: 1418016 - DNA, 17 bp, Homo sapiens
aattagtgccacttaat

SEQ ID NO: 1418017 - DNA, 20 bp, Homo sapiens
aattagtgccacttaatgta

SEQ ID NO: 1418018 - DNA, 21 bp, Homo sapiens
aattagtggtcataaaataga

SEQ ID NO: 1418019 - DNA, 22 bp, Homo sapiens
aattagtgtgacagtttccaaa

SEQ ID NO: 1418020 - DNA, 23 bp, Homo sapiens
aattagtgtgacagtttccaaat

SEQ ID NO: 1418021 - DNA, 19 bp, Homo sapiens
aattagttggtttgtgtga

SEQ ID NO: 1418022 - DNA, 20 bp, Homo sapiens
aattagtttatattactctc

SEQ ID NO: 1418023 - DNA, 23 bp, Homo sapiens
aattagtttcctttttaatatgc

SEQ ID NO: 1418024 - DNA, 15 bp, Homo sapiens
aattataacagttat

SEQ ID NO: 1418025 - DNA, 17 bp, Homo sapiens
aattataacttaaaata

SEQ ID NO: 1418026 - DNA, 23 bp, Homo sapiens
aattataacttaaaatattttat

SEQ ID NO: 1418027 - DNA, 12 bp, Homo sapiens
aattataatgta

SEQ ID NO: 1418028 - DNA, 16 bp, Homo sapiens
aattataatgtattca

SEQ ID NO: 1418029 - DNA, 18 bp, Homo sapiens
aattataatgtattcata

SEQ ID NO: 1418030 - DNA, 22 bp, Homo sapiens
aattataatgtattcatatttg

SEQ ID NO: 1418031 - DNA, 14 bp, Homo sapiens
aattatactacttt

SEQ ID NO: 1418032 - DNA, 21 bp, Homo sapiens
aattataggagccttaatttt

SEQ ID NO: 1418033 - DNA, 20 bp, Homo sapiens
aattatagtagcttataaga

SEQ ID NO: 1418034 - DNA, 21 bp, Homo sapiens
aattatagtttctgaggcttt

SEQ ID NO: 1418035 - DNA, 14 bp, Homo sapiens
aattatataactgt

SEQ ID NO: 1418036 - DNA, 15 bp, Homo sapiens
aattatataagtatt

SEQ ID NO: 1418037 - DNA, 17 bp, Homo sapiens
aattatataagtattct

SEQ ID NO: 1418038 - DNA, 21 bp, Homo sapiens
aattatatattttgttgttcc

SEQ ID NO: 1418039 - DNA, 20 bp, Homo sapiens
aattatcagcaaagaaaaaa

SEQ ID NO: 1418040 - DNA, 21 bp, Homo sapiens
aattatcctgaactcttctgc

SEQ ID NO: 1418041 - DNA, 17 bp, Homo sapiens
aattatcggaagcagtg

SEQ ID NO: 1418042 - DNA, 20 bp, Homo sapiens
aattatcggaagcagtgcct

SEQ ID NO: 1418043 - DNA, 17 bp, Homo sapiens
aattatcgggaacagtg

SEQ ID NO: 1418044 - DNA, 19 bp, Homo sapiens
aattatcgggaacagtgtt

SEQ ID NO: 1418045 - DNA, 20 bp, Homo sapiens
aattatcgggaacagtgttt

SEQ ID NO: 1418046 - DNA, 18 bp, Homo sapiens
aattatctaatttataaa

SEQ ID NO: 1418047 - DNA, 19 bp, Homo sapiens
aattatctaatttataaaa

SEQ ID NO: 1418048 - DNA, 13 bp, Homo sapiens
aattatgacagtt

SEQ ID NO: 1418049 - DNA, 18 bp, Homo sapiens
aattatggcatttctatt

SEQ ID NO: 1418050 - DNA, 21 bp, Homo sapiens
aattatgggaataattgcttt

SEQ ID NO: 1418051 - DNA, 22 bp, Homo sapiens
aattatgggaataattgctttt

SEQ ID NO: 1418052 - DNA, 19 bp, Homo sapiens
aattatgtaaatacaattt

SEQ ID NO: 1418053 - DNA, 18 bp, Homo sapiens
aattatgtaatgcaaaat

SEQ ID NO: 1418054 - DNA, 13 bp, Homo sapiens
aattatgtaccat

SEQ ID NO: 1418055 - DNA, 15 bp, Homo sapiens
aattatgtctcttga

SEQ ID NO: 1418056 - DNA, 11 bp, Homo sapiens
aattatgtgac

SEQ ID NO: 1418057 - DNA, 19 bp, Homo sapiens
aattattaccagttatttg

SEQ ID NO: 1418058 - DNA, 16 bp, Homo sapiens
aattattagcatttgt

SEQ ID NO: 1418059 - DNA, 20 bp, Homo sapiens
aattattagtttacatcatt

SEQ ID NO: 1418060 - DNA, 11 bp, Homo sapiens
aattattattt

SEQ ID NO: 1418061 - DNA, 16 bp, Homo sapiens
aattattatttatata

SEQ ID NO: 1418062 - DNA, 15 bp, Homo sapiens
aattattatttgtgt

SEQ ID NO: 1418063 - DNA, 18 bp, Homo sapiens
aattattatttgtgtttt

SEQ ID NO: 1418064 - DNA, 18 bp, Homo sapiens
aattattattttaaaata

SEQ ID NO: 1418065 - DNA, 20 bp, Homo sapiens
aattattattttaaaatata

SEQ ID NO: 1418066 - DNA, 22 bp, Homo sapiens
aattattattttaaaatatatg

SEQ ID NO: 1418067 - DNA, 12 bp, Homo sapiens
aattattctagt

SEQ ID NO: 1418068 - DNA, 18 bp, Homo sapiens
aattattctagtcaactg

SEQ ID NO: 1418069 - DNA, 13 bp, Homo sapiens
aattattctgatt

SEQ ID NO: 1418070 - DNA, 11 bp, Homo sapiens
aattattgtaa

SEQ ID NO: 1418071 - DNA, 12 bp, Homo sapiens
aattatttgaat

SEQ ID NO: 1418072 - DNA, 17 bp, Homo sapiens
aattattttaaaatatt

SEQ ID NO: 1418073 - DNA, 22 bp, Homo sapiens
aattattttgaatgtcacaaat

SEQ ID NO: 1418074 - DNA, 11 bp, Homo sapiens
aattattttgg

SEQ ID NO: 1418075 - DNA, 18 bp, Homo sapiens
aattattttgttcataca

SEQ ID NO: 1418076 - DNA, 21 bp, Homo sapiens
aattattttgttcatacatat

SEQ ID NO: 1418077 - DNA, 13 bp, Homo sapiens
aattcaaaaacaa

SEQ ID NO: 1418078 - DNA, 15 bp, Homo sapiens
aattcaaaagtattg

SEQ ID NO: 1418079 - DNA, 19 bp, Homo sapiens
aattcaaaagtgattatct

SEQ ID NO: 1418080 - DNA, 15 bp, Homo sapiens
aattcaactttgtaa

SEQ ID NO: 1418081 - DNA, 16 bp, Homo sapiens
aattcaactttgtaaa

SEQ ID NO: 1418082 - DNA, 12 bp, Homo sapiens
aattcaagaaaa

SEQ ID NO: 1418083 - DNA, 20 bp, Homo sapiens
aattcaagaaaacaacttca

SEQ ID NO: 1418084 - DNA, 17 bp, Homo sapiens
aattcaatcctactttt

SEQ ID NO: 1418085 - DNA, 17 bp, Homo sapiens
aattcaccaaagtattt

SEQ ID NO: 1418086 - DNA, 21 bp, Homo sapiens
aattcactccagtcaacagat

SEQ ID NO: 1418087 - DNA, 23 bp, Homo sapiens
aattcactcccacacccaagaag

SEQ ID NO: 1418088 - DNA, 21 bp, Homo sapiens
aattcagaaggatcttcatct

SEQ ID NO: 1418089 - DNA, 18 bp, Homo sapiens
aattcagacaacattatg

SEQ ID NO: 1418090 - DNA, 16 bp, Homo sapiens
aattcagacatctgag

SEQ ID NO: 1418091 - DNA, 16 bp, Homo sapiens
aattcagcaaaccatt

SEQ ID NO: 1418092 - DNA, 20 bp, Homo sapiens
aattcagcactgatttcaca

SEQ ID NO: 1418093 - DNA, 18 bp, Homo sapiens
aattcagtctcagctgct

SEQ ID NO: 1418094 - DNA, 15 bp, Homo sapiens
aattcataaaaacaa

SEQ ID NO: 1418095 - DNA, 16 bp, Homo sapiens
aattcataaccaaaga

SEQ ID NO: 1418096 - DNA, 17 bp, Homo sapiens
aattcatctatttcgag

SEQ ID NO: 1418097 - DNA, 20 bp, Homo sapiens
aattcattgagcagttagct

SEQ ID NO: 1418098 - DNA, 12 bp, Homo sapiens
aattcatttgta

SEQ ID NO: 1418099 - DNA, 19 bp, Homo sapiens
aattcatttgtattgctta

SEQ ID NO: 1418100 - DNA, 15 bp, Homo sapiens
aattcatttttttca

SEQ ID NO: 1418101 - DNA, 14 bp, Homo sapiens
aattccaaacatgg

SEQ ID NO: 1418102 - DNA, 14 bp, Homo sapiens
aattccaaaggaat

SEQ ID NO: 1418103 - DNA, 12 bp, Homo sapiens
aattccaaagtc

SEQ ID NO: 1418104 - DNA, 11 bp, Homo sapiens
aattccacagg

SEQ ID NO: 1418105 - DNA, 21 bp, Homo sapiens
aattccactggacttgagctt

SEQ ID NO: 1418106 - DNA, 14 bp, Homo sapiens
aatggcctggaggg

SEQ ID NO: 1418107 - DNA, 17 bp, Homo sapiens
aatggcgtctgctctgg

SEQ ID NO: 1418108 - DNA, 18 bp, Homo sapiens
aatggctaataaactgta

SEQ ID NO: 1418109 - DNA, 19 bp, Homo sapiens
aatggctaataaactgtat

SEQ ID NO: 1418110 - DNA, 23 bp, Homo sapiens
aatggctaataaactgtattaaa

SEQ ID NO: 1418111 - DNA, 21 bp, Homo sapiens
aatggctgcacctttttgcat

SEQ ID NO: 1418112 - DNA, 15 bp, Homo sapiens
aatggctgggtcagg

SEQ ID NO: 1418113 - DNA, 17 bp, Homo sapiens
aatggctgtaatcattt

SEQ ID NO: 1418114 - DNA, 15 bp, Homo sapiens
aatgggaaaaaactt

SEQ ID NO: 1418115 - DNA, 12 bp, Homo sapiens
aatgggaaatag

SEQ ID NO: 1418116 - DNA, 15 bp, Homo sapiens
aatgggaagactcag

SEQ ID NO: 1418117 - DNA, 18 bp, Homo sapiens
aatgggactggagtccct

SEQ ID NO: 1418118 - DNA, 18 bp, Homo sapiens
aatgggagacagcctctt

SEQ ID NO: 1418119 - DNA, 18 bp, Homo sapiens
aatgggagatggtcagtg

SEQ ID NO: 1418120 - DNA, 23 bp, Homo sapiens
aatgggatggtcggatctcacag

SEQ ID NO: 1418121 - DNA, 15 bp, Homo sapiens
aatggggattattat

SEQ ID NO: 1418122 - DNA, 13 bp, Homo sapiens
aatggggccagat

SEQ ID NO: 1418123 - DNA, 19 bp, Homo sapiens
aatggggggcgggccaggg

SEQ ID NO: 1418124 - DNA, 21 bp, Homo sapiens
aatggggggcgggccagggtg

SEQ ID NO: 1418125 - DNA, 15 bp, Homo sapiens
aatgggtcatgacaa

SEQ ID NO: 1418126 - DNA, 15 bp, Homo sapiens
aatgggttacttgat

SEQ ID NO: 1418127 - DNA, 23 bp, Homo sapiens
aatggtagtaatcacagttggcc

SEQ ID NO: 1418128 - DNA, 15 bp, Homo sapiens
aatggtatagcaaat

SEQ ID NO: 1418129 - DNA, 16 bp, Homo sapiens
aatggtattgtaacta

SEQ ID NO: 1418130 - DNA, 18 bp, Homo sapiens
aatggtcccaattaagaa

SEQ ID NO: 1418131 - DNA, 15 bp, Homo sapiens
aatggtcgcccagga

SEQ ID NO: 1418132 - DNA, 16 bp, Homo sapiens
aatggtcgcccaggag

SEQ ID NO: 1418133 - DNA, 13 bp, Homo sapiens
aatggtgatttta

SEQ ID NO: 1418134 - DNA, 22 bp, Homo sapiens
aatggtgcgtggcttccctgtc

SEQ ID NO: 1418135 - DNA, 22 bp, Homo sapiens
aatggtggggaactataaagaa

SEQ ID NO: 1418136 - DNA, 19 bp, Homo sapiens
aatggtgtagaacactaat

SEQ ID NO: 1418137 - DNA, 15 bp, Homo sapiens
aatggttcagaatta

SEQ ID NO: 1418138 - DNA, 14 bp, Homo sapiens
aatggttccatgcc

SEQ ID NO: 1418139 - DNA, 21 bp, Homo sapiens
aatggttgaatgaataaaaca

SEQ ID NO: 1418140 - DNA, 19 bp, Homo sapiens
aatggttgatggaaaataa

SEQ ID NO: 1418141 - DNA, 13 bp, Homo sapiens
aatggtttcaaag

SEQ ID NO: 1418142 - DNA, 17 bp, Homo sapiens
aatggtttttgttagtt

SEQ ID NO: 1418143 - DNA, 19 bp, Homo sapiens
aatgtaaaaaagaaaaaca

SEQ ID NO: 1418144 - DNA, 13 bp, Homo sapiens
aatgtaaataaac

SEQ ID NO: 1418145 - DNA, 22 bp, Homo sapiens
aatgtaaataaaggatttctag

SEQ ID NO: 1418146 - DNA, 12 bp, Homo sapiens
aatgtaaatttg

SEQ ID NO: 1418147 - DNA, 18 bp, Homo sapiens
aatgtaaatttgtactat

SEQ ID NO: 1418148 - DNA, 18 bp, Homo sapiens
aatgtaacatcataatta

SEQ ID NO: 1418149 - DNA, 22 bp, Homo sapiens
aatgtaacatcataattacatt

SEQ ID NO: 1418150 - DNA, 23 bp, Homo sapiens
aatgtaactccagatagagaaat

SEQ ID NO: 1418151 - DNA, 19 bp, Homo sapiens
aatgtaagattatagattc

SEQ ID NO: 1418152 - DNA, 21 bp, Homo sapiens
aatgtaagattatagattcta

SEQ ID NO: 1418153 - DNA, 16 bp, Homo sapiens
aatgtaagcatacttt

SEQ ID NO: 1418154 - DNA, 20 bp, Homo sapiens
aatgtaagggaaactgccag

SEQ ID NO: 1418155 - DNA, 23 bp, Homo sapiens
aatgtaaggtatatcattctaaa

SEQ ID NO: 1418156 - DNA, 19 bp, Homo sapiens
aatgtaatcaatgtttctt

SEQ ID NO: 1418157 - DNA, 17 bp, Homo sapiens
aatgtacaagttttgta

SEQ ID NO: 1418158 - DNA, 15 bp, Homo sapiens
aatgtacaattatgt

SEQ ID NO: 1418159 - DNA, 19 bp, Homo sapiens
aatgtacaattatgtctct

SEQ ID NO: 1418160 - DNA, 17 bp, Homo sapiens
aatgtacatctggcctt

SEQ ID NO: 1418161 - DNA, 16 bp, Homo sapiens
aatgtacatgtattaa

SEQ ID NO: 1418162 - DNA, 18 bp, Homo sapiens
aatgtacccctctcagtc

SEQ ID NO: 1418163 - DNA, 16 bp, Homo sapiens
aatgtacgctgctgca

SEQ ID NO: 1418164 - DNA, 22 bp, Homo sapiens
aatgtactcttccgatgtttgt

SEQ ID NO: 1418165 - DNA, 19 bp, Homo sapiens
aatgtactgatttcagtaa

SEQ ID NO: 1418166 - DNA, 18 bp, Homo sapiens
aatgtactgcatatgaaa

SEQ ID NO: 1418167 - DNA, 21 bp, Homo sapiens
aatgtactggtaattgtacaa

SEQ ID NO: 1418168 - DNA, 20 bp, Homo sapiens
aatgtagcatctgagaaggc

SEQ ID NO: 1418169 - DNA, 23 bp, Homo sapiens
aatgtagcgactgtcaacagcgt

SEQ ID NO: 1418170 - DNA, 17 bp, Homo sapiens
aatgtagctggtttcct

SEQ ID NO: 1418171 - DNA, 16 bp, Homo sapiens
aatgtaggcttagttt

SEQ ID NO: 1418172 - DNA, 19 bp, Homo sapiens
aatgtaggcttagtttgtg

SEQ ID NO: 1418173 - DNA, 22 bp, Homo sapiens
aatgtaggcttagtttgtgtgt

SEQ ID NO: 1418174 - DNA, 22 bp, Homo sapiens
aatgtagggcctgcatggagaa

SEQ ID NO: 1418175 - DNA, 20 bp, Homo sapiens
aatgtaggtatgaataagtt

SEQ ID NO: 1418176 - DNA, 16 bp, Homo sapiens
aatgtaggtcctcaga

SEQ ID NO: 1418177 - DNA, 18 bp, Homo sapiens
aatgtaggtcctcagaaa

SEQ ID NO: 1418178 - DNA, 15 bp, Homo sapiens
aatgtagtttgagga

SEQ ID NO: 1418179 - DNA, 20 bp, Homo sapiens
aatgtataaaaattatcaaa

SEQ ID NO: 1418180 - DNA, 22 bp, Homo sapiens
aatgtataaaaattatcaaaaa

SEQ ID NO: 1418181 - DNA, 15 bp, Homo sapiens
aatgtataaatatac

SEQ ID NO: 1418182 - DNA, 15 bp, Homo sapiens
aatgtatcaggaaat

SEQ ID NO: 1418183 - DNA, 18 bp, Homo sapiens
aatgtatcatagaaatgt

SEQ ID NO: 1418184 - DNA, 18 bp, Homo sapiens
aatgtatctatttgtaca

SEQ ID NO: 1418185 - DNA, 18 bp, Homo sapiens
aatgtatcttattcacat

SEQ ID NO: 1418186 - DNA, 20 bp, Homo sapiens
aatgtatctttattaaaaca

SEQ ID NO: 1418187 - DNA, 20 bp, Homo sapiens
aatgtatgcattcacattta

SEQ ID NO: 1418188 - DNA, 13 bp, Homo sapiens
aatgtatgtatca

SEQ ID NO: 1418189 - DNA, 15 bp, Homo sapiens
aatgtatgtcagtgc

SEQ ID NO: 1418190 - DNA, 12 bp, Homo sapiens
aatgtatgtgta

SEQ ID NO: 1418191 - DNA, 14 bp, Homo sapiens
aatgtatgtgtaag

SEQ ID NO: 1418192 - DNA, 21 bp, Homo sapiens
aatgtatgtgtggctgtgggt

SEQ ID NO: 1418193 - DNA, 18 bp, Homo sapiens
aatgtattattctgcagc

SEQ ID NO: 1418194 - DNA, 13 bp, Homo sapiens
aatgcagcaggaa

SEQ ID NO: 1418195 - DNA, 19 bp, Homo sapiens
aatgcagcaggaaggaaca

SEQ ID NO: 1418196 - DNA, 23 bp, Homo sapiens
aatgcagggattgctgccacttt

SEQ ID NO: 1418197 - DNA, 15 bp, Homo sapiens
aatgcagttttaaga

SEQ ID NO: 1418198 - DNA, 14 bp, Homo sapiens
aatgcataaatgca

SEQ ID NO: 1418199 - DNA, 20 bp, Homo sapiens
aatgcataaatgcataattt

SEQ ID NO: 1418200 - DNA, 18 bp, Homo sapiens
aatgcatatcctgagcca

SEQ ID NO: 1418201 - DNA, 18 bp, Homo sapiens
aatgcatcaatatgtatt

SEQ ID NO: 1418202 - DNA, 15 bp, Homo sapiens
aatgcatcaggtcct

SEQ ID NO: 1418203 - DNA, 18 bp, Homo sapiens
aatgcatcatcatagaaa

SEQ ID NO: 1418204 - DNA, 13 bp, Homo sapiens
aatgcattattga

SEQ ID NO: 1418205 - DNA, 17 bp, Homo sapiens
aatgcattattttgaat

SEQ ID NO: 1418206 - DNA, 18 bp, Homo sapiens
aatgcattccctgaatct

SEQ ID NO: 1418207 - DNA, 13 bp, Homo sapiens
aatgcattggcct

SEQ ID NO: 1418208 - DNA, 15 bp, Homo sapiens
aatgcattggcctct

SEQ ID NO: 1418209 - DNA, 16 bp, Homo sapiens
aatgcattggcctctg

SEQ ID NO: 1418210 - DNA, 17 bp, Homo sapiens
aatgcattggcctctgt

SEQ ID NO: 1418211 - DNA, 15 bp, Homo sapiens
aatgcatttaaaata

SEQ ID NO: 1418212 - DNA, 21 bp, Homo sapiens
aatgcatttaaactcatttga

SEQ ID NO: 1418213 - DNA, 23 bp, Homo sapiens
aatgccaacttgtccttttgtac

SEQ ID NO: 1418214 - DNA, 21 bp, Homo sapiens
aatgccactgggacagctggc

SEQ ID NO: 1418215 - DNA, 15 bp, Homo sapiens
aatgccagagccaac

SEQ ID NO: 1418216 - DNA, 19 bp, Homo sapiens
aatgccagagccaacctgg

SEQ ID NO: 1418217 - DNA, 23 bp, Homo sapiens
aatgccagagccaacctggactt

SEQ ID NO: 1418218 - DNA, 15 bp, Homo sapiens
aatgccatgaacaaa

SEQ ID NO: 1418219 - DNA, 20 bp, Homo sapiens
aatgccatttagaatctaga

SEQ ID NO: 1418220 - DNA, 16 bp, Homo sapiens
aatgcccccctcccaa

SEQ ID NO: 1418221 - DNA, 16 bp, Homo sapiens
aatgccctacatctta

SEQ ID NO: 1418222 - DNA, 13 bp, Homo sapiens
aatgccctgccat

SEQ ID NO: 1418223 - DNA, 16 bp, Homo sapiens
aatgcccttaaatcat

SEQ ID NO: 1418224 - DNA, 17 bp, Homo sapiens
aatgccgctgtctctga

SEQ ID NO: 1418225 - DNA, 20 bp, Homo sapiens
aatgcctacagctgtcttca

SEQ ID NO: 1418226 - DNA, 19 bp, Homo sapiens
aatgcctgctttttggaaa

SEQ ID NO: 1418227 - DNA, 22 bp, Homo sapiens
aatgcctgtctctagctgttct

SEQ ID NO: 1418228 - DNA, 19 bp, Homo sapiens
aatgcctgtgaaaaagaaa

SEQ ID NO: 1418229 - DNA, 12 bp, Homo sapiens
aatgcctgtgcc

SEQ ID NO: 1418230 - DNA, 19 bp, Homo sapiens
aatgcctgtgccaataaaa

SEQ ID NO: 1418231 - DNA, 12 bp, Homo sapiens
aatgcctttaaa

SEQ ID NO: 1418232 - DNA, 21 bp, Homo sapiens
aatgcctttttagatgtattt

SEQ ID NO: 1418233 - DNA, 16 bp, Homo sapiens
aatgctaagaaatgct

SEQ ID NO: 1418234 - DNA, 22 bp, Homo sapiens
aatgctaatgtaatcatttatc

SEQ ID NO: 1418235 - DNA, 19 bp, Homo sapiens
aatgctaatttaaagagac

SEQ ID NO: 1418236 - DNA, 15 bp, Homo sapiens
aatgctacatgtgag

SEQ ID NO: 1418237 - DNA, 13 bp, Homo sapiens
aatgctaccagga

SEQ ID NO: 1418238 - DNA, 15 bp, Homo sapiens
aatgctagaaaaatt

SEQ ID NO: 1418239 - DNA, 18 bp, Homo sapiens
aatgctaggttaattcca

SEQ ID NO: 1418240 - DNA, 19 bp, Homo sapiens
aatgctaggttaattccaa

SEQ ID NO: 1418241 - DNA, 19 bp, Homo sapiens
aatgctattgttgtgggct

SEQ ID NO: 1418242 - DNA, 22 bp, Homo sapiens
aatgctcagggtcactgaacca

SEQ ID NO: 1418243 - DNA, 18 bp, Homo sapiens
aatgctcattttctggtt

SEQ ID NO: 1418244 - DNA, 16 bp, Homo sapiens
aatgctcctctctttg

SEQ ID NO: 1418245 - DNA, 18 bp, Homo sapiens
aatgctcgtgtgatttcc

SEQ ID NO: 1418246 - DNA, 23 bp, Homo sapiens
aatgctcgtgtgatttcctacag

SEQ ID NO: 1418247 - DNA, 20 bp, Homo sapiens
aatgctctggggtcttttta

SEQ ID NO: 1418248 - DNA, 23 bp, Homo sapiens
aatgctctttacttcatggactt

SEQ ID NO: 1418249 - DNA, 17 bp, Homo sapiens
aatgctcttttgcacaa

SEQ ID NO: 1418250 - DNA, 18 bp, Homo sapiens
aatgctcttttgcacaag

SEQ ID NO: 1418251 - DNA, 18 bp, Homo sapiens
aatgctgaatatatagaa

SEQ ID NO: 1418252 - DNA, 18 bp, Homo sapiens
aatgctgacaaaaatatt

SEQ ID NO: 1418253 - DNA, 16 bp, Homo sapiens
aatgctgcattttaat

SEQ ID NO: 1418254 - DNA, 11 bp, Homo sapiens
aatgctgccag

SEQ ID NO: 1418255 - DNA, 12 bp, Homo sapiens
aatgctgcctgc

SEQ ID NO: 1418256 - DNA, 17 bp, Homo sapiens
aatgctgcgcttcgctt

SEQ ID NO: 1418257 - DNA, 21 bp, Homo sapiens
aatgctggttttcctaaatgc

SEQ ID NO: 1418258 - DNA, 22 bp, Homo sapiens
aatgctggttttcctaaatgca

SEQ ID NO: 1418259 - DNA, 12 bp, Homo sapiens
aatgctgtgtta

SEQ ID NO: 1418260 - DNA, 16 bp, Homo sapiens
aatgctgttgtaaaca

SEQ ID NO: 1418261 - DNA, 13 bp, Homo sapiens
aatgctgtttcta

SEQ ID NO: 1418262 - DNA, 20 bp, Homo sapiens
aatgctgtttctaagaaaat

SEQ ID NO: 1418263 - DNA, 22 bp, Homo sapiens
aatgctgtttctaagaaaatgt

SEQ ID NO: 1418264 - DNA, 23 bp, Homo sapiens
aatgcttattttaaaatgacagt

SEQ ID NO: 1418265 - DNA, 20 bp, Homo sapiens
aatgcttcaagtgttgctct

SEQ ID NO: 1418266 - DNA, 13 bp, Homo sapiens
aatgcttcattat

SEQ ID NO: 1418267 - DNA, 21 bp, Homo sapiens
aatgcttcattcaatattgac

SEQ ID NO: 1418268 - DNA, 22 bp, Homo sapiens
aatgcttcattcaatattgaca

SEQ ID NO: 1418269 - DNA, 23 bp, Homo sapiens
aatgcttcctagaagttactgaa

SEQ ID NO: 1418270 - DNA, 15 bp, Homo sapiens
aatgcttctgagagc

SEQ ID NO: 1418271 - DNA, 19 bp, Homo sapiens
aatgcttgtagaagtagga

SEQ ID NO: 1418272 - DNA, 20 bp, Homo sapiens
aatgcttgtggattgagggt

SEQ ID NO: 1418273 - DNA, 21 bp, Homo sapiens
aatgcttttagtgtgtgcata

SEQ ID NO: 1418274 - DNA, 19 bp, Homo sapiens
aatgctttttagaaagcat

SEQ ID NO: 1418275 - DNA, 11 bp, Homo sapiens
aatggaaaaaa

SEQ ID NO: 1418276 - DNA, 14 bp, Homo sapiens
aatggaaaaaaaca

SEQ ID NO: 1418277 - DNA, 17 bp, Homo sapiens
aatggaaactattataa

SEQ ID NO: 1418278 - DNA, 13 bp, Homo sapiens
aatggaaactgaa

SEQ ID NO: 1418279 - DNA, 20 bp, Homo sapiens
aatggaaatttaaatgacat

SEQ ID NO: 1418280 - DNA, 17 bp, Homo sapiens
aatggaaattttgctat

SEQ ID NO: 1418281 - DNA, 14 bp, Homo sapiens
aatggaactgaccc

SEQ ID NO: 1418282 - DNA, 14 bp, Homo sapiens
aatggaagtgtctg

SEQ ID NO: 1418283 - DNA, 13 bp, Homo sapiens
aatggacatttct

SEQ ID NO: 1418284 - DNA, 20 bp, Homo sapiens
aatggactaaaacattttga

SEQ ID NO: 1418285 - DNA, 14 bp, Homo sapiens
aatggactcaaact

SEQ ID NO: 1418286 - DNA, 16 bp, Homo sapiens
aatggagctttctgta

SEQ ID NO: 1418287 - DNA, 15 bp, Homo sapiens
aatggaggaatatga

SEQ ID NO: 1418288 - DNA, 22 bp, Homo sapiens
aatgaaatatctgtatttaatt

SEQ ID NO: 1418289 - DNA, 17 bp, Homo sapiens
aatgaaatcaaatgtat

SEQ ID NO: 1418290 - DNA, 21 bp, Homo sapiens
aatgaaatcctgcttcagtgt

SEQ ID NO: 1418291 - DNA, 14 bp, Homo sapiens
aatgaaatgtatgt

SEQ ID NO: 1418292 - DNA, 15 bp, Homo sapiens
aatgaaatgtatgtg

SEQ ID NO: 1418293 - DNA, 17 bp, Homo sapiens
aatgaaatgtatgtgct

SEQ ID NO: 1418294 - DNA, 20 bp, Homo sapiens
aatgaaattaaaaataaaat

SEQ ID NO: 1418295 - DNA, 15 bp, Homo sapiens
aatgaaattaacaca

SEQ ID NO: 1418296 - DNA, 20 bp, Homo sapiens
aatgaaattaacacaaagga

SEQ ID NO: 1418297 - DNA, 18 bp, Homo sapiens
aatgaacatctcttgaaa

SEQ ID NO: 1418298 - DNA, 12 bp, Homo sapiens
aatgaacatttt

SEQ ID NO: 1418299 - DNA, 19 bp, Homo sapiens
aatgaactaccatctgatg

SEQ ID NO: 1418300 - DNA, 18 bp, Homo sapiens
aatgaactgtccgtgaat

SEQ ID NO: 1418301 - DNA, 22 bp, Homo sapiens
aatgaacttccatttgtattca

SEQ ID NO: 1418302 - DNA, 13 bp, Homo sapiens
aatgaagaagaca

SEQ ID NO: 1418303 - DNA, 19 bp, Homo sapiens
aatgaagaattatgtaata

SEQ ID NO: 1418304 - DNA, 23 bp, Homo sapiens
aatgaagaattatgtaatatatt

SEQ ID NO: 1418305 - DNA, 13 bp, Homo sapiens
aatgaagagaaaa

SEQ ID NO: 1418306 - DNA, 15 bp, Homo sapiens
aatgaagcagcttta

SEQ ID NO: 1418307 - DNA, 19 bp, Homo sapiens
aatgaagcagctttaaaca

SEQ ID NO: 1418308 - DNA, 15 bp, Homo sapiens
aatgaagccttagcc

SEQ ID NO: 1418309 - DNA, 22 bp, Homo sapiens
aatgaaggcgggcctgcaagcc

SEQ ID NO: 1418310 - DNA, 16 bp, Homo sapiens
aatgaagtatttctca

SEQ ID NO: 1418311 - DNA, 10 bp, Homo sapiens
aatgaataat

SEQ ID NO: 1418312 - DNA, 21 bp, Homo sapiens
aatgaataatggaaaatgcca

SEQ ID NO: 1418313 - DNA, 16 bp, Homo sapiens
aatgaataatttccca

SEQ ID NO: 1418314 - DNA, 16 bp, Homo sapiens
aatgaatatcaggcta

SEQ ID NO: 1418315 - DNA, 15 bp, Homo sapiens
aatgaatatctatta

SEQ ID NO: 1418316 - DNA, 15 bp, Homo sapiens
aatgaattataacag

SEQ ID NO: 1418317 - DNA, 17 bp, Homo sapiens
aatgaattataacagtt

SEQ ID NO: 1418318 - DNA, 18 bp, Homo sapiens
aatgaattataacagtta

SEQ ID NO: 1418319 - DNA, 18 bp, Homo sapiens
aatgaattgaaaaacaat

SEQ ID NO: 1418320 - DNA, 19 bp, Homo sapiens
aatgaatttgctaaataca

SEQ ID NO: 1418321 - DNA, 13 bp, Homo sapiens
aatgacaacagaa

SEQ ID NO: 1418322 - DNA, 12 bp, Homo sapiens
aatgacaatatt

SEQ ID NO: 1418323 - DNA, 13 bp, Homo sapiens
aatgacacagtct

SEQ ID NO: 1418324 - DNA, 16 bp, Homo sapiens
aatgacacccatgcca

SEQ ID NO: 1418325 - DNA, 16 bp, Homo sapiens
aatgacagagccagtg

SEQ ID NO: 1418326 - DNA, 23 bp, Homo sapiens
aatgacagataaatccttaacat

SEQ ID NO: 1418327 - DNA, 14 bp, Homo sapiens
aatgacagatttct

SEQ ID NO: 1418328 - DNA, 22 bp, Homo sapiens
aatgacataaaaagaagccttc

SEQ ID NO: 1418329 - DNA, 13 bp, Homo sapiens
aatgacatcttca

SEQ ID NO: 1418330 - DNA, 16 bp, Homo sapiens
aatgacatgcactgac

SEQ ID NO: 1418331 - DNA, 19 bp, Homo sapiens
aatgacatgcactgaccct

SEQ ID NO: 1418332 - DNA, 14 bp, Homo sapiens
aatgacattcccct

SEQ ID NO: 1418333 - DNA, 12 bp, Homo sapiens
aatgaccaaaga

SEQ ID NO: 1418334 - DNA, 22 bp, Homo sapiens
aatgaccttcattctgagacca

SEQ ID NO: 1418335 - DNA, 12 bp, Homo sapiens
aatgacgcctga

SEQ ID NO: 1418336 - DNA, 19 bp, Homo sapiens
aatgacgtgtgtggctggg

SEQ ID NO: 1418337 - DNA, 21 bp, Homo sapiens
aatgacgtgtgtggctgggac

SEQ ID NO: 1418338 - DNA, 22 bp, Homo sapiens
aatgactaagaggaaagtacat

SEQ ID NO: 1418339 - DNA, 17 bp, Homo sapiens
aatgactcgttacctgc

SEQ ID NO: 1418340 - DNA, 19 bp, Homo sapiens
aatgacttccccaatatct

SEQ ID NO: 1418341 - DNA, 21 bp, Homo sapiens
aatgacttccccaatatcttg

SEQ ID NO: 1418342 - DNA, 13 bp, Homo sapiens
aatgactttatgt

SEQ ID NO: 1418343 - DNA, 17 bp, Homo sapiens
aatgagaaaggacagag

SEQ ID NO: 1418344 - DNA, 19 bp, Homo sapiens
aatgagaattttatattct

SEQ ID NO: 1418345 - DNA, 18 bp, Homo sapiens
aatgagagcaaatgcaaa

SEQ ID NO: 1418346 - DNA, 18 bp, Homo sapiens
aatgagagcgacacagac

SEQ ID NO: 1418347 - DNA, 22 bp, Homo sapiens
aatgagagcgacacagacgtta

SEQ ID NO: 1418348 - DNA, 23 bp, Homo sapiens
aatgagagggcagtgtttccttt

SEQ ID NO: 1418349 - DNA, 18 bp, Homo sapiens
aatgagatatttgtattt

SEQ ID NO: 1418350 - DNA, 13 bp, Homo sapiens
aatgagcatcaga

SEQ ID NO: 1418351 - DNA, 21 bp, Homo sapiens
aatgagccatcactagaagaa

SEQ ID NO: 1418352 - DNA, 23 bp, Homo sapiens
aatgagccccttcatccgcctgt

SEQ ID NO: 1418353 - DNA, 18 bp, Homo sapiens
aatgagcttgattaaatc

SEQ ID NO: 1418354 - DNA, 23 bp, Homo sapiens
aatgaggaaaaaatggtataaaa

SEQ ID NO: 1418355 - DNA, 19 bp, Homo sapiens
aatgaggaatagcaaaatt

SEQ ID NO: 1418356 - DNA, 15 bp, Homo sapiens
aatgaggtcagcatg

SEQ ID NO: 1418357 - DNA, 15 bp, Homo sapiens
aatgaggtcccaggc

SEQ ID NO: 1418358 - DNA, 17 bp, Homo sapiens
aatgagtaaaaactaga

SEQ ID NO: 1418359 - DNA, 19 bp, Homo sapiens
aatgagtaacatttgctgt

SEQ ID NO: 1418360 - DNA, 13 bp, Homo sapiens
aatgagtgggaat

SEQ ID NO: 1418361 - DNA, 19 bp, Homo sapiens
aatgagtgggctgtagttg

SEQ ID NO: 1418362 - DNA, 18 bp, Homo sapiens
aatgagtttaaaaaaata

SEQ ID NO: 1418363 - DNA, 21 bp, Homo sapiens
aatgagtttaaaaaaataaca

SEQ ID NO: 1418364 - DNA, 22 bp, Homo sapiens
aatgagtttcttagacttttcc

SEQ ID NO: 1418365 - DNA, 19 bp, Homo sapiens
aatgataaactcagatctg

SEQ ID NO: 1418366 - DNA, 14 bp, Homo sapiens
aatgataaatgtac

SEQ ID NO: 1418367 - DNA, 16 bp, Homo sapiens
aatgatactgatggtg

SEQ ID NO: 1418368 - DNA, 15 bp, Homo sapiens
aatgatagaactgta

SEQ ID NO: 1418369 - DNA, 15 bp, Homo sapiens
aatgataggtaattt

SEQ ID NO: 1418370 - DNA, 22 bp, Homo sapiens
aatgatcgttctgggtcagctt

SEQ ID NO: 1418371 - DNA, 14 bp, Homo sapiens
aatgatctattgct

SEQ ID NO: 1418372 - DNA, 19 bp, Homo sapiens
aatgatctcggatgaccaa

SEQ ID NO: 1418373 - DNA, 16 bp, Homo sapiens
aatgatgacccactaa

SEQ ID NO: 1418374 - DNA, 18 bp, Homo sapiens
aatgatgacccactaaag

SEQ ID NO: 1418375 - DNA, 19 bp, Homo sapiens
aatgatgacccactaaaga

SEQ ID NO: 1418376 - DNA, 21 bp, Homo sapiens
aatgatgatcaattatagttt

SEQ ID NO: 1418377 - DNA, 23 bp, Homo sapiens
aatgatgatgacgacgacaacga

SEQ ID NO: 1418378 - DNA, 17 bp, Homo sapiens
aatgatgatgataatga

SEQ ID NO: 1418379 - DNA, 18 bp, Homo sapiens
aatgatgatgataatgat

SEQ ID NO: 1418380 - DNA, 22 bp, Homo sapiens
aatgatggatcaccattatatt

SEQ ID NO: 1418381 - DNA, 14 bp, Homo sapiens
aatgatgttttaaa

SEQ ID NO: 1418382 - DNA, 16 bp, Homo sapiens
aatgatgttttaaaaa

SEQ ID NO: 1418383 - DNA, 18 bp, Homo sapiens
aatgattaaagactgtga

SEQ ID NO: 1418384 - DNA, 15 bp, Homo sapiens
aatgattaatcaaag

SEQ ID NO: 1418385 - DNA, 16 bp, Homo sapiens
aatgattaatcaaagg

SEQ ID NO: 1418386 - DNA, 17 bp, Homo sapiens
aatgattaatcaaaggc

SEQ ID NO: 1418387 - DNA, 13 bp, Homo sapiens
aatgattatattc

SEQ ID NO: 1418388 - DNA, 13 bp, Homo sapiens
aatctagagttta

SEQ ID NO: 1418389 - DNA, 18 bp, Homo sapiens
aatctagccgatggaaaa

SEQ ID NO: 1418390 - DNA, 19 bp, Homo sapiens
aatctagccgatggaaaat

SEQ ID NO: 1418391 - DNA, 18 bp, Homo sapiens
aatctatatttgtcttcc

SEQ ID NO: 1418392 - DNA, 16 bp, Homo sapiens
aatctatgccaaagat

SEQ ID NO: 1418393 - DNA, 18 bp, Homo sapiens
aatctatgccaaagatca

SEQ ID NO: 1418394 - DNA, 20 bp, Homo sapiens
aatctatgccaaagatcact

SEQ ID NO: 1418395 - DNA, 19 bp, Homo sapiens
aatctatggcttatttcta

SEQ ID NO: 1418396 - DNA, 22 bp, Homo sapiens
aatctatggcttatttctatga

SEQ ID NO: 1418397 - DNA, 18 bp, Homo sapiens
aatctattatactgtatt

SEQ ID NO: 1418398 - DNA, 22 bp, Homo sapiens
aatctattatttggagcctgcc

SEQ ID NO: 1418399 - DNA, 12 bp, Homo sapiens
aatctattcaga

SEQ ID NO: 1418400 - DNA, 19 bp, Homo sapiens
aatctattcagacaagcaa

SEQ ID NO: 1418401 - DNA, 21 bp, Homo sapiens
aatctattcctgtaaataaga

SEQ ID NO: 1418402 - DNA, 22 bp, Homo sapiens
aatctattcctgtaaataagag

SEQ ID NO: 1418403 - DNA, 13 bp, Homo sapiens
aatctcaaaatta

SEQ ID NO: 1418404 - DNA, 15 bp, Homo sapiens
aatctcaaaggagaa

SEQ ID NO: 1418405 - DNA, 15 bp, Homo sapiens
aatctcaaataacta

SEQ ID NO: 1418406 - DNA, 15 bp, Homo sapiens
aatctcagagacagg

SEQ ID NO: 1418407 - DNA, 21 bp, Homo sapiens
aatctcagttgtttgcttctt

SEQ ID NO: 1418408 - DNA, 16 bp, Homo sapiens
aatctcataatttata

SEQ ID NO: 1418409 - DNA, 16 bp, Homo sapiens
aatctccacttttttc

SEQ ID NO: 1418410 - DNA, 16 bp, Homo sapiens
aatctccagggctcca

SEQ ID NO: 1418411 - DNA, 17 bp, Homo sapiens
aatctcccgctgctgct

SEQ ID NO: 1418412 - DNA, 16 bp, Homo sapiens
aatctccgtagaattt

SEQ ID NO: 1418413 - DNA, 15 bp, Homo sapiens
aatctcctaaccttg

SEQ ID NO: 1418414 - DNA, 16 bp, Homo sapiens
aatctctaaaattcta

SEQ ID NO: 1418415 - DNA, 19 bp, Homo sapiens
aatctctaaaattctagtc

SEQ ID NO: 1418416 - DNA, 22 bp, Homo sapiens
aatctctcatattcgctagtgt

SEQ ID NO: 1418417 - DNA, 15 bp, Homo sapiens
aatctctctgcagct

SEQ ID NO: 1418418 - DNA, 19 bp, Homo sapiens
aatctctctgcagctgccg

SEQ ID NO: 1418419 - DNA, 12 bp, Homo sapiens
aatctctgatta

SEQ ID NO: 1418420 - DNA, 13 bp, Homo sapiens
aatctctgttact

SEQ ID NO: 1418421 - DNA, 19 bp, Homo sapiens
aatctcttcactaccctga

SEQ ID NO: 1418422 - DNA, 20 bp, Homo sapiens
aatctcttcactaccctgat

SEQ ID NO: 1418423 - DNA, 15 bp, Homo sapiens
aatctcttcattatt

SEQ ID NO: 1418424 - DNA, 17 bp, Homo sapiens
aatctctttttgtttgc

SEQ ID NO: 1418425 - DNA, 13 bp, Homo sapiens
aatctgacccagt

SEQ ID NO: 1418426 - DNA, 13 bp, Homo sapiens
aatctgatcaatt

SEQ ID NO: 1418427 - DNA, 17 bp, Homo sapiens
aatctgatggccttaat

SEQ ID NO: 1418428 - DNA, 21 bp, Homo sapiens
aatctgatggccttaatttcc

SEQ ID NO: 1418429 - DNA, 22 bp, Homo sapiens
aatctgatggccttaatttcct

SEQ ID NO: 1418430 - DNA, 23 bp, Homo sapiens
aatctgatggccttaatttcctt

SEQ ID NO: 1418431 - DNA, 18 bp, Homo sapiens
aatctgatgtaacaaggt

SEQ ID NO: 1418432 - DNA, 20 bp, Homo sapiens
aatctgctcactttaaacct

SEQ ID NO: 1418433 - DNA, 16 bp, Homo sapiens
aatctgcttcatccaa

SEQ ID NO: 1418434 - DNA, 22 bp, Homo sapiens
aatctgcttcatccaatgtgaa

SEQ ID NO: 1418435 - DNA, 15 bp, Homo sapiens
aatctggcccagggt

SEQ ID NO: 1418436 - DNA, 13 bp, Homo sapiens
aatctggctcact

SEQ ID NO: 1418437 - DNA, 17 bp, Homo sapiens
aatctggcttagtgcca

SEQ ID NO: 1418438 - DNA, 22 bp, Homo sapiens
aatctgggtggtaactgccagc

SEQ ID NO: 1418439 - DNA, 15 bp, Homo sapiens
aatctggtctcttct

SEQ ID NO: 1418440 - DNA, 14 bp, Homo sapiens
aatctgtaaactgt

SEQ ID NO: 1418441 - DNA, 19 bp, Homo sapiens
aatctgtagggctggacct

SEQ ID NO: 1418442 - DNA, 22 bp, Homo sapiens
aatctgtagggctggacctatg

SEQ ID NO: 1418443 - DNA, 16 bp, Homo sapiens
aatctgtatatgttgt

SEQ ID NO: 1418444 - DNA, 23 bp, Homo sapiens
aatctgtatatgttgtaataaaa

SEQ ID NO: 1418445 - DNA, 23 bp, Homo sapiens
aatctgtcataagcattacttta

SEQ ID NO: 1418446 - DNA, 14 bp, Homo sapiens
aatctgtcctctgt

SEQ ID NO: 1418447 - DNA, 16 bp, Homo sapiens
aatctgtctgattcta

SEQ ID NO: 1418448 - DNA, 12 bp, Homo sapiens
aatctgtgatga

SEQ ID NO: 1418449 - DNA, 23 bp, Homo sapiens
aatctgttatgtactagtgttct

SEQ ID NO: 1418450 - DNA, 20 bp, Homo sapiens
aatctgtttctctgctgtca

SEQ ID NO: 1418451 - DNA, 17 bp, Homo sapiens
aatctgtttgatccctg

SEQ ID NO: 1418452 - DNA, 12 bp, Homo sapiens
aatctgttttgg

SEQ ID NO: 1418453 - DNA, 17 bp, Homo sapiens
aatcttaaacaatgtat

SEQ ID NO: 1418454 - DNA, 18 bp, Homo sapiens
aatcttaaacaatgtata

SEQ ID NO: 1418455 - DNA, 20 bp, Homo sapiens
aatcttaaacaatgtataaa

SEQ ID NO: 1418456 - DNA, 17 bp, Homo sapiens
aatcttaaattttgacg

SEQ ID NO: 1418457 - DNA, 19 bp, Homo sapiens
aatcttaaccctgtgctgt

SEQ ID NO: 1418458 - DNA, 15 bp, Homo sapiens
aatcttaagaaataa

SEQ ID NO: 1418459 - DNA, 17 bp, Homo sapiens
aatcttaatactgttat

SEQ ID NO: 1418460 - DNA, 21 bp, Homo sapiens
aatcttaatactgttattctt

SEQ ID NO: 1418461 - DNA, 11 bp, Homo sapiens
aatcttagctt

SEQ ID NO: 1418462 - DNA, 21 bp, Homo sapiens
aatcttagtgtatgattactg

SEQ ID NO: 1418463 - DNA, 23 bp, Homo sapiens
aatcttagtgtatgattactggc

SEQ ID NO: 1418464 - DNA, 15 bp, Homo sapiens
aatcttatagttcta

SEQ ID NO: 1418465 - DNA, 18 bp, Homo sapiens
aatcttatagttctaggc

SEQ ID NO: 1418466 - DNA, 21 bp, Homo sapiens
aatcttattccgagcattcca

SEQ ID NO: 1418467 - DNA, 22 bp, Homo sapiens
aatcttattccgagcattccag

SEQ ID NO: 1418468 - DNA, 22 bp, Homo sapiens
aatcttattgtttaatcttttt

SEQ ID NO: 1418469 - DNA, 15 bp, Homo sapiens
aatcttcacctcaga

SEQ ID NO: 1418470 - DNA, 20 bp, Homo sapiens
aatcttctcccttgtcctgc

SEQ ID NO: 1418471 - DNA, 20 bp, Homo sapiens
aatcttgcataagctgaact

SEQ ID NO: 1418472 - DNA, 14 bp, Homo sapiens
aatcttgctttctt

SEQ ID NO: 1418473 - DNA, 15 bp, Homo sapiens
aatcttggggctgat

SEQ ID NO: 1418474 - DNA, 17 bp, Homo sapiens
aatcttggggctgatga

SEQ ID NO: 1418475 - DNA, 15 bp, Homo sapiens
aatcttgtcatgtgt

SEQ ID NO: 1418476 - DNA, 22 bp, Homo sapiens
aatcttgttaatgtcattgcta

SEQ ID NO: 1418477 - DNA, 13 bp, Homo sapiens
aatcttgttactg

SEQ ID NO: 1418478 - DNA, 18 bp, Homo sapiens
aatcttgttactgctgat

SEQ ID NO: 1418479 - DNA, 14 bp, Homo sapiens
aatcttgttttgaa

SEQ ID NO: 1418480 - DNA, 23 bp, Homo sapiens
aatctttacctgtatacagtgca

SEQ ID NO: 1418481 - DNA, 16 bp, Homo sapiens
aatctttataaatgta

SEQ ID NO: 1418482 - DNA, 17 bp, Homo sapiens
aatctttccatatccat

SEQ ID NO: 1418483 - DNA, 15 bp, Homo sapiens
aatctttctttacct

SEQ ID NO: 1418484 - DNA, 17 bp, Homo sapiens
aatctttctttacctga

SEQ ID NO: 1418485 - DNA, 19 bp, Homo sapiens
aatctttctttacctgaga

SEQ ID NO: 1418486 - DNA, 21 bp, Homo sapiens
aatctttgaaaggttagagaa

SEQ ID NO: 1418487 - DNA, 20 bp, Homo sapiens
aatctttgtaccaaaatttt

SEQ ID NO: 1418488 - DNA, 22 bp, Homo sapiens
aatctttgtttcaggttcagta

SEQ ID NO: 1418489 - DNA, 19 bp, Homo sapiens
aatctttttgcttctactt

SEQ ID NO: 1418490 - DNA, 22 bp, Homo sapiens
aatctttttgcttctactttca

SEQ ID NO: 1418491 - DNA, 16 bp, Homo sapiens
aatgaaaaatataatg

SEQ ID NO: 1418492 - DNA, 15 bp, Homo sapiens
aatgaaaacatgtac

SEQ ID NO: 1418493 - DNA, 23 bp, Homo sapiens
aatgaaaacatgtactacagcta

SEQ ID NO: 1418494 - DNA, 13 bp, Homo sapiens
aatgaaaatgtca

SEQ ID NO: 1418495 - DNA, 23 bp, Homo sapiens
aatgaaaatgtcagaaaccagtt

SEQ ID NO: 1418496 - DNA, 20 bp, Homo sapiens
aatgaaagactgtacaaagt

SEQ ID NO: 1418497 - DNA, 17 bp, Homo sapiens
aatgaaagcatgtctca

SEQ ID NO: 1418498 - DNA, 15 bp, Homo sapiens
aatgaaagggaaact

SEQ ID NO: 1418499 - DNA, 23 bp, Homo sapiens
aatgaaaggtactatatttgcta

SEQ ID NO: 1418500 - DNA, 15 bp, Homo sapiens
aatgaaataatcagt

SEQ ID NO: 1418501 - DNA, 16 bp, Homo sapiens
aatgaaataatcagtg

SEQ ID NO: 1418502 - DNA, 14 bp, Homo sapiens
aatgaaatacacaa

SEQ ID NO: 1418503 - DNA, 14 bp, Homo sapiens
aatgaaatatctgt

SEQ ID NO: 1418504 - DNA, 14 bp, Homo sapiens
aaaaaaaaccttgt

SEQ ID NO: 1418505 - DNA, 11 bp, Homo sapiens
aaaaaaaagaa

SEQ ID NO: 1418506 - DNA, 12 bp, Homo sapiens
aaaaaaaagaat

SEQ ID NO: 1418507 - DNA, 11 bp, Homo sapiens
aaaaaaacaaa

SEQ ID NO: 1418508 - DNA, 13 bp, Homo sapiens
aaaaaaacaaagc

SEQ ID NO: 1418509 - DNA, 10 bp, Homo sapiens
aaaaaaagaa

SEQ ID NO: 1418510 - DNA, 12 bp, Homo sapiens
aaaaaaagcatg

SEQ ID NO: 1418511 - DNA, 13 bp, Homo sapiens
aaaaaaaggaaaa

SEQ ID NO: 1418512 - DNA, 12 bp, Homo sapiens
aaaaaaataata

SEQ ID NO: 1418513 - DNA, 11 bp, Homo sapiens
aaaaaaatttg

SEQ ID NO: 1418514 - DNA, 11 bp, Homo sapiens
aaaaaacactt

SEQ ID NO: 1418515 - DNA, 21 bp, Homo sapiens
aaaaaacacttggcatacaaa

SEQ ID NO: 1418516 - DNA, 15 bp, Homo sapiens
aaaaaaccttgtaaa

SEQ ID NO: 1418517 - DNA, 10 bp, Homo sapiens
aaaaaactac

SEQ ID NO: 1418518 - DNA, 12 bp, Homo sapiens
aaaaaagaaaat

SEQ ID NO: 1418519 - DNA, 12 bp, Homo sapiens
aaaaaagaaatg

SEQ ID NO: 1418520 - DNA, 11 bp, Homo sapiens
aaaaaagcaaa

SEQ ID NO: 1418521 - DNA, 12 bp, Homo sapiens
aaaaaagcaatt

SEQ ID NO: 1418522 - DNA, 16 bp, Homo sapiens
aaaaaaggcattgttt

SEQ ID NO: 1418523 - DNA, 10 bp, Homo sapiens
aaaaaataca

SEQ ID NO: 1418524 - DNA, 13 bp, Homo sapiens
aaaaaatactatt

SEQ ID NO: 1418525 - DNA, 13 bp, Homo sapiens
aaaaaatatcaga

SEQ ID NO: 1418526 - DNA, 12 bp, Homo sapiens
aaaaaatatcta

SEQ ID NO: 1418527 - DNA, 11 bp, Homo sapiens
aaaaacaaaca

SEQ ID NO: 1418528 - DNA, 20 bp, Homo sapiens
catggaatttaatgctgaat

SEQ ID NO: 1418529 - DNA, 20 bp, Homo sapiens
catggacagacttcacagcg

SEQ ID NO: 1418530 - DNA, 24 bp, Homo sapiens
catggacagacttcacagcgtctg

SEQ ID NO: 1418531 - DNA, 15 bp, Homo sapiens
catggacatttagaa

SEQ ID NO: 1418532 - DNA, 15 bp, Homo sapiens
catggacccactacc

SEQ ID NO: 1418533 - DNA, 19 bp, Homo sapiens
catggacgttcggggcatg

SEQ ID NO: 1418534 - DNA, 15 bp, Homo sapiens
catggagaaaccctg

SEQ ID NO: 1418535 - DNA, 17 bp, Homo sapiens
catggagaaaccctgtc

SEQ ID NO: 1418536 - DNA, 21 bp, Homo sapiens
catggagaagggttctgccct

SEQ ID NO: 1418537 - DNA, 20 bp, Homo sapiens
catggagaatctgctgcata

SEQ ID NO: 1418538 - DNA, 19 bp, Homo sapiens
catggagactcctgccctg

SEQ ID NO: 1418539 - DNA, 20 bp, Homo sapiens
catggagactcctgccctgt

SEQ ID NO: 1418540 - DNA, 10 bp, Homo sapiens
catggagcca

SEQ ID NO: 1418541 - DNA, 14 bp, Homo sapiens
catggagccagctc

SEQ ID NO: 1418542 - DNA, 14 bp, Homo sapiens
catggaggactctc

SEQ ID NO: 1418543 - DNA, 13 bp, Homo sapiens
catggaggttcta

SEQ ID NO: 1418544 - DNA, 16 bp, Homo sapiens
catggaggttctaagg

SEQ ID NO: 1418545 - DNA, 18 bp, Homo sapiens
catggagtgcttctggaa

SEQ ID NO: 1418546 - DNA, 23 bp, Homo sapiens
catggcaacgtgtgaactgcaac

SEQ ID NO: 1418547 - DNA, 20 bp, Homo sapiens
catggcaccaaagccaccag

SEQ ID NO: 1418548 - DNA, 17 bp, Homo sapiens
catggcaccagccccct

SEQ ID NO: 1418549 - DNA, 20 bp, Homo sapiens
catggcaccagccccctgga

SEQ ID NO: 1418550 - DNA, 23 bp, Homo sapiens
catggcacctgtcgcccagtgcc

SEQ ID NO: 1418551 - DNA, 22 bp, Homo sapiens
catggcaccttcagactttgct

SEQ ID NO: 1418552 - DNA, 23 bp, Homo sapiens
catggcaccttcagactttgctt

SEQ ID NO: 1418553 - DNA, 14 bp, Homo sapiens
catggcagcagcca

SEQ ID NO: 1418554 - DNA, 20 bp, Homo sapiens
catggcagcatggagagcct

SEQ ID NO: 1418555 - DNA, 12 bp, Homo sapiens
catggcagctgt

SEQ ID NO: 1418556 - DNA, 19 bp, Homo sapiens
catggcagctgtttctcat

SEQ ID NO: 1418557 - DNA, 20 bp, Homo sapiens
catggcagctgtttctcatg

SEQ ID NO: 1418558 - DNA, 23 bp, Homo sapiens
catggcatatttttcacatatct

SEQ ID NO: 1418559 - DNA, 14 bp, Homo sapiens
catggccaggtggc

SEQ ID NO: 1418560 - DNA, 15 bp, Homo sapiens
catggccaggtggcc

SEQ ID NO: 1418561 - DNA, 16 bp, Homo sapiens
catggccatagaggcc

SEQ ID NO: 1418562 - DNA, 17 bp, Homo sapiens
catggccatagaggccc

SEQ ID NO: 1418563 - DNA, 19 bp, Homo sapiens
catggccatagaggcccag

SEQ ID NO: 1418564 - DNA, 18 bp, Homo sapiens
catggcccaaatccagtg

SEQ ID NO: 1418565 - DNA, 15 bp, Homo sapiens
catggcccccaataa

SEQ ID NO: 1418566 - DNA, 24 bp, Homo sapiens
catggcccccaataaaggcagctg

SEQ ID NO: 1418567 - DNA, 15 bp, Homo sapiens
catggcccccagggg

SEQ ID NO: 1418568 - DNA, 14 bp, Homo sapiens
catgtcacctcagc

SEQ ID NO: 1418569 - DNA, 15 bp, Homo sapiens
catgtcacctcagct

SEQ ID NO: 1418570 - DNA, 12 bp, Homo sapiens
catgtccaaaga

SEQ ID NO: 1418571 - DNA, 17 bp, Homo sapiens
catgtccaaagaggctg

SEQ ID NO: 1418572 - DNA, 21 bp, Homo sapiens
catgtccaaagaggctgcccc

SEQ ID NO: 1418573 - DNA, 20 bp, Homo sapiens
catgtccagcaccttgtgcc

SEQ ID NO: 1418574 - DNA, 21 bp, Homo sapiens
catgtccagcaccttgtgcct

SEQ ID NO: 1418575 - DNA, 22 bp, Homo sapiens
catgtccagcaccttgtgcctg

SEQ ID NO: 1418576 - DNA, 23 bp, Homo sapiens
catgtccatacactttgttgcaa

SEQ ID NO: 1418577 - DNA, 17 bp, Homo sapiens
catgtcccacccacccg

SEQ ID NO: 1418578 - DNA, 17 bp, Homo sapiens
catgtcccccgtgcacg

SEQ ID NO: 1418579 - DNA, 16 bp, Homo sapiens
catgtccctaccgagt

SEQ ID NO: 1418580 - DNA, 19 bp, Homo sapiens
catgtcctaattcttctgt

SEQ ID NO: 1418581 - DNA, 13 bp, Homo sapiens
catgtcctgtcct

SEQ ID NO: 1418582 - DNA, 15 bp, Homo sapiens
catgtcctgtcctgg

SEQ ID NO: 1418583 - DNA, 16 bp, Homo sapiens
catgtcctgtcctggt

SEQ ID NO: 1418584 - DNA, 20 bp, Homo sapiens
catgtcctttccatctgtcc

SEQ ID NO: 1418585 - DNA, 15 bp, Homo sapiens
catgtcgctccggtc

SEQ ID NO: 1418586 - DNA, 16 bp, Homo sapiens
catgtcgctccggtca

SEQ ID NO: 1418587 - DNA, 21 bp, Homo sapiens
catgtcgtggacacacacaga

SEQ ID NO: 1418588 - DNA, 17 bp, Homo sapiens
catgtctctcagaattc

SEQ ID NO: 1418589 - DNA, 19 bp, Homo sapiens
catgtctgaaacagagaac

SEQ ID NO: 1418590 - DNA, 17 bp, Homo sapiens
catgtctgcagtgtgcc

SEQ ID NO: 1418591 - DNA, 21 bp, Homo sapiens
catgtctggagtcccctcctc

SEQ ID NO: 1418592 - DNA, 22 bp, Homo sapiens
catgtctggagtcccctcctcc

SEQ ID NO: 1418593 - DNA, 13 bp, Homo sapiens
catgtctgtatac

SEQ ID NO: 1418594 - DNA, 14 bp, Homo sapiens
catgtcttgtacat

SEQ ID NO: 1418595 - DNA, 23 bp, Homo sapiens
catgtcttgtacatgtgtagcct

SEQ ID NO: 1418596 - DNA, 15 bp, Homo sapiens
catgtcttttaaaat

SEQ ID NO: 1418597 - DNA, 19 bp, Homo sapiens
catgtgaaaatcaaataca

SEQ ID NO: 1418598 - DNA, 14 bp, Homo sapiens
catgtgacacatat

SEQ ID NO: 1418599 - DNA, 18 bp, Homo sapiens
catgtgagcatggtcaca

SEQ ID NO: 1418600 - DNA, 22 bp, Homo sapiens
catgtgagcatggtcacaagca

SEQ ID NO: 1418601 - DNA, 12 bp, Homo sapiens
catgtgagccac

SEQ ID NO: 1418602 - DNA, 17 bp, Homo sapiens
catgtgagccaccgctg

SEQ ID NO: 1418603 - DNA, 15 bp, Homo sapiens
catgtgaggaggaaa

SEQ ID NO: 1418604 - DNA, 16 bp, Homo sapiens
catgtgaggaggaaaa

SEQ ID NO: 1418605 - DNA, 17 bp, Homo sapiens
catgtgagtattaataa

SEQ ID NO: 1418606 - DNA, 15 bp, Homo sapiens
catgtgatacatttt

SEQ ID NO: 1418607 - DNA, 16 bp, Homo sapiens
catgtgatacattttt

SEQ ID NO: 1418608 - DNA, 18 bp, Homo sapiens
catgtgatctcattgttc

SEQ ID NO: 1418609 - DNA, 22 bp, Homo sapiens
catgtgattcactgccttcctc

SEQ ID NO: 1418610 - DNA, 24 bp, Homo sapiens
catgtgccaagattctactcttgt

SEQ ID NO: 1418611 - DNA, 14 bp, Homo sapiens
catgtgccatctgt

SEQ ID NO: 1418612 - DNA, 18 bp, Homo sapiens
catgtgccatctgtacat

SEQ ID NO: 1418613 - DNA, 22 bp, Homo sapiens
catgtgcctatagtcccagcta

SEQ ID NO: 1418614 - DNA, 16 bp, Homo sapiens
catgtgcctgcaccag

SEQ ID NO: 1418615 - DNA, 23 bp, Homo sapiens
catgtgcctgcaccaggagacag

SEQ ID NO: 1418616 - DNA, 21 bp, Homo sapiens
catgtgcctttctttgcctct

SEQ ID NO: 1418617 - DNA, 22 bp, Homo sapiens
catgtgcctttctttgcctctg

SEQ ID NO: 1418618 - DNA, 16 bp, Homo sapiens
catgtgccttttctga

SEQ ID NO: 1418619 - DNA, 15 bp, Homo sapiens
catgtggccatggcc

SEQ ID NO: 1418620 - DNA, 18 bp, Homo sapiens
catgtggccatggcctct

SEQ ID NO: 1418621 - DNA, 23 bp, Homo sapiens
catgtggcctttatctcaacgga

SEQ ID NO: 1418622 - DNA, 15 bp, Homo sapiens
catgtgggcgcccac

SEQ ID NO: 1418623 - DNA, 17 bp, Homo sapiens
catgtggggacagggct

SEQ ID NO: 1418624 - DNA, 19 bp, Homo sapiens
catgtggggacagggctgg

SEQ ID NO: 1418625 - DNA, 14 bp, Homo sapiens
catgtggggccagg

SEQ ID NO: 1418626 - DNA, 20 bp, Homo sapiens
catgtgggtgagccagtgga

SEQ ID NO: 1418627 - DNA, 21 bp, Homo sapiens
catgtgggtggagaagggagg

SEQ ID NO: 1418628 - DNA, 22 bp, Homo sapiens
catgtggtggcacaggccccct

SEQ ID NO: 1418629 - DNA, 14 bp, Homo sapiens
catgtggtttgaaa

SEQ ID NO: 1418630 - DNA, 15 bp, Homo sapiens
catgtgtacatatat

SEQ ID NO: 1418631 - DNA, 17 bp, Homo sapiens
catgtgtacatatatgt

SEQ ID NO: 1418632 - DNA, 19 bp, Homo sapiens
catgtgtacatatatgtat

SEQ ID NO: 1418633 - DNA, 22 bp, Homo sapiens
catgtgtacattctgcctagag

SEQ ID NO: 1418634 - DNA, 16 bp, Homo sapiens
catgtgtagcctgtgc

SEQ ID NO: 1418635 - DNA, 18 bp, Homo sapiens
catgtgtccatcccagcg

SEQ ID NO: 1418636 - DNA, 21 bp, Homo sapiens
catgtgtccatcccagcggct

SEQ ID NO: 1418637 - DNA, 15 bp, Homo sapiens
catgtgtcctggttc

SEQ ID NO: 1418638 - DNA, 18 bp, Homo sapiens
catgtgtgcaacagggta

SEQ ID NO: 1418639 - DNA, 14 bp, Homo sapiens
catgtgtgcatgtg

SEQ ID NO: 1418640 - DNA, 20 bp, Homo sapiens
catgtgtgcatgtgagcaca

SEQ ID NO: 1418641 - DNA, 18 bp, Homo sapiens
catgtgtgcatgtgctgt

SEQ ID NO: 1418642 - DNA, 16 bp, Homo sapiens
catgtgtgcctgtggc

SEQ ID NO: 1418643 - DNA, 19 bp, Homo sapiens
catgtgtgcctgtggcaga

SEQ ID NO: 1418644 - DNA, 20 bp, Homo sapiens
catgtgtgcgtgtctccatg

SEQ ID NO: 1418645 - DNA, 11 bp, Homo sapiens
catgtgtgtgt

SEQ ID NO: 1418646 - DNA, 14 bp, Homo sapiens
catgtgttgaaaaa

SEQ ID NO: 1418647 - DNA, 13 bp, Homo sapiens
aaaacacacaggt

SEQ ID NO: 1418648 - DNA, 16 bp, Homo sapiens
aaaacacatgttttta

SEQ ID NO: 1418649 - DNA, 15 bp, Homo sapiens
aaaacacctagcttt

SEQ ID NO: 1418650 - DNA, 21 bp, Homo sapiens
aaaacactaaaaataaaaatg

SEQ ID NO: 1418651 - DNA, 15 bp, Homo sapiens
aaaacactgccctct

SEQ ID NO: 1418652 - DNA, 22 bp, Homo sapiens
aaaacacttggcatacaaaata

SEQ ID NO: 1418653 - DNA, 18 bp, Homo sapiens
aaaacagaacatcattag

SEQ ID NO: 1418654 - DNA, 17 bp, Homo sapiens
aaaacagaatcttctgg

SEQ ID NO: 1418655 - DNA, 11 bp, Homo sapiens
aaaacagatat

SEQ ID NO: 1418656 - DNA, 18 bp, Homo sapiens
aaaacagcctcacagaag

SEQ ID NO: 1418657 - DNA, 17 bp, Homo sapiens
aaaacaggcaaagtttt

SEQ ID NO: 1418658 - DNA, 23 bp, Homo sapiens
aaaacagggccacatagatgctg

SEQ ID NO: 1418659 - DNA, 17 bp, Homo sapiens
aaaacaggtagaattat

SEQ ID NO: 1418660 - DNA, 18 bp, Homo sapiens
aaaacaggtatatacttt

SEQ ID NO: 1418661 - DNA, 19 bp, Homo sapiens
aaaacaggtatatactttg

SEQ ID NO: 1418662 - DNA, 16 bp, Homo sapiens
aaaacatccagataca

SEQ ID NO: 1418663 - DNA, 13 bp, Homo sapiens
aaaacatctattc

SEQ ID NO: 1418664 - DNA, 16 bp, Homo sapiens
aaaacatggtagaatt

SEQ ID NO: 1418665 - DNA, 19 bp, Homo sapiens
aaaacatttaatattatat

SEQ ID NO: 1418666 - DNA, 12 bp, Homo sapiens
aaaacatttgct

SEQ ID NO: 1418667 - DNA, 21 bp, Homo sapiens
aaaacattttttaatagaata

SEQ ID NO: 1418668 - DNA, 15 bp, Homo sapiens
aaaaccacacaaaga

SEQ ID NO: 1418669 - DNA, 12 bp, Homo sapiens
aaaaccacagca

SEQ ID NO: 1418670 - DNA, 13 bp, Homo sapiens
aaaaccagctgct

SEQ ID NO: 1418671 - DNA, 21 bp, Homo sapiens
aaaaccatcagatatttctta

SEQ ID NO: 1418672 - DNA, 12 bp, Homo sapiens
aaaacccagact

SEQ ID NO: 1418673 - DNA, 12 bp, Homo sapiens
aaaacccagaga

SEQ ID NO: 1418674 - DNA, 13 bp, Homo sapiens
aaaacccagagag

SEQ ID NO: 1418675 - DNA, 16 bp, Homo sapiens
aaaacccttgggccag

SEQ ID NO: 1418676 - DNA, 21 bp, Homo sapiens
aaaacctcatgacagccagag

SEQ ID NO: 1418677 - DNA, 15 bp, Homo sapiens
aaaacctgcagttaa

SEQ ID NO: 1418678 - DNA, 13 bp, Homo sapiens
aaaacctgcctaa

SEQ ID NO: 1418679 - DNA, 17 bp, Homo sapiens
aaaacctttacagttag

SEQ ID NO: 1418680 - DNA, 21 bp, Homo sapiens
aaaacgaagctcattcccaac

SEQ ID NO: 1418681 - DNA, 15 bp, Homo sapiens
aaaactaaaattcaa

SEQ ID NO: 1418682 - DNA, 12 bp, Homo sapiens
aaaactacattt

SEQ ID NO: 1418683 - DNA, 13 bp, Homo sapiens
cattaaacttttt

SEQ ID NO: 1418684 - DNA, 14 bp, Homo sapiens
cattaaactttttt

SEQ ID NO: 1418685 - DNA, 20 bp, Homo sapiens
cattaaaggcataaatgact

SEQ ID NO: 1418686 - DNA, 17 bp, Homo sapiens
cattaaattagctattt

SEQ ID NO: 1418687 - DNA, 13 bp, Homo sapiens
cattaacaaataa

SEQ ID NO: 1418688 - DNA, 15 bp, Homo sapiens
cattaacggtgctaa

SEQ ID NO: 1418689 - DNA, 16 bp, Homo sapiens
cattaacggtgctaaa

SEQ ID NO: 1418690 - DNA, 13 bp, Homo sapiens
cattaactccctc

SEQ ID NO: 1418691 - DNA, 15 bp, Homo sapiens
cattaactccctcca

SEQ ID NO: 1418692 - DNA, 13 bp, Homo sapiens
cattaagcacaca

SEQ ID NO: 1418693 - DNA, 16 bp, Homo sapiens
cattaagcacacacat

SEQ ID NO: 1418694 - DNA, 16 bp, Homo sapiens
cattaagtaaatgctg

SEQ ID NO: 1418695 - DNA, 14 bp, Homo sapiens
cattaataagtgaa

SEQ ID NO: 1418696 - DNA, 15 bp, Homo sapiens
cattaatagcagcct

SEQ ID NO: 1418697 - DNA, 18 bp, Homo sapiens
cattaatagcagcctttc

SEQ ID NO: 1418698 - DNA, 17 bp, Homo sapiens
cattaatatttaccaaa

SEQ ID NO: 1418699 - DNA, 18 bp, Homo sapiens
cattaatatttaccaaag

SEQ ID NO: 1418700 - DNA, 16 bp, Homo sapiens
cattaatatttgctga

SEQ ID NO: 1418701 - DNA, 13 bp, Homo sapiens
cattaatctcaaa

SEQ ID NO: 1418702 - DNA, 23 bp, Homo sapiens
cattaatgagatgttattactgt

SEQ ID NO: 1418703 - DNA, 21 bp, Homo sapiens
cattaatgcctgctttttgga

SEQ ID NO: 1418704 - DNA, 22 bp, Homo sapiens
cattaatgcctgctttttggaa

SEQ ID NO: 1418705 - DNA, 15 bp, Homo sapiens
cattaatgtttctat

SEQ ID NO: 1418706 - DNA, 15 bp, Homo sapiens
cattaattacataca

SEQ ID NO: 1418707 - DNA, 22 bp, Homo sapiens
cattaattagttccagtttctc

SEQ ID NO: 1418708 - DNA, 21 bp, Homo sapiens
cattaattattattgctgttg

SEQ ID NO: 1418709 - DNA, 16 bp, Homo sapiens
cattaattttgtgcat

SEQ ID NO: 1418710 - DNA, 21 bp, Homo sapiens
cattaattttgtgcattcttt

SEQ ID NO: 1418711 - DNA, 22 bp, Homo sapiens
cattacaactgaccaagtttct

SEQ ID NO: 1418712 - DNA, 16 bp, Homo sapiens
cattacaattttctgt

SEQ ID NO: 1418713 - DNA, 22 bp, Homo sapiens
cattacaattttctgtaagaga

SEQ ID NO: 1418714 - DNA, 16 bp, Homo sapiens
cattacactaaattat

SEQ ID NO: 1418715 - DNA, 12 bp, Homo sapiens
cattacagttct

SEQ ID NO: 1418716 - DNA, 17 bp, Homo sapiens
cattacagttctttcct

SEQ ID NO: 1418717 - DNA, 23 bp, Homo sapiens
cattaccaaaataataaaaatca

SEQ ID NO: 1418718 - DNA, 20 bp, Homo sapiens
cattaccagacggttcacca

SEQ ID NO: 1418719 - DNA, 23 bp, Homo sapiens
cattaccagacggttcaccagcc

SEQ ID NO: 1418720 - DNA, 21 bp, Homo sapiens
cattacctcagtgagaagcca

SEQ ID NO: 1418721 - DNA, 16 bp, Homo sapiens
cattacctccatccat

SEQ ID NO: 1418722 - DNA, 15 bp, Homo sapiens
cattactctttttca

SEQ ID NO: 1418723 - DNA, 19 bp, Homo sapiens
cattactgtatttaagaaa

SEQ ID NO: 1418724 - DNA, 13 bp, Homo sapiens
cattactgtcccc

SEQ ID NO: 1418725 - DNA, 18 bp, Homo sapiens
cattagaaaattttgtaa

SEQ ID NO: 1418726 - DNA, 19 bp, Homo sapiens
cattagaaaattttgtaaa

SEQ ID NO: 1418727 - DNA, 22 bp, Homo sapiens
cattagaaaattttgtaaaaca

SEQ ID NO: 1418728 - DNA, 20 bp, Homo sapiens
cattagactgaatttaacta

SEQ ID NO: 1418729 - DNA, 18 bp, Homo sapiens
cattagataaacacaggc

SEQ ID NO: 1418730 - DNA, 22 bp, Homo sapiens
cattagataaacacaggcaggt

SEQ ID NO: 1418731 - DNA, 22 bp, Homo sapiens
cattagatattaggggggaaag

SEQ ID NO: 1418732 - DNA, 21 bp, Homo sapiens
cattagattttattttactat

SEQ ID NO: 1418733 - DNA, 19 bp, Homo sapiens
cattagccagatttgtctt

SEQ ID NO: 1418734 - DNA, 20 bp, Homo sapiens
cattaggaccttagaatttt

SEQ ID NO: 1418735 - DNA, 16 bp, Homo sapiens
cattaggccagcaacg

SEQ ID NO: 1418736 - DNA, 19 bp, Homo sapiens
cattaggctgttggttcaa

SEQ ID NO: 1418737 - DNA, 20 bp, Homo sapiens
cattagggatgcctcctttc

SEQ ID NO: 1418738 - DNA, 14 bp, Homo sapiens
cattagttgcacta

SEQ ID NO: 1418739 - DNA, 20 bp, Homo sapiens
cattagttgcactaactgct

SEQ ID NO: 1418740 - DNA, 13 bp, Homo sapiens
cattataaaaaga

SEQ ID NO: 1418741 - DNA, 20 bp, Homo sapiens
cattataactgaaggagaag

SEQ ID NO: 1418742 - DNA, 13 bp, Homo sapiens
cattatattttga

SEQ ID NO: 1418743 - DNA, 21 bp, Homo sapiens
cattatcgggagcagtgtctt

SEQ ID NO: 1418744 - DNA, 15 bp, Homo sapiens
cattatcttcatatg

SEQ ID NO: 1418745 - DNA, 22 bp, Homo sapiens
cattatgagaggcaatgattgt

SEQ ID NO: 1418746 - DNA, 11 bp, Homo sapiens
cattatgatct

SEQ ID NO: 1418747 - DNA, 12 bp, Homo sapiens
cattatgatcta

SEQ ID NO: 1418748 - DNA, 15 bp, Homo sapiens
cattatgatctaata

SEQ ID NO: 1418749 - DNA, 23 bp, Homo sapiens
cattatgatctaataaactttat

SEQ ID NO: 1418750 - DNA, 13 bp, Homo sapiens
cattatgattctt

SEQ ID NO: 1418751 - DNA, 21 bp, Homo sapiens
cattatgcacttttagaaatg

SEQ ID NO: 1418752 - DNA, 23 bp, Homo sapiens
cattatgccacttccttttaact

SEQ ID NO: 1418753 - DNA, 21 bp, Homo sapiens
cattatgggttaggcattaat

SEQ ID NO: 1418754 - DNA, 17 bp, Homo sapiens
cattatgtaaaatgttt

SEQ ID NO: 1418755 - DNA, 17 bp, Homo sapiens
cattatgtccactgtgt

SEQ ID NO: 1418756 - DNA, 20 bp, Homo sapiens
cattatgtccactgtgtata

SEQ ID NO: 1418757 - DNA, 22 bp, Homo sapiens
cattattatataaatcatgatg

SEQ ID NO: 1418758 - DNA, 15 bp, Homo sapiens
cattattatgatgtt

SEQ ID NO: 1418759 - DNA, 19 bp, Homo sapiens
cattattatttctgttctt

SEQ ID NO: 1418760 - DNA, 21 bp, Homo sapiens
cattattcaagaatgaaaaat

SEQ ID NO: 1418761 - DNA, 24 bp, Homo sapiens
cattattctctgctatatataaaa

SEQ ID NO: 1418762 - DNA, 16 bp, Homo sapiens
cattattggatgtcaa

SEQ ID NO: 1418763 - DNA, 13 bp, Homo sapiens
cattatttgtgct

SEQ ID NO: 1418764 - DNA, 22 bp, Homo sapiens
cattcaaaaaactctctcccag

SEQ ID NO: 1418765 - DNA, 20 bp, Homo sapiens
aaaagcgacccattcagaga

SEQ ID NO: 1418766 - DNA, 17 bp, Homo sapiens
aaaagctataaagcagt

SEQ ID NO: 1418767 - DNA, 21 bp, Homo sapiens
aaaagctataaagcagtattt

SEQ ID NO: 1418768 - DNA, 23 bp, Homo sapiens
aaaagctctgttccatgcaactg

SEQ ID NO: 1418769 - DNA, 18 bp, Homo sapiens
aaaagctgaacacatttc

SEQ ID NO: 1418770 - DNA, 17 bp, Homo sapiens
aaaagctggaccttttc

SEQ ID NO: 1418771 - DNA, 13 bp, Homo sapiens
aaaagctttgttt

SEQ ID NO: 1418772 - DNA, 19 bp, Homo sapiens
aaaagctttgtttgttctt

SEQ ID NO: 1418773 - DNA, 14 bp, Homo sapiens
aaaagctttttatt

SEQ ID NO: 1418774 - DNA, 18 bp, Homo sapiens
aaaaggaaaaataatcaa

SEQ ID NO: 1418775 - DNA, 20 bp, Homo sapiens
aaaaggaaatttgtttgtat

SEQ ID NO: 1418776 - DNA, 19 bp, Homo sapiens
aaaaggagccttttgctct

SEQ ID NO: 1418777 - DNA, 18 bp, Homo sapiens
aaaaggagtcaagaacaa

SEQ ID NO: 1418778 - DNA, 17 bp, Homo sapiens
aaaaggatgtataaatt

SEQ ID NO: 1418779 - DNA, 18 bp, Homo sapiens
aaaaggattcctctttgt

SEQ ID NO: 1418780 - DNA, 14 bp, Homo sapiens
aaaaggcaaatatt

SEQ ID NO: 1418781 - DNA, 16 bp, Homo sapiens
aaaaggcaaatgtgta

SEQ ID NO: 1418782 - DNA, 20 bp, Homo sapiens
aaaaggcgcatctaacgcgt

SEQ ID NO: 1418783 - DNA, 20 bp, Homo sapiens
aaaaggcggtactagttcag

SEQ ID NO: 1418784 - DNA, 20 bp, Homo sapiens
aaaaggctaggtacacagct

SEQ ID NO: 1418785 - DNA, 19 bp, Homo sapiens
aaaaggctcgtttggatct

SEQ ID NO: 1418786 - DNA, 15 bp, Homo sapiens
aaaaggctgaaaaga

SEQ ID NO: 1418787 - DNA, 14 bp, Homo sapiens
aaaaggctgagaag

SEQ ID NO: 1418788 - DNA, 12 bp, Homo sapiens
aaaagggaagga

SEQ ID NO: 1418789 - DNA, 22 bp, Homo sapiens
aaaagggagaataaaattccta

SEQ ID NO: 1418790 - DNA, 19 bp, Homo sapiens
aaaagggctctttagccag

SEQ ID NO: 1418791 - DNA, 13 bp, Homo sapiens
aaaaggggctcct

SEQ ID NO: 1418792 - DNA, 20 bp, Homo sapiens
aaaagggtgtatagtgttca

SEQ ID NO: 1418793 - DNA, 23 bp, Homo sapiens
aaaaggtagatcctgagatgatt

SEQ ID NO: 1418794 - DNA, 22 bp, Homo sapiens
aaaaggtagcttacctgacaca

SEQ ID NO: 1418795 - DNA, 15 bp, Homo sapiens
aaaaggtaggtcaga

SEQ ID NO: 1418796 - DNA, 23 bp, Homo sapiens
aaaaggtcctacgaaaacggaat

SEQ ID NO: 1418797 - DNA, 18 bp, Homo sapiens
cattccagctctgccccc

SEQ ID NO: 1418798 - DNA, 17 bp, Homo sapiens
cattccagtaacttttt

SEQ ID NO: 1418799 - DNA, 23 bp, Homo sapiens
cattccagtaacttttttgtgta

SEQ ID NO: 1418800 - DNA, 12 bp, Homo sapiens
cattccattgtt

SEQ ID NO: 1418801 - DNA, 12 bp, Homo sapiens
cattcccactgc

SEQ ID NO: 1418802 - DNA, 14 bp, Homo sapiens
cattcccactgcca

SEQ ID NO: 1418803 - DNA, 13 bp, Homo sapiens
cattccccaggtg

SEQ ID NO: 1418804 - DNA, 23 bp, Homo sapiens
cattccccaggtggctgacccag

SEQ ID NO: 1418805 - DNA, 20 bp, Homo sapiens
cattccctacagcctagggc

SEQ ID NO: 1418806 - DNA, 16 bp, Homo sapiens
cattccctgaatctgt

SEQ ID NO: 1418807 - DNA, 19 bp, Homo sapiens
cattccctgaatctgtgcc

SEQ ID NO: 1418808 - DNA, 11 bp, Homo sapiens
cattccctgag

SEQ ID NO: 1418809 - DNA, 20 bp, Homo sapiens
cattccctgagtcaccagga

SEQ ID NO: 1418810 - DNA, 20 bp, Homo sapiens
cattccgcagcccccacccc

SEQ ID NO: 1418811 - DNA, 22 bp, Homo sapiens
cattcctaaagaaaaatatctt

SEQ ID NO: 1418812 - DNA, 20 bp, Homo sapiens
cattcctaacacagcatgtg

SEQ ID NO: 1418813 - DNA, 23 bp, Homo sapiens
cattcctaacacagcatgtgtat

SEQ ID NO: 1418814 - DNA, 14 bp, Homo sapiens
cattcctaactaga

SEQ ID NO: 1418815 - DNA, 16 bp, Homo sapiens
cattcctaactagaat

SEQ ID NO: 1418816 - DNA, 12 bp, Homo sapiens
cattcctcagct

SEQ ID NO: 1418817 - DNA, 13 bp, Homo sapiens
cattcctcaggga

SEQ ID NO: 1418818 - DNA, 13 bp, Homo sapiens
cattcctgaaaga

SEQ ID NO: 1418819 - DNA, 16 bp, Homo sapiens
cattcctgaagaacca

SEQ ID NO: 1418820 - DNA, 17 bp, Homo sapiens
cattcctgaagaaccag

SEQ ID NO: 1418821 - DNA, 14 bp, Homo sapiens
cattcctgcctgtc

SEQ ID NO: 1418822 - DNA, 17 bp, Homo sapiens
cattcctggagcccgag

SEQ ID NO: 1418823 - DNA, 18 bp, Homo sapiens
cattcctggagcccgagg

SEQ ID NO: 1418824 - DNA, 12 bp, Homo sapiens
cattcctggccc

SEQ ID NO: 1418825 - DNA, 21 bp, Homo sapiens
cattcctggtacccagccatc

SEQ ID NO: 1418826 - DNA, 17 bp, Homo sapiens
cattcctgtgccctaga

SEQ ID NO: 1418827 - DNA, 16 bp, Homo sapiens
cattccttaattgtat

SEQ ID NO: 1418828 - DNA, 21 bp, Homo sapiens
cattcgacctataagaagcct

SEQ ID NO: 1418829 - DNA, 22 bp, Homo sapiens
cattcgacctataagaagcctt

SEQ ID NO: 1418830 - DNA, 23 bp, Homo sapiens
cattcgacctataagaagcctta

SEQ ID NO: 1418831 - DNA, 16 bp, Homo sapiens
cattcgatctcattca

SEQ ID NO: 1418832 - DNA, 24 bp, Homo sapiens
cattcgcctttgtcttgtacttct

SEQ ID NO: 1418833 - DNA, 22 bp, Homo sapiens
cattcggggtgatcctgttctg

SEQ ID NO: 1418834 - DNA, 23 bp, Homo sapiens
cattcggtacttacccggagaag

SEQ ID NO: 1418835 - DNA, 20 bp, Homo sapiens
cattcgtctgtcccagagct

SEQ ID NO: 1418836 - DNA, 19 bp, Homo sapiens
cattcgtgagctggggact

SEQ ID NO: 1418837 - DNA, 23 bp, Homo sapiens
cattcgtgagctggggactcagg

SEQ ID NO: 1418838 - DNA, 19 bp, Homo sapiens
cattcgtggcatgttttga

SEQ ID NO: 1418839 - DNA, 19 bp, Homo sapiens
cattctaaaccaaaacaga

SEQ ID NO: 1418840 - DNA, 13 bp, Homo sapiens
cattctagatcct

SEQ ID NO: 1418841 - DNA, 18 bp, Homo sapiens
cattctagatcctgcacc

SEQ ID NO: 1418842 - DNA, 23 bp, Homo sapiens
cattctaggtaggggcccacttc

SEQ ID NO: 1418843 - DNA, 16 bp, Homo sapiens
cattctcaagccctgc

SEQ ID NO: 1418844 - DNA, 16 bp, Homo sapiens
cattctcaccctgtga

SEQ ID NO: 1418845 - DNA, 21 bp, Homo sapiens
cattctccagttgattatttc

SEQ ID NO: 1418846 - DNA, 23 bp, Homo sapiens
cattctcccaggtaccagctgcg

SEQ ID NO: 1418847 - DNA, 22 bp, Homo sapiens
cattctccccagtgtatgtctt

SEQ ID NO: 1418848 - DNA, 18 bp, Homo sapiens
cattctcccgcttcctgg

SEQ ID NO: 1418849 - DNA, 22 bp, Homo sapiens
cattctcccgcttcctggcctc

SEQ ID NO: 1418850 - DNA, 23 bp, Homo sapiens
cattctcccgcttcctggcctcc

SEQ ID NO: 1418851 - DNA, 11 bp, Homo sapiens
cattctcctgc

SEQ ID NO: 1418852 - DNA, 12 bp, Homo sapiens
cattctcctgcc

SEQ ID NO: 1418853 - DNA, 15 bp, Homo sapiens
cattctcctgcctca

SEQ ID NO: 1418854 - DNA, 21 bp, Homo sapiens
cattctctcccatcctggggc

SEQ ID NO: 1418855 - DNA, 15 bp, Homo sapiens
cattctctctcctgt

SEQ ID NO: 1418856 - DNA, 18 bp, Homo sapiens
cattctcttcttgctata

SEQ ID NO: 1418857 - DNA, 15 bp, Homo sapiens
cattctgaattaatt

SEQ ID NO: 1418858 - DNA, 23 bp, Homo sapiens
cattctgaattaattaatttgga

SEQ ID NO: 1418859 - DNA, 15 bp, Homo sapiens
cattctgagcagggg

SEQ ID NO: 1418860 - DNA, 17 bp, Homo sapiens
cattctgcaagtatact

SEQ ID NO: 1418861 - DNA, 20 bp, Homo sapiens
cattctgcattgctagataa

SEQ ID NO: 1418862 - DNA, 22 bp, Homo sapiens
cattctgccgccccctcctgaa

SEQ ID NO: 1418863 - DNA, 17 bp, Homo sapiens
cattctgcctagagtgt

SEQ ID NO: 1418864 - DNA, 19 bp, Homo sapiens
cattctgcctagagtgtag

SEQ ID NO: 1418865 - DNA, 17 bp, Homo sapiens
cattctgcctctctagg

SEQ ID NO: 1418866 - DNA, 20 bp, Homo sapiens
cattctgctttcatcttggt

SEQ ID NO: 1418867 - DNA, 18 bp, Homo sapiens
cattctggaaacttttgt

SEQ ID NO: 1418868 - DNA, 12 bp, Homo sapiens
cattctggaggg

SEQ ID NO: 1418869 - DNA, 14 bp, Homo sapiens
cattctgtgccatt

SEQ ID NO: 1418870 - DNA, 17 bp, Homo sapiens
cattctgttttccccca

SEQ ID NO: 1418871 - DNA, 18 bp, Homo sapiens
cattctgttttcccccag

SEQ ID NO: 1418872 - DNA, 21 bp, Homo sapiens
cattctgttttcccccagcaa

SEQ ID NO: 1418873 - DNA, 20 bp, Homo sapiens
cattcttaacaaactcttca

SEQ ID NO: 1418874 - DNA, 17 bp, Homo sapiens
cattcttatgttccaga

SEQ ID NO: 1418875 - DNA, 18 bp, Homo sapiens
cattcttatgttccagat

SEQ ID NO: 1418876 - DNA, 19 bp, Homo sapiens
cattcttccatcatcactg

SEQ ID NO: 1418877 - DNA, 22 bp, Homo sapiens
cattcttccatcatcactgtaa

SEQ ID NO: 1418878 - DNA, 20 bp, Homo sapiens
cattcttggcttaatcattt

SEQ ID NO: 1418879 - DNA, 18 bp, Homo sapiens
cattcttgtcacaataaa

SEQ ID NO: 1418880 - DNA, 19 bp, Homo sapiens
cattcttgtcacaataaat

SEQ ID NO: 1418881 - DNA, 21 bp, Homo sapiens
cattcttgtgggagacagcag

SEQ ID NO: 1418882 - DNA, 14 bp, Homo sapiens
aaaatatttaatat

SEQ ID NO: 1418883 - DNA, 14 bp, Homo sapiens
aaaatatttaatgt

SEQ ID NO: 1418884 - DNA, 20 bp, Homo sapiens
aaaatatttcccctagtttt

SEQ ID NO: 1418885 - DNA, 22 bp, Homo sapiens
aaaatatttcctgacttgagtg

SEQ ID NO: 1418886 - DNA, 21 bp, Homo sapiens
aaaatatttctaagcttattt

SEQ ID NO: 1418887 - DNA, 13 bp, Homo sapiens
aaaatattttata

SEQ ID NO: 1418888 - DNA, 20 bp, Homo sapiens
aaaatattttttatatatac

SEQ ID NO: 1418889 - DNA, 15 bp, Homo sapiens
aaaatcaaaacaaaa

SEQ ID NO: 1418890 - DNA, 18 bp, Homo sapiens
aaaatcaaaacaaaaaaa

SEQ ID NO: 1418891 - DNA, 14 bp, Homo sapiens
aaaatcaaataata

SEQ ID NO: 1418892 - DNA, 11 bp, Homo sapiens
aaaatcaactt

SEQ ID NO: 1418893 - DNA, 15 bp, Homo sapiens
aaaatcaacttgtgt

SEQ ID NO: 1418894 - DNA, 12 bp, Homo sapiens
aaaatcaagagt

SEQ ID NO: 1418895 - DNA, 16 bp, Homo sapiens
aaaatcaagagtgaga

SEQ ID NO: 1418896 - DNA, 24 bp, Homo sapiens
aaaatcaagagtgagatgtagaaa

SEQ ID NO: 1418897 - DNA, 19 bp, Homo sapiens
aaaatcactatctttctga

SEQ ID NO: 1418898 - DNA, 18 bp, Homo sapiens
aaaatcagctattttgtg

SEQ ID NO: 1418899 - DNA, 23 bp, Homo sapiens
aaaatcatcaagaagggctgcat

SEQ ID NO: 1418900 - DNA, 19 bp, Homo sapiens
aaaatcatgaaaagaggaa

SEQ ID NO: 1418901 - DNA, 15 bp, Homo sapiens
aaaatcatgtttatt

SEQ ID NO: 1418902 - DNA, 22 bp, Homo sapiens
aaaatcattgattgtcagctac

SEQ ID NO: 1418903 - DNA, 21 bp, Homo sapiens
aaaatcatttctgcatcagct

SEQ ID NO: 1418904 - DNA, 14 bp, Homo sapiens
aaaatccaaatatt

SEQ ID NO: 1418905 - DNA, 19 bp, Homo sapiens
aaaatccaaatattgttaa

SEQ ID NO: 1418906 - DNA, 22 bp, Homo sapiens
aaaatccaaatattgttaaggg

SEQ ID NO: 1418907 - DNA, 16 bp, Homo sapiens
aaaatccaatattgta

SEQ ID NO: 1418908 - DNA, 20 bp, Homo sapiens
aaaatccattttacacagca

SEQ ID NO: 1418909 - DNA, 18 bp, Homo sapiens
aaaatcccaccttcccac

SEQ ID NO: 1418910 - DNA, 18 bp, Homo sapiens
aaaatcctcaacactatt

SEQ ID NO: 1418911 - DNA, 17 bp, Homo sapiens
aaaattttgtaaaacaa

SEQ ID NO: 1418912 - DNA, 21 bp, Homo sapiens
aaaattttgtatgttaaagag

SEQ ID NO: 1418913 - DNA, 17 bp, Homo sapiens
aaaatttttacattcat

SEQ ID NO: 1418914 - DNA, 14 bp, Homo sapiens
aaaatttttataaa

SEQ ID NO: 1418915 - DNA, 13 bp, Homo sapiens
aaaatttttatgt

SEQ ID NO: 1418916 - DNA, 16 bp, Homo sapiens
aaacaaaaagatgtct

SEQ ID NO: 1418917 - DNA, 13 bp, Homo sapiens
aaacaaaaagccc

SEQ ID NO: 1418918 - DNA, 11 bp, Homo sapiens
aaacaaaacaa

SEQ ID NO: 1418919 - DNA, 16 bp, Homo sapiens
aaacaaaaccaagcct

SEQ ID NO: 1418920 - DNA, 14 bp, Homo sapiens
aaacaaaagagaga

SEQ ID NO: 1418921 - DNA, 16 bp, Homo sapiens
aaacaaaagagagaat

SEQ ID NO: 1418922 - DNA, 20 bp, Homo sapiens
aaacaaaagggtgtatagtg

SEQ ID NO: 1418923 - DNA, 14 bp, Homo sapiens
aaacaaaatttcta

SEQ ID NO: 1418924 - DNA, 13 bp, Homo sapiens
aaacaaaatttga

SEQ ID NO: 1418925 - DNA, 13 bp, Homo sapiens
aaacaaacaaaaa

SEQ ID NO: 1418926 - DNA, 16 bp, Homo sapiens
aaacaaataatcacat

SEQ ID NO: 1418927 - DNA, 12 bp, Homo sapiens
aaacaaatatgc

SEQ ID NO: 1418928 - DNA, 13 bp, Homo sapiens
aaacaaatatgca

SEQ ID NO: 1418929 - DNA, 14 bp, Homo sapiens
aaacaaatatgcaa

SEQ ID NO: 1418930 - DNA, 13 bp, Homo sapiens
aaacaaatgattt

SEQ ID NO: 1418931 - DNA, 19 bp, Homo sapiens
aaacaaattcatattctgt

SEQ ID NO: 1418932 - DNA, 16 bp, Homo sapiens
aaacaaattggacagc

SEQ ID NO: 1418933 - DNA, 18 bp, Homo sapiens
aaacaacatttatatgta

SEQ ID NO: 1418934 - DNA, 18 bp, Homo sapiens
aaacaacgtgtatagtgc

SEQ ID NO: 1418935 - DNA, 19 bp, Homo sapiens
aaacaacttcaatatccaa

SEQ ID NO: 1418936 - DNA, 14 bp, Homo sapiens
aaacaacttggcat

SEQ ID NO: 1418937 - DNA, 16 bp, Homo sapiens
aaacaactttcacttc

SEQ ID NO: 1418938 - DNA, 13 bp, Homo sapiens
aaacaaggaagcc

SEQ ID NO: 1418939 - DNA, 16 bp, Homo sapiens
aaacaagtgtgatgcc

SEQ ID NO: 1418940 - DNA, 15 bp, Homo sapiens
aaacaataaatgtgc

SEQ ID NO: 1418941 - DNA, 14 bp, Homo sapiens
aaacaatcctgtta

SEQ ID NO: 1418942 - DNA, 18 bp, Homo sapiens
aaacaatctggaagaaaa

SEQ ID NO: 1418943 - DNA, 16 bp, Homo sapiens
aaacaatgaagtgaaa

SEQ ID NO: 1418944 - DNA, 13 bp, Homo sapiens
aaacaatgtaaag

SEQ ID NO: 1418945 - DNA, 13 bp, Homo sapiens
aaacaatgtataa

SEQ ID NO: 1418946 - DNA, 14 bp, Homo sapiens
aaacaatgtataaa

SEQ ID NO: 1418947 - DNA, 20 bp, Homo sapiens
aaacaatgttgtccaacaat

SEQ ID NO: 1418948 - DNA, 22 bp, Homo sapiens
aaacaatgttgtccaacaataa

SEQ ID NO: 1418949 - DNA, 17 bp, Homo sapiens
aaacaattttctgtaat

SEQ ID NO: 1418950 - DNA, 17 bp, Homo sapiens
aaacacaaagaagtttt

SEQ ID NO: 1418951 - DNA, 11 bp, Homo sapiens
aaacacagcaa

SEQ ID NO: 1418952 - DNA, 10 bp, Homo sapiens
aaacacaggg

SEQ ID NO: 1418953 - DNA, 19 bp, Homo sapiens
aaacacagggaaagcattt

SEQ ID NO: 1418954 - DNA, 17 bp, Homo sapiens
aaacacagggttttgta

SEQ ID NO: 1418955 - DNA, 18 bp, Homo sapiens
aaacacagggttttgtat

SEQ ID NO: 1418956 - DNA, 18 bp, Homo sapiens
aaacacataattaacact

SEQ ID NO: 1418957 - DNA, 13 bp, Homo sapiens
aaacacccctctg

SEQ ID NO: 1418958 - DNA, 14 bp, Homo sapiens
aaacacccctctgt

SEQ ID NO: 1418959 - DNA, 20 bp, Homo sapiens
aaacacccgacgtcatgtat

SEQ ID NO: 1418960 - DNA, 14 bp, Homo sapiens
aaacacctagcttt

SEQ ID NO: 1418961 - DNA, 17 bp, Homo sapiens
aaacacctccccagccc

SEQ ID NO: 1418962 - DNA, 16 bp, Homo sapiens
aaacactaagctctct

SEQ ID NO: 1418963 - DNA, 13 bp, Homo sapiens
aaacactcatccc

SEQ ID NO: 1418964 - DNA, 18 bp, Homo sapiens
aaacactgcagtttcctg

SEQ ID NO: 1418965 - DNA, 22 bp, Homo sapiens
aaacactgccatattgtgtaat

SEQ ID NO: 1418966 - DNA, 23 bp, Homo sapiens
aaacactgccatcttagtttgga

SEQ ID NO: 1418967 - DNA, 18 bp, Homo sapiens
aaacactgcctttttatt

SEQ ID NO: 1418968 - DNA, 12 bp, Homo sapiens
aaacactgtaat

SEQ ID NO: 1418969 - DNA, 14 bp, Homo sapiens
aaacactgtaatct

SEQ ID NO: 1418970 - DNA, 15 bp, Homo sapiens
aaacactgtaatctt

SEQ ID NO: 1418971 - DNA, 18 bp, Homo sapiens
aaacacttatcttctgga

SEQ ID NO: 1418972 - DNA, 18 bp, Homo sapiens
aaacacttctcatcatat

SEQ ID NO: 1418973 - DNA, 16 bp, Homo sapiens
aaacacttctgctttc

SEQ ID NO: 1418974 - DNA, 20 bp, Homo sapiens
aaacacttgtgacttttgct

SEQ ID NO: 1418975 - DNA, 13 bp, Homo sapiens
aaacacttttcaa

SEQ ID NO: 1418976 - DNA, 13 bp, Homo sapiens
aaacagaaacaaa

SEQ ID NO: 1418977 - DNA, 19 bp, Homo sapiens
aaacagaaacaaaaacact

SEQ ID NO: 1418978 - DNA, 21 bp, Homo sapiens
aaacagaaacaaaaacactaa

SEQ ID NO: 1418979 - DNA, 14 bp, Homo sapiens
aaacagaaacgaga

SEQ ID NO: 1418980 - DNA, 11 bp, Homo sapiens
aaacagaaata

SEQ ID NO: 1418981 - DNA, 14 bp, Homo sapiens
aaacagaaatggaa

SEQ ID NO: 1418982 - DNA, 12 bp, Homo sapiens
aaacagaacact

SEQ ID NO: 1418983 - DNA, 21 bp, Homo sapiens
aaacagaacatcattagaaca

SEQ ID NO: 1418984 - DNA, 15 bp, Homo sapiens
aaacagaatcttctg

SEQ ID NO: 1418985 - DNA, 22 bp, Homo sapiens
aaacagacaaaaacagcctcac

SEQ ID NO: 1418986 - DNA, 14 bp, Homo sapiens
aaacagacaatatg

SEQ ID NO: 1418987 - DNA, 12 bp, Homo sapiens
aaacagacactg

SEQ ID NO: 1418988 - DNA, 16 bp, Homo sapiens
aaacagagacaggccc

SEQ ID NO: 1418989 - DNA, 16 bp, Homo sapiens
aaacagagatgtgata

SEQ ID NO: 1418990 - DNA, 12 bp, Homo sapiens
aaacagatataa

SEQ ID NO: 1418991 - DNA, 15 bp, Homo sapiens
aaacagatataaatg

SEQ ID NO: 1418992 - DNA, 20 bp, Homo sapiens
aaacagattcaggccagccc

SEQ ID NO: 1418993 - DNA, 22 bp, Homo sapiens
aaacagattcaggccagcccag

SEQ ID NO: 1418994 - DNA, 20 bp, Homo sapiens
aaacagcacacctgtgtcca

SEQ ID NO: 1418995 - DNA, 12 bp, Homo sapiens
aaacagcatgaa

SEQ ID NO: 1418996 - DNA, 15 bp, Homo sapiens
aaacagcatgaataa

SEQ ID NO: 1418997 - DNA, 19 bp, Homo sapiens
aaacagcatgaataaaaca

SEQ ID NO: 1418998 - DNA, 23 bp, Homo sapiens
aaacagcatgaataaaacactca

SEQ ID NO: 1418999 - DNA, 17 bp, Homo sapiens
aaacagcattgctttct

SEQ ID NO: 1419000 - DNA, 18 bp, Homo sapiens
aaacagcattgctttctg

SEQ ID NO: 1419001 - DNA, 15 bp, Homo sapiens
aaacagcctcacaga

SEQ ID NO: 1419002 - DNA, 18 bp, Homo sapiens
aaacagctgcattagaaa

SEQ ID NO: 1419003 - DNA, 20 bp, Homo sapiens
aaacagctgcattagaaaaa

SEQ ID NO: 1419004 - DNA, 18 bp, Homo sapiens
catttaaactcatttgag

SEQ ID NO: 1419005 - DNA, 17 bp, Homo sapiens
catttaaagctaaattt

SEQ ID NO: 1419006 - DNA, 19 bp, Homo sapiens
catttaaagctaaattttg

SEQ ID NO: 1419007 - DNA, 19 bp, Homo sapiens
catttaaagcttattaaaa

SEQ ID NO: 1419008 - DNA, 23 bp, Homo sapiens
catttaaattttaccctttagac

SEQ ID NO: 1419009 - DNA, 18 bp, Homo sapiens
catttaaattttttggca

SEQ ID NO: 1419010 - DNA, 20 bp, Homo sapiens
catttaagtatcttgtgctt

SEQ ID NO: 1419011 - DNA, 12 bp, Homo sapiens
catttaagtttc

SEQ ID NO: 1419012 - DNA, 21 bp, Homo sapiens
catttaataaaactgcgagga

SEQ ID NO: 1419013 - DNA, 22 bp, Homo sapiens
catttaatggcagctagtgcct

SEQ ID NO: 1419014 - DNA, 20 bp, Homo sapiens
catttacatgtattatttca

SEQ ID NO: 1419015 - DNA, 13 bp, Homo sapiens
catttactgacca

SEQ ID NO: 1419016 - DNA, 15 bp, Homo sapiens
catttacttttaata

SEQ ID NO: 1419017 - DNA, 12 bp, Homo sapiens
catttagaaaag

SEQ ID NO: 1419018 - DNA, 15 bp, Homo sapiens
catttagaaaagtga

SEQ ID NO: 1419019 - DNA, 13 bp, Homo sapiens
catttagaagaaa

SEQ ID NO: 1419020 - DNA, 13 bp, Homo sapiens
catttagaatcta

SEQ ID NO: 1419021 - DNA, 12 bp, Homo sapiens
catttagaatgg

SEQ ID NO: 1419022 - DNA, 22 bp, Homo sapiens
catttagatcctggtttcataa

SEQ ID NO: 1419023 - DNA, 14 bp, Homo sapiens
catttagctggcca

SEQ ID NO: 1419024 - DNA, 20 bp, Homo sapiens
catttagttctttgttattt

SEQ ID NO: 1419025 - DNA, 21 bp, Homo sapiens
catttataaagctaaaataac

SEQ ID NO: 1419026 - DNA, 17 bp, Homo sapiens
catttataatgtttgct

SEQ ID NO: 1419027 - DNA, 19 bp, Homo sapiens
aaactagaaggcttctctc

SEQ ID NO: 1419028 - DNA, 18 bp, Homo sapiens
aaactatcggttcaagtt

SEQ ID NO: 1419029 - DNA, 17 bp, Homo sapiens
aaactatggttcccaat

SEQ ID NO: 1419030 - DNA, 23 bp, Homo sapiens
aaactatggttcccaataaaagt

SEQ ID NO: 1419031 - DNA, 15 bp, Homo sapiens
aaactatgttcctaa

SEQ ID NO: 1419032 - DNA, 17 bp, Homo sapiens
aaactatgttcctaaca

SEQ ID NO: 1419033 - DNA, 18 bp, Homo sapiens
aaactattagagtatttc

SEQ ID NO: 1419034 - DNA, 13 bp, Homo sapiens
aaactcaccttga

SEQ ID NO: 1419035 - DNA, 16 bp, Homo sapiens
aaactcactgctcaag

SEQ ID NO: 1419036 - DNA, 15 bp, Homo sapiens
aaactcagatctgat

SEQ ID NO: 1419037 - DNA, 13 bp, Homo sapiens
aaactcaggccca

SEQ ID NO: 1419038 - DNA, 14 bp, Homo sapiens
aaactcaggcccag

SEQ ID NO: 1419039 - DNA, 14 bp, Homo sapiens
aaactcagttaaaa

SEQ ID NO: 1419040 - DNA, 15 bp, Homo sapiens
aaactcagttaaaat

SEQ ID NO: 1419041 - DNA, 14 bp, Homo sapiens
aaactcagttccaa

SEQ ID NO: 1419042 - DNA, 15 bp, Homo sapiens
aaactcatttcctat

SEQ ID NO: 1419043 - DNA, 19 bp, Homo sapiens
aaactccacatctgcctta

SEQ ID NO: 1419044 - DNA, 23 bp, Homo sapiens
aaactcccacttgtcatgtgaca

SEQ ID NO: 1419045 - DNA, 17 bp, Homo sapiens
aaactcctgattttgta

SEQ ID NO: 1419046 - DNA, 14 bp, Homo sapiens
aaactccttttgct

SEQ ID NO: 1419047 - DNA, 20 bp, Homo sapiens
aaactccttttgctgtcttt

SEQ ID NO: 1419048 - DNA, 21 bp, Homo sapiens
aaactcgcgagtgtaactttc

SEQ ID NO: 1419049 - DNA, 17 bp, Homo sapiens
aaactctcccctttctt

SEQ ID NO: 1419050 - DNA, 14 bp, Homo sapiens
aaactctctcccag

SEQ ID NO: 1419051 - DNA, 15 bp, Homo sapiens
aaactctctcccagg

SEQ ID NO: 1419052 - DNA, 17 bp, Homo sapiens
aaactctgaatttatct

SEQ ID NO: 1419053 - DNA, 14 bp, Homo sapiens
aaactctgccagcc

SEQ ID NO: 1419054 - DNA, 14 bp, Homo sapiens
aaactctgggaaat

SEQ ID NO: 1419055 - DNA, 19 bp, Homo sapiens
aaactctgttgcaagtgca

SEQ ID NO: 1419056 - DNA, 21 bp, Homo sapiens
aaactcttcagttaattctta

SEQ ID NO: 1419057 - DNA, 14 bp, Homo sapiens
aaactgaatgaatc

SEQ ID NO: 1419058 - DNA, 21 bp, Homo sapiens
aaactgagatgtgaacacatc

SEQ ID NO: 1419059 - DNA, 14 bp, Homo sapiens
aaactgaggaattt

SEQ ID NO: 1419060 - DNA, 19 bp, Homo sapiens
aaactgaggaatttcacct

SEQ ID NO: 1419061 - DNA, 16 bp, Homo sapiens
aaactgagtataatca

SEQ ID NO: 1419062 - DNA, 22 bp, Homo sapiens
aaactgagtataatcaataagc

SEQ ID NO: 1419063 - DNA, 20 bp, Homo sapiens
aaactgatcaaaaataaact

SEQ ID NO: 1419064 - DNA, 22 bp, Homo sapiens
aaactgatcaaaaataaactag

SEQ ID NO: 1419065 - DNA, 12 bp, Homo sapiens
aaactgcaatag

SEQ ID NO: 1419066 - DNA, 18 bp, Homo sapiens
aaactgcaatagagactg

SEQ ID NO: 1419067 - DNA, 16 bp, Homo sapiens
aaactgcatgaaaaat

SEQ ID NO: 1419068 - DNA, 17 bp, Homo sapiens
aaactgcatgaaaaatc

SEQ ID NO: 1419069 - DNA, 15 bp, Homo sapiens
aaactgccagcaacg

SEQ ID NO: 1419070 - DNA, 21 bp, Homo sapiens
aaactgcgaggacatcaaagt

SEQ ID NO: 1419071 - DNA, 21 bp, Homo sapiens
aaactgcttttttttttccag

SEQ ID NO: 1419072 - DNA, 15 bp, Homo sapiens
aaactggcatctgct

SEQ ID NO: 1419073 - DNA, 19 bp, Homo sapiens
aaactggcttccccactcc

SEQ ID NO: 1419074 - DNA, 17 bp, Homo sapiens
aaactggggcctccaga

SEQ ID NO: 1419075 - DNA, 18 bp, Homo sapiens
aaactggggcctccagaa

SEQ ID NO: 1419076 - DNA, 20 bp, Homo sapiens
aaactggggcctccagaact

SEQ ID NO: 1419077 - DNA, 16 bp, Homo sapiens
aaactggggcctccct

SEQ ID NO: 1419078 - DNA, 16 bp, Homo sapiens
aaactgggtttctcat

SEQ ID NO: 1419079 - DNA, 16 bp, Homo sapiens
aaactggtattttatc

SEQ ID NO: 1419080 - DNA, 22 bp, Homo sapiens
aaactgtaaataaaatgtgtac

SEQ ID NO: 1419081 - DNA, 20 bp, Homo sapiens
aaactgtaaatatgtttgtg

SEQ ID NO: 1419082 - DNA, 17 bp, Homo sapiens
aaactgtacatttaaaa

SEQ ID NO: 1419083 - DNA, 22 bp, Homo sapiens
aaactgtacatttaaaattgct

SEQ ID NO: 1419084 - DNA, 15 bp, Homo sapiens
aaactgtagaaatga

SEQ ID NO: 1419085 - DNA, 22 bp, Homo sapiens
aaactgtattaaatcttaaaca

SEQ ID NO: 1419086 - DNA, 20 bp, Homo sapiens
aaactgtctttaaaagagag

SEQ ID NO: 1419087 - DNA, 18 bp, Homo sapiens
aaactgtgaaaaatcaga

SEQ ID NO: 1419088 - DNA, 17 bp, Homo sapiens
aaactgtgaaaatagtg

SEQ ID NO: 1419089 - DNA, 22 bp, Homo sapiens
aaactgtgactaggcatacact

SEQ ID NO: 1419090 - DNA, 10 bp, Homo sapiens
aaactgtgta

SEQ ID NO: 1419091 - DNA, 22 bp, Homo sapiens
aaactgttcaagaaataataaa

SEQ ID NO: 1419092 - DNA, 23 bp, Homo sapiens
aaactgttctctattagacttta

SEQ ID NO: 1419093 - DNA, 19 bp, Homo sapiens
aaactgttggaatggattt

SEQ ID NO: 1419094 - DNA, 14 bp, Homo sapiens
aaactgttttcatg

SEQ ID NO: 1419095 - DNA, 16 bp, Homo sapiens
aaacttaaatgttatt

SEQ ID NO: 1419096 - DNA, 20 bp, Homo sapiens
aaacttcatgtaattttatt

SEQ ID NO: 1419097 - DNA, 18 bp, Homo sapiens
aaacttccaaagaaagtt

SEQ ID NO: 1419098 - DNA, 13 bp, Homo sapiens
aaacttgaaatat

SEQ ID NO: 1419099 - DNA, 20 bp, Homo sapiens
aaacttgaaatatataatat

SEQ ID NO: 1419100 - DNA, 15 bp, Homo sapiens
aaacttgagtggctg

SEQ ID NO: 1419101 - DNA, 19 bp, Homo sapiens
aaacttgcatcacttaacg

SEQ ID NO: 1419102 - DNA, 24 bp, Homo sapiens
aaacttggaagggggagacaggaa

SEQ ID NO: 1419103 - DNA, 18 bp, Homo sapiens
aaacttggattctctaac

SEQ ID NO: 1419104 - DNA, 24 bp, Homo sapiens
aaacttggctcgaatctctgtgcc

SEQ ID NO: 1419105 - DNA, 18 bp, Homo sapiens
aaacttgtgagcatcaga

SEQ ID NO: 1419106 - DNA, 20 bp, Homo sapiens
aaacttgtttgctgtgaaca

SEQ ID NO: 1419107 - DNA, 15 bp, Homo sapiens
aaactttatcactta

SEQ ID NO: 1419108 - DNA, 12 bp, Homo sapiens
aaactttatttt

SEQ ID NO: 1419109 - DNA, 13 bp, Homo sapiens
aaactttcacttt

SEQ ID NO: 1419110 - DNA, 13 bp, Homo sapiens
aaactttcccttg

SEQ ID NO: 1419111 - DNA, 22 bp, Homo sapiens
aaactttgagatctaaaaataa

SEQ ID NO: 1419112 - DNA, 18 bp, Homo sapiens
aaactttgagtacagata

SEQ ID NO: 1419113 - DNA, 13 bp, Homo sapiens
aaactttgggaaa

SEQ ID NO: 1419114 - DNA, 16 bp, Homo sapiens
aaactttggtgcattg

SEQ ID NO: 1419115 - DNA, 12 bp, Homo sapiens
aaacttttctca

SEQ ID NO: 1419116 - DNA, 16 bp, Homo sapiens
aaacttttctgctgat

SEQ ID NO: 1419117 - DNA, 21 bp, Homo sapiens
aaacttttgttagggctgctt

SEQ ID NO: 1419118 - DNA, 22 bp, Homo sapiens
aaacttttgtttagagccctcc

SEQ ID NO: 1419119 - DNA, 19 bp, Homo sapiens
aaactttttttctgtacca

SEQ ID NO: 1419120 - DNA, 22 bp, Homo sapiens
aaactttttttctgtaccagtt

SEQ ID NO: 1419121 - DNA, 18 bp, Homo sapiens
aaagaaaaaaaagaaagc

SEQ ID NO: 1419122 - DNA, 18 bp, Homo sapiens
aaagaaaaaataattgat

SEQ ID NO: 1419123 - DNA, 18 bp, Homo sapiens
aaagaaaaatatttaatg

SEQ ID NO: 1419124 - DNA, 14 bp, Homo sapiens
aaagaaaacaaaaa

SEQ ID NO: 1419125 - DNA, 14 bp, Homo sapiens
aaagaaaacaaaac

SEQ ID NO: 1419126 - DNA, 17 bp, Homo sapiens
aaagaaaagacatttta

SEQ ID NO: 1419127 - DNA, 14 bp, Homo sapiens
ccaaaagacaaaaa

SEQ ID NO: 1419128 - DNA, 22 bp, Homo sapiens
ccaaaagattgctgaaatttta

SEQ ID NO: 1419129 - DNA, 15 bp, Homo sapiens
ccaaaagctttttat

SEQ ID NO: 1419130 - DNA, 22 bp, Homo sapiens
ccaaaagtcaaaaggtgcctgt

SEQ ID NO: 1419131 - DNA, 17 bp, Homo sapiens
ccaaaataccagagcct

SEQ ID NO: 1419132 - DNA, 12 bp, Homo sapiens
ccaaaatcaaga

SEQ ID NO: 1419133 - DNA, 14 bp, Homo sapiens
ccaaaatcaagagt

SEQ ID NO: 1419134 - DNA, 23 bp, Homo sapiens
ccaaaatgtaggcttagtttgtg

SEQ ID NO: 1419135 - DNA, 18 bp, Homo sapiens
ccaaacaaggaagccaaa

SEQ ID NO: 1419136 - DNA, 14 bp, Homo sapiens
ccaaacaccggcag

SEQ ID NO: 1419137 - DNA, 19 bp, Homo sapiens
ccaaacaccttccagctcc

SEQ ID NO: 1419138 - DNA, 18 bp, Homo sapiens
ccaaacagcaagaagctg

SEQ ID NO: 1419139 - DNA, 21 bp, Homo sapiens
ccaaacatcagacctgtcttc

SEQ ID NO: 1419140 - DNA, 13 bp, Homo sapiens
ccaaaccagcctt

SEQ ID NO: 1419141 - DNA, 17 bp, Homo sapiens
ccaaaccaggacactac

SEQ ID NO: 1419142 - DNA, 12 bp, Homo sapiens
ccaaccccaggg

SEQ ID NO: 1419143 - DNA, 14 bp, Homo sapiens
ccaaccccagggcc

SEQ ID NO: 1419144 - DNA, 23 bp, Homo sapiens
ccaaccccagggcccccacaggc

SEQ ID NO: 1419145 - DNA, 17 bp, Homo sapiens
ccaacccccaccccaca

SEQ ID NO: 1419146 - DNA, 20 bp, Homo sapiens
ccaacccccaccccacactt

SEQ ID NO: 1419147 - DNA, 15 bp, Homo sapiens
ccaaccccccagcac

SEQ ID NO: 1419148 - DNA, 20 bp, Homo sapiens
ccaaccccccagcactgagg

SEQ ID NO: 1419149 - DNA, 21 bp, Homo sapiens
ccaaccccccagcactgagga

SEQ ID NO: 1419150 - DNA, 20 bp, Homo sapiens
ccaacccccgccacctcagg

SEQ ID NO: 1419151 - DNA, 17 bp, Homo sapiens
ccaacccgaggcccgca

SEQ ID NO: 1419152 - DNA, 13 bp, Homo sapiens
ccaaccctgggct

SEQ ID NO: 1419153 - DNA, 19 bp, Homo sapiens
ccaaccctgggctggggag

SEQ ID NO: 1419154 - DNA, 22 bp, Homo sapiens
ccaaccctgggctggggaggag

SEQ ID NO: 1419155 - DNA, 17 bp, Homo sapiens
ccaaccctggggaagga

SEQ ID NO: 1419156 - DNA, 18 bp, Homo sapiens
ccaaccctggggaaggag

SEQ ID NO: 1419157 - DNA, 12 bp, Homo sapiens
ccaaccctgtgg

SEQ ID NO: 1419158 - DNA, 20 bp, Homo sapiens
ccaacctcaatgccctgcca

SEQ ID NO: 1419159 - DNA, 21 bp, Homo sapiens
ccaacctcaatgccctgccat

SEQ ID NO: 1419160 - DNA, 22 bp, Homo sapiens
ccaacctcaatgccctgccatt

SEQ ID NO: 1419161 - DNA, 20 bp, Homo sapiens
ccaacctcagggctcccagg

SEQ ID NO: 1419162 - DNA, 22 bp, Homo sapiens
ccaacctcagggctcccagggg

SEQ ID NO: 1419163 - DNA, 12 bp, Homo sapiens
ccaacctcctgc

SEQ ID NO: 1419164 - DNA, 15 bp, Homo sapiens
ccaacctcctgctct

SEQ ID NO: 1419165 - DNA, 20 bp, Homo sapiens
ccaacctcctgctctgggac

SEQ ID NO: 1419166 - DNA, 16 bp, Homo sapiens
ccaacctgaccaacat

SEQ ID NO: 1419167 - DNA, 19 bp, Homo sapiens
ccaacctgcaaagatctgt

SEQ ID NO: 1419168 - DNA, 13 bp, Homo sapiens
ccaacctggacaa

SEQ ID NO: 1419169 - DNA, 14 bp, Homo sapiens
ccaacctggacaac

SEQ ID NO: 1419170 - DNA, 13 bp, Homo sapiens
ccaacctggactt

SEQ ID NO: 1419171 - DNA, 21 bp, Homo sapiens
ccaacctgttcttagagtgta

SEQ ID NO: 1419172 - DNA, 15 bp, Homo sapiens
ccaacgcacaggaaa

SEQ ID NO: 1419173 - DNA, 13 bp, Homo sapiens
ccaacgccgcctt

SEQ ID NO: 1419174 - DNA, 17 bp, Homo sapiens
ccaacgccgccttggcc

SEQ ID NO: 1419175 - DNA, 14 bp, Homo sapiens
ccaactaagccctc

SEQ ID NO: 1419176 - DNA, 19 bp, Homo sapiens
ccaactaatgccttactct

SEQ ID NO: 1419177 - DNA, 16 bp, Homo sapiens
ccaactacaaccaagc

SEQ ID NO: 1419178 - DNA, 22 bp, Homo sapiens
ccaactacaaccaagctctctg

SEQ ID NO: 1419179 - DNA, 15 bp, Homo sapiens
ccaactagcccctgg

SEQ ID NO: 1419180 - DNA, 22 bp, Homo sapiens
ccaactccatggggttcgagac

SEQ ID NO: 1419181 - DNA, 14 bp, Homo sapiens
ccaactccctctct

SEQ ID NO: 1419182 - DNA, 22 bp, Homo sapiens
ccaactcctggaagctgtgtcc

SEQ ID NO: 1419183 - DNA, 15 bp, Homo sapiens
ccaactctccccagt

SEQ ID NO: 1419184 - DNA, 18 bp, Homo sapiens
ccaactctccccagtgcc

SEQ ID NO: 1419185 - DNA, 22 bp, Homo sapiens
ccaactctccccagtgcctgcc

SEQ ID NO: 1419186 - DNA, 20 bp, Homo sapiens
ccaactctgcactccatggc

SEQ ID NO: 1419187 - DNA, 19 bp, Homo sapiens
ccaactgccaggctgcctc

SEQ ID NO: 1419188 - DNA, 17 bp, Homo sapiens
ccaactggcttctgtgc

SEQ ID NO: 1419189 - DNA, 21 bp, Homo sapiens
ccaactgtggtagctccagcg

SEQ ID NO: 1419190 - DNA, 16 bp, Homo sapiens
ccaactgtttccctgc

SEQ ID NO: 1419191 - DNA, 18 bp, Homo sapiens
ccaactgtttccctgctg

SEQ ID NO: 1419192 - DNA, 19 bp, Homo sapiens
ccaactgtttccctgctga

SEQ ID NO: 1419193 - DNA, 16 bp, Homo sapiens
ccaacttcaccacccc

SEQ ID NO: 1419194 - DNA, 16 bp, Homo sapiens
ccaacttcttcctgtg

SEQ ID NO: 1419195 - DNA, 10 bp, Homo sapiens
ccaacttgag

SEQ ID NO: 1419196 - DNA, 14 bp, Homo sapiens
ccaacttgccacat

SEQ ID NO: 1419197 - DNA, 19 bp, Homo sapiens
ccaacttggttctgcttca

SEQ ID NO: 1419198 - DNA, 11 bp, Homo sapiens
ccaagaacata

SEQ ID NO: 1419199 - DNA, 15 bp, Homo sapiens
ccaagaactgcatgg

SEQ ID NO: 1419200 - DNA, 14 bp, Homo sapiens
ccaagaagcagtgg

SEQ ID NO: 1419201 - DNA, 16 bp, Homo sapiens
ccaagaagcctgcagg

SEQ ID NO: 1419202 - DNA, 19 bp, Homo sapiens
ccaagaatagatgctgact

SEQ ID NO: 1419203 - DNA, 12 bp, Homo sapiens
ccaagaatctat

SEQ ID NO: 1419204 - DNA, 21 bp, Homo sapiens
ccaagacagatgccccagagc

SEQ ID NO: 1419205 - DNA, 22 bp, Homo sapiens
ccaagacagatgccccagagct

SEQ ID NO: 1419206 - DNA, 19 bp, Homo sapiens
ccaagacggaggaggggaa

SEQ ID NO: 1419207 - DNA, 20 bp, Homo sapiens
ccaagacggaggaggggaag

SEQ ID NO: 1419208 - DNA, 21 bp, Homo sapiens
ccaagacggaggaggggaagg

SEQ ID NO: 1419209 - DNA, 22 bp, Homo sapiens
ccaagacggaggaggggaaggg

SEQ ID NO: 1419210 - DNA, 16 bp, Homo sapiens
ccaagactcctcaggc

SEQ ID NO: 1419211 - DNA, 14 bp, Homo sapiens
ccaagactctagag

SEQ ID NO: 1419212 - DNA, 15 bp, Homo sapiens
ccaagactctagagt

SEQ ID NO: 1419213 - DNA, 22 bp, Homo sapiens
ccaagactctagagtccaaggt

SEQ ID NO: 1419214 - DNA, 22 bp, Homo sapiens
ccaagagaaggtggacctggca

SEQ ID NO: 1419215 - DNA, 12 bp, Homo sapiens
ccaagagagaaa

SEQ ID NO: 1419216 - DNA, 15 bp, Homo sapiens
ccaagagagaaagaa

SEQ ID NO: 1419217 - DNA, 21 bp, Homo sapiens
ccaagagatctgtgtggctcc

SEQ ID NO: 1419218 - DNA, 22 bp, Homo sapiens
ccaagagatctgtgtggctcct

SEQ ID NO: 1419219 - DNA, 21 bp, Homo sapiens
ccaagaggctgttcccaccag

SEQ ID NO: 1419220 - DNA, 15 bp, Homo sapiens
ccaagaggtctgagc

SEQ ID NO: 1419221 - DNA, 18 bp, Homo sapiens
ccaagatggctgctgcct

SEQ ID NO: 1419222 - DNA, 18 bp, Homo sapiens
ccaagatgggcatctttt

SEQ ID NO: 1419223 - DNA, 15 bp, Homo sapiens
ccaagattctagatg

SEQ ID NO: 1419224 - DNA, 17 bp, Homo sapiens
ccaagattctagatgat

SEQ ID NO: 1419225 - DNA, 21 bp, Homo sapiens
ccaagattgcgccattgcact

SEQ ID NO: 1419226 - DNA, 17 bp, Homo sapiens
ccaagatttaaatgcca

SEQ ID NO: 1419227 - DNA, 19 bp, Homo sapiens
ccaagatttaaatgccata

SEQ ID NO: 1419228 - DNA, 22 bp, Homo sapiens
ccaagcaagtagctttccacat

SEQ ID NO: 1419229 - DNA, 20 bp, Homo sapiens
ccaagcactcgagaccatcc

SEQ ID NO: 1419230 - DNA, 14 bp, Homo sapiens
ccaagcagccagcc

SEQ ID NO: 1419231 - DNA, 16 bp, Homo sapiens
ccaagccaatgttata

SEQ ID NO: 1419232 - DNA, 11 bp, Homo sapiens
ccaagccagag

SEQ ID NO: 1419233 - DNA, 17 bp, Homo sapiens
ccaagccagaggctggg

SEQ ID NO: 1419234 - DNA, 16 bp, Homo sapiens
ccaagccagattctct

SEQ ID NO: 1419235 - DNA, 17 bp, Homo sapiens
ccaagcccgacttgctg

SEQ ID NO: 1419236 - DNA, 23 bp, Homo sapiens
ccaagccgaccttccctccgcct

SEQ ID NO: 1419237 - DNA, 16 bp, Homo sapiens
ccaagccgtggcttcc

SEQ ID NO: 1419238 - DNA, 23 bp, Homo sapiens
ccaagccgtggcttcccgctcag

SEQ ID NO: 1419239 - DNA, 13 bp, Homo sapiens
ccaagcctccaca

SEQ ID NO: 1419240 - DNA, 15 bp, Homo sapiens
ccaagcctccacagc

SEQ ID NO: 1419241 - DNA, 18 bp, Homo sapiens
ccaagcctccacagcgag

SEQ ID NO: 1419242 - DNA, 20 bp, Homo sapiens
ccaagcgaggtcaacagaga

SEQ ID NO: 1419243 - DNA, 18 bp, Homo sapiens
ccaagcgttcctggcctt

SEQ ID NO: 1419244 - DNA, 17 bp, Homo sapiens
ccaagctattcaattct

SEQ ID NO: 1419245 - DNA, 14 bp, Homo sapiens
ccaagctctctgca

SEQ ID NO: 1419246 - DNA, 18 bp, Homo sapiens
ccaagctgagtttcctat

SEQ ID NO: 1419247 - DNA, 19 bp, Homo sapiens
ccaagctgagtttcctatg

SEQ ID NO: 1419248 - DNA, 13 bp, Homo sapiens
aaagcaaaagaga

SEQ ID NO: 1419249 - DNA, 15 bp, Homo sapiens
aaagcaaaagagaaa

SEQ ID NO: 1419250 - DNA, 21 bp, Homo sapiens
aaagcaaaagagaaatacata

SEQ ID NO: 1419251 - DNA, 17 bp, Homo sapiens
aaagcaaaaggctgaga

SEQ ID NO: 1419252 - DNA, 14 bp, Homo sapiens
aaagcaaaagtgct

SEQ ID NO: 1419253 - DNA, 13 bp, Homo sapiens
aaagcaaaataca

SEQ ID NO: 1419254 - DNA, 23 bp, Homo sapiens
aaagcaaacttaagaaacactga

SEQ ID NO: 1419255 - DNA, 14 bp, Homo sapiens
aaagcaaagtcact

SEQ ID NO: 1419256 - DNA, 22 bp, Homo sapiens
aaagcaacaaattaactagata

SEQ ID NO: 1419257 - DNA, 20 bp, Homo sapiens
aaagtagagctagctgccac

SEQ ID NO: 1419258 - DNA, 14 bp, Homo sapiens
aaagtagattaaga

SEQ ID NO: 1419259 - DNA, 15 bp, Homo sapiens
aaagtaggattttga

SEQ ID NO: 1419260 - DNA, 21 bp, Homo sapiens
aaagtatagatacaaaacctt

SEQ ID NO: 1419261 - DNA, 13 bp, Homo sapiens
aaagtatatatag

SEQ ID NO: 1419262 - DNA, 22 bp, Homo sapiens
aaagtatatatatatattatat

SEQ ID NO: 1419263 - DNA, 15 bp, Homo sapiens
aaagtatatatttat

SEQ ID NO: 1419264 - DNA, 12 bp, Homo sapiens
aaagtatatgtg

SEQ ID NO: 1419265 - DNA, 14 bp, Homo sapiens
aaagtatatgttag

SEQ ID NO: 1419266 - DNA, 18 bp, Homo sapiens
aaagtatgcattattaaa

SEQ ID NO: 1419267 - DNA, 19 bp, Homo sapiens
aaagtatgcattattaaat

SEQ ID NO: 1419268 - DNA, 19 bp, Homo sapiens
aaagtatgtattatttaca

SEQ ID NO: 1419269 - DNA, 17 bp, Homo sapiens
aaagtattatcattgct

SEQ ID NO: 1419270 - DNA, 21 bp, Homo sapiens
aaagtattcaacaatttcaat

SEQ ID NO: 1419271 - DNA, 16 bp, Homo sapiens
aaagtattctcttttc

SEQ ID NO: 1419272 - DNA, 12 bp, Homo sapiens
aaagtattttct

SEQ ID NO: 1419273 - DNA, 23 bp, Homo sapiens
aaagtcaaaaaattatttgctat

SEQ ID NO: 1419274 - DNA, 18 bp, Homo sapiens
aaagtcaaaaggtgcctg

SEQ ID NO: 1419275 - DNA, 13 bp, Homo sapiens
aaagtcacagtta

SEQ ID NO: 1419276 - DNA, 15 bp, Homo sapiens
aaagtcagaagtttt

SEQ ID NO: 1419277 - DNA, 23 bp, Homo sapiens
aaagtcagttgctcaaaaagaaa

SEQ ID NO: 1419278 - DNA, 15 bp, Homo sapiens
aaagtcctctgctcc

SEQ ID NO: 1419279 - DNA, 23 bp, Homo sapiens
aaagtctaagcaagatgttttgt

SEQ ID NO: 1419280 - DNA, 18 bp, Homo sapiens
aaagtcttggttttatct

SEQ ID NO: 1419281 - DNA, 18 bp, Homo sapiens
aaagtgacagagacccag

SEQ ID NO: 1419282 - DNA, 12 bp, Homo sapiens
aaagtgacattt

SEQ ID NO: 1419283 - DNA, 22 bp, Homo sapiens
aaagtgacatttgctttcggta

SEQ ID NO: 1419284 - DNA, 19 bp, Homo sapiens
aaagtgagagccagcagca

SEQ ID NO: 1419285 - DNA, 15 bp, Homo sapiens
aaagtgataagtgca

SEQ ID NO: 1419286 - DNA, 21 bp, Homo sapiens
aaagtgatcttgagaaccttt

SEQ ID NO: 1419287 - DNA, 16 bp, Homo sapiens
aaagtgattatctctt

SEQ ID NO: 1419288 - DNA, 21 bp, Homo sapiens
aaagtgccccttaagggttga

SEQ ID NO: 1419289 - DNA, 23 bp, Homo sapiens
aaagtgctaaggttctaaggcct

SEQ ID NO: 1419290 - DNA, 13 bp, Homo sapiens
aaagtgctgagat

SEQ ID NO: 1419291 - DNA, 22 bp, Homo sapiens
aaagtgctgcagggctttaaaa

SEQ ID NO: 1419292 - DNA, 13 bp, Homo sapiens
aaagtggaacgaa

SEQ ID NO: 1419293 - DNA, 20 bp, Homo sapiens
aaagtggaacgaaaatgaaa

SEQ ID NO: 1419294 - DNA, 19 bp, Homo sapiens
aaagtggccaagaagcagt

SEQ ID NO: 1419295 - DNA, 21 bp, Homo sapiens
aaagtggcgtgggagccagcc

SEQ ID NO: 1419296 - DNA, 21 bp, Homo sapiens
aaagtgggaggtcaggaaact

SEQ ID NO: 1419297 - DNA, 22 bp, Homo sapiens
aaagtgggttttttagttgaat

SEQ ID NO: 1419298 - DNA, 20 bp, Homo sapiens
aaagtgtaaatcctttttct

SEQ ID NO: 1419299 - DNA, 14 bp, Homo sapiens
aaagtgtatttgga

SEQ ID NO: 1419300 - DNA, 21 bp, Homo sapiens
aaagtgtctcaaaggagcttt

SEQ ID NO: 1419301 - DNA, 17 bp, Homo sapiens
aaagtgtcttttgacat

SEQ ID NO: 1419302 - DNA, 20 bp, Homo sapiens
aaagtgtgagctcttccctt

SEQ ID NO: 1419303 - DNA, 20 bp, Homo sapiens
aaagtgtgtaattatgtaaa

SEQ ID NO: 1419304 - DNA, 22 bp, Homo sapiens
aaagtgtgtaattatgtaaata

SEQ ID NO: 1419305 - DNA, 19 bp, Homo sapiens
aaagtgtgtatatattttg

SEQ ID NO: 1419306 - DNA, 21 bp, Homo sapiens
aaagtgtgtatatattttgtg

SEQ ID NO: 1419307 - DNA, 19 bp, Homo sapiens
aaagtgttggctaatgaag

SEQ ID NO: 1419308 - DNA, 18 bp, Homo sapiens
aaagtgttgtgttcctgg

SEQ ID NO: 1419309 - DNA, 19 bp, Homo sapiens
aaagtgttgtgttcctggc

SEQ ID NO: 1419310 - DNA, 22 bp, Homo sapiens
aaagttaacaggcaaacatttt

SEQ ID NO: 1419311 - DNA, 13 bp, Homo sapiens
aaagttacccaaa

SEQ ID NO: 1419312 - DNA, 22 bp, Homo sapiens
aaagttacttgaatttcaaaca

SEQ ID NO: 1419313 - DNA, 18 bp, Homo sapiens
aaagttagggggttctta

SEQ ID NO: 1419314 - DNA, 18 bp, Homo sapiens
aaagttagtatcttttga

SEQ ID NO: 1419315 - DNA, 14 bp, Homo sapiens
aaagttatgtattt

SEQ ID NO: 1419316 - DNA, 22 bp, Homo sapiens
aaagttattgctggtgcaaaga

SEQ ID NO: 1419317 - DNA, 19 bp, Homo sapiens
aaagttattgtgatatcct

SEQ ID NO: 1419318 - DNA, 16 bp, Homo sapiens
aaagttccaagagtct

SEQ ID NO: 1419319 - DNA, 22 bp, Homo sapiens
aaagttccaagagtctaaagat

SEQ ID NO: 1419320 - DNA, 15 bp, Homo sapiens
aaagttctaagattc

SEQ ID NO: 1419321 - DNA, 19 bp, Homo sapiens
aaagttctaataatttcta

SEQ ID NO: 1419322 - DNA, 20 bp, Homo sapiens
aaagttctaataatttctaa

SEQ ID NO: 1419323 - DNA, 13 bp, Homo sapiens
aaagttgaaaagc

SEQ ID NO: 1419324 - DNA, 19 bp, Homo sapiens
aaagttggaaggatctgct

SEQ ID NO: 1419325 - DNA, 19 bp, Homo sapiens
aaagttgggcccctgagga

SEQ ID NO: 1419326 - DNA, 15 bp, Homo sapiens
aaagttgtactttaa

SEQ ID NO: 1419327 - DNA, 19 bp, Homo sapiens
aaagttgtactttaaaaat

SEQ ID NO: 1419328 - DNA, 13 bp, Homo sapiens
aaagttgtatcca

SEQ ID NO: 1419329 - DNA, 22 bp, Homo sapiens
aaagttgtatccattaacctgg

SEQ ID NO: 1419330 - DNA, 14 bp, Homo sapiens
aaagttgtcttaaa

SEQ ID NO: 1419331 - DNA, 12 bp, Homo sapiens
aaagtttacaac

SEQ ID NO: 1419332 - DNA, 15 bp, Homo sapiens
aaagtttacagatgt

SEQ ID NO: 1419333 - DNA, 20 bp, Homo sapiens
aaagtttcacctgtattgaa

SEQ ID NO: 1419334 - DNA, 13 bp, Homo sapiens
aaagtttgccaga

SEQ ID NO: 1419335 - DNA, 22 bp, Homo sapiens
aaagttttacagagaggataca

SEQ ID NO: 1419336 - DNA, 13 bp, Homo sapiens
aaagttttgtaaa

SEQ ID NO: 1419337 - DNA, 23 bp, Homo sapiens
aaagttttgttgtacttaaatgg

SEQ ID NO: 1419338 - DNA, 19 bp, Homo sapiens
aaagtttttaatttgatgc

SEQ ID NO: 1419339 - DNA, 22 bp, Homo sapiens
aaagttttttattatgcattat

SEQ ID NO: 1419340 - DNA, 19 bp, Homo sapiens
aaataaaaaaaaaaggatg

SEQ ID NO: 1419341 - DNA, 22 bp, Homo sapiens
aaataaaaaaaaaaggatgaaa

SEQ ID NO: 1419342 - DNA, 15 bp, Homo sapiens
aaataaaaaagatcc

SEQ ID NO: 1419343 - DNA, 21 bp, Homo sapiens
aaataaaaaagctcttttaat

SEQ ID NO: 1419344 - DNA, 15 bp, Homo sapiens
aaataaaaactaatt

SEQ ID NO: 1419345 - DNA, 12 bp, Homo sapiens
aaataaaaagag

SEQ ID NO: 1419346 - DNA, 13 bp, Homo sapiens
aaataaaaagaga

SEQ ID NO: 1419347 - DNA, 19 bp, Homo sapiens
aaataaaaagtaatgactt

SEQ ID NO: 1419348 - DNA, 19 bp, Homo sapiens
aaataaaaagtgacacagc

SEQ ID NO: 1419349 - DNA, 17 bp, Homo sapiens
aaataaaaatatgtaat

SEQ ID NO: 1419350 - DNA, 15 bp, Homo sapiens
aaataaaaatggata

SEQ ID NO: 1419351 - DNA, 12 bp, Homo sapiens
aaataaaacaca

SEQ ID NO: 1419352 - DNA, 13 bp, Homo sapiens
aaataaaagcaca

SEQ ID NO: 1419353 - DNA, 12 bp, Homo sapiens
aaataaaatatt

SEQ ID NO: 1419354 - DNA, 16 bp, Homo sapiens
aaataaaatattcact

SEQ ID NO: 1419355 - DNA, 17 bp, Homo sapiens
aaataaaatgtgtacag

SEQ ID NO: 1419356 - DNA, 18 bp, Homo sapiens
aaataaacaaataacaat

SEQ ID NO: 1419357 - DNA, 13 bp, Homo sapiens
aaataaaccactg

SEQ ID NO: 1419358 - DNA, 19 bp, Homo sapiens
aaataaacctcaaaatgtc

SEQ ID NO: 1419359 - DNA, 12 bp, Homo sapiens
aaataaacctga

SEQ ID NO: 1419360 - DNA, 11 bp, Homo sapiens
aaataaagaag

SEQ ID NO: 1419361 - DNA, 14 bp, Homo sapiens
aaataaagaagtat

SEQ ID NO: 1419362 - DNA, 15 bp, Homo sapiens
aaataaagagccata

SEQ ID NO: 1419363 - DNA, 20 bp, Homo sapiens
aaataaagcttgcaacaaaa

SEQ ID NO: 1419364 - DNA, 18 bp, Homo sapiens
aaataaaggatttctaga

SEQ ID NO: 1419365 - DNA, 20 bp, Homo sapiens
aaataaaggcgctaatttat

SEQ ID NO: 1419366 - DNA, 13 bp, Homo sapiens
aaataaagtatat

SEQ ID NO: 1419367 - DNA, 21 bp, Homo sapiens
aaataaatagggaagatggag

SEQ ID NO: 1419368 - DNA, 20 bp, Homo sapiens
aaataaatgagctatgtatt

SEQ ID NO: 1419369 - DNA, 22 bp, Homo sapiens
aaataaatgagctatgtattaa

SEQ ID NO: 1419370 - DNA, 12 bp, Homo sapiens
ccaatcatttta

SEQ ID NO: 1419371 - DNA, 20 bp, Homo sapiens
aaatagttgcatagcagtat

SEQ ID NO: 1419372 - DNA, 16 bp, Homo sapiens
aaatataacacatttt

SEQ ID NO: 1419373 - DNA, 11 bp, Homo sapiens
aaatataattc

SEQ ID NO: 1419374 - DNA, 17 bp, Homo sapiens
ccacaggcccttcctct

SEQ ID NO: 1419375 - DNA, 18 bp, Homo sapiens
ccacaggcccttcctctc

SEQ ID NO: 1419376 - DNA, 19 bp, Homo sapiens
ccacaggcccttcctctcc

SEQ ID NO: 1419377 - DNA, 12 bp, Homo sapiens
ccacaggcctga

SEQ ID NO: 1419378 - DNA, 13 bp, Homo sapiens
ccacagggaccag

SEQ ID NO: 1419379 - DNA, 18 bp, Homo sapiens
ccacagggaccagggcca

SEQ ID NO: 1419380 - DNA, 21 bp, Homo sapiens
ccacagggaccagggccaccg

SEQ ID NO: 1419381 - DNA, 14 bp, Homo sapiens
ccacagggctaaga

SEQ ID NO: 1419382 - DNA, 20 bp, Homo sapiens
ccacagggctaagagctagc

SEQ ID NO: 1419383 - DNA, 18 bp, Homo sapiens
ccacaggggcaggcctgg

SEQ ID NO: 1419384 - DNA, 19 bp, Homo sapiens
ccacaggggcaggcctggg

SEQ ID NO: 1419385 - DNA, 16 bp, Homo sapiens
ccacaggggccaccac

SEQ ID NO: 1419386 - DNA, 18 bp, Homo sapiens
ccacagggttcaaaatgt

SEQ ID NO: 1419387 - DNA, 17 bp, Homo sapiens
ccacaggtgggaggagt

SEQ ID NO: 1419388 - DNA, 14 bp, Homo sapiens
ccacagtcagtgga

SEQ ID NO: 1419389 - DNA, 16 bp, Homo sapiens
ccacagtgccacccat

SEQ ID NO: 1419390 - DNA, 15 bp, Homo sapiens
ccacagtgctgcttc

SEQ ID NO: 1419391 - DNA, 18 bp, Homo sapiens
ccacagtgctgcttctct

SEQ ID NO: 1419392 - DNA, 14 bp, Homo sapiens
ccacagtgggtggc

SEQ ID NO: 1419393 - DNA, 23 bp, Homo sapiens
ccacagtgtcactggtcaggtgc

SEQ ID NO: 1419394 - DNA, 12 bp, Homo sapiens
ccacagtgtctg

SEQ ID NO: 1419395 - DNA, 21 bp, Homo sapiens
ccacagttttaataagaacag

SEQ ID NO: 1419396 - DNA, 20 bp, Homo sapiens
ccacataagaaggcaatttt

SEQ ID NO: 1419397 - DNA, 20 bp, Homo sapiens
ccacatacaacacaaagaga

SEQ ID NO: 1419398 - DNA, 23 bp, Homo sapiens
ccacatacgtgagggggagctga

SEQ ID NO: 1419399 - DNA, 23 bp, Homo sapiens
ccacatagtgatggttcccctgt

SEQ ID NO: 1419400 - DNA, 14 bp, Homo sapiens
ccacatccccagag

SEQ ID NO: 1419401 - DNA, 17 bp, Homo sapiens
ccacatccccagagccc

SEQ ID NO: 1419402 - DNA, 19 bp, Homo sapiens
ccacatccccagagcccag

SEQ ID NO: 1419403 - DNA, 23 bp, Homo sapiens
ccacatccccagagcccagctct

SEQ ID NO: 1419404 - DNA, 13 bp, Homo sapiens
ccacatctgctct

SEQ ID NO: 1419405 - DNA, 15 bp, Homo sapiens
ccacatctgtttcaa

SEQ ID NO: 1419406 - DNA, 14 bp, Homo sapiens
ccacatgacctcca

SEQ ID NO: 1419407 - DNA, 13 bp, Homo sapiens
ccacatgaggcca

SEQ ID NO: 1419408 - DNA, 20 bp, Homo sapiens
ccacatgaggccatctcagg

SEQ ID NO: 1419409 - DNA, 21 bp, Homo sapiens
ccacatgaggccatctcagga

SEQ ID NO: 1419410 - DNA, 14 bp, Homo sapiens
ccacatgccccagg

SEQ ID NO: 1419411 - DNA, 15 bp, Homo sapiens
ccacatgccccaggc

SEQ ID NO: 1419412 - DNA, 16 bp, Homo sapiens
ccacatggagccccct

SEQ ID NO: 1419413 - DNA, 18 bp, Homo sapiens
ccacatggcggagagttt

SEQ ID NO: 1419414 - DNA, 18 bp, Homo sapiens
ccacatggggttcctggt

SEQ ID NO: 1419415 - DNA, 20 bp, Homo sapiens
ccacatgtggggacagggct

SEQ ID NO: 1419416 - DNA, 17 bp, Homo sapiens
ccacatgtgtccatccc

SEQ ID NO: 1419417 - DNA, 16 bp, Homo sapiens
ccacattgctggctgc

SEQ ID NO: 1419418 - DNA, 14 bp, Homo sapiens
ccacattgttttaa

SEQ ID NO: 1419419 - DNA, 12 bp, Homo sapiens
ccacatttgatg

SEQ ID NO: 1419420 - DNA, 16 bp, Homo sapiens
ccacattttatattta

SEQ ID NO: 1419421 - DNA, 15 bp, Homo sapiens
ccaccaaactgcaca

SEQ ID NO: 1419422 - DNA, 21 bp, Homo sapiens
ccaccaaactgcacacacagc

SEQ ID NO: 1419423 - DNA, 13 bp, Homo sapiens
ccaccaaagctgc

SEQ ID NO: 1419424 - DNA, 16 bp, Homo sapiens
ccaccaaagctgccca

SEQ ID NO: 1419425 - DNA, 19 bp, Homo sapiens
ccaccaacactgctcacag

SEQ ID NO: 1419426 - DNA, 15 bp, Homo sapiens
ccaccaagggatctg

SEQ ID NO: 1419427 - DNA, 15 bp, Homo sapiens
ccaccacagccagca

SEQ ID NO: 1419428 - DNA, 13 bp, Homo sapiens
ccaccacaggcat

SEQ ID NO: 1419429 - DNA, 20 bp, Homo sapiens
ccaccacagtccccagagtg

SEQ ID NO: 1419430 - DNA, 15 bp, Homo sapiens
ccaccaccactggcc

SEQ ID NO: 1419431 - DNA, 14 bp, Homo sapiens
ccaccacccccttt

SEQ ID NO: 1419432 - DNA, 11 bp, Homo sapiens
ccaccaccctg

SEQ ID NO: 1419433 - DNA, 14 bp, Homo sapiens
ccaccaccctgccc

SEQ ID NO: 1419434 - DNA, 21 bp, Homo sapiens
ccaccacctaggccactcctc

SEQ ID NO: 1419435 - DNA, 20 bp, Homo sapiens
ccaccacgatgtggccctgg

SEQ ID NO: 1419436 - DNA, 16 bp, Homo sapiens
ccaccacgtctgccag

SEQ ID NO: 1419437 - DNA, 14 bp, Homo sapiens
ccaccactggccac

SEQ ID NO: 1419438 - DNA, 21 bp, Homo sapiens
ccaccactggccaccaggctg

SEQ ID NO: 1419439 - DNA, 23 bp, Homo sapiens
ccaccagactgacaaatgtgtat

SEQ ID NO: 1419440 - DNA, 12 bp, Homo sapiens
ccaccagcaagg

SEQ ID NO: 1419441 - DNA, 14 bp, Homo sapiens
ccaccagcacctta

SEQ ID NO: 1419442 - DNA, 13 bp, Homo sapiens
ccaccagcagcat

SEQ ID NO: 1419443 - DNA, 12 bp, Homo sapiens
ccaccagcctaa

SEQ ID NO: 1419444 - DNA, 13 bp, Homo sapiens
ccaccagcctaag

SEQ ID NO: 1419445 - DNA, 17 bp, Homo sapiens
ccaccaggactgaaaga

SEQ ID NO: 1419446 - DNA, 11 bp, Homo sapiens
ccaccaggagc

SEQ ID NO: 1419447 - DNA, 15 bp, Homo sapiens
ccaccaggagcagca

SEQ ID NO: 1419448 - DNA, 18 bp, Homo sapiens
ccaccaggagcagcagcc

SEQ ID NO: 1419449 - DNA, 13 bp, Homo sapiens
ccaccaggccacc

SEQ ID NO: 1419450 - DNA, 19 bp, Homo sapiens
ccaccaggccacctcccca

SEQ ID NO: 1419451 - DNA, 20 bp, Homo sapiens
ccaccaggctgctcagggct

SEQ ID NO: 1419452 - DNA, 22 bp, Homo sapiens
ccaccaggctgctcagggctgg

SEQ ID NO: 1419453 - DNA, 18 bp, Homo sapiens
ccaccaggctggcgcagc

SEQ ID NO: 1419454 - DNA, 20 bp, Homo sapiens
ccaccaggctggcgcagcca

SEQ ID NO: 1419455 - DNA, 15 bp, Homo sapiens
ccaccaggggaagga

SEQ ID NO: 1419456 - DNA, 12 bp, Homo sapiens
ccaccagttctc

SEQ ID NO: 1419457 - DNA, 22 bp, Homo sapiens
ccaccatattcagtgctgtggc

SEQ ID NO: 1419458 - DNA, 23 bp, Homo sapiens
ccaccatattcagtgctgtggcc

SEQ ID NO: 1419459 - DNA, 14 bp, Homo sapiens
ccaccatccccacc

SEQ ID NO: 1419460 - DNA, 16 bp, Homo sapiens
ccaccatggccagcta

SEQ ID NO: 1419461 - DNA, 21 bp, Homo sapiens
ccaccatggtcatcaccaccc

SEQ ID NO: 1419462 - DNA, 22 bp, Homo sapiens
ccaccatggtcatcaccaccct

SEQ ID NO: 1419463 - DNA, 13 bp, Homo sapiens
ccaccattcacat

SEQ ID NO: 1419464 - DNA, 19 bp, Homo sapiens
ccaccattcctgcctttaa

SEQ ID NO: 1419465 - DNA, 23 bp, Homo sapiens
ccaccattcctgcctttaagcca

SEQ ID NO: 1419466 - DNA, 16 bp, Homo sapiens
ccacccaaccctatct

SEQ ID NO: 1419467 - DNA, 18 bp, Homo sapiens
ccacccaagcctgctggc

SEQ ID NO: 1419468 - DNA, 15 bp, Homo sapiens
ccacccaagcttggc

SEQ ID NO: 1419469 - DNA, 21 bp, Homo sapiens
ccacccaagcttggcagccga

SEQ ID NO: 1419470 - DNA, 18 bp, Homo sapiens
ccacccacacagctgccc

SEQ ID NO: 1419471 - DNA, 12 bp, Homo sapiens
ccacccacatga

SEQ ID NO: 1419472 - DNA, 13 bp, Homo sapiens
ccacccaccccaa

SEQ ID NO: 1419473 - DNA, 22 bp, Homo sapiens
ccacccagaatgagacatccag

SEQ ID NO: 1419474 - DNA, 12 bp, Homo sapiens
ccacccagccca

SEQ ID NO: 1419475 - DNA, 22 bp, Homo sapiens
ccacccagcccattctctctcc

SEQ ID NO: 1419476 - DNA, 12 bp, Homo sapiens
ccacccaggagg

SEQ ID NO: 1419477 - DNA, 14 bp, Homo sapiens
ccacccaggaggga

SEQ ID NO: 1419478 - DNA, 17 bp, Homo sapiens
ccacccaggagggaggg

SEQ ID NO: 1419479 - DNA, 13 bp, Homo sapiens
ccacccaggctgc

SEQ ID NO: 1419480 - DNA, 16 bp, Homo sapiens
ccacccaggctgcact

SEQ ID NO: 1419481 - DNA, 21 bp, Homo sapiens
ccacccaggctgcactgcagt

SEQ ID NO: 1419482 - DNA, 17 bp, Homo sapiens
ccacccagtgctgccat

SEQ ID NO: 1419483 - DNA, 22 bp, Homo sapiens
ccacccagtgctgccatgccac

SEQ ID NO: 1419484 - DNA, 17 bp, Homo sapiens
ccacccatcgctgtgtg

SEQ ID NO: 1419485 - DNA, 18 bp, Homo sapiens
ccacccatcttcctgctg

SEQ ID NO: 1419486 - DNA, 13 bp, Homo sapiens
ccaccccaactct

SEQ ID NO: 1419487 - DNA, 15 bp, Homo sapiens
aacagacaggagaaa

SEQ ID NO: 1419488 - DNA, 18 bp, Homo sapiens
aacagaccccctctagaa

SEQ ID NO: 1419489 - DNA, 19 bp, Homo sapiens
aacagaccccctctagaaa

SEQ ID NO: 1419490 - DNA, 13 bp, Homo sapiens
aacagagatgtga

SEQ ID NO: 1419491 - DNA, 23 bp, Homo sapiens
aacagagggagtttaatacagga

SEQ ID NO: 1419492 - DNA, 19 bp, Homo sapiens
aacagagtgagaccctgtc

SEQ ID NO: 1419493 - DNA, 20 bp, Homo sapiens
aacagagtggattgggctgc

SEQ ID NO: 1419494 - DNA, 15 bp, Homo sapiens
aacagagttatagaa

SEQ ID NO: 1419495 - DNA, 23 bp, Homo sapiens
aacagatactggaagttttgcat

SEQ ID NO: 1419496 - DNA, 20 bp, Homo sapiens
aacagatataaatggctggt

SEQ ID NO: 1419497 - DNA, 16 bp, Homo sapiens
aacagatcaatttgta

SEQ ID NO: 1419498 - DNA, 21 bp, Homo sapiens
aacagatgcaatgtgctactg

SEQ ID NO: 1419499 - DNA, 12 bp, Homo sapiens
aacagattcaga

SEQ ID NO: 1419500 - DNA, 13 bp, Homo sapiens
aacagatttttac

SEQ ID NO: 1419501 - DNA, 14 bp, Homo sapiens
aacagatttttaca

SEQ ID NO: 1419502 - DNA, 17 bp, Homo sapiens
aacagcaagtgtttgtg

SEQ ID NO: 1419503 - DNA, 20 bp, Homo sapiens
aacagcaagtgtttgtggga

SEQ ID NO: 1419504 - DNA, 13 bp, Homo sapiens
aacagcacacctg

SEQ ID NO: 1419505 - DNA, 20 bp, Homo sapiens
aacagcacacctgtgtccaa

SEQ ID NO: 1419506 - DNA, 19 bp, Homo sapiens
aacagcagctcatagaatt

SEQ ID NO: 1419507 - DNA, 21 bp, Homo sapiens
aacagcagtctccttcagcac

SEQ ID NO: 1419508 - DNA, 15 bp, Homo sapiens
aacagcatgtctact

SEQ ID NO: 1419509 - DNA, 20 bp, Homo sapiens
aacagcattgctttctgaaa

SEQ ID NO: 1419510 - DNA, 19 bp, Homo sapiens
aacagccaactagcccctg

SEQ ID NO: 1419511 - DNA, 13 bp, Homo sapiens
catatcccttcca

SEQ ID NO: 1419512 - DNA, 15 bp, Homo sapiens
catatcccttccaga

SEQ ID NO: 1419513 - DNA, 23 bp, Homo sapiens
catatcctgagccatcggtgaaa

SEQ ID NO: 1419514 - DNA, 11 bp, Homo sapiens
catatcctgcc

SEQ ID NO: 1419515 - DNA, 14 bp, Homo sapiens
catatcctgcctca

SEQ ID NO: 1419516 - DNA, 15 bp, Homo sapiens
catatctaaagtcat

SEQ ID NO: 1419517 - DNA, 21 bp, Homo sapiens
catatctacagtacttccaga

SEQ ID NO: 1419518 - DNA, 15 bp, Homo sapiens
catatctagtatgaa

SEQ ID NO: 1419519 - DNA, 15 bp, Homo sapiens
catatctccttcccc

SEQ ID NO: 1419520 - DNA, 15 bp, Homo sapiens
catatctgcctcccc

SEQ ID NO: 1419521 - DNA, 16 bp, Homo sapiens
catatctgcctcccct

SEQ ID NO: 1419522 - DNA, 18 bp, Homo sapiens
catatcttaaagaaacag

SEQ ID NO: 1419523 - DNA, 20 bp, Homo sapiens
catatcttaaagaaacagct

SEQ ID NO: 1419524 - DNA, 23 bp, Homo sapiens
catatcttaaagaaacagctttc

SEQ ID NO: 1419525 - DNA, 24 bp, Homo sapiens
catatcttctatatctgaagagta

SEQ ID NO: 1419526 - DNA, 18 bp, Homo sapiens
catatgaatatatgtttt

SEQ ID NO: 1419527 - DNA, 19 bp, Homo sapiens
catatgaatatatgttttg

SEQ ID NO: 1419528 - DNA, 15 bp, Homo sapiens
catatgaattgtaca

SEQ ID NO: 1419529 - DNA, 19 bp, Homo sapiens
catatgacaaatgtttcta

SEQ ID NO: 1419530 - DNA, 20 bp, Homo sapiens
catatgacaagcctttgtgc

SEQ ID NO: 1419531 - DNA, 22 bp, Homo sapiens
catatgactcacatgatgcata

SEQ ID NO: 1419532 - DNA, 20 bp, Homo sapiens
catatgagaatataccttat

SEQ ID NO: 1419533 - DNA, 18 bp, Homo sapiens
catatgcaccttgtgtct

SEQ ID NO: 1419534 - DNA, 13 bp, Homo sapiens
catatgcagaaat

SEQ ID NO: 1419535 - DNA, 21 bp, Homo sapiens
catatgctccaggatctttga

SEQ ID NO: 1419536 - DNA, 23 bp, Homo sapiens
catatgctgtatatcctttctaa

SEQ ID NO: 1419537 - DNA, 15 bp, Homo sapiens
catatggaggcctga

SEQ ID NO: 1419538 - DNA, 21 bp, Homo sapiens
catatgggatattcccaagcc

SEQ ID NO: 1419539 - DNA, 15 bp, Homo sapiens
catatgtacttgttt

SEQ ID NO: 1419540 - DNA, 19 bp, Homo sapiens
catatgtacttgtttgcta

SEQ ID NO: 1419541 - DNA, 16 bp, Homo sapiens
catatgtatacatgtg

SEQ ID NO: 1419542 - DNA, 23 bp, Homo sapiens
catatgtcagtgtaaatccttgt

SEQ ID NO: 1419543 - DNA, 22 bp, Homo sapiens
catatgtttcgctgatatatgt

SEQ ID NO: 1419544 - DNA, 16 bp, Homo sapiens
catattaagacagtgt

SEQ ID NO: 1419545 - DNA, 20 bp, Homo sapiens
catattaagacagtgtacaa

SEQ ID NO: 1419546 - DNA, 21 bp, Homo sapiens
catattaagacagtgtacaaa

SEQ ID NO: 1419547 - DNA, 20 bp, Homo sapiens
catattaagcactttaagct

SEQ ID NO: 1419548 - DNA, 16 bp, Homo sapiens
catattactgttgcat

SEQ ID NO: 1419549 - DNA, 23 bp, Homo sapiens
catattactgttgcatttacttt

SEQ ID NO: 1419550 - DNA, 20 bp, Homo sapiens
catattcatgaaatgtggaa

SEQ ID NO: 1419551 - DNA, 15 bp, Homo sapiens
catattctaaaacca

SEQ ID NO: 1419552 - DNA, 21 bp, Homo sapiens
catattctagtgtaacactgc

SEQ ID NO: 1419553 - DNA, 16 bp, Homo sapiens
catattgtaaaacagg

SEQ ID NO: 1419554 - DNA, 16 bp, Homo sapiens
catattgtatgtaagt

SEQ ID NO: 1419555 - DNA, 18 bp, Homo sapiens
catattgtatgtaagtaa

SEQ ID NO: 1419556 - DNA, 20 bp, Homo sapiens
catattgtgattctgccttt

SEQ ID NO: 1419557 - DNA, 23 bp, Homo sapiens
catattgtgcttcacagtagagc

SEQ ID NO: 1419558 - DNA, 19 bp, Homo sapiens
catattgttagggtcagcc

SEQ ID NO: 1419559 - DNA, 21 bp, Homo sapiens
catattgttagggtcagccat

SEQ ID NO: 1419560 - DNA, 16 bp, Homo sapiens
catattgttgaaaggt

SEQ ID NO: 1419561 - DNA, 17 bp, Homo sapiens
catatttaaagatcttt

SEQ ID NO: 1419562 - DNA, 22 bp, Homo sapiens
catatttatagcaatccatgtt

SEQ ID NO: 1419563 - DNA, 21 bp, Homo sapiens
catatttccccttggacactt

SEQ ID NO: 1419564 - DNA, 15 bp, Homo sapiens
catatttctgtggag

SEQ ID NO: 1419565 - DNA, 14 bp, Homo sapiens
catatttgatttct

SEQ ID NO: 1419566 - DNA, 15 bp, Homo sapiens
catatttgatttcta

SEQ ID NO: 1419567 - DNA, 16 bp, Homo sapiens
catatttgatttctaa

SEQ ID NO: 1419568 - DNA, 21 bp, Homo sapiens
catatttgatttctaattgta

SEQ ID NO: 1419569 - DNA, 23 bp, Homo sapiens
catatttgatttctaattgtaag

SEQ ID NO: 1419570 - DNA, 16 bp, Homo sapiens
catatttgccaataaa

SEQ ID NO: 1419571 - DNA, 17 bp, Homo sapiens
catatttgccaataaag

SEQ ID NO: 1419572 - DNA, 19 bp, Homo sapiens
catattttaaaatttgttc

SEQ ID NO: 1419573 - DNA, 19 bp, Homo sapiens
catattttccccctgtttt

SEQ ID NO: 1419574 - DNA, 12 bp, Homo sapiens
catattttctgt

SEQ ID NO: 1419575 - DNA, 13 bp, Homo sapiens
catattttgctgg

SEQ ID NO: 1419576 - DNA, 15 bp, Homo sapiens
catatttttatactt

SEQ ID NO: 1419577 - DNA, 18 bp, Homo sapiens
catatttttcacatatct

SEQ ID NO: 1419578 - DNA, 21 bp, Homo sapiens
catcaaaaacatcactccctc

SEQ ID NO: 1419579 - DNA, 18 bp, Homo sapiens
catcaaaaactttggagt

SEQ ID NO: 1419580 - DNA, 15 bp, Homo sapiens
catcaaagcctggcc

SEQ ID NO: 1419581 - DNA, 14 bp, Homo sapiens
catcaaagcttctt

SEQ ID NO: 1419582 - DNA, 20 bp, Homo sapiens
catcaaagtggtaaatactg

SEQ ID NO: 1419583 - DNA, 15 bp, Homo sapiens
catcaaccaggaaga

SEQ ID NO: 1419584 - DNA, 16 bp, Homo sapiens
catcaactaaagttgt

SEQ ID NO: 1419585 - DNA, 22 bp, Homo sapiens
catcaactaaagttgtacttta

SEQ ID NO: 1419586 - DNA, 13 bp, Homo sapiens
catcagctgctga

SEQ ID NO: 1419587 - DNA, 18 bp, Homo sapiens
catcagctgctgaaacaa

SEQ ID NO: 1419588 - DNA, 18 bp, Homo sapiens
catcaggaagcctgtggt

SEQ ID NO: 1419589 - DNA, 13 bp, Homo sapiens
catcaggcactgg

SEQ ID NO: 1419590 - DNA, 16 bp, Homo sapiens
catcaggcactggtgg

SEQ ID NO: 1419591 - DNA, 15 bp, Homo sapiens
catcagtacttgttt

SEQ ID NO: 1419592 - DNA, 17 bp, Homo sapiens
catcagtccctatgtat

SEQ ID NO: 1419593 - DNA, 15 bp, Homo sapiens
catcagtgaggaggg

SEQ ID NO: 1419594 - DNA, 23 bp, Homo sapiens
catcagtgaggagggatgtgggt

SEQ ID NO: 1419595 - DNA, 17 bp, Homo sapiens
catcagtgttaaaaaat

SEQ ID NO: 1419596 - DNA, 22 bp, Homo sapiens
catcagttactctgaagggcat

SEQ ID NO: 1419597 - DNA, 13 bp, Homo sapiens
catcataaaataa

SEQ ID NO: 1419598 - DNA, 14 bp, Homo sapiens
catcataaaataaa

SEQ ID NO: 1419599 - DNA, 22 bp, Homo sapiens
catcataaaataaagtatatat

SEQ ID NO: 1419600 - DNA, 16 bp, Homo sapiens
catcatattgtatgta

SEQ ID NO: 1419601 - DNA, 13 bp, Homo sapiens
catcatcactgta

SEQ ID NO: 1419602 - DNA, 14 bp, Homo sapiens
catcatcactgtaa

SEQ ID NO: 1419603 - DNA, 14 bp, Homo sapiens
catcatctcagctc

SEQ ID NO: 1419604 - DNA, 15 bp, Homo sapiens
catcatgaactggct

SEQ ID NO: 1419605 - DNA, 21 bp, Homo sapiens
catcatgaactggcttgtaca

SEQ ID NO: 1419606 - DNA, 22 bp, Homo sapiens
catcatgaactggcttgtacat

SEQ ID NO: 1419607 - DNA, 13 bp, Homo sapiens
catcatgcctgac

SEQ ID NO: 1419608 - DNA, 21 bp, Homo sapiens
catcatgcttacaaaaaagaa

SEQ ID NO: 1419609 - DNA, 17 bp, Homo sapiens
catcatggctgcttgat

SEQ ID NO: 1419610 - DNA, 22 bp, Homo sapiens
catcatgtcctatagtttgtca

SEQ ID NO: 1419611 - DNA, 16 bp, Homo sapiens
catcatgtctgtatac

SEQ ID NO: 1419612 - DNA, 15 bp, Homo sapiens
catcattaataagtg

SEQ ID NO: 1419613 - DNA, 17 bp, Homo sapiens
catcattaataagtgaa

SEQ ID NO: 1419614 - DNA, 21 bp, Homo sapiens
catcattaatgactttatgta

SEQ ID NO: 1419615 - DNA, 17 bp, Homo sapiens
catcattactggtaaag

SEQ ID NO: 1419616 - DNA, 11 bp, Homo sapiens
catcattccaa

SEQ ID NO: 1419617 - DNA, 16 bp, Homo sapiens
catcattccttctggc

SEQ ID NO: 1419618 - DNA, 17 bp, Homo sapiens
catcattccttctggcc

SEQ ID NO: 1419619 - DNA, 18 bp, Homo sapiens
catcattgcacctgcagg

SEQ ID NO: 1419620 - DNA, 13 bp, Homo sapiens
catcattgtttct

SEQ ID NO: 1419621 - DNA, 16 bp, Homo sapiens
catccaaccttcccaa

SEQ ID NO: 1419622 - DNA, 18 bp, Homo sapiens
catccaactccagcaact

SEQ ID NO: 1419623 - DNA, 13 bp, Homo sapiens
catccaagccaga

SEQ ID NO: 1419624 - DNA, 22 bp, Homo sapiens
catccaagtctttcttcttttt

SEQ ID NO: 1419625 - DNA, 17 bp, Homo sapiens
catccaatcctcactgg

SEQ ID NO: 1419626 - DNA, 21 bp, Homo sapiens
catccaatcctcactgggtgg

SEQ ID NO: 1419627 - DNA, 15 bp, Homo sapiens
catccaatgtgaagt

SEQ ID NO: 1419628 - DNA, 22 bp, Homo sapiens
catccaatgtgaagttcatctt

SEQ ID NO: 1419629 - DNA, 20 bp, Homo sapiens
catccacaactaatgaggga

SEQ ID NO: 1419630 - DNA, 18 bp, Homo sapiens
catccacaataaccaaga

SEQ ID NO: 1419631 - DNA, 19 bp, Homo sapiens
catccacacaacaccagga

SEQ ID NO: 1419632 - DNA, 21 bp, Homo sapiens
catccacacaacaccaggact

SEQ ID NO: 1419633 - DNA, 17 bp, Homo sapiens
catccacattgttttaa

SEQ ID NO: 1419634 - DNA, 17 bp, Homo sapiens
catccacccagtgctgc

SEQ ID NO: 1419635 - DNA, 14 bp, Homo sapiens
catccaccccatcc

SEQ ID NO: 1419636 - DNA, 19 bp, Homo sapiens
catccacccgggggagccc

SEQ ID NO: 1419637 - DNA, 21 bp, Homo sapiens
catccacctcatcactggact

SEQ ID NO: 1419638 - DNA, 22 bp, Homo sapiens
catccacctgtcttggcctccc

SEQ ID NO: 1419639 - DNA, 15 bp, Homo sapiens
catccaccttccctt

SEQ ID NO: 1419640 - DNA, 14 bp, Homo sapiens
catccactctaccc

SEQ ID NO: 1419641 - DNA, 17 bp, Homo sapiens
catccactctaccctcc

SEQ ID NO: 1419642 - DNA, 18 bp, Homo sapiens
catccactctaccctccc

SEQ ID NO: 1419643 - DNA, 12 bp, Homo sapiens
catccactgtga

SEQ ID NO: 1419644 - DNA, 16 bp, Homo sapiens
catccagaaataaaga

SEQ ID NO: 1419645 - DNA, 23 bp, Homo sapiens
catccagcagatttccagccttc

SEQ ID NO: 1419646 - DNA, 16 bp, Homo sapiens
catccagcctccaggg

SEQ ID NO: 1419647 - DNA, 13 bp, Homo sapiens
catccagcctgtg

SEQ ID NO: 1419648 - DNA, 15 bp, Homo sapiens
catccagcctgtgtg

SEQ ID NO: 1419649 - DNA, 22 bp, Homo sapiens
catccaggccagggctcctgtg

SEQ ID NO: 1419650 - DNA, 20 bp, Homo sapiens
catccaggctggccagtgct

SEQ ID NO: 1419651 - DNA, 14 bp, Homo sapiens
catccagtctattc

SEQ ID NO: 1419652 - DNA, 14 bp, Homo sapiens
catccatccttcca

SEQ ID NO: 1419653 - DNA, 18 bp, Homo sapiens
catccattacctccatcc

SEQ ID NO: 1419654 - DNA, 13 bp, Homo sapiens
catccattaggcc

SEQ ID NO: 1419655 - DNA, 15 bp, Homo sapiens
cagttttctgagaaa

SEQ ID NO: 1419656 - DNA, 18 bp, Homo sapiens
cagttttgtaaatgtact

SEQ ID NO: 1419657 - DNA, 19 bp, Homo sapiens
cagttttgtaaatgtactg

SEQ ID NO: 1419658 - DNA, 24 bp, Homo sapiens
cagttttgtaaatgtactggtaat

SEQ ID NO: 1419659 - DNA, 15 bp, Homo sapiens
cagtttttaaaaacc

SEQ ID NO: 1419660 - DNA, 22 bp, Homo sapiens
cagtttttcagagtggaatgct

SEQ ID NO: 1419661 - DNA, 20 bp, Homo sapiens
cagtttttgtttttgcatga

SEQ ID NO: 1419662 - DNA, 23 bp, Homo sapiens
cagtttttgtttttgcatgaaat

SEQ ID NO: 1419663 - DNA, 16 bp, Homo sapiens
cagttttttatgctaa

SEQ ID NO: 1419664 - DNA, 18 bp, Homo sapiens
cataaaaactgatttgct

SEQ ID NO: 1419665 - DNA, 12 bp, Homo sapiens
cataaaaagcag

SEQ ID NO: 1419666 - DNA, 21 bp, Homo sapiens
cataaaaagcagaattttaat

SEQ ID NO: 1419667 - DNA, 16 bp, Homo sapiens
cataaaagaagtttca

SEQ ID NO: 1419668 - DNA, 16 bp, Homo sapiens
cataaaagccccagct

SEQ ID NO: 1419669 - DNA, 21 bp, Homo sapiens
cataaaatccaatattgtaat

SEQ ID NO: 1419670 - DNA, 17 bp, Homo sapiens
cataaacacttttcaag

SEQ ID NO: 1419671 - DNA, 19 bp, Homo sapiens
cataaacagcacacctgtg

SEQ ID NO: 1419672 - DNA, 17 bp, Homo sapiens
cataaactaagagaaac

SEQ ID NO: 1419673 - DNA, 12 bp, Homo sapiens
cataaagaaaag

SEQ ID NO: 1419674 - DNA, 21 bp, Homo sapiens
cataaagacaatcactgccaa

SEQ ID NO: 1419675 - DNA, 17 bp, Homo sapiens
cataaagctcaaatgaa

SEQ ID NO: 1419676 - DNA, 13 bp, Homo sapiens
cataaagggattt

SEQ ID NO: 1419677 - DNA, 19 bp, Homo sapiens
cataaagggtgtaggggcc

SEQ ID NO: 1419678 - DNA, 18 bp, Homo sapiens
cataaagtacaaatgaag

SEQ ID NO: 1419679 - DNA, 15 bp, Homo sapiens
cataaagtcagtgcc

SEQ ID NO: 1419680 - DNA, 20 bp, Homo sapiens
cataaatacaaaaatgaata

SEQ ID NO: 1419681 - DNA, 22 bp, Homo sapiens
cataaatactgtcaaacaataa

SEQ ID NO: 1419682 - DNA, 15 bp, Homo sapiens
cataaatctgtctga

SEQ ID NO: 1419683 - DNA, 18 bp, Homo sapiens
cataaatctgtctgattc

SEQ ID NO: 1419684 - DNA, 20 bp, Homo sapiens
cataaatctgtctgattcta

SEQ ID NO: 1419685 - DNA, 16 bp, Homo sapiens
cataaatggattaatt

SEQ ID NO: 1419686 - DNA, 13 bp, Homo sapiens
cataaatgtgttc

SEQ ID NO: 1419687 - DNA, 14 bp, Homo sapiens
cataaattactgtt

SEQ ID NO: 1419688 - DNA, 16 bp, Homo sapiens
cataaattcaactttg

SEQ ID NO: 1419689 - DNA, 19 bp, Homo sapiens
cataaattcaactttgtaa

SEQ ID NO: 1419690 - DNA, 20 bp, Homo sapiens
cataaattcaactttgtaaa

SEQ ID NO: 1419691 - DNA, 19 bp, Homo sapiens
cataaattggcctctgtat

SEQ ID NO: 1419692 - DNA, 12 bp, Homo sapiens
cataaatttttt

SEQ ID NO: 1419693 - DNA, 22 bp, Homo sapiens
cataaattttttgaagtcttta

SEQ ID NO: 1419694 - DNA, 20 bp, Homo sapiens
cataacaccgtcccagggct

SEQ ID NO: 1419695 - DNA, 21 bp, Homo sapiens
cataacaccgtcccagggctc

SEQ ID NO: 1419696 - DNA, 20 bp, Homo sapiens
cataacagattttttttgga

SEQ ID NO: 1419697 - DNA, 14 bp, Homo sapiens
cataacatccagag

SEQ ID NO: 1419698 - DNA, 12 bp, Homo sapiens
cataaccaaaga

SEQ ID NO: 1419699 - DNA, 14 bp, Homo sapiens
cataactgcttctt

SEQ ID NO: 1419700 - DNA, 23 bp, Homo sapiens
cataactggttttgtttttttgc

SEQ ID NO: 1419701 - DNA, 21 bp, Homo sapiens
cataacttgctgaatttcagg

SEQ ID NO: 1419702 - DNA, 20 bp, Homo sapiens
cataagacaaacactgccat

SEQ ID NO: 1419703 - DNA, 19 bp, Homo sapiens
cataagagaaagaggccag

SEQ ID NO: 1419704 - DNA, 22 bp, Homo sapiens
cataagagaaagaggccagaca

SEQ ID NO: 1419705 - DNA, 20 bp, Homo sapiens
cataagattaaaggaaggaa

SEQ ID NO: 1419706 - DNA, 22 bp, Homo sapiens
cataagattaaaggaaggaaaa

SEQ ID NO: 1419707 - DNA, 23 bp, Homo sapiens
cataagcctccatttagttcttt

SEQ ID NO: 1419708 - DNA, 19 bp, Homo sapiens
cataagcggcgtaagttta

SEQ ID NO: 1419709 - DNA, 21 bp, Homo sapiens
cataagctgaactaaaataaa

SEQ ID NO: 1419710 - DNA, 13 bp, Homo sapiens
cataagcttccat

SEQ ID NO: 1419711 - DNA, 17 bp, Homo sapiens
cataagcttccatttta

SEQ ID NO: 1419712 - DNA, 15 bp, Homo sapiens
cataaggatgacttt

SEQ ID NO: 1419713 - DNA, 22 bp, Homo sapiens
cataaggccagaaactcctttt

SEQ ID NO: 1419714 - DNA, 20 bp, Homo sapiens
cataaggtgctatctgttca

SEQ ID NO: 1419715 - DNA, 21 bp, Homo sapiens
cataaggtttcgtttctgtat

SEQ ID NO: 1419716 - DNA, 19 bp, Homo sapiens
cataagtattatgtctctt

SEQ ID NO: 1419717 - DNA, 14 bp, Homo sapiens
cataagtgacacca

SEQ ID NO: 1419718 - DNA, 17 bp, Homo sapiens
cataagtgacaccaata

SEQ ID NO: 1419719 - DNA, 19 bp, Homo sapiens
cataagtgacaccaataaa

SEQ ID NO: 1419720 - DNA, 19 bp, Homo sapiens
cataagttatgcctctgac

SEQ ID NO: 1419721 - DNA, 12 bp, Homo sapiens
cataagtttctg

SEQ ID NO: 1419722 - DNA, 23 bp, Homo sapiens
cataataaaaaattatgacaatg

SEQ ID NO: 1419723 - DNA, 14 bp, Homo sapiens
cataataaaagtga

SEQ ID NO: 1419724 - DNA, 16 bp, Homo sapiens
cataatatatgacttc

SEQ ID NO: 1419725 - DNA, 14 bp, Homo sapiens
cataatcaaagcta

SEQ ID NO: 1419726 - DNA, 23 bp, Homo sapiens
cataatcagtaaatagtgtcata

SEQ ID NO: 1419727 - DNA, 13 bp, Homo sapiens
cataatcttctgc

SEQ ID NO: 1419728 - DNA, 18 bp, Homo sapiens
cataatgctaatttaaag

SEQ ID NO: 1419729 - DNA, 20 bp, Homo sapiens
cataatgctcccatctcctg

SEQ ID NO: 1419730 - DNA, 20 bp, Homo sapiens
cataatgtccctctcttggc

SEQ ID NO: 1419731 - DNA, 17 bp, Homo sapiens
cataatgttacattatt

SEQ ID NO: 1419732 - DNA, 18 bp, Homo sapiens
cataatgtttctggattt

SEQ ID NO: 1419733 - DNA, 13 bp, Homo sapiens
cataattacattc

SEQ ID NO: 1419734 - DNA, 17 bp, Homo sapiens
cataattacattcctaa

SEQ ID NO: 1419735 - DNA, 21 bp, Homo sapiens
cataattacattcctaactag

SEQ ID NO: 1419736 - DNA, 21 bp, Homo sapiens
cataattctaagttatttact

SEQ ID NO: 1419737 - DNA, 21 bp, Homo sapiens
cataattctgttactttgcta

SEQ ID NO: 1419738 - DNA, 14 bp, Homo sapiens
cataattgctttgc

SEQ ID NO: 1419739 - DNA, 12 bp, Homo sapiens
cataattggaat

SEQ ID NO: 1419740 - DNA, 13 bp, Homo sapiens
cataattgtggat

SEQ ID NO: 1419741 - DNA, 21 bp, Homo sapiens
cataatttgtacatatgtaaa

SEQ ID NO: 1419742 - DNA, 14 bp, Homo sapiens
cataattttcttca

SEQ ID NO: 1419743 - DNA, 13 bp, Homo sapiens
cataattttgcaa

SEQ ID NO: 1419744 - DNA, 17 bp, Homo sapiens
catacaaactctcacca

SEQ ID NO: 1419745 - DNA, 22 bp, Homo sapiens
catacaacagaaaccagaaaag

SEQ ID NO: 1419746 - DNA, 18 bp, Homo sapiens
catacaatgtatgtacaa

SEQ ID NO: 1419747 - DNA, 19 bp, Homo sapiens
catacaatgtatgtacaat

SEQ ID NO: 1419748 - DNA, 15 bp, Homo sapiens
catacaattccaaac

SEQ ID NO: 1419749 - DNA, 22 bp, Homo sapiens
catacacccccacctcctgcaa

SEQ ID NO: 1419750 - DNA, 22 bp, Homo sapiens
catacactgtagtttttgaaaa

SEQ ID NO: 1419751 - DNA, 21 bp, Homo sapiens
catacagaggatgccttttct

SEQ ID NO: 1419752 - DNA, 23 bp, Homo sapiens
catagtcttgaaatgaaagggaa

SEQ ID NO: 1419753 - DNA, 15 bp, Homo sapiens
catagtggtgcagag

SEQ ID NO: 1419754 - DNA, 15 bp, Homo sapiens
catagttactgtaaa

SEQ ID NO: 1419755 - DNA, 17 bp, Homo sapiens
catagttactgtaaaat

SEQ ID NO: 1419756 - DNA, 16 bp, Homo sapiens
catagttctttttagt

SEQ ID NO: 1419757 - DNA, 16 bp, Homo sapiens
catagtttaagttgat

SEQ ID NO: 1419758 - DNA, 22 bp, Homo sapiens
catagtttcaaatctgtaatca

SEQ ID NO: 1419759 - DNA, 14 bp, Homo sapiens
catataaccaaaat

SEQ ID NO: 1419760 - DNA, 23 bp, Homo sapiens
catataagattcatatttacttc

SEQ ID NO: 1419761 - DNA, 17 bp, Homo sapiens
catataagcccttgatt

SEQ ID NO: 1419762 - DNA, 24 bp, Homo sapiens
catataagtttgaaggaaacagtt

SEQ ID NO: 1419763 - DNA, 15 bp, Homo sapiens
catataatgttgtta

SEQ ID NO: 1419764 - DNA, 18 bp, Homo sapiens
catatacaacaccaaaaa

SEQ ID NO: 1419765 - DNA, 21 bp, Homo sapiens
catatacatattgtatatata

SEQ ID NO: 1419766 - DNA, 19 bp, Homo sapiens
catataggtgatgtttgct

SEQ ID NO: 1419767 - DNA, 16 bp, Homo sapiens
catatatacaggcata

SEQ ID NO: 1419768 - DNA, 19 bp, Homo sapiens
catatataggcagttgcat

SEQ ID NO: 1419769 - DNA, 13 bp, Homo sapiens
catatatatatgt

SEQ ID NO: 1419770 - DNA, 12 bp, Homo sapiens
catatatcaaga

SEQ ID NO: 1419771 - DNA, 21 bp, Homo sapiens
catatatgtataatatatatc

SEQ ID NO: 1419772 - DNA, 19 bp, Homo sapiens
catatattaattagcaggt

SEQ ID NO: 1419773 - DNA, 12 bp, Homo sapiens
catatatttatt

SEQ ID NO: 1419774 - DNA, 13 bp, Homo sapiens
catatcagttgag

SEQ ID NO: 1419775 - DNA, 13 bp, Homo sapiens
cagtgccacccat

SEQ ID NO: 1419776 - DNA, 14 bp, Homo sapiens
cagtgccactgccc

SEQ ID NO: 1419777 - DNA, 19 bp, Homo sapiens
cagtgccactgccccccga

SEQ ID NO: 1419778 - DNA, 20 bp, Homo sapiens
cagtgccatgtaaatcccca

SEQ ID NO: 1419779 - DNA, 17 bp, Homo sapiens
cagtgcccaagagtggg

SEQ ID NO: 1419780 - DNA, 16 bp, Homo sapiens
cagtgcccaccaacat

SEQ ID NO: 1419781 - DNA, 15 bp, Homo sapiens
cagtgcccatgtgta

SEQ ID NO: 1419782 - DNA, 23 bp, Homo sapiens
cagtgcccccactgaccagaact

SEQ ID NO: 1419783 - DNA, 17 bp, Homo sapiens
cagtgccctcattttat

SEQ ID NO: 1419784 - DNA, 13 bp, Homo sapiens
cagtgccctgaga

SEQ ID NO: 1419785 - DNA, 13 bp, Homo sapiens
cagtgccctttga

SEQ ID NO: 1419786 - DNA, 22 bp, Homo sapiens
cagtgcctcttccagtgaacat

SEQ ID NO: 1419787 - DNA, 23 bp, Homo sapiens
cagtgcctgccactctctgggac

SEQ ID NO: 1419788 - DNA, 11 bp, Homo sapiens
cagtgcctgct

SEQ ID NO: 1419789 - DNA, 17 bp, Homo sapiens
cagtgccttacctcctg

SEQ ID NO: 1419790 - DNA, 15 bp, Homo sapiens
cagtgccttcaataa

SEQ ID NO: 1419791 - DNA, 14 bp, Homo sapiens
cagtgccttccata

SEQ ID NO: 1419792 - DNA, 22 bp, Homo sapiens
cagtgccttcctgtttttcaca

SEQ ID NO: 1419793 - DNA, 12 bp, Homo sapiens
cagtgccttctc

SEQ ID NO: 1419794 - DNA, 21 bp, Homo sapiens
cagtgccttctctcagctccc

SEQ ID NO: 1419795 - DNA, 23 bp, Homo sapiens
cagtgccttctctcagctcccag

SEQ ID NO: 1419796 - DNA, 24 bp, Homo sapiens
cagtgccttctctcagctcccagg

SEQ ID NO: 1419797 - DNA, 22 bp, Homo sapiens
cagtgccttggggaatttcctc

SEQ ID NO: 1419798 - DNA, 18 bp, Homo sapiens
cagtgcgattctggataa

SEQ ID NO: 1419799 - DNA, 23 bp, Homo sapiens
cagtgctataaatgccagagcca

SEQ ID NO: 1419800 - DNA, 13 bp, Homo sapiens
cagtgctcaaggt

SEQ ID NO: 1419801 - DNA, 15 bp, Homo sapiens
cagtgctcagctgtg

SEQ ID NO: 1419802 - DNA, 19 bp, Homo sapiens
cagtgctcagctgtggctg

SEQ ID NO: 1419803 - DNA, 14 bp, Homo sapiens
cagtgctcttttct

SEQ ID NO: 1419804 - DNA, 12 bp, Homo sapiens
cagtgctgccat

SEQ ID NO: 1419805 - DNA, 15 bp, Homo sapiens
cagtgctgccatgcc

SEQ ID NO: 1419806 - DNA, 20 bp, Homo sapiens
cagtgctgccatgccactgc

SEQ ID NO: 1419807 - DNA, 23 bp, Homo sapiens
cagtgctgccatgccactgccag

SEQ ID NO: 1419808 - DNA, 19 bp, Homo sapiens
cagtgctgcttctcttggg

SEQ ID NO: 1419809 - DNA, 13 bp, Homo sapiens
cagtgctggattt

SEQ ID NO: 1419810 - DNA, 19 bp, Homo sapiens
cagtgctggatttgatgag

SEQ ID NO: 1419811 - DNA, 19 bp, Homo sapiens
cagtgctgggaccagagcc

SEQ ID NO: 1419812 - DNA, 20 bp, Homo sapiens
cagtgctgggaccagagcca

SEQ ID NO: 1419813 - DNA, 21 bp, Homo sapiens
cagtgctgggaccagagccag

SEQ ID NO: 1419814 - DNA, 13 bp, Homo sapiens
cagtgctgtggcc

SEQ ID NO: 1419815 - DNA, 19 bp, Homo sapiens
cagtgctgtggcctgggca

SEQ ID NO: 1419816 - DNA, 17 bp, Homo sapiens
cagtgcttctctacaga

SEQ ID NO: 1419817 - DNA, 19 bp, Homo sapiens
cagtggaacagcgggagac

SEQ ID NO: 1419818 - DNA, 23 bp, Homo sapiens
cagtggaatataaggaaagcaat

SEQ ID NO: 1419819 - DNA, 21 bp, Homo sapiens
cagtggaccgaaatctgtatt

SEQ ID NO: 1419820 - DNA, 13 bp, Homo sapiens
cagtggagcctgg

SEQ ID NO: 1419821 - DNA, 20 bp, Homo sapiens
cagtggaggaagagggacag

SEQ ID NO: 1419822 - DNA, 21 bp, Homo sapiens
cagtggatatgacccacactg

SEQ ID NO: 1419823 - DNA, 21 bp, Homo sapiens
cagtggatcacacacatggaa

SEQ ID NO: 1419824 - DNA, 17 bp, Homo sapiens
cagtggcacaaaaaaat

SEQ ID NO: 1419825 - DNA, 14 bp, Homo sapiens
cagtggcaggggag

SEQ ID NO: 1419826 - DNA, 21 bp, Homo sapiens
cagtggcatcatctcagctca

SEQ ID NO: 1419827 - DNA, 15 bp, Homo sapiens
cagtggcctggccgt

SEQ ID NO: 1419828 - DNA, 11 bp, Homo sapiens
cagtggcctta

SEQ ID NO: 1419829 - DNA, 20 bp, Homo sapiens
cagtggcgcattctaggctc

SEQ ID NO: 1419830 - DNA, 18 bp, Homo sapiens
cagtggcgcgatctcagc

SEQ ID NO: 1419831 - DNA, 22 bp, Homo sapiens
cagtggcggcacgtccttgggc

SEQ ID NO: 1419832 - DNA, 15 bp, Homo sapiens
cagtggcgtgatctt

SEQ ID NO: 1419833 - DNA, 19 bp, Homo sapiens
cagtggcgtgatcttggct

SEQ ID NO: 1419834 - DNA, 17 bp, Homo sapiens
cagtggctcacgcctgt

SEQ ID NO: 1419835 - DNA, 19 bp, Homo sapiens
cagtggctggtccagggct

SEQ ID NO: 1419836 - DNA, 20 bp, Homo sapiens
cagtggctggtccagggcta

SEQ ID NO: 1419837 - DNA, 11 bp, Homo sapiens
cagtggcttcc

SEQ ID NO: 1419838 - DNA, 15 bp, Homo sapiens
cagtggcttcccagc

SEQ ID NO: 1419839 - DNA, 19 bp, Homo sapiens
cagtggcttcccagctctg

SEQ ID NO: 1419840 - DNA, 20 bp, Homo sapiens
cagtgggaacgtgactgccc

SEQ ID NO: 1419841 - DNA, 22 bp, Homo sapiens
cagtgggaactctgacaagggc

SEQ ID NO: 1419842 - DNA, 16 bp, Homo sapiens
cagtgggacagggcat

SEQ ID NO: 1419843 - DNA, 14 bp, Homo sapiens
cagtgggagaaaac

SEQ ID NO: 1419844 - DNA, 12 bp, Homo sapiens
cagtgggagggg

SEQ ID NO: 1419845 - DNA, 15 bp, Homo sapiens
cagtgggaggggcag

SEQ ID NO: 1419846 - DNA, 21 bp, Homo sapiens
cagtgggatgaaccagccggg

SEQ ID NO: 1419847 - DNA, 13 bp, Homo sapiens
cagtgggcaggtg

SEQ ID NO: 1419848 - DNA, 20 bp, Homo sapiens
cagtgggcatagtcagtgtc

SEQ ID NO: 1419849 - DNA, 15 bp, Homo sapiens
cagtgggcctgtgtg

SEQ ID NO: 1419850 - DNA, 22 bp, Homo sapiens
cagtgggcgttgggagcctagc

SEQ ID NO: 1419851 - DNA, 14 bp, Homo sapiens
cagtggggccagca

SEQ ID NO: 1419852 - DNA, 15 bp, Homo sapiens
cagtggggctggcat

SEQ ID NO: 1419853 - DNA, 16 bp, Homo sapiens
cagtggggctggcatc

SEQ ID NO: 1419854 - DNA, 17 bp, Homo sapiens
cagtggggctggcatca

SEQ ID NO: 1419855 - DNA, 13 bp, Homo sapiens
cagtgggtgcccc

SEQ ID NO: 1419856 - DNA, 17 bp, Homo sapiens
cagtgggtggcacctcc

SEQ ID NO: 1419857 - DNA, 20 bp, Homo sapiens
cagtgggtggcacctcctga

SEQ ID NO: 1419858 - DNA, 20 bp, Homo sapiens
cagtggtcccatttatatct

SEQ ID NO: 1419859 - DNA, 18 bp, Homo sapiens
cagtggtttgagacactg

SEQ ID NO: 1419860 - DNA, 15 bp, Homo sapiens
cagtggttttatact

SEQ ID NO: 1419861 - DNA, 20 bp, Homo sapiens
cagtggttttatactgaagg

SEQ ID NO: 1419862 - DNA, 17 bp, Homo sapiens
cagtgtacacgtctgga

SEQ ID NO: 1419863 - DNA, 21 bp, Homo sapiens
cagtgtacacgtctggacccc

SEQ ID NO: 1419864 - DNA, 20 bp, Homo sapiens
cagtgtacatggaataacat

SEQ ID NO: 1419865 - DNA, 23 bp, Homo sapiens
cagtgtacatggaataacatgta

SEQ ID NO: 1419866 - DNA, 15 bp, Homo sapiens
cagtgtatggggcag

SEQ ID NO: 1419867 - DNA, 19 bp, Homo sapiens
cagtgtatggggcagcttc

SEQ ID NO: 1419868 - DNA, 18 bp, Homo sapiens
cagtgtatggggctgcag

SEQ ID NO: 1419869 - DNA, 14 bp, Homo sapiens
cagtgtcactggtc

SEQ ID NO: 1419870 - DNA, 19 bp, Homo sapiens
cagtgtccagcttccaaag

SEQ ID NO: 1419871 - DNA, 22 bp, Homo sapiens
cagtgtccagcttccaaagcct

SEQ ID NO: 1419872 - DNA, 23 bp, Homo sapiens
cagtgtccagcttccaaagccta

SEQ ID NO: 1419873 - DNA, 20 bp, Homo sapiens
cagtgtccatggactcagaa

SEQ ID NO: 1419874 - DNA, 22 bp, Homo sapiens
cagtgtccatggactcagaaac

SEQ ID NO: 1419875 - DNA, 13 bp, Homo sapiens
cagtgtcccctgc

SEQ ID NO: 1419876 - DNA, 14 bp, Homo sapiens
cagtgtcccctgcc

SEQ ID NO: 1419877 - DNA, 19 bp, Homo sapiens
cagtgtcccctgccccaga

SEQ ID NO: 1419878 - DNA, 18 bp, Homo sapiens
cagtgtcctcccctcaag

SEQ ID NO: 1419879 - DNA, 19 bp, Homo sapiens
cagtgtcctcccctcaagg

SEQ ID NO: 1419880 - DNA, 20 bp, Homo sapiens
cagtgtcctcccctcaagga

SEQ ID NO: 1419881 - DNA, 13 bp, Homo sapiens
cagtgtcttccat

SEQ ID NO: 1419882 - DNA, 17 bp, Homo sapiens
cagtgtcttccataatg

SEQ ID NO: 1419883 - DNA, 19 bp, Homo sapiens
cagtgtcttgagctctaaa

SEQ ID NO: 1419884 - DNA, 17 bp, Homo sapiens
cagtgtgagggaaagag

SEQ ID NO: 1419885 - DNA, 14 bp, Homo sapiens
cagtgtgagtcaga

SEQ ID NO: 1419886 - DNA, 16 bp, Homo sapiens
cagtgtgcacccctcc

SEQ ID NO: 1419887 - DNA, 18 bp, Homo sapiens
cagtgtgcacgagtggga

SEQ ID NO: 1419888 - DNA, 22 bp, Homo sapiens
cagtgtgcctggttaatattaa

SEQ ID NO: 1419889 - DNA, 13 bp, Homo sapiens
cagtgtggagagg

SEQ ID NO: 1419890 - DNA, 13 bp, Homo sapiens
cagtgtggagttc

SEQ ID NO: 1419891 - DNA, 16 bp, Homo sapiens
cagtgcatgtgaagca

SEQ ID NO: 1419892 - DNA, 18 bp, Homo sapiens
cagtgcatgtgaagcatg

SEQ ID NO: 1419893 - DNA, 19 bp, Homo sapiens
cagtgcatttcaaggaaca

SEQ ID NO: 1419894 - DNA, 23 bp, Homo sapiens
cagtgcattttgtttctgtatat

SEQ ID NO: 1419895 - DNA, 23 bp, Homo sapiens
cagatccagggacagaggcccca

SEQ ID NO: 1419896 - DNA, 16 bp, Homo sapiens
cagatccttgtttcaa

SEQ ID NO: 1419897 - DNA, 16 bp, Homo sapiens
cagatcggccacaggg

SEQ ID NO: 1419898 - DNA, 17 bp, Homo sapiens
cagatcggccacagggc

SEQ ID NO: 1419899 - DNA, 15 bp, Homo sapiens
cagatctcatgtcct

SEQ ID NO: 1419900 - DNA, 13 bp, Homo sapiens
cagatctgaggtt

SEQ ID NO: 1419901 - DNA, 12 bp, Homo sapiens
cagatctgcctg

SEQ ID NO: 1419902 - DNA, 20 bp, Homo sapiens
cagatctgcctgggcctgtg

SEQ ID NO: 1419903 - DNA, 14 bp, Homo sapiens
cagatctggaacct

SEQ ID NO: 1419904 - DNA, 21 bp, Homo sapiens
cagatctggaacctcagcctg

SEQ ID NO: 1419905 - DNA, 23 bp, Homo sapiens
cagatctggaacctcagcctggc

SEQ ID NO: 1419906 - DNA, 18 bp, Homo sapiens
cagatctggtcccttgca

SEQ ID NO: 1419907 - DNA, 13 bp, Homo sapiens
cagatctgtgccc

SEQ ID NO: 1419908 - DNA, 14 bp, Homo sapiens
cagatctgtgcccc

SEQ ID NO: 1419909 - DNA, 23 bp, Homo sapiens
cagatctgtgccccatgcctgtc

SEQ ID NO: 1419910 - DNA, 13 bp, Homo sapiens
cagatctgttttg

SEQ ID NO: 1419911 - DNA, 13 bp, Homo sapiens
cagatcttgacag

SEQ ID NO: 1419912 - DNA, 20 bp, Homo sapiens
cagatctttctcttccctga

SEQ ID NO: 1419913 - DNA, 23 bp, Homo sapiens
cagatgaactctttctggcctgc

SEQ ID NO: 1419914 - DNA, 14 bp, Homo sapiens
cagatgaatgataa

SEQ ID NO: 1419915 - DNA, 15 bp, Homo sapiens
cagatgaatgtattt

SEQ ID NO: 1419916 - DNA, 19 bp, Homo sapiens
cagatgaattgataaaaga

SEQ ID NO: 1419917 - DNA, 18 bp, Homo sapiens
cagatgacacataaatct

SEQ ID NO: 1419918 - DNA, 21 bp, Homo sapiens
cagatgacacgcgctctccac

SEQ ID NO: 1419919 - DNA, 20 bp, Homo sapiens
cagatgagcagtcacactgt

SEQ ID NO: 1419920 - DNA, 23 bp, Homo sapiens
cagatgagcagtcacactgttac

SEQ ID NO: 1419921 - DNA, 17 bp, Homo sapiens
cagatgaggatccgaaa

SEQ ID NO: 1419922 - DNA, 16 bp, Homo sapiens
cagatgagtaaaggag

SEQ ID NO: 1419923 - DNA, 23 bp, Homo sapiens
cagatgatgccaacctctggagc

SEQ ID NO: 1419924 - DNA, 15 bp, Homo sapiens
cagatgcaggacagg

SEQ ID NO: 1419925 - DNA, 21 bp, Homo sapiens
cagatgcaggacaggaggcgg

SEQ ID NO: 1419926 - DNA, 23 bp, Homo sapiens
cagatgcaggacaggaggcggcc

SEQ ID NO: 1419927 - DNA, 18 bp, Homo sapiens
cagatgccaccctagcca

SEQ ID NO: 1419928 - DNA, 19 bp, Homo sapiens
cagatgccatggcctgtgc

SEQ ID NO: 1419929 - DNA, 22 bp, Homo sapiens
cagatgccatggcctgtgctgg

SEQ ID NO: 1419930 - DNA, 23 bp, Homo sapiens
cagatgcctccccaagactgtca

SEQ ID NO: 1419931 - DNA, 19 bp, Homo sapiens
cagatgcctgcttgataat

SEQ ID NO: 1419932 - DNA, 13 bp, Homo sapiens
cagatgcgtccca

SEQ ID NO: 1419933 - DNA, 18 bp, Homo sapiens
cagatgctaggctgtctg

SEQ ID NO: 1419934 - DNA, 24 bp, Homo sapiens
cagatgctaggctgtctgcgaaga

SEQ ID NO: 1419935 - DNA, 12 bp, Homo sapiens
cagatgcttctg

SEQ ID NO: 1419936 - DNA, 22 bp, Homo sapiens
cagatgcttgcggcaaaaggaa

SEQ ID NO: 1419937 - DNA, 23 bp, Homo sapiens
cagatgcttgcggcaaaaggaaa

SEQ ID NO: 1419938 - DNA, 17 bp, Homo sapiens
cagatggaaaaataaca

SEQ ID NO: 1419939 - DNA, 19 bp, Homo sapiens
cagatggaatgctgtgtta

SEQ ID NO: 1419940 - DNA, 19 bp, Homo sapiens
cagatggacagcgatgagg

SEQ ID NO: 1419941 - DNA, 14 bp, Homo sapiens
cagatggagcccat

SEQ ID NO: 1419942 - DNA, 23 bp, Homo sapiens
cagatggattgataattgcattc

SEQ ID NO: 1419943 - DNA, 13 bp, Homo sapiens
cagatggctcttt

SEQ ID NO: 1419944 - DNA, 19 bp, Homo sapiens
cagatggctttcagggcag

SEQ ID NO: 1419945 - DNA, 21 bp, Homo sapiens
cagatggggtctgtgactgga

SEQ ID NO: 1419946 - DNA, 23 bp, Homo sapiens
cagatgggtctgatattaatcaa

SEQ ID NO: 1419947 - DNA, 22 bp, Homo sapiens
cagatggtttccacatttagat

SEQ ID NO: 1419948 - DNA, 16 bp, Homo sapiens
cagatgtcttctgcct

SEQ ID NO: 1419949 - DNA, 17 bp, Homo sapiens
cagatgtcttctgcctg

SEQ ID NO: 1419950 - DNA, 14 bp, Homo sapiens
cagatgtgcaataa

SEQ ID NO: 1419951 - DNA, 20 bp, Homo sapiens
cagatgtgcaataatttgta

SEQ ID NO: 1419952 - DNA, 21 bp, Homo sapiens
cagatgtgcaataatttgtac

SEQ ID NO: 1419953 - DNA, 23 bp, Homo sapiens
cagatgtgggccaccattgcaac

SEQ ID NO: 1419954 - DNA, 19 bp, Homo sapiens
cagatgtggggctgagctg

SEQ ID NO: 1419955 - DNA, 21 bp, Homo sapiens
cagatgtggggctgagctggg

SEQ ID NO: 1419956 - DNA, 13 bp, Homo sapiens
cagatgttgcttt

SEQ ID NO: 1419957 - DNA, 18 bp, Homo sapiens
cagatgttgcttttgaaa

SEQ ID NO: 1419958 - DNA, 23 bp, Homo sapiens
cagatgttgggaggatacagagg

SEQ ID NO: 1419959 - DNA, 18 bp, Homo sapiens
cagatgtttccagacttc

SEQ ID NO: 1419960 - DNA, 12 bp, Homo sapiens
cagattaaaaaa

SEQ ID NO: 1419961 - DNA, 18 bp, Homo sapiens
cagattatgttcctgctg

SEQ ID NO: 1419962 - DNA, 17 bp, Homo sapiens
cagattcagaatgagaa

SEQ ID NO: 1419963 - DNA, 18 bp, Homo sapiens
cagattcaggccagccca

SEQ ID NO: 1419964 - DNA, 16 bp, Homo sapiens
cagattcccctgtgtc

SEQ ID NO: 1419965 - DNA, 18 bp, Homo sapiens
cagattcctgggcctgtc

SEQ ID NO: 1419966 - DNA, 12 bp, Homo sapiens
cagattctgatg

SEQ ID NO: 1419967 - DNA, 13 bp, Homo sapiens
cagattgcctcct

SEQ ID NO: 1419968 - DNA, 14 bp, Homo sapiens
cagattgcctcctt

SEQ ID NO: 1419969 - DNA, 22 bp, Homo sapiens
cagattggctcacactgagaat

SEQ ID NO: 1419970 - DNA, 14 bp, Homo sapiens
cagattgtgtacat

SEQ ID NO: 1419971 - DNA, 21 bp, Homo sapiens
cagatttaagccttacaaagg

SEQ ID NO: 1419972 - DNA, 22 bp, Homo sapiens
cagatttctggttgatttgtaa

SEQ ID NO: 1419973 - DNA, 19 bp, Homo sapiens
cagatttgaactcttcaat

SEQ ID NO: 1419974 - DNA, 13 bp, Homo sapiens
cagattttaaatt

SEQ ID NO: 1419975 - DNA, 23 bp, Homo sapiens
cagattttaattttgaataaata

SEQ ID NO: 1419976 - DNA, 14 bp, Homo sapiens
cagattttacaaaa

SEQ ID NO: 1419977 - DNA, 19 bp, Homo sapiens
cagattttacaaaagatgt

SEQ ID NO: 1419978 - DNA, 22 bp, Homo sapiens
cagattttcagcaaactctttt

SEQ ID NO: 1419979 - DNA, 20 bp, Homo sapiens
cagattttggggttgtgttg

SEQ ID NO: 1419980 - DNA, 14 bp, Homo sapiens
cagatttttacaaa

SEQ ID NO: 1419981 - DNA, 15 bp, Homo sapiens
cagcaaaactccatc

SEQ ID NO: 1419982 - DNA, 11 bp, Homo sapiens
cagcaaaagat

SEQ ID NO: 1419983 - DNA, 14 bp, Homo sapiens
cagcaaaccggggc

SEQ ID NO: 1419984 - DNA, 16 bp, Homo sapiens
cagcaaaccggggcct

SEQ ID NO: 1419985 - DNA, 20 bp, Homo sapiens
cagcaaactcttttcccact

SEQ ID NO: 1419986 - DNA, 15 bp, Homo sapiens
cagcaaagaaaaaaa

SEQ ID NO: 1419987 - DNA, 23 bp, Homo sapiens
cagcaacaaaatcatggcttagg

SEQ ID NO: 1419988 - DNA, 18 bp, Homo sapiens
cagcaacaagactgccag

SEQ ID NO: 1419989 - DNA, 18 bp, Homo sapiens
cagcaacacagcctgggc

SEQ ID NO: 1419990 - DNA, 20 bp, Homo sapiens
cagctctccctctggccctg

SEQ ID NO: 1419991 - DNA, 15 bp, Homo sapiens
cagctctctgacgct

SEQ ID NO: 1419992 - DNA, 13 bp, Homo sapiens
cagctctctggga

SEQ ID NO: 1419993 - DNA, 16 bp, Homo sapiens
cagctctgacatccct

SEQ ID NO: 1419994 - DNA, 17 bp, Homo sapiens
cagctctgacatccctt

SEQ ID NO: 1419995 - DNA, 18 bp, Homo sapiens
cagctctgacatcccttc

SEQ ID NO: 1419996 - DNA, 19 bp, Homo sapiens
cagctctgacatcccttcc

SEQ ID NO: 1419997 - DNA, 21 bp, Homo sapiens
cagctctgacatcccttcctg

SEQ ID NO: 1419998 - DNA, 16 bp, Homo sapiens
cagctctgaggggagg

SEQ ID NO: 1419999 - DNA, 13 bp, Homo sapiens
cagctctgccccc

SEQ ID NO: 1420000 - DNA, 14 bp, Homo sapiens
cagctctgcccccg

SEQ ID NO: 1420001 - DNA, 22 bp, Homo sapiens
cagctctgcccccgcgggttct

SEQ ID NO: 1420002 - DNA, 17 bp, Homo sapiens
cagctctggacagcccc

SEQ ID NO: 1420003 - DNA, 18 bp, Homo sapiens
cagctctggatgaaggca

SEQ ID NO: 1420004 - DNA, 12 bp, Homo sapiens
cagctctggctt

SEQ ID NO: 1420005 - DNA, 23 bp, Homo sapiens
cagctctggtccaggccctgtgg

SEQ ID NO: 1420006 - DNA, 15 bp, Homo sapiens
cagctctgtggcctg

SEQ ID NO: 1420007 - DNA, 16 bp, Homo sapiens
cagctctgtggcctgt

SEQ ID NO: 1420008 - DNA, 18 bp, Homo sapiens
cagctctgtggcctgtgt

SEQ ID NO: 1420009 - DNA, 19 bp, Homo sapiens
cagctctgtggcctgtgtc

SEQ ID NO: 1420010 - DNA, 20 bp, Homo sapiens
cagctctgtggcctgtgtcc

SEQ ID NO: 1420011 - DNA, 15 bp, Homo sapiens
cagctcttcattcca

SEQ ID NO: 1420012 - DNA, 21 bp, Homo sapiens
cagctcttcattccattgact

SEQ ID NO: 1420013 - DNA, 21 bp, Homo sapiens
cagctcttctcttcctagatc

SEQ ID NO: 1420014 - DNA, 15 bp, Homo sapiens
cagctcttgcccttc

SEQ ID NO: 1420015 - DNA, 17 bp, Homo sapiens
cagctcttgcccttccc

SEQ ID NO: 1420016 - DNA, 18 bp, Homo sapiens
cagctcttgcccttccct

SEQ ID NO: 1420017 - DNA, 19 bp, Homo sapiens
cagctcttgcccttccctg

SEQ ID NO: 1420018 - DNA, 16 bp, Homo sapiens
cagctcttgctctctt

SEQ ID NO: 1420019 - DNA, 19 bp, Homo sapiens
cagctcttggcccctgtgt

SEQ ID NO: 1420020 - DNA, 14 bp, Homo sapiens
cagctctttccaaa

SEQ ID NO: 1420021 - DNA, 16 bp, Homo sapiens
cagctctttccaaatt

SEQ ID NO: 1420022 - DNA, 16 bp, Homo sapiens
cagctgaaattgaaaa

SEQ ID NO: 1420023 - DNA, 23 bp, Homo sapiens
cagctgaagttgcagatgttaga

SEQ ID NO: 1420024 - DNA, 13 bp, Homo sapiens
cagctgacctctg

SEQ ID NO: 1420025 - DNA, 17 bp, Homo sapiens
cagctgacctctgttgt

SEQ ID NO: 1420026 - DNA, 18 bp, Homo sapiens
cagctgacctctgttgtc

SEQ ID NO: 1420027 - DNA, 21 bp, Homo sapiens
cagctgaggctgggggagagc

SEQ ID NO: 1420028 - DNA, 23 bp, Homo sapiens
cagctgaggctgggggagagccg

SEQ ID NO: 1420029 - DNA, 20 bp, Homo sapiens
cagctgaggtctcttgaggg

SEQ ID NO: 1420030 - DNA, 14 bp, Homo sapiens
cagctgagttatga

SEQ ID NO: 1420031 - DNA, 16 bp, Homo sapiens
cagctgatccatagga

SEQ ID NO: 1420032 - DNA, 17 bp, Homo sapiens
cagctgatccataggac

SEQ ID NO: 1420033 - DNA, 21 bp, Homo sapiens
cagctgatgcctccttggcca

SEQ ID NO: 1420034 - DNA, 18 bp, Homo sapiens
cagctgatgttggaagag

SEQ ID NO: 1420035 - DNA, 20 bp, Homo sapiens
cagctgattcagcagtgcct

SEQ ID NO: 1420036 - DNA, 20 bp, Homo sapiens
cagctgcaaggtactctggt

SEQ ID NO: 1420037 - DNA, 15 bp, Homo sapiens
cagctgcacattcct

SEQ ID NO: 1420038 - DNA, 17 bp, Homo sapiens
cagctgcacctgccagc

SEQ ID NO: 1420039 - DNA, 20 bp, Homo sapiens
cagctgcacctgccagcctg

SEQ ID NO: 1420040 - DNA, 21 bp, Homo sapiens
cagctgcacctgccagcctgg

SEQ ID NO: 1420041 - DNA, 22 bp, Homo sapiens
cagctgcacctgccagcctggc

SEQ ID NO: 1420042 - DNA, 20 bp, Homo sapiens
cagctgcagaccatgccaga

SEQ ID NO: 1420043 - DNA, 13 bp, Homo sapiens
cagctgcagctga

SEQ ID NO: 1420044 - DNA, 14 bp, Homo sapiens
cagctgcagctggg

SEQ ID NO: 1420045 - DNA, 16 bp, Homo sapiens
cagctgcagctgggcc

SEQ ID NO: 1420046 - DNA, 18 bp, Homo sapiens
cagctgcagctgggcccc

SEQ ID NO: 1420047 - DNA, 23 bp, Homo sapiens
cagctgcagctgggccccatgct

SEQ ID NO: 1420048 - DNA, 19 bp, Homo sapiens
cagctgcagtcaacagttc

SEQ ID NO: 1420049 - DNA, 22 bp, Homo sapiens
cagctgccaagcactcgagacc

SEQ ID NO: 1420050 - DNA, 23 bp, Homo sapiens
cagctgccaagcactcgagacca

SEQ ID NO: 1420051 - DNA, 19 bp, Homo sapiens
cagctgccaagtgctcttt

SEQ ID NO: 1420052 - DNA, 16 bp, Homo sapiens
cagctgcccatcccag

SEQ ID NO: 1420053 - DNA, 21 bp, Homo sapiens
cagctgcccatcccagtccct

SEQ ID NO: 1420054 - DNA, 22 bp, Homo sapiens
cagctgcccatcccagtccctc

SEQ ID NO: 1420055 - DNA, 23 bp, Homo sapiens
cagctgcccatcccagtccctcg

SEQ ID NO: 1420056 - DNA, 13 bp, Homo sapiens
cagctgcccctgg

SEQ ID NO: 1420057 - DNA, 15 bp, Homo sapiens
cagctgcccctggca

SEQ ID NO: 1420058 - DNA, 15 bp, Homo sapiens
cagctgccctagctg

SEQ ID NO: 1420059 - DNA, 15 bp, Homo sapiens
cagctgccctggctg

SEQ ID NO: 1420060 - DNA, 19 bp, Homo sapiens
cagctgccgaccagagccc

SEQ ID NO: 1420061 - DNA, 12 bp, Homo sapiens
cagctgcctctg

SEQ ID NO: 1420062 - DNA, 14 bp, Homo sapiens
cagctgcctctgct

SEQ ID NO: 1420063 - DNA, 19 bp, Homo sapiens
cagctgcctctgctccctc

SEQ ID NO: 1420064 - DNA, 11 bp, Homo sapiens
cagctgcctgg

SEQ ID NO: 1420065 - DNA, 13 bp, Homo sapiens
cagctgccttcct

SEQ ID NO: 1420066 - DNA, 18 bp, Homo sapiens
cagctgccttcctcatcc

SEQ ID NO: 1420067 - DNA, 16 bp, Homo sapiens
cagctgctatccccat

SEQ ID NO: 1420068 - DNA, 13 bp, Homo sapiens
cagctgctcccca

SEQ ID NO: 1420069 - DNA, 14 bp, Homo sapiens
cagctgctccccag

SEQ ID NO: 1420070 - DNA, 23 bp, Homo sapiens
cagctgctccgaggacccaggaa

SEQ ID NO: 1420071 - DNA, 12 bp, Homo sapiens
cagctgctctgc

SEQ ID NO: 1420072 - DNA, 13 bp, Homo sapiens
cagctgctctgcc

SEQ ID NO: 1420073 - DNA, 23 bp, Homo sapiens
cagctgctcttgcatctgggcca

SEQ ID NO: 1420074 - DNA, 21 bp, Homo sapiens
cagctgctgaagttctgagcc

SEQ ID NO: 1420075 - DNA, 20 bp, Homo sapiens
cagctgctgactggcagggc

SEQ ID NO: 1420076 - DNA, 11 bp, Homo sapiens
cagctgctgct

SEQ ID NO: 1420077 - DNA, 12 bp, Homo sapiens
cagctgctggga

SEQ ID NO: 1420078 - DNA, 19 bp, Homo sapiens
cagctgctgggacccacct

SEQ ID NO: 1420079 - DNA, 22 bp, Homo sapiens
cagctgctgggacccacctccc

SEQ ID NO: 1420080 - DNA, 10 bp, Homo sapiens
cagctgcttg

SEQ ID NO: 1420081 - DNA, 13 bp, Homo sapiens
cagctgcttgtcc

SEQ ID NO: 1420082 - DNA, 15 bp, Homo sapiens
cagctgcttgtcctg

SEQ ID NO: 1420083 - DNA, 23 bp, Homo sapiens
cagctgcttgtcctgctctcttc

SEQ ID NO: 1420084 - DNA, 21 bp, Homo sapiens
cagctgcttgtgggcccggag

SEQ ID NO: 1420085 - DNA, 15 bp, Homo sapiens
cagctgcttttgcat

SEQ ID NO: 1420086 - DNA, 19 bp, Homo sapiens
cagctggaaagttgggccc

SEQ ID NO: 1420087 - DNA, 21 bp, Homo sapiens
cagctggaaagttgggcccct

SEQ ID NO: 1420088 - DNA, 21 bp, Homo sapiens
cagctggatgagacttccaaa

SEQ ID NO: 1420089 - DNA, 13 bp, Homo sapiens
cagctggcccact

SEQ ID NO: 1420090 - DNA, 22 bp, Homo sapiens
cagctggcccactgctggctgc

SEQ ID NO: 1420091 - DNA, 13 bp, Homo sapiens
cagctggcctgga

SEQ ID NO: 1420092 - DNA, 15 bp, Homo sapiens
cagctggcctggaca

SEQ ID NO: 1420093 - DNA, 22 bp, Homo sapiens
cagctggctctgacaagatggt

SEQ ID NO: 1420094 - DNA, 12 bp, Homo sapiens
cagctggctggg

SEQ ID NO: 1420095 - DNA, 14 bp, Homo sapiens
cagctggctgggcc

SEQ ID NO: 1420096 - DNA, 16 bp, Homo sapiens
cagctgggagcactgg

SEQ ID NO: 1420097 - DNA, 13 bp, Homo sapiens
cagctgggcccag

SEQ ID NO: 1420098 - DNA, 17 bp, Homo sapiens
cagctgggccccatgct

SEQ ID NO: 1420099 - DNA, 19 bp, Homo sapiens
cagctgggccccatgctct

SEQ ID NO: 1420100 - DNA, 16 bp, Homo sapiens
cagctgggcctcctgc

SEQ ID NO: 1420101 - DNA, 22 bp, Homo sapiens
cagctgggcctcctgcctccgg

SEQ ID NO: 1420102 - DNA, 17 bp, Homo sapiens
cagctgggctctgcaat

SEQ ID NO: 1420103 - DNA, 15 bp, Homo sapiens
cagctgggctctgcc

SEQ ID NO: 1420104 - DNA, 16 bp, Homo sapiens
cagctggggagcagct

SEQ ID NO: 1420105 - DNA, 18 bp, Homo sapiens
cagctggggagcagctga

SEQ ID NO: 1420106 - DNA, 20 bp, Homo sapiens
cagctggggagcagctgaga

SEQ ID NO: 1420107 - DNA, 19 bp, Homo sapiens
cagctggggcgtggggagg

SEQ ID NO: 1420108 - DNA, 20 bp, Homo sapiens
cagctggggcgtggggaggg

SEQ ID NO: 1420109 - DNA, 21 bp, Homo sapiens
cagctggggcgtggggagggc

SEQ ID NO: 1420110 - DNA, 22 bp, Homo sapiens
cagctggtgccaaatagcccca

SEQ ID NO: 1420111 - DNA, 13 bp, Homo sapiens
cagctggtgcccc

SEQ ID NO: 1420112 - DNA, 19 bp, Homo sapiens
cagctggtgccccacctgc

SEQ ID NO: 1420113 - DNA, 22 bp, Homo sapiens
cagctggtgccccacctgcctg

SEQ ID NO: 1420114 - DNA, 23 bp, Homo sapiens
cagctggtgccccacctgcctgg

SEQ ID NO: 1420115 - DNA, 21 bp, Homo sapiens
cagctggtggccctgtgcctg

SEQ ID NO: 1420116 - DNA, 23 bp, Homo sapiens
cagctggtggccctgtgcctggg

SEQ ID NO: 1420117 - DNA, 16 bp, Homo sapiens
cagctggttcgtggtt

SEQ ID NO: 1420118 - DNA, 19 bp, Homo sapiens
cagctgtaagaagagactg

SEQ ID NO: 1420119 - DNA, 14 bp, Homo sapiens
cagctgtagccatg

SEQ ID NO: 1420120 - DNA, 16 bp, Homo sapiens
cagctgtagccatggc

SEQ ID NO: 1420121 - DNA, 23 bp, Homo sapiens
cagctgtagccatggctcaggca

SEQ ID NO: 1420122 - DNA, 18 bp, Homo sapiens
cagctgtccctgtcacca

SEQ ID NO: 1420123 - DNA, 24 bp, Homo sapiens
cagctgtcccttgcttgcctgcag

SEQ ID NO: 1420124 - DNA, 22 bp, Homo sapiens
cagctgtcctgcagcaaacact

SEQ ID NO: 1420125 - DNA, 17 bp, Homo sapiens
cagctgtgagaagtcac

SEQ ID NO: 1420126 - DNA, 17 bp, Homo sapiens
cagctgtggcagagtta

SEQ ID NO: 1420127 - DNA, 22 bp, Homo sapiens
cagctgtgtctgccaaacacat

SEQ ID NO: 1420128 - DNA, 14 bp, Homo sapiens
cagctgtttcaaag

SEQ ID NO: 1420129 - DNA, 15 bp, Homo sapiens
cagctgtttcaaagt

SEQ ID NO: 1420130 - DNA, 16 bp, Homo sapiens
cagctgtttcaaagtt

SEQ ID NO: 1420131 - DNA, 16 bp, Homo sapiens
cagctgtttctcatga

SEQ ID NO: 1420132 - DNA, 17 bp, Homo sapiens
cagctgtttctcatgaa

SEQ ID NO: 1420133 - DNA, 21 bp, Homo sapiens
cagctgtttctcatgaagcta

SEQ ID NO: 1420134 - DNA, 15 bp, Homo sapiens
cagctgtttgtcata

SEQ ID NO: 1420135 - DNA, 19 bp, Homo sapiens
cagcttaaacccatacaat

SEQ ID NO: 1420136 - DNA, 19 bp, Homo sapiens
cagcttaacattgacttct

SEQ ID NO: 1420137 - DNA, 14 bp, Homo sapiens
cagcttaataagta

SEQ ID NO: 1420138 - DNA, 18 bp, Homo sapiens
cagcttatctcttttata

SEQ ID NO: 1420139 - DNA, 22 bp, Homo sapiens
cagcttatgggatccttgtctt

SEQ ID NO: 1420140 - DNA, 22 bp, Homo sapiens
cagcttattgtgtgcgctgcct

SEQ ID NO: 1420141 - DNA, 13 bp, Homo sapiens
cagcttattgttt

SEQ ID NO: 1420142 - DNA, 18 bp, Homo sapiens
cagcttatttttttctac

SEQ ID NO: 1420143 - DNA, 21 bp, Homo sapiens
cagcttcaacttttctcttta

SEQ ID NO: 1420144 - DNA, 23 bp, Homo sapiens
cagcttcagaaagagctcaaaat

SEQ ID NO: 1420145 - DNA, 11 bp, Homo sapiens
cagcttcagct

SEQ ID NO: 1420146 - DNA, 16 bp, Homo sapiens
cagcttcagctcaact

SEQ ID NO: 1420147 - DNA, 12 bp, Homo sapiens
cagcttccaaag

SEQ ID NO: 1420148 - DNA, 13 bp, Homo sapiens
cagcttccaaagc

SEQ ID NO: 1420149 - DNA, 16 bp, Homo sapiens
cagcttcctcacaccc

SEQ ID NO: 1420150 - DNA, 18 bp, Homo sapiens
cagcttcctgtcaagcaa

SEQ ID NO: 1420151 - DNA, 21 bp, Homo sapiens
cagcttcggagggcccctgcg

SEQ ID NO: 1420152 - DNA, 22 bp, Homo sapiens
cagcttcgtttattttcaagaa

SEQ ID NO: 1420153 - DNA, 14 bp, Homo sapiens
cagcttctaagagc

SEQ ID NO: 1420154 - DNA, 17 bp, Homo sapiens
cagcttctccaagcatc

SEQ ID NO: 1420155 - DNA, 14 bp, Homo sapiens
cagcttctctctcc

SEQ ID NO: 1420156 - DNA, 16 bp, Homo sapiens
cagcttctctctccag

SEQ ID NO: 1420157 - DNA, 19 bp, Homo sapiens
cagcttctgccacataaaa

SEQ ID NO: 1420158 - DNA, 23 bp, Homo sapiens
cagcttgaatgtccccattctat

SEQ ID NO: 1420159 - DNA, 15 bp, Homo sapiens
cagcttgacctgagg

SEQ ID NO: 1420160 - DNA, 16 bp, Homo sapiens
cagcttgacctgaggc

SEQ ID NO: 1420161 - DNA, 20 bp, Homo sapiens
cagcttgacctgaggctgtg

SEQ ID NO: 1420162 - DNA, 22 bp, Homo sapiens
cagcttgacctgaggctgtggt

SEQ ID NO: 1420163 - DNA, 23 bp, Homo sapiens
cagcttgacctgaggctgtggtc

SEQ ID NO: 1420164 - DNA, 21 bp, Homo sapiens
cagcttgagccgggcccctgg

SEQ ID NO: 1420165 - DNA, 12 bp, Homo sapiens
cagcttgcattg

SEQ ID NO: 1420166 - DNA, 12 bp, Homo sapiens
cagcttgccccg

SEQ ID NO: 1420167 - DNA, 23 bp, Homo sapiens
cagcttgctcttcagtgggagaa

SEQ ID NO: 1420168 - DNA, 20 bp, Homo sapiens
cagcttgctgtcacttcttc

SEQ ID NO: 1420169 - DNA, 23 bp, Homo sapiens
cagcttggctcacaaggcccagg

SEQ ID NO: 1420170 - DNA, 13 bp, Homo sapiens
cagcggcccctcc

SEQ ID NO: 1420171 - DNA, 15 bp, Homo sapiens
cagcggcccctccca

SEQ ID NO: 1420172 - DNA, 14 bp, Homo sapiens
cagcggccctgtca

SEQ ID NO: 1420173 - DNA, 15 bp, Homo sapiens
cagcggccttgaaga

SEQ ID NO: 1420174 - DNA, 18 bp, Homo sapiens
cagcgggagacctgtgct

SEQ ID NO: 1420175 - DNA, 13 bp, Homo sapiens
cagcgggcacagg

SEQ ID NO: 1420176 - DNA, 14 bp, Homo sapiens
cagcgggcacaggg

SEQ ID NO: 1420177 - DNA, 20 bp, Homo sapiens
cagcgggcaggttctgcctg

SEQ ID NO: 1420178 - DNA, 12 bp, Homo sapiens
cagcgggccagg

SEQ ID NO: 1420179 - DNA, 16 bp, Homo sapiens
cagcgggggccttgaa

SEQ ID NO: 1420180 - DNA, 18 bp, Homo sapiens
cagcgggggccttgaaga

SEQ ID NO: 1420181 - DNA, 20 bp, Homo sapiens
cagcggtccaacgccgcctt

SEQ ID NO: 1420182 - DNA, 14 bp, Homo sapiens
cagcgtcactccag

SEQ ID NO: 1420183 - DNA, 14 bp, Homo sapiens
cagcgtcccagtct

SEQ ID NO: 1420184 - DNA, 21 bp, Homo sapiens
cagcgtcccagtctctggcag

SEQ ID NO: 1420185 - DNA, 17 bp, Homo sapiens
cagcgtccctagcagtg

SEQ ID NO: 1420186 - DNA, 18 bp, Homo sapiens
cagcgtccggggtggtgg

SEQ ID NO: 1420187 - DNA, 13 bp, Homo sapiens
cagcgtctgctca

SEQ ID NO: 1420188 - DNA, 16 bp, Homo sapiens
cagcgtgcacatctgc

SEQ ID NO: 1420189 - DNA, 15 bp, Homo sapiens
cagcgtgtggagcag

SEQ ID NO: 1420190 - DNA, 16 bp, Homo sapiens
cagcgtgtggagcaga

SEQ ID NO: 1420191 - DNA, 21 bp, Homo sapiens
cagcgttaacacaaaatccat

SEQ ID NO: 1420192 - DNA, 21 bp, Homo sapiens
cagcgtttagtttctagaggc

SEQ ID NO: 1420193 - DNA, 15 bp, Homo sapiens
cagcgttttgcaagg

SEQ ID NO: 1420194 - DNA, 19 bp, Homo sapiens
cagcgttttgcaaggtaaa

SEQ ID NO: 1420195 - DNA, 20 bp, Homo sapiens
cagctaaacaccaacccctg

SEQ ID NO: 1420196 - DNA, 18 bp, Homo sapiens
cagctaaagcccaacctc

SEQ ID NO: 1420197 - DNA, 22 bp, Homo sapiens
cagctaaagcccaacctcctga

SEQ ID NO: 1420198 - DNA, 19 bp, Homo sapiens
cagctaactccgagagcag

SEQ ID NO: 1420199 - DNA, 23 bp, Homo sapiens
cagctaagaacctggaacttggg

SEQ ID NO: 1420200 - DNA, 18 bp, Homo sapiens
cagctaagatagaaagct

SEQ ID NO: 1420201 - DNA, 21 bp, Homo sapiens
cagctaagatagaaagctgga

SEQ ID NO: 1420202 - DNA, 23 bp, Homo sapiens
cagctaagatagaaagctggact

SEQ ID NO: 1420203 - DNA, 14 bp, Homo sapiens
cagctaagctcacg

SEQ ID NO: 1420204 - DNA, 19 bp, Homo sapiens
cagctaaggacatttccca

SEQ ID NO: 1420205 - DNA, 17 bp, Homo sapiens
cagctaatctgtagggc

SEQ ID NO: 1420206 - DNA, 21 bp, Homo sapiens
cagctaatctgtagggctgga

SEQ ID NO: 1420207 - DNA, 22 bp, Homo sapiens
cagctaattctactcacagtgc

SEQ ID NO: 1420208 - DNA, 19 bp, Homo sapiens
cagctaattggacttttat

SEQ ID NO: 1420209 - DNA, 19 bp, Homo sapiens
cagctaatttttgtatttt

SEQ ID NO: 1420210 - DNA, 21 bp, Homo sapiens
cagctacaaccctaccctggc

SEQ ID NO: 1420211 - DNA, 12 bp, Homo sapiens
cagctacattcc

SEQ ID NO: 1420212 - DNA, 21 bp, Homo sapiens
cagctacattcctcagctgcc

SEQ ID NO: 1420213 - DNA, 17 bp, Homo sapiens
cagctaccctcagcctc

SEQ ID NO: 1420214 - DNA, 21 bp, Homo sapiens
cagctaccctttttctccagc

SEQ ID NO: 1420215 - DNA, 21 bp, Homo sapiens
cagctactcagaagcctgagg

SEQ ID NO: 1420216 - DNA, 22 bp, Homo sapiens
cagctactcagaagcctgaggc

SEQ ID NO: 1420217 - DNA, 12 bp, Homo sapiens
cagctactcagg

SEQ ID NO: 1420218 - DNA, 14 bp, Homo sapiens
cagctactcgggag

SEQ ID NO: 1420219 - DNA, 13 bp, Homo sapiens
cagctactctccc

SEQ ID NO: 1420220 - DNA, 23 bp, Homo sapiens
cagctactctccccacgagggct

SEQ ID NO: 1420221 - DNA, 19 bp, Homo sapiens
cagctactctgtccaggcc

SEQ ID NO: 1420222 - DNA, 20 bp, Homo sapiens
cagctactctgtccaggcca

SEQ ID NO: 1420223 - DNA, 21 bp, Homo sapiens
cagctactctgtccaggccac

SEQ ID NO: 1420224 - DNA, 22 bp, Homo sapiens
cagctactctgtccaggccact

SEQ ID NO: 1420225 - DNA, 16 bp, Homo sapiens
cagctactggaatggt

SEQ ID NO: 1420226 - DNA, 18 bp, Homo sapiens
cagctactggaatggtgt

SEQ ID NO: 1420227 - DNA, 19 bp, Homo sapiens
cagctactggggaggctga

SEQ ID NO: 1420228 - DNA, 20 bp, Homo sapiens
cagctactggggaggctgag

SEQ ID NO: 1420229 - DNA, 15 bp, Homo sapiens
cagctacttgggagg

SEQ ID NO: 1420230 - DNA, 14 bp, Homo sapiens
caggagtgtcctgc

SEQ ID NO: 1420231 - DNA, 16 bp, Homo sapiens
caggagtgtcctggct

SEQ ID NO: 1420232 - DNA, 22 bp, Homo sapiens
caggagtgtcctggctgtgaat

SEQ ID NO: 1420233 - DNA, 19 bp, Homo sapiens
caggagttaaaaagggcag

SEQ ID NO: 1420234 - DNA, 19 bp, Homo sapiens
caggagttagaggccagcc

SEQ ID NO: 1420235 - DNA, 22 bp, Homo sapiens
caggagttcaagaccagcctgt

SEQ ID NO: 1420236 - DNA, 21 bp, Homo sapiens
caggagttcaataaatgtctg

SEQ ID NO: 1420237 - DNA, 17 bp, Homo sapiens
caggagttggagaccag

SEQ ID NO: 1420238 - DNA, 19 bp, Homo sapiens
caggagttggagaccaggc

SEQ ID NO: 1420239 - DNA, 22 bp, Homo sapiens
caggagttgtgtctaggctgga

SEQ ID NO: 1420240 - DNA, 20 bp, Homo sapiens
caggagttgtttctgaccca

SEQ ID NO: 1420241 - DNA, 22 bp, Homo sapiens
caggagtttgagacaagccctg

SEQ ID NO: 1420242 - DNA, 22 bp, Homo sapiens
caggagtttgagaccaggctgg

SEQ ID NO: 1420243 - DNA, 23 bp, Homo sapiens
caggagtttgagaccaggctggg

SEQ ID NO: 1420244 - DNA, 17 bp, Homo sapiens
caggagtttgaggctgc

SEQ ID NO: 1420245 - DNA, 19 bp, Homo sapiens
caggagtttgaggctgcaa

SEQ ID NO: 1420246 - DNA, 20 bp, Homo sapiens
caggagtttgaggctgcagc

SEQ ID NO: 1420247 - DNA, 14 bp, Homo sapiens
caggataagaaaaa

SEQ ID NO: 1420248 - DNA, 23 bp, Homo sapiens
caggataagaaagcctaaaattg

SEQ ID NO: 1420249 - DNA, 18 bp, Homo sapiens
caggatactctgtcagat

SEQ ID NO: 1420250 - DNA, 16 bp, Homo sapiens
caggatattagttaat

SEQ ID NO: 1420251 - DNA, 14 bp, Homo sapiens
caggatcctgcagg

SEQ ID NO: 1420252 - DNA, 15 bp, Homo sapiens
caggatcgaagggtt

SEQ ID NO: 1420253 - DNA, 10 bp, Homo sapiens
caggatctat

SEQ ID NO: 1420254 - DNA, 16 bp, Homo sapiens
caggatctcaagccag

SEQ ID NO: 1420255 - DNA, 18 bp, Homo sapiens
caggatctcaagccagcc

SEQ ID NO: 1420256 - DNA, 19 bp, Homo sapiens
caggatctcaagccagccc

SEQ ID NO: 1420257 - DNA, 18 bp, Homo sapiens
caggatctgctccaacag

SEQ ID NO: 1420258 - DNA, 15 bp, Homo sapiens
caggatgaaagttcc

SEQ ID NO: 1420259 - DNA, 23 bp, Homo sapiens
caggatgaaagttcccccatcag

SEQ ID NO: 1420260 - DNA, 21 bp, Homo sapiens
caggatgcccagatgaactga

SEQ ID NO: 1420261 - DNA, 22 bp, Homo sapiens
caggatgcccagatgaactgac

SEQ ID NO: 1420262 - DNA, 13 bp, Homo sapiens
caggatgcccagg

SEQ ID NO: 1420263 - DNA, 14 bp, Homo sapiens
caggatgcccaggg

SEQ ID NO: 1420264 - DNA, 19 bp, Homo sapiens
caggatggggttctggaaa

SEQ ID NO: 1420265 - DNA, 16 bp, Homo sapiens
caggatggtgggcagg

SEQ ID NO: 1420266 - DNA, 17 bp, Homo sapiens
caggatggtgggcagga

SEQ ID NO: 1420267 - DNA, 19 bp, Homo sapiens
caggagaagggctggggcc

SEQ ID NO: 1420268 - DNA, 12 bp, Homo sapiens
caggagaagggg

SEQ ID NO: 1420269 - DNA, 16 bp, Homo sapiens
caggagaagtgctccc

SEQ ID NO: 1420270 - DNA, 19 bp, Homo sapiens
caggagaagtgctccctgg

SEQ ID NO: 1420271 - DNA, 20 bp, Homo sapiens
caggagaagtgctccctgga

SEQ ID NO: 1420272 - DNA, 22 bp, Homo sapiens
caggagaagtgctccctggagg

SEQ ID NO: 1420273 - DNA, 23 bp, Homo sapiens
caggagaagtgctccctggaggc

SEQ ID NO: 1420274 - DNA, 23 bp, Homo sapiens
caggagaatcgcttgaacctggg

SEQ ID NO: 1420275 - DNA, 16 bp, Homo sapiens
caggagactccaagga

SEQ ID NO: 1420276 - DNA, 20 bp, Homo sapiens
caggagactccaaggagcta

SEQ ID NO: 1420277 - DNA, 23 bp, Homo sapiens
caggagagacccctcccctccca

SEQ ID NO: 1420278 - DNA, 19 bp, Homo sapiens
caggagagactgagcagcc

SEQ ID NO: 1420279 - DNA, 21 bp, Homo sapiens
caggagagactgagcagccgc

SEQ ID NO: 1420280 - DNA, 11 bp, Homo sapiens
caggagagagc

SEQ ID NO: 1420281 - DNA, 16 bp, Homo sapiens
caggagagagccagga

SEQ ID NO: 1420282 - DNA, 19 bp, Homo sapiens
caggagagccagccctccc

SEQ ID NO: 1420283 - DNA, 13 bp, Homo sapiens
caggagaggcagc

SEQ ID NO: 1420284 - DNA, 23 bp, Homo sapiens
caggagaggcagcatgcttgggc

SEQ ID NO: 1420285 - DNA, 12 bp, Homo sapiens
caggagagggaa

SEQ ID NO: 1420286 - DNA, 17 bp, Homo sapiens
caggagaggggcagaac

SEQ ID NO: 1420287 - DNA, 12 bp, Homo sapiens
caggagagtaga

SEQ ID NO: 1420288 - DNA, 19 bp, Homo sapiens
caggagagtgtgtgggcag

SEQ ID NO: 1420289 - DNA, 20 bp, Homo sapiens
caggagagtgtgtgggcagg

SEQ ID NO: 1420290 - DNA, 21 bp, Homo sapiens
caggagagtgtgtgggcaggg

SEQ ID NO: 1420291 - DNA, 15 bp, Homo sapiens
caggagatcagcagc

SEQ ID NO: 1420292 - DNA, 22 bp, Homo sapiens
caggagatcgagaccatcctgg

SEQ ID NO: 1420293 - DNA, 17 bp, Homo sapiens
caggagatggagggctt

SEQ ID NO: 1420294 - DNA, 21 bp, Homo sapiens
caggagatggagggcttggcc

SEQ ID NO: 1420295 - DNA, 17 bp, Homo sapiens
caggagcaaatggcgtt

SEQ ID NO: 1420296 - DNA, 13 bp, Homo sapiens
caggagcagcagc

SEQ ID NO: 1420297 - DNA, 14 bp, Homo sapiens
caggagcagcagcc

SEQ ID NO: 1420298 - DNA, 15 bp, Homo sapiens
caggagcagcagcca

SEQ ID NO: 1420299 - DNA, 17 bp, Homo sapiens
caggagcagcagccagc

SEQ ID NO: 1420300 - DNA, 18 bp, Homo sapiens
caggagcagcagccagca

SEQ ID NO: 1420301 - DNA, 13 bp, Homo sapiens
caggagcagctgt

SEQ ID NO: 1420302 - DNA, 15 bp, Homo sapiens
caggagcagctgtgc

SEQ ID NO: 1420303 - DNA, 23 bp, Homo sapiens
caggagcagcttttggtctcctt

SEQ ID NO: 1420304 - DNA, 15 bp, Homo sapiens
caggagcaggaccta

SEQ ID NO: 1420305 - DNA, 15 bp, Homo sapiens
caggagcaggcacgg

SEQ ID NO: 1420306 - DNA, 17 bp, Homo sapiens
caggagcaggcacgggt

SEQ ID NO: 1420307 - DNA, 18 bp, Homo sapiens
caggagcaggcacgggtg

SEQ ID NO: 1420308 - DNA, 20 bp, Homo sapiens
caggagcccctggggctgta

SEQ ID NO: 1420309 - DNA, 16 bp, Homo sapiens
caggagccgggcctcc

SEQ ID NO: 1420310 - DNA, 17 bp, Homo sapiens
caggagccgggcctccc

SEQ ID NO: 1420311 - DNA, 19 bp, Homo sapiens
caggagccgggcctcccac

SEQ ID NO: 1420312 - DNA, 21 bp, Homo sapiens
caggagcctagcggagcccag

SEQ ID NO: 1420313 - DNA, 22 bp, Homo sapiens
caggagcctagcggagcccagc

SEQ ID NO: 1420314 - DNA, 16 bp, Homo sapiens
caggagcctgtgcctc

SEQ ID NO: 1420315 - DNA, 21 bp, Homo sapiens
caggagccttcctttctcctg

SEQ ID NO: 1420316 - DNA, 16 bp, Homo sapiens
caggagcgcaagatag

SEQ ID NO: 1420317 - DNA, 21 bp, Homo sapiens
caggagctagcccagtccctg

SEQ ID NO: 1420318 - DNA, 23 bp, Homo sapiens
caggagctagcccagtccctgga

SEQ ID NO: 1420319 - DNA, 23 bp, Homo sapiens
caggagctagttctcagcttgca

SEQ ID NO: 1420320 - DNA, 13 bp, Homo sapiens
caggagctcctgg

SEQ ID NO: 1420321 - DNA, 17 bp, Homo sapiens
caggagctcctggaagc

SEQ ID NO: 1420322 - DNA, 15 bp, Homo sapiens
caggagctctgcgcc

SEQ ID NO: 1420323 - DNA, 19 bp, Homo sapiens
caggagctctgcgccaggc

SEQ ID NO: 1420324 - DNA, 22 bp, Homo sapiens
caggagctcttcaggcctccct

SEQ ID NO: 1420325 - DNA, 23 bp, Homo sapiens
caggagctcttcaggcctccctc

SEQ ID NO: 1420326 - DNA, 12 bp, Homo sapiens
caggagctgagt

SEQ ID NO: 1420327 - DNA, 18 bp, Homo sapiens
caggagctgagtcacctc

SEQ ID NO: 1420328 - DNA, 21 bp, Homo sapiens
caggagctgagtcacctcctc

SEQ ID NO: 1420329 - DNA, 18 bp, Homo sapiens
caggagctgatggcagct

SEQ ID NO: 1420330 - DNA, 15 bp, Homo sapiens
caggagctgggcaga

SEQ ID NO: 1420331 - DNA, 14 bp, Homo sapiens
caggaggcagtgga

SEQ ID NO: 1420332 - DNA, 15 bp, Homo sapiens
caggaggcagtggac

SEQ ID NO: 1420333 - DNA, 15 bp, Homo sapiens
caggaggccccaggc

SEQ ID NO: 1420334 - DNA, 17 bp, Homo sapiens
caggaggccccaggctg

SEQ ID NO: 1420335 - DNA, 19 bp, Homo sapiens
caggaggcccctggcccag

SEQ ID NO: 1420336 - DNA, 14 bp, Homo sapiens
caggaggccctggt

SEQ ID NO: 1420337 - DNA, 13 bp, Homo sapiens
caggaggcccttg

SEQ ID NO: 1420338 - DNA, 15 bp, Homo sapiens
caggaggcggcccgg

SEQ ID NO: 1420339 - DNA, 17 bp, Homo sapiens
caggaggcggcccggcc

SEQ ID NO: 1420340 - DNA, 21 bp, Homo sapiens
caggaggcggcccggccagcg

SEQ ID NO: 1420341 - DNA, 12 bp, Homo sapiens
caggaggctgag

SEQ ID NO: 1420342 - DNA, 18 bp, Homo sapiens
caggaggctgaggcagaa

SEQ ID NO: 1420343 - DNA, 17 bp, Homo sapiens
caggaggctgaggcagg

SEQ ID NO: 1420344 - DNA, 21 bp, Homo sapiens
caggaggctgaggcaggagga

SEQ ID NO: 1420345 - DNA, 15 bp, Homo sapiens
caggaggctggagga

SEQ ID NO: 1420346 - DNA, 19 bp, Homo sapiens
caggagggccagcgctgtg

SEQ ID NO: 1420347 - DNA, 22 bp, Homo sapiens
caggagggccagcgctgtggac

SEQ ID NO: 1420348 - DNA, 16 bp, Homo sapiens
caggagggccctacct

SEQ ID NO: 1420349 - DNA, 21 bp, Homo sapiens
caggaggggcagcgcatgtgt

SEQ ID NO: 1420350 - DNA, 24 bp, Homo sapiens
caggaggggtgagtcccctactcc

SEQ ID NO: 1420351 - DNA, 18 bp, Homo sapiens
caggagggtgacgcccag

SEQ ID NO: 1420352 - DNA, 19 bp, Homo sapiens
caggagggtgacgcccagc

SEQ ID NO: 1420353 - DNA, 21 bp, Homo sapiens
caggaggtgcttgaggccccg

SEQ ID NO: 1420354 - DNA, 15 bp, Homo sapiens
caggaggtggaggtt

SEQ ID NO: 1420355 - DNA, 22 bp, Homo sapiens
caggaggtggctatggccaccc

SEQ ID NO: 1420356 - DNA, 17 bp, Homo sapiens
caggaggttctgggcct

SEQ ID NO: 1420357 - DNA, 18 bp, Homo sapiens
caggaggttctgggcctc

SEQ ID NO: 1420358 - DNA, 20 bp, Homo sapiens
caggagtaaaagagtcaagt

SEQ ID NO: 1420359 - DNA, 22 bp, Homo sapiens
caggagtaagacaagtgggatt

SEQ ID NO: 1420360 - DNA, 14 bp, Homo sapiens
caggagtccacttt

SEQ ID NO: 1420361 - DNA, 15 bp, Homo sapiens
caggagtcccaagga

SEQ ID NO: 1420362 - DNA, 17 bp, Homo sapiens
caggagtcccaaggaaa

SEQ ID NO: 1420363 - DNA, 18 bp, Homo sapiens
caggagtcccaaggaaag

SEQ ID NO: 1420364 - DNA, 19 bp, Homo sapiens
caggagtcccaaggaaagc

SEQ ID NO: 1420365 - DNA, 24 bp, Homo sapiens
caggagtcccaaggaaagccccag

SEQ ID NO: 1420366 - DNA, 15 bp, Homo sapiens
caggagtccctgcca

SEQ ID NO: 1420367 - DNA, 21 bp, Homo sapiens
caggagtccctgccatcatgt

SEQ ID NO: 1420368 - DNA, 15 bp, Homo sapiens
caggagtccctggta

SEQ ID NO: 1420369 - DNA, 15 bp, Homo sapiens
caggagtctgccact

SEQ ID NO: 1420370 - DNA, 14 bp, Homo sapiens
caggagtctgtgct

SEQ ID NO: 1420371 - DNA, 17 bp, Homo sapiens
caggagtctgtgctctt

SEQ ID NO: 1420372 - DNA, 17 bp, Homo sapiens
caggagtcttcagaccc

SEQ ID NO: 1420373 - DNA, 18 bp, Homo sapiens
caggagtcttcagaccca

SEQ ID NO: 1420374 - DNA, 19 bp, Homo sapiens
caggagtcttcagacccag

SEQ ID NO: 1420375 - DNA, 20 bp, Homo sapiens
caggagtcttcagacccaga

SEQ ID NO: 1420376 - DNA, 22 bp, Homo sapiens
caggagtcttcagacccagaga

SEQ ID NO: 1420377 - DNA, 16 bp, Homo sapiens
caggagtgccaggacc

SEQ ID NO: 1420378 - DNA, 20 bp, Homo sapiens
caggagtgccaggaccagcc

SEQ ID NO: 1420379 - DNA, 22 bp, Homo sapiens
caggagtgccaggaccagcctg

SEQ ID NO: 1420380 - DNA, 22 bp, Homo sapiens
caggagtgggaaaacactgcca

SEQ ID NO: 1420381 - DNA, 17 bp, Homo sapiens
caggagtgtcctcttcc

SEQ ID NO: 1420382 - DNA, 20 bp, Homo sapiens
cagcttgggcccagctgggc

SEQ ID NO: 1420383 - DNA, 22 bp, Homo sapiens
cagcttggggccaccaaagctg

SEQ ID NO: 1420384 - DNA, 14 bp, Homo sapiens
cagctttagccaag

SEQ ID NO: 1420385 - DNA, 22 bp, Homo sapiens
cagctttcctcaaaaagcagaa

SEQ ID NO: 1420386 - DNA, 15 bp, Homo sapiens
cagctttctgggatg

SEQ ID NO: 1420387 - DNA, 16 bp, Homo sapiens
cagctttctgggatgt

SEQ ID NO: 1420388 - DNA, 19 bp, Homo sapiens
cagctttgagaagccttca

SEQ ID NO: 1420389 - DNA, 20 bp, Homo sapiens
cagctttgagaagccttcag

SEQ ID NO: 1420390 - DNA, 20 bp, Homo sapiens
cagctttgatccctgacatc

SEQ ID NO: 1420391 - DNA, 12 bp, Homo sapiens
cagctttgcaaa

SEQ ID NO: 1420392 - DNA, 22 bp, Homo sapiens
cagctttgctaccaaagcacct

SEQ ID NO: 1420393 - DNA, 21 bp, Homo sapiens
cagcttttctcaactgggtcc

SEQ ID NO: 1420394 - DNA, 15 bp, Homo sapiens
cagcttttctgtccc

SEQ ID NO: 1420395 - DNA, 14 bp, Homo sapiens
cagcttttggtctc

SEQ ID NO: 1420396 - DNA, 14 bp, Homo sapiens
cagcttttgttcta

SEQ ID NO: 1420397 - DNA, 17 bp, Homo sapiens
cagcttttgttctagac

SEQ ID NO: 1420398 - DNA, 18 bp, Homo sapiens
cagcttttgttctagact

SEQ ID NO: 1420399 - DNA, 19 bp, Homo sapiens
cagcttttgttctagactt

SEQ ID NO: 1420400 - DNA, 18 bp, Homo sapiens
cagcttttgttgtttata

SEQ ID NO: 1420401 - DNA, 23 bp, Homo sapiens
caggaaaaaaaattctgttgttc

SEQ ID NO: 1420402 - DNA, 19 bp, Homo sapiens
caggaaaaaataaaaagag

SEQ ID NO: 1420403 - DNA, 17 bp, Homo sapiens
caggaaaaatgaggaat

SEQ ID NO: 1420404 - DNA, 19 bp, Homo sapiens
caggaaaaatgaggaatcc

SEQ ID NO: 1420405 - DNA, 22 bp, Homo sapiens
caggaaaacaaatcactgtatt

SEQ ID NO: 1420406 - DNA, 22 bp, Homo sapiens
caggaaacaaggggtctgagga

SEQ ID NO: 1420407 - DNA, 22 bp, Homo sapiens
caggaaactccacatctgcctt

SEQ ID NO: 1420408 - DNA, 13 bp, Homo sapiens
caggaaatatata

SEQ ID NO: 1420409 - DNA, 16 bp, Homo sapiens
caggaaatatatatgt

SEQ ID NO: 1420410 - DNA, 23 bp, Homo sapiens
caggaaatatatatgtgtgtgta

SEQ ID NO: 1420411 - DNA, 21 bp, Homo sapiens
caggaaatcaaatatgcaaag

SEQ ID NO: 1420412 - DNA, 23 bp, Homo sapiens
caggaaatcaaatatgcaaagca

SEQ ID NO: 1420413 - DNA, 15 bp, Homo sapiens
caggaacaaacaggg

SEQ ID NO: 1420414 - DNA, 18 bp, Homo sapiens
caggaacagaaggatgaa

SEQ ID NO: 1420415 - DNA, 22 bp, Homo sapiens
caggaacgagcactggccagag

SEQ ID NO: 1420416 - DNA, 12 bp, Homo sapiens
caggaactgggc

SEQ ID NO: 1420417 - DNA, 12 bp, Homo sapiens
caggaagaaact

SEQ ID NO: 1420418 - DNA, 14 bp, Homo sapiens
caggaagaaacttt

SEQ ID NO: 1420419 - DNA, 16 bp, Homo sapiens
caggaagaaacttttt

SEQ ID NO: 1420420 - DNA, 20 bp, Homo sapiens
caggaagaaacttttttatt

SEQ ID NO: 1420421 - DNA, 21 bp, Homo sapiens
caggaagaaacttttttattt

SEQ ID NO: 1420422 - DNA, 22 bp, Homo sapiens
caggaagaaacttttttatttt

SEQ ID NO: 1420423 - DNA, 14 bp, Homo sapiens
caggaagaaatcac

SEQ ID NO: 1420424 - DNA, 14 bp, Homo sapiens
caggaagagctatg

SEQ ID NO: 1420425 - DNA, 13 bp, Homo sapiens
caggaagaggccc

SEQ ID NO: 1420426 - DNA, 16 bp, Homo sapiens
caggaagcaccccatg

SEQ ID NO: 1420427 - DNA, 12 bp, Homo sapiens
caggaagccagg

SEQ ID NO: 1420428 - DNA, 15 bp, Homo sapiens
caggaagccaggctg

SEQ ID NO: 1420429 - DNA, 18 bp, Homo sapiens
caggaagccaggctgagt

SEQ ID NO: 1420430 - DNA, 16 bp, Homo sapiens
caggaagcccaattgc

SEQ ID NO: 1420431 - DNA, 18 bp, Homo sapiens
caggaagcccaattgctg

SEQ ID NO: 1420432 - DNA, 15 bp, Homo sapiens
caggaagccgtcctg

SEQ ID NO: 1420433 - DNA, 13 bp, Homo sapiens
caggaagcctgca

SEQ ID NO: 1420434 - DNA, 19 bp, Homo sapiens
caggaagcctgcagtcctg

SEQ ID NO: 1420435 - DNA, 15 bp, Homo sapiens
caggaagcctgtggt

SEQ ID NO: 1420436 - DNA, 13 bp, Homo sapiens
caggaagctctct

SEQ ID NO: 1420437 - DNA, 20 bp, Homo sapiens
caggaagctggcagaacgga

SEQ ID NO: 1420438 - DNA, 13 bp, Homo sapiens
caggaaggagagc

SEQ ID NO: 1420439 - DNA, 16 bp, Homo sapiens
caggaaggagagcctg

SEQ ID NO: 1420440 - DNA, 17 bp, Homo sapiens
caggaaggagagcctgc

SEQ ID NO: 1420441 - DNA, 14 bp, Homo sapiens
caggaaggcagctg

SEQ ID NO: 1420442 - DNA, 14 bp, Homo sapiens
caggaaggcaggag

SEQ ID NO: 1420443 - DNA, 22 bp, Homo sapiens
caggaaggccaaaatcaagagt

SEQ ID NO: 1420444 - DNA, 19 bp, Homo sapiens
caggaagtacttccacctc

SEQ ID NO: 1420445 - DNA, 10 bp, Homo sapiens
caggaagtga

SEQ ID NO: 1420446 - DNA, 12 bp, Homo sapiens
caggaataaggc

SEQ ID NO: 1420447 - DNA, 22 bp, Homo sapiens
caggaatatcccaaacttcgga

SEQ ID NO: 1420448 - DNA, 14 bp, Homo sapiens
caggaatatgacac

SEQ ID NO: 1420449 - DNA, 19 bp, Homo sapiens
caggaatattgtcatcctt

SEQ ID NO: 1420450 - DNA, 15 bp, Homo sapiens
caggaatccttactg

SEQ ID NO: 1420451 - DNA, 14 bp, Homo sapiens
caggaatctcagag

SEQ ID NO: 1420452 - DNA, 20 bp, Homo sapiens
caggaatgaagccttagcca

SEQ ID NO: 1420453 - DNA, 22 bp, Homo sapiens
caggaatggggggcgggccagg

SEQ ID NO: 1420454 - DNA, 23 bp, Homo sapiens
caggaatggggggcgggccaggg

SEQ ID NO: 1420455 - DNA, 17 bp, Homo sapiens
caggaatgtgtggcaga

SEQ ID NO: 1420456 - DNA, 16 bp, Homo sapiens
caggaatgtgtggcct

SEQ ID NO: 1420457 - DNA, 19 bp, Homo sapiens
caggaatgtgtggcctgca

SEQ ID NO: 1420458 - DNA, 19 bp, Homo sapiens
caggaatgttaaagtcagt

SEQ ID NO: 1420459 - DNA, 13 bp, Homo sapiens
caggaattagaga

SEQ ID NO: 1420460 - DNA, 22 bp, Homo sapiens
caggaattagagaagctgaaag

SEQ ID NO: 1420461 - DNA, 19 bp, Homo sapiens
caggaattcagtgccttca

SEQ ID NO: 1420462 - DNA, 17 bp, Homo sapiens
caggaatttcccaggac

SEQ ID NO: 1420463 - DNA, 22 bp, Homo sapiens
caggacacatcccggcctcttc

SEQ ID NO: 1420464 - DNA, 18 bp, Homo sapiens
caggacactaccctgaga

SEQ ID NO: 1420465 - DNA, 12 bp, Homo sapiens
caggacagctct

SEQ ID NO: 1420466 - DNA, 13 bp, Homo sapiens
caggacaggaggc

SEQ ID NO: 1420467 - DNA, 16 bp, Homo sapiens
caggacagtgcttcag

SEQ ID NO: 1420468 - DNA, 23 bp, Homo sapiens
caggacattaataaagttgcttt

SEQ ID NO: 1420469 - DNA, 13 bp, Homo sapiens
caggaccaagcca

SEQ ID NO: 1420470 - DNA, 16 bp, Homo sapiens
caggaccacaaaaatg

SEQ ID NO: 1420471 - DNA, 13 bp, Homo sapiens
caggaccagctca

SEQ ID NO: 1420472 - DNA, 13 bp, Homo sapiens
caggaccagctgg

SEQ ID NO: 1420473 - DNA, 14 bp, Homo sapiens
caggaccagctggg

SEQ ID NO: 1420474 - DNA, 15 bp, Homo sapiens
caggaccagctgggg

SEQ ID NO: 1420475 - DNA, 16 bp, Homo sapiens
caggaccagctggggc

SEQ ID NO: 1420476 - DNA, 18 bp, Homo sapiens
caggacccaggccctcca

SEQ ID NO: 1420477 - DNA, 24 bp, Homo sapiens
caggacccaggccctccatgggct

SEQ ID NO: 1420478 - DNA, 21 bp, Homo sapiens
caggacccatcacgcctgtgc

SEQ ID NO: 1420479 - DNA, 15 bp, Homo sapiens
caggacccgccagcc

SEQ ID NO: 1420480 - DNA, 15 bp, Homo sapiens
caggaccctcaggaa

SEQ ID NO: 1420481 - DNA, 13 bp, Homo sapiens
caggaccctgaag

SEQ ID NO: 1420482 - DNA, 15 bp, Homo sapiens
caggaccctgaaggg

SEQ ID NO: 1420483 - DNA, 17 bp, Homo sapiens
caggaccctgaaggggc

SEQ ID NO: 1420484 - DNA, 21 bp, Homo sapiens
caggaccttcgggctgtgccc

SEQ ID NO: 1420485 - DNA, 18 bp, Homo sapiens
caggacgggccacacgtg

SEQ ID NO: 1420486 - DNA, 20 bp, Homo sapiens
caggactatatttgggcctg

SEQ ID NO: 1420487 - DNA, 16 bp, Homo sapiens
caggactccaggccca

SEQ ID NO: 1420488 - DNA, 18 bp, Homo sapiens
caggactccaggcccaag

SEQ ID NO: 1420489 - DNA, 16 bp, Homo sapiens
caggactccctcctca

SEQ ID NO: 1420490 - DNA, 20 bp, Homo sapiens
caggactgaattgtccccag

SEQ ID NO: 1420491 - DNA, 21 bp, Homo sapiens
caggactgagtcccctccagg

SEQ ID NO: 1420492 - DNA, 16 bp, Homo sapiens
caggactgggtctgac

SEQ ID NO: 1420493 - DNA, 21 bp, Homo sapiens
caggacttaacggctccagga

SEQ ID NO: 1420494 - DNA, 11 bp, Homo sapiens
caggagaacca

SEQ ID NO: 1420495 - DNA, 15 bp, Homo sapiens
caggagaagaacaag

SEQ ID NO: 1420496 - DNA, 14 bp, Homo sapiens
caggagaagagagg

SEQ ID NO: 1420497 - DNA, 16 bp, Homo sapiens
caggagaagctcagct

SEQ ID NO: 1420498 - DNA, 15 bp, Homo sapiens
caggagaagggctgg

SEQ ID NO: 1420499 - DNA, 15 bp, Homo sapiens
cagaggcttcttcag

SEQ ID NO: 1420500 - DNA, 17 bp, Homo sapiens
cagagggaatgttccct

SEQ ID NO: 1420501 - DNA, 20 bp, Homo sapiens
cagagggaatgttccctgca

SEQ ID NO: 1420502 - DNA, 23 bp, Homo sapiens
cagagggaatgttccctgcaccc

SEQ ID NO: 1420503 - DNA, 14 bp, Homo sapiens
cagagggacagggt

SEQ ID NO: 1420504 - DNA, 20 bp, Homo sapiens
cagagggagtttaatacagg

SEQ ID NO: 1420505 - DNA, 24 bp, Homo sapiens
cagagggcacatgaacagcttgcc

SEQ ID NO: 1420506 - DNA, 18 bp, Homo sapiens
cagagggcagaggctgga

SEQ ID NO: 1420507 - DNA, 15 bp, Homo sapiens
cagagggcaggggtg

SEQ ID NO: 1420508 - DNA, 16 bp, Homo sapiens
cagagggccagcaggc

SEQ ID NO: 1420509 - DNA, 13 bp, Homo sapiens
cagagggcccagg

SEQ ID NO: 1420510 - DNA, 16 bp, Homo sapiens
cagagggcccaggcag

SEQ ID NO: 1420511 - DNA, 13 bp, Homo sapiens
cagagggctgatg

SEQ ID NO: 1420512 - DNA, 20 bp, Homo sapiens
cagagggctggaggcccagg

SEQ ID NO: 1420513 - DNA, 17 bp, Homo sapiens
cagaggggactctgacc

SEQ ID NO: 1420514 - DNA, 21 bp, Homo sapiens
cagaggggtcacgtgtaggag

SEQ ID NO: 1420515 - DNA, 16 bp, Homo sapiens
cagagggtgtcaaaca

SEQ ID NO: 1420516 - DNA, 13 bp, Homo sapiens
cagaggtaccctg

SEQ ID NO: 1420517 - DNA, 17 bp, Homo sapiens
cagaggtaccctgggtg

SEQ ID NO: 1420518 - DNA, 23 bp, Homo sapiens
cagaggtattaaaactaaatttc

SEQ ID NO: 1420519 - DNA, 17 bp, Homo sapiens
cagaggtcgcagctacc

SEQ ID NO: 1420520 - DNA, 22 bp, Homo sapiens
cagaggtggagccaagtggtcc

SEQ ID NO: 1420521 - DNA, 20 bp, Homo sapiens
cagaggtggatgttatgaac

SEQ ID NO: 1420522 - DNA, 23 bp, Homo sapiens
cagaggtggatgttatgaacagc

SEQ ID NO: 1420523 - DNA, 20 bp, Homo sapiens
cagaggtgggatcctccctc

SEQ ID NO: 1420524 - DNA, 12 bp, Homo sapiens
cagaggtgggca

SEQ ID NO: 1420525 - DNA, 17 bp, Homo sapiens
cagaggtgggcaggtgg

SEQ ID NO: 1420526 - DNA, 23 bp, Homo sapiens
cagaggtgggcaggtggtggcac

SEQ ID NO: 1420527 - DNA, 20 bp, Homo sapiens
cagaggtgtcatccacaggc

SEQ ID NO: 1420528 - DNA, 21 bp, Homo sapiens
cagaggttgcagtgagctgag

SEQ ID NO: 1420529 - DNA, 17 bp, Homo sapiens
cagaggttgcagtgtgg

SEQ ID NO: 1420530 - DNA, 21 bp, Homo sapiens
cagagtatgaacacctgggct

SEQ ID NO: 1420531 - DNA, 20 bp, Homo sapiens
cagagtatgtccgatggtat

SEQ ID NO: 1420532 - DNA, 20 bp, Homo sapiens
cagagtatttgaaaaatgta

SEQ ID NO: 1420533 - DNA, 18 bp, Homo sapiens
cagagtcaaggcctgctc

SEQ ID NO: 1420534 - DNA, 15 bp, Homo sapiens
cagagtcctttccaa

SEQ ID NO: 1420535 - DNA, 15 bp, Homo sapiens
cagagtctgagcccc

SEQ ID NO: 1420536 - DNA, 14 bp, Homo sapiens
cagagtctggctct

SEQ ID NO: 1420537 - DNA, 20 bp, Homo sapiens
cagagtcttcactaaccttt

SEQ ID NO: 1420538 - DNA, 23 bp, Homo sapiens
cagagtcttgctctgttgcccaa

SEQ ID NO: 1420539 - DNA, 20 bp, Homo sapiens
cagagtgaaagggctatggc

SEQ ID NO: 1420540 - DNA, 11 bp, Homo sapiens
cagagtgaacc

SEQ ID NO: 1420541 - DNA, 16 bp, Homo sapiens
cagagtgacagtcata

SEQ ID NO: 1420542 - DNA, 18 bp, Homo sapiens
cagagtgagaccctgtct

SEQ ID NO: 1420543 - DNA, 15 bp, Homo sapiens
cagagtgagccagtg

SEQ ID NO: 1420544 - DNA, 17 bp, Homo sapiens
cagagtgaggatgtgtt

SEQ ID NO: 1420545 - DNA, 22 bp, Homo sapiens
cagagtgaggatgtgttttgca

SEQ ID NO: 1420546 - DNA, 17 bp, Homo sapiens
cagagtgcacagctgtc

SEQ ID NO: 1420547 - DNA, 15 bp, Homo sapiens
cagagtgccactgcg

SEQ ID NO: 1420548 - DNA, 13 bp, Homo sapiens
cagagtgcccaga

SEQ ID NO: 1420549 - DNA, 15 bp, Homo sapiens
cagagtgcccagaac

SEQ ID NO: 1420550 - DNA, 18 bp, Homo sapiens
cagagtggactcttccct

SEQ ID NO: 1420551 - DNA, 15 bp, Homo sapiens
cagagtggactgcat

SEQ ID NO: 1420552 - DNA, 19 bp, Homo sapiens
cagagtggagttgaaactg

SEQ ID NO: 1420553 - DNA, 17 bp, Homo sapiens
cagagtggcctccctgc

SEQ ID NO: 1420554 - DNA, 19 bp, Homo sapiens
cagagtggcctccctgctg

SEQ ID NO: 1420555 - DNA, 23 bp, Homo sapiens
cagagtggcctccctgctgtgcc

SEQ ID NO: 1420556 - DNA, 12 bp, Homo sapiens
cagagtggcctg

SEQ ID NO: 1420557 - DNA, 15 bp, Homo sapiens
cagagtggcctggcc

SEQ ID NO: 1420558 - DNA, 21 bp, Homo sapiens
cagagtggcctggccaggagc

SEQ ID NO: 1420559 - DNA, 23 bp, Homo sapiens
cagagtggcctggccaggagctc

SEQ ID NO: 1420560 - DNA, 12 bp, Homo sapiens
cagagtggctgc

SEQ ID NO: 1420561 - DNA, 19 bp, Homo sapiens
cagagtgggtcttggacca

SEQ ID NO: 1420562 - DNA, 22 bp, Homo sapiens
cagagtgggtcttggaccaggg

SEQ ID NO: 1420563 - DNA, 20 bp, Homo sapiens
cagagtggtcgagtgacaca

SEQ ID NO: 1420564 - DNA, 19 bp, Homo sapiens
cagagtgtgggaagggaga

SEQ ID NO: 1420565 - DNA, 14 bp, Homo sapiens
cagagttaaaatgt

SEQ ID NO: 1420566 - DNA, 21 bp, Homo sapiens
cagagttaaaatgtttactgt

SEQ ID NO: 1420567 - DNA, 15 bp, Homo sapiens
cagagttacagttct

SEQ ID NO: 1420568 - DNA, 21 bp, Homo sapiens
cagagttattgaatcttaatt

SEQ ID NO: 1420569 - DNA, 14 bp, Homo sapiens
cagagttcactata

SEQ ID NO: 1420570 - DNA, 19 bp, Homo sapiens
cagagttctgtgaagagga

SEQ ID NO: 1420571 - DNA, 22 bp, Homo sapiens
cagagttctgtgaagaggaaca

SEQ ID NO: 1420572 - DNA, 20 bp, Homo sapiens
cagagttgctgcaaacctga

SEQ ID NO: 1420573 - DNA, 16 bp, Homo sapiens
cagagtttacattcta

SEQ ID NO: 1420574 - DNA, 22 bp, Homo sapiens
cagagtttgtgtgttgtcttga

SEQ ID NO: 1420575 - DNA, 17 bp, Homo sapiens
cagagttttcattaaat

SEQ ID NO: 1420576 - DNA, 22 bp, Homo sapiens
cagagttttcattaaatccttt

SEQ ID NO: 1420577 - DNA, 20 bp, Homo sapiens
cagagtttttaaagccttct

SEQ ID NO: 1420578 - DNA, 22 bp, Homo sapiens
cagagtttttaaagccttctgg

SEQ ID NO: 1420579 - DNA, 18 bp, Homo sapiens
cagataactctctttcct

SEQ ID NO: 1420580 - DNA, 21 bp, Homo sapiens
cagataagaatgctggttttc

SEQ ID NO: 1420581 - DNA, 22 bp, Homo sapiens
cagataagcaagagagatgttt

SEQ ID NO: 1420582 - DNA, 19 bp, Homo sapiens
cagataagttggagcaggg

SEQ ID NO: 1420583 - DNA, 23 bp, Homo sapiens
cagataagttggagcaggggttg

SEQ ID NO: 1420584 - DNA, 17 bp, Homo sapiens
cagataattcatttgta

SEQ ID NO: 1420585 - DNA, 19 bp, Homo sapiens
cagataattcatttgtatt

SEQ ID NO: 1420586 - DNA, 20 bp, Homo sapiens
cagataattcatttgtattg

SEQ ID NO: 1420587 - DNA, 17 bp, Homo sapiens
cagatacaatgtattta

SEQ ID NO: 1420588 - DNA, 16 bp, Homo sapiens
cagatacataggtctg

SEQ ID NO: 1420589 - DNA, 22 bp, Homo sapiens
cagataccttatcttacaatat

SEQ ID NO: 1420590 - DNA, 21 bp, Homo sapiens
cagatacgggggctgtgactc

SEQ ID NO: 1420591 - DNA, 14 bp, Homo sapiens
cagatagaaagcat

SEQ ID NO: 1420592 - DNA, 16 bp, Homo sapiens
cagatagaaagcatta

SEQ ID NO: 1420593 - DNA, 19 bp, Homo sapiens
cagatagatatatgctctg

SEQ ID NO: 1420594 - DNA, 20 bp, Homo sapiens
cagatagtgtagctgaggag

SEQ ID NO: 1420595 - DNA, 16 bp, Homo sapiens
cagatataactgtctt

SEQ ID NO: 1420596 - DNA, 18 bp, Homo sapiens
cagatataactgtcttgt

SEQ ID NO: 1420597 - DNA, 22 bp, Homo sapiens
cagatataactgtcttgtttca

SEQ ID NO: 1420598 - DNA, 13 bp, Homo sapiens
cagatatattttt

SEQ ID NO: 1420599 - DNA, 23 bp, Homo sapiens
cagagcaattccaggctgagcca

SEQ ID NO: 1420600 - DNA, 16 bp, Homo sapiens
cagagcacagaggtag

SEQ ID NO: 1420601 - DNA, 13 bp, Homo sapiens
cagagcaccccct

SEQ ID NO: 1420602 - DNA, 20 bp, Homo sapiens
cagagcaccccctgctccac

SEQ ID NO: 1420603 - DNA, 16 bp, Homo sapiens
cagagcacgcctgcca

SEQ ID NO: 1420604 - DNA, 21 bp, Homo sapiens
cagagcagagcaaatgaggga

SEQ ID NO: 1420605 - DNA, 23 bp, Homo sapiens
cagagcagctaactccgagagca

SEQ ID NO: 1420606 - DNA, 16 bp, Homo sapiens
cagagcaggagcccct

SEQ ID NO: 1420607 - DNA, 17 bp, Homo sapiens
cagagcaggagcccctg

SEQ ID NO: 1420608 - DNA, 19 bp, Homo sapiens
cagagcaggaggcccctgg

SEQ ID NO: 1420609 - DNA, 23 bp, Homo sapiens
cagagcaggaggcccctggccca

SEQ ID NO: 1420610 - DNA, 21 bp, Homo sapiens
cagagcatttccaacaccaca

SEQ ID NO: 1420611 - DNA, 14 bp, Homo sapiens
cagagccaacctgg

SEQ ID NO: 1420612 - DNA, 20 bp, Homo sapiens
cagagccaacctggacttcc

SEQ ID NO: 1420613 - DNA, 15 bp, Homo sapiens
cagagccaagcactg

SEQ ID NO: 1420614 - DNA, 22 bp, Homo sapiens
cagagccacccctaaagagata

SEQ ID NO: 1420615 - DNA, 16 bp, Homo sapiens
cagagccactctatga

SEQ ID NO: 1420616 - DNA, 22 bp, Homo sapiens
cagagccactctatgagttgga

SEQ ID NO: 1420617 - DNA, 13 bp, Homo sapiens
cagagccagatgc

SEQ ID NO: 1420618 - DNA, 12 bp, Homo sapiens
cagagccagcct

SEQ ID NO: 1420619 - DNA, 23 bp, Homo sapiens
cagagccagcctggctctgcccc

SEQ ID NO: 1420620 - DNA, 18 bp, Homo sapiens
cagagccagcctgggact

SEQ ID NO: 1420621 - DNA, 23 bp, Homo sapiens
cagagccagcctgggactcccag

SEQ ID NO: 1420622 - DNA, 11 bp, Homo sapiens
cagagccagtg

SEQ ID NO: 1420623 - DNA, 14 bp, Homo sapiens
cagagccagtgaag

SEQ ID NO: 1420624 - DNA, 17 bp, Homo sapiens
cagagccagtgaaggag

SEQ ID NO: 1420625 - DNA, 13 bp, Homo sapiens
cagagccatgggc

SEQ ID NO: 1420626 - DNA, 19 bp, Homo sapiens
cagagccattcccttggaa

SEQ ID NO: 1420627 - DNA, 16 bp, Homo sapiens
cagagcccagctcttg

SEQ ID NO: 1420628 - DNA, 15 bp, Homo sapiens
cagagcccatgctca

SEQ ID NO: 1420629 - DNA, 16 bp, Homo sapiens
cagagcccctacagca

SEQ ID NO: 1420630 - DNA, 21 bp, Homo sapiens
cagagcccctacagcattgtt

SEQ ID NO: 1420631 - DNA, 19 bp, Homo sapiens
cagagcccggtgggtccgc

SEQ ID NO: 1420632 - DNA, 13 bp, Homo sapiens
cagagccctccag

SEQ ID NO: 1420633 - DNA, 15 bp, Homo sapiens
cagagccctccaggc

SEQ ID NO: 1420634 - DNA, 18 bp, Homo sapiens
cagagccctccaggcctg

SEQ ID NO: 1420635 - DNA, 15 bp, Homo sapiens
cagagcccttcactg

SEQ ID NO: 1420636 - DNA, 17 bp, Homo sapiens
cagagcccttcactgcc

SEQ ID NO: 1420637 - DNA, 20 bp, Homo sapiens
cagagcccttcactgccatg

SEQ ID NO: 1420638 - DNA, 21 bp, Homo sapiens
cagagcccttcactgccatga

SEQ ID NO: 1420639 - DNA, 12 bp, Homo sapiens
cagagccgccac

SEQ ID NO: 1420640 - DNA, 22 bp, Homo sapiens
cagagccgggaggaaaaggccc

SEQ ID NO: 1420641 - DNA, 23 bp, Homo sapiens
cagagccgggaggaaaaggcccc

SEQ ID NO: 1420642 - DNA, 13 bp, Homo sapiens
cagagcctagcca

SEQ ID NO: 1420643 - DNA, 16 bp, Homo sapiens
cagagcctagccacct

SEQ ID NO: 1420644 - DNA, 23 bp, Homo sapiens
cagagcctagccacctcccaccc

SEQ ID NO: 1420645 - DNA, 17 bp, Homo sapiens
cagagcctgtctttcag

SEQ ID NO: 1420646 - DNA, 20 bp, Homo sapiens
cagagccttcaagtgccaaa

SEQ ID NO: 1420647 - DNA, 21 bp, Homo sapiens
cagagccttcaagtgccaaac

SEQ ID NO: 1420648 - DNA, 21 bp, Homo sapiens
cagagccttctcagaagcaca

SEQ ID NO: 1420649 - DNA, 13 bp, Homo sapiens
cagagccttgaga

SEQ ID NO: 1420650 - DNA, 18 bp, Homo sapiens
cagagcgagactccatct

SEQ ID NO: 1420651 - DNA, 19 bp, Homo sapiens
cagagcggggtcccctctg

SEQ ID NO: 1420652 - DNA, 21 bp, Homo sapiens
cagagcggggtcccctctgtg

SEQ ID NO: 1420653 - DNA, 22 bp, Homo sapiens
cagagcggggtcccctctgtgc

SEQ ID NO: 1420654 - DNA, 20 bp, Homo sapiens
cagagctactgagacttgga

SEQ ID NO: 1420655 - DNA, 21 bp, Homo sapiens
cagagctactgagacttggaa

SEQ ID NO: 1420656 - DNA, 13 bp, Homo sapiens
cagagctaggccc

SEQ ID NO: 1420657 - DNA, 23 bp, Homo sapiens
cagagctcatcccccctgctgcc

SEQ ID NO: 1420658 - DNA, 18 bp, Homo sapiens
cagagctctcccctcctg

SEQ ID NO: 1420659 - DNA, 22 bp, Homo sapiens
cagagctctcccctcctgctgg

SEQ ID NO: 1420660 - DNA, 18 bp, Homo sapiens
cagagctctctctacaga

SEQ ID NO: 1420661 - DNA, 18 bp, Homo sapiens
cagagctcttcaagctgt

SEQ ID NO: 1420662 - DNA, 12 bp, Homo sapiens
cagagctgaccc

SEQ ID NO: 1420663 - DNA, 18 bp, Homo sapiens
cagagctggaaggcaggg

SEQ ID NO: 1420664 - DNA, 19 bp, Homo sapiens
cagagctggaaggcagggc

SEQ ID NO: 1420665 - DNA, 18 bp, Homo sapiens
cagagctggctctgagcg

SEQ ID NO: 1420666 - DNA, 14 bp, Homo sapiens
cagagctgtgccag

SEQ ID NO: 1420667 - DNA, 15 bp, Homo sapiens
cagagctgtgccagc

SEQ ID NO: 1420668 - DNA, 13 bp, Homo sapiens
cagagctgtgcct

SEQ ID NO: 1420669 - DNA, 12 bp, Homo sapiens
cagagctgtgga

SEQ ID NO: 1420670 - DNA, 15 bp, Homo sapiens
cagagctgtggagga

SEQ ID NO: 1420671 - DNA, 18 bp, Homo sapiens
cagagcttattggccact

SEQ ID NO: 1420672 - DNA, 19 bp, Homo sapiens
cagagcttattggccactg

SEQ ID NO: 1420673 - DNA, 20 bp, Homo sapiens
cagagcttattggccactgg

SEQ ID NO: 1420674 - DNA, 16 bp, Homo sapiens
cagagcttctctgggc

SEQ ID NO: 1420675 - DNA, 17 bp, Homo sapiens
cagagcttctctgggct

SEQ ID NO: 1420676 - DNA, 13 bp, Homo sapiens
cagagctttttgg

SEQ ID NO: 1420677 - DNA, 20 bp, Homo sapiens
cagaggaaaaatgggagcca

SEQ ID NO: 1420678 - DNA, 14 bp, Homo sapiens
cagaggaaagacag

SEQ ID NO: 1420679 - DNA, 15 bp, Homo sapiens
cagaggaagagcagg

SEQ ID NO: 1420680 - DNA, 14 bp, Homo sapiens
cagaggaagcccct

SEQ ID NO: 1420681 - DNA, 19 bp, Homo sapiens
cagaggaatgtagggcctg

SEQ ID NO: 1420682 - DNA, 21 bp, Homo sapiens
cagaggacagtctggagaagg

SEQ ID NO: 1420683 - DNA, 15 bp, Homo sapiens
cagaggaccacagtg

SEQ ID NO: 1420684 - DNA, 21 bp, Homo sapiens
cagaggaccacagtgggtggc

SEQ ID NO: 1420685 - DNA, 12 bp, Homo sapiens
cagaggaccctt

SEQ ID NO: 1420686 - DNA, 16 bp, Homo sapiens
cagaggagagacggtg

SEQ ID NO: 1420687 - DNA, 20 bp, Homo sapiens
cagaggagagtcccagagca

SEQ ID NO: 1420688 - DNA, 16 bp, Homo sapiens
cagaggagcagctctc

SEQ ID NO: 1420689 - DNA, 20 bp, Homo sapiens
cagaggagccaccagttctc

SEQ ID NO: 1420690 - DNA, 21 bp, Homo sapiens
cagaggagctgggagccgggc

SEQ ID NO: 1420691 - DNA, 14 bp, Homo sapiens
cagaggagggcagc

SEQ ID NO: 1420692 - DNA, 22 bp, Homo sapiens
cagaggatgctctttcccagga

SEQ ID NO: 1420693 - DNA, 14 bp, Homo sapiens
cagaggcaataggt

SEQ ID NO: 1420694 - DNA, 19 bp, Homo sapiens
cagaggcagaggttgcagt

SEQ ID NO: 1420695 - DNA, 13 bp, Homo sapiens
cagaggccccagc

SEQ ID NO: 1420696 - DNA, 16 bp, Homo sapiens
cagaggccccagcctc

SEQ ID NO: 1420697 - DNA, 17 bp, Homo sapiens
cagaggcccccagccca

SEQ ID NO: 1420698 - DNA, 19 bp, Homo sapiens
cagaggcccccagcccagg

SEQ ID NO: 1420699 - DNA, 19 bp, Homo sapiens
cagaggccgaaggtgcctc

SEQ ID NO: 1420700 - DNA, 17 bp, Homo sapiens
cagaggccggggtccag

SEQ ID NO: 1420701 - DNA, 18 bp, Homo sapiens
cagaggccggggtccagg

SEQ ID NO: 1420702 - DNA, 22 bp, Homo sapiens
cagaggccggggtccaggcccg

SEQ ID NO: 1420703 - DNA, 22 bp, Homo sapiens
cagaggcctcccccagccagga

SEQ ID NO: 1420704 - DNA, 17 bp, Homo sapiens
cagaggcctgctgccag

SEQ ID NO: 1420705 - DNA, 20 bp, Homo sapiens
cagactcagagctctctcta

SEQ ID NO: 1420706 - DNA, 23 bp, Homo sapiens
cagactcagagctctctctacag

SEQ ID NO: 1420707 - DNA, 15 bp, Homo sapiens
cagactcaggttcca

SEQ ID NO: 1420708 - DNA, 16 bp, Homo sapiens
cagactcaggttccag

SEQ ID NO: 1420709 - DNA, 17 bp, Homo sapiens
cagactcagtttgtcag

SEQ ID NO: 1420710 - DNA, 22 bp, Homo sapiens
cagactccaatggggccagcac

SEQ ID NO: 1420711 - DNA, 19 bp, Homo sapiens
cagactccatctcttctgc

SEQ ID NO: 1420712 - DNA, 20 bp, Homo sapiens
cagactccatctcttctgca

SEQ ID NO: 1420713 - DNA, 17 bp, Homo sapiens
cagactcccattcctga

SEQ ID NO: 1420714 - DNA, 18 bp, Homo sapiens
cagactcccattcctgaa

SEQ ID NO: 1420715 - DNA, 20 bp, Homo sapiens
cagactcccattcctgaaga

SEQ ID NO: 1420716 - DNA, 14 bp, Homo sapiens
cagactccgccctc

SEQ ID NO: 1420717 - DNA, 16 bp, Homo sapiens
cagactccgccctcct

SEQ ID NO: 1420718 - DNA, 18 bp, Homo sapiens
cagactccgccctcctcg

SEQ ID NO: 1420719 - DNA, 14 bp, Homo sapiens
cagactcctcagat

SEQ ID NO: 1420720 - DNA, 15 bp, Homo sapiens
cagactgaccccaga

SEQ ID NO: 1420721 - DNA, 16 bp, Homo sapiens
cagactgagctctcca

SEQ ID NO: 1420722 - DNA, 18 bp, Homo sapiens
cagactgagctctccagg

SEQ ID NO: 1420723 - DNA, 20 bp, Homo sapiens
cagactgagctctccaggcc

SEQ ID NO: 1420724 - DNA, 22 bp, Homo sapiens
cagactgagctctccaggccag

SEQ ID NO: 1420725 - DNA, 14 bp, Homo sapiens
cagactgcttccaa

SEQ ID NO: 1420726 - DNA, 21 bp, Homo sapiens
cagactggaagacacttcaga

SEQ ID NO: 1420727 - DNA, 18 bp, Homo sapiens
cagactggcacagttttc

SEQ ID NO: 1420728 - DNA, 23 bp, Homo sapiens
cagactggcacagttttctgaga

SEQ ID NO: 1420729 - DNA, 16 bp, Homo sapiens
cagactggctggctgc

SEQ ID NO: 1420730 - DNA, 17 bp, Homo sapiens
cagactgggcccaggca

SEQ ID NO: 1420731 - DNA, 18 bp, Homo sapiens
cagactgggcccaggcag

SEQ ID NO: 1420732 - DNA, 19 bp, Homo sapiens
cagactgggcccaggcagg

SEQ ID NO: 1420733 - DNA, 22 bp, Homo sapiens
cagactgggcccaggcaggtct

SEQ ID NO: 1420734 - DNA, 24 bp, Homo sapiens
cagactgggcccaggcaggtctgc

SEQ ID NO: 1420735 - DNA, 14 bp, Homo sapiens
cagactggggcatc

SEQ ID NO: 1420736 - DNA, 18 bp, Homo sapiens
cagactgggtttctagcc

SEQ ID NO: 1420737 - DNA, 20 bp, Homo sapiens
cagactgggtttctagccca

SEQ ID NO: 1420738 - DNA, 17 bp, Homo sapiens
cagactgtctccacggc

SEQ ID NO: 1420739 - DNA, 16 bp, Homo sapiens
cagactgttaattata

SEQ ID NO: 1420740 - DNA, 20 bp, Homo sapiens
cagactgttttactgtttta

SEQ ID NO: 1420741 - DNA, 23 bp, Homo sapiens
cagactgttttactgttttaatt

SEQ ID NO: 1420742 - DNA, 14 bp, Homo sapiens
cagacttcacactg

SEQ ID NO: 1420743 - DNA, 16 bp, Homo sapiens
cagacttcacagcgtc

SEQ ID NO: 1420744 - DNA, 21 bp, Homo sapiens
cagacttcacagcgtctgctc

SEQ ID NO: 1420745 - DNA, 22 bp, Homo sapiens
cagacttcacagcgtctgctca

SEQ ID NO: 1420746 - DNA, 14 bp, Homo sapiens
cagacttcccagct

SEQ ID NO: 1420747 - DNA, 15 bp, Homo sapiens
cagacttcccagcta

SEQ ID NO: 1420748 - DNA, 13 bp, Homo sapiens
cagacttctccag

SEQ ID NO: 1420749 - DNA, 20 bp, Homo sapiens
cagacttctccagacccacc

SEQ ID NO: 1420750 - DNA, 14 bp, Homo sapiens
cagacttctggaag

SEQ ID NO: 1420751 - DNA, 15 bp, Homo sapiens
cagacttctggaagg

SEQ ID NO: 1420752 - DNA, 21 bp, Homo sapiens
cagacttcttaaaaggagctc

SEQ ID NO: 1420753 - DNA, 17 bp, Homo sapiens
cagacttgcactgaagc

SEQ ID NO: 1420754 - DNA, 14 bp, Homo sapiens
cagacttggctcag

SEQ ID NO: 1420755 - DNA, 20 bp, Homo sapiens
cagactttgtgttcatttca

SEQ ID NO: 1420756 - DNA, 21 bp, Homo sapiens
cagactttgtgttcatttcat

SEQ ID NO: 1420757 - DNA, 22 bp, Homo sapiens
cagactttgtgttcatttcatt

SEQ ID NO: 1420758 - DNA, 18 bp, Homo sapiens
cagagaaaaatgctcccc

SEQ ID NO: 1420759 - DNA, 20 bp, Homo sapiens
cagagaaatctaagctgtgt

SEQ ID NO: 1420760 - DNA, 19 bp, Homo sapiens
cagagaagataatgttctt

SEQ ID NO: 1420761 - DNA, 13 bp, Homo sapiens
cagagaagctcct

SEQ ID NO: 1420762 - DNA, 16 bp, Homo sapiens
cagagaagctcctgct

SEQ ID NO: 1420763 - DNA, 20 bp, Homo sapiens
cagagaaggacggtgccaag

SEQ ID NO: 1420764 - DNA, 23 bp, Homo sapiens
cagagaaggacggtgccaagggc

SEQ ID NO: 1420765 - DNA, 15 bp, Homo sapiens
cagagaaggcagcag

SEQ ID NO: 1420766 - DNA, 13 bp, Homo sapiens
cagagaaggcagg

SEQ ID NO: 1420767 - DNA, 14 bp, Homo sapiens
cagagaaggcctct

SEQ ID NO: 1420768 - DNA, 15 bp, Homo sapiens
cagagaaggcctctt

SEQ ID NO: 1420769 - DNA, 12 bp, Homo sapiens
cagagaaggcta

SEQ ID NO: 1420770 - DNA, 16 bp, Homo sapiens
cagagaaggctatgta

SEQ ID NO: 1420771 - DNA, 21 bp, Homo sapiens
cagagaatggctgggtcaggg

SEQ ID NO: 1420772 - DNA, 15 bp, Homo sapiens
cagagaatttctacc

SEQ ID NO: 1420773 - DNA, 16 bp, Homo sapiens
cagagaatttctacca

SEQ ID NO: 1420774 - DNA, 20 bp, Homo sapiens
cagagacaaaatatttccca

SEQ ID NO: 1420775 - DNA, 22 bp, Homo sapiens
cagagacaacaggtaaaacagg

SEQ ID NO: 1420776 - DNA, 22 bp, Homo sapiens
cagagacaagaaaggcagacac

SEQ ID NO: 1420777 - DNA, 15 bp, Homo sapiens
cagagacacctgcac

SEQ ID NO: 1420778 - DNA, 20 bp, Homo sapiens
cagagacacctgcacctccc

SEQ ID NO: 1420779 - DNA, 15 bp, Homo sapiens
cagagacactttgtc

SEQ ID NO: 1420780 - DNA, 18 bp, Homo sapiens
cagagacaggtggcctag

SEQ ID NO: 1420781 - DNA, 21 bp, Homo sapiens
cagagacaggtggcctagcag

SEQ ID NO: 1420782 - DNA, 16 bp, Homo sapiens
cagagacatacttgaa

SEQ ID NO: 1420783 - DNA, 20 bp, Homo sapiens
cagagacatacttgaagggc

SEQ ID NO: 1420784 - DNA, 21 bp, Homo sapiens
cagagacatgggcctcccact

SEQ ID NO: 1420785 - DNA, 14 bp, Homo sapiens
cagagaccacacca

SEQ ID NO: 1420786 - DNA, 16 bp, Homo sapiens
cagagaccagcactca

SEQ ID NO: 1420787 - DNA, 15 bp, Homo sapiens
cagagaccaggctgt

SEQ ID NO: 1420788 - DNA, 13 bp, Homo sapiens
cagagaccagggc

SEQ ID NO: 1420789 - DNA, 15 bp, Homo sapiens
cagagaccagggctc

SEQ ID NO: 1420790 - DNA, 14 bp, Homo sapiens
cagagaccattgca

SEQ ID NO: 1420791 - DNA, 15 bp, Homo sapiens
cagagacgcaggaat

SEQ ID NO: 1420792 - DNA, 18 bp, Homo sapiens
cagagacgcaggaatgga

SEQ ID NO: 1420793 - DNA, 22 bp, Homo sapiens
cagagactcagggccccagcac

SEQ ID NO: 1420794 - DNA, 16 bp, Homo sapiens
cagagagaatgagagc

SEQ ID NO: 1420795 - DNA, 19 bp, Homo sapiens
cagagagaatgagagcgac

SEQ ID NO: 1420796 - DNA, 22 bp, Homo sapiens
cagagagaatgagagcgacaca

SEQ ID NO: 1420797 - DNA, 17 bp, Homo sapiens
cagagagacctcatcct

SEQ ID NO: 1420798 - DNA, 23 bp, Homo sapiens
cagagagacctcatcctgctctt

SEQ ID NO: 1420799 - DNA, 18 bp, Homo sapiens
cagagagaggggcctgca

SEQ ID NO: 1420800 - DNA, 12 bp, Homo sapiens
cagagagagtgt

SEQ ID NO: 1420801 - DNA, 21 bp, Homo sapiens
cagagaggaaattctccactg

SEQ ID NO: 1420802 - DNA, 15 bp, Homo sapiens
cagagaggaatcaga

SEQ ID NO: 1420803 - DNA, 19 bp, Homo sapiens
cagagaggatacatttaat

SEQ ID NO: 1420804 - DNA, 21 bp, Homo sapiens
cagagagggaactagggcacc

SEQ ID NO: 1420805 - DNA, 17 bp, Homo sapiens
cagagagggcccagctg

SEQ ID NO: 1420806 - DNA, 20 bp, Homo sapiens
cagagagggcccagctgtag

SEQ ID NO: 1420807 - DNA, 21 bp, Homo sapiens
cagagaggtctcaggttcttt

SEQ ID NO: 1420808 - DNA, 23 bp, Homo sapiens
cagagaggtggagaactgggatt

SEQ ID NO: 1420809 - DNA, 13 bp, Homo sapiens
cagagagtggctc

SEQ ID NO: 1420810 - DNA, 23 bp, Homo sapiens
cagagatccaaaagaagccccca

SEQ ID NO: 1420811 - DNA, 19 bp, Homo sapiens
cagagatgcctccaccgct

SEQ ID NO: 1420812 - DNA, 13 bp, Homo sapiens
cagagattctgga

SEQ ID NO: 1420813 - DNA, 19 bp, Homo sapiens
cagagatttctcattgact

SEQ ID NO: 1420814 - DNA, 24 bp, Homo sapiens
cagagcaaaagacttgagccatcc

SEQ ID NO: 1420815 - DNA, 21 bp, Homo sapiens
cagacaaaaacagcctcacag

SEQ ID NO: 1420816 - DNA, 17 bp, Homo sapiens
cagacaaagccctgtcc

SEQ ID NO: 1420817 - DNA, 18 bp, Homo sapiens
cagacaaagccctgtcct

SEQ ID NO: 1420818 - DNA, 16 bp, Homo sapiens
cagacaacagaagtca

SEQ ID NO: 1420819 - DNA, 22 bp, Homo sapiens
cagacaacattatgatctaata

SEQ ID NO: 1420820 - DNA, 15 bp, Homo sapiens
cagacaagagctgct

SEQ ID NO: 1420821 - DNA, 21 bp, Homo sapiens
cagacaagagctgctgtcctt

SEQ ID NO: 1420822 - DNA, 13 bp, Homo sapiens
cagacaagcacta

SEQ ID NO: 1420823 - DNA, 15 bp, Homo sapiens
cagacaagcactatt

SEQ ID NO: 1420824 - DNA, 15 bp, Homo sapiens
cagacaagcagccct

SEQ ID NO: 1420825 - DNA, 20 bp, Homo sapiens
cagacaatagtatagaagtc

SEQ ID NO: 1420826 - DNA, 14 bp, Homo sapiens
cagacacacacacg

SEQ ID NO: 1420827 - DNA, 18 bp, Homo sapiens
cagacacacacacgcacg

SEQ ID NO: 1420828 - DNA, 16 bp, Homo sapiens
cagacacaccgcggcc

SEQ ID NO: 1420829 - DNA, 18 bp, Homo sapiens
cagacacaggccctccct

SEQ ID NO: 1420830 - DNA, 13 bp, Homo sapiens
cagacacatgcta

SEQ ID NO: 1420831 - DNA, 12 bp, Homo sapiens
cagacaccatgt

SEQ ID NO: 1420832 - DNA, 14 bp, Homo sapiens
cagacacccaggac

SEQ ID NO: 1420833 - DNA, 15 bp, Homo sapiens
cagacacccaggact

SEQ ID NO: 1420834 - DNA, 14 bp, Homo sapiens
cagacaccctcaac

SEQ ID NO: 1420835 - DNA, 21 bp, Homo sapiens
cagacaccctcaacctcttct

SEQ ID NO: 1420836 - DNA, 18 bp, Homo sapiens
cagacaccctctccttaa

SEQ ID NO: 1420837 - DNA, 18 bp, Homo sapiens
cagacaccttggacatcc

SEQ ID NO: 1420838 - DNA, 18 bp, Homo sapiens
cagacacgccttcccctc

SEQ ID NO: 1420839 - DNA, 23 bp, Homo sapiens
cagacacgctcgcgggcagcggg

SEQ ID NO: 1420840 - DNA, 12 bp, Homo sapiens
cagacactaagt

SEQ ID NO: 1420841 - DNA, 16 bp, Homo sapiens
cagacactctgctctg

SEQ ID NO: 1420842 - DNA, 21 bp, Homo sapiens
cagacactgaccatccactct

SEQ ID NO: 1420843 - DNA, 20 bp, Homo sapiens
cagacagaacttgaatgtgt

SEQ ID NO: 1420844 - DNA, 23 bp, Homo sapiens
cagacagaacttgaatgtgtcag

SEQ ID NO: 1420845 - DNA, 13 bp, Homo sapiens
cagacagagccag

SEQ ID NO: 1420846 - DNA, 15 bp, Homo sapiens
cagacagagccagga

SEQ ID NO: 1420847 - DNA, 16 bp, Homo sapiens
cagacagagccaggag

SEQ ID NO: 1420848 - DNA, 18 bp, Homo sapiens
cagacagagccaggagaa

SEQ ID NO: 1420849 - DNA, 23 bp, Homo sapiens
cagacagagccaggagaagctca

SEQ ID NO: 1420850 - DNA, 13 bp, Homo sapiens
cagacagagggga

SEQ ID NO: 1420851 - DNA, 15 bp, Homo sapiens
cagacagcagctcag

SEQ ID NO: 1420852 - DNA, 18 bp, Homo sapiens
cagacagcagctcaggca

SEQ ID NO: 1420853 - DNA, 20 bp, Homo sapiens
cagacagccatgcgtggcca

SEQ ID NO: 1420854 - DNA, 11 bp, Homo sapiens
cagacagctcc

SEQ ID NO: 1420855 - DNA, 19 bp, Homo sapiens
cagacagcttgactgcttt

SEQ ID NO: 1420856 - DNA, 13 bp, Homo sapiens
cagacaggagaaa

SEQ ID NO: 1420857 - DNA, 14 bp, Homo sapiens
cagacaggctctta

SEQ ID NO: 1420858 - DNA, 15 bp, Homo sapiens
cagacagggtctgaa

SEQ ID NO: 1420859 - DNA, 20 bp, Homo sapiens
cagacagggtctgaaggact

SEQ ID NO: 1420860 - DNA, 20 bp, Homo sapiens
cagacagtctgttatgcact

SEQ ID NO: 1420861 - DNA, 23 bp, Homo sapiens
cagacagtctgttatgcactgtg

SEQ ID NO: 1420862 - DNA, 19 bp, Homo sapiens
cagacagtgttttctggga

SEQ ID NO: 1420863 - DNA, 21 bp, Homo sapiens
cagacatacagctgcctacct

SEQ ID NO: 1420864 - DNA, 17 bp, Homo sapiens
cagacatacgaaacaca

SEQ ID NO: 1420865 - DNA, 18 bp, Homo sapiens
cagacatacgaaacacaa

SEQ ID NO: 1420866 - DNA, 18 bp, Homo sapiens
cagacatatgggatattc

SEQ ID NO: 1420867 - DNA, 18 bp, Homo sapiens
cagacatgccacaaggac

SEQ ID NO: 1420868 - DNA, 18 bp, Homo sapiens
cagacatgtggtgggaca

SEQ ID NO: 1420869 - DNA, 16 bp, Homo sapiens
cagacattcaatgaat

SEQ ID NO: 1420870 - DNA, 18 bp, Homo sapiens
cagacattttgtgtgaga

SEQ ID NO: 1420871 - DNA, 13 bp, Homo sapiens
cagaccacagcag

SEQ ID NO: 1420872 - DNA, 13 bp, Homo sapiens
cagaccaccccgc

SEQ ID NO: 1420873 - DNA, 15 bp, Homo sapiens
cagaccaccccgcct

SEQ ID NO: 1420874 - DNA, 19 bp, Homo sapiens
cagaccaccccgcctgccc

SEQ ID NO: 1420875 - DNA, 17 bp, Homo sapiens
cagaccacctgcttctg

SEQ ID NO: 1420876 - DNA, 23 bp, Homo sapiens
cagaccacgcccgtcctgcctgt

SEQ ID NO: 1420877 - DNA, 13 bp, Homo sapiens
cagaccactgtct

SEQ ID NO: 1420878 - DNA, 19 bp, Homo sapiens
cagaccacttgccacgctg

SEQ ID NO: 1420879 - DNA, 16 bp, Homo sapiens
cagaccagagctgtct

SEQ ID NO: 1420880 - DNA, 17 bp, Homo sapiens
cagaccagagctgtctg

SEQ ID NO: 1420881 - DNA, 18 bp, Homo sapiens
cagaccagagctgtctga

SEQ ID NO: 1420882 - DNA, 13 bp, Homo sapiens
cagaccaggaaag

SEQ ID NO: 1420883 - DNA, 16 bp, Homo sapiens
cagaccaggaaaggct

SEQ ID NO: 1420884 - DNA, 14 bp, Homo sapiens
cagaccatgaagta

SEQ ID NO: 1420885 - DNA, 13 bp, Homo sapiens
cagacccagagaa

SEQ ID NO: 1420886 - DNA, 16 bp, Homo sapiens
cagacccagagaagga

SEQ ID NO: 1420887 - DNA, 15 bp, Homo sapiens
cagaccccagcggct

SEQ ID NO: 1420888 - DNA, 14 bp, Homo sapiens
cagacccccactct

SEQ ID NO: 1420889 - DNA, 16 bp, Homo sapiens
cagacccccactctca

SEQ ID NO: 1420890 - DNA, 13 bp, Homo sapiens
cagaccccgcccc

SEQ ID NO: 1420891 - DNA, 20 bp, Homo sapiens
cagaccccgcccctggggaa

SEQ ID NO: 1420892 - DNA, 21 bp, Homo sapiens
cagacccctctggccaggatg

SEQ ID NO: 1420893 - DNA, 14 bp, Homo sapiens
cagacccctggctt

SEQ ID NO: 1420894 - DNA, 15 bp, Homo sapiens
cagacccctggcttt

SEQ ID NO: 1420895 - DNA, 21 bp, Homo sapiens
cagacccctggcttttcactg

SEQ ID NO: 1420896 - DNA, 23 bp, Homo sapiens
cagacccctggcttttcactgct

SEQ ID NO: 1420897 - DNA, 13 bp, Homo sapiens
cagaccccttggc

SEQ ID NO: 1420898 - DNA, 15 bp, Homo sapiens
cagaccccttggcca

SEQ ID NO: 1420899 - DNA, 15 bp, Homo sapiens
cagaccctgcctgag

SEQ ID NO: 1420900 - DNA, 19 bp, Homo sapiens
cagaccctgcctgagccca

SEQ ID NO: 1420901 - DNA, 18 bp, Homo sapiens
cagaccctggaggcccca

SEQ ID NO: 1420902 - DNA, 13 bp, Homo sapiens
cagaccctgggca

SEQ ID NO: 1420903 - DNA, 22 bp, Homo sapiens
cagacctaggatttcatgattt

SEQ ID NO: 1420904 - DNA, 22 bp, Homo sapiens
cagacctgaatgcttctgagag

SEQ ID NO: 1420905 - DNA, 21 bp, Homo sapiens
cagacctgacaccgtccctca

SEQ ID NO: 1420906 - DNA, 14 bp, Homo sapiens
cagacctgatcctg

SEQ ID NO: 1420907 - DNA, 17 bp, Homo sapiens
cagacctgatcctggag

SEQ ID NO: 1420908 - DNA, 16 bp, Homo sapiens
cagacctggagcccct

SEQ ID NO: 1420909 - DNA, 21 bp, Homo sapiens
cagacctggagcccctgggtg

SEQ ID NO: 1420910 - DNA, 23 bp, Homo sapiens
cagacctggagcccctgggtggg

SEQ ID NO: 1420911 - DNA, 16 bp, Homo sapiens
cagacctggctctcag

SEQ ID NO: 1420912 - DNA, 20 bp, Homo sapiens
cagacctggctctcagagga

SEQ ID NO: 1420913 - DNA, 14 bp, Homo sapiens
cagacgcagcagct

SEQ ID NO: 1420914 - DNA, 17 bp, Homo sapiens
cagacgcagcagctggg

SEQ ID NO: 1420915 - DNA, 20 bp, Homo sapiens
cagacgcatagactgaggta

SEQ ID NO: 1420916 - DNA, 15 bp, Homo sapiens
cagacgccttactgg

SEQ ID NO: 1420917 - DNA, 17 bp, Homo sapiens
cagacgctgctgtcaca

SEQ ID NO: 1420918 - DNA, 12 bp, Homo sapiens
cagacggcggcc

SEQ ID NO: 1420919 - DNA, 15 bp, Homo sapiens
cagacggcggccagg

SEQ ID NO: 1420920 - DNA, 18 bp, Homo sapiens
cagacggcggccaggcac

SEQ ID NO: 1420921 - DNA, 19 bp, Homo sapiens
cagacggcggccaggcaca

SEQ ID NO: 1420922 - DNA, 15 bp, Homo sapiens
cagacgggcacagac

SEQ ID NO: 1420923 - DNA, 14 bp, Homo sapiens
cagacgtctgcctt

SEQ ID NO: 1420924 - DNA, 19 bp, Homo sapiens
cagacgttaggcatttcct

SEQ ID NO: 1420925 - DNA, 19 bp, Homo sapiens
cagactaaaaatacaccgt

SEQ ID NO: 1420926 - DNA, 22 bp, Homo sapiens
cagactagatggacctgcctgc

SEQ ID NO: 1420927 - DNA, 14 bp, Homo sapiens
cagactagatgtag

SEQ ID NO: 1420928 - DNA, 19 bp, Homo sapiens
cagactagatgtagtattt

SEQ ID NO: 1420929 - DNA, 21 bp, Homo sapiens
cagactagatgtagtattttt

SEQ ID NO: 1420930 - DNA, 23 bp, Homo sapiens
cactccacttgaagcacttaagt

SEQ ID NO: 1420931 - DNA, 17 bp, Homo sapiens
cactccagacccctggc

SEQ ID NO: 1420932 - DNA, 11 bp, Homo sapiens
cactccagcct

SEQ ID NO: 1420933 - DNA, 12 bp, Homo sapiens
cactccagcctg

SEQ ID NO: 1420934 - DNA, 21 bp, Homo sapiens
cactccagcctgggcgacaga

SEQ ID NO: 1420935 - DNA, 14 bp, Homo sapiens
cactccagtcaaca

SEQ ID NO: 1420936 - DNA, 17 bp, Homo sapiens
cactccagtgctcagct

SEQ ID NO: 1420937 - DNA, 14 bp, Homo sapiens
cactccatggccac

SEQ ID NO: 1420938 - DNA, 23 bp, Homo sapiens
cactcccaagggacagcaagtga

SEQ ID NO: 1420939 - DNA, 12 bp, Homo sapiens
cactcccaccac

SEQ ID NO: 1420940 - DNA, 22 bp, Homo sapiens
cactcccacctgacacaccagg

SEQ ID NO: 1420941 - DNA, 23 bp, Homo sapiens
cactcccacctgacacaccaggc

SEQ ID NO: 1420942 - DNA, 18 bp, Homo sapiens
cactcccacctgcatctg

SEQ ID NO: 1420943 - DNA, 17 bp, Homo sapiens
cactcccatctgattta

SEQ ID NO: 1420944 - DNA, 14 bp, Homo sapiens
cactccccaccttc

SEQ ID NO: 1420945 - DNA, 12 bp, Homo sapiens
cactccccaggg

SEQ ID NO: 1420946 - DNA, 13 bp, Homo sapiens
cactccccaggga

SEQ ID NO: 1420947 - DNA, 19 bp, Homo sapiens
cactccccagggagctctg

SEQ ID NO: 1420948 - DNA, 22 bp, Homo sapiens
cactccccagggagctctgggg

SEQ ID NO: 1420949 - DNA, 15 bp, Homo sapiens
cactcccccacctga

SEQ ID NO: 1420950 - DNA, 14 bp, Homo sapiens
cactcccctagggg

SEQ ID NO: 1420951 - DNA, 13 bp, Homo sapiens
cactcccctgcac

SEQ ID NO: 1420952 - DNA, 13 bp, Homo sapiens
cactcccggccta

SEQ ID NO: 1420953 - DNA, 23 bp, Homo sapiens
cacttagcccaagaggtctgagc

SEQ ID NO: 1420954 - DNA, 19 bp, Homo sapiens
cacttagccgtccatggca

SEQ ID NO: 1420955 - DNA, 17 bp, Homo sapiens
cacttagggatatatat

SEQ ID NO: 1420956 - DNA, 13 bp, Homo sapiens
cacttagtatgca

SEQ ID NO: 1420957 - DNA, 16 bp, Homo sapiens
cacttagtatgcagtt

SEQ ID NO: 1420958 - DNA, 14 bp, Homo sapiens
cacttatattttat

SEQ ID NO: 1420959 - DNA, 18 bp, Homo sapiens
cacttatattttatgaac

SEQ ID NO: 1420960 - DNA, 20 bp, Homo sapiens
cacttatattttatgaacat

SEQ ID NO: 1420961 - DNA, 18 bp, Homo sapiens
cacttatcttctggatta

SEQ ID NO: 1420962 - DNA, 23 bp, Homo sapiens
cacttatgttactggtgtccagc

SEQ ID NO: 1420963 - DNA, 22 bp, Homo sapiens
cacttattatgaggctattaaa

SEQ ID NO: 1420964 - DNA, 20 bp, Homo sapiens
cacttattccccattcttcc

SEQ ID NO: 1420965 - DNA, 15 bp, Homo sapiens
cacttattgtcccct

SEQ ID NO: 1420966 - DNA, 14 bp, Homo sapiens
cacttatttcataa

SEQ ID NO: 1420967 - DNA, 18 bp, Homo sapiens
cacttattttctgaattc

SEQ ID NO: 1420968 - DNA, 14 bp, Homo sapiens
cacttcaaagctaa

SEQ ID NO: 1420969 - DNA, 20 bp, Homo sapiens
cacttcaacccccagctaat

SEQ ID NO: 1420970 - DNA, 21 bp, Homo sapiens
cacttcaagtgaccaccagga

SEQ ID NO: 1420971 - DNA, 15 bp, Homo sapiens
cacttcacccccaac

SEQ ID NO: 1420972 - DNA, 16 bp, Homo sapiens
cacttcacccccaact

SEQ ID NO: 1420973 - DNA, 18 bp, Homo sapiens
cacttcacccccaacttc

SEQ ID NO: 1420974 - DNA, 14 bp, Homo sapiens
cacttcactgtgag

SEQ ID NO: 1420975 - DNA, 16 bp, Homo sapiens
cacttcagatctgagg

SEQ ID NO: 1420976 - DNA, 16 bp, Homo sapiens
cacttcaggctcttct

SEQ ID NO: 1420977 - DNA, 22 bp, Homo sapiens
cacttcattgagagttttgtct

SEQ ID NO: 1420978 - DNA, 19 bp, Homo sapiens
cacttcattgtaaatcact

SEQ ID NO: 1420979 - DNA, 13 bp, Homo sapiens
cacttcattgttt

SEQ ID NO: 1420980 - DNA, 14 bp, Homo sapiens
cacttccaccagcc

SEQ ID NO: 1420981 - DNA, 19 bp, Homo sapiens
cacttccaccagcctgcac

SEQ ID NO: 1420982 - DNA, 20 bp, Homo sapiens
cacttccaccagcctgcact

SEQ ID NO: 1420983 - DNA, 14 bp, Homo sapiens
cacttccaggggaa

SEQ ID NO: 1420984 - DNA, 14 bp, Homo sapiens
cacttcccaccctg

SEQ ID NO: 1420985 - DNA, 13 bp, Homo sapiens
cacttcccaggat

SEQ ID NO: 1420986 - DNA, 19 bp, Homo sapiens
cacttcccgtagctgccag

SEQ ID NO: 1420987 - DNA, 18 bp, Homo sapiens
cacttcccgtctcagaat

SEQ ID NO: 1420988 - DNA, 17 bp, Homo sapiens
cacttcccgtttcctct

SEQ ID NO: 1420989 - DNA, 16 bp, Homo sapiens
cacttccctctgtttc

SEQ ID NO: 1420990 - DNA, 18 bp, Homo sapiens
cacttccctctgtttctc

SEQ ID NO: 1420991 - DNA, 23 bp, Homo sapiens
cacttcctacaagagcagcctgt

SEQ ID NO: 1420992 - DNA, 21 bp, Homo sapiens
cacttcctctcgcggccctca

SEQ ID NO: 1420993 - DNA, 15 bp, Homo sapiens
cacttccttttaact

SEQ ID NO: 1420994 - DNA, 22 bp, Homo sapiens
cacttctaataactgcagtgtt

SEQ ID NO: 1420995 - DNA, 17 bp, Homo sapiens
cacttctagatctcagc

SEQ ID NO: 1420996 - DNA, 19 bp, Homo sapiens
cacttctcatcatattgta

SEQ ID NO: 1420997 - DNA, 13 bp, Homo sapiens
cacttctccaaga

SEQ ID NO: 1420998 - DNA, 14 bp, Homo sapiens
cacttctccatgct

SEQ ID NO: 1420999 - DNA, 16 bp, Homo sapiens
cacttctccccagaaa

SEQ ID NO: 1421000 - DNA, 13 bp, Homo sapiens
cacttctccccgc

SEQ ID NO: 1421001 - DNA, 19 bp, Homo sapiens
cacttctccccgcagcccg

SEQ ID NO: 1421002 - DNA, 23 bp, Homo sapiens
cacttctccccgcagcccgcctg

SEQ ID NO: 1421003 - DNA, 21 bp, Homo sapiens
cacttctggtataattgtgta

SEQ ID NO: 1421004 - DNA, 14 bp, Homo sapiens
cacttctgtctcct

SEQ ID NO: 1421005 - DNA, 21 bp, Homo sapiens
cacttctgtgagacccccaca

SEQ ID NO: 1421006 - DNA, 18 bp, Homo sapiens
cacttcttaaaggcctgg

SEQ ID NO: 1421007 - DNA, 19 bp, Homo sapiens
cacttcttaaaggcctgga

SEQ ID NO: 1421008 - DNA, 21 bp, Homo sapiens
cacttcttaaaggcctggaac

SEQ ID NO: 1421009 - DNA, 15 bp, Homo sapiens
cacttgaaagatttt

SEQ ID NO: 1421010 - DNA, 15 bp, Homo sapiens
cacttgacattcctt

SEQ ID NO: 1421011 - DNA, 18 bp, Homo sapiens
cacttgaggccaggagtt

SEQ ID NO: 1421012 - DNA, 15 bp, Homo sapiens
cacttgaggcctgat

SEQ ID NO: 1421013 - DNA, 18 bp, Homo sapiens
cacttgaggtcaggagtt

SEQ ID NO: 1421014 - DNA, 23 bp, Homo sapiens
cacttgatgatacaatgaacact

SEQ ID NO: 1421015 - DNA, 14 bp, Homo sapiens
cacttgatgtttcc

SEQ ID NO: 1421016 - DNA, 17 bp, Homo sapiens
cacttgatgtttcctgg

SEQ ID NO: 1421017 - DNA, 21 bp, Homo sapiens
cacttgatgtttcctggaagc

SEQ ID NO: 1421018 - DNA, 13 bp, Homo sapiens
cacttgccatgca

SEQ ID NO: 1421019 - DNA, 15 bp, Homo sapiens
cacttgccatgcagg

SEQ ID NO: 1421020 - DNA, 20 bp, Homo sapiens
cacttgccattccaaaatat

SEQ ID NO: 1421021 - DNA, 12 bp, Homo sapiens
cacttgcctctt

SEQ ID NO: 1421022 - DNA, 13 bp, Homo sapiens
cacttgcctcttc

SEQ ID NO: 1421023 - DNA, 21 bp, Homo sapiens
cacttgcctcttccttgaaga

SEQ ID NO: 1421024 - DNA, 19 bp, Homo sapiens
cacttgcctgttggctgct

SEQ ID NO: 1421025 - DNA, 20 bp, Homo sapiens
cacttgcctgttggctgctg

SEQ ID NO: 1421026 - DNA, 22 bp, Homo sapiens
cacttgcctgttggctgctgcg

SEQ ID NO: 1421027 - DNA, 23 bp, Homo sapiens
cacttgcgtcctgcagaggacca

SEQ ID NO: 1421028 - DNA, 12 bp, Homo sapiens
cacttggagcca

SEQ ID NO: 1421029 - DNA, 14 bp, Homo sapiens
cacttggcagcgcg

SEQ ID NO: 1421030 - DNA, 17 bp, Homo sapiens
cacttggcatacaaaat

SEQ ID NO: 1421031 - DNA, 21 bp, Homo sapiens
cacttggcatacaaaatattt

SEQ ID NO: 1421032 - DNA, 14 bp, Homo sapiens
cacttggctgtctg

SEQ ID NO: 1421033 - DNA, 20 bp, Homo sapiens
cacttggtcctacctattat

SEQ ID NO: 1421034 - DNA, 17 bp, Homo sapiens
cacttggttagacgcct

SEQ ID NO: 1421035 - DNA, 10 bp, Homo sapiens
cacttgtatt

SEQ ID NO: 1421036 - DNA, 16 bp, Homo sapiens
cacttgtattgacttt

SEQ ID NO: 1421037 - DNA, 17 bp, Homo sapiens
cacttgtcaaagaaggt

SEQ ID NO: 1421038 - DNA, 13 bp, Homo sapiens
cacttgtgacttt

SEQ ID NO: 1421039 - DNA, 20 bp, Homo sapiens
cacttgtgacttttgcttta

SEQ ID NO: 1421040 - DNA, 22 bp, Homo sapiens
cacttgtgcaccctctatccca

SEQ ID NO: 1421041 - DNA, 15 bp, Homo sapiens
cacttgtgtgtgggc

SEQ ID NO: 1421042 - DNA, 19 bp, Homo sapiens
cacttgtgtgtgggctgtg

SEQ ID NO: 1421043 - DNA, 15 bp, Homo sapiens
cacttgttccagctc

SEQ ID NO: 1421044 - DNA, 13 bp, Homo sapiens
cacttgtttgcac

SEQ ID NO: 1421045 - DNA, 13 bp, Homo sapiens
cactttaaacctg

SEQ ID NO: 1421046 - DNA, 20 bp, Homo sapiens
cactttataagtcattgtat

SEQ ID NO: 1421047 - DNA, 22 bp, Homo sapiens
cactttataagtcattgtatgt

SEQ ID NO: 1421048 - DNA, 21 bp, Homo sapiens
cactttatgccggatgtgctt

SEQ ID NO: 1421049 - DNA, 23 bp, Homo sapiens
cactttattgccttttaattttt

SEQ ID NO: 1421050 - DNA, 14 bp, Homo sapiens
cactttcaagctgc

SEQ ID NO: 1421051 - DNA, 18 bp, Homo sapiens
cactttcaagctgcactg

SEQ ID NO: 1421052 - DNA, 19 bp, Homo sapiens
cactttcaagctgcactga

SEQ ID NO: 1421053 - DNA, 23 bp, Homo sapiens
cactttcagagcccccagccctg

SEQ ID NO: 1421054 - DNA, 24 bp, Homo sapiens
cactttcagagcccccagccctgg

SEQ ID NO: 1421055 - DNA, 11 bp, Homo sapiens
cagaagaaaga

SEQ ID NO: 1421056 - DNA, 18 bp, Homo sapiens
cagaagaaagatggaaat

SEQ ID NO: 1421057 - DNA, 16 bp, Homo sapiens
cagaagaaagggtgga

SEQ ID NO: 1421058 - DNA, 15 bp, Homo sapiens
cagaagaaccctggc

SEQ ID NO: 1421059 - DNA, 14 bp, Homo sapiens
cagaagaagagaag

SEQ ID NO: 1421060 - DNA, 18 bp, Homo sapiens
cagaagaatattcaggac

SEQ ID NO: 1421061 - DNA, 18 bp, Homo sapiens
cagaagacaaaaagacaa

SEQ ID NO: 1421062 - DNA, 16 bp, Homo sapiens
cagaagacccctgact

SEQ ID NO: 1421063 - DNA, 21 bp, Homo sapiens
cagaagactagaggccagggc

SEQ ID NO: 1421064 - DNA, 18 bp, Homo sapiens
cagaagacttcccagctt

SEQ ID NO: 1421065 - DNA, 22 bp, Homo sapiens
cagaagagaaaggactcagtgt

SEQ ID NO: 1421066 - DNA, 22 bp, Homo sapiens
cagaagagaattcagtattttt

SEQ ID NO: 1421067 - DNA, 20 bp, Homo sapiens
cagaagagagtggggcctgc

SEQ ID NO: 1421068 - DNA, 22 bp, Homo sapiens
cagaagataacttgagcaccgt

SEQ ID NO: 1421069 - DNA, 16 bp, Homo sapiens
cagaagatgccagctt

SEQ ID NO: 1421070 - DNA, 20 bp, Homo sapiens
cagaagatgccagcttctct

SEQ ID NO: 1421071 - DNA, 14 bp, Homo sapiens
cagaagatgtgaaa

SEQ ID NO: 1421072 - DNA, 13 bp, Homo sapiens
cagaagcaaacaa

SEQ ID NO: 1421073 - DNA, 11 bp, Homo sapiens
cagaagcagag

SEQ ID NO: 1421074 - DNA, 13 bp, Homo sapiens
cagaagcatattt

SEQ ID NO: 1421075 - DNA, 19 bp, Homo sapiens
cagaagcatattttgctgg

SEQ ID NO: 1421076 - DNA, 15 bp, Homo sapiens
cagaagcattgcctg

SEQ ID NO: 1421077 - DNA, 23 bp, Homo sapiens
cagaagccctgatgtgtcctcag

SEQ ID NO: 1421078 - DNA, 22 bp, Homo sapiens
cagaagcctccaagcctgcctc

SEQ ID NO: 1421079 - DNA, 15 bp, Homo sapiens
cagaagcctgaggct

SEQ ID NO: 1421080 - DNA, 16 bp, Homo sapiens
cagaagctgtactttt

SEQ ID NO: 1421081 - DNA, 14 bp, Homo sapiens
cagaaggaaagaag

SEQ ID NO: 1421082 - DNA, 17 bp, Homo sapiens
cagaaggaaagaagggg

SEQ ID NO: 1421083 - DNA, 19 bp, Homo sapiens
cagaaggaataagcattcc

SEQ ID NO: 1421084 - DNA, 12 bp, Homo sapiens
cagaaggactgg

SEQ ID NO: 1421085 - DNA, 13 bp, Homo sapiens
cagaaggactggt

SEQ ID NO: 1421086 - DNA, 15 bp, Homo sapiens
cagaaggactggtgc

SEQ ID NO: 1421087 - DNA, 14 bp, Homo sapiens
cagaaggagaagga

SEQ ID NO: 1421088 - DNA, 15 bp, Homo sapiens
cagaaggagggcaga

SEQ ID NO: 1421089 - DNA, 22 bp, Homo sapiens
cagaaggagggcagagccatgg

SEQ ID NO: 1421090 - DNA, 18 bp, Homo sapiens
cagaaggccaagaggctg

SEQ ID NO: 1421091 - DNA, 16 bp, Homo sapiens
cagaaggccagccgcc

SEQ ID NO: 1421092 - DNA, 15 bp, Homo sapiens
cagaagggaattgct

SEQ ID NO: 1421093 - DNA, 14 bp, Homo sapiens
cagaagggggtggt

SEQ ID NO: 1421094 - DNA, 19 bp, Homo sapiens
cagaaggtaggggccgtgt

SEQ ID NO: 1421095 - DNA, 15 bp, Homo sapiens
cagaaggtattcctt

SEQ ID NO: 1421096 - DNA, 23 bp, Homo sapiens
cagaaggttggtggggggtccag

SEQ ID NO: 1421097 - DNA, 14 bp, Homo sapiens
cagaagtcatcttg

SEQ ID NO: 1421098 - DNA, 16 bp, Homo sapiens
cagaagtcatcttgct

SEQ ID NO: 1421099 - DNA, 17 bp, Homo sapiens
cagaagtcatcttgcta

SEQ ID NO: 1421100 - DNA, 16 bp, Homo sapiens
cagaagtcatgaagcc

SEQ ID NO: 1421101 - DNA, 17 bp, Homo sapiens
cagaagtcatgaagccc

SEQ ID NO: 1421102 - DNA, 19 bp, Homo sapiens
cagaagtcatgaagcccaa

SEQ ID NO: 1421103 - DNA, 23 bp, Homo sapiens
cagaagtcctccctcctgcaggc

SEQ ID NO: 1421104 - DNA, 24 bp, Homo sapiens
cagaagtcctccctcctgcaggct

SEQ ID NO: 1421105 - DNA, 14 bp, Homo sapiens
cagaagtctggctt

SEQ ID NO: 1421106 - DNA, 22 bp, Homo sapiens
cagaagtgctctttgtggcagt

SEQ ID NO: 1421107 - DNA, 23 bp, Homo sapiens
cagaagtgctctttgtggcagtg

SEQ ID NO: 1421108 - DNA, 14 bp, Homo sapiens
cagaagttactttt

SEQ ID NO: 1421109 - DNA, 16 bp, Homo sapiens
cagaagttagtttgta

SEQ ID NO: 1421110 - DNA, 20 bp, Homo sapiens
cagaagtttgcaaataggca

SEQ ID NO: 1421111 - DNA, 19 bp, Homo sapiens
cagaagtttgtcaagtcaa

SEQ ID NO: 1421112 - DNA, 18 bp, Homo sapiens
cagaataactacctcctc

SEQ ID NO: 1421113 - DNA, 17 bp, Homo sapiens
cagaataatctttgggt

SEQ ID NO: 1421114 - DNA, 23 bp, Homo sapiens
cagaatacagtaagctgctctat

SEQ ID NO: 1421115 - DNA, 15 bp, Homo sapiens
cagaatacatacaaa

SEQ ID NO: 1421116 - DNA, 12 bp, Homo sapiens
cagaatactggt

SEQ ID NO: 1421117 - DNA, 15 bp, Homo sapiens
cagaatactggtctc

SEQ ID NO: 1421118 - DNA, 21 bp, Homo sapiens
cagaatagatctgatggtgag

SEQ ID NO: 1421119 - DNA, 20 bp, Homo sapiens
cagaatataacatgtaaaat

SEQ ID NO: 1421120 - DNA, 15 bp, Homo sapiens
cagaatatgtttcaa

SEQ ID NO: 1421121 - DNA, 17 bp, Homo sapiens
cagaatatgtttcaaac

SEQ ID NO: 1421122 - DNA, 18 bp, Homo sapiens
cagaatatgtttcaaact

SEQ ID NO: 1421123 - DNA, 13 bp, Homo sapiens
cagaatattgctt

SEQ ID NO: 1421124 - DNA, 13 bp, Homo sapiens
cagaatatttcta

SEQ ID NO: 1421125 - DNA, 19 bp, Homo sapiens
cagaatcatatgattctgc

SEQ ID NO: 1421126 - DNA, 21 bp, Homo sapiens
cagaatcatatgattctgctt

SEQ ID NO: 1421127 - DNA, 15 bp, Homo sapiens
cagaatccaaagatc

SEQ ID NO: 1421128 - DNA, 18 bp, Homo sapiens
cagaatccataaatgtgt

SEQ ID NO: 1421129 - DNA, 20 bp, Homo sapiens
cagaatccataaatgtgttc

SEQ ID NO: 1421130 - DNA, 14 bp, Homo sapiens
cagaatcctcagtt

SEQ ID NO: 1421131 - DNA, 17 bp, Homo sapiens
cagaatctaaagccagt

SEQ ID NO: 1421132 - DNA, 18 bp, Homo sapiens
cagaatctcaaataacta

SEQ ID NO: 1421133 - DNA, 19 bp, Homo sapiens
cagaatctctatgtatatt

SEQ ID NO: 1421134 - DNA, 14 bp, Homo sapiens
cagaatctctgagc

SEQ ID NO: 1421135 - DNA, 13 bp, Homo sapiens
cagaatcttctgg

SEQ ID NO: 1421136 - DNA, 16 bp, Homo sapiens
cagaatcttgactttc

SEQ ID NO: 1421137 - DNA, 19 bp, Homo sapiens
cagaatcttgactttctga

SEQ ID NO: 1421138 - DNA, 13 bp, Homo sapiens
cagaatcttgtat

SEQ ID NO: 1421139 - DNA, 17 bp, Homo sapiens
cagaatcttgttttgaa

SEQ ID NO: 1421140 - DNA, 19 bp, Homo sapiens
cagaatcttgttttgaaaa

SEQ ID NO: 1421141 - DNA, 19 bp, Homo sapiens
cagaatgaaaactgtaaat

SEQ ID NO: 1421142 - DNA, 20 bp, Homo sapiens
cagaatgcaaccaagtcaca

SEQ ID NO: 1421143 - DNA, 21 bp, Homo sapiens
cagaatgcaaccaagtcacac

SEQ ID NO: 1421144 - DNA, 12 bp, Homo sapiens
cagaatgctcag

SEQ ID NO: 1421145 - DNA, 16 bp, Homo sapiens
cagaatgctgaactcc

SEQ ID NO: 1421146 - DNA, 18 bp, Homo sapiens
cagaatgctgcaggactt

SEQ ID NO: 1421147 - DNA, 19 bp, Homo sapiens
cagaatgtaagtgggccca

SEQ ID NO: 1421148 - DNA, 17 bp, Homo sapiens
cagaatgtgaaaaagga

SEQ ID NO: 1421149 - DNA, 16 bp, Homo sapiens
cagaattaaactttta

SEQ ID NO: 1421150 - DNA, 22 bp, Homo sapiens
cagaattaagaaatactcatgt

SEQ ID NO: 1421151 - DNA, 14 bp, Homo sapiens
cagaattaagcaga

SEQ ID NO: 1421152 - DNA, 15 bp, Homo sapiens
cagaattaagcagaa

SEQ ID NO: 1421153 - DNA, 15 bp, Homo sapiens
cagaattcaaaagtg

SEQ ID NO: 1421154 - DNA, 16 bp, Homo sapiens
cagaattcaaaagtga

SEQ ID NO: 1421155 - DNA, 20 bp, Homo sapiens
cagaattcggtgtgctgcca

SEQ ID NO: 1421156 - DNA, 22 bp, Homo sapiens
cagaattcggtgtgctgccaac

SEQ ID NO: 1421157 - DNA, 23 bp, Homo sapiens
cagaattcggtgtgctgccaact

SEQ ID NO: 1421158 - DNA, 22 bp, Homo sapiens
cagaattctcccagcgttaaca

SEQ ID NO: 1421159 - DNA, 23 bp, Homo sapiens
cagaattctgctacctcactggg

SEQ ID NO: 1421160 - DNA, 21 bp, Homo sapiens
cagaatttattagtttaaaat

SEQ ID NO: 1421161 - DNA, 11 bp, Homo sapiens
cagaatttgag

SEQ ID NO: 1421162 - DNA, 13 bp, Homo sapiens
cagaattttaatg

SEQ ID NO: 1421163 - DNA, 18 bp, Homo sapiens
cagaattttaatgtgaag

SEQ ID NO: 1421164 - DNA, 13 bp, Homo sapiens
cagaattttgtat

SEQ ID NO: 1421165 - DNA, 14 bp, Homo sapiens
cactttgggaggct

SEQ ID NO: 1421166 - DNA, 15 bp, Homo sapiens
cactttgttgcaaga

SEQ ID NO: 1421167 - DNA, 21 bp, Homo sapiens
cactttgttgcaagatgtgaa

SEQ ID NO: 1421168 - DNA, 22 bp, Homo sapiens
cactttgttgcaagatgtgaat

SEQ ID NO: 1421169 - DNA, 21 bp, Homo sapiens
cactttgtttcgtggggaggt

SEQ ID NO: 1421170 - DNA, 13 bp, Homo sapiens
cacttttcatcct

SEQ ID NO: 1421171 - DNA, 19 bp, Homo sapiens
cacttttcatccttcccca

SEQ ID NO: 1421172 - DNA, 19 bp, Homo sapiens
cacttttccacattccagt

SEQ ID NO: 1421173 - DNA, 14 bp, Homo sapiens
cactttttatgcta

SEQ ID NO: 1421174 - DNA, 23 bp, Homo sapiens
cacttttttatgaagaaaaagta

SEQ ID NO: 1421175 - DNA, 22 bp, Homo sapiens
cactttttttttttctgcctga

SEQ ID NO: 1421176 - DNA, 20 bp, Homo sapiens
cagaaaaaatgtctgtaaat

SEQ ID NO: 1421177 - DNA, 12 bp, Homo sapiens
cagaaaaacaat

SEQ ID NO: 1421178 - DNA, 13 bp, Homo sapiens
cagaaaaagcatg

SEQ ID NO: 1421179 - DNA, 17 bp, Homo sapiens
cagaaaacccttgggcc

SEQ ID NO: 1421180 - DNA, 19 bp, Homo sapiens
cagaaaacccttgggccag

SEQ ID NO: 1421181 - DNA, 15 bp, Homo sapiens
cagaaaacctccagt

SEQ ID NO: 1421182 - DNA, 15 bp, Homo sapiens
cagaaaagcacctgc

SEQ ID NO: 1421183 - DNA, 17 bp, Homo sapiens
cagaaaagtgcctgagc

SEQ ID NO: 1421184 - DNA, 19 bp, Homo sapiens
cagaaaagtgcctgagctg

SEQ ID NO: 1421185 - DNA, 21 bp, Homo sapiens
cagaaaataaaatattcactc

SEQ ID NO: 1421186 - DNA, 12 bp, Homo sapiens
cagaaaataagg

SEQ ID NO: 1421187 - DNA, 14 bp, Homo sapiens
cagaaaatatgtat

SEQ ID NO: 1421188 - DNA, 15 bp, Homo sapiens
cagaaaatatgtatt

SEQ ID NO: 1421189 - DNA, 16 bp, Homo sapiens
cagaaaatatgtatta

SEQ ID NO: 1421190 - DNA, 17 bp, Homo sapiens
cagaaaatatttaatat

SEQ ID NO: 1421191 - DNA, 14 bp, Homo sapiens
cagaaaatgaaaaa

SEQ ID NO: 1421192 - DNA, 17 bp, Homo sapiens
cagaaaatgaaatccgt

SEQ ID NO: 1421193 - DNA, 18 bp, Homo sapiens
cagaaacacccctctgtc

SEQ ID NO: 1421194 - DNA, 12 bp, Homo sapiens
cagaaacactgc

SEQ ID NO: 1421195 - DNA, 22 bp, Homo sapiens
cagaaacaggtgcatctgggga

SEQ ID NO: 1421196 - DNA, 12 bp, Homo sapiens
cagaaacatctc

SEQ ID NO: 1421197 - DNA, 15 bp, Homo sapiens
cagaaaccaagccat

SEQ ID NO: 1421198 - DNA, 13 bp, Homo sapiens
cagaaaccagtta

SEQ ID NO: 1421199 - DNA, 19 bp, Homo sapiens
cagaaacccttcagtgcta

SEQ ID NO: 1421200 - DNA, 22 bp, Homo sapiens
cagaaacgagatcgggaagcag

SEQ ID NO: 1421201 - DNA, 17 bp, Homo sapiens
cagaaacgcatccagca

SEQ ID NO: 1421202 - DNA, 21 bp, Homo sapiens
cagaaactccttttgctgtct

SEQ ID NO: 1421203 - DNA, 23 bp, Homo sapiens
cagaaactccttttgctgtcttt

SEQ ID NO: 1421204 - DNA, 20 bp, Homo sapiens
cagaaagactgagctcaagg

SEQ ID NO: 1421205 - DNA, 13 bp, Homo sapiens
cagaaagagggac

SEQ ID NO: 1421206 - DNA, 20 bp, Homo sapiens
cagaaagcaggagcagctgt

SEQ ID NO: 1421207 - DNA, 15 bp, Homo sapiens
cagaaagcctccgct

SEQ ID NO: 1421208 - DNA, 18 bp, Homo sapiens
cagaaagctttattttga

SEQ ID NO: 1421209 - DNA, 15 bp, Homo sapiens
cagaaagggccaccc

SEQ ID NO: 1421210 - DNA, 19 bp, Homo sapiens
cagaaaggggcattttgta

SEQ ID NO: 1421211 - DNA, 12 bp, Homo sapiens
cagaaagtgcct

SEQ ID NO: 1421212 - DNA, 22 bp, Homo sapiens
cagaaagttcaacttccaaagg

SEQ ID NO: 1421213 - DNA, 12 bp, Homo sapiens
cagaaataaaga

SEQ ID NO: 1421214 - DNA, 14 bp, Homo sapiens
cagaaatacaaaaa

SEQ ID NO: 1421215 - DNA, 18 bp, Homo sapiens
cagaaatacaaaaaatta

SEQ ID NO: 1421216 - DNA, 11 bp, Homo sapiens
cagaaatacag

SEQ ID NO: 1421217 - DNA, 20 bp, Homo sapiens
cagaaatagacaaaaagtat

SEQ ID NO: 1421218 - DNA, 21 bp, Homo sapiens
cagaaatagacaaaaagtata

SEQ ID NO: 1421219 - DNA, 20 bp, Homo sapiens
cagaaatatcgctgatgcag

SEQ ID NO: 1421220 - DNA, 15 bp, Homo sapiens
cagaaatcagaggag

SEQ ID NO: 1421221 - DNA, 18 bp, Homo sapiens
cagaaatcagaggagaga

SEQ ID NO: 1421222 - DNA, 20 bp, Homo sapiens
cagaaatcagtaatatttat

SEQ ID NO: 1421223 - DNA, 16 bp, Homo sapiens
cagaaatcgagagtgt

SEQ ID NO: 1421224 - DNA, 17 bp, Homo sapiens
cagaaatcgagagtgtg

SEQ ID NO: 1421225 - DNA, 14 bp, Homo sapiens
cagaaatctgagga

SEQ ID NO: 1421226 - DNA, 15 bp, Homo sapiens
cagaaatctgaggaa

SEQ ID NO: 1421227 - DNA, 12 bp, Homo sapiens
cagaaatgcaaa

SEQ ID NO: 1421228 - DNA, 20 bp, Homo sapiens
cagaaatgctgcctgcctgt

SEQ ID NO: 1421229 - DNA, 21 bp, Homo sapiens
cagaaatgctgcctgcctgtc

SEQ ID NO: 1421230 - DNA, 15 bp, Homo sapiens
cagaaatgctgctgg

SEQ ID NO: 1421231 - DNA, 17 bp, Homo sapiens
cagaaatgctgctggcc

SEQ ID NO: 1421232 - DNA, 19 bp, Homo sapiens
cagaaatgctgctggccaa

SEQ ID NO: 1421233 - DNA, 13 bp, Homo sapiens
cagaaattaagat

SEQ ID NO: 1421234 - DNA, 20 bp, Homo sapiens
cagaaattctggcccagcca

SEQ ID NO: 1421235 - DNA, 17 bp, Homo sapiens
cagaaattctgttttta

SEQ ID NO: 1421236 - DNA, 18 bp, Homo sapiens
cagaaattctgtttttaa

SEQ ID NO: 1421237 - DNA, 11 bp, Homo sapiens
cagaaattgga

SEQ ID NO: 1421238 - DNA, 20 bp, Homo sapiens
cagaaattggaacagaatgt

SEQ ID NO: 1421239 - DNA, 21 bp, Homo sapiens
cagaaattggaacagaatgtt

SEQ ID NO: 1421240 - DNA, 12 bp, Homo sapiens
cagaaattgtat

SEQ ID NO: 1421241 - DNA, 19 bp, Homo sapiens
cagaaattgtatattgtaa

SEQ ID NO: 1421242 - DNA, 21 bp, Homo sapiens
cagaaattgtatattgtaatt

SEQ ID NO: 1421243 - DNA, 18 bp, Homo sapiens
cagaacaaatgtgttttt

SEQ ID NO: 1421244 - DNA, 20 bp, Homo sapiens
cagaacacactttttttcct

SEQ ID NO: 1421245 - DNA, 19 bp, Homo sapiens
cagaacacggctcacgctt

SEQ ID NO: 1421246 - DNA, 23 bp, Homo sapiens
cagaacagccctcggcctccgag

SEQ ID NO: 1421247 - DNA, 13 bp, Homo sapiens
cagaacagctgaa

SEQ ID NO: 1421248 - DNA, 14 bp, Homo sapiens
cagaacatacactg

SEQ ID NO: 1421249 - DNA, 18 bp, Homo sapiens
cagaacatcattagaaca

SEQ ID NO: 1421250 - DNA, 12 bp, Homo sapiens
cagaacatgtta

SEQ ID NO: 1421251 - DNA, 15 bp, Homo sapiens
cagaacatgttaaga

SEQ ID NO: 1421252 - DNA, 17 bp, Homo sapiens
cagaacatgttaagata

SEQ ID NO: 1421253 - DNA, 16 bp, Homo sapiens
cagaacattcagctct

SEQ ID NO: 1421254 - DNA, 18 bp, Homo sapiens
cagaacattcagctctgg

SEQ ID NO: 1421255 - DNA, 14 bp, Homo sapiens
cagaaccaaatctt

SEQ ID NO: 1421256 - DNA, 21 bp, Homo sapiens
cagaaccacacttgaaacctt

SEQ ID NO: 1421257 - DNA, 15 bp, Homo sapiens
cagaaccagagggca

SEQ ID NO: 1421258 - DNA, 22 bp, Homo sapiens
cagaacccatcggtaggcaaag

SEQ ID NO: 1421259 - DNA, 17 bp, Homo sapiens
cagaacccccaggtggc

SEQ ID NO: 1421260 - DNA, 14 bp, Homo sapiens
cagaacctcttccc

SEQ ID NO: 1421261 - DNA, 21 bp, Homo sapiens
cagaacctcttccccagaaag

SEQ ID NO: 1421262 - DNA, 18 bp, Homo sapiens
cagaacctgcacacagga

SEQ ID NO: 1421263 - DNA, 17 bp, Homo sapiens
cagaaccttcaacccag

SEQ ID NO: 1421264 - DNA, 20 bp, Homo sapiens
cagaaccttcaacccagtgg

SEQ ID NO: 1421265 - DNA, 22 bp, Homo sapiens
cagaacgtggtttgcctgaggc

SEQ ID NO: 1421266 - DNA, 17 bp, Homo sapiens
cagaactacatatttgt

SEQ ID NO: 1421267 - DNA, 21 bp, Homo sapiens
cagaactcaaatggggccaga

SEQ ID NO: 1421268 - DNA, 22 bp, Homo sapiens
cagaactcaaatggggccagat

SEQ ID NO: 1421269 - DNA, 13 bp, Homo sapiens
cacgtccccctgg

SEQ ID NO: 1421270 - DNA, 14 bp, Homo sapiens
cacgtccttgggcg

SEQ ID NO: 1421271 - DNA, 13 bp, Homo sapiens
cacgtctgccagg

SEQ ID NO: 1421272 - DNA, 16 bp, Homo sapiens
cacgtctgccaggccc

SEQ ID NO: 1421273 - DNA, 19 bp, Homo sapiens
cacgtctggctccctgccc

SEQ ID NO: 1421274 - DNA, 21 bp, Homo sapiens
cacgtctggctccctgcccct

SEQ ID NO: 1421275 - DNA, 13 bp, Homo sapiens
cacgtctgtcctc

SEQ ID NO: 1421276 - DNA, 23 bp, Homo sapiens
cacgtgaaatatttaagtatata

SEQ ID NO: 1421277 - DNA, 18 bp, Homo sapiens
cacgtgacagtgcctggg

SEQ ID NO: 1421278 - DNA, 13 bp, Homo sapiens
cacgtgcaggaca

SEQ ID NO: 1421279 - DNA, 16 bp, Homo sapiens
cacgtgccaggcccgg

SEQ ID NO: 1421280 - DNA, 15 bp, Homo sapiens
cacgtggagagctgg

SEQ ID NO: 1421281 - DNA, 23 bp, Homo sapiens
cacgtggagagctggtgcccgga

SEQ ID NO: 1421282 - DNA, 18 bp, Homo sapiens
cacgtggcatgtggcctg

SEQ ID NO: 1421283 - DNA, 22 bp, Homo sapiens
cacgtggcatgtggcctgtggc

SEQ ID NO: 1421284 - DNA, 17 bp, Homo sapiens
cacgtggcctcttgagc

SEQ ID NO: 1421285 - DNA, 20 bp, Homo sapiens
cacgtggcctcttgagcagt

SEQ ID NO: 1421286 - DNA, 23 bp, Homo sapiens
cacgtggcctcttgagcagtggc

SEQ ID NO: 1421287 - DNA, 17 bp, Homo sapiens
cacgtggggagcggtgg

SEQ ID NO: 1421288 - DNA, 13 bp, Homo sapiens
cacgtggggccca

SEQ ID NO: 1421289 - DNA, 15 bp, Homo sapiens
cacgtggggcccact

SEQ ID NO: 1421290 - DNA, 20 bp, Homo sapiens
cacgtgtaactgtcagccgg

SEQ ID NO: 1421291 - DNA, 22 bp, Homo sapiens
cacgtgttttattcctgtatgt

SEQ ID NO: 1421292 - DNA, 19 bp, Homo sapiens
cacgttccttactgcagaa

SEQ ID NO: 1421293 - DNA, 22 bp, Homo sapiens
cacgttctcacacccaccgtcc

SEQ ID NO: 1421294 - DNA, 21 bp, Homo sapiens
cacgttggggtgatttaatcc

SEQ ID NO: 1421295 - DNA, 20 bp, Homo sapiens
cacgtttaatcccagcactt

SEQ ID NO: 1421296 - DNA, 19 bp, Homo sapiens
cactaaaacacacaggtgc

SEQ ID NO: 1421297 - DNA, 19 bp, Homo sapiens
cacctggatctatccctgc

SEQ ID NO: 1421298 - DNA, 11 bp, Homo sapiens
cacctggccac

SEQ ID NO: 1421299 - DNA, 11 bp, Homo sapiens
cacctggcccc

SEQ ID NO: 1421300 - DNA, 15 bp, Homo sapiens
cacctggccccatgt

SEQ ID NO: 1421301 - DNA, 16 bp, Homo sapiens
cacctggccccatgtc

SEQ ID NO: 1421302 - DNA, 18 bp, Homo sapiens
cacctggcctgctgggaa

SEQ ID NO: 1421303 - DNA, 19 bp, Homo sapiens
cacctggcctgctgggaac

SEQ ID NO: 1421304 - DNA, 20 bp, Homo sapiens
cacctggcctgggccacacc

SEQ ID NO: 1421305 - DNA, 20 bp, Homo sapiens
cacctggccttaaagaggga

SEQ ID NO: 1421306 - DNA, 22 bp, Homo sapiens
cacctggctgaggttcctctgc

SEQ ID NO: 1421307 - DNA, 22 bp, Homo sapiens
cacctgggagaaggtctccaag

SEQ ID NO: 1421308 - DNA, 19 bp, Homo sapiens
cacctgggcttaagaaatc

SEQ ID NO: 1421309 - DNA, 20 bp, Homo sapiens
cacctggtactccctctcag

SEQ ID NO: 1421310 - DNA, 20 bp, Homo sapiens
cacctggtactgacccagga

SEQ ID NO: 1421311 - DNA, 19 bp, Homo sapiens
cacctggtattatttttct

SEQ ID NO: 1421312 - DNA, 17 bp, Homo sapiens
cacctggtcctccgcct

SEQ ID NO: 1421313 - DNA, 23 bp, Homo sapiens
cacctggtgcgggcctggccctc

SEQ ID NO: 1421314 - DNA, 22 bp, Homo sapiens
cacctggtgggtggtgtcctga

SEQ ID NO: 1421315 - DNA, 23 bp, Homo sapiens
cacctggtgggtggtgtcctgaa

SEQ ID NO: 1421316 - DNA, 15 bp, Homo sapiens
cacctgtaaacctga

SEQ ID NO: 1421317 - DNA, 21 bp, Homo sapiens
cacctgtaatcccagctactt

SEQ ID NO: 1421318 - DNA, 15 bp, Homo sapiens
cacctgtactcagga

SEQ ID NO: 1421319 - DNA, 23 bp, Homo sapiens
cacctgtactcaggaggctgagg

SEQ ID NO: 1421320 - DNA, 17 bp, Homo sapiens
cacctgtagtcccagct

SEQ ID NO: 1421321 - DNA, 22 bp, Homo sapiens
cacctgtagtcccagctacttg

SEQ ID NO: 1421322 - DNA, 17 bp, Homo sapiens
cacctgtcgcccagtgc

SEQ ID NO: 1421323 - DNA, 18 bp, Homo sapiens
cacctgtcgcccagtgcc

SEQ ID NO: 1421324 - DNA, 15 bp, Homo sapiens
cacctgtctcagcct

SEQ ID NO: 1421325 - DNA, 11 bp, Homo sapiens
cacctgtctgg

SEQ ID NO: 1421326 - DNA, 14 bp, Homo sapiens
cacctgtgacaaag

SEQ ID NO: 1421327 - DNA, 21 bp, Homo sapiens
cacctgtgtgcccagcacctg

SEQ ID NO: 1421328 - DNA, 19 bp, Homo sapiens
cacctgttaaaatgtacac

SEQ ID NO: 1421329 - DNA, 23 bp, Homo sapiens
cacctgttactaagtcaggagtg

SEQ ID NO: 1421330 - DNA, 15 bp, Homo sapiens
cacctgttttctgaa

SEQ ID NO: 1421331 - DNA, 18 bp, Homo sapiens
caccttagggtggcttta

SEQ ID NO: 1421332 - DNA, 15 bp, Homo sapiens
caccttagtacttta

SEQ ID NO: 1421333 - DNA, 16 bp, Homo sapiens
caccttcaaaatgttc

SEQ ID NO: 1421334 - DNA, 17 bp, Homo sapiens
caccttcaattcctggg

SEQ ID NO: 1421335 - DNA, 18 bp, Homo sapiens
caccttcaattcctgggc

SEQ ID NO: 1421336 - DNA, 20 bp, Homo sapiens
caccttcagaggctgaggtg

SEQ ID NO: 1421337 - DNA, 14 bp, Homo sapiens
caccttccagctcc

SEQ ID NO: 1421338 - DNA, 15 bp, Homo sapiens
caccttccagctcct

SEQ ID NO: 1421339 - DNA, 16 bp, Homo sapiens
caccttccagctcctg

SEQ ID NO: 1421340 - DNA, 12 bp, Homo sapiens
caccttcccagc

SEQ ID NO: 1421341 - DNA, 21 bp, Homo sapiens
caccttcccagctctccctct

SEQ ID NO: 1421342 - DNA, 12 bp, Homo sapiens
caccttcctcct

SEQ ID NO: 1421343 - DNA, 13 bp, Homo sapiens
caccttcctcctc

SEQ ID NO: 1421344 - DNA, 19 bp, Homo sapiens
caccttgacgtttcttctt

SEQ ID NO: 1421345 - DNA, 23 bp, Homo sapiens
caccttgacgtttcttctttcta

SEQ ID NO: 1421346 - DNA, 18 bp, Homo sapiens
caccttgccaatggtgta

SEQ ID NO: 1421347 - DNA, 16 bp, Homo sapiens
caccttgctcttcttt

SEQ ID NO: 1421348 - DNA, 12 bp, Homo sapiens
caccttggccca

SEQ ID NO: 1421349 - DNA, 17 bp, Homo sapiens
caccttggcccaggagc

SEQ ID NO: 1421350 - DNA, 18 bp, Homo sapiens
caccttggcccaggagct

SEQ ID NO: 1421351 - DNA, 23 bp, Homo sapiens
caccttggcccaggagctctgcg

SEQ ID NO: 1421352 - DNA, 14 bp, Homo sapiens
caccttggccttct

SEQ ID NO: 1421353 - DNA, 19 bp, Homo sapiens
caccttgggatgatgcctc

SEQ ID NO: 1421354 - DNA, 22 bp, Homo sapiens
caccttgtcatgtaccatcaat

SEQ ID NO: 1421355 - DNA, 23 bp, Homo sapiens
caccttgtcatgtaccatcaata

SEQ ID NO: 1421356 - DNA, 18 bp, Homo sapiens
caccttgtgcctggggtg

SEQ ID NO: 1421357 - DNA, 15 bp, Homo sapiens
caccttgtgtctgta

SEQ ID NO: 1421358 - DNA, 17 bp, Homo sapiens
caccttgtgtctgtaca

SEQ ID NO: 1421359 - DNA, 12 bp, Homo sapiens
caccttgtgttt

SEQ ID NO: 1421360 - DNA, 12 bp, Homo sapiens
cacctttactgt

SEQ ID NO: 1421361 - DNA, 13 bp, Homo sapiens
cacctttactgtg

SEQ ID NO: 1421362 - DNA, 15 bp, Homo sapiens
cacctttaggttctt

SEQ ID NO: 1421363 - DNA, 12 bp, Homo sapiens
cacctttattaa

SEQ ID NO: 1421364 - DNA, 14 bp, Homo sapiens
cacctttattaaaa

SEQ ID NO: 1421365 - DNA, 19 bp, Homo sapiens
cacctttctccactgggtg

SEQ ID NO: 1421366 - DNA, 13 bp, Homo sapiens
cacctttggtgca

SEQ ID NO: 1421367 - DNA, 22 bp, Homo sapiens
cacctttgtaagacatttgtat

SEQ ID NO: 1421368 - DNA, 21 bp, Homo sapiens
cacctttgtttagaacactgg

SEQ ID NO: 1421369 - DNA, 18 bp, Homo sapiens
caccttttaactcacctc

SEQ ID NO: 1421370 - DNA, 21 bp, Homo sapiens
caccttttatgaatcaaatat

SEQ ID NO: 1421371 - DNA, 21 bp, Homo sapiens
caccttttcatggtctctgca

SEQ ID NO: 1421372 - DNA, 13 bp, Homo sapiens
cacctttttaata

SEQ ID NO: 1421373 - DNA, 17 bp, Homo sapiens
cacctttttaataaaaa

SEQ ID NO: 1421374 - DNA, 16 bp, Homo sapiens
cacgaaatgttatttt

SEQ ID NO: 1421375 - DNA, 14 bp, Homo sapiens
cacgaacccacctg

SEQ ID NO: 1421376 - DNA, 19 bp, Homo sapiens
cacgaactttagctgcatc

SEQ ID NO: 1421377 - DNA, 14 bp, Homo sapiens
cacgagcacaatgg

SEQ ID NO: 1421378 - DNA, 23 bp, Homo sapiens
cacgagcacaatggtcttacatt

SEQ ID NO: 1421379 - DNA, 19 bp, Homo sapiens
cacgagcaggctactgtca

SEQ ID NO: 1421380 - DNA, 13 bp, Homo sapiens
cacgagccacaag

SEQ ID NO: 1421381 - DNA, 20 bp, Homo sapiens
cacgagccacaagctgcact

SEQ ID NO: 1421382 - DNA, 12 bp, Homo sapiens
cacgagccacct

SEQ ID NO: 1421383 - DNA, 22 bp, Homo sapiens
cacgaggaatctgtgggtctgg

SEQ ID NO: 1421384 - DNA, 12 bp, Homo sapiens
cacgagggctgg

SEQ ID NO: 1421385 - DNA, 15 bp, Homo sapiens
cacgaggtcaggaga

SEQ ID NO: 1421386 - DNA, 15 bp, Homo sapiens
cacgagtcacctgca

SEQ ID NO: 1421387 - DNA, 17 bp, Homo sapiens
cacgagtcacctgcaag

SEQ ID NO: 1421388 - DNA, 16 bp, Homo sapiens
cacgatcccctccccc

SEQ ID NO: 1421389 - DNA, 17 bp, Homo sapiens
cacgatcccctccccca

SEQ ID NO: 1421390 - DNA, 18 bp, Homo sapiens
cacgatgcatttaataaa

SEQ ID NO: 1421391 - DNA, 20 bp, Homo sapiens
cacgatgcatttaataaaga

SEQ ID NO: 1421392 - DNA, 18 bp, Homo sapiens
cacgattttcaagattct

SEQ ID NO: 1421393 - DNA, 18 bp, Homo sapiens
cacgcaaatacactccag

SEQ ID NO: 1421394 - DNA, 21 bp, Homo sapiens
cacgcaagggcatcaggcact

SEQ ID NO: 1421395 - DNA, 12 bp, Homo sapiens
cacgcacacaca

SEQ ID NO: 1421396 - DNA, 15 bp, Homo sapiens
cacgcacacacacaa

SEQ ID NO: 1421397 - DNA, 20 bp, Homo sapiens
cacgcaccactgcttcccac

SEQ ID NO: 1421398 - DNA, 20 bp, Homo sapiens
cacgcacgacgtcagcctct

SEQ ID NO: 1421399 - DNA, 12 bp, Homo sapiens
cacgcacgcaca

SEQ ID NO: 1421400 - DNA, 13 bp, Homo sapiens
cacgcacgcacac

SEQ ID NO: 1421401 - DNA, 15 bp, Homo sapiens
cacgcacgcacacac

SEQ ID NO: 1421402 - DNA, 16 bp, Homo sapiens
cacgcacgcacacaca

SEQ ID NO: 1421403 - DNA, 21 bp, Homo sapiens
cacgcactctccccgctcagg

SEQ ID NO: 1421404 - DNA, 22 bp, Homo sapiens
cacgcactctccccgctcaggg

SEQ ID NO: 1421405 - DNA, 18 bp, Homo sapiens
caattaatagtttgtcta

SEQ ID NO: 1421406 - DNA, 13 bp, Homo sapiens
caattaatgcttt

SEQ ID NO: 1421407 - DNA, 14 bp, Homo sapiens
caattaattttaga

SEQ ID NO: 1421408 - DNA, 19 bp, Homo sapiens
caattacaacggagtcaaa

SEQ ID NO: 1421409 - DNA, 19 bp, Homo sapiens
caattactaaattgtatac

SEQ ID NO: 1421410 - DNA, 17 bp, Homo sapiens
caattactggtccaaaa

SEQ ID NO: 1421411 - DNA, 21 bp, Homo sapiens
caattacttattttaggaaat

SEQ ID NO: 1421412 - DNA, 15 bp, Homo sapiens
caattaggaagtgta

SEQ ID NO: 1421413 - DNA, 20 bp, Homo sapiens
caattaggaagtgtaacagc

SEQ ID NO: 1421414 - DNA, 18 bp, Homo sapiens
caattagtggtcataaaa

SEQ ID NO: 1421415 - DNA, 21 bp, Homo sapiens
caattagtttcctttttaata

SEQ ID NO: 1421416 - DNA, 14 bp, Homo sapiens
caattatgtctctt

SEQ ID NO: 1421417 - DNA, 23 bp, Homo sapiens
caattatttgcatattttgagaa

SEQ ID NO: 1421418 - DNA, 13 bp, Homo sapiens
caattcaaaagtt

SEQ ID NO: 1421419 - DNA, 17 bp, Homo sapiens
caattcaaaagttccaa

SEQ ID NO: 1421420 - DNA, 14 bp, Homo sapiens
caattcacagcaca

SEQ ID NO: 1421421 - DNA, 15 bp, Homo sapiens
caattccaggctgag

SEQ ID NO: 1421422 - DNA, 15 bp, Homo sapiens
caattccatttccag

SEQ ID NO: 1421423 - DNA, 13 bp, Homo sapiens
caattcccctctg

SEQ ID NO: 1421424 - DNA, 14 bp, Homo sapiens
caattcctctggga

SEQ ID NO: 1421425 - DNA, 12 bp, Homo sapiens
caattcctgggc

SEQ ID NO: 1421426 - DNA, 11 bp, Homo sapiens
caattctaaat

SEQ ID NO: 1421427 - DNA, 12 bp, Homo sapiens
caattctgactg

SEQ ID NO: 1421428 - DNA, 15 bp, Homo sapiens
caattctgactgtcc

SEQ ID NO: 1421429 - DNA, 16 bp, Homo sapiens
caattctgactgtcca

SEQ ID NO: 1421430 - DNA, 14 bp, Homo sapiens
caattctgttttta

SEQ ID NO: 1421431 - DNA, 19 bp, Homo sapiens
caattcttttaactgttgt

SEQ ID NO: 1421432 - DNA, 15 bp, Homo sapiens
caattgaagtaaact

SEQ ID NO: 1421433 - DNA, 17 bp, Homo sapiens
caattgaagtaaacttt

SEQ ID NO: 1421434 - DNA, 21 bp, Homo sapiens
caattgaagtaaactttttgt

SEQ ID NO: 1421435 - DNA, 22 bp, Homo sapiens
caattgagggcattagtacttt

SEQ ID NO: 1421436 - DNA, 16 bp, Homo sapiens
caattgatacttcagg

SEQ ID NO: 1421437 - DNA, 16 bp, Homo sapiens
caattgctcccatcag

SEQ ID NO: 1421438 - DNA, 20 bp, Homo sapiens
caattgcttactcattaaaa

SEQ ID NO: 1421439 - DNA, 22 bp, Homo sapiens
caattgctttgtcatatagctg

SEQ ID NO: 1421440 - DNA, 22 bp, Homo sapiens
caattggtggaattcctcttta

SEQ ID NO: 1421441 - DNA, 15 bp, Homo sapiens
caattgtcacttttt

SEQ ID NO: 1421442 - DNA, 22 bp, Homo sapiens
caattgtcttttttttcctttg

SEQ ID NO: 1421443 - DNA, 16 bp, Homo sapiens
caattgtgctgccatt

SEQ ID NO: 1421444 - DNA, 17 bp, Homo sapiens
caattgttaattgtaat

SEQ ID NO: 1421445 - DNA, 20 bp, Homo sapiens
caattgttacaagtgttctt

SEQ ID NO: 1421446 - DNA, 16 bp, Homo sapiens
caattgttacagtact

SEQ ID NO: 1421447 - DNA, 16 bp, Homo sapiens
caatttattactgaaa

SEQ ID NO: 1421448 - DNA, 14 bp, Homo sapiens
caatttcagaacca

SEQ ID NO: 1421449 - DNA, 14 bp, Homo sapiens
caatttcagactcc

SEQ ID NO: 1421450 - DNA, 21 bp, Homo sapiens
caatttcctctccactgctgg

SEQ ID NO: 1421451 - DNA, 14 bp, Homo sapiens
caatttcctggccc

SEQ ID NO: 1421452 - DNA, 17 bp, Homo sapiens
caatttctaatttttaa

SEQ ID NO: 1421453 - DNA, 19 bp, Homo sapiens
caatttctaatttttaaga

SEQ ID NO: 1421454 - DNA, 15 bp, Homo sapiens
caatttctgtgttgc

SEQ ID NO: 1421455 - DNA, 11 bp, Homo sapiens
caatttcttac

SEQ ID NO: 1421456 - DNA, 24 bp, Homo sapiens
caatttgaagtaacttatttgact

SEQ ID NO: 1421457 - DNA, 14 bp, Homo sapiens
caatttgatacata

SEQ ID NO: 1421458 - DNA, 22 bp, Homo sapiens
caatttggtaaaaatgctgctc

SEQ ID NO: 1421459 - DNA, 12 bp, Homo sapiens
caatttgtaagt

SEQ ID NO: 1421460 - DNA, 16 bp, Homo sapiens
caatttgtttgtgttc

SEQ ID NO: 1421461 - DNA, 19 bp, Homo sapiens
caattttaaaaaataacat

SEQ ID NO: 1421462 - DNA, 12 bp, Homo sapiens
caattttaaaga

SEQ ID NO: 1421463 - DNA, 16 bp, Homo sapiens
caattttaaagttctt

SEQ ID NO: 1421464 - DNA, 17 bp, Homo sapiens
caattttaatgctattt

SEQ ID NO: 1421465 - DNA, 20 bp, Homo sapiens
caattttagtgtattaatca

SEQ ID NO: 1421466 - DNA, 20 bp, Homo sapiens
caattttctggaatacatga

SEQ ID NO: 1421467 - DNA, 21 bp, Homo sapiens
caattttgatctttttatatt

SEQ ID NO: 1421468 - DNA, 11 bp, Homo sapiens
caattttgtaa

SEQ ID NO: 1421469 - DNA, 22 bp, Homo sapiens
caatttttaccacttctgttta

SEQ ID NO: 1421470 - DNA, 15 bp, Homo sapiens
caatttttcccagta

SEQ ID NO: 1421471 - DNA, 17 bp, Homo sapiens
caatttttcccagtatt

SEQ ID NO: 1421472 - DNA, 19 bp, Homo sapiens
caatttttcccagtatttt

SEQ ID NO: 1421473 - DNA, 10 bp, Homo sapiens
caatttttga

SEQ ID NO: 1421474 - DNA, 21 bp, Homo sapiens
caattttttatcatgcatgtc

SEQ ID NO: 1421475 - DNA, 22 bp, Homo sapiens
cacaaaaaaagttgaaggcctt

SEQ ID NO: 1421476 - DNA, 23 bp, Homo sapiens
cacaaaaaaatatcagacaagca

SEQ ID NO: 1421477 - DNA, 16 bp, Homo sapiens
cacaaaacttgaaaga

SEQ ID NO: 1421478 - DNA, 14 bp, Homo sapiens
cacaaaatatttct

SEQ ID NO: 1421479 - DNA, 17 bp, Homo sapiens
cacaaaattagaaagga

SEQ ID NO: 1421480 - DNA, 15 bp, Homo sapiens
cacaaaccatgcaaa

SEQ ID NO: 1421481 - DNA, 17 bp, Homo sapiens
cacaaaccctgctgaac

SEQ ID NO: 1421482 - DNA, 17 bp, Homo sapiens
cacaaacggagcccctg

SEQ ID NO: 1421483 - DNA, 16 bp, Homo sapiens
cacaaactacctctgg

SEQ ID NO: 1421484 - DNA, 20 bp, Homo sapiens
cacaaactgtgaaaatagtg

SEQ ID NO: 1421485 - DNA, 21 bp, Homo sapiens
cacaaacttgtgagcatcaga

SEQ ID NO: 1421486 - DNA, 20 bp, Homo sapiens
cacaaagagaaaaagaaatg

SEQ ID NO: 1421487 - DNA, 13 bp, Homo sapiens
cacaaatatttat

SEQ ID NO: 1421488 - DNA, 23 bp, Homo sapiens
cacaaatatttattttctttctg

SEQ ID NO: 1421489 - DNA, 21 bp, Homo sapiens
cacaaatgtcattgtctactc

SEQ ID NO: 1421490 - DNA, 14 bp, Homo sapiens
cacaaatgtggagt

SEQ ID NO: 1421491 - DNA, 14 bp, Homo sapiens
cacaacagagtaac

SEQ ID NO: 1421492 - DNA, 15 bp, Homo sapiens
cacaacatttgcaga

SEQ ID NO: 1421493 - DNA, 16 bp, Homo sapiens
cacaaccagccaggca

SEQ ID NO: 1421494 - DNA, 18 bp, Homo sapiens
cacaacccaataggagtc

SEQ ID NO: 1421495 - DNA, 23 bp, Homo sapiens
cacaacctctctgatcttgtgct

SEQ ID NO: 1421496 - DNA, 19 bp, Homo sapiens
cacaaccttcggctccggg

SEQ ID NO: 1421497 - DNA, 18 bp, Homo sapiens
cacaaccttctgtggctc

SEQ ID NO: 1421498 - DNA, 19 bp, Homo sapiens
cacaactatttttccaaaa

SEQ ID NO: 1421499 - DNA, 12 bp, Homo sapiens
cacaactgacac

SEQ ID NO: 1421500 - DNA, 19 bp, Homo sapiens
cacaactgtgtgattaaaa

SEQ ID NO: 1421501 - DNA, 20 bp, Homo sapiens
cacaagggatataaaatgaa

SEQ ID NO: 1421502 - DNA, 21 bp, Homo sapiens
cacaagggatataaaatgaaa

SEQ ID NO: 1421503 - DNA, 13 bp, Homo sapiens
cacaagtaaacat

SEQ ID NO: 1421504 - DNA, 18 bp, Homo sapiens
cacaagtaacacatttgg

SEQ ID NO: 1421505 - DNA, 15 bp, Homo sapiens
cacaagtctttccag

SEQ ID NO: 1421506 - DNA, 16 bp, Homo sapiens
cacaagtctttccaga

SEQ ID NO: 1421507 - DNA, 17 bp, Homo sapiens
cacaagtctttccagag

SEQ ID NO: 1421508 - DNA, 12 bp, Homo sapiens
cacaagtggtgt

SEQ ID NO: 1421509 - DNA, 13 bp, Homo sapiens
cacaataaaaaat

SEQ ID NO: 1421510 - DNA, 19 bp, Homo sapiens
cacaataaatgtattcaaa

SEQ ID NO: 1421511 - DNA, 18 bp, Homo sapiens
cacaatatagttttttct

SEQ ID NO: 1421512 - DNA, 11 bp, Homo sapiens
cacaatatttt

SEQ ID NO: 1421513 - DNA, 22 bp, Homo sapiens
cacaatcaccgatgcaaacatt

SEQ ID NO: 1421514 - DNA, 20 bp, Homo sapiens
cacaatcctaacacattatc

SEQ ID NO: 1421515 - DNA, 21 bp, Homo sapiens
cacaatcctccaagaatttga

SEQ ID NO: 1421516 - DNA, 15 bp, Homo sapiens
cacaatctcggctca

SEQ ID NO: 1421517 - DNA, 17 bp, Homo sapiens
cacaatgtgaaactgaa

SEQ ID NO: 1421518 - DNA, 21 bp, Homo sapiens
cacaatgtgaaactgaaggtc

SEQ ID NO: 1421519 - DNA, 17 bp, Homo sapiens
cacaatgtttcttcatt

SEQ ID NO: 1421520 - DNA, 19 bp, Homo sapiens
cacaattgatacttcaggt

SEQ ID NO: 1421521 - DNA, 22 bp, Homo sapiens
cacaattgatacttcaggtgct

SEQ ID NO: 1421522 - DNA, 10 bp, Homo sapiens
cacacaaaca

SEQ ID NO: 1421523 - DNA, 21 bp, Homo sapiens
cacacaaacctactgcccaca

SEQ ID NO: 1421524 - DNA, 14 bp, Homo sapiens
cacacaacaccagg

SEQ ID NO: 1421525 - DNA, 19 bp, Homo sapiens
cacacaaggatagatgctg

SEQ ID NO: 1421526 - DNA, 16 bp, Homo sapiens
cacacacaataaagaa

SEQ ID NO: 1421527 - DNA, 15 bp, Homo sapiens
cacacacacaaacct

SEQ ID NO: 1421528 - DNA, 11 bp, Homo sapiens
cacacacacac

SEQ ID NO: 1421529 - DNA, 14 bp, Homo sapiens
cacacacacacaaa

SEQ ID NO: 1421530 - DNA, 14 bp, Homo sapiens
cacacacacacaca

SEQ ID NO: 1421531 - DNA, 15 bp, Homo sapiens
cacacacacacacac

SEQ ID NO: 1421532 - DNA, 15 bp, Homo sapiens
cacacacacacacga

SEQ ID NO: 1421533 - DNA, 15 bp, Homo sapiens
cacacacacgatgca

SEQ ID NO: 1421534 - DNA, 18 bp, Homo sapiens
cacacacagacatatata

SEQ ID NO: 1421535 - DNA, 21 bp, Homo sapiens
cacacacaggcaactgaggca

SEQ ID NO: 1421536 - DNA, 13 bp, Homo sapiens
cacacacatctgg

SEQ ID NO: 1421537 - DNA, 12 bp, Homo sapiens
cacacacctgcc

SEQ ID NO: 1421538 - DNA, 15 bp, Homo sapiens
cacacacctgcctgc

SEQ ID NO: 1421539 - DNA, 13 bp, Homo sapiens
cacacacgatgca

SEQ ID NO: 1421540 - DNA, 15 bp, Homo sapiens
cacacacgcacgcac

SEQ ID NO: 1421541 - DNA, 16 bp, Homo sapiens
cacacacgcacgcaca

SEQ ID NO: 1421542 - DNA, 19 bp, Homo sapiens
cacacacgctttcttatgc

SEQ ID NO: 1421543 - DNA, 17 bp, Homo sapiens
cacacagaatgctcagg

SEQ ID NO: 1421544 - DNA, 14 bp, Homo sapiens
cacacagagtggtc

SEQ ID NO: 1421545 - DNA, 18 bp, Homo sapiens
cacacagatacacacaca

SEQ ID NO: 1421546 - DNA, 12 bp, Homo sapiens
cacacagcactc

SEQ ID NO: 1421547 - DNA, 14 bp, Homo sapiens
cacacagcactctc

SEQ ID NO: 1421548 - DNA, 14 bp, Homo sapiens
cacacagcagtgtc

SEQ ID NO: 1421549 - DNA, 20 bp, Homo sapiens
cacacagcagtgtcccctgc

SEQ ID NO: 1421550 - DNA, 12 bp, Homo sapiens
cacacagcccag

SEQ ID NO: 1421551 - DNA, 13 bp, Homo sapiens
cacacagcccagt

SEQ ID NO: 1421552 - DNA, 15 bp, Homo sapiens
cacacagcccagttc

SEQ ID NO: 1421553 - DNA, 18 bp, Homo sapiens
cacacagctactctcccc

SEQ ID NO: 1421554 - DNA, 15 bp, Homo sapiens
cacacagctgagcac

SEQ ID NO: 1421555 - DNA, 13 bp, Homo sapiens
cacacagctgccc

SEQ ID NO: 1421556 - DNA, 15 bp, Homo sapiens
cacacagctgcccta

SEQ ID NO: 1421557 - DNA, 16 bp, Homo sapiens
cacacagctgccctag

SEQ ID NO: 1421558 - DNA, 13 bp, Homo sapiens
cacacaggcaact

SEQ ID NO: 1421559 - DNA, 16 bp, Homo sapiens
cacacaggcaactgag

SEQ ID NO: 1421560 - DNA, 12 bp, Homo sapiens
cacacagggcac

SEQ ID NO: 1421561 - DNA, 17 bp, Homo sapiens
cacacaggtacagcaac

SEQ ID NO: 1421562 - DNA, 18 bp, Homo sapiens
cacacatacgtgcacagg

SEQ ID NO: 1421563 - DNA, 20 bp, Homo sapiens
cacacatacgtgcacagggt

SEQ ID NO: 1421564 - DNA, 23 bp, Homo sapiens
cacacatataaacatcacacaca

SEQ ID NO: 1421565 - DNA, 11 bp, Homo sapiens
cacacatatat

SEQ ID NO: 1421566 - DNA, 14 bp, Homo sapiens
cacacatcccagga

SEQ ID NO: 1421567 - DNA, 14 bp, Homo sapiens
cacacatctggccc

SEQ ID NO: 1421568 - DNA, 20 bp, Homo sapiens
cacacatctgggtgccctga

SEQ ID NO: 1421569 - DNA, 14 bp, Homo sapiens
cacacatgccctcc

SEQ ID NO: 1421570 - DNA, 16 bp, Homo sapiens
cacacatgccctcctg

SEQ ID NO: 1421571 - DNA, 18 bp, Homo sapiens
cacaccactaaccatccc

SEQ ID NO: 1421572 - DNA, 21 bp, Homo sapiens
cacaccactaaccatccccaa

SEQ ID NO: 1421573 - DNA, 16 bp, Homo sapiens
cacaccagaagatgtg

SEQ ID NO: 1421574 - DNA, 16 bp, Homo sapiens
cacaccagccgctgca

SEQ ID NO: 1421575 - DNA, 18 bp, Homo sapiens
cacaccaggcgctaattc

SEQ ID NO: 1421576 - DNA, 19 bp, Homo sapiens
cacacccaaagctgagcct

SEQ ID NO: 1421577 - DNA, 23 bp, Homo sapiens
cacacccaggcacttaagcacaa

SEQ ID NO: 1421578 - DNA, 20 bp, Homo sapiens
cacacccctggggctgagtc

SEQ ID NO: 1421579 - DNA, 17 bp, Homo sapiens
cacacccctgtcccacc

SEQ ID NO: 1421580 - DNA, 18 bp, Homo sapiens
cacacccctgtcccaccc

SEQ ID NO: 1421581 - DNA, 13 bp, Homo sapiens
cacaccctacctt

SEQ ID NO: 1421582 - DNA, 15 bp, Homo sapiens
cacaccctaccttcc

SEQ ID NO: 1421583 - DNA, 18 bp, Homo sapiens
cacaccctaccttcccca

SEQ ID NO: 1421584 - DNA, 14 bp, Homo sapiens
cacaccctccccat

SEQ ID NO: 1421585 - DNA, 23 bp, Homo sapiens
cacaccctccccattcagacact

SEQ ID NO: 1421586 - DNA, 22 bp, Homo sapiens
cacaccgccagcagcgcgcagg

SEQ ID NO: 1421587 - DNA, 20 bp, Homo sapiens
cacaccgcggccaggcaccc

SEQ ID NO: 1421588 - DNA, 22 bp, Homo sapiens
cacaccgcggccaggcacccat

SEQ ID NO: 1421589 - DNA, 24 bp, Homo sapiens
cacaccgcggccaggcacccatgt

SEQ ID NO: 1421590 - DNA, 22 bp, Homo sapiens
cacaccgctggtccctgccctc

SEQ ID NO: 1421591 - DNA, 13 bp, Homo sapiens
cacacctcagttc

SEQ ID NO: 1421592 - DNA, 16 bp, Homo sapiens
cacctatagtcccagc

SEQ ID NO: 1421593 - DNA, 18 bp, Homo sapiens
cacctcaaggtcatcaaa

SEQ ID NO: 1421594 - DNA, 14 bp, Homo sapiens
cacctcactcctgt

SEQ ID NO: 1421595 - DNA, 15 bp, Homo sapiens
cacctcactcctgtt

SEQ ID NO: 1421596 - DNA, 11 bp, Homo sapiens
cacctcagagc

SEQ ID NO: 1421597 - DNA, 13 bp, Homo sapiens
cacctcagagcag

SEQ ID NO: 1421598 - DNA, 13 bp, Homo sapiens
cacctcagcccca

SEQ ID NO: 1421599 - DNA, 16 bp, Homo sapiens
cacctcagccccactg

SEQ ID NO: 1421600 - DNA, 17 bp, Homo sapiens
cacctcagcctgcacag

SEQ ID NO: 1421601 - DNA, 12 bp, Homo sapiens
cacctcagcctt

SEQ ID NO: 1421602 - DNA, 12 bp, Homo sapiens
cacctcagctga

SEQ ID NO: 1421603 - DNA, 11 bp, Homo sapiens
cacctcagggc

SEQ ID NO: 1421604 - DNA, 13 bp, Homo sapiens
cacctcagggcac

SEQ ID NO: 1421605 - DNA, 16 bp, Homo sapiens
cacctcagtgggaaga

SEQ ID NO: 1421606 - DNA, 19 bp, Homo sapiens
cacctcagttcccttggcc

SEQ ID NO: 1421607 - DNA, 16 bp, Homo sapiens
cacctcatcactggac

SEQ ID NO: 1421608 - DNA, 17 bp, Homo sapiens
cacctcatcactggact

SEQ ID NO: 1421609 - DNA, 16 bp, Homo sapiens
cacctcatgcccaccc

SEQ ID NO: 1421610 - DNA, 19 bp, Homo sapiens
cacctcatgcccaccccct

SEQ ID NO: 1421611 - DNA, 19 bp, Homo sapiens
cacctcattctgaaccctt

SEQ ID NO: 1421612 - DNA, 18 bp, Homo sapiens
cacctccaagcatttcat

SEQ ID NO: 1421613 - DNA, 22 bp, Homo sapiens
cacctccacccccgccacggcc

SEQ ID NO: 1421614 - DNA, 15 bp, Homo sapiens
cacctccaggcaggc

SEQ ID NO: 1421615 - DNA, 21 bp, Homo sapiens
cacctccaggcaggccaggct

SEQ ID NO: 1421616 - DNA, 22 bp, Homo sapiens
cacctcccaccccactccagcc

SEQ ID NO: 1421617 - DNA, 17 bp, Homo sapiens
cacctcccactcctgct

SEQ ID NO: 1421618 - DNA, 20 bp, Homo sapiens
cacctcccactcctgctgca

SEQ ID NO: 1421619 - DNA, 10 bp, Homo sapiens
cacctcccag

SEQ ID NO: 1421620 - DNA, 15 bp, Homo sapiens
cacctcccagcccct

SEQ ID NO: 1421621 - DNA, 16 bp, Homo sapiens
cacctcccagcccctg

SEQ ID NO: 1421622 - DNA, 15 bp, Homo sapiens
cacctccccccactg

SEQ ID NO: 1421623 - DNA, 23 bp, Homo sapiens
cacctccccctccccggccacat

SEQ ID NO: 1421624 - DNA, 24 bp, Homo sapiens
cacctccccctgctgctgctgccc

SEQ ID NO: 1421625 - DNA, 22 bp, Homo sapiens
cacctccccctttcacactgga

SEQ ID NO: 1421626 - DNA, 13 bp, Homo sapiens
cacctcccctatc

SEQ ID NO: 1421627 - DNA, 14 bp, Homo sapiens
cacctcccctatcc

SEQ ID NO: 1421628 - DNA, 20 bp, Homo sapiens
cacctcccctatccacccag

SEQ ID NO: 1421629 - DNA, 21 bp, Homo sapiens
cacctccctactcccctgggc

SEQ ID NO: 1421630 - DNA, 14 bp, Homo sapiens
cacctccctcccca

SEQ ID NO: 1421631 - DNA, 19 bp, Homo sapiens
cacctccctgaaccatccc

SEQ ID NO: 1421632 - DNA, 14 bp, Homo sapiens
cacctccctgaccc

SEQ ID NO: 1421633 - DNA, 12 bp, Homo sapiens
cacctcccttcc

SEQ ID NO: 1421634 - DNA, 14 bp, Homo sapiens
cacctcccttccct

SEQ ID NO: 1421635 - DNA, 22 bp, Homo sapiens
cacctcctagaggtgggcagct

SEQ ID NO: 1421636 - DNA, 23 bp, Homo sapiens
cacctcctagaggtgggcagctg

SEQ ID NO: 1421637 - DNA, 13 bp, Homo sapiens
cacctcctccact

SEQ ID NO: 1421638 - DNA, 11 bp, Homo sapiens
cacctcctccc

SEQ ID NO: 1421639 - DNA, 13 bp, Homo sapiens
cacctcctccccc

SEQ ID NO: 1421640 - DNA, 15 bp, Homo sapiens
cacctcctccccctg

SEQ ID NO: 1421641 - DNA, 20 bp, Homo sapiens
cacctcctccccctgttctg

SEQ ID NO: 1421642 - DNA, 20 bp, Homo sapiens
cacctcctcgaacccactcc

SEQ ID NO: 1421643 - DNA, 21 bp, Homo sapiens
cacctcctcgaacccactccg

SEQ ID NO: 1421644 - DNA, 19 bp, Homo sapiens
cacctcgcaggttcaagca

SEQ ID NO: 1421645 - DNA, 19 bp, Homo sapiens
cacctcgcccttcagccca

SEQ ID NO: 1421646 - DNA, 20 bp, Homo sapiens
cacctcgcccttcagcccac

SEQ ID NO: 1421647 - DNA, 20 bp, Homo sapiens
cacctcggagggatggagaa

SEQ ID NO: 1421648 - DNA, 14 bp, Homo sapiens
cacctcgtctccct

SEQ ID NO: 1421649 - DNA, 12 bp, Homo sapiens
cacctctccaag

SEQ ID NO: 1421650 - DNA, 13 bp, Homo sapiens
cacctctccaagg

SEQ ID NO: 1421651 - DNA, 16 bp, Homo sapiens
cacctctcctgccctg

SEQ ID NO: 1421652 - DNA, 16 bp, Homo sapiens
cacctctctcctttgc

SEQ ID NO: 1421653 - DNA, 13 bp, Homo sapiens
cacctctgcctca

SEQ ID NO: 1421654 - DNA, 13 bp, Homo sapiens
cacctctgcctct

SEQ ID NO: 1421655 - DNA, 13 bp, Homo sapiens
cacctctggactg

SEQ ID NO: 1421656 - DNA, 17 bp, Homo sapiens
cacctctggactggcta

SEQ ID NO: 1421657 - DNA, 18 bp, Homo sapiens
cacctctggctagagccg

SEQ ID NO: 1421658 - DNA, 20 bp, Homo sapiens
cacctctggctagagccgag

SEQ ID NO: 1421659 - DNA, 18 bp, Homo sapiens
cacctctggtggctcctc

SEQ ID NO: 1421660 - DNA, 11 bp, Homo sapiens
cacctcttcca

SEQ ID NO: 1421661 - DNA, 12 bp, Homo sapiens
cacctcttcctc

SEQ ID NO: 1421662 - DNA, 18 bp, Homo sapiens
caagtggggtgctgggag

SEQ ID NO: 1421663 - DNA, 21 bp, Homo sapiens
caagtggggtgctgggaggag

SEQ ID NO: 1421664 - DNA, 20 bp, Homo sapiens
caagtggtagcaagaagtga

SEQ ID NO: 1421665 - DNA, 13 bp, Homo sapiens
caagtggtccagc

SEQ ID NO: 1421666 - DNA, 23 bp, Homo sapiens
caagtggtccagcgtcactccag

SEQ ID NO: 1421667 - DNA, 21 bp, Homo sapiens
caagtgtgggccactgtggtg

SEQ ID NO: 1421668 - DNA, 23 bp, Homo sapiens
caagtgtggtagggacttaaaaa

SEQ ID NO: 1421669 - DNA, 21 bp, Homo sapiens
caagtgttcttaggtttactg

SEQ ID NO: 1421670 - DNA, 24 bp, Homo sapiens
caagtgttcttaggtttactgtga

SEQ ID NO: 1421671 - DNA, 18 bp, Homo sapiens
caagttaaagtgaataac

SEQ ID NO: 1421672 - DNA, 16 bp, Homo sapiens
caagttaacaaggaat

SEQ ID NO: 1421673 - DNA, 14 bp, Homo sapiens
caagttagctcagg

SEQ ID NO: 1421674 - DNA, 16 bp, Homo sapiens
caagttagctcaggag

SEQ ID NO: 1421675 - DNA, 19 bp, Homo sapiens
caagttattcaaatttgta

SEQ ID NO: 1421676 - DNA, 16 bp, Homo sapiens
caagttattctcttca

SEQ ID NO: 1421677 - DNA, 18 bp, Homo sapiens
caagttccaagttgctaa

SEQ ID NO: 1421678 - DNA, 15 bp, Homo sapiens
caagttcccaactga

SEQ ID NO: 1421679 - DNA, 21 bp, Homo sapiens
caagttcctctagtgccctcc

SEQ ID NO: 1421680 - DNA, 12 bp, Homo sapiens
caagttctaaga

SEQ ID NO: 1421681 - DNA, 18 bp, Homo sapiens
caagttctaagattctaa

SEQ ID NO: 1421682 - DNA, 15 bp, Homo sapiens
caagttgcgacggag

SEQ ID NO: 1421683 - DNA, 20 bp, Homo sapiens
caagttgcgacggagagaaa

SEQ ID NO: 1421684 - DNA, 23 bp, Homo sapiens
caagttgcgacggagagaaaaaa

SEQ ID NO: 1421685 - DNA, 16 bp, Homo sapiens
caagttgctgtcactg

SEQ ID NO: 1421686 - DNA, 18 bp, Homo sapiens
caagttggatgcggccat

SEQ ID NO: 1421687 - DNA, 20 bp, Homo sapiens
caagttgggttcacttgcca

SEQ ID NO: 1421688 - DNA, 14 bp, Homo sapiens
caagttgttaaaac

SEQ ID NO: 1421689 - DNA, 14 bp, Homo sapiens
caagttgttgactg

SEQ ID NO: 1421690 - DNA, 14 bp, Homo sapiens
caagtttatatata

SEQ ID NO: 1421691 - DNA, 16 bp, Homo sapiens
caagtttcagacaggg

SEQ ID NO: 1421692 - DNA, 16 bp, Homo sapiens
caagtttccatagcaa

SEQ ID NO: 1421693 - DNA, 22 bp, Homo sapiens
caagtttctagctagaaatatg

SEQ ID NO: 1421694 - DNA, 21 bp, Homo sapiens
caagttttcttccatgatttt

SEQ ID NO: 1421695 - DNA, 19 bp, Homo sapiens
caagttttgtataaataat

SEQ ID NO: 1421696 - DNA, 13 bp, Homo sapiens
caataaaaaaaag

SEQ ID NO: 1421697 - DNA, 11 bp, Homo sapiens
caataaaaaat

SEQ ID NO: 1421698 - DNA, 17 bp, Homo sapiens
caataaaaatgtttaac

SEQ ID NO: 1421699 - DNA, 12 bp, Homo sapiens
caataaaagtga

SEQ ID NO: 1421700 - DNA, 22 bp, Homo sapiens
caataaaatgtgatttttctga

SEQ ID NO: 1421701 - DNA, 13 bp, Homo sapiens
caataaaatttaa

SEQ ID NO: 1421702 - DNA, 20 bp, Homo sapiens
caataaaatttaaaaaataa

SEQ ID NO: 1421703 - DNA, 20 bp, Homo sapiens
caataaacttagaggaaaat

SEQ ID NO: 1421704 - DNA, 12 bp, Homo sapiens
caataaaggcag

SEQ ID NO: 1421705 - DNA, 13 bp, Homo sapiens
caataaaggcagc

SEQ ID NO: 1421706 - DNA, 19 bp, Homo sapiens
caataaaggcagctgcctc

SEQ ID NO: 1421707 - DNA, 21 bp, Homo sapiens
caataaaggcagctgcctctg

SEQ ID NO: 1421708 - DNA, 23 bp, Homo sapiens
caataaaggcagctgcctctgct

SEQ ID NO: 1421709 - DNA, 23 bp, Homo sapiens
caataaaggtcccttagccccga

SEQ ID NO: 1421710 - DNA, 18 bp, Homo sapiens
caataaagtataatgttt

SEQ ID NO: 1421711 - DNA, 20 bp, Homo sapiens
caataaagtataatgtttat

SEQ ID NO: 1421712 - DNA, 14 bp, Homo sapiens
caataaagtttaca

SEQ ID NO: 1421713 - DNA, 17 bp, Homo sapiens
caataaatatgtattac

SEQ ID NO: 1421714 - DNA, 20 bp, Homo sapiens
caataaatctgacccagtgc

SEQ ID NO: 1421715 - DNA, 15 bp, Homo sapiens
caataaatgtctgtt

SEQ ID NO: 1421716 - DNA, 16 bp, Homo sapiens
caataaatgtttgtta

SEQ ID NO: 1421717 - DNA, 15 bp, Homo sapiens
caataaatttgtaac

SEQ ID NO: 1421718 - DNA, 23 bp, Homo sapiens
caataaattttttttggtcaaat

SEQ ID NO: 1421719 - DNA, 17 bp, Homo sapiens
caataacactgtatttt

SEQ ID NO: 1421720 - DNA, 22 bp, Homo sapiens
caataacactgtattttaatgt

SEQ ID NO: 1421721 - DNA, 20 bp, Homo sapiens
caataacttctatattttaa

SEQ ID NO: 1421722 - DNA, 22 bp, Homo sapiens
caataacttctatattttaata

SEQ ID NO: 1421723 - DNA, 23 bp, Homo sapiens
caataaggtcaagggaaaacccc

SEQ ID NO: 1421724 - DNA, 17 bp, Homo sapiens
caataatatttcaagtg

SEQ ID NO: 1421725 - DNA, 21 bp, Homo sapiens
caataatatttcaagtgccta

SEQ ID NO: 1421726 - DNA, 18 bp, Homo sapiens
caataatggtcccatcca

SEQ ID NO: 1421727 - DNA, 20 bp, Homo sapiens
caataatggtcccatccagg

SEQ ID NO: 1421728 - DNA, 16 bp, Homo sapiens
caataattgcagaact

SEQ ID NO: 1421729 - DNA, 18 bp, Homo sapiens
caataatttgtacaatgg

SEQ ID NO: 1421730 - DNA, 22 bp, Homo sapiens
caataatttgtacaatggttta

SEQ ID NO: 1421731 - DNA, 15 bp, Homo sapiens
caatacaaatggatt

SEQ ID NO: 1421732 - DNA, 19 bp, Homo sapiens
caatacactagttgtttct

SEQ ID NO: 1421733 - DNA, 21 bp, Homo sapiens
caatacagtattatagacaaa

SEQ ID NO: 1421734 - DNA, 15 bp, Homo sapiens
caatacatttgtatt

SEQ ID NO: 1421735 - DNA, 20 bp, Homo sapiens
caataccagcaggaggttct

SEQ ID NO: 1421736 - DNA, 23 bp, Homo sapiens
caatacgtttgtgcagaatctct

SEQ ID NO: 1421737 - DNA, 19 bp, Homo sapiens
caatacttttgtgtattct

SEQ ID NO: 1421738 - DNA, 23 bp, Homo sapiens
caatagaaggatgtacatttcca

SEQ ID NO: 1421739 - DNA, 13 bp, Homo sapiens
caatagaatttat

SEQ ID NO: 1421740 - DNA, 16 bp, Homo sapiens
caatagacacatacat

SEQ ID NO: 1421741 - DNA, 22 bp, Homo sapiens
caatagagactgtagattgctt

SEQ ID NO: 1421742 - DNA, 15 bp, Homo sapiens
caatagatctccagc

SEQ ID NO: 1421743 - DNA, 16 bp, Homo sapiens
caatagcacatatgga

SEQ ID NO: 1421744 - DNA, 17 bp, Homo sapiens
caatagcacatatggaa

SEQ ID NO: 1421745 - DNA, 13 bp, Homo sapiens
caataggaaagca

SEQ ID NO: 1421746 - DNA, 18 bp, Homo sapiens
caataggaaagcatatgc

SEQ ID NO: 1421747 - DNA, 22 bp, Homo sapiens
caataggcagactgggtttcta

SEQ ID NO: 1421748 - DNA, 21 bp, Homo sapiens
caatagggtagaatgattaat

SEQ ID NO: 1421749 - DNA, 18 bp, Homo sapiens
caatagtatagaagtctg

SEQ ID NO: 1421750 - DNA, 13 bp, Homo sapiens
caatagtgcaaca

SEQ ID NO: 1421751 - DNA, 15 bp, Homo sapiens
caatagttgaattag

SEQ ID NO: 1421752 - DNA, 16 bp, Homo sapiens
caatagttttttactt

SEQ ID NO: 1421753 - DNA, 18 bp, Homo sapiens
caatataaaactgtactt

SEQ ID NO: 1421754 - DNA, 23 bp, Homo sapiens
caatataaaaggcaaatgtgtac

SEQ ID NO: 1421755 - DNA, 23 bp, Homo sapiens
caatataactatgtggctgaaaa

SEQ ID NO: 1421756 - DNA, 13 bp, Homo sapiens
caatataagaagc

SEQ ID NO: 1421757 - DNA, 22 bp, Homo sapiens
caatataagcataaaagatcac

SEQ ID NO: 1421758 - DNA, 21 bp, Homo sapiens
caatataatctttgaatttct

SEQ ID NO: 1421759 - DNA, 22 bp, Homo sapiens
caatatagaaaaataaaaatct

SEQ ID NO: 1421760 - DNA, 19 bp, Homo sapiens
caatatagaaacacgaact

SEQ ID NO: 1421761 - DNA, 20 bp, Homo sapiens
caatatagttttttctttcc

SEQ ID NO: 1421762 - DNA, 16 bp, Homo sapiens
caatatattaccagca

SEQ ID NO: 1421763 - DNA, 14 bp, Homo sapiens
caatatattgaact

SEQ ID NO: 1421764 - DNA, 13 bp, Homo sapiens
caatatcagtgct

SEQ ID NO: 1421765 - DNA, 17 bp, Homo sapiens
caatatcgtacctgtcc

SEQ ID NO: 1421766 - DNA, 18 bp, Homo sapiens
caatatcgtacctgtccc

SEQ ID NO: 1421767 - DNA, 13 bp, Homo sapiens
caatatctgaagc

SEQ ID NO: 1421768 - DNA, 23 bp, Homo sapiens
caatatctgaagccctcccaggt

SEQ ID NO: 1421769 - DNA, 16 bp, Homo sapiens
caatatgaatctataa

SEQ ID NO: 1421770 - DNA, 19 bp, Homo sapiens
caatatgaatctataagta

SEQ ID NO: 1421771 - DNA, 17 bp, Homo sapiens
caatatgtgagtgcctt

SEQ ID NO: 1421772 - DNA, 22 bp, Homo sapiens
caatattaaatacagacactaa

SEQ ID NO: 1421773 - DNA, 23 bp, Homo sapiens
caatattaaatacagacactaag

SEQ ID NO: 1421774 - DNA, 22 bp, Homo sapiens
caatattaacacgctgcctggt

SEQ ID NO: 1421775 - DNA, 13 bp, Homo sapiens
caagggagggtgc

SEQ ID NO: 1421776 - DNA, 15 bp, Homo sapiens
caagggatataaaat

SEQ ID NO: 1421777 - DNA, 18 bp, Homo sapiens
caagggcaagaacccaag

SEQ ID NO: 1421778 - DNA, 15 bp, Homo sapiens
caagggcccagagtg

SEQ ID NO: 1421779 - DNA, 14 bp, Homo sapiens
caagggccctggca

SEQ ID NO: 1421780 - DNA, 15 bp, Homo sapiens
caagggcccttctct

SEQ ID NO: 1421781 - DNA, 13 bp, Homo sapiens
caagggctccagc

SEQ ID NO: 1421782 - DNA, 19 bp, Homo sapiens
caagggctccagcatccag

SEQ ID NO: 1421783 - DNA, 23 bp, Homo sapiens
caagggctccagcatccagcctg

SEQ ID NO: 1421784 - DNA, 21 bp, Homo sapiens
caagggctgcaatgccctcat

SEQ ID NO: 1421785 - DNA, 14 bp, Homo sapiens
caagctaagcactg

SEQ ID NO: 1421786 - DNA, 16 bp, Homo sapiens
caagctaagcactgcc

SEQ ID NO: 1421787 - DNA, 15 bp, Homo sapiens
caagctagccagagg

SEQ ID NO: 1421788 - DNA, 15 bp, Homo sapiens
caagctaggccccag

SEQ ID NO: 1421789 - DNA, 15 bp, Homo sapiens
caagctatttaatat

SEQ ID NO: 1421790 - DNA, 16 bp, Homo sapiens
caagctcacagttcct

SEQ ID NO: 1421791 - DNA, 15 bp, Homo sapiens
caagctcagaataga

SEQ ID NO: 1421792 - DNA, 21 bp, Homo sapiens
caagctcagcacaatctgtaa

SEQ ID NO: 1421793 - DNA, 15 bp, Homo sapiens
caagctcatctattt

SEQ ID NO: 1421794 - DNA, 17 bp, Homo sapiens
caatccatgtaaggtat

SEQ ID NO: 1421795 - DNA, 16 bp, Homo sapiens
caatcccaccaaccct

SEQ ID NO: 1421796 - DNA, 12 bp, Homo sapiens
caatcccctcct

SEQ ID NO: 1421797 - DNA, 16 bp, Homo sapiens
caatcccctccttggg

SEQ ID NO: 1421798 - DNA, 22 bp, Homo sapiens
caatcctaacacattatcggga

SEQ ID NO: 1421799 - DNA, 20 bp, Homo sapiens
caatcctaatttctcctccc

SEQ ID NO: 1421800 - DNA, 18 bp, Homo sapiens
caatcctagaaccaagct

SEQ ID NO: 1421801 - DNA, 20 bp, Homo sapiens
caatcctagaaccaagcttc

SEQ ID NO: 1421802 - DNA, 21 bp, Homo sapiens
caatcctagaaccaagcttca

SEQ ID NO: 1421803 - DNA, 22 bp, Homo sapiens
caatcctcccacttcagcctcc

SEQ ID NO: 1421804 - DNA, 12 bp, Homo sapiens
caatcctctctc

SEQ ID NO: 1421805 - DNA, 18 bp, Homo sapiens
caatcctgattcctctct

SEQ ID NO: 1421806 - DNA, 17 bp, Homo sapiens
caatcctgttactctgt

SEQ ID NO: 1421807 - DNA, 19 bp, Homo sapiens
caatccttccctgctcttg

SEQ ID NO: 1421808 - DNA, 15 bp, Homo sapiens
caatccttttgataa

SEQ ID NO: 1421809 - DNA, 14 bp, Homo sapiens
caatcggactgcca

SEQ ID NO: 1421810 - DNA, 17 bp, Homo sapiens
caatcggactgccaaat

SEQ ID NO: 1421811 - DNA, 21 bp, Homo sapiens
caatctaacaataatatttca

SEQ ID NO: 1421812 - DNA, 15 bp, Homo sapiens
caatctactggaaat

SEQ ID NO: 1421813 - DNA, 19 bp, Homo sapiens
caatctatggcttatttct

SEQ ID NO: 1421814 - DNA, 11 bp, Homo sapiens
caatctctgtt

SEQ ID NO: 1421815 - DNA, 14 bp, Homo sapiens
caatctctgttctg

SEQ ID NO: 1421816 - DNA, 15 bp, Homo sapiens
caatctctgttctgc

SEQ ID NO: 1421817 - DNA, 22 bp, Homo sapiens
caatctcttcattattctctgc

SEQ ID NO: 1421818 - DNA, 17 bp, Homo sapiens
caatctctttttgtttg

SEQ ID NO: 1421819 - DNA, 19 bp, Homo sapiens
caatctggcttagtgccac

SEQ ID NO: 1421820 - DNA, 17 bp, Homo sapiens
caatctgtaaactgtgt

SEQ ID NO: 1421821 - DNA, 12 bp, Homo sapiens
caatctgtgggc

SEQ ID NO: 1421822 - DNA, 17 bp, Homo sapiens
caatcttggggctgatg

SEQ ID NO: 1421823 - DNA, 21 bp, Homo sapiens
caatcttggggctgatgaaga

SEQ ID NO: 1421824 - DNA, 12 bp, Homo sapiens
caatctttgaaa

SEQ ID NO: 1421825 - DNA, 19 bp, Homo sapiens
caatctttgaaataaaaaa

SEQ ID NO: 1421826 - DNA, 12 bp, Homo sapiens
caatctttgctg

SEQ ID NO: 1421827 - DNA, 17 bp, Homo sapiens
caatcttttaaattgca

SEQ ID NO: 1421828 - DNA, 14 bp, Homo sapiens
caatgaaaacatgt

SEQ ID NO: 1421829 - DNA, 15 bp, Homo sapiens
caatgaaaacatgta

SEQ ID NO: 1421830 - DNA, 20 bp, Homo sapiens
caatgaaaacatgtactaca

SEQ ID NO: 1421831 - DNA, 23 bp, Homo sapiens
caatgaaatgaattaaagtggac

SEQ ID NO: 1421832 - DNA, 18 bp, Homo sapiens
caatgaacacttataagt

SEQ ID NO: 1421833 - DNA, 16 bp, Homo sapiens
caatgaacggccttgc

SEQ ID NO: 1421834 - DNA, 19 bp, Homo sapiens
caatgaagggaaattgttt

SEQ ID NO: 1421835 - DNA, 13 bp, Homo sapiens
caatgaattatta

SEQ ID NO: 1421836 - DNA, 14 bp, Homo sapiens
caatgacacagtct

SEQ ID NO: 1421837 - DNA, 21 bp, Homo sapiens
caatgacacagtcttggctca

SEQ ID NO: 1421838 - DNA, 21 bp, Homo sapiens
caatgactcgttacctgccgc

SEQ ID NO: 1421839 - DNA, 21 bp, Homo sapiens
caatgagactctagggtccag

SEQ ID NO: 1421840 - DNA, 11 bp, Homo sapiens
caatgagccat

SEQ ID NO: 1421841 - DNA, 16 bp, Homo sapiens
caatgatggcaatttt

SEQ ID NO: 1421842 - DNA, 14 bp, Homo sapiens
caatgatggtcacc

SEQ ID NO: 1421843 - DNA, 21 bp, Homo sapiens
caatgcaaatagtagacattt

SEQ ID NO: 1421844 - DNA, 16 bp, Homo sapiens
caatgcaagagtgatt

SEQ ID NO: 1421845 - DNA, 17 bp, Homo sapiens
caatgcatttaaaatac

SEQ ID NO: 1421846 - DNA, 15 bp, Homo sapiens
caatgccatgaacaa

SEQ ID NO: 1421847 - DNA, 17 bp, Homo sapiens
caatgccatgaacaaat

SEQ ID NO: 1421848 - DNA, 18 bp, Homo sapiens
caatgccatttcagtggc

SEQ ID NO: 1421849 - DNA, 17 bp, Homo sapiens
caatgccgcaacatata

SEQ ID NO: 1421850 - DNA, 20 bp, Homo sapiens
caatgcctcttgtcttccta

SEQ ID NO: 1421851 - DNA, 14 bp, Homo sapiens
caatgcctgtgaag

SEQ ID NO: 1421852 - DNA, 15 bp, Homo sapiens
caatgcctgtgaagc

SEQ ID NO: 1421853 - DNA, 14 bp, Homo sapiens
caatgcctttttag

SEQ ID NO: 1421854 - DNA, 17 bp, Homo sapiens
caatgctatcactgtct

SEQ ID NO: 1421855 - DNA, 16 bp, Homo sapiens
caatgctgatttggtg

SEQ ID NO: 1421856 - DNA, 21 bp, Homo sapiens
caatgctgatttggtgaccaa

SEQ ID NO: 1421857 - DNA, 19 bp, Homo sapiens
caatgctttgggaggccaa

SEQ ID NO: 1421858 - DNA, 22 bp, Homo sapiens
caatgctttgggaggccaaggc

SEQ ID NO: 1421859 - DNA, 17 bp, Homo sapiens
caatggaaactgaatgc

SEQ ID NO: 1421860 - DNA, 20 bp, Homo sapiens
caatggagactgtctcaaga

SEQ ID NO: 1421861 - DNA, 13 bp, Homo sapiens
caatggatttgat

SEQ ID NO: 1421862 - DNA, 14 bp, Homo sapiens
caatggcagctaga

SEQ ID NO: 1421863 - DNA, 19 bp, Homo sapiens
caatggcagctagactgga

SEQ ID NO: 1421864 - DNA, 22 bp, Homo sapiens
caatggcagctagactggagtg

SEQ ID NO: 1421865 - DNA, 23 bp, Homo sapiens
caatggcagctagactggagtga

SEQ ID NO: 1421866 - DNA, 14 bp, Homo sapiens
caatgggtggtgaa

SEQ ID NO: 1421867 - DNA, 14 bp, Homo sapiens
caatggtgcttccc

SEQ ID NO: 1421868 - DNA, 17 bp, Homo sapiens
caatggtgcttccccca

SEQ ID NO: 1421869 - DNA, 19 bp, Homo sapiens
caatggtgtagctgtcctc

SEQ ID NO: 1421870 - DNA, 13 bp, Homo sapiens
caatggtttattc

SEQ ID NO: 1421871 - DNA, 15 bp, Homo sapiens
caatggtttgtgtca

SEQ ID NO: 1421872 - DNA, 14 bp, Homo sapiens
caatgtacaattat

SEQ ID NO: 1421873 - DNA, 17 bp, Homo sapiens
caatgtacaattatgtc

SEQ ID NO: 1421874 - DNA, 18 bp, Homo sapiens
caatgtacaattatgtct

SEQ ID NO: 1421875 - DNA, 22 bp, Homo sapiens
caatgtacaattatgtctcttg

SEQ ID NO: 1421876 - DNA, 20 bp, Homo sapiens
caatgtactcttccgatgtt

SEQ ID NO: 1421877 - DNA, 22 bp, Homo sapiens
caatgtactcttccgatgtttg

SEQ ID NO: 1421878 - DNA, 14 bp, Homo sapiens
caatgtatctttat

SEQ ID NO: 1421879 - DNA, 13 bp, Homo sapiens
caatgtatgtaca

SEQ ID NO: 1421880 - DNA, 15 bp, Homo sapiens
caatgtatgtacaat

SEQ ID NO: 1421881 - DNA, 17 bp, Homo sapiens
caatgtatgtacaatac

SEQ ID NO: 1421882 - DNA, 17 bp, Homo sapiens
caatgtatgtgtggctg

SEQ ID NO: 1421883 - DNA, 12 bp, Homo sapiens
caatgtatttta

SEQ ID NO: 1421884 - DNA, 18 bp, Homo sapiens
caatgtcacaacctctct

SEQ ID NO: 1421885 - DNA, 21 bp, Homo sapiens
caatgtcacaacctctctgat

SEQ ID NO: 1421886 - DNA, 14 bp, Homo sapiens
caatgtcaggaaca

SEQ ID NO: 1421887 - DNA, 19 bp, Homo sapiens
caatgtcaggaacagaagg

SEQ ID NO: 1421888 - DNA, 20 bp, Homo sapiens
caatgtctgtgctagggaaa

SEQ ID NO: 1421889 - DNA, 22 bp, Homo sapiens
caatgtgaagttcatcttgcag

SEQ ID NO: 1421890 - DNA, 18 bp, Homo sapiens
caatgtgaatcagaccct

SEQ ID NO: 1421891 - DNA, 17 bp, Homo sapiens
caaccccccacctgcca

SEQ ID NO: 1421892 - DNA, 15 bp, Homo sapiens
caaccccccagcact

SEQ ID NO: 1421893 - DNA, 18 bp, Homo sapiens
caaccccccagcactgag

SEQ ID NO: 1421894 - DNA, 20 bp, Homo sapiens
caaccccccagcactgagga

SEQ ID NO: 1421895 - DNA, 19 bp, Homo sapiens
caaccccccagctcgctgg

SEQ ID NO: 1421896 - DNA, 15 bp, Homo sapiens
caacccccctcctgc

SEQ ID NO: 1421897 - DNA, 18 bp, Homo sapiens
caacccccctcctgctcc

SEQ ID NO: 1421898 - DNA, 22 bp, Homo sapiens
caacccccctcctgctcctccc

SEQ ID NO: 1421899 - DNA, 20 bp, Homo sapiens
caacccccgccacctcaggg

SEQ ID NO: 1421900 - DNA, 19 bp, Homo sapiens
caaccccgcggtgctctgg

SEQ ID NO: 1421901 - DNA, 22 bp, Homo sapiens
caacccctctttcgtctactgc

SEQ ID NO: 1421902 - DNA, 22 bp, Homo sapiens
caacccgtctggcccaccaggg

SEQ ID NO: 1421903 - DNA, 12 bp, Homo sapiens
caaccctctcct

SEQ ID NO: 1421904 - DNA, 14 bp, Homo sapiens
caaccctgccctgc

SEQ ID NO: 1421905 - DNA, 17 bp, Homo sapiens
caaccctgttttatact

SEQ ID NO: 1421906 - DNA, 19 bp, Homo sapiens
caacccttaccccttagcc

SEQ ID NO: 1421907 - DNA, 18 bp, Homo sapiens
caaccgttggaaacataa

SEQ ID NO: 1421908 - DNA, 15 bp, Homo sapiens
caacctaaaactctt

SEQ ID NO: 1421909 - DNA, 13 bp, Homo sapiens
caacctaaatttg

SEQ ID NO: 1421910 - DNA, 15 bp, Homo sapiens
caacctaagcaacag

SEQ ID NO: 1421911 - DNA, 12 bp, Homo sapiens
caacctactgtc

SEQ ID NO: 1421912 - DNA, 14 bp, Homo sapiens
caacctcaatgccc

SEQ ID NO: 1421913 - DNA, 17 bp, Homo sapiens
caacctcaatgccctgc

SEQ ID NO: 1421914 - DNA, 15 bp, Homo sapiens
caacctcagggctcc

SEQ ID NO: 1421915 - DNA, 20 bp, Homo sapiens
caacctcagggctcccaggg

SEQ ID NO: 1421916 - DNA, 13 bp, Homo sapiens
caacctcccatcc

SEQ ID NO: 1421917 - DNA, 14 bp, Homo sapiens
caacctcccatccc

SEQ ID NO: 1421918 - DNA, 21 bp, Homo sapiens
caacctcctgctctgggacgt

SEQ ID NO: 1421919 - DNA, 19 bp, Homo sapiens
caacctctagaattttaag

SEQ ID NO: 1421920 - DNA, 13 bp, Homo sapiens
caacctctccttt

SEQ ID NO: 1421921 - DNA, 20 bp, Homo sapiens
caacctctgcctcccaggtt

SEQ ID NO: 1421922 - DNA, 14 bp, Homo sapiens
caacctctgtatta

SEQ ID NO: 1421923 - DNA, 23 bp, Homo sapiens
caacctgaaggtcccctggcagt

SEQ ID NO: 1421924 - DNA, 23 bp, Homo sapiens
caacctgcccaaagattgatttg

SEQ ID NO: 1421925 - DNA, 13 bp, Homo sapiens
caacctggacttc

SEQ ID NO: 1421926 - DNA, 18 bp, Homo sapiens
caaccttcggctccgggc

SEQ ID NO: 1421927 - DNA, 13 bp, Homo sapiens
caacgaagaaaaa

SEQ ID NO: 1421928 - DNA, 17 bp, Homo sapiens
caacgagacacattgcc

SEQ ID NO: 1421929 - DNA, 19 bp, Homo sapiens
caacgagacacattgcctt

SEQ ID NO: 1421930 - DNA, 12 bp, Homo sapiens
caacgcagccct

SEQ ID NO: 1421931 - DNA, 15 bp, Homo sapiens
caacgcagccctgct

SEQ ID NO: 1421932 - DNA, 14 bp, Homo sapiens
caacgcccctccaa

SEQ ID NO: 1421933 - DNA, 12 bp, Homo sapiens
caacgcccctgt

SEQ ID NO: 1421934 - DNA, 16 bp, Homo sapiens
caacgcccctgtggcc

SEQ ID NO: 1421935 - DNA, 17 bp, Homo sapiens
caacgcccctgtggcca

SEQ ID NO: 1421936 - DNA, 22 bp, Homo sapiens
caacgcccctgtggccaactgc

SEQ ID NO: 1421937 - DNA, 21 bp, Homo sapiens
caacgccgccttggccttgca

SEQ ID NO: 1421938 - DNA, 14 bp, Homo sapiens
caacgccgtgggct

SEQ ID NO: 1421939 - DNA, 22 bp, Homo sapiens
caacggaagccccctcttcctc

SEQ ID NO: 1421940 - DNA, 20 bp, Homo sapiens
caacggaggcctgcgaccct

SEQ ID NO: 1421941 - DNA, 13 bp, Homo sapiens
caacggagtcaaa

SEQ ID NO: 1421942 - DNA, 14 bp, Homo sapiens
caacggcaagacag

SEQ ID NO: 1421943 - DNA, 12 bp, Homo sapiens
caacggccaggg

SEQ ID NO: 1421944 - DNA, 13 bp, Homo sapiens
caacggccagggt

SEQ ID NO: 1421945 - DNA, 14 bp, Homo sapiens
caacggccagggtt

SEQ ID NO: 1421946 - DNA, 20 bp, Homo sapiens
caacggccctgcagccagct

SEQ ID NO: 1421947 - DNA, 23 bp, Homo sapiens
caacgggattgaagggtcctgcc

SEQ ID NO: 1421948 - DNA, 14 bp, Homo sapiens
caacgtagcctggg

SEQ ID NO: 1421949 - DNA, 15 bp, Homo sapiens
caacgtagcttctac

SEQ ID NO: 1421950 - DNA, 15 bp, Homo sapiens
caacgtgagagaaag

SEQ ID NO: 1421951 - DNA, 19 bp, Homo sapiens
caacgtgcaaagccaaggc

SEQ ID NO: 1421952 - DNA, 14 bp, Homo sapiens
caacgtgcgtgtct

SEQ ID NO: 1421953 - DNA, 23 bp, Homo sapiens
caacgtgcgtgtctctgccatgt

SEQ ID NO: 1421954 - DNA, 16 bp, Homo sapiens
caacgtggacctgcct

SEQ ID NO: 1421955 - DNA, 17 bp, Homo sapiens
caacgtggcccagagaa

SEQ ID NO: 1421956 - DNA, 21 bp, Homo sapiens
caacgtggcccagagaagcca

SEQ ID NO: 1421957 - DNA, 23 bp, Homo sapiens
caacgtttacaccgactagccag

SEQ ID NO: 1421958 - DNA, 22 bp, Homo sapiens
caactaaaaatatatctgttgg

SEQ ID NO: 1421959 - DNA, 13 bp, Homo sapiens
caactaagccctc

SEQ ID NO: 1421960 - DNA, 17 bp, Homo sapiens
caactacattttaaaaa

SEQ ID NO: 1421961 - DNA, 11 bp, Homo sapiens
caactacctga

SEQ ID NO: 1421962 - DNA, 15 bp, Homo sapiens
caactacctgagcta

SEQ ID NO: 1421963 - DNA, 21 bp, Homo sapiens
caactactaatagaataaagg

SEQ ID NO: 1421964 - DNA, 21 bp, Homo sapiens
caactagatcaaggagcccag

SEQ ID NO: 1421965 - DNA, 17 bp, Homo sapiens
caactaggcttcagcat

SEQ ID NO: 1421966 - DNA, 19 bp, Homo sapiens
caactataagcccactgtt

SEQ ID NO: 1421967 - DNA, 19 bp, Homo sapiens
caactatattatcatgcaa

SEQ ID NO: 1421968 - DNA, 15 bp, Homo sapiens
caactcacagcttct

SEQ ID NO: 1421969 - DNA, 15 bp, Homo sapiens
caactcctaatttta

SEQ ID NO: 1421970 - DNA, 14 bp, Homo sapiens
caactcctggaagc

SEQ ID NO: 1421971 - DNA, 19 bp, Homo sapiens
caactcgctttaggtcagc

SEQ ID NO: 1421972 - DNA, 21 bp, Homo sapiens
caactctcccaaagggcacac

SEQ ID NO: 1421973 - DNA, 18 bp, Homo sapiens
caactctccccagtgcct

SEQ ID NO: 1421974 - DNA, 21 bp, Homo sapiens
caactctccccagtgcctgcc

SEQ ID NO: 1421975 - DNA, 12 bp, Homo sapiens
caactctgaagc

SEQ ID NO: 1421976 - DNA, 23 bp, Homo sapiens
caactctgaagctaattgtacta

SEQ ID NO: 1421977 - DNA, 13 bp, Homo sapiens
caactctggctcc

SEQ ID NO: 1421978 - DNA, 18 bp, Homo sapiens
caactcttccctgaactt

SEQ ID NO: 1421979 - DNA, 19 bp, Homo sapiens
caactcttcgaagccttgc

SEQ ID NO: 1421980 - DNA, 14 bp, Homo sapiens
caactgaggcagac

SEQ ID NO: 1421981 - DNA, 16 bp, Homo sapiens
caactgaggcagacag

SEQ ID NO: 1421982 - DNA, 17 bp, Homo sapiens
caactgaggcagacagc

SEQ ID NO: 1421983 - DNA, 21 bp, Homo sapiens
caactgaggcagacagcagct

SEQ ID NO: 1421984 - DNA, 21 bp, Homo sapiens
caactgagggccagggaccca

SEQ ID NO: 1421985 - DNA, 18 bp, Homo sapiens
caactgaggttcttggga

SEQ ID NO: 1421986 - DNA, 21 bp, Homo sapiens
caactgaggttcttgggatac

SEQ ID NO: 1421987 - DNA, 16 bp, Homo sapiens
caactgatcctgctcc

SEQ ID NO: 1421988 - DNA, 11 bp, Homo sapiens
caactgcccta

SEQ ID NO: 1421989 - DNA, 13 bp, Homo sapiens
caactgcccttcc

SEQ ID NO: 1421990 - DNA, 15 bp, Homo sapiens
caactgctaatctac

SEQ ID NO: 1421991 - DNA, 13 bp, Homo sapiens
caactgctcagct

SEQ ID NO: 1421992 - DNA, 15 bp, Homo sapiens
caactgctggtgatt

SEQ ID NO: 1421993 - DNA, 13 bp, Homo sapiens
caactggcttctg

SEQ ID NO: 1421994 - DNA, 15 bp, Homo sapiens
caactggcttctgtg

SEQ ID NO: 1421995 - DNA, 17 bp, Homo sapiens
caactggcttctgtgca

SEQ ID NO: 1421996 - DNA, 18 bp, Homo sapiens
caactgtggtagctccag

SEQ ID NO: 1421997 - DNA, 19 bp, Homo sapiens
caactgtggtagctccagc

SEQ ID NO: 1421998 - DNA, 20 bp, Homo sapiens
caactgtggtagctccagcg

SEQ ID NO: 1421999 - DNA, 12 bp, Homo sapiens
caactgtgtgat

SEQ ID NO: 1422000 - DNA, 22 bp, Homo sapiens
caactgtgtgattaaaaggtat

SEQ ID NO: 1422001 - DNA, 18 bp, Homo sapiens
caaaaggtgcctgtgagg

SEQ ID NO: 1422002 - DNA, 19 bp, Homo sapiens
caaaaggttcactaaagca

SEQ ID NO: 1422003 - DNA, 20 bp, Homo sapiens
caaaaggttcactaaagcag

SEQ ID NO: 1422004 - DNA, 19 bp, Homo sapiens
caaaagtcaaaaggtgcct

SEQ ID NO: 1422005 - DNA, 12 bp, Homo sapiens
caaaagttatta

SEQ ID NO: 1422006 - DNA, 17 bp, Homo sapiens
caaaataaaaatgaggt

SEQ ID NO: 1422007 - DNA, 13 bp, Homo sapiens
caaaataaattgg

SEQ ID NO: 1422008 - DNA, 23 bp, Homo sapiens
caaaataccagagccttcaagtg

SEQ ID NO: 1422009 - DNA, 13 bp, Homo sapiens
caaaatagttcta

SEQ ID NO: 1422010 - DNA, 17 bp, Homo sapiens
caaaatagttctatttc

SEQ ID NO: 1422011 - DNA, 22 bp, Homo sapiens
caaaatatattttgtttacaaa

SEQ ID NO: 1422012 - DNA, 18 bp, Homo sapiens
caaaatatttaagtgaag

SEQ ID NO: 1422013 - DNA, 23 bp, Homo sapiens
caaaatatttaagtgaaggagaa

SEQ ID NO: 1422014 - DNA, 17 bp, Homo sapiens
caaaatatttctaagct

SEQ ID NO: 1422015 - DNA, 20 bp, Homo sapiens
caaaatatttctaagcttat

SEQ ID NO: 1422016 - DNA, 22 bp, Homo sapiens
caaaatatttctaagcttattt

SEQ ID NO: 1422017 - DNA, 13 bp, Homo sapiens
caaaatcaagagt

SEQ ID NO: 1422018 - DNA, 20 bp, Homo sapiens
caaaatccaaaacttctctt

SEQ ID NO: 1422019 - DNA, 21 bp, Homo sapiens
caaaatcgatgcagtgcttcc

SEQ ID NO: 1422020 - DNA, 18 bp, Homo sapiens
caaaatcgattggcttta

SEQ ID NO: 1422021 - DNA, 13 bp, Homo sapiens
caaaatctgtcca

SEQ ID NO: 1422022 - DNA, 22 bp, Homo sapiens
caaaatgtctgtagctcctcaa

SEQ ID NO: 1422023 - DNA, 16 bp, Homo sapiens
caaaatgtgtatttct

SEQ ID NO: 1422024 - DNA, 21 bp, Homo sapiens
caaaatgttatcttctcaagt

SEQ ID NO: 1422025 - DNA, 16 bp, Homo sapiens
caaaatgttctattta

SEQ ID NO: 1422026 - DNA, 18 bp, Homo sapiens
caaaatgttctatttaac

SEQ ID NO: 1422027 - DNA, 16 bp, Homo sapiens
caaaatgttgaagaaa

SEQ ID NO: 1422028 - DNA, 17 bp, Homo sapiens
caaaatgttggtcattt

SEQ ID NO: 1422029 - DNA, 18 bp, Homo sapiens
caaaatgttggtcatttt

SEQ ID NO: 1422030 - DNA, 22 bp, Homo sapiens
caaaattaagcaaatgttaaaa

SEQ ID NO: 1422031 - DNA, 16 bp, Homo sapiens
caaaattagccgggca

SEQ ID NO: 1422032 - DNA, 15 bp, Homo sapiens
caaaattcatttcta

SEQ ID NO: 1422033 - DNA, 18 bp, Homo sapiens
caaaattcatttctaatt

SEQ ID NO: 1422034 - DNA, 19 bp, Homo sapiens
caaaattcatttctaatta

SEQ ID NO: 1422035 - DNA, 12 bp, Homo sapiens
caaaattcctgt

SEQ ID NO: 1422036 - DNA, 17 bp, Homo sapiens
caaaattctagctgtat

SEQ ID NO: 1422037 - DNA, 14 bp, Homo sapiens
caaaattgcttcta

SEQ ID NO: 1422038 - DNA, 19 bp, Homo sapiens
caaaattgcttctaaaaca

SEQ ID NO: 1422039 - DNA, 23 bp, Homo sapiens
caaaattgggaaaggagtagaaa

SEQ ID NO: 1422040 - DNA, 18 bp, Homo sapiens
caaaattgttttcacttg

SEQ ID NO: 1422041 - DNA, 20 bp, Homo sapiens
caaaattgttttcacttgta

SEQ ID NO: 1422042 - DNA, 22 bp, Homo sapiens
caaaattgttttcacttgtatt

SEQ ID NO: 1422043 - DNA, 20 bp, Homo sapiens
caaaatttattttataagaa

SEQ ID NO: 1422044 - DNA, 21 bp, Homo sapiens
caaaatttattttataagaaa

SEQ ID NO: 1422045 - DNA, 23 bp, Homo sapiens
caaaatttattttataagaaaaa

SEQ ID NO: 1422046 - DNA, 19 bp, Homo sapiens
caaaatttccagtaccttt

SEQ ID NO: 1422047 - DNA, 14 bp, Homo sapiens
caaaatttgactaa

SEQ ID NO: 1422048 - DNA, 13 bp, Homo sapiens
caaaatttgagaa

SEQ ID NO: 1422049 - DNA, 14 bp, Homo sapiens
caaaattttaaaaa

SEQ ID NO: 1422050 - DNA, 21 bp, Homo sapiens
caaaattttatagctcagttt

SEQ ID NO: 1422051 - DNA, 14 bp, Homo sapiens
caaaattttattcc

SEQ ID NO: 1422052 - DNA, 16 bp, Homo sapiens
caaaattttattttgt

SEQ ID NO: 1422053 - DNA, 16 bp, Homo sapiens
caaacaaaaaggttct

SEQ ID NO: 1422054 - DNA, 20 bp, Homo sapiens
caaacaaaaaggttctcagg

SEQ ID NO: 1422055 - DNA, 15 bp, Homo sapiens
caaacaaacaaacaa

SEQ ID NO: 1422056 - DNA, 14 bp, Homo sapiens
caaacaaatatgca

SEQ ID NO: 1422057 - DNA, 15 bp, Homo sapiens
caaacaaatatgcaa

SEQ ID NO: 1422058 - DNA, 11 bp, Homo sapiens
caaacaaggaa

SEQ ID NO: 1422059 - DNA, 19 bp, Homo sapiens
caaacacatttaccctttg

SEQ ID NO: 1422060 - DNA, 22 bp, Homo sapiens
caaacacccacttatttttcaa

SEQ ID NO: 1422061 - DNA, 18 bp, Homo sapiens
caaacactccaccctcca

SEQ ID NO: 1422062 - DNA, 20 bp, Homo sapiens
caaacactgcagtttcctgg

SEQ ID NO: 1422063 - DNA, 11 bp, Homo sapiens
caaacactgcc

SEQ ID NO: 1422064 - DNA, 22 bp, Homo sapiens
caaacactgccatattgtgtaa

SEQ ID NO: 1422065 - DNA, 14 bp, Homo sapiens
caaacacttctgct

SEQ ID NO: 1422066 - DNA, 18 bp, Homo sapiens
caaacaggttgttttcta

SEQ ID NO: 1422067 - DNA, 19 bp, Homo sapiens
caaacaggttgttttctac

SEQ ID NO: 1422068 - DNA, 22 bp, Homo sapiens
caaacaggttgttttctacttt

SEQ ID NO: 1422069 - DNA, 19 bp, Homo sapiens
caaacagtatataactttt

SEQ ID NO: 1422070 - DNA, 12 bp, Homo sapiens
caaacagtattt

SEQ ID NO: 1422071 - DNA, 16 bp, Homo sapiens
caaacagtctcaggaa

SEQ ID NO: 1422072 - DNA, 22 bp, Homo sapiens
caaacatcagacctgtcttcca

SEQ ID NO: 1422073 - DNA, 18 bp, Homo sapiens
caaacatcctatcaacaa

SEQ ID NO: 1422074 - DNA, 23 bp, Homo sapiens
caaacatgagatgtgtggactgt

SEQ ID NO: 1422075 - DNA, 13 bp, Homo sapiens
caaacatgcacac

SEQ ID NO: 1422076 - DNA, 15 bp, Homo sapiens
caaacattcttattt

SEQ ID NO: 1422077 - DNA, 15 bp, Homo sapiens
caaaccaaataaaaa

SEQ ID NO: 1422078 - DNA, 18 bp, Homo sapiens
caaaccaacaccccatat

SEQ ID NO: 1422079 - DNA, 16 bp, Homo sapiens
caaaccaacatctttg

SEQ ID NO: 1422080 - DNA, 22 bp, Homo sapiens
caaaccacgcctcttgaccagg

SEQ ID NO: 1422081 - DNA, 23 bp, Homo sapiens
atttagaagccaactatgattat

SEQ ID NO: 1422082 - DNA, 21 bp, Homo sapiens
atttagaatggtgattttaaa

SEQ ID NO: 1422083 - DNA, 16 bp, Homo sapiens
atttagagaggaaaag

SEQ ID NO: 1422084 - DNA, 17 bp, Homo sapiens
atttagagataggaaac

SEQ ID NO: 1422085 - DNA, 19 bp, Homo sapiens
atttagagataggaaactg

SEQ ID NO: 1422086 - DNA, 16 bp, Homo sapiens
atttagagatgctgta

SEQ ID NO: 1422087 - DNA, 18 bp, Homo sapiens
atttagctacagcttgtt

SEQ ID NO: 1422088 - DNA, 23 bp, Homo sapiens
atttagctgtggctccctcctcc

SEQ ID NO: 1422089 - DNA, 14 bp, Homo sapiens
atttaggagaagcc

SEQ ID NO: 1422090 - DNA, 17 bp, Homo sapiens
atttaggagaagccagg

SEQ ID NO: 1422091 - DNA, 12 bp, Homo sapiens
atttaggagaat

SEQ ID NO: 1422092 - DNA, 22 bp, Homo sapiens
atttaggcagattgaaaaggac

SEQ ID NO: 1422093 - DNA, 15 bp, Homo sapiens
atttagtaagaatac

SEQ ID NO: 1422094 - DNA, 19 bp, Homo sapiens
atttagtgctaaacaagta

SEQ ID NO: 1422095 - DNA, 16 bp, Homo sapiens
atttagttctttgtta

SEQ ID NO: 1422096 - DNA, 14 bp, Homo sapiens
atttagtttttaac

SEQ ID NO: 1422097 - DNA, 14 bp, Homo sapiens
atttataaaacttt

SEQ ID NO: 1422098 - DNA, 23 bp, Homo sapiens
atttataaacagacaatatgtga

SEQ ID NO: 1422099 - DNA, 12 bp, Homo sapiens
atttataaacta

SEQ ID NO: 1422100 - DNA, 18 bp, Homo sapiens
atttataaactaggtaaa

SEQ ID NO: 1422101 - DNA, 13 bp, Homo sapiens
atttataactcat

SEQ ID NO: 1422102 - DNA, 14 bp, Homo sapiens
atttataactcatc

SEQ ID NO: 1422103 - DNA, 15 bp, Homo sapiens
atttataactcatca

SEQ ID NO: 1422104 - DNA, 17 bp, Homo sapiens
atttataactcatcata

SEQ ID NO: 1422105 - DNA, 18 bp, Homo sapiens
atttataactcatcataa

SEQ ID NO: 1422106 - DNA, 21 bp, Homo sapiens
atttataactcatcataaaat

SEQ ID NO: 1422107 - DNA, 22 bp, Homo sapiens
atttataactcatcataaaata

SEQ ID NO: 1422108 - DNA, 14 bp, Homo sapiens
atttataagcagat

SEQ ID NO: 1422109 - DNA, 18 bp, Homo sapiens
atttataatacagaatct

SEQ ID NO: 1422110 - DNA, 20 bp, Homo sapiens
atttataatgttagtagaaa

SEQ ID NO: 1422111 - DNA, 14 bp, Homo sapiens
atttataattccta

SEQ ID NO: 1422112 - DNA, 15 bp, Homo sapiens
atttatacaagattg

SEQ ID NO: 1422113 - DNA, 23 bp, Homo sapiens
atttatactctagaacatgcaca

SEQ ID NO: 1422114 - DNA, 20 bp, Homo sapiens
atttatactcttttttcatg

SEQ ID NO: 1422115 - DNA, 17 bp, Homo sapiens
atttatatatatatgta

SEQ ID NO: 1422116 - DNA, 15 bp, Homo sapiens
atttatatatgtatt

SEQ ID NO: 1422117 - DNA, 15 bp, Homo sapiens
atttatatatttata

SEQ ID NO: 1422118 - DNA, 19 bp, Homo sapiens
atttatatatttataactc

SEQ ID NO: 1422119 - DNA, 22 bp, Homo sapiens
atttatatcacacaatatagtt

SEQ ID NO: 1422120 - DNA, 21 bp, Homo sapiens
atttatatctgcttctagctt

SEQ ID NO: 1422121 - DNA, 20 bp, Homo sapiens
atttatatggggaatatatt

SEQ ID NO: 1422122 - DNA, 16 bp, Homo sapiens
atttatatgtactgtt

SEQ ID NO: 1422123 - DNA, 14 bp, Homo sapiens
atttatattccatt

SEQ ID NO: 1422124 - DNA, 15 bp, Homo sapiens
atttatattccattt

SEQ ID NO: 1422125 - DNA, 19 bp, Homo sapiens
atttatattccatttacat

SEQ ID NO: 1422126 - DNA, 15 bp, Homo sapiens
atttatattccgtat

SEQ ID NO: 1422127 - DNA, 13 bp, Homo sapiens
atttatatttcac

SEQ ID NO: 1422128 - DNA, 17 bp, Homo sapiens
atttatcaaatcagtca

SEQ ID NO: 1422129 - DNA, 21 bp, Homo sapiens
attttgagtcctaggacttaa

SEQ ID NO: 1422130 - DNA, 21 bp, Homo sapiens
attttgagtctatcctagtct

SEQ ID NO: 1422131 - DNA, 14 bp, Homo sapiens
attttgagtgttta

SEQ ID NO: 1422132 - DNA, 17 bp, Homo sapiens
attttgataccagaagg

SEQ ID NO: 1422133 - DNA, 17 bp, Homo sapiens
attttgatatacattgt

SEQ ID NO: 1422134 - DNA, 20 bp, Homo sapiens
attttgatatacattgtgtg

SEQ ID NO: 1422135 - DNA, 22 bp, Homo sapiens
attttgcaaaaatcctattctg

SEQ ID NO: 1422136 - DNA, 16 bp, Homo sapiens
attttgcaaagattta

SEQ ID NO: 1422137 - DNA, 19 bp, Homo sapiens
attttgcaatgtatttagc

SEQ ID NO: 1422138 - DNA, 11 bp, Homo sapiens
attttgcactg

SEQ ID NO: 1422139 - DNA, 15 bp, Homo sapiens
attttgcagcagtga

SEQ ID NO: 1422140 - DNA, 16 bp, Homo sapiens
attttgcattccagaa

SEQ ID NO: 1422141 - DNA, 15 bp, Homo sapiens
attttgccagactta

SEQ ID NO: 1422142 - DNA, 21 bp, Homo sapiens
attttgcctcttttctctgtg

SEQ ID NO: 1422143 - DNA, 11 bp, Homo sapiens
attttgctaac

SEQ ID NO: 1422144 - DNA, 12 bp, Homo sapiens
attttgctaact

SEQ ID NO: 1422145 - DNA, 16 bp, Homo sapiens
attttgctaactgggt

SEQ ID NO: 1422146 - DNA, 21 bp, Homo sapiens
attttgctaactggttaaaca

SEQ ID NO: 1422147 - DNA, 20 bp, Homo sapiens
attttgctgagttgttctaa

SEQ ID NO: 1422148 - DNA, 17 bp, Homo sapiens
attttgctttaattgct

SEQ ID NO: 1422149 - DNA, 14 bp, Homo sapiens
attttgctttggtt

SEQ ID NO: 1422150 - DNA, 22 bp, Homo sapiens
attttggaataatttctattaa

SEQ ID NO: 1422151 - DNA, 20 bp, Homo sapiens
attttggagagtttcctgaa

SEQ ID NO: 1422152 - DNA, 21 bp, Homo sapiens
attttggagagtttcctgaaa

SEQ ID NO: 1422153 - DNA, 18 bp, Homo sapiens
attttggagattataata

SEQ ID NO: 1422154 - DNA, 16 bp, Homo sapiens
attttgggacttctac

SEQ ID NO: 1422155 - DNA, 18 bp, Homo sapiens
attttgggcctgttcctt

SEQ ID NO: 1422156 - DNA, 21 bp, Homo sapiens
attttgggtattaatatatag

SEQ ID NO: 1422157 - DNA, 22 bp, Homo sapiens
attttggtaaaatacttcttga

SEQ ID NO: 1422158 - DNA, 12 bp, Homo sapiens
attttggtttct

SEQ ID NO: 1422159 - DNA, 13 bp, Homo sapiens
attttgtaaaaca

SEQ ID NO: 1422160 - DNA, 15 bp, Homo sapiens
attttgtaaaacaat

SEQ ID NO: 1422161 - DNA, 17 bp, Homo sapiens
attttgtaaactcaaaa

SEQ ID NO: 1422162 - DNA, 20 bp, Homo sapiens
attttgtaaactcaaaatat

SEQ ID NO: 1422163 - DNA, 22 bp, Homo sapiens
attttgtaagagtgagctctgg

SEQ ID NO: 1422164 - DNA, 20 bp, Homo sapiens
attttgtacaaatttgttat

SEQ ID NO: 1422165 - DNA, 16 bp, Homo sapiens
attttgtagatgtgat

SEQ ID NO: 1422166 - DNA, 16 bp, Homo sapiens
attttgtatatttgta

SEQ ID NO: 1422167 - DNA, 15 bp, Homo sapiens
attttgtatgctgaa

SEQ ID NO: 1422168 - DNA, 15 bp, Homo sapiens
attttgtatgttaaa

SEQ ID NO: 1422169 - DNA, 17 bp, Homo sapiens
attttgtattaatttct

SEQ ID NO: 1422170 - DNA, 20 bp, Homo sapiens
attttgtattacatctaatg

SEQ ID NO: 1422171 - DNA, 16 bp, Homo sapiens
attttgtattttcaac

SEQ ID NO: 1422172 - DNA, 23 bp, Homo sapiens
attttgtgatgaatctacatttg

SEQ ID NO: 1422173 - DNA, 15 bp, Homo sapiens
atttttttcaatatt

SEQ ID NO: 1422174 - DNA, 21 bp, Homo sapiens
atttttttctacataattgtg

SEQ ID NO: 1422175 - DNA, 13 bp, Homo sapiens
atttttttctagc

SEQ ID NO: 1422176 - DNA, 22 bp, Homo sapiens
atttttttctagctataacaac

SEQ ID NO: 1422177 - DNA, 16 bp, Homo sapiens
atttttttctctctgg

SEQ ID NO: 1422178 - DNA, 17 bp, Homo sapiens
atttttttctctctgga

SEQ ID NO: 1422179 - DNA, 20 bp, Homo sapiens
atttttttctttacttatct

SEQ ID NO: 1422180 - DNA, 22 bp, Homo sapiens
atttttttgcatgcatgcaaat

SEQ ID NO: 1422181 - DNA, 14 bp, Homo sapiens
atttttttgtaata

SEQ ID NO: 1422182 - DNA, 14 bp, Homo sapiens
attttttttagtat

SEQ ID NO: 1422183 - DNA, 16 bp, Homo sapiens
attttttttatattta

SEQ ID NO: 1422184 - DNA, 19 bp, Homo sapiens
attttttttccttgcctgt

SEQ ID NO: 1422185 - DNA, 17 bp, Homo sapiens
attttttttggtcaaat

SEQ ID NO: 1422186 - DNA, 18 bp, Homo sapiens
attttttttggtcaaatt

SEQ ID NO: 1422187 - DNA, 22 bp, Homo sapiens
atttttttttaattttgatata

SEQ ID NO: 1422188 - DNA, 23 bp, Homo sapiens
atttttttttcatagagatttgt

SEQ ID NO: 1422189 - DNA, 18 bp, Homo sapiens
atttttttttcctggaat

SEQ ID NO: 1422190 - DNA, 18 bp, Homo sapiens
atttttttttggatgaag

SEQ ID NO: 1422191 - DNA, 22 bp, Homo sapiens
attttttttttaaataaaagca

SEQ ID NO: 1422192 - DNA, 17 bp, Homo sapiens
attttttttttcttttt

SEQ ID NO: 1422193 - DNA, 23 bp, Homo sapiens
atttttttttttttttttttaag

SEQ ID NO: 1422194 - DNA, 19 bp, Homo sapiens
caaaaaaaaaaaaaaatta

SEQ ID NO: 1422195 - DNA, 17 bp, Homo sapiens
caaaaaaaaagttttat

SEQ ID NO: 1422196 - DNA, 21 bp, Homo sapiens
caaaaaaaatttagccgggcg

SEQ ID NO: 1422197 - DNA, 16 bp, Homo sapiens
caaaaaaacactagtt

SEQ ID NO: 1422198 - DNA, 14 bp, Homo sapiens
caaaaaaagcctcc

SEQ ID NO: 1422199 - DNA, 14 bp, Homo sapiens
caaaaaaagccttt

SEQ ID NO: 1422200 - DNA, 15 bp, Homo sapiens
caaaaaaaggaaaaa

SEQ ID NO: 1422201 - DNA, 20 bp, Homo sapiens
caaaaaaagggaaggattta

SEQ ID NO: 1422202 - DNA, 20 bp, Homo sapiens
caaaaaaagttgaaggcctt

SEQ ID NO: 1422203 - DNA, 23 bp, Homo sapiens
caaaaaaatatatttaatgataa

SEQ ID NO: 1422204 - DNA, 19 bp, Homo sapiens
caaaaaactatcaactaca

SEQ ID NO: 1422205 - DNA, 20 bp, Homo sapiens
caaaaaactatcaactacaa

SEQ ID NO: 1422206 - DNA, 14 bp, Homo sapiens
caaaaaataaattt

SEQ ID NO: 1422207 - DNA, 19 bp, Homo sapiens
caaaaaatatctagtaata

SEQ ID NO: 1422208 - DNA, 20 bp, Homo sapiens
caaaaaatgtgagctataat

SEQ ID NO: 1422209 - DNA, 16 bp, Homo sapiens
caaaaaattagccggg

SEQ ID NO: 1422210 - DNA, 11 bp, Homo sapiens
caaaaaattat

SEQ ID NO: 1422211 - DNA, 13 bp, Homo sapiens
caaaaacacagca

SEQ ID NO: 1422212 - DNA, 13 bp, Homo sapiens
caaaaacagcctc

SEQ ID NO: 1422213 - DNA, 22 bp, Homo sapiens
caaaaacatgtatgtgcatttc

SEQ ID NO: 1422214 - DNA, 14 bp, Homo sapiens
caaaaacattttat

SEQ ID NO: 1422215 - DNA, 23 bp, Homo sapiens
caaaaacgaaactccatctcaaa

SEQ ID NO: 1422216 - DNA, 16 bp, Homo sapiens
caaaaactatttggga

SEQ ID NO: 1422217 - DNA, 15 bp, Homo sapiens
caaaaactgtactgt

SEQ ID NO: 1422218 - DNA, 14 bp, Homo sapiens
caaaaagaaacttt

SEQ ID NO: 1422219 - DNA, 15 bp, Homo sapiens
caaaaagaaatgatg

SEQ ID NO: 1422220 - DNA, 20 bp, Homo sapiens
caaaaagcaagggagaaaag

SEQ ID NO: 1422221 - DNA, 16 bp, Homo sapiens
caaaaagcagagtgga

SEQ ID NO: 1422222 - DNA, 18 bp, Homo sapiens
caaaaagctaatgtgcag

SEQ ID NO: 1422223 - DNA, 24 bp, Homo sapiens
caaaaaggagccttttgctctctg

SEQ ID NO: 1422224 - DNA, 17 bp, Homo sapiens
caaaaaggcaaatattg

SEQ ID NO: 1422225 - DNA, 23 bp, Homo sapiens
caaaaaggcaaatattgaagttg

SEQ ID NO: 1422226 - DNA, 13 bp, Homo sapiens
caaaaaggttgct

SEQ ID NO: 1422227 - DNA, 14 bp, Homo sapiens
caaaaagtatatta

SEQ ID NO: 1422228 - DNA, 14 bp, Homo sapiens
caaaaataaaatat

SEQ ID NO: 1422229 - DNA, 13 bp, Homo sapiens
caaaaataaacta

SEQ ID NO: 1422230 - DNA, 16 bp, Homo sapiens
caaaaataaactagtt

SEQ ID NO: 1422231 - DNA, 12 bp, Homo sapiens
caaaaatagaaa

SEQ ID NO: 1422232 - DNA, 21 bp, Homo sapiens
caaaaatcaaagaacagatgg

SEQ ID NO: 1422233 - DNA, 15 bp, Homo sapiens
caaaaatccaaatat

SEQ ID NO: 1422234 - DNA, 20 bp, Homo sapiens
caaaaatccaaatattgtta

SEQ ID NO: 1422235 - DNA, 20 bp, Homo sapiens
caaaaatccttgttgaagtt

SEQ ID NO: 1422236 - DNA, 17 bp, Homo sapiens
caaaaatgacaacagaa

SEQ ID NO: 1422237 - DNA, 20 bp, Homo sapiens
caaaaatgacaacagaaaaa

SEQ ID NO: 1422238 - DNA, 17 bp, Homo sapiens
caaaaatgtttccactg

SEQ ID NO: 1422239 - DNA, 18 bp, Homo sapiens
caaaacaaaaagatgtct

SEQ ID NO: 1422240 - DNA, 12 bp, Homo sapiens
caaaacaaaaca

SEQ ID NO: 1422241 - DNA, 17 bp, Homo sapiens
caaaacatctctgcagt

SEQ ID NO: 1422242 - DNA, 12 bp, Homo sapiens
caaaacatttct

SEQ ID NO: 1422243 - DNA, 20 bp, Homo sapiens
caaaacattttgaaggaaaa

SEQ ID NO: 1422244 - DNA, 18 bp, Homo sapiens
caaaaccaaaagttatta

SEQ ID NO: 1422245 - DNA, 23 bp, Homo sapiens
caaaaccaaaagttattaaaatt

SEQ ID NO: 1422246 - DNA, 13 bp, Homo sapiens
caaaaccagctgc

SEQ ID NO: 1422247 - DNA, 18 bp, Homo sapiens
caaaacctcagttaaact

SEQ ID NO: 1422248 - DNA, 19 bp, Homo sapiens
caaaacctcatgacagcca

SEQ ID NO: 1422249 - DNA, 13 bp, Homo sapiens
atttcttctctta

SEQ ID NO: 1422250 - DNA, 21 bp, Homo sapiens
atttcttctcttatcctctct

SEQ ID NO: 1422251 - DNA, 16 bp, Homo sapiens
atttcttcttctaaga

SEQ ID NO: 1422252 - DNA, 19 bp, Homo sapiens
atttcttcttctaagaaga

SEQ ID NO: 1422253 - DNA, 16 bp, Homo sapiens
atttcttggcaaattt

SEQ ID NO: 1422254 - DNA, 17 bp, Homo sapiens
atttcttggcattggaa

SEQ ID NO: 1422255 - DNA, 23 bp, Homo sapiens
atttcttggcattggaattctac

SEQ ID NO: 1422256 - DNA, 20 bp, Homo sapiens
atttcttggtaagaagccgg

SEQ ID NO: 1422257 - DNA, 17 bp, Homo sapiens
atttctttccttcccaa

SEQ ID NO: 1422258 - DNA, 14 bp, Homo sapiens
atttctttttaatt

SEQ ID NO: 1422259 - DNA, 21 bp, Homo sapiens
atttctttttgggagagactt

SEQ ID NO: 1422260 - DNA, 16 bp, Homo sapiens
atttctttttttcctt

SEQ ID NO: 1422261 - DNA, 11 bp, Homo sapiens
atttgaaattt

SEQ ID NO: 1422262 - DNA, 21 bp, Homo sapiens
atttgaacccccgccatcctt

SEQ ID NO: 1422263 - DNA, 14 bp, Homo sapiens
atttgaagggtctt

SEQ ID NO: 1422264 - DNA, 16 bp, Homo sapiens
atttgaatatccattc

SEQ ID NO: 1422265 - DNA, 18 bp, Homo sapiens
atttgaattttaaatcta

SEQ ID NO: 1422266 - DNA, 13 bp, Homo sapiens
atttgactaattt

SEQ ID NO: 1422267 - DNA, 14 bp, Homo sapiens
atttgactaatttt

SEQ ID NO: 1422268 - DNA, 16 bp, Homo sapiens
atttgacttgaatatg

SEQ ID NO: 1422269 - DNA, 12 bp, Homo sapiens
atttgagaaatg

SEQ ID NO: 1422270 - DNA, 14 bp, Homo sapiens
atttgagaaatgca

SEQ ID NO: 1422271 - DNA, 18 bp, Homo sapiens
atttgagagaaatatgaa

SEQ ID NO: 1422272 - DNA, 18 bp, Homo sapiens
atttgagataaagtcaaa

SEQ ID NO: 1422273 - DNA, 16 bp, Homo sapiens
atttgagcatatcagt

SEQ ID NO: 1422274 - DNA, 15 bp, Homo sapiens
atttgagcatgcaca

SEQ ID NO: 1422275 - DNA, 22 bp, Homo sapiens
atttgaggacaaccattccaga

SEQ ID NO: 1422276 - DNA, 14 bp, Homo sapiens
atttgaggctcaga

SEQ ID NO: 1422277 - DNA, 20 bp, Homo sapiens
atttgagggcccagccagga

SEQ ID NO: 1422278 - DNA, 17 bp, Homo sapiens
atttgaggggaaaacac

SEQ ID NO: 1422279 - DNA, 12 bp, Homo sapiens
atttgagtgttt

SEQ ID NO: 1422280 - DNA, 15 bp, Homo sapiens
atttgatacataata

SEQ ID NO: 1422281 - DNA, 17 bp, Homo sapiens
atttgatcgttccagtt

SEQ ID NO: 1422282 - DNA, 22 bp, Homo sapiens
atttgatgagttaactgtgaaa

SEQ ID NO: 1422283 - DNA, 16 bp, Homo sapiens
atttgatgctgtttga

SEQ ID NO: 1422284 - DNA, 17 bp, Homo sapiens
atttgatggactaatta

SEQ ID NO: 1422285 - DNA, 22 bp, Homo sapiens
atttgatggactaattattatt

SEQ ID NO: 1422286 - DNA, 21 bp, Homo sapiens
atttgatggtggtattgtgac

SEQ ID NO: 1422287 - DNA, 14 bp, Homo sapiens
atttgattaacatt

SEQ ID NO: 1422288 - DNA, 16 bp, Homo sapiens
atttgattaacatttg

SEQ ID NO: 1422289 - DNA, 14 bp, Homo sapiens
atttgattatgtat

SEQ ID NO: 1422290 - DNA, 19 bp, Homo sapiens
atttgattcattttcctgt

SEQ ID NO: 1422291 - DNA, 20 bp, Homo sapiens
atttgattcattttcctgtt

SEQ ID NO: 1422292 - DNA, 13 bp, Homo sapiens
atttgattcgtat

SEQ ID NO: 1422293 - DNA, 18 bp, Homo sapiens
atttgattcgtatgatca

SEQ ID NO: 1422294 - DNA, 13 bp, Homo sapiens
atttgatttccat

SEQ ID NO: 1422295 - DNA, 11 bp, Homo sapiens
atttgcacagt

SEQ ID NO: 1422296 - DNA, 21 bp, Homo sapiens
atttgcactggagttctatgc

SEQ ID NO: 1422297 - DNA, 16 bp, Homo sapiens
atttgcagcttccaat

SEQ ID NO: 1422298 - DNA, 18 bp, Homo sapiens
atttgcaggattcccttc

SEQ ID NO: 1422299 - DNA, 20 bp, Homo sapiens
atttgcatatcacccttccc

SEQ ID NO: 1422300 - DNA, 22 bp, Homo sapiens
atttgcatatcacccttccctg

SEQ ID NO: 1422301 - DNA, 20 bp, Homo sapiens
atttgcatattttgagaaac

SEQ ID NO: 1422302 - DNA, 13 bp, Homo sapiens
atttgcattgtgt

SEQ ID NO: 1422303 - DNA, 22 bp, Homo sapiens
atttgccaaaaactaaaattca

SEQ ID NO: 1422304 - DNA, 14 bp, Homo sapiens
atttgccagcacag

SEQ ID NO: 1422305 - DNA, 15 bp, Homo sapiens
atttgcctgtgccac

SEQ ID NO: 1422306 - DNA, 16 bp, Homo sapiens
attttaaaaacataga

SEQ ID NO: 1422307 - DNA, 17 bp, Homo sapiens
attttaaaaaggaattt

SEQ ID NO: 1422308 - DNA, 19 bp, Homo sapiens
attttaaaataaattagtt

SEQ ID NO: 1422309 - DNA, 14 bp, Homo sapiens
attttaaaatattt

SEQ ID NO: 1422310 - DNA, 18 bp, Homo sapiens
attttaaaatatttaaac

SEQ ID NO: 1422311 - DNA, 13 bp, Homo sapiens
attttaaaatcag

SEQ ID NO: 1422312 - DNA, 18 bp, Homo sapiens
attttaaaatgtacatgt

SEQ ID NO: 1422313 - DNA, 13 bp, Homo sapiens
attttaaaatttg

SEQ ID NO: 1422314 - DNA, 18 bp, Homo sapiens
attttaaagccattctga

SEQ ID NO: 1422315 - DNA, 22 bp, Homo sapiens
attttaaagtatgcattattaa

SEQ ID NO: 1422316 - DNA, 13 bp, Homo sapiens
attttaaagttag

SEQ ID NO: 1422317 - DNA, 17 bp, Homo sapiens
attttaaagttcttatt

SEQ ID NO: 1422318 - DNA, 21 bp, Homo sapiens
attttaaataaaagtgatcaa

SEQ ID NO: 1422319 - DNA, 22 bp, Homo sapiens
attttaaatatccacagtactc

SEQ ID NO: 1422320 - DNA, 21 bp, Homo sapiens
attttaaatatccatttatct

SEQ ID NO: 1422321 - DNA, 19 bp, Homo sapiens
attttaaatctaaatctat

SEQ ID NO: 1422322 - DNA, 18 bp, Homo sapiens
attttaaatgaagtgatt

SEQ ID NO: 1422323 - DNA, 13 bp, Homo sapiens
attttaaatgtgt

SEQ ID NO: 1422324 - DNA, 16 bp, Homo sapiens
attttaaattcacaat

SEQ ID NO: 1422325 - DNA, 17 bp, Homo sapiens
attttaaattttatgtc

SEQ ID NO: 1422326 - DNA, 18 bp, Homo sapiens
attttaaattttatgtca

SEQ ID NO: 1422327 - DNA, 13 bp, Homo sapiens
attttaacaaaag

SEQ ID NO: 1422328 - DNA, 18 bp, Homo sapiens
attttaacaaaagcaaga

SEQ ID NO: 1422329 - DNA, 11 bp, Homo sapiens
attttaacact

SEQ ID NO: 1422330 - DNA, 13 bp, Homo sapiens
attttaacacttt

SEQ ID NO: 1422331 - DNA, 15 bp, Homo sapiens
attttaacactttgt

SEQ ID NO: 1422332 - DNA, 16 bp, Homo sapiens
attttaacactttgta

SEQ ID NO: 1422333 - DNA, 18 bp, Homo sapiens
attttaacactttgtatt

SEQ ID NO: 1422334 - DNA, 16 bp, Homo sapiens
attttaaccaaaacat

SEQ ID NO: 1422335 - DNA, 13 bp, Homo sapiens
attttaactattt

SEQ ID NO: 1422336 - DNA, 15 bp, Homo sapiens
attttaactttatca

SEQ ID NO: 1422337 - DNA, 19 bp, Homo sapiens
attttaactttatcacatt

SEQ ID NO: 1422338 - DNA, 16 bp, Homo sapiens
attttaagactgattt

SEQ ID NO: 1422339 - DNA, 17 bp, Homo sapiens
attttaagatccagaaa

SEQ ID NO: 1422340 - DNA, 15 bp, Homo sapiens
attttaaggttctca

SEQ ID NO: 1422341 - DNA, 19 bp, Homo sapiens
attttaaggttgcacacag

SEQ ID NO: 1422342 - DNA, 18 bp, Homo sapiens
attttaagtgctttgtaa

SEQ ID NO: 1422343 - DNA, 13 bp, Homo sapiens
attttaataacat

SEQ ID NO: 1422344 - DNA, 16 bp, Homo sapiens
attttaatattttgta

SEQ ID NO: 1422345 - DNA, 13 bp, Homo sapiens
attttaatgaaat

SEQ ID NO: 1422346 - DNA, 20 bp, Homo sapiens
attttaatgaaatcaaatgt

SEQ ID NO: 1422347 - DNA, 19 bp, Homo sapiens
attttaatgaatattgatg

SEQ ID NO: 1422348 - DNA, 22 bp, Homo sapiens
attttaatgcagttgcttacta

SEQ ID NO: 1422349 - DNA, 15 bp, Homo sapiens
attttaatgtaaaat

SEQ ID NO: 1422350 - DNA, 20 bp, Homo sapiens
attttaatgtaaaattcata

SEQ ID NO: 1422351 - DNA, 17 bp, Homo sapiens
attttaatgtacttgaa

SEQ ID NO: 1422352 - DNA, 21 bp, Homo sapiens
attttaatgtgaagacatttt

SEQ ID NO: 1422353 - DNA, 20 bp, Homo sapiens
attttaattactgctataaa

SEQ ID NO: 1422354 - DNA, 18 bp, Homo sapiens
attttaattatcttttct

SEQ ID NO: 1422355 - DNA, 16 bp, Homo sapiens
attttaatttatttgt

SEQ ID NO: 1422356 - DNA, 18 bp, Homo sapiens
attttaatttcaggaaaa

SEQ ID NO: 1422357 - DNA, 19 bp, Homo sapiens
attttaatttttaaatgca

SEQ ID NO: 1422358 - DNA, 11 bp, Homo sapiens
attttacaaaa

SEQ ID NO: 1422359 - DNA, 15 bp, Homo sapiens
attttacaaaatgct

SEQ ID NO: 1422360 - DNA, 20 bp, Homo sapiens
attttacaataggtgcttat

SEQ ID NO: 1422361 - DNA, 13 bp, Homo sapiens
attttacaattga

SEQ ID NO: 1422362 - DNA, 15 bp, Homo sapiens
attttacacagaaac

SEQ ID NO: 1422363 - DNA, 22 bp, Homo sapiens
attttacacagaaacactgcct

SEQ ID NO: 1422364 - DNA, 23 bp, Homo sapiens
attttacacagaaacactgcctt

SEQ ID NO: 1422365 - DNA, 18 bp, Homo sapiens
attttacagctcattaaa

SEQ ID NO: 1422366 - DNA, 23 bp, Homo sapiens
attttacatgaagctgtataatt

SEQ ID NO: 1422367 - DNA, 16 bp, Homo sapiens
attttaccaaagcatc

SEQ ID NO: 1422368 - DNA, 22 bp, Homo sapiens
attttaccaaagcatcaataca

SEQ ID NO: 1422369 - DNA, 18 bp, Homo sapiens
attttagagaaactttga

SEQ ID NO: 1422370 - DNA, 19 bp, Homo sapiens
attttagatttctttgatt

SEQ ID NO: 1422371 - DNA, 18 bp, Homo sapiens
atttcagtttttcatttg

SEQ ID NO: 1422372 - DNA, 21 bp, Homo sapiens
atttcatacctcagaatgtaa

SEQ ID NO: 1422373 - DNA, 17 bp, Homo sapiens
atttcatcattgtttct

SEQ ID NO: 1422374 - DNA, 19 bp, Homo sapiens
atttcatctatttctgaga

SEQ ID NO: 1422375 - DNA, 15 bp, Homo sapiens
atttcatctgctctc

SEQ ID NO: 1422376 - DNA, 18 bp, Homo sapiens
atttcatctgctctcctt

SEQ ID NO: 1422377 - DNA, 14 bp, Homo sapiens
atttcatgaaaaag

SEQ ID NO: 1422378 - DNA, 17 bp, Homo sapiens
atttcatgaaaaagctg

SEQ ID NO: 1422379 - DNA, 17 bp, Homo sapiens
atttcattcaaatcagt

SEQ ID NO: 1422380 - DNA, 19 bp, Homo sapiens
atttcattcaaatcagtga

SEQ ID NO: 1422381 - DNA, 20 bp, Homo sapiens
atttcattcaaatcagtgat

SEQ ID NO: 1422382 - DNA, 14 bp, Homo sapiens
atttcattcctaac

SEQ ID NO: 1422383 - DNA, 14 bp, Homo sapiens
atttcatttaaata

SEQ ID NO: 1422384 - DNA, 21 bp, Homo sapiens
atttcatttccaactcaggtt

SEQ ID NO: 1422385 - DNA, 14 bp, Homo sapiens
atttccaaacatcc

SEQ ID NO: 1422386 - DNA, 16 bp, Homo sapiens
atttccaaagagaaaa

SEQ ID NO: 1422387 - DNA, 23 bp, Homo sapiens
atttccaacaaacttactgtcag

SEQ ID NO: 1422388 - DNA, 23 bp, Homo sapiens
atttccaacaccacagacacaca

SEQ ID NO: 1422389 - DNA, 18 bp, Homo sapiens
atttccactgaacaaaac

SEQ ID NO: 1422390 - DNA, 14 bp, Homo sapiens
atttccagtttaag

SEQ ID NO: 1422391 - DNA, 12 bp, Homo sapiens
atttccatattt

SEQ ID NO: 1422392 - DNA, 13 bp, Homo sapiens
atttccattgctt

SEQ ID NO: 1422393 - DNA, 13 bp, Homo sapiens
atttccatttctt

SEQ ID NO: 1422394 - DNA, 18 bp, Homo sapiens
atttcccaattaggaagt

SEQ ID NO: 1422395 - DNA, 21 bp, Homo sapiens
atttcccactgcactccagcc

SEQ ID NO: 1422396 - DNA, 16 bp, Homo sapiens
atttcccaggaccctg

SEQ ID NO: 1422397 - DNA, 19 bp, Homo sapiens
atttcccaggaccctgaag

SEQ ID NO: 1422398 - DNA, 15 bp, Homo sapiens
atttcccagggttaa

SEQ ID NO: 1422399 - DNA, 16 bp, Homo sapiens
atttcccagttaaaga

SEQ ID NO: 1422400 - DNA, 18 bp, Homo sapiens
atttcccagttaaagatt

SEQ ID NO: 1422401 - DNA, 21 bp, Homo sapiens
atttcccctcccaatcctctc

SEQ ID NO: 1422402 - DNA, 17 bp, Homo sapiens
atttccctatcttctcc

SEQ ID NO: 1422403 - DNA, 15 bp, Homo sapiens
atttcccttccaaag

SEQ ID NO: 1422404 - DNA, 16 bp, Homo sapiens
atttccctttagctgt

SEQ ID NO: 1422405 - DNA, 20 bp, Homo sapiens
atttccctttagctgtgtta

SEQ ID NO: 1422406 - DNA, 22 bp, Homo sapiens
atttccctttagctgtgttatt

SEQ ID NO: 1422407 - DNA, 14 bp, Homo sapiens
atttcctaaggcat

SEQ ID NO: 1422408 - DNA, 15 bp, Homo sapiens
atttcctaaggcatg

SEQ ID NO: 1422409 - DNA, 21 bp, Homo sapiens
atttcctaatactgtcatcct

SEQ ID NO: 1422410 - DNA, 22 bp, Homo sapiens
atttcctacagaaatactgctc

SEQ ID NO: 1422411 - DNA, 23 bp, Homo sapiens
atttcctatagctacatgttctt

SEQ ID NO: 1422412 - DNA, 20 bp, Homo sapiens
atttcctatgtaactgcatt

SEQ ID NO: 1422413 - DNA, 22 bp, Homo sapiens
atttcctcaacgttgctcccca

SEQ ID NO: 1422414 - DNA, 17 bp, Homo sapiens
atttcctcacgtgcagg

SEQ ID NO: 1422415 - DNA, 12 bp, Homo sapiens
atttcctcctcc

SEQ ID NO: 1422416 - DNA, 24 bp, Homo sapiens
atttcctcctcccagtgccttctg

SEQ ID NO: 1422417 - DNA, 16 bp, Homo sapiens
atttcctgcttccctg

SEQ ID NO: 1422418 - DNA, 21 bp, Homo sapiens
atttcctgttggatttgttta

SEQ ID NO: 1422419 - DNA, 23 bp, Homo sapiens
atttcctgttggatttgtttaaa

SEQ ID NO: 1422420 - DNA, 19 bp, Homo sapiens
atttcctgtttgaaatatc

SEQ ID NO: 1422421 - DNA, 13 bp, Homo sapiens
atttccttggagg

SEQ ID NO: 1422422 - DNA, 13 bp, Homo sapiens
atttcctttatgt

SEQ ID NO: 1422423 - DNA, 15 bp, Homo sapiens
atttcctttttgaca

SEQ ID NO: 1422424 - DNA, 19 bp, Homo sapiens
atttcctttttgacactga

SEQ ID NO: 1422425 - DNA, 15 bp, Homo sapiens
atttcgccttaaact

SEQ ID NO: 1422426 - DNA, 22 bp, Homo sapiens
atttcgccttaaactctggaca

SEQ ID NO: 1422427 - DNA, 15 bp, Homo sapiens
atttctaacagtcct

SEQ ID NO: 1422428 - DNA, 23 bp, Homo sapiens
atttctaacagtccttgctttgg

SEQ ID NO: 1422429 - DNA, 19 bp, Homo sapiens
atttctaagcttatttcta

SEQ ID NO: 1422430 - DNA, 21 bp, Homo sapiens
atttctaagcttatttctaac

SEQ ID NO: 1422431 - DNA, 18 bp, Homo sapiens
atttctaatccttttcct

SEQ ID NO: 1422432 - DNA, 20 bp, Homo sapiens
attgctcgcccagacaccat

SEQ ID NO: 1422433 - DNA, 22 bp, Homo sapiens
attgctcgcccagacaccatgt

SEQ ID NO: 1422434 - DNA, 19 bp, Homo sapiens
attgctctatgtctgcctt

SEQ ID NO: 1422435 - DNA, 15 bp, Homo sapiens
attgctctggagcag

SEQ ID NO: 1422436 - DNA, 14 bp, Homo sapiens
attgctgagcctct

SEQ ID NO: 1422437 - DNA, 22 bp, Homo sapiens
attgctgagcctctgctcccca

SEQ ID NO: 1422438 - DNA, 21 bp, Homo sapiens
attgctgaggcaccgtccagg

SEQ ID NO: 1422439 - DNA, 13 bp, Homo sapiens
attgctgcatatt

SEQ ID NO: 1422440 - DNA, 14 bp, Homo sapiens
attgctgccaggca

SEQ ID NO: 1422441 - DNA, 22 bp, Homo sapiens
attgctggaggaaccagaggca

SEQ ID NO: 1422442 - DNA, 21 bp, Homo sapiens
attgctggttctatttaatgg

SEQ ID NO: 1422443 - DNA, 22 bp, Homo sapiens
attgctggttctatttaatgga

SEQ ID NO: 1422444 - DNA, 21 bp, Homo sapiens
attgctgtaccacatctgctc

SEQ ID NO: 1422445 - DNA, 11 bp, Homo sapiens
attgctgtgcc

SEQ ID NO: 1422446 - DNA, 18 bp, Homo sapiens
attgctgtgctttatgga

SEQ ID NO: 1422447 - DNA, 12 bp, Homo sapiens
attgctgtgtct

SEQ ID NO: 1422448 - DNA, 21 bp, Homo sapiens
attgctgtgtctcctctcaga

SEQ ID NO: 1422449 - DNA, 22 bp, Homo sapiens
attgctgtgtcttcattttcat

SEQ ID NO: 1422450 - DNA, 19 bp, Homo sapiens
attgctgtgtgtcccaggc

SEQ ID NO: 1422451 - DNA, 20 bp, Homo sapiens
attgcttaaaagacattttt

SEQ ID NO: 1422452 - DNA, 13 bp, Homo sapiens
attgcttacattt

SEQ ID NO: 1422453 - DNA, 19 bp, Homo sapiens
attgcttacatttttacaa

SEQ ID NO: 1422454 - DNA, 16 bp, Homo sapiens
attgcttcctcctccc

SEQ ID NO: 1422455 - DNA, 13 bp, Homo sapiens
attgcttctaaaa

SEQ ID NO: 1422456 - DNA, 23 bp, Homo sapiens
attgcttctaaaacaataaagat

SEQ ID NO: 1422457 - DNA, 13 bp, Homo sapiens
attgcttctgtag

SEQ ID NO: 1422458 - DNA, 16 bp, Homo sapiens
attgctttactgtcaa

SEQ ID NO: 1422459 - DNA, 16 bp, Homo sapiens
attgctttctgaaatt

SEQ ID NO: 1422460 - DNA, 23 bp, Homo sapiens
attgctttgccaaaataccagag

SEQ ID NO: 1422461 - DNA, 14 bp, Homo sapiens
attgctttggtcat

SEQ ID NO: 1422462 - DNA, 20 bp, Homo sapiens
attgcttttgttgtgacttt

SEQ ID NO: 1422463 - DNA, 23 bp, Homo sapiens
attgcttttttccaaaacaaaaa

SEQ ID NO: 1422464 - DNA, 15 bp, Homo sapiens
attgcttttttgtat

SEQ ID NO: 1422465 - DNA, 18 bp, Homo sapiens
attgcttttttgtattgg

SEQ ID NO: 1422466 - DNA, 22 bp, Homo sapiens
attggaactctactcaacccat

SEQ ID NO: 1422467 - DNA, 19 bp, Homo sapiens
attggaatcttcacctcag

SEQ ID NO: 1422468 - DNA, 22 bp, Homo sapiens
attggaatgcagaggtctccaa

SEQ ID NO: 1422469 - DNA, 18 bp, Homo sapiens
attggaatgttctcagat

SEQ ID NO: 1422470 - DNA, 18 bp, Homo sapiens
attggaattctactggaa

SEQ ID NO: 1422471 - DNA, 19 bp, Homo sapiens
attggaatttttttttcct

SEQ ID NO: 1422472 - DNA, 10 bp, Homo sapiens
attggacagc

SEQ ID NO: 1422473 - DNA, 15 bp, Homo sapiens
attggaccaggccat

SEQ ID NO: 1422474 - DNA, 21 bp, Homo sapiens
attggactccaggcctgacca

SEQ ID NO: 1422475 - DNA, 23 bp, Homo sapiens
attggactccaggcctgaccagg

SEQ ID NO: 1422476 - DNA, 23 bp, Homo sapiens
attggagggtgggagagcccagc

SEQ ID NO: 1422477 - DNA, 20 bp, Homo sapiens
attggagttggagtagaatg

SEQ ID NO: 1422478 - DNA, 19 bp, Homo sapiens
attggattattcatttaaa

SEQ ID NO: 1422479 - DNA, 21 bp, Homo sapiens
attggattattcatttaaaat

SEQ ID NO: 1422480 - DNA, 22 bp, Homo sapiens
attggattattcatttaaaatg

SEQ ID NO: 1422481 - DNA, 22 bp, Homo sapiens
attggatttcctaatactgtca

SEQ ID NO: 1422482 - DNA, 21 bp, Homo sapiens
attggcacatgccacctggca

SEQ ID NO: 1422483 - DNA, 19 bp, Homo sapiens
attggccagaccacagcag

SEQ ID NO: 1422484 - DNA, 15 bp, Homo sapiens
attggcctctgtgta

SEQ ID NO: 1422485 - DNA, 14 bp, Homo sapiens
attggcctggcctc

SEQ ID NO: 1422486 - DNA, 19 bp, Homo sapiens
attggcctggcctccagct

SEQ ID NO: 1422487 - DNA, 21 bp, Homo sapiens
attggcctgtagagttgctga

SEQ ID NO: 1422488 - DNA, 19 bp, Homo sapiens
attggctatttaaagacaa

SEQ ID NO: 1422489 - DNA, 21 bp, Homo sapiens
attggctccatatcatttgag

SEQ ID NO: 1422490 - DNA, 16 bp, Homo sapiens
attggctgcaggaaga

SEQ ID NO: 1422491 - DNA, 12 bp, Homo sapiens
attgggagaggt

SEQ ID NO: 1422492 - DNA, 17 bp, Homo sapiens
attgggcaagtgattga

SEQ ID NO: 1422493 - DNA, 18 bp, Homo sapiens
attgggcaagtgattgaa

SEQ ID NO: 1422494 - DNA, 16 bp, Homo sapiens
attgggcttcaatcac

SEQ ID NO: 1422495 - DNA, 18 bp, Homo sapiens
attgggcttcaatcactg

SEQ ID NO: 1422496 - DNA, 14 bp, Homo sapiens
attggggaggaggg

SEQ ID NO: 1422497 - DNA, 22 bp, Homo sapiens
attgggggctggtgccagcctt

SEQ ID NO: 1422498 - DNA, 13 bp, Homo sapiens
attggggtagttg

SEQ ID NO: 1422499 - DNA, 22 bp, Homo sapiens
attggtaattacctggagaaga

SEQ ID NO: 1422500 - DNA, 17 bp, Homo sapiens
attggtccagcttgctc

SEQ ID NO: 1422501 - DNA, 15 bp, Homo sapiens
attggtctctatctc

SEQ ID NO: 1422502 - DNA, 23 bp, Homo sapiens
attggtctctatctcctgaatct

SEQ ID NO: 1422503 - DNA, 17 bp, Homo sapiens
attggtgagttaggaac

SEQ ID NO: 1422504 - DNA, 18 bp, Homo sapiens
attggtgggattttttgt

SEQ ID NO: 1422505 - DNA, 12 bp, Homo sapiens
attggtgttgac

SEQ ID NO: 1422506 - DNA, 18 bp, Homo sapiens
attggttgggggctcctg

SEQ ID NO: 1422507 - DNA, 14 bp, Homo sapiens
attgttttaaaaag

SEQ ID NO: 1422508 - DNA, 13 bp, Homo sapiens
attgttttagtaa

SEQ ID NO: 1422509 - DNA, 17 bp, Homo sapiens
attgttttcagtgtaca

SEQ ID NO: 1422510 - DNA, 15 bp, Homo sapiens
attgttttgcacttt

SEQ ID NO: 1422511 - DNA, 15 bp, Homo sapiens
attgttttggaataa

SEQ ID NO: 1422512 - DNA, 15 bp, Homo sapiens
attgtttttaaacct

SEQ ID NO: 1422513 - DNA, 23 bp, Homo sapiens
attgtttttgaatttaaataaag

SEQ ID NO: 1422514 - DNA, 19 bp, Homo sapiens
atttaaaaataagtcaaca

SEQ ID NO: 1422515 - DNA, 22 bp, Homo sapiens
atttaaaaataagtcaacagta

SEQ ID NO: 1422516 - DNA, 15 bp, Homo sapiens
atttaaaaatatttc

SEQ ID NO: 1422517 - DNA, 18 bp, Homo sapiens
atttaaaaatctccatta

SEQ ID NO: 1422518 - DNA, 18 bp, Homo sapiens
atttaaaaattgtttctt

SEQ ID NO: 1422519 - DNA, 20 bp, Homo sapiens
atttaaaaattgtttcttga

SEQ ID NO: 1422520 - DNA, 14 bp, Homo sapiens
atttaaaacagaca

SEQ ID NO: 1422521 - DNA, 23 bp, Homo sapiens
atttaaaacagacactggcatgg

SEQ ID NO: 1422522 - DNA, 13 bp, Homo sapiens
atttaaaacaggc

SEQ ID NO: 1422523 - DNA, 17 bp, Homo sapiens
atttaaaagcctgctca

SEQ ID NO: 1422524 - DNA, 16 bp, Homo sapiens
atttaaaataattata

SEQ ID NO: 1422525 - DNA, 16 bp, Homo sapiens
atttaaaataccactg

SEQ ID NO: 1422526 - DNA, 18 bp, Homo sapiens
atttaaaatgttacttat

SEQ ID NO: 1422527 - DNA, 17 bp, Homo sapiens
atttaaaattgctatgt

SEQ ID NO: 1422528 - DNA, 13 bp, Homo sapiens
atttaaacacaca

SEQ ID NO: 1422529 - DNA, 15 bp, Homo sapiens
atttaaacacacaga

SEQ ID NO: 1422530 - DNA, 18 bp, Homo sapiens
atttaaacaggcccagca

SEQ ID NO: 1422531 - DNA, 11 bp, Homo sapiens
atttaaacctt

SEQ ID NO: 1422532 - DNA, 15 bp, Homo sapiens
atttaaacctttttc

SEQ ID NO: 1422533 - DNA, 18 bp, Homo sapiens
atttaaactctgaattta

SEQ ID NO: 1422534 - DNA, 23 bp, Homo sapiens
atttaaactctgaatttatcttt

SEQ ID NO: 1422535 - DNA, 15 bp, Homo sapiens
atttaaactgtgttt

SEQ ID NO: 1422536 - DNA, 19 bp, Homo sapiens
atttaaagaacaccctata

SEQ ID NO: 1422537 - DNA, 17 bp, Homo sapiens
atttaaagctaaatttt

SEQ ID NO: 1422538 - DNA, 19 bp, Homo sapiens
atttaaagcttattaaaac

SEQ ID NO: 1422539 - DNA, 20 bp, Homo sapiens
atttaaagggtgtacttata

SEQ ID NO: 1422540 - DNA, 13 bp, Homo sapiens
atttaaatataat

SEQ ID NO: 1422541 - DNA, 23 bp, Homo sapiens
atttaaatataattctgtaaatg

SEQ ID NO: 1422542 - DNA, 15 bp, Homo sapiens
atttaaatatctgtt

SEQ ID NO: 1422543 - DNA, 16 bp, Homo sapiens
atttaaatatctgtta

SEQ ID NO: 1422544 - DNA, 22 bp, Homo sapiens
atttaaatatctgttattcaaa

SEQ ID NO: 1422545 - DNA, 20 bp, Homo sapiens
atttaaatggttctgtgcta

SEQ ID NO: 1422546 - DNA, 14 bp, Homo sapiens
atttaaatgtttaa

SEQ ID NO: 1422547 - DNA, 21 bp, Homo sapiens
atttaaattacaattttatct

SEQ ID NO: 1422548 - DNA, 14 bp, Homo sapiens
atttaaatttgatt

SEQ ID NO: 1422549 - DNA, 19 bp, Homo sapiens
atttaaattttacccttta

SEQ ID NO: 1422550 - DNA, 14 bp, Homo sapiens
atttaacagaaatt

SEQ ID NO: 1422551 - DNA, 13 bp, Homo sapiens
atgcatattgtat

SEQ ID NO: 1422552 - DNA, 15 bp, Homo sapiens
atgcatattgtatta

SEQ ID NO: 1422553 - DNA, 14 bp, Homo sapiens
atgcatccattcct

SEQ ID NO: 1422554 - DNA, 22 bp, Homo sapiens
atgcatccattcctcagggaca

SEQ ID NO: 1422555 - DNA, 16 bp, Homo sapiens
atgcatgagctccctc

SEQ ID NO: 1422556 - DNA, 20 bp, Homo sapiens
atgcatggaggactctcctc

SEQ ID NO: 1422557 - DNA, 16 bp, Homo sapiens
atgcatggtgccccag

SEQ ID NO: 1422558 - DNA, 20 bp, Homo sapiens
atgcatggtgccccaggacc

SEQ ID NO: 1422559 - DNA, 16 bp, Homo sapiens
atgcatgtcaaacatg

SEQ ID NO: 1422560 - DNA, 16 bp, Homo sapiens
atgcatgtcctgtaaa

SEQ ID NO: 1422561 - DNA, 18 bp, Homo sapiens
atgcatgtcttttaaaat

SEQ ID NO: 1422562 - DNA, 22 bp, Homo sapiens
atgcattataggatcatttgtt

SEQ ID NO: 1422563 - DNA, 19 bp, Homo sapiens
atgcattcacatttagaaa

SEQ ID NO: 1422564 - DNA, 22 bp, Homo sapiens
atgcattgaacatcttgcattc

SEQ ID NO: 1422565 - DNA, 12 bp, Homo sapiens
atgcatttaaaa

SEQ ID NO: 1422566 - DNA, 17 bp, Homo sapiens
atgcatttaaaatacca

SEQ ID NO: 1422567 - DNA, 20 bp, Homo sapiens
atgcatttaaactcatttga

SEQ ID NO: 1422568 - DNA, 12 bp, Homo sapiens
atgcatttaata

SEQ ID NO: 1422569 - DNA, 15 bp, Homo sapiens
atgcatttaataaag

SEQ ID NO: 1422570 - DNA, 19 bp, Homo sapiens
atgcatttaataaagatga

SEQ ID NO: 1422571 - DNA, 23 bp, Homo sapiens
atgcattttattttagacacaaa

SEQ ID NO: 1422572 - DNA, 19 bp, Homo sapiens
atgcattttgcagcagtga

SEQ ID NO: 1422573 - DNA, 22 bp, Homo sapiens
atgccaaagctagggtggccct

SEQ ID NO: 1422574 - DNA, 20 bp, Homo sapiens
atgccaagagtgcacccatg

SEQ ID NO: 1422575 - DNA, 16 bp, Homo sapiens
atgccacacagagtgg

SEQ ID NO: 1422576 - DNA, 18 bp, Homo sapiens
atgccacacagagtggtc

SEQ ID NO: 1422577 - DNA, 14 bp, Homo sapiens
atgccaccctagcc

SEQ ID NO: 1422578 - DNA, 20 bp, Homo sapiens
atgccacgcctggaagggcc

SEQ ID NO: 1422579 - DNA, 14 bp, Homo sapiens
atgccactcctccc

SEQ ID NO: 1422580 - DNA, 18 bp, Homo sapiens
atgccactgccaggcacc

SEQ ID NO: 1422581 - DNA, 20 bp, Homo sapiens
atgccactgccaggcacctg

SEQ ID NO: 1422582 - DNA, 14 bp, Homo sapiens
atgccactgccttc

SEQ ID NO: 1422583 - DNA, 15 bp, Homo sapiens
atgccactgccttcg

SEQ ID NO: 1422584 - DNA, 18 bp, Homo sapiens
atgccactgccttcgctt

SEQ ID NO: 1422585 - DNA, 21 bp, Homo sapiens
atgccactgctttccagcctg

SEQ ID NO: 1422586 - DNA, 18 bp, Homo sapiens
atgccactgggacagctg

SEQ ID NO: 1422587 - DNA, 23 bp, Homo sapiens
atgccactgggacagctggctgg

SEQ ID NO: 1422588 - DNA, 12 bp, Homo sapiens
atgccacttcct

SEQ ID NO: 1422589 - DNA, 18 bp, Homo sapiens
atgccacttctaagaaaa

SEQ ID NO: 1422590 - DNA, 19 bp, Homo sapiens
atgccacttctcactcacc

SEQ ID NO: 1422591 - DNA, 12 bp, Homo sapiens
atgccagagcca

SEQ ID NO: 1422592 - DNA, 13 bp, Homo sapiens
atgccagagccaa

SEQ ID NO: 1422593 - DNA, 17 bp, Homo sapiens
atgtaagggtctttggt

SEQ ID NO: 1422594 - DNA, 14 bp, Homo sapiens
atgtaagtgggccc

SEQ ID NO: 1422595 - DNA, 19 bp, Homo sapiens
atgtaagtgtggttttgta

SEQ ID NO: 1422596 - DNA, 19 bp, Homo sapiens
atgtaataaaaagtatatg

SEQ ID NO: 1422597 - DNA, 14 bp, Homo sapiens
atgtaataaattca

SEQ ID NO: 1422598 - DNA, 15 bp, Homo sapiens
atgtaataaattcaa

SEQ ID NO: 1422599 - DNA, 13 bp, Homo sapiens
atgtaatataaat

SEQ ID NO: 1422600 - DNA, 14 bp, Homo sapiens
atgtaatataatgt

SEQ ID NO: 1422601 - DNA, 12 bp, Homo sapiens
atgtaatatatt

SEQ ID NO: 1422602 - DNA, 14 bp, Homo sapiens
atgtaatatattgt

SEQ ID NO: 1422603 - DNA, 15 bp, Homo sapiens
atgtaatatattgta

SEQ ID NO: 1422604 - DNA, 18 bp, Homo sapiens
atgtaatatatttcagac

SEQ ID NO: 1422605 - DNA, 19 bp, Homo sapiens
atgtaatcatttatcttat

SEQ ID NO: 1422606 - DNA, 23 bp, Homo sapiens
atgtaatggaaagggtgttggca

SEQ ID NO: 1422607 - DNA, 15 bp, Homo sapiens
atgtaattaagtact

SEQ ID NO: 1422608 - DNA, 17 bp, Homo sapiens
atgtaattaagtactat

SEQ ID NO: 1422609 - DNA, 23 bp, Homo sapiens
atgtaattaagtactatgtatca

SEQ ID NO: 1422610 - DNA, 12 bp, Homo sapiens
atgtaattggaa

SEQ ID NO: 1422611 - DNA, 14 bp, Homo sapiens
atgtaattggaatc

SEQ ID NO: 1422612 - DNA, 15 bp, Homo sapiens
atgtaattggaatct

SEQ ID NO: 1422613 - DNA, 13 bp, Homo sapiens
atgtaatttatgc

SEQ ID NO: 1422614 - DNA, 14 bp, Homo sapiens
atgtaatttatgca

SEQ ID NO: 1422615 - DNA, 20 bp, Homo sapiens
atgtaatttcaaaatacatt

SEQ ID NO: 1422616 - DNA, 20 bp, Homo sapiens
atgtacaaaaaaaaaaccct

SEQ ID NO: 1422617 - DNA, 21 bp, Homo sapiens
atgtacaaaatcgattggctt

SEQ ID NO: 1422618 - DNA, 15 bp, Homo sapiens
atgtacaagttttgt

SEQ ID NO: 1422619 - DNA, 15 bp, Homo sapiens
atgtacaatacaatg

SEQ ID NO: 1422620 - DNA, 22 bp, Homo sapiens
atgtacaatacaatgtacaatt

SEQ ID NO: 1422621 - DNA, 13 bp, Homo sapiens
atgtacagtctgt

SEQ ID NO: 1422622 - DNA, 14 bp, Homo sapiens
atgtacagtctgtc

SEQ ID NO: 1422623 - DNA, 15 bp, Homo sapiens
atgtacagtctgtca

SEQ ID NO: 1422624 - DNA, 17 bp, Homo sapiens
atgtacagtctgtcatg

SEQ ID NO: 1422625 - DNA, 16 bp, Homo sapiens
atgtacagttgaaata

SEQ ID NO: 1422626 - DNA, 14 bp, Homo sapiens
atgtacataactcc

SEQ ID NO: 1422627 - DNA, 17 bp, Homo sapiens
atgtacatagtaaagta

SEQ ID NO: 1422628 - DNA, 18 bp, Homo sapiens
atgtaccatgaaacaaag

SEQ ID NO: 1422629 - DNA, 20 bp, Homo sapiens
atgtacccctctcagtctgc

SEQ ID NO: 1422630 - DNA, 20 bp, Homo sapiens
atgtacctcagatctctctc

SEQ ID NO: 1422631 - DNA, 21 bp, Homo sapiens
atgtacctcagatctctctct

SEQ ID NO: 1422632 - DNA, 18 bp, Homo sapiens
atgtacgtccagcctgcc

SEQ ID NO: 1422633 - DNA, 14 bp, Homo sapiens
atgtactaagaatg

SEQ ID NO: 1422634 - DNA, 17 bp, Homo sapiens
atgtactacagctatat

SEQ ID NO: 1422635 - DNA, 15 bp, Homo sapiens
atgtactagtgttct

SEQ ID NO: 1422636 - DNA, 15 bp, Homo sapiens
atgtactatgtctga

SEQ ID NO: 1422637 - DNA, 16 bp, Homo sapiens
atgtactcacatataa

SEQ ID NO: 1422638 - DNA, 17 bp, Homo sapiens
atgtactcctctttaca

SEQ ID NO: 1422639 - DNA, 20 bp, Homo sapiens
atgtactcctctttacactg

SEQ ID NO: 1422640 - DNA, 17 bp, Homo sapiens
atgtactgaattccata

SEQ ID NO: 1422641 - DNA, 16 bp, Homo sapiens
atgtactgatttcagt

SEQ ID NO: 1422642 - DNA, 18 bp, Homo sapiens
atgtactgatttcagtaa

SEQ ID NO: 1422643 - DNA, 19 bp, Homo sapiens
atgtactggtaattgtaca

SEQ ID NO: 1422644 - DNA, 20 bp, Homo sapiens
atgtactggtaattgtacaa

SEQ ID NO: 1422645 - DNA, 15 bp, Homo sapiens
atgtactgtttgctg

SEQ ID NO: 1422646 - DNA, 15 bp, Homo sapiens
atgtacttagctgta

SEQ ID NO: 1422647 - DNA, 19 bp, Homo sapiens
atgtacttagctgtactat

SEQ ID NO: 1422648 - DNA, 21 bp, Homo sapiens
atgtacttagctgtactataa

SEQ ID NO: 1422649 - DNA, 14 bp, Homo sapiens
atgtacttctctgt

SEQ ID NO: 1422650 - DNA, 19 bp, Homo sapiens
atgtacttgtttctctgtt

SEQ ID NO: 1422651 - DNA, 17 bp, Homo sapiens
atgtacttgtttgctat

SEQ ID NO: 1422652 - DNA, 22 bp, Homo sapiens
atgtacttttattttacacaga

SEQ ID NO: 1422653 - DNA, 14 bp, Homo sapiens
atgtactttttagt

SEQ ID NO: 1422654 - DNA, 15 bp, Homo sapiens
atgtagaactcagca

SEQ ID NO: 1422655 - DNA, 15 bp, Homo sapiens
atgtagaactgttca

SEQ ID NO: 1422656 - DNA, 16 bp, Homo sapiens
atgtagaactgttcat

SEQ ID NO: 1422657 - DNA, 15 bp, Homo sapiens
atgtagaataggcag

SEQ ID NO: 1422658 - DNA, 18 bp, Homo sapiens
atgtagacagatatttca

SEQ ID NO: 1422659 - DNA, 16 bp, Homo sapiens
atgtagagagaacagg

SEQ ID NO: 1422660 - DNA, 20 bp, Homo sapiens
atgtagcactactacagaaa

SEQ ID NO: 1422661 - DNA, 18 bp, Homo sapiens
atgtagcacttacgtaaa

SEQ ID NO: 1422662 - DNA, 16 bp, Homo sapiens
atgtagcctttactgt

SEQ ID NO: 1422663 - DNA, 20 bp, Homo sapiens
atgtaggggaagagatgttt

SEQ ID NO: 1422664 - DNA, 23 bp, Homo sapiens
atgtaggggttaacttggtcaga

SEQ ID NO: 1422665 - DNA, 17 bp, Homo sapiens
atgtaggtatgaataag

SEQ ID NO: 1422666 - DNA, 12 bp, Homo sapiens
atgtaggtcctc

SEQ ID NO: 1422667 - DNA, 12 bp, Homo sapiens
atgtagtaacac

SEQ ID NO: 1422668 - DNA, 14 bp, Homo sapiens
atgtagtaacacta

SEQ ID NO: 1422669 - DNA, 20 bp, Homo sapiens
atgtagtaacactaatatat

SEQ ID NO: 1422670 - DNA, 22 bp, Homo sapiens
atgtagtaacactaatatattt

SEQ ID NO: 1422671 - DNA, 19 bp, Homo sapiens
atgtagtataaagaaaagt

SEQ ID NO: 1422672 - DNA, 19 bp, Homo sapiens
atgtagtattaaaagttgc

SEQ ID NO: 1422673 - DNA, 21 bp, Homo sapiens
atgtagtattttttgtataat

SEQ ID NO: 1422674 - DNA, 23 bp, Homo sapiens
atgtagtttgaggaaatttgcag

SEQ ID NO: 1422675 - DNA, 20 bp, Homo sapiens
atgtagtttttatatgttgt

SEQ ID NO: 1422676 - DNA, 21 bp, Homo sapiens
atgtagtttttatatgttgta

SEQ ID NO: 1422677 - DNA, 20 bp, Homo sapiens
atgtataaaatacatagtga

SEQ ID NO: 1422678 - DNA, 17 bp, Homo sapiens
atgtataaagaacaagg

SEQ ID NO: 1422679 - DNA, 12 bp, Homo sapiens
atgtataaagat

SEQ ID NO: 1422680 - DNA, 18 bp, Homo sapiens
atgtataaagattgtact

SEQ ID NO: 1422681 - DNA, 14 bp, Homo sapiens
atgtataaattttt

SEQ ID NO: 1422682 - DNA, 23 bp, Homo sapiens
atgtataacaagccaaacattct

SEQ ID NO: 1422683 - DNA, 20 bp, Homo sapiens
atgtataatgtgcagaaaat

SEQ ID NO: 1422684 - DNA, 14 bp, Homo sapiens
atgtatacatgtgc

SEQ ID NO: 1422685 - DNA, 14 bp, Homo sapiens
atgtatagtgtcta

SEQ ID NO: 1422686 - DNA, 19 bp, Homo sapiens
atgtatatatatatagtaa

SEQ ID NO: 1422687 - DNA, 19 bp, Homo sapiens
atgtatatatatatatgca

SEQ ID NO: 1422688 - DNA, 13 bp, Homo sapiens
atgtatatatcta

SEQ ID NO: 1422689 - DNA, 15 bp, Homo sapiens
atgtatatgccatta

SEQ ID NO: 1422690 - DNA, 14 bp, Homo sapiens
atgtatatgtatat

SEQ ID NO: 1422691 - DNA, 15 bp, Homo sapiens
atgtatatgtatata

SEQ ID NO: 1422692 - DNA, 16 bp, Homo sapiens
atgcctgtccagcctg

SEQ ID NO: 1422693 - DNA, 17 bp, Homo sapiens
atgcctgtccagcctgg

SEQ ID NO: 1422694 - DNA, 18 bp, Homo sapiens
atgcctgtccagcctggg

SEQ ID NO: 1422695 - DNA, 22 bp, Homo sapiens
atgcctgtctctagctgttctg

SEQ ID NO: 1422696 - DNA, 13 bp, Homo sapiens
atgccttaagcag

SEQ ID NO: 1422697 - DNA, 15 bp, Homo sapiens
atgccttaagcagaa

SEQ ID NO: 1422698 - DNA, 23 bp, Homo sapiens
atgccttaagcagaacaaatgtg

SEQ ID NO: 1422699 - DNA, 18 bp, Homo sapiens
atgccttccagcaccctg

SEQ ID NO: 1422700 - DNA, 14 bp, Homo sapiens
atgccttgcttgta

SEQ ID NO: 1422701 - DNA, 23 bp, Homo sapiens
atgccttgtataaaatccaaaat

SEQ ID NO: 1422702 - DNA, 21 bp, Homo sapiens
atgcctttaaatctgtgatga

SEQ ID NO: 1422703 - DNA, 17 bp, Homo sapiens
atgcctttatatactta

SEQ ID NO: 1422704 - DNA, 13 bp, Homo sapiens
atgcctttctagt

SEQ ID NO: 1422705 - DNA, 16 bp, Homo sapiens
atgcctttgtaagtta

SEQ ID NO: 1422706 - DNA, 15 bp, Homo sapiens
atgccttttctgtga

SEQ ID NO: 1422707 - DNA, 17 bp, Homo sapiens
atgccttttgaatacat

SEQ ID NO: 1422708 - DNA, 15 bp, Homo sapiens
atgcggatcctgctg

SEQ ID NO: 1422709 - DNA, 21 bp, Homo sapiens
atgcggttataaaaaatggtt

SEQ ID NO: 1422710 - DNA, 21 bp, Homo sapiens
atgcgtacgtttcctgagaag

SEQ ID NO: 1422711 - DNA, 16 bp, Homo sapiens
atgcgtgccgcctgct

SEQ ID NO: 1422712 - DNA, 24 bp, Homo sapiens
atgcgtgccgcctgctcctcactg

SEQ ID NO: 1422713 - DNA, 14 bp, Homo sapiens
atgcgtgtgtttgg

SEQ ID NO: 1422714 - DNA, 17 bp, Homo sapiens
atgcgtgtttctgactc

SEQ ID NO: 1422715 - DNA, 20 bp, Homo sapiens
atgctaaaccttagtactga

SEQ ID NO: 1422716 - DNA, 23 bp, Homo sapiens
atgctaaaccttagtactgagtt

SEQ ID NO: 1422717 - DNA, 12 bp, Homo sapiens
atgctaaactgt

SEQ ID NO: 1422718 - DNA, 20 bp, Homo sapiens
atgctaaactgtgaaaaatc

SEQ ID NO: 1422719 - DNA, 13 bp, Homo sapiens
atgctaatgtaat

SEQ ID NO: 1422720 - DNA, 20 bp, Homo sapiens
atgctaatttttggagaaat

SEQ ID NO: 1422721 - DNA, 21 bp, Homo sapiens
atgctaatttttggagaaatg

SEQ ID NO: 1422722 - DNA, 17 bp, Homo sapiens
atgctacaattttaaga

SEQ ID NO: 1422723 - DNA, 14 bp, Homo sapiens
atgctactgtctca

SEQ ID NO: 1422724 - DNA, 15 bp, Homo sapiens
atgctagcaggctgt

SEQ ID NO: 1422725 - DNA, 15 bp, Homo sapiens
atgctaggctgtctg

SEQ ID NO: 1422726 - DNA, 17 bp, Homo sapiens
atgctatggtcaggtta

SEQ ID NO: 1422727 - DNA, 15 bp, Homo sapiens
atgctatgttctgtc

SEQ ID NO: 1422728 - DNA, 18 bp, Homo sapiens
atgctatgttctgtcttc

SEQ ID NO: 1422729 - DNA, 20 bp, Homo sapiens
attctgatgtttctgtgaaa

SEQ ID NO: 1422730 - DNA, 23 bp, Homo sapiens
attctgattattgagttccagtt

SEQ ID NO: 1422731 - DNA, 16 bp, Homo sapiens
attctgatttcagttt

SEQ ID NO: 1422732 - DNA, 20 bp, Homo sapiens
attctgatttcagtttttca

SEQ ID NO: 1422733 - DNA, 16 bp, Homo sapiens
attctgcaactagcca

SEQ ID NO: 1422734 - DNA, 19 bp, Homo sapiens
attctgcaagcacatctgc

SEQ ID NO: 1422735 - DNA, 14 bp, Homo sapiens
attctgcaagtata

SEQ ID NO: 1422736 - DNA, 18 bp, Homo sapiens
attctgcaagtttctgtt

SEQ ID NO: 1422737 - DNA, 23 bp, Homo sapiens
attctgcaagtttctgtttcaaa

SEQ ID NO: 1422738 - DNA, 15 bp, Homo sapiens
attctgccccagagt

SEQ ID NO: 1422739 - DNA, 16 bp, Homo sapiens
attctgcctatgtaaa

SEQ ID NO: 1422740 - DNA, 18 bp, Homo sapiens
attctgcctcagcctcct

SEQ ID NO: 1422741 - DNA, 17 bp, Homo sapiens
attctgcctctctagga

SEQ ID NO: 1422742 - DNA, 15 bp, Homo sapiens
attctgctacctcac

SEQ ID NO: 1422743 - DNA, 21 bp, Homo sapiens
attctggataaagccactgaa

SEQ ID NO: 1422744 - DNA, 16 bp, Homo sapiens
attctggatctcctgc

SEQ ID NO: 1422745 - DNA, 17 bp, Homo sapiens
attctggatggccgggc

SEQ ID NO: 1422746 - DNA, 20 bp, Homo sapiens
attctggatggccgggctgc

SEQ ID NO: 1422747 - DNA, 15 bp, Homo sapiens
attctggcccagcca

SEQ ID NO: 1422748 - DNA, 22 bp, Homo sapiens
attctggcggagatgggtcctg

SEQ ID NO: 1422749 - DNA, 22 bp, Homo sapiens
attctgggaagcttgagcctcc

SEQ ID NO: 1422750 - DNA, 21 bp, Homo sapiens
attctgggaggcaagaaaagg

SEQ ID NO: 1422751 - DNA, 23 bp, Homo sapiens
attctgggctcctggaaccaatc

SEQ ID NO: 1422752 - DNA, 14 bp, Homo sapiens
attctgtactctta

SEQ ID NO: 1422753 - DNA, 17 bp, Homo sapiens
attctgtagattctgtg

SEQ ID NO: 1422754 - DNA, 17 bp, Homo sapiens
attctgtagttgcagct

SEQ ID NO: 1422755 - DNA, 17 bp, Homo sapiens
attctgtatccgtgaat

SEQ ID NO: 1422756 - DNA, 23 bp, Homo sapiens
attctgtatccgtgaattgcttt

SEQ ID NO: 1422757 - DNA, 16 bp, Homo sapiens
attctgtggattctat

SEQ ID NO: 1422758 - DNA, 18 bp, Homo sapiens
attctgtggattctatat

SEQ ID NO: 1422759 - DNA, 11 bp, Homo sapiens
attctgtgttg

SEQ ID NO: 1422760 - DNA, 14 bp, Homo sapiens
attctgtgttgaac

SEQ ID NO: 1422761 - DNA, 13 bp, Homo sapiens
attctgttatatg

SEQ ID NO: 1422762 - DNA, 18 bp, Homo sapiens
attctgttccctgggctg

SEQ ID NO: 1422763 - DNA, 12 bp, Homo sapiens
attctgtttctt

SEQ ID NO: 1422764 - DNA, 17 bp, Homo sapiens
attctgttttcccccag

SEQ ID NO: 1422765 - DNA, 13 bp, Homo sapiens
attctgttttgca

SEQ ID NO: 1422766 - DNA, 16 bp, Homo sapiens
attcttaacaaactct

SEQ ID NO: 1422767 - DNA, 22 bp, Homo sapiens
attcttatgtagcaggaaataa

SEQ ID NO: 1422768 - DNA, 17 bp, Homo sapiens
attcttatgttgaatat

SEQ ID NO: 1422769 - DNA, 18 bp, Homo sapiens
attcttatttaatgaaag

SEQ ID NO: 1422770 - DNA, 16 bp, Homo sapiens
attcttatttcattta

SEQ ID NO: 1422771 - DNA, 18 bp, Homo sapiens
attcttatttgatggtgg

SEQ ID NO: 1422772 - DNA, 19 bp, Homo sapiens
attcttatttgatggtggt

SEQ ID NO: 1422773 - DNA, 16 bp, Homo sapiens
attcttcacctttgta

SEQ ID NO: 1422774 - DNA, 19 bp, Homo sapiens
attcttcacctttgtaaga

SEQ ID NO: 1422775 - DNA, 15 bp, Homo sapiens
attcttccagaatgc

SEQ ID NO: 1422776 - DNA, 21 bp, Homo sapiens
attcttccatcatcactgtaa

SEQ ID NO: 1422777 - DNA, 20 bp, Homo sapiens
attcttcccaacttgccttt

SEQ ID NO: 1422778 - DNA, 19 bp, Homo sapiens
attcttcccgctccccacc

SEQ ID NO: 1422779 - DNA, 20 bp, Homo sapiens
attcttcccgctccccacct

SEQ ID NO: 1422780 - DNA, 10 bp, Homo sapiens
attcttcctt

SEQ ID NO: 1422781 - DNA, 14 bp, Homo sapiens
attcttctaggcat

SEQ ID NO: 1422782 - DNA, 17 bp, Homo sapiens
attcttctgagcactgt

SEQ ID NO: 1422783 - DNA, 13 bp, Homo sapiens
attcttctgcaac

SEQ ID NO: 1422784 - DNA, 19 bp, Homo sapiens
attcttctgtgtttataaa

SEQ ID NO: 1422785 - DNA, 22 bp, Homo sapiens
attcttcttccaacgtggccca

SEQ ID NO: 1422786 - DNA, 19 bp, Homo sapiens
attcttgatcagtagtttg

SEQ ID NO: 1422787 - DNA, 21 bp, Homo sapiens
attcttgatcagtagtttgca

SEQ ID NO: 1422788 - DNA, 22 bp, Homo sapiens
attcttgatgaaaagctttgtt

SEQ ID NO: 1422789 - DNA, 16 bp, Homo sapiens
attcttgatgtaaaat

SEQ ID NO: 1422790 - DNA, 12 bp, Homo sapiens
attcttgctggg

SEQ ID NO: 1422791 - DNA, 19 bp, Homo sapiens
attcttgctgggcatactt

SEQ ID NO: 1422792 - DNA, 21 bp, Homo sapiens
attcttgctgggcatactttc

SEQ ID NO: 1422793 - DNA, 22 bp, Homo sapiens
attcttgctgggcatactttct

SEQ ID NO: 1422794 - DNA, 20 bp, Homo sapiens
attcttgctttcacaaatat

SEQ ID NO: 1422795 - DNA, 14 bp, Homo sapiens
attcttgtaaatct

SEQ ID NO: 1422796 - DNA, 17 bp, Homo sapiens
attcttgtaaatctttt

SEQ ID NO: 1422797 - DNA, 19 bp, Homo sapiens
attcttgtaaatctttttg

SEQ ID NO: 1422798 - DNA, 12 bp, Homo sapiens
attcttgtgctt

SEQ ID NO: 1422799 - DNA, 18 bp, Homo sapiens
attcttgtgcttttcctg

SEQ ID NO: 1422800 - DNA, 14 bp, Homo sapiens
attcttgtggttaa

SEQ ID NO: 1422801 - DNA, 22 bp, Homo sapiens
attcttgttggtagcatgtact

SEQ ID NO: 1422802 - DNA, 20 bp, Homo sapiens
attctttaacatacatctaa

SEQ ID NO: 1422803 - DNA, 17 bp, Homo sapiens
attctttactgcactca

SEQ ID NO: 1422804 - DNA, 16 bp, Homo sapiens
attctttagtactcaa

SEQ ID NO: 1422805 - DNA, 18 bp, Homo sapiens
attctttcagctgtgtct

SEQ ID NO: 1422806 - DNA, 17 bp, Homo sapiens
attctttcagttctttg

SEQ ID NO: 1422807 - DNA, 16 bp, Homo sapiens
attctttccattatga

SEQ ID NO: 1422808 - DNA, 21 bp, Homo sapiens
attctttccattatgattctt

SEQ ID NO: 1422809 - DNA, 15 bp, Homo sapiens
attctttccccagag

SEQ ID NO: 1422810 - DNA, 16 bp, Homo sapiens
attctttctcataaaa

SEQ ID NO: 1422811 - DNA, 22 bp, Homo sapiens
attctttctgcctttaattttc

SEQ ID NO: 1422812 - DNA, 12 bp, Homo sapiens
attctttgaaca

SEQ ID NO: 1422813 - DNA, 19 bp, Homo sapiens
attctttgaacatgaacta

SEQ ID NO: 1422814 - DNA, 21 bp, Homo sapiens
attctttgcactttttcttaa

SEQ ID NO: 1422815 - DNA, 14 bp, Homo sapiens
attctttgctagtt

SEQ ID NO: 1422816 - DNA, 18 bp, Homo sapiens
attctttgctagttggag

SEQ ID NO: 1422817 - DNA, 22 bp, Homo sapiens
attctttgctagttggagtgct

SEQ ID NO: 1422818 - DNA, 21 bp, Homo sapiens
attctttggagttaaaatgca

SEQ ID NO: 1422819 - DNA, 22 bp, Homo sapiens
attctttgtaccatctgtcttg

SEQ ID NO: 1422820 - DNA, 13 bp, Homo sapiens
attctttgttctg

SEQ ID NO: 1422821 - DNA, 22 bp, Homo sapiens
attcttttatactcagctttct

SEQ ID NO: 1422822 - DNA, 13 bp, Homo sapiens
attcttttcaatt

SEQ ID NO: 1422823 - DNA, 18 bp, Homo sapiens
attcttttcagcttgttt

SEQ ID NO: 1422824 - DNA, 21 bp, Homo sapiens
attcttttcagcttgtttcta

SEQ ID NO: 1422825 - DNA, 22 bp, Homo sapiens
attcttttcagcttgtttctat

SEQ ID NO: 1422826 - DNA, 16 bp, Homo sapiens
attctttttaaagtat

SEQ ID NO: 1422827 - DNA, 22 bp, Homo sapiens
attctttttgctctaaaatatt

SEQ ID NO: 1422828 - DNA, 19 bp, Homo sapiens
attgaaaaaaattgaaata

SEQ ID NO: 1422829 - DNA, 22 bp, Homo sapiens
attgaaaaacaattttctgtaa

SEQ ID NO: 1422830 - DNA, 14 bp, Homo sapiens
attgaaaacactta

SEQ ID NO: 1422831 - DNA, 21 bp, Homo sapiens
attgaaaagaagaaagtctat

SEQ ID NO: 1422832 - DNA, 16 bp, Homo sapiens
attgaaaagtgttctg

SEQ ID NO: 1422833 - DNA, 23 bp, Homo sapiens
attgaaaagtttttgtttggaga

SEQ ID NO: 1422834 - DNA, 22 bp, Homo sapiens
attgaaaatgtccaggaaagtg

SEQ ID NO: 1422835 - DNA, 18 bp, Homo sapiens
attgaaactacactaaat

SEQ ID NO: 1422836 - DNA, 14 bp, Homo sapiens
attgaaagaactta

SEQ ID NO: 1422837 - DNA, 19 bp, Homo sapiens
attgaaagaacttaagtct

SEQ ID NO: 1422838 - DNA, 19 bp, Homo sapiens
attgaaagcttttaaaatg

SEQ ID NO: 1422839 - DNA, 20 bp, Homo sapiens
attgaaagcttttaaaatgt

SEQ ID NO: 1422840 - DNA, 23 bp, Homo sapiens
attgaaaggggacacctgtacat

SEQ ID NO: 1422841 - DNA, 17 bp, Homo sapiens
attgaaataaggaggga

SEQ ID NO: 1422842 - DNA, 12 bp, Homo sapiens
attgaaattcta

SEQ ID NO: 1422843 - DNA, 13 bp, Homo sapiens
attgaaattctga

SEQ ID NO: 1422844 - DNA, 20 bp, Homo sapiens
attgaaatttttctctttaa

SEQ ID NO: 1422845 - DNA, 19 bp, Homo sapiens
attcctgccctgctgttta

SEQ ID NO: 1422846 - DNA, 17 bp, Homo sapiens
attcctgcctgtctcct

SEQ ID NO: 1422847 - DNA, 20 bp, Homo sapiens
attcctgcctttaagccaaa

SEQ ID NO: 1422848 - DNA, 15 bp, Homo sapiens
attcctggagcccga

SEQ ID NO: 1422849 - DNA, 23 bp, Homo sapiens
attcctggagcccgaggcaccag

SEQ ID NO: 1422850 - DNA, 13 bp, Homo sapiens
attcctgggcctg

SEQ ID NO: 1422851 - DNA, 18 bp, Homo sapiens
attcctgtaaataagagt

SEQ ID NO: 1422852 - DNA, 16 bp, Homo sapiens
attcctgtatgttgtc

SEQ ID NO: 1422853 - DNA, 17 bp, Homo sapiens
attcctgtatgttgtcc

SEQ ID NO: 1422854 - DNA, 18 bp, Homo sapiens
attcctgtatgttgtcca

SEQ ID NO: 1422855 - DNA, 17 bp, Homo sapiens
attcctgttgctgtctt

SEQ ID NO: 1422856 - DNA, 22 bp, Homo sapiens
attccttagcttagacctcagc

SEQ ID NO: 1422857 - DNA, 18 bp, Homo sapiens
attccttcgaaaggcctt

SEQ ID NO: 1422858 - DNA, 23 bp, Homo sapiens
attccttctgcctaacttgtaaa

SEQ ID NO: 1422859 - DNA, 16 bp, Homo sapiens
attccttctttcacag

SEQ ID NO: 1422860 - DNA, 16 bp, Homo sapiens
attccttgtcaccagc

SEQ ID NO: 1422861 - DNA, 16 bp, Homo sapiens
attcgcctttgtcttg

SEQ ID NO: 1422862 - DNA, 14 bp, Homo sapiens
attcgctagtgttt

SEQ ID NO: 1422863 - DNA, 15 bp, Homo sapiens
attcgctagtgttta

SEQ ID NO: 1422864 - DNA, 16 bp, Homo sapiens
attcgctgtacccttt

SEQ ID NO: 1422865 - DNA, 21 bp, Homo sapiens
attcggaactgtcctttcctt

SEQ ID NO: 1422866 - DNA, 22 bp, Homo sapiens
attctaaaatgtgatgttctaa

SEQ ID NO: 1422867 - DNA, 23 bp, Homo sapiens
attctaaaatgtgatgttctaag

SEQ ID NO: 1422868 - DNA, 12 bp, Homo sapiens
attctaaagata

SEQ ID NO: 1422869 - DNA, 19 bp, Homo sapiens
attctaaagattctatagt

SEQ ID NO: 1422870 - DNA, 15 bp, Homo sapiens
attctaaatgaatgt

SEQ ID NO: 1422871 - DNA, 18 bp, Homo sapiens
attctaaatgaatgttta

SEQ ID NO: 1422872 - DNA, 19 bp, Homo sapiens
attctaacattaaatcaca

SEQ ID NO: 1422873 - DNA, 20 bp, Homo sapiens
attctaagacttactctaag

SEQ ID NO: 1422874 - DNA, 22 bp, Homo sapiens
attctaagacttactctaagat

SEQ ID NO: 1422875 - DNA, 23 bp, Homo sapiens
attctaagacttactctaagatc

SEQ ID NO: 1422876 - DNA, 21 bp, Homo sapiens
attctaagccagttttcattt

SEQ ID NO: 1422877 - DNA, 22 bp, Homo sapiens
attctaagccagttttcatttt

SEQ ID NO: 1422878 - DNA, 23 bp, Homo sapiens
attctaagccagttttcattttg

SEQ ID NO: 1422879 - DNA, 23 bp, Homo sapiens
attctaatgatgatcaattatag

SEQ ID NO: 1422880 - DNA, 19 bp, Homo sapiens
attctacaaaaaaccagga

SEQ ID NO: 1422881 - DNA, 19 bp, Homo sapiens
attctacacatgtaaaata

SEQ ID NO: 1422882 - DNA, 23 bp, Homo sapiens
attctacacatgtaaaatatgta

SEQ ID NO: 1422883 - DNA, 16 bp, Homo sapiens
attctactcttgtcat

SEQ ID NO: 1422884 - DNA, 22 bp, Homo sapiens
attctagaaagtactttggcct

SEQ ID NO: 1422885 - DNA, 15 bp, Homo sapiens
attctagctaatgta

SEQ ID NO: 1422886 - DNA, 20 bp, Homo sapiens
attctaggcatcccagggga

SEQ ID NO: 1422887 - DNA, 17 bp, Homo sapiens
attctagtcaactgctg

SEQ ID NO: 1422888 - DNA, 22 bp, Homo sapiens
attctagtcaactgctgtttta

SEQ ID NO: 1422889 - DNA, 17 bp, Homo sapiens
attctagtctctgattt

SEQ ID NO: 1422890 - DNA, 21 bp, Homo sapiens
attctagtctctgatttgcaa

SEQ ID NO: 1422891 - DNA, 15 bp, Homo sapiens
attctagtgctgctg

SEQ ID NO: 1422892 - DNA, 19 bp, Homo sapiens
attctagtgtaacactgca

SEQ ID NO: 1422893 - DNA, 21 bp, Homo sapiens
attctagtgtctgacttttgt

SEQ ID NO: 1422894 - DNA, 13 bp, Homo sapiens
attctataaaact

SEQ ID NO: 1422895 - DNA, 14 bp, Homo sapiens
attctataaaactc

SEQ ID NO: 1422896 - DNA, 15 bp, Homo sapiens
attctataaattcaa

SEQ ID NO: 1422897 - DNA, 13 bp, Homo sapiens
attctatatgaat

SEQ ID NO: 1422898 - DNA, 14 bp, Homo sapiens
attctatatttcat

SEQ ID NO: 1422899 - DNA, 16 bp, Homo sapiens
attctatatttcatat

SEQ ID NO: 1422900 - DNA, 17 bp, Homo sapiens
attctatatttcatatt

SEQ ID NO: 1422901 - DNA, 19 bp, Homo sapiens
attctatccatctcctggt

SEQ ID NO: 1422902 - DNA, 20 bp, Homo sapiens
attctatgaagcccacccag

SEQ ID NO: 1422903 - DNA, 19 bp, Homo sapiens
attctatggaatagttctg

SEQ ID NO: 1422904 - DNA, 13 bp, Homo sapiens
attctatgtatgt

SEQ ID NO: 1422905 - DNA, 15 bp, Homo sapiens
attctattaaagtgc

SEQ ID NO: 1422906 - DNA, 14 bp, Homo sapiens
attctattaacttt

SEQ ID NO: 1422907 - DNA, 16 bp, Homo sapiens
attctattgaaaacag

SEQ ID NO: 1422908 - DNA, 12 bp, Homo sapiens
attctatttgaa

SEQ ID NO: 1422909 - DNA, 15 bp, Homo sapiens
attctcaaacacagt

SEQ ID NO: 1422910 - DNA, 15 bp, Homo sapiens
attctcaagacctga

SEQ ID NO: 1422911 - DNA, 18 bp, Homo sapiens
attctcaccctgtgaaac

SEQ ID NO: 1422912 - DNA, 17 bp, Homo sapiens
attctcactccaccacc

SEQ ID NO: 1422913 - DNA, 20 bp, Homo sapiens
attctcagaatctcaaataa

SEQ ID NO: 1422914 - DNA, 13 bp, Homo sapiens
attctcagagtgt

SEQ ID NO: 1422915 - DNA, 22 bp, Homo sapiens
attctcaggtaggaagcaacag

SEQ ID NO: 1422916 - DNA, 18 bp, Homo sapiens
attctcataggagactgc

SEQ ID NO: 1422917 - DNA, 13 bp, Homo sapiens
attctccactgtg

SEQ ID NO: 1422918 - DNA, 19 bp, Homo sapiens
attctccagttgattattt

SEQ ID NO: 1422919 - DNA, 13 bp, Homo sapiens
attctcccagcgt

SEQ ID NO: 1422920 - DNA, 21 bp, Homo sapiens
attctcccaggtaccagctgc

SEQ ID NO: 1422921 - DNA, 24 bp, Homo sapiens
attctcccaggtaccagctgcgct

SEQ ID NO: 1422922 - DNA, 18 bp, Homo sapiens
attctcccgcctcagcct

SEQ ID NO: 1422923 - DNA, 19 bp, Homo sapiens
attctcccgcctcagcctc

SEQ ID NO: 1422924 - DNA, 23 bp, Homo sapiens
attctcccgcttcctggcctccc

SEQ ID NO: 1422925 - DNA, 14 bp, Homo sapiens
attctccctgacct

SEQ ID NO: 1422926 - DNA, 12 bp, Homo sapiens
attctccctggg

SEQ ID NO: 1422927 - DNA, 16 bp, Homo sapiens
attctccctgggcctc

SEQ ID NO: 1422928 - DNA, 13 bp, Homo sapiens
attctcctgcctc

SEQ ID NO: 1422929 - DNA, 14 bp, Homo sapiens
attctccttcagcc

SEQ ID NO: 1422930 - DNA, 23 bp, Homo sapiens
attctccttcagccctcacccct

SEQ ID NO: 1422931 - DNA, 22 bp, Homo sapiens
attctctaaactggcatctgct

SEQ ID NO: 1422932 - DNA, 16 bp, Homo sapiens
attctctagatttatt

SEQ ID NO: 1422933 - DNA, 17 bp, Homo sapiens
attctctcccatcctgg

SEQ ID NO: 1422934 - DNA, 15 bp, Homo sapiens
attctctctcctgta

SEQ ID NO: 1422935 - DNA, 12 bp, Homo sapiens
attctctcttta

SEQ ID NO: 1422936 - DNA, 13 bp, Homo sapiens
attctctgcaatt

SEQ ID NO: 1422937 - DNA, 16 bp, Homo sapiens
attctctgcaatttgt

SEQ ID NO: 1422938 - DNA, 14 bp, Homo sapiens
attctctgcccagc

SEQ ID NO: 1422939 - DNA, 17 bp, Homo sapiens
attctctggctgtaagg

SEQ ID NO: 1422940 - DNA, 19 bp, Homo sapiens
attctctgtaagtgtagct

SEQ ID NO: 1422941 - DNA, 10 bp, Homo sapiens
attctctgtg

SEQ ID NO: 1422942 - DNA, 21 bp, Homo sapiens
attctctgtgtctaagattct

SEQ ID NO: 1422943 - DNA, 15 bp, Homo sapiens
attctcttcttgcta

SEQ ID NO: 1422944 - DNA, 15 bp, Homo sapiens
attctcttgcattgt

SEQ ID NO: 1422945 - DNA, 15 bp, Homo sapiens
attctcttgtataag

SEQ ID NO: 1422946 - DNA, 18 bp, Homo sapiens
attctcttgtataagatc

SEQ ID NO: 1422947 - DNA, 21 bp, Homo sapiens
attctctttaaaaaagactga

SEQ ID NO: 1422948 - DNA, 14 bp, Homo sapiens
attctctttcaaag

SEQ ID NO: 1422949 - DNA, 13 bp, Homo sapiens
attctctttgata

SEQ ID NO: 1422950 - DNA, 14 bp, Homo sapiens
attctctttgataa

SEQ ID NO: 1422951 - DNA, 18 bp, Homo sapiens
attctctttgataacaaa

SEQ ID NO: 1422952 - DNA, 19 bp, Homo sapiens
attctctttgataacaaaa

SEQ ID NO: 1422953 - DNA, 14 bp, Homo sapiens
attctgacatgtaa

SEQ ID NO: 1422954 - DNA, 20 bp, Homo sapiens
attctgaccgttaaaaaatt

SEQ ID NO: 1422955 - DNA, 23 bp, Homo sapiens
attctgaccgttaaaaaattctt

SEQ ID NO: 1422956 - DNA, 15 bp, Homo sapiens
attctgagaaaacaa

SEQ ID NO: 1422957 - DNA, 17 bp, Homo sapiens
attctgagcctgatatt

SEQ ID NO: 1422958 - DNA, 17 bp, Homo sapiens
attctgagttttgtgtt

SEQ ID NO: 1422959 - DNA, 22 bp, Homo sapiens
attctgagttttgtgtttgttg

SEQ ID NO: 1422960 - DNA, 18 bp, Homo sapiens
attctgatgtttctgtga

SEQ ID NO: 1422961 - DNA, 17 bp, Homo sapiens
atctcagggtccagacc

SEQ ID NO: 1422962 - DNA, 18 bp, Homo sapiens
atctcagggtccagaccc

SEQ ID NO: 1422963 - DNA, 15 bp, Homo sapiens
atctcaggtgccact

SEQ ID NO: 1422964 - DNA, 17 bp, Homo sapiens
atctcaggtgccactcc

SEQ ID NO: 1422965 - DNA, 16 bp, Homo sapiens
atctcagttgtttgct

SEQ ID NO: 1422966 - DNA, 20 bp, Homo sapiens
atctcagttgtttgcttctt

SEQ ID NO: 1422967 - DNA, 18 bp, Homo sapiens
atctcatccctcaactga

SEQ ID NO: 1422968 - DNA, 21 bp, Homo sapiens
atctcatggaaactggccagg

SEQ ID NO: 1422969 - DNA, 17 bp, Homo sapiens
atctccacttttttcat

SEQ ID NO: 1422970 - DNA, 22 bp, Homo sapiens
atctccattgtgcctaagtcca

SEQ ID NO: 1422971 - DNA, 14 bp, Homo sapiens
atctccatttcaaa

SEQ ID NO: 1422972 - DNA, 14 bp, Homo sapiens
atctccccaggcct

SEQ ID NO: 1422973 - DNA, 20 bp, Homo sapiens
atctcccccatcccccactg

SEQ ID NO: 1422974 - DNA, 15 bp, Homo sapiens
atctccctgccgcct

SEQ ID NO: 1422975 - DNA, 17 bp, Homo sapiens
atctccctgcctggccc

SEQ ID NO: 1422976 - DNA, 20 bp, Homo sapiens
atctccctgcctggccccca

SEQ ID NO: 1422977 - DNA, 18 bp, Homo sapiens
atctccctggctcactgg

SEQ ID NO: 1422978 - DNA, 22 bp, Homo sapiens
atctcccttcagcaacttattt

SEQ ID NO: 1422979 - DNA, 22 bp, Homo sapiens
atctccgcctccacactgacca

SEQ ID NO: 1422980 - DNA, 21 bp, Homo sapiens
atctccgttccatctgggctt

SEQ ID NO: 1422981 - DNA, 14 bp, Homo sapiens
atctcctaacaaaa

SEQ ID NO: 1422982 - DNA, 11 bp, Homo sapiens
atctcctcccg

SEQ ID NO: 1422983 - DNA, 14 bp, Homo sapiens
atctcctcttttgt

SEQ ID NO: 1422984 - DNA, 15 bp, Homo sapiens
atctcctgacagaag

SEQ ID NO: 1422985 - DNA, 19 bp, Homo sapiens
atctcctggtgttctgcag

SEQ ID NO: 1422986 - DNA, 13 bp, Homo sapiens
atctcctgtattc

SEQ ID NO: 1422987 - DNA, 18 bp, Homo sapiens
atctcctgtgcatgggtg

SEQ ID NO: 1422988 - DNA, 19 bp, Homo sapiens
atctcctgtgcatgggtga

SEQ ID NO: 1422989 - DNA, 18 bp, Homo sapiens
atctccttcccccagccc

SEQ ID NO: 1422990 - DNA, 19 bp, Homo sapiens
atctccttcccccagccca

SEQ ID NO: 1422991 - DNA, 21 bp, Homo sapiens
atctccttcccccagcccaat

SEQ ID NO: 1422992 - DNA, 16 bp, Homo sapiens
atctccttcccttctc

SEQ ID NO: 1422993 - DNA, 16 bp, Homo sapiens
atctcgagccccctgg

SEQ ID NO: 1422994 - DNA, 21 bp, Homo sapiens
atctcgccacccctccttcct

SEQ ID NO: 1422995 - DNA, 18 bp, Homo sapiens
atctcggatgaccaaacc

SEQ ID NO: 1422996 - DNA, 20 bp, Homo sapiens
atctcgtaatagcttctgtg

SEQ ID NO: 1422997 - DNA, 23 bp, Homo sapiens
atctcgtaatagcttctgtgtgt

SEQ ID NO: 1422998 - DNA, 19 bp, Homo sapiens
atctctaaaattctagtct

SEQ ID NO: 1422999 - DNA, 15 bp, Homo sapiens
atctctagaatttta

SEQ ID NO: 1423000 - DNA, 20 bp, Homo sapiens
atctctatcagaaatacaaa

SEQ ID NO: 1423001 - DNA, 17 bp, Homo sapiens
atctctatttgagaagt

SEQ ID NO: 1423002 - DNA, 18 bp, Homo sapiens
atctctatttgagaagtt

SEQ ID NO: 1423003 - DNA, 19 bp, Homo sapiens
atctctcaaaacaatatta

SEQ ID NO: 1423004 - DNA, 22 bp, Homo sapiens
atctctcaggagcacaggcagc

SEQ ID NO: 1423005 - DNA, 23 bp, Homo sapiens
atctctcaggagcacaggcagct

SEQ ID NO: 1423006 - DNA, 23 bp, Homo sapiens
atctctcatattcgctagtgttt

SEQ ID NO: 1423007 - DNA, 20 bp, Homo sapiens
atctctcggttccacgtccc

SEQ ID NO: 1423008 - DNA, 21 bp, Homo sapiens
atctctctactcctacctcag

SEQ ID NO: 1423009 - DNA, 17 bp, Homo sapiens
atctctctactgctgga

SEQ ID NO: 1423010 - DNA, 19 bp, Homo sapiens
atctctctgcagctgccgg

SEQ ID NO: 1423011 - DNA, 18 bp, Homo sapiens
atctctgaagatctaaac

SEQ ID NO: 1423012 - DNA, 22 bp, Homo sapiens
atctctgaaggagttacaggga

SEQ ID NO: 1423013 - DNA, 18 bp, Homo sapiens
atctctgattaaatttaa

SEQ ID NO: 1423014 - DNA, 19 bp, Homo sapiens
atctctgattaaatttaat

SEQ ID NO: 1423015 - DNA, 20 bp, Homo sapiens
atctctgcaccctggggcct

SEQ ID NO: 1423016 - DNA, 20 bp, Homo sapiens
atctctgcagtttttcccaa

SEQ ID NO: 1423017 - DNA, 21 bp, Homo sapiens
atctctgccaacatgaggaca

SEQ ID NO: 1423018 - DNA, 12 bp, Homo sapiens
atctctgcctgt

SEQ ID NO: 1423019 - DNA, 17 bp, Homo sapiens
atctctgtgtgcacaaa

SEQ ID NO: 1423020 - DNA, 12 bp, Homo sapiens
atctctgttact

SEQ ID NO: 1423021 - DNA, 15 bp, Homo sapiens
atctctgttcttttc

SEQ ID NO: 1423022 - DNA, 22 bp, Homo sapiens
atctctgttcttttcccgcctc

SEQ ID NO: 1423023 - DNA, 13 bp, Homo sapiens
atctcttagctcc

SEQ ID NO: 1423024 - DNA, 16 bp, Homo sapiens
atctcttagctcccct

SEQ ID NO: 1423025 - DNA, 18 bp, Homo sapiens
atctcttagctcccctcc

SEQ ID NO: 1423026 - DNA, 19 bp, Homo sapiens
atctcttagctcccctcca

SEQ ID NO: 1423027 - DNA, 16 bp, Homo sapiens
atctcttattttacaa

SEQ ID NO: 1423028 - DNA, 13 bp, Homo sapiens
atctcttcagtct

SEQ ID NO: 1423029 - DNA, 21 bp, Homo sapiens
atctcttcagtctctatacca

SEQ ID NO: 1423030 - DNA, 20 bp, Homo sapiens
atctcttcattattctctgc

SEQ ID NO: 1423031 - DNA, 22 bp, Homo sapiens
atctcttcctacccaaccactc

SEQ ID NO: 1423032 - DNA, 15 bp, Homo sapiens
atctgtagggctgga

SEQ ID NO: 1423033 - DNA, 18 bp, Homo sapiens
atctgtagggctggacct

SEQ ID NO: 1423034 - DNA, 23 bp, Homo sapiens
atctgtagtaatttattgtctgt

SEQ ID NO: 1423035 - DNA, 19 bp, Homo sapiens
atctgtagttccagctata

SEQ ID NO: 1423036 - DNA, 14 bp, Homo sapiens
atctgtatatacaa

SEQ ID NO: 1423037 - DNA, 21 bp, Homo sapiens
atctgtatatacaataacata

SEQ ID NO: 1423038 - DNA, 18 bp, Homo sapiens
atctgtatttaattttga

SEQ ID NO: 1423039 - DNA, 21 bp, Homo sapiens
atctgtcagcatctggctgtc

SEQ ID NO: 1423040 - DNA, 12 bp, Homo sapiens
atctgtcagttc

SEQ ID NO: 1423041 - DNA, 17 bp, Homo sapiens
atctgtcataagcatta

SEQ ID NO: 1423042 - DNA, 18 bp, Homo sapiens
atctgtccaaaggaggct

SEQ ID NO: 1423043 - DNA, 22 bp, Homo sapiens
atctgtccacatccccagagcc

SEQ ID NO: 1423044 - DNA, 16 bp, Homo sapiens
atctgtctgattctat

SEQ ID NO: 1423045 - DNA, 22 bp, Homo sapiens
atctgtctgccaacctaaaact

SEQ ID NO: 1423046 - DNA, 16 bp, Homo sapiens
atctgtctggtggccc

SEQ ID NO: 1423047 - DNA, 17 bp, Homo sapiens
atctgtcttgccagcca

SEQ ID NO: 1423048 - DNA, 22 bp, Homo sapiens
atctgtcttgccagccagaagc

SEQ ID NO: 1423049 - DNA, 23 bp, Homo sapiens
atctgtcttgccagccagaagcc

SEQ ID NO: 1423050 - DNA, 13 bp, Homo sapiens
atctgtgaattaa

SEQ ID NO: 1423051 - DNA, 13 bp, Homo sapiens
atctgtgactata

SEQ ID NO: 1423052 - DNA, 18 bp, Homo sapiens
atctgtgactataaagct

SEQ ID NO: 1423053 - DNA, 20 bp, Homo sapiens
atctgtgactataaagctgt

SEQ ID NO: 1423054 - DNA, 21 bp, Homo sapiens
atctgtgaggggctctctcat

SEQ ID NO: 1423055 - DNA, 18 bp, Homo sapiens
atctgtgaggtgctgatg

SEQ ID NO: 1423056 - DNA, 15 bp, Homo sapiens
atctgtgattggctg

SEQ ID NO: 1423057 - DNA, 13 bp, Homo sapiens
atctgtgccccat

SEQ ID NO: 1423058 - DNA, 23 bp, Homo sapiens
atctgtgccccatgcctgtccag

SEQ ID NO: 1423059 - DNA, 13 bp, Homo sapiens
atctgtggaaagc

SEQ ID NO: 1423060 - DNA, 16 bp, Homo sapiens
atctgtggaaagctag

SEQ ID NO: 1423061 - DNA, 14 bp, Homo sapiens
atctgtggagctgc

SEQ ID NO: 1423062 - DNA, 21 bp, Homo sapiens
atctgtggagctgccacagag

SEQ ID NO: 1423063 - DNA, 16 bp, Homo sapiens
atctgtggagttcctg

SEQ ID NO: 1423064 - DNA, 20 bp, Homo sapiens
atctgtggagttcctgctcc

SEQ ID NO: 1423065 - DNA, 19 bp, Homo sapiens
atctgtgggcatggtcaaa

SEQ ID NO: 1423066 - DNA, 16 bp, Homo sapiens
atctgttagggccttg

SEQ ID NO: 1423067 - DNA, 23 bp, Homo sapiens
atctgttataggtcctttagaaa

SEQ ID NO: 1423068 - DNA, 14 bp, Homo sapiens
atctgttattcaaa

SEQ ID NO: 1423069 - DNA, 18 bp, Homo sapiens
atctgttattcaaatttg

SEQ ID NO: 1423070 - DNA, 23 bp, Homo sapiens
atctgttattcaaatttgatgat

SEQ ID NO: 1423071 - DNA, 17 bp, Homo sapiens
atctgttggagaaagaa

SEQ ID NO: 1423072 - DNA, 17 bp, Homo sapiens
atctgtttctctgctgt

SEQ ID NO: 1423073 - DNA, 22 bp, Homo sapiens
atctgttttaaatttatttcaa

SEQ ID NO: 1423074 - DNA, 13 bp, Homo sapiens
atctgttttcaac

SEQ ID NO: 1423075 - DNA, 14 bp, Homo sapiens
atctgttttctgga

SEQ ID NO: 1423076 - DNA, 21 bp, Homo sapiens
atctgttttgtggtttggaat

SEQ ID NO: 1423077 - DNA, 15 bp, Homo sapiens
atcttaaaagtgtaa

SEQ ID NO: 1423078 - DNA, 15 bp, Homo sapiens
atcttaaacaatgta

SEQ ID NO: 1423079 - DNA, 17 bp, Homo sapiens
atcttaaacaatgtata

SEQ ID NO: 1423080 - DNA, 20 bp, Homo sapiens
atcttaaacaatgtataaag

SEQ ID NO: 1423081 - DNA, 21 bp, Homo sapiens
atcaactctgaagctaattgt

SEQ ID NO: 1423082 - DNA, 13 bp, Homo sapiens
atcaactgaatga

SEQ ID NO: 1423083 - DNA, 14 bp, Homo sapiens
atcaactgaatgag

SEQ ID NO: 1423084 - DNA, 12 bp, Homo sapiens
atcaacttaaca

SEQ ID NO: 1423085 - DNA, 21 bp, Homo sapiens
atcaactttaatcaagttgta

SEQ ID NO: 1423086 - DNA, 14 bp, Homo sapiens
atcaactttactgt

SEQ ID NO: 1423087 - DNA, 22 bp, Homo sapiens
atcaagaagggctgcatgatgt

SEQ ID NO: 1423088 - DNA, 13 bp, Homo sapiens
atcaagagaaact

SEQ ID NO: 1423089 - DNA, 15 bp, Homo sapiens
atcaagagaaacttc

SEQ ID NO: 1423090 - DNA, 17 bp, Homo sapiens
atcaagagcattgcttt

SEQ ID NO: 1423091 - DNA, 19 bp, Homo sapiens
atcaagagtccggatttct

SEQ ID NO: 1423092 - DNA, 20 bp, Homo sapiens
atcaagagtccggatttcta

SEQ ID NO: 1423093 - DNA, 21 bp, Homo sapiens
atcaagagtccggatttctaa

SEQ ID NO: 1423094 - DNA, 14 bp, Homo sapiens
atcaagattttagg

SEQ ID NO: 1423095 - DNA, 13 bp, Homo sapiens
atcaagatttttt

SEQ ID NO: 1423096 - DNA, 16 bp, Homo sapiens
atatttattgttagaa

SEQ ID NO: 1423097 - DNA, 19 bp, Homo sapiens
atatttattgttagaaaat

SEQ ID NO: 1423098 - DNA, 20 bp, Homo sapiens
atatttattttcagtatact

SEQ ID NO: 1423099 - DNA, 19 bp, Homo sapiens
atatttattttttttaagt

SEQ ID NO: 1423100 - DNA, 16 bp, Homo sapiens
atatttcaatctttta

SEQ ID NO: 1423101 - DNA, 18 bp, Homo sapiens
atatttcagacattttca

SEQ ID NO: 1423102 - DNA, 17 bp, Homo sapiens
atatttcagatatcaaa

SEQ ID NO: 1423103 - DNA, 13 bp, Homo sapiens
atatttccaagaa

SEQ ID NO: 1423104 - DNA, 14 bp, Homo sapiens
atatttccatttct

SEQ ID NO: 1423105 - DNA, 16 bp, Homo sapiens
atatttccatttcttc

SEQ ID NO: 1423106 - DNA, 16 bp, Homo sapiens
ataatggggcagacac

SEQ ID NO: 1423107 - DNA, 15 bp, Homo sapiens
ataatggtaatagaa

SEQ ID NO: 1423108 - DNA, 17 bp, Homo sapiens
ataatggtaatagaata

SEQ ID NO: 1423109 - DNA, 18 bp, Homo sapiens
ataatggtcccatccagg

SEQ ID NO: 1423110 - DNA, 15 bp, Homo sapiens
ataatgtaagctcta

SEQ ID NO: 1423111 - DNA, 16 bp, Homo sapiens
ataatgtactcacata

SEQ ID NO: 1423112 - DNA, 15 bp, Homo sapiens
ataatgtattcatat

SEQ ID NO: 1423113 - DNA, 19 bp, Homo sapiens
ataatgtattcatatttgt

SEQ ID NO: 1423114 - DNA, 20 bp, Homo sapiens
ataatgtattttctttttat

SEQ ID NO: 1423115 - DNA, 11 bp, Homo sapiens
ataatgtctct

SEQ ID NO: 1423116 - DNA, 11 bp, Homo sapiens
ataatgtgaac

SEQ ID NO: 1423117 - DNA, 12 bp, Homo sapiens
ataatgtgttaa

SEQ ID NO: 1423118 - DNA, 19 bp, Homo sapiens
ataatgttatcggctctat

SEQ ID NO: 1423119 - DNA, 15 bp, Homo sapiens
ataatgttattcatt

SEQ ID NO: 1423120 - DNA, 14 bp, Homo sapiens
ataatgttgttatt

SEQ ID NO: 1423121 - DNA, 19 bp, Homo sapiens
ataatgtttattaaatgct

SEQ ID NO: 1423122 - DNA, 17 bp, Homo sapiens
ataattaaaaaaaaaac

SEQ ID NO: 1423123 - DNA, 19 bp, Homo sapiens
atattactgtctttattct

SEQ ID NO: 1423124 - DNA, 20 bp, Homo sapiens
atattactgtctttattctt

SEQ ID NO: 1423125 - DNA, 21 bp, Homo sapiens
atattactgtctttattctta

SEQ ID NO: 1423126 - DNA, 21 bp, Homo sapiens
atattactgttgcatttactt

SEQ ID NO: 1423127 - DNA, 13 bp, Homo sapiens
atattagatcaaa

SEQ ID NO: 1423128 - DNA, 21 bp, Homo sapiens
atgattgcagaattgtttaga

SEQ ID NO: 1423129 - DNA, 14 bp, Homo sapiens
atgattgctccaga

SEQ ID NO: 1423130 - DNA, 14 bp, Homo sapiens
atgattggattatt

SEQ ID NO: 1423131 - DNA, 17 bp, Homo sapiens
atgatttagcaagttct

SEQ ID NO: 1423132 - DNA, 20 bp, Homo sapiens
atgatttcatgctatctctg

SEQ ID NO: 1423133 - DNA, 14 bp, Homo sapiens
atgatttcatttca

SEQ ID NO: 1423134 - DNA, 17 bp, Homo sapiens
atgatttgttttgaatt

SEQ ID NO: 1423135 - DNA, 13 bp, Homo sapiens
atgattttccttt

SEQ ID NO: 1423136 - DNA, 14 bp, Homo sapiens
atgatttttcattg

SEQ ID NO: 1423137 - DNA, 15 bp, Homo sapiens
atgatttttgtcatc

SEQ ID NO: 1423138 - DNA, 21 bp, Homo sapiens
atgattttttaaggagctggg

SEQ ID NO: 1423139 - DNA, 17 bp, Homo sapiens
atgatttttttttccaa

SEQ ID NO: 1423140 - DNA, 13 bp, Homo sapiens
atgcaaaaaatct

SEQ ID NO: 1423141 - DNA, 17 bp, Homo sapiens
atgcaaaagcagctaaa

SEQ ID NO: 1423142 - DNA, 23 bp, Homo sapiens
atgcaaaaggttcactaaagcag

SEQ ID NO: 1423143 - DNA, 22 bp, Homo sapiens
atgcaaaattgttttcacttgt

SEQ ID NO: 1423144 - DNA, 22 bp, Homo sapiens
atgcaaacaggttgttttctac

SEQ ID NO: 1423145 - DNA, 14 bp, Homo sapiens
atgcaaagcactga

SEQ ID NO: 1423146 - DNA, 10 bp, Homo sapiens
atgcaaatac

SEQ ID NO: 1423147 - DNA, 19 bp, Homo sapiens
atgcaaatagtagacattt

SEQ ID NO: 1423148 - DNA, 21 bp, Homo sapiens
atgcaaatctgccaagagaga

SEQ ID NO: 1423149 - DNA, 20 bp, Homo sapiens
atgcaaatgagctctgaaat

SEQ ID NO: 1423150 - DNA, 23 bp, Homo sapiens
atgcaaatgagctctgaaatctt

SEQ ID NO: 1423151 - DNA, 17 bp, Homo sapiens
atgcaaatgtctaattg

SEQ ID NO: 1423152 - DNA, 14 bp, Homo sapiens
atgcaacagaagtg

SEQ ID NO: 1423153 - DNA, 16 bp, Homo sapiens
atgcaaccaagtcaca

SEQ ID NO: 1423154 - DNA, 21 bp, Homo sapiens
atgcaaccaagtcacacgctt

SEQ ID NO: 1423155 - DNA, 18 bp, Homo sapiens
atgcaagagtgattgcag

SEQ ID NO: 1423156 - DNA, 17 bp, Homo sapiens
atgcaagcagaggacca

SEQ ID NO: 1423157 - DNA, 23 bp, Homo sapiens
atgcaagcagaggaccagggcct

SEQ ID NO: 1423158 - DNA, 14 bp, Homo sapiens
atgcaaggaaggaa

SEQ ID NO: 1423159 - DNA, 20 bp, Homo sapiens
atgcaaggaaggaaagaaag

SEQ ID NO: 1423160 - DNA, 16 bp, Homo sapiens
atgcaagtattctcat

SEQ ID NO: 1423161 - DNA, 16 bp, Homo sapiens
atgcaagttttttttc

SEQ ID NO: 1423162 - DNA, 18 bp, Homo sapiens
atgcaataactctgggag

SEQ ID NO: 1423163 - DNA, 16 bp, Homo sapiens
atgcaatcagacaagt

SEQ ID NO: 1423164 - DNA, 18 bp, Homo sapiens
atgcaatgcttcattatt

SEQ ID NO: 1423165 - DNA, 18 bp, Homo sapiens
atgcaatgtgctactgat

SEQ ID NO: 1423166 - DNA, 17 bp, Homo sapiens
atgcaatttcctttttt

SEQ ID NO: 1423167 - DNA, 19 bp, Homo sapiens
atgcaatttgaagtaactt

SEQ ID NO: 1423168 - DNA, 12 bp, Homo sapiens
atgcaatttgat

SEQ ID NO: 1423169 - DNA, 16 bp, Homo sapiens
atgcacaagaatggat

SEQ ID NO: 1423170 - DNA, 14 bp, Homo sapiens
atgcacaattccat

SEQ ID NO: 1423171 - DNA, 21 bp, Homo sapiens
atgcacacacacacgctttct

SEQ ID NO: 1423172 - DNA, 15 bp, Homo sapiens
atgcacacggctggt

SEQ ID NO: 1423173 - DNA, 22 bp, Homo sapiens
atgcacacggctggtcactctg

SEQ ID NO: 1423174 - DNA, 21 bp, Homo sapiens
atgcacacgggaaagccttaa

SEQ ID NO: 1423175 - DNA, 14 bp, Homo sapiens
atgcacagctgctt

SEQ ID NO: 1423176 - DNA, 20 bp, Homo sapiens
atgcacagctgcttgtcctg

SEQ ID NO: 1423177 - DNA, 22 bp, Homo sapiens
atgcacagctgcttgtcctgct

SEQ ID NO: 1423178 - DNA, 17 bp, Homo sapiens
atgcacagtaaaaatgg

SEQ ID NO: 1423179 - DNA, 13 bp, Homo sapiens
atgcacagtacaa

SEQ ID NO: 1423180 - DNA, 18 bp, Homo sapiens
atgcacagtacaataatg

SEQ ID NO: 1423181 - DNA, 22 bp, Homo sapiens
atgcacagtacaataatgtact

SEQ ID NO: 1423182 - DNA, 15 bp, Homo sapiens
atgcacagtatttgt

SEQ ID NO: 1423183 - DNA, 21 bp, Homo sapiens
atgcacagtatttgtaattaa

SEQ ID NO: 1423184 - DNA, 21 bp, Homo sapiens
atgcacatatggactctgcac

SEQ ID NO: 1423185 - DNA, 13 bp, Homo sapiens
atgcacatttata

SEQ ID NO: 1423186 - DNA, 16 bp, Homo sapiens
atgcacatttatatat

SEQ ID NO: 1423187 - DNA, 12 bp, Homo sapiens
atgcacatttct

SEQ ID NO: 1423188 - DNA, 13 bp, Homo sapiens
atgcacatttctg

SEQ ID NO: 1423189 - DNA, 15 bp, Homo sapiens
atgcacatttctgga

SEQ ID NO: 1423190 - DNA, 23 bp, Homo sapiens
atgcacctcccttccctccctga

SEQ ID NO: 1423191 - DNA, 20 bp, Homo sapiens
atgcacctcttgttactccc

SEQ ID NO: 1423192 - DNA, 19 bp, Homo sapiens
atgcacggtgaggccgggc

SEQ ID NO: 1423193 - DNA, 14 bp, Homo sapiens
atgcactatgtata

SEQ ID NO: 1423194 - DNA, 13 bp, Homo sapiens
atgcactcacccc

SEQ ID NO: 1423195 - DNA, 21 bp, Homo sapiens
atgcactcacccctagccctg

SEQ ID NO: 1423196 - DNA, 23 bp, Homo sapiens
atgcactgaaaacttagccagag

SEQ ID NO: 1423197 - DNA, 23 bp, Homo sapiens
atgcactgacccttccagacata

SEQ ID NO: 1423198 - DNA, 16 bp, Homo sapiens
atgcactgatgttgtg

SEQ ID NO: 1423199 - DNA, 17 bp, Homo sapiens
atgcactgctgtaactg

SEQ ID NO: 1423200 - DNA, 20 bp, Homo sapiens
atgcactgtgaaggaccctt

SEQ ID NO: 1423201 - DNA, 22 bp, Homo sapiens
atgcactgtggtttcagatgtg

SEQ ID NO: 1423202 - DNA, 15 bp, Homo sapiens
atgcacttttagaaa

SEQ ID NO: 1423203 - DNA, 22 bp, Homo sapiens
atgcacttttagaaatgcatat

SEQ ID NO: 1423204 - DNA, 22 bp, Homo sapiens
atgcagaaaacagggtctggga

SEQ ID NO: 1423205 - DNA, 15 bp, Homo sapiens
atgcagaaagcatcc

SEQ ID NO: 1423206 - DNA, 20 bp, Homo sapiens
atgcagaaatagacaaaaag

SEQ ID NO: 1423207 - DNA, 23 bp, Homo sapiens
atgcagaagcatattttgctggt

SEQ ID NO: 1423208 - DNA, 14 bp, Homo sapiens
atgcagaagtattc

SEQ ID NO: 1423209 - DNA, 15 bp, Homo sapiens
atgcagaagtattct

SEQ ID NO: 1423210 - DNA, 15 bp, Homo sapiens
atgcagaatttgatt

SEQ ID NO: 1423211 - DNA, 20 bp, Homo sapiens
atgcagacaaagccctgtcc

SEQ ID NO: 1423212 - DNA, 22 bp, Homo sapiens
atgcagacaaagccctgtcctt

SEQ ID NO: 1423213 - DNA, 21 bp, Homo sapiens
atgcagactcctcagatctga

SEQ ID NO: 1423214 - DNA, 18 bp, Homo sapiens
atgcagaggcctggggga

SEQ ID NO: 1423215 - DNA, 21 bp, Homo sapiens
atgcagaggtctccaaactga

SEQ ID NO: 1423216 - DNA, 15 bp, Homo sapiens
atgcagagtaagtat

SEQ ID NO: 1423217 - DNA, 19 bp, Homo sapiens
atgcagagttgacatgaga

SEQ ID NO: 1423218 - DNA, 17 bp, Homo sapiens
atgcagattcctgggcc

SEQ ID NO: 1423219 - DNA, 20 bp, Homo sapiens
atgcagattcctgggcctgt

SEQ ID NO: 1423220 - DNA, 23 bp, Homo sapiens
atgcagcaggaaggaacaaagac

SEQ ID NO: 1423221 - DNA, 22 bp, Homo sapiens
atgcagcccatgcccacctgcc

SEQ ID NO: 1423222 - DNA, 18 bp, Homo sapiens
atgcagccttggggcatt

SEQ ID NO: 1423223 - DNA, 16 bp, Homo sapiens
atgcagctactggaat

SEQ ID NO: 1423224 - DNA, 21 bp, Homo sapiens
atgcagctactggaatggtgt

SEQ ID NO: 1423225 - DNA, 18 bp, Homo sapiens
atgcaggaagaggcccac

SEQ ID NO: 1423226 - DNA, 20 bp, Homo sapiens
atgcaggccttaactttccc

SEQ ID NO: 1423227 - DNA, 17 bp, Homo sapiens
atgcagggaagagggca

SEQ ID NO: 1423228 - DNA, 20 bp, Homo sapiens
atgcagggaatgcaatcctt

SEQ ID NO: 1423229 - DNA, 19 bp, Homo sapiens
atgcagggattgctgccac

SEQ ID NO: 1423230 - DNA, 20 bp, Homo sapiens
atgcagggattgctgccact

SEQ ID NO: 1423231 - DNA, 18 bp, Homo sapiens
atgcaggggtcagtgcag

SEQ ID NO: 1423232 - DNA, 15 bp, Homo sapiens
atgcagtcctcagga

SEQ ID NO: 1423233 - DNA, 13 bp, Homo sapiens
atgcagtgcttcc

SEQ ID NO: 1423234 - DNA, 19 bp, Homo sapiens
atgcagttacaaattataa

SEQ ID NO: 1423235 - DNA, 22 bp, Homo sapiens
atgcagttagctgaagaattga

SEQ ID NO: 1423236 - DNA, 15 bp, Homo sapiens
atgcagttttaagaa

SEQ ID NO: 1423237 - DNA, 13 bp, Homo sapiens
atgcataaatgca

SEQ ID NO: 1423238 - DNA, 19 bp, Homo sapiens
atgcataaatgcataattt

SEQ ID NO: 1423239 - DNA, 17 bp, Homo sapiens
atgcataggtttagcag

SEQ ID NO: 1423240 - DNA, 20 bp, Homo sapiens
atgcatatatatatgtgtgt

SEQ ID NO: 1423241 - DNA, 17 bp, Homo sapiens
atgcatatcctgagcca

SEQ ID NO: 1423242 - DNA, 17 bp, Homo sapiens
atgcatatcgctgggct

SEQ ID NO: 1423243 - DNA, 17 bp, Homo sapiens
atgcatattcaatgtat

SEQ ID NO: 1423244 - DNA, 22 bp, Homo sapiens
atctttgaatttcttgattttt

SEQ ID NO: 1423245 - DNA, 17 bp, Homo sapiens
atctttgccaacatggt

SEQ ID NO: 1423246 - DNA, 13 bp, Homo sapiens
atctttgccttgg

SEQ ID NO: 1423247 - DNA, 14 bp, Homo sapiens
atctttgccttggg

SEQ ID NO: 1423248 - DNA, 20 bp, Homo sapiens
atctttgccttgggctgctc

SEQ ID NO: 1423249 - DNA, 14 bp, Homo sapiens
atctttgctgcaga

SEQ ID NO: 1423250 - DNA, 16 bp, Homo sapiens
atctttgctgtatact

SEQ ID NO: 1423251 - DNA, 20 bp, Homo sapiens
atctttgtaccaaaatttta

SEQ ID NO: 1423252 - DNA, 19 bp, Homo sapiens
atcttttaaattgcaatat

SEQ ID NO: 1423253 - DNA, 22 bp, Homo sapiens
atcttttaaattgcaatatata

SEQ ID NO: 1423254 - DNA, 14 bp, Homo sapiens
atcttttatttaag

SEQ ID NO: 1423255 - DNA, 16 bp, Homo sapiens
atcttttattttggaa

SEQ ID NO: 1423256 - DNA, 14 bp, Homo sapiens
atcttttccttcag

SEQ ID NO: 1423257 - DNA, 22 bp, Homo sapiens
atcttttctagagacacattgg

SEQ ID NO: 1423258 - DNA, 13 bp, Homo sapiens
atcttttcttatt

SEQ ID NO: 1423259 - DNA, 23 bp, Homo sapiens
atcttttcttgcctctgtcccct

SEQ ID NO: 1423260 - DNA, 17 bp, Homo sapiens
atcttttgaagcataga

SEQ ID NO: 1423261 - DNA, 17 bp, Homo sapiens
atcttttgtaagacatt

SEQ ID NO: 1423262 - DNA, 16 bp, Homo sapiens
atcttttgtattaaga

SEQ ID NO: 1423263 - DNA, 13 bp, Homo sapiens
atctttttctaac

SEQ ID NO: 1423264 - DNA, 16 bp, Homo sapiens
atctttttctttttaa

SEQ ID NO: 1423265 - DNA, 22 bp, Homo sapiens
atctttttgcttctactttcat

SEQ ID NO: 1423266 - DNA, 18 bp, Homo sapiens
atcttttttagcataaaa

SEQ ID NO: 1423267 - DNA, 19 bp, Homo sapiens
atcttttttagcataaaat

SEQ ID NO: 1423268 - DNA, 14 bp, Homo sapiens
atcttttttcacaa

SEQ ID NO: 1423269 - DNA, 19 bp, Homo sapiens
atcttttttttaaaaaaac

SEQ ID NO: 1423270 - DNA, 15 bp, Homo sapiens
atgaaaaatacttta

SEQ ID NO: 1423271 - DNA, 17 bp, Homo sapiens
atgaaaaatatttctga

SEQ ID NO: 1423272 - DNA, 12 bp, Homo sapiens
atgaaaaattat

SEQ ID NO: 1423273 - DNA, 13 bp, Homo sapiens
atgaaaaattctc

SEQ ID NO: 1423274 - DNA, 13 bp, Homo sapiens
atgaaaactgtaa

SEQ ID NO: 1423275 - DNA, 17 bp, Homo sapiens
atgaaaatacaacttaa

SEQ ID NO: 1423276 - DNA, 14 bp, Homo sapiens
atgaaaataccatt

SEQ ID NO: 1423277 - DNA, 24 bp, Homo sapiens
atgaaaataccatttagtaagaat

SEQ ID NO: 1423278 - DNA, 16 bp, Homo sapiens
atgaaacaaataatca

SEQ ID NO: 1423279 - DNA, 17 bp, Homo sapiens
atgaaacacttctcatc

SEQ ID NO: 1423280 - DNA, 23 bp, Homo sapiens
atgaaaccttattttttcccaaa

SEQ ID NO: 1423281 - DNA, 12 bp, Homo sapiens
atgaaagaaaat

SEQ ID NO: 1423282 - DNA, 19 bp, Homo sapiens
atgaaagactgtacaaagt

SEQ ID NO: 1423283 - DNA, 20 bp, Homo sapiens
atgaaagactgtacaaagta

SEQ ID NO: 1423284 - DNA, 19 bp, Homo sapiens
atgaaagcatggctaatag

SEQ ID NO: 1423285 - DNA, 21 bp, Homo sapiens
atgaaagctgattactgtcaa

SEQ ID NO: 1423286 - DNA, 16 bp, Homo sapiens
atgaaagctgttcctt

SEQ ID NO: 1423287 - DNA, 20 bp, Homo sapiens
atgaaagggaaagtcagctt

SEQ ID NO: 1423288 - DNA, 18 bp, Homo sapiens
atgaaagggtttgtaata

SEQ ID NO: 1423289 - DNA, 21 bp, Homo sapiens
atgaaaggtactatatttgct

SEQ ID NO: 1423290 - DNA, 21 bp, Homo sapiens
atgaaaggttaaaaaagcgag

SEQ ID NO: 1423291 - DNA, 19 bp, Homo sapiens
atgaaatacacaagtaaac

SEQ ID NO: 1423292 - DNA, 17 bp, Homo sapiens
atgaaatactatttaaa

SEQ ID NO: 1423293 - DNA, 13 bp, Homo sapiens
atgaaatatcaga

SEQ ID NO: 1423294 - DNA, 20 bp, Homo sapiens
atgaaatctgctagaaagtt

SEQ ID NO: 1423295 - DNA, 21 bp, Homo sapiens
atgaaatctgctagaaagtta

SEQ ID NO: 1423296 - DNA, 18 bp, Homo sapiens
atgaaatggggattatta

SEQ ID NO: 1423297 - DNA, 12 bp, Homo sapiens
atgaaatgtgaa

SEQ ID NO: 1423298 - DNA, 13 bp, Homo sapiens
atgaaatgtgaat

SEQ ID NO: 1423299 - DNA, 19 bp, Homo sapiens
atgaaattatataagtatt

SEQ ID NO: 1423300 - DNA, 18 bp, Homo sapiens
atgaaattggttttccag

SEQ ID NO: 1423301 - DNA, 15 bp, Homo sapiens
atgaaattgtatctc

SEQ ID NO: 1423302 - DNA, 15 bp, Homo sapiens
atgaacaaacctgtg

SEQ ID NO: 1423303 - DNA, 15 bp, Homo sapiens
atgaacaaattcttt

SEQ ID NO: 1423304 - DNA, 17 bp, Homo sapiens
atgagtttaaaaaaata

SEQ ID NO: 1423305 - DNA, 18 bp, Homo sapiens
atgagttttgggaagtta

SEQ ID NO: 1423306 - DNA, 21 bp, Homo sapiens
atgagtttttgatagctttat

SEQ ID NO: 1423307 - DNA, 20 bp, Homo sapiens
atgataaactcagatctgat

SEQ ID NO: 1423308 - DNA, 16 bp, Homo sapiens
atgataataataataa

SEQ ID NO: 1423309 - DNA, 15 bp, Homo sapiens
atgataatagattct

SEQ ID NO: 1423310 - DNA, 13 bp, Homo sapiens
atgatacaatgaa

SEQ ID NO: 1423311 - DNA, 17 bp, Homo sapiens
atgataccacctttact

SEQ ID NO: 1423312 - DNA, 18 bp, Homo sapiens
atgataccacctttactg

SEQ ID NO: 1423313 - DNA, 20 bp, Homo sapiens
atgatactctcagattttaa

SEQ ID NO: 1423314 - DNA, 17 bp, Homo sapiens
atgatagtaagaaaagt

SEQ ID NO: 1423315 - DNA, 21 bp, Homo sapiens
atgatatgtaaacataattct

SEQ ID NO: 1423316 - DNA, 22 bp, Homo sapiens
atgatatgtaaacataattctt

SEQ ID NO: 1423317 - DNA, 13 bp, Homo sapiens
atgatcaataaag

SEQ ID NO: 1423318 - DNA, 20 bp, Homo sapiens
atgatcagctgtttgtcata

SEQ ID NO: 1423319 - DNA, 14 bp, Homo sapiens
atgatcagtactga

SEQ ID NO: 1423320 - DNA, 18 bp, Homo sapiens
atgatccctgtgttgtct

SEQ ID NO: 1423321 - DNA, 16 bp, Homo sapiens
atgatcctagtaattg

SEQ ID NO: 1423322 - DNA, 15 bp, Homo sapiens
atgatcgtagacaca

SEQ ID NO: 1423323 - DNA, 17 bp, Homo sapiens
atgatctaataaacttt

SEQ ID NO: 1423324 - DNA, 18 bp, Homo sapiens
atgatctaataaacttta

SEQ ID NO: 1423325 - DNA, 14 bp, Homo sapiens
atgatctactcaga

SEQ ID NO: 1423326 - DNA, 15 bp, Homo sapiens
atgatctactcagaa

SEQ ID NO: 1423327 - DNA, 17 bp, Homo sapiens
atgatctattgctcatc

SEQ ID NO: 1423328 - DNA, 14 bp, Homo sapiens
atgatctccctgcc

SEQ ID NO: 1423329 - DNA, 23 bp, Homo sapiens
atgatctcggatgaccaaaccag

SEQ ID NO: 1423330 - DNA, 22 bp, Homo sapiens
atgatctcttcttttggcttcc

SEQ ID NO: 1423331 - DNA, 14 bp, Homo sapiens
atgatcttctttat

SEQ ID NO: 1423332 - DNA, 16 bp, Homo sapiens
atgatctttaaaatac

SEQ ID NO: 1423333 - DNA, 18 bp, Homo sapiens
atgatgaaaaggttgcct

SEQ ID NO: 1423334 - DNA, 19 bp, Homo sapiens
atgatgaaattcttatgtt

SEQ ID NO: 1423335 - DNA, 18 bp, Homo sapiens
atgatgacccactaaaga

SEQ ID NO: 1423336 - DNA, 16 bp, Homo sapiens
atgatgaccccggcct

SEQ ID NO: 1423337 - DNA, 22 bp, Homo sapiens
atgatgacgacgacaacgatga

SEQ ID NO: 1423338 - DNA, 19 bp, Homo sapiens
atgatgactcaagattttt

SEQ ID NO: 1423339 - DNA, 16 bp, Homo sapiens
atgatgagaggccagc

SEQ ID NO: 1423340 - DNA, 20 bp, Homo sapiens
atgatgatcaattatagttt

SEQ ID NO: 1423341 - DNA, 21 bp, Homo sapiens
atgatgatctttaaaatacac

SEQ ID NO: 1423342 - DNA, 13 bp, Homo sapiens
atgatgatgatga

SEQ ID NO: 1423343 - DNA, 18 bp, Homo sapiens
atgatgccaacctctgga

SEQ ID NO: 1423344 - DNA, 15 bp, Homo sapiens
atgatgctaagctga

SEQ ID NO: 1423345 - DNA, 17 bp, Homo sapiens
atgatggagcgcacctg

SEQ ID NO: 1423346 - DNA, 19 bp, Homo sapiens
atgatggcaggtcctctgt

SEQ ID NO: 1423347 - DNA, 21 bp, Homo sapiens
atgatgggaaaatatttcctg

SEQ ID NO: 1423348 - DNA, 22 bp, Homo sapiens
atgatgggaatagggagacagg

SEQ ID NO: 1423349 - DNA, 16 bp, Homo sapiens
atgatggggaaggagt

SEQ ID NO: 1423350 - DNA, 14 bp, Homo sapiens
atgatgggggaaaa

SEQ ID NO: 1423351 - DNA, 13 bp, Homo sapiens
atgatgtatattt

SEQ ID NO: 1423352 - DNA, 15 bp, Homo sapiens
atgatgtccagaaga

SEQ ID NO: 1423353 - DNA, 18 bp, Homo sapiens
atgatgtccagaagaata

SEQ ID NO: 1423354 - DNA, 19 bp, Homo sapiens
atgatgtctcttgtagaag

SEQ ID NO: 1423355 - DNA, 13 bp, Homo sapiens
atgatgtgtgagt

SEQ ID NO: 1423356 - DNA, 20 bp, Homo sapiens
atgatgttaaatgtaatata

SEQ ID NO: 1423357 - DNA, 21 bp, Homo sapiens
atgatgttagaagaagaggaa

SEQ ID NO: 1423358 - DNA, 19 bp, Homo sapiens
atgatgtttcttttgcaat

SEQ ID NO: 1423359 - DNA, 16 bp, Homo sapiens
atgattaattcacctt

SEQ ID NO: 1423360 - DNA, 19 bp, Homo sapiens
atgattactggcctttttc

SEQ ID NO: 1423361 - DNA, 22 bp, Homo sapiens
atgattactggcctttttcatt

SEQ ID NO: 1423362 - DNA, 14 bp, Homo sapiens
atgattagcaagtt

SEQ ID NO: 1423363 - DNA, 13 bp, Homo sapiens
atgattatttgta

SEQ ID NO: 1423364 - DNA, 17 bp, Homo sapiens
atgattcagaaattgga

SEQ ID NO: 1423365 - DNA, 18 bp, Homo sapiens
atgattcctggacatcac

SEQ ID NO: 1423366 - DNA, 13 bp, Homo sapiens
atgattctctgtg

SEQ ID NO: 1423367 - DNA, 15 bp, Homo sapiens
atgattctgctttta

SEQ ID NO: 1423368 - DNA, 20 bp, Homo sapiens
atgattctttgttacaggca

SEQ ID NO: 1423369 - DNA, 14 bp, Homo sapiens
atggcagaagggaa

SEQ ID NO: 1423370 - DNA, 16 bp, Homo sapiens
atggcagaagggaatt

SEQ ID NO: 1423371 - DNA, 15 bp, Homo sapiens
atggcagagccaggc

SEQ ID NO: 1423372 - DNA, 16 bp, Homo sapiens
atggcaggagaatcag

SEQ ID NO: 1423373 - DNA, 21 bp, Homo sapiens
atggcaggagaatcagcctgg

SEQ ID NO: 1423374 - DNA, 13 bp, Homo sapiens
atggcagtcctgg

SEQ ID NO: 1423375 - DNA, 17 bp, Homo sapiens
atggcataacctgtctc

SEQ ID NO: 1423376 - DNA, 15 bp, Homo sapiens
atggcatcttcaata

SEQ ID NO: 1423377 - DNA, 17 bp, Homo sapiens
atggcatttctctttaa

SEQ ID NO: 1423378 - DNA, 21 bp, Homo sapiens
atggcatttctctttaaacta

SEQ ID NO: 1423379 - DNA, 23 bp, Homo sapiens
atggcatttctctttaaactatg

SEQ ID NO: 1423380 - DNA, 20 bp, Homo sapiens
atggcatttggtctcaggca

SEQ ID NO: 1423381 - DNA, 23 bp, Homo sapiens
atggcatttggtctcaggcagca

SEQ ID NO: 1423382 - DNA, 21 bp, Homo sapiens
atggccaagggggtggacgca

SEQ ID NO: 1423383 - DNA, 18 bp, Homo sapiens
atggccaccccgtgccac

SEQ ID NO: 1423384 - DNA, 22 bp, Homo sapiens
atggccaccccgtgccacccgt

SEQ ID NO: 1423385 - DNA, 16 bp, Homo sapiens
atggccagttttctgg

SEQ ID NO: 1423386 - DNA, 15 bp, Homo sapiens
atggccatgcaggag

SEQ ID NO: 1423387 - DNA, 13 bp, Homo sapiens
atggcccccaata

SEQ ID NO: 1423388 - DNA, 18 bp, Homo sapiens
atggcccccaataaaggc

SEQ ID NO: 1423389 - DNA, 22 bp, Homo sapiens
atggcccccaataaaggcagct

SEQ ID NO: 1423390 - DNA, 15 bp, Homo sapiens
atggcccccaggggc

SEQ ID NO: 1423391 - DNA, 19 bp, Homo sapiens
atggcccccaggggcagga

SEQ ID NO: 1423392 - DNA, 22 bp, Homo sapiens
atggcccccaggggcaggactg

SEQ ID NO: 1423393 - DNA, 23 bp, Homo sapiens
atggcccccaggggcaggactga

SEQ ID NO: 1423394 - DNA, 17 bp, Homo sapiens
atggtacagcttctgga

SEQ ID NO: 1423395 - DNA, 21 bp, Homo sapiens
atggtactgactttgcttgct

SEQ ID NO: 1423396 - DNA, 13 bp, Homo sapiens
atggtaggggagg

SEQ ID NO: 1423397 - DNA, 19 bp, Homo sapiens
atggtagttattctgcctt

SEQ ID NO: 1423398 - DNA, 19 bp, Homo sapiens
atggtataaaaggttgcca

SEQ ID NO: 1423399 - DNA, 21 bp, Homo sapiens
atggtataaaaggttgccaaa

SEQ ID NO: 1423400 - DNA, 14 bp, Homo sapiens
atggtattacaaaa

SEQ ID NO: 1423401 - DNA, 23 bp, Homo sapiens
atggtcacgaggtccagacccac

SEQ ID NO: 1423402 - DNA, 21 bp, Homo sapiens
atggtcatcaccacccttcca

SEQ ID NO: 1423403 - DNA, 20 bp, Homo sapiens
atggtccaattagtttcctt

SEQ ID NO: 1423404 - DNA, 14 bp, Homo sapiens
atggtcccatccag

SEQ ID NO: 1423405 - DNA, 15 bp, Homo sapiens
atggtcccatccagg

SEQ ID NO: 1423406 - DNA, 19 bp, Homo sapiens
atggtcccatccaggcagt

SEQ ID NO: 1423407 - DNA, 20 bp, Homo sapiens
atggtcccatccaggcagtc

SEQ ID NO: 1423408 - DNA, 14 bp, Homo sapiens
atggtcctggggct

SEQ ID NO: 1423409 - DNA, 17 bp, Homo sapiens
atggtcctggggctctg

SEQ ID NO: 1423410 - DNA, 20 bp, Homo sapiens
atggtcctggggctctgtgc

SEQ ID NO: 1423411 - DNA, 16 bp, Homo sapiens
atggtcggatctcaca

SEQ ID NO: 1423412 - DNA, 17 bp, Homo sapiens
atggtcggatctcacag

SEQ ID NO: 1423413 - DNA, 18 bp, Homo sapiens
atggtctcgatctcctga

SEQ ID NO: 1423414 - DNA, 12 bp, Homo sapiens
atggtctttgct

SEQ ID NO: 1423415 - DNA, 22 bp, Homo sapiens
atggtgaagggaagtggggagt

SEQ ID NO: 1423416 - DNA, 15 bp, Homo sapiens
atggtgacattgaaa

SEQ ID NO: 1423417 - DNA, 13 bp, Homo sapiens
atggtgagctggg

SEQ ID NO: 1423418 - DNA, 14 bp, Homo sapiens
atggtgagctggga

SEQ ID NO: 1423419 - DNA, 16 bp, Homo sapiens
atggtgagctgggaag

SEQ ID NO: 1423420 - DNA, 15 bp, Homo sapiens
atggtgccccaggac

SEQ ID NO: 1423421 - DNA, 18 bp, Homo sapiens
atggtgccccaggaccag

SEQ ID NO: 1423422 - DNA, 19 bp, Homo sapiens
atggtgccccaggaccagc

SEQ ID NO: 1423423 - DNA, 19 bp, Homo sapiens
atggtgcctatatctgaga

SEQ ID NO: 1423424 - DNA, 14 bp, Homo sapiens
atggtgcctgagag

SEQ ID NO: 1423425 - DNA, 16 bp, Homo sapiens
atggtgctgcccaggc

SEQ ID NO: 1423426 - DNA, 23 bp, Homo sapiens
atggtgcttgttaatgctttctg

SEQ ID NO: 1423427 - DNA, 15 bp, Homo sapiens
atggtggactaagca

SEQ ID NO: 1423428 - DNA, 18 bp, Homo sapiens
atggtggcacacgcctgt

SEQ ID NO: 1423429 - DNA, 16 bp, Homo sapiens
atggtggcgcgcacct

SEQ ID NO: 1423430 - DNA, 22 bp, Homo sapiens
atggtggcgctttctcctgtgc

SEQ ID NO: 1423431 - DNA, 23 bp, Homo sapiens
atggtggttggttgggttttttg

SEQ ID NO: 1423432 - DNA, 16 bp, Homo sapiens
atggtgtagaacacta

SEQ ID NO: 1423433 - DNA, 18 bp, Homo sapiens
atggtgtgggtgtcctgc

SEQ ID NO: 1423434 - DNA, 20 bp, Homo sapiens
atggtgtgggtgtcctgcct

SEQ ID NO: 1423435 - DNA, 22 bp, Homo sapiens
atggttaaaaaggccaaagata

SEQ ID NO: 1423436 - DNA, 23 bp, Homo sapiens
atggttaatttttcctgcatgtt

SEQ ID NO: 1423437 - DNA, 18 bp, Homo sapiens
atggttacttcttctctt

SEQ ID NO: 1423438 - DNA, 22 bp, Homo sapiens
atggttagtgtggaggggagat

SEQ ID NO: 1423439 - DNA, 16 bp, Homo sapiens
atggttccatgcctga

SEQ ID NO: 1423440 - DNA, 17 bp, Homo sapiens
atggttccatgcctgag

SEQ ID NO: 1423441 - DNA, 18 bp, Homo sapiens
atggttccatgcctgagg

SEQ ID NO: 1423442 - DNA, 22 bp, Homo sapiens
atggttccatgcctgagggtgg

SEQ ID NO: 1423443 - DNA, 19 bp, Homo sapiens
atggttcccaataaaagtg

SEQ ID NO: 1423444 - DNA, 18 bp, Homo sapiens
atggttccttccctggga

SEQ ID NO: 1423445 - DNA, 19 bp, Homo sapiens
atggttccttccctgggaa

SEQ ID NO: 1423446 - DNA, 17 bp, Homo sapiens
atggttctcagatcttg

SEQ ID NO: 1423447 - DNA, 22 bp, Homo sapiens
atggttctcagatcttgacagt

SEQ ID NO: 1423448 - DNA, 18 bp, Homo sapiens
atggttctggctgtttga

SEQ ID NO: 1423449 - DNA, 23 bp, Homo sapiens
atggttgccaggacgaattgaga

SEQ ID NO: 1423450 - DNA, 12 bp, Homo sapiens
atggttgtagca

SEQ ID NO: 1423451 - DNA, 17 bp, Homo sapiens
atggttgtcacctctct

SEQ ID NO: 1423452 - DNA, 19 bp, Homo sapiens
atggttgtcacctctctct

SEQ ID NO: 1423453 - DNA, 22 bp, Homo sapiens
atggttgtcacctctctctgag

SEQ ID NO: 1423454 - DNA, 22 bp, Homo sapiens
atggtttattcccaagtatgcc

SEQ ID NO: 1423455 - DNA, 23 bp, Homo sapiens
atggtttattcccaagtatgcct

SEQ ID NO: 1423456 - DNA, 18 bp, Homo sapiens
atggtttcaagttattca

SEQ ID NO: 1423457 - DNA, 15 bp, Homo sapiens
atggtttcttgcaag

SEQ ID NO: 1423458 - DNA, 22 bp, Homo sapiens
atggtttgttgttctgcctgga

SEQ ID NO: 1423459 - DNA, 14 bp, Homo sapiens
atggttttaaactt

SEQ ID NO: 1423460 - DNA, 11 bp, Homo sapiens
atgtaaaaaag

SEQ ID NO: 1423461 - DNA, 19 bp, Homo sapiens
atgtaaaagaacttactga

SEQ ID NO: 1423462 - DNA, 22 bp, Homo sapiens
atgtaaaagaacttactgatta

SEQ ID NO: 1423463 - DNA, 21 bp, Homo sapiens
atgtaaaatcttgtcatgtgt

SEQ ID NO: 1423464 - DNA, 16 bp, Homo sapiens
atgtaaacagtgcctg

SEQ ID NO: 1423465 - DNA, 20 bp, Homo sapiens
atgtaaacagtgcctgctga

SEQ ID NO: 1423466 - DNA, 16 bp, Homo sapiens
atgtaaagatgattta

SEQ ID NO: 1423467 - DNA, 21 bp, Homo sapiens
atgtaaaggtatattgtgaac

SEQ ID NO: 1423468 - DNA, 23 bp, Homo sapiens
atgtaaagttatgtatttaaagt

SEQ ID NO: 1423469 - DNA, 13 bp, Homo sapiens
atgtaaataaact

SEQ ID NO: 1423470 - DNA, 20 bp, Homo sapiens
atgtaaataaactatttata

SEQ ID NO: 1423471 - DNA, 19 bp, Homo sapiens
atgtaaatacaatttgtac

SEQ ID NO: 1423472 - DNA, 17 bp, Homo sapiens
atgtaaatactttccat

SEQ ID NO: 1423473 - DNA, 12 bp, Homo sapiens
atgtaaatattc

SEQ ID NO: 1423474 - DNA, 15 bp, Homo sapiens
atgtaaatattctat

SEQ ID NO: 1423475 - DNA, 22 bp, Homo sapiens
atgtaaatcacttcattgtttt

SEQ ID NO: 1423476 - DNA, 21 bp, Homo sapiens
atgtaaatgattttatgtttt

SEQ ID NO: 1423477 - DNA, 21 bp, Homo sapiens
atgtaaattaactcaccagat

SEQ ID NO: 1423478 - DNA, 15 bp, Homo sapiens
atgtaaatttgtact

SEQ ID NO: 1423479 - DNA, 17 bp, Homo sapiens
atgtaaatttgtactat

SEQ ID NO: 1423480 - DNA, 21 bp, Homo sapiens
atgtaaatttgtactatttaa

SEQ ID NO: 1423481 - DNA, 18 bp, Homo sapiens
atgtaacagttggtgatt

SEQ ID NO: 1423482 - DNA, 22 bp, Homo sapiens
atgtaacagttggtgattttag

SEQ ID NO: 1423483 - DNA, 11 bp, Homo sapiens
atgtaacatca

SEQ ID NO: 1423484 - DNA, 16 bp, Homo sapiens
atgtaacatcataatt

SEQ ID NO: 1423485 - DNA, 13 bp, Homo sapiens
atgtaacatgttt

SEQ ID NO: 1423486 - DNA, 16 bp, Homo sapiens
ataagaaaatatattc

SEQ ID NO: 1423487 - DNA, 21 bp, Homo sapiens
ataagaaataatgctacaatt

SEQ ID NO: 1423488 - DNA, 22 bp, Homo sapiens
ataagaaataatgctacaattt

SEQ ID NO: 1423489 - DNA, 21 bp, Homo sapiens
ataagaagcaatctttgaaat

SEQ ID NO: 1423490 - DNA, 23 bp, Homo sapiens
ataagaagcaatctttgaaataa

SEQ ID NO: 1423491 - DNA, 13 bp, Homo sapiens
ataagaaggcaat

SEQ ID NO: 1423492 - DNA, 21 bp, Homo sapiens
ataagaatgctggttttccta

SEQ ID NO: 1423493 - DNA, 22 bp, Homo sapiens
ataagaatgctggttttcctaa

SEQ ID NO: 1423494 - DNA, 16 bp, Homo sapiens
ataagacaaacactgc

SEQ ID NO: 1423495 - DNA, 14 bp, Homo sapiens
ataagagaaagaaa

SEQ ID NO: 1423496 - DNA, 17 bp, Homo sapiens
ataagagaatgttccta

SEQ ID NO: 1423497 - DNA, 19 bp, Homo sapiens
ataagagagtcataaacct

SEQ ID NO: 1423498 - DNA, 18 bp, Homo sapiens
ataagagggcatatacag

SEQ ID NO: 1423499 - DNA, 22 bp, Homo sapiens
ataagaggtgtgggtgtctgtt

SEQ ID NO: 1423500 - DNA, 17 bp, Homo sapiens
ataagataaatgtgctg

SEQ ID NO: 1423501 - DNA, 14 bp, Homo sapiens
ataagatggctgtg

SEQ ID NO: 1423502 - DNA, 11 bp, Homo sapiens
ataagattcta

SEQ ID NO: 1423503 - DNA, 17 bp, Homo sapiens
ataagattctaacggtc

SEQ ID NO: 1423504 - DNA, 14 bp, Homo sapiens
ataagcaagagaga

SEQ ID NO: 1423505 - DNA, 13 bp, Homo sapiens
ataagcactgtaa

SEQ ID NO: 1423506 - DNA, 22 bp, Homo sapiens
ataagcaggtggatctatttca

SEQ ID NO: 1423507 - DNA, 14 bp, Homo sapiens
ataagcattacttt

SEQ ID NO: 1423508 - DNA, 21 bp, Homo sapiens
ataagcctccatttagttctt

SEQ ID NO: 1423509 - DNA, 18 bp, Homo sapiens
ataagcggcgtaagttta

SEQ ID NO: 1423510 - DNA, 23 bp, Homo sapiens
ataagctatcacctagcagcctc

SEQ ID NO: 1423511 - DNA, 14 bp, Homo sapiens
ataagctctagttc

SEQ ID NO: 1423512 - DNA, 22 bp, Homo sapiens
ataagcttccattttaatttta

SEQ ID NO: 1423513 - DNA, 15 bp, Homo sapiens
ataaggacagcagct

SEQ ID NO: 1423514 - DNA, 14 bp, Homo sapiens
ataaggccagaaac

SEQ ID NO: 1423515 - DNA, 16 bp, Homo sapiens
ataaggccagaaactc

SEQ ID NO: 1423516 - DNA, 16 bp, Homo sapiens
ataagggaaaaatcaa

SEQ ID NO: 1423517 - DNA, 19 bp, Homo sapiens
ataagggagagctgagcca

SEQ ID NO: 1423518 - DNA, 20 bp, Homo sapiens
ataaggtttcgtttctgtat

SEQ ID NO: 1423519 - DNA, 15 bp, Homo sapiens
ataagtaaatgctag

SEQ ID NO: 1423520 - DNA, 17 bp, Homo sapiens
ataagtaattcaagaaa

SEQ ID NO: 1423521 - DNA, 13 bp, Homo sapiens
ataagtagtaaat

SEQ ID NO: 1423522 - DNA, 21 bp, Homo sapiens
ataagtagtaaatcagaaagt

SEQ ID NO: 1423523 - DNA, 21 bp, Homo sapiens
ataagtatgggatgatagttg

SEQ ID NO: 1423524 - DNA, 19 bp, Homo sapiens
ataagtatttataatagca

SEQ ID NO: 1423525 - DNA, 18 bp, Homo sapiens
ataagtcaacagtaaacc

SEQ ID NO: 1423526 - DNA, 13 bp, Homo sapiens
ataagtcaagcac

SEQ ID NO: 1423527 - DNA, 15 bp, Homo sapiens
ataagtgaagtgata

SEQ ID NO: 1423528 - DNA, 19 bp, Homo sapiens
ataagtgaggaagagttta

SEQ ID NO: 1423529 - DNA, 17 bp, Homo sapiens
ataagttaacttccaat

SEQ ID NO: 1423530 - DNA, 18 bp, Homo sapiens
ataagttcaaattcttct

SEQ ID NO: 1423531 - DNA, 21 bp, Homo sapiens
ataagttcaaattcttctgaa

SEQ ID NO: 1423532 - DNA, 13 bp, Homo sapiens
ataagttcataca

SEQ ID NO: 1423533 - DNA, 14 bp, Homo sapiens
ataagttcatacat

SEQ ID NO: 1423534 - DNA, 16 bp, Homo sapiens
ataagttctattttac

SEQ ID NO: 1423535 - DNA, 14 bp, Homo sapiens
ataagttgctgtgt

SEQ ID NO: 1423536 - DNA, 21 bp, Homo sapiens
ataagtttctgggacctcagt

SEQ ID NO: 1423537 - DNA, 20 bp, Homo sapiens
ataagtttgaaggaaacagt

SEQ ID NO: 1423538 - DNA, 12 bp, Homo sapiens
ataataaaatag

SEQ ID NO: 1423539 - DNA, 12 bp, Homo sapiens
ataataaacttt

SEQ ID NO: 1423540 - DNA, 14 bp, Homo sapiens
ataataaatactca

SEQ ID NO: 1423541 - DNA, 13 bp, Homo sapiens
ataataaatatat

SEQ ID NO: 1423542 - DNA, 23 bp, Homo sapiens
ataataaattgtttggcttcctc

SEQ ID NO: 1423543 - DNA, 18 bp, Homo sapiens
ataataactgtcttctgg

SEQ ID NO: 1423544 - DNA, 23 bp, Homo sapiens
ataataagagaatgttcctactc

SEQ ID NO: 1423545 - DNA, 12 bp, Homo sapiens
ataataatatat

SEQ ID NO: 1423546 - DNA, 19 bp, Homo sapiens
ataataattgaaaagattt

SEQ ID NO: 1423547 - DNA, 17 bp, Homo sapiens
ataatacacaaaatcaa

SEQ ID NO: 1423548 - DNA, 21 bp, Homo sapiens
ataatacagaatcttgttttg

SEQ ID NO: 1423549 - DNA, 13 bp, Homo sapiens
ataatagaagaac

SEQ ID NO: 1423550 - DNA, 13 bp, Homo sapiens
ataatagattctc

SEQ ID NO: 1423551 - DNA, 12 bp, Homo sapiens
ataataggaatg

SEQ ID NO: 1423552 - DNA, 12 bp, Homo sapiens
ataatataaaaa

SEQ ID NO: 1423553 - DNA, 13 bp, Homo sapiens
ataatataaaaaa

SEQ ID NO: 1423554 - DNA, 15 bp, Homo sapiens
ataatatataaacaa

SEQ ID NO: 1423555 - DNA, 14 bp, Homo sapiens
ataatatatattaa

SEQ ID NO: 1423556 - DNA, 23 bp, Homo sapiens
ataatatattctatttttatact

SEQ ID NO: 1423557 - DNA, 13 bp, Homo sapiens
ataatatatttct

SEQ ID NO: 1423558 - DNA, 14 bp, Homo sapiens
ataatatcaaataa

SEQ ID NO: 1423559 - DNA, 19 bp, Homo sapiens
ataatatcaaataaaatat

SEQ ID NO: 1423560 - DNA, 13 bp, Homo sapiens
ataatatctgtga

SEQ ID NO: 1423561 - DNA, 24 bp, Homo sapiens
ataatatctgtgaggtgctgatga

SEQ ID NO: 1423562 - DNA, 21 bp, Homo sapiens
ataatatgctgccaaattttg

SEQ ID NO: 1423563 - DNA, 14 bp, Homo sapiens
ataatatgtgcctt

SEQ ID NO: 1423564 - DNA, 17 bp, Homo sapiens
ataatatgtgccttaag

SEQ ID NO: 1423565 - DNA, 14 bp, Homo sapiens
ataatattagtgat

SEQ ID NO: 1423566 - DNA, 12 bp, Homo sapiens
ataatattgaaa

SEQ ID NO: 1423567 - DNA, 14 bp, Homo sapiens
ataatattgaaaat

SEQ ID NO: 1423568 - DNA, 15 bp, Homo sapiens
ataatattgtctgtc

SEQ ID NO: 1423569 - DNA, 16 bp, Homo sapiens
ataatattgtttggta

SEQ ID NO: 1423570 - DNA, 16 bp, Homo sapiens
ataatatttactgtta

SEQ ID NO: 1423571 - DNA, 20 bp, Homo sapiens
ataatatttttgtatttctc

SEQ ID NO: 1423572 - DNA, 14 bp, Homo sapiens
ataatcaagatttt

SEQ ID NO: 1423573 - DNA, 18 bp, Homo sapiens
ataatcacaacccttcag

SEQ ID NO: 1423574 - DNA, 15 bp, Homo sapiens
ataatcaggaaaaat

SEQ ID NO: 1423575 - DNA, 16 bp, Homo sapiens
ataatcaggaaaaatg

SEQ ID NO: 1423576 - DNA, 17 bp, Homo sapiens
ataatcaggaaaaatga

SEQ ID NO: 1423577 - DNA, 14 bp, Homo sapiens
ataatcagtaaata

SEQ ID NO: 1423578 - DNA, 16 bp, Homo sapiens
ataatcagtgactgaa

SEQ ID NO: 1423579 - DNA, 19 bp, Homo sapiens
ataatcattagttttagag

SEQ ID NO: 1423580 - DNA, 15 bp, Homo sapiens
ataatcccagctact

SEQ ID NO: 1423581 - DNA, 14 bp, Homo sapiens
ataatctagtttac

SEQ ID NO: 1423582 - DNA, 17 bp, Homo sapiens
ataatctatttctatga

SEQ ID NO: 1423583 - DNA, 18 bp, Homo sapiens
ataatctcaaaggagaaa

SEQ ID NO: 1423584 - DNA, 17 bp, Homo sapiens
ataatctggtgacaaat

SEQ ID NO: 1423585 - DNA, 18 bp, Homo sapiens
ataatcttaaattttgac

SEQ ID NO: 1423586 - DNA, 14 bp, Homo sapiens
ataatcttctgcct

SEQ ID NO: 1423587 - DNA, 13 bp, Homo sapiens
ataatctttgggt

SEQ ID NO: 1423588 - DNA, 13 bp, Homo sapiens
ataatgaacccat

SEQ ID NO: 1423589 - DNA, 13 bp, Homo sapiens
ataatgaattata

SEQ ID NO: 1423590 - DNA, 14 bp, Homo sapiens
ataatgagagcaaa

SEQ ID NO: 1423591 - DNA, 19 bp, Homo sapiens
ataatgagagcaaatgcaa

SEQ ID NO: 1423592 - DNA, 20 bp, Homo sapiens
ataatgagagcaaatgcaaa

SEQ ID NO: 1423593 - DNA, 17 bp, Homo sapiens
ataatgaggagtttatg

SEQ ID NO: 1423594 - DNA, 18 bp, Homo sapiens
ataatgaggagtttatga

SEQ ID NO: 1423595 - DNA, 22 bp, Homo sapiens
ataatgaggatgattattttca

SEQ ID NO: 1423596 - DNA, 14 bp, Homo sapiens
ataatgatacttaa

SEQ ID NO: 1423597 - DNA, 17 bp, Homo sapiens
ataatgccggtgagaat

SEQ ID NO: 1423598 - DNA, 14 bp, Homo sapiens
ataatgctacaatt

SEQ ID NO: 1423599 - DNA, 15 bp, Homo sapiens
ataatgctacaattt

SEQ ID NO: 1423600 - DNA, 17 bp, Homo sapiens
ataatgctacaatttta

SEQ ID NO: 1423601 - DNA, 17 bp, Homo sapiens
ataatgctcacttggtc

SEQ ID NO: 1423602 - DNA, 20 bp, Homo sapiens
ataatgctcccatctcctga

SEQ ID NO: 1423603 - DNA, 14 bp, Homo sapiens
ataatgcttcagat

SEQ ID NO: 1423604 - DNA, 21 bp, Homo sapiens
agttccaaagtcacaggaaga

SEQ ID NO: 1423605 - DNA, 16 bp, Homo sapiens
agttccagtttctcct

SEQ ID NO: 1423606 - DNA, 18 bp, Homo sapiens
agttcccaccatctgatt

SEQ ID NO: 1423607 - DNA, 19 bp, Homo sapiens
agttcccagctccccccgc

SEQ ID NO: 1423608 - DNA, 19 bp, Homo sapiens
agttcccattattatttct

SEQ ID NO: 1423609 - DNA, 22 bp, Homo sapiens
agttcccattattatttctgtt

SEQ ID NO: 1423610 - DNA, 23 bp, Homo sapiens
agttcccccatcagttcccccag

SEQ ID NO: 1423611 - DNA, 21 bp, Homo sapiens
agttcccggagcacagccctg

SEQ ID NO: 1423612 - DNA, 14 bp, Homo sapiens
agttccctgaaaac

SEQ ID NO: 1423613 - DNA, 22 bp, Homo sapiens
agttcccttgaaactttgggaa

SEQ ID NO: 1423614 - DNA, 15 bp, Homo sapiens
agttcccttggcctc

SEQ ID NO: 1423615 - DNA, 20 bp, Homo sapiens
agttcctataacactgtgaa

SEQ ID NO: 1423616 - DNA, 18 bp, Homo sapiens
agttcctcctacttacaa

SEQ ID NO: 1423617 - DNA, 12 bp, Homo sapiens
agttcctcgccc

SEQ ID NO: 1423618 - DNA, 21 bp, Homo sapiens
agttcctgcggagtgaagagg

SEQ ID NO: 1423619 - DNA, 11 bp, Homo sapiens
agttcctgctc

SEQ ID NO: 1423620 - DNA, 12 bp, Homo sapiens
agttcctgctcc

SEQ ID NO: 1423621 - DNA, 20 bp, Homo sapiens
agttcctgctccgtggactg

SEQ ID NO: 1423622 - DNA, 21 bp, Homo sapiens
agttccttatccctctcttcc

SEQ ID NO: 1423623 - DNA, 13 bp, Homo sapiens
agttccttgcctt

SEQ ID NO: 1423624 - DNA, 14 bp, Homo sapiens
agttcctttagaaa

SEQ ID NO: 1423625 - DNA, 18 bp, Homo sapiens
agttcgagaccagcctgg

SEQ ID NO: 1423626 - DNA, 21 bp, Homo sapiens
agttcgagaccagcctggcca

SEQ ID NO: 1423627 - DNA, 22 bp, Homo sapiens
agttctaaaaaaaatgcatatt

SEQ ID NO: 1423628 - DNA, 19 bp, Homo sapiens
agttctaacagtgaagttt

SEQ ID NO: 1423629 - DNA, 23 bp, Homo sapiens
agttctaacagtgaagttttact

SEQ ID NO: 1423630 - DNA, 18 bp, Homo sapiens
agttctaagactcaaatg

SEQ ID NO: 1423631 - DNA, 18 bp, Homo sapiens
agttctaagattctaatg

SEQ ID NO: 1423632 - DNA, 15 bp, Homo sapiens
agttctacataagta

SEQ ID NO: 1423633 - DNA, 22 bp, Homo sapiens
agttctacctcaggcagctcaa

SEQ ID NO: 1423634 - DNA, 21 bp, Homo sapiens
agttctagacatggaggttct

SEQ ID NO: 1423635 - DNA, 23 bp, Homo sapiens
agttctagacatggaggttctaa

SEQ ID NO: 1423636 - DNA, 23 bp, Homo sapiens
agttctagatggagaaagtaaca

SEQ ID NO: 1423637 - DNA, 20 bp, Homo sapiens
agttctatccttttgcctgc

SEQ ID NO: 1423638 - DNA, 20 bp, Homo sapiens
agttctatttctatctgcaa

SEQ ID NO: 1423639 - DNA, 18 bp, Homo sapiens
agttctattttactgtct

SEQ ID NO: 1423640 - DNA, 15 bp, Homo sapiens
agttctccagcttca

SEQ ID NO: 1423641 - DNA, 23 bp, Homo sapiens
agttctcccaacaacatgaaact

SEQ ID NO: 1423642 - DNA, 20 bp, Homo sapiens
agttctccttttgaacttgt

SEQ ID NO: 1423643 - DNA, 23 bp, Homo sapiens
agttctccttttgaacttgtcac

SEQ ID NO: 1423644 - DNA, 16 bp, Homo sapiens
agttctctcccttcct

SEQ ID NO: 1423645 - DNA, 22 bp, Homo sapiens
agttctctcccttcctctctcc

SEQ ID NO: 1423646 - DNA, 21 bp, Homo sapiens
agttttacagattgcctcctt

SEQ ID NO: 1423647 - DNA, 20 bp, Homo sapiens
agttttactctgctgcaaaa

SEQ ID NO: 1423648 - DNA, 23 bp, Homo sapiens
agttttactgtctattaatattc

SEQ ID NO: 1423649 - DNA, 21 bp, Homo sapiens
agttttagaataaggaggagg

SEQ ID NO: 1423650 - DNA, 15 bp, Homo sapiens
agttttagttttctc

SEQ ID NO: 1423651 - DNA, 14 bp, Homo sapiens
agttttataaaact

SEQ ID NO: 1423652 - DNA, 17 bp, Homo sapiens
agttttatatgctttat

SEQ ID NO: 1423653 - DNA, 14 bp, Homo sapiens
agttttatcatttt

SEQ ID NO: 1423654 - DNA, 15 bp, Homo sapiens
agttttatcattttc

SEQ ID NO: 1423655 - DNA, 14 bp, Homo sapiens
agttttatttgaat

SEQ ID NO: 1423656 - DNA, 18 bp, Homo sapiens
agttttatttgtattact

SEQ ID NO: 1423657 - DNA, 20 bp, Homo sapiens
agttttcagaacctcttccc

SEQ ID NO: 1423658 - DNA, 22 bp, Homo sapiens
agttttcagaacctcttcccca

SEQ ID NO: 1423659 - DNA, 21 bp, Homo sapiens
agttttcatttagaaaataga

SEQ ID NO: 1423660 - DNA, 18 bp, Homo sapiens
agttttccggtagagttg

SEQ ID NO: 1423661 - DNA, 23 bp, Homo sapiens
agttttccttctcatctgtgatt

SEQ ID NO: 1423662 - DNA, 16 bp, Homo sapiens
agttttccttctgtta

SEQ ID NO: 1423663 - DNA, 17 bp, Homo sapiens
agttttctcctcccagg

SEQ ID NO: 1423664 - DNA, 17 bp, Homo sapiens
agttttctccttttact

SEQ ID NO: 1423665 - DNA, 12 bp, Homo sapiens
agttttctctta

SEQ ID NO: 1423666 - DNA, 12 bp, Homo sapiens
agttttctgaga

SEQ ID NO: 1423667 - DNA, 17 bp, Homo sapiens
agttttgaaagaaaaat

SEQ ID NO: 1423668 - DNA, 14 bp, Homo sapiens
agttttgattttgg

SEQ ID NO: 1423669 - DNA, 19 bp, Homo sapiens
agttttgattttggaaaga

SEQ ID NO: 1423670 - DNA, 17 bp, Homo sapiens
agttttgcatagttcta

SEQ ID NO: 1423671 - DNA, 17 bp, Homo sapiens
agttttggagagggaag

SEQ ID NO: 1423672 - DNA, 16 bp, Homo sapiens
agttttgggaagttaa

SEQ ID NO: 1423673 - DNA, 20 bp, Homo sapiens
agttttggggggcggggctg

SEQ ID NO: 1423674 - DNA, 15 bp, Homo sapiens
agttttgtaaatgta

SEQ ID NO: 1423675 - DNA, 15 bp, Homo sapiens
agttttgtataaata

SEQ ID NO: 1423676 - DNA, 14 bp, Homo sapiens
agttttgtcagaaa

SEQ ID NO: 1423677 - DNA, 12 bp, Homo sapiens
agttttgtcttg

SEQ ID NO: 1423678 - DNA, 19 bp, Homo sapiens
agttttgttccagaggagc

SEQ ID NO: 1423679 - DNA, 16 bp, Homo sapiens
agtttttaaagccttc

SEQ ID NO: 1423680 - DNA, 16 bp, Homo sapiens
agtttttaatttgatg

SEQ ID NO: 1423681 - DNA, 21 bp, Homo sapiens
agtttttacctaccacagtgt

SEQ ID NO: 1423682 - DNA, 23 bp, Homo sapiens
agtttttacctaccacagtgtct

SEQ ID NO: 1423683 - DNA, 16 bp, Homo sapiens
agtttttatgagaaac

SEQ ID NO: 1423684 - DNA, 17 bp, Homo sapiens
agtttttatggggctga

SEQ ID NO: 1423685 - DNA, 9 bp, Homo sapiens
agtttttca

SEQ ID NO: 1423686 - DNA, 20 bp, Homo sapiens
agtttttcaggagcgcaaga

SEQ ID NO: 1423687 - DNA, 20 bp, Homo sapiens
agtttttcattaaataaatt

SEQ ID NO: 1423688 - DNA, 14 bp, Homo sapiens
agtttttcatttgt

SEQ ID NO: 1423689 - DNA, 21 bp, Homo sapiens
agtttttcatttgttttgctt

SEQ ID NO: 1423690 - DNA, 22 bp, Homo sapiens
agtttttcatttgttttgcttt

SEQ ID NO: 1423691 - DNA, 23 bp, Homo sapiens
agtttttcatttgttttgctttt

SEQ ID NO: 1423692 - DNA, 16 bp, Homo sapiens
agtttttgatagcttt

SEQ ID NO: 1423693 - DNA, 21 bp, Homo sapiens
agtttttgatcaagaatgcaa

SEQ ID NO: 1423694 - DNA, 16 bp, Homo sapiens
agtttttggttgggaa

SEQ ID NO: 1423695 - DNA, 12 bp, Homo sapiens
agtttttgtttg

SEQ ID NO: 1423696 - DNA, 16 bp, Homo sapiens
agtttttgtttggaga

SEQ ID NO: 1423697 - DNA, 16 bp, Homo sapiens
agtttttgtttttgca

SEQ ID NO: 1423698 - DNA, 18 bp, Homo sapiens
agttttttacttctctta

SEQ ID NO: 1423699 - DNA, 17 bp, Homo sapiens
agttttttattatgcat

SEQ ID NO: 1423700 - DNA, 22 bp, Homo sapiens
agttttttgaaaatgggctcaa

SEQ ID NO: 1423701 - DNA, 23 bp, Homo sapiens
agttttttggggggataggaaga

SEQ ID NO: 1423702 - DNA, 12 bp, Homo sapiens
agtttttttgct

SEQ ID NO: 1423703 - DNA, 14 bp, Homo sapiens
agttttttttctgg

SEQ ID NO: 1423704 - DNA, 21 bp, Homo sapiens
agttttttttgtttgcctctt

SEQ ID NO: 1423705 - DNA, 20 bp, Homo sapiens
ataaaaaaaaaaggatgaaa

SEQ ID NO: 1423706 - DNA, 13 bp, Homo sapiens
ataaaaaaaagaa

SEQ ID NO: 1423707 - DNA, 16 bp, Homo sapiens
ataaaaaagatcccaa

SEQ ID NO: 1423708 - DNA, 13 bp, Homo sapiens
ataaaaaatcatg

SEQ ID NO: 1423709 - DNA, 16 bp, Homo sapiens
ataaaaaatcatgcca

SEQ ID NO: 1423710 - DNA, 17 bp, Homo sapiens
ataaaaaatgtaacatc

SEQ ID NO: 1423711 - DNA, 15 bp, Homo sapiens
ataaaaaattatgac

SEQ ID NO: 1423712 - DNA, 15 bp, Homo sapiens
ataaaaacaaaaaca

SEQ ID NO: 1423713 - DNA, 14 bp, Homo sapiens
ataaaaacaacttt

SEQ ID NO: 1423714 - DNA, 18 bp, Homo sapiens
ataaaaactaatttcata

SEQ ID NO: 1423715 - DNA, 13 bp, Homo sapiens
ataaaaagaaatt

SEQ ID NO: 1423716 - DNA, 13 bp, Homo sapiens
ataaaaagaatga

SEQ ID NO: 1423717 - DNA, 11 bp, Homo sapiens
ataaaaagaga

SEQ ID NO: 1423718 - DNA, 20 bp, Homo sapiens
ataaaaagcagaattttaat

SEQ ID NO: 1423719 - DNA, 17 bp, Homo sapiens
ataaaaagcctctttct

SEQ ID NO: 1423720 - DNA, 20 bp, Homo sapiens
ataaaaagcctgcaatttca

SEQ ID NO: 1423721 - DNA, 12 bp, Homo sapiens
ataaaaaggtgt

SEQ ID NO: 1423722 - DNA, 17 bp, Homo sapiens
ataaaaagtgacacagc

SEQ ID NO: 1423723 - DNA, 20 bp, Homo sapiens
ataaaaagtgacacagcagc

SEQ ID NO: 1423724 - DNA, 13 bp, Homo sapiens
ataaaaagtttca

SEQ ID NO: 1423725 - DNA, 13 bp, Homo sapiens
ataaaaatatgta

SEQ ID NO: 1423726 - DNA, 22 bp, Homo sapiens
ataaaaatattgtgttgtgaat

SEQ ID NO: 1423727 - DNA, 20 bp, Homo sapiens
ataaaaattatcaaaaagct

SEQ ID NO: 1423728 - DNA, 14 bp, Homo sapiens
ataaaacacacctc

SEQ ID NO: 1423729 - DNA, 14 bp, Homo sapiens
ataaaacagaatct

SEQ ID NO: 1423730 - DNA, 13 bp, Homo sapiens
ataaaacagtcat

SEQ ID NO: 1423731 - DNA, 14 bp, Homo sapiens
ataaaactaggaat

SEQ ID NO: 1423732 - DNA, 17 bp, Homo sapiens
ataaaactcagttaaaa

SEQ ID NO: 1423733 - DNA, 18 bp, Homo sapiens
ataaaactcagttaaaat

SEQ ID NO: 1423734 - DNA, 19 bp, Homo sapiens
ataaaactcagttaaaatg

SEQ ID NO: 1423735 - DNA, 15 bp, Homo sapiens
ataaaactgcgagga

SEQ ID NO: 1423736 - DNA, 14 bp, Homo sapiens
ataaaactgtgact

SEQ ID NO: 1423737 - DNA, 20 bp, Homo sapiens
ataaaactttggcaacatct

SEQ ID NO: 1423738 - DNA, 21 bp, Homo sapiens
ataaaactttggcaacatctt

SEQ ID NO: 1423739 - DNA, 12 bp, Homo sapiens
ataaaagacaca

SEQ ID NO: 1423740 - DNA, 14 bp, Homo sapiens
ataaaagacacaga

SEQ ID NO: 1423741 - DNA, 14 bp, Homo sapiens
ataaaagatcacct

SEQ ID NO: 1423742 - DNA, 16 bp, Homo sapiens
ataaaagcaaaagaga

SEQ ID NO: 1423743 - DNA, 21 bp, Homo sapiens
ataaaagctagatactggaaa

SEQ ID NO: 1423744 - DNA, 14 bp, Homo sapiens
ataaaagctataaa

SEQ ID NO: 1423745 - DNA, 20 bp, Homo sapiens
ataaaagctataaagtatat

SEQ ID NO: 1423746 - DNA, 22 bp, Homo sapiens
ataaaagctgaagttactttat

SEQ ID NO: 1423747 - DNA, 19 bp, Homo sapiens
ataaaaggcaaatgtgtac

SEQ ID NO: 1423748 - DNA, 12 bp, Homo sapiens
ataaaaggttgc

SEQ ID NO: 1423749 - DNA, 20 bp, Homo sapiens
ataaaaggttgccaaattgc

SEQ ID NO: 1423750 - DNA, 23 bp, Homo sapiens
ataaaagtgaagtgaatctgatt

SEQ ID NO: 1423751 - DNA, 22 bp, Homo sapiens
ataaaagtgatcaataaaatgt

SEQ ID NO: 1423752 - DNA, 17 bp, Homo sapiens
ataaaatacatagtgaa

SEQ ID NO: 1423753 - DNA, 17 bp, Homo sapiens
ataaaatactctagcct

SEQ ID NO: 1423754 - DNA, 12 bp, Homo sapiens
ataaaatatcat

SEQ ID NO: 1423755 - DNA, 16 bp, Homo sapiens
ataaaatatcataaag

SEQ ID NO: 1423756 - DNA, 23 bp, Homo sapiens
ataaaatattcactctccattag

SEQ ID NO: 1423757 - DNA, 12 bp, Homo sapiens
ataaaatatttt

SEQ ID NO: 1423758 - DNA, 16 bp, Homo sapiens
ataaaatcataagtat

SEQ ID NO: 1423759 - DNA, 17 bp, Homo sapiens
ataaaatccaaaatgaa

SEQ ID NO: 1423760 - DNA, 18 bp, Homo sapiens
ataaaatccaatattgta

SEQ ID NO: 1423761 - DNA, 19 bp, Homo sapiens
ataaaatccaatattgtaa

SEQ ID NO: 1423762 - DNA, 21 bp, Homo sapiens
ataaaatctgaattttgcaat

SEQ ID NO: 1423763 - DNA, 17 bp, Homo sapiens
ataaaatgaaagatttt

SEQ ID NO: 1423764 - DNA, 18 bp, Homo sapiens
ataaaatgatttgtggaa

SEQ ID NO: 1423765 - DNA, 14 bp, Homo sapiens
ataaaatggaaagg

SEQ ID NO: 1423766 - DNA, 13 bp, Homo sapiens
ataaaatgtgtac

SEQ ID NO: 1423767 - DNA, 18 bp, Homo sapiens
ataaaatgtgtacagtga

SEQ ID NO: 1423768 - DNA, 19 bp, Homo sapiens
ataaaatgtgtacagtgaa

SEQ ID NO: 1423769 - DNA, 20 bp, Homo sapiens
ataaaatgtgtacagtgaat

SEQ ID NO: 1423770 - DNA, 16 bp, Homo sapiens
ataaaattttgctttt

SEQ ID NO: 1423771 - DNA, 16 bp, Homo sapiens
ataaacaacagctgaa

SEQ ID NO: 1423772 - DNA, 19 bp, Homo sapiens
ataaacaacttaatgttct

SEQ ID NO: 1423773 - DNA, 14 bp, Homo sapiens
ataaacaagaatga

SEQ ID NO: 1423774 - DNA, 13 bp, Homo sapiens
ataaacagcacac

SEQ ID NO: 1423775 - DNA, 20 bp, Homo sapiens
ataaacaggaattttatttt

SEQ ID NO: 1423776 - DNA, 21 bp, Homo sapiens
ataaacagtatattctttggt

SEQ ID NO: 1423777 - DNA, 20 bp, Homo sapiens
ataaacatacgtgtgcatgt

SEQ ID NO: 1423778 - DNA, 22 bp, Homo sapiens
ataaacatacgtgtgcatgtgt

SEQ ID NO: 1423779 - DNA, 17 bp, Homo sapiens
ataaacatcacacacac

SEQ ID NO: 1423780 - DNA, 12 bp, Homo sapiens
ataaacattaaa

SEQ ID NO: 1423781 - DNA, 15 bp, Homo sapiens
ataaacattaaacac

SEQ ID NO: 1423782 - DNA, 18 bp, Homo sapiens
ataaacattaaacactgt

SEQ ID NO: 1423783 - DNA, 14 bp, Homo sapiens
ataaacattaattt

SEQ ID NO: 1423784 - DNA, 21 bp, Homo sapiens
ataaacattaattttgtgcat

SEQ ID NO: 1423785 - DNA, 15 bp, Homo sapiens
ataaaccaataaatc

SEQ ID NO: 1423786 - DNA, 15 bp, Homo sapiens
ataaaccactgtgcg

SEQ ID NO: 1423787 - DNA, 16 bp, Homo sapiens
ataaaccttaagtaag

SEQ ID NO: 1423788 - DNA, 20 bp, Homo sapiens
ataaacgcgggaaaaaagat

SEQ ID NO: 1423789 - DNA, 12 bp, Homo sapiens
ataaactataaa

SEQ ID NO: 1423790 - DNA, 16 bp, Homo sapiens
ataaactataaactta

SEQ ID NO: 1423791 - DNA, 18 bp, Homo sapiens
ataaactattggaaagta

SEQ ID NO: 1423792 - DNA, 17 bp, Homo sapiens
ataaactatttatatca

SEQ ID NO: 1423793 - DNA, 16 bp, Homo sapiens
ataaactcagatctga

SEQ ID NO: 1423794 - DNA, 14 bp, Homo sapiens
ataaactcatttat

SEQ ID NO: 1423795 - DNA, 14 bp, Homo sapiens
ataaactgtattaa

SEQ ID NO: 1423796 - DNA, 22 bp, Homo sapiens
ataaactgtattaaatcttaaa

SEQ ID NO: 1423797 - DNA, 17 bp, Homo sapiens
ataaacttagaggaaaa

SEQ ID NO: 1423798 - DNA, 18 bp, Homo sapiens
ataaacttagaggaaaat

SEQ ID NO: 1423799 - DNA, 23 bp, Homo sapiens
ataaacttagtgcggacaagttt

SEQ ID NO: 1423800 - DNA, 13 bp, Homo sapiens
ataaacttcagag

SEQ ID NO: 1423801 - DNA, 20 bp, Homo sapiens
ataaactttaatataaagta

SEQ ID NO: 1423802 - DNA, 12 bp, Homo sapiens
ataaagaaaaat

SEQ ID NO: 1423803 - DNA, 13 bp, Homo sapiens
ataaagaaaaata

SEQ ID NO: 1423804 - DNA, 15 bp, Homo sapiens
ataaagaacaaggta

SEQ ID NO: 1423805 - DNA, 21 bp, Homo sapiens
ataaagaactccttattttgt

SEQ ID NO: 1423806 - DNA, 18 bp, Homo sapiens
ataaagaattaatgactt

SEQ ID NO: 1423807 - DNA, 16 bp, Homo sapiens
ataaagacaacaaaag

SEQ ID NO: 1423808 - DNA, 21 bp, Homo sapiens
ataaagactcctaatagcttt

SEQ ID NO: 1423809 - DNA, 23 bp, Homo sapiens
ataaagactcctaatagcttttc

SEQ ID NO: 1423810 - DNA, 13 bp, Homo sapiens
ataaagataaaat

SEQ ID NO: 1423811 - DNA, 18 bp, Homo sapiens
ataaagatatttccaaga

SEQ ID NO: 1423812 - DNA, 12 bp, Homo sapiens
ataaagatgagt

SEQ ID NO: 1423813 - DNA, 19 bp, Homo sapiens
ataaagatgatctactcag

SEQ ID NO: 1423814 - DNA, 20 bp, Homo sapiens
ataaagatgatctactcaga

SEQ ID NO: 1423815 - DNA, 14 bp, Homo sapiens
ataaagatgctctt

SEQ ID NO: 1423816 - DNA, 15 bp, Homo sapiens
ataaagatgctcttt

SEQ ID NO: 1423817 - DNA, 19 bp, Homo sapiens
ataaagattataatatgtg

SEQ ID NO: 1423818 - DNA, 14 bp, Homo sapiens
ataaagcaaataga

SEQ ID NO: 1423819 - DNA, 19 bp, Homo sapiens
ataaagcacagatttgcat

SEQ ID NO: 1423820 - DNA, 17 bp, Homo sapiens
ataaagcagacaggtgt

SEQ ID NO: 1423821 - DNA, 14 bp, Homo sapiens
ataaagcagtattt

SEQ ID NO: 1423822 - DNA, 13 bp, Homo sapiens
ataaagcattctt

SEQ ID NO: 1423823 - DNA, 15 bp, Homo sapiens
ataaagccaaatttc

SEQ ID NO: 1423824 - DNA, 16 bp, Homo sapiens
ataaagccactgaaaa

SEQ ID NO: 1423825 - DNA, 14 bp, Homo sapiens
ataaagcctatttt

SEQ ID NO: 1423826 - DNA, 22 bp, Homo sapiens
ataaagcctcaaggttttaggt

SEQ ID NO: 1423827 - DNA, 16 bp, Homo sapiens
ataaagctgttattct

SEQ ID NO: 1423828 - DNA, 12 bp, Homo sapiens
ataaaggcagct

SEQ ID NO: 1423829 - DNA, 15 bp, Homo sapiens
ataaaggcagctgcc

SEQ ID NO: 1423830 - DNA, 21 bp, Homo sapiens
ataaaggcagctgcctctgct

SEQ ID NO: 1423831 - DNA, 22 bp, Homo sapiens
ataaaggcagctgcctctgctc

SEQ ID NO: 1423832 - DNA, 16 bp, Homo sapiens
ataaaggcagttttct

SEQ ID NO: 1423833 - DNA, 17 bp, Homo sapiens
ataaaggctgaagcttt

SEQ ID NO: 1423834 - DNA, 22 bp, Homo sapiens
ataaagggcccacacctggtgg

SEQ ID NO: 1423835 - DNA, 15 bp, Homo sapiens
ataaaggtctttgca

SEQ ID NO: 1423836 - DNA, 16 bp, Homo sapiens
ataaaggttgacaata

SEQ ID NO: 1423837 - DNA, 13 bp, Homo sapiens
ataaagtacaaat

SEQ ID NO: 1423838 - DNA, 22 bp, Homo sapiens
ataaagtacaaatgaagaaagt

SEQ ID NO: 1423839 - DNA, 13 bp, Homo sapiens
ataaagtatatat

SEQ ID NO: 1423840 - DNA, 20 bp, Homo sapiens
ataaagtattcaacaatttc

SEQ ID NO: 1423841 - DNA, 20 bp, Homo sapiens
ataaagtctaagcaagatgt

SEQ ID NO: 1423842 - DNA, 17 bp, Homo sapiens
ataaagttacttgaatt

SEQ ID NO: 1423843 - DNA, 15 bp, Homo sapiens
ataaagttccttaag

SEQ ID NO: 1423844 - DNA, 22 bp, Homo sapiens
ataaagttgaagctaagattta

SEQ ID NO: 1423845 - DNA, 16 bp, Homo sapiens
ataaagttggtgacag

SEQ ID NO: 1423846 - DNA, 17 bp, Homo sapiens
ataaagttggtgacaga

SEQ ID NO: 1423847 - DNA, 18 bp, Homo sapiens
ataaagttggtgacagat

SEQ ID NO: 1423848 - DNA, 13 bp, Homo sapiens
ataaagtttacaa

SEQ ID NO: 1423849 - DNA, 13 bp, Homo sapiens
ataaagtttctca

SEQ ID NO: 1423850 - DNA, 20 bp, Homo sapiens
ataaataaaatcatgtagtt

SEQ ID NO: 1423851 - DNA, 13 bp, Homo sapiens
ataaataaatatt

SEQ ID NO: 1423852 - DNA, 12 bp, Homo sapiens
ataaataaatgt

SEQ ID NO: 1423853 - DNA, 13 bp, Homo sapiens
ataaataataaag

SEQ ID NO: 1423854 - DNA, 16 bp, Homo sapiens
ataaatacaaaaatga

SEQ ID NO: 1423855 - DNA, 20 bp, Homo sapiens
ataaatacagcatacttcaa

SEQ ID NO: 1423856 - DNA, 18 bp, Homo sapiens
ataaatactgcaaatcag

SEQ ID NO: 1423857 - DNA, 21 bp, Homo sapiens
ataaatagatgctgtgtatat

SEQ ID NO: 1423858 - DNA, 15 bp, Homo sapiens
ataaatatatacatt

SEQ ID NO: 1423859 - DNA, 21 bp, Homo sapiens
ataaatatatctaccccagac

SEQ ID NO: 1423860 - DNA, 19 bp, Homo sapiens
ataaatattcacacttgaa

SEQ ID NO: 1423861 - DNA, 15 bp, Homo sapiens
ataaatattttccgt

SEQ ID NO: 1423862 - DNA, 20 bp, Homo sapiens
ataaatatttttggggcatc

SEQ ID NO: 1423863 - DNA, 16 bp, Homo sapiens
ataaatcataaagtca

SEQ ID NO: 1423864 - DNA, 18 bp, Homo sapiens
ataaatcataaagtcagt

SEQ ID NO: 1423865 - DNA, 18 bp, Homo sapiens
ataaatccacccatgtta

SEQ ID NO: 1423866 - DNA, 20 bp, Homo sapiens
ataaatccagtgacctctct

SEQ ID NO: 1423867 - DNA, 19 bp, Homo sapiens
ataaatctgacccagtgcc

SEQ ID NO: 1423868 - DNA, 17 bp, Homo sapiens
ataaatctgtctgattc

SEQ ID NO: 1423869 - DNA, 18 bp, Homo sapiens
ataaatgaagcagcttta

SEQ ID NO: 1423870 - DNA, 13 bp, Homo sapiens
ataaatgaatgaa

SEQ ID NO: 1423871 - DNA, 15 bp, Homo sapiens
ataaatgattcaaaa

SEQ ID NO: 1423872 - DNA, 18 bp, Homo sapiens
ataaatgattcttagtga

SEQ ID NO: 1423873 - DNA, 17 bp, Homo sapiens
ataaatgcataatttat

SEQ ID NO: 1423874 - DNA, 13 bp, Homo sapiens
ataaatgccagag

SEQ ID NO: 1423875 - DNA, 17 bp, Homo sapiens
ataaatgccagagccaa

SEQ ID NO: 1423876 - DNA, 16 bp, Homo sapiens
ataaatgcttttctaa

SEQ ID NO: 1423877 - DNA, 16 bp, Homo sapiens
ataaatggctggtttt

SEQ ID NO: 1423878 - DNA, 22 bp, Homo sapiens
ataaatggtatagcaaatgttt

SEQ ID NO: 1423879 - DNA, 18 bp, Homo sapiens
ataaatgtaccagagaga

SEQ ID NO: 1423880 - DNA, 20 bp, Homo sapiens
ataaatgtacccctctcagt

SEQ ID NO: 1423881 - DNA, 19 bp, Homo sapiens
ataaatgtataaatataca

SEQ ID NO: 1423882 - DNA, 22 bp, Homo sapiens
ataaatgtattcaaataccaat

SEQ ID NO: 1423883 - DNA, 15 bp, Homo sapiens
ataaatgtctgttga

SEQ ID NO: 1423884 - DNA, 12 bp, Homo sapiens
ataaatgtttgt

SEQ ID NO: 1423885 - DNA, 14 bp, Homo sapiens
ataaatgtttgtct

SEQ ID NO: 1423886 - DNA, 19 bp, Homo sapiens
ataaatgtttgttatttac

SEQ ID NO: 1423887 - DNA, 20 bp, Homo sapiens
ataaattactatctgttgaa

SEQ ID NO: 1423888 - DNA, 22 bp, Homo sapiens
ataaattactatctgttgaaaa

SEQ ID NO: 1423889 - DNA, 14 bp, Homo sapiens
ataaattactgttt

SEQ ID NO: 1423890 - DNA, 14 bp, Homo sapiens
ataaattaggacca

SEQ ID NO: 1423891 - DNA, 15 bp, Homo sapiens
ataaattatggcatt

SEQ ID NO: 1423892 - DNA, 21 bp, Homo sapiens
ataaattattagtttacatca

SEQ ID NO: 1423893 - DNA, 13 bp, Homo sapiens
ataaattcagata

SEQ ID NO: 1423894 - DNA, 19 bp, Homo sapiens
ataaattgatttttataaa

SEQ ID NO: 1423895 - DNA, 19 bp, Homo sapiens
ataaattggattattttct

SEQ ID NO: 1423896 - DNA, 21 bp, Homo sapiens
ataaattggcctctgtatgca

SEQ ID NO: 1423897 - DNA, 13 bp, Homo sapiens
ataaatttaaaat

SEQ ID NO: 1423898 - DNA, 23 bp, Homo sapiens
ataaatttcccagttaaagatta

SEQ ID NO: 1423899 - DNA, 20 bp, Homo sapiens
ataaatttgacttttctgta

SEQ ID NO: 1423900 - DNA, 16 bp, Homo sapiens
ataaatttgtaacttt

SEQ ID NO: 1423901 - DNA, 16 bp, Homo sapiens
ataaattttgtttcag

SEQ ID NO: 1423902 - DNA, 17 bp, Homo sapiens
ataaattttttttggtc

SEQ ID NO: 1423903 - DNA, 22 bp, Homo sapiens
ataaattttttttggtcaaatt

SEQ ID NO: 1423904 - DNA, 17 bp, Homo sapiens
ataacaaaaaataaatt

SEQ ID NO: 1423905 - DNA, 22 bp, Homo sapiens
ataacaagccaaacattcttat

SEQ ID NO: 1423906 - DNA, 11 bp, Homo sapiens
ataacacacat

SEQ ID NO: 1423907 - DNA, 13 bp, Homo sapiens
ataacacagagag

SEQ ID NO: 1423908 - DNA, 14 bp, Homo sapiens
ataacactgcagcc

SEQ ID NO: 1423909 - DNA, 20 bp, Homo sapiens
ataacactgcagccctctcc

SEQ ID NO: 1423910 - DNA, 21 bp, Homo sapiens
ataacactgtattttaatgta

SEQ ID NO: 1423911 - DNA, 17 bp, Homo sapiens
ataacactgtgaagagc

SEQ ID NO: 1423912 - DNA, 14 bp, Homo sapiens
ataacagagagaat

SEQ ID NO: 1423913 - DNA, 16 bp, Homo sapiens
ataacataaatttttt

SEQ ID NO: 1423914 - DNA, 11 bp, Homo sapiens
ataacatatat

SEQ ID NO: 1423915 - DNA, 17 bp, Homo sapiens
ataacatatctaaagtc

SEQ ID NO: 1423916 - DNA, 18 bp, Homo sapiens
ataacatatctaaagtca

SEQ ID NO: 1423917 - DNA, 15 bp, Homo sapiens
ataacatattcttgc

SEQ ID NO: 1423918 - DNA, 16 bp, Homo sapiens
ataacatctgaaaaga

SEQ ID NO: 1423919 - DNA, 14 bp, Homo sapiens
ataacatctttatt

SEQ ID NO: 1423920 - DNA, 18 bp, Homo sapiens
ataacatctttattgaaa

SEQ ID NO: 1423921 - DNA, 13 bp, Homo sapiens
ataacatgtaaaa

SEQ ID NO: 1423922 - DNA, 15 bp, Homo sapiens
ataacatgtaaaatc

SEQ ID NO: 1423923 - DNA, 13 bp, Homo sapiens
ataaccacattta

SEQ ID NO: 1423924 - DNA, 22 bp, Homo sapiens
ataaccacttaaaaaatgtcca

SEQ ID NO: 1423925 - DNA, 20 bp, Homo sapiens
ataaccccagctccctagga

SEQ ID NO: 1423926 - DNA, 17 bp, Homo sapiens
ataacctagttaaagaa

SEQ ID NO: 1423927 - DNA, 18 bp, Homo sapiens
ataacctatttttttctc

SEQ ID NO: 1423928 - DNA, 19 bp, Homo sapiens
ataactaagatatagaaac

SEQ ID NO: 1423929 - DNA, 13 bp, Homo sapiens
ataactatctttt

SEQ ID NO: 1423930 - DNA, 22 bp, Homo sapiens
ataactatctttttgaaagcaa

SEQ ID NO: 1423931 - DNA, 18 bp, Homo sapiens
ataactcatcataaaata

SEQ ID NO: 1423932 - DNA, 19 bp, Homo sapiens
ataactcatcataaaataa

SEQ ID NO: 1423933 - DNA, 22 bp, Homo sapiens
ataactcctgtcccttttccct

SEQ ID NO: 1423934 - DNA, 15 bp, Homo sapiens
ataactctctttcct

SEQ ID NO: 1423935 - DNA, 22 bp, Homo sapiens
ataactctgtggcattattgca

SEQ ID NO: 1423936 - DNA, 15 bp, Homo sapiens
ataactgaatttgga

SEQ ID NO: 1423937 - DNA, 20 bp, Homo sapiens
ataactgcaaagtgaagttg

SEQ ID NO: 1423938 - DNA, 20 bp, Homo sapiens
ataactgccttgggcaagga

SEQ ID NO: 1423939 - DNA, 17 bp, Homo sapiens
ataactgtaattatttg

SEQ ID NO: 1423940 - DNA, 18 bp, Homo sapiens
ataactgtaattatttga

SEQ ID NO: 1423941 - DNA, 19 bp, Homo sapiens
ataactgtaattatttgaa

SEQ ID NO: 1423942 - DNA, 22 bp, Homo sapiens
ataactgtaattatttgaatga

SEQ ID NO: 1423943 - DNA, 15 bp, Homo sapiens
ataactgtcttctgg

SEQ ID NO: 1423944 - DNA, 16 bp, Homo sapiens
ataactgtcttgtttc

SEQ ID NO: 1423945 - DNA, 20 bp, Homo sapiens
ataactgtcttgtttcagtg

SEQ ID NO: 1423946 - DNA, 12 bp, Homo sapiens
ataactgtgaag

SEQ ID NO: 1423947 - DNA, 13 bp, Homo sapiens
ataactgtgaagt

SEQ ID NO: 1423948 - DNA, 15 bp, Homo sapiens
ataactgtgtactgt

SEQ ID NO: 1423949 - DNA, 12 bp, Homo sapiens
ataacttaaaaa

SEQ ID NO: 1423950 - DNA, 19 bp, Homo sapiens
ataacttaaaaaaatgaca

SEQ ID NO: 1423951 - DNA, 20 bp, Homo sapiens
ataacttaaaaatgtaaata

SEQ ID NO: 1423952 - DNA, 12 bp, Homo sapiens
ataacttaaaat

SEQ ID NO: 1423953 - DNA, 15 bp, Homo sapiens
ataacttactgtata

SEQ ID NO: 1423954 - DNA, 17 bp, Homo sapiens
ataacttactgtatatg

SEQ ID NO: 1423955 - DNA, 22 bp, Homo sapiens
ataacttactgtatatgtattc

SEQ ID NO: 1423956 - DNA, 16 bp, Homo sapiens
ataacttgctgaattt

SEQ ID NO: 1423957 - DNA, 19 bp, Homo sapiens
ataacttgctgaatttcag

SEQ ID NO: 1423958 - DNA, 21 bp, Homo sapiens
ataactttaaatcttttcttc

SEQ ID NO: 1423959 - DNA, 18 bp, Homo sapiens
ataacttttacacgacca

SEQ ID NO: 1423960 - DNA, 20 bp, Homo sapiens
ataacttttcaccaatgagc

SEQ ID NO: 1423961 - DNA, 17 bp, Homo sapiens
ataagaaaaatcatgtt

SEQ ID NO: 1423962 - DNA, 14 bp, Homo sapiens
ataagaaaagcctg

SEQ ID NO: 1423963 - DNA, 21 bp, Homo sapiens
agtgctgcccatgagcaagcc

SEQ ID NO: 1423964 - DNA, 13 bp, Homo sapiens
agtgctgcttctc

SEQ ID NO: 1423965 - DNA, 19 bp, Homo sapiens
agtgctgcttctcttggga

SEQ ID NO: 1423966 - DNA, 14 bp, Homo sapiens
agtgctggaaggga

SEQ ID NO: 1423967 - DNA, 16 bp, Homo sapiens
agtgctggcccaccca

SEQ ID NO: 1423968 - DNA, 23 bp, Homo sapiens
agtgctggcccacccagtccatg

SEQ ID NO: 1423969 - DNA, 15 bp, Homo sapiens
agtgctgggaccaga

SEQ ID NO: 1423970 - DNA, 16 bp, Homo sapiens
agtgctgggaccagag

SEQ ID NO: 1423971 - DNA, 20 bp, Homo sapiens
agtgctgggaccagagccag

SEQ ID NO: 1423972 - DNA, 20 bp, Homo sapiens
agtgctgggattacaggcat

SEQ ID NO: 1423973 - DNA, 20 bp, Homo sapiens
agtgctgggattacaggcgt

SEQ ID NO: 1423974 - DNA, 20 bp, Homo sapiens
agtgctgggattacaggtgt

SEQ ID NO: 1423975 - DNA, 20 bp, Homo sapiens
agtgctgggattaccggcgt

SEQ ID NO: 1423976 - DNA, 13 bp, Homo sapiens
agtgctggtcaga

SEQ ID NO: 1423977 - DNA, 16 bp, Homo sapiens
agtgctgtaatattgt

SEQ ID NO: 1423978 - DNA, 20 bp, Homo sapiens
agtgctgtaatattgtaaat

SEQ ID NO: 1423979 - DNA, 17 bp, Homo sapiens
agtgctgtacccttcca

SEQ ID NO: 1423980 - DNA, 14 bp, Homo sapiens
agtgctgtggcctg

SEQ ID NO: 1423981 - DNA, 17 bp, Homo sapiens
agtgctgtggcctgggc

SEQ ID NO: 1423982 - DNA, 15 bp, Homo sapiens
agtgcttcagagttt

SEQ ID NO: 1423983 - DNA, 17 bp, Homo sapiens
agtgcttcagagtttgt

SEQ ID NO: 1423984 - DNA, 23 bp, Homo sapiens
agtgcttcagagtttgtgtgtat

SEQ ID NO: 1423985 - DNA, 19 bp, Homo sapiens
agtgcttgatatgtaagta

SEQ ID NO: 1423986 - DNA, 23 bp, Homo sapiens
agtgcttgggtggtgggtgctgg

SEQ ID NO: 1423987 - DNA, 13 bp, Homo sapiens
agtgctttaatgg

SEQ ID NO: 1423988 - DNA, 20 bp, Homo sapiens
agtgctttgttgatttagat

SEQ ID NO: 1423989 - DNA, 19 bp, Homo sapiens
agtgcttttaagtgaaaat

SEQ ID NO: 1423990 - DNA, 16 bp, Homo sapiens
agtggaaactcagccg

SEQ ID NO: 1423991 - DNA, 19 bp, Homo sapiens
agtggaatagtgaatactt

SEQ ID NO: 1423992 - DNA, 22 bp, Homo sapiens
agtggaatagtgaatacttact

SEQ ID NO: 1423993 - DNA, 14 bp, Homo sapiens
agtggacaacaggt

SEQ ID NO: 1423994 - DNA, 22 bp, Homo sapiens
agtggacaccaggagtccctgg

SEQ ID NO: 1423995 - DNA, 19 bp, Homo sapiens
agtggaccaggacaggacc

SEQ ID NO: 1423996 - DNA, 20 bp, Homo sapiens
agtggaccgaaatctgtatt

SEQ ID NO: 1423997 - DNA, 20 bp, Homo sapiens
agtggaccttaggccttcct

SEQ ID NO: 1423998 - DNA, 16 bp, Homo sapiens
agtggactcttccctc

SEQ ID NO: 1423999 - DNA, 13 bp, Homo sapiens
agtggagccaggt

SEQ ID NO: 1424000 - DNA, 16 bp, Homo sapiens
agtggagctgggaggt

SEQ ID NO: 1424001 - DNA, 22 bp, Homo sapiens
agtggaggaggaggaggagcct

SEQ ID NO: 1424002 - DNA, 19 bp, Homo sapiens
agtggagttgaaactgcta

SEQ ID NO: 1424003 - DNA, 21 bp, Homo sapiens
agtggatatgacccacactgc

SEQ ID NO: 1424004 - DNA, 22 bp, Homo sapiens
agtggatatgacccacactgcc

SEQ ID NO: 1424005 - DNA, 16 bp, Homo sapiens
agtggatcacaaagtg

SEQ ID NO: 1424006 - DNA, 14 bp, Homo sapiens
agtggatcacacac

SEQ ID NO: 1424007 - DNA, 18 bp, Homo sapiens
agtggatgggaatttgtc

SEQ ID NO: 1424008 - DNA, 21 bp, Homo sapiens
agtggcaagaccaaaatgaca

SEQ ID NO: 1424009 - DNA, 12 bp, Homo sapiens
agtggcacagga

SEQ ID NO: 1424010 - DNA, 15 bp, Homo sapiens
agtggcacggagaga

SEQ ID NO: 1424011 - DNA, 15 bp, Homo sapiens
agtggcagcagcccc

SEQ ID NO: 1424012 - DNA, 13 bp, Homo sapiens
agtggcagccatg

SEQ ID NO: 1424013 - DNA, 22 bp, Homo sapiens
agtggcagccatgcctcatgcc

SEQ ID NO: 1424014 - DNA, 11 bp, Homo sapiens
agtggcagggg

SEQ ID NO: 1424015 - DNA, 18 bp, Homo sapiens
agtggcaggggacaggag

SEQ ID NO: 1424016 - DNA, 18 bp, Homo sapiens
agtggcaggggagcaggt

SEQ ID NO: 1424017 - DNA, 20 bp, Homo sapiens
agtggcaggtgggctgcctg

SEQ ID NO: 1424018 - DNA, 19 bp, Homo sapiens
agtgttttctcagaacagc

SEQ ID NO: 1424019 - DNA, 22 bp, Homo sapiens
agtgttttctcagaacagctga

SEQ ID NO: 1424020 - DNA, 13 bp, Homo sapiens
agtgttttctggg

SEQ ID NO: 1424021 - DNA, 14 bp, Homo sapiens
agtgttttggactc

SEQ ID NO: 1424022 - DNA, 15 bp, Homo sapiens
agtgttttggactcc

SEQ ID NO: 1424023 - DNA, 20 bp, Homo sapiens
agtgttttggactccatctc

SEQ ID NO: 1424024 - DNA, 23 bp, Homo sapiens
agttaaaatgtttactgtaaatt

SEQ ID NO: 1424025 - DNA, 16 bp, Homo sapiens
agttaaactaaaaaaa

SEQ ID NO: 1424026 - DNA, 14 bp, Homo sapiens
agttaaactgtgaa

SEQ ID NO: 1424027 - DNA, 16 bp, Homo sapiens
agttaaagaaaggaaa

SEQ ID NO: 1424028 - DNA, 11 bp, Homo sapiens
agttaaagcca

SEQ ID NO: 1424029 - DNA, 17 bp, Homo sapiens
agttaaagggaagaaaa

SEQ ID NO: 1424030 - DNA, 18 bp, Homo sapiens
agttaaaggttgccagca

SEQ ID NO: 1424031 - DNA, 16 bp, Homo sapiens
agttaaataactgtgt

SEQ ID NO: 1424032 - DNA, 18 bp, Homo sapiens
agttaaatgttacctctg

SEQ ID NO: 1424033 - DNA, 13 bp, Homo sapiens
agttaacaaggaa

SEQ ID NO: 1424034 - DNA, 17 bp, Homo sapiens
agttaacaaggaatgcc

SEQ ID NO: 1424035 - DNA, 12 bp, Homo sapiens
agttaacagaga

SEQ ID NO: 1424036 - DNA, 13 bp, Homo sapiens
agttaacaggata

SEQ ID NO: 1424037 - DNA, 23 bp, Homo sapiens
agttaacagtctcattacagatt

SEQ ID NO: 1424038 - DNA, 18 bp, Homo sapiens
agttaacttgaagaaacc

SEQ ID NO: 1424039 - DNA, 20 bp, Homo sapiens
agttaataggagtatttttg

SEQ ID NO: 1424040 - DNA, 14 bp, Homo sapiens
agttaatgagccat

SEQ ID NO: 1424041 - DNA, 20 bp, Homo sapiens
agttaattacatcctcatgc

SEQ ID NO: 1424042 - DNA, 21 bp, Homo sapiens
agttacaaattataatgtatt

SEQ ID NO: 1424043 - DNA, 15 bp, Homo sapiens
agttacaataaagtt

SEQ ID NO: 1424044 - DNA, 22 bp, Homo sapiens
agttacacagaaatgctgctgg

SEQ ID NO: 1424045 - DNA, 15 bp, Homo sapiens
agttacagttctgtg

SEQ ID NO: 1424046 - DNA, 16 bp, Homo sapiens
agttacagttctgtgg

SEQ ID NO: 1424047 - DNA, 16 bp, Homo sapiens
agttacagtttgcaca

SEQ ID NO: 1424048 - DNA, 20 bp, Homo sapiens
agttaccctgatctggaccc

SEQ ID NO: 1424049 - DNA, 20 bp, Homo sapiens
agttaccttatagttactgt

SEQ ID NO: 1424050 - DNA, 18 bp, Homo sapiens
agttactaagaagaaaat

SEQ ID NO: 1424051 - DNA, 13 bp, Homo sapiens
agttactcagccc

SEQ ID NO: 1424052 - DNA, 18 bp, Homo sapiens
agttactcagccctgggc

SEQ ID NO: 1424053 - DNA, 19 bp, Homo sapiens
agttactcagccctgggcc

SEQ ID NO: 1424054 - DNA, 23 bp, Homo sapiens
agttactcagccctgggccccac

SEQ ID NO: 1424055 - DNA, 15 bp, Homo sapiens
agttactctgaaggg

SEQ ID NO: 1424056 - DNA, 16 bp, Homo sapiens
agttactctgaagggc

SEQ ID NO: 1424057 - DNA, 13 bp, Homo sapiens
agttactgaatgc

SEQ ID NO: 1424058 - DNA, 14 bp, Homo sapiens
agttactgaatgca

SEQ ID NO: 1424059 - DNA, 14 bp, Homo sapiens
agttactgtgtaat

SEQ ID NO: 1424060 - DNA, 15 bp, Homo sapiens
agttactgtgtaatt

SEQ ID NO: 1424061 - DNA, 14 bp, Homo sapiens
agttacttcctatc

SEQ ID NO: 1424062 - DNA, 15 bp, Homo sapiens
agttacttgaatttc

SEQ ID NO: 1424063 - DNA, 20 bp, Homo sapiens
agttacttgtctgaggcctc

SEQ ID NO: 1424064 - DNA, 12 bp, Homo sapiens
agttacttgtga

SEQ ID NO: 1424065 - DNA, 13 bp, Homo sapiens
agagccctgctgt

SEQ ID NO: 1424066 - DNA, 15 bp, Homo sapiens
agagccctgtggccg

SEQ ID NO: 1424067 - DNA, 18 bp, Homo sapiens
agagccctgtggccgcca

SEQ ID NO: 1424068 - DNA, 20 bp, Homo sapiens
agagcccttcactgccatga

SEQ ID NO: 1424069 - DNA, 19 bp, Homo sapiens
agagcccttgcctccccat

SEQ ID NO: 1424070 - DNA, 19 bp, Homo sapiens
agagccgaggggagagagg

SEQ ID NO: 1424071 - DNA, 13 bp, Homo sapiens
agagccgggaagc

SEQ ID NO: 1424072 - DNA, 17 bp, Homo sapiens
agagccgtgatgcctcc

SEQ ID NO: 1424073 - DNA, 19 bp, Homo sapiens
agagcctattttggtgagg

SEQ ID NO: 1424074 - DNA, 13 bp, Homo sapiens
agagcctcttagt

SEQ ID NO: 1424075 - DNA, 19 bp, Homo sapiens
agagcctgctcccccaccc

SEQ ID NO: 1424076 - DNA, 11 bp, Homo sapiens
agagcctgctg

SEQ ID NO: 1424077 - DNA, 12 bp, Homo sapiens
agagcctgctgc

SEQ ID NO: 1424078 - DNA, 17 bp, Homo sapiens
agagcctgctgcatggg

SEQ ID NO: 1424079 - DNA, 18 bp, Homo sapiens
agagcctggggtgttctc

SEQ ID NO: 1424080 - DNA, 12 bp, Homo sapiens
agagcctgtcac

SEQ ID NO: 1424081 - DNA, 20 bp, Homo sapiens
agagcctgtcaccagagctt

SEQ ID NO: 1424082 - DNA, 20 bp, Homo sapiens
agagcctgtctttcagcatt

SEQ ID NO: 1424083 - DNA, 15 bp, Homo sapiens
agagccttcaagtgc

SEQ ID NO: 1424084 - DNA, 14 bp, Homo sapiens
agagccttcagaat

SEQ ID NO: 1424085 - DNA, 20 bp, Homo sapiens
agagccttccacagtgaatg

SEQ ID NO: 1424086 - DNA, 13 bp, Homo sapiens
agagccttctcag

SEQ ID NO: 1424087 - DNA, 18 bp, Homo sapiens
agagccttctcagaagca

SEQ ID NO: 1424088 - DNA, 21 bp, Homo sapiens
agagccttggtgtccacctgg

SEQ ID NO: 1424089 - DNA, 16 bp, Homo sapiens
agagcgaggaaaggat

SEQ ID NO: 1424090 - DNA, 14 bp, Homo sapiens
agagcgaggctgag

SEQ ID NO: 1424091 - DNA, 21 bp, Homo sapiens
agagcggggtcccctctgtgc

SEQ ID NO: 1424092 - DNA, 19 bp, Homo sapiens
agagcgtgcacttgtgatc

SEQ ID NO: 1424093 - DNA, 21 bp, Homo sapiens
agagctaataaatctcttctt

SEQ ID NO: 1424094 - DNA, 15 bp, Homo sapiens
agagctactgagact

SEQ ID NO: 1424095 - DNA, 16 bp, Homo sapiens
agagctagcgctgccg

SEQ ID NO: 1424096 - DNA, 21 bp, Homo sapiens
agagctagctgccactttcac

SEQ ID NO: 1424097 - DNA, 19 bp, Homo sapiens
agagctatggtgcttgctg

SEQ ID NO: 1424098 - DNA, 14 bp, Homo sapiens
agagctcaggcagc

SEQ ID NO: 1424099 - DNA, 21 bp, Homo sapiens
agagctcatcccccctgctgc

SEQ ID NO: 1424100 - DNA, 15 bp, Homo sapiens
agagctcccctccac

SEQ ID NO: 1424101 - DNA, 20 bp, Homo sapiens
agagctcccctccacagctg

SEQ ID NO: 1424102 - DNA, 22 bp, Homo sapiens
agagctcccctccacagctgca

SEQ ID NO: 1424103 - DNA, 23 bp, Homo sapiens
agagctcccctccacagctgcag

SEQ ID NO: 1424104 - DNA, 20 bp, Homo sapiens
agagctctggccccgctagc

SEQ ID NO: 1424105 - DNA, 15 bp, Homo sapiens
agagctcttaatgtt

SEQ ID NO: 1424106 - DNA, 22 bp, Homo sapiens
agagctcttcaagctgtcccct

SEQ ID NO: 1424107 - DNA, 21 bp, Homo sapiens
agagctcttcggtttctgagc

SEQ ID NO: 1424108 - DNA, 23 bp, Homo sapiens
agagctgacccagagtggagtct

SEQ ID NO: 1424109 - DNA, 17 bp, Homo sapiens
agagctgagccagttgt

SEQ ID NO: 1424110 - DNA, 21 bp, Homo sapiens
agagctgagccagttgtccta

SEQ ID NO: 1424111 - DNA, 18 bp, Homo sapiens
agagctgagggccctgtg

SEQ ID NO: 1424112 - DNA, 17 bp, Homo sapiens
agagctgatccagagca

SEQ ID NO: 1424113 - DNA, 21 bp, Homo sapiens
agagctgatccagagcacaga

SEQ ID NO: 1424114 - DNA, 20 bp, Homo sapiens
agagctgattgcagaaagga

SEQ ID NO: 1424115 - DNA, 22 bp, Homo sapiens
agagctgattgcagaaaggaga

SEQ ID NO: 1424116 - DNA, 15 bp, Homo sapiens
agagctgcagggtgg

SEQ ID NO: 1424117 - DNA, 22 bp, Homo sapiens
agagctgccactgggcacctgc

SEQ ID NO: 1424118 - DNA, 14 bp, Homo sapiens
agagctgcctggat

SEQ ID NO: 1424119 - DNA, 19 bp, Homo sapiens
agagctgcctggatgagaa

SEQ ID NO: 1424120 - DNA, 19 bp, Homo sapiens
agagctgctgagggacctt

SEQ ID NO: 1424121 - DNA, 21 bp, Homo sapiens
agagctgctgagggaccttgg

SEQ ID NO: 1424122 - DNA, 19 bp, Homo sapiens
agagctgctgtccttttag

SEQ ID NO: 1424123 - DNA, 15 bp, Homo sapiens
agagctggaaggcag

SEQ ID NO: 1424124 - DNA, 19 bp, Homo sapiens
agagctggaaggcagggca

SEQ ID NO: 1424125 - DNA, 20 bp, Homo sapiens
agagctggaaggcagggcag

SEQ ID NO: 1424126 - DNA, 21 bp, Homo sapiens
agagctggaaggcagggcaga

SEQ ID NO: 1424127 - DNA, 23 bp, Homo sapiens
agagctggaaggcagggcagagg

SEQ ID NO: 1424128 - DNA, 15 bp, Homo sapiens
agagctggctctgag

SEQ ID NO: 1424129 - DNA, 13 bp, Homo sapiens
agagctggtgccc

SEQ ID NO: 1424130 - DNA, 11 bp, Homo sapiens
agagctggtgt

SEQ ID NO: 1424131 - DNA, 17 bp, Homo sapiens
agagctggtgtctgatt

SEQ ID NO: 1424132 - DNA, 12 bp, Homo sapiens
agagctgtgcct

SEQ ID NO: 1424133 - DNA, 19 bp, Homo sapiens
agagctgtgcctgctcagc

SEQ ID NO: 1424134 - DNA, 12 bp, Homo sapiens
agtcccctcctc

SEQ ID NO: 1424135 - DNA, 20 bp, Homo sapiens
agtccctatgtatttgcagt

SEQ ID NO: 1424136 - DNA, 18 bp, Homo sapiens
agtccctcgccgtccctc

SEQ ID NO: 1424137 - DNA, 20 bp, Homo sapiens
agtccctcgccgtccctccc

SEQ ID NO: 1424138 - DNA, 20 bp, Homo sapiens
agtccctgggggaagccctg

SEQ ID NO: 1424139 - DNA, 21 bp, Homo sapiens
agtccctgggggaagccctgg

SEQ ID NO: 1424140 - DNA, 22 bp, Homo sapiens
agtccctgggggaagccctgga

SEQ ID NO: 1424141 - DNA, 23 bp, Homo sapiens
agtccctgtcatttgaacctgga

SEQ ID NO: 1424142 - DNA, 23 bp, Homo sapiens
agtcccttaatcttatggggccg

SEQ ID NO: 1424143 - DNA, 17 bp, Homo sapiens
agtcccttcagactggc

SEQ ID NO: 1424144 - DNA, 19 bp, Homo sapiens
agtcccttcccctccctgg

SEQ ID NO: 1424145 - DNA, 22 bp, Homo sapiens
agtcccttcccctccctggctc

SEQ ID NO: 1424146 - DNA, 23 bp, Homo sapiens
agtcccttcccctccctggctcc

SEQ ID NO: 1424147 - DNA, 12 bp, Homo sapiens
agtccgcctggc

SEQ ID NO: 1424148 - DNA, 18 bp, Homo sapiens
agtccgcctggccggctc

SEQ ID NO: 1424149 - DNA, 16 bp, Homo sapiens
agtccggatttctaac

SEQ ID NO: 1424150 - DNA, 19 bp, Homo sapiens
agtcctatggaaaaaacca

SEQ ID NO: 1424151 - DNA, 17 bp, Homo sapiens
agtcctcattgaatcct

SEQ ID NO: 1424152 - DNA, 20 bp, Homo sapiens
agtcctcattgaatcctcat

SEQ ID NO: 1424153 - DNA, 14 bp, Homo sapiens
agtcctccctcctg

SEQ ID NO: 1424154 - DNA, 24 bp, Homo sapiens
agtcctccctcctgcaggctggct

SEQ ID NO: 1424155 - DNA, 15 bp, Homo sapiens
agtcctcgtagccat

SEQ ID NO: 1424156 - DNA, 17 bp, Homo sapiens
agtcctcgtagccatct

SEQ ID NO: 1424157 - DNA, 17 bp, Homo sapiens
agtcctctagcaggcct

SEQ ID NO: 1424158 - DNA, 22 bp, Homo sapiens
agtcctgaagaggcgggccagc

SEQ ID NO: 1424159 - DNA, 16 bp, Homo sapiens
agtcctgcctcagcct

SEQ ID NO: 1424160 - DNA, 14 bp, Homo sapiens
agtcctgcctggcc

SEQ ID NO: 1424161 - DNA, 16 bp, Homo sapiens
agtcctgcctggccag

SEQ ID NO: 1424162 - DNA, 17 bp, Homo sapiens
agtcctgcctggccagg

SEQ ID NO: 1424163 - DNA, 24 bp, Homo sapiens
agtcctgctacctcccttgccttt

SEQ ID NO: 1424164 - DNA, 22 bp, Homo sapiens
agtcctggaagccagctttccc

SEQ ID NO: 1424165 - DNA, 18 bp, Homo sapiens
agtcctggaggcaggggg

SEQ ID NO: 1424166 - DNA, 18 bp, Homo sapiens
agtcctggctacatccca

SEQ ID NO: 1424167 - DNA, 22 bp, Homo sapiens
agtcctggctacatcccagcct

SEQ ID NO: 1424168 - DNA, 13 bp, Homo sapiens
agtcctgggaggt

SEQ ID NO: 1424169 - DNA, 13 bp, Homo sapiens
agtcctggtcctg

SEQ ID NO: 1424170 - DNA, 15 bp, Homo sapiens
agtcctggtcctggc

SEQ ID NO: 1424171 - DNA, 16 bp, Homo sapiens
agtcctggtggggctg

SEQ ID NO: 1424172 - DNA, 17 bp, Homo sapiens
agtcctgtctctgcctg

SEQ ID NO: 1424173 - DNA, 13 bp, Homo sapiens
agtcctgtgaatg

SEQ ID NO: 1424174 - DNA, 20 bp, Homo sapiens
agtcctgttactatggtaac

SEQ ID NO: 1424175 - DNA, 14 bp, Homo sapiens
agtccttgaaaata

SEQ ID NO: 1424176 - DNA, 16 bp, Homo sapiens
agtccttgaaaatatt

SEQ ID NO: 1424177 - DNA, 21 bp, Homo sapiens
agtccttgctgtgggatgtgc

SEQ ID NO: 1424178 - DNA, 17 bp, Homo sapiens
agtcctttatgtggaaa

SEQ ID NO: 1424179 - DNA, 22 bp, Homo sapiens
agtcgcagaccagagctgtctg

SEQ ID NO: 1424180 - DNA, 23 bp, Homo sapiens
agtcgcaggatccgctgccacca

SEQ ID NO: 1424181 - DNA, 15 bp, Homo sapiens
agtcgccagtcactg

SEQ ID NO: 1424182 - DNA, 18 bp, Homo sapiens
agtcggcatgccaggacc

SEQ ID NO: 1424183 - DNA, 16 bp, Homo sapiens
agtcggtctgctttgg

SEQ ID NO: 1424184 - DNA, 14 bp, Homo sapiens
agtcgtgatgtgga

SEQ ID NO: 1424185 - DNA, 17 bp, Homo sapiens
agtcgtgatgtggagga

SEQ ID NO: 1424186 - DNA, 17 bp, Homo sapiens
agtcgtggggtgtgctg

SEQ ID NO: 1424187 - DNA, 18 bp, Homo sapiens
agtcgtggggtgtgctgg

SEQ ID NO: 1424188 - DNA, 19 bp, Homo sapiens
agtcgtggggtgtgctggg

SEQ ID NO: 1424189 - DNA, 20 bp, Homo sapiens
agtcgtggggtgtgctggga

SEQ ID NO: 1424190 - DNA, 15 bp, Homo sapiens
agtcgttatatttga

SEQ ID NO: 1424191 - DNA, 23 bp, Homo sapiens
agtctaaagatggagtttctaag

SEQ ID NO: 1424192 - DNA, 16 bp, Homo sapiens
agtctaaatatttcct

SEQ ID NO: 1424193 - DNA, 23 bp, Homo sapiens
agtctaaatatttccttaaactg

SEQ ID NO: 1424194 - DNA, 23 bp, Homo sapiens
agtctaacaactgcccagtttcc

SEQ ID NO: 1424195 - DNA, 16 bp, Homo sapiens
agtctaagcaagatgt

SEQ ID NO: 1424196 - DNA, 24 bp, Homo sapiens
agtctagacacaatttcatttcca

SEQ ID NO: 1424197 - DNA, 14 bp, Homo sapiens
agtctagattcaaa

SEQ ID NO: 1424198 - DNA, 21 bp, Homo sapiens
agtctagattcaaaggttcta

SEQ ID NO: 1424199 - DNA, 22 bp, Homo sapiens
agtctagattcaaaggttctag

SEQ ID NO: 1424200 - DNA, 14 bp, Homo sapiens
agtctatcattgtt

SEQ ID NO: 1424201 - DNA, 10 bp, Homo sapiens
agtctatttt

SEQ ID NO: 1424202 - DNA, 11 bp, Homo sapiens
agtctatttta

SEQ ID NO: 1424203 - DNA, 13 bp, Homo sapiens
agtctcacagaga

SEQ ID NO: 1424204 - DNA, 15 bp, Homo sapiens
agtctcacagagaag

SEQ ID NO: 1424205 - DNA, 16 bp, Homo sapiens
agtctcacagagaagc

SEQ ID NO: 1424206 - DNA, 20 bp, Homo sapiens
agtctcacccattatctgga

SEQ ID NO: 1424207 - DNA, 18 bp, Homo sapiens
agtctcactgcttgaact

SEQ ID NO: 1424208 - DNA, 15 bp, Homo sapiens
agtctcagagaccag

SEQ ID NO: 1424209 - DNA, 13 bp, Homo sapiens
agtctcagagcac

SEQ ID NO: 1424210 - DNA, 16 bp, Homo sapiens
agtctcagagcacaga

SEQ ID NO: 1424211 - DNA, 11 bp, Homo sapiens
agtctcagcta

SEQ ID NO: 1424212 - DNA, 18 bp, Homo sapiens
agtctcagctaagctcac

SEQ ID NO: 1424213 - DNA, 13 bp, Homo sapiens
agtctcagctgct

SEQ ID NO: 1424214 - DNA, 14 bp, Homo sapiens
agtctcagctgctg

SEQ ID NO: 1424215 - DNA, 22 bp, Homo sapiens
agtctcaggaaatcaaatatgc

SEQ ID NO: 1424216 - DNA, 13 bp, Homo sapiens
agtctcaggagca

SEQ ID NO: 1424217 - DNA, 13 bp, Homo sapiens
agtctcccaggcc

SEQ ID NO: 1424218 - DNA, 19 bp, Homo sapiens
agtctcccaggccccctgc

SEQ ID NO: 1424219 - DNA, 23 bp, Homo sapiens
agtctcccaggccccctgcatct

SEQ ID NO: 1424220 - DNA, 13 bp, Homo sapiens
agtctcctctcca

SEQ ID NO: 1424221 - DNA, 15 bp, Homo sapiens
agtctcctctctgag

SEQ ID NO: 1424222 - DNA, 16 bp, Homo sapiens
agtctcctctctgaga

SEQ ID NO: 1424223 - DNA, 23 bp, Homo sapiens
agtctcctgtcttatggtccaga

SEQ ID NO: 1424224 - DNA, 14 bp, Homo sapiens
agtctccttcagca

SEQ ID NO: 1424225 - DNA, 16 bp, Homo sapiens
agtctccttcagcacg

SEQ ID NO: 1424226 - DNA, 14 bp, Homo sapiens
agtctcgaatgtaa

SEQ ID NO: 1424227 - DNA, 14 bp, Homo sapiens
agtctctaattcta

SEQ ID NO: 1424228 - DNA, 15 bp, Homo sapiens
agtctctctgcaaga

SEQ ID NO: 1424229 - DNA, 18 bp, Homo sapiens
agtctctcttctctccag

SEQ ID NO: 1424230 - DNA, 21 bp, Homo sapiens
agtctctcttctctccagctg

SEQ ID NO: 1424231 - DNA, 23 bp, Homo sapiens
agtctctcttctctccagctgac

SEQ ID NO: 1424232 - DNA, 13 bp, Homo sapiens
agtctctggaaaa

SEQ ID NO: 1424233 - DNA, 14 bp, Homo sapiens
agtctcttctccac

SEQ ID NO: 1424234 - DNA, 15 bp, Homo sapiens
agtctcttctccact

SEQ ID NO: 1424235 - DNA, 21 bp, Homo sapiens
agtctctttttttggcccagg

SEQ ID NO: 1424236 - DNA, 23 bp, Homo sapiens
agtctctttttttggcccaggcc

SEQ ID NO: 1424237 - DNA, 17 bp, Homo sapiens
agtctgagcccccggct

SEQ ID NO: 1424238 - DNA, 16 bp, Homo sapiens
agtctgagtcctgtct

SEQ ID NO: 1424239 - DNA, 20 bp, Homo sapiens
agtctgagtcctgtctctgc

SEQ ID NO: 1424240 - DNA, 15 bp, Homo sapiens
agtctgagtctgagt

SEQ ID NO: 1424241 - DNA, 20 bp, Homo sapiens
agtctgataaactgacgatt

SEQ ID NO: 1424242 - DNA, 22 bp, Homo sapiens
agtctgatccatatttaataat

SEQ ID NO: 1424243 - DNA, 15 bp, Homo sapiens
agtctggatctggga

SEQ ID NO: 1424244 - DNA, 14 bp, Homo sapiens
agtctgggctgccg

SEQ ID NO: 1424245 - DNA, 16 bp, Homo sapiens
agtctgggctgccggg

SEQ ID NO: 1424246 - DNA, 15 bp, Homo sapiens
agtctggtttctaga

SEQ ID NO: 1424247 - DNA, 13 bp, Homo sapiens
agtctgtcctgtg

SEQ ID NO: 1424248 - DNA, 13 bp, Homo sapiens
agtctgtctactg

SEQ ID NO: 1424249 - DNA, 20 bp, Homo sapiens
agtctgtctactgtggtgat

SEQ ID NO: 1424250 - DNA, 22 bp, Homo sapiens
agtgaatacttactataatttg

SEQ ID NO: 1424251 - DNA, 17 bp, Homo sapiens
agtgaatatttttgtat

SEQ ID NO: 1424252 - DNA, 15 bp, Homo sapiens
agtgaatgctgggac

SEQ ID NO: 1424253 - DNA, 19 bp, Homo sapiens
agtgaatgctgggactcag

SEQ ID NO: 1424254 - DNA, 22 bp, Homo sapiens
agtgaattgaatattgtaagtc

SEQ ID NO: 1424255 - DNA, 13 bp, Homo sapiens
agtgaattgtctt

SEQ ID NO: 1424256 - DNA, 20 bp, Homo sapiens
agtgaattgtcttttagaca

SEQ ID NO: 1424257 - DNA, 16 bp, Homo sapiens
agtgaatttttctcta

SEQ ID NO: 1424258 - DNA, 13 bp, Homo sapiens
agtgacacaatct

SEQ ID NO: 1424259 - DNA, 24 bp, Homo sapiens
agtgacacacctcacgcaggctga

SEQ ID NO: 1424260 - DNA, 13 bp, Homo sapiens
agtgacacagaca

SEQ ID NO: 1424261 - DNA, 14 bp, Homo sapiens
agtgacacagacat

SEQ ID NO: 1424262 - DNA, 17 bp, Homo sapiens
agtgacacagcagcttc

SEQ ID NO: 1424263 - DNA, 17 bp, Homo sapiens
agtgacacattaatgat

SEQ ID NO: 1424264 - DNA, 18 bp, Homo sapiens
agtgacagagacccagat

SEQ ID NO: 1424265 - DNA, 21 bp, Homo sapiens
agtgacagagcccagcatccc

SEQ ID NO: 1424266 - DNA, 19 bp, Homo sapiens
agtgacagagttcactata

SEQ ID NO: 1424267 - DNA, 20 bp, Homo sapiens
agtgacataatatattctat

SEQ ID NO: 1424268 - DNA, 15 bp, Homo sapiens
agtgacatagcctca

SEQ ID NO: 1424269 - DNA, 15 bp, Homo sapiens
agtgaccgagagaac

SEQ ID NO: 1424270 - DNA, 14 bp, Homo sapiens
agtgacctgtttat

SEQ ID NO: 1424271 - DNA, 15 bp, Homo sapiens
agtgactggcaggtg

SEQ ID NO: 1424272 - DNA, 17 bp, Homo sapiens
agtgactggcaggtgca

SEQ ID NO: 1424273 - DNA, 15 bp, Homo sapiens
agtgactgtatctgt

SEQ ID NO: 1424274 - DNA, 16 bp, Homo sapiens
agtgactgtatctgtg

SEQ ID NO: 1424275 - DNA, 18 bp, Homo sapiens
agtgactgtatctgtgta

SEQ ID NO: 1424276 - DNA, 20 bp, Homo sapiens
agtgactgtatctgtgtaga

SEQ ID NO: 1424277 - DNA, 15 bp, Homo sapiens
agtgacttcctgggg

SEQ ID NO: 1424278 - DNA, 12 bp, Homo sapiens
agtgacttctga

SEQ ID NO: 1424279 - DNA, 13 bp, Homo sapiens
agtgacttctgag

SEQ ID NO: 1424280 - DNA, 17 bp, Homo sapiens
agtgactttacaggagg

SEQ ID NO: 1424281 - DNA, 16 bp, Homo sapiens
agtgactttttctgag

SEQ ID NO: 1424282 - DNA, 20 bp, Homo sapiens
agtgactttttctgagcttt

SEQ ID NO: 1424283 - DNA, 16 bp, Homo sapiens
agtgagaccctgtctc

SEQ ID NO: 1424284 - DNA, 15 bp, Homo sapiens
agtgagactccatct

SEQ ID NO: 1424285 - DNA, 17 bp, Homo sapiens
agtgagcaagggggccc

SEQ ID NO: 1424286 - DNA, 20 bp, Homo sapiens
agtgagcacacccgtgtgca

SEQ ID NO: 1424287 - DNA, 15 bp, Homo sapiens
agtgagcagaacagg

SEQ ID NO: 1424288 - DNA, 16 bp, Homo sapiens
agtgagcagagatgta

SEQ ID NO: 1424289 - DNA, 22 bp, Homo sapiens
agtgagcatggaacacttcgag

SEQ ID NO: 1424290 - DNA, 20 bp, Homo sapiens
agtgagccaagatcgcacca

SEQ ID NO: 1424291 - DNA, 13 bp, Homo sapiens
agtgagccacaga

SEQ ID NO: 1424292 - DNA, 16 bp, Homo sapiens
agtgagccacagacca

SEQ ID NO: 1424293 - DNA, 19 bp, Homo sapiens
agtgagccgcatcttctcc

SEQ ID NO: 1424294 - DNA, 22 bp, Homo sapiens
agtgagccgcatcttctccatc

SEQ ID NO: 1424295 - DNA, 14 bp, Homo sapiens
agtgagctttgctg

SEQ ID NO: 1424296 - DNA, 21 bp, Homo sapiens
agtgaggaatagttgagcccc

SEQ ID NO: 1424297 - DNA, 15 bp, Homo sapiens
agtgaggagggatgt

SEQ ID NO: 1424298 - DNA, 18 bp, Homo sapiens
agtgaggagggtggagga

SEQ ID NO: 1424299 - DNA, 17 bp, Homo sapiens
agtgaggcttccaggct

SEQ ID NO: 1424300 - DNA, 19 bp, Homo sapiens
agtgaggcttccaggctct

SEQ ID NO: 1424301 - DNA, 22 bp, Homo sapiens
agtgagtacatgcacactcatg

SEQ ID NO: 1424302 - DNA, 22 bp, Homo sapiens
agtgagtatgcttgggccctgc

SEQ ID NO: 1424303 - DNA, 22 bp, Homo sapiens
ccctgacctccgcccctgcccc

SEQ ID NO: 1424304 - DNA, 15 bp, Homo sapiens
ccctgacttgcttta

SEQ ID NO: 1424305 - DNA, 22 bp, Homo sapiens
ccctgagaaacccaccagccta

SEQ ID NO: 1424306 - DNA, 15 bp, Homo sapiens
ccctgagactccaga

SEQ ID NO: 1424307 - DNA, 16 bp, Homo sapiens
ccctgagactccagaa

SEQ ID NO: 1424308 - DNA, 19 bp, Homo sapiens
ccctgagactccagaatct

SEQ ID NO: 1424309 - DNA, 21 bp, Homo sapiens
ccctgagagagaatagagctg

SEQ ID NO: 1424310 - DNA, 20 bp, Homo sapiens
ccctgagagtggtgccctgg

SEQ ID NO: 1424311 - DNA, 18 bp, Homo sapiens
ccctgagcaatgtctgtg

SEQ ID NO: 1424312 - DNA, 21 bp, Homo sapiens
ccctgagcagaatactggtct

SEQ ID NO: 1424313 - DNA, 22 bp, Homo sapiens
ccctgagcagggtccacagctg

SEQ ID NO: 1424314 - DNA, 23 bp, Homo sapiens
ccctgagcagggtccacagctgg

SEQ ID NO: 1424315 - DNA, 14 bp, Homo sapiens
ccctgagcccacca

SEQ ID NO: 1424316 - DNA, 15 bp, Homo sapiens
ccctgagcccagaga

SEQ ID NO: 1424317 - DNA, 18 bp, Homo sapiens
ccctgaggacctctcagc

SEQ ID NO: 1424318 - DNA, 13 bp, Homo sapiens
ccctgaggcagcc

SEQ ID NO: 1424319 - DNA, 17 bp, Homo sapiens
ccctgaggcagcccagc

SEQ ID NO: 1424320 - DNA, 15 bp, Homo sapiens
ccctgaggtcactgc

SEQ ID NO: 1424321 - DNA, 23 bp, Homo sapiens
ccctgaggtgtgggggctgcagc

SEQ ID NO: 1424322 - DNA, 22 bp, Homo sapiens
ccctgagtaatcgcttaaagat

SEQ ID NO: 1424323 - DNA, 16 bp, Homo sapiens
ccctgagtcaccagga

SEQ ID NO: 1424324 - DNA, 23 bp, Homo sapiens
ccctgagtgggctgggccctctg

SEQ ID NO: 1424325 - DNA, 21 bp, Homo sapiens
ccctgagtgtcccaagccggg

SEQ ID NO: 1424326 - DNA, 20 bp, Homo sapiens
ccctgagttcatccaggccc

SEQ ID NO: 1424327 - DNA, 18 bp, Homo sapiens
ccctgatcccaccccctc

SEQ ID NO: 1424328 - DNA, 18 bp, Homo sapiens
ccctgatcccattttcct

SEQ ID NO: 1424329 - DNA, 22 bp, Homo sapiens
ccctgatcccattttcctctga

SEQ ID NO: 1424330 - DNA, 15 bp, Homo sapiens
ccctgatgcagcctg

SEQ ID NO: 1424331 - DNA, 19 bp, Homo sapiens
ccctgatgcgtctacccag

SEQ ID NO: 1424332 - DNA, 13 bp, Homo sapiens
ccctgattcttga

SEQ ID NO: 1424333 - DNA, 18 bp, Homo sapiens
ccctgattgtgccagtgc

SEQ ID NO: 1424334 - DNA, 19 bp, Homo sapiens
ccctgcaacttccgctgag

SEQ ID NO: 1424335 - DNA, 21 bp, Homo sapiens
ccctgcaacttccgctgaggg

SEQ ID NO: 1424336 - DNA, 18 bp, Homo sapiens
ccctgcaagaccacggag

SEQ ID NO: 1424337 - DNA, 9 bp, Homo sapiens
ccctgcaat

SEQ ID NO: 1424338 - DNA, 13 bp, Homo sapiens
ccctgcacagcct

SEQ ID NO: 1424339 - DNA, 23 bp, Homo sapiens
ccctgcaccatgctgctggggaa

SEQ ID NO: 1424340 - DNA, 23 bp, Homo sapiens
ccctgcacccacccctgcccagg

SEQ ID NO: 1424341 - DNA, 13 bp, Homo sapiens
ccctgcacctgct

SEQ ID NO: 1424342 - DNA, 15 bp, Homo sapiens
ccctgcacctgctgc

SEQ ID NO: 1424343 - DNA, 14 bp, Homo sapiens
ccctgcacctggcc

SEQ ID NO: 1424344 - DNA, 22 bp, Homo sapiens
ccctgcactggagtccagtctc

SEQ ID NO: 1424345 - DNA, 15 bp, Homo sapiens
ccctgcagatgccac

SEQ ID NO: 1424346 - DNA, 14 bp, Homo sapiens
ccctgcagcccaaa

SEQ ID NO: 1424347 - DNA, 23 bp, Homo sapiens
ccctgcagcccaaaacccagggc

SEQ ID NO: 1424348 - DNA, 13 bp, Homo sapiens
ccctgcagggcca

SEQ ID NO: 1424349 - DNA, 21 bp, Homo sapiens
ccctgcagggcccttatggac

SEQ ID NO: 1424350 - DNA, 21 bp, Homo sapiens
ccctgcagtttggccctggag

SEQ ID NO: 1424351 - DNA, 24 bp, Homo sapiens
ccctgcagtttggccctggagcca

SEQ ID NO: 1424352 - DNA, 16 bp, Homo sapiens
ccctgcattggcctgg

SEQ ID NO: 1424353 - DNA, 17 bp, Homo sapiens
ccctgcattggcctggc

SEQ ID NO: 1424354 - DNA, 20 bp, Homo sapiens
ccctgcattggcctggcctc

SEQ ID NO: 1424355 - DNA, 18 bp, Homo sapiens
ccctgcattttcctcttg

SEQ ID NO: 1424356 - DNA, 14 bp, Homo sapiens
ccctgccacctccc

SEQ ID NO: 1424357 - DNA, 20 bp, Homo sapiens
ccctgccactcactaggccc

SEQ ID NO: 1424358 - DNA, 18 bp, Homo sapiens
ccctgccagttctctgtg

SEQ ID NO: 1424359 - DNA, 14 bp, Homo sapiens
ccctgccatcttcc

SEQ ID NO: 1424360 - DNA, 16 bp, Homo sapiens
ccctgccatcttccca

SEQ ID NO: 1424361 - DNA, 18 bp, Homo sapiens
ccctgccatcttcccagc

SEQ ID NO: 1424362 - DNA, 15 bp, Homo sapiens
ccctgcccagcccat

SEQ ID NO: 1424363 - DNA, 12 bp, Homo sapiens
ccctgcccaggc

SEQ ID NO: 1424364 - DNA, 20 bp, Homo sapiens
ccctgcccaggcagtctttg

SEQ ID NO: 1424365 - DNA, 22 bp, Homo sapiens
ccctgcccaggcagtctttgct

SEQ ID NO: 1424366 - DNA, 23 bp, Homo sapiens
ccctgccccaccccacctcacag

SEQ ID NO: 1424367 - DNA, 13 bp, Homo sapiens
ccctgcccccagg

SEQ ID NO: 1424368 - DNA, 18 bp, Homo sapiens
ccctgcccccaggactgg

SEQ ID NO: 1424369 - DNA, 16 bp, Homo sapiens
ccctgcccccatctcc

SEQ ID NO: 1424370 - DNA, 20 bp, Homo sapiens
ccctgcccccatctccccag

SEQ ID NO: 1424371 - DNA, 16 bp, Homo sapiens
ccctgccccccagcct

SEQ ID NO: 1424372 - DNA, 19 bp, Homo sapiens
ccctgccccctcgggggcc

SEQ ID NO: 1424373 - DNA, 22 bp, Homo sapiens
ccctgcccctacgggcgctgca

SEQ ID NO: 1424374 - DNA, 23 bp, Homo sapiens
ccctgcccctaggatgctgcagc

SEQ ID NO: 1424375 - DNA, 16 bp, Homo sapiens
ccctgcccctcatgcc

SEQ ID NO: 1424376 - DNA, 18 bp, Homo sapiens
ccctgcccctcccttcaa

SEQ ID NO: 1424377 - DNA, 19 bp, Homo sapiens
ccctgcccctcccttcaac

SEQ ID NO: 1424378 - DNA, 14 bp, Homo sapiens
ccctgccccttaac

SEQ ID NO: 1424379 - DNA, 21 bp, Homo sapiens
ccctgccctcccctgctccca

SEQ ID NO: 1424380 - DNA, 22 bp, Homo sapiens
ccctgccctcccctgctcccag

SEQ ID NO: 1424381 - DNA, 16 bp, Homo sapiens
ccctgccctcgtggcc

SEQ ID NO: 1424382 - DNA, 21 bp, Homo sapiens
ccctgccctcgtggccagccc

SEQ ID NO: 1424383 - DNA, 22 bp, Homo sapiens
ccctgccctgggcgagcccctc

SEQ ID NO: 1424384 - DNA, 23 bp, Homo sapiens
ccctgccctgggcgagcccctcc

SEQ ID NO: 1424385 - DNA, 15 bp, Homo sapiens
ccctgccctggtcca

SEQ ID NO: 1424386 - DNA, 17 bp, Homo sapiens
ccctgccgaacacacat

SEQ ID NO: 1424387 - DNA, 18 bp, Homo sapiens
ccctgccgaacacacatc

SEQ ID NO: 1424388 - DNA, 22 bp, Homo sapiens
ccctgccgaacacacatcccag

SEQ ID NO: 1424389 - DNA, 21 bp, Homo sapiens
ccctgccggtgcacaggcctc

SEQ ID NO: 1424390 - DNA, 22 bp, Homo sapiens
ccctgccggtgcacaggcctct

SEQ ID NO: 1424391 - DNA, 13 bp, Homo sapiens
ccctgcctcctgc

SEQ ID NO: 1424392 - DNA, 14 bp, Homo sapiens
ccctgcctcctgcc

SEQ ID NO: 1424393 - DNA, 15 bp, Homo sapiens
ccctgcctcctgcca

SEQ ID NO: 1424394 - DNA, 12 bp, Homo sapiens
ccctgcctctca

SEQ ID NO: 1424395 - DNA, 22 bp, Homo sapiens
ccctgcctctcatcaactgaat

SEQ ID NO: 1424396 - DNA, 13 bp, Homo sapiens
ccctgcctctgtg

SEQ ID NO: 1424397 - DNA, 14 bp, Homo sapiens
ccctgcctctgtgt

SEQ ID NO: 1424398 - DNA, 16 bp, Homo sapiens
ccctgcctgaggagga

SEQ ID NO: 1424399 - DNA, 19 bp, Homo sapiens
ccctgcctgagggcccctc

SEQ ID NO: 1424400 - DNA, 11 bp, Homo sapiens
ccctgcctgcc

SEQ ID NO: 1424401 - DNA, 17 bp, Homo sapiens
ccctgcctggcccccaa

SEQ ID NO: 1424402 - DNA, 22 bp, Homo sapiens
ccctgccttatcttgcacccca

SEQ ID NO: 1424403 - DNA, 20 bp, Homo sapiens
ccctgccttgctgacaataa

SEQ ID NO: 1424404 - DNA, 13 bp, Homo sapiens
ccctgcgcctcca

SEQ ID NO: 1424405 - DNA, 15 bp, Homo sapiens
ccctgcgcctccaga

SEQ ID NO: 1424406 - DNA, 12 bp, Homo sapiens
ccctgcggagcc

SEQ ID NO: 1424407 - DNA, 13 bp, Homo sapiens
ccctgcggcctcc

SEQ ID NO: 1424408 - DNA, 18 bp, Homo sapiens
ccctgcgggcgcgggcag

SEQ ID NO: 1424409 - DNA, 21 bp, Homo sapiens
ccctgcgggcgcgggcagcca

SEQ ID NO: 1424410 - DNA, 22 bp, Homo sapiens
ccctgcgtgggggccagtcagg

SEQ ID NO: 1424411 - DNA, 16 bp, Homo sapiens
ccctgcgttggagcca

SEQ ID NO: 1424412 - DNA, 17 bp, Homo sapiens
ccctgcgttggagccac

SEQ ID NO: 1424413 - DNA, 18 bp, Homo sapiens
ccctgcgttggagccact

SEQ ID NO: 1424414 - DNA, 19 bp, Homo sapiens
ccctgcgttggagccactc

SEQ ID NO: 1424415 - DNA, 11 bp, Homo sapiens
ccctgctacct

SEQ ID NO: 1424416 - DNA, 16 bp, Homo sapiens
ccctgctcagtaaagc

SEQ ID NO: 1424417 - DNA, 17 bp, Homo sapiens
ccctgctccaccagcag

SEQ ID NO: 1424418 - DNA, 23 bp, Homo sapiens
ccctgctcccaccaccagtgaga

SEQ ID NO: 1424419 - DNA, 14 bp, Homo sapiens
ccctgctcccaggt

SEQ ID NO: 1424420 - DNA, 21 bp, Homo sapiens
ccctgctcccattcctccctc

SEQ ID NO: 1424421 - DNA, 18 bp, Homo sapiens
ccctgctcctccctggct

SEQ ID NO: 1424422 - DNA, 18 bp, Homo sapiens
ccctgctgaagctgctgc

SEQ ID NO: 1424423 - DNA, 21 bp, Homo sapiens
ccctgctgaagctgctgcagc

SEQ ID NO: 1424424 - DNA, 13 bp, Homo sapiens
ccctgctgaatgc

SEQ ID NO: 1424425 - DNA, 17 bp, Homo sapiens
ccctgctgaatgcctcg

SEQ ID NO: 1424426 - DNA, 13 bp, Homo sapiens
ccctgctgccatg

SEQ ID NO: 1424427 - DNA, 19 bp, Homo sapiens
ccctgctgctggtgcacag

SEQ ID NO: 1424428 - DNA, 14 bp, Homo sapiens
ccctgctgtctctc

SEQ ID NO: 1424429 - DNA, 22 bp, Homo sapiens
ccctgctgtctctctgggctgc

SEQ ID NO: 1424430 - DNA, 20 bp, Homo sapiens
ccctgctgtgccatgctggg

SEQ ID NO: 1424431 - DNA, 13 bp, Homo sapiens
ccctgctgtggga

SEQ ID NO: 1424432 - DNA, 14 bp, Homo sapiens
ccctgctgtgggag

SEQ ID NO: 1424433 - DNA, 14 bp, Homo sapiens
ccctgctgtttatc

SEQ ID NO: 1424434 - DNA, 19 bp, Homo sapiens
ccctgcttcctgcttgcca

SEQ ID NO: 1424435 - DNA, 15 bp, Homo sapiens
ccctgcttctgctgc

SEQ ID NO: 1424436 - DNA, 20 bp, Homo sapiens
ccctgctttgggctgccctg

SEQ ID NO: 1424437 - DNA, 16 bp, Homo sapiens
ccctgctttttttctt

SEQ ID NO: 1424438 - DNA, 18 bp, Homo sapiens
ccctgctttttttcttaa

SEQ ID NO: 1424439 - DNA, 17 bp, Homo sapiens
ccctggaaaacagacgg

SEQ ID NO: 1424440 - DNA, 16 bp, Homo sapiens
ccctggaagagcccag

SEQ ID NO: 1424441 - DNA, 17 bp, Homo sapiens
ccctggaagctggaaga

SEQ ID NO: 1424442 - DNA, 18 bp, Homo sapiens
ccctggaagctggaagac

SEQ ID NO: 1424443 - DNA, 20 bp, Homo sapiens
ccctggaattcagcaccctg

SEQ ID NO: 1424444 - DNA, 22 bp, Homo sapiens
ccctggaattcagcaccctggg

SEQ ID NO: 1424445 - DNA, 17 bp, Homo sapiens
ccctggacacagctctt

SEQ ID NO: 1424446 - DNA, 18 bp, Homo sapiens
ccctggacacagctcttc

SEQ ID NO: 1424447 - DNA, 20 bp, Homo sapiens
ccctggacacagctcttcat

SEQ ID NO: 1424448 - DNA, 10 bp, Homo sapiens
ccctggacag

SEQ ID NO: 1424449 - DNA, 17 bp, Homo sapiens
ccctggaccaccagccc

SEQ ID NO: 1424450 - DNA, 16 bp, Homo sapiens
ccctggaccagcctcc

SEQ ID NO: 1424451 - DNA, 18 bp, Homo sapiens
ccctggagaccacactgc

SEQ ID NO: 1424452 - DNA, 15 bp, Homo sapiens
ccctggagccagggc

SEQ ID NO: 1424453 - DNA, 16 bp, Homo sapiens
ccctggagccagggca

SEQ ID NO: 1424454 - DNA, 18 bp, Homo sapiens
ccctggagccagggcaga

SEQ ID NO: 1424455 - DNA, 21 bp, Homo sapiens
ccctggagccagggcagagga

SEQ ID NO: 1424456 - DNA, 22 bp, Homo sapiens
ccctggagccagggcagaggaa

SEQ ID NO: 1424457 - DNA, 12 bp, Homo sapiens
ccctggagccat

SEQ ID NO: 1424458 - DNA, 18 bp, Homo sapiens
ccctggagcctccactgc

SEQ ID NO: 1424459 - DNA, 23 bp, Homo sapiens
ccctggatcagtcctttgatcag

SEQ ID NO: 1424460 - DNA, 17 bp, Homo sapiens
ccctggatgggcattgg

SEQ ID NO: 1424461 - DNA, 21 bp, Homo sapiens
ccctggatgggcattgggctg

SEQ ID NO: 1424462 - DNA, 18 bp, Homo sapiens
ccctggatgtcccctgtc

SEQ ID NO: 1424463 - DNA, 15 bp, Homo sapiens
ccctggcagcagcag

SEQ ID NO: 1424464 - DNA, 16 bp, Homo sapiens
ccctggcagcagcagg

SEQ ID NO: 1424465 - DNA, 13 bp, Homo sapiens
ccctggcagtgct

SEQ ID NO: 1424466 - DNA, 12 bp, Homo sapiens
ccctggccacca

SEQ ID NO: 1424467 - DNA, 18 bp, Homo sapiens
ccctggccactaaagctt

SEQ ID NO: 1424468 - DNA, 21 bp, Homo sapiens
ccctggccactaaagcttcag

SEQ ID NO: 1424469 - DNA, 15 bp, Homo sapiens
ccctggccagctctg

SEQ ID NO: 1424470 - DNA, 21 bp, Homo sapiens
ccctggcccagcggcccctcc

SEQ ID NO: 1424471 - DNA, 18 bp, Homo sapiens
ccctggccccgcctgcct

SEQ ID NO: 1424472 - DNA, 15 bp, Homo sapiens
ccctggccctgccca

SEQ ID NO: 1424473 - DNA, 17 bp, Homo sapiens
ccctggccctgcccagc

SEQ ID NO: 1424474 - DNA, 21 bp, Homo sapiens
ccctggcctcagttcccagct

SEQ ID NO: 1424475 - DNA, 22 bp, Homo sapiens
ccctggcctcagttcccagctc

SEQ ID NO: 1424476 - DNA, 13 bp, Homo sapiens
ccctggcctctgt

SEQ ID NO: 1424477 - DNA, 14 bp, Homo sapiens
ccctggcctgctgg

SEQ ID NO: 1424478 - DNA, 21 bp, Homo sapiens
ccctggcctgctgggctctcc

SEQ ID NO: 1424479 - DNA, 16 bp, Homo sapiens
ccctggctacttccct

SEQ ID NO: 1424480 - DNA, 13 bp, Homo sapiens
ccctggctcccat

SEQ ID NO: 1424481 - DNA, 15 bp, Homo sapiens
ccctggctcccatga

SEQ ID NO: 1424482 - DNA, 15 bp, Homo sapiens
ccctggctccctcct

SEQ ID NO: 1424483 - DNA, 23 bp, Homo sapiens
ccctggctccctcctccaggcct

SEQ ID NO: 1424484 - DNA, 14 bp, Homo sapiens
ccctggctctgggc

SEQ ID NO: 1424485 - DNA, 15 bp, Homo sapiens
ccctggctgccctgg

SEQ ID NO: 1424486 - DNA, 20 bp, Homo sapiens
ccctggctgccctggccctg

SEQ ID NO: 1424487 - DNA, 22 bp, Homo sapiens
ccctggctgccctggccctgag

SEQ ID NO: 1424488 - DNA, 23 bp, Homo sapiens
ccctggcttgtaactccaccaac

SEQ ID NO: 1424489 - DNA, 13 bp, Homo sapiens
ccctggctttgcc

SEQ ID NO: 1424490 - DNA, 14 bp, Homo sapiens
ccctggctttgcct

SEQ ID NO: 1424491 - DNA, 15 bp, Homo sapiens
ccctggctttgcctc

SEQ ID NO: 1424492 - DNA, 19 bp, Homo sapiens
ccctggctttgcctcttct

SEQ ID NO: 1424493 - DNA, 16 bp, Homo sapiens
ccctgggaaggctaag

SEQ ID NO: 1424494 - DNA, 19 bp, Homo sapiens
ccctgggcaaacagagcta

SEQ ID NO: 1424495 - DNA, 22 bp, Homo sapiens
ccctgggccccaccacctaggc

SEQ ID NO: 1424496 - DNA, 13 bp, Homo sapiens
ccctgggccctgg

SEQ ID NO: 1424497 - DNA, 19 bp, Homo sapiens
ccctgggccctgggctgga

SEQ ID NO: 1424498 - DNA, 21 bp, Homo sapiens
ccctgggcgagcccctccttc

SEQ ID NO: 1424499 - DNA, 23 bp, Homo sapiens
ccctgggcgagcccctccttctc

SEQ ID NO: 1424500 - DNA, 20 bp, Homo sapiens
ccctgggctaccatctgcat

SEQ ID NO: 1424501 - DNA, 14 bp, Homo sapiens
ccctgggctccaca

SEQ ID NO: 1424502 - DNA, 15 bp, Homo sapiens
ccctgggctccacac

SEQ ID NO: 1424503 - DNA, 18 bp, Homo sapiens
ccctgggctccacacagc

SEQ ID NO: 1424504 - DNA, 21 bp, Homo sapiens
ccctgggctccacacagcagt

SEQ ID NO: 1424505 - DNA, 17 bp, Homo sapiens
ccctgggctctcaccca

SEQ ID NO: 1424506 - DNA, 13 bp, Homo sapiens
ccctgggctctgc

SEQ ID NO: 1424507 - DNA, 14 bp, Homo sapiens
ccctgggctgggga

SEQ ID NO: 1424508 - DNA, 18 bp, Homo sapiens
ccctgggctggggaggag

SEQ ID NO: 1424509 - DNA, 19 bp, Homo sapiens
ccctgggcttggcctgctg

SEQ ID NO: 1424510 - DNA, 20 bp, Homo sapiens
ccctggggatcttcccacag

SEQ ID NO: 1424511 - DNA, 14 bp, Homo sapiens
ccctggggcctgac

SEQ ID NO: 1424512 - DNA, 14 bp, Homo sapiens
ccctggggctgagt

SEQ ID NO: 1424513 - DNA, 19 bp, Homo sapiens
ccctggggctgagtctcca

SEQ ID NO: 1424514 - DNA, 21 bp, Homo sapiens
ccctggggctgagtctccagg

SEQ ID NO: 1424515 - DNA, 21 bp, Homo sapiens
ccctggggctgatctcaggga

SEQ ID NO: 1424516 - DNA, 19 bp, Homo sapiens
ccctgggggaagccctgga

SEQ ID NO: 1424517 - DNA, 22 bp, Homo sapiens
ccctggggtggcgtctgcctag

SEQ ID NO: 1424518 - DNA, 24 bp, Homo sapiens
ccctggggtggcgtctgcctagga

SEQ ID NO: 1424519 - DNA, 21 bp, Homo sapiens
ccctggggtgggatctgagct

SEQ ID NO: 1424520 - DNA, 22 bp, Homo sapiens
ccctggggtgggatctgagctc

SEQ ID NO: 1424521 - DNA, 18 bp, Homo sapiens
ccctgggtaccctgagcc

SEQ ID NO: 1424522 - DNA, 20 bp, Homo sapiens
ccctgggtcttgccatgtgc

SEQ ID NO: 1424523 - DNA, 18 bp, Homo sapiens
ccctgggtgggctctgtg

SEQ ID NO: 1424524 - DNA, 22 bp, Homo sapiens
ccctgggtgggtggtggggagg

SEQ ID NO: 1424525 - DNA, 20 bp, Homo sapiens
ccctgggtgtccccgctgct

SEQ ID NO: 1424526 - DNA, 23 bp, Homo sapiens
ccctgggtgtccccgctgctgtg

SEQ ID NO: 1424527 - DNA, 17 bp, Homo sapiens
ccctgggttaacaaatg

SEQ ID NO: 1424528 - DNA, 22 bp, Homo sapiens
ccctggtcacccgactttggaa

SEQ ID NO: 1424529 - DNA, 18 bp, Homo sapiens
ccctggtccagggaagct

SEQ ID NO: 1424530 - DNA, 18 bp, Homo sapiens
ccctggtcctggcctcct

SEQ ID NO: 1424531 - DNA, 13 bp, Homo sapiens
ccctggtccttca

SEQ ID NO: 1424532 - DNA, 15 bp, Homo sapiens
ccctggtccttcact

SEQ ID NO: 1424533 - DNA, 17 bp, Homo sapiens
ccctggtccttccaggc

SEQ ID NO: 1424534 - DNA, 21 bp, Homo sapiens
ccctggtgctgccacacttca

SEQ ID NO: 1424535 - DNA, 14 bp, Homo sapiens
aatgttttgtacaa

SEQ ID NO: 1424536 - DNA, 18 bp, Homo sapiens
aatgttttgtacaattac

SEQ ID NO: 1424537 - DNA, 22 bp, Homo sapiens
aatgtttttaagatgatcatct

SEQ ID NO: 1424538 - DNA, 16 bp, Homo sapiens
aattaaaaaaaaattg

SEQ ID NO: 1424539 - DNA, 17 bp, Homo sapiens
aattaaaaaaaaattgt

SEQ ID NO: 1424540 - DNA, 17 bp, Homo sapiens
aattaaaaaatgaaatt

SEQ ID NO: 1424541 - DNA, 19 bp, Homo sapiens
aattaaaacaaatatacat

SEQ ID NO: 1424542 - DNA, 21 bp, Homo sapiens
aattaaaagcaaatcatttgt

SEQ ID NO: 1424543 - DNA, 16 bp, Homo sapiens
aattaaaagtcttttt

SEQ ID NO: 1424544 - DNA, 16 bp, Homo sapiens
aattaaacttccaaag

SEQ ID NO: 1424545 - DNA, 21 bp, Homo sapiens
aattaaacttccaaagaaagt

SEQ ID NO: 1424546 - DNA, 22 bp, Homo sapiens
aattaaacttccaaagaaagtt

SEQ ID NO: 1424547 - DNA, 14 bp, Homo sapiens
aattaaacttttaa

SEQ ID NO: 1424548 - DNA, 19 bp, Homo sapiens
aattaaacttttaattcat

SEQ ID NO: 1424549 - DNA, 21 bp, Homo sapiens
aattaaatccaactttcacag

SEQ ID NO: 1424550 - DNA, 14 bp, Homo sapiens
aattaaattgggct

SEQ ID NO: 1424551 - DNA, 21 bp, Homo sapiens
aattaaattgggcttcaatca

SEQ ID NO: 1424552 - DNA, 23 bp, Homo sapiens
aattaaattgggcttcaatcact

SEQ ID NO: 1424553 - DNA, 14 bp, Homo sapiens
aattaaattttaat

SEQ ID NO: 1424554 - DNA, 17 bp, Homo sapiens
aattaaattttgtgtct

SEQ ID NO: 1424555 - DNA, 20 bp, Homo sapiens
aattaagaaatactcatgtg

SEQ ID NO: 1424556 - DNA, 19 bp, Homo sapiens
aattaagattctctgccca

SEQ ID NO: 1424557 - DNA, 22 bp, Homo sapiens
aattaagcaaatgttaaaagtt

SEQ ID NO: 1424558 - DNA, 19 bp, Homo sapiens
aattaagccctaaggtcct

SEQ ID NO: 1424559 - DNA, 22 bp, Homo sapiens
aattaagccctaaggtcctaag

SEQ ID NO: 1424560 - DNA, 16 bp, Homo sapiens
aattaaggcataagaa

SEQ ID NO: 1424561 - DNA, 13 bp, Homo sapiens
aattaagtactat

SEQ ID NO: 1424562 - DNA, 13 bp, Homo sapiens
aattaagtagaac

SEQ ID NO: 1424563 - DNA, 15 bp, Homo sapiens
aattaagtatatata

SEQ ID NO: 1424564 - DNA, 16 bp, Homo sapiens
aattaagtatatatat

SEQ ID NO: 1424565 - DNA, 14 bp, Homo sapiens
aattaagttatctt

SEQ ID NO: 1424566 - DNA, 14 bp, Homo sapiens
aattaagttgaaaa

SEQ ID NO: 1424567 - DNA, 20 bp, Homo sapiens
aattaatagtttgtctattt

SEQ ID NO: 1424568 - DNA, 22 bp, Homo sapiens
aattaatagtttgtctatttta

SEQ ID NO: 1424569 - DNA, 17 bp, Homo sapiens
aattaatatattaaaat

SEQ ID NO: 1424570 - DNA, 19 bp, Homo sapiens
aattaatatattaaaattc

SEQ ID NO: 1424571 - DNA, 16 bp, Homo sapiens
aattaatcatgaatgt

SEQ ID NO: 1424572 - DNA, 16 bp, Homo sapiens
aattaatcttgcttca

SEQ ID NO: 1424573 - DNA, 13 bp, Homo sapiens
aattaatgacaga

SEQ ID NO: 1424574 - DNA, 19 bp, Homo sapiens
aattaatgcagatttctct

SEQ ID NO: 1424575 - DNA, 15 bp, Homo sapiens
aattaattgaatcta

SEQ ID NO: 1424576 - DNA, 12 bp, Homo sapiens
aattaattgtaa

SEQ ID NO: 1424577 - DNA, 15 bp, Homo sapiens
aattaattgtcatta

SEQ ID NO: 1424578 - DNA, 13 bp, Homo sapiens
aattaatttggag

SEQ ID NO: 1424579 - DNA, 23 bp, Homo sapiens
aattacaattgtcatttataaaa

SEQ ID NO: 1424580 - DNA, 14 bp, Homo sapiens
aattacaattttat

SEQ ID NO: 1424581 - DNA, 18 bp, Homo sapiens
aattacagattaaaaaaa

SEQ ID NO: 1424582 - DNA, 17 bp, Homo sapiens
aattacatgtaaaacat

SEQ ID NO: 1424583 - DNA, 16 bp, Homo sapiens
aattacatgttaatga

SEQ ID NO: 1424584 - DNA, 14 bp, Homo sapiens
aattacattcctaa

SEQ ID NO: 1424585 - DNA, 23 bp, Homo sapiens
aattacattcctaactagaatta

SEQ ID NO: 1424586 - DNA, 12 bp, Homo sapiens
aattacatttgt

SEQ ID NO: 1424587 - DNA, 18 bp, Homo sapiens
aattacatttgtaattta

SEQ ID NO: 1424588 - DNA, 21 bp, Homo sapiens
aattaccatgcttcacaatgt

SEQ ID NO: 1424589 - DNA, 13 bp, Homo sapiens
aattaccattaat

SEQ ID NO: 1424590 - DNA, 18 bp, Homo sapiens
aattaccattaattacat

SEQ ID NO: 1424591 - DNA, 22 bp, Homo sapiens
aattaccattaattacatacag

SEQ ID NO: 1424592 - DNA, 16 bp, Homo sapiens
aattacccataaacag

SEQ ID NO: 1424593 - DNA, 18 bp, Homo sapiens
aattacccataaacagca

SEQ ID NO: 1424594 - DNA, 21 bp, Homo sapiens
aattaccttgagccagtaatt

SEQ ID NO: 1424595 - DNA, 16 bp, Homo sapiens
aattacctttaatttt

SEQ ID NO: 1424596 - DNA, 17 bp, Homo sapiens
aattacctttaatttta

SEQ ID NO: 1424597 - DNA, 20 bp, Homo sapiens
aattacctttaattttaatg

SEQ ID NO: 1424598 - DNA, 16 bp, Homo sapiens
aattactacaaaattt

SEQ ID NO: 1424599 - DNA, 13 bp, Homo sapiens
aattactataaag

SEQ ID NO: 1424600 - DNA, 13 bp, Homo sapiens
aattactatctgt

SEQ ID NO: 1424601 - DNA, 18 bp, Homo sapiens
aattactatctgttgaaa

SEQ ID NO: 1424602 - DNA, 16 bp, Homo sapiens
aattactgccttgaaa

SEQ ID NO: 1424603 - DNA, 21 bp, Homo sapiens
aattactggaattcttctgca

SEQ ID NO: 1424604 - DNA, 14 bp, Homo sapiens
aattactggtccaa

SEQ ID NO: 1424605 - DNA, 20 bp, Homo sapiens
aattactgtatataaactcc

SEQ ID NO: 1424606 - DNA, 21 bp, Homo sapiens
aattacttgtgttacttgcca

SEQ ID NO: 1424607 - DNA, 14 bp, Homo sapiens
aattactttcagaa

SEQ ID NO: 1424608 - DNA, 15 bp, Homo sapiens
aattactttcagaat

SEQ ID NO: 1424609 - DNA, 22 bp, Homo sapiens
aattactttggggctaatttaa

SEQ ID NO: 1424610 - DNA, 14 bp, Homo sapiens
aattacttttaaat

SEQ ID NO: 1424611 - DNA, 18 bp, Homo sapiens
aattagaacccttgcaca

SEQ ID NO: 1424612 - DNA, 13 bp, Homo sapiens
aattagaagacat

SEQ ID NO: 1424613 - DNA, 19 bp, Homo sapiens
aattagagatcatgaatta

SEQ ID NO: 1424614 - DNA, 13 bp, Homo sapiens
aattagatttgtg

SEQ ID NO: 1424615 - DNA, 23 bp, Homo sapiens
aattagcatgctgctttttgtac

SEQ ID NO: 1424616 - DNA, 16 bp, Homo sapiens
aattagctgtgtgaaa

SEQ ID NO: 1424617 - DNA, 21 bp, Homo sapiens
aattaggaagtgtaacagctg

SEQ ID NO: 1424618 - DNA, 22 bp, Homo sapiens
aattaggaagtgtaacagctga

SEQ ID NO: 1424619 - DNA, 15 bp, Homo sapiens
aattaggctgtaact

SEQ ID NO: 1424620 - DNA, 16 bp, Homo sapiens
aattaggctgtaacta

SEQ ID NO: 1424621 - DNA, 15 bp, Homo sapiens
aattaggtagcacag

SEQ ID NO: 1424622 - DNA, 13 bp, Homo sapiens
aattagtgaacca

SEQ ID NO: 1424623 - DNA, 17 bp, Homo sapiens
aattagtggtcataaaa

SEQ ID NO: 1424624 - DNA, 23 bp, Homo sapiens
aattataacagttatatttttgt

SEQ ID NO: 1424625 - DNA, 20 bp, Homo sapiens
aattataactgtaaagatgt

SEQ ID NO: 1424626 - DNA, 15 bp, Homo sapiens
aattatagtttctga

SEQ ID NO: 1424627 - DNA, 16 bp, Homo sapiens
aattatataaatcatt

SEQ ID NO: 1424628 - DNA, 19 bp, Homo sapiens
aattatataactgtatttg

SEQ ID NO: 1424629 - DNA, 13 bp, Homo sapiens
aattatataattt

SEQ ID NO: 1424630 - DNA, 17 bp, Homo sapiens
aattatatatttctaac

SEQ ID NO: 1424631 - DNA, 16 bp, Homo sapiens
aattatattcaatgca

SEQ ID NO: 1424632 - DNA, 19 bp, Homo sapiens
aattatattcaatgcattt

SEQ ID NO: 1424633 - DNA, 13 bp, Homo sapiens
aattatattgtta

SEQ ID NO: 1424634 - DNA, 21 bp, Homo sapiens
aattatattgttagtggactt

SEQ ID NO: 1424635 - DNA, 23 bp, Homo sapiens
aattatattttgttgctttctta

SEQ ID NO: 1424636 - DNA, 13 bp, Homo sapiens
aattatcagcaaa

SEQ ID NO: 1424637 - DNA, 19 bp, Homo sapiens
aattatcatcccaacagcc

SEQ ID NO: 1424638 - DNA, 20 bp, Homo sapiens
aattatgaaactaatcttaa

SEQ ID NO: 1424639 - DNA, 17 bp, Homo sapiens
aattatgagattggttt

SEQ ID NO: 1424640 - DNA, 12 bp, Homo sapiens
aattatgatgtc

SEQ ID NO: 1424641 - DNA, 15 bp, Homo sapiens
aattatgcaaaagca

SEQ ID NO: 1424642 - DNA, 20 bp, Homo sapiens
aattatgtaatatattgtac

SEQ ID NO: 1424643 - DNA, 14 bp, Homo sapiens
aattattagcattt

SEQ ID NO: 1424644 - DNA, 21 bp, Homo sapiens
aattattagcatttgttttag

SEQ ID NO: 1424645 - DNA, 21 bp, Homo sapiens
aattattatttatatatgtat

SEQ ID NO: 1424646 - DNA, 16 bp, Homo sapiens
aattattatttgtgtt

SEQ ID NO: 1424647 - DNA, 23 bp, Homo sapiens
aattattattttaaaatatatga

SEQ ID NO: 1424648 - DNA, 19 bp, Homo sapiens
aattattctagtcaactgc

SEQ ID NO: 1424649 - DNA, 17 bp, Homo sapiens
aattattctgattcttt

SEQ ID NO: 1424650 - DNA, 16 bp, Homo sapiens
aattattgacactgaa

SEQ ID NO: 1424651 - DNA, 17 bp, Homo sapiens
aattattgacactgaac

SEQ ID NO: 1424652 - DNA, 21 bp, Homo sapiens
ccaggggcagccacaccactg

SEQ ID NO: 1424653 - DNA, 21 bp, Homo sapiens
ccaggggcatgtattggcctg

SEQ ID NO: 1424654 - DNA, 23 bp, Homo sapiens
ccaggggcatgtattggcctgga

SEQ ID NO: 1424655 - DNA, 15 bp, Homo sapiens
ccaggggcctgcaga

SEQ ID NO: 1424656 - DNA, 21 bp, Homo sapiens
ccaggggcctgcagaaggaaa

SEQ ID NO: 1424657 - DNA, 14 bp, Homo sapiens
ccaggggcgaggcc

SEQ ID NO: 1424658 - DNA, 21 bp, Homo sapiens
ccaggggctgcttcctcctgg

SEQ ID NO: 1424659 - DNA, 13 bp, Homo sapiens
ccagggggcccga

SEQ ID NO: 1424660 - DNA, 17 bp, Homo sapiens
ccaggggggtgaggagc

SEQ ID NO: 1424661 - DNA, 19 bp, Homo sapiens
ccaggggggtgaggagctg

SEQ ID NO: 1424662 - DNA, 20 bp, Homo sapiens
ccaggggggtgaggagctgg

SEQ ID NO: 1424663 - DNA, 18 bp, Homo sapiens
ccagggggtctcacccat

SEQ ID NO: 1424664 - DNA, 14 bp, Homo sapiens
ccaggggtcccagc

SEQ ID NO: 1424665 - DNA, 14 bp, Homo sapiens
ccaggggtctccct

SEQ ID NO: 1424666 - DNA, 17 bp, Homo sapiens
ccagggtagaattgttt

SEQ ID NO: 1424667 - DNA, 14 bp, Homo sapiens
ccagggtcaggcgg

SEQ ID NO: 1424668 - DNA, 16 bp, Homo sapiens
ccagggtccctctgtg

SEQ ID NO: 1424669 - DNA, 17 bp, Homo sapiens
ccagggtccctctgtgt

SEQ ID NO: 1424670 - DNA, 21 bp, Homo sapiens
ccagggtccgcaccagctgct

SEQ ID NO: 1424671 - DNA, 15 bp, Homo sapiens
ccagggtcctctagc

SEQ ID NO: 1424672 - DNA, 18 bp, Homo sapiens
ccagggtcctctagccca

SEQ ID NO: 1424673 - DNA, 16 bp, Homo sapiens
ccagggtcctgtgcct

SEQ ID NO: 1424674 - DNA, 14 bp, Homo sapiens
ccagggtcttgggc

SEQ ID NO: 1424675 - DNA, 18 bp, Homo sapiens
ccagggtgggaagagaag

SEQ ID NO: 1424676 - DNA, 22 bp, Homo sapiens
ccagggtgtttgcagctgtgag

SEQ ID NO: 1424677 - DNA, 21 bp, Homo sapiens
ccagggttttgccccaagtcc

SEQ ID NO: 1424678 - DNA, 18 bp, Homo sapiens
ccaggtacaggagaggca

SEQ ID NO: 1424679 - DNA, 23 bp, Homo sapiens
ccaggtacaggagaggcagcatg

SEQ ID NO: 1424680 - DNA, 18 bp, Homo sapiens
ccaggtaccagctgcgct

SEQ ID NO: 1424681 - DNA, 14 bp, Homo sapiens
ccaggtagaaactt

SEQ ID NO: 1424682 - DNA, 14 bp, Homo sapiens
ccaggtcagcctgg

SEQ ID NO: 1424683 - DNA, 18 bp, Homo sapiens
ccaggtcagcctggaagg

SEQ ID NO: 1424684 - DNA, 22 bp, Homo sapiens
ccaggtcaggatgcacatttct

SEQ ID NO: 1424685 - DNA, 23 bp, Homo sapiens
ccaggtcaggatgcacatttctg

SEQ ID NO: 1424686 - DNA, 16 bp, Homo sapiens
ccaggtccagctctgg

SEQ ID NO: 1424687 - DNA, 17 bp, Homo sapiens
ccaggtccagctctgga

SEQ ID NO: 1424688 - DNA, 14 bp, Homo sapiens
ccaggtccttcctt

SEQ ID NO: 1424689 - DNA, 19 bp, Homo sapiens
ccaggtcctttctcctgat

SEQ ID NO: 1424690 - DNA, 18 bp, Homo sapiens
ccaggtctctccactgct

SEQ ID NO: 1424691 - DNA, 23 bp, Homo sapiens
ccaggtcttgactcatggcagct

SEQ ID NO: 1424692 - DNA, 14 bp, Homo sapiens
ccaggtgcagacct

SEQ ID NO: 1424693 - DNA, 14 bp, Homo sapiens
ccaggtgcagaggt

SEQ ID NO: 1424694 - DNA, 22 bp, Homo sapiens
ccaggtgcagtggctcacgcct

SEQ ID NO: 1424695 - DNA, 12 bp, Homo sapiens
ccaggtgccagt

SEQ ID NO: 1424696 - DNA, 13 bp, Homo sapiens
ccaggtgccagtt

SEQ ID NO: 1424697 - DNA, 17 bp, Homo sapiens
ccaggtggagggcacag

SEQ ID NO: 1424698 - DNA, 19 bp, Homo sapiens
ccaggtggagggcacagcc

SEQ ID NO: 1424699 - DNA, 20 bp, Homo sapiens
ccaggtggagggcacagccc

SEQ ID NO: 1424700 - DNA, 22 bp, Homo sapiens
ccaggtggagggtttgcactcc

SEQ ID NO: 1424701 - DNA, 13 bp, Homo sapiens
ccaggtggcctgc

SEQ ID NO: 1424702 - DNA, 20 bp, Homo sapiens
ccaggtggcgtgagaggcaa

SEQ ID NO: 1424703 - DNA, 22 bp, Homo sapiens
ccaggtggctgacccagtccct

SEQ ID NO: 1424704 - DNA, 14 bp, Homo sapiens
ccaggtgtgcctgt

SEQ ID NO: 1424705 - DNA, 22 bp, Homo sapiens
ccaggtgtggttgctcacagct

SEQ ID NO: 1424706 - DNA, 19 bp, Homo sapiens
ccaggtgttaacattccaa

SEQ ID NO: 1424707 - DNA, 15 bp, Homo sapiens
ccaggttcaacccac

SEQ ID NO: 1424708 - DNA, 17 bp, Homo sapiens
ccaggttcccccagcaa

SEQ ID NO: 1424709 - DNA, 19 bp, Homo sapiens
ccaggttcccccagcaagc

SEQ ID NO: 1424710 - DNA, 24 bp, Homo sapiens
ccaggttctccgttagctcctgtg

SEQ ID NO: 1424711 - DNA, 16 bp, Homo sapiens
ccaggttgaaagacct

SEQ ID NO: 1424712 - DNA, 16 bp, Homo sapiens
ccaggttgcagctgct

SEQ ID NO: 1424713 - DNA, 23 bp, Homo sapiens
ccaggttgcagctgctcttgcat

SEQ ID NO: 1424714 - DNA, 19 bp, Homo sapiens
ccaggtttttcatctgaaa

SEQ ID NO: 1424715 - DNA, 23 bp, Homo sapiens
ccagtaacttttttgtgtatgta

SEQ ID NO: 1424716 - DNA, 16 bp, Homo sapiens
ccagtacctccaagca

SEQ ID NO: 1424717 - DNA, 23 bp, Homo sapiens
ccagtacgtcccgctgctgtgct

SEQ ID NO: 1424718 - DNA, 18 bp, Homo sapiens
ccagtagccaaggcccgg

SEQ ID NO: 1424719 - DNA, 22 bp, Homo sapiens
ccagtagtgggatcatccagag

SEQ ID NO: 1424720 - DNA, 18 bp, Homo sapiens
ccagtatctatatatgtg

SEQ ID NO: 1424721 - DNA, 15 bp, Homo sapiens
ccagtattgccccct

SEQ ID NO: 1424722 - DNA, 14 bp, Homo sapiens
ccagtatttttaaa

SEQ ID NO: 1424723 - DNA, 15 bp, Homo sapiens
ccagtcacactgtgg

SEQ ID NO: 1424724 - DNA, 22 bp, Homo sapiens
ccagtcactccctctgccttca

SEQ ID NO: 1424725 - DNA, 16 bp, Homo sapiens
ccagtcactcctctct

SEQ ID NO: 1424726 - DNA, 15 bp, Homo sapiens
ccagtcaggcccagg

SEQ ID NO: 1424727 - DNA, 21 bp, Homo sapiens
ccagtccaaatgtcctccaga

SEQ ID NO: 1424728 - DNA, 13 bp, Homo sapiens
ccagtccaggctg

SEQ ID NO: 1424729 - DNA, 15 bp, Homo sapiens
ccagtccaggctgcc

SEQ ID NO: 1424730 - DNA, 16 bp, Homo sapiens
ccagtccatgctccag

SEQ ID NO: 1424731 - DNA, 17 bp, Homo sapiens
ccagtccatgctccagg

SEQ ID NO: 1424732 - DNA, 18 bp, Homo sapiens
ccagtccatgctccaggg

SEQ ID NO: 1424733 - DNA, 19 bp, Homo sapiens
ccagtccccacccctgccc

SEQ ID NO: 1424734 - DNA, 22 bp, Homo sapiens
ccagtccccgaggagctgggcc

SEQ ID NO: 1424735 - DNA, 14 bp, Homo sapiens
ccagtccccgctag

SEQ ID NO: 1424736 - DNA, 18 bp, Homo sapiens
ccagtccctcgccgtccc

SEQ ID NO: 1424737 - DNA, 12 bp, Homo sapiens
ccagtccctgga

SEQ ID NO: 1424738 - DNA, 13 bp, Homo sapiens
ccagtccctggag

SEQ ID NO: 1424739 - DNA, 15 bp, Homo sapiens
ccagtccctggagct

SEQ ID NO: 1424740 - DNA, 17 bp, Homo sapiens
ccagtccctggagctgt

SEQ ID NO: 1424741 - DNA, 13 bp, Homo sapiens
ccagtccctgggg

SEQ ID NO: 1424742 - DNA, 21 bp, Homo sapiens
ccagtcctccactcgacccag

SEQ ID NO: 1424743 - DNA, 14 bp, Homo sapiens
ccagtcctgcctgg

SEQ ID NO: 1424744 - DNA, 16 bp, Homo sapiens
ccagtcctgcctggcc

SEQ ID NO: 1424745 - DNA, 17 bp, Homo sapiens
ccagtcctgcctggcca

SEQ ID NO: 1424746 - DNA, 18 bp, Homo sapiens
ccagtcctgcctggccag

SEQ ID NO: 1424747 - DNA, 22 bp, Homo sapiens
ccagtcctgcctggccaggcag

SEQ ID NO: 1424748 - DNA, 21 bp, Homo sapiens
ccagtcctgctacctcccttg

SEQ ID NO: 1424749 - DNA, 15 bp, Homo sapiens
ccagtcctggtcctg

SEQ ID NO: 1424750 - DNA, 23 bp, Homo sapiens
ccagtccttagcaaggggctcag

SEQ ID NO: 1424751 - DNA, 14 bp, Homo sapiens
ccagtcgaccccaa

SEQ ID NO: 1424752 - DNA, 19 bp, Homo sapiens
ccagtcgaccccaaaggaa

SEQ ID NO: 1424753 - DNA, 14 bp, Homo sapiens
ccagtcgggaggag

SEQ ID NO: 1424754 - DNA, 22 bp, Homo sapiens
ccagtcgtgatgtggaggaaga

SEQ ID NO: 1424755 - DNA, 16 bp, Homo sapiens
ccagtctcagagacca

SEQ ID NO: 1424756 - DNA, 18 bp, Homo sapiens
ccagtctcagagaccagc

SEQ ID NO: 1424757 - DNA, 21 bp, Homo sapiens
ccagtctcagagaccagcact

SEQ ID NO: 1424758 - DNA, 13 bp, Homo sapiens
ccagtctcccagg

SEQ ID NO: 1424759 - DNA, 16 bp, Homo sapiens
ccagtctgggctgccg

SEQ ID NO: 1424760 - DNA, 19 bp, Homo sapiens
ccagtctgggctgccgggt

SEQ ID NO: 1424761 - DNA, 14 bp, Homo sapiens
ccagtctgtctact

SEQ ID NO: 1424762 - DNA, 16 bp, Homo sapiens
ccagtctgtctactgt

SEQ ID NO: 1424763 - DNA, 17 bp, Homo sapiens
ccagtctgtctactgtg

SEQ ID NO: 1424764 - DNA, 13 bp, Homo sapiens
ccagtctgtggat

SEQ ID NO: 1424765 - DNA, 22 bp, Homo sapiens
ccagtcttcctcttagcctctg

SEQ ID NO: 1424766 - DNA, 22 bp, Homo sapiens
ccagtcttcctgacactttaat

SEQ ID NO: 1424767 - DNA, 12 bp, Homo sapiens
ccagtcttgcct

SEQ ID NO: 1424768 - DNA, 22 bp, Homo sapiens
aagcccatgagtccttgaaaat

SEQ ID NO: 1424769 - DNA, 13 bp, Homo sapiens
aagccccacatgt

SEQ ID NO: 1424770 - DNA, 17 bp, Homo sapiens
aagccccagcttggctc

SEQ ID NO: 1424771 - DNA, 13 bp, Homo sapiens
aagccccagggcc

SEQ ID NO: 1424772 - DNA, 14 bp, Homo sapiens
aagccccagggcct

SEQ ID NO: 1424773 - DNA, 18 bp, Homo sapiens
aagccccagggcctgggg

SEQ ID NO: 1424774 - DNA, 16 bp, Homo sapiens
aagccccatttcctca

SEQ ID NO: 1424775 - DNA, 16 bp, Homo sapiens
aagcccccagctaaga

SEQ ID NO: 1424776 - DNA, 23 bp, Homo sapiens
aagcccccagctaagaacctgga

SEQ ID NO: 1424777 - DNA, 14 bp, Homo sapiens
aagcccccagggcc

SEQ ID NO: 1424778 - DNA, 19 bp, Homo sapiens
aagccctacagagctgtgg

SEQ ID NO: 1424779 - DNA, 15 bp, Homo sapiens
aagccctcattttta

SEQ ID NO: 1424780 - DNA, 22 bp, Homo sapiens
aagccctcatttttataacctg

SEQ ID NO: 1424781 - DNA, 13 bp, Homo sapiens
aagccctcccagg

SEQ ID NO: 1424782 - DNA, 21 bp, Homo sapiens
aagccctcgaaccaaggcagc

SEQ ID NO: 1424783 - DNA, 23 bp, Homo sapiens
aagccctgattgtgtatattcat

SEQ ID NO: 1424784 - DNA, 19 bp, Homo sapiens
aagccctgcctctgtgtag

SEQ ID NO: 1424785 - DNA, 21 bp, Homo sapiens
aagcccttggaacaccctgga

SEQ ID NO: 1424786 - DNA, 18 bp, Homo sapiens
aagccctttgctctggag

SEQ ID NO: 1424787 - DNA, 15 bp, Homo sapiens
aagccgaccttccct

SEQ ID NO: 1424788 - DNA, 17 bp, Homo sapiens
aagccgactctggccct

SEQ ID NO: 1424789 - DNA, 21 bp, Homo sapiens
aagccgactctggccctggcc

SEQ ID NO: 1424790 - DNA, 17 bp, Homo sapiens
aagccgagagccttttg

SEQ ID NO: 1424791 - DNA, 14 bp, Homo sapiens
aagccggacagctg

SEQ ID NO: 1424792 - DNA, 16 bp, Homo sapiens
aagccggacagctgcc

SEQ ID NO: 1424793 - DNA, 22 bp, Homo sapiens
aagccggacagctgcccagaca

SEQ ID NO: 1424794 - DNA, 14 bp, Homo sapiens
aagccgggaacaga

SEQ ID NO: 1424795 - DNA, 21 bp, Homo sapiens
aagccggggtgtaacttcctg

SEQ ID NO: 1424796 - DNA, 22 bp, Homo sapiens
aagccggggtgtaacttcctgc

SEQ ID NO: 1424797 - DNA, 23 bp, Homo sapiens
aagccggggtgtaacttcctgct

SEQ ID NO: 1424798 - DNA, 16 bp, Homo sapiens
aagccgtctgactcca

SEQ ID NO: 1424799 - DNA, 19 bp, Homo sapiens
aagccgtctgactccagag

SEQ ID NO: 1424800 - DNA, 15 bp, Homo sapiens
aagccgtggcttccc

SEQ ID NO: 1424801 - DNA, 13 bp, Homo sapiens
aagcctaaagatt

SEQ ID NO: 1424802 - DNA, 23 bp, Homo sapiens
aagcctacattctccagttgatt

SEQ ID NO: 1424803 - DNA, 22 bp, Homo sapiens
aagcctcaactagtcatttttt

SEQ ID NO: 1424804 - DNA, 18 bp, Homo sapiens
aagcctcatattttctgt

SEQ ID NO: 1424805 - DNA, 12 bp, Homo sapiens
aagcctccttgt

SEQ ID NO: 1424806 - DNA, 23 bp, Homo sapiens
aagcctctctccttggccacaga

SEQ ID NO: 1424807 - DNA, 23 bp, Homo sapiens
aagcctctctctccctccctctc

SEQ ID NO: 1424808 - DNA, 22 bp, Homo sapiens
aagcctctggccgtcacacgta

SEQ ID NO: 1424809 - DNA, 14 bp, Homo sapiens
aagcctctggctag

SEQ ID NO: 1424810 - DNA, 22 bp, Homo sapiens
aagcctcttattccaggagaag

SEQ ID NO: 1424811 - DNA, 16 bp, Homo sapiens
aagcctgaactgaggc

SEQ ID NO: 1424812 - DNA, 18 bp, Homo sapiens
aagcctgaactgaggcct

SEQ ID NO: 1424813 - DNA, 19 bp, Homo sapiens
aagcctgaactgaggcctt

SEQ ID NO: 1424814 - DNA, 15 bp, Homo sapiens
aagcctgaggctggg

SEQ ID NO: 1424815 - DNA, 19 bp, Homo sapiens
aagcctgatactttagcca

SEQ ID NO: 1424816 - DNA, 16 bp, Homo sapiens
aagcctgatccagcct

SEQ ID NO: 1424817 - DNA, 22 bp, Homo sapiens
aagcctgcaatttcatatgctg

SEQ ID NO: 1424818 - DNA, 16 bp, Homo sapiens
aagcctgcaggagaaa

SEQ ID NO: 1424819 - DNA, 13 bp, Homo sapiens
aagcctgcctccc

SEQ ID NO: 1424820 - DNA, 12 bp, Homo sapiens
aagcctgctggc

SEQ ID NO: 1424821 - DNA, 14 bp, Homo sapiens
aagcctgctggctg

SEQ ID NO: 1424822 - DNA, 17 bp, Homo sapiens
aagcctggactctaagc

SEQ ID NO: 1424823 - DNA, 20 bp, Homo sapiens
aagcctggattccagcagtg

SEQ ID NO: 1424824 - DNA, 21 bp, Homo sapiens
aagcctgtattctcaaacaca

SEQ ID NO: 1424825 - DNA, 12 bp, Homo sapiens
aagcctgtgaat

SEQ ID NO: 1424826 - DNA, 23 bp, Homo sapiens
aagcctgtgaataaaaaccctgt

SEQ ID NO: 1424827 - DNA, 14 bp, Homo sapiens
aagcctgtgccagc

SEQ ID NO: 1424828 - DNA, 19 bp, Homo sapiens
aagccttaatttgcacagt

SEQ ID NO: 1424829 - DNA, 15 bp, Homo sapiens
aagccttcagctcca

SEQ ID NO: 1424830 - DNA, 11 bp, Homo sapiens
aagccttccta

SEQ ID NO: 1424831 - DNA, 22 bp, Homo sapiens
aagccttcgggcgtctgtgtgc

SEQ ID NO: 1424832 - DNA, 14 bp, Homo sapiens
aagccttctggatc

SEQ ID NO: 1424833 - DNA, 20 bp, Homo sapiens
aagccttctggatccatggg

SEQ ID NO: 1424834 - DNA, 22 bp, Homo sapiens
aagccttggctcgttctcttct

SEQ ID NO: 1424835 - DNA, 17 bp, Homo sapiens
aagcctttagttcctac

SEQ ID NO: 1424836 - DNA, 15 bp, Homo sapiens
aagcctttcattttg

SEQ ID NO: 1424837 - DNA, 14 bp, Homo sapiens
aagcctttccataa

SEQ ID NO: 1424838 - DNA, 18 bp, Homo sapiens
aagcgagatcccatctct

SEQ ID NO: 1424839 - DNA, 21 bp, Homo sapiens
aagcgatgaatttggagactc

SEQ ID NO: 1424840 - DNA, 23 bp, Homo sapiens
aagcgattctcccgcctcagcct

SEQ ID NO: 1424841 - DNA, 14 bp, Homo sapiens
aagcgatttgaaac

SEQ ID NO: 1424842 - DNA, 15 bp, Homo sapiens
aagcgatttgaaaca

SEQ ID NO: 1424843 - DNA, 14 bp, Homo sapiens
aagcgcccacccag

SEQ ID NO: 1424844 - DNA, 17 bp, Homo sapiens
aagcgcccacccaggtc

SEQ ID NO: 1424845 - DNA, 19 bp, Homo sapiens
aagcgctcatgttgagcca

SEQ ID NO: 1424846 - DNA, 23 bp, Homo sapiens
aagcgcttctgctgaaagttcat

SEQ ID NO: 1424847 - DNA, 21 bp, Homo sapiens
aagcggaggttgcagggagcc

SEQ ID NO: 1424848 - DNA, 14 bp, Homo sapiens
aagcggggggaggg

SEQ ID NO: 1424849 - DNA, 16 bp, Homo sapiens
aagcgttcctggcctt

SEQ ID NO: 1424850 - DNA, 20 bp, Homo sapiens
aagcgttcctggccttctga

SEQ ID NO: 1424851 - DNA, 17 bp, Homo sapiens
aagcgtttttctttttc

SEQ ID NO: 1424852 - DNA, 15 bp, Homo sapiens
aagctaaaaggaaaa

SEQ ID NO: 1424853 - DNA, 14 bp, Homo sapiens
aagctaaaatgtta

SEQ ID NO: 1424854 - DNA, 21 bp, Homo sapiens
aagctaaatcctttactgtta

SEQ ID NO: 1424855 - DNA, 12 bp, Homo sapiens
aagctaaattac

SEQ ID NO: 1424856 - DNA, 23 bp, Homo sapiens
aagctaaattttgttactgattc

SEQ ID NO: 1424857 - DNA, 19 bp, Homo sapiens
aagctacctcaaacttcca

SEQ ID NO: 1424858 - DNA, 15 bp, Homo sapiens
aagctagacacatga

SEQ ID NO: 1424859 - DNA, 17 bp, Homo sapiens
aagctagacacatgaag

SEQ ID NO: 1424860 - DNA, 14 bp, Homo sapiens
aagctagagatatg

SEQ ID NO: 1424861 - DNA, 21 bp, Homo sapiens
aagctagatacgaaatcagtt

SEQ ID NO: 1424862 - DNA, 18 bp, Homo sapiens
aagctagccagagggtgg

SEQ ID NO: 1424863 - DNA, 15 bp, Homo sapiens
aagctaggccccaga

SEQ ID NO: 1424864 - DNA, 22 bp, Homo sapiens
aagctaggccccagaggccctg

SEQ ID NO: 1424865 - DNA, 15 bp, Homo sapiens
aagctataaagcagt

SEQ ID NO: 1424866 - DNA, 15 bp, Homo sapiens
aagctatattagctg

SEQ ID NO: 1424867 - DNA, 13 bp, Homo sapiens
aagctatctgtgc

SEQ ID NO: 1424868 - DNA, 22 bp, Homo sapiens
aagctattcagtaataactcta

SEQ ID NO: 1424869 - DNA, 21 bp, Homo sapiens
aagctcaaaggtttggaagga

SEQ ID NO: 1424870 - DNA, 11 bp, Homo sapiens
aagctcacagt

SEQ ID NO: 1424871 - DNA, 22 bp, Homo sapiens
aagctcacagttcctcgccctg

SEQ ID NO: 1424872 - DNA, 23 bp, Homo sapiens
aagctcacagttcctcgccctgg

SEQ ID NO: 1424873 - DNA, 21 bp, Homo sapiens
aagctcacatccagccttgga

SEQ ID NO: 1424874 - DNA, 15 bp, Homo sapiens
aagctcacgtcctga

SEQ ID NO: 1424875 - DNA, 19 bp, Homo sapiens
aagctcacgtcctgagaaa

SEQ ID NO: 1424876 - DNA, 14 bp, Homo sapiens
aagctcacttctgg

SEQ ID NO: 1424877 - DNA, 13 bp, Homo sapiens
aagctcagaatcc

SEQ ID NO: 1424878 - DNA, 14 bp, Homo sapiens
aagctcagaatcca

SEQ ID NO: 1424879 - DNA, 12 bp, Homo sapiens
aagctcagcctt

SEQ ID NO: 1424880 - DNA, 15 bp, Homo sapiens
aagctcagctgcatt

SEQ ID NO: 1424881 - DNA, 18 bp, Homo sapiens
aagctcataaactgccaa

SEQ ID NO: 1424882 - DNA, 20 bp, Homo sapiens
aagctcctctccccagccca

SEQ ID NO: 1424883 - DNA, 23 bp, Homo sapiens
aagctcctctccccagcccagag

SEQ ID NO: 1424884 - DNA, 21 bp, Homo sapiens
ccaggcaggggtgggggtgga

SEQ ID NO: 1424885 - DNA, 21 bp, Homo sapiens
ccaggcaggtctgcaagggcc

SEQ ID NO: 1424886 - DNA, 17 bp, Homo sapiens
ccaggcagtcgggggct

SEQ ID NO: 1424887 - DNA, 24 bp, Homo sapiens
ccaggcagtcgggggctggcctag

SEQ ID NO: 1424888 - DNA, 15 bp, Homo sapiens
ccaggcatggcgagg

SEQ ID NO: 1424889 - DNA, 19 bp, Homo sapiens
ccaggcatggcgaggctga

SEQ ID NO: 1424890 - DNA, 13 bp, Homo sapiens
ccaggccaacagc

SEQ ID NO: 1424891 - DNA, 18 bp, Homo sapiens
ccaggccaacagcacctc

SEQ ID NO: 1424892 - DNA, 21 bp, Homo sapiens
ccaggccacctccccagcatt

SEQ ID NO: 1424893 - DNA, 15 bp, Homo sapiens
ccaggccactgtggc

SEQ ID NO: 1424894 - DNA, 18 bp, Homo sapiens
ccaggccactgtggccag

SEQ ID NO: 1424895 - DNA, 15 bp, Homo sapiens
ccaggccagcctccg

SEQ ID NO: 1424896 - DNA, 19 bp, Homo sapiens
ccaggccagcctccgagag

SEQ ID NO: 1424897 - DNA, 23 bp, Homo sapiens
ccaggccagcctccgagagggag

SEQ ID NO: 1424898 - DNA, 17 bp, Homo sapiens
ccaggccaggtccctgg

SEQ ID NO: 1424899 - DNA, 14 bp, Homo sapiens
ccaggcccaaggct

SEQ ID NO: 1424900 - DNA, 17 bp, Homo sapiens
ccaggcccactgtgcct

SEQ ID NO: 1424901 - DNA, 20 bp, Homo sapiens
ccaggccccaccggccaggc

SEQ ID NO: 1424902 - DNA, 14 bp, Homo sapiens
ccaggcccctgagg

SEQ ID NO: 1424903 - DNA, 15 bp, Homo sapiens
ccaggcccctgagga

SEQ ID NO: 1424904 - DNA, 21 bp, Homo sapiens
ccaggcccgcaccccggcctc

SEQ ID NO: 1424905 - DNA, 15 bp, Homo sapiens
ccaggcccggggctg

SEQ ID NO: 1424906 - DNA, 20 bp, Homo sapiens
ccaggcccggggctggcggc

SEQ ID NO: 1424907 - DNA, 12 bp, Homo sapiens
ccaggcccgtgg

SEQ ID NO: 1424908 - DNA, 14 bp, Homo sapiens
ccaggccctactac

SEQ ID NO: 1424909 - DNA, 15 bp, Homo sapiens
ccaggccctccatgg

SEQ ID NO: 1424910 - DNA, 17 bp, Homo sapiens
ccaggccctccatgggc

SEQ ID NO: 1424911 - DNA, 20 bp, Homo sapiens
ccaggccctccatgggctag

SEQ ID NO: 1424912 - DNA, 18 bp, Homo sapiens
ccaggccctcctctccca

SEQ ID NO: 1424913 - DNA, 23 bp, Homo sapiens
ccaggccctgccagtggggaagg

SEQ ID NO: 1424914 - DNA, 14 bp, Homo sapiens
ccaggccctgggtc

SEQ ID NO: 1424915 - DNA, 16 bp, Homo sapiens
ccaggcccttggctgc

SEQ ID NO: 1424916 - DNA, 17 bp, Homo sapiens
ccaggcccttggctgca

SEQ ID NO: 1424917 - DNA, 14 bp, Homo sapiens
ccaggccctttggc

SEQ ID NO: 1424918 - DNA, 15 bp, Homo sapiens
ccaggccctttggct

SEQ ID NO: 1424919 - DNA, 16 bp, Homo sapiens
ccaggccctttggctt

SEQ ID NO: 1424920 - DNA, 17 bp, Homo sapiens
ccaggccctttggcttc

SEQ ID NO: 1424921 - DNA, 24 bp, Homo sapiens
ccaggccgcaccatttctgtcact

SEQ ID NO: 1424922 - DNA, 14 bp, Homo sapiens
ccaggccgcagctc

SEQ ID NO: 1424923 - DNA, 16 bp, Homo sapiens
ccaggccgcagctctt

SEQ ID NO: 1424924 - DNA, 17 bp, Homo sapiens
ccaggccgcagctcttg

SEQ ID NO: 1424925 - DNA, 16 bp, Homo sapiens
ccaggccgcgcccagc

SEQ ID NO: 1424926 - DNA, 22 bp, Homo sapiens
ccaggccgcgcccagcagaggc

SEQ ID NO: 1424927 - DNA, 13 bp, Homo sapiens
ccaggccggagcc

SEQ ID NO: 1424928 - DNA, 18 bp, Homo sapiens
ccaggccggagcccagat

SEQ ID NO: 1424929 - DNA, 19 bp, Homo sapiens
ccaggccggagcccagata

SEQ ID NO: 1424930 - DNA, 20 bp, Homo sapiens
ccaggccgggcttgggccct

SEQ ID NO: 1424931 - DNA, 21 bp, Homo sapiens
ccaggccggggtggagcatgg

SEQ ID NO: 1424932 - DNA, 22 bp, Homo sapiens
ccaggccgtcctcccgggccct

SEQ ID NO: 1424933 - DNA, 21 bp, Homo sapiens
ccaggccgttccccttggctt

SEQ ID NO: 1424934 - DNA, 16 bp, Homo sapiens
ccaggcctccagcctc

SEQ ID NO: 1424935 - DNA, 17 bp, Homo sapiens
ccaggcctccagcctct

SEQ ID NO: 1424936 - DNA, 19 bp, Homo sapiens
ccaggcctccagcctctcc

SEQ ID NO: 1424937 - DNA, 22 bp, Homo sapiens
aagatggtccatttgttcctgc

SEQ ID NO: 1424938 - DNA, 23 bp, Homo sapiens
aagatggtccatttgttcctgct

SEQ ID NO: 1424939 - DNA, 19 bp, Homo sapiens
aagatggtttatgcatgta

SEQ ID NO: 1424940 - DNA, 12 bp, Homo sapiens
aagatgtgaatt

SEQ ID NO: 1424941 - DNA, 19 bp, Homo sapiens
aagatgtgatattctaaga

SEQ ID NO: 1424942 - DNA, 21 bp, Homo sapiens
aagatgtgatattctaagact

SEQ ID NO: 1424943 - DNA, 16 bp, Homo sapiens
aagatgtgtaaacagg

SEQ ID NO: 1424944 - DNA, 15 bp, Homo sapiens
aagatgtgttcttat

SEQ ID NO: 1424945 - DNA, 16 bp, Homo sapiens
aagatgttatggtgtt

SEQ ID NO: 1424946 - DNA, 20 bp, Homo sapiens
aagatgttatggtgtttaga

SEQ ID NO: 1424947 - DNA, 15 bp, Homo sapiens
aagatgttccagtga

SEQ ID NO: 1424948 - DNA, 21 bp, Homo sapiens
aagatgttgatttttactgtg

SEQ ID NO: 1424949 - DNA, 13 bp, Homo sapiens
aagatgtttattg

SEQ ID NO: 1424950 - DNA, 23 bp, Homo sapiens
aagatgttttgtataaaatctga

SEQ ID NO: 1424951 - DNA, 16 bp, Homo sapiens
aagattaaaggaagga

SEQ ID NO: 1424952 - DNA, 19 bp, Homo sapiens
aagattaaaggaaggaaaa

SEQ ID NO: 1424953 - DNA, 18 bp, Homo sapiens
aagattaatctttaaacc

SEQ ID NO: 1424954 - DNA, 19 bp, Homo sapiens
aagattaatctttaaacca

SEQ ID NO: 1424955 - DNA, 21 bp, Homo sapiens
aagattacaaatcagaagtca

SEQ ID NO: 1424956 - DNA, 11 bp, Homo sapiens
aagattagaag

SEQ ID NO: 1424957 - DNA, 20 bp, Homo sapiens
aagattataattgttgcata

SEQ ID NO: 1424958 - DNA, 15 bp, Homo sapiens
aagattatagattct

SEQ ID NO: 1424959 - DNA, 16 bp, Homo sapiens
aagattatagattcta

SEQ ID NO: 1424960 - DNA, 20 bp, Homo sapiens
aagattatagattctaaaga

SEQ ID NO: 1424961 - DNA, 20 bp, Homo sapiens
aagattatgatgcatacagt

SEQ ID NO: 1424962 - DNA, 21 bp, Homo sapiens
aagattattgtgacttcactg

SEQ ID NO: 1424963 - DNA, 19 bp, Homo sapiens
aagattcacacctgactct

SEQ ID NO: 1424964 - DNA, 15 bp, Homo sapiens
aagattcaggtatgt

SEQ ID NO: 1424965 - DNA, 21 bp, Homo sapiens
aagattcatttttaatcatga

SEQ ID NO: 1424966 - DNA, 12 bp, Homo sapiens
aagattcccaga

SEQ ID NO: 1424967 - DNA, 19 bp, Homo sapiens
aagattcccagagacagga

SEQ ID NO: 1424968 - DNA, 20 bp, Homo sapiens
aagattcccagagacaggaa

SEQ ID NO: 1424969 - DNA, 17 bp, Homo sapiens
aagattctaaagctcaa

SEQ ID NO: 1424970 - DNA, 18 bp, Homo sapiens
aagattctaaagctcaat

SEQ ID NO: 1424971 - DNA, 14 bp, Homo sapiens
aagattctaatgat

SEQ ID NO: 1424972 - DNA, 20 bp, Homo sapiens
aagattctagatcagatgct

SEQ ID NO: 1424973 - DNA, 12 bp, Homo sapiens
aagattctgctg

SEQ ID NO: 1424974 - DNA, 23 bp, Homo sapiens
aagattctgtgtcagagcccagc

SEQ ID NO: 1424975 - DNA, 21 bp, Homo sapiens
aagattgatatctataaaata

SEQ ID NO: 1424976 - DNA, 21 bp, Homo sapiens
aagattggtgggattttttgt

SEQ ID NO: 1424977 - DNA, 13 bp, Homo sapiens
aagattgtactta

SEQ ID NO: 1424978 - DNA, 19 bp, Homo sapiens
aagatttatgaacagaaat

SEQ ID NO: 1424979 - DNA, 12 bp, Homo sapiens
aagatttattgt

SEQ ID NO: 1424980 - DNA, 17 bp, Homo sapiens
aagatttccatttgtca

SEQ ID NO: 1424981 - DNA, 18 bp, Homo sapiens
aagatttccatttgtcaa

SEQ ID NO: 1424982 - DNA, 20 bp, Homo sapiens
aagatttctagtaggcagca

SEQ ID NO: 1424983 - DNA, 13 bp, Homo sapiens
aagatttcttgag

SEQ ID NO: 1424984 - DNA, 16 bp, Homo sapiens
aagatttgtgaactgg

SEQ ID NO: 1424985 - DNA, 19 bp, Homo sapiens
aagatttgtgaactggaag

SEQ ID NO: 1424986 - DNA, 22 bp, Homo sapiens
aagatttgtgtttttctttttc

SEQ ID NO: 1424987 - DNA, 21 bp, Homo sapiens
aagatttgttgacagcaaaat

SEQ ID NO: 1424988 - DNA, 16 bp, Homo sapiens
aagatttgtttttgta

SEQ ID NO: 1424989 - DNA, 22 bp, Homo sapiens
aagattttagggcttttatttt

SEQ ID NO: 1424990 - DNA, 20 bp, Homo sapiens
aagattttattgtataaaaa

SEQ ID NO: 1424991 - DNA, 23 bp, Homo sapiens
aagattttgatctcacattttta

SEQ ID NO: 1424992 - DNA, 24 bp, Homo sapiens
aagatttttaccttcctttctaaa

SEQ ID NO: 1424993 - DNA, 13 bp, Homo sapiens
aagatttttttcc

SEQ ID NO: 1424994 - DNA, 15 bp, Homo sapiens
aagatttttttcctg

SEQ ID NO: 1424995 - DNA, 14 bp, Homo sapiens
aagcaaaagaaaaa

SEQ ID NO: 1424996 - DNA, 15 bp, Homo sapiens
aagcaaaagaaaaag

SEQ ID NO: 1424997 - DNA, 13 bp, Homo sapiens
aagcaaaatacat

SEQ ID NO: 1424998 - DNA, 21 bp, Homo sapiens
aagcaaaccgccctgcagcat

SEQ ID NO: 1424999 - DNA, 13 bp, Homo sapiens
aagcaaagatgca

SEQ ID NO: 1425000 - DNA, 11 bp, Homo sapiens
aagcaaaggtg

SEQ ID NO: 1425001 - DNA, 14 bp, Homo sapiens
aagcaaagtcactt

SEQ ID NO: 1425002 - DNA, 13 bp, Homo sapiens
aagcaaatacaat

SEQ ID NO: 1425003 - DNA, 17 bp, Homo sapiens
aagcaaatcagaaactt

SEQ ID NO: 1425004 - DNA, 16 bp, Homo sapiens
aagcaaatgttgggaa

SEQ ID NO: 1425005 - DNA, 20 bp, Homo sapiens
aagcaacaaagattgagaag

SEQ ID NO: 1425006 - DNA, 22 bp, Homo sapiens
aagcaacaaattaactagatac

SEQ ID NO: 1425007 - DNA, 15 bp, Homo sapiens
aagcaagacacgtgg

SEQ ID NO: 1425008 - DNA, 12 bp, Homo sapiens
aagcaaggctgg

SEQ ID NO: 1425009 - DNA, 21 bp, Homo sapiens
aagcaagggagaaaagagaaa

SEQ ID NO: 1425010 - DNA, 17 bp, Homo sapiens
aagcaagggctccagca

SEQ ID NO: 1425011 - DNA, 13 bp, Homo sapiens
aagcaataactat

SEQ ID NO: 1425012 - DNA, 20 bp, Homo sapiens
aagcaataatggtcccatcc

SEQ ID NO: 1425013 - DNA, 21 bp, Homo sapiens
aagcaataatggtcccatcca

SEQ ID NO: 1425014 - DNA, 22 bp, Homo sapiens
aagcaataatggtcccatccag

SEQ ID NO: 1425015 - DNA, 18 bp, Homo sapiens
aagcaataattgtttcca

SEQ ID NO: 1425016 - DNA, 22 bp, Homo sapiens
aagcaatacgtttgtgcagaat

SEQ ID NO: 1425017 - DNA, 13 bp, Homo sapiens
aagcaatgtgttt

SEQ ID NO: 1425018 - DNA, 16 bp, Homo sapiens
aagcaattaggtagca

SEQ ID NO: 1425019 - DNA, 16 bp, Homo sapiens
aagcaattctgactgt

SEQ ID NO: 1425020 - DNA, 16 bp, Homo sapiens
aagcaattgccctgta

SEQ ID NO: 1425021 - DNA, 17 bp, Homo sapiens
aagcaattgccctgtaa

SEQ ID NO: 1425022 - DNA, 16 bp, Homo sapiens
aagcacaaagctcaag

SEQ ID NO: 1425023 - DNA, 17 bp, Homo sapiens
aagcacaagtacttttg

SEQ ID NO: 1425024 - DNA, 18 bp, Homo sapiens
aagcacacacatctggcc

SEQ ID NO: 1425025 - DNA, 21 bp, Homo sapiens
aagcacacacatctggccctg

SEQ ID NO: 1425026 - DNA, 22 bp, Homo sapiens
aagcacacacatctggccctga

SEQ ID NO: 1425027 - DNA, 14 bp, Homo sapiens
aagcacactggaat

SEQ ID NO: 1425028 - DNA, 21 bp, Homo sapiens
aagcacactggaatataaaac

SEQ ID NO: 1425029 - DNA, 15 bp, Homo sapiens
aagcacagctcctgc

SEQ ID NO: 1425030 - DNA, 11 bp, Homo sapiens
aagcacagctg

SEQ ID NO: 1425031 - DNA, 13 bp, Homo sapiens
aagcacagctggg

SEQ ID NO: 1425032 - DNA, 15 bp, Homo sapiens
aagcacagtttgaac

SEQ ID NO: 1425033 - DNA, 18 bp, Homo sapiens
aagcaccccagtcactag

SEQ ID NO: 1425034 - DNA, 19 bp, Homo sapiens
aagcaccgcctccaaatgc

SEQ ID NO: 1425035 - DNA, 15 bp, Homo sapiens
aagcactacaatcat

SEQ ID NO: 1425036 - DNA, 16 bp, Homo sapiens
aagcactacaatcatg

SEQ ID NO: 1425037 - DNA, 23 bp, Homo sapiens
aagcactcctgcttaatcttcaa

SEQ ID NO: 1425038 - DNA, 19 bp, Homo sapiens
aagcactgacttctaagta

SEQ ID NO: 1425039 - DNA, 13 bp, Homo sapiens
aagcactgctcac

SEQ ID NO: 1425040 - DNA, 23 bp, Homo sapiens
aagcactgctcacgtctctgccg

SEQ ID NO: 1425041 - DNA, 18 bp, Homo sapiens
aagcacttaaacagaagc

SEQ ID NO: 1425042 - DNA, 16 bp, Homo sapiens
aagcacttcccaggat

SEQ ID NO: 1425043 - DNA, 19 bp, Homo sapiens
aagcacttcccaggatctg

SEQ ID NO: 1425044 - DNA, 18 bp, Homo sapiens
aagcactttgggattctt

SEQ ID NO: 1425045 - DNA, 15 bp, Homo sapiens
aagcacttttaaaaa

SEQ ID NO: 1425046 - DNA, 22 bp, Homo sapiens
aagcagaaatcctgcaatgaaa

SEQ ID NO: 1425047 - DNA, 19 bp, Homo sapiens
aagcagaacaaatgtgttt

SEQ ID NO: 1425048 - DNA, 15 bp, Homo sapiens
aagcagaattttaat

SEQ ID NO: 1425049 - DNA, 20 bp, Homo sapiens
aagcagaattttaatgtgaa

SEQ ID NO: 1425050 - DNA, 15 bp, Homo sapiens
aagcagactcagctg

SEQ ID NO: 1425051 - DNA, 17 bp, Homo sapiens
aagcagactcagctgct

SEQ ID NO: 1425052 - DNA, 19 bp, Homo sapiens
aagcagacttttgtgtaaa

SEQ ID NO: 1425053 - DNA, 18 bp, Homo sapiens
aagcagagaggtggagaa

SEQ ID NO: 1425054 - DNA, 13 bp, Homo sapiens
aagcagagcaaaa

SEQ ID NO: 1425055 - DNA, 13 bp, Homo sapiens
aagcagaggacca

SEQ ID NO: 1425056 - DNA, 19 bp, Homo sapiens
aagcagaggaccagggcct

SEQ ID NO: 1425057 - DNA, 17 bp, Homo sapiens
aagcagagtgcacagct

SEQ ID NO: 1425058 - DNA, 20 bp, Homo sapiens
aagcagatggaatgctgtgt

SEQ ID NO: 1425059 - DNA, 17 bp, Homo sapiens
aagcagcatggaaaaat

SEQ ID NO: 1425060 - DNA, 11 bp, Homo sapiens
aagcagccagc

SEQ ID NO: 1425061 - DNA, 14 bp, Homo sapiens
aagcagcccttgct

SEQ ID NO: 1425062 - DNA, 15 bp, Homo sapiens
aagcagcccttgctt

SEQ ID NO: 1425063 - DNA, 16 bp, Homo sapiens
aagcagcctctcccca

SEQ ID NO: 1425064 - DNA, 22 bp, Homo sapiens
aagcagctaaatgtaacttatt

SEQ ID NO: 1425065 - DNA, 23 bp, Homo sapiens
aagcagctgattcagcagtgcct

SEQ ID NO: 1425066 - DNA, 20 bp, Homo sapiens
aagcagctggtcagtctttg

SEQ ID NO: 1425067 - DNA, 16 bp, Homo sapiens
aagcagctttaaacaa

SEQ ID NO: 1425068 - DNA, 14 bp, Homo sapiens
aagcaggaattatg

SEQ ID NO: 1425069 - DNA, 13 bp, Homo sapiens
aagcaggagcagc

SEQ ID NO: 1425070 - DNA, 14 bp, Homo sapiens
aagcaggtgctaca

SEQ ID NO: 1425071 - DNA, 19 bp, Homo sapiens
aagcaggtggatctatttc

SEQ ID NO: 1425072 - DNA, 15 bp, Homo sapiens
aagcaggttcttgat

SEQ ID NO: 1425073 - DNA, 14 bp, Homo sapiens
aagcaggtttgttt

SEQ ID NO: 1425074 - DNA, 14 bp, Homo sapiens
aagcagtaaaaact

SEQ ID NO: 1425075 - DNA, 18 bp, Homo sapiens
aagcagtatttttcttga

SEQ ID NO: 1425076 - DNA, 15 bp, Homo sapiens
aagcagtcccattca

SEQ ID NO: 1425077 - DNA, 17 bp, Homo sapiens
aagcagtcccattcata

SEQ ID NO: 1425078 - DNA, 19 bp, Homo sapiens
aagcagtcgtgcctgtgtc

SEQ ID NO: 1425079 - DNA, 17 bp, Homo sapiens
aagcagtgcctcgaggc

SEQ ID NO: 1425080 - DNA, 17 bp, Homo sapiens
aagcagtggacaccagg

SEQ ID NO: 1425081 - DNA, 22 bp, Homo sapiens
aagcagttatggtgatgactta

SEQ ID NO: 1425082 - DNA, 14 bp, Homo sapiens
aagcagttcagaag

SEQ ID NO: 1425083 - DNA, 15 bp, Homo sapiens
aagcagttttgtaaa

SEQ ID NO: 1425084 - DNA, 18 bp, Homo sapiens
aagcagttttgtaaatgt

SEQ ID NO: 1425085 - DNA, 14 bp, Homo sapiens
aagcatactttgta

SEQ ID NO: 1425086 - DNA, 16 bp, Homo sapiens
aagcatattttgctgg

SEQ ID NO: 1425087 - DNA, 18 bp, Homo sapiens
aagcatcacctcaggcca

SEQ ID NO: 1425088 - DNA, 14 bp, Homo sapiens
aagcatccctcacc

SEQ ID NO: 1425089 - DNA, 16 bp, Homo sapiens
aagcatcctcctcctg

SEQ ID NO: 1425090 - DNA, 19 bp, Homo sapiens
aagcatctggctctaattc

SEQ ID NO: 1425091 - DNA, 21 bp, Homo sapiens
aagcatgacaacttttaaaga

SEQ ID NO: 1425092 - DNA, 19 bp, Homo sapiens
aagcatgatcttgttactg

SEQ ID NO: 1425093 - DNA, 20 bp, Homo sapiens
aagcatgatcttgttactgt

SEQ ID NO: 1425094 - DNA, 18 bp, Homo sapiens
aagcatgatgggaaaata

SEQ ID NO: 1425095 - DNA, 19 bp, Homo sapiens
aagcatgatgggaaaatat

SEQ ID NO: 1425096 - DNA, 21 bp, Homo sapiens
aagcatgatgggaaaatattt

SEQ ID NO: 1425097 - DNA, 22 bp, Homo sapiens
aagcatgatgggaaaatatttc

SEQ ID NO: 1425098 - DNA, 13 bp, Homo sapiens
aagcatgcattct

SEQ ID NO: 1425099 - DNA, 19 bp, Homo sapiens
aagcatgctttgctgctat

SEQ ID NO: 1425100 - DNA, 19 bp, Homo sapiens
aagcatggacatttagaag

SEQ ID NO: 1425101 - DNA, 16 bp, Homo sapiens
aagcatgtcaattcat

SEQ ID NO: 1425102 - DNA, 13 bp, Homo sapiens
aagcatgttttgc

SEQ ID NO: 1425103 - DNA, 14 bp, Homo sapiens
aagcattactttat

SEQ ID NO: 1425104 - DNA, 18 bp, Homo sapiens
aagcattctccccagtgt

SEQ ID NO: 1425105 - DNA, 16 bp, Homo sapiens
aagcatttcaaagccc

SEQ ID NO: 1425106 - DNA, 24 bp, Homo sapiens
aagcatttcaaagccctgcctctg

SEQ ID NO: 1425107 - DNA, 11 bp, Homo sapiens
aagcatttcat

SEQ ID NO: 1425108 - DNA, 12 bp, Homo sapiens
aagcatttcatg

SEQ ID NO: 1425109 - DNA, 23 bp, Homo sapiens
aagcatttcatgaaaaagctgct

SEQ ID NO: 1425110 - DNA, 12 bp, Homo sapiens
aagcatttccta

SEQ ID NO: 1425111 - DNA, 23 bp, Homo sapiens
aagcattttcagtcttgtagtgt

SEQ ID NO: 1425112 - DNA, 17 bp, Homo sapiens
aagcattttgaaacaaa

SEQ ID NO: 1425113 - DNA, 17 bp, Homo sapiens
aagccaaactcaggccc

SEQ ID NO: 1425114 - DNA, 19 bp, Homo sapiens
aagccaaactcaggcccag

SEQ ID NO: 1425115 - DNA, 21 bp, Homo sapiens
aagccaaactcaggcccagaa

SEQ ID NO: 1425116 - DNA, 15 bp, Homo sapiens
aagccaaactctgcc

SEQ ID NO: 1425117 - DNA, 11 bp, Homo sapiens
aagccaaagaa

SEQ ID NO: 1425118 - DNA, 21 bp, Homo sapiens
aagccaaagaaaaataaccct

SEQ ID NO: 1425119 - DNA, 14 bp, Homo sapiens
aagccaaagaaaca

SEQ ID NO: 1425120 - DNA, 22 bp, Homo sapiens
aagccaaagaaacaagctgtgc

SEQ ID NO: 1425121 - DNA, 16 bp, Homo sapiens
aagccaaagacttagt

SEQ ID NO: 1425122 - DNA, 22 bp, Homo sapiens
aagccaaaggtcaaacaggctg

SEQ ID NO: 1425123 - DNA, 14 bp, Homo sapiens
aagccaaccagcct

SEQ ID NO: 1425124 - DNA, 15 bp, Homo sapiens
aagccaaccagcctt

SEQ ID NO: 1425125 - DNA, 19 bp, Homo sapiens
aagccaacttgtaaataca

SEQ ID NO: 1425126 - DNA, 13 bp, Homo sapiens
aagccaagggaaa

SEQ ID NO: 1425127 - DNA, 15 bp, Homo sapiens
aagccacaggcctga

SEQ ID NO: 1425128 - DNA, 23 bp, Homo sapiens
aagccacaggcctgagatttcat

SEQ ID NO: 1425129 - DNA, 18 bp, Homo sapiens
aagccacattatttctag

SEQ ID NO: 1425130 - DNA, 19 bp, Homo sapiens
aagccactctgtcccttcc

SEQ ID NO: 1425131 - DNA, 13 bp, Homo sapiens
aagccactgaagc

SEQ ID NO: 1425132 - DNA, 17 bp, Homo sapiens
aagccactgaagctggg

SEQ ID NO: 1425133 - DNA, 21 bp, Homo sapiens
aagccactggaaggagcacat

SEQ ID NO: 1425134 - DNA, 21 bp, Homo sapiens
aagccacttctggcttcagcc

SEQ ID NO: 1425135 - DNA, 23 bp, Homo sapiens
aagccagactctgccaaaaccaa

SEQ ID NO: 1425136 - DNA, 15 bp, Homo sapiens
aagccagaggagaag

SEQ ID NO: 1425137 - DNA, 16 bp, Homo sapiens
aagccagaggctgggt

SEQ ID NO: 1425138 - DNA, 22 bp, Homo sapiens
aagccagagtttttaaagcctt

SEQ ID NO: 1425139 - DNA, 17 bp, Homo sapiens
aagccagattctcttga

SEQ ID NO: 1425140 - DNA, 21 bp, Homo sapiens
aagccagccacagacccctgg

SEQ ID NO: 1425141 - DNA, 18 bp, Homo sapiens
aagccagccccctccagc

SEQ ID NO: 1425142 - DNA, 20 bp, Homo sapiens
aagccagccccctccagctc

SEQ ID NO: 1425143 - DNA, 16 bp, Homo sapiens
aagccagcccggccgc

SEQ ID NO: 1425144 - DNA, 23 bp, Homo sapiens
aagccagctgccgaccagagccc

SEQ ID NO: 1425145 - DNA, 12 bp, Homo sapiens
aagccagctttc

SEQ ID NO: 1425146 - DNA, 20 bp, Homo sapiens
aagccaggaatttcccagga

SEQ ID NO: 1425147 - DNA, 22 bp, Homo sapiens
aagccaggaatttcccaggacc

SEQ ID NO: 1425148 - DNA, 16 bp, Homo sapiens
aagccaggctcactca

SEQ ID NO: 1425149 - DNA, 18 bp, Homo sapiens
aagccaggctcactcaca

SEQ ID NO: 1425150 - DNA, 19 bp, Homo sapiens
aagccaggctcactcacag

SEQ ID NO: 1425151 - DNA, 22 bp, Homo sapiens
aagccaggctcactcacagagt

SEQ ID NO: 1425152 - DNA, 15 bp, Homo sapiens
aagccaggtacagga

SEQ ID NO: 1425153 - DNA, 20 bp, Homo sapiens
aagccagtgtccttcgagga

SEQ ID NO: 1425154 - DNA, 20 bp, Homo sapiens
aagccatcacttctccccgc

SEQ ID NO: 1425155 - DNA, 23 bp, Homo sapiens
aagccatgagttccagaaagtaa

SEQ ID NO: 1425156 - DNA, 21 bp, Homo sapiens
aagccatggctgacctctgga

SEQ ID NO: 1425157 - DNA, 23 bp, Homo sapiens
aagccattcacttccccaatctt

SEQ ID NO: 1425158 - DNA, 17 bp, Homo sapiens
aagcccaaggtgctgat

SEQ ID NO: 1425159 - DNA, 19 bp, Homo sapiens
aagcccagcccctactgct

SEQ ID NO: 1425160 - DNA, 22 bp, Homo sapiens
aagcccagcccctactgctgtg

SEQ ID NO: 1425161 - DNA, 14 bp, Homo sapiens
aagcccagctccag

SEQ ID NO: 1425162 - DNA, 11 bp, Homo sapiens
aagcccaggct

SEQ ID NO: 1425163 - DNA, 22 bp, Homo sapiens
aagcccagtgcactgaaagtca

SEQ ID NO: 1425164 - DNA, 14 bp, Homo sapiens
aagcccagttcatc

SEQ ID NO: 1425165 - DNA, 21 bp, Homo sapiens
aagcccataaggccagaaact

SEQ ID NO: 1425166 - DNA, 15 bp, Homo sapiens
aagcccatcctgacc

SEQ ID NO: 1425167 - DNA, 16 bp, Homo sapiens
aagcccatcctgacca

SEQ ID NO: 1425168 - DNA, 19 bp, Homo sapiens
aagcccatgagtccttgaa

SEQ ID NO: 1425169 - DNA, 11 bp, Homo sapiens
ccaggcctccc

SEQ ID NO: 1425170 - DNA, 15 bp, Homo sapiens
ccaggcctccctgca

SEQ ID NO: 1425171 - DNA, 13 bp, Homo sapiens
ccaggcctgacca

SEQ ID NO: 1425172 - DNA, 15 bp, Homo sapiens
ccaggcctgaccagg

SEQ ID NO: 1425173 - DNA, 12 bp, Homo sapiens
ccaggcctggcc

SEQ ID NO: 1425174 - DNA, 17 bp, Homo sapiens
ccaggcctggcctctgg

SEQ ID NO: 1425175 - DNA, 15 bp, Homo sapiens
ccaggcctgtccacc

SEQ ID NO: 1425176 - DNA, 19 bp, Homo sapiens
ccaggcctgtccaccctgc

SEQ ID NO: 1425177 - DNA, 17 bp, Homo sapiens
ccaggcgctgcagggcc

SEQ ID NO: 1425178 - DNA, 16 bp, Homo sapiens
ccaggcgggctcaagg

SEQ ID NO: 1425179 - DNA, 22 bp, Homo sapiens
ccaggcgtgggacgtggtcagg

SEQ ID NO: 1425180 - DNA, 18 bp, Homo sapiens
ccaggcgttggtgccact

SEQ ID NO: 1425181 - DNA, 19 bp, Homo sapiens
ccaggcgttggtgccactt

SEQ ID NO: 1425182 - DNA, 19 bp, Homo sapiens
ccaggctatgtataaaata

SEQ ID NO: 1425183 - DNA, 20 bp, Homo sapiens
ccaggctatgtataaaatac

SEQ ID NO: 1425184 - DNA, 22 bp, Homo sapiens
ccaggctatgtataaaatacat

SEQ ID NO: 1425185 - DNA, 18 bp, Homo sapiens
ccaggctcactcacagag

SEQ ID NO: 1425186 - DNA, 20 bp, Homo sapiens
ccaggctcactcacagagtc

SEQ ID NO: 1425187 - DNA, 17 bp, Homo sapiens
ccaggctcctacctgtc

SEQ ID NO: 1425188 - DNA, 21 bp, Homo sapiens
ccaggctcgtggactgagtgg

SEQ ID NO: 1425189 - DNA, 20 bp, Homo sapiens
ccaggctcttcctggacctg

SEQ ID NO: 1425190 - DNA, 23 bp, Homo sapiens
ccaggctcttcctggacctgagt

SEQ ID NO: 1425191 - DNA, 16 bp, Homo sapiens
ccaggctgaattacag

SEQ ID NO: 1425192 - DNA, 16 bp, Homo sapiens
ccaggctgagccatga

SEQ ID NO: 1425193 - DNA, 19 bp, Homo sapiens
ccaggctgagccatgagga

SEQ ID NO: 1425194 - DNA, 21 bp, Homo sapiens
ccaggctgagccatgaggagc

SEQ ID NO: 1425195 - DNA, 17 bp, Homo sapiens
ccaggctgagtgagcca

SEQ ID NO: 1425196 - DNA, 21 bp, Homo sapiens
ccaggctgagtgagccacaga

SEQ ID NO: 1425197 - DNA, 23 bp, Homo sapiens
ccaggctgagtgagccacagacc

SEQ ID NO: 1425198 - DNA, 12 bp, Homo sapiens
ccaggctgcact

SEQ ID NO: 1425199 - DNA, 18 bp, Homo sapiens
ccaggctgcactgcagtg

SEQ ID NO: 1425200 - DNA, 23 bp, Homo sapiens
ccaggctgcagcctccacttccc

SEQ ID NO: 1425201 - DNA, 14 bp, Homo sapiens
ccaggctgccgtgg

SEQ ID NO: 1425202 - DNA, 16 bp, Homo sapiens
ccaggctgcctcctgc

SEQ ID NO: 1425203 - DNA, 21 bp, Homo sapiens
ccaggctgcctcctgccctta

SEQ ID NO: 1425204 - DNA, 13 bp, Homo sapiens
ccaggctgcctcg

SEQ ID NO: 1425205 - DNA, 15 bp, Homo sapiens
ccaggctgcctgagc

SEQ ID NO: 1425206 - DNA, 15 bp, Homo sapiens
ccaggctggacaccc

SEQ ID NO: 1425207 - DNA, 23 bp, Homo sapiens
ccaggctggacaccctctgccga

SEQ ID NO: 1425208 - DNA, 18 bp, Homo sapiens
ccaggctggagtgcagtg

SEQ ID NO: 1425209 - DNA, 16 bp, Homo sapiens
ccaggctggccagtgc

SEQ ID NO: 1425210 - DNA, 18 bp, Homo sapiens
ccaggctggccagtgctg

SEQ ID NO: 1425211 - DNA, 13 bp, Homo sapiens
ccaggctggcgca

SEQ ID NO: 1425212 - DNA, 14 bp, Homo sapiens
ccaggctggcgcag

SEQ ID NO: 1425213 - DNA, 21 bp, Homo sapiens
ccaggctggcgcagccaaggc

SEQ ID NO: 1425214 - DNA, 23 bp, Homo sapiens
ccaggctggcgcagccaaggccg

SEQ ID NO: 1425215 - DNA, 16 bp, Homo sapiens
ccaggcttcaccctga

SEQ ID NO: 1425216 - DNA, 23 bp, Homo sapiens
ccaggcttcctgggtcctgcctg

SEQ ID NO: 1425217 - DNA, 22 bp, Homo sapiens
ccaggcttgtcactagcagctg

SEQ ID NO: 1425218 - DNA, 18 bp, Homo sapiens
ccaggctttgtacagagt

SEQ ID NO: 1425219 - DNA, 18 bp, Homo sapiens
ccagggaacagccccagg

SEQ ID NO: 1425220 - DNA, 18 bp, Homo sapiens
ccagggaagctggccgag

SEQ ID NO: 1425221 - DNA, 10 bp, Homo sapiens
ccagggaagg

SEQ ID NO: 1425222 - DNA, 14 bp, Homo sapiens
ccagggaaggtggg

SEQ ID NO: 1425223 - DNA, 15 bp, Homo sapiens
ccagggaatccaagc

SEQ ID NO: 1425224 - DNA, 17 bp, Homo sapiens
ccagggaatccaagcct

SEQ ID NO: 1425225 - DNA, 21 bp, Homo sapiens
ccagggaatccaagcctccac

SEQ ID NO: 1425226 - DNA, 17 bp, Homo sapiens
ccagggacacctcgccc

SEQ ID NO: 1425227 - DNA, 22 bp, Homo sapiens
ccagggaccactgggtgagaga

SEQ ID NO: 1425228 - DNA, 13 bp, Homo sapiens
ccagggacccagg

SEQ ID NO: 1425229 - DNA, 20 bp, Homo sapiens
ccagggacccaggtgtgcct

SEQ ID NO: 1425230 - DNA, 13 bp, Homo sapiens
ccagggagaagct

SEQ ID NO: 1425231 - DNA, 15 bp, Homo sapiens
ccagggagaagctcc

SEQ ID NO: 1425232 - DNA, 16 bp, Homo sapiens
ccagggagcaagacag

SEQ ID NO: 1425233 - DNA, 18 bp, Homo sapiens
ccagggagcaagacagag

SEQ ID NO: 1425234 - DNA, 12 bp, Homo sapiens
ccagggagcctt

SEQ ID NO: 1425235 - DNA, 15 bp, Homo sapiens
ccagggaggagagga

SEQ ID NO: 1425236 - DNA, 15 bp, Homo sapiens
ccagggatctctcta

SEQ ID NO: 1425237 - DNA, 12 bp, Homo sapiens
ccagggatgctg

SEQ ID NO: 1425238 - DNA, 13 bp, Homo sapiens
ccagggatgctgg

SEQ ID NO: 1425239 - DNA, 15 bp, Homo sapiens
ccagggatgctgggc

SEQ ID NO: 1425240 - DNA, 19 bp, Homo sapiens
ccagggatgctgggctggg

SEQ ID NO: 1425241 - DNA, 14 bp, Homo sapiens
ccagggatgggcag

SEQ ID NO: 1425242 - DNA, 15 bp, Homo sapiens
ccagggatgggcagc

SEQ ID NO: 1425243 - DNA, 21 bp, Homo sapiens
ccagggcaagggttaaggcct

SEQ ID NO: 1425244 - DNA, 16 bp, Homo sapiens
ccagggcattgctcag

SEQ ID NO: 1425245 - DNA, 23 bp, Homo sapiens
ccagggcattgctcagcccgctt

SEQ ID NO: 1425246 - DNA, 13 bp, Homo sapiens
ccagggccaccgc

SEQ ID NO: 1425247 - DNA, 15 bp, Homo sapiens
ccagggccaccgcag

SEQ ID NO: 1425248 - DNA, 19 bp, Homo sapiens
ccagggccacgctccagct

SEQ ID NO: 1425249 - DNA, 21 bp, Homo sapiens
ccagggccacgtgccaggccc

SEQ ID NO: 1425250 - DNA, 22 bp, Homo sapiens
ccagggccacgtgccaggcccg

SEQ ID NO: 1425251 - DNA, 17 bp, Homo sapiens
ccagggccactctgcct

SEQ ID NO: 1425252 - DNA, 21 bp, Homo sapiens
ccagggccactctgcctctgc

SEQ ID NO: 1425253 - DNA, 13 bp, Homo sapiens
ccagggcccagag

SEQ ID NO: 1425254 - DNA, 18 bp, Homo sapiens
ccagggcccagagcccag

SEQ ID NO: 1425255 - DNA, 15 bp, Homo sapiens
ccagggcccccacag

SEQ ID NO: 1425256 - DNA, 13 bp, Homo sapiens
ccagggcccccca

SEQ ID NO: 1425257 - DNA, 22 bp, Homo sapiens
ccagggcccctccctctgcccc

SEQ ID NO: 1425258 - DNA, 23 bp, Homo sapiens
ccagggcccctccctctgcccca

SEQ ID NO: 1425259 - DNA, 19 bp, Homo sapiens
ccagggcctgacaccccct

SEQ ID NO: 1425260 - DNA, 20 bp, Homo sapiens
ccagggcctgagcagctgga

SEQ ID NO: 1425261 - DNA, 16 bp, Homo sapiens
ccagggcctgggggca

SEQ ID NO: 1425262 - DNA, 20 bp, Homo sapiens
ccagggccttttctggcacc

SEQ ID NO: 1425263 - DNA, 16 bp, Homo sapiens
ccagggctagtgactt

SEQ ID NO: 1425264 - DNA, 19 bp, Homo sapiens
ccagggctcaccagctggg

SEQ ID NO: 1425265 - DNA, 12 bp, Homo sapiens
ccagggctcagc

SEQ ID NO: 1425266 - DNA, 13 bp, Homo sapiens
ccagggctccaaa

SEQ ID NO: 1425267 - DNA, 14 bp, Homo sapiens
ccagggctccaaat

SEQ ID NO: 1425268 - DNA, 17 bp, Homo sapiens
ccagggctccagcccct

SEQ ID NO: 1425269 - DNA, 16 bp, Homo sapiens
ccagggctcctgtggc

SEQ ID NO: 1425270 - DNA, 18 bp, Homo sapiens
ccagggctctgcaggcca

SEQ ID NO: 1425271 - DNA, 14 bp, Homo sapiens
ccagggctgcccct

SEQ ID NO: 1425272 - DNA, 18 bp, Homo sapiens
ccagggctggactgaggc

SEQ ID NO: 1425273 - DNA, 22 bp, Homo sapiens
ccagggctggactgaggcctga

SEQ ID NO: 1425274 - DNA, 15 bp, Homo sapiens
ccagggctgggagga

SEQ ID NO: 1425275 - DNA, 14 bp, Homo sapiens
ccagggctggggac

SEQ ID NO: 1425276 - DNA, 12 bp, Homo sapiens
ccaggggaacct

SEQ ID NO: 1425277 - DNA, 13 bp, Homo sapiens
ccaggggaacctg

SEQ ID NO: 1425278 - DNA, 17 bp, Homo sapiens
ccaggggaacctgccat

SEQ ID NO: 1425279 - DNA, 19 bp, Homo sapiens
ccaggggaaggaaggaggg

SEQ ID NO: 1425280 - DNA, 13 bp, Homo sapiens
ccaggggaccaca

SEQ ID NO: 1425281 - DNA, 18 bp, Homo sapiens
ccaggggagagggtctgg

SEQ ID NO: 1425282 - DNA, 16 bp, Homo sapiens
ccaggggagccagctg

SEQ ID NO: 1425283 - DNA, 18 bp, Homo sapiens
ccaggggagccagctgct

SEQ ID NO: 1425284 - DNA, 20 bp, Homo sapiens
ccaggggcagcaaggccttg

SEQ ID NO: 1425285 - DNA, 14 bp, Homo sapiens
ccaggggcagccac

SEQ ID NO: 1425286 - DNA, 19 bp, Homo sapiens
aatttaaacacctcctcat

SEQ ID NO: 1425287 - DNA, 19 bp, Homo sapiens
aatttaaacaggcccagca

SEQ ID NO: 1425288 - DNA, 20 bp, Homo sapiens
aatttaaacaggcccagcat

SEQ ID NO: 1425289 - DNA, 13 bp, Homo sapiens
aatttaaataaag

SEQ ID NO: 1425290 - DNA, 14 bp, Homo sapiens
aatttaaatataat

SEQ ID NO: 1425291 - DNA, 16 bp, Homo sapiens
aatttaaatataattc

SEQ ID NO: 1425292 - DNA, 20 bp, Homo sapiens
aatttaaatataattctgta

SEQ ID NO: 1425293 - DNA, 15 bp, Homo sapiens
aatttaaatggcttt

SEQ ID NO: 1425294 - DNA, 15 bp, Homo sapiens
aatttaactgcatat

SEQ ID NO: 1425295 - DNA, 16 bp, Homo sapiens
aatttaagtgacacag

SEQ ID NO: 1425296 - DNA, 17 bp, Homo sapiens
aatttaagtgacacaga

SEQ ID NO: 1425297 - DNA, 17 bp, Homo sapiens
aatttaataaaaaggaa

SEQ ID NO: 1425298 - DNA, 17 bp, Homo sapiens
aatttaatatactgcat

SEQ ID NO: 1425299 - DNA, 14 bp, Homo sapiens
aatttaatgctgcc

SEQ ID NO: 1425300 - DNA, 15 bp, Homo sapiens
aatttaatgctgcct

SEQ ID NO: 1425301 - DNA, 21 bp, Homo sapiens
aatttaattaggggttgctaa

SEQ ID NO: 1425302 - DNA, 19 bp, Homo sapiens
aatttaattcatgtttctt

SEQ ID NO: 1425303 - DNA, 19 bp, Homo sapiens
aatttaatttcttttttcc

SEQ ID NO: 1425304 - DNA, 19 bp, Homo sapiens
aatttacaggttcttaggc

SEQ ID NO: 1425305 - DNA, 18 bp, Homo sapiens
aatttacctaagattaca

SEQ ID NO: 1425306 - DNA, 17 bp, Homo sapiens
aatttactacaatatgt

SEQ ID NO: 1425307 - DNA, 22 bp, Homo sapiens
aatttactacaatatgtacatt

SEQ ID NO: 1425308 - DNA, 23 bp, Homo sapiens
aatttactacaatatgtacattt

SEQ ID NO: 1425309 - DNA, 15 bp, Homo sapiens
aatttacttgttttg

SEQ ID NO: 1425310 - DNA, 18 bp, Homo sapiens
aatttactttcttcacca

SEQ ID NO: 1425311 - DNA, 16 bp, Homo sapiens
aatttagaccttttcc

SEQ ID NO: 1425312 - DNA, 22 bp, Homo sapiens
aatttaggggaaaaaaaagtta

SEQ ID NO: 1425313 - DNA, 16 bp, Homo sapiens
cccttgagacctcagc

SEQ ID NO: 1425314 - DNA, 17 bp, Homo sapiens
cccttgagacctcagcc

SEQ ID NO: 1425315 - DNA, 18 bp, Homo sapiens
cccttgaggatggagagc

SEQ ID NO: 1425316 - DNA, 20 bp, Homo sapiens
cccttgatttaaacacacag

SEQ ID NO: 1425317 - DNA, 20 bp, Homo sapiens
cccttgcaccgtcctcagca

SEQ ID NO: 1425318 - DNA, 21 bp, Homo sapiens
cccttgcccagggctcagcct

SEQ ID NO: 1425319 - DNA, 22 bp, Homo sapiens
cccttgcccagggctcagcctg

SEQ ID NO: 1425320 - DNA, 17 bp, Homo sapiens
cccttgccctccgcctg

SEQ ID NO: 1425321 - DNA, 15 bp, Homo sapiens
cccttgcctccccat

SEQ ID NO: 1425322 - DNA, 23 bp, Homo sapiens
cccttgcctccccatttcccatc

SEQ ID NO: 1425323 - DNA, 20 bp, Homo sapiens
cccttgcctctgccctggat

SEQ ID NO: 1425324 - DNA, 20 bp, Homo sapiens
cccttgcctttcgaggcctg

SEQ ID NO: 1425325 - DNA, 19 bp, Homo sapiens
cccttgcttgcctgcaggg

SEQ ID NO: 1425326 - DNA, 22 bp, Homo sapiens
cccttgctttcctgggcctttg

SEQ ID NO: 1425327 - DNA, 18 bp, Homo sapiens
cccttggaaacctgccct

SEQ ID NO: 1425328 - DNA, 19 bp, Homo sapiens
cccttggaacaccctggat

SEQ ID NO: 1425329 - DNA, 21 bp, Homo sapiens
cccttggaggagagagacccc

SEQ ID NO: 1425330 - DNA, 12 bp, Homo sapiens
cccttggcctgt

SEQ ID NO: 1425331 - DNA, 16 bp, Homo sapiens
cccttggcctgtctca

SEQ ID NO: 1425332 - DNA, 23 bp, Homo sapiens
cccttgggcatccacccagtgct

SEQ ID NO: 1425333 - DNA, 15 bp, Homo sapiens
cccttgggccagaag

SEQ ID NO: 1425334 - DNA, 23 bp, Homo sapiens
cccttggggcctggcttgctcca

SEQ ID NO: 1425335 - DNA, 17 bp, Homo sapiens
cccttggtagcagcctg

SEQ ID NO: 1425336 - DNA, 19 bp, Homo sapiens
cccttggtagcagcctggg

SEQ ID NO: 1425337 - DNA, 15 bp, Homo sapiens
cccttgtcctgccag

SEQ ID NO: 1425338 - DNA, 16 bp, Homo sapiens
cccttgtcctgccagc

SEQ ID NO: 1425339 - DNA, 22 bp, Homo sapiens
cccttgttgtaaaaagcccagc

SEQ ID NO: 1425340 - DNA, 17 bp, Homo sapiens
cccttgtttctgttgtt

SEQ ID NO: 1425341 - DNA, 18 bp, Homo sapiens
ccctttactcagcccagc

SEQ ID NO: 1425342 - DNA, 12 bp, Homo sapiens
ccctttactcgt

SEQ ID NO: 1425343 - DNA, 16 bp, Homo sapiens
ccctttcacactggat

SEQ ID NO: 1425344 - DNA, 20 bp, Homo sapiens
ccctttcagatgtcttctgc

SEQ ID NO: 1425345 - DNA, 13 bp, Homo sapiens
ccctttccagtta

SEQ ID NO: 1425346 - DNA, 12 bp, Homo sapiens
ccctttcctgtc

SEQ ID NO: 1425347 - DNA, 15 bp, Homo sapiens
ccctttccttccatc

SEQ ID NO: 1425348 - DNA, 18 bp, Homo sapiens
ccctttccttgccttctt

SEQ ID NO: 1425349 - DNA, 14 bp, Homo sapiens
ccctttctcccctg

SEQ ID NO: 1425350 - DNA, 22 bp, Homo sapiens
ccctttctcccctgcccccagg

SEQ ID NO: 1425351 - DNA, 23 bp, Homo sapiens
ccctttctctctccaccccccac

SEQ ID NO: 1425352 - DNA, 17 bp, Homo sapiens
ccctttcttggccagtt

SEQ ID NO: 1425353 - DNA, 18 bp, Homo sapiens
ccctttgcacctgagacc

SEQ ID NO: 1425354 - DNA, 16 bp, Homo sapiens
ccctttgggaggctga

SEQ ID NO: 1425355 - DNA, 20 bp, Homo sapiens
ccctttggtttttttcttct

SEQ ID NO: 1425356 - DNA, 16 bp, Homo sapiens
cccttttccagcctca

SEQ ID NO: 1425357 - DNA, 12 bp, Homo sapiens
cccttttctcag

SEQ ID NO: 1425358 - DNA, 14 bp, Homo sapiens
cccttttgcctggc

SEQ ID NO: 1425359 - DNA, 15 bp, Homo sapiens
cccttttgcctggct

SEQ ID NO: 1425360 - DNA, 19 bp, Homo sapiens
cccttttgcctggctgtgg

SEQ ID NO: 1425361 - DNA, 22 bp, Homo sapiens
cccttttgtgggtttctctgtg

SEQ ID NO: 1425362 - DNA, 21 bp, Homo sapiens
ccctttttatgtgggatatag

SEQ ID NO: 1425363 - DNA, 15 bp, Homo sapiens
ccctttttcccttcc

SEQ ID NO: 1425364 - DNA, 17 bp, Homo sapiens
ccctttttcccttccct

SEQ ID NO: 1425365 - DNA, 15 bp, Homo sapiens
ccctttttctccaca

SEQ ID NO: 1425366 - DNA, 17 bp, Homo sapiens
cccttttttgtccccca

SEQ ID NO: 1425367 - DNA, 18 bp, Homo sapiens
cccttttttgtcccccaa

SEQ ID NO: 1425368 - DNA, 19 bp, Homo sapiens
ccgaaaatggacattgaga

SEQ ID NO: 1425369 - DNA, 17 bp, Homo sapiens
ccgaagccatcacttct

SEQ ID NO: 1425370 - DNA, 16 bp, Homo sapiens
ccgaagctctggctga

SEQ ID NO: 1425371 - DNA, 16 bp, Homo sapiens
ccgaaggtgcctcaga

SEQ ID NO: 1425372 - DNA, 17 bp, Homo sapiens
ccgaaggtgcctcagac

SEQ ID NO: 1425373 - DNA, 13 bp, Homo sapiens
ccgaagtaaaata

SEQ ID NO: 1425374 - DNA, 19 bp, Homo sapiens
ccgaatcccctccctgtca

SEQ ID NO: 1425375 - DNA, 16 bp, Homo sapiens
ccgacactgctgcacc

SEQ ID NO: 1425376 - DNA, 17 bp, Homo sapiens
ccgacactgctgcacca

SEQ ID NO: 1425377 - DNA, 13 bp, Homo sapiens
ccgacagcctggc

SEQ ID NO: 1425378 - DNA, 22 bp, Homo sapiens
ccgacagcctggcacagggcag

SEQ ID NO: 1425379 - DNA, 13 bp, Homo sapiens
ccgacatggctcc

SEQ ID NO: 1425380 - DNA, 12 bp, Homo sapiens
ccgacctcagcc

SEQ ID NO: 1425381 - DNA, 22 bp, Homo sapiens
ccgacgacacatatacatatga

SEQ ID NO: 1425382 - DNA, 22 bp, Homo sapiens
ccgacggctgtgacgcagccgg

SEQ ID NO: 1425383 - DNA, 14 bp, Homo sapiens
ccgacgtcatgtat

SEQ ID NO: 1425384 - DNA, 13 bp, Homo sapiens
ccgactctggccc

SEQ ID NO: 1425385 - DNA, 14 bp, Homo sapiens
ccgactctggccct

SEQ ID NO: 1425386 - DNA, 14 bp, Homo sapiens
ccgactgcctgtct

SEQ ID NO: 1425387 - DNA, 19 bp, Homo sapiens
ccgactgcctgtctccatg

SEQ ID NO: 1425388 - DNA, 16 bp, Homo sapiens
ccgactgctttggacc

SEQ ID NO: 1425389 - DNA, 17 bp, Homo sapiens
ccgactgctttggacct

SEQ ID NO: 1425390 - DNA, 14 bp, Homo sapiens
ccgactggctgtga

SEQ ID NO: 1425391 - DNA, 22 bp, Homo sapiens
ccgacttgaatattcctggact

SEQ ID NO: 1425392 - DNA, 19 bp, Homo sapiens
ccgacttggagactcctgg

SEQ ID NO: 1425393 - DNA, 15 bp, Homo sapiens
ccgagaaccctgagc

SEQ ID NO: 1425394 - DNA, 22 bp, Homo sapiens
ccgagacaccatcctgagccag

SEQ ID NO: 1425395 - DNA, 22 bp, Homo sapiens
ccgagaccccatcttccagcca

SEQ ID NO: 1425396 - DNA, 13 bp, Homo sapiens
ccgagagcctgct

SEQ ID NO: 1425397 - DNA, 14 bp, Homo sapiens
ccgagagcctgctc

SEQ ID NO: 1425398 - DNA, 15 bp, Homo sapiens
ccgagagcctgctcc

SEQ ID NO: 1425399 - DNA, 13 bp, Homo sapiens
ccgagagggagag

SEQ ID NO: 1425400 - DNA, 15 bp, Homo sapiens
ccgagaggtgggcca

SEQ ID NO: 1425401 - DNA, 20 bp, Homo sapiens
aatttgtaaaatgttctctt

SEQ ID NO: 1425402 - DNA, 22 bp, Homo sapiens
aatttgtaagtaacacagtatt

SEQ ID NO: 1425403 - DNA, 14 bp, Homo sapiens
aatttgtacaatgg

SEQ ID NO: 1425404 - DNA, 19 bp, Homo sapiens
aatttgtacaatggtttat

SEQ ID NO: 1425405 - DNA, 23 bp, Homo sapiens
aatttgtataaagcattactctt

SEQ ID NO: 1425406 - DNA, 14 bp, Homo sapiens
aatttgtatatcat

SEQ ID NO: 1425407 - DNA, 15 bp, Homo sapiens
aatttgtattaaaaa

SEQ ID NO: 1425408 - DNA, 10 bp, Homo sapiens
aatttgtcag

SEQ ID NO: 1425409 - DNA, 14 bp, Homo sapiens
aatttgtgtgtttt

SEQ ID NO: 1425410 - DNA, 23 bp, Homo sapiens
aatttgtgtgtttttagctgtga

SEQ ID NO: 1425411 - DNA, 14 bp, Homo sapiens
aatttgttcttgta

SEQ ID NO: 1425412 - DNA, 16 bp, Homo sapiens
aatttgttcttgtatt

SEQ ID NO: 1425413 - DNA, 12 bp, Homo sapiens
aatttgttcttt

SEQ ID NO: 1425414 - DNA, 18 bp, Homo sapiens
aatttgttgaaattatgt

SEQ ID NO: 1425415 - DNA, 15 bp, Homo sapiens
aatttgttgtttgtt

SEQ ID NO: 1425416 - DNA, 18 bp, Homo sapiens
aatttgtttaaagaataa

SEQ ID NO: 1425417 - DNA, 20 bp, Homo sapiens
aatttgtttaaagaataaag

SEQ ID NO: 1425418 - DNA, 17 bp, Homo sapiens
aatttgtttgtattttt

SEQ ID NO: 1425419 - DNA, 15 bp, Homo sapiens
aattttaaaaaataa

SEQ ID NO: 1425420 - DNA, 17 bp, Homo sapiens
aattttaaaaaataaca

SEQ ID NO: 1425421 - DNA, 19 bp, Homo sapiens
aattttaaaagtctatttt

SEQ ID NO: 1425422 - DNA, 13 bp, Homo sapiens
aattttaaagtat

SEQ ID NO: 1425423 - DNA, 22 bp, Homo sapiens
aattttaagtgctttgtaatgg

SEQ ID NO: 1425424 - DNA, 18 bp, Homo sapiens
aattttaatgctgtttct

SEQ ID NO: 1425425 - DNA, 17 bp, Homo sapiens
aattttaccctttagac

SEQ ID NO: 1425426 - DNA, 11 bp, Homo sapiens
aattttacttc

SEQ ID NO: 1425427 - DNA, 13 bp, Homo sapiens
aattttagaaata

SEQ ID NO: 1425428 - DNA, 16 bp, Homo sapiens
aattttagagaaactt

SEQ ID NO: 1425429 - DNA, 14 bp, Homo sapiens
aattttagtattca

SEQ ID NO: 1425430 - DNA, 15 bp, Homo sapiens
aattttagtgtatta

SEQ ID NO: 1425431 - DNA, 15 bp, Homo sapiens
aattttagtttttca

SEQ ID NO: 1425432 - DNA, 16 bp, Homo sapiens
ccgagtctcttctcca

SEQ ID NO: 1425433 - DNA, 20 bp, Homo sapiens
ccgagtctcttctccactgg

SEQ ID NO: 1425434 - DNA, 11 bp, Homo sapiens
ccgagtcttgc

SEQ ID NO: 1425435 - DNA, 14 bp, Homo sapiens
ccgatattctccct

SEQ ID NO: 1425436 - DNA, 20 bp, Homo sapiens
ccgatgagggaaggagccca

SEQ ID NO: 1425437 - DNA, 20 bp, Homo sapiens
ccgatgcaaacattggaaga

SEQ ID NO: 1425438 - DNA, 14 bp, Homo sapiens
ccgatgctgacctc

SEQ ID NO: 1425439 - DNA, 19 bp, Homo sapiens
ccgatgctgaggccaccca

SEQ ID NO: 1425440 - DNA, 11 bp, Homo sapiens
ccgatgctgct

SEQ ID NO: 1425441 - DNA, 14 bp, Homo sapiens
ccgatggactcctg

SEQ ID NO: 1425442 - DNA, 16 bp, Homo sapiens
ccgatggactcctgac

SEQ ID NO: 1425443 - DNA, 19 bp, Homo sapiens
ccgatgttattagatgtta

SEQ ID NO: 1425444 - DNA, 13 bp, Homo sapiens
ccgattcaccctg

SEQ ID NO: 1425445 - DNA, 13 bp, Homo sapiens
ccgatttctgcta

SEQ ID NO: 1425446 - DNA, 14 bp, Homo sapiens
ccgcaacccacagc

SEQ ID NO: 1425447 - DNA, 15 bp, Homo sapiens
ccgcaacccacagct

SEQ ID NO: 1425448 - DNA, 16 bp, Homo sapiens
ccgcaacccacagctc

SEQ ID NO: 1425449 - DNA, 23 bp, Homo sapiens
ccgcaacccacagctcagctgcc

SEQ ID NO: 1425450 - DNA, 18 bp, Homo sapiens
ccgcacatggtgtggggg

SEQ ID NO: 1425451 - DNA, 21 bp, Homo sapiens
ccgcaccagcccgaacaccat

SEQ ID NO: 1425452 - DNA, 13 bp, Homo sapiens
ccgcaccagctgc

SEQ ID NO: 1425453 - DNA, 18 bp, Homo sapiens
ccgcaccagctgctctgc

SEQ ID NO: 1425454 - DNA, 17 bp, Homo sapiens
ccgcaccccagagtgtg

SEQ ID NO: 1425455 - DNA, 13 bp, Homo sapiens
ccgcaccccccaa

SEQ ID NO: 1425456 - DNA, 19 bp, Homo sapiens
ccgcaccccggcctcaggg

SEQ ID NO: 1425457 - DNA, 13 bp, Homo sapiens
ccgcaccctgcac

SEQ ID NO: 1425458 - DNA, 17 bp, Homo sapiens
ccgcaccctgcacctgc

SEQ ID NO: 1425459 - DNA, 18 bp, Homo sapiens
ccgcaccctgcacctgct

SEQ ID NO: 1425460 - DNA, 14 bp, Homo sapiens
ccgcaccctggcct

SEQ ID NO: 1425461 - DNA, 17 bp, Homo sapiens
ccgcacctaaagcagcc

SEQ ID NO: 1425462 - DNA, 16 bp, Homo sapiens
ccgcaccttcctcctc

SEQ ID NO: 1425463 - DNA, 14 bp, Homo sapiens
ccgcagaagccctg

SEQ ID NO: 1425464 - DNA, 14 bp, Homo sapiens
ccgcagacaccttg

SEQ ID NO: 1425465 - DNA, 16 bp, Homo sapiens
ccgcagacaccttgga

SEQ ID NO: 1425466 - DNA, 16 bp, Homo sapiens
ccgcagacgggcacag

SEQ ID NO: 1425467 - DNA, 15 bp, Homo sapiens
ccgcagagctggccg

SEQ ID NO: 1425468 - DNA, 23 bp, Homo sapiens
ccgcagatgacacgcgctctcca

SEQ ID NO: 1425469 - DNA, 14 bp, Homo sapiens
ccgcagcagggaag

SEQ ID NO: 1425470 - DNA, 15 bp, Homo sapiens
ccgcagcccccaccc

SEQ ID NO: 1425471 - DNA, 14 bp, Homo sapiens
ccgcagcccgcctg

SEQ ID NO: 1425472 - DNA, 18 bp, Homo sapiens
ccgcagcccgcctgccgt

SEQ ID NO: 1425473 - DNA, 20 bp, Homo sapiens
ccgcagcccgtgaagcagtg

SEQ ID NO: 1425474 - DNA, 22 bp, Homo sapiens
ccgcagcccgtgaagcagtgcc

SEQ ID NO: 1425475 - DNA, 14 bp, Homo sapiens
ccgcagccctggca

SEQ ID NO: 1425476 - DNA, 20 bp, Homo sapiens
ccgcaggaactgggctgggc

SEQ ID NO: 1425477 - DNA, 13 bp, Homo sapiens
ccgcaggatccct

SEQ ID NO: 1425478 - DNA, 17 bp, Homo sapiens
ccgcaggatccctcctg

SEQ ID NO: 1425479 - DNA, 19 bp, Homo sapiens
ccgcaggcccggactcacc

SEQ ID NO: 1425480 - DNA, 21 bp, Homo sapiens
ccgcaggcccggactcaccaa

SEQ ID NO: 1425481 - DNA, 17 bp, Homo sapiens
ccgcagggagggctgtg

SEQ ID NO: 1425482 - DNA, 14 bp, Homo sapiens
ccgcagggccatgc

SEQ ID NO: 1425483 - DNA, 18 bp, Homo sapiens
ccgcaggggactgtctca

SEQ ID NO: 1425484 - DNA, 20 bp, Homo sapiens
ccgcagtgctgggaccagag

SEQ ID NO: 1425485 - DNA, 19 bp, Homo sapiens
ccgcatcttctccatctgg

SEQ ID NO: 1425486 - DNA, 14 bp, Homo sapiens
ccgcattccctgag

SEQ ID NO: 1425487 - DNA, 11 bp, Homo sapiens
ccgccacagcc

SEQ ID NO: 1425488 - DNA, 14 bp, Homo sapiens
ccgccacagccttc

SEQ ID NO: 1425489 - DNA, 15 bp, Homo sapiens
ccgccacccccatct

SEQ ID NO: 1425490 - DNA, 22 bp, Homo sapiens
ccgccacccccatcttccacct

SEQ ID NO: 1425491 - DNA, 13 bp, Homo sapiens
ccgccacctcagg

SEQ ID NO: 1425492 - DNA, 15 bp, Homo sapiens
ccgccacggccaccc

SEQ ID NO: 1425493 - DNA, 13 bp, Homo sapiens
ccgccacggcctg

SEQ ID NO: 1425494 - DNA, 16 bp, Homo sapiens
ccgccacggcctggct

SEQ ID NO: 1425495 - DNA, 20 bp, Homo sapiens
ccgccacggcctggctggtg

SEQ ID NO: 1425496 - DNA, 18 bp, Homo sapiens
ccgccactcagccatttc

SEQ ID NO: 1425497 - DNA, 20 bp, Homo sapiens
ccgccagcagcgcgcaggcc

SEQ ID NO: 1425498 - DNA, 19 bp, Homo sapiens
ccgccagccccgctcccac

SEQ ID NO: 1425499 - DNA, 11 bp, Homo sapiens
ccgccagcctc

SEQ ID NO: 1425500 - DNA, 22 bp, Homo sapiens
ccgccagcgtgtggagcagagc

SEQ ID NO: 1425501 - DNA, 14 bp, Homo sapiens
ccgccagctgccgc

SEQ ID NO: 1425502 - DNA, 12 bp, Homo sapiens
ccgccagctggg

SEQ ID NO: 1425503 - DNA, 15 bp, Homo sapiens
ccgccagctgggagc

SEQ ID NO: 1425504 - DNA, 20 bp, Homo sapiens
ccgccaggcgctgcagggcc

SEQ ID NO: 1425505 - DNA, 21 bp, Homo sapiens
ccgccaggcgctgcagggccg

SEQ ID NO: 1425506 - DNA, 15 bp, Homo sapiens
ccgccagggctgggg

SEQ ID NO: 1425507 - DNA, 22 bp, Homo sapiens
ccgccatccttcaccagagccc

SEQ ID NO: 1425508 - DNA, 16 bp, Homo sapiens
ccgccattgccaccag

SEQ ID NO: 1425509 - DNA, 19 bp, Homo sapiens
ccgccattgccaccaggag

SEQ ID NO: 1425510 - DNA, 23 bp, Homo sapiens
ccgcccacaggaagcctgcagtc

SEQ ID NO: 1425511 - DNA, 16 bp, Homo sapiens
ccgcccactgtcctgg

SEQ ID NO: 1425512 - DNA, 14 bp, Homo sapiens
ccgcccccgcctgg

SEQ ID NO: 1425513 - DNA, 16 bp, Homo sapiens
ccgcccccgcctgggc

SEQ ID NO: 1425514 - DNA, 17 bp, Homo sapiens
ccgcccccgcctgggca

SEQ ID NO: 1425515 - DNA, 15 bp, Homo sapiens
ccgccccgcccctcc

SEQ ID NO: 1425516 - DNA, 18 bp, Homo sapiens
ccgcccctctccaaacac

SEQ ID NO: 1425517 - DNA, 16 bp, Homo sapiens
acaaaaagatgtctca

SEQ ID NO: 1425518 - DNA, 18 bp, Homo sapiens
acaaaaagtttccatatg

SEQ ID NO: 1425519 - DNA, 14 bp, Homo sapiens
acaaaacaaaacaa

SEQ ID NO: 1425520 - DNA, 20 bp, Homo sapiens
acaaaacattttgaaggaaa

SEQ ID NO: 1425521 - DNA, 16 bp, Homo sapiens
acaaaacctaacttgc

SEQ ID NO: 1425522 - DNA, 17 bp, Homo sapiens
acaaaactctgtataag

SEQ ID NO: 1425523 - DNA, 12 bp, Homo sapiens
acaaaactgtaa

SEQ ID NO: 1425524 - DNA, 22 bp, Homo sapiens
acaaaactgtaaataaaatgtg

SEQ ID NO: 1425525 - DNA, 13 bp, Homo sapiens
acaaaacttgaaa

SEQ ID NO: 1425526 - DNA, 14 bp, Homo sapiens
acaaaacttgcatc

SEQ ID NO: 1425527 - DNA, 12 bp, Homo sapiens
acaaaagattta

SEQ ID NO: 1425528 - DNA, 21 bp, Homo sapiens
acaaaagctgaacacatttct

SEQ ID NO: 1425529 - DNA, 17 bp, Homo sapiens
acaaaagctttttaaaa

SEQ ID NO: 1425530 - DNA, 21 bp, Homo sapiens
acaaaagggtttaaactgatt

SEQ ID NO: 1425531 - DNA, 14 bp, Homo sapiens
acaaaataaacaaa

SEQ ID NO: 1425532 - DNA, 15 bp, Homo sapiens
acaaaatacaaaaaa

SEQ ID NO: 1425533 - DNA, 14 bp, Homo sapiens
acaaaatacattct

SEQ ID NO: 1425534 - DNA, 12 bp, Homo sapiens
acaaaatattta

SEQ ID NO: 1425535 - DNA, 22 bp, Homo sapiens
acaaaatatttaagtgaaggag

SEQ ID NO: 1425536 - DNA, 16 bp, Homo sapiens
acaaaatatttcccat

SEQ ID NO: 1425537 - DNA, 13 bp, Homo sapiens
acaaaatatttct

SEQ ID NO: 1425538 - DNA, 15 bp, Homo sapiens
acaaaatatttctaa

SEQ ID NO: 1425539 - DNA, 19 bp, Homo sapiens
acaaaatcgattggcttta

SEQ ID NO: 1425540 - DNA, 19 bp, Homo sapiens
acaaaattagaaaggacaa

SEQ ID NO: 1425541 - DNA, 18 bp, Homo sapiens
acaaaattcaaagcatgg

SEQ ID NO: 1425542 - DNA, 14 bp, Homo sapiens
acaaaatttctatt

SEQ ID NO: 1425543 - DNA, 22 bp, Homo sapiens
acaaaattttattttgtgctca

SEQ ID NO: 1425544 - DNA, 11 bp, Homo sapiens
acaaacaaaaa

SEQ ID NO: 1425545 - DNA, 12 bp, Homo sapiens
acaaacaaaaaa

SEQ ID NO: 1425546 - DNA, 18 bp, Homo sapiens
acaaacaaaatttctatt

SEQ ID NO: 1425547 - DNA, 15 bp, Homo sapiens
acaaacaaacaaaaa

SEQ ID NO: 1425548 - DNA, 16 bp, Homo sapiens
acaaacaaacaaaact

SEQ ID NO: 1425549 - DNA, 18 bp, Homo sapiens
acaaacacacctctgcca

SEQ ID NO: 1425550 - DNA, 21 bp, Homo sapiens
acaaacactgcagtttcctgg

SEQ ID NO: 1425551 - DNA, 12 bp, Homo sapiens
acaaacactgcc

SEQ ID NO: 1425552 - DNA, 14 bp, Homo sapiens
acaaacactgccat

SEQ ID NO: 1425553 - DNA, 16 bp, Homo sapiens
ccgccttggccttgca

SEQ ID NO: 1425554 - DNA, 12 bp, Homo sapiens
ccgcgagaggcc

SEQ ID NO: 1425555 - DNA, 13 bp, Homo sapiens
ccgcgccagtccc

SEQ ID NO: 1425556 - DNA, 22 bp, Homo sapiens
ccgcgccagtccccgctagtgg

SEQ ID NO: 1425557 - DNA, 16 bp, Homo sapiens
ccgcgccgatgccacc

SEQ ID NO: 1425558 - DNA, 17 bp, Homo sapiens
ccgcgccgatgccaccg

SEQ ID NO: 1425559 - DNA, 20 bp, Homo sapiens
ccgcgcgcccctgcccgaga

SEQ ID NO: 1425560 - DNA, 16 bp, Homo sapiens
ccgcgctcgcccagca

SEQ ID NO: 1425561 - DNA, 18 bp, Homo sapiens
ccgcgctcgcccagcagg

SEQ ID NO: 1425562 - DNA, 20 bp, Homo sapiens
ccgcgggcgctcgctcaggt

SEQ ID NO: 1425563 - DNA, 16 bp, Homo sapiens
ccgcgggcggccaggc

SEQ ID NO: 1425564 - DNA, 15 bp, Homo sapiens
ccgcgggtcccggcc

SEQ ID NO: 1425565 - DNA, 20 bp, Homo sapiens
ccgcgggtcccggccgcgcc

SEQ ID NO: 1425566 - DNA, 15 bp, Homo sapiens
ccgcgggttctagac

SEQ ID NO: 1425567 - DNA, 15 bp, Homo sapiens
ccgcggtgctctggc

SEQ ID NO: 1425568 - DNA, 15 bp, Homo sapiens
ccgcggtgctgactg

SEQ ID NO: 1425569 - DNA, 20 bp, Homo sapiens
ccgcggtgctgactgaggcc

SEQ ID NO: 1425570 - DNA, 21 bp, Homo sapiens
ccgcggtgctgactgaggcct

SEQ ID NO: 1425571 - DNA, 15 bp, Homo sapiens
ccgcgtgctggagaa

SEQ ID NO: 1425572 - DNA, 14 bp, Homo sapiens
ccgcgtgtgcctgt

SEQ ID NO: 1425573 - DNA, 16 bp, Homo sapiens
ccgctacctccctccc

SEQ ID NO: 1425574 - DNA, 18 bp, Homo sapiens
ccgctagaggcctgagga

SEQ ID NO: 1425575 - DNA, 11 bp, Homo sapiens
ccgctcagccc

SEQ ID NO: 1425576 - DNA, 13 bp, Homo sapiens
ccgctcagccctc

SEQ ID NO: 1425577 - DNA, 13 bp, Homo sapiens
ccgctcagtattt

SEQ ID NO: 1425578 - DNA, 20 bp, Homo sapiens
ccgctcccaacccccctcct

SEQ ID NO: 1425579 - DNA, 18 bp, Homo sapiens
ccgctcccaccgccccca

SEQ ID NO: 1425580 - DNA, 15 bp, Homo sapiens
ccgctcccacctagt

SEQ ID NO: 1425581 - DNA, 15 bp, Homo sapiens
ccgctccgtctctgt

SEQ ID NO: 1425582 - DNA, 17 bp, Homo sapiens
ccgctccgtctctgtcc

SEQ ID NO: 1425583 - DNA, 20 bp, Homo sapiens
ccgctctacatcttctgcct

SEQ ID NO: 1425584 - DNA, 12 bp, Homo sapiens
ccgctctccctg

SEQ ID NO: 1425585 - DNA, 18 bp, Homo sapiens
ccgctgacgcttcccttg

SEQ ID NO: 1425586 - DNA, 15 bp, Homo sapiens
ccgctgatggagccc

SEQ ID NO: 1425587 - DNA, 17 bp, Homo sapiens
ccgctgcagggctccca

SEQ ID NO: 1425588 - DNA, 12 bp, Homo sapiens
ccgctgccacca

SEQ ID NO: 1425589 - DNA, 22 bp, Homo sapiens
ccgctgccaccacgtctgccag

SEQ ID NO: 1425590 - DNA, 24 bp, Homo sapiens
ccgctgccaccacgtctgccaggc

SEQ ID NO: 1425591 - DNA, 20 bp, Homo sapiens
ccgctgccacgttggagaag

SEQ ID NO: 1425592 - DNA, 15 bp, Homo sapiens
ccgctgccagcacag

SEQ ID NO: 1425593 - DNA, 16 bp, Homo sapiens
ccgctgctgctgctgc

SEQ ID NO: 1425594 - DNA, 13 bp, Homo sapiens
ccgctgctgtgct

SEQ ID NO: 1425595 - DNA, 11 bp, Homo sapiens
ccgctggggtc

SEQ ID NO: 1425596 - DNA, 12 bp, Homo sapiens
ccgctggggtcc

SEQ ID NO: 1425597 - DNA, 15 bp, Homo sapiens
ccgctggtccctgcc

SEQ ID NO: 1425598 - DNA, 22 bp, Homo sapiens
ccgctggtccctgccctcccct

SEQ ID NO: 1425599 - DNA, 13 bp, Homo sapiens
ccgctgtctctga

SEQ ID NO: 1425600 - DNA, 21 bp, Homo sapiens
ccgctgtggccgcacgcctct

SEQ ID NO: 1425601 - DNA, 15 bp, Homo sapiens
ccgcttcctggcctc

SEQ ID NO: 1425602 - DNA, 16 bp, Homo sapiens
ccgcttcctggcctcc

SEQ ID NO: 1425603 - DNA, 13 bp, Homo sapiens
ccgcttggtggcc

SEQ ID NO: 1425604 - DNA, 17 bp, Homo sapiens
ccgcttgtccagcgcct

SEQ ID NO: 1425605 - DNA, 17 bp, Homo sapiens
ccgctttgaaagaagca

SEQ ID NO: 1425606 - DNA, 22 bp, Homo sapiens
ccggaaggaatgtcagggccag

SEQ ID NO: 1425607 - DNA, 12 bp, Homo sapiens
ccggaagggctt

SEQ ID NO: 1425608 - DNA, 14 bp, Homo sapiens
ccggacacggcttc

SEQ ID NO: 1425609 - DNA, 17 bp, Homo sapiens
ccggacagctgcccaga

SEQ ID NO: 1425610 - DNA, 12 bp, Homo sapiens
ccggactggtgc

SEQ ID NO: 1425611 - DNA, 17 bp, Homo sapiens
ccggagattggacggcc

SEQ ID NO: 1425612 - DNA, 12 bp, Homo sapiens
ccggagcccaga

SEQ ID NO: 1425613 - DNA, 13 bp, Homo sapiens
ccggagcccagat

SEQ ID NO: 1425614 - DNA, 15 bp, Homo sapiens
ccggagctttcaaag

SEQ ID NO: 1425615 - DNA, 14 bp, Homo sapiens
ccggaggggcctgg

SEQ ID NO: 1425616 - DNA, 17 bp, Homo sapiens
ccggaggtagaggttgt

SEQ ID NO: 1425617 - DNA, 16 bp, Homo sapiens
ccggaggtcactccac

SEQ ID NO: 1425618 - DNA, 18 bp, Homo sapiens
ccggagtaatcaggcagc

SEQ ID NO: 1425619 - DNA, 21 bp, Homo sapiens
ccggagtaatcaggcagcctt

SEQ ID NO: 1425620 - DNA, 20 bp, Homo sapiens
ccggataattttttttaatt

SEQ ID NO: 1425621 - DNA, 21 bp, Homo sapiens
ccggatattttttttttaatt

SEQ ID NO: 1425622 - DNA, 17 bp, Homo sapiens
ccggatttctaacagtc

SEQ ID NO: 1425623 - DNA, 19 bp, Homo sapiens
ccggcacctacatccccag

SEQ ID NO: 1425624 - DNA, 16 bp, Homo sapiens
ccggcagccccttctg

SEQ ID NO: 1425625 - DNA, 15 bp, Homo sapiens
ccggcagcgggcgga

SEQ ID NO: 1425626 - DNA, 16 bp, Homo sapiens
ccggcagggcgggcag

SEQ ID NO: 1425627 - DNA, 21 bp, Homo sapiens
ccggcagggcgggcagagggc

SEQ ID NO: 1425628 - DNA, 23 bp, Homo sapiens
ccggcagggcgggcagagggctg

SEQ ID NO: 1425629 - DNA, 19 bp, Homo sapiens
ccggcatctcccctagctc

SEQ ID NO: 1425630 - DNA, 18 bp, Homo sapiens
ccggcatgtttccagcag

SEQ ID NO: 1425631 - DNA, 14 bp, Homo sapiens
ccggccacacccag

SEQ ID NO: 1425632 - DNA, 13 bp, Homo sapiens
ccggccacagctg

SEQ ID NO: 1425633 - DNA, 19 bp, Homo sapiens
acaacagttctgagctgta

SEQ ID NO: 1425634 - DNA, 19 bp, Homo sapiens
acaacatcccacagtggca

SEQ ID NO: 1425635 - DNA, 21 bp, Homo sapiens
acaacatcgcaatagtttttt

SEQ ID NO: 1425636 - DNA, 13 bp, Homo sapiens
acaacatgttcta

SEQ ID NO: 1425637 - DNA, 16 bp, Homo sapiens
acaacattatgatcta

SEQ ID NO: 1425638 - DNA, 21 bp, Homo sapiens
acaaccaatttacactgccat

SEQ ID NO: 1425639 - DNA, 18 bp, Homo sapiens
acaaccacatacaacaca

SEQ ID NO: 1425640 - DNA, 15 bp, Homo sapiens
acaaccactggtctg

SEQ ID NO: 1425641 - DNA, 14 bp, Homo sapiens
acaaccatagaact

SEQ ID NO: 1425642 - DNA, 15 bp, Homo sapiens
acaaccatagaactg

SEQ ID NO: 1425643 - DNA, 22 bp, Homo sapiens
acaaccatgtcatttcagaagt

SEQ ID NO: 1425644 - DNA, 14 bp, Homo sapiens
acaaccattccaga

SEQ ID NO: 1425645 - DNA, 16 bp, Homo sapiens
acaacctcaactgcct

SEQ ID NO: 1425646 - DNA, 20 bp, Homo sapiens
acaacctctctgatcttgtg

SEQ ID NO: 1425647 - DNA, 18 bp, Homo sapiens
acaaccttctgtggctca

SEQ ID NO: 1425648 - DNA, 13 bp, Homo sapiens
acaacctttctgt

SEQ ID NO: 1425649 - DNA, 13 bp, Homo sapiens
acaacggaggcct

SEQ ID NO: 1425650 - DNA, 22 bp, Homo sapiens
acaacggaggcctgcgaccctg

SEQ ID NO: 1425651 - DNA, 20 bp, Homo sapiens
acaacggagtcaaaaattaa

SEQ ID NO: 1425652 - DNA, 16 bp, Homo sapiens
acaacgtgagagaaag

SEQ ID NO: 1425653 - DNA, 12 bp, Homo sapiens
acaactagattt

SEQ ID NO: 1425654 - DNA, 16 bp, Homo sapiens
acaactaggcttcagc

SEQ ID NO: 1425655 - DNA, 18 bp, Homo sapiens
acaactatttactttttt

SEQ ID NO: 1425656 - DNA, 18 bp, Homo sapiens
acaactctgcctttatga

SEQ ID NO: 1425657 - DNA, 17 bp, Homo sapiens
acaactggagttttttt

SEQ ID NO: 1425658 - DNA, 13 bp, Homo sapiens
acaactgtgactg

SEQ ID NO: 1425659 - DNA, 14 bp, Homo sapiens
acaactgtgactgt

SEQ ID NO: 1425660 - DNA, 16 bp, Homo sapiens
acaacttagctcaggt

SEQ ID NO: 1425661 - DNA, 20 bp, Homo sapiens
acaacttagctcaggtgcct

SEQ ID NO: 1425662 - DNA, 18 bp, Homo sapiens
acaacttatttaaaaata

SEQ ID NO: 1425663 - DNA, 13 bp, Homo sapiens
acaacttggcatt

SEQ ID NO: 1425664 - DNA, 18 bp, Homo sapiens
acaacttggcatttctat

SEQ ID NO: 1425665 - DNA, 17 bp, Homo sapiens
acaacttgtatttccaa

SEQ ID NO: 1425666 - DNA, 20 bp, Homo sapiens
acaactttattgattgaatt

SEQ ID NO: 1425667 - DNA, 21 bp, Homo sapiens
acaactttattgattgaattt

SEQ ID NO: 1425668 - DNA, 17 bp, Homo sapiens
acaacttttaaagaaaa

SEQ ID NO: 1425669 - DNA, 12 bp, Homo sapiens
acaagaaaatgt

SEQ ID NO: 1425670 - DNA, 20 bp, Homo sapiens
acaagaagccacagacctag

SEQ ID NO: 1425671 - DNA, 23 bp, Homo sapiens
acaagaatgcattccctgaatct

SEQ ID NO: 1425672 - DNA, 15 bp, Homo sapiens
acaagacccccagca

SEQ ID NO: 1425673 - DNA, 23 bp, Homo sapiens
ccggcttcctttcccaagccttc

SEQ ID NO: 1425674 - DNA, 14 bp, Homo sapiens
ccggcttctcggct

SEQ ID NO: 1425675 - DNA, 11 bp, Homo sapiens
ccgggaaggaa

SEQ ID NO: 1425676 - DNA, 14 bp, Homo sapiens
ccgggaaggaaggc

SEQ ID NO: 1425677 - DNA, 18 bp, Homo sapiens
ccgggaaggaaggctctc

SEQ ID NO: 1425678 - DNA, 23 bp, Homo sapiens
ccgggaagggtggcctgttccct

SEQ ID NO: 1425679 - DNA, 16 bp, Homo sapiens
ccgggacagacctgga

SEQ ID NO: 1425680 - DNA, 18 bp, Homo sapiens
ccgggacagacctggaca

SEQ ID NO: 1425681 - DNA, 15 bp, Homo sapiens
ccgggaccacagctg

SEQ ID NO: 1425682 - DNA, 17 bp, Homo sapiens
ccgggaccacagctgct

SEQ ID NO: 1425683 - DNA, 20 bp, Homo sapiens
ccgggaccacagctgctggc

SEQ ID NO: 1425684 - DNA, 23 bp, Homo sapiens
ccgggaccacagctgctggccag

SEQ ID NO: 1425685 - DNA, 21 bp, Homo sapiens
ccgggaccaccctgagccggc

SEQ ID NO: 1425686 - DNA, 17 bp, Homo sapiens
ccgggaccattgacctc

SEQ ID NO: 1425687 - DNA, 20 bp, Homo sapiens
ccgggacccggcggccctgc

SEQ ID NO: 1425688 - DNA, 16 bp, Homo sapiens
ccgggacttcaaagcc

SEQ ID NO: 1425689 - DNA, 23 bp, Homo sapiens
ccgggagaaggcatgagaaagaa

SEQ ID NO: 1425690 - DNA, 22 bp, Homo sapiens
ccgggaggaaaaggcccctgca

SEQ ID NO: 1425691 - DNA, 23 bp, Homo sapiens
ccgggaggaaaaggcccctgcaa

SEQ ID NO: 1425692 - DNA, 17 bp, Homo sapiens
ccgggatattatagaaa

SEQ ID NO: 1425693 - DNA, 10 bp, Homo sapiens
ccgggcccag

SEQ ID NO: 1425694 - DNA, 13 bp, Homo sapiens
ccgggcccagagg

SEQ ID NO: 1425695 - DNA, 20 bp, Homo sapiens
ccgggcccagaggagctggg

SEQ ID NO: 1425696 - DNA, 23 bp, Homo sapiens
ccgggcccctgggcttggcctgc

SEQ ID NO: 1425697 - DNA, 13 bp, Homo sapiens
ccgggccctccct

SEQ ID NO: 1425698 - DNA, 17 bp, Homo sapiens
ccgggccctcccttgga

SEQ ID NO: 1425699 - DNA, 14 bp, Homo sapiens
ccgggccctctgta

SEQ ID NO: 1425700 - DNA, 22 bp, Homo sapiens
ccgggccctctgtagctccctc

SEQ ID NO: 1425701 - DNA, 23 bp, Homo sapiens
ccgggccgaatcccctccctgtc

SEQ ID NO: 1425702 - DNA, 18 bp, Homo sapiens
ccgggccggacgcaggtg

SEQ ID NO: 1425703 - DNA, 16 bp, Homo sapiens
ccgggcctcccaccgc

SEQ ID NO: 1425704 - DNA, 15 bp, Homo sapiens
ccgggctctggccac

SEQ ID NO: 1425705 - DNA, 16 bp, Homo sapiens
ccgggctctggccacc

SEQ ID NO: 1425706 - DNA, 16 bp, Homo sapiens
ccgggctgagggcctg

SEQ ID NO: 1425707 - DNA, 15 bp, Homo sapiens
ccgggctgcctgggc

SEQ ID NO: 1425708 - DNA, 21 bp, Homo sapiens
ccgggctgcctgggctgttgg

SEQ ID NO: 1425709 - DNA, 12 bp, Homo sapiens
ccgggctggaga

SEQ ID NO: 1425710 - DNA, 12 bp, Homo sapiens
ccgggcttgggc

SEQ ID NO: 1425711 - DNA, 12 bp, Homo sapiens
ccggggaacaaa

SEQ ID NO: 1425712 - DNA, 23 bp, Homo sapiens
ccggggaggcaggggtcctgcag

SEQ ID NO: 1425713 - DNA, 16 bp, Homo sapiens
ccggggcagggcagcc

SEQ ID NO: 1425714 - DNA, 19 bp, Homo sapiens
ccggggccttatcgggctc

SEQ ID NO: 1425715 - DNA, 13 bp, Homo sapiens
ccgggggacagag

SEQ ID NO: 1425716 - DNA, 14 bp, Homo sapiens
ccgggggagcccag

SEQ ID NO: 1425717 - DNA, 15 bp, Homo sapiens
ccgggggagcccagt

SEQ ID NO: 1425718 - DNA, 23 bp, Homo sapiens
ccggggtgtaacttcctgctgca

SEQ ID NO: 1425719 - DNA, 22 bp, Homo sapiens
ccgggtcatctgtacctctgcc

SEQ ID NO: 1425720 - DNA, 14 bp, Homo sapiens
ccgggtccaggaga

SEQ ID NO: 1425721 - DNA, 15 bp, Homo sapiens
ccgggtccccagctc

SEQ ID NO: 1425722 - DNA, 20 bp, Homo sapiens
ccgggtccccagctccccag

SEQ ID NO: 1425723 - DNA, 14 bp, Homo sapiens
ccgggtctccttgg

SEQ ID NO: 1425724 - DNA, 18 bp, Homo sapiens
ccgggtctcgcagcctga

SEQ ID NO: 1425725 - DNA, 20 bp, Homo sapiens
ccgggttctagtctcctttg

SEQ ID NO: 1425726 - DNA, 19 bp, Homo sapiens
ccgggtttggctgagcctg

SEQ ID NO: 1425727 - DNA, 15 bp, Homo sapiens
ccggtaactgtcctg

SEQ ID NO: 1425728 - DNA, 15 bp, Homo sapiens
ccggtcacgttcttg

SEQ ID NO: 1425729 - DNA, 14 bp, Homo sapiens
ccggtccagctggc

SEQ ID NO: 1425730 - DNA, 18 bp, Homo sapiens
ccggtcccttgagacctc

SEQ ID NO: 1425731 - DNA, 18 bp, Homo sapiens
ccggtcgggcagccagca

SEQ ID NO: 1425732 - DNA, 19 bp, Homo sapiens
ccggtcgggcagccagcag

SEQ ID NO: 1425733 - DNA, 21 bp, Homo sapiens
ccggtcgggcagccagcagag

SEQ ID NO: 1425734 - DNA, 13 bp, Homo sapiens
ccggtgctgcagg

SEQ ID NO: 1425735 - DNA, 12 bp, Homo sapiens
ccggtgctgggt

SEQ ID NO: 1425736 - DNA, 13 bp, Homo sapiens
ccggtgctgggtt

SEQ ID NO: 1425737 - DNA, 15 bp, Homo sapiens
ccggtgctgggttcc

SEQ ID NO: 1425738 - DNA, 24 bp, Homo sapiens
ccggtgcttccaacaaggacagcc

SEQ ID NO: 1425739 - DNA, 13 bp, Homo sapiens
ccggtggctctgg

SEQ ID NO: 1425740 - DNA, 22 bp, Homo sapiens
ccggtgggtccgcatccctgct

SEQ ID NO: 1425741 - DNA, 17 bp, Homo sapiens
ccggtggtttgccatgt

SEQ ID NO: 1425742 - DNA, 20 bp, Homo sapiens
ccggttcagacccctgcctg

SEQ ID NO: 1425743 - DNA, 15 bp, Homo sapiens
ccggttcaggaccac

SEQ ID NO: 1425744 - DNA, 16 bp, Homo sapiens
ccggttcttccagtgg

SEQ ID NO: 1425745 - DNA, 21 bp, Homo sapiens
ccggtttcgaagttgatgcaa

SEQ ID NO: 1425746 - DNA, 16 bp, Homo sapiens
ccgtaacccaccccca

SEQ ID NO: 1425747 - DNA, 13 bp, Homo sapiens
ccgtaattatgta

SEQ ID NO: 1425748 - DNA, 21 bp, Homo sapiens
acaataaaaacaactttcact

SEQ ID NO: 1425749 - DNA, 20 bp, Homo sapiens
acaataaacaggaattttat

SEQ ID NO: 1425750 - DNA, 21 bp, Homo sapiens
acaataaacaggaattttatt

SEQ ID NO: 1425751 - DNA, 19 bp, Homo sapiens
acaataaagggagaatggt

SEQ ID NO: 1425752 - DNA, 13 bp, Homo sapiens
acaataaatgtat

SEQ ID NO: 1425753 - DNA, 19 bp, Homo sapiens
acaataaatgtattcaaat

SEQ ID NO: 1425754 - DNA, 14 bp, Homo sapiens
acaataaatgtgca

SEQ ID NO: 1425755 - DNA, 17 bp, Homo sapiens
acaataaattttttttg

SEQ ID NO: 1425756 - DNA, 14 bp, Homo sapiens
acaataataaagat

SEQ ID NO: 1425757 - DNA, 16 bp, Homo sapiens
acaataataaagatgt

SEQ ID NO: 1425758 - DNA, 18 bp, Homo sapiens
acaataatatttcaagtg

SEQ ID NO: 1425759 - DNA, 21 bp, Homo sapiens
acaataatatttcaagtgcct

SEQ ID NO: 1425760 - DNA, 19 bp, Homo sapiens
acaataatctctatttgag

SEQ ID NO: 1425761 - DNA, 18 bp, Homo sapiens
acaataatgcaattagaa

SEQ ID NO: 1425762 - DNA, 15 bp, Homo sapiens
acaataatgtactca

SEQ ID NO: 1425763 - DNA, 18 bp, Homo sapiens
acaataattctacatgtt

SEQ ID NO: 1425764 - DNA, 12 bp, Homo sapiens
acaatacaaatg

SEQ ID NO: 1425765 - DNA, 13 bp, Homo sapiens
acaatacaaatgg

SEQ ID NO: 1425766 - DNA, 13 bp, Homo sapiens
acaatacaatgta

SEQ ID NO: 1425767 - DNA, 16 bp, Homo sapiens
acaatacaatgtacaa

SEQ ID NO: 1425768 - DNA, 18 bp, Homo sapiens
acaatacaatgtacaatt

SEQ ID NO: 1425769 - DNA, 19 bp, Homo sapiens
acaatacaatgtacaatta

SEQ ID NO: 1425770 - DNA, 21 bp, Homo sapiens
acaatacttgcattccagagt

SEQ ID NO: 1425771 - DNA, 19 bp, Homo sapiens
acaatagctttaccctcag

SEQ ID NO: 1425772 - DNA, 20 bp, Homo sapiens
acaatagctttaccctcagg

SEQ ID NO: 1425773 - DNA, 19 bp, Homo sapiens
acaatagtatagaagtctg

SEQ ID NO: 1425774 - DNA, 14 bp, Homo sapiens
acaatagtcagaaa

SEQ ID NO: 1425775 - DNA, 15 bp, Homo sapiens
acaatatagtttttt

SEQ ID NO: 1425776 - DNA, 16 bp, Homo sapiens
acaatatagttttttc

SEQ ID NO: 1425777 - DNA, 14 bp, Homo sapiens
acaatatgtgagtg

SEQ ID NO: 1425778 - DNA, 22 bp, Homo sapiens
acaatattactttgtcttttca

SEQ ID NO: 1425779 - DNA, 14 bp, Homo sapiens
acaatattgtttct

SEQ ID NO: 1425780 - DNA, 15 bp, Homo sapiens
acaatattgtttcta

SEQ ID NO: 1425781 - DNA, 14 bp, Homo sapiens
acaatcaaaggaaa

SEQ ID NO: 1425782 - DNA, 23 bp, Homo sapiens
acaatcaactctaatagtgctta

SEQ ID NO: 1425783 - DNA, 22 bp, Homo sapiens
acaatcagtcccctcccatctg

SEQ ID NO: 1425784 - DNA, 20 bp, Homo sapiens
acaatcatggtcaagttccc

SEQ ID NO: 1425785 - DNA, 16 bp, Homo sapiens
acaatcgtcttaagtt

SEQ ID NO: 1425786 - DNA, 21 bp, Homo sapiens
acaatctatggcttatttcta

SEQ ID NO: 1425787 - DNA, 20 bp, Homo sapiens
acaatctctaggtttggcta

SEQ ID NO: 1425788 - DNA, 19 bp, Homo sapiens
acaatctggcttagtgcca

SEQ ID NO: 1425789 - DNA, 15 bp, Homo sapiens
acaatctgtaaattt

SEQ ID NO: 1425790 - DNA, 16 bp, Homo sapiens
acaatgaacacttata

SEQ ID NO: 1425791 - DNA, 15 bp, Homo sapiens
ccgtggacaggccca

SEQ ID NO: 1425792 - DNA, 13 bp, Homo sapiens
ccgtggactgcag

SEQ ID NO: 1425793 - DNA, 20 bp, Homo sapiens
ccgtggaggaggaaggcaag

SEQ ID NO: 1425794 - DNA, 22 bp, Homo sapiens
ccgtggaggaggaaggcaagag

SEQ ID NO: 1425795 - DNA, 18 bp, Homo sapiens
ccgtggatctccttccct

SEQ ID NO: 1425796 - DNA, 23 bp, Homo sapiens
ccgtggatctccttcccttctct

SEQ ID NO: 1425797 - DNA, 21 bp, Homo sapiens
ccgtggatggccgtggatgcg

SEQ ID NO: 1425798 - DNA, 22 bp, Homo sapiens
ccgtggattgcacgtggcctct

SEQ ID NO: 1425799 - DNA, 16 bp, Homo sapiens
ccgtggccctgccctc

SEQ ID NO: 1425800 - DNA, 20 bp, Homo sapiens
ccgtggccctgccctctcct

SEQ ID NO: 1425801 - DNA, 15 bp, Homo sapiens
ccgtggcttcccgct

SEQ ID NO: 1425802 - DNA, 23 bp, Homo sapiens
ccgtgggcgcaaaggtgcctcat

SEQ ID NO: 1425803 - DNA, 18 bp, Homo sapiens
ccgtggggtctgcgcttg

SEQ ID NO: 1425804 - DNA, 15 bp, Homo sapiens
ccgtggtatgtctgc

SEQ ID NO: 1425805 - DNA, 21 bp, Homo sapiens
ccgtggtcagagtgccactgc

SEQ ID NO: 1425806 - DNA, 19 bp, Homo sapiens
ccgtgtaaaaagcctcctt

SEQ ID NO: 1425807 - DNA, 21 bp, Homo sapiens
ccgtgtaaaaagcctccttgt

SEQ ID NO: 1425808 - DNA, 23 bp, Homo sapiens
ccgtgtcaagctgctctgagcca

SEQ ID NO: 1425809 - DNA, 11 bp, Homo sapiens
ccgtgtcccaa

SEQ ID NO: 1425810 - DNA, 15 bp, Homo sapiens
ccgtgtcccaaggag

SEQ ID NO: 1425811 - DNA, 17 bp, Homo sapiens
ccgtgtcccaaggagct

SEQ ID NO: 1425812 - DNA, 18 bp, Homo sapiens
ccgtgtcccgcggtgctg

SEQ ID NO: 1425813 - DNA, 23 bp, Homo sapiens
ccgtgtcccgcggtgctgactga

SEQ ID NO: 1425814 - DNA, 19 bp, Homo sapiens
ccgtgtcctctccctgcca

SEQ ID NO: 1425815 - DNA, 15 bp, Homo sapiens
ccgtgtctggatgca

SEQ ID NO: 1425816 - DNA, 13 bp, Homo sapiens
ccgtgtgccctcg

SEQ ID NO: 1425817 - DNA, 22 bp, Homo sapiens
ccgtgtgtcccagatgctgtca

SEQ ID NO: 1425818 - DNA, 20 bp, Homo sapiens
ccgtgtgtgtgtatgtgtgt

SEQ ID NO: 1425819 - DNA, 15 bp, Homo sapiens
ccgtgttagccagga

SEQ ID NO: 1425820 - DNA, 14 bp, Homo sapiens
ccgtgttcaggaca

SEQ ID NO: 1425821 - DNA, 16 bp, Homo sapiens
ccgtgttcaggacaca

SEQ ID NO: 1425822 - DNA, 14 bp, Homo sapiens
ccgtgttcctcggt

SEQ ID NO: 1425823 - DNA, 13 bp, Homo sapiens
ccgttagctcctg

SEQ ID NO: 1425824 - DNA, 15 bp, Homo sapiens
ccgttagctcctgtg

SEQ ID NO: 1425825 - DNA, 13 bp, Homo sapiens
ccgttcagcctgt

SEQ ID NO: 1425826 - DNA, 23 bp, Homo sapiens
ccgttctgctggcctggatctcc

SEQ ID NO: 1425827 - DNA, 19 bp, Homo sapiens
ccgttctgttccaacctcc

SEQ ID NO: 1425828 - DNA, 13 bp, Homo sapiens
ccgttgcttcccg

SEQ ID NO: 1425829 - DNA, 23 bp, Homo sapiens
ccgttggaaacataaccattaca

SEQ ID NO: 1425830 - DNA, 12 bp, Homo sapiens
ccgttgtgagct

SEQ ID NO: 1425831 - DNA, 13 bp, Homo sapiens
ccgttgtgagctg

SEQ ID NO: 1425832 - DNA, 15 bp, Homo sapiens
ccgttgtgagctgga

SEQ ID NO: 1425833 - DNA, 20 bp, Homo sapiens
ccgttgtttacttaaagatt

SEQ ID NO: 1425834 - DNA, 16 bp, Homo sapiens
ccgtttatgggccttg

SEQ ID NO: 1425835 - DNA, 18 bp, Homo sapiens
ccgtttcagaaggaccaa

SEQ ID NO: 1425836 - DNA, 13 bp, Homo sapiens
ccgtttctccttt

SEQ ID NO: 1425837 - DNA, 17 bp, Homo sapiens
ccgtttctccttttcct

SEQ ID NO: 1425838 - DNA, 14 bp, Homo sapiens
cctaaaaagagaag

SEQ ID NO: 1425839 - DNA, 18 bp, Homo sapiens
cctaaaagaaaccctgca

SEQ ID NO: 1425840 - DNA, 23 bp, Homo sapiens
cctaaaataacagtatgtgggat

SEQ ID NO: 1425841 - DNA, 21 bp, Homo sapiens
cctaaaatattacaaaataag

SEQ ID NO: 1425842 - DNA, 14 bp, Homo sapiens
cctaaacccaatga

SEQ ID NO: 1425843 - DNA, 14 bp, Homo sapiens
cctaaactttagac

SEQ ID NO: 1425844 - DNA, 23 bp, Homo sapiens
cctaaagagagtatttttataca

SEQ ID NO: 1425845 - DNA, 15 bp, Homo sapiens
cctaaagcagccagc

SEQ ID NO: 1425846 - DNA, 19 bp, Homo sapiens
cctaaataataaaaataaa

SEQ ID NO: 1425847 - DNA, 14 bp, Homo sapiens
cctaaatccaaaga

SEQ ID NO: 1425848 - DNA, 18 bp, Homo sapiens
cctaaatggcctcatgtg

SEQ ID NO: 1425849 - DNA, 15 bp, Homo sapiens
cctaaattatttact

SEQ ID NO: 1425850 - DNA, 13 bp, Homo sapiens
cctaaatttaatg

SEQ ID NO: 1425851 - DNA, 16 bp, Homo sapiens
cctaaatttaatgctg

SEQ ID NO: 1425852 - DNA, 18 bp, Homo sapiens
cctaaatttcattgtgtt

SEQ ID NO: 1425853 - DNA, 19 bp, Homo sapiens
cctaacaattttttattaa

SEQ ID NO: 1425854 - DNA, 14 bp, Homo sapiens
cctaaccccttcca

SEQ ID NO: 1425855 - DNA, 16 bp, Homo sapiens
cctaaccccttccaga

SEQ ID NO: 1425856 - DNA, 15 bp, Homo sapiens
cctaacccctttcct

SEQ ID NO: 1425857 - DNA, 18 bp, Homo sapiens
cctaacctcgggcctgct

SEQ ID NO: 1425858 - DNA, 18 bp, Homo sapiens
cctaactgcaatgtggat

SEQ ID NO: 1425859 - DNA, 16 bp, Homo sapiens
cctaacttacccagat

SEQ ID NO: 1425860 - DNA, 13 bp, Homo sapiens
cctaagaagctct

SEQ ID NO: 1425861 - DNA, 14 bp, Homo sapiens
cctaagaagctctg

SEQ ID NO: 1425862 - DNA, 23 bp, Homo sapiens
cctaagacatgtgaggaggaaaa

SEQ ID NO: 1425863 - DNA, 22 bp, Homo sapiens
acacaaagagaaaaagaaatgc

SEQ ID NO: 1425864 - DNA, 20 bp, Homo sapiens
acacaaaggtggaataaaca

SEQ ID NO: 1425865 - DNA, 13 bp, Homo sapiens
acacaacacacac

SEQ ID NO: 1425866 - DNA, 12 bp, Homo sapiens
acacaacaccag

SEQ ID NO: 1425867 - DNA, 17 bp, Homo sapiens
acacaacagcagtctcc

SEQ ID NO: 1425868 - DNA, 21 bp, Homo sapiens
acacaacagcagtctccttca

SEQ ID NO: 1425869 - DNA, 20 bp, Homo sapiens
acacaacagcgtggcttaga

SEQ ID NO: 1425870 - DNA, 18 bp, Homo sapiens
acacaactatttttccaa

SEQ ID NO: 1425871 - DNA, 14 bp, Homo sapiens
acacaactttattg

SEQ ID NO: 1425872 - DNA, 21 bp, Homo sapiens
acacaaggacccttcaggtgt

SEQ ID NO: 1425873 - DNA, 23 bp, Homo sapiens
acacaaggatagatgctggccca

SEQ ID NO: 1425874 - DNA, 19 bp, Homo sapiens
acacaagggatataaaatg

SEQ ID NO: 1425875 - DNA, 15 bp, Homo sapiens
acacaaggtgatttc

SEQ ID NO: 1425876 - DNA, 17 bp, Homo sapiens
acacaaggtgatttcag

SEQ ID NO: 1425877 - DNA, 18 bp, Homo sapiens
acacaaggtgatttcaga

SEQ ID NO: 1425878 - DNA, 14 bp, Homo sapiens
acacaagtaaaact

SEQ ID NO: 1425879 - DNA, 13 bp, Homo sapiens
acacaagtaaaca

SEQ ID NO: 1425880 - DNA, 14 bp, Homo sapiens
acacaagtaaacat

SEQ ID NO: 1425881 - DNA, 12 bp, Homo sapiens
acacacaaaaac

SEQ ID NO: 1425882 - DNA, 10 bp, Homo sapiens
acacacacaa

SEQ ID NO: 1425883 - DNA, 10 bp, Homo sapiens
acacacacac

SEQ ID NO: 1425884 - DNA, 15 bp, Homo sapiens
acacacacacaaacc

SEQ ID NO: 1425885 - DNA, 16 bp, Homo sapiens
acacacacacgatgca

SEQ ID NO: 1425886 - DNA, 21 bp, Homo sapiens
acacacacgcacgcacacaca

SEQ ID NO: 1425887 - DNA, 17 bp, Homo sapiens
acacacagactttctgt

SEQ ID NO: 1425888 - DNA, 19 bp, Homo sapiens
acacacagatacacacaca

SEQ ID NO: 1425889 - DNA, 13 bp, Homo sapiens
acacacagctcct

SEQ ID NO: 1425890 - DNA, 12 bp, Homo sapiens
acacacagtacg

SEQ ID NO: 1425891 - DNA, 21 bp, Homo sapiens
acacacatataaacatcacac

SEQ ID NO: 1425892 - DNA, 17 bp, Homo sapiens
acacacatctggccctg

SEQ ID NO: 1425893 - DNA, 13 bp, Homo sapiens
acacacatgccct

SEQ ID NO: 1425894 - DNA, 16 bp, Homo sapiens
acacacatgccctcct

SEQ ID NO: 1425895 - DNA, 20 bp, Homo sapiens
acacaccaccacgcctggct

SEQ ID NO: 1425896 - DNA, 17 bp, Homo sapiens
acacaccaggcgctaat

SEQ ID NO: 1425897 - DNA, 18 bp, Homo sapiens
acacacctgcctgcagag

SEQ ID NO: 1425898 - DNA, 20 bp, Homo sapiens
acacacgagcaaacccagag

SEQ ID NO: 1425899 - DNA, 13 bp, Homo sapiens
acacacgatgcat

SEQ ID NO: 1425900 - DNA, 14 bp, Homo sapiens
acacacgcacgcac

SEQ ID NO: 1425901 - DNA, 15 bp, Homo sapiens
acacacgcacgcaca

SEQ ID NO: 1425902 - DNA, 20 bp, Homo sapiens
acacacgtgctgtgggcctc

SEQ ID NO: 1425903 - DNA, 13 bp, Homo sapiens
acacactaatcga

SEQ ID NO: 1425904 - DNA, 20 bp, Homo sapiens
acacactcaaatcaagaaac

SEQ ID NO: 1425905 - DNA, 22 bp, Homo sapiens
acacactcacaatttaaaatat

SEQ ID NO: 1425906 - DNA, 14 bp, Homo sapiens
acacactcagtgca

SEQ ID NO: 1425907 - DNA, 20 bp, Homo sapiens
acacactgtgtcctggtgct

SEQ ID NO: 1425908 - DNA, 13 bp, Homo sapiens
acacagaaacact

SEQ ID NO: 1425909 - DNA, 21 bp, Homo sapiens
acacagaaatgctgctggcca

SEQ ID NO: 1425910 - DNA, 17 bp, Homo sapiens
acacagaatgctcaggg

SEQ ID NO: 1425911 - DNA, 22 bp, Homo sapiens
cctacagttttaactgtggata

SEQ ID NO: 1425912 - DNA, 15 bp, Homo sapiens
cctacatccccaggt

SEQ ID NO: 1425913 - DNA, 19 bp, Homo sapiens
cctacatccccaggtctct

SEQ ID NO: 1425914 - DNA, 20 bp, Homo sapiens
cctacatccccaggtctctc

SEQ ID NO: 1425915 - DNA, 19 bp, Homo sapiens
cctacatgaaacagaaaca

SEQ ID NO: 1425916 - DNA, 14 bp, Homo sapiens
cctaccacagtgtc

SEQ ID NO: 1425917 - DNA, 16 bp, Homo sapiens
cctaccacagtgtctg

SEQ ID NO: 1425918 - DNA, 14 bp, Homo sapiens
cctaccactctaat

SEQ ID NO: 1425919 - DNA, 21 bp, Homo sapiens
cctaccagcgcccgctgggct

SEQ ID NO: 1425920 - DNA, 15 bp, Homo sapiens
cctaccatgctgctt

SEQ ID NO: 1425921 - DNA, 15 bp, Homo sapiens
cctacccaaccactc

SEQ ID NO: 1425922 - DNA, 21 bp, Homo sapiens
cctaccccacaccaggccgtc

SEQ ID NO: 1425923 - DNA, 11 bp, Homo sapiens
cctaccccacc

SEQ ID NO: 1425924 - DNA, 14 bp, Homo sapiens
cctaccccagccag

SEQ ID NO: 1425925 - DNA, 21 bp, Homo sapiens
cctaccccctgaaagtgacag

SEQ ID NO: 1425926 - DNA, 20 bp, Homo sapiens
cctaccccgcagacaccttg

SEQ ID NO: 1425927 - DNA, 18 bp, Homo sapiens
cctaccctaaccaagttc

SEQ ID NO: 1425928 - DNA, 14 bp, Homo sapiens
cctaccctcgggcc

SEQ ID NO: 1425929 - DNA, 18 bp, Homo sapiens
cctaccctcgggcccacc

SEQ ID NO: 1425930 - DNA, 14 bp, Homo sapiens
cctaccctggactt

SEQ ID NO: 1425931 - DNA, 14 bp, Homo sapiens
cctaccctggcagg

SEQ ID NO: 1425932 - DNA, 19 bp, Homo sapiens
cctaccgagtctcttctcc

SEQ ID NO: 1425933 - DNA, 20 bp, Homo sapiens
cctaccgagtctcttctcca

SEQ ID NO: 1425934 - DNA, 21 bp, Homo sapiens
cctaccgagtctcttctccac

SEQ ID NO: 1425935 - DNA, 23 bp, Homo sapiens
cctaccgagtctcttctccactg

SEQ ID NO: 1425936 - DNA, 12 bp, Homo sapiens
cctacctcagcc

SEQ ID NO: 1425937 - DNA, 14 bp, Homo sapiens
cctacctcagccta

SEQ ID NO: 1425938 - DNA, 21 bp, Homo sapiens
cctacctgattggtgcaaccc

SEQ ID NO: 1425939 - DNA, 17 bp, Homo sapiens
cctacctgtctgctgcc

SEQ ID NO: 1425940 - DNA, 18 bp, Homo sapiens
cctacctgtctgctgcca

SEQ ID NO: 1425941 - DNA, 21 bp, Homo sapiens
cctacctgtctgctgccagca

SEQ ID NO: 1425942 - DNA, 13 bp, Homo sapiens
cctacctgttcag

SEQ ID NO: 1425943 - DNA, 22 bp, Homo sapiens
cctacctgttcagtgtcccggg

SEQ ID NO: 1425944 - DNA, 20 bp, Homo sapiens
cctacgggcgctgcagcctc

SEQ ID NO: 1425945 - DNA, 21 bp, Homo sapiens
cctacgggcgctgcagcctcc

SEQ ID NO: 1425946 - DNA, 16 bp, Homo sapiens
cctactccactgccct

SEQ ID NO: 1425947 - DNA, 18 bp, Homo sapiens
cctactccactgccctgg

SEQ ID NO: 1425948 - DNA, 15 bp, Homo sapiens
cctactccctgcaga

SEQ ID NO: 1425949 - DNA, 19 bp, Homo sapiens
cctactgcactttccccct

SEQ ID NO: 1425950 - DNA, 11 bp, Homo sapiens
cctactgctgt

SEQ ID NO: 1425951 - DNA, 12 bp, Homo sapiens
cctactgctgtg

SEQ ID NO: 1425952 - DNA, 12 bp, Homo sapiens
cctactgtccct

SEQ ID NO: 1425953 - DNA, 15 bp, Homo sapiens
cctactgtcctcaga

SEQ ID NO: 1425954 - DNA, 22 bp, Homo sapiens
cctactgttctaaagctctgac

SEQ ID NO: 1425955 - DNA, 20 bp, Homo sapiens
cctacttctgactttacttg

SEQ ID NO: 1425956 - DNA, 16 bp, Homo sapiens
cctacttcttttgctc

SEQ ID NO: 1425957 - DNA, 14 bp, Homo sapiens
cctacttgtgactg

SEQ ID NO: 1425958 - DNA, 13 bp, Homo sapiens
cctagaaatatct

SEQ ID NO: 1425959 - DNA, 18 bp, Homo sapiens
cctagaaatatctttctc

SEQ ID NO: 1425960 - DNA, 21 bp, Homo sapiens
cctagaacactaactcaccag

SEQ ID NO: 1425961 - DNA, 22 bp, Homo sapiens
cctagaaccaagcttcagagcc

SEQ ID NO: 1425962 - DNA, 20 bp, Homo sapiens
cctagaacctagataacgaa

SEQ ID NO: 1425963 - DNA, 17 bp, Homo sapiens
cctagaagtaagaagag

SEQ ID NO: 1425964 - DNA, 20 bp, Homo sapiens
cctagaagtaagaagaggag

SEQ ID NO: 1425965 - DNA, 16 bp, Homo sapiens
cctagaagtctccctg

SEQ ID NO: 1425966 - DNA, 17 bp, Homo sapiens
cctagacaacctttctg

SEQ ID NO: 1425967 - DNA, 23 bp, Homo sapiens
cctagaccagcagacagagccag

SEQ ID NO: 1425968 - DNA, 15 bp, Homo sapiens
cctagactgttactt

SEQ ID NO: 1425969 - DNA, 22 bp, Homo sapiens
cctagagacagtgatgcctgcc

SEQ ID NO: 1425970 - DNA, 23 bp, Homo sapiens
cctagagacagtgatgcctgccc

SEQ ID NO: 1425971 - DNA, 18 bp, Homo sapiens
cctagagagaataaattg

SEQ ID NO: 1425972 - DNA, 21 bp, Homo sapiens
cctagagagaataaattggat

SEQ ID NO: 1425973 - DNA, 21 bp, Homo sapiens
cctagaggggcaccttttcat

SEQ ID NO: 1425974 - DNA, 18 bp, Homo sapiens
cctagaggtgggcagctg

SEQ ID NO: 1425975 - DNA, 19 bp, Homo sapiens
cctagaggtgggcagctgg

SEQ ID NO: 1425976 - DNA, 20 bp, Homo sapiens
cctagaggtgggcagctggg

SEQ ID NO: 1425977 - DNA, 11 bp, Homo sapiens
cctagagtgta

SEQ ID NO: 1425978 - DNA, 20 bp, Homo sapiens
acacatttgctactgttgta

SEQ ID NO: 1425979 - DNA, 22 bp, Homo sapiens
acaccaaggtttatgccaccag

SEQ ID NO: 1425980 - DNA, 14 bp, Homo sapiens
acaccaataaatgt

SEQ ID NO: 1425981 - DNA, 16 bp, Homo sapiens
acaccaataaatgttt

SEQ ID NO: 1425982 - DNA, 20 bp, Homo sapiens
acaccaataaatgtttgtta

SEQ ID NO: 1425983 - DNA, 23 bp, Homo sapiens
acaccaataaatgtttgttattt

SEQ ID NO: 1425984 - DNA, 12 bp, Homo sapiens
acaccacagaca

SEQ ID NO: 1425985 - DNA, 15 bp, Homo sapiens
acaccacagacacac

SEQ ID NO: 1425986 - DNA, 16 bp, Homo sapiens
acaccacagacacaca

SEQ ID NO: 1425987 - DNA, 18 bp, Homo sapiens
acaccacagacacacaca

SEQ ID NO: 1425988 - DNA, 21 bp, Homo sapiens
acaccacagacacacacacgc

SEQ ID NO: 1425989 - DNA, 18 bp, Homo sapiens
acaccacctcactcctgt

SEQ ID NO: 1425990 - DNA, 19 bp, Homo sapiens
acaccactaaccatcccca

SEQ ID NO: 1425991 - DNA, 11 bp, Homo sapiens
acaccactgcc

SEQ ID NO: 1425992 - DNA, 13 bp, Homo sapiens
acaccactgccct

SEQ ID NO: 1425993 - DNA, 14 bp, Homo sapiens
acaccactgccctg

SEQ ID NO: 1425994 - DNA, 22 bp, Homo sapiens
acaccactgccctgcctgccca

SEQ ID NO: 1425995 - DNA, 17 bp, Homo sapiens
acaccagagctgccgac

SEQ ID NO: 1425996 - DNA, 13 bp, Homo sapiens
acaccagccgctg

SEQ ID NO: 1425997 - DNA, 15 bp, Homo sapiens
acaccagcctcctgg

SEQ ID NO: 1425998 - DNA, 20 bp, Homo sapiens
acaccagcctttctcccagg

SEQ ID NO: 1425999 - DNA, 16 bp, Homo sapiens
acaccaggaatttaga

SEQ ID NO: 1426000 - DNA, 13 bp, Homo sapiens
acaccaggactta

SEQ ID NO: 1426001 - DNA, 17 bp, Homo sapiens
acaccaggagtccctgg

SEQ ID NO: 1426002 - DNA, 19 bp, Homo sapiens
acaccaggagtccctggta

SEQ ID NO: 1426003 - DNA, 14 bp, Homo sapiens
acaccatcctgagc

SEQ ID NO: 1426004 - DNA, 15 bp, Homo sapiens
acaccatcctgagcc

SEQ ID NO: 1426005 - DNA, 17 bp, Homo sapiens
acaccattgaaggctta

SEQ ID NO: 1426006 - DNA, 22 bp, Homo sapiens
acacccaaagcatggactaacc

SEQ ID NO: 1426007 - DNA, 14 bp, Homo sapiens
acacccaaagctga

SEQ ID NO: 1426008 - DNA, 23 bp, Homo sapiens
acacccaccgtccgccctgctcc

SEQ ID NO: 1426009 - DNA, 23 bp, Homo sapiens
acacccaggctggagtgcagtgg

SEQ ID NO: 1426010 - DNA, 13 bp, Homo sapiens
acacccatttaaa

SEQ ID NO: 1426011 - DNA, 19 bp, Homo sapiens
acacccccatccctcggga

SEQ ID NO: 1426012 - DNA, 22 bp, Homo sapiens
acaccccctccccgcccctgtg

SEQ ID NO: 1426013 - DNA, 20 bp, Homo sapiens
acaccccgcctgcctcctgg

SEQ ID NO: 1426014 - DNA, 14 bp, Homo sapiens
acacccctgtgctc

SEQ ID NO: 1426015 - DNA, 22 bp, Homo sapiens
acacccctgtgctcccctgcca

SEQ ID NO: 1426016 - DNA, 18 bp, Homo sapiens
acacccgtgtgcacactc

SEQ ID NO: 1426017 - DNA, 16 bp, Homo sapiens
acaccctctcccagga

SEQ ID NO: 1426018 - DNA, 17 bp, Homo sapiens
acaccctctcccaggac

SEQ ID NO: 1426019 - DNA, 12 bp, Homo sapiens
acaccctctgcc

SEQ ID NO: 1426020 - DNA, 22 bp, Homo sapiens
acaccctctgggggtcctctct

SEQ ID NO: 1426021 - DNA, 23 bp, Homo sapiens
acaccctctgggggtcctctctg

SEQ ID NO: 1426022 - DNA, 11 bp, Homo sapiens
acaccctggat

SEQ ID NO: 1426023 - DNA, 17 bp, Homo sapiens
acaccctggcctgaact

SEQ ID NO: 1426024 - DNA, 17 bp, Homo sapiens
acaccctggtcctgact

SEQ ID NO: 1426025 - DNA, 13 bp, Homo sapiens
acaccctgtactg

SEQ ID NO: 1426026 - DNA, 15 bp, Homo sapiens
acacccttagaaaat

SEQ ID NO: 1426027 - DNA, 20 bp, Homo sapiens
acacccttcacataccctcc

SEQ ID NO: 1426028 - DNA, 13 bp, Homo sapiens
acaccgactagcc

SEQ ID NO: 1426029 - DNA, 13 bp, Homo sapiens
cctagtgccccag

SEQ ID NO: 1426030 - DNA, 23 bp, Homo sapiens
cctagtgcttccacttctatgca

SEQ ID NO: 1426031 - DNA, 14 bp, Homo sapiens
cctagtgggagtta

SEQ ID NO: 1426032 - DNA, 17 bp, Homo sapiens
cctagtggggtctccct

SEQ ID NO: 1426033 - DNA, 18 bp, Homo sapiens
cctagtggggtctccctc

SEQ ID NO: 1426034 - DNA, 19 bp, Homo sapiens
cctagtggggtctccctct

SEQ ID NO: 1426035 - DNA, 21 bp, Homo sapiens
cctagtggggtctccctctcc

SEQ ID NO: 1426036 - DNA, 23 bp, Homo sapiens
cctagtggggtctccctctcctg

SEQ ID NO: 1426037 - DNA, 16 bp, Homo sapiens
cctagtgtgtgtgctt

SEQ ID NO: 1426038 - DNA, 19 bp, Homo sapiens
cctagttaaagaaaggaaa

SEQ ID NO: 1426039 - DNA, 20 bp, Homo sapiens
cctagttagcatccaggctg

SEQ ID NO: 1426040 - DNA, 15 bp, Homo sapiens
cctagtttgacctca

SEQ ID NO: 1426041 - DNA, 17 bp, Homo sapiens
cctagtttgacctcaca

SEQ ID NO: 1426042 - DNA, 20 bp, Homo sapiens
cctagtttgggaggagcaga

SEQ ID NO: 1426043 - DNA, 15 bp, Homo sapiens
cctagttttctcctc

SEQ ID NO: 1426044 - DNA, 15 bp, Homo sapiens
cctataaagggccca

SEQ ID NO: 1426045 - DNA, 20 bp, Homo sapiens
cctataacactgtgaagagc

SEQ ID NO: 1426046 - DNA, 23 bp, Homo sapiens
cctataaggagagttcaagcctg

SEQ ID NO: 1426047 - DNA, 16 bp, Homo sapiens
cctatacctgagcctc

SEQ ID NO: 1426048 - DNA, 18 bp, Homo sapiens
cctatactggttatagtt

SEQ ID NO: 1426049 - DNA, 13 bp, Homo sapiens
cctatagagaggg

SEQ ID NO: 1426050 - DNA, 16 bp, Homo sapiens
cctatagctacatgtt

SEQ ID NO: 1426051 - DNA, 18 bp, Homo sapiens
cctatagtcccagctact

SEQ ID NO: 1426052 - DNA, 13 bp, Homo sapiens
cctatatatttct

SEQ ID NO: 1426053 - DNA, 17 bp, Homo sapiens
cctatatcagtcgtttt

SEQ ID NO: 1426054 - DNA, 13 bp, Homo sapiens
cctatatctgaga

SEQ ID NO: 1426055 - DNA, 22 bp, Homo sapiens
cctatattgttttcagtgtaca

SEQ ID NO: 1426056 - DNA, 20 bp, Homo sapiens
cctatcaacctaagcaacag

SEQ ID NO: 1426057 - DNA, 20 bp, Homo sapiens
cctatcagagttgctgcaaa

SEQ ID NO: 1426058 - DNA, 16 bp, Homo sapiens
cctatccccaggccag

SEQ ID NO: 1426059 - DNA, 14 bp, Homo sapiens
cctatccctctcct

SEQ ID NO: 1426060 - DNA, 15 bp, Homo sapiens
cctatccgctgccag

SEQ ID NO: 1426061 - DNA, 14 bp, Homo sapiens
cctatcctctgagt

SEQ ID NO: 1426062 - DNA, 16 bp, Homo sapiens
cctatctatcttccaa

SEQ ID NO: 1426063 - DNA, 21 bp, Homo sapiens
cctatctatcttccaaatgca

SEQ ID NO: 1426064 - DNA, 13 bp, Homo sapiens
cctatctccctgg

SEQ ID NO: 1426065 - DNA, 15 bp, Homo sapiens
cctatcttccttcct

SEQ ID NO: 1426066 - DNA, 18 bp, Homo sapiens
cctatcttttagttttag

SEQ ID NO: 1426067 - DNA, 13 bp, Homo sapiens
cctatgacacagt

SEQ ID NO: 1426068 - DNA, 14 bp, Homo sapiens
cctatgatcccagc

SEQ ID NO: 1426069 - DNA, 20 bp, Homo sapiens
cctatgcacatatggactct

SEQ ID NO: 1426070 - DNA, 21 bp, Homo sapiens
cctatgcacatatggactctg

SEQ ID NO: 1426071 - DNA, 22 bp, Homo sapiens
cctatgctggtagatgctgagg

SEQ ID NO: 1426072 - DNA, 13 bp, Homo sapiens
cctatggaaaaaa

SEQ ID NO: 1426073 - DNA, 14 bp, Homo sapiens
cctatgtcctaagg

SEQ ID NO: 1426074 - DNA, 19 bp, Homo sapiens
cctatgtcctaaggacaca

SEQ ID NO: 1426075 - DNA, 21 bp, Homo sapiens
cctatgtcctaaggacacact

SEQ ID NO: 1426076 - DNA, 22 bp, Homo sapiens
cctatgtcctaaggacacacta

SEQ ID NO: 1426077 - DNA, 14 bp, Homo sapiens
cctatgtctcagga

SEQ ID NO: 1426078 - DNA, 17 bp, Homo sapiens
cctatgtctcaggagtg

SEQ ID NO: 1426079 - DNA, 16 bp, Homo sapiens
cctatgtggcagctgg

SEQ ID NO: 1426080 - DNA, 16 bp, Homo sapiens
cctattcaccctccac

SEQ ID NO: 1426081 - DNA, 19 bp, Homo sapiens
cctattcaccctccacttc

SEQ ID NO: 1426082 - DNA, 20 bp, Homo sapiens
cctattcaccctccacttcc

SEQ ID NO: 1426083 - DNA, 23 bp, Homo sapiens
cctattcaccctccacttcccgt

SEQ ID NO: 1426084 - DNA, 22 bp, Homo sapiens
cctattcacgccgtaattcttt

SEQ ID NO: 1426085 - DNA, 20 bp, Homo sapiens
cctattctatccatctcctg

SEQ ID NO: 1426086 - DNA, 22 bp, Homo sapiens
cctattgcaaaggttccaactg

SEQ ID NO: 1426087 - DNA, 18 bp, Homo sapiens
cctatttaaaactgggtc

SEQ ID NO: 1426088 - DNA, 12 bp, Homo sapiens
cctatttaatac

SEQ ID NO: 1426089 - DNA, 15 bp, Homo sapiens
cctatttaatacagc

SEQ ID NO: 1426090 - DNA, 12 bp, Homo sapiens
cctatttcagaa

SEQ ID NO: 1426091 - DNA, 23 bp, Homo sapiens
cctatttcagtgttacctgtgtg

SEQ ID NO: 1426092 - DNA, 15 bp, Homo sapiens
cctatttctatgtca

SEQ ID NO: 1426093 - DNA, 13 bp, Homo sapiens
acactagcctctc

SEQ ID NO: 1426094 - DNA, 19 bp, Homo sapiens
acactagttttgtgccagc

SEQ ID NO: 1426095 - DNA, 17 bp, Homo sapiens
acactatatctgtatat

SEQ ID NO: 1426096 - DNA, 19 bp, Homo sapiens
acactatgcactgctgtaa

SEQ ID NO: 1426097 - DNA, 18 bp, Homo sapiens
acactattaccatgagaa

SEQ ID NO: 1426098 - DNA, 17 bp, Homo sapiens
acactcaaatcaagaaa

SEQ ID NO: 1426099 - DNA, 17 bp, Homo sapiens
acactcagtccactgtt

SEQ ID NO: 1426100 - DNA, 18 bp, Homo sapiens
acactcagtcccccacca

SEQ ID NO: 1426101 - DNA, 16 bp, Homo sapiens
acactcagttgttcaa

SEQ ID NO: 1426102 - DNA, 22 bp, Homo sapiens
acactccaccctccaccttcca

SEQ ID NO: 1426103 - DNA, 11 bp, Homo sapiens
acactccactg

SEQ ID NO: 1426104 - DNA, 12 bp, Homo sapiens
acactccagcct

SEQ ID NO: 1426105 - DNA, 16 bp, Homo sapiens
acactccagcctgagc

SEQ ID NO: 1426106 - DNA, 17 bp, Homo sapiens
acactccagcctgagca

SEQ ID NO: 1426107 - DNA, 15 bp, Homo sapiens
acactccagtggcag

SEQ ID NO: 1426108 - DNA, 20 bp, Homo sapiens
acactcccaaggttggagcc

SEQ ID NO: 1426109 - DNA, 18 bp, Homo sapiens
acactcctcctcggaaga

SEQ ID NO: 1426110 - DNA, 14 bp, Homo sapiens
acactcctctgcgt

SEQ ID NO: 1426111 - DNA, 23 bp, Homo sapiens
acactcgcccgcccactgtcctg

SEQ ID NO: 1426112 - DNA, 24 bp, Homo sapiens
acactcgcccgcccactgtcctgg

SEQ ID NO: 1426113 - DNA, 22 bp, Homo sapiens
acactctatatgtagtgcattt

SEQ ID NO: 1426114 - DNA, 16 bp, Homo sapiens
acactctgctctgccc

SEQ ID NO: 1426115 - DNA, 12 bp, Homo sapiens
acactctttgta

SEQ ID NO: 1426116 - DNA, 13 bp, Homo sapiens
acactgaaaggaa

SEQ ID NO: 1426117 - DNA, 13 bp, Homo sapiens
acactgaaagttt

SEQ ID NO: 1426118 - DNA, 12 bp, Homo sapiens
acactgaactta

SEQ ID NO: 1426119 - DNA, 19 bp, Homo sapiens
acactgaagttaacagaga

SEQ ID NO: 1426120 - DNA, 17 bp, Homo sapiens
acactgaccatccactc

SEQ ID NO: 1426121 - DNA, 22 bp, Homo sapiens
acactgaccttggagagacaca

SEQ ID NO: 1426122 - DNA, 19 bp, Homo sapiens
acactgagagcctttttga

SEQ ID NO: 1426123 - DNA, 15 bp, Homo sapiens
acactgagcaagatc

SEQ ID NO: 1426124 - DNA, 19 bp, Homo sapiens
acactgagcaagatcttgt

SEQ ID NO: 1426125 - DNA, 21 bp, Homo sapiens
acactgaggcttaggcctctc

SEQ ID NO: 1426126 - DNA, 23 bp, Homo sapiens
acactgatgagtttcactgtact

SEQ ID NO: 1426127 - DNA, 18 bp, Homo sapiens
acactgcaagagccttgg

SEQ ID NO: 1426128 - DNA, 17 bp, Homo sapiens
acactgcagccctctcc

SEQ ID NO: 1426129 - DNA, 16 bp, Homo sapiens
acactgccagaagaga

SEQ ID NO: 1426130 - DNA, 18 bp, Homo sapiens
acactgccatattgtgta

SEQ ID NO: 1426131 - DNA, 22 bp, Homo sapiens
acactgccatcttagtttggat

SEQ ID NO: 1426132 - DNA, 14 bp, Homo sapiens
acactgcctgggct

SEQ ID NO: 1426133 - DNA, 16 bp, Homo sapiens
acactgcctgggctga

SEQ ID NO: 1426134 - DNA, 19 bp, Homo sapiens
acactgcctttttatttat

SEQ ID NO: 1426135 - DNA, 20 bp, Homo sapiens
acactgcggaagccaaaggc

SEQ ID NO: 1426136 - DNA, 19 bp, Homo sapiens
acactgctctaacagccct

SEQ ID NO: 1426137 - DNA, 24 bp, Homo sapiens
acactgctgtccacatgacctcca

SEQ ID NO: 1426138 - DNA, 19 bp, Homo sapiens
acactggaacatggctagc

SEQ ID NO: 1426139 - DNA, 19 bp, Homo sapiens
acactggacaacattttac

SEQ ID NO: 1426140 - DNA, 14 bp, Homo sapiens
acactggatatgtt

SEQ ID NO: 1426141 - DNA, 21 bp, Homo sapiens
acactggatccatcttgagcc

SEQ ID NO: 1426142 - DNA, 18 bp, Homo sapiens
acactgggcagcaaggct

SEQ ID NO: 1426143 - DNA, 13 bp, Homo sapiens
acactgggcctgg

SEQ ID NO: 1426144 - DNA, 16 bp, Homo sapiens
acactgggtgcgtctc

SEQ ID NO: 1426145 - DNA, 19 bp, Homo sapiens
acactgggtgcgtctccag

SEQ ID NO: 1426146 - DNA, 19 bp, Homo sapiens
acactgggtggtggcctgg

SEQ ID NO: 1426147 - DNA, 14 bp, Homo sapiens
cctcactcttgaag

SEQ ID NO: 1426148 - DNA, 17 bp, Homo sapiens
cctcactgctggggagt

SEQ ID NO: 1426149 - DNA, 20 bp, Homo sapiens
cctcactgctggggagtccc

SEQ ID NO: 1426150 - DNA, 13 bp, Homo sapiens
cctcactggctgg

SEQ ID NO: 1426151 - DNA, 14 bp, Homo sapiens
cctcactggctggg

SEQ ID NO: 1426152 - DNA, 19 bp, Homo sapiens
cctcactggggtcctgggg

SEQ ID NO: 1426153 - DNA, 21 bp, Homo sapiens
cctcactgggtggggtgagga

SEQ ID NO: 1426154 - DNA, 20 bp, Homo sapiens
cctcactgtatccaggttcc

SEQ ID NO: 1426155 - DNA, 13 bp, Homo sapiens
cctcactgtcctg

SEQ ID NO: 1426156 - DNA, 16 bp, Homo sapiens
cctcacttctgtctcc

SEQ ID NO: 1426157 - DNA, 17 bp, Homo sapiens
cctcacttggctgtctg

SEQ ID NO: 1426158 - DNA, 20 bp, Homo sapiens
cctcacttggctgtctgacc

SEQ ID NO: 1426159 - DNA, 22 bp, Homo sapiens
cctcacttggctgtctgaccag

SEQ ID NO: 1426160 - DNA, 16 bp, Homo sapiens
cctcagaaaggatttt

SEQ ID NO: 1426161 - DNA, 13 bp, Homo sapiens
cctcagaagaaaa

SEQ ID NO: 1426162 - DNA, 21 bp, Homo sapiens
cctcagaagaaaacaaagttc

SEQ ID NO: 1426163 - DNA, 14 bp, Homo sapiens
cctcagaaggcccc

SEQ ID NO: 1426164 - DNA, 16 bp, Homo sapiens
cctcagaaggccccag

SEQ ID NO: 1426165 - DNA, 21 bp, Homo sapiens
cctcagaaggccccagagaga

SEQ ID NO: 1426166 - DNA, 17 bp, Homo sapiens
cctcagagaccagggct

SEQ ID NO: 1426167 - DNA, 19 bp, Homo sapiens
cctcagagaccagggctcc

SEQ ID NO: 1426168 - DNA, 16 bp, Homo sapiens
cctcagcaccccttcc

SEQ ID NO: 1426169 - DNA, 17 bp, Homo sapiens
cctcagcaccccttcca

SEQ ID NO: 1426170 - DNA, 18 bp, Homo sapiens
cctcagcaccccttccat

SEQ ID NO: 1426171 - DNA, 19 bp, Homo sapiens
cctcagccagtggcacagg

SEQ ID NO: 1426172 - DNA, 20 bp, Homo sapiens
cctcagccagtggcacagga

SEQ ID NO: 1426173 - DNA, 23 bp, Homo sapiens
cctcagccccactgacacccagt

SEQ ID NO: 1426174 - DNA, 14 bp, Homo sapiens
cctcagccctggcc

SEQ ID NO: 1426175 - DNA, 15 bp, Homo sapiens
cctcagccctggccc

SEQ ID NO: 1426176 - DNA, 16 bp, Homo sapiens
cctcagccctggccct

SEQ ID NO: 1426177 - DNA, 11 bp, Homo sapiens
cctcagccctt

SEQ ID NO: 1426178 - DNA, 18 bp, Homo sapiens
cctcagcccttgccccca

SEQ ID NO: 1426179 - DNA, 15 bp, Homo sapiens
cctcagcctccaatg

SEQ ID NO: 1426180 - DNA, 12 bp, Homo sapiens
cctcagcctccg

SEQ ID NO: 1426181 - DNA, 15 bp, Homo sapiens
cctcagcctcctgag

SEQ ID NO: 1426182 - DNA, 20 bp, Homo sapiens
cctcagcctgatcaggcttc

SEQ ID NO: 1426183 - DNA, 22 bp, Homo sapiens
cctcagcctgatcaggcttcct

SEQ ID NO: 1426184 - DNA, 11 bp, Homo sapiens
cctcagcctgg

SEQ ID NO: 1426185 - DNA, 15 bp, Homo sapiens
cctcagcctggccag

SEQ ID NO: 1426186 - DNA, 16 bp, Homo sapiens
cctcagcctggccaga

SEQ ID NO: 1426187 - DNA, 12 bp, Homo sapiens
cctcagcctgtg

SEQ ID NO: 1426188 - DNA, 16 bp, Homo sapiens
cctcagcctgtgctgc

SEQ ID NO: 1426189 - DNA, 14 bp, Homo sapiens
cctcagctgcacat

SEQ ID NO: 1426190 - DNA, 15 bp, Homo sapiens
cctcagctgccaagc

SEQ ID NO: 1426191 - DNA, 16 bp, Homo sapiens
cctcagctgccaagca

SEQ ID NO: 1426192 - DNA, 21 bp, Homo sapiens
cctcagcttcttcacaggcac

SEQ ID NO: 1426193 - DNA, 20 bp, Homo sapiens
cctcaggcacacagctactc

SEQ ID NO: 1426194 - DNA, 13 bp, Homo sapiens
cctcaggcaggaa

SEQ ID NO: 1426195 - DNA, 15 bp, Homo sapiens
cctcaggcaggaagg

SEQ ID NO: 1426196 - DNA, 16 bp, Homo sapiens
cctcaggccagggctc

SEQ ID NO: 1426197 - DNA, 21 bp, Homo sapiens
cctcaggccaggtgcagtggc

SEQ ID NO: 1426198 - DNA, 16 bp, Homo sapiens
cctcaggcttccttgg

SEQ ID NO: 1426199 - DNA, 11 bp, Homo sapiens
cctcagggaca

SEQ ID NO: 1426200 - DNA, 23 bp, Homo sapiens
cctcagggacagagacacctgca

SEQ ID NO: 1426201 - DNA, 19 bp, Homo sapiens
cctcagggagcagggaagg

SEQ ID NO: 1426202 - DNA, 20 bp, Homo sapiens
cctcagggagcagggaaggc

SEQ ID NO: 1426203 - DNA, 19 bp, Homo sapiens
cctcagggcacgcaggacc

SEQ ID NO: 1426204 - DNA, 21 bp, Homo sapiens
cctcagggcacgcaggaccag

SEQ ID NO: 1426205 - DNA, 17 bp, Homo sapiens
cctcaggggtggagaag

SEQ ID NO: 1426206 - DNA, 14 bp, Homo sapiens
cctcagggtggggg

SEQ ID NO: 1426207 - DNA, 14 bp, Homo sapiens
cctcaggtgctgtc

SEQ ID NO: 1426208 - DNA, 14 bp, Homo sapiens
acactttccatctc

SEQ ID NO: 1426209 - DNA, 15 bp, Homo sapiens
acactttccatctct

SEQ ID NO: 1426210 - DNA, 16 bp, Homo sapiens
acactttccatctctg

SEQ ID NO: 1426211 - DNA, 23 bp, Homo sapiens
acactttgaaatgtgtttctgta

SEQ ID NO: 1426212 - DNA, 22 bp, Homo sapiens
acactttggaagtttgtgttct

SEQ ID NO: 1426213 - DNA, 15 bp, Homo sapiens
acagaaaaagacttt

SEQ ID NO: 1426214 - DNA, 22 bp, Homo sapiens
acagaaaaagcatgatgggaaa

SEQ ID NO: 1426215 - DNA, 15 bp, Homo sapiens
acagaaaaatcttgt

SEQ ID NO: 1426216 - DNA, 22 bp, Homo sapiens
acagaaaaatcttgtgctagaa

SEQ ID NO: 1426217 - DNA, 20 bp, Homo sapiens
acagaaaacaaaagagagaa

SEQ ID NO: 1426218 - DNA, 14 bp, Homo sapiens
acagaaaatatgta

SEQ ID NO: 1426219 - DNA, 21 bp, Homo sapiens
acagaaaattgttgtgcttag

SEQ ID NO: 1426220 - DNA, 22 bp, Homo sapiens
acagaaaattgttgtgcttaga

SEQ ID NO: 1426221 - DNA, 13 bp, Homo sapiens
acagaaacactgc

SEQ ID NO: 1426222 - DNA, 19 bp, Homo sapiens
acagaaaccaagccattaa

SEQ ID NO: 1426223 - DNA, 16 bp, Homo sapiens
acagaaaccagaaaag

SEQ ID NO: 1426224 - DNA, 17 bp, Homo sapiens
acagaaaccagaaaagc

SEQ ID NO: 1426225 - DNA, 12 bp, Homo sapiens
acagaaaccttt

SEQ ID NO: 1426226 - DNA, 16 bp, Homo sapiens
acagaaacgtgttaaa

SEQ ID NO: 1426227 - DNA, 21 bp, Homo sapiens
acagaaacgtgttaaaggttt

SEQ ID NO: 1426228 - DNA, 21 bp, Homo sapiens
acagaaagcctccgctgggct

SEQ ID NO: 1426229 - DNA, 21 bp, Homo sapiens
acagaaagttggaaaggaaaa

SEQ ID NO: 1426230 - DNA, 15 bp, Homo sapiens
acagaaatactgctc

SEQ ID NO: 1426231 - DNA, 17 bp, Homo sapiens
acagaaatagacttaat

SEQ ID NO: 1426232 - DNA, 14 bp, Homo sapiens
acagaaatgctgct

SEQ ID NO: 1426233 - DNA, 16 bp, Homo sapiens
acagaaatgctgctgg

SEQ ID NO: 1426234 - DNA, 17 bp, Homo sapiens
acagaaatggaaagcag

SEQ ID NO: 1426235 - DNA, 15 bp, Homo sapiens
acagaaattctgcaa

SEQ ID NO: 1426236 - DNA, 21 bp, Homo sapiens
acagaaattctgcaagtttct

SEQ ID NO: 1426237 - DNA, 23 bp, Homo sapiens
acagaaattgtatattgtaattt

SEQ ID NO: 1426238 - DNA, 16 bp, Homo sapiens
acagaaccaaatcgtg

SEQ ID NO: 1426239 - DNA, 17 bp, Homo sapiens
acagaacccctacatga

SEQ ID NO: 1426240 - DNA, 17 bp, Homo sapiens
acagaaccttcaaccca

SEQ ID NO: 1426241 - DNA, 21 bp, Homo sapiens
acagaaccttcaacccagtgg

SEQ ID NO: 1426242 - DNA, 17 bp, Homo sapiens
acagaacttcagaaaga

SEQ ID NO: 1426243 - DNA, 19 bp, Homo sapiens
acagaacttcagaaagact

SEQ ID NO: 1426244 - DNA, 12 bp, Homo sapiens
acagaaggcaaa

SEQ ID NO: 1426245 - DNA, 17 bp, Homo sapiens
acagaagtcatgaagcc

SEQ ID NO: 1426246 - DNA, 19 bp, Homo sapiens
acagaatacggaagagcag

SEQ ID NO: 1426247 - DNA, 21 bp, Homo sapiens
acagaatatgtttcaaacttt

SEQ ID NO: 1426248 - DNA, 22 bp, Homo sapiens
acagaatatttttatatttcct

SEQ ID NO: 1426249 - DNA, 23 bp, Homo sapiens
acagaatatttttatatttcctt

SEQ ID NO: 1426250 - DNA, 23 bp, Homo sapiens
acagaatcatatgattctgcttt

SEQ ID NO: 1426251 - DNA, 15 bp, Homo sapiens
acagaatgctcaggg

SEQ ID NO: 1426252 - DNA, 21 bp, Homo sapiens
acagaatgttttactgtgaaa

SEQ ID NO: 1426253 - DNA, 17 bp, Homo sapiens
acagaattctcccagcg

SEQ ID NO: 1426254 - DNA, 21 bp, Homo sapiens
acagaatttgagaaccttgga

SEQ ID NO: 1426255 - DNA, 13 bp, Homo sapiens
acagacaaaaaca

SEQ ID NO: 1426256 - DNA, 18 bp, Homo sapiens
acagacaagcagcccttg

SEQ ID NO: 1426257 - DNA, 21 bp, Homo sapiens
acagacacgctcgcgggcagc

SEQ ID NO: 1426258 - DNA, 14 bp, Homo sapiens
acagacactaactt

SEQ ID NO: 1426259 - DNA, 18 bp, Homo sapiens
acagacactaagttatag

SEQ ID NO: 1426260 - DNA, 15 bp, Homo sapiens
acagacactacatat

SEQ ID NO: 1426261 - DNA, 21 bp, Homo sapiens
acagacagagaaggcagcagg

SEQ ID NO: 1426262 - DNA, 15 bp, Homo sapiens
acagacaggagaaat

SEQ ID NO: 1426263 - DNA, 19 bp, Homo sapiens
acagaccacctgcttctga

SEQ ID NO: 1426264 - DNA, 20 bp, Homo sapiens
acagacctggagcccctggg

SEQ ID NO: 1426265 - DNA, 19 bp, Homo sapiens
cctcattgctaccacagac

SEQ ID NO: 1426266 - DNA, 20 bp, Homo sapiens
cctcattgctaccacagact

SEQ ID NO: 1426267 - DNA, 17 bp, Homo sapiens
cctccaaacctccagcc

SEQ ID NO: 1426268 - DNA, 18 bp, Homo sapiens
cctccaaagtggagctgg

SEQ ID NO: 1426269 - DNA, 19 bp, Homo sapiens
cctccaacctggggggcag

SEQ ID NO: 1426270 - DNA, 20 bp, Homo sapiens
cctccaacgcccctgtggcc

SEQ ID NO: 1426271 - DNA, 17 bp, Homo sapiens
cctccaagccattcact

SEQ ID NO: 1426272 - DNA, 11 bp, Homo sapiens
cctccaagcct

SEQ ID NO: 1426273 - DNA, 15 bp, Homo sapiens
cctccaagggtttcg

SEQ ID NO: 1426274 - DNA, 15 bp, Homo sapiens
cctccaatgcattgg

SEQ ID NO: 1426275 - DNA, 20 bp, Homo sapiens
cctccaatgcattggcctct

SEQ ID NO: 1426276 - DNA, 21 bp, Homo sapiens
cctccacactgaccaagtgct

SEQ ID NO: 1426277 - DNA, 17 bp, Homo sapiens
cctccacagccgcagcc

SEQ ID NO: 1426278 - DNA, 22 bp, Homo sapiens
cctccacagcgagggcagctgc

SEQ ID NO: 1426279 - DNA, 17 bp, Homo sapiens
cctccacagtgctgctt

SEQ ID NO: 1426280 - DNA, 17 bp, Homo sapiens
cctccaccaaaccccac

SEQ ID NO: 1426281 - DNA, 15 bp, Homo sapiens
cctccaccaccactg

SEQ ID NO: 1426282 - DNA, 17 bp, Homo sapiens
cctccaccaccactggc

SEQ ID NO: 1426283 - DNA, 20 bp, Homo sapiens
cctccaccaccactggccac

SEQ ID NO: 1426284 - DNA, 23 bp, Homo sapiens
cctccaccaccactggccaccag

SEQ ID NO: 1426285 - DNA, 17 bp, Homo sapiens
cctccaccagcctgctg

SEQ ID NO: 1426286 - DNA, 22 bp, Homo sapiens
cctccaccatgcactcacccct

SEQ ID NO: 1426287 - DNA, 22 bp, Homo sapiens
cctccacccaccccctttggtt

SEQ ID NO: 1426288 - DNA, 18 bp, Homo sapiens
cctccacccccgccacgg

SEQ ID NO: 1426289 - DNA, 20 bp, Homo sapiens
cctccacccccgccacggcc

SEQ ID NO: 1426290 - DNA, 21 bp, Homo sapiens
cctccaccctgtcccccagct

SEQ ID NO: 1426291 - DNA, 13 bp, Homo sapiens
cctccaccttcca

SEQ ID NO: 1426292 - DNA, 15 bp, Homo sapiens
cctccactcactcca

SEQ ID NO: 1426293 - DNA, 16 bp, Homo sapiens
cctccactcactccag

SEQ ID NO: 1426294 - DNA, 21 bp, Homo sapiens
cctccactcactccagcccaa

SEQ ID NO: 1426295 - DNA, 21 bp, Homo sapiens
cctccactcagctgtcctgca

SEQ ID NO: 1426296 - DNA, 16 bp, Homo sapiens
cctccactccactgcc

SEQ ID NO: 1426297 - DNA, 12 bp, Homo sapiens
cctccactcccc

SEQ ID NO: 1426298 - DNA, 19 bp, Homo sapiens
cctccactctagttctaga

SEQ ID NO: 1426299 - DNA, 20 bp, Homo sapiens
cctccactctagttctagat

SEQ ID NO: 1426300 - DNA, 15 bp, Homo sapiens
cctccacttcccgtc

SEQ ID NO: 1426301 - DNA, 16 bp, Homo sapiens
cctccacttccctcgt

SEQ ID NO: 1426302 - DNA, 18 bp, Homo sapiens
cctccacttctggtataa

SEQ ID NO: 1426303 - DNA, 22 bp, Homo sapiens
cctccagaactcactggggcct

SEQ ID NO: 1426304 - DNA, 17 bp, Homo sapiens
cctccagaagcctctgg

SEQ ID NO: 1426305 - DNA, 18 bp, Homo sapiens
cctccagaagcctctggc

SEQ ID NO: 1426306 - DNA, 16 bp, Homo sapiens
cctccagaccctgcct

SEQ ID NO: 1426307 - DNA, 17 bp, Homo sapiens
cctccagaccctgcctg

SEQ ID NO: 1426308 - DNA, 12 bp, Homo sapiens
cctccagagcca

SEQ ID NO: 1426309 - DNA, 15 bp, Homo sapiens
cctccagcaccactt

SEQ ID NO: 1426310 - DNA, 15 bp, Homo sapiens
cctccagcccctgtc

SEQ ID NO: 1426311 - DNA, 17 bp, Homo sapiens
cctccagcccctgtccc

SEQ ID NO: 1426312 - DNA, 18 bp, Homo sapiens
cctccagcccctgtccca

SEQ ID NO: 1426313 - DNA, 21 bp, Homo sapiens
cctccagcctccctgtctcca

SEQ ID NO: 1426314 - DNA, 23 bp, Homo sapiens
cctccagcctccctgtctccagc

SEQ ID NO: 1426315 - DNA, 18 bp, Homo sapiens
cctccagcctctcccggc

SEQ ID NO: 1426316 - DNA, 16 bp, Homo sapiens
cctccagcctgaacag

SEQ ID NO: 1426317 - DNA, 13 bp, Homo sapiens
cctccagctccca

SEQ ID NO: 1426318 - DNA, 15 bp, Homo sapiens
cctccagctcccact

SEQ ID NO: 1426319 - DNA, 20 bp, Homo sapiens
cctccagcttcaggcaggcc

SEQ ID NO: 1426320 - DNA, 15 bp, Homo sapiens
cctccagcttttgaa

SEQ ID NO: 1426321 - DNA, 21 bp, Homo sapiens
cctccaggcaggccaggctgc

SEQ ID NO: 1426322 - DNA, 18 bp, Homo sapiens
acagatatttcaaacatc

SEQ ID NO: 1426323 - DNA, 19 bp, Homo sapiens
acagatatttcaaacatca

SEQ ID NO: 1426324 - DNA, 23 bp, Homo sapiens
acagatatttccatttcttcctc

SEQ ID NO: 1426325 - DNA, 23 bp, Homo sapiens
acagatcaggaattctaaataaa

SEQ ID NO: 1426326 - DNA, 19 bp, Homo sapiens
acagatgaactctttctgg

SEQ ID NO: 1426327 - DNA, 14 bp, Homo sapiens
acagatgaatgtat

SEQ ID NO: 1426328 - DNA, 17 bp, Homo sapiens
acagatgaatgtattta

SEQ ID NO: 1426329 - DNA, 13 bp, Homo sapiens
acagatgagtcac

SEQ ID NO: 1426330 - DNA, 18 bp, Homo sapiens
acagatgatacttccaag

SEQ ID NO: 1426331 - DNA, 21 bp, Homo sapiens
acagatgccatggcctgtgct

SEQ ID NO: 1426332 - DNA, 14 bp, Homo sapiens
acagatgccccaga

SEQ ID NO: 1426333 - DNA, 18 bp, Homo sapiens
acagatgcctcctgatgg

SEQ ID NO: 1426334 - DNA, 17 bp, Homo sapiens
acagatggatttgcctg

SEQ ID NO: 1426335 - DNA, 18 bp, Homo sapiens
acagatggggtctgtgac

SEQ ID NO: 1426336 - DNA, 22 bp, Homo sapiens
acagatggggtctgtgactgga

SEQ ID NO: 1426337 - DNA, 18 bp, Homo sapiens
acagatgggtattaaact

SEQ ID NO: 1426338 - DNA, 19 bp, Homo sapiens
acagatgggtattaaactt

SEQ ID NO: 1426339 - DNA, 17 bp, Homo sapiens
acagattcagaatgaga

SEQ ID NO: 1426340 - DNA, 19 bp, Homo sapiens
acagattcagaatgagaat

SEQ ID NO: 1426341 - DNA, 15 bp, Homo sapiens
acagattcaggccag

SEQ ID NO: 1426342 - DNA, 23 bp, Homo sapiens
acagattcaggccagcccagcca

SEQ ID NO: 1426343 - DNA, 19 bp, Homo sapiens
acagattctttcagttctt

SEQ ID NO: 1426344 - DNA, 13 bp, Homo sapiens
acagattgcctcc

SEQ ID NO: 1426345 - DNA, 15 bp, Homo sapiens
acagatttcatacct

SEQ ID NO: 1426346 - DNA, 19 bp, Homo sapiens
acagattttatttgtaatt

SEQ ID NO: 1426347 - DNA, 22 bp, Homo sapiens
acagattttggggttgtgttgt

SEQ ID NO: 1426348 - DNA, 18 bp, Homo sapiens
acagcaaaactccatctc

SEQ ID NO: 1426349 - DNA, 19 bp, Homo sapiens
acagcaaaatgttgaagaa

SEQ ID NO: 1426350 - DNA, 20 bp, Homo sapiens
acagcaacaatttatgaatt

SEQ ID NO: 1426351 - DNA, 21 bp, Homo sapiens
acagcaagagtaagcagtgtt

SEQ ID NO: 1426352 - DNA, 20 bp, Homo sapiens
acagcaagatgaattttatc

SEQ ID NO: 1426353 - DNA, 15 bp, Homo sapiens
acagcaagccatcat

SEQ ID NO: 1426354 - DNA, 16 bp, Homo sapiens
acagcacacacagtgg

SEQ ID NO: 1426355 - DNA, 14 bp, Homo sapiens
acagcacaccagcc

SEQ ID NO: 1426356 - DNA, 17 bp, Homo sapiens
acagcacatcacctctt

SEQ ID NO: 1426357 - DNA, 17 bp, Homo sapiens
acagcacctccccgctg

SEQ ID NO: 1426358 - DNA, 14 bp, Homo sapiens
acagcactactctg

SEQ ID NO: 1426359 - DNA, 20 bp, Homo sapiens
acagcactactctgtgccag

SEQ ID NO: 1426360 - DNA, 15 bp, Homo sapiens
acagcagaggttctt

SEQ ID NO: 1426361 - DNA, 14 bp, Homo sapiens
acagcagcctgtat

SEQ ID NO: 1426362 - DNA, 15 bp, Homo sapiens
acagcagctcaggca

SEQ ID NO: 1426363 - DNA, 16 bp, Homo sapiens
acagcagctcaggcac

SEQ ID NO: 1426364 - DNA, 22 bp, Homo sapiens
acagcagctgcaggggcctctg

SEQ ID NO: 1426365 - DNA, 23 bp, Homo sapiens
acagcagctggtgccccacctgc

SEQ ID NO: 1426366 - DNA, 13 bp, Homo sapiens
acagcagcttcac

SEQ ID NO: 1426367 - DNA, 16 bp, Homo sapiens
acagcagcttcaccag

SEQ ID NO: 1426368 - DNA, 19 bp, Homo sapiens
acagcaggactgaggacag

SEQ ID NO: 1426369 - DNA, 18 bp, Homo sapiens
acagcagtctccttcagc

SEQ ID NO: 1426370 - DNA, 18 bp, Homo sapiens
acagcagtgatctcaggg

SEQ ID NO: 1426371 - DNA, 22 bp, Homo sapiens
acagcagtgatctcagggcaga

SEQ ID NO: 1426372 - DNA, 18 bp, Homo sapiens
acagcagtgtcccctgcc

SEQ ID NO: 1426373 - DNA, 21 bp, Homo sapiens
acagcagtgtcccctgcccca

SEQ ID NO: 1426374 - DNA, 18 bp, Homo sapiens
acagcagttgaaaagact

SEQ ID NO: 1426375 - DNA, 21 bp, Homo sapiens
acagcatcgggagcacccaga

SEQ ID NO: 1426376 - DNA, 13 bp, Homo sapiens
acagcatgaataa

SEQ ID NO: 1426377 - DNA, 15 bp, Homo sapiens
acagcatgaataaaa

SEQ ID NO: 1426378 - DNA, 24 bp, Homo sapiens
acagcatgaataaaacactcatcc

SEQ ID NO: 1426379 - DNA, 14 bp, Homo sapiens
acagcatgtctact

SEQ ID NO: 1426380 - DNA, 13 bp, Homo sapiens
acagcatgtgtat

SEQ ID NO: 1426381 - DNA, 19 bp, Homo sapiens
acagcattgtctttgctgt

SEQ ID NO: 1426382 - DNA, 21 bp, Homo sapiens
cctcccccaaaccctgcttct

SEQ ID NO: 1426383 - DNA, 13 bp, Homo sapiens
cctcccccaaagc

SEQ ID NO: 1426384 - DNA, 19 bp, Homo sapiens
cctcccccaacccccaccc

SEQ ID NO: 1426385 - DNA, 12 bp, Homo sapiens
cctcccccaaga

SEQ ID NO: 1426386 - DNA, 16 bp, Homo sapiens
cctcccccagccagga

SEQ ID NO: 1426387 - DNA, 17 bp, Homo sapiens
cctcccccattccctcc

SEQ ID NO: 1426388 - DNA, 14 bp, Homo sapiens
cctccccccagacc

SEQ ID NO: 1426389 - DNA, 22 bp, Homo sapiens
cctccccccagaccccgcccct

SEQ ID NO: 1426390 - DNA, 15 bp, Homo sapiens
cctcccccccatgca

SEQ ID NO: 1426391 - DNA, 12 bp, Homo sapiens
cctccccctcct

SEQ ID NO: 1426392 - DNA, 12 bp, Homo sapiens
cctccccctgag

SEQ ID NO: 1426393 - DNA, 11 bp, Homo sapiens
cctccccctgc

SEQ ID NO: 1426394 - DNA, 12 bp, Homo sapiens
cctccccctgca

SEQ ID NO: 1426395 - DNA, 13 bp, Homo sapiens
cctccccctgcaa

SEQ ID NO: 1426396 - DNA, 16 bp, Homo sapiens
cctccccctgccagga

SEQ ID NO: 1426397 - DNA, 15 bp, Homo sapiens
cctccccctgttctg

SEQ ID NO: 1426398 - DNA, 21 bp, Homo sapiens
cctccccgcagtgggaagtga

SEQ ID NO: 1426399 - DNA, 12 bp, Homo sapiens
cctccccgcccc

SEQ ID NO: 1426400 - DNA, 13 bp, Homo sapiens
cctccccgcccct

SEQ ID NO: 1426401 - DNA, 17 bp, Homo sapiens
cctccccgctctccctg

SEQ ID NO: 1426402 - DNA, 20 bp, Homo sapiens
cctccccgctctccctgtca

SEQ ID NO: 1426403 - DNA, 15 bp, Homo sapiens
cctccccgctgggaa

SEQ ID NO: 1426404 - DNA, 13 bp, Homo sapiens
cctccccggccac

SEQ ID NO: 1426405 - DNA, 15 bp, Homo sapiens
cctccccggccacat

SEQ ID NO: 1426406 - DNA, 23 bp, Homo sapiens
cctccccggctcgagcagtcctg

SEQ ID NO: 1426407 - DNA, 18 bp, Homo sapiens
cctcccctatccacccag

SEQ ID NO: 1426408 - DNA, 22 bp, Homo sapiens
cctcccctatccacccagccca

SEQ ID NO: 1426409 - DNA, 15 bp, Homo sapiens
cctcccctatgctgg

SEQ ID NO: 1426410 - DNA, 14 bp, Homo sapiens
cctcccctcaagga

SEQ ID NO: 1426411 - DNA, 21 bp, Homo sapiens
cctcccctccggactggtgcc

SEQ ID NO: 1426412 - DNA, 14 bp, Homo sapiens
cctcccctcctctt

SEQ ID NO: 1426413 - DNA, 16 bp, Homo sapiens
cctcccctctcagaac

SEQ ID NO: 1426414 - DNA, 18 bp, Homo sapiens
cctcccctctcagaacat

SEQ ID NO: 1426415 - DNA, 17 bp, Homo sapiens
cctcccctctccttcct

SEQ ID NO: 1426416 - DNA, 23 bp, Homo sapiens
cctcccctctcttgcacccgcct

SEQ ID NO: 1426417 - DNA, 17 bp, Homo sapiens
cctcccctgccaccagg

SEQ ID NO: 1426418 - DNA, 13 bp, Homo sapiens
cctcccctgccct

SEQ ID NO: 1426419 - DNA, 16 bp, Homo sapiens
cctcccctgccctggt

SEQ ID NO: 1426420 - DNA, 13 bp, Homo sapiens
cctcccctgctcc

SEQ ID NO: 1426421 - DNA, 18 bp, Homo sapiens
cctcccctgctcccaggt

SEQ ID NO: 1426422 - DNA, 15 bp, Homo sapiens
cctcccctgggcagg

SEQ ID NO: 1426423 - DNA, 21 bp, Homo sapiens
cctcccctgggttaacaaatg

SEQ ID NO: 1426424 - DNA, 14 bp, Homo sapiens
cctccccttcccct

SEQ ID NO: 1426425 - DNA, 12 bp, Homo sapiens
cctccccttggg

SEQ ID NO: 1426426 - DNA, 16 bp, Homo sapiens
cctccccttgggcggc

SEQ ID NO: 1426427 - DNA, 16 bp, Homo sapiens
cctcccgccccgcccc

SEQ ID NO: 1426428 - DNA, 16 bp, Homo sapiens
cctcccgggccctccc

SEQ ID NO: 1426429 - DNA, 17 bp, Homo sapiens
cctcccgggccctccct

SEQ ID NO: 1426430 - DNA, 16 bp, Homo sapiens
cctcccggtgcccaag

SEQ ID NO: 1426431 - DNA, 15 bp, Homo sapiens
cctccctactcccct

SEQ ID NO: 1426432 - DNA, 18 bp, Homo sapiens
cctccctactcccctggg

SEQ ID NO: 1426433 - DNA, 21 bp, Homo sapiens
cctccctagccagcacttgta

SEQ ID NO: 1426434 - DNA, 22 bp, Homo sapiens
cctccctagttagcatccaggc

SEQ ID NO: 1426435 - DNA, 23 bp, Homo sapiens
cctccctcagagacaccaaactg

SEQ ID NO: 1426436 - DNA, 23 bp, Homo sapiens
cctccctccggccatactgcctt

SEQ ID NO: 1426437 - DNA, 23 bp, Homo sapiens
acagctcaagtcttccctgatca

SEQ ID NO: 1426438 - DNA, 15 bp, Homo sapiens
acagctcacctctga

SEQ ID NO: 1426439 - DNA, 17 bp, Homo sapiens
acagctcacctctgaag

SEQ ID NO: 1426440 - DNA, 16 bp, Homo sapiens
acagctcagccagtgg

SEQ ID NO: 1426441 - DNA, 20 bp, Homo sapiens
acagctcagccagtggggat

SEQ ID NO: 1426442 - DNA, 13 bp, Homo sapiens
acagctcagctgc

SEQ ID NO: 1426443 - DNA, 16 bp, Homo sapiens
acagctcagctgccca

SEQ ID NO: 1426444 - DNA, 17 bp, Homo sapiens
acagctcagctgcccat

SEQ ID NO: 1426445 - DNA, 19 bp, Homo sapiens
acagctcattaaacttttt

SEQ ID NO: 1426446 - DNA, 19 bp, Homo sapiens
acagctcccaaacggaaga

SEQ ID NO: 1426447 - DNA, 13 bp, Homo sapiens
acagctcccaccc

SEQ ID NO: 1426448 - DNA, 14 bp, Homo sapiens
acagctcccacccc

SEQ ID NO: 1426449 - DNA, 14 bp, Homo sapiens
acagctccctctgc

SEQ ID NO: 1426450 - DNA, 16 bp, Homo sapiens
acagctccgagctgta

SEQ ID NO: 1426451 - DNA, 12 bp, Homo sapiens
acagctcctgcc

SEQ ID NO: 1426452 - DNA, 14 bp, Homo sapiens
acagctcctgccag

SEQ ID NO: 1426453 - DNA, 13 bp, Homo sapiens
acagctctagaca

SEQ ID NO: 1426454 - DNA, 15 bp, Homo sapiens
acagctcttcattcc

SEQ ID NO: 1426455 - DNA, 16 bp, Homo sapiens
acagctcttcattcca

SEQ ID NO: 1426456 - DNA, 17 bp, Homo sapiens
acagctcttctaaggaa

SEQ ID NO: 1426457 - DNA, 14 bp, Homo sapiens
acagctcttctcag

SEQ ID NO: 1426458 - DNA, 22 bp, Homo sapiens
acagctcttctcagtgtctgaa

SEQ ID NO: 1426459 - DNA, 15 bp, Homo sapiens
acagctgcagctgat

SEQ ID NO: 1426460 - DNA, 18 bp, Homo sapiens
acagctgcagctgggccc

SEQ ID NO: 1426461 - DNA, 12 bp, Homo sapiens
acagctgcccag

SEQ ID NO: 1426462 - DNA, 16 bp, Homo sapiens
acagctgccctagctg

SEQ ID NO: 1426463 - DNA, 17 bp, Homo sapiens
acagctgccctagctga

SEQ ID NO: 1426464 - DNA, 16 bp, Homo sapiens
acagctgccctggctg

SEQ ID NO: 1426465 - DNA, 17 bp, Homo sapiens
acagctgccctggctgt

SEQ ID NO: 1426466 - DNA, 21 bp, Homo sapiens
acagctgcttgtcctgctctc

SEQ ID NO: 1426467 - DNA, 22 bp, Homo sapiens
acagctggctgggccttcacca

SEQ ID NO: 1426468 - DNA, 13 bp, Homo sapiens
acagctgggcagg

SEQ ID NO: 1426469 - DNA, 12 bp, Homo sapiens
acagctggtgcc

SEQ ID NO: 1426470 - DNA, 14 bp, Homo sapiens
acagctgtccctgt

SEQ ID NO: 1426471 - DNA, 23 bp, Homo sapiens
acagctgtgtgacatttggagag

SEQ ID NO: 1426472 - DNA, 12 bp, Homo sapiens
acagctgtgtta

SEQ ID NO: 1426473 - DNA, 22 bp, Homo sapiens
acagctgtgttattctttgcgt

SEQ ID NO: 1426474 - DNA, 19 bp, Homo sapiens
acagcttacctagtcttgt

SEQ ID NO: 1426475 - DNA, 13 bp, Homo sapiens
acagcttcagaaa

SEQ ID NO: 1426476 - DNA, 20 bp, Homo sapiens
acagcttcctcacacccctg

SEQ ID NO: 1426477 - DNA, 13 bp, Homo sapiens
acagcttctccaa

SEQ ID NO: 1426478 - DNA, 14 bp, Homo sapiens
acagcttctccaag

SEQ ID NO: 1426479 - DNA, 16 bp, Homo sapiens
acagcttctccaagca

SEQ ID NO: 1426480 - DNA, 14 bp, Homo sapiens
acagcttctggagc

SEQ ID NO: 1426481 - DNA, 19 bp, Homo sapiens
acagcttgacctgaggctg

SEQ ID NO: 1426482 - DNA, 22 bp, Homo sapiens
acagcttgacctgaggctgtgg

SEQ ID NO: 1426483 - DNA, 23 bp, Homo sapiens
acagcttgacctgaggctgtggt

SEQ ID NO: 1426484 - DNA, 16 bp, Homo sapiens
acagcttgagccgggc

SEQ ID NO: 1426485 - DNA, 22 bp, Homo sapiens
acagcttgagccgggcccctgg

SEQ ID NO: 1426486 - DNA, 22 bp, Homo sapiens
acagcttgctgtcacttcttca

SEQ ID NO: 1426487 - DNA, 19 bp, Homo sapiens
acagctttacaacttccat

SEQ ID NO: 1426488 - DNA, 20 bp, Homo sapiens
acagctttcatgattagcaa

SEQ ID NO: 1426489 - DNA, 19 bp, Homo sapiens
acagctttcctcaaaaagc

SEQ ID NO: 1426490 - DNA, 16 bp, Homo sapiens
acagctttctgggatg

SEQ ID NO: 1426491 - DNA, 17 bp, Homo sapiens
acagctttctgggatgt

SEQ ID NO: 1426492 - DNA, 21 bp, Homo sapiens
acagctttctgggatgtcaca

SEQ ID NO: 1426493 - DNA, 22 bp, Homo sapiens
acagctttctgggatgtcacag

SEQ ID NO: 1426494 - DNA, 20 bp, Homo sapiens
acagctttgctccgctccca

SEQ ID NO: 1426495 - DNA, 22 bp, Homo sapiens
acagctttgctccgctcccacc

SEQ ID NO: 1426496 - DNA, 14 bp, Homo sapiens
acagcttttgcaac

SEQ ID NO: 1426497 - DNA, 15 bp, Homo sapiens
acagcttttgcaact

SEQ ID NO: 1426498 - DNA, 12 bp, Homo sapiens
acaggaaaaagt

SEQ ID NO: 1426499 - DNA, 17 bp, Homo sapiens
acaggaaaatcctctgg

SEQ ID NO: 1426500 - DNA, 14 bp, Homo sapiens
acaggaaccttaag

SEQ ID NO: 1426501 - DNA, 14 bp, Homo sapiens
acaggaagctcagc

SEQ ID NO: 1426502 - DNA, 16 bp, Homo sapiens
cctccgtccacccagg

SEQ ID NO: 1426503 - DNA, 15 bp, Homo sapiens
cctccgtccatatca

SEQ ID NO: 1426504 - DNA, 17 bp, Homo sapiens
cctccgtttatgggcct

SEQ ID NO: 1426505 - DNA, 21 bp, Homo sapiens
cctccgtttatgggccttgct

SEQ ID NO: 1426506 - DNA, 22 bp, Homo sapiens
cctccgtttatgggccttgctt

SEQ ID NO: 1426507 - DNA, 13 bp, Homo sapiens
cctccgtttttct

SEQ ID NO: 1426508 - DNA, 14 bp, Homo sapiens
cctcctagacccag

SEQ ID NO: 1426509 - DNA, 18 bp, Homo sapiens
cctcctagaggtgggcag

SEQ ID NO: 1426510 - DNA, 22 bp, Homo sapiens
cctcctagaggtgggcagctgg

SEQ ID NO: 1426511 - DNA, 17 bp, Homo sapiens
cctcctatctccctggc

SEQ ID NO: 1426512 - DNA, 13 bp, Homo sapiens
cctcctcaccccg

SEQ ID NO: 1426513 - DNA, 15 bp, Homo sapiens
cctcctcaccccgtc

SEQ ID NO: 1426514 - DNA, 14 bp, Homo sapiens
cctcctcacctcat

SEQ ID NO: 1426515 - DNA, 13 bp, Homo sapiens
cctcctcacctct

SEQ ID NO: 1426516 - DNA, 16 bp, Homo sapiens
cctcctcacctctgga

SEQ ID NO: 1426517 - DNA, 21 bp, Homo sapiens
cctcctcacctctggactggc

SEQ ID NO: 1426518 - DNA, 21 bp, Homo sapiens
cctcctcacttggctgtctga

SEQ ID NO: 1426519 - DNA, 17 bp, Homo sapiens
cctcctcaggcacacag

SEQ ID NO: 1426520 - DNA, 19 bp, Homo sapiens
cctcctcaggcacacagct

SEQ ID NO: 1426521 - DNA, 21 bp, Homo sapiens
cctcctcaggcacacagctac

SEQ ID NO: 1426522 - DNA, 14 bp, Homo sapiens
cctcctcagtgaag

SEQ ID NO: 1426523 - DNA, 13 bp, Homo sapiens
cctcctccactca

SEQ ID NO: 1426524 - DNA, 12 bp, Homo sapiens
cctcctccagcc

SEQ ID NO: 1426525 - DNA, 12 bp, Homo sapiens
cctcctccaggt

SEQ ID NO: 1426526 - DNA, 12 bp, Homo sapiens
cctcctccagta

SEQ ID NO: 1426527 - DNA, 23 bp, Homo sapiens
cctcctcccacccggctgcagag

SEQ ID NO: 1426528 - DNA, 19 bp, Homo sapiens
cctcctcccagtgccttct

SEQ ID NO: 1426529 - DNA, 14 bp, Homo sapiens
cctcctccccactt

SEQ ID NO: 1426530 - DNA, 21 bp, Homo sapiens
cctcctcccccggctgggcct

SEQ ID NO: 1426531 - DNA, 13 bp, Homo sapiens
cctcctcccctcc

SEQ ID NO: 1426532 - DNA, 13 bp, Homo sapiens
cctcctcctgggc

SEQ ID NO: 1426533 - DNA, 15 bp, Homo sapiens
cctcctcgaacccac

SEQ ID NO: 1426534 - DNA, 16 bp, Homo sapiens
cctcctcgaagccatg

SEQ ID NO: 1426535 - DNA, 18 bp, Homo sapiens
cctcctcgaagccatgtg

SEQ ID NO: 1426536 - DNA, 21 bp, Homo sapiens
cctcctcggagagcagcagca

SEQ ID NO: 1426537 - DNA, 22 bp, Homo sapiens
cctcctcgggccgaggcccagc

SEQ ID NO: 1426538 - DNA, 13 bp, Homo sapiens
cctcctctcagtg

SEQ ID NO: 1426539 - DNA, 13 bp, Homo sapiens
cctcctctcccat

SEQ ID NO: 1426540 - DNA, 15 bp, Homo sapiens
cctcctctcccatcc

SEQ ID NO: 1426541 - DNA, 16 bp, Homo sapiens
cctcctctcccatccc

SEQ ID NO: 1426542 - DNA, 21 bp, Homo sapiens
cctcctctgcactcccacctg

SEQ ID NO: 1426543 - DNA, 14 bp, Homo sapiens
cctcctctgccacc

SEQ ID NO: 1426544 - DNA, 18 bp, Homo sapiens
cctcctctgtccagggcc

SEQ ID NO: 1426545 - DNA, 16 bp, Homo sapiens
cctcctcttggagctg

SEQ ID NO: 1426546 - DNA, 22 bp, Homo sapiens
cctcctgagctcggggggctct

SEQ ID NO: 1426547 - DNA, 18 bp, Homo sapiens
cctcctgatggccaagag

SEQ ID NO: 1426548 - DNA, 14 bp, Homo sapiens
cctcctgcaggctg

SEQ ID NO: 1426549 - DNA, 12 bp, Homo sapiens
cctcctgccctt

SEQ ID NO: 1426550 - DNA, 15 bp, Homo sapiens
cctcctgctactctg

SEQ ID NO: 1426551 - DNA, 15 bp, Homo sapiens
cctcctgctcctccc

SEQ ID NO: 1426552 - DNA, 13 bp, Homo sapiens
cctcctgctctgg

SEQ ID NO: 1426553 - DNA, 20 bp, Homo sapiens
acaggctgttctgcactgaa

SEQ ID NO: 1426554 - DNA, 21 bp, Homo sapiens
acagggaaagcatttaggaga

SEQ ID NO: 1426555 - DNA, 20 bp, Homo sapiens
acagggaacattggagctga

SEQ ID NO: 1426556 - DNA, 13 bp, Homo sapiens
acagggacatgcc

SEQ ID NO: 1426557 - DNA, 12 bp, Homo sapiens
acagggaccagg

SEQ ID NO: 1426558 - DNA, 12 bp, Homo sapiens
acagggacccac

SEQ ID NO: 1426559 - DNA, 20 bp, Homo sapiens
acagggacttgtttagagag

SEQ ID NO: 1426560 - DNA, 21 bp, Homo sapiens
acagggacttgtttagagagc

SEQ ID NO: 1426561 - DNA, 16 bp, Homo sapiens
acagggagctgggaca

SEQ ID NO: 1426562 - DNA, 13 bp, Homo sapiens
acagggcaccaga

SEQ ID NO: 1426563 - DNA, 14 bp, Homo sapiens
acagggcaccagag

SEQ ID NO: 1426564 - DNA, 16 bp, Homo sapiens
acagggcaccagaggc

SEQ ID NO: 1426565 - DNA, 12 bp, Homo sapiens
acagggcactga

SEQ ID NO: 1426566 - DNA, 17 bp, Homo sapiens
acagggcagagcaggaa

SEQ ID NO: 1426567 - DNA, 20 bp, Homo sapiens
acagggcagagcaggaagga

SEQ ID NO: 1426568 - DNA, 19 bp, Homo sapiens
acagggctgggagaagaaa

SEQ ID NO: 1426569 - DNA, 22 bp, Homo sapiens
acaggggaggtgatagcattgc

SEQ ID NO: 1426570 - DNA, 23 bp, Homo sapiens
acaggggaggtgatagcattgct

SEQ ID NO: 1426571 - DNA, 16 bp, Homo sapiens
acaggggcaggcctgg

SEQ ID NO: 1426572 - DNA, 23 bp, Homo sapiens
acagggtctgctctttctctgcc

SEQ ID NO: 1426573 - DNA, 14 bp, Homo sapiens
acagggtctgggac

SEQ ID NO: 1426574 - DNA, 21 bp, Homo sapiens
acagggtgtggtatgaggggg

SEQ ID NO: 1426575 - DNA, 22 bp, Homo sapiens
acagggtgtggtatgagggggt

SEQ ID NO: 1426576 - DNA, 13 bp, Homo sapiens
acagggttttgta

SEQ ID NO: 1426577 - DNA, 22 bp, Homo sapiens
acaggtagaattatctaattta

SEQ ID NO: 1426578 - DNA, 16 bp, Homo sapiens
acaggtatatactttg

SEQ ID NO: 1426579 - DNA, 19 bp, Homo sapiens
acaggtatatactttgaaa

SEQ ID NO: 1426580 - DNA, 17 bp, Homo sapiens
acaggtatttttttaaa

SEQ ID NO: 1426581 - DNA, 20 bp, Homo sapiens
acaggtatttttttaaatca

SEQ ID NO: 1426582 - DNA, 18 bp, Homo sapiens
acaggtcacccatcagga

SEQ ID NO: 1426583 - DNA, 15 bp, Homo sapiens
acaggtcatcagatg

SEQ ID NO: 1426584 - DNA, 13 bp, Homo sapiens
acaggtctagact

SEQ ID NO: 1426585 - DNA, 14 bp, Homo sapiens
acaggtctcctctt

SEQ ID NO: 1426586 - DNA, 18 bp, Homo sapiens
acaggtgattaacttgga

SEQ ID NO: 1426587 - DNA, 22 bp, Homo sapiens
acaggtgccgccagctgccgca

SEQ ID NO: 1426588 - DNA, 12 bp, Homo sapiens
acaggtggaggt

SEQ ID NO: 1426589 - DNA, 15 bp, Homo sapiens
acaggttataacagt

SEQ ID NO: 1426590 - DNA, 18 bp, Homo sapiens
acaggttataacagtgtt

SEQ ID NO: 1426591 - DNA, 21 bp, Homo sapiens
acaggttcttaaaaaggaaca

SEQ ID NO: 1426592 - DNA, 18 bp, Homo sapiens
acaggttttaaaagcctt

SEQ ID NO: 1426593 - DNA, 20 bp, Homo sapiens
acagtaaaaacttgtactat

SEQ ID NO: 1426594 - DNA, 22 bp, Homo sapiens
acagtaaaaacttgtactatgt

SEQ ID NO: 1426595 - DNA, 23 bp, Homo sapiens
acagtaaaaacttgtactatgtt

SEQ ID NO: 1426596 - DNA, 18 bp, Homo sapiens
acagtaaaccactgaaaa

SEQ ID NO: 1426597 - DNA, 19 bp, Homo sapiens
acagtaaaccactgaaaaa

SEQ ID NO: 1426598 - DNA, 20 bp, Homo sapiens
acagtaaaccactgaaaaaa

SEQ ID NO: 1426599 - DNA, 17 bp, Homo sapiens
acagtaaagaaagcaga

SEQ ID NO: 1426600 - DNA, 10 bp, Homo sapiens
acagtaactt

SEQ ID NO: 1426601 - DNA, 16 bp, Homo sapiens
acagtaactttatgtg

SEQ ID NO: 1426602 - DNA, 21 bp, Homo sapiens
acagtaactttatgtgtaaat

SEQ ID NO: 1426603 - DNA, 14 bp, Homo sapiens
acagtaagctgctc

SEQ ID NO: 1426604 - DNA, 17 bp, Homo sapiens
acagtaagtcatttaac

SEQ ID NO: 1426605 - DNA, 16 bp, Homo sapiens
acagtaagttcctact

SEQ ID NO: 1426606 - DNA, 20 bp, Homo sapiens
acagtaagttcctactaggc

SEQ ID NO: 1426607 - DNA, 21 bp, Homo sapiens
acagtaatacattccattgtt

SEQ ID NO: 1426608 - DNA, 14 bp, Homo sapiens
acagtacaataatg

SEQ ID NO: 1426609 - DNA, 15 bp, Homo sapiens
acagtacaataatgt

SEQ ID NO: 1426610 - DNA, 23 bp, Homo sapiens
acagtacaataatgtactcacat

SEQ ID NO: 1426611 - DNA, 15 bp, Homo sapiens
acagtacagaaggca

SEQ ID NO: 1426612 - DNA, 13 bp, Homo sapiens
acagtacatatgt

SEQ ID NO: 1426613 - DNA, 19 bp, Homo sapiens
acagtacctcgtttctaca

SEQ ID NO: 1426614 - DNA, 19 bp, Homo sapiens
acagtacctgattgtattt

SEQ ID NO: 1426615 - DNA, 21 bp, Homo sapiens
acagtacctgattgtattttt

SEQ ID NO: 1426616 - DNA, 14 bp, Homo sapiens
acagtacttccaga

SEQ ID NO: 1426617 - DNA, 18 bp, Homo sapiens
acagtactttattgtaca

SEQ ID NO: 1426618 - DNA, 20 bp, Homo sapiens
acagtactttattgtacaga

SEQ ID NO: 1426619 - DNA, 22 bp, Homo sapiens
acagtactttattgtacagact

SEQ ID NO: 1426620 - DNA, 13 bp, Homo sapiens
acagtagctgcta

SEQ ID NO: 1426621 - DNA, 14 bp, Homo sapiens
cctctaaagcagag

SEQ ID NO: 1426622 - DNA, 14 bp, Homo sapiens
cctctacagccgtc

SEQ ID NO: 1426623 - DNA, 15 bp, Homo sapiens
cctctacagccgtcc

SEQ ID NO: 1426624 - DNA, 21 bp, Homo sapiens
cctctacagccgtcccgcgtt

SEQ ID NO: 1426625 - DNA, 18 bp, Homo sapiens
cctctactttgattctga

SEQ ID NO: 1426626 - DNA, 17 bp, Homo sapiens
cctctagaatcccagca

SEQ ID NO: 1426627 - DNA, 21 bp, Homo sapiens
cctctagtaagatgcactgaa

SEQ ID NO: 1426628 - DNA, 17 bp, Homo sapiens
cctctagtccccaaggc

SEQ ID NO: 1426629 - DNA, 20 bp, Homo sapiens
cctctagtccccaaggcctc

SEQ ID NO: 1426630 - DNA, 15 bp, Homo sapiens
cctctagtgccctcc

SEQ ID NO: 1426631 - DNA, 15 bp, Homo sapiens
cctctagtgccttct

SEQ ID NO: 1426632 - DNA, 22 bp, Homo sapiens
cctctatactttgttctgttgt

SEQ ID NO: 1426633 - DNA, 13 bp, Homo sapiens
cctctatcccaat

SEQ ID NO: 1426634 - DNA, 20 bp, Homo sapiens
cctctattgatgtacagtct

SEQ ID NO: 1426635 - DNA, 17 bp, Homo sapiens
cctctatttattagcca

SEQ ID NO: 1426636 - DNA, 22 bp, Homo sapiens
cctctatttcctgaacctggaa

SEQ ID NO: 1426637 - DNA, 23 bp, Homo sapiens
cctctatttcctgaacctggaaa

SEQ ID NO: 1426638 - DNA, 14 bp, Homo sapiens
cctctattttaatt

SEQ ID NO: 1426639 - DNA, 17 bp, Homo sapiens
cctctcaagctagccag

SEQ ID NO: 1426640 - DNA, 17 bp, Homo sapiens
cctctcaagtagctggg

SEQ ID NO: 1426641 - DNA, 20 bp, Homo sapiens
cctctcactccccagcccca

SEQ ID NO: 1426642 - DNA, 18 bp, Homo sapiens
cctctcagaactcctgtg

SEQ ID NO: 1426643 - DNA, 20 bp, Homo sapiens
cctctcagaactcctgtgtg

SEQ ID NO: 1426644 - DNA, 13 bp, Homo sapiens
cctctcagagtga

SEQ ID NO: 1426645 - DNA, 20 bp, Homo sapiens
cctctcagagtgacagtcat

SEQ ID NO: 1426646 - DNA, 14 bp, Homo sapiens
cctctcaggtgggt

SEQ ID NO: 1426647 - DNA, 16 bp, Homo sapiens
cctctcagtctgcagt

SEQ ID NO: 1426648 - DNA, 19 bp, Homo sapiens
cctctccaagggcttctgc

SEQ ID NO: 1426649 - DNA, 19 bp, Homo sapiens
cctctccactgccttcgat

SEQ ID NO: 1426650 - DNA, 13 bp, Homo sapiens
cctctccactgct

SEQ ID NO: 1426651 - DNA, 12 bp, Homo sapiens
cctctccaggcc

SEQ ID NO: 1426652 - DNA, 20 bp, Homo sapiens
cctctccatttgctcttcag

SEQ ID NO: 1426653 - DNA, 15 bp, Homo sapiens
cctctcccaagtcca

SEQ ID NO: 1426654 - DNA, 12 bp, Homo sapiens
cctctcccagga

SEQ ID NO: 1426655 - DNA, 13 bp, Homo sapiens
cctctcccaggac

SEQ ID NO: 1426656 - DNA, 14 bp, Homo sapiens
cctctcccaggccc

SEQ ID NO: 1426657 - DNA, 12 bp, Homo sapiens
cctctcccatca

SEQ ID NO: 1426658 - DNA, 14 bp, Homo sapiens
cctctcccatcccc

SEQ ID NO: 1426659 - DNA, 15 bp, Homo sapiens
cctctcccatccccc

SEQ ID NO: 1426660 - DNA, 18 bp, Homo sapiens
cctctcccatccccctgc

SEQ ID NO: 1426661 - DNA, 21 bp, Homo sapiens
cctctcccatccccctgccct

SEQ ID NO: 1426662 - DNA, 12 bp, Homo sapiens
cctctccccagc

SEQ ID NO: 1426663 - DNA, 18 bp, Homo sapiens
cctctccccagcccagag

SEQ ID NO: 1426664 - DNA, 23 bp, Homo sapiens
cctctccccaggtccagctctgg

SEQ ID NO: 1426665 - DNA, 22 bp, Homo sapiens
cctctcccgccagactgttaga

SEQ ID NO: 1426666 - DNA, 17 bp, Homo sapiens
cctctcccggctgcctg

SEQ ID NO: 1426667 - DNA, 15 bp, Homo sapiens
cctctccctctctct

SEQ ID NO: 1426668 - DNA, 23 bp, Homo sapiens
acagtgagcttggaaaggaccag

SEQ ID NO: 1426669 - DNA, 18 bp, Homo sapiens
acagtgaggcaggagaag

SEQ ID NO: 1426670 - DNA, 18 bp, Homo sapiens
acagtgatctccatatgt

SEQ ID NO: 1426671 - DNA, 21 bp, Homo sapiens
acagtgatctccatatgttac

SEQ ID NO: 1426672 - DNA, 22 bp, Homo sapiens
acagtgatctccatatgttaca

SEQ ID NO: 1426673 - DNA, 24 bp, Homo sapiens
acagtgatgctgtgctatgaattt

SEQ ID NO: 1426674 - DNA, 13 bp, Homo sapiens
acagtgatgttgt

SEQ ID NO: 1426675 - DNA, 13 bp, Homo sapiens
acagtgatttttt

SEQ ID NO: 1426676 - DNA, 10 bp, Homo sapiens
acagtgcccc

SEQ ID NO: 1426677 - DNA, 12 bp, Homo sapiens
acagtgcctctt

SEQ ID NO: 1426678 - DNA, 13 bp, Homo sapiens
acagtgcctcttc

SEQ ID NO: 1426679 - DNA, 15 bp, Homo sapiens
acagtgcctcttcca

SEQ ID NO: 1426680 - DNA, 22 bp, Homo sapiens
acagtgcctcttccagtgaaca

SEQ ID NO: 1426681 - DNA, 13 bp, Homo sapiens
acagtgcctgctg

SEQ ID NO: 1426682 - DNA, 14 bp, Homo sapiens
acagtgcctgctga

SEQ ID NO: 1426683 - DNA, 14 bp, Homo sapiens
acagtgcctgggaa

SEQ ID NO: 1426684 - DNA, 20 bp, Homo sapiens
acagtgccttcaataaatgg

SEQ ID NO: 1426685 - DNA, 21 bp, Homo sapiens
acagtgccttcaataaatggt

SEQ ID NO: 1426686 - DNA, 14 bp, Homo sapiens
acagtgccttctct

SEQ ID NO: 1426687 - DNA, 15 bp, Homo sapiens
acagtgctactgaaa

SEQ ID NO: 1426688 - DNA, 17 bp, Homo sapiens
acagtgcttcagcctga

SEQ ID NO: 1426689 - DNA, 20 bp, Homo sapiens
acagtgcttcagcctgaggc

SEQ ID NO: 1426690 - DNA, 22 bp, Homo sapiens
acagtgcttcagcctgaggctg

SEQ ID NO: 1426691 - DNA, 23 bp, Homo sapiens
acagtggatatgacccacactgc

SEQ ID NO: 1426692 - DNA, 19 bp, Homo sapiens
acagtggcacggagagaag

SEQ ID NO: 1426693 - DNA, 19 bp, Homo sapiens
acagtggctcgtatcccaa

SEQ ID NO: 1426694 - DNA, 16 bp, Homo sapiens
acagtgggaactctga

SEQ ID NO: 1426695 - DNA, 18 bp, Homo sapiens
acagtgggaactctgaca

SEQ ID NO: 1426696 - DNA, 21 bp, Homo sapiens
acagtgggaactctgacaagg

SEQ ID NO: 1426697 - DNA, 14 bp, Homo sapiens
acagtgggagccag

SEQ ID NO: 1426698 - DNA, 17 bp, Homo sapiens
acagtgggagccagggc

SEQ ID NO: 1426699 - DNA, 14 bp, Homo sapiens
acagtgggagctga

SEQ ID NO: 1426700 - DNA, 18 bp, Homo sapiens
acagtgggagctgagctg

SEQ ID NO: 1426701 - DNA, 23 bp, Homo sapiens
acagtgggagctgagctggaagg

SEQ ID NO: 1426702 - DNA, 22 bp, Homo sapiens
acagtgggcaggaggccccagg

SEQ ID NO: 1426703 - DNA, 22 bp, Homo sapiens
acagtgggcgttgggagcctag

SEQ ID NO: 1426704 - DNA, 23 bp, Homo sapiens
acagtgggcgttgggagcctagc

SEQ ID NO: 1426705 - DNA, 21 bp, Homo sapiens
acagtgggtgccccccttgcc

SEQ ID NO: 1426706 - DNA, 14 bp, Homo sapiens
acagtgggtggcac

SEQ ID NO: 1426707 - DNA, 21 bp, Homo sapiens
acagtgggtggcacctcctga

SEQ ID NO: 1426708 - DNA, 17 bp, Homo sapiens
acagtggtggcaacatt

SEQ ID NO: 1426709 - DNA, 12 bp, Homo sapiens
acagtgtacatg

SEQ ID NO: 1426710 - DNA, 16 bp, Homo sapiens
acagtgtcccccaggt

SEQ ID NO: 1426711 - DNA, 22 bp, Homo sapiens
acagtgtcctaccactctaatc

SEQ ID NO: 1426712 - DNA, 17 bp, Homo sapiens
acagtgttagtgctggt

SEQ ID NO: 1426713 - DNA, 16 bp, Homo sapiens
acagtgttattttctt

SEQ ID NO: 1426714 - DNA, 22 bp, Homo sapiens
acagtgttattttctttgaaat

SEQ ID NO: 1426715 - DNA, 16 bp, Homo sapiens
acagtgttgtgcccct

SEQ ID NO: 1426716 - DNA, 16 bp, Homo sapiens
acagttaactttcaga

SEQ ID NO: 1426717 - DNA, 22 bp, Homo sapiens
acagttagcagggatgttcctt

SEQ ID NO: 1426718 - DNA, 14 bp, Homo sapiens
acagttatattttt

SEQ ID NO: 1426719 - DNA, 16 bp, Homo sapiens
acagttcaagaaagct

SEQ ID NO: 1426720 - DNA, 20 bp, Homo sapiens
acagttcaagaaagcttcaa

SEQ ID NO: 1426721 - DNA, 15 bp, Homo sapiens
acagttcatatgtac

SEQ ID NO: 1426722 - DNA, 18 bp, Homo sapiens
acagttcctcgccctggg

SEQ ID NO: 1426723 - DNA, 13 bp, Homo sapiens
acagttcctggga

SEQ ID NO: 1426724 - DNA, 13 bp, Homo sapiens
acagttctttcct

SEQ ID NO: 1426725 - DNA, 16 bp, Homo sapiens
acagttctttcctctt

SEQ ID NO: 1426726 - DNA, 17 bp, Homo sapiens
acagttctttgggccag

SEQ ID NO: 1426727 - DNA, 20 bp, Homo sapiens
acagttctttgggccagaca

SEQ ID NO: 1426728 - DNA, 15 bp, Homo sapiens
acagttgctgtcata

SEQ ID NO: 1426729 - DNA, 21 bp, Homo sapiens
acagttgctgtcataagaatg

SEQ ID NO: 1426730 - DNA, 22 bp, Homo sapiens
acagttggcagagaaggcctct

SEQ ID NO: 1426731 - DNA, 14 bp, Homo sapiens
acagttggtaactt

SEQ ID NO: 1426732 - DNA, 12 bp, Homo sapiens
acagttgtattt

SEQ ID NO: 1426733 - DNA, 21 bp, Homo sapiens
acagttgtctattctgagcct

SEQ ID NO: 1426734 - DNA, 12 bp, Homo sapiens
acagttgtgcag

SEQ ID NO: 1426735 - DNA, 17 bp, Homo sapiens
acagttgtgcaggaggt

SEQ ID NO: 1426736 - DNA, 19 bp, Homo sapiens
acagtttcttttttcttac

SEQ ID NO: 1426737 - DNA, 15 bp, Homo sapiens
acagtttgaacaaaa

SEQ ID NO: 1426738 - DNA, 17 bp, Homo sapiens
acagttttaactgtgga

SEQ ID NO: 1426739 - DNA, 14 bp, Homo sapiens
acagttttccttct

SEQ ID NO: 1426740 - DNA, 15 bp, Homo sapiens
cctctgatacctcaa

SEQ ID NO: 1426741 - DNA, 14 bp, Homo sapiens
cctctgcaaccccc

SEQ ID NO: 1426742 - DNA, 19 bp, Homo sapiens
cctctgcaagcttcttgct

SEQ ID NO: 1426743 - DNA, 20 bp, Homo sapiens
cctctgcactactgacatgt

SEQ ID NO: 1426744 - DNA, 12 bp, Homo sapiens
cctctgcagaag

SEQ ID NO: 1426745 - DNA, 16 bp, Homo sapiens
cctctgcagaatccct

SEQ ID NO: 1426746 - DNA, 12 bp, Homo sapiens
cctctgcagctg

SEQ ID NO: 1426747 - DNA, 17 bp, Homo sapiens
cctctgcagctgacctc

SEQ ID NO: 1426748 - DNA, 13 bp, Homo sapiens
cctctgcagtctc

SEQ ID NO: 1426749 - DNA, 21 bp, Homo sapiens
cctctgcagtctcatttctca

SEQ ID NO: 1426750 - DNA, 16 bp, Homo sapiens
cctctgccacctcccc

SEQ ID NO: 1426751 - DNA, 14 bp, Homo sapiens
cctctgccagcgcc

SEQ ID NO: 1426752 - DNA, 17 bp, Homo sapiens
cctctgcccagcttggg

SEQ ID NO: 1426753 - DNA, 15 bp, Homo sapiens
cctctgccccaagca

SEQ ID NO: 1426754 - DNA, 22 bp, Homo sapiens
cctctgccccaagcagccagcc

SEQ ID NO: 1426755 - DNA, 23 bp, Homo sapiens
cctctgccccaagcagccagcca

SEQ ID NO: 1426756 - DNA, 13 bp, Homo sapiens
cctctgccctgga

SEQ ID NO: 1426757 - DNA, 15 bp, Homo sapiens
cctctgccctggatt

SEQ ID NO: 1426758 - DNA, 22 bp, Homo sapiens
cctctgccgctgcttccaggct

SEQ ID NO: 1426759 - DNA, 23 bp, Homo sapiens
cctctgccgctgcttccaggctg

SEQ ID NO: 1426760 - DNA, 18 bp, Homo sapiens
cctctgccggtcccccat

SEQ ID NO: 1426761 - DNA, 19 bp, Homo sapiens
cctctgccggtcgggcagc

SEQ ID NO: 1426762 - DNA, 22 bp, Homo sapiens
cctctgccggtcgggcagccag

SEQ ID NO: 1426763 - DNA, 23 bp, Homo sapiens
cctctgccggtcgggcagccagc

SEQ ID NO: 1426764 - DNA, 13 bp, Homo sapiens
cctctgcctcaat

SEQ ID NO: 1426765 - DNA, 19 bp, Homo sapiens
cctctgcctgaaccttcca

SEQ ID NO: 1426766 - DNA, 13 bp, Homo sapiens
cctctgcctgcac

SEQ ID NO: 1426767 - DNA, 17 bp, Homo sapiens
cctctgcctgcactccc

SEQ ID NO: 1426768 - DNA, 21 bp, Homo sapiens
cctctgcctgcactccctggc

SEQ ID NO: 1426769 - DNA, 23 bp, Homo sapiens
cctctgcctgcactccctggcct

SEQ ID NO: 1426770 - DNA, 14 bp, Homo sapiens
cctctgcctgctgg

SEQ ID NO: 1426771 - DNA, 14 bp, Homo sapiens
cctctgccttcagg

SEQ ID NO: 1426772 - DNA, 21 bp, Homo sapiens
cctctgcggggaggacccggg

SEQ ID NO: 1426773 - DNA, 13 bp, Homo sapiens
cctctgctcccca

SEQ ID NO: 1426774 - DNA, 12 bp, Homo sapiens
cctctgctccct

SEQ ID NO: 1426775 - DNA, 14 bp, Homo sapiens
cctctgctccctct

SEQ ID NO: 1426776 - DNA, 18 bp, Homo sapiens
cctctgctctgcctggag

SEQ ID NO: 1426777 - DNA, 17 bp, Homo sapiens
cctctgctgaatgcagg

SEQ ID NO: 1426778 - DNA, 10 bp, Homo sapiens
cctctgctgc

SEQ ID NO: 1426779 - DNA, 11 bp, Homo sapiens
cctctgctgcc

SEQ ID NO: 1426780 - DNA, 16 bp, Homo sapiens
cctctgctgccggctc

SEQ ID NO: 1426781 - DNA, 23 bp, Homo sapiens
cctctgctgccggctctgggcct

SEQ ID NO: 1426782 - DNA, 15 bp, Homo sapiens
cctctgctgctgccc

SEQ ID NO: 1426783 - DNA, 13 bp, Homo sapiens
cctgaatgaaata

SEQ ID NO: 1426784 - DNA, 14 bp, Homo sapiens
cctgaatgcttctg

SEQ ID NO: 1426785 - DNA, 15 bp, Homo sapiens
cctgaatgcttctga

SEQ ID NO: 1426786 - DNA, 21 bp, Homo sapiens
cctgaatggttccatgcctga

SEQ ID NO: 1426787 - DNA, 22 bp, Homo sapiens
cctgaatggttccatgcctgag

SEQ ID NO: 1426788 - DNA, 14 bp, Homo sapiens
cctgaattctattt

SEQ ID NO: 1426789 - DNA, 18 bp, Homo sapiens
cctgaattctatttgctg

SEQ ID NO: 1426790 - DNA, 21 bp, Homo sapiens
cctgaattttgttgctgtttt

SEQ ID NO: 1426791 - DNA, 18 bp, Homo sapiens
cctgacaaccactggtct

SEQ ID NO: 1426792 - DNA, 14 bp, Homo sapiens
cctgacacaccagg

SEQ ID NO: 1426793 - DNA, 17 bp, Homo sapiens
cctgacacaccaggcgc

SEQ ID NO: 1426794 - DNA, 23 bp, Homo sapiens
cctgacacactaaccaagctgag

SEQ ID NO: 1426795 - DNA, 15 bp, Homo sapiens
cctgacaccccctcc

SEQ ID NO: 1426796 - DNA, 18 bp, Homo sapiens
cctgacaccccctccccg

SEQ ID NO: 1426797 - DNA, 13 bp, Homo sapiens
cctgacactttaa

SEQ ID NO: 1426798 - DNA, 16 bp, Homo sapiens
cctgacagaaggtgcc

SEQ ID NO: 1426799 - DNA, 21 bp, Homo sapiens
cctgacagatgtcagccgagc

SEQ ID NO: 1426800 - DNA, 19 bp, Homo sapiens
cctgacatcatcattcttg

SEQ ID NO: 1426801 - DNA, 13 bp, Homo sapiens
cctgacattgtct

SEQ ID NO: 1426802 - DNA, 12 bp, Homo sapiens
cctgaccaccct

SEQ ID NO: 1426803 - DNA, 14 bp, Homo sapiens
cctgaccaccctcc

SEQ ID NO: 1426804 - DNA, 20 bp, Homo sapiens
cctgaccaccctcccctctc

SEQ ID NO: 1426805 - DNA, 21 bp, Homo sapiens
cctgaccaccctcccctctct

SEQ ID NO: 1426806 - DNA, 20 bp, Homo sapiens
cctgaccacgctttctagct

SEQ ID NO: 1426807 - DNA, 21 bp, Homo sapiens
cctgaccagctgctccgagga

SEQ ID NO: 1426808 - DNA, 22 bp, Homo sapiens
cctgaccagctgctccgaggac

SEQ ID NO: 1426809 - DNA, 12 bp, Homo sapiens
cctgaccagggg

SEQ ID NO: 1426810 - DNA, 23 bp, Homo sapiens
cctgaccagggggcccgaacagg

SEQ ID NO: 1426811 - DNA, 19 bp, Homo sapiens
cctgaccataatcctagcc

SEQ ID NO: 1426812 - DNA, 20 bp, Homo sapiens
cctgaccataatcctagccc

SEQ ID NO: 1426813 - DNA, 13 bp, Homo sapiens
cctgacccaggcc

SEQ ID NO: 1426814 - DNA, 15 bp, Homo sapiens
cctgacccagtcccc

SEQ ID NO: 1426815 - DNA, 23 bp, Homo sapiens
cctgaccccaagttatccacctg

SEQ ID NO: 1426816 - DNA, 13 bp, Homo sapiens
cctgacccctgcc

SEQ ID NO: 1426817 - DNA, 16 bp, Homo sapiens
cctgacccctgcctgt

SEQ ID NO: 1426818 - DNA, 15 bp, Homo sapiens
cctgacccctgctca

SEQ ID NO: 1426819 - DNA, 12 bp, Homo sapiens
cctgacccgtct

SEQ ID NO: 1426820 - DNA, 22 bp, Homo sapiens
cctgacccgtctaatatataaa

SEQ ID NO: 1426821 - DNA, 15 bp, Homo sapiens
cctgacctaccccag

SEQ ID NO: 1426822 - DNA, 17 bp, Homo sapiens
cctgacctaccccagcc

SEQ ID NO: 1426823 - DNA, 22 bp, Homo sapiens
cctgacctaccccagccaggct

SEQ ID NO: 1426824 - DNA, 18 bp, Homo sapiens
cctgacctcaagcaacca

SEQ ID NO: 1426825 - DNA, 17 bp, Homo sapiens
cctgacctccgcccctg

SEQ ID NO: 1426826 - DNA, 16 bp, Homo sapiens
cctgacctgtctcacc

SEQ ID NO: 1426827 - DNA, 18 bp, Homo sapiens
cctgaccttagcgttctg

SEQ ID NO: 1426828 - DNA, 10 bp, Homo sapiens
cctgactcaa

SEQ ID NO: 1426829 - DNA, 16 bp, Homo sapiens
cctgactcatcatttg

SEQ ID NO: 1426830 - DNA, 14 bp, Homo sapiens
cctgactcctgggt

SEQ ID NO: 1426831 - DNA, 16 bp, Homo sapiens
cctgactcctgggtgg

SEQ ID NO: 1426832 - DNA, 14 bp, Homo sapiens
cctgactctcagca

SEQ ID NO: 1426833 - DNA, 18 bp, Homo sapiens
cctgactctctgtgacct

SEQ ID NO: 1426834 - DNA, 18 bp, Homo sapiens
cctgactctgaaatctga

SEQ ID NO: 1426835 - DNA, 13 bp, Homo sapiens
cctgactggtgct

SEQ ID NO: 1426836 - DNA, 19 bp, Homo sapiens
cctgacttcagtgaatatt

SEQ ID NO: 1426837 - DNA, 21 bp, Homo sapiens
cctgacttcagtgaatatttt

SEQ ID NO: 1426838 - DNA, 23 bp, Homo sapiens
cctgacttcagtgaatatttttg

SEQ ID NO: 1426839 - DNA, 23 bp, Homo sapiens
cctgacttctggagatggatcct

SEQ ID NO: 1426840 - DNA, 17 bp, Homo sapiens
cctgagaaagctcaaag

SEQ ID NO: 1426841 - DNA, 13 bp, Homo sapiens
cctgagaactgaa

SEQ ID NO: 1426842 - DNA, 23 bp, Homo sapiens
cctgagaactgaattttgggact

SEQ ID NO: 1426843 - DNA, 14 bp, Homo sapiens
cctgagaaggcgag

SEQ ID NO: 1426844 - DNA, 22 bp, Homo sapiens
cctgagaagtgtctaaaaacac

SEQ ID NO: 1426845 - DNA, 15 bp, Homo sapiens
cctgagacaaatgga

SEQ ID NO: 1426846 - DNA, 18 bp, Homo sapiens
cctgagaccacagagaga

SEQ ID NO: 1426847 - DNA, 21 bp, Homo sapiens
cctgagaccagttgggagcac

SEQ ID NO: 1426848 - DNA, 13 bp, Homo sapiens
cctgagacctcaa

SEQ ID NO: 1426849 - DNA, 13 bp, Homo sapiens
cctgagacctcca

SEQ ID NO: 1426850 - DNA, 20 bp, Homo sapiens
cctgagacctcgccggcctt

SEQ ID NO: 1426851 - DNA, 18 bp, Homo sapiens
cctgagagacctgccctc

SEQ ID NO: 1426852 - DNA, 21 bp, Homo sapiens
cctgagagagaatagagctgc

SEQ ID NO: 1426853 - DNA, 16 bp, Homo sapiens
cctgagagcatctcag

SEQ ID NO: 1426854 - DNA, 22 bp, Homo sapiens
cctgagagcatctcaggagggg

SEQ ID NO: 1426855 - DNA, 12 bp, Homo sapiens
cctgagaggcag

SEQ ID NO: 1426856 - DNA, 15 bp, Homo sapiens
cctgagaggcaggca

SEQ ID NO: 1426857 - DNA, 17 bp, Homo sapiens
cctgagaggcaggcata

SEQ ID NO: 1426858 - DNA, 16 bp, Homo sapiens
cggggcccagcgctct

SEQ ID NO: 1426859 - DNA, 21 bp, Homo sapiens
cggggcccttggggcctggct

SEQ ID NO: 1426860 - DNA, 22 bp, Homo sapiens
cggggccttatcgggctccagc

SEQ ID NO: 1426861 - DNA, 23 bp, Homo sapiens
cggggctcttctcatttcacccc

SEQ ID NO: 1426862 - DNA, 11 bp, Homo sapiens
cggggctggca

SEQ ID NO: 1426863 - DNA, 19 bp, Homo sapiens
cggggctggcaagcaggga

SEQ ID NO: 1426864 - DNA, 16 bp, Homo sapiens
cgggggcagtgtgagg

SEQ ID NO: 1426865 - DNA, 15 bp, Homo sapiens
cgggggccttgaaga

SEQ ID NO: 1426866 - DNA, 19 bp, Homo sapiens
cgggggccttgaagactcc

SEQ ID NO: 1426867 - DNA, 12 bp, Homo sapiens
cgggggctggcc

SEQ ID NO: 1426868 - DNA, 15 bp, Homo sapiens
cgggggctggcctag

SEQ ID NO: 1426869 - DNA, 15 bp, Homo sapiens
cggggtatcctgggg

SEQ ID NO: 1426870 - DNA, 22 bp, Homo sapiens
cggggtattcccactcaccagc

SEQ ID NO: 1426871 - DNA, 18 bp, Homo sapiens
cggggtccaggcccgtgg

SEQ ID NO: 1426872 - DNA, 18 bp, Homo sapiens
cggggtcccctctgtgct

SEQ ID NO: 1426873 - DNA, 14 bp, Homo sapiens
cggggtctgtgctg

SEQ ID NO: 1426874 - DNA, 19 bp, Homo sapiens
cggggtctgtgctgtgcct

SEQ ID NO: 1426875 - DNA, 14 bp, Homo sapiens
acccctgtgctccg

SEQ ID NO: 1426876 - DNA, 15 bp, Homo sapiens
accccttagcctccc

SEQ ID NO: 1426877 - DNA, 16 bp, Homo sapiens
accccttagcctccct

SEQ ID NO: 1426878 - DNA, 13 bp, Homo sapiens
accccttccagat

SEQ ID NO: 1426879 - DNA, 15 bp, Homo sapiens
accccttccatgtgg

SEQ ID NO: 1426880 - DNA, 19 bp, Homo sapiens
accccttccatgtggagaa

SEQ ID NO: 1426881 - DNA, 14 bp, Homo sapiens
accccttccccagg

SEQ ID NO: 1426882 - DNA, 12 bp, Homo sapiens
accccttcgtgg

SEQ ID NO: 1426883 - DNA, 23 bp, Homo sapiens
accccttctctcctccccaaatc

SEQ ID NO: 1426884 - DNA, 21 bp, Homo sapiens
acccgagcccagctacattcc

SEQ ID NO: 1426885 - DNA, 16 bp, Homo sapiens
acccgaggatttctgg

SEQ ID NO: 1426886 - DNA, 19 bp, Homo sapiens
acccgaggatttctgggac

SEQ ID NO: 1426887 - DNA, 14 bp, Homo sapiens
acccgatgctgctt

SEQ ID NO: 1426888 - DNA, 21 bp, Homo sapiens
acccgccgcctcccacggcac

SEQ ID NO: 1426889 - DNA, 18 bp, Homo sapiens
acccgcctctcccgtcag

SEQ ID NO: 1426890 - DNA, 14 bp, Homo sapiens
acccgcctgcagag

SEQ ID NO: 1426891 - DNA, 21 bp, Homo sapiens
acccggaggggcctggcagcc

SEQ ID NO: 1426892 - DNA, 22 bp, Homo sapiens
acccggccgccgccaggactgt

SEQ ID NO: 1426893 - DNA, 17 bp, Homo sapiens
acccgggaccacagctg

SEQ ID NO: 1426894 - DNA, 18 bp, Homo sapiens
acccgggaccacagctgc

SEQ ID NO: 1426895 - DNA, 20 bp, Homo sapiens
acccgggcagggctcccaca

SEQ ID NO: 1426896 - DNA, 13 bp, Homo sapiens
acccgggggacag

SEQ ID NO: 1426897 - DNA, 14 bp, Homo sapiens
acccgggggacaga

SEQ ID NO: 1426898 - DNA, 18 bp, Homo sapiens
acccgggggagcccagtg

SEQ ID NO: 1426899 - DNA, 15 bp, Homo sapiens
acccggggtctcctg

SEQ ID NO: 1426900 - DNA, 16 bp, Homo sapiens
acccggggtctcctgg

SEQ ID NO: 1426901 - DNA, 15 bp, Homo sapiens
acccgtaggcagcct

SEQ ID NO: 1426902 - DNA, 19 bp, Homo sapiens
acccgtaggcagcctctct

SEQ ID NO: 1426903 - DNA, 23 bp, Homo sapiens
acccgtaggcagcctctctgcta

SEQ ID NO: 1426904 - DNA, 22 bp, Homo sapiens
acccgtgacctgagatgtgtga

SEQ ID NO: 1426905 - DNA, 18 bp, Homo sapiens
acccgtggggtgctgccc

SEQ ID NO: 1426906 - DNA, 20 bp, Homo sapiens
acccgttctgctggcctgga

SEQ ID NO: 1426907 - DNA, 22 bp, Homo sapiens
acccgttctgctggcctggatc

SEQ ID NO: 1426908 - DNA, 19 bp, Homo sapiens
accctaaaattctagggga

SEQ ID NO: 1426909 - DNA, 20 bp, Homo sapiens
accctaaataataaaaataa

SEQ ID NO: 1426910 - DNA, 14 bp, Homo sapiens
accctaaccaagtt

SEQ ID NO: 1426911 - DNA, 14 bp, Homo sapiens
accctaccccacca

SEQ ID NO: 1426912 - DNA, 15 bp, Homo sapiens
accctaccccaccac

SEQ ID NO: 1426913 - DNA, 17 bp, Homo sapiens
accctacctgtgcctga

SEQ ID NO: 1426914 - DNA, 13 bp, Homo sapiens
accctaccttccc

SEQ ID NO: 1426915 - DNA, 18 bp, Homo sapiens
accctaccttccccagac

SEQ ID NO: 1426916 - DNA, 16 bp, Homo sapiens
accctactttgcttcc

SEQ ID NO: 1426917 - DNA, 19 bp, Homo sapiens
accctactttgcttccgcc

SEQ ID NO: 1426918 - DNA, 16 bp, Homo sapiens
accctagccattcctg

SEQ ID NO: 1426919 - DNA, 23 bp, Homo sapiens
accctagccattcctggtaccca

SEQ ID NO: 1426920 - DNA, 21 bp, Homo sapiens
accctagttctacctcaggca

SEQ ID NO: 1426921 - DNA, 14 bp, Homo sapiens
accctatgggtcta

SEQ ID NO: 1426922 - DNA, 21 bp, Homo sapiens
accctcaacctcttctggctc

SEQ ID NO: 1426923 - DNA, 14 bp, Homo sapiens
accctcagcacccc

SEQ ID NO: 1426924 - DNA, 16 bp, Homo sapiens
accctcagcacccctt

SEQ ID NO: 1426925 - DNA, 17 bp, Homo sapiens
accctcagcaccccttc

SEQ ID NO: 1426926 - DNA, 14 bp, Homo sapiens
accctcagcctcca

SEQ ID NO: 1426927 - DNA, 20 bp, Homo sapiens
accctcaggcataggcctgg

SEQ ID NO: 1426928 - DNA, 18 bp, Homo sapiens
accctcataccatctgct

SEQ ID NO: 1426929 - DNA, 17 bp, Homo sapiens
accctcatggcccccag

SEQ ID NO: 1426930 - DNA, 18 bp, Homo sapiens
accctcatttctgccagc

SEQ ID NO: 1426931 - DNA, 14 bp, Homo sapiens
accctccaccctgt

SEQ ID NO: 1426932 - DNA, 16 bp, Homo sapiens
accctccaccctgtcc

SEQ ID NO: 1426933 - DNA, 17 bp, Homo sapiens
accctccaccctgtccc

SEQ ID NO: 1426934 - DNA, 23 bp, Homo sapiens
accctccaccctgtcccccagct

SEQ ID NO: 1426935 - DNA, 15 bp, Homo sapiens
accctccaccttcca

SEQ ID NO: 1426936 - DNA, 16 bp, Homo sapiens
accctccagtgctgga

SEQ ID NO: 1426937 - DNA, 13 bp, Homo sapiens
accctccatgctc

SEQ ID NO: 1426938 - DNA, 12 bp, Homo sapiens
accctcccaccc

SEQ ID NO: 1426939 - DNA, 23 bp, Homo sapiens
accctcccagaaacatctctggc

SEQ ID NO: 1426940 - DNA, 14 bp, Homo sapiens
accctccccattca

SEQ ID NO: 1426941 - DNA, 10 bp, Homo sapiens
accctccccc

SEQ ID NO: 1426942 - DNA, 17 bp, Homo sapiens
accctccctccctaccc

SEQ ID NO: 1426943 - DNA, 15 bp, Homo sapiens
accctccgccttcac

SEQ ID NO: 1426944 - DNA, 11 bp, Homo sapiens
accctcctggg

SEQ ID NO: 1426945 - DNA, 21 bp, Homo sapiens
accctcctgtaaatggtgtac

SEQ ID NO: 1426946 - DNA, 18 bp, Homo sapiens
accctcgggcccacctgg

SEQ ID NO: 1426947 - DNA, 21 bp, Homo sapiens
accctcgggcccacctggcca

SEQ ID NO: 1426948 - DNA, 14 bp, Homo sapiens
accctcgtggcctt

SEQ ID NO: 1426949 - DNA, 20 bp, Homo sapiens
accctcgtggccttccccag

SEQ ID NO: 1426950 - DNA, 15 bp, Homo sapiens
accctctcagctcca

SEQ ID NO: 1426951 - DNA, 22 bp, Homo sapiens
accctctcctgtctgccctctg

SEQ ID NO: 1426952 - DNA, 23 bp, Homo sapiens
accctctggaggggtgtggctcc

SEQ ID NO: 1426953 - DNA, 12 bp, Homo sapiens
accctctggggg

SEQ ID NO: 1426954 - DNA, 13 bp, Homo sapiens
accctctgggggt

SEQ ID NO: 1426955 - DNA, 21 bp, Homo sapiens
accctctgggggtcctctctg

SEQ ID NO: 1426956 - DNA, 15 bp, Homo sapiens
accctcttcctgtga

SEQ ID NO: 1426957 - DNA, 16 bp, Homo sapiens
accctctttcttgttt

SEQ ID NO: 1426958 - DNA, 19 bp, Homo sapiens
accctgaaaggaacactgg

SEQ ID NO: 1426959 - DNA, 21 bp, Homo sapiens
accctgaatggttccatgcct

SEQ ID NO: 1426960 - DNA, 16 bp, Homo sapiens
accctgagcagggtcc

SEQ ID NO: 1426961 - DNA, 17 bp, Homo sapiens
accctgagcagggtcca

SEQ ID NO: 1426962 - DNA, 16 bp, Homo sapiens
accctgagttcatcca

SEQ ID NO: 1426963 - DNA, 17 bp, Homo sapiens
accctgagttttgtttt

SEQ ID NO: 1426964 - DNA, 22 bp, Homo sapiens
accctgattcttgattcctggc

SEQ ID NO: 1426965 - DNA, 15 bp, Homo sapiens
accctgcacctgctg

SEQ ID NO: 1426966 - DNA, 16 bp, Homo sapiens
accctgcacctgctgc

SEQ ID NO: 1426967 - DNA, 13 bp, Homo sapiens
accctgcagagca

SEQ ID NO: 1426968 - DNA, 14 bp, Homo sapiens
accctgcagagcac

SEQ ID NO: 1426969 - DNA, 19 bp, Homo sapiens
accctgcagagcacacagg

SEQ ID NO: 1426970 - DNA, 12 bp, Homo sapiens
accctgcaggac

SEQ ID NO: 1426971 - DNA, 18 bp, Homo sapiens
accctgcaggacttgcca

SEQ ID NO: 1426972 - DNA, 20 bp, Homo sapiens
accctgccccccctaagaga

SEQ ID NO: 1426973 - DNA, 17 bp, Homo sapiens
accctgcctgagcccag

SEQ ID NO: 1426974 - DNA, 16 bp, Homo sapiens
accctgcgcctccaga

SEQ ID NO: 1426975 - DNA, 17 bp, Homo sapiens
accctgcgcctccagag

SEQ ID NO: 1426976 - DNA, 22 bp, Homo sapiens
accctgcgcctccagaggtcct

SEQ ID NO: 1426977 - DNA, 18 bp, Homo sapiens
accctgctcatccactct

SEQ ID NO: 1426978 - DNA, 19 bp, Homo sapiens
accctgctgaacacagtgt

SEQ ID NO: 1426979 - DNA, 23 bp, Homo sapiens
accctgctgaacacagtgtctgt

SEQ ID NO: 1426980 - DNA, 14 bp, Homo sapiens
accctgcttctgct

SEQ ID NO: 1426981 - DNA, 21 bp, Homo sapiens
accctgcttctgctgccctga

SEQ ID NO: 1426982 - DNA, 10 bp, Homo sapiens
accctggaat

SEQ ID NO: 1426983 - DNA, 19 bp, Homo sapiens
accctggaattcagcaccc

SEQ ID NO: 1426984 - DNA, 21 bp, Homo sapiens
accctggaattcagcaccctg

SEQ ID NO: 1426985 - DNA, 13 bp, Homo sapiens
accctggagccat

SEQ ID NO: 1426986 - DNA, 15 bp, Homo sapiens
accctggagttcttg

SEQ ID NO: 1426987 - DNA, 12 bp, Homo sapiens
accctggatgct

SEQ ID NO: 1426988 - DNA, 14 bp, Homo sapiens
accctggcagggac

SEQ ID NO: 1426989 - DNA, 15 bp, Homo sapiens
accctggcattatgt

SEQ ID NO: 1426990 - DNA, 11 bp, Homo sapiens
accctggcccg

SEQ ID NO: 1426991 - DNA, 17 bp, Homo sapiens
accctggccgccccctg

SEQ ID NO: 1426992 - DNA, 21 bp, Homo sapiens
cggggtctgtgctgtgcctgc

SEQ ID NO: 1426993 - DNA, 22 bp, Homo sapiens
cggggtctgtgctgtgcctgct

SEQ ID NO: 1426994 - DNA, 12 bp, Homo sapiens
cggggtggagca

SEQ ID NO: 1426995 - DNA, 17 bp, Homo sapiens
cggggtggcggtggacc

SEQ ID NO: 1426996 - DNA, 17 bp, Homo sapiens
cggggtggtggacaggg

SEQ ID NO: 1426997 - DNA, 19 bp, Homo sapiens
cggggtgtaacttcctgct

SEQ ID NO: 1426998 - DNA, 15 bp, Homo sapiens
cgggtcatctgtacc

SEQ ID NO: 1426999 - DNA, 16 bp, Homo sapiens
cgggtccccagctccc

SEQ ID NO: 1427000 - DNA, 13 bp, Homo sapiens
cgggtctccttgg

SEQ ID NO: 1427001 - DNA, 16 bp, Homo sapiens
cgggtctcgcagcctg

SEQ ID NO: 1427002 - DNA, 17 bp, Homo sapiens
cgggtctcgcagcctga

SEQ ID NO: 1427003 - DNA, 13 bp, Homo sapiens
cgggtctgagact

SEQ ID NO: 1427004 - DNA, 20 bp, Homo sapiens
cgggtgcccgtaatcccagc

SEQ ID NO: 1427005 - DNA, 23 bp, Homo sapiens
cgggtgctggaagtctccatgaa

SEQ ID NO: 1427006 - DNA, 18 bp, Homo sapiens
cgggtggctagtcagaga

SEQ ID NO: 1427007 - DNA, 13 bp, Homo sapiens
cgggtgggcctgg

SEQ ID NO: 1427008 - DNA, 18 bp, Homo sapiens
cgggtgggcctggcctga

SEQ ID NO: 1427009 - DNA, 15 bp, Homo sapiens
cgggtgggggagcca

SEQ ID NO: 1427010 - DNA, 14 bp, Homo sapiens
cgggtggtccccgt

SEQ ID NO: 1427011 - DNA, 17 bp, Homo sapiens
cgggttataatgaatga

SEQ ID NO: 1427012 - DNA, 22 bp, Homo sapiens
cgggttcgcaccattctcctgc

SEQ ID NO: 1427013 - DNA, 12 bp, Homo sapiens
cgggttctagac

SEQ ID NO: 1427014 - DNA, 19 bp, Homo sapiens
cgggttctagacgcccctc

SEQ ID NO: 1427015 - DNA, 12 bp, Homo sapiens
cgggttgaaaga

SEQ ID NO: 1427016 - DNA, 14 bp, Homo sapiens
cgggttgaaagaca

SEQ ID NO: 1427017 - DNA, 19 bp, Homo sapiens
cgggttgaaagacatcaat

SEQ ID NO: 1427018 - DNA, 21 bp, Homo sapiens
cgggttgaaagacatcaatga

SEQ ID NO: 1427019 - DNA, 20 bp, Homo sapiens
cggtaagtgttctcatgaag

SEQ ID NO: 1427020 - DNA, 22 bp, Homo sapiens
cggtatccccccatcttgcttc

SEQ ID NO: 1427021 - DNA, 14 bp, Homo sapiens
cggtcatgtgtgca

SEQ ID NO: 1427022 - DNA, 11 bp, Homo sapiens
cggtccagctg

SEQ ID NO: 1427023 - DNA, 13 bp, Homo sapiens
cggtccagctggc

SEQ ID NO: 1427024 - DNA, 15 bp, Homo sapiens
cggtccagctggcct

SEQ ID NO: 1427025 - DNA, 18 bp, Homo sapiens
cggtcccccatgccacca

SEQ ID NO: 1427026 - DNA, 13 bp, Homo sapiens
cggtccctgtccc

SEQ ID NO: 1427027 - DNA, 19 bp, Homo sapiens
cggtcccttgagacctcag

SEQ ID NO: 1427028 - DNA, 23 bp, Homo sapiens
cggtcccttgagacctcagccat

SEQ ID NO: 1427029 - DNA, 15 bp, Homo sapiens
cggtcgggcagccag

SEQ ID NO: 1427030 - DNA, 19 bp, Homo sapiens
cggtcgggcagccagcaga

SEQ ID NO: 1427031 - DNA, 15 bp, Homo sapiens
cggtctcctgactgg

SEQ ID NO: 1427032 - DNA, 15 bp, Homo sapiens
cggtctgacagtcct

SEQ ID NO: 1427033 - DNA, 14 bp, Homo sapiens
cggtgaggccgggc

SEQ ID NO: 1427034 - DNA, 17 bp, Homo sapiens
cggtgcacaggcctctg

SEQ ID NO: 1427035 - DNA, 20 bp, Homo sapiens
cggtgcacaggcctctgcct

SEQ ID NO: 1427036 - DNA, 21 bp, Homo sapiens
cggtgcacaggcctctgcctg

SEQ ID NO: 1427037 - DNA, 23 bp, Homo sapiens
cggtgcacaggcctctgcctgct

SEQ ID NO: 1427038 - DNA, 23 bp, Homo sapiens
cggtgcatacacccccacctcct

SEQ ID NO: 1427039 - DNA, 18 bp, Homo sapiens
cggtgccaagggccccag

SEQ ID NO: 1427040 - DNA, 20 bp, Homo sapiens
cggtgccaagggccccaggg

SEQ ID NO: 1427041 - DNA, 14 bp, Homo sapiens
cggtgcccaagcca

SEQ ID NO: 1427042 - DNA, 18 bp, Homo sapiens
cggtgcccaagccagagg

SEQ ID NO: 1427043 - DNA, 20 bp, Homo sapiens
cggtgcccaagccagaggct

SEQ ID NO: 1427044 - DNA, 18 bp, Homo sapiens
cggtgcgtggctgtggca

SEQ ID NO: 1427045 - DNA, 24 bp, Homo sapiens
cggtgcgtggctgtggcacagact

SEQ ID NO: 1427046 - DNA, 18 bp, Homo sapiens
cggtgctaaaaatgaaaa

SEQ ID NO: 1427047 - DNA, 14 bp, Homo sapiens
cggtgctctggcgg

SEQ ID NO: 1427048 - DNA, 20 bp, Homo sapiens
cggtgctgactgaggcctgc

SEQ ID NO: 1427049 - DNA, 15 bp, Homo sapiens
cggtgctgcaggagt

SEQ ID NO: 1427050 - DNA, 16 bp, Homo sapiens
cggtgctgcaggagtg

SEQ ID NO: 1427051 - DNA, 16 bp, Homo sapiens
cggtgctgggttccca

SEQ ID NO: 1427052 - DNA, 16 bp, Homo sapiens
cggtgctgtgagggag

SEQ ID NO: 1427053 - DNA, 19 bp, Homo sapiens
cggtgctgtgagggagggg

SEQ ID NO: 1427054 - DNA, 22 bp, Homo sapiens
cggtggagaagatcgcatggca

SEQ ID NO: 1427055 - DNA, 18 bp, Homo sapiens
cggtggataactagccag

SEQ ID NO: 1427056 - DNA, 19 bp, Homo sapiens
cggtggcctattccaggaa

SEQ ID NO: 1427057 - DNA, 16 bp, Homo sapiens
cggtggctgccccggc

SEQ ID NO: 1427058 - DNA, 12 bp, Homo sapiens
cggtggctgggc

SEQ ID NO: 1427059 - DNA, 19 bp, Homo sapiens
cggtgggcatttgtgaggc

SEQ ID NO: 1427060 - DNA, 17 bp, Homo sapiens
cggtgggccagagctga

SEQ ID NO: 1427061 - DNA, 14 bp, Homo sapiens
cggtgggtcacaca

SEQ ID NO: 1427062 - DNA, 21 bp, Homo sapiens
cggtggtttgccatgtcgctt

SEQ ID NO: 1427063 - DNA, 16 bp, Homo sapiens
cggtggtttgtaattc

SEQ ID NO: 1427064 - DNA, 14 bp, Homo sapiens
cggtgtgctgccaa

SEQ ID NO: 1427065 - DNA, 19 bp, Homo sapiens
cggtgttaattttgctaac

SEQ ID NO: 1427066 - DNA, 22 bp, Homo sapiens
cggtgttaattttgctaactgg

SEQ ID NO: 1427067 - DNA, 21 bp, Homo sapiens
cggtgtttggcaatgctaatt

SEQ ID NO: 1427068 - DNA, 18 bp, Homo sapiens
cggttaagaaagcactta

SEQ ID NO: 1427069 - DNA, 18 bp, Homo sapiens
cggttataaaaaatggtt

SEQ ID NO: 1427070 - DNA, 20 bp, Homo sapiens
cggttataaaaaatggttca

SEQ ID NO: 1427071 - DNA, 18 bp, Homo sapiens
cggttccacgtccccctg

SEQ ID NO: 1427072 - DNA, 20 bp, Homo sapiens
cggttccacgtccccctggg

SEQ ID NO: 1427073 - DNA, 21 bp, Homo sapiens
cggttccccgcaacccacagc

SEQ ID NO: 1427074 - DNA, 12 bp, Homo sapiens
cggttcttccag

SEQ ID NO: 1427075 - DNA, 21 bp, Homo sapiens
cggttggagcgagcatccccc

SEQ ID NO: 1427076 - DNA, 13 bp, Homo sapiens
cggtttccaggga

SEQ ID NO: 1427077 - DNA, 16 bp, Homo sapiens
cggtttccagggaggg

SEQ ID NO: 1427078 - DNA, 16 bp, Homo sapiens
cggtttcccggccctt

SEQ ID NO: 1427079 - DNA, 21 bp, Homo sapiens
cggtttttttctttggctgca

SEQ ID NO: 1427080 - DNA, 22 bp, Homo sapiens
cggtttttttctttggctgcag

SEQ ID NO: 1427081 - DNA, 12 bp, Homo sapiens
cgtaaactatga

SEQ ID NO: 1427082 - DNA, 15 bp, Homo sapiens
cgtaaccacggaaaa

SEQ ID NO: 1427083 - DNA, 14 bp, Homo sapiens
cgtaataattatta

SEQ ID NO: 1427084 - DNA, 17 bp, Homo sapiens
cgtaataattattatta

SEQ ID NO: 1427085 - DNA, 19 bp, Homo sapiens
cgtaatagcttctgtgtgt

SEQ ID NO: 1427086 - DNA, 13 bp, Homo sapiens
cgtaatcccagct

SEQ ID NO: 1427087 - DNA, 17 bp, Homo sapiens
cgtaatgggcctgccca

SEQ ID NO: 1427088 - DNA, 15 bp, Homo sapiens
cgtaattctttctgt

SEQ ID NO: 1427089 - DNA, 20 bp, Homo sapiens
cgtaattctttctgtctccc

SEQ ID NO: 1427090 - DNA, 15 bp, Homo sapiens
cgtacacagagaagg

SEQ ID NO: 1427091 - DNA, 14 bp, Homo sapiens
cgtaccccaccctc

SEQ ID NO: 1427092 - DNA, 15 bp, Homo sapiens
cgtaccccaccctca

SEQ ID NO: 1427093 - DNA, 14 bp, Homo sapiens
cgtaccccactggg

SEQ ID NO: 1427094 - DNA, 19 bp, Homo sapiens
cgtaccccactgggccagc

SEQ ID NO: 1427095 - DNA, 13 bp, Homo sapiens
cgtacgcccagga

SEQ ID NO: 1427096 - DNA, 18 bp, Homo sapiens
cgtactacccagctctgt

SEQ ID NO: 1427097 - DNA, 20 bp, Homo sapiens
cgtagccaaggtgggctgag

SEQ ID NO: 1427098 - DNA, 15 bp, Homo sapiens
cgtagcctgggctca

SEQ ID NO: 1427099 - DNA, 13 bp, Homo sapiens
cgtagctctctta

SEQ ID NO: 1427100 - DNA, 14 bp, Homo sapiens
cgtaggcagccacg

SEQ ID NO: 1427101 - DNA, 20 bp, Homo sapiens
cgtaggcagccacggccccg

SEQ ID NO: 1427102 - DNA, 15 bp, Homo sapiens
cgtaggggctcctga

SEQ ID NO: 1427103 - DNA, 15 bp, Homo sapiens
cgtagggtggcactg

SEQ ID NO: 1427104 - DNA, 18 bp, Homo sapiens
cgtagggtggcactggga

SEQ ID NO: 1427105 - DNA, 19 bp, Homo sapiens
cgtagggtggcactgggag

SEQ ID NO: 1427106 - DNA, 15 bp, Homo sapiens
cgtataaatatcagt

SEQ ID NO: 1427107 - DNA, 16 bp, Homo sapiens
cgtataggcatgtaaa

SEQ ID NO: 1427108 - DNA, 15 bp, Homo sapiens
cgtattggtccagct

SEQ ID NO: 1427109 - DNA, 19 bp, Homo sapiens
accctggcctggtccctgg

SEQ ID NO: 1427110 - DNA, 20 bp, Homo sapiens
accctggcctggtccctggt

SEQ ID NO: 1427111 - DNA, 21 bp, Homo sapiens
accctggcttgcttgccgagc

SEQ ID NO: 1427112 - DNA, 11 bp, Homo sapiens
accctgggcaa

SEQ ID NO: 1427113 - DNA, 19 bp, Homo sapiens
accctgggcaaacagagct

SEQ ID NO: 1427114 - DNA, 21 bp, Homo sapiens
accctgggcaaacagagctac

SEQ ID NO: 1427115 - DNA, 17 bp, Homo sapiens
accctgggccctgggct

SEQ ID NO: 1427116 - DNA, 18 bp, Homo sapiens
accctgggccctgggctg

SEQ ID NO: 1427117 - DNA, 21 bp, Homo sapiens
accctgggctattgctgctgc

SEQ ID NO: 1427118 - DNA, 12 bp, Homo sapiens
accctgggctcc

SEQ ID NO: 1427119 - DNA, 20 bp, Homo sapiens
accctgggctccacacagca

SEQ ID NO: 1427120 - DNA, 16 bp, Homo sapiens
accctgggctggggag

SEQ ID NO: 1427121 - DNA, 14 bp, Homo sapiens
accctggggcctga

SEQ ID NO: 1427122 - DNA, 22 bp, Homo sapiens
accctggggcctgactgctcag

SEQ ID NO: 1427123 - DNA, 14 bp, Homo sapiens
accctgggtgccat

SEQ ID NO: 1427124 - DNA, 20 bp, Homo sapiens
accctgggtgccattcccag

SEQ ID NO: 1427125 - DNA, 18 bp, Homo sapiens
accctgggtgggctctgt

SEQ ID NO: 1427126 - DNA, 20 bp, Homo sapiens
accctgggtgggctctgtgc

SEQ ID NO: 1427127 - DNA, 23 bp, Homo sapiens
accctgggtgtccccgctgctgt

SEQ ID NO: 1427128 - DNA, 20 bp, Homo sapiens
accctggtctgaggatgtag

SEQ ID NO: 1427129 - DNA, 22 bp, Homo sapiens
accctgtactgttctgtgtctt

SEQ ID NO: 1427130 - DNA, 21 bp, Homo sapiens
accctgtcaagttaacaagga

SEQ ID NO: 1427131 - DNA, 19 bp, Homo sapiens
accctgtccaaactgccta

SEQ ID NO: 1427132 - DNA, 14 bp, Homo sapiens
accctgtcccccag

SEQ ID NO: 1427133 - DNA, 15 bp, Homo sapiens
accctgtccggccca

SEQ ID NO: 1427134 - DNA, 15 bp, Homo sapiens
accctgtctgtccct

SEQ ID NO: 1427135 - DNA, 17 bp, Homo sapiens
accctgtctgtcccttt

SEQ ID NO: 1427136 - DNA, 17 bp, Homo sapiens
accctgtcttctgggca

SEQ ID NO: 1427137 - DNA, 14 bp, Homo sapiens
accctgtgcaggag

SEQ ID NO: 1427138 - DNA, 19 bp, Homo sapiens
accctgtgctggtgtcctg

SEQ ID NO: 1427139 - DNA, 23 bp, Homo sapiens
accctgtgctggtgtcctgacca

SEQ ID NO: 1427140 - DNA, 19 bp, Homo sapiens
acccttaccccttagcctc

SEQ ID NO: 1427141 - DNA, 17 bp, Homo sapiens
acccttattgctgtcct

SEQ ID NO: 1427142 - DNA, 19 bp, Homo sapiens
acccttattgctgtcctgg

SEQ ID NO: 1427143 - DNA, 21 bp, Homo sapiens
acccttattgctgtcctggag

SEQ ID NO: 1427144 - DNA, 14 bp, Homo sapiens
acccttcagggcca

SEQ ID NO: 1427145 - DNA, 16 bp, Homo sapiens
acccttcagggccaga

SEQ ID NO: 1427146 - DNA, 17 bp, Homo sapiens
acccttcagggccagaa

SEQ ID NO: 1427147 - DNA, 18 bp, Homo sapiens
acccttcatcttcctgtg

SEQ ID NO: 1427148 - DNA, 20 bp, Homo sapiens
acccttcatcttcctgtgtc

SEQ ID NO: 1427149 - DNA, 13 bp, Homo sapiens
acccttccacctc

SEQ ID NO: 1427150 - DNA, 13 bp, Homo sapiens
acccttccagaca

SEQ ID NO: 1427151 - DNA, 12 bp, Homo sapiens
acccttccatca

SEQ ID NO: 1427152 - DNA, 13 bp, Homo sapiens
acccttcccaatc

SEQ ID NO: 1427153 - DNA, 21 bp, Homo sapiens
acccttcccaatcagcactga

SEQ ID NO: 1427154 - DNA, 23 bp, Homo sapiens
acccttcccaatcagcactgaaa

SEQ ID NO: 1427155 - DNA, 12 bp, Homo sapiens
acccttccctct

SEQ ID NO: 1427156 - DNA, 14 bp, Homo sapiens
acccttccctcttc

SEQ ID NO: 1427157 - DNA, 20 bp, Homo sapiens
acccttccctcttccctctc

SEQ ID NO: 1427158 - DNA, 23 bp, Homo sapiens
acccttccctcttccctctccct

SEQ ID NO: 1427159 - DNA, 11 bp, Homo sapiens
acccttccctg

SEQ ID NO: 1427160 - DNA, 19 bp, Homo sapiens
acccttcctgctgctgcta

SEQ ID NO: 1427161 - DNA, 13 bp, Homo sapiens
acccttctccttt

SEQ ID NO: 1427162 - DNA, 16 bp, Homo sapiens
acccttctcctttcct

SEQ ID NO: 1427163 - DNA, 23 bp, Homo sapiens
acccttctcctttccttcccagg

SEQ ID NO: 1427164 - DNA, 22 bp, Homo sapiens
acccttgattttgccccctgag

SEQ ID NO: 1427165 - DNA, 22 bp, Homo sapiens
acccttgcccggctgtgattgc

SEQ ID NO: 1427166 - DNA, 19 bp, Homo sapiens
acccttgctttcctgggcc

SEQ ID NO: 1427167 - DNA, 12 bp, Homo sapiens
acccttggcctc

SEQ ID NO: 1427168 - DNA, 18 bp, Homo sapiens
acccttgggccagaagta

SEQ ID NO: 1427169 - DNA, 19 bp, Homo sapiens
acccttgtcatctctctgc

SEQ ID NO: 1427170 - DNA, 17 bp, Homo sapiens
accctttaaatgtaaaa

SEQ ID NO: 1427171 - DNA, 20 bp, Homo sapiens
accctttaagatatccatct

SEQ ID NO: 1427172 - DNA, 15 bp, Homo sapiens
accctttctgttgcc

SEQ ID NO: 1427173 - DNA, 12 bp, Homo sapiens
accctttgcccc

SEQ ID NO: 1427174 - DNA, 14 bp, Homo sapiens
acccttttccccct

SEQ ID NO: 1427175 - DNA, 16 bp, Homo sapiens
acccttttcccccttc

SEQ ID NO: 1427176 - DNA, 15 bp, Homo sapiens
acccttttttctaag

SEQ ID NO: 1427177 - DNA, 15 bp, Homo sapiens
accgaccaactgccc

SEQ ID NO: 1427178 - DNA, 17 bp, Homo sapiens
accgaccaactgcccta

SEQ ID NO: 1427179 - DNA, 23 bp, Homo sapiens
accgacctggtttttaaatagag

SEQ ID NO: 1427180 - DNA, 20 bp, Homo sapiens
accgactaccccagtcccag

SEQ ID NO: 1427181 - DNA, 17 bp, Homo sapiens
accgactagccaggaag

SEQ ID NO: 1427182 - DNA, 17 bp, Homo sapiens
accgagagtagccgaga

SEQ ID NO: 1427183 - DNA, 23 bp, Homo sapiens
accgagagtagccgagagcctgc

SEQ ID NO: 1427184 - DNA, 13 bp, Homo sapiens
accgagcccagca

SEQ ID NO: 1427185 - DNA, 14 bp, Homo sapiens
accgagccctggag

SEQ ID NO: 1427186 - DNA, 15 bp, Homo sapiens
accgaggggcctttg

SEQ ID NO: 1427187 - DNA, 21 bp, Homo sapiens
accgaggggcctttgttctgg

SEQ ID NO: 1427188 - DNA, 16 bp, Homo sapiens
accgagtctcttctcc

SEQ ID NO: 1427189 - DNA, 24 bp, Homo sapiens
accgagtctcttctccactggatg

SEQ ID NO: 1427190 - DNA, 18 bp, Homo sapiens
accgcaaacgtgaaattc

SEQ ID NO: 1427191 - DNA, 12 bp, Homo sapiens
accgcaggcccg

SEQ ID NO: 1427192 - DNA, 19 bp, Homo sapiens
accgcaggggactgtctca

SEQ ID NO: 1427193 - DNA, 20 bp, Homo sapiens
accgcaggggactgtctcag

SEQ ID NO: 1427194 - DNA, 16 bp, Homo sapiens
accgccacgtcccagc

SEQ ID NO: 1427195 - DNA, 20 bp, Homo sapiens
accgccacgtcccagcatcc

SEQ ID NO: 1427196 - DNA, 13 bp, Homo sapiens
accgcccccaccc

SEQ ID NO: 1427197 - DNA, 14 bp, Homo sapiens
accgcccccacccc

SEQ ID NO: 1427198 - DNA, 22 bp, Homo sapiens
accgcccccaccccttccccag

SEQ ID NO: 1427199 - DNA, 11 bp, Homo sapiens
accgccccctc

SEQ ID NO: 1427200 - DNA, 14 bp, Homo sapiens
accgccccctcctc

SEQ ID NO: 1427201 - DNA, 19 bp, Homo sapiens
accgccccctcctctagct

SEQ ID NO: 1427202 - DNA, 21 bp, Homo sapiens
accgcccggcagccccttctg

SEQ ID NO: 1427203 - DNA, 12 bp, Homo sapiens
accgcctctggc

SEQ ID NO: 1427204 - DNA, 13 bp, Homo sapiens
accgcctctggcc

SEQ ID NO: 1427205 - DNA, 12 bp, Homo sapiens
accgcctgccct

SEQ ID NO: 1427206 - DNA, 13 bp, Homo sapiens
accgcctgccctc

SEQ ID NO: 1427207 - DNA, 15 bp, Homo sapiens
accgcctgccctccc

SEQ ID NO: 1427208 - DNA, 23 bp, Homo sapiens
accgcctgccctcccgcaccttc

SEQ ID NO: 1427209 - DNA, 15 bp, Homo sapiens
accgcggccaggcac

SEQ ID NO: 1427210 - DNA, 16 bp, Homo sapiens
accgctgccagcacag

SEQ ID NO: 1427211 - DNA, 20 bp, Homo sapiens
accgctgcctaagtggctgc

SEQ ID NO: 1427212 - DNA, 15 bp, Homo sapiens
accgctggccctgcc

SEQ ID NO: 1427213 - DNA, 15 bp, Homo sapiens
accgctggtccctgc

SEQ ID NO: 1427214 - DNA, 15 bp, Homo sapiens
accgcttcacccctg

SEQ ID NO: 1427215 - DNA, 20 bp, Homo sapiens
accgcttcacccctgcactt

SEQ ID NO: 1427216 - DNA, 12 bp, Homo sapiens
accggaccatct

SEQ ID NO: 1427217 - DNA, 16 bp, Homo sapiens
accggacttttctgca

SEQ ID NO: 1427218 - DNA, 19 bp, Homo sapiens
accggagagttatcctgat

SEQ ID NO: 1427219 - DNA, 14 bp, Homo sapiens
accggattctctct

SEQ ID NO: 1427220 - DNA, 18 bp, Homo sapiens
accggcctgtgggtctct

SEQ ID NO: 1427221 - DNA, 14 bp, Homo sapiens
accgggaccccctc

SEQ ID NO: 1427222 - DNA, 19 bp, Homo sapiens
accgggtgggcctggcctg

SEQ ID NO: 1427223 - DNA, 21 bp, Homo sapiens
accgggtgggcctggcctgag

SEQ ID NO: 1427224 - DNA, 17 bp, Homo sapiens
accggtgctgcaggagt

SEQ ID NO: 1427225 - DNA, 22 bp, Homo sapiens
accgtcatggcttaatgtttat

SEQ ID NO: 1427226 - DNA, 13 bp, Homo sapiens
cgtatttataata

SEQ ID NO: 1427227 - DNA, 19 bp, Homo sapiens
cgtatttatatttggaaag

SEQ ID NO: 1427228 - DNA, 15 bp, Homo sapiens
cgtcaagacatttgc

SEQ ID NO: 1427229 - DNA, 21 bp, Homo sapiens
cgtcacccctgtttctggcac

SEQ ID NO: 1427230 - DNA, 19 bp, Homo sapiens
cgtcactccagtgctcagc

SEQ ID NO: 1427231 - DNA, 21 bp, Homo sapiens
cgtcactccagtgctcagctg

SEQ ID NO: 1427232 - DNA, 21 bp, Homo sapiens
cgtcagggagaggtcaccagc

SEQ ID NO: 1427233 - DNA, 20 bp, Homo sapiens
cgtcagggcccaagtccctg

SEQ ID NO: 1427234 - DNA, 13 bp, Homo sapiens
cgtcatctcaggg

SEQ ID NO: 1427235 - DNA, 19 bp, Homo sapiens
cgtcatggcttaatgttta

SEQ ID NO: 1427236 - DNA, 15 bp, Homo sapiens
cgtcatgttcctcaa

SEQ ID NO: 1427237 - DNA, 15 bp, Homo sapiens
cgtcattgctgctgc

SEQ ID NO: 1427238 - DNA, 17 bp, Homo sapiens
cgtccaagggacagccc

SEQ ID NO: 1427239 - DNA, 15 bp, Homo sapiens
cgtccacaggggcag

SEQ ID NO: 1427240 - DNA, 13 bp, Homo sapiens
cgtccacccaggc

SEQ ID NO: 1427241 - DNA, 12 bp, Homo sapiens
cgtccaccccag

SEQ ID NO: 1427242 - DNA, 13 bp, Homo sapiens
cgtccaggcccca

SEQ ID NO: 1427243 - DNA, 17 bp, Homo sapiens
cgtccagggtttacatt

SEQ ID NO: 1427244 - DNA, 15 bp, Homo sapiens
cgtccatggcaccag

SEQ ID NO: 1427245 - DNA, 18 bp, Homo sapiens
cgtccatggcaccagccc

SEQ ID NO: 1427246 - DNA, 19 bp, Homo sapiens
cgtccatggcaccagcccc

SEQ ID NO: 1427247 - DNA, 19 bp, Homo sapiens
cgtcccagcatccctggag

SEQ ID NO: 1427248 - DNA, 21 bp, Homo sapiens
cgtccccagttgccgtctagg

SEQ ID NO: 1427249 - DNA, 17 bp, Homo sapiens
cgtcccccgccgcgcca

SEQ ID NO: 1427250 - DNA, 14 bp, Homo sapiens
cgtcccctccgccg

SEQ ID NO: 1427251 - DNA, 22 bp, Homo sapiens
cgtcccctccgccgtgccggcg

SEQ ID NO: 1427252 - DNA, 21 bp, Homo sapiens
cgtcccgctgctgtgctctgg

SEQ ID NO: 1427253 - DNA, 13 bp, Homo sapiens
cgtccctcccagg

SEQ ID NO: 1427254 - DNA, 23 bp, Homo sapiens
cgtccctcccaggtcgggcagtg

SEQ ID NO: 1427255 - DNA, 16 bp, Homo sapiens
cgtccctttttctcca

SEQ ID NO: 1427256 - DNA, 18 bp, Homo sapiens
cgtccctttttctccaca

SEQ ID NO: 1427257 - DNA, 19 bp, Homo sapiens
cgtccgccctgctcctccc

SEQ ID NO: 1427258 - DNA, 22 bp, Homo sapiens
cgtccgccctgctcctccctgg

SEQ ID NO: 1427259 - DNA, 15 bp, Homo sapiens
cgtccgtctgtctcg

SEQ ID NO: 1427260 - DNA, 16 bp, Homo sapiens
cgtcctccccctgcca

SEQ ID NO: 1427261 - DNA, 22 bp, Homo sapiens
cgtcctccccctgccagtgcct

SEQ ID NO: 1427262 - DNA, 21 bp, Homo sapiens
cgtcctccctgatcccacccc

SEQ ID NO: 1427263 - DNA, 18 bp, Homo sapiens
cgtcctccgtccatatca

SEQ ID NO: 1427264 - DNA, 21 bp, Homo sapiens
cgtcctcctcacctcatgccc

SEQ ID NO: 1427265 - DNA, 23 bp, Homo sapiens
cgtcctcgtggcggggcagcagg

SEQ ID NO: 1427266 - DNA, 12 bp, Homo sapiens
cgtcctgcagag

SEQ ID NO: 1427267 - DNA, 14 bp, Homo sapiens
cgtcctgcagagga

SEQ ID NO: 1427268 - DNA, 15 bp, Homo sapiens
cgtcctgcagaggac

SEQ ID NO: 1427269 - DNA, 19 bp, Homo sapiens
cgtcctgcagaggaccaca

SEQ ID NO: 1427270 - DNA, 13 bp, Homo sapiens
cgtcctgcctgtg

SEQ ID NO: 1427271 - DNA, 14 bp, Homo sapiens
cgtcctgcctgtgg

SEQ ID NO: 1427272 - DNA, 12 bp, Homo sapiens
cgtcctgtccca

SEQ ID NO: 1427273 - DNA, 13 bp, Homo sapiens
cgtcctgtcccag

SEQ ID NO: 1427274 - DNA, 16 bp, Homo sapiens
cgtcctgtcccagagg

SEQ ID NO: 1427275 - DNA, 18 bp, Homo sapiens
cgtcctttcacacatctg

SEQ ID NO: 1427276 - DNA, 16 bp, Homo sapiens
cgtcgcgctggacagc

SEQ ID NO: 1427277 - DNA, 14 bp, Homo sapiens
cgtcggagctgcct

SEQ ID NO: 1427278 - DNA, 19 bp, Homo sapiens
cgtcggagctgcctgcagc

SEQ ID NO: 1427279 - DNA, 22 bp, Homo sapiens
cgtcggagctgcctgcagcaca

SEQ ID NO: 1427280 - DNA, 19 bp, Homo sapiens
cgtcggccgaccaggctgg

SEQ ID NO: 1427281 - DNA, 16 bp, Homo sapiens
cgtctcagaatctaaa

SEQ ID NO: 1427282 - DNA, 19 bp, Homo sapiens
cgtctccaggggctgcttc

SEQ ID NO: 1427283 - DNA, 18 bp, Homo sapiens
cgtctccctggtgcctct

SEQ ID NO: 1427284 - DNA, 20 bp, Homo sapiens
cgtctcccttggcccagaga

SEQ ID NO: 1427285 - DNA, 13 bp, Homo sapiens
cgtctctcttgct

SEQ ID NO: 1427286 - DNA, 14 bp, Homo sapiens
cgtctctcttgctt

SEQ ID NO: 1427287 - DNA, 18 bp, Homo sapiens
cgtctgaagcttgactcc

SEQ ID NO: 1427288 - DNA, 14 bp, Homo sapiens
cgtctgactccaga

SEQ ID NO: 1427289 - DNA, 13 bp, Homo sapiens
cgtctgccaggcc

SEQ ID NO: 1427290 - DNA, 15 bp, Homo sapiens
cgtctgccaggccca

SEQ ID NO: 1427291 - DNA, 19 bp, Homo sapiens
cgtctgctcataggacctg

SEQ ID NO: 1427292 - DNA, 17 bp, Homo sapiens
cgtctggcccaccaggg

SEQ ID NO: 1427293 - DNA, 14 bp, Homo sapiens
cgtctggggtgtgg

SEQ ID NO: 1427294 - DNA, 11 bp, Homo sapiens
cgtctgtccca

SEQ ID NO: 1427295 - DNA, 21 bp, Homo sapiens
cgtctgtctcgatgcctgatt

SEQ ID NO: 1427296 - DNA, 22 bp, Homo sapiens
cgtctgttgtggaaagtagctg

SEQ ID NO: 1427297 - DNA, 23 bp, Homo sapiens
cgtcttagaagtggaccaggaca

SEQ ID NO: 1427298 - DNA, 14 bp, Homo sapiens
cgtcttcacactgc

SEQ ID NO: 1427299 - DNA, 13 bp, Homo sapiens
cgtcttcagccta

SEQ ID NO: 1427300 - DNA, 14 bp, Homo sapiens
cgtcttcagcctag

SEQ ID NO: 1427301 - DNA, 13 bp, Homo sapiens
cgtcttccttctt

SEQ ID NO: 1427302 - DNA, 17 bp, Homo sapiens
cgtcttctccctattcc

SEQ ID NO: 1427303 - DNA, 21 bp, Homo sapiens
cgtcttgacgggagcattggc

SEQ ID NO: 1427304 - DNA, 17 bp, Homo sapiens
cgtcttgcccagcagct

SEQ ID NO: 1427305 - DNA, 16 bp, Homo sapiens
cgtcttggtgtaattt

SEQ ID NO: 1427306 - DNA, 18 bp, Homo sapiens
cgtcttttcctgtttcct

SEQ ID NO: 1427307 - DNA, 19 bp, Homo sapiens
cgtgaaagaattatttttg

SEQ ID NO: 1427308 - DNA, 16 bp, Homo sapiens
cgtgaaagcagatgag

SEQ ID NO: 1427309 - DNA, 12 bp, Homo sapiens
cgtgaaatactt

SEQ ID NO: 1427310 - DNA, 14 bp, Homo sapiens
cgtgaagaagcctg

SEQ ID NO: 1427311 - DNA, 16 bp, Homo sapiens
cgtgaagcagtgcctc

SEQ ID NO: 1427312 - DNA, 20 bp, Homo sapiens
cgtgaagcagtgcctcgagg

SEQ ID NO: 1427313 - DNA, 16 bp, Homo sapiens
cgtgacagtgcctggg

SEQ ID NO: 1427314 - DNA, 13 bp, Homo sapiens
cgtgacctattca

SEQ ID NO: 1427315 - DNA, 18 bp, Homo sapiens
cgtgacggacatccaggc

SEQ ID NO: 1427316 - DNA, 15 bp, Homo sapiens
cgtgactcacccaag

SEQ ID NO: 1427317 - DNA, 18 bp, Homo sapiens
cgtgactcacccaagcat

SEQ ID NO: 1427318 - DNA, 13 bp, Homo sapiens
cgtgactgcccca

SEQ ID NO: 1427319 - DNA, 16 bp, Homo sapiens
cgtgactgccccaact

SEQ ID NO: 1427320 - DNA, 23 bp, Homo sapiens
cgtgactgccccaactcctggaa

SEQ ID NO: 1427321 - DNA, 15 bp, Homo sapiens
cgtgagcgccccgcc

SEQ ID NO: 1427322 - DNA, 16 bp, Homo sapiens
cgtgagcgccccgccc

SEQ ID NO: 1427323 - DNA, 18 bp, Homo sapiens
cgtgagctggggactcag

SEQ ID NO: 1427324 - DNA, 15 bp, Homo sapiens
cgtgaggctgctgcc

SEQ ID NO: 1427325 - DNA, 12 bp, Homo sapiens
cgtgaggggcaa

SEQ ID NO: 1427326 - DNA, 22 bp, Homo sapiens
cgtgaggggcaagctaggcccc

SEQ ID NO: 1427327 - DNA, 20 bp, Homo sapiens
cgtgagtgacatagcctcat

SEQ ID NO: 1427328 - DNA, 22 bp, Homo sapiens
cgtgatccatccatctccaggg

SEQ ID NO: 1427329 - DNA, 21 bp, Homo sapiens
cgtgatccgcctgcctctgcc

SEQ ID NO: 1427330 - DNA, 15 bp, Homo sapiens
cgtgatctcccctca

SEQ ID NO: 1427331 - DNA, 14 bp, Homo sapiens
cgtgatcttggctc

SEQ ID NO: 1427332 - DNA, 23 bp, Homo sapiens
cgtgatgtagggtaaggtgcctt

SEQ ID NO: 1427333 - DNA, 13 bp, Homo sapiens
cgtgatgtgccac

SEQ ID NO: 1427334 - DNA, 13 bp, Homo sapiens
cgtgatgtggagg

SEQ ID NO: 1427335 - DNA, 16 bp, Homo sapiens
cgtgatgtggaggaag

SEQ ID NO: 1427336 - DNA, 17 bp, Homo sapiens
cgtgcaaagccaaggca

SEQ ID NO: 1427337 - DNA, 12 bp, Homo sapiens
cgtgcacagggt

SEQ ID NO: 1427338 - DNA, 17 bp, Homo sapiens
cgtgcacggttcaatgg

SEQ ID NO: 1427339 - DNA, 17 bp, Homo sapiens
cgtgcacgtggagagct

SEQ ID NO: 1427340 - DNA, 20 bp, Homo sapiens
cgtgcactgtgaatcctggc

SEQ ID NO: 1427341 - DNA, 13 bp, Homo sapiens
cgtgcacttccca

SEQ ID NO: 1427342 - DNA, 19 bp, Homo sapiens
cgtgcagcgcccctctgca

SEQ ID NO: 1427343 - DNA, 14 bp, Homo sapiens
cgaccacttccagg

SEQ ID NO: 1427344 - DNA, 15 bp, Homo sapiens
cgaccagagccccac

SEQ ID NO: 1427345 - DNA, 16 bp, Homo sapiens
cgaccagaggagcctt

SEQ ID NO: 1427346 - DNA, 23 bp, Homo sapiens
cgaccaggctggacaccctctgc

SEQ ID NO: 1427347 - DNA, 14 bp, Homo sapiens
cgaccctcatggcc

SEQ ID NO: 1427348 - DNA, 15 bp, Homo sapiens
cgaccctcatggccc

SEQ ID NO: 1427349 - DNA, 13 bp, Homo sapiens
cgaccctgccctg

SEQ ID NO: 1427350 - DNA, 16 bp, Homo sapiens
cgaccctgccctgggc

SEQ ID NO: 1427351 - DNA, 19 bp, Homo sapiens
cgaccctgggggcacagga

SEQ ID NO: 1427352 - DNA, 18 bp, Homo sapiens
cgacctcaagtgtcctga

SEQ ID NO: 1427353 - DNA, 22 bp, Homo sapiens
cgacctcgtcctccccctgcca

SEQ ID NO: 1427354 - DNA, 11 bp, Homo sapiens
cgaccttggcc

SEQ ID NO: 1427355 - DNA, 12 bp, Homo sapiens
cgacctttacct

SEQ ID NO: 1427356 - DNA, 11 bp, Homo sapiens
cgactcaggat

SEQ ID NO: 1427357 - DNA, 18 bp, Homo sapiens
cgactctatagactctag

SEQ ID NO: 1427358 - DNA, 15 bp, Homo sapiens
cgactggccagggcc

SEQ ID NO: 1427359 - DNA, 12 bp, Homo sapiens
cgactggtccag

SEQ ID NO: 1427360 - DNA, 15 bp, Homo sapiens
cgacttcctgactct

SEQ ID NO: 1427361 - DNA, 17 bp, Homo sapiens
cgagaaagaggcaccag

SEQ ID NO: 1427362 - DNA, 13 bp, Homo sapiens
cgagaagtgctct

SEQ ID NO: 1427363 - DNA, 15 bp, Homo sapiens
cgagacacattgcct

SEQ ID NO: 1427364 - DNA, 17 bp, Homo sapiens
cgagacacattgccttc

SEQ ID NO: 1427365 - DNA, 17 bp, Homo sapiens
cgagaccaacctgacca

SEQ ID NO: 1427366 - DNA, 14 bp, Homo sapiens
cgagaccagcctgg

SEQ ID NO: 1427367 - DNA, 13 bp, Homo sapiens
cgagaccatcctg

SEQ ID NO: 1427368 - DNA, 21 bp, Homo sapiens
cgagaccatcctggcccctcc

SEQ ID NO: 1427369 - DNA, 11 bp, Homo sapiens
cgagaccccag

SEQ ID NO: 1427370 - DNA, 18 bp, Homo sapiens
cgagacccccatccagcc

SEQ ID NO: 1427371 - DNA, 20 bp, Homo sapiens
cgagacccccatccagcctc

SEQ ID NO: 1427372 - DNA, 21 bp, Homo sapiens
cgagacccccatccagcctcc

SEQ ID NO: 1427373 - DNA, 21 bp, Homo sapiens
cgagacgcacacagctgagca

SEQ ID NO: 1427374 - DNA, 11 bp, Homo sapiens
cgagactccat

SEQ ID NO: 1427375 - DNA, 15 bp, Homo sapiens
cgagactccatctct

SEQ ID NO: 1427376 - DNA, 14 bp, Homo sapiens
cgagagcagtgggc

SEQ ID NO: 1427377 - DNA, 21 bp, Homo sapiens
cgagagcctgctcccccaccc

SEQ ID NO: 1427378 - DNA, 14 bp, Homo sapiens
cgagaggtgggcca

SEQ ID NO: 1427379 - DNA, 19 bp, Homo sapiens
cgagaggtgggccagtctg

SEQ ID NO: 1427380 - DNA, 19 bp, Homo sapiens
cgagagtagccgagagcct

SEQ ID NO: 1427381 - DNA, 14 bp, Homo sapiens
cgagagtgtgctct

SEQ ID NO: 1427382 - DNA, 21 bp, Homo sapiens
cgagatagggggaagacagat

SEQ ID NO: 1427383 - DNA, 15 bp, Homo sapiens
cgagatcccatctct

SEQ ID NO: 1427384 - DNA, 17 bp, Homo sapiens
cgagatccccagggcag

SEQ ID NO: 1427385 - DNA, 17 bp, Homo sapiens
cgagatcgggaagcaga

SEQ ID NO: 1427386 - DNA, 14 bp, Homo sapiens
cgagatctcaggag

SEQ ID NO: 1427387 - DNA, 23 bp, Homo sapiens
cgagatggcagattcccactgcc

SEQ ID NO: 1427388 - DNA, 18 bp, Homo sapiens
cgagatgtgacccaccag

SEQ ID NO: 1427389 - DNA, 21 bp, Homo sapiens
cgagatgtgacccaccagtgc

SEQ ID NO: 1427390 - DNA, 16 bp, Homo sapiens
cgagattgcgccactg

SEQ ID NO: 1427391 - DNA, 23 bp, Homo sapiens
cgagcaaacccagaggtggatgt

SEQ ID NO: 1427392 - DNA, 14 bp, Homo sapiens
cgagcaaagatcaa

SEQ ID NO: 1427393 - DNA, 15 bp, Homo sapiens
cgagcaaagatcaaa

SEQ ID NO: 1427394 - DNA, 20 bp, Homo sapiens
cgagcaaagatcaaaataaa

SEQ ID NO: 1427395 - DNA, 18 bp, Homo sapiens
cgagcacatagagctttt

SEQ ID NO: 1427396 - DNA, 15 bp, Homo sapiens
cgagcagcccagggc

SEQ ID NO: 1427397 - DNA, 20 bp, Homo sapiens
cgagcagcccagggcctaga

SEQ ID NO: 1427398 - DNA, 17 bp, Homo sapiens
cgagcagtcctgcctca

SEQ ID NO: 1427399 - DNA, 14 bp, Homo sapiens
cgagcatcccccaa

SEQ ID NO: 1427400 - DNA, 21 bp, Homo sapiens
cgagcattccagtaacttttt

SEQ ID NO: 1427401 - DNA, 16 bp, Homo sapiens
cgagccacaagctgca

SEQ ID NO: 1427402 - DNA, 18 bp, Homo sapiens
cgagccacaagctgcact

SEQ ID NO: 1427403 - DNA, 19 bp, Homo sapiens
cgagccacaagctgcactg

SEQ ID NO: 1427404 - DNA, 21 bp, Homo sapiens
cgagccacaagctgcactgtg

SEQ ID NO: 1427405 - DNA, 14 bp, Homo sapiens
cgagcccctccttc

SEQ ID NO: 1427406 - DNA, 21 bp, Homo sapiens
cgagcccctccttctcccctg

SEQ ID NO: 1427407 - DNA, 15 bp, Homo sapiens
cgagcccctcggctc

SEQ ID NO: 1427408 - DNA, 22 bp, Homo sapiens
cgagcccctcggctctggaggc

SEQ ID NO: 1427409 - DNA, 13 bp, Homo sapiens
cgagccctggaga

SEQ ID NO: 1427410 - DNA, 21 bp, Homo sapiens
cgagccttctcaccccaggat

SEQ ID NO: 1427411 - DNA, 18 bp, Homo sapiens
cgagctcgtgtatcctgg

SEQ ID NO: 1427412 - DNA, 20 bp, Homo sapiens
cgagctcgtgtatcctgggg

SEQ ID NO: 1427413 - DNA, 21 bp, Homo sapiens
cgaggacactcgcttgccggg

SEQ ID NO: 1427414 - DNA, 22 bp, Homo sapiens
cgaggacactcgcttgccgggc

SEQ ID NO: 1427415 - DNA, 21 bp, Homo sapiens
cgaggacatgcatgacacttc

SEQ ID NO: 1427416 - DNA, 20 bp, Homo sapiens
cgaggactttgattgcacat

SEQ ID NO: 1427417 - DNA, 15 bp, Homo sapiens
cgaggagctgggccc

SEQ ID NO: 1427418 - DNA, 15 bp, Homo sapiens
cgaggaggaggagta

SEQ ID NO: 1427419 - DNA, 13 bp, Homo sapiens
cgaggatttctgg

SEQ ID NO: 1427420 - DNA, 15 bp, Homo sapiens
cgaggcaccggcgct

SEQ ID NO: 1427421 - DNA, 16 bp, Homo sapiens
cgaggcaggggctctg

SEQ ID NO: 1427422 - DNA, 22 bp, Homo sapiens
cgaggcatggggcatgtccttt

SEQ ID NO: 1427423 - DNA, 18 bp, Homo sapiens
cgaggccacattgctggc

SEQ ID NO: 1427424 - DNA, 19 bp, Homo sapiens
cgaggccacattgctggct

SEQ ID NO: 1427425 - DNA, 20 bp, Homo sapiens
cgaggccacattgctggctg

SEQ ID NO: 1427426 - DNA, 11 bp, Homo sapiens
cgaggcccagc

SEQ ID NO: 1427427 - DNA, 13 bp, Homo sapiens
cgaggcccagcgg

SEQ ID NO: 1427428 - DNA, 10 bp, Homo sapiens
cgaggcctga

SEQ ID NO: 1427429 - DNA, 16 bp, Homo sapiens
cgaggcctggccaatg

SEQ ID NO: 1427430 - DNA, 21 bp, Homo sapiens
cgaggctagaggcatttggaa

SEQ ID NO: 1427431 - DNA, 15 bp, Homo sapiens
cgaggctccccgcct

SEQ ID NO: 1427432 - DNA, 18 bp, Homo sapiens
cgaggctccccgcctcca

SEQ ID NO: 1427433 - DNA, 12 bp, Homo sapiens
cgaggctgagaa

SEQ ID NO: 1427434 - DNA, 20 bp, Homo sapiens
cgaggctgagaatcagactg

SEQ ID NO: 1427435 - DNA, 14 bp, Homo sapiens
cgaggctgcagtca

SEQ ID NO: 1427436 - DNA, 15 bp, Homo sapiens
cgaggctgcagtcag

SEQ ID NO: 1427437 - DNA, 16 bp, Homo sapiens
cgaggctgccccaggc

SEQ ID NO: 1427438 - DNA, 17 bp, Homo sapiens
cgagggatggtgcccct

SEQ ID NO: 1427439 - DNA, 16 bp, Homo sapiens
cgagggcaacagggag

SEQ ID NO: 1427440 - DNA, 17 bp, Homo sapiens
cgagggcaacagggagc

SEQ ID NO: 1427441 - DNA, 18 bp, Homo sapiens
cgagggccgcccgctccc

SEQ ID NO: 1427442 - DNA, 22 bp, Homo sapiens
cgaggggcctttgttctggggg

SEQ ID NO: 1427443 - DNA, 19 bp, Homo sapiens
cgaggggtgtcttgggcag

SEQ ID NO: 1427444 - DNA, 14 bp, Homo sapiens
cgagggtcctggct

SEQ ID NO: 1427445 - DNA, 16 bp, Homo sapiens
cgaggtcaacagagaa

SEQ ID NO: 1427446 - DNA, 13 bp, Homo sapiens
cgaggtcaggaga

SEQ ID NO: 1427447 - DNA, 14 bp, Homo sapiens
cgaggtccagaccc

SEQ ID NO: 1427448 - DNA, 19 bp, Homo sapiens
cgagtagagaggcccgccc

SEQ ID NO: 1427449 - DNA, 14 bp, Homo sapiens
cgagtcactgcctc

SEQ ID NO: 1427450 - DNA, 12 bp, Homo sapiens
cgagtggctgcc

SEQ ID NO: 1427451 - DNA, 22 bp, Homo sapiens
cgagttgtggaaagcctctgct

SEQ ID NO: 1427452 - DNA, 18 bp, Homo sapiens
cgagtttgcaatgtcaca

SEQ ID NO: 1427453 - DNA, 19 bp, Homo sapiens
cgatactgcgactttctgc

SEQ ID NO: 1427454 - DNA, 12 bp, Homo sapiens
cgatagagtctc

SEQ ID NO: 1427455 - DNA, 16 bp, Homo sapiens
cgatagtttactgaga

SEQ ID NO: 1427456 - DNA, 16 bp, Homo sapiens
cgatcaaaaccttcct

SEQ ID NO: 1427457 - DNA, 21 bp, Homo sapiens
cgatcaaaaccttccttccct

SEQ ID NO: 1427458 - DNA, 13 bp, Homo sapiens
cgatcaacattta

SEQ ID NO: 1427459 - DNA, 19 bp, Homo sapiens
cgatcaacatttatgacct

SEQ ID NO: 1427460 - DNA, 23 bp, Homo sapiens
cgatcaagttgttgactgtgatt

SEQ ID NO: 1427461 - DNA, 19 bp, Homo sapiens
cgatcatatttccccttgg

SEQ ID NO: 1427462 - DNA, 21 bp, Homo sapiens
cgatcatatttccccttggac

SEQ ID NO: 1427463 - DNA, 14 bp, Homo sapiens
cgatcccacacagg

SEQ ID NO: 1427464 - DNA, 12 bp, Homo sapiens
cgatcccctccc

SEQ ID NO: 1427465 - DNA, 14 bp, Homo sapiens
cgatcccctccccc

SEQ ID NO: 1427466 - DNA, 13 bp, Homo sapiens
cgatctcctgacc

SEQ ID NO: 1427467 - DNA, 15 bp, Homo sapiens
cgatctctcctggcc

SEQ ID NO: 1427468 - DNA, 16 bp, Homo sapiens
cgatctctcctggcct

SEQ ID NO: 1427469 - DNA, 22 bp, Homo sapiens
cgatcttccagaagctgtactt

SEQ ID NO: 1427470 - DNA, 20 bp, Homo sapiens
cgatcttggttcactgcaac

SEQ ID NO: 1427471 - DNA, 21 bp, Homo sapiens
cgatgaatttggagactctgt

SEQ ID NO: 1427472 - DNA, 13 bp, Homo sapiens
cgatgacagtgct

SEQ ID NO: 1427473 - DNA, 21 bp, Homo sapiens
cgatgatgcttgtaacaagaa

SEQ ID NO: 1427474 - DNA, 22 bp, Homo sapiens
cgatgatgcttgtaacaagaaa

SEQ ID NO: 1427475 - DNA, 16 bp, Homo sapiens
cgatgcatttaataaa

SEQ ID NO: 1427476 - DNA, 17 bp, Homo sapiens
cgatgcatttaataaag

SEQ ID NO: 1427477 - DNA, 19 bp, Homo sapiens
cgatgcatttaataaagat

SEQ ID NO: 1427478 - DNA, 24 bp, Homo sapiens
cgatgcatttaataaagatgagtt

SEQ ID NO: 1427479 - DNA, 13 bp, Homo sapiens
cgatgccagcctt

SEQ ID NO: 1427480 - DNA, 13 bp, Homo sapiens
cgatgcctgattc

SEQ ID NO: 1427481 - DNA, 17 bp, Homo sapiens
cgatgctgacctcacct

SEQ ID NO: 1427482 - DNA, 23 bp, Homo sapiens
cgatgctgacctcacctggtcct

SEQ ID NO: 1427483 - DNA, 17 bp, Homo sapiens
cgatgctgaggccaccc

SEQ ID NO: 1427484 - DNA, 22 bp, Homo sapiens
cgatgctgctttcccctgtggg

SEQ ID NO: 1427485 - DNA, 17 bp, Homo sapiens
cgatggactcctgacca

SEQ ID NO: 1427486 - DNA, 18 bp, Homo sapiens
cgatgtgcaatacatttt

SEQ ID NO: 1427487 - DNA, 11 bp, Homo sapiens
cgatgtggccc

SEQ ID NO: 1427488 - DNA, 17 bp, Homo sapiens
cgatgttattagatgtt

SEQ ID NO: 1427489 - DNA, 20 bp, Homo sapiens
cgattctcccgcctcagcct

SEQ ID NO: 1427490 - DNA, 21 bp, Homo sapiens
cgattctcccgcctcagcctc

SEQ ID NO: 1427491 - DNA, 11 bp, Homo sapiens
cgattctggat

SEQ ID NO: 1427492 - DNA, 23 bp, Homo sapiens
cgattgcaggagtccctgccatc

SEQ ID NO: 1427493 - DNA, 15 bp, Homo sapiens
cgattggctttaaac

SEQ ID NO: 1427494 - DNA, 21 bp, Homo sapiens
cgatttccctggttttagtct

SEQ ID NO: 1427495 - DNA, 12 bp, Homo sapiens
cgatttctgcta

SEQ ID NO: 1427496 - DNA, 12 bp, Homo sapiens
cgatttgaaaca

SEQ ID NO: 1427497 - DNA, 20 bp, Homo sapiens
cgatttgcaggattcccttc

SEQ ID NO: 1427498 - DNA, 18 bp, Homo sapiens
cgattttcaagattctaa

SEQ ID NO: 1427499 - DNA, 13 bp, Homo sapiens
cgattttgtctac

SEQ ID NO: 1427500 - DNA, 18 bp, Homo sapiens
cgcaaggcctgtgctgca

SEQ ID NO: 1427501 - DNA, 18 bp, Homo sapiens
cgcaagggcatcaggcac

SEQ ID NO: 1427502 - DNA, 21 bp, Homo sapiens
cgcaattgtgggatgtcctct

SEQ ID NO: 1427503 - DNA, 16 bp, Homo sapiens
cgcacacagctgagca

SEQ ID NO: 1427504 - DNA, 17 bp, Homo sapiens
cgcacaccgccagcagc

SEQ ID NO: 1427505 - DNA, 12 bp, Homo sapiens
cgcacagccacc

SEQ ID NO: 1427506 - DNA, 16 bp, Homo sapiens
cgcacagccacccgtg

SEQ ID NO: 1427507 - DNA, 17 bp, Homo sapiens
cgcacagccacccgtgg

SEQ ID NO: 1427508 - DNA, 13 bp, Homo sapiens
cgcacaggtggga

SEQ ID NO: 1427509 - DNA, 20 bp, Homo sapiens
cgcaccaaaactatcctgat

SEQ ID NO: 1427510 - DNA, 22 bp, Homo sapiens
cgcaccactgcactccagcctg

SEQ ID NO: 1427511 - DNA, 12 bp, Homo sapiens
cgcaccactgct

SEQ ID NO: 1427512 - DNA, 15 bp, Homo sapiens
cgcaccactgcttcc

SEQ ID NO: 1427513 - DNA, 16 bp, Homo sapiens
cgcaccaggccgggct

SEQ ID NO: 1427514 - DNA, 16 bp, Homo sapiens
cgcaccatgtgggcac

SEQ ID NO: 1427515 - DNA, 14 bp, Homo sapiens
cgcaccattctgac

SEQ ID NO: 1427516 - DNA, 15 bp, Homo sapiens
cgcaccattctgact

SEQ ID NO: 1427517 - DNA, 17 bp, Homo sapiens
cgcaccccccaagctgt

SEQ ID NO: 1427518 - DNA, 15 bp, Homo sapiens
cgcaccccggcctca

SEQ ID NO: 1427519 - DNA, 13 bp, Homo sapiens
cgcaccctggcct

SEQ ID NO: 1427520 - DNA, 16 bp, Homo sapiens
cgcaccttcctcctcc

SEQ ID NO: 1427521 - DNA, 16 bp, Homo sapiens
cgcacgacgtcagcct

SEQ ID NO: 1427522 - DNA, 17 bp, Homo sapiens
cgcacgacgtcagcctc

SEQ ID NO: 1427523 - DNA, 13 bp, Homo sapiens
cgcacgcctctcc

SEQ ID NO: 1427524 - DNA, 16 bp, Homo sapiens
cgcacgcctctccctg

SEQ ID NO: 1427525 - DNA, 14 bp, Homo sapiens
cgcactctgccccc

SEQ ID NO: 1427526 - DNA, 12 bp, Homo sapiens
cgcactgtggat

SEQ ID NO: 1427527 - DNA, 22 bp, Homo sapiens
cgcacttgcctgttggctgctg

SEQ ID NO: 1427528 - DNA, 17 bp, Homo sapiens
cgcagacaccttggaca

SEQ ID NO: 1427529 - DNA, 16 bp, Homo sapiens
cgcagagccctccagg

SEQ ID NO: 1427530 - DNA, 17 bp, Homo sapiens
cgcagagccctccaggc

SEQ ID NO: 1427531 - DNA, 12 bp, Homo sapiens
cgcagccaaggc

SEQ ID NO: 1427532 - DNA, 12 bp, Homo sapiens
cgcagccaggac

SEQ ID NO: 1427533 - DNA, 14 bp, Homo sapiens
cgcagccaggacac

SEQ ID NO: 1427534 - DNA, 15 bp, Homo sapiens
cgcagcccgcctgcc

SEQ ID NO: 1427535 - DNA, 16 bp, Homo sapiens
cgcagcccgcctgccg

SEQ ID NO: 1427536 - DNA, 17 bp, Homo sapiens
cgcagcccgtgaagcag

SEQ ID NO: 1427537 - DNA, 21 bp, Homo sapiens
cgcagcccgtgaagcagtgcc

SEQ ID NO: 1427538 - DNA, 23 bp, Homo sapiens
cgcagcccgtgaagcagtgcctc

SEQ ID NO: 1427539 - DNA, 23 bp, Homo sapiens
cgcagccctggcagggggcatgc

SEQ ID NO: 1427540 - DNA, 17 bp, Homo sapiens
cgcagccggagggaggc

SEQ ID NO: 1427541 - DNA, 14 bp, Homo sapiens
cgcagcctgaagcc

SEQ ID NO: 1427542 - DNA, 22 bp, Homo sapiens
cgcaggaccagtttgattgagg

SEQ ID NO: 1427543 - DNA, 18 bp, Homo sapiens
cgcaggatccctcctgag

SEQ ID NO: 1427544 - DNA, 19 bp, Homo sapiens
cgcaggatccctcctgagc

SEQ ID NO: 1427545 - DNA, 20 bp, Homo sapiens
cgcaggatccgctgccacca

SEQ ID NO: 1427546 - DNA, 18 bp, Homo sapiens
cgcaggcacagcagctgc

SEQ ID NO: 1427547 - DNA, 19 bp, Homo sapiens
cgcaggcacagcagctgca

SEQ ID NO: 1427548 - DNA, 18 bp, Homo sapiens
cgcaggcccccaggtgcc

SEQ ID NO: 1427549 - DNA, 15 bp, Homo sapiens
cgcaggcgggcgagc

SEQ ID NO: 1427550 - DNA, 16 bp, Homo sapiens
cgcagggccatccact

SEQ ID NO: 1427551 - DNA, 17 bp, Homo sapiens
cgcagggccatccactg

SEQ ID NO: 1427552 - DNA, 22 bp, Homo sapiens
cgcagggccatccactgtgacg

SEQ ID NO: 1427553 - DNA, 14 bp, Homo sapiens
cgcaggggactgtc

SEQ ID NO: 1427554 - DNA, 15 bp, Homo sapiens
cgcaggggactgtct

SEQ ID NO: 1427555 - DNA, 20 bp, Homo sapiens
cgcaggtctcttctgggcgt

SEQ ID NO: 1427556 - DNA, 20 bp, Homo sapiens
cgcaggtgccatgcctgctc

SEQ ID NO: 1427557 - DNA, 13 bp, Homo sapiens
cgcaggtgggctg

SEQ ID NO: 1427558 - DNA, 18 bp, Homo sapiens
cgcaggtgggctggactt

SEQ ID NO: 1427559 - DNA, 19 bp, Homo sapiens
cgcaggttatgtcagcagc

SEQ ID NO: 1427560 - DNA, 12 bp, Homo sapiens
cgcagtccccag

SEQ ID NO: 1427561 - DNA, 15 bp, Homo sapiens
cgcagtccccagccc

SEQ ID NO: 1427562 - DNA, 16 bp, Homo sapiens
cgcagtccccagccct

SEQ ID NO: 1427563 - DNA, 21 bp, Homo sapiens
cgcagtccccagcccttctgc

SEQ ID NO: 1427564 - DNA, 16 bp, Homo sapiens
cgcagtcgcaggatcc

SEQ ID NO: 1427565 - DNA, 15 bp, Homo sapiens
cgcagtctggcctgg

SEQ ID NO: 1427566 - DNA, 15 bp, Homo sapiens
cgcagtgctgggacc

SEQ ID NO: 1427567 - DNA, 17 bp, Homo sapiens
cgcagtgctgggaccag

SEQ ID NO: 1427568 - DNA, 18 bp, Homo sapiens
cgcagtgctgggaccaga

SEQ ID NO: 1427569 - DNA, 22 bp, Homo sapiens
cgcagtgctgggaccagagcca

SEQ ID NO: 1427570 - DNA, 22 bp, Homo sapiens
cgcatacacacatgccctcctg

SEQ ID NO: 1427571 - DNA, 22 bp, Homo sapiens
cgcatagactgaggtataaaga

SEQ ID NO: 1427572 - DNA, 16 bp, Homo sapiens
cgcatccctgcttctg

SEQ ID NO: 1427573 - DNA, 16 bp, Homo sapiens
cgcatcttgcctccag

SEQ ID NO: 1427574 - DNA, 17 bp, Homo sapiens
cgcatcttgcctccagg

SEQ ID NO: 1427575 - DNA, 14 bp, Homo sapiens
cgcattaagcacac

SEQ ID NO: 1427576 - DNA, 24 bp, Homo sapiens
cgcattgccacggaaacatacaga

SEQ ID NO: 1427577 - DNA, 15 bp, Homo sapiens
cgccaaatgttcatc

SEQ ID NO: 1427578 - DNA, 17 bp, Homo sapiens
cgcctcgtgccagcagc

SEQ ID NO: 1427579 - DNA, 15 bp, Homo sapiens
cgcctctcccgtcag

SEQ ID NO: 1427580 - DNA, 21 bp, Homo sapiens
cgcctctcccgtcagggccca

SEQ ID NO: 1427581 - DNA, 17 bp, Homo sapiens
cgcctctccctgcactc

SEQ ID NO: 1427582 - DNA, 21 bp, Homo sapiens
accagtgtagccttgcccgga

SEQ ID NO: 1427583 - DNA, 14 bp, Homo sapiens
accagttaattttt

SEQ ID NO: 1427584 - DNA, 14 bp, Homo sapiens
accagttataaata

SEQ ID NO: 1427585 - DNA, 16 bp, Homo sapiens
accagttataaataca

SEQ ID NO: 1427586 - DNA, 12 bp, Homo sapiens
accagttgcctt

SEQ ID NO: 1427587 - DNA, 18 bp, Homo sapiens
accagttgggagcactgg

SEQ ID NO: 1427588 - DNA, 22 bp, Homo sapiens
accataaattcaactttgtaaa

SEQ ID NO: 1427589 - DNA, 22 bp, Homo sapiens
accataaggtttcgtttctgta

SEQ ID NO: 1427590 - DNA, 22 bp, Homo sapiens
accataatgtactgatttcagt

SEQ ID NO: 1427591 - DNA, 14 bp, Homo sapiens
accatacccagcta

SEQ ID NO: 1427592 - DNA, 15 bp, Homo sapiens
accataccttccttc

SEQ ID NO: 1427593 - DNA, 12 bp, Homo sapiens
accatagaaaaa

SEQ ID NO: 1427594 - DNA, 14 bp, Homo sapiens
accatagaaaaatg

SEQ ID NO: 1427595 - DNA, 15 bp, Homo sapiens
accatagttactgta

SEQ ID NO: 1427596 - DNA, 12 bp, Homo sapiens
accatatgaatt

SEQ ID NO: 1427597 - DNA, 16 bp, Homo sapiens
accatatttactcttt

SEQ ID NO: 1427598 - DNA, 12 bp, Homo sapiens
accatcaataaa

SEQ ID NO: 1427599 - DNA, 14 bp, Homo sapiens
accatcaccaccgc

SEQ ID NO: 1427600 - DNA, 16 bp, Homo sapiens
accatcaccaccgcct

SEQ ID NO: 1427601 - DNA, 18 bp, Homo sapiens
accatcaccaccgcctct

SEQ ID NO: 1427602 - DNA, 20 bp, Homo sapiens
accatcaccaccgcctctgg

SEQ ID NO: 1427603 - DNA, 21 bp, Homo sapiens
accatcaccaccgcctctggc

SEQ ID NO: 1427604 - DNA, 13 bp, Homo sapiens
accatcagcctgt

SEQ ID NO: 1427605 - DNA, 20 bp, Homo sapiens
accatcatgtttcagtgaag

SEQ ID NO: 1427606 - DNA, 15 bp, Homo sapiens
accatcctgagccag

SEQ ID NO: 1427607 - DNA, 13 bp, Homo sapiens
accatcctggccc

SEQ ID NO: 1427608 - DNA, 14 bp, Homo sapiens
accatcctggcccc

SEQ ID NO: 1427609 - DNA, 19 bp, Homo sapiens
accatcctggcccctccag

SEQ ID NO: 1427610 - DNA, 22 bp, Homo sapiens
accatcctggctaacatggtga

SEQ ID NO: 1427611 - DNA, 15 bp, Homo sapiens
accatcgctttattg

SEQ ID NO: 1427612 - DNA, 12 bp, Homo sapiens
accatctgctgc

SEQ ID NO: 1427613 - DNA, 20 bp, Homo sapiens
accatctgtcttgccagcca

SEQ ID NO: 1427614 - DNA, 23 bp, Homo sapiens
accatctgtcttgccagccagaa

SEQ ID NO: 1427615 - DNA, 12 bp, Homo sapiens
accatctgtgac

SEQ ID NO: 1427616 - DNA, 14 bp, Homo sapiens
accatctgtgacta

SEQ ID NO: 1427617 - DNA, 15 bp, Homo sapiens
accatctgtgactat

SEQ ID NO: 1427618 - DNA, 14 bp, Homo sapiens
accatgaaacaaag

SEQ ID NO: 1427619 - DNA, 14 bp, Homo sapiens
accatgaacttgat

SEQ ID NO: 1427620 - DNA, 18 bp, Homo sapiens
accatgaagtaaattatg

SEQ ID NO: 1427621 - DNA, 20 bp, Homo sapiens
accatgagaagagggcctgt

SEQ ID NO: 1427622 - DNA, 23 bp, Homo sapiens
accatgagaataagagaaagaaa

SEQ ID NO: 1427623 - DNA, 23 bp, Homo sapiens
accatgccagacccactgaaatg

SEQ ID NO: 1427624 - DNA, 20 bp, Homo sapiens
accatgcccgactaattttt

SEQ ID NO: 1427625 - DNA, 17 bp, Homo sapiens
accatgcctcactaatt

SEQ ID NO: 1427626 - DNA, 19 bp, Homo sapiens
accatgctcatctgctggt

SEQ ID NO: 1427627 - DNA, 16 bp, Homo sapiens
accatggagacaagaa

SEQ ID NO: 1427628 - DNA, 15 bp, Homo sapiens
accatggccagccaa

SEQ ID NO: 1427629 - DNA, 20 bp, Homo sapiens
accatggccagctaattttt

SEQ ID NO: 1427630 - DNA, 19 bp, Homo sapiens
accatggttaagagtccaa

SEQ ID NO: 1427631 - DNA, 12 bp, Homo sapiens
accatgtcattt

SEQ ID NO: 1427632 - DNA, 19 bp, Homo sapiens
accatgtctctaagccaac

SEQ ID NO: 1427633 - DNA, 18 bp, Homo sapiens
accatgtgagctcttcct

SEQ ID NO: 1427634 - DNA, 14 bp, Homo sapiens
accatgttgcgttc

SEQ ID NO: 1427635 - DNA, 23 bp, Homo sapiens
accatgttggccaggcttgtctc

SEQ ID NO: 1427636 - DNA, 20 bp, Homo sapiens
accatgtttgagctcagacc

SEQ ID NO: 1427637 - DNA, 21 bp, Homo sapiens
accatgtttgagctcagaccc

SEQ ID NO: 1427638 - DNA, 16 bp, Homo sapiens
accattaaaactgctt

SEQ ID NO: 1427639 - DNA, 19 bp, Homo sapiens
accattaaaactgcttttt

SEQ ID NO: 1427640 - DNA, 15 bp, Homo sapiens
accattaaagtcaga

SEQ ID NO: 1427641 - DNA, 19 bp, Homo sapiens
accattacaactagatcaa

SEQ ID NO: 1427642 - DNA, 14 bp, Homo sapiens
accattaccaaaat

SEQ ID NO: 1427643 - DNA, 14 bp, Homo sapiens
accattcaaatgac

SEQ ID NO: 1427644 - DNA, 17 bp, Homo sapiens
accattcacaataaaag

SEQ ID NO: 1427645 - DNA, 20 bp, Homo sapiens
accattcacaataaaagctt

SEQ ID NO: 1427646 - DNA, 13 bp, Homo sapiens
accattcacattt

SEQ ID NO: 1427647 - DNA, 14 bp, Homo sapiens
accattcacatttg

SEQ ID NO: 1427648 - DNA, 19 bp, Homo sapiens
accattcacatttgatgta

SEQ ID NO: 1427649 - DNA, 22 bp, Homo sapiens
accattcactactcatgcgtga

SEQ ID NO: 1427650 - DNA, 12 bp, Homo sapiens
accattccccat

SEQ ID NO: 1427651 - DNA, 13 bp, Homo sapiens
accattcctgcct

SEQ ID NO: 1427652 - DNA, 21 bp, Homo sapiens
accattcctgcctttaagcca

SEQ ID NO: 1427653 - DNA, 21 bp, Homo sapiens
accattcgaagtcagctaatt

SEQ ID NO: 1427654 - DNA, 23 bp, Homo sapiens
accattctaggtgtttcaacaga

SEQ ID NO: 1427655 - DNA, 19 bp, Homo sapiens
accattgaaggaaagctat

SEQ ID NO: 1427656 - DNA, 13 bp, Homo sapiens
accattgaaggct

SEQ ID NO: 1427657 - DNA, 13 bp, Homo sapiens
accattgacctca

SEQ ID NO: 1427658 - DNA, 15 bp, Homo sapiens
accattgacctcagc

SEQ ID NO: 1427659 - DNA, 16 bp, Homo sapiens
accattgacctcagct

SEQ ID NO: 1427660 - DNA, 17 bp, Homo sapiens
accattgagtccctgct

SEQ ID NO: 1427661 - DNA, 18 bp, Homo sapiens
accattgatttaatgtaa

SEQ ID NO: 1427662 - DNA, 18 bp, Homo sapiens
accattgcaacaaaatac

SEQ ID NO: 1427663 - DNA, 15 bp, Homo sapiens
accatttgtaataaa

SEQ ID NO: 1427664 - DNA, 19 bp, Homo sapiens
accatttgtaataaagtat

SEQ ID NO: 1427665 - DNA, 15 bp, Homo sapiens
accattttaaagtta

SEQ ID NO: 1427666 - DNA, 16 bp, Homo sapiens
accatttttgctgaat

SEQ ID NO: 1427667 - DNA, 17 bp, Homo sapiens
accatttttgctgaatt

SEQ ID NO: 1427668 - DNA, 17 bp, Homo sapiens
accattttttaatttac

SEQ ID NO: 1427669 - DNA, 19 bp, Homo sapiens
acccaaacacttctgcttt

SEQ ID NO: 1427670 - DNA, 20 bp, Homo sapiens
acccaaacacttctgctttc

SEQ ID NO: 1427671 - DNA, 17 bp, Homo sapiens
acccaaagcatggacta

SEQ ID NO: 1427672 - DNA, 20 bp, Homo sapiens
acccaaagcggtccctgtcc

SEQ ID NO: 1427673 - DNA, 22 bp, Homo sapiens
acccaaagcggtccctgtccct

SEQ ID NO: 1427674 - DNA, 18 bp, Homo sapiens
acccaaagctgagcctgc

SEQ ID NO: 1427675 - DNA, 22 bp, Homo sapiens
acccaacaggtgctgaactgtg

SEQ ID NO: 1427676 - DNA, 18 bp, Homo sapiens
acccaaccctatctcctg

SEQ ID NO: 1427677 - DNA, 15 bp, Homo sapiens
acccaaccctgccct

SEQ ID NO: 1427678 - DNA, 22 bp, Homo sapiens
acccaactgatcctgctccagc

SEQ ID NO: 1427679 - DNA, 18 bp, Homo sapiens
acccaactgggggcaaag

SEQ ID NO: 1427680 - DNA, 16 bp, Homo sapiens
acccaagcctgctggc

SEQ ID NO: 1427681 - DNA, 20 bp, Homo sapiens
acccaagcctgctggctgcg

SEQ ID NO: 1427682 - DNA, 20 bp, Homo sapiens
acccaagctgtggcagccgt

SEQ ID NO: 1427683 - DNA, 15 bp, Homo sapiens
acccaagcttagaac

SEQ ID NO: 1427684 - DNA, 14 bp, Homo sapiens
acccaagcttggca

SEQ ID NO: 1427685 - DNA, 22 bp, Homo sapiens
acccaagcttggcagccgagct

SEQ ID NO: 1427686 - DNA, 16 bp, Homo sapiens
acccaagtccaagcat

SEQ ID NO: 1427687 - DNA, 14 bp, Homo sapiens
acccaagtcttctc

SEQ ID NO: 1427688 - DNA, 14 bp, Homo sapiens
acccaagtgcctca

SEQ ID NO: 1427689 - DNA, 15 bp, Homo sapiens
acccaatgcctgtga

SEQ ID NO: 1427690 - DNA, 17 bp, Homo sapiens
acccaatgcctgtgaag

SEQ ID NO: 1427691 - DNA, 13 bp, Homo sapiens
acccacacagctg

SEQ ID NO: 1427692 - DNA, 13 bp, Homo sapiens
acccacagctcag

SEQ ID NO: 1427693 - DNA, 18 bp, Homo sapiens
acccattgttgtcaagga

SEQ ID NO: 1427694 - DNA, 22 bp, Homo sapiens
acccattgttgtcaaggaagaa

SEQ ID NO: 1427695 - DNA, 15 bp, Homo sapiens
acccatttacaaata

SEQ ID NO: 1427696 - DNA, 16 bp, Homo sapiens
acccatttttgagcca

SEQ ID NO: 1427697 - DNA, 16 bp, Homo sapiens
accccaaacaccttcc

SEQ ID NO: 1427698 - DNA, 15 bp, Homo sapiens
accccaaacttccag

SEQ ID NO: 1427699 - DNA, 20 bp, Homo sapiens
accccaaagactctggaggt

SEQ ID NO: 1427700 - DNA, 13 bp, Homo sapiens
cgcctctggccgc

SEQ ID NO: 1427701 - DNA, 16 bp, Homo sapiens
cgcctgaaagccacaa

SEQ ID NO: 1427702 - DNA, 17 bp, Homo sapiens
cgcctgatggtgctgct

SEQ ID NO: 1427703 - DNA, 12 bp, Homo sapiens
cgcctgccaccg

SEQ ID NO: 1427704 - DNA, 15 bp, Homo sapiens
cgcctgccaccggag

SEQ ID NO: 1427705 - DNA, 20 bp, Homo sapiens
cgcctgccgtgcatggctcc

SEQ ID NO: 1427706 - DNA, 13 bp, Homo sapiens
cgcctgcctcctg

SEQ ID NO: 1427707 - DNA, 16 bp, Homo sapiens
cgcctgcctcctggct

SEQ ID NO: 1427708 - DNA, 16 bp, Homo sapiens
cgcctgcctctgcctc

SEQ ID NO: 1427709 - DNA, 18 bp, Homo sapiens
cgcctgcctgccaccctg

SEQ ID NO: 1427710 - DNA, 16 bp, Homo sapiens
cgcctgctcctcactg

SEQ ID NO: 1427711 - DNA, 19 bp, Homo sapiens
cgcctgctcctcactggag

SEQ ID NO: 1427712 - DNA, 13 bp, Homo sapiens
cgcctggccagga

SEQ ID NO: 1427713 - DNA, 15 bp, Homo sapiens
cgcctggccaggagc

SEQ ID NO: 1427714 - DNA, 16 bp, Homo sapiens
cgcctggccggctcca

SEQ ID NO: 1427715 - DNA, 16 bp, Homo sapiens
cgcctgtaatcccagc

SEQ ID NO: 1427716 - DNA, 16 bp, Homo sapiens
cgcctgtgatgctggg

SEQ ID NO: 1427717 - DNA, 18 bp, Homo sapiens
cgccttccaaaacctgct

SEQ ID NO: 1427718 - DNA, 20 bp, Homo sapiens
cgccttccaaaacctgcttc

SEQ ID NO: 1427719 - DNA, 23 bp, Homo sapiens
cgccttccaaaacctgcttcctt

SEQ ID NO: 1427720 - DNA, 15 bp, Homo sapiens
cgccttcctcctcca

SEQ ID NO: 1427721 - DNA, 16 bp, Homo sapiens
cgccttcctcctccac

SEQ ID NO: 1427722 - DNA, 18 bp, Homo sapiens
cgccttcctcctccacag

SEQ ID NO: 1427723 - DNA, 17 bp, Homo sapiens
cgccttggccttgcagc

SEQ ID NO: 1427724 - DNA, 19 bp, Homo sapiens
cgcctttgtcttgtacttc

SEQ ID NO: 1427725 - DNA, 14 bp, Homo sapiens
cgcgaactgggttc

SEQ ID NO: 1427726 - DNA, 19 bp, Homo sapiens
cgcgccaaataatgtctct

SEQ ID NO: 1427727 - DNA, 18 bp, Homo sapiens
cgcgccctcccccatggg

SEQ ID NO: 1427728 - DNA, 14 bp, Homo sapiens
cgcgccgatgccac

SEQ ID NO: 1427729 - DNA, 14 bp, Homo sapiens
cgcgctcgcccagc

SEQ ID NO: 1427730 - DNA, 17 bp, Homo sapiens
cgcgctcgcccagcagg

SEQ ID NO: 1427731 - DNA, 23 bp, Homo sapiens
cgcggaggaggagggaggccagg

SEQ ID NO: 1427732 - DNA, 14 bp, Homo sapiens
cgcggccaggcacc

SEQ ID NO: 1427733 - DNA, 23 bp, Homo sapiens
cgcgggagccatgcgccccctcc

SEQ ID NO: 1427734 - DNA, 15 bp, Homo sapiens
cgcgggaggcaccag

SEQ ID NO: 1427735 - DNA, 16 bp, Homo sapiens
cgcgggaggcaccagc

SEQ ID NO: 1427736 - DNA, 17 bp, Homo sapiens
cgcgggcagccacccaa

SEQ ID NO: 1427737 - DNA, 19 bp, Homo sapiens
cgcgggcagcgggccaggc

SEQ ID NO: 1427738 - DNA, 20 bp, Homo sapiens
cgcgggcagcgggccaggcc

SEQ ID NO: 1427739 - DNA, 18 bp, Homo sapiens
cgcggtgctctggcggct

SEQ ID NO: 1427740 - DNA, 12 bp, Homo sapiens
cgcgtcttcctg

SEQ ID NO: 1427741 - DNA, 13 bp, Homo sapiens
cgcgtcttcctga

SEQ ID NO: 1427742 - DNA, 16 bp, Homo sapiens
cgcgtcttcctgagtg

SEQ ID NO: 1427743 - DNA, 14 bp, Homo sapiens
cgcgtgacggacat

SEQ ID NO: 1427744 - DNA, 18 bp, Homo sapiens
cgcgtgtgggtctctggg

SEQ ID NO: 1427745 - DNA, 20 bp, Homo sapiens
cgctaagctggctctgtttg

SEQ ID NO: 1427746 - DNA, 21 bp, Homo sapiens
cgctaatcccgattcaccctg

SEQ ID NO: 1427747 - DNA, 17 bp, Homo sapiens
cgctacctctctgtccc

SEQ ID NO: 1427748 - DNA, 16 bp, Homo sapiens
cgctactataaagaga

SEQ ID NO: 1427749 - DNA, 17 bp, Homo sapiens
cgctactataaagagaa

SEQ ID NO: 1427750 - DNA, 13 bp, Homo sapiens
cgctagaggcctg

SEQ ID NO: 1427751 - DNA, 14 bp, Homo sapiens
cgctagaggcctga

SEQ ID NO: 1427752 - DNA, 15 bp, Homo sapiens
cgctagaggcctgag

SEQ ID NO: 1427753 - DNA, 17 bp, Homo sapiens
cgctagaggcctgagga

SEQ ID NO: 1427754 - DNA, 17 bp, Homo sapiens
cgctagtgtttaaaagg

SEQ ID NO: 1427755 - DNA, 17 bp, Homo sapiens
cgctatccagttgcagg

SEQ ID NO: 1427756 - DNA, 15 bp, Homo sapiens
cgctattgcactcca

SEQ ID NO: 1427757 - DNA, 15 bp, Homo sapiens
cgctcacctcagagc

SEQ ID NO: 1427758 - DNA, 13 bp, Homo sapiens
cgctcacctgcag

SEQ ID NO: 1427759 - DNA, 15 bp, Homo sapiens
cgctcaggacccagg

SEQ ID NO: 1427760 - DNA, 18 bp, Homo sapiens
cgctcaggacccaggccc

SEQ ID NO: 1427761 - DNA, 20 bp, Homo sapiens
cgctcaggacccaggccctc

SEQ ID NO: 1427762 - DNA, 22 bp, Homo sapiens
cgctcaggacccaggccctcca

SEQ ID NO: 1427763 - DNA, 20 bp, Homo sapiens
cgctcagggccatgctgagg

SEQ ID NO: 1427764 - DNA, 22 bp, Homo sapiens
cgctcagggccatgctgaggcc

SEQ ID NO: 1427765 - DNA, 14 bp, Homo sapiens
cgctcaggggcctg

SEQ ID NO: 1427766 - DNA, 15 bp, Homo sapiens
cgctcaggggcctgg

SEQ ID NO: 1427767 - DNA, 12 bp, Homo sapiens
cgctcagtattt

SEQ ID NO: 1427768 - DNA, 15 bp, Homo sapiens
cgctccagctgcccc

SEQ ID NO: 1427769 - DNA, 20 bp, Homo sapiens
cgctcccaacccccctcctg

SEQ ID NO: 1427770 - DNA, 22 bp, Homo sapiens
cgctcccaacccccctcctgct

SEQ ID NO: 1427771 - DNA, 18 bp, Homo sapiens
cgctcccaccgcccccac

SEQ ID NO: 1427772 - DNA, 16 bp, Homo sapiens
cgctcccacctagtgc

SEQ ID NO: 1427773 - DNA, 22 bp, Homo sapiens
cgctcccacctagtgccccaga

SEQ ID NO: 1427774 - DNA, 23 bp, Homo sapiens
cgctcccacctagtgccccagac

SEQ ID NO: 1427775 - DNA, 12 bp, Homo sapiens
cgctcccactca

SEQ ID NO: 1427776 - DNA, 13 bp, Homo sapiens
cgctcccactcag

SEQ ID NO: 1427777 - DNA, 17 bp, Homo sapiens
cgctccccacctaccca

SEQ ID NO: 1427778 - DNA, 20 bp, Homo sapiens
cgctccccacctacccagct

SEQ ID NO: 1427779 - DNA, 19 bp, Homo sapiens
cgctcccccgcagtcccca

SEQ ID NO: 1427780 - DNA, 23 bp, Homo sapiens
cgctcccctctgccggtccccca

SEQ ID NO: 1427781 - DNA, 14 bp, Homo sapiens
cgctccctggaagc

SEQ ID NO: 1427782 - DNA, 17 bp, Homo sapiens
cgctcccttcctgccac

SEQ ID NO: 1427783 - DNA, 17 bp, Homo sapiens
cgctccgtctctgtcct

SEQ ID NO: 1427784 - DNA, 19 bp, Homo sapiens
cgctccgtgttcctcggtg

SEQ ID NO: 1427785 - DNA, 18 bp, Homo sapiens
cgctcctgccgcagacgg

SEQ ID NO: 1427786 - DNA, 18 bp, Homo sapiens
cgctcctgccgcagagct

SEQ ID NO: 1427787 - DNA, 19 bp, Homo sapiens
cgctcctgccgcagagctg

SEQ ID NO: 1427788 - DNA, 16 bp, Homo sapiens
cgctcctgtctgccag

SEQ ID NO: 1427789 - DNA, 20 bp, Homo sapiens
cgctcgcccagcaggagaga

SEQ ID NO: 1427790 - DNA, 14 bp, Homo sapiens
cgctcgcgggcagc

SEQ ID NO: 1427791 - DNA, 23 bp, Homo sapiens
cgctcgcgggcagcgggccaggc

SEQ ID NO: 1427792 - DNA, 12 bp, Homo sapiens
cgctctccacca

SEQ ID NO: 1427793 - DNA, 12 bp, Homo sapiens
cgctctccctac

SEQ ID NO: 1427794 - DNA, 16 bp, Homo sapiens
cgctctccctaccttg

SEQ ID NO: 1427795 - DNA, 13 bp, Homo sapiens
cgctctccctgtc

SEQ ID NO: 1427796 - DNA, 14 bp, Homo sapiens
cgctctccctgtca

SEQ ID NO: 1427797 - DNA, 14 bp, Homo sapiens
cgctctcgctctct

SEQ ID NO: 1427798 - DNA, 16 bp, Homo sapiens
cgctctcgctctctct

SEQ ID NO: 1427799 - DNA, 22 bp, Homo sapiens
cgctctggttgaagctttgctt

SEQ ID NO: 1427800 - DNA, 21 bp, Homo sapiens
cgctctgtggatgccagggcc

SEQ ID NO: 1427801 - DNA, 21 bp, Homo sapiens
cgctcttagctttctcagggg

SEQ ID NO: 1427802 - DNA, 20 bp, Homo sapiens
cgctgaactgacaatgaagg

SEQ ID NO: 1427803 - DNA, 17 bp, Homo sapiens
cgctgaccctgggcctg

SEQ ID NO: 1427804 - DNA, 20 bp, Homo sapiens
cgctgaccctgggcctggag

SEQ ID NO: 1427805 - DNA, 20 bp, Homo sapiens
cgctgagcatggggcgctcc

SEQ ID NO: 1427806 - DNA, 18 bp, Homo sapiens
cgctgaggggtctcggat

SEQ ID NO: 1427807 - DNA, 20 bp, Homo sapiens
cgctgagtggcaggggacag

SEQ ID NO: 1427808 - DNA, 19 bp, Homo sapiens
acccctggaccaccagccc

SEQ ID NO: 1427809 - DNA, 13 bp, Homo sapiens
acccctggccagc

SEQ ID NO: 1427810 - DNA, 19 bp, Homo sapiens
acccctggccagctctgag

SEQ ID NO: 1427811 - DNA, 15 bp, Homo sapiens
acccctggcttttca

SEQ ID NO: 1427812 - DNA, 22 bp, Homo sapiens
acccctggggctgagtctccag

SEQ ID NO: 1427813 - DNA, 14 bp, Homo sapiens
acccctggttctca

SEQ ID NO: 1427814 - DNA, 16 bp, Homo sapiens
acccctggttctcatc

SEQ ID NO: 1427815 - DNA, 15 bp, Homo sapiens
acccctgtagggaaa

SEQ ID NO: 1427816 - DNA, 21 bp, Homo sapiens
acccctgtagggaaaccttgg

SEQ ID NO: 1427817 - DNA, 21 bp, Homo sapiens
acccctgtcccacccacacag

SEQ ID NO: 1427818 - DNA, 22 bp, Homo sapiens
acccctgtgctcccctgccaca

SEQ ID NO: 1427819 - DNA, 15 bp, Homo sapiens
cgctgccccagcccc

SEQ ID NO: 1427820 - DNA, 16 bp, Homo sapiens
cgctgccctgcatgct

SEQ ID NO: 1427821 - DNA, 12 bp, Homo sapiens
cgctgccctgtg

SEQ ID NO: 1427822 - DNA, 16 bp, Homo sapiens
cgctgccctgtggaca

SEQ ID NO: 1427823 - DNA, 20 bp, Homo sapiens
cgctgcccttgggtcccccc

SEQ ID NO: 1427824 - DNA, 22 bp, Homo sapiens
cgctgcccttgggtccccccga

SEQ ID NO: 1427825 - DNA, 17 bp, Homo sapiens
cgctgcctaagtggctg

SEQ ID NO: 1427826 - DNA, 14 bp, Homo sapiens
cgctgcctccatgg

SEQ ID NO: 1427827 - DNA, 22 bp, Homo sapiens
cgctgcctggaacaccagcagc

SEQ ID NO: 1427828 - DNA, 11 bp, Homo sapiens
cgctgcctggc

SEQ ID NO: 1427829 - DNA, 14 bp, Homo sapiens
cgctgcctggccag

SEQ ID NO: 1427830 - DNA, 17 bp, Homo sapiens
cgctgcctggccaggcc

SEQ ID NO: 1427831 - DNA, 21 bp, Homo sapiens
cgctgcctggccaggccctgg

SEQ ID NO: 1427832 - DNA, 18 bp, Homo sapiens
cgctgcctggtctgtctg

SEQ ID NO: 1427833 - DNA, 21 bp, Homo sapiens
cgctgcctggtctgtctggat

SEQ ID NO: 1427834 - DNA, 14 bp, Homo sapiens
cgctgccttttgtt

SEQ ID NO: 1427835 - DNA, 18 bp, Homo sapiens
cgctgctctagctggcag

SEQ ID NO: 1427836 - DNA, 20 bp, Homo sapiens
cgctgctgcaggacattaat

SEQ ID NO: 1427837 - DNA, 12 bp, Homo sapiens
cgctgctgtgct

SEQ ID NO: 1427838 - DNA, 14 bp, Homo sapiens
cgctgctgtgctct

SEQ ID NO: 1427839 - DNA, 16 bp, Homo sapiens
cgctgcttccaggctg

SEQ ID NO: 1427840 - DNA, 20 bp, Homo sapiens
cgctgctttgcgctggtgga

SEQ ID NO: 1427841 - DNA, 23 bp, Homo sapiens
cgctggactattgtgccaactgc

SEQ ID NO: 1427842 - DNA, 14 bp, Homo sapiens
cgctggcccagccg

SEQ ID NO: 1427843 - DNA, 16 bp, Homo sapiens
cgctggcccagccggc

SEQ ID NO: 1427844 - DNA, 19 bp, Homo sapiens
cgctggctttctctctggc

SEQ ID NO: 1427845 - DNA, 22 bp, Homo sapiens
cgctgggatttcttcgctgctc

SEQ ID NO: 1427846 - DNA, 18 bp, Homo sapiens
cgctgggcttcattccgg

SEQ ID NO: 1427847 - DNA, 21 bp, Homo sapiens
cgctgggcttcattccggact

SEQ ID NO: 1427848 - DNA, 14 bp, Homo sapiens
cgctggtccctgcc

SEQ ID NO: 1427849 - DNA, 16 bp, Homo sapiens
cgctggtggaccacag

SEQ ID NO: 1427850 - DNA, 21 bp, Homo sapiens
cgctggtggaccacaggcatc

SEQ ID NO: 1427851 - DNA, 18 bp, Homo sapiens
cgctggttccgccaggcg

SEQ ID NO: 1427852 - DNA, 12 bp, Homo sapiens
cgctgtctctga

SEQ ID NO: 1427853 - DNA, 13 bp, Homo sapiens
cgctgtgtacaat

SEQ ID NO: 1427854 - DNA, 14 bp, Homo sapiens
cgctgttcacccac

SEQ ID NO: 1427855 - DNA, 21 bp, Homo sapiens
cgctgttgacatcagcctgct

SEQ ID NO: 1427856 - DNA, 20 bp, Homo sapiens
cgcttatcaactaatgattt

SEQ ID NO: 1427857 - DNA, 17 bp, Homo sapiens
cgcttcacccctgcact

SEQ ID NO: 1427858 - DNA, 16 bp, Homo sapiens
cgcttccccacagaac

SEQ ID NO: 1427859 - DNA, 13 bp, Homo sapiens
cgcttcctggcct

SEQ ID NO: 1427860 - DNA, 14 bp, Homo sapiens
cgcttcctggcctc

SEQ ID NO: 1427861 - DNA, 22 bp, Homo sapiens
cgcttcctggcctcccttctcc

SEQ ID NO: 1427862 - DNA, 20 bp, Homo sapiens
cgcttctgtgtatctctttc

SEQ ID NO: 1427863 - DNA, 18 bp, Homo sapiens
cgcttcttgcctctgtgc

SEQ ID NO: 1427864 - DNA, 16 bp, Homo sapiens
cgcttgagcccaggag

SEQ ID NO: 1427865 - DNA, 19 bp, Homo sapiens
cgcttgtagaactcactct

SEQ ID NO: 1427866 - DNA, 21 bp, Homo sapiens
cgcttgtagaactcactctgg

SEQ ID NO: 1427867 - DNA, 20 bp, Homo sapiens
cgcttgtccagcgcctagtg

SEQ ID NO: 1427868 - DNA, 14 bp, Homo sapiens
cgcttgtgacagtg

SEQ ID NO: 1427869 - DNA, 15 bp, Homo sapiens
cgcttgtgacagtgc

SEQ ID NO: 1427870 - DNA, 17 bp, Homo sapiens
cgctttgaaagaagcaa

SEQ ID NO: 1427871 - DNA, 11 bp, Homo sapiens
cggaaaacaat

SEQ ID NO: 1427872 - DNA, 15 bp, Homo sapiens
cggaaacatacagag

SEQ ID NO: 1427873 - DNA, 19 bp, Homo sapiens
cggaaagtgagagccagca

SEQ ID NO: 1427874 - DNA, 11 bp, Homo sapiens
cggaacagctc

SEQ ID NO: 1427875 - DNA, 19 bp, Homo sapiens
cggaacccaagcttagaac

SEQ ID NO: 1427876 - DNA, 17 bp, Homo sapiens
cggaactgtcctttcct

SEQ ID NO: 1427877 - DNA, 14 bp, Homo sapiens
cggaagcagtgcct

SEQ ID NO: 1427878 - DNA, 22 bp, Homo sapiens
cggaagccaaaggcagctaaga

SEQ ID NO: 1427879 - DNA, 18 bp, Homo sapiens
cggaaggctggctgggca

SEQ ID NO: 1427880 - DNA, 17 bp, Homo sapiens
cggaaggtttttaaaca

SEQ ID NO: 1427881 - DNA, 20 bp, Homo sapiens
cggaagtaaattatgatgtc

SEQ ID NO: 1427882 - DNA, 11 bp, Homo sapiens
cggaatgaact

SEQ ID NO: 1427883 - DNA, 13 bp, Homo sapiens
cggacaagtttta

SEQ ID NO: 1427884 - DNA, 23 bp, Homo sapiens
cggacacggcttcactgaccagc

SEQ ID NO: 1427885 - DNA, 23 bp, Homo sapiens
cggacagctgcccagacacatgg

SEQ ID NO: 1427886 - DNA, 20 bp, Homo sapiens
cggacatgcttttctgccac

SEQ ID NO: 1427887 - DNA, 12 bp, Homo sapiens
cggacccacccc

SEQ ID NO: 1427888 - DNA, 13 bp, Homo sapiens
cggacccacccca

SEQ ID NO: 1427889 - DNA, 24 bp, Homo sapiens
cggacccaccccaactctccccag

SEQ ID NO: 1427890 - DNA, 22 bp, Homo sapiens
cggacgcaggtgctgcggcgcg

SEQ ID NO: 1427891 - DNA, 15 bp, Homo sapiens
cggacgctggctccc

SEQ ID NO: 1427892 - DNA, 21 bp, Homo sapiens
cggactctcccaggcctgcct

SEQ ID NO: 1427893 - DNA, 23 bp, Homo sapiens
cggactggcagaagcattgcctg

SEQ ID NO: 1427894 - DNA, 15 bp, Homo sapiens
cggactggtgccctc

SEQ ID NO: 1427895 - DNA, 15 bp, Homo sapiens
cggacttttctgcaa

SEQ ID NO: 1427896 - DNA, 17 bp, Homo sapiens
cggagaaggccgctgcc

SEQ ID NO: 1427897 - DNA, 18 bp, Homo sapiens
cggagaaggccgctgccc

SEQ ID NO: 1427898 - DNA, 12 bp, Homo sapiens
cggagagagcca

SEQ ID NO: 1427899 - DNA, 14 bp, Homo sapiens
cggagagagccaag

SEQ ID NO: 1427900 - DNA, 16 bp, Homo sapiens
cggagagagccaagac

SEQ ID NO: 1427901 - DNA, 16 bp, Homo sapiens
cggagagcagcagcac

SEQ ID NO: 1427902 - DNA, 15 bp, Homo sapiens
cggagcacagccctg

SEQ ID NO: 1427903 - DNA, 16 bp, Homo sapiens
cggagcacagccctgg

SEQ ID NO: 1427904 - DNA, 21 bp, Homo sapiens
cggagcacagccctgggaggg

SEQ ID NO: 1427905 - DNA, 15 bp, Homo sapiens
cggagcccagcctgg

SEQ ID NO: 1427906 - DNA, 13 bp, Homo sapiens
cggagcccctgaa

SEQ ID NO: 1427907 - DNA, 20 bp, Homo sapiens
cggagcctcatccgaggcag

SEQ ID NO: 1427908 - DNA, 22 bp, Homo sapiens
cggagcctcatccgaggcaggg

SEQ ID NO: 1427909 - DNA, 14 bp, Homo sapiens
cggagcctttggaa

SEQ ID NO: 1427910 - DNA, 22 bp, Homo sapiens
cggagcgttctctgtcctactt

SEQ ID NO: 1427911 - DNA, 18 bp, Homo sapiens
cggaggaggggaaggggc

SEQ ID NO: 1427912 - DNA, 19 bp, Homo sapiens
cggaggaggggaaggggct

SEQ ID NO: 1427913 - DNA, 17 bp, Homo sapiens
cggaggatagtatgagc

SEQ ID NO: 1427914 - DNA, 17 bp, Homo sapiens
cggagggatggagaaag

SEQ ID NO: 1427915 - DNA, 14 bp, Homo sapiens
cggaggggagtaga

SEQ ID NO: 1427916 - DNA, 14 bp, Homo sapiens
cggaggggatccag

SEQ ID NO: 1427917 - DNA, 19 bp, Homo sapiens
cggaggggatccagccact

SEQ ID NO: 1427918 - DNA, 15 bp, Homo sapiens
cggaggggcctggca

SEQ ID NO: 1427919 - DNA, 18 bp, Homo sapiens
cggaggggcctggcagcc

SEQ ID NO: 1427920 - DNA, 16 bp, Homo sapiens
cggaggtccagctggg

SEQ ID NO: 1427921 - DNA, 19 bp, Homo sapiens
cggaggtccagctgggcct

SEQ ID NO: 1427922 - DNA, 21 bp, Homo sapiens
cggaggtccagctgggcctcc

SEQ ID NO: 1427923 - DNA, 15 bp, Homo sapiens
cggcggtagcagctg

SEQ ID NO: 1427924 - DNA, 13 bp, Homo sapiens
cggctactcagca

SEQ ID NO: 1427925 - DNA, 16 bp, Homo sapiens
cggctactcagcagcc

SEQ ID NO: 1427926 - DNA, 20 bp, Homo sapiens
cggctactcagcagccctcc

SEQ ID NO: 1427927 - DNA, 12 bp, Homo sapiens
cggctccaactc

SEQ ID NO: 1427928 - DNA, 15 bp, Homo sapiens
cggctccccatgtgt

SEQ ID NO: 1427929 - DNA, 20 bp, Homo sapiens
cggctccccatgtgtcctgg

SEQ ID NO: 1427930 - DNA, 21 bp, Homo sapiens
cggctcgtgtatttattaccg

SEQ ID NO: 1427931 - DNA, 13 bp, Homo sapiens
cggctctcacctg

SEQ ID NO: 1427932 - DNA, 15 bp, Homo sapiens
cggctgaccatgctc

SEQ ID NO: 1427933 - DNA, 15 bp, Homo sapiens
cggctgagagcccca

SEQ ID NO: 1427934 - DNA, 17 bp, Homo sapiens
cggctgagagccccagc

SEQ ID NO: 1427935 - DNA, 16 bp, Homo sapiens
cggctgagccccccat

SEQ ID NO: 1427936 - DNA, 11 bp, Homo sapiens
cggctgagtgg

SEQ ID NO: 1427937 - DNA, 18 bp, Homo sapiens
cggctgagtggcagcagc

SEQ ID NO: 1427938 - DNA, 17 bp, Homo sapiens
cctgtttaaataaaatt

SEQ ID NO: 1427939 - DNA, 19 bp, Homo sapiens
cctgtttcagaccccccca

SEQ ID NO: 1427940 - DNA, 15 bp, Homo sapiens
cctgtttcccaggcc

SEQ ID NO: 1427941 - DNA, 14 bp, Homo sapiens
cctgtttgaaatat

SEQ ID NO: 1427942 - DNA, 15 bp, Homo sapiens
cctgtttgaaatatc

SEQ ID NO: 1427943 - DNA, 11 bp, Homo sapiens
cctgtttgatg

SEQ ID NO: 1427944 - DNA, 16 bp, Homo sapiens
cctgtttgatgtatgt

SEQ ID NO: 1427945 - DNA, 16 bp, Homo sapiens
cctgttttagtttctg

SEQ ID NO: 1427946 - DNA, 15 bp, Homo sapiens
cctgttttctgaaac

SEQ ID NO: 1427947 - DNA, 15 bp, Homo sapiens
cctgttttctgagcc

SEQ ID NO: 1427948 - DNA, 13 bp, Homo sapiens
ccttaaaaatcac

SEQ ID NO: 1427949 - DNA, 17 bp, Homo sapiens
ccttaaaaccaaagagg

SEQ ID NO: 1427950 - DNA, 15 bp, Homo sapiens
ccttaaacacaggct

SEQ ID NO: 1427951 - DNA, 22 bp, Homo sapiens
ccttaaacacaggctgtcctta

SEQ ID NO: 1427952 - DNA, 13 bp, Homo sapiens
ccttaaatttaat

SEQ ID NO: 1427953 - DNA, 16 bp, Homo sapiens
ccttaacagttgtatt

SEQ ID NO: 1427954 - DNA, 15 bp, Homo sapiens
ccttaacccacctct

SEQ ID NO: 1427955 - DNA, 14 bp, Homo sapiens
ccttaaccccaagg

SEQ ID NO: 1427956 - DNA, 16 bp, Homo sapiens
ccttaaccccaaggac

SEQ ID NO: 1427957 - DNA, 19 bp, Homo sapiens
ccttaagaacacaaagcgg

SEQ ID NO: 1427958 - DNA, 13 bp, Homo sapiens
ccttaagcagaac

SEQ ID NO: 1427959 - DNA, 19 bp, Homo sapiens
ccttaagcagaacaaatgt

SEQ ID NO: 1427960 - DNA, 21 bp, Homo sapiens
ccttaagcagaacaaatgtgt

SEQ ID NO: 1427961 - DNA, 22 bp, Homo sapiens
ccttaagccaaactcaggccca

SEQ ID NO: 1427962 - DNA, 22 bp, Homo sapiens
ccttaagggttgaaggcagtct

SEQ ID NO: 1427963 - DNA, 13 bp, Homo sapiens
ccttaatcttgct

SEQ ID NO: 1427964 - DNA, 15 bp, Homo sapiens
ccttaatttcctttt

SEQ ID NO: 1427965 - DNA, 23 bp, Homo sapiens
ccttaatttcctttttgacactg

SEQ ID NO: 1427966 - DNA, 19 bp, Homo sapiens
ccttacaacgccgagtgca

SEQ ID NO: 1427967 - DNA, 20 bp, Homo sapiens
ccttacaacgccgagtgcac

SEQ ID NO: 1427968 - DNA, 22 bp, Homo sapiens
ccttacaacgccgagtgcactg

SEQ ID NO: 1427969 - DNA, 22 bp, Homo sapiens
ccttacaagttagaaaacataa

SEQ ID NO: 1427970 - DNA, 16 bp, Homo sapiens
ccttacctcctgccca

SEQ ID NO: 1427971 - DNA, 18 bp, Homo sapiens
ccttacctttcctgatgc

SEQ ID NO: 1427972 - DNA, 19 bp, Homo sapiens
ccttacgacactttggttt

SEQ ID NO: 1427973 - DNA, 13 bp, Homo sapiens
ccttacgtgagaa

SEQ ID NO: 1427974 - DNA, 17 bp, Homo sapiens
ccttacgtgagaaatag

SEQ ID NO: 1427975 - DNA, 14 bp, Homo sapiens
ccttactaattata

SEQ ID NO: 1427976 - DNA, 18 bp, Homo sapiens
ccttactatgatctcagg

SEQ ID NO: 1427977 - DNA, 17 bp, Homo sapiens
ccttactcctctttcct

SEQ ID NO: 1427978 - DNA, 15 bp, Homo sapiens
ccttactctgagccc

SEQ ID NO: 1427979 - DNA, 21 bp, Homo sapiens
ccttactctgagcccaggccg

SEQ ID NO: 1427980 - DNA, 17 bp, Homo sapiens
ccttactggtttcccca

SEQ ID NO: 1427981 - DNA, 14 bp, Homo sapiens
ccttactgtctcac

SEQ ID NO: 1427982 - DNA, 15 bp, Homo sapiens
ccttagaaaatgtgt

SEQ ID NO: 1427983 - DNA, 21 bp, Homo sapiens
ccttagaaatcattgtagaaa

SEQ ID NO: 1427984 - DNA, 18 bp, Homo sapiens
ccttagaaggtattaaga

SEQ ID NO: 1427985 - DNA, 21 bp, Homo sapiens
ccttagaaggtattaagatta

SEQ ID NO: 1427986 - DNA, 14 bp, Homo sapiens
ccttagacctgagg

SEQ ID NO: 1427987 - DNA, 16 bp, Homo sapiens
ccttagaccttccata

SEQ ID NO: 1427988 - DNA, 20 bp, Homo sapiens
ccttagccctgtctgctagg

SEQ ID NO: 1427989 - DNA, 17 bp, Homo sapiens
ccttagcctctcccacc

SEQ ID NO: 1427990 - DNA, 21 bp, Homo sapiens
ccttagcgttctggactctgc

SEQ ID NO: 1427991 - DNA, 19 bp, Homo sapiens
ccttagctggcattacagc

SEQ ID NO: 1427992 - DNA, 18 bp, Homo sapiens
ccttagcttagacctcag

SEQ ID NO: 1427993 - DNA, 21 bp, Homo sapiens
ccttagcttagacctcagcct

SEQ ID NO: 1427994 - DNA, 23 bp, Homo sapiens
ccttagcttagacctcagcctgt

SEQ ID NO: 1427995 - DNA, 16 bp, Homo sapiens
ccttaggcctctgaga

SEQ ID NO: 1427996 - DNA, 13 bp, Homo sapiens
ccttaggccttcc

SEQ ID NO: 1427997 - DNA, 15 bp, Homo sapiens
ccttaggccttcctc

SEQ ID NO: 1427998 - DNA, 23 bp, Homo sapiens
ccttaggccttcctctctccaga

SEQ ID NO: 1427999 - DNA, 18 bp, Homo sapiens
ccttagggaagctggcct

SEQ ID NO: 1428000 - DNA, 20 bp, Homo sapiens
ccttagggaagctggcctga

SEQ ID NO: 1428001 - DNA, 16 bp, Homo sapiens
ccttagggcactgggc

SEQ ID NO: 1428002 - DNA, 14 bp, Homo sapiens
ccttagtactgagt

SEQ ID NO: 1428003 - DNA, 14 bp, Homo sapiens
ccttagtctcagtt

SEQ ID NO: 1428004 - DNA, 20 bp, Homo sapiens
ccttagtctcagtttgtgtg

SEQ ID NO: 1428005 - DNA, 16 bp, Homo sapiens
ccttagtttcaagagt

SEQ ID NO: 1428006 - DNA, 15 bp, Homo sapiens
ccttatcattcattc

SEQ ID NO: 1428007 - DNA, 13 bp, Homo sapiens
ccttatccctctc

SEQ ID NO: 1428008 - DNA, 17 bp, Homo sapiens
ccttatccctctcttcc

SEQ ID NO: 1428009 - DNA, 22 bp, Homo sapiens
ccttatgcccggcgccgggcac

SEQ ID NO: 1428010 - DNA, 19 bp, Homo sapiens
ccttatggatgatttaagt

SEQ ID NO: 1428011 - DNA, 18 bp, Homo sapiens
ccttattcacctttttaa

SEQ ID NO: 1428012 - DNA, 20 bp, Homo sapiens
ccttattgcctcccaggcaa

SEQ ID NO: 1428013 - DNA, 19 bp, Homo sapiens
ccttatttatttttgtgta

SEQ ID NO: 1428014 - DNA, 14 bp, Homo sapiens
ccttatttgccttc

SEQ ID NO: 1428015 - DNA, 15 bp, Homo sapiens
ccttatttgccttct

SEQ ID NO: 1428016 - DNA, 23 bp, Homo sapiens
ccttatttgtctgtaaaaaatgg

SEQ ID NO: 1428017 - DNA, 14 bp, Homo sapiens
ccttattttgtatt

SEQ ID NO: 1428018 - DNA, 20 bp, Homo sapiens
ccttcaaaactatagcttgc

SEQ ID NO: 1428019 - DNA, 24 bp, Homo sapiens
ccttcaactgaaaagactcagtgt

SEQ ID NO: 1428020 - DNA, 18 bp, Homo sapiens
ccttcaagacgaggggca

SEQ ID NO: 1428021 - DNA, 21 bp, Homo sapiens
ccttcaagacgaggggcaggg

SEQ ID NO: 1428022 - DNA, 21 bp, Homo sapiens
ccttcaaggactgtttcagtg

SEQ ID NO: 1428023 - DNA, 22 bp, Homo sapiens
ccttcaaggactgtttcagtgt

SEQ ID NO: 1428024 - DNA, 14 bp, Homo sapiens
ccttcaattcctgg

SEQ ID NO: 1428025 - DNA, 11 bp, Homo sapiens
ccttcacaaat

SEQ ID NO: 1428026 - DNA, 12 bp, Homo sapiens
ccttcacagtgt

SEQ ID NO: 1428027 - DNA, 14 bp, Homo sapiens
ccttcactcatttt

SEQ ID NO: 1428028 - DNA, 14 bp, Homo sapiens
ccttcactccggtg

SEQ ID NO: 1428029 - DNA, 23 bp, Homo sapiens
ccttcactccggtgtgcctgcag

SEQ ID NO: 1428030 - DNA, 14 bp, Homo sapiens
ccttcactgccatg

SEQ ID NO: 1428031 - DNA, 19 bp, Homo sapiens
ccttcactgccatgatagc

SEQ ID NO: 1428032 - DNA, 14 bp, Homo sapiens
ccttcactggcgcc

SEQ ID NO: 1428033 - DNA, 17 bp, Homo sapiens
ccttcactggcgccttc

SEQ ID NO: 1428034 - DNA, 17 bp, Homo sapiens
ccttcactgttccctct

SEQ ID NO: 1428035 - DNA, 19 bp, Homo sapiens
ccttcagaatgctcctgag

SEQ ID NO: 1428036 - DNA, 16 bp, Homo sapiens
ccttcagactggccct

SEQ ID NO: 1428037 - DNA, 15 bp, Homo sapiens
ccttcagcccaccac

SEQ ID NO: 1428038 - DNA, 19 bp, Homo sapiens
ccttcagcccaccaccctg

SEQ ID NO: 1428039 - DNA, 19 bp, Homo sapiens
ccttcagggccagaaggag

SEQ ID NO: 1428040 - DNA, 11 bp, Homo sapiens
ccttcaggttt

SEQ ID NO: 1428041 - DNA, 12 bp, Homo sapiens
ccttcaggtttt

SEQ ID NO: 1428042 - DNA, 24 bp, Homo sapiens
ccttcagtaccctctcagctccag

SEQ ID NO: 1428043 - DNA, 21 bp, Homo sapiens
ccttcagtgctacattttgtg

SEQ ID NO: 1428044 - DNA, 12 bp, Homo sapiens
ccttcagtttat

SEQ ID NO: 1428045 - DNA, 18 bp, Homo sapiens
ccttcataccgcctcgtg

SEQ ID NO: 1428046 - DNA, 22 bp, Homo sapiens
ccttcataccgcctcgtgccag

SEQ ID NO: 1428047 - DNA, 21 bp, Homo sapiens
ccttcatgtggctcagtgcct

SEQ ID NO: 1428048 - DNA, 21 bp, Homo sapiens
ccttcatgtggttcagtgcct

SEQ ID NO: 1428049 - DNA, 18 bp, Homo sapiens
ccttccaaaacctgcttc

SEQ ID NO: 1428050 - DNA, 13 bp, Homo sapiens
ccttccacccagt

SEQ ID NO: 1428051 - DNA, 20 bp, Homo sapiens
ccttccacctgccaccccct

SEQ ID NO: 1428052 - DNA, 21 bp, Homo sapiens
ccttccacggatccatgtagc

SEQ ID NO: 1428053 - DNA, 14 bp, Homo sapiens
ccttccagacatac

SEQ ID NO: 1428054 - DNA, 13 bp, Homo sapiens
ccttccagatcac

SEQ ID NO: 1428055 - DNA, 23 bp, Homo sapiens
acatgtatgaaattggttttcca

SEQ ID NO: 1428056 - DNA, 20 bp, Homo sapiens
acatgtattaaattacattt

SEQ ID NO: 1428057 - DNA, 15 bp, Homo sapiens
acatgtattatttca

SEQ ID NO: 1428058 - DNA, 20 bp, Homo sapiens
acatgtcctaattcttctgt

SEQ ID NO: 1428059 - DNA, 22 bp, Homo sapiens
acatgtcctaattcttctgtcc

SEQ ID NO: 1428060 - DNA, 18 bp, Homo sapiens
acatgtctgttctacata

SEQ ID NO: 1428061 - DNA, 13 bp, Homo sapiens
acatgtcttccat

SEQ ID NO: 1428062 - DNA, 20 bp, Homo sapiens
acatgtcttccatgtatctt

SEQ ID NO: 1428063 - DNA, 13 bp, Homo sapiens
acatgtcttgtac

SEQ ID NO: 1428064 - DNA, 23 bp, Homo sapiens
acatgtgagcatggtcacaagca

SEQ ID NO: 1428065 - DNA, 23 bp, Homo sapiens
acatgtgatacattttttaagct

SEQ ID NO: 1428066 - DNA, 18 bp, Homo sapiens
acatgtggggacagggct

SEQ ID NO: 1428067 - DNA, 16 bp, Homo sapiens
acatgtgtacatatat

SEQ ID NO: 1428068 - DNA, 17 bp, Homo sapiens
acatgtgtacatatatg

SEQ ID NO: 1428069 - DNA, 19 bp, Homo sapiens
acatgtgtacatatatgta

SEQ ID NO: 1428070 - DNA, 21 bp, Homo sapiens
acatgtgtacatatatgtata

SEQ ID NO: 1428071 - DNA, 20 bp, Homo sapiens
acatgtgtatgatactaaag

SEQ ID NO: 1428072 - DNA, 17 bp, Homo sapiens
acatgttaatgaacagt

SEQ ID NO: 1428073 - DNA, 20 bp, Homo sapiens
acatgttaatgacaatattc

SEQ ID NO: 1428074 - DNA, 21 bp, Homo sapiens
acatgttatcaaatctgggta

SEQ ID NO: 1428075 - DNA, 12 bp, Homo sapiens
acatgttctcca

SEQ ID NO: 1428076 - DNA, 21 bp, Homo sapiens
acatgtttaataaataaaaat

SEQ ID NO: 1428077 - DNA, 18 bp, Homo sapiens
acatgtttcaagaaccgc

SEQ ID NO: 1428078 - DNA, 13 bp, Homo sapiens
acatgtttctgtt

SEQ ID NO: 1428079 - DNA, 15 bp, Homo sapiens
acatgtttttatatg

SEQ ID NO: 1428080 - DNA, 15 bp, Homo sapiens
acattaaaacaatat

SEQ ID NO: 1428081 - DNA, 21 bp, Homo sapiens
acattaaacactgtaatctta

SEQ ID NO: 1428082 - DNA, 15 bp, Homo sapiens
acattaacaaataaa

SEQ ID NO: 1428083 - DNA, 18 bp, Homo sapiens
acattaacggtgctaaaa

SEQ ID NO: 1428084 - DNA, 15 bp, Homo sapiens
acattaactccctcc

SEQ ID NO: 1428085 - DNA, 20 bp, Homo sapiens
acattaactccctccaccag

SEQ ID NO: 1428086 - DNA, 18 bp, Homo sapiens
acattaatagcagccttt

SEQ ID NO: 1428087 - DNA, 19 bp, Homo sapiens
acattaatatttaccaaag

SEQ ID NO: 1428088 - DNA, 20 bp, Homo sapiens
acattaatatttaccaaagt

SEQ ID NO: 1428089 - DNA, 17 bp, Homo sapiens
acattaattttgtgcat

SEQ ID NO: 1428090 - DNA, 23 bp, Homo sapiens
acattaattttgtgcattctttg

SEQ ID NO: 1428091 - DNA, 15 bp, Homo sapiens
acattacaacagtag

SEQ ID NO: 1428092 - DNA, 17 bp, Homo sapiens
acattacactaaattat

SEQ ID NO: 1428093 - DNA, 18 bp, Homo sapiens
acattagataaattacta

SEQ ID NO: 1428094 - DNA, 19 bp, Homo sapiens
acattagataaattactat

SEQ ID NO: 1428095 - DNA, 15 bp, Homo sapiens
acattagttgcacta

SEQ ID NO: 1428096 - DNA, 13 bp, Homo sapiens
acattatgatcta

SEQ ID NO: 1428097 - DNA, 20 bp, Homo sapiens
acattatgatctaataaact

SEQ ID NO: 1428098 - DNA, 21 bp, Homo sapiens
acattatgtggttttagattt

SEQ ID NO: 1428099 - DNA, 13 bp, Homo sapiens
acattattaaacg

SEQ ID NO: 1428100 - DNA, 14 bp, Homo sapiens
acattatttgcatg

SEQ ID NO: 1428101 - DNA, 19 bp, Homo sapiens
acattcaatgaattatatt

SEQ ID NO: 1428102 - DNA, 15 bp, Homo sapiens
acattcagctctgga

SEQ ID NO: 1428103 - DNA, 16 bp, Homo sapiens
acattcagctctggag

SEQ ID NO: 1428104 - DNA, 21 bp, Homo sapiens
acattcagctctggagaacag

SEQ ID NO: 1428105 - DNA, 20 bp, Homo sapiens
acattcatcaatatccctct

SEQ ID NO: 1428106 - DNA, 17 bp, Homo sapiens
acattccacatctgttt

SEQ ID NO: 1428107 - DNA, 17 bp, Homo sapiens
acattcctaactagaat

SEQ ID NO: 1428108 - DNA, 21 bp, Homo sapiens
acattcctaactagaattagt

SEQ ID NO: 1428109 - DNA, 12 bp, Homo sapiens
acattcctcagc

SEQ ID NO: 1428110 - DNA, 17 bp, Homo sapiens
acattcctcatgaatgt

SEQ ID NO: 1428111 - DNA, 18 bp, Homo sapiens
acattcctcatgaatgta

SEQ ID NO: 1428112 - DNA, 14 bp, Homo sapiens
acattcctggcccc

SEQ ID NO: 1428113 - DNA, 19 bp, Homo sapiens
acattccttgtcaccagca

SEQ ID NO: 1428114 - DNA, 20 bp, Homo sapiens
acattcgggaccaatatata

SEQ ID NO: 1428115 - DNA, 22 bp, Homo sapiens
acattcgtgaaaaccaaccctg

SEQ ID NO: 1428116 - DNA, 12 bp, Homo sapiens
acattctcacat

SEQ ID NO: 1428117 - DNA, 13 bp, Homo sapiens
acattctcacata

SEQ ID NO: 1428118 - DNA, 18 bp, Homo sapiens
acattctcacataagccc

SEQ ID NO: 1428119 - DNA, 20 bp, Homo sapiens
acattctctttgataacaaa

SEQ ID NO: 1428120 - DNA, 18 bp, Homo sapiens
acattctgcctagagtgt

SEQ ID NO: 1428121 - DNA, 23 bp, Homo sapiens
acattctgcctagagtgtagcct

SEQ ID NO: 1428122 - DNA, 18 bp, Homo sapiens
acattctgctttcatctt

SEQ ID NO: 1428123 - DNA, 19 bp, Homo sapiens
acattcttccaaaaagatt

SEQ ID NO: 1428124 - DNA, 20 bp, Homo sapiens
acattcttggcttaatcatt

SEQ ID NO: 1428125 - DNA, 18 bp, Homo sapiens
acattctttaacatacat

SEQ ID NO: 1428126 - DNA, 14 bp, Homo sapiens
acattctttttgct

SEQ ID NO: 1428127 - DNA, 19 bp, Homo sapiens
acattctttttgctctaaa

SEQ ID NO: 1428128 - DNA, 12 bp, Homo sapiens
acattgaaagag

SEQ ID NO: 1428129 - DNA, 18 bp, Homo sapiens
acattgaagtaatgaatt

SEQ ID NO: 1428130 - DNA, 19 bp, Homo sapiens
acattgaccaagaactgca

SEQ ID NO: 1428131 - DNA, 18 bp, Homo sapiens
acattgataattcaacat

SEQ ID NO: 1428132 - DNA, 16 bp, Homo sapiens
acattgcctgttctgc

SEQ ID NO: 1428133 - DNA, 12 bp, Homo sapiens
acattgccttct

SEQ ID NO: 1428134 - DNA, 18 bp, Homo sapiens
acattgccttctggagct

SEQ ID NO: 1428135 - DNA, 18 bp, Homo sapiens
acattgctctatgtctgc

SEQ ID NO: 1428136 - DNA, 14 bp, Homo sapiens
acattgctggctgc

SEQ ID NO: 1428137 - DNA, 15 bp, Homo sapiens
acattggaatgttct

SEQ ID NO: 1428138 - DNA, 17 bp, Homo sapiens
acattgtaaatagtatt

SEQ ID NO: 1428139 - DNA, 21 bp, Homo sapiens
acattgtaaatagtatttgag

SEQ ID NO: 1428140 - DNA, 12 bp, Homo sapiens
acattgtactgt

SEQ ID NO: 1428141 - DNA, 19 bp, Homo sapiens
acattgtctcctatatatt

SEQ ID NO: 1428142 - DNA, 19 bp, Homo sapiens
acattgtgactgtgtttgc

SEQ ID NO: 1428143 - DNA, 14 bp, Homo sapiens
acattgtgagctct

SEQ ID NO: 1428144 - DNA, 14 bp, Homo sapiens
acattgtgctttct

SEQ ID NO: 1428145 - DNA, 12 bp, Homo sapiens
acattgtgtcta

SEQ ID NO: 1428146 - DNA, 16 bp, Homo sapiens
acatttaataaaactg

SEQ ID NO: 1428147 - DNA, 16 bp, Homo sapiens
acatttaatacagata

SEQ ID NO: 1428148 - DNA, 22 bp, Homo sapiens
acatttaatattatataggata

SEQ ID NO: 1428149 - DNA, 16 bp, Homo sapiens
acatttacaataaata

SEQ ID NO: 1428150 - DNA, 16 bp, Homo sapiens
acatttacatgtatta

SEQ ID NO: 1428151 - DNA, 16 bp, Homo sapiens
acatttagaaaagtga

SEQ ID NO: 1428152 - DNA, 20 bp, Homo sapiens
acatttagaaaagtgaattg

SEQ ID NO: 1428153 - DNA, 23 bp, Homo sapiens
acatttagatcctggtttcataa

SEQ ID NO: 1428154 - DNA, 18 bp, Homo sapiens
acatttataatgtttgct

SEQ ID NO: 1428155 - DNA, 17 bp, Homo sapiens
acatttatatatatatg

SEQ ID NO: 1428156 - DNA, 21 bp, Homo sapiens
acatttattttgagaagctct

SEQ ID NO: 1428157 - DNA, 14 bp, Homo sapiens
acatttcaaagttt

SEQ ID NO: 1428158 - DNA, 21 bp, Homo sapiens
acatttcatagcctacatttt

SEQ ID NO: 1428159 - DNA, 23 bp, Homo sapiens
acatttcatagtttcaaatctgt

SEQ ID NO: 1428160 - DNA, 20 bp, Homo sapiens
acatttccagggcagcagcc

SEQ ID NO: 1428161 - DNA, 15 bp, Homo sapiens
acatttcctttgaac

SEQ ID NO: 1428162 - DNA, 16 bp, Homo sapiens
acatttctcactgaaa

SEQ ID NO: 1428163 - DNA, 22 bp, Homo sapiens
acatttctctaactcctgccat

SEQ ID NO: 1428164 - DNA, 22 bp, Homo sapiens
acatttctctccaccttagtac

SEQ ID NO: 1428165 - DNA, 15 bp, Homo sapiens
acatttctctgagca

SEQ ID NO: 1428166 - DNA, 15 bp, Homo sapiens
acatttctgttctca

SEQ ID NO: 1428167 - DNA, 19 bp, Homo sapiens
acatttcttctagtgatga

SEQ ID NO: 1428168 - DNA, 18 bp, Homo sapiens
acatttctttgcattcca

SEQ ID NO: 1428169 - DNA, 13 bp, Homo sapiens
acatttgatattt

SEQ ID NO: 1428170 - DNA, 20 bp, Homo sapiens
acatttgatatttttccatt

SEQ ID NO: 1428171 - DNA, 17 bp, Homo sapiens
acatttgatgtacatgt

SEQ ID NO: 1428172 - DNA, 19 bp, Homo sapiens
acatttgatgtacatgtgt

SEQ ID NO: 1428173 - DNA, 12 bp, Homo sapiens
acatttgctgaa

SEQ ID NO: 1428174 - DNA, 21 bp, Homo sapiens
acatttgtaagtgtaaaaaat

SEQ ID NO: 1428175 - DNA, 15 bp, Homo sapiens
acatttgtatattgt

SEQ ID NO: 1428176 - DNA, 16 bp, Homo sapiens
acatttgtatattgtg

SEQ ID NO: 1428177 - DNA, 14 bp, Homo sapiens
acatttgtcagtat

SEQ ID NO: 1428178 - DNA, 21 bp, Homo sapiens
acatttgtgaactcaaacgat

SEQ ID NO: 1428179 - DNA, 15 bp, Homo sapiens
acatttgtgtggaaa

SEQ ID NO: 1428180 - DNA, 15 bp, Homo sapiens
acatttgttcctgga

SEQ ID NO: 1428181 - DNA, 16 bp, Homo sapiens
acatttgtttccccca

SEQ ID NO: 1428182 - DNA, 15 bp, Homo sapiens
acatttgtttgtatt

SEQ ID NO: 1428183 - DNA, 13 bp, Homo sapiens
acattttattaaa

SEQ ID NO: 1428184 - DNA, 12 bp, Homo sapiens
acattttctaaa

SEQ ID NO: 1428185 - DNA, 13 bp, Homo sapiens
acattttctaaat

SEQ ID NO: 1428186 - DNA, 16 bp, Homo sapiens
acattttctaaataaa

SEQ ID NO: 1428187 - DNA, 17 bp, Homo sapiens
acattttctcttagaaa

SEQ ID NO: 1428188 - DNA, 16 bp, Homo sapiens
acattttctggattct

SEQ ID NO: 1428189 - DNA, 14 bp, Homo sapiens
acattttctttttt

SEQ ID NO: 1428190 - DNA, 15 bp, Homo sapiens
acattttgaaggaaa

SEQ ID NO: 1428191 - DNA, 14 bp, Homo sapiens
acattttgtacatt

SEQ ID NO: 1428192 - DNA, 13 bp, Homo sapiens
acattttgtgtga

SEQ ID NO: 1428193 - DNA, 19 bp, Homo sapiens
acattttgttatagaatac

SEQ ID NO: 1428194 - DNA, 12 bp, Homo sapiens
acatttttacaa

SEQ ID NO: 1428195 - DNA, 20 bp, Homo sapiens
acattttttgctataatcat

SEQ ID NO: 1428196 - DNA, 21 bp, Homo sapiens
acattttttgctataatcatt

SEQ ID NO: 1428197 - DNA, 13 bp, Homo sapiens
accaaaaaaattg

SEQ ID NO: 1428198 - DNA, 12 bp, Homo sapiens
accaaaaaatat

SEQ ID NO: 1428199 - DNA, 16 bp, Homo sapiens
accaaaacagttaatc

SEQ ID NO: 1428200 - DNA, 14 bp, Homo sapiens
accaaaacttccaa

SEQ ID NO: 1428201 - DNA, 15 bp, Homo sapiens
accaaaacttccaag

SEQ ID NO: 1428202 - DNA, 15 bp, Homo sapiens
accaaaagaacaaga

SEQ ID NO: 1428203 - DNA, 20 bp, Homo sapiens
accaaaagggaggctctctg

SEQ ID NO: 1428204 - DNA, 16 bp, Homo sapiens
accaaaagttattaaa

SEQ ID NO: 1428205 - DNA, 19 bp, Homo sapiens
accaaaagttattaaaatt

SEQ ID NO: 1428206 - DNA, 17 bp, Homo sapiens
accaaaatatagttaat

SEQ ID NO: 1428207 - DNA, 19 bp, Homo sapiens
accaaacaaggaagccaaa

SEQ ID NO: 1428208 - DNA, 20 bp, Homo sapiens
accaaaccccacttcccctc

SEQ ID NO: 1428209 - DNA, 15 bp, Homo sapiens
accaaactcagttca

SEQ ID NO: 1428210 - DNA, 22 bp, Homo sapiens
accaaactgcacacacagctcc

SEQ ID NO: 1428211 - DNA, 18 bp, Homo sapiens
accaaagagggcttcctc

SEQ ID NO: 1428212 - DNA, 13 bp, Homo sapiens
accaaagcatcaa

SEQ ID NO: 1428213 - DNA, 24 bp, Homo sapiens
accaaagcatcaatacaaccagcc

SEQ ID NO: 1428214 - DNA, 13 bp, Homo sapiens
accaaaggaagga

SEQ ID NO: 1428215 - DNA, 22 bp, Homo sapiens
accaaagggaagtgaggcccaa

SEQ ID NO: 1428216 - DNA, 15 bp, Homo sapiens
accaaagtatttttt

SEQ ID NO: 1428217 - DNA, 19 bp, Homo sapiens
accaaagtgtcttttgaca

SEQ ID NO: 1428218 - DNA, 14 bp, Homo sapiens
accaaagttctaat

SEQ ID NO: 1428219 - DNA, 14 bp, Homo sapiens
accaaatacctcaa

SEQ ID NO: 1428220 - DNA, 22 bp, Homo sapiens
accaaatacctcaatttttgtt

SEQ ID NO: 1428221 - DNA, 23 bp, Homo sapiens
accaaatacctcaatttttgttt

SEQ ID NO: 1428222 - DNA, 18 bp, Homo sapiens
accaaatagtgtgaaata

SEQ ID NO: 1428223 - DNA, 16 bp, Homo sapiens
accaaatcagctgcta

SEQ ID NO: 1428224 - DNA, 19 bp, Homo sapiens
accaaatcagctgctacta

SEQ ID NO: 1428225 - DNA, 22 bp, Homo sapiens
accaaatctcagttgtttgctt

SEQ ID NO: 1428226 - DNA, 19 bp, Homo sapiens
accaaatggccagttttct

SEQ ID NO: 1428227 - DNA, 22 bp, Homo sapiens
accaaattagtgaaccaaaaat

SEQ ID NO: 1428228 - DNA, 17 bp, Homo sapiens
accaaatttttctatca

SEQ ID NO: 1428229 - DNA, 14 bp, Homo sapiens
accaacacgagcag

SEQ ID NO: 1428230 - DNA, 18 bp, Homo sapiens
accaacatcccattgccc

SEQ ID NO: 1428231 - DNA, 13 bp, Homo sapiens
accaacatctttg

SEQ ID NO: 1428232 - DNA, 24 bp, Homo sapiens
accaacatggagaaaccctgtctc

SEQ ID NO: 1428233 - DNA, 22 bp, Homo sapiens
accaacccatcagaaggagaag

SEQ ID NO: 1428234 - DNA, 15 bp, Homo sapiens
accaaccctgtgggc

SEQ ID NO: 1428235 - DNA, 20 bp, Homo sapiens
accaaccttccattcacacc

SEQ ID NO: 1428236 - DNA, 14 bp, Homo sapiens
accaactctgcact

SEQ ID NO: 1428237 - DNA, 22 bp, Homo sapiens
accaacttggttctgcttcaat

SEQ ID NO: 1428238 - DNA, 16 bp, Homo sapiens
accaagactctgaaat

SEQ ID NO: 1428239 - DNA, 23 bp, Homo sapiens
accaagcaagtcccttcagactg

SEQ ID NO: 1428240 - DNA, 20 bp, Homo sapiens
accaagccaagggaacctgt

SEQ ID NO: 1428241 - DNA, 14 bp, Homo sapiens
accaagccgtggct

SEQ ID NO: 1428242 - DNA, 11 bp, Homo sapiens
accaagccttg

SEQ ID NO: 1428243 - DNA, 12 bp, Homo sapiens
accaagccttgg

SEQ ID NO: 1428244 - DNA, 18 bp, Homo sapiens
accaagctcacagttcct

SEQ ID NO: 1428245 - DNA, 14 bp, Homo sapiens
accaagctgagttt

SEQ ID NO: 1428246 - DNA, 18 bp, Homo sapiens
accaagctgagtttccta

SEQ ID NO: 1428247 - DNA, 15 bp, Homo sapiens
accaagcttcagagc

SEQ ID NO: 1428248 - DNA, 16 bp, Homo sapiens
accaagcttcagagcc

SEQ ID NO: 1428249 - DNA, 17 bp, Homo sapiens
accaagcttcagagcct

SEQ ID NO: 1428250 - DNA, 19 bp, Homo sapiens
accaagcttcagagcctag

SEQ ID NO: 1428251 - DNA, 21 bp, Homo sapiens
accaaggaaacgctacctctc

SEQ ID NO: 1428252 - DNA, 22 bp, Homo sapiens
accaaggacggaaaatgcttaa

SEQ ID NO: 1428253 - DNA, 13 bp, Homo sapiens
accaaggcagcct

SEQ ID NO: 1428254 - DNA, 17 bp, Homo sapiens
accaaggcagcctccag

SEQ ID NO: 1428255 - DNA, 21 bp, Homo sapiens
accaaggctgagacagtgaat

SEQ ID NO: 1428256 - DNA, 20 bp, Homo sapiens
accaaggggctcttgaaccc

SEQ ID NO: 1428257 - DNA, 18 bp, Homo sapiens
accaagggtatctgctgc

SEQ ID NO: 1428258 - DNA, 14 bp, Homo sapiens
accaagtcacacgc

SEQ ID NO: 1428259 - DNA, 23 bp, Homo sapiens
accaagtcctggctacatcccag

SEQ ID NO: 1428260 - DNA, 11 bp, Homo sapiens
accaataaagt

SEQ ID NO: 1428261 - DNA, 19 bp, Homo sapiens
accaataaatgtttgttat

SEQ ID NO: 1428262 - DNA, 14 bp, Homo sapiens
accaatacatttgt

SEQ ID NO: 1428263 - DNA, 13 bp, Homo sapiens
accaatcatttta

SEQ ID NO: 1428264 - DNA, 13 bp, Homo sapiens
accaatcccaact

SEQ ID NO: 1428265 - DNA, 22 bp, Homo sapiens
accaatcccgtgaaagaattat

SEQ ID NO: 1428266 - DNA, 23 bp, Homo sapiens
accaatcccgtgaaagaattatt

SEQ ID NO: 1428267 - DNA, 14 bp, Homo sapiens
accaatgaagaaga

SEQ ID NO: 1428268 - DNA, 16 bp, Homo sapiens
accaatgaagaagaca

SEQ ID NO: 1428269 - DNA, 13 bp, Homo sapiens
accaatgcctttt

SEQ ID NO: 1428270 - DNA, 23 bp, Homo sapiens
accaatgcctttttagatgtatt

SEQ ID NO: 1428271 - DNA, 18 bp, Homo sapiens
accaatgctgttgtaaac

SEQ ID NO: 1428272 - DNA, 19 bp, Homo sapiens
accaattacccataaacag

SEQ ID NO: 1428273 - DNA, 18 bp, Homo sapiens
accaattctggacagaca

SEQ ID NO: 1428274 - DNA, 16 bp, Homo sapiens
accaattgaaaagtgt

SEQ ID NO: 1428275 - DNA, 15 bp, Homo sapiens
accaattgctttgtc

SEQ ID NO: 1428276 - DNA, 17 bp, Homo sapiens
accaattgtcaaattac

SEQ ID NO: 1428277 - DNA, 13 bp, Homo sapiens
accaattgtgctg

SEQ ID NO: 1428278 - DNA, 14 bp, Homo sapiens
accaattgtgctgc

SEQ ID NO: 1428279 - DNA, 15 bp, Homo sapiens
accaattgtgctgcc

SEQ ID NO: 1428280 - DNA, 18 bp, Homo sapiens
accaattgtgctgccatt

SEQ ID NO: 1428281 - DNA, 18 bp, Homo sapiens
accaatttacactgccat

SEQ ID NO: 1428282 - DNA, 17 bp, Homo sapiens
accacaaaccctgctga

SEQ ID NO: 1428283 - DNA, 19 bp, Homo sapiens
accacaaacggagcccctg

SEQ ID NO: 1428284 - DNA, 16 bp, Homo sapiens
accacaaatgcataaa

SEQ ID NO: 1428285 - DNA, 16 bp, Homo sapiens
accacaactgacacag

SEQ ID NO: 1428286 - DNA, 17 bp, Homo sapiens
accacaagcctgagaac

SEQ ID NO: 1428287 - DNA, 19 bp, Homo sapiens
accacaatgtttcttcatt

SEQ ID NO: 1428288 - DNA, 18 bp, Homo sapiens
cctggtgggtcagcccag

SEQ ID NO: 1428289 - DNA, 20 bp, Homo sapiens
cctggtgggtcagcccagca

SEQ ID NO: 1428290 - DNA, 16 bp, Homo sapiens
cctggttagctgacag

SEQ ID NO: 1428291 - DNA, 21 bp, Homo sapiens
cctggttagctgacagtcagc

SEQ ID NO: 1428292 - DNA, 22 bp, Homo sapiens
cctggttcatatttatactttg

SEQ ID NO: 1428293 - DNA, 22 bp, Homo sapiens
cctggttcccgtttctccacct

SEQ ID NO: 1428294 - DNA, 16 bp, Homo sapiens
cctggttcctgctgtc

SEQ ID NO: 1428295 - DNA, 20 bp, Homo sapiens
cctggttcctgctgtcctgg

SEQ ID NO: 1428296 - DNA, 16 bp, Homo sapiens
cctggttctcatcttt

SEQ ID NO: 1428297 - DNA, 15 bp, Homo sapiens
cctggtttagcctgg

SEQ ID NO: 1428298 - DNA, 21 bp, Homo sapiens
cctggtttcataacttcctgt

SEQ ID NO: 1428299 - DNA, 16 bp, Homo sapiens
cctggtttcctggcag

SEQ ID NO: 1428300 - DNA, 17 bp, Homo sapiens
cctggtttcctggcagc

SEQ ID NO: 1428301 - DNA, 15 bp, Homo sapiens
cctggtttgactcag

SEQ ID NO: 1428302 - DNA, 19 bp, Homo sapiens
cctgtaaactttatcactt

SEQ ID NO: 1428303 - DNA, 18 bp, Homo sapiens
cctgtaaataagagttgc

SEQ ID NO: 1428304 - DNA, 13 bp, Homo sapiens
cctgtaaatatat

SEQ ID NO: 1428305 - DNA, 23 bp, Homo sapiens
cctgtaacaggtgtggggacaca

SEQ ID NO: 1428306 - DNA, 23 bp, Homo sapiens
cctgtaacatactggcctggact

SEQ ID NO: 1428307 - DNA, 18 bp, Homo sapiens
cctgtaacttgagagtag

SEQ ID NO: 1428308 - DNA, 13 bp, Homo sapiens
cctgtaagaaaaa

SEQ ID NO: 1428309 - DNA, 20 bp, Homo sapiens
cctgtaatcatataataaat

SEQ ID NO: 1428310 - DNA, 13 bp, Homo sapiens
cctgtaatcccag

SEQ ID NO: 1428311 - DNA, 17 bp, Homo sapiens
cctgtaatcccagaact

SEQ ID NO: 1428312 - DNA, 18 bp, Homo sapiens
cctgtaatcccagcactt

SEQ ID NO: 1428313 - DNA, 12 bp, Homo sapiens
cctgtacactga

SEQ ID NO: 1428314 - DNA, 21 bp, Homo sapiens
cctgtacactgaatatttata

SEQ ID NO: 1428315 - DNA, 12 bp, Homo sapiens
cctgtacattct

SEQ ID NO: 1428316 - DNA, 14 bp, Homo sapiens
cctgtacccagctc

SEQ ID NO: 1428317 - DNA, 17 bp, Homo sapiens
cctgtacccagctcctt

SEQ ID NO: 1428318 - DNA, 14 bp, Homo sapiens
cctgtaccccagca

SEQ ID NO: 1428319 - DNA, 15 bp, Homo sapiens
cctgtactcaggagg

SEQ ID NO: 1428320 - DNA, 21 bp, Homo sapiens
cctgtactcaggaggctgagg

SEQ ID NO: 1428321 - DNA, 23 bp, Homo sapiens
cctgtactcaggaggctgagggg

SEQ ID NO: 1428322 - DNA, 20 bp, Homo sapiens
cctgtactgttctgtgtctt

SEQ ID NO: 1428323 - DNA, 14 bp, Homo sapiens
cctgtagagttgct

SEQ ID NO: 1428324 - DNA, 17 bp, Homo sapiens
cctgtagagttgctgag

SEQ ID NO: 1428325 - DNA, 17 bp, Homo sapiens
cctgtagcacttactgg

SEQ ID NO: 1428326 - DNA, 15 bp, Homo sapiens
cctgtagccactggc

SEQ ID NO: 1428327 - DNA, 17 bp, Homo sapiens
cctgtagctcagtcatc

SEQ ID NO: 1428328 - DNA, 18 bp, Homo sapiens
cctgtagctttcctggtc

SEQ ID NO: 1428329 - DNA, 19 bp, Homo sapiens
cctgtagctttcctggtcc

SEQ ID NO: 1428330 - DNA, 22 bp, Homo sapiens
cctgtagggaaaccttggagag

SEQ ID NO: 1428331 - DNA, 23 bp, Homo sapiens
cctgtagggaaaccttggagagg

SEQ ID NO: 1428332 - DNA, 23 bp, Homo sapiens
cctgtagggtccaaccagacctg

SEQ ID NO: 1428333 - DNA, 13 bp, Homo sapiens
cctgtagtcccag

SEQ ID NO: 1428334 - DNA, 15 bp, Homo sapiens
cctgtagtcccagct

SEQ ID NO: 1428335 - DNA, 16 bp, Homo sapiens
cctgtagtcccagcta

SEQ ID NO: 1428336 - DNA, 18 bp, Homo sapiens
cctgtagttgcgtggact

SEQ ID NO: 1428337 - DNA, 16 bp, Homo sapiens
cctgtatacagtgcag

SEQ ID NO: 1428338 - DNA, 20 bp, Homo sapiens
cctgtatatttgtaaagcta

SEQ ID NO: 1428339 - DNA, 22 bp, Homo sapiens
cctgtatcctccctggcagaca

SEQ ID NO: 1428340 - DNA, 14 bp, Homo sapiens
cctgtattcttgtt

SEQ ID NO: 1428341 - DNA, 18 bp, Homo sapiens
cctgtattcttgtttgaa

SEQ ID NO: 1428342 - DNA, 13 bp, Homo sapiens
cctgtatttccaa

SEQ ID NO: 1428343 - DNA, 17 bp, Homo sapiens
cctgtatttgagagact

SEQ ID NO: 1428344 - DNA, 15 bp, Homo sapiens
cctgtcaagttaaca

SEQ ID NO: 1428345 - DNA, 16 bp, Homo sapiens
cctgtcaagttaacaa

SEQ ID NO: 1428346 - DNA, 22 bp, Homo sapiens
cctgtcaatatcgtacctgtcc

SEQ ID NO: 1428347 - DNA, 18 bp, Homo sapiens
cctgtcaccctgcaggac

SEQ ID NO: 1428348 - DNA, 15 bp, Homo sapiens
cctgtcacgctctgg

SEQ ID NO: 1428349 - DNA, 16 bp, Homo sapiens
cctgtcactcagctga

SEQ ID NO: 1428350 - DNA, 20 bp, Homo sapiens
cctgtcagaataataaatat

SEQ ID NO: 1428351 - DNA, 22 bp, Homo sapiens
cctgtcagaataataaatattg

SEQ ID NO: 1428352 - DNA, 13 bp, Homo sapiens
cctgtcagaggct

SEQ ID NO: 1428353 - DNA, 20 bp, Homo sapiens
cctgtcatagagctgcaggg

SEQ ID NO: 1428354 - DNA, 12 bp, Homo sapiens
cctgtcatgccc

SEQ ID NO: 1428355 - DNA, 19 bp, Homo sapiens
cctgtcattttgcactgta

SEQ ID NO: 1428356 - DNA, 19 bp, Homo sapiens
cctgtccaaactgcctaag

SEQ ID NO: 1428357 - DNA, 12 bp, Homo sapiens
cctgtccaacct

SEQ ID NO: 1428358 - DNA, 14 bp, Homo sapiens
cctgtccaccctgc

SEQ ID NO: 1428359 - DNA, 12 bp, Homo sapiens
cctgtccagcct

SEQ ID NO: 1428360 - DNA, 13 bp, Homo sapiens
cctgtccagctcc

SEQ ID NO: 1428361 - DNA, 11 bp, Homo sapiens
cctgtcccacc

SEQ ID NO: 1428362 - DNA, 23 bp, Homo sapiens
cctgtcccaccaactctgcactc

SEQ ID NO: 1428363 - DNA, 15 bp, Homo sapiens
cctgtcccaccccca

SEQ ID NO: 1428364 - DNA, 17 bp, Homo sapiens
cctgtcccacccccacc

SEQ ID NO: 1428365 - DNA, 18 bp, Homo sapiens
cctgtcccattctagatc

SEQ ID NO: 1428366 - DNA, 19 bp, Homo sapiens
cctgtccccaccctccact

SEQ ID NO: 1428367 - DNA, 13 bp, Homo sapiens
cctgtcccccagc

SEQ ID NO: 1428368 - DNA, 14 bp, Homo sapiens
cctgtcccccagct

SEQ ID NO: 1428369 - DNA, 16 bp, Homo sapiens
cctgtcccccagctct

SEQ ID NO: 1428370 - DNA, 18 bp, Homo sapiens
cctgtcccctgaaaaact

SEQ ID NO: 1428371 - DNA, 19 bp, Homo sapiens
cctgtcccctgaaaaactg

SEQ ID NO: 1428372 - DNA, 15 bp, Homo sapiens
cctgtccctccaggc

SEQ ID NO: 1428373 - DNA, 23 bp, Homo sapiens
cctgtccctccaggcccatctca

SEQ ID NO: 1428374 - DNA, 19 bp, Homo sapiens
cctgtccctgtagctcagt

SEQ ID NO: 1428375 - DNA, 21 bp, Homo sapiens
cctgtccctgtagctcagtca

SEQ ID NO: 1428376 - DNA, 15 bp, Homo sapiens
cctgtcccttgcctc

SEQ ID NO: 1428377 - DNA, 17 bp, Homo sapiens
cctgtcccttgcctctg

SEQ ID NO: 1428378 - DNA, 23 bp, Homo sapiens
cctgtcccttgcctctgccctgg

SEQ ID NO: 1428379 - DNA, 16 bp, Homo sapiens
cctgtccggcccagtg

SEQ ID NO: 1428380 - DNA, 19 bp, Homo sapiens
cctgtccggcccagtgcca

SEQ ID NO: 1428381 - DNA, 19 bp, Homo sapiens
cctgtccttgaaaaacaaa

SEQ ID NO: 1428382 - DNA, 22 bp, Homo sapiens
cctgtccttgtcacgatcacag

SEQ ID NO: 1428383 - DNA, 23 bp, Homo sapiens
cctgtccttgtcacgatcacagg

SEQ ID NO: 1428384 - DNA, 17 bp, Homo sapiens
cctgtcgagacacttgc

SEQ ID NO: 1428385 - DNA, 17 bp, Homo sapiens
cctgtctaggtctcctc

SEQ ID NO: 1428386 - DNA, 20 bp, Homo sapiens
cctgtctataagagaattat

SEQ ID NO: 1428387 - DNA, 15 bp, Homo sapiens
cctgtctcagcctcc

SEQ ID NO: 1428388 - DNA, 19 bp, Homo sapiens
cctgtctcagcctcctgag

SEQ ID NO: 1428389 - DNA, 21 bp, Homo sapiens
cctgtctcatcttctgaagag

SEQ ID NO: 1428390 - DNA, 16 bp, Homo sapiens
cctgtctccagctgcc

SEQ ID NO: 1428391 - DNA, 18 bp, Homo sapiens
cctgtctccagctgcctg

SEQ ID NO: 1428392 - DNA, 21 bp, Homo sapiens
cctgtctccagctgcctgggc

SEQ ID NO: 1428393 - DNA, 14 bp, Homo sapiens
cctgtctctaaaaa

SEQ ID NO: 1428394 - DNA, 22 bp, Homo sapiens
cctgtctctaaaaagaagccac

SEQ ID NO: 1428395 - DNA, 16 bp, Homo sapiens
cctgtctctaaggagc

SEQ ID NO: 1428396 - DNA, 16 bp, Homo sapiens
cctgtctctgcctgcg

SEQ ID NO: 1428397 - DNA, 19 bp, Homo sapiens
cctgtctgccagccagcag

SEQ ID NO: 1428398 - DNA, 20 bp, Homo sapiens
cctgtctgccccagcccaga

SEQ ID NO: 1428399 - DNA, 12 bp, Homo sapiens
cctgtctgctgc

SEQ ID NO: 1428400 - DNA, 14 bp, Homo sapiens
cctgtctgctgcca

SEQ ID NO: 1428401 - DNA, 18 bp, Homo sapiens
cctgtctgctgccagcac

SEQ ID NO: 1428402 - DNA, 18 bp, Homo sapiens
cctgtctggctcggaccc

SEQ ID NO: 1428403 - DNA, 22 bp, Homo sapiens
cctgtctggctcggacccaccc

SEQ ID NO: 1428404 - DNA, 21 bp, Homo sapiens
cctgtctgtctctccatctgt

SEQ ID NO: 1428405 - DNA, 16 bp, Homo sapiens
cctgtctgtgtcccag

SEQ ID NO: 1428406 - DNA, 17 bp, Homo sapiens
cctgtctgtgtcccagc

SEQ ID NO: 1428407 - DNA, 18 bp, Homo sapiens
cctgtctgtgtcccagcc

SEQ ID NO: 1428408 - DNA, 19 bp, Homo sapiens
cctgtcttcctgcattcac

SEQ ID NO: 1428409 - DNA, 22 bp, Homo sapiens
cctgtcttcctgcattcaccca

SEQ ID NO: 1428410 - DNA, 18 bp, Homo sapiens
cctgtctttcagcattca

SEQ ID NO: 1428411 - DNA, 23 bp, Homo sapiens
cctgtgaagtaacccctcctggc

SEQ ID NO: 1428412 - DNA, 16 bp, Homo sapiens
cctgtgaatgccactg

SEQ ID NO: 1428413 - DNA, 17 bp, Homo sapiens
cctgtgacaaaggatga

SEQ ID NO: 1428414 - DNA, 19 bp, Homo sapiens
cctgtgacatggtgcctga

SEQ ID NO: 1428415 - DNA, 21 bp, Homo sapiens
cctgtgacatggtgcctgaga

SEQ ID NO: 1428416 - DNA, 22 bp, Homo sapiens
cctgtgacatggtgcctgagag

SEQ ID NO: 1428417 - DNA, 17 bp, Homo sapiens
cctgtgaccagcactgt

SEQ ID NO: 1428418 - DNA, 14 bp, Homo sapiens
cctgtgagcatcct

SEQ ID NO: 1428419 - DNA, 14 bp, Homo sapiens
cctgtgagccagtc

SEQ ID NO: 1428420 - DNA, 15 bp, Homo sapiens
cctgtgagccagtct

SEQ ID NO: 1428421 - DNA, 16 bp, Homo sapiens
cctgtgagccagtcta

SEQ ID NO: 1428422 - DNA, 14 bp, Homo sapiens
cctgtgaggcaggg

SEQ ID NO: 1428423 - DNA, 13 bp, Homo sapiens
cctgtgagggcga

SEQ ID NO: 1428424 - DNA, 23 bp, Homo sapiens
cctgtgaggtgcagagtgcccag

SEQ ID NO: 1428425 - DNA, 15 bp, Homo sapiens
cctgtgcagcagccc

SEQ ID NO: 1428426 - DNA, 16 bp, Homo sapiens
cctgtgcagcagccca

SEQ ID NO: 1428427 - DNA, 20 bp, Homo sapiens
cctgtgcagcagcccagctt

SEQ ID NO: 1428428 - DNA, 20 bp, Homo sapiens
cctgtgcatgtatgtcttgg

SEQ ID NO: 1428429 - DNA, 12 bp, Homo sapiens
cctgtgccaata

SEQ ID NO: 1428430 - DNA, 19 bp, Homo sapiens
cctgtgccacccaccaggg

SEQ ID NO: 1428431 - DNA, 14 bp, Homo sapiens
cctgtgccagcacc

SEQ ID NO: 1428432 - DNA, 23 bp, Homo sapiens
cctgtgcccacatcccaggcttc

SEQ ID NO: 1428433 - DNA, 18 bp, Homo sapiens
cctgtgccctcaccacca

SEQ ID NO: 1428434 - DNA, 16 bp, Homo sapiens
cctgtgcgtcccagct

SEQ ID NO: 1428435 - DNA, 13 bp, Homo sapiens
cctgtgctagttt

SEQ ID NO: 1428436 - DNA, 18 bp, Homo sapiens
cctgtgctcccctgccac

SEQ ID NO: 1428437 - DNA, 18 bp, Homo sapiens
cctgtgctccgtgcctcc

SEQ ID NO: 1428438 - DNA, 12 bp, Homo sapiens
cctgtgctcctg

SEQ ID NO: 1428439 - DNA, 16 bp, Homo sapiens
cctgtgctcctgccca

SEQ ID NO: 1428440 - DNA, 21 bp, Homo sapiens
cctgtgctcctgcccaggagc

SEQ ID NO: 1428441 - DNA, 22 bp, Homo sapiens
cctgtgctcctgcccaggagca

SEQ ID NO: 1428442 - DNA, 18 bp, Homo sapiens
cctgtgctctggaggctg

SEQ ID NO: 1428443 - DNA, 17 bp, Homo sapiens
cctgtgctgatcctgct

SEQ ID NO: 1428444 - DNA, 20 bp, Homo sapiens
cctgtgctgatcctgctgac

SEQ ID NO: 1428445 - DNA, 23 bp, Homo sapiens
cctgtgctgatcctgctgacctc

SEQ ID NO: 1428446 - DNA, 19 bp, Homo sapiens
cctgtgctgcatgcgacag

SEQ ID NO: 1428447 - DNA, 15 bp, Homo sapiens
cctgtgctgggccag

SEQ ID NO: 1428448 - DNA, 21 bp, Homo sapiens
cctgtgctgggccagtggctg

SEQ ID NO: 1428449 - DNA, 14 bp, Homo sapiens
cctgtgctggtgtc

SEQ ID NO: 1428450 - DNA, 17 bp, Homo sapiens
cctgtgctggtgtcctg

SEQ ID NO: 1428451 - DNA, 22 bp, Homo sapiens
cctgtgctggtgtcctgaccac

SEQ ID NO: 1428452 - DNA, 24 bp, Homo sapiens
cctgtgctggtgtcctgaccaccc

SEQ ID NO: 1428453 - DNA, 14 bp, Homo sapiens
cctgtggacaggat

SEQ ID NO: 1428454 - DNA, 18 bp, Homo sapiens
cctgtggagtccagctct

SEQ ID NO: 1428455 - DNA, 16 bp, Homo sapiens
cctgtggcacagccct

SEQ ID NO: 1428456 - DNA, 20 bp, Homo sapiens
cctgtggcacagccctgagt

SEQ ID NO: 1428457 - DNA, 19 bp, Homo sapiens
cctgtggcactcagggagc

SEQ ID NO: 1428458 - DNA, 21 bp, Homo sapiens
cctgtggcagaaaagaggaga

SEQ ID NO: 1428459 - DNA, 13 bp, Homo sapiens
cctgtggcagctg

SEQ ID NO: 1428460 - DNA, 15 bp, Homo sapiens
cctgtggcagctgcc

SEQ ID NO: 1428461 - DNA, 23 bp, Homo sapiens
cctgtggcagctgcccctggcac

SEQ ID NO: 1428462 - DNA, 23 bp, Homo sapiens
cctgtggcatctttgccttgggc

SEQ ID NO: 1428463 - DNA, 15 bp, Homo sapiens
cctgtggccccaccc

SEQ ID NO: 1428464 - DNA, 15 bp, Homo sapiens
cctgtggccctggcc

SEQ ID NO: 1428465 - DNA, 17 bp, Homo sapiens
cctgtggccctggccac

SEQ ID NO: 1428466 - DNA, 16 bp, Homo sapiens
cctgtggccgccacct

SEQ ID NO: 1428467 - DNA, 13 bp, Homo sapiens
cctgtggcctgtg

SEQ ID NO: 1428468 - DNA, 15 bp, Homo sapiens
cctgtggccttgccc

SEQ ID NO: 1428469 - DNA, 17 bp, Homo sapiens
cctgtggccttgcccgc

SEQ ID NO: 1428470 - DNA, 19 bp, Homo sapiens
cctgtggccttgcccgcca

SEQ ID NO: 1428471 - DNA, 22 bp, Homo sapiens
cctgtggccttgcccgccagcc

SEQ ID NO: 1428472 - DNA, 17 bp, Homo sapiens
cctgtggcggccttccg

SEQ ID NO: 1428473 - DNA, 14 bp, Homo sapiens
cctgtgggcgcata

SEQ ID NO: 1428474 - DNA, 22 bp, Homo sapiens
cctgtgggcttatgtctctgcc

SEQ ID NO: 1428475 - DNA, 12 bp, Homo sapiens
cctgtgggcttc

SEQ ID NO: 1428476 - DNA, 20 bp, Homo sapiens
cctgtggggatctcaggggc

SEQ ID NO: 1428477 - DNA, 22 bp, Homo sapiens
cctgtggggggtaatccctgct

SEQ ID NO: 1428478 - DNA, 16 bp, Homo sapiens
cctgtggggttgtttt

SEQ ID NO: 1428479 - DNA, 19 bp, Homo sapiens
cctgtgggtctctgaaggg

SEQ ID NO: 1428480 - DNA, 14 bp, Homo sapiens
cctgtggtggctcc

SEQ ID NO: 1428481 - DNA, 19 bp, Homo sapiens
cctgtggttacagtgcaga

SEQ ID NO: 1428482 - DNA, 23 bp, Homo sapiens
cctgtggttacagtgcagacagg

SEQ ID NO: 1428483 - DNA, 13 bp, Homo sapiens
cctgtgtccatgc

SEQ ID NO: 1428484 - DNA, 21 bp, Homo sapiens
cctgtgtccatgtgatctcat

SEQ ID NO: 1428485 - DNA, 11 bp, Homo sapiens
cctgtgtccca

SEQ ID NO: 1428486 - DNA, 14 bp, Homo sapiens
cctgtgtcccatga

SEQ ID NO: 1428487 - DNA, 18 bp, Homo sapiens
cctgtgtcccatgaccca

SEQ ID NO: 1428488 - DNA, 13 bp, Homo sapiens
cctgtgtgcaggt

SEQ ID NO: 1428489 - DNA, 14 bp, Homo sapiens
cctgtgtgctccgg

SEQ ID NO: 1428490 - DNA, 14 bp, Homo sapiens
cctgtgtggagagg

SEQ ID NO: 1428491 - DNA, 15 bp, Homo sapiens
cctgtgtggagaggg

SEQ ID NO: 1428492 - DNA, 21 bp, Homo sapiens
cctgtgtggagagggaatgtg

SEQ ID NO: 1428493 - DNA, 19 bp, Homo sapiens
cctgtgtgtactctgtcca

SEQ ID NO: 1428494 - DNA, 20 bp, Homo sapiens
cctgtgtgtccaaaactgcc

SEQ ID NO: 1428495 - DNA, 21 bp, Homo sapiens
cctgtgtgtccaaaactgcct

SEQ ID NO: 1428496 - DNA, 14 bp, Homo sapiens
cctgtgtgtgtgta

SEQ ID NO: 1428497 - DNA, 15 bp, Homo sapiens
cctgtgttccagccc

SEQ ID NO: 1428498 - DNA, 22 bp, Homo sapiens
cctgtgttgtctctagagcagg

SEQ ID NO: 1428499 - DNA, 13 bp, Homo sapiens
cctgtgtttctag

SEQ ID NO: 1428500 - DNA, 15 bp, Homo sapiens
cctgttacccagaga

SEQ ID NO: 1428501 - DNA, 14 bp, Homo sapiens
cctgttacttacct

SEQ ID NO: 1428502 - DNA, 20 bp, Homo sapiens
cctgttacttgcttcagtgg

SEQ ID NO: 1428503 - DNA, 14 bp, Homo sapiens
cctgttatttttct

SEQ ID NO: 1428504 - DNA, 15 bp, Homo sapiens
cctgttccccagaga

SEQ ID NO: 1428505 - DNA, 13 bp, Homo sapiens
cctgttccctaga

SEQ ID NO: 1428506 - DNA, 15 bp, Homo sapiens
cctgttccctagaga

SEQ ID NO: 1428507 - DNA, 14 bp, Homo sapiens
cctgttctcctgtc

SEQ ID NO: 1428508 - DNA, 15 bp, Homo sapiens
cctgttctcctgtcc

SEQ ID NO: 1428509 - DNA, 12 bp, Homo sapiens
cctgttctgaaa

SEQ ID NO: 1428510 - DNA, 12 bp, Homo sapiens
cctgttctgctt

SEQ ID NO: 1428511 - DNA, 15 bp, Homo sapiens
cctgttctgcttcga

SEQ ID NO: 1428512 - DNA, 19 bp, Homo sapiens
cctgttcttgggcctcagg

SEQ ID NO: 1428513 - DNA, 23 bp, Homo sapiens
cctgttcttgggcctcaggctct

SEQ ID NO: 1428514 - DNA, 21 bp, Homo sapiens
cctgttgaagattatttcatt

SEQ ID NO: 1428515 - DNA, 22 bp, Homo sapiens
cctgttgaattggtgaataaaa

SEQ ID NO: 1428516 - DNA, 19 bp, Homo sapiens
cctgttgctatagagccta

SEQ ID NO: 1428517 - DNA, 15 bp, Homo sapiens
cctgttgctgtcttc

SEQ ID NO: 1428518 - DNA, 13 bp, Homo sapiens
cctgttggctgct

SEQ ID NO: 1428519 - DNA, 15 bp, Homo sapiens
cctgttggctgctgc

SEQ ID NO: 1428520 - DNA, 16 bp, Homo sapiens
cctgttggctgctgcg

SEQ ID NO: 1428521 - DNA, 19 bp, Homo sapiens
acatagattaatggcactg

SEQ ID NO: 1428522 - DNA, 18 bp, Homo sapiens
acatagcatgacatttct

SEQ ID NO: 1428523 - DNA, 16 bp, Homo sapiens
acatagcatgcttcct

SEQ ID NO: 1428524 - DNA, 20 bp, Homo sapiens
acatagcatgcttcctttct

SEQ ID NO: 1428525 - DNA, 12 bp, Homo sapiens
acatagcctcat

SEQ ID NO: 1428526 - DNA, 19 bp, Homo sapiens
acataggaagggatctgag

SEQ ID NO: 1428527 - DNA, 21 bp, Homo sapiens
acataggaagggatctgagaa

SEQ ID NO: 1428528 - DNA, 16 bp, Homo sapiens
acataggactcaaagt

SEQ ID NO: 1428529 - DNA, 19 bp, Homo sapiens
acataggctggtggccttg

SEQ ID NO: 1428530 - DNA, 20 bp, Homo sapiens
acataggcttcaattggtgg

SEQ ID NO: 1428531 - DNA, 15 bp, Homo sapiens
acatagtaaagtatt

SEQ ID NO: 1428532 - DNA, 13 bp, Homo sapiens
acatagtgaaaat

SEQ ID NO: 1428533 - DNA, 14 bp, Homo sapiens
acatagtgaaaatt

SEQ ID NO: 1428534 - DNA, 20 bp, Homo sapiens
acatagtgggaccctgtctc

SEQ ID NO: 1428535 - DNA, 14 bp, Homo sapiens
acatataacatgca

SEQ ID NO: 1428536 - DNA, 22 bp, Homo sapiens
acatataacatgcaaacaggtt

SEQ ID NO: 1428537 - DNA, 16 bp, Homo sapiens
acatatagaatgcaga

SEQ ID NO: 1428538 - DNA, 22 bp, Homo sapiens
acatatataggcagttgcatgc

SEQ ID NO: 1428539 - DNA, 16 bp, Homo sapiens
acatatatatatataa

SEQ ID NO: 1428540 - DNA, 15 bp, Homo sapiens
acatatatttattga

SEQ ID NO: 1428541 - DNA, 23 bp, Homo sapiens
acatatctagtatgaaattatat

SEQ ID NO: 1428542 - DNA, 15 bp, Homo sapiens
acatatgaaaataca

SEQ ID NO: 1428543 - DNA, 12 bp, Homo sapiens
acatatgaacac

SEQ ID NO: 1428544 - DNA, 15 bp, Homo sapiens
acatatgaacacaga

SEQ ID NO: 1428545 - DNA, 17 bp, Homo sapiens
acatatgcaccttgtgt

SEQ ID NO: 1428546 - DNA, 18 bp, Homo sapiens
acatatgcaccttgtgtc

SEQ ID NO: 1428547 - DNA, 19 bp, Homo sapiens
acatatgcaccttgtgtct

SEQ ID NO: 1428548 - DNA, 17 bp, Homo sapiens
acatatggaattttgca

SEQ ID NO: 1428549 - DNA, 20 bp, Homo sapiens
acatatggaattttgcaaag

SEQ ID NO: 1428550 - DNA, 18 bp, Homo sapiens
acatatgtaacagtcaaa

SEQ ID NO: 1428551 - DNA, 21 bp, Homo sapiens
acatatgtaacagtcaaatat

SEQ ID NO: 1428552 - DNA, 12 bp, Homo sapiens
acatatgtaatt

SEQ ID NO: 1428553 - DNA, 15 bp, Homo sapiens
acatatgtaattctt

SEQ ID NO: 1428554 - DNA, 23 bp, Homo sapiens
acatatgtagatattgttttctg

SEQ ID NO: 1428555 - DNA, 17 bp, Homo sapiens
acatatgtatacatgtg

SEQ ID NO: 1428556 - DNA, 19 bp, Homo sapiens
acatattactgttgcattt

SEQ ID NO: 1428557 - DNA, 13 bp, Homo sapiens
acatattcatgaa

SEQ ID NO: 1428558 - DNA, 21 bp, Homo sapiens
acatattcttgctttcacaaa

SEQ ID NO: 1428559 - DNA, 18 bp, Homo sapiens
acatattgtatatatatt

SEQ ID NO: 1428560 - DNA, 20 bp, Homo sapiens
acatatttttatactttatt

SEQ ID NO: 1428561 - DNA, 17 bp, Homo sapiens
acatcaaacctttgagt

SEQ ID NO: 1428562 - DNA, 16 bp, Homo sapiens
acatcaaagcttcttc

SEQ ID NO: 1428563 - DNA, 17 bp, Homo sapiens
acatcaaatatttcttg

SEQ ID NO: 1428564 - DNA, 18 bp, Homo sapiens
acatcaagtccatctgac

SEQ ID NO: 1428565 - DNA, 19 bp, Homo sapiens
acatcaagtccatctgaca

SEQ ID NO: 1428566 - DNA, 20 bp, Homo sapiens
acatcaagtccatctgacaa

SEQ ID NO: 1428567 - DNA, 21 bp, Homo sapiens
acatcaagtccatctgacaaa

SEQ ID NO: 1428568 - DNA, 15 bp, Homo sapiens
acatcaatcctggta

SEQ ID NO: 1428569 - DNA, 18 bp, Homo sapiens
acatcacagggtgggcct

SEQ ID NO: 1428570 - DNA, 12 bp, Homo sapiens
acatcaccagtc

SEQ ID NO: 1428571 - DNA, 13 bp, Homo sapiens
acatcaccagtcc

SEQ ID NO: 1428572 - DNA, 15 bp, Homo sapiens
acatcacttgtacaa

SEQ ID NO: 1428573 - DNA, 11 bp, Homo sapiens
acatcagaaag

SEQ ID NO: 1428574 - DNA, 13 bp, Homo sapiens
acatcagaaagga

SEQ ID NO: 1428575 - DNA, 16 bp, Homo sapiens
acatcagacctgtctt

SEQ ID NO: 1428576 - DNA, 20 bp, Homo sapiens
acatcagacctgtcttccaa

SEQ ID NO: 1428577 - DNA, 18 bp, Homo sapiens
acatcagcaagactttat

SEQ ID NO: 1428578 - DNA, 19 bp, Homo sapiens
acatcagcaatttcagaac

SEQ ID NO: 1428579 - DNA, 12 bp, Homo sapiens
acatcagccttc

SEQ ID NO: 1428580 - DNA, 20 bp, Homo sapiens
acatcagccttcaagaatca

SEQ ID NO: 1428581 - DNA, 14 bp, Homo sapiens
acatcagctgaatt

SEQ ID NO: 1428582 - DNA, 15 bp, Homo sapiens
acatcaggagactgg

SEQ ID NO: 1428583 - DNA, 21 bp, Homo sapiens
acatcaggagactgggctctg

SEQ ID NO: 1428584 - DNA, 16 bp, Homo sapiens
acatcagtgaggaggg

SEQ ID NO: 1428585 - DNA, 20 bp, Homo sapiens
acatcagtgaggagggatgt

SEQ ID NO: 1428586 - DNA, 18 bp, Homo sapiens
acatcataattacattcc

SEQ ID NO: 1428587 - DNA, 14 bp, Homo sapiens
acatcatgttattt

SEQ ID NO: 1428588 - DNA, 21 bp, Homo sapiens
acatcatttctttttgggaga

SEQ ID NO: 1428589 - DNA, 22 bp, Homo sapiens
acatcatttctttttgggagag

SEQ ID NO: 1428590 - DNA, 16 bp, Homo sapiens
acatccaagccagagt

SEQ ID NO: 1428591 - DNA, 12 bp, Homo sapiens
acatccatccct

SEQ ID NO: 1428592 - DNA, 15 bp, Homo sapiens
acatccatccctcca

SEQ ID NO: 1428593 - DNA, 16 bp, Homo sapiens
acatcccattgccctg

SEQ ID NO: 1428594 - DNA, 13 bp, Homo sapiens
acatcccattggg

SEQ ID NO: 1428595 - DNA, 17 bp, Homo sapiens
acatccccagagcccag

SEQ ID NO: 1428596 - DNA, 15 bp, Homo sapiens
acatccccaggtctc

SEQ ID NO: 1428597 - DNA, 23 bp, Homo sapiens
acatccctacaaaaaattagaaa

SEQ ID NO: 1428598 - DNA, 19 bp, Homo sapiens
acatccctcccccagcaga

SEQ ID NO: 1428599 - DNA, 14 bp, Homo sapiens
acatcccttcctgg

SEQ ID NO: 1428600 - DNA, 17 bp, Homo sapiens
acatcccttcctggaaa

SEQ ID NO: 1428601 - DNA, 19 bp, Homo sapiens
acatcccttcctggaaaca

SEQ ID NO: 1428602 - DNA, 20 bp, Homo sapiens
acatcccttcctggaaacag

SEQ ID NO: 1428603 - DNA, 23 bp, Homo sapiens
acatcccttcctggaaacagcat

SEQ ID NO: 1428604 - DNA, 22 bp, Homo sapiens
acatccgcgtgtgcctgtgtgc

SEQ ID NO: 1428605 - DNA, 21 bp, Homo sapiens
acatccgtcattgctgctgct

SEQ ID NO: 1428606 - DNA, 17 bp, Homo sapiens
acatcctccgtccagcc

SEQ ID NO: 1428607 - DNA, 13 bp, Homo sapiens
acatcctcctccc

SEQ ID NO: 1428608 - DNA, 15 bp, Homo sapiens
cctgggcctgtgcag

SEQ ID NO: 1428609 - DNA, 21 bp, Homo sapiens
cctgggcctgtgcagcagccc

SEQ ID NO: 1428610 - DNA, 20 bp, Homo sapiens
cctgggcgagcccctccttc

SEQ ID NO: 1428611 - DNA, 22 bp, Homo sapiens
cctgggcgagcccctccttctc

SEQ ID NO: 1428612 - DNA, 23 bp, Homo sapiens
cctgggcgagcccctccttctcc

SEQ ID NO: 1428613 - DNA, 15 bp, Homo sapiens
cctgggcgccctgga

SEQ ID NO: 1428614 - DNA, 14 bp, Homo sapiens
cctgggctatattc

SEQ ID NO: 1428615 - DNA, 14 bp, Homo sapiens
cctgggctcaaatg

SEQ ID NO: 1428616 - DNA, 17 bp, Homo sapiens
cctgggctcactgtgct

SEQ ID NO: 1428617 - DNA, 18 bp, Homo sapiens
cctgggctcactgtgctg

SEQ ID NO: 1428618 - DNA, 22 bp, Homo sapiens
cctgggctcactgtgctggggc

SEQ ID NO: 1428619 - DNA, 17 bp, Homo sapiens
cctgggctccacacagc

SEQ ID NO: 1428620 - DNA, 21 bp, Homo sapiens
cctgggctccacacagcagtg

SEQ ID NO: 1428621 - DNA, 15 bp, Homo sapiens
cctgggctctcaccc

SEQ ID NO: 1428622 - DNA, 21 bp, Homo sapiens
cctgggctctcacccagtccc

SEQ ID NO: 1428623 - DNA, 12 bp, Homo sapiens
cctgggctctgc

SEQ ID NO: 1428624 - DNA, 20 bp, Homo sapiens
cctgggctctgccccagctc

SEQ ID NO: 1428625 - DNA, 24 bp, Homo sapiens
cctgggctctgccccagctctggc

SEQ ID NO: 1428626 - DNA, 20 bp, Homo sapiens
cctgggctggaatcaggaat

SEQ ID NO: 1428627 - DNA, 14 bp, Homo sapiens
cctgggctgggaaa

SEQ ID NO: 1428628 - DNA, 15 bp, Homo sapiens
cctgggctggggagg

SEQ ID NO: 1428629 - DNA, 21 bp, Homo sapiens
cctgggctggggaggaggaga

SEQ ID NO: 1428630 - DNA, 21 bp, Homo sapiens
cctgggctgggtggcccctgt

SEQ ID NO: 1428631 - DNA, 14 bp, Homo sapiens
cctgggctgtgcta

SEQ ID NO: 1428632 - DNA, 18 bp, Homo sapiens
cctgggctgttggcactc

SEQ ID NO: 1428633 - DNA, 20 bp, Homo sapiens
cctgggctgttggcactcac

SEQ ID NO: 1428634 - DNA, 13 bp, Homo sapiens
cctggggaaggag

SEQ ID NO: 1428635 - DNA, 19 bp, Homo sapiens
cctggggaccaggagctag

SEQ ID NO: 1428636 - DNA, 19 bp, Homo sapiens
cctggggaccccacttcag

SEQ ID NO: 1428637 - DNA, 19 bp, Homo sapiens
cctggggacgaattccact

SEQ ID NO: 1428638 - DNA, 21 bp, Homo sapiens
cctggggacgaattccactcg

SEQ ID NO: 1428639 - DNA, 21 bp, Homo sapiens
cctggggagcttttgcccaca

SEQ ID NO: 1428640 - DNA, 21 bp, Homo sapiens
cctggggatcttcccacagga

SEQ ID NO: 1428641 - DNA, 19 bp, Homo sapiens
cctggggatgtaaccaagc

SEQ ID NO: 1428642 - DNA, 22 bp, Homo sapiens
cctggggatgtaaccaagctgt

SEQ ID NO: 1428643 - DNA, 16 bp, Homo sapiens
cctggggcagcactcc

SEQ ID NO: 1428644 - DNA, 12 bp, Homo sapiens
cctggggccccg

SEQ ID NO: 1428645 - DNA, 17 bp, Homo sapiens
cctggggccccgctggg

SEQ ID NO: 1428646 - DNA, 22 bp, Homo sapiens
cctggggcctcggagcctcatc

SEQ ID NO: 1428647 - DNA, 16 bp, Homo sapiens
cctggggcctgactgc

SEQ ID NO: 1428648 - DNA, 17 bp, Homo sapiens
cctggggcctgactgct

SEQ ID NO: 1428649 - DNA, 16 bp, Homo sapiens
cctggggcctggacct

SEQ ID NO: 1428650 - DNA, 18 bp, Homo sapiens
cctggggcctggacctgc

SEQ ID NO: 1428651 - DNA, 19 bp, Homo sapiens
cctggggcctggacctgcc

SEQ ID NO: 1428652 - DNA, 14 bp, Homo sapiens
cctggggctccctc

SEQ ID NO: 1428653 - DNA, 15 bp, Homo sapiens
cctggggctcctttc

SEQ ID NO: 1428654 - DNA, 21 bp, Homo sapiens
cctggggctcctttctccagc

SEQ ID NO: 1428655 - DNA, 22 bp, Homo sapiens
cctggggctcctttctccagcc

SEQ ID NO: 1428656 - DNA, 18 bp, Homo sapiens
cctggggctctgtgcagg

SEQ ID NO: 1428657 - DNA, 15 bp, Homo sapiens
cctggggctgatctc

SEQ ID NO: 1428658 - DNA, 20 bp, Homo sapiens
cctggggctgatctcaggga

SEQ ID NO: 1428659 - DNA, 22 bp, Homo sapiens
cctggggctgatctcagggaag

SEQ ID NO: 1428660 - DNA, 16 bp, Homo sapiens
cctgggggaagccctg

SEQ ID NO: 1428661 - DNA, 17 bp, Homo sapiens
cctgggggaagccctgg

SEQ ID NO: 1428662 - DNA, 18 bp, Homo sapiens
cctgggggcacaggaggc

SEQ ID NO: 1428663 - DNA, 19 bp, Homo sapiens
cctgggggccccaggatgg

SEQ ID NO: 1428664 - DNA, 21 bp, Homo sapiens
cctgggggcttttgccactcc

SEQ ID NO: 1428665 - DNA, 15 bp, Homo sapiens
cctggggtgacctct

SEQ ID NO: 1428666 - DNA, 18 bp, Homo sapiens
cctggggtgcatctcctc

SEQ ID NO: 1428667 - DNA, 19 bp, Homo sapiens
cctggggtggcgtctgcct

SEQ ID NO: 1428668 - DNA, 22 bp, Homo sapiens
cctggggtggcgtctgcctagg

SEQ ID NO: 1428669 - DNA, 19 bp, Homo sapiens
cctggggtgggatctgagc

SEQ ID NO: 1428670 - DNA, 23 bp, Homo sapiens
cctggggtgggatctgagctccc

SEQ ID NO: 1428671 - DNA, 21 bp, Homo sapiens
cctgggtaccctgagcccacc

SEQ ID NO: 1428672 - DNA, 18 bp, Homo sapiens
cctgggtactgaaagcct

SEQ ID NO: 1428673 - DNA, 20 bp, Homo sapiens
cctgggtatcccctgcctcc

SEQ ID NO: 1428674 - DNA, 17 bp, Homo sapiens
cctgggtcacagagtga

SEQ ID NO: 1428675 - DNA, 17 bp, Homo sapiens
cctgggtcctgcctggt

SEQ ID NO: 1428676 - DNA, 15 bp, Homo sapiens
cctgggtgacagagt

SEQ ID NO: 1428677 - DNA, 18 bp, Homo sapiens
cctgggtgacagagtgag

SEQ ID NO: 1428678 - DNA, 18 bp, Homo sapiens
cctgggtgccattcccag

SEQ ID NO: 1428679 - DNA, 23 bp, Homo sapiens
cctgggtgctggctgcccagacc

SEQ ID NO: 1428680 - DNA, 15 bp, Homo sapiens
cctgggtgggctctg

SEQ ID NO: 1428681 - DNA, 17 bp, Homo sapiens
cctgggtggggctgctc

SEQ ID NO: 1428682 - DNA, 19 bp, Homo sapiens
cctgggtggggctgctcct

SEQ ID NO: 1428683 - DNA, 20 bp, Homo sapiens
cctgggtggggctgctcctc

SEQ ID NO: 1428684 - DNA, 20 bp, Homo sapiens
cctgggtgggtggggtacag

SEQ ID NO: 1428685 - DNA, 17 bp, Homo sapiens
cctgggttaacaaatga

SEQ ID NO: 1428686 - DNA, 18 bp, Homo sapiens
cctgggttaacaaatgag

SEQ ID NO: 1428687 - DNA, 22 bp, Homo sapiens
cctgggttagggtgtgtgttca

SEQ ID NO: 1428688 - DNA, 19 bp, Homo sapiens
cctgggttcagaaatgctg

SEQ ID NO: 1428689 - DNA, 23 bp, Homo sapiens
cctgggttcagaaatgctgcctg

SEQ ID NO: 1428690 - DNA, 20 bp, Homo sapiens
cctggtaaccaaatattaaa

SEQ ID NO: 1428691 - DNA, 22 bp, Homo sapiens
cctggtaaccaaatattaaaga

SEQ ID NO: 1428692 - DNA, 23 bp, Homo sapiens
cctggtaagggggtccctgtgct

SEQ ID NO: 1428693 - DNA, 20 bp, Homo sapiens
cctggtacccagccatctgc

SEQ ID NO: 1428694 - DNA, 22 bp, Homo sapiens
cctggtacccagccatctgccc

SEQ ID NO: 1428695 - DNA, 13 bp, Homo sapiens
cctggtacctgga

SEQ ID NO: 1428696 - DNA, 19 bp, Homo sapiens
cctggtagtgtagctgtgt

SEQ ID NO: 1428697 - DNA, 22 bp, Homo sapiens
cctggtagtgtagctgtgtggc

SEQ ID NO: 1428698 - DNA, 13 bp, Homo sapiens
cctggtattttca

SEQ ID NO: 1428699 - DNA, 22 bp, Homo sapiens
cctggtcacccgactttggaat

SEQ ID NO: 1428700 - DNA, 15 bp, Homo sapiens
cctggtccctcgtcc

SEQ ID NO: 1428701 - DNA, 19 bp, Homo sapiens
cctggtccctcgtccacag

SEQ ID NO: 1428702 - DNA, 13 bp, Homo sapiens
cctggtccctggt

SEQ ID NO: 1428703 - DNA, 19 bp, Homo sapiens
cctggtcctccgcctactg

SEQ ID NO: 1428704 - DNA, 20 bp, Homo sapiens
cctggtcctccgcctactgt

SEQ ID NO: 1428705 - DNA, 15 bp, Homo sapiens
cctggtcctgacttc

SEQ ID NO: 1428706 - DNA, 17 bp, Homo sapiens
cctggtcctgacttccc

SEQ ID NO: 1428707 - DNA, 23 bp, Homo sapiens
cctggtcctggcctccttccccg

SEQ ID NO: 1428708 - DNA, 16 bp, Homo sapiens
cctggtccttcactgg

SEQ ID NO: 1428709 - DNA, 18 bp, Homo sapiens
cctggtccttccaggccc

SEQ ID NO: 1428710 - DNA, 21 bp, Homo sapiens
cctggtctgaggatgtagaga

SEQ ID NO: 1428711 - DNA, 18 bp, Homo sapiens
cctggtctgtctggatcc

SEQ ID NO: 1428712 - DNA, 14 bp, Homo sapiens
cctggtgagaactg

SEQ ID NO: 1428713 - DNA, 16 bp, Homo sapiens
cctggtgcattgctgt

SEQ ID NO: 1428714 - DNA, 22 bp, Homo sapiens
cctggtgccccccacccctgga

SEQ ID NO: 1428715 - DNA, 17 bp, Homo sapiens
cctggtgcgggcctggc

SEQ ID NO: 1428716 - DNA, 19 bp, Homo sapiens
cctggtgcgggcctggccc

SEQ ID NO: 1428717 - DNA, 12 bp, Homo sapiens
cctggtgctctc

SEQ ID NO: 1428718 - DNA, 15 bp, Homo sapiens
cctggtgctctctgc

SEQ ID NO: 1428719 - DNA, 21 bp, Homo sapiens
cctggtgctgccacacttcag

SEQ ID NO: 1428720 - DNA, 20 bp, Homo sapiens
cctggtggacagtcctggga

SEQ ID NO: 1428721 - DNA, 18 bp, Homo sapiens
cctggtgggcctcctctg

SEQ ID NO: 1428722 - DNA, 13 bp, Homo sapiens
cctggtggggctg

SEQ ID NO: 1428723 - DNA, 23 bp, Homo sapiens
acatcctgtgtttctagggaaat

SEQ ID NO: 1428724 - DNA, 13 bp, Homo sapiens
acatccttccttc

SEQ ID NO: 1428725 - DNA, 18 bp, Homo sapiens
acatccttggactgagaa

SEQ ID NO: 1428726 - DNA, 19 bp, Homo sapiens
acatcctttctaaacaaga

SEQ ID NO: 1428727 - DNA, 14 bp, Homo sapiens
acatcgaatgtgta

SEQ ID NO: 1428728 - DNA, 19 bp, Homo sapiens
acatcgatatacatttatt

SEQ ID NO: 1428729 - DNA, 21 bp, Homo sapiens
acatcgcaatagttttttact

SEQ ID NO: 1428730 - DNA, 15 bp, Homo sapiens
acatcggaaaaataa

SEQ ID NO: 1428731 - DNA, 21 bp, Homo sapiens
acatcgtaggcagccacggcc

SEQ ID NO: 1428732 - DNA, 17 bp, Homo sapiens
acatctaagtcagtttc

SEQ ID NO: 1428733 - DNA, 16 bp, Homo sapiens
acatctcgagccccct

SEQ ID NO: 1428734 - DNA, 12 bp, Homo sapiens
acatctcgggag

SEQ ID NO: 1428735 - DNA, 12 bp, Homo sapiens
acatctctgaat

SEQ ID NO: 1428736 - DNA, 13 bp, Homo sapiens
acatctcttgaaa

SEQ ID NO: 1428737 - DNA, 12 bp, Homo sapiens
acatctgaaaag

SEQ ID NO: 1428738 - DNA, 13 bp, Homo sapiens
acatctgaaagcc

SEQ ID NO: 1428739 - DNA, 12 bp, Homo sapiens
acatctgataac

SEQ ID NO: 1428740 - DNA, 11 bp, Homo sapiens
acatctgcctt

SEQ ID NO: 1428741 - DNA, 14 bp, Homo sapiens
acatctgctctagg

SEQ ID NO: 1428742 - DNA, 20 bp, Homo sapiens
acatcttaaatctaaacaaa

SEQ ID NO: 1428743 - DNA, 14 bp, Homo sapiens
acatcttgaatcct

SEQ ID NO: 1428744 - DNA, 19 bp, Homo sapiens
acatcttgaatccttccat

SEQ ID NO: 1428745 - DNA, 22 bp, Homo sapiens
acatctttaacatagtcctgtt

SEQ ID NO: 1428746 - DNA, 11 bp, Homo sapiens
acatctttaag

SEQ ID NO: 1428747 - DNA, 20 bp, Homo sapiens
acatctttaaggggaggaac

SEQ ID NO: 1428748 - DNA, 19 bp, Homo sapiens
acatcttttttcacaaatt

SEQ ID NO: 1428749 - DNA, 20 bp, Homo sapiens
acatgaaaacaagaaagaaa

SEQ ID NO: 1428750 - DNA, 13 bp, Homo sapiens
acatgaaacagaa

SEQ ID NO: 1428751 - DNA, 18 bp, Homo sapiens
acatgaaacctacacact

SEQ ID NO: 1428752 - DNA, 22 bp, Homo sapiens
acatgaaactgcctattcacgc

SEQ ID NO: 1428753 - DNA, 16 bp, Homo sapiens
acatgaaagttttgca

SEQ ID NO: 1428754 - DNA, 16 bp, Homo sapiens
acatgaaataatgcac

SEQ ID NO: 1428755 - DNA, 18 bp, Homo sapiens
acatgaaataatgcactg

SEQ ID NO: 1428756 - DNA, 18 bp, Homo sapiens
acatgaaatgcttccaag

SEQ ID NO: 1428757 - DNA, 19 bp, Homo sapiens
acatgaacacccttagaaa

SEQ ID NO: 1428758 - DNA, 15 bp, Homo sapiens
acatgaacagcttgc

SEQ ID NO: 1428759 - DNA, 16 bp, Homo sapiens
acatgaagaagctaaa

SEQ ID NO: 1428760 - DNA, 17 bp, Homo sapiens
acatgaagctgtataat

SEQ ID NO: 1428761 - DNA, 15 bp, Homo sapiens
acatgaaggtaaata

SEQ ID NO: 1428762 - DNA, 21 bp, Homo sapiens
acatgaaggtaaataaaaaga

SEQ ID NO: 1428763 - DNA, 20 bp, Homo sapiens
acatgaatcccacccacatg

SEQ ID NO: 1428764 - DNA, 21 bp, Homo sapiens
acatgaatcccacccacatgt

SEQ ID NO: 1428765 - DNA, 23 bp, Homo sapiens
acatgaatcccacccacatgtga

SEQ ID NO: 1428766 - DNA, 11 bp, Homo sapiens
acatgacactg

SEQ ID NO: 1428767 - DNA, 17 bp, Homo sapiens
acatgacccagcctgaa

SEQ ID NO: 1428768 - DNA, 15 bp, Homo sapiens
acatgagatggagag

SEQ ID NO: 1428769 - DNA, 14 bp, Homo sapiens
acatgagatttata

SEQ ID NO: 1428770 - DNA, 17 bp, Homo sapiens
acatgaggaactgtaga

SEQ ID NO: 1428771 - DNA, 18 bp, Homo sapiens
acatgaggaactgtagat

SEQ ID NO: 1428772 - DNA, 21 bp, Homo sapiens
acatgaggaactgtagatgat

SEQ ID NO: 1428773 - DNA, 22 bp, Homo sapiens
acatgaggaactgtagatgatg

SEQ ID NO: 1428774 - DNA, 19 bp, Homo sapiens
acatgaggacagaaggact

SEQ ID NO: 1428775 - DNA, 19 bp, Homo sapiens
acatgaggactcatatatt

SEQ ID NO: 1428776 - DNA, 22 bp, Homo sapiens
acatgaggccatctcaggagat

SEQ ID NO: 1428777 - DNA, 15 bp, Homo sapiens
acatgagtcaaaaca

SEQ ID NO: 1428778 - DNA, 16 bp, Homo sapiens
acatgagtcaaaacaa

SEQ ID NO: 1428779 - DNA, 17 bp, Homo sapiens
acatgagtcaaaacaaa

SEQ ID NO: 1428780 - DNA, 13 bp, Homo sapiens
acatgcaataaaa

SEQ ID NO: 1428781 - DNA, 15 bp, Homo sapiens
acatgcaataaaatt

SEQ ID NO: 1428782 - DNA, 18 bp, Homo sapiens
acatgcacacgggcgagc

SEQ ID NO: 1428783 - DNA, 14 bp, Homo sapiens
acatgcacatttat

SEQ ID NO: 1428784 - DNA, 18 bp, Homo sapiens
acatgcacattttgtaca

SEQ ID NO: 1428785 - DNA, 22 bp, Homo sapiens
acatgcagcccatgcccacctg

SEQ ID NO: 1428786 - DNA, 14 bp, Homo sapiens
acatgccccaggct

SEQ ID NO: 1428787 - DNA, 15 bp, Homo sapiens
acatgccgcagggag

SEQ ID NO: 1428788 - DNA, 22 bp, Homo sapiens
acatgcctgccccaaacaaata

SEQ ID NO: 1428789 - DNA, 17 bp, Homo sapiens
acatgctaaatagttct

SEQ ID NO: 1428790 - DNA, 20 bp, Homo sapiens
acatgctactaaatttttat

SEQ ID NO: 1428791 - DNA, 13 bp, Homo sapiens
acatgctcacaca

SEQ ID NO: 1428792 - DNA, 15 bp, Homo sapiens
acatgctggaaataa

SEQ ID NO: 1428793 - DNA, 20 bp, Homo sapiens
acatgctggaaataaaacag

SEQ ID NO: 1428794 - DNA, 15 bp, Homo sapiens
acatgctgtctggcc

SEQ ID NO: 1428795 - DNA, 17 bp, Homo sapiens
acatgctgtctggccct

SEQ ID NO: 1428796 - DNA, 19 bp, Homo sapiens
acatgctgtctggccctgg

SEQ ID NO: 1428797 - DNA, 16 bp, Homo sapiens
acatgctgtgctcttt

SEQ ID NO: 1428798 - DNA, 17 bp, Homo sapiens
acatgctgtgctctttg

SEQ ID NO: 1428799 - DNA, 16 bp, Homo sapiens
acatgcttgaataact

SEQ ID NO: 1428800 - DNA, 17 bp, Homo sapiens
acatggaactcattcct

SEQ ID NO: 1428801 - DNA, 21 bp, Homo sapiens
acatggaatcgaagtgtttat

SEQ ID NO: 1428802 - DNA, 15 bp, Homo sapiens
acatggacagacttc

SEQ ID NO: 1428803 - DNA, 19 bp, Homo sapiens
acatggacccactaccctt

SEQ ID NO: 1428804 - DNA, 23 bp, Homo sapiens
acatggacccactacccttctcc

SEQ ID NO: 1428805 - DNA, 18 bp, Homo sapiens
acatggacttgtatattt

SEQ ID NO: 1428806 - DNA, 23 bp, Homo sapiens
acatggacttgtatatttgtaca

SEQ ID NO: 1428807 - DNA, 15 bp, Homo sapiens
acatggagaaatcta

SEQ ID NO: 1428808 - DNA, 21 bp, Homo sapiens
acatggagactcctgccctgt

SEQ ID NO: 1428809 - DNA, 18 bp, Homo sapiens
acatggaggttctaaggc

SEQ ID NO: 1428810 - DNA, 15 bp, Homo sapiens
acatggagtatatgt

SEQ ID NO: 1428811 - DNA, 19 bp, Homo sapiens
acatggccatagaggccca

SEQ ID NO: 1428812 - DNA, 22 bp, Homo sapiens
acatggcccctccccctgccag

SEQ ID NO: 1428813 - DNA, 22 bp, Homo sapiens
acatggccgggccctctgtagc

SEQ ID NO: 1428814 - DNA, 18 bp, Homo sapiens
acatggcctatgcacata

SEQ ID NO: 1428815 - DNA, 20 bp, Homo sapiens
acatggcctatgcacatatg

SEQ ID NO: 1428816 - DNA, 19 bp, Homo sapiens
acatggcttaatcttattt

SEQ ID NO: 1428817 - DNA, 22 bp, Homo sapiens
acatgggaaaggaggcatgcct

SEQ ID NO: 1428818 - DNA, 14 bp, Homo sapiens
acatgggcttgtga

SEQ ID NO: 1428819 - DNA, 17 bp, Homo sapiens
acatggggcctggccca

SEQ ID NO: 1428820 - DNA, 16 bp, Homo sapiens
acatgggtattttata

SEQ ID NO: 1428821 - DNA, 18 bp, Homo sapiens
acatggtgaaacccccat

SEQ ID NO: 1428822 - DNA, 18 bp, Homo sapiens
acatggtgcctgagaggc

SEQ ID NO: 1428823 - DNA, 19 bp, Homo sapiens
acatggtgcctgagaggca

SEQ ID NO: 1428824 - DNA, 16 bp, Homo sapiens
acatggtgtctcacac

SEQ ID NO: 1428825 - DNA, 18 bp, Homo sapiens
acatggttgtgacctgag

SEQ ID NO: 1428826 - DNA, 20 bp, Homo sapiens
acatggtttaaatatgaatg

SEQ ID NO: 1428827 - DNA, 15 bp, Homo sapiens
acatgtaaaatatgt

SEQ ID NO: 1428828 - DNA, 16 bp, Homo sapiens
acatgtaagaaaatgt

SEQ ID NO: 1428829 - DNA, 18 bp, Homo sapiens
acatgtaagaaaatgtta

SEQ ID NO: 1428830 - DNA, 19 bp, Homo sapiens
acatgtaagaaaatgttac

SEQ ID NO: 1428831 - DNA, 14 bp, Homo sapiens
acatgtaataaatt

SEQ ID NO: 1428832 - DNA, 18 bp, Homo sapiens
acatgtaataaattcaaa

SEQ ID NO: 1428833 - DNA, 18 bp, Homo sapiens
acatgtaatataaagatg

SEQ ID NO: 1428834 - DNA, 15 bp, Homo sapiens
acatgtaattaagta

SEQ ID NO: 1428835 - DNA, 19 bp, Homo sapiens
acatgtaattaagtactat

SEQ ID NO: 1428836 - DNA, 21 bp, Homo sapiens
acatgtaattaagtactatgt

SEQ ID NO: 1428837 - DNA, 23 bp, Homo sapiens
acatgtaattaagtactatgtat

SEQ ID NO: 1428838 - DNA, 19 bp, Homo sapiens
acatgtacatagtaaagta

SEQ ID NO: 1428839 - DNA, 18 bp, Homo sapiens
cctggaccttgacagagc

SEQ ID NO: 1428840 - DNA, 22 bp, Homo sapiens
cctggacgaagagcaggccagc

SEQ ID NO: 1428841 - DNA, 20 bp, Homo sapiens
cctggactaaaggcatcctt

SEQ ID NO: 1428842 - DNA, 13 bp, Homo sapiens
cctggactcccct

SEQ ID NO: 1428843 - DNA, 14 bp, Homo sapiens
cctggactcccctc

SEQ ID NO: 1428844 - DNA, 21 bp, Homo sapiens
cctggactctaagctggagct

SEQ ID NO: 1428845 - DNA, 13 bp, Homo sapiens
cctggactgacca

SEQ ID NO: 1428846 - DNA, 18 bp, Homo sapiens
cctggactgactgcagcc

SEQ ID NO: 1428847 - DNA, 19 bp, Homo sapiens
cctggactgactgcagccc

SEQ ID NO: 1428848 - DNA, 22 bp, Homo sapiens
cctggactgactgcagccccct

SEQ ID NO: 1428849 - DNA, 20 bp, Homo sapiens
cctggacttaagcatctggc

SEQ ID NO: 1428850 - DNA, 14 bp, Homo sapiens
cctggacttcctgt

SEQ ID NO: 1428851 - DNA, 15 bp, Homo sapiens
cctggacttcctgtc

SEQ ID NO: 1428852 - DNA, 16 bp, Homo sapiens
cctggacttgcctctg

SEQ ID NO: 1428853 - DNA, 16 bp, Homo sapiens
cctggagaactagaga

SEQ ID NO: 1428854 - DNA, 17 bp, Homo sapiens
cctggagacaaggtgct

SEQ ID NO: 1428855 - DNA, 18 bp, Homo sapiens
cctggagacaaggtgcta

SEQ ID NO: 1428856 - DNA, 20 bp, Homo sapiens
cctggagacaaggtgctaac

SEQ ID NO: 1428857 - DNA, 19 bp, Homo sapiens
cctggagacttagggcacc

SEQ ID NO: 1428858 - DNA, 23 bp, Homo sapiens
cctggagacttagggcaccaggg

SEQ ID NO: 1428859 - DNA, 22 bp, Homo sapiens
cctggagagtacatttgcttta

SEQ ID NO: 1428860 - DNA, 16 bp, Homo sapiens
cctggagatcctcctg

SEQ ID NO: 1428861 - DNA, 15 bp, Homo sapiens
cctggagatgcagct

SEQ ID NO: 1428862 - DNA, 18 bp, Homo sapiens
cctggagcagaccacccc

SEQ ID NO: 1428863 - DNA, 15 bp, Homo sapiens
cctggagcaggagcc

SEQ ID NO: 1428864 - DNA, 12 bp, Homo sapiens
cctggagccaga

SEQ ID NO: 1428865 - DNA, 17 bp, Homo sapiens
cctggagccagggcaga

SEQ ID NO: 1428866 - DNA, 21 bp, Homo sapiens
cctggagccagggcagaggaa

SEQ ID NO: 1428867 - DNA, 13 bp, Homo sapiens
cctggagccatcc

SEQ ID NO: 1428868 - DNA, 16 bp, Homo sapiens
cctggagcccacaacc

SEQ ID NO: 1428869 - DNA, 11 bp, Homo sapiens
cctggagcccc

SEQ ID NO: 1428870 - DNA, 22 bp, Homo sapiens
cctggagcccctgggtgggtgg

SEQ ID NO: 1428871 - DNA, 14 bp, Homo sapiens
cctggagctctgtg

SEQ ID NO: 1428872 - DNA, 18 bp, Homo sapiens
cctggagctgtccttcat

SEQ ID NO: 1428873 - DNA, 15 bp, Homo sapiens
cctggcgcctggcag

SEQ ID NO: 1428874 - DNA, 20 bp, Homo sapiens
cctggctaatttttgtattt

SEQ ID NO: 1428875 - DNA, 18 bp, Homo sapiens
cctggctacatcccagcc

SEQ ID NO: 1428876 - DNA, 23 bp, Homo sapiens
cctggctacatcccagcctgtgg

SEQ ID NO: 1428877 - DNA, 12 bp, Homo sapiens
cctggctagatg

SEQ ID NO: 1428878 - DNA, 14 bp, Homo sapiens
cctggctcactggc

SEQ ID NO: 1428879 - DNA, 12 bp, Homo sapiens
cctggctccact

SEQ ID NO: 1428880 - DNA, 14 bp, Homo sapiens
cctggctccactct

SEQ ID NO: 1428881 - DNA, 19 bp, Homo sapiens
cctggctccactcttgatc

SEQ ID NO: 1428882 - DNA, 21 bp, Homo sapiens
cctggctccactcttgatctc

SEQ ID NO: 1428883 - DNA, 17 bp, Homo sapiens
cctggctcccacaggcc

SEQ ID NO: 1428884 - DNA, 14 bp, Homo sapiens
cctggctcccagga

SEQ ID NO: 1428885 - DNA, 15 bp, Homo sapiens
cctggctcccatgac

SEQ ID NO: 1428886 - DNA, 22 bp, Homo sapiens
cctggctcccatgaccatactg

SEQ ID NO: 1428887 - DNA, 22 bp, Homo sapiens
cctggctccccacgagtcacct

SEQ ID NO: 1428888 - DNA, 23 bp, Homo sapiens
cctggctccccacgagtcacctg

SEQ ID NO: 1428889 - DNA, 14 bp, Homo sapiens
cctggctccctcct

SEQ ID NO: 1428890 - DNA, 22 bp, Homo sapiens
cctggctccctcctccaggcct

SEQ ID NO: 1428891 - DNA, 15 bp, Homo sapiens
cctggctctaccctg

SEQ ID NO: 1428892 - DNA, 16 bp, Homo sapiens
cctggctctcagaagg

SEQ ID NO: 1428893 - DNA, 17 bp, Homo sapiens
cctggctctcagaggaa

SEQ ID NO: 1428894 - DNA, 13 bp, Homo sapiens
cctggctctgggc

SEQ ID NO: 1428895 - DNA, 20 bp, Homo sapiens
cctggctgaggttcctctgc

SEQ ID NO: 1428896 - DNA, 13 bp, Homo sapiens
cctggctgccagg

SEQ ID NO: 1428897 - DNA, 23 bp, Homo sapiens
cctggctgcccatcatgtggccc

SEQ ID NO: 1428898 - DNA, 15 bp, Homo sapiens
cctggctgccctggc

SEQ ID NO: 1428899 - DNA, 16 bp, Homo sapiens
cctggctgccctggcc

SEQ ID NO: 1428900 - DNA, 17 bp, Homo sapiens
cctggctgccctggccc

SEQ ID NO: 1428901 - DNA, 20 bp, Homo sapiens
cctggctgccctggccctga

SEQ ID NO: 1428902 - DNA, 21 bp, Homo sapiens
cctggctgctgcccccacccc

SEQ ID NO: 1428903 - DNA, 18 bp, Homo sapiens
cctggctgtgacacctgg

SEQ ID NO: 1428904 - DNA, 19 bp, Homo sapiens
cctggctgtgacacctggt

SEQ ID NO: 1428905 - DNA, 18 bp, Homo sapiens
cctggctgtgagcagcct

SEQ ID NO: 1428906 - DNA, 21 bp, Homo sapiens
cctggctgtgagcagcctcca

SEQ ID NO: 1428907 - DNA, 21 bp, Homo sapiens
cctggctgtgatgagtgtcct

SEQ ID NO: 1428908 - DNA, 21 bp, Homo sapiens
cctggctgtgcccagcaggcc

SEQ ID NO: 1428909 - DNA, 12 bp, Homo sapiens
cctggctgtgga

SEQ ID NO: 1428910 - DNA, 13 bp, Homo sapiens
cctggctgtggag

SEQ ID NO: 1428911 - DNA, 22 bp, Homo sapiens
cctggctgtggaggcctgatgc

SEQ ID NO: 1428912 - DNA, 23 bp, Homo sapiens
cctggctgtggaggcctgatgct

SEQ ID NO: 1428913 - DNA, 13 bp, Homo sapiens
cctggcttctgga

SEQ ID NO: 1428914 - DNA, 16 bp, Homo sapiens
cctggcttctggagcc

SEQ ID NO: 1428915 - DNA, 14 bp, Homo sapiens
cctggcttgctcca

SEQ ID NO: 1428916 - DNA, 18 bp, Homo sapiens
cctggcttgctccagggt

SEQ ID NO: 1428917 - DNA, 16 bp, Homo sapiens
cctggcttgcttgccg

SEQ ID NO: 1428918 - DNA, 19 bp, Homo sapiens
cctggcttgcttgccgagc

SEQ ID NO: 1428919 - DNA, 16 bp, Homo sapiens
cctggctttgcctctt

SEQ ID NO: 1428920 - DNA, 18 bp, Homo sapiens
cctggcttttcactgctg

SEQ ID NO: 1428921 - DNA, 20 bp, Homo sapiens
cctggcttttcactgctggc

SEQ ID NO: 1428922 - DNA, 21 bp, Homo sapiens
cctggcttttcactgctggct

SEQ ID NO: 1428923 - DNA, 20 bp, Homo sapiens
cctgggaaggagggagctgc

SEQ ID NO: 1428924 - DNA, 22 bp, Homo sapiens
cctgggaaggagggagctgctc

SEQ ID NO: 1428925 - DNA, 13 bp, Homo sapiens
cctgggaaggcca

SEQ ID NO: 1428926 - DNA, 23 bp, Homo sapiens
cctgggacatcaggagactgggc

SEQ ID NO: 1428927 - DNA, 16 bp, Homo sapiens
cctgggacccagctac

SEQ ID NO: 1428928 - DNA, 14 bp, Homo sapiens
cctgggactcccag

SEQ ID NO: 1428929 - DNA, 16 bp, Homo sapiens
cctgggactcccagtg

SEQ ID NO: 1428930 - DNA, 18 bp, Homo sapiens
cctgggagaacctcaggc

SEQ ID NO: 1428931 - DNA, 21 bp, Homo sapiens
cctgggagaaggtctccaagg

SEQ ID NO: 1428932 - DNA, 14 bp, Homo sapiens
cctgggagccagtc

SEQ ID NO: 1428933 - DNA, 14 bp, Homo sapiens
cctgggagggaggt

SEQ ID NO: 1428934 - DNA, 18 bp, Homo sapiens
cctgggagtgggtggagg

SEQ ID NO: 1428935 - DNA, 22 bp, Homo sapiens
cctgggatctggcacactccct

SEQ ID NO: 1428936 - DNA, 22 bp, Homo sapiens
cctgggatgtccacagatgcct

SEQ ID NO: 1428937 - DNA, 13 bp, Homo sapiens
cctgggattacag

SEQ ID NO: 1428938 - DNA, 15 bp, Homo sapiens
cctgggatttgagat

SEQ ID NO: 1428939 - DNA, 19 bp, Homo sapiens
cctgggcaaacagagctac

SEQ ID NO: 1428940 - DNA, 15 bp, Homo sapiens
cctgggcaagagatg

SEQ ID NO: 1428941 - DNA, 18 bp, Homo sapiens
cctgggcaatcagacacc

SEQ ID NO: 1428942 - DNA, 23 bp, Homo sapiens
cctgggcactccgcgccgatgcc

SEQ ID NO: 1428943 - DNA, 18 bp, Homo sapiens
cctgggcagccaggctgc

SEQ ID NO: 1428944 - DNA, 14 bp, Homo sapiens
cctgggcagtgctc

SEQ ID NO: 1428945 - DNA, 18 bp, Homo sapiens
cctgggcatcttctggct

SEQ ID NO: 1428946 - DNA, 14 bp, Homo sapiens
cctgggcattgctt

SEQ ID NO: 1428947 - DNA, 15 bp, Homo sapiens
cctgggccccaccac

SEQ ID NO: 1428948 - DNA, 23 bp, Homo sapiens
cctgggccccaccacctaggcca

SEQ ID NO: 1428949 - DNA, 13 bp, Homo sapiens
cctgggccctggg

SEQ ID NO: 1428950 - DNA, 16 bp, Homo sapiens
cctgggccgctgccac

SEQ ID NO: 1428951 - DNA, 17 bp, Homo sapiens
cctgggccgctgccacg

SEQ ID NO: 1428952 - DNA, 15 bp, Homo sapiens
cctgggccggctgag

SEQ ID NO: 1428953 - DNA, 23 bp, Homo sapiens
cctgggccggctgagtggcagca

SEQ ID NO: 1428954 - DNA, 15 bp, Homo sapiens
cctgggcctcatggc

SEQ ID NO: 1428955 - DNA, 20 bp, Homo sapiens
cctgggcctgcttttccagg

SEQ ID NO: 1428956 - DNA, 21 bp, Homo sapiens
cctgggcctgcttttccagga

SEQ ID NO: 1428957 - DNA, 23 bp, Homo sapiens
cctgggcctgcttttccaggatc

SEQ ID NO: 1428958 - DNA, 17 bp, Homo sapiens
cctgctgccccagctga

SEQ ID NO: 1428959 - DNA, 12 bp, Homo sapiens
cctgctgccctc

SEQ ID NO: 1428960 - DNA, 13 bp, Homo sapiens
cctgctgccctcc

SEQ ID NO: 1428961 - DNA, 15 bp, Homo sapiens
cctgctgccctccca

SEQ ID NO: 1428962 - DNA, 18 bp, Homo sapiens
cctgctgccctcccacag

SEQ ID NO: 1428963 - DNA, 23 bp, Homo sapiens
cctgctgccctcccacagcctcc

SEQ ID NO: 1428964 - DNA, 20 bp, Homo sapiens
cctgctgcgcgtgtgggtct

SEQ ID NO: 1428965 - DNA, 18 bp, Homo sapiens
cctgctgcggaggagctg

SEQ ID NO: 1428966 - DNA, 14 bp, Homo sapiens
cctgctgcgtcccc

SEQ ID NO: 1428967 - DNA, 15 bp, Homo sapiens
cctgctgctgctgcc

SEQ ID NO: 1428968 - DNA, 15 bp, Homo sapiens
cctgctgctggtgca

SEQ ID NO: 1428969 - DNA, 11 bp, Homo sapiens
cctgctgctgt

SEQ ID NO: 1428970 - DNA, 23 bp, Homo sapiens
cctgctgctgtaactgctgagcc

SEQ ID NO: 1428971 - DNA, 13 bp, Homo sapiens
cctgctggaagcc

SEQ ID NO: 1428972 - DNA, 16 bp, Homo sapiens
cctgctggaagcccag

SEQ ID NO: 1428973 - DNA, 14 bp, Homo sapiens
cctgctggaggcct

SEQ ID NO: 1428974 - DNA, 17 bp, Homo sapiens
cctgctggctgcggccc

SEQ ID NO: 1428975 - DNA, 21 bp, Homo sapiens
cctgctggctgcggccccctc

SEQ ID NO: 1428976 - DNA, 20 bp, Homo sapiens
cctgctgggaaccccgcagc

SEQ ID NO: 1428977 - DNA, 23 bp, Homo sapiens
cctgctgggaaccccgcagcccg

SEQ ID NO: 1428978 - DNA, 17 bp, Homo sapiens
cctgctgggaagagctc

SEQ ID NO: 1428979 - DNA, 21 bp, Homo sapiens
cctgctgggcgtgtgtgacac

SEQ ID NO: 1428980 - DNA, 23 bp, Homo sapiens
cctgctggggatccccgcctggc

SEQ ID NO: 1428981 - DNA, 16 bp, Homo sapiens
cctgctggtacctgcc

SEQ ID NO: 1428982 - DNA, 18 bp, Homo sapiens
cctgctggtacctgccct

SEQ ID NO: 1428983 - DNA, 20 bp, Homo sapiens
cctgctggtacctgccctct

SEQ ID NO: 1428984 - DNA, 20 bp, Homo sapiens
cctgctggttgttgccaggt

SEQ ID NO: 1428985 - DNA, 17 bp, Homo sapiens
cctgctgtatttcctgc

SEQ ID NO: 1428986 - DNA, 23 bp, Homo sapiens
cctgctgtatttcctgcttccct

SEQ ID NO: 1428987 - DNA, 21 bp, Homo sapiens
cctgctgtcctggtggctggg

SEQ ID NO: 1428988 - DNA, 16 bp, Homo sapiens
cctgctgtctctctgg

SEQ ID NO: 1428989 - DNA, 20 bp, Homo sapiens
cctgctgtgccatgctgggc

SEQ ID NO: 1428990 - DNA, 23 bp, Homo sapiens
cctgctgtgctggaattccacag

SEQ ID NO: 1428991 - DNA, 12 bp, Homo sapiens
cctgctgtggga

SEQ ID NO: 1428992 - DNA, 13 bp, Homo sapiens
cctgctgtgggag

SEQ ID NO: 1428993 - DNA, 19 bp, Homo sapiens
cctgctgtgttaagaggac

SEQ ID NO: 1428994 - DNA, 15 bp, Homo sapiens
cctgcttccaggcct

SEQ ID NO: 1428995 - DNA, 19 bp, Homo sapiens
cctgcttccccctccccct

SEQ ID NO: 1428996 - DNA, 14 bp, Homo sapiens
cctgcttccttcag

SEQ ID NO: 1428997 - DNA, 14 bp, Homo sapiens
cctgcttctgaact

SEQ ID NO: 1428998 - DNA, 14 bp, Homo sapiens
cctgcttctgctgc

SEQ ID NO: 1428999 - DNA, 15 bp, Homo sapiens
cctgcttctgctgcc

SEQ ID NO: 1429000 - DNA, 18 bp, Homo sapiens
cctgcttgataatatata

SEQ ID NO: 1429001 - DNA, 14 bp, Homo sapiens
cctgcttgcacact

SEQ ID NO: 1429002 - DNA, 15 bp, Homo sapiens
cctgcttgcacactt

SEQ ID NO: 1429003 - DNA, 17 bp, Homo sapiens
cctgcttgcacacttcc

SEQ ID NO: 1429004 - DNA, 20 bp, Homo sapiens
cctgcttgcacacttcccca

SEQ ID NO: 1429005 - DNA, 21 bp, Homo sapiens
cctgcttgccaaggcagaggc

SEQ ID NO: 1429006 - DNA, 23 bp, Homo sapiens
cctgcttgccaaggcagaggcct

SEQ ID NO: 1429007 - DNA, 14 bp, Homo sapiens
cctgcttggcccgg

SEQ ID NO: 1429008 - DNA, 19 bp, Homo sapiens
cctgcttttccaggatcct

SEQ ID NO: 1429009 - DNA, 17 bp, Homo sapiens
cctgcttttctgtcctg

SEQ ID NO: 1429010 - DNA, 19 bp, Homo sapiens
cctgcttttctgtcctggg

SEQ ID NO: 1429011 - DNA, 15 bp, Homo sapiens
cctgctttttggaaa

SEQ ID NO: 1429012 - DNA, 20 bp, Homo sapiens
cctgctttttggaaagtcag

SEQ ID NO: 1429013 - DNA, 17 bp, Homo sapiens
cctggaaacagcatgaa

SEQ ID NO: 1429014 - DNA, 18 bp, Homo sapiens
cctggaaaccttccaccc

SEQ ID NO: 1429015 - DNA, 20 bp, Homo sapiens
cctggaaaccttccacccag

SEQ ID NO: 1429016 - DNA, 22 bp, Homo sapiens
cctggaaaggctcagtctcagg

SEQ ID NO: 1429017 - DNA, 14 bp, Homo sapiens
cctggaaaggggag

SEQ ID NO: 1429018 - DNA, 15 bp, Homo sapiens
cctggaaatgatgtt

SEQ ID NO: 1429019 - DNA, 23 bp, Homo sapiens
cctggaacaccagcagcactgga

SEQ ID NO: 1429020 - DNA, 13 bp, Homo sapiens
cctggaaccaatc

SEQ ID NO: 1429021 - DNA, 18 bp, Homo sapiens
cctggaaccagagccaca

SEQ ID NO: 1429022 - DNA, 21 bp, Homo sapiens
cctggaaccgggaagggtggc

SEQ ID NO: 1429023 - DNA, 15 bp, Homo sapiens
cctggaactcctggc

SEQ ID NO: 1429024 - DNA, 16 bp, Homo sapiens
cctggaacttggggag

SEQ ID NO: 1429025 - DNA, 16 bp, Homo sapiens
cctggaagagcccagt

SEQ ID NO: 1429026 - DNA, 13 bp, Homo sapiens
cctggaagcagag

SEQ ID NO: 1429027 - DNA, 17 bp, Homo sapiens
cctggaagcagagcaaa

SEQ ID NO: 1429028 - DNA, 17 bp, Homo sapiens
cctggaagccagctttc

SEQ ID NO: 1429029 - DNA, 23 bp, Homo sapiens
cctggaagctctccgagctctgg

SEQ ID NO: 1429030 - DNA, 15 bp, Homo sapiens
cctggaagctggaag

SEQ ID NO: 1429031 - DNA, 23 bp, Homo sapiens
cctggaagctgtgtccttgcacc

SEQ ID NO: 1429032 - DNA, 18 bp, Homo sapiens
cctggaattcagcaccct

SEQ ID NO: 1429033 - DNA, 16 bp, Homo sapiens
cctggacactcagacc

SEQ ID NO: 1429034 - DNA, 15 bp, Homo sapiens
cctggacaggcagcc

SEQ ID NO: 1429035 - DNA, 12 bp, Homo sapiens
cctggaccaaag

SEQ ID NO: 1429036 - DNA, 18 bp, Homo sapiens
cctggaccaccagcccca

SEQ ID NO: 1429037 - DNA, 21 bp, Homo sapiens
cctggacctgccctgggccac

SEQ ID NO: 1429038 - DNA, 20 bp, Homo sapiens
cctggacctgcctcctgcct

SEQ ID NO: 1429039 - DNA, 16 bp, Homo sapiens
cctgagggcccctctg

SEQ ID NO: 1429040 - DNA, 22 bp, Homo sapiens
cctgaggggcatctgcccctcc

SEQ ID NO: 1429041 - DNA, 18 bp, Homo sapiens
cctgagggtccacctgga

SEQ ID NO: 1429042 - DNA, 15 bp, Homo sapiens
cctgaggtcactgct

SEQ ID NO: 1429043 - DNA, 19 bp, Homo sapiens
cctgaggtgggcccaggac

SEQ ID NO: 1429044 - DNA, 18 bp, Homo sapiens
cctgaggtgggctggggc

SEQ ID NO: 1429045 - DNA, 23 bp, Homo sapiens
cctgaggtgtgggggctgcagca

SEQ ID NO: 1429046 - DNA, 23 bp, Homo sapiens
cctgagtaatcgcttaaagatgt

SEQ ID NO: 1429047 - DNA, 15 bp, Homo sapiens
cctgagtagctggat

SEQ ID NO: 1429048 - DNA, 19 bp, Homo sapiens
cctgagtcaactggagcaa

SEQ ID NO: 1429049 - DNA, 12 bp, Homo sapiens
cctgagtcagtg

SEQ ID NO: 1429050 - DNA, 13 bp, Homo sapiens
cctgagtcagtgc

SEQ ID NO: 1429051 - DNA, 15 bp, Homo sapiens
cctgagtcagtgctc

SEQ ID NO: 1429052 - DNA, 23 bp, Homo sapiens
cctgagtccaagagggtccttta

SEQ ID NO: 1429053 - DNA, 19 bp, Homo sapiens
cctgagtcggccccacatg

SEQ ID NO: 1429054 - DNA, 22 bp, Homo sapiens
cctgagtcgtacagaaagctgc

SEQ ID NO: 1429055 - DNA, 17 bp, Homo sapiens
cctgagtctgggcagct

SEQ ID NO: 1429056 - DNA, 13 bp, Homo sapiens
cctgagtgacaga

SEQ ID NO: 1429057 - DNA, 14 bp, Homo sapiens
cctgagtgcgtgga

SEQ ID NO: 1429058 - DNA, 17 bp, Homo sapiens
cctgagtgggctgggcc

SEQ ID NO: 1429059 - DNA, 18 bp, Homo sapiens
cctgagtgggctgggccc

SEQ ID NO: 1429060 - DNA, 20 bp, Homo sapiens
cctgagttgcttttcagctg

SEQ ID NO: 1429061 - DNA, 23 bp, Homo sapiens
cctgataaacattaaacactgta

SEQ ID NO: 1429062 - DNA, 13 bp, Homo sapiens
cctgatagaagat

SEQ ID NO: 1429063 - DNA, 18 bp, Homo sapiens
cctgatagtcacctgctg

SEQ ID NO: 1429064 - DNA, 19 bp, Homo sapiens
cctgatagtcacctgctgg

SEQ ID NO: 1429065 - DNA, 22 bp, Homo sapiens
cctgatagtcacctgctggttg

SEQ ID NO: 1429066 - DNA, 17 bp, Homo sapiens
cctgatccagcctttcc

SEQ ID NO: 1429067 - DNA, 21 bp, Homo sapiens
cctgatcccaccccctcctcc

SEQ ID NO: 1429068 - DNA, 12 bp, Homo sapiens
cctgatccctga

SEQ ID NO: 1429069 - DNA, 20 bp, Homo sapiens
cctgatcctggaggcccagt

SEQ ID NO: 1429070 - DNA, 17 bp, Homo sapiens
cctgatctctcagcccc

SEQ ID NO: 1429071 - DNA, 15 bp, Homo sapiens
cctgatctttctaga

SEQ ID NO: 1429072 - DNA, 16 bp, Homo sapiens
cctgatctttctagag

SEQ ID NO: 1429073 - DNA, 13 bp, Homo sapiens
cctgatgaacagt

SEQ ID NO: 1429074 - DNA, 21 bp, Homo sapiens
cctgatgacccaggctgcctg

SEQ ID NO: 1429075 - DNA, 13 bp, Homo sapiens
cctgatgcagcct

SEQ ID NO: 1429076 - DNA, 15 bp, Homo sapiens
cctgatgcagcctgt

SEQ ID NO: 1429077 - DNA, 14 bp, Homo sapiens
cctgatgcccgttg

SEQ ID NO: 1429078 - DNA, 16 bp, Homo sapiens
cctgatgctccctccc

SEQ ID NO: 1429079 - DNA, 21 bp, Homo sapiens
cctgatggagtgtgcagacag

SEQ ID NO: 1429080 - DNA, 22 bp, Homo sapiens
cctgatggagtgtgcagacagc

SEQ ID NO: 1429081 - DNA, 23 bp, Homo sapiens
cctgatggagtgtgcagacagcc

SEQ ID NO: 1429082 - DNA, 13 bp, Homo sapiens
cctgatggccaag

SEQ ID NO: 1429083 - DNA, 21 bp, Homo sapiens
cctgatggccaagggggtgga

SEQ ID NO: 1429084 - DNA, 16 bp, Homo sapiens
cctgatggggaaggga

SEQ ID NO: 1429085 - DNA, 16 bp, Homo sapiens
cctgatgtttgaagag

SEQ ID NO: 1429086 - DNA, 13 bp, Homo sapiens
cctgattcctctc

SEQ ID NO: 1429087 - DNA, 15 bp, Homo sapiens
cctgattcttgattc

SEQ ID NO: 1429088 - DNA, 21 bp, Homo sapiens
cctgattcttgattcctggct

SEQ ID NO: 1429089 - DNA, 14 bp, Homo sapiens
cctgattgatcaca

SEQ ID NO: 1429090 - DNA, 21 bp, Homo sapiens
cctgattgatcacacagtgtt

SEQ ID NO: 1429091 - DNA, 20 bp, Homo sapiens
cctgattgtgtatattcata

SEQ ID NO: 1429092 - DNA, 21 bp, Homo sapiens
cctgatttaggagaagccagg

SEQ ID NO: 1429093 - DNA, 16 bp, Homo sapiens
cctgatttctctgaac

SEQ ID NO: 1429094 - DNA, 18 bp, Homo sapiens
cctgatttggtacttttg

SEQ ID NO: 1429095 - DNA, 18 bp, Homo sapiens
cctgcaaaatgagaccct

SEQ ID NO: 1429096 - DNA, 22 bp, Homo sapiens
cctgcaagagaatctgatcaat

SEQ ID NO: 1429097 - DNA, 13 bp, Homo sapiens
cctgcaagcagaa

SEQ ID NO: 1429098 - DNA, 19 bp, Homo sapiens
cctgcaagccccagggcct

SEQ ID NO: 1429099 - DNA, 22 bp, Homo sapiens
cctgcaagccccagggcctggg

SEQ ID NO: 1429100 - DNA, 23 bp, Homo sapiens
cctgcaagccccagggcctgggg

SEQ ID NO: 1429101 - DNA, 16 bp, Homo sapiens
cctgcaatatttgaat

SEQ ID NO: 1429102 - DNA, 15 bp, Homo sapiens
cctgcacaagccagg

SEQ ID NO: 1429103 - DNA, 16 bp, Homo sapiens
cctgcacaagccaggg

SEQ ID NO: 1429104 - DNA, 14 bp, Homo sapiens
cctgcacacacctg

SEQ ID NO: 1429105 - DNA, 17 bp, Homo sapiens
cctgcacacacctgcct

SEQ ID NO: 1429106 - DNA, 20 bp, Homo sapiens
cctgcacacagaatgctcag

SEQ ID NO: 1429107 - DNA, 21 bp, Homo sapiens
cctgcacacagaatgctcagg

SEQ ID NO: 1429108 - DNA, 20 bp, Homo sapiens
cctgcacacaggacagcggg

SEQ ID NO: 1429109 - DNA, 19 bp, Homo sapiens
cctgcacagatatttccat

SEQ ID NO: 1429110 - DNA, 13 bp, Homo sapiens
cctgcacagcctc

SEQ ID NO: 1429111 - DNA, 14 bp, Homo sapiens
cctgcacagcctct

SEQ ID NO: 1429112 - DNA, 17 bp, Homo sapiens
cctgcacaggcacacag

SEQ ID NO: 1429113 - DNA, 17 bp, Homo sapiens
cctgcacagtgacttct

SEQ ID NO: 1429114 - DNA, 21 bp, Homo sapiens
cctgcacagtgacttctgaga

SEQ ID NO: 1429115 - DNA, 16 bp, Homo sapiens
ccagtcttgcctaggc

SEQ ID NO: 1429116 - DNA, 17 bp, Homo sapiens
ccagtcttgcctaggcc

SEQ ID NO: 1429117 - DNA, 17 bp, Homo sapiens
ccagtgaacattcccag

SEQ ID NO: 1429118 - DNA, 12 bp, Homo sapiens
ccagtgaagcct

SEQ ID NO: 1429119 - DNA, 17 bp, Homo sapiens
ccagtgaaggagccacg

SEQ ID NO: 1429120 - DNA, 20 bp, Homo sapiens
ccagtgaattcttgaaggaa

SEQ ID NO: 1429121 - DNA, 23 bp, Homo sapiens
ccagtgaattcttgaaggaaaat

SEQ ID NO: 1429122 - DNA, 14 bp, Homo sapiens
ccagtgacaacatc

SEQ ID NO: 1429123 - DNA, 17 bp, Homo sapiens
ccagtgacccctgacct

SEQ ID NO: 1429124 - DNA, 12 bp, Homo sapiens
ccagtgactttt

SEQ ID NO: 1429125 - DNA, 20 bp, Homo sapiens
ccagtgagaactctctccct

SEQ ID NO: 1429126 - DNA, 17 bp, Homo sapiens
ccagtgaggatgctgca

SEQ ID NO: 1429127 - DNA, 21 bp, Homo sapiens
ccagtgaggatgctgcagtga

SEQ ID NO: 1429128 - DNA, 18 bp, Homo sapiens
ccagtgagggacgtcaga

SEQ ID NO: 1429129 - DNA, 23 bp, Homo sapiens
ccagtgagggacgtcagacttgg

SEQ ID NO: 1429130 - DNA, 23 bp, Homo sapiens
ccagtgcactccggtcccaaatg

SEQ ID NO: 1429131 - DNA, 14 bp, Homo sapiens
ccagtgcactgaaa

SEQ ID NO: 1429132 - DNA, 16 bp, Homo sapiens
ccagtgcagaatgtaa

SEQ ID NO: 1429133 - DNA, 15 bp, Homo sapiens
ccagtgcatatgcaa

SEQ ID NO: 1429134 - DNA, 13 bp, Homo sapiens
ccagtgccactgc

SEQ ID NO: 1429135 - DNA, 22 bp, Homo sapiens
ccagtgccctggggctgatctc

SEQ ID NO: 1429136 - DNA, 15 bp, Homo sapiens
ccagtgccgaggaca

SEQ ID NO: 1429137 - DNA, 16 bp, Homo sapiens
ccagtgccgaggacat

SEQ ID NO: 1429138 - DNA, 18 bp, Homo sapiens
ccagtgccgaggacatgc

SEQ ID NO: 1429139 - DNA, 15 bp, Homo sapiens
ccagtgcctgccact

SEQ ID NO: 1429140 - DNA, 21 bp, Homo sapiens
ccagtgcctgccactctctgg

SEQ ID NO: 1429141 - DNA, 23 bp, Homo sapiens
ccagtgcctgccactctctggga

SEQ ID NO: 1429142 - DNA, 21 bp, Homo sapiens
ccagtgccttacctcctgccc

SEQ ID NO: 1429143 - DNA, 22 bp, Homo sapiens
ccagtgccttacctcctgccca

SEQ ID NO: 1429144 - DNA, 14 bp, Homo sapiens
ccagtgccttctgg

SEQ ID NO: 1429145 - DNA, 18 bp, Homo sapiens
ccagtgctcagctgtggc

SEQ ID NO: 1429146 - DNA, 13 bp, Homo sapiens
ccagtgctgccat

SEQ ID NO: 1429147 - DNA, 17 bp, Homo sapiens
ccagtgctgcccatgag

SEQ ID NO: 1429148 - DNA, 21 bp, Homo sapiens
ccagtggaaggagaatttaat

SEQ ID NO: 1429149 - DNA, 21 bp, Homo sapiens
ccagtggatgccacagcccag

SEQ ID NO: 1429150 - DNA, 14 bp, Homo sapiens
ccagtggattccca

SEQ ID NO: 1429151 - DNA, 14 bp, Homo sapiens
ccagtggcacagga

SEQ ID NO: 1429152 - DNA, 15 bp, Homo sapiens
ccagtggcacaggag

SEQ ID NO: 1429153 - DNA, 21 bp, Homo sapiens
ccagtggcggcacgtccttgg

SEQ ID NO: 1429154 - DNA, 20 bp, Homo sapiens
ccagtggctggaagaaccac

SEQ ID NO: 1429155 - DNA, 13 bp, Homo sapiens
ccagtggctgggg

SEQ ID NO: 1429156 - DNA, 13 bp, Homo sapiens
ccagtggctggtc

SEQ ID NO: 1429157 - DNA, 13 bp, Homo sapiens
ccagtgggagggg

SEQ ID NO: 1429158 - DNA, 19 bp, Homo sapiens
ccagtgggaggggcaggct

SEQ ID NO: 1429159 - DNA, 17 bp, Homo sapiens
ccagtggtcatgctcag

SEQ ID NO: 1429160 - DNA, 18 bp, Homo sapiens
ccagtggtcatgctcagc

SEQ ID NO: 1429161 - DNA, 19 bp, Homo sapiens
ccagtggtcatgctcagcc

SEQ ID NO: 1429162 - DNA, 17 bp, Homo sapiens
ccagtggtgggtaattg

SEQ ID NO: 1429163 - DNA, 17 bp, Homo sapiens
ccagtgtacaggtcacc

SEQ ID NO: 1429164 - DNA, 21 bp, Homo sapiens
ccagtgtactaggtcaatcag

SEQ ID NO: 1429165 - DNA, 19 bp, Homo sapiens
ccagtgtcaagttgtgctt

SEQ ID NO: 1429166 - DNA, 22 bp, Homo sapiens
ccagtgtcaagttgtgcttgtt

SEQ ID NO: 1429167 - DNA, 20 bp, Homo sapiens
ccagtgtgcacccctcccca

SEQ ID NO: 1429168 - DNA, 13 bp, Homo sapiens
ccagtgtgggctt

SEQ ID NO: 1429169 - DNA, 19 bp, Homo sapiens
ccagtgttctatttgcttt

SEQ ID NO: 1429170 - DNA, 20 bp, Homo sapiens
ccagtgttctatttgcttta

SEQ ID NO: 1429171 - DNA, 17 bp, Homo sapiens
ccagtgttgggtttttt

SEQ ID NO: 1429172 - DNA, 15 bp, Homo sapiens
ccagtgttgtttgta

SEQ ID NO: 1429173 - DNA, 17 bp, Homo sapiens
ccagtgttgtttgtaaa

SEQ ID NO: 1429174 - DNA, 23 bp, Homo sapiens
ccagtgttgtttgtaaataagag

SEQ ID NO: 1429175 - DNA, 13 bp, Homo sapiens
ccagttaaagcca

SEQ ID NO: 1429176 - DNA, 13 bp, Homo sapiens
ccagttaattttt

SEQ ID NO: 1429177 - DNA, 16 bp, Homo sapiens
ccagttaatttttcca

SEQ ID NO: 1429178 - DNA, 17 bp, Homo sapiens
ccagttatgtgaatgat

SEQ ID NO: 1429179 - DNA, 17 bp, Homo sapiens
ccagttcaaagtgtata

SEQ ID NO: 1429180 - DNA, 19 bp, Homo sapiens
ccagttcaatctcccgctg

SEQ ID NO: 1429181 - DNA, 21 bp, Homo sapiens
ccagttcaggagtcccaagga

SEQ ID NO: 1429182 - DNA, 18 bp, Homo sapiens
ccagttcctatgacacag

SEQ ID NO: 1429183 - DNA, 11 bp, Homo sapiens
ccagttcctgt

SEQ ID NO: 1429184 - DNA, 12 bp, Homo sapiens
ccagttcctgta

SEQ ID NO: 1429185 - DNA, 19 bp, Homo sapiens
ccagttgtgttgacacata

SEQ ID NO: 1429186 - DNA, 20 bp, Homo sapiens
ccagtttccccatggggctg

SEQ ID NO: 1429187 - DNA, 13 bp, Homo sapiens
ccagtttgcagaa

SEQ ID NO: 1429188 - DNA, 15 bp, Homo sapiens
ccagtttgcatttgg

SEQ ID NO: 1429189 - DNA, 20 bp, Homo sapiens
ccagtttgggtaaaatactt

SEQ ID NO: 1429190 - DNA, 13 bp, Homo sapiens
ccagttttctggt

SEQ ID NO: 1429191 - DNA, 16 bp, Homo sapiens
ccagttttctggtagg

SEQ ID NO: 1429192 - DNA, 16 bp, Homo sapiens
ccagtttttgtttttg

SEQ ID NO: 1429193 - DNA, 15 bp, Homo sapiens
ccataaacagcacac

SEQ ID NO: 1429194 - DNA, 20 bp, Homo sapiens
ccataaagacaatcactgcc

SEQ ID NO: 1429195 - DNA, 15 bp, Homo sapiens
ccataaccacattta

SEQ ID NO: 1429196 - DNA, 23 bp, Homo sapiens
ccataagacaaacactgccatat

SEQ ID NO: 1429197 - DNA, 13 bp, Homo sapiens
ccataagaggagt

SEQ ID NO: 1429198 - DNA, 18 bp, Homo sapiens
ccataagaggagtaggcc

SEQ ID NO: 1429199 - DNA, 17 bp, Homo sapiens
ccataagcctccattta

SEQ ID NO: 1429200 - DNA, 21 bp, Homo sapiens
ccataagcctccatttagttc

SEQ ID NO: 1429201 - DNA, 17 bp, Homo sapiens
ccataagtgacaccaat

SEQ ID NO: 1429202 - DNA, 22 bp, Homo sapiens
ccataagtgacaccaataaatg

SEQ ID NO: 1429203 - DNA, 19 bp, Homo sapiens
ccataataaaaggctttga

SEQ ID NO: 1429204 - DNA, 18 bp, Homo sapiens
ccataatagttagccctc

SEQ ID NO: 1429205 - DNA, 16 bp, Homo sapiens
ccataatcagaacaca

SEQ ID NO: 1429206 - DNA, 19 bp, Homo sapiens
ccataatgtataaagaaca

SEQ ID NO: 1429207 - DNA, 20 bp, Homo sapiens
ccataattatgacagttata

SEQ ID NO: 1429208 - DNA, 17 bp, Homo sapiens
ccataattttcttcatg

SEQ ID NO: 1429209 - DNA, 15 bp, Homo sapiens
ccatacaatgtatgt

SEQ ID NO: 1429210 - DNA, 15 bp, Homo sapiens
ccataccttttctct

SEQ ID NO: 1429211 - DNA, 21 bp, Homo sapiens
ccataccttttctcttttctt

SEQ ID NO: 1429212 - DNA, 19 bp, Homo sapiens
ccatactccttgcttcctg

SEQ ID NO: 1429213 - DNA, 17 bp, Homo sapiens
ccatacttttgagaggg

SEQ ID NO: 1429214 - DNA, 20 bp, Homo sapiens
ccatagaaaaatgtataaaa

SEQ ID NO: 1429215 - DNA, 18 bp, Homo sapiens
ccatagacctacagacct

SEQ ID NO: 1429216 - DNA, 14 bp, Homo sapiens
ccatagatcttctg

SEQ ID NO: 1429217 - DNA, 15 bp, Homo sapiens
ccatagatcttctga

SEQ ID NO: 1429218 - DNA, 20 bp, Homo sapiens
ccatagatcttctgaaatga

SEQ ID NO: 1429219 - DNA, 21 bp, Homo sapiens
ccatagcaagattgcttaaaa

SEQ ID NO: 1429220 - DNA, 17 bp, Homo sapiens
ccataggactaccgcag

SEQ ID NO: 1429221 - DNA, 15 bp, Homo sapiens
ccatagtcttaactg

SEQ ID NO: 1429222 - DNA, 18 bp, Homo sapiens
ccatagtcttaactggtc

SEQ ID NO: 1429223 - DNA, 17 bp, Homo sapiens
ccatagtgtcacagaga

SEQ ID NO: 1429224 - DNA, 16 bp, Homo sapiens
ccatatcttaaagaaa

SEQ ID NO: 1429225 - DNA, 21 bp, Homo sapiens
ccatatcttaaagaaacagct

SEQ ID NO: 1429226 - DNA, 17 bp, Homo sapiens
ccatatgaattgtacag

SEQ ID NO: 1429227 - DNA, 14 bp, Homo sapiens
ccatatgcagaaat

SEQ ID NO: 1429228 - DNA, 15 bp, Homo sapiens
ccatattacctggat

SEQ ID NO: 1429229 - DNA, 16 bp, Homo sapiens
ccatattacctggatt

SEQ ID NO: 1429230 - DNA, 12 bp, Homo sapiens
ccatattgtgta

SEQ ID NO: 1429231 - DNA, 19 bp, Homo sapiens
ccatatttaataatgcttt

SEQ ID NO: 1429232 - DNA, 15 bp, Homo sapiens
aagctctagaatctg

SEQ ID NO: 1429233 - DNA, 21 bp, Homo sapiens
aagctctcagcaagtgcccag

SEQ ID NO: 1429234 - DNA, 13 bp, Homo sapiens
aagctctccaggc

SEQ ID NO: 1429235 - DNA, 16 bp, Homo sapiens
aagctctccgagctct

SEQ ID NO: 1429236 - DNA, 22 bp, Homo sapiens
aagctctccgagctctggtgct

SEQ ID NO: 1429237 - DNA, 16 bp, Homo sapiens
aagctctctgggcctg

SEQ ID NO: 1429238 - DNA, 14 bp, Homo sapiens
aagctctgcctccc

SEQ ID NO: 1429239 - DNA, 23 bp, Homo sapiens
aagctctggccccaggcttgtca

SEQ ID NO: 1429240 - DNA, 13 bp, Homo sapiens
aagctctggctga

SEQ ID NO: 1429241 - DNA, 15 bp, Homo sapiens
aagctctggctgaac

SEQ ID NO: 1429242 - DNA, 20 bp, Homo sapiens
aagctctggtgacaccagcc

SEQ ID NO: 1429243 - DNA, 21 bp, Homo sapiens
aagctctggtgacaccagcct

SEQ ID NO: 1429244 - DNA, 11 bp, Homo sapiens
aagctgaaatt

SEQ ID NO: 1429245 - DNA, 18 bp, Homo sapiens
aagctgaaattttagaaa

SEQ ID NO: 1429246 - DNA, 18 bp, Homo sapiens
aagctgaacacatttctt

SEQ ID NO: 1429247 - DNA, 22 bp, Homo sapiens
aagctgaagaggttgaagctaa

SEQ ID NO: 1429248 - DNA, 17 bp, Homo sapiens
aagctgacttggcactt

SEQ ID NO: 1429249 - DNA, 15 bp, Homo sapiens
aagctgagaagaatg

SEQ ID NO: 1429250 - DNA, 13 bp, Homo sapiens
aagctgagcctgc

SEQ ID NO: 1429251 - DNA, 23 bp, Homo sapiens
aagctgagttacttgtctgaggc

SEQ ID NO: 1429252 - DNA, 13 bp, Homo sapiens
aagctgagtttcc

SEQ ID NO: 1429253 - DNA, 14 bp, Homo sapiens
aagctgagtttcct

SEQ ID NO: 1429254 - DNA, 16 bp, Homo sapiens
aagctgattactgtca

SEQ ID NO: 1429255 - DNA, 23 bp, Homo sapiens
aagctgattactgtcaataaaca

SEQ ID NO: 1429256 - DNA, 15 bp, Homo sapiens
aagctgcagagattt

SEQ ID NO: 1429257 - DNA, 17 bp, Homo sapiens
aagctgcagagatttct

SEQ ID NO: 1429258 - DNA, 18 bp, Homo sapiens
aagctgcccactgtttct

SEQ ID NO: 1429259 - DNA, 14 bp, Homo sapiens
aagctgcctctggg

SEQ ID NO: 1429260 - DNA, 16 bp, Homo sapiens
aagctgctctgagcca

SEQ ID NO: 1429261 - DNA, 21 bp, Homo sapiens
aagctgctggagcccgcactg

SEQ ID NO: 1429262 - DNA, 13 bp, Homo sapiens
aagctgctgtgat

SEQ ID NO: 1429263 - DNA, 16 bp, Homo sapiens
aagctggaacatttga

SEQ ID NO: 1429264 - DNA, 21 bp, Homo sapiens
aagctggaagactgtgcagaa

SEQ ID NO: 1429265 - DNA, 22 bp, Homo sapiens
aagctggaccttttcccttgct

SEQ ID NO: 1429266 - DNA, 11 bp, Homo sapiens
aagctggactg

SEQ ID NO: 1429267 - DNA, 12 bp, Homo sapiens
aagctggactga

SEQ ID NO: 1429268 - DNA, 13 bp, Homo sapiens
aagctggactgac

SEQ ID NO: 1429269 - DNA, 17 bp, Homo sapiens
aagctggagtgcagtgg

SEQ ID NO: 1429270 - DNA, 20 bp, Homo sapiens
aagctggagtgcagtggcat

SEQ ID NO: 1429271 - DNA, 15 bp, Homo sapiens
aagctggcagaacgg

SEQ ID NO: 1429272 - DNA, 16 bp, Homo sapiens
aagctggctctgtttg

SEQ ID NO: 1429273 - DNA, 19 bp, Homo sapiens
aagctggctgggctggctg

SEQ ID NO: 1429274 - DNA, 20 bp, Homo sapiens
aagctggctgggctggctga

SEQ ID NO: 1429275 - DNA, 12 bp, Homo sapiens
aagctgggtgag

SEQ ID NO: 1429276 - DNA, 22 bp, Homo sapiens
aagctgtataattaattgtcat

SEQ ID NO: 1429277 - DNA, 13 bp, Homo sapiens
aagctgtccctgc

SEQ ID NO: 1429278 - DNA, 16 bp, Homo sapiens
aagctgtccctgcagg

SEQ ID NO: 1429279 - DNA, 17 bp, Homo sapiens
aagctgtccctgcaggg

SEQ ID NO: 1429280 - DNA, 14 bp, Homo sapiens
aagctgtgaatatt

SEQ ID NO: 1429281 - DNA, 10 bp, Homo sapiens
aagctgtgca

SEQ ID NO: 1429282 - DNA, 22 bp, Homo sapiens
aagctgtggcagccgtcccagg

SEQ ID NO: 1429283 - DNA, 12 bp, Homo sapiens
aagctgtgtcct

SEQ ID NO: 1429284 - DNA, 23 bp, Homo sapiens
aagctgtgtctgcccaatgaata

SEQ ID NO: 1429285 - DNA, 14 bp, Homo sapiens
aagctgttattctt

SEQ ID NO: 1429286 - DNA, 17 bp, Homo sapiens
aagctgttattcttgtt

SEQ ID NO: 1429287 - DNA, 23 bp, Homo sapiens
aagctgtttccatagggtgacac

SEQ ID NO: 1429288 - DNA, 19 bp, Homo sapiens
aagcttcaaagtttatatg

SEQ ID NO: 1429289 - DNA, 12 bp, Homo sapiens
aagcttcaaccc

SEQ ID NO: 1429290 - DNA, 17 bp, Homo sapiens
aagcttcagagcctagc

SEQ ID NO: 1429291 - DNA, 19 bp, Homo sapiens
aagcttcagagcctagcca

SEQ ID NO: 1429292 - DNA, 22 bp, Homo sapiens
aagcttcagagcctagccacct

SEQ ID NO: 1429293 - DNA, 15 bp, Homo sapiens
aagcttccacctgtc

SEQ ID NO: 1429294 - DNA, 13 bp, Homo sapiens
aagcttctaatta

SEQ ID NO: 1429295 - DNA, 14 bp, Homo sapiens
aagcttgagcctcc

SEQ ID NO: 1429296 - DNA, 20 bp, Homo sapiens
aagcttggcttcctcttctt

SEQ ID NO: 1429297 - DNA, 17 bp, Homo sapiens
aagcttgtcaaagatgc

SEQ ID NO: 1429298 - DNA, 19 bp, Homo sapiens
aagcttgtggtgttcctga

SEQ ID NO: 1429299 - DNA, 20 bp, Homo sapiens
aagcttgtggtgttcctgaa

SEQ ID NO: 1429300 - DNA, 13 bp, Homo sapiens
aagctttaaatta

SEQ ID NO: 1429301 - DNA, 12 bp, Homo sapiens
aagctttcctgc

SEQ ID NO: 1429302 - DNA, 18 bp, Homo sapiens
aagctttcctgccccagg

SEQ ID NO: 1429303 - DNA, 21 bp, Homo sapiens
aagctttcctgccccaggcct

SEQ ID NO: 1429304 - DNA, 14 bp, Homo sapiens
aagctttggctgag

SEQ ID NO: 1429305 - DNA, 13 bp, Homo sapiens
aagcttttctttt

SEQ ID NO: 1429306 - DNA, 14 bp, Homo sapiens
aagctttttaaaat

SEQ ID NO: 1429307 - DNA, 23 bp, Homo sapiens
aagctttttattcctcctgctca

SEQ ID NO: 1429308 - DNA, 12 bp, Homo sapiens
aagctttttgga

SEQ ID NO: 1429309 - DNA, 13 bp, Homo sapiens
aagctttttggaa

SEQ ID NO: 1429310 - DNA, 14 bp, Homo sapiens
aagctttttggaat

SEQ ID NO: 1429311 - DNA, 13 bp, Homo sapiens
aaggaaaaattca

SEQ ID NO: 1429312 - DNA, 20 bp, Homo sapiens
aaggaaaagaaaacaaaaaa

SEQ ID NO: 1429313 - DNA, 21 bp, Homo sapiens
aaggaaaagaagttgcaagac

SEQ ID NO: 1429314 - DNA, 14 bp, Homo sapiens
aaggaaaagcaaga

SEQ ID NO: 1429315 - DNA, 16 bp, Homo sapiens
aaggaaaagcaagaaa

SEQ ID NO: 1429316 - DNA, 19 bp, Homo sapiens
aaggaaaaggttgttgtta

SEQ ID NO: 1429317 - DNA, 17 bp, Homo sapiens
aaggaaaatctatattt

SEQ ID NO: 1429318 - DNA, 12 bp, Homo sapiens
aaggaaaatgat

SEQ ID NO: 1429319 - DNA, 20 bp, Homo sapiens
aaggaaacaaccatgtcatt

SEQ ID NO: 1429320 - DNA, 16 bp, Homo sapiens
aaggaaacattttatc

SEQ ID NO: 1429321 - DNA, 22 bp, Homo sapiens
aaggaaaccacagtgagcctga

SEQ ID NO: 1429322 - DNA, 15 bp, Homo sapiens
aaggaaagaaaacat

SEQ ID NO: 1429323 - DNA, 13 bp, Homo sapiens
aaggaaagaaggg

SEQ ID NO: 1429324 - DNA, 20 bp, Homo sapiens
aaggaaagaagggggccctg

SEQ ID NO: 1429325 - DNA, 19 bp, Homo sapiens
aaggaaagatttgtgaact

SEQ ID NO: 1429326 - DNA, 20 bp, Homo sapiens
aaggaaagcaataaatgaat

SEQ ID NO: 1429327 - DNA, 18 bp, Homo sapiens
aaggaaagctgtgtttat

SEQ ID NO: 1429328 - DNA, 21 bp, Homo sapiens
aaggaaaggctcatttaaaac

SEQ ID NO: 1429329 - DNA, 14 bp, Homo sapiens
aaggaaatattctt

SEQ ID NO: 1429330 - DNA, 16 bp, Homo sapiens
aaggaaatctcacccc

SEQ ID NO: 1429331 - DNA, 17 bp, Homo sapiens
aaggaacagcaatggtg

SEQ ID NO: 1429332 - DNA, 13 bp, Homo sapiens
aaggaacagccac

SEQ ID NO: 1429333 - DNA, 14 bp, Homo sapiens
aaggaacagccaca

SEQ ID NO: 1429334 - DNA, 12 bp, Homo sapiens
aaggaaccttcc

SEQ ID NO: 1429335 - DNA, 11 bp, Homo sapiens
aaggaagaggg

SEQ ID NO: 1429336 - DNA, 20 bp, Homo sapiens
aaggaagatcttgagagctg

SEQ ID NO: 1429337 - DNA, 13 bp, Homo sapiens
aaggaaggaaaga

SEQ ID NO: 1429338 - DNA, 12 bp, Homo sapiens
aaggaagggcag

SEQ ID NO: 1429339 - DNA, 23 bp, Homo sapiens
aaggaagggcagagaatggctgg

SEQ ID NO: 1429340 - DNA, 16 bp, Homo sapiens
aaggaaggtaaaaagt

SEQ ID NO: 1429341 - DNA, 18 bp, Homo sapiens
aaggaaggtggatggccc

SEQ ID NO: 1429342 - DNA, 18 bp, Homo sapiens
aaggaagtatcagcacta

SEQ ID NO: 1429343 - DNA, 19 bp, Homo sapiens
aaggaagtggggtgttctt

SEQ ID NO: 1429344 - DNA, 13 bp, Homo sapiens
aaggaataaatga

SEQ ID NO: 1429345 - DNA, 14 bp, Homo sapiens
aaggaataagcatt

SEQ ID NO: 1429346 - DNA, 17 bp, Homo sapiens
aaggaatagccagagag

SEQ ID NO: 1429347 - DNA, 21 bp, Homo sapiens
aaggaatagccagagaggagc

SEQ ID NO: 1429348 - DNA, 17 bp, Homo sapiens
aaggaatctccagtttt

SEQ ID NO: 1429349 - DNA, 14 bp, Homo sapiens
aaggaatctgtgca

SEQ ID NO: 1429350 - DNA, 18 bp, Homo sapiens
ccatatttgatttctaat

SEQ ID NO: 1429351 - DNA, 15 bp, Homo sapiens
ccatcaaaaatattc

SEQ ID NO: 1429352 - DNA, 20 bp, Homo sapiens
ccatcaagaacctacagact

SEQ ID NO: 1429353 - DNA, 13 bp, Homo sapiens
ccatcacagggtt

SEQ ID NO: 1429354 - DNA, 13 bp, Homo sapiens
ccatcaccctctt

SEQ ID NO: 1429355 - DNA, 16 bp, Homo sapiens
ccatcaccctcttcct

SEQ ID NO: 1429356 - DNA, 20 bp, Homo sapiens
ccatcaccctcttcctgtga

SEQ ID NO: 1429357 - DNA, 16 bp, Homo sapiens
ccatcactagaagaaa

SEQ ID NO: 1429358 - DNA, 18 bp, Homo sapiens
ccatcactggagcaccag

SEQ ID NO: 1429359 - DNA, 20 bp, Homo sapiens
ccatcacttctccccgcagc

SEQ ID NO: 1429360 - DNA, 16 bp, Homo sapiens
ccatcagattctgtga

SEQ ID NO: 1429361 - DNA, 16 bp, Homo sapiens
ccatcagcaccccagt

SEQ ID NO: 1429362 - DNA, 20 bp, Homo sapiens
ccatcagcctgttccagaag

SEQ ID NO: 1429363 - DNA, 21 bp, Homo sapiens
ccatcagcgggtctcctccca

SEQ ID NO: 1429364 - DNA, 12 bp, Homo sapiens
ccatcaggcagt

SEQ ID NO: 1429365 - DNA, 19 bp, Homo sapiens
ccatcagggttctcttagc

SEQ ID NO: 1429366 - DNA, 17 bp, Homo sapiens
ccatcaggttccatccc

SEQ ID NO: 1429367 - DNA, 21 bp, Homo sapiens
ccatcagttcccccagtacct

SEQ ID NO: 1429368 - DNA, 20 bp, Homo sapiens
ccatcatctatagaaagcta

SEQ ID NO: 1429369 - DNA, 13 bp, Homo sapiens
ccatcatctctga

SEQ ID NO: 1429370 - DNA, 20 bp, Homo sapiens
ccatcatgtttacagaggac

SEQ ID NO: 1429371 - DNA, 24 bp, Homo sapiens
ccatcatgtttcagtgaagatgct

SEQ ID NO: 1429372 - DNA, 18 bp, Homo sapiens
ccatcattccttctggcc

SEQ ID NO: 1429373 - DNA, 16 bp, Homo sapiens
ccatcattgcacctgc

SEQ ID NO: 1429374 - DNA, 20 bp, Homo sapiens
ccatcattgcacctgcaggc

SEQ ID NO: 1429375 - DNA, 22 bp, Homo sapiens
ccatcattgcacctgcaggctt

SEQ ID NO: 1429376 - DNA, 13 bp, Homo sapiens
ccatccaccacct

SEQ ID NO: 1429377 - DNA, 16 bp, Homo sapiens
ccatccaccaccttgc

SEQ ID NO: 1429378 - DNA, 16 bp, Homo sapiens
ccatccactctaccct

SEQ ID NO: 1429379 - DNA, 22 bp, Homo sapiens
ccatccactctaccctcccacc

SEQ ID NO: 1429380 - DNA, 13 bp, Homo sapiens
ccatccactgtga

SEQ ID NO: 1429381 - DNA, 18 bp, Homo sapiens
ccatccagacctggctcc

SEQ ID NO: 1429382 - DNA, 20 bp, Homo sapiens
ccatccagccagaccccacg

SEQ ID NO: 1429383 - DNA, 12 bp, Homo sapiens
ccatccaggcag

SEQ ID NO: 1429384 - DNA, 13 bp, Homo sapiens
ccatccaggcagt

SEQ ID NO: 1429385 - DNA, 12 bp, Homo sapiens
ccatccagtggg

SEQ ID NO: 1429386 - DNA, 24 bp, Homo sapiens
ccatccatgtgctagtcactggca

SEQ ID NO: 1429387 - DNA, 16 bp, Homo sapiens
ccatccattaggccag

SEQ ID NO: 1429388 - DNA, 17 bp, Homo sapiens
ccatccattaggccagc

SEQ ID NO: 1429389 - DNA, 18 bp, Homo sapiens
ccatccattaggccagca

SEQ ID NO: 1429390 - DNA, 12 bp, Homo sapiens
ccatcccacacc

SEQ ID NO: 1429391 - DNA, 11 bp, Homo sapiens
ccatcccatga

SEQ ID NO: 1429392 - DNA, 19 bp, Homo sapiens
ccatcccatgaacacactg

SEQ ID NO: 1429393 - DNA, 15 bp, Homo sapiens
ccatccccaccttca

SEQ ID NO: 1429394 - DNA, 15 bp, Homo sapiens
ccatccccagctggt

SEQ ID NO: 1429395 - DNA, 14 bp, Homo sapiens
ccatcccccactgc

SEQ ID NO: 1429396 - DNA, 12 bp, Homo sapiens
ccatccccctgc

SEQ ID NO: 1429397 - DNA, 15 bp, Homo sapiens
ccatccccctgccct

SEQ ID NO: 1429398 - DNA, 13 bp, Homo sapiens
ccatcccgaagcc

SEQ ID NO: 1429399 - DNA, 12 bp, Homo sapiens
ccatccctcggg

SEQ ID NO: 1429400 - DNA, 23 bp, Homo sapiens
ccatccctcgggaagcagccagc

SEQ ID NO: 1429401 - DNA, 17 bp, Homo sapiens
ccatcccttcggagcca

SEQ ID NO: 1429402 - DNA, 20 bp, Homo sapiens
ccatccggtttgccatgttg

SEQ ID NO: 1429403 - DNA, 15 bp, Homo sapiens
ccatcctaaaagcca

SEQ ID NO: 1429404 - DNA, 18 bp, Homo sapiens
ccatcctaccctcgggcc

SEQ ID NO: 1429405 - DNA, 22 bp, Homo sapiens
ccatcctaccctcgggcccacc

SEQ ID NO: 1429406 - DNA, 13 bp, Homo sapiens
ccatcctgactga

SEQ ID NO: 1429407 - DNA, 22 bp, Homo sapiens
ccatcctgcagcctcctcctga

SEQ ID NO: 1429408 - DNA, 13 bp, Homo sapiens
ccatcctggcccc

SEQ ID NO: 1429409 - DNA, 21 bp, Homo sapiens
ccatcctggggcagcactccc

SEQ ID NO: 1429410 - DNA, 19 bp, Homo sapiens
ccatccttcaccagagccc

SEQ ID NO: 1429411 - DNA, 21 bp, Homo sapiens
ccatccttcaccagagcccat

SEQ ID NO: 1429412 - DNA, 15 bp, Homo sapiens
ccatccttccctttg

SEQ ID NO: 1429413 - DNA, 14 bp, Homo sapiens
ccatcgctgtgtgt

SEQ ID NO: 1429414 - DNA, 19 bp, Homo sapiens
ccatctaatgcttgtttat

SEQ ID NO: 1429415 - DNA, 23 bp, Homo sapiens
ccatctagccagcccctcttccc

SEQ ID NO: 1429416 - DNA, 12 bp, Homo sapiens
ccatctcaggag

SEQ ID NO: 1429417 - DNA, 17 bp, Homo sapiens
ccatctcaggagatgga

SEQ ID NO: 1429418 - DNA, 17 bp, Homo sapiens
ccatctcaggtgccact

SEQ ID NO: 1429419 - DNA, 15 bp, Homo sapiens
ccatctccccaggcc

SEQ ID NO: 1429420 - DNA, 16 bp, Homo sapiens
ccatctccccaggcct

SEQ ID NO: 1429421 - DNA, 20 bp, Homo sapiens
ccatctccccaggcctccag

SEQ ID NO: 1429422 - DNA, 23 bp, Homo sapiens
ccatctccccaggcctccagcct

SEQ ID NO: 1429423 - DNA, 13 bp, Homo sapiens
ccatctcccccat

SEQ ID NO: 1429424 - DNA, 20 bp, Homo sapiens
ccatctcccccatcccccac

SEQ ID NO: 1429425 - DNA, 23 bp, Homo sapiens
ccatctcccccatcccccactgc

SEQ ID NO: 1429426 - DNA, 18 bp, Homo sapiens
ccatctccctgcctggcc

SEQ ID NO: 1429427 - DNA, 18 bp, Homo sapiens
ccatctcctgatttctct

SEQ ID NO: 1429428 - DNA, 17 bp, Homo sapiens
ccatctccttcccccag

SEQ ID NO: 1429429 - DNA, 21 bp, Homo sapiens
ccatctccttcccccagccca

SEQ ID NO: 1429430 - DNA, 22 bp, Homo sapiens
ccatctccttcccccagcccaa

SEQ ID NO: 1429431 - DNA, 18 bp, Homo sapiens
ccatctcctttcagggaa

SEQ ID NO: 1429432 - DNA, 22 bp, Homo sapiens
ccatctcgccacccctccttcc

SEQ ID NO: 1429433 - DNA, 20 bp, Homo sapiens
ccatctctctactcctacct

SEQ ID NO: 1429434 - DNA, 18 bp, Homo sapiens
ccatctctgattttcaaa

SEQ ID NO: 1429435 - DNA, 21 bp, Homo sapiens
ccatctcttcctacccaacca

SEQ ID NO: 1429436 - DNA, 21 bp, Homo sapiens
ccatctcttctgcaagcctca

SEQ ID NO: 1429437 - DNA, 18 bp, Homo sapiens
ccatctctttaaaaacaa

SEQ ID NO: 1429438 - DNA, 22 bp, Homo sapiens
ccatctgacaaaatggggcaga

SEQ ID NO: 1429439 - DNA, 14 bp, Homo sapiens
ccatctgactgcca

SEQ ID NO: 1429440 - DNA, 17 bp, Homo sapiens
ccatctgcaccccttct

SEQ ID NO: 1429441 - DNA, 17 bp, Homo sapiens
ccatctgcccaggggtg

SEQ ID NO: 1429442 - DNA, 20 bp, Homo sapiens
ccatctgcccaggggtgccc

SEQ ID NO: 1429443 - DNA, 22 bp, Homo sapiens
ccatctgcccaggggtgccccc

SEQ ID NO: 1429444 - DNA, 12 bp, Homo sapiens
ccatctggatgt

SEQ ID NO: 1429445 - DNA, 16 bp, Homo sapiens
ccatctggatgtaaat

SEQ ID NO: 1429446 - DNA, 13 bp, Homo sapiens
ccatctggctttt

SEQ ID NO: 1429447 - DNA, 16 bp, Homo sapiens
ccatctggctttttct

SEQ ID NO: 1429448 - DNA, 21 bp, Homo sapiens
ccatctgtcttgccagccaga

SEQ ID NO: 1429449 - DNA, 23 bp, Homo sapiens
ccatctgtgactataaagctgtt

SEQ ID NO: 1429450 - DNA, 16 bp, Homo sapiens
ccatcttcctgctgct

SEQ ID NO: 1429451 - DNA, 18 bp, Homo sapiens
ccatcttcctgctgctgt

SEQ ID NO: 1429452 - DNA, 13 bp, Homo sapiens
ccatcttcttccc

SEQ ID NO: 1429453 - DNA, 23 bp, Homo sapiens
ccatcttcttcccttaactccaa

SEQ ID NO: 1429454 - DNA, 14 bp, Homo sapiens
ccatcttgagatgg

SEQ ID NO: 1429455 - DNA, 22 bp, Homo sapiens
ccatcttgagatggtgaggctg

SEQ ID NO: 1429456 - DNA, 20 bp, Homo sapiens
ccatcttgcttccctaatct

SEQ ID NO: 1429457 - DNA, 21 bp, Homo sapiens
ccatcttggtagttctgtgcc

SEQ ID NO: 1429458 - DNA, 17 bp, Homo sapiens
ccatcttgtggggccag

SEQ ID NO: 1429459 - DNA, 14 bp, Homo sapiens
ccatctttctttgg

SEQ ID NO: 1429460 - DNA, 14 bp, Homo sapiens
ccatctttgatcct

SEQ ID NO: 1429461 - DNA, 12 bp, Homo sapiens
ccatctttttct

SEQ ID NO: 1429462 - DNA, 15 bp, Homo sapiens
ccatgaacaaattct

SEQ ID NO: 1429463 - DNA, 17 bp, Homo sapiens
ccatgaacacactgtgt

SEQ ID NO: 1429464 - DNA, 21 bp, Homo sapiens
ccatgaacacactgtgtcctg

SEQ ID NO: 1429465 - DNA, 22 bp, Homo sapiens
ccatgaacacactgtgtcctgg

SEQ ID NO: 1429466 - DNA, 13 bp, Homo sapiens
aaggaatttaaaa

SEQ ID NO: 1429467 - DNA, 16 bp, Homo sapiens
aaggaatttaaaactg

SEQ ID NO: 1429468 - DNA, 14 bp, Homo sapiens
aaggaatttgtact

SEQ ID NO: 1429469 - DNA, 16 bp, Homo sapiens
aaggaatttgtacttc

SEQ ID NO: 1429470 - DNA, 17 bp, Homo sapiens
aaggacaaagtctccag

SEQ ID NO: 1429471 - DNA, 15 bp, Homo sapiens
aaggacacagtgatg

SEQ ID NO: 1429472 - DNA, 16 bp, Homo sapiens
aaggacacttcctgcc

SEQ ID NO: 1429473 - DNA, 14 bp, Homo sapiens
aaggacagagccag

SEQ ID NO: 1429474 - DNA, 15 bp, Homo sapiens
aaggacagagccagc

SEQ ID NO: 1429475 - DNA, 18 bp, Homo sapiens
aaggacagcagctggtgc

SEQ ID NO: 1429476 - DNA, 13 bp, Homo sapiens
aaggacaggaccc

SEQ ID NO: 1429477 - DNA, 18 bp, Homo sapiens
aaggacaggaccctcagg

SEQ ID NO: 1429478 - DNA, 15 bp, Homo sapiens
aaggacattgtatgc

SEQ ID NO: 1429479 - DNA, 22 bp, Homo sapiens
aaggaccaactggcttctgtgc

SEQ ID NO: 1429480 - DNA, 12 bp, Homo sapiens
aaggaccaggac

SEQ ID NO: 1429481 - DNA, 13 bp, Homo sapiens
aaggacccaccca

SEQ ID NO: 1429482 - DNA, 24 bp, Homo sapiens
aaggacccacccatcttcctgctg

SEQ ID NO: 1429483 - DNA, 22 bp, Homo sapiens
aaggacctctttactctctccg

SEQ ID NO: 1429484 - DNA, 12 bp, Homo sapiens
aaggaccttaag

SEQ ID NO: 1429485 - DNA, 18 bp, Homo sapiens
aaggaccttaagacagag

SEQ ID NO: 1429486 - DNA, 20 bp, Homo sapiens
aaggacgctggctactgtct

SEQ ID NO: 1429487 - DNA, 17 bp, Homo sapiens
aaggacggtgccaaggg

SEQ ID NO: 1429488 - DNA, 18 bp, Homo sapiens
aaggactaacataaaatc

SEQ ID NO: 1429489 - DNA, 18 bp, Homo sapiens
aaggactgacgagagatg

SEQ ID NO: 1429490 - DNA, 21 bp, Homo sapiens
aaggactgagcaccctctgga

SEQ ID NO: 1429491 - DNA, 18 bp, Homo sapiens
aaggactggattggccaa

SEQ ID NO: 1429492 - DNA, 23 bp, Homo sapiens
aaggactggtgcgaccccccacc

SEQ ID NO: 1429493 - DNA, 16 bp, Homo sapiens
aaggacttcaggaaca

SEQ ID NO: 1429494 - DNA, 22 bp, Homo sapiens
aaggacttcctgtccagctcca

SEQ ID NO: 1429495 - DNA, 23 bp, Homo sapiens
aaggacttcctgtccagctccaa

SEQ ID NO: 1429496 - DNA, 12 bp, Homo sapiens
aaggagaaaaaa

SEQ ID NO: 1429497 - DNA, 15 bp, Homo sapiens
aaggagaaaaaaaac

SEQ ID NO: 1429498 - DNA, 16 bp, Homo sapiens
aaggagaaaaaaaacc

SEQ ID NO: 1429499 - DNA, 20 bp, Homo sapiens
aaggagaaaaaaaaccttgt

SEQ ID NO: 1429500 - DNA, 19 bp, Homo sapiens
aaggagaagagtattttta

SEQ ID NO: 1429501 - DNA, 22 bp, Homo sapiens
aaggagaatcatgtttctttga

SEQ ID NO: 1429502 - DNA, 17 bp, Homo sapiens
aaggagactcacctctg

SEQ ID NO: 1429503 - DNA, 23 bp, Homo sapiens
aaggagactcacctctgcctcaa

SEQ ID NO: 1429504 - DNA, 17 bp, Homo sapiens
aaggagagcaagaagga

SEQ ID NO: 1429505 - DNA, 17 bp, Homo sapiens
aaggagatagggaaaag

SEQ ID NO: 1429506 - DNA, 15 bp, Homo sapiens
aaggagatttcttag

SEQ ID NO: 1429507 - DNA, 13 bp, Homo sapiens
aaggagcacaagc

SEQ ID NO: 1429508 - DNA, 23 bp, Homo sapiens
aaggagcacatactacctagaag

SEQ ID NO: 1429509 - DNA, 14 bp, Homo sapiens
aaggagcccagaaa

SEQ ID NO: 1429510 - DNA, 21 bp, Homo sapiens
aaggagctactgacattccta

SEQ ID NO: 1429511 - DNA, 19 bp, Homo sapiens
aaggagctcaccctgcccg

SEQ ID NO: 1429512 - DNA, 21 bp, Homo sapiens
aaggagctcaccctgcccgct

SEQ ID NO: 1429513 - DNA, 21 bp, Homo sapiens
aaggagctgatttccaggccc

SEQ ID NO: 1429514 - DNA, 23 bp, Homo sapiens
aaggagctgggggaaggcaggag

SEQ ID NO: 1429515 - DNA, 16 bp, Homo sapiens
aaggagctttctcaat

SEQ ID NO: 1429516 - DNA, 11 bp, Homo sapiens
aaggaggaaaa

SEQ ID NO: 1429517 - DNA, 21 bp, Homo sapiens
aaggaggaggagggagaagag

SEQ ID NO: 1429518 - DNA, 23 bp, Homo sapiens
aaggaggaggagggagaagagaa

SEQ ID NO: 1429519 - DNA, 20 bp, Homo sapiens
aaggaggaggtgtctggggt

SEQ ID NO: 1429520 - DNA, 18 bp, Homo sapiens
aaggaggccaaccagccc

SEQ ID NO: 1429521 - DNA, 23 bp, Homo sapiens
aaggaggccaaccagcccgacag

SEQ ID NO: 1429522 - DNA, 18 bp, Homo sapiens
aaggagggagctgctcag

SEQ ID NO: 1429523 - DNA, 13 bp, Homo sapiens
aaggagggcagag

SEQ ID NO: 1429524 - DNA, 17 bp, Homo sapiens
aaggagggcagagccat

SEQ ID NO: 1429525 - DNA, 18 bp, Homo sapiens
aaggagggttagggaggg

SEQ ID NO: 1429526 - DNA, 13 bp, Homo sapiens
aaggagtagaaaa

SEQ ID NO: 1429527 - DNA, 17 bp, Homo sapiens
aaggagtttattacaat

SEQ ID NO: 1429528 - DNA, 19 bp, Homo sapiens
aaggagtttattacaatgt

SEQ ID NO: 1429529 - DNA, 19 bp, Homo sapiens
aaggataaatcataaagtc

SEQ ID NO: 1429530 - DNA, 19 bp, Homo sapiens
aaggatagatgctggccca

SEQ ID NO: 1429531 - DNA, 15 bp, Homo sapiens
aaggatagtaagcat

SEQ ID NO: 1429532 - DNA, 20 bp, Homo sapiens
aaggatagtgcgatgtttca

SEQ ID NO: 1429533 - DNA, 15 bp, Homo sapiens
aaggatcaattgtaa

SEQ ID NO: 1429534 - DNA, 17 bp, Homo sapiens
aaggatccaggaatatg

SEQ ID NO: 1429535 - DNA, 16 bp, Homo sapiens
aaggatctctcaggag

SEQ ID NO: 1429536 - DNA, 21 bp, Homo sapiens
aaggatctctcaggagcacag

SEQ ID NO: 1429537 - DNA, 22 bp, Homo sapiens
aaggatctgtgattggctggtt

SEQ ID NO: 1429538 - DNA, 20 bp, Homo sapiens
aaggatgaagaacacagcat

SEQ ID NO: 1429539 - DNA, 20 bp, Homo sapiens
aaggatgacaaaatggaaat

SEQ ID NO: 1429540 - DNA, 12 bp, Homo sapiens
aaggatgacttt

SEQ ID NO: 1429541 - DNA, 21 bp, Homo sapiens
aaggatggatggcaccctgga

SEQ ID NO: 1429542 - DNA, 18 bp, Homo sapiens
aaggatgggggaaagaag

SEQ ID NO: 1429543 - DNA, 21 bp, Homo sapiens
aaggatggtggttattttaaa

SEQ ID NO: 1429544 - DNA, 17 bp, Homo sapiens
aaggatgtaaacagtgc

SEQ ID NO: 1429545 - DNA, 20 bp, Homo sapiens
aaggatgtaaacagtgcctg

SEQ ID NO: 1429546 - DNA, 21 bp, Homo sapiens
aaggattcctctttgtttatc

SEQ ID NO: 1429547 - DNA, 13 bp, Homo sapiens
aaggattctggaa

SEQ ID NO: 1429548 - DNA, 14 bp, Homo sapiens
aaggattgtgatat

SEQ ID NO: 1429549 - DNA, 17 bp, Homo sapiens
aaggattttaccaaagc

SEQ ID NO: 1429550 - DNA, 18 bp, Homo sapiens
aaggattttaccaaagca

SEQ ID NO: 1429551 - DNA, 12 bp, Homo sapiens
aaggcaaataat

SEQ ID NO: 1429552 - DNA, 17 bp, Homo sapiens
aaggcacaaaattttgt

SEQ ID NO: 1429553 - DNA, 21 bp, Homo sapiens
aaggcacacagagattctgga

SEQ ID NO: 1429554 - DNA, 14 bp, Homo sapiens
aaggcacagtggga

SEQ ID NO: 1429555 - DNA, 16 bp, Homo sapiens
aaggcacagtgggagc

SEQ ID NO: 1429556 - DNA, 20 bp, Homo sapiens
aaggcacccacaaataaatg

SEQ ID NO: 1429557 - DNA, 19 bp, Homo sapiens
aaggcacccatctgtctgc

SEQ ID NO: 1429558 - DNA, 15 bp, Homo sapiens
aaggcactctagatt

SEQ ID NO: 1429559 - DNA, 16 bp, Homo sapiens
aaggcactctagattc

SEQ ID NO: 1429560 - DNA, 11 bp, Homo sapiens
aaggcactgtc

SEQ ID NO: 1429561 - DNA, 22 bp, Homo sapiens
aaggcagagaaatctaagctgt

SEQ ID NO: 1429562 - DNA, 17 bp, Homo sapiens
aaggcagaggcctgggc

SEQ ID NO: 1429563 - DNA, 13 bp, Homo sapiens
aaggcagcaggcg

SEQ ID NO: 1429564 - DNA, 12 bp, Homo sapiens
aaggcagccctc

SEQ ID NO: 1429565 - DNA, 13 bp, Homo sapiens
aaggcagcctcca

SEQ ID NO: 1429566 - DNA, 17 bp, Homo sapiens
aaggcagcctccagagc

SEQ ID NO: 1429567 - DNA, 23 bp, Homo sapiens
aaggcagcctccagagccagcct

SEQ ID NO: 1429568 - DNA, 16 bp, Homo sapiens
aaggcagctgcctctg

SEQ ID NO: 1429569 - DNA, 19 bp, Homo sapiens
aaggcaggaatgtgtggca

SEQ ID NO: 1429570 - DNA, 13 bp, Homo sapiens
aaggcaggagcct

SEQ ID NO: 1429571 - DNA, 18 bp, Homo sapiens
aaggcagggaaaggctct

SEQ ID NO: 1429572 - DNA, 17 bp, Homo sapiens
aaggcaggtgcctccag

SEQ ID NO: 1429573 - DNA, 23 bp, Homo sapiens
aaggcagtagaactccaggccct

SEQ ID NO: 1429574 - DNA, 15 bp, Homo sapiens
aaggcagttttctaa

SEQ ID NO: 1429575 - DNA, 17 bp, Homo sapiens
aaggcatacgagagcag

SEQ ID NO: 1429576 - DNA, 13 bp, Homo sapiens
aaggcatgagaaa

SEQ ID NO: 1429577 - DNA, 17 bp, Homo sapiens
aaggcattctctgaaga

SEQ ID NO: 1429578 - DNA, 15 bp, Homo sapiens
aaggcattgtttgag

SEQ ID NO: 1429579 - DNA, 14 bp, Homo sapiens
aaggccaaagataa

SEQ ID NO: 1429580 - DNA, 20 bp, Homo sapiens
aaggccaaagataaaaggtt

SEQ ID NO: 1429581 - DNA, 22 bp, Homo sapiens
aaggccacctcccactcctgct

SEQ ID NO: 1429582 - DNA, 16 bp, Homo sapiens
ccatgacaagaacaaa

SEQ ID NO: 1429583 - DNA, 18 bp, Homo sapiens
ccatgacccacccctgtg

SEQ ID NO: 1429584 - DNA, 19 bp, Homo sapiens
ccatgaccttggggtacaa

SEQ ID NO: 1429585 - DNA, 22 bp, Homo sapiens
ccatgactggctgtctgcctgt

SEQ ID NO: 1429586 - DNA, 13 bp, Homo sapiens
ccatgagaagagg

SEQ ID NO: 1429587 - DNA, 22 bp, Homo sapiens
ccatgagaataagagaaagaaa

SEQ ID NO: 1429588 - DNA, 20 bp, Homo sapiens
ccatgagatagcattagctg

SEQ ID NO: 1429589 - DNA, 13 bp, Homo sapiens
ccatgagctgctc

SEQ ID NO: 1429590 - DNA, 19 bp, Homo sapiens
ccatgaggagcgtggactc

SEQ ID NO: 1429591 - DNA, 22 bp, Homo sapiens
ccatgaggtactggtcccttcc

SEQ ID NO: 1429592 - DNA, 13 bp, Homo sapiens
ccatgatagctgg

SEQ ID NO: 1429593 - DNA, 24 bp, Homo sapiens
ccatgatcagacatacagctgcct

SEQ ID NO: 1429594 - DNA, 14 bp, Homo sapiens
ccatgatccctgtg

SEQ ID NO: 1429595 - DNA, 16 bp, Homo sapiens
ccatgatccctgtgtt

SEQ ID NO: 1429596 - DNA, 17 bp, Homo sapiens
ccatgatccctgtgttg

SEQ ID NO: 1429597 - DNA, 21 bp, Homo sapiens
ccatgatggcaacagatctgg

SEQ ID NO: 1429598 - DNA, 16 bp, Homo sapiens
ccatgcaagcagagga

SEQ ID NO: 1429599 - DNA, 17 bp, Homo sapiens
ccatgcaagcagaggac

SEQ ID NO: 1429600 - DNA, 13 bp, Homo sapiens
ccatgcaaggtgc

SEQ ID NO: 1429601 - DNA, 20 bp, Homo sapiens
ccatgcaaggtgcccacatg

SEQ ID NO: 1429602 - DNA, 22 bp, Homo sapiens
ccatgcacagtacaataatgta

SEQ ID NO: 1429603 - DNA, 15 bp, Homo sapiens
ccatgcactgtgaag

SEQ ID NO: 1429604 - DNA, 16 bp, Homo sapiens
ccatgcactgtgaagg

SEQ ID NO: 1429605 - DNA, 19 bp, Homo sapiens
ccatgcactgtgaaggacc

SEQ ID NO: 1429606 - DNA, 20 bp, Homo sapiens
ccatgcactgtgaaggaccc

SEQ ID NO: 1429607 - DNA, 15 bp, Homo sapiens
ccatgcagaaagcat

SEQ ID NO: 1429608 - DNA, 16 bp, Homo sapiens
ccatgcagccttgggg

SEQ ID NO: 1429609 - DNA, 19 bp, Homo sapiens
ccatgcaggggtcagtgca

SEQ ID NO: 1429610 - DNA, 17 bp, Homo sapiens
ccatgccaccacccacc

SEQ ID NO: 1429611 - DNA, 20 bp, Homo sapiens
ccatgccaccacccacccca

SEQ ID NO: 1429612 - DNA, 21 bp, Homo sapiens
ccatgccaccacccaccccaa

SEQ ID NO: 1429613 - DNA, 16 bp, Homo sapiens
ccatgccactgccagg

SEQ ID NO: 1429614 - DNA, 18 bp, Homo sapiens
ccatgccactgccaggca

SEQ ID NO: 1429615 - DNA, 19 bp, Homo sapiens
ccatgccactgccaggcac

SEQ ID NO: 1429616 - DNA, 20 bp, Homo sapiens
ccatgccactgccaggcacc

SEQ ID NO: 1429617 - DNA, 13 bp, Homo sapiens
ccatgcccacctg

SEQ ID NO: 1429618 - DNA, 18 bp, Homo sapiens
ccatgcccacctgcccat

SEQ ID NO: 1429619 - DNA, 17 bp, Homo sapiens
ccatgccccagctctgg

SEQ ID NO: 1429620 - DNA, 12 bp, Homo sapiens
ccatgcctgagg

SEQ ID NO: 1429621 - DNA, 16 bp, Homo sapiens
ccatgcctgagggtgg

SEQ ID NO: 1429622 - DNA, 14 bp, Homo sapiens
ccatgcctgctccc

SEQ ID NO: 1429623 - DNA, 17 bp, Homo sapiens
ccatgcctgctccctgt

SEQ ID NO: 1429624 - DNA, 19 bp, Homo sapiens
ccatgcctgctccctgtct

SEQ ID NO: 1429625 - DNA, 22 bp, Homo sapiens
ccatgcctgctccctgtctgtg

SEQ ID NO: 1429626 - DNA, 22 bp, Homo sapiens
ccatgcctgtagctttcctggt

SEQ ID NO: 1429627 - DNA, 17 bp, Homo sapiens
ccatgcctgtccagcct

SEQ ID NO: 1429628 - DNA, 18 bp, Homo sapiens
ccatgcgtgccgcctgct

SEQ ID NO: 1429629 - DNA, 20 bp, Homo sapiens
ccatgcgtgccgcctgctcc

SEQ ID NO: 1429630 - DNA, 22 bp, Homo sapiens
ccatgctatctgttcctatctg

SEQ ID NO: 1429631 - DNA, 16 bp, Homo sapiens
ccatgctcaaccactg

SEQ ID NO: 1429632 - DNA, 21 bp, Homo sapiens
ccatgctccagggtcaggcgg

SEQ ID NO: 1429633 - DNA, 15 bp, Homo sapiens
ccatgctcctcacct

SEQ ID NO: 1429634 - DNA, 18 bp, Homo sapiens
ccatgctgaggcctgggc

SEQ ID NO: 1429635 - DNA, 20 bp, Homo sapiens
ccatgctgctggggaagaca

SEQ ID NO: 1429636 - DNA, 22 bp, Homo sapiens
ccatgctgctttttggcacagt

SEQ ID NO: 1429637 - DNA, 17 bp, Homo sapiens
ccatgctgggccactgg

SEQ ID NO: 1429638 - DNA, 20 bp, Homo sapiens
ccatgctgggccactgggga

SEQ ID NO: 1429639 - DNA, 19 bp, Homo sapiens
ccatgctgtgcgcccaggg

SEQ ID NO: 1429640 - DNA, 20 bp, Homo sapiens
ccatgctgtgcgcccagggc

SEQ ID NO: 1429641 - DNA, 18 bp, Homo sapiens
ccatgcttagtcactgcc

SEQ ID NO: 1429642 - DNA, 15 bp, Homo sapiens
ccatgcttgggtgta

SEQ ID NO: 1429643 - DNA, 18 bp, Homo sapiens
ccatggatttccactgct

SEQ ID NO: 1429644 - DNA, 14 bp, Homo sapiens
ccatggcaccagcc

SEQ ID NO: 1429645 - DNA, 21 bp, Homo sapiens
ccatggcaccagccccctgga

SEQ ID NO: 1429646 - DNA, 13 bp, Homo sapiens
ccatggcagcagc

SEQ ID NO: 1429647 - DNA, 17 bp, Homo sapiens
ccatggcagcagccagg

SEQ ID NO: 1429648 - DNA, 20 bp, Homo sapiens
ccatggcagcagccagggac

SEQ ID NO: 1429649 - DNA, 16 bp, Homo sapiens
ccatggccccaggccc

SEQ ID NO: 1429650 - DNA, 20 bp, Homo sapiens
ccatggcccccaataaaggc

SEQ ID NO: 1429651 - DNA, 22 bp, Homo sapiens
ccatggcccccaataaaggcag

SEQ ID NO: 1429652 - DNA, 23 bp, Homo sapiens
ccatggcccccaataaaggcagc

SEQ ID NO: 1429653 - DNA, 17 bp, Homo sapiens
ccatggcctctggccag

SEQ ID NO: 1429654 - DNA, 15 bp, Homo sapiens
ccatggcctgtgctg

SEQ ID NO: 1429655 - DNA, 13 bp, Homo sapiens
ccatggctcaggc

SEQ ID NO: 1429656 - DNA, 17 bp, Homo sapiens
ccatggctcaggcaagc

SEQ ID NO: 1429657 - DNA, 18 bp, Homo sapiens
ccatggctcaggcaagcc

SEQ ID NO: 1429658 - DNA, 17 bp, Homo sapiens
ccatggctcagggtggt

SEQ ID NO: 1429659 - DNA, 18 bp, Homo sapiens
ccatggctgaagctggag

SEQ ID NO: 1429660 - DNA, 19 bp, Homo sapiens
ccatggctgaagctggagc

SEQ ID NO: 1429661 - DNA, 22 bp, Homo sapiens
ccatggctgaagctggagcagc

SEQ ID NO: 1429662 - DNA, 11 bp, Homo sapiens
ccatgggcctg

SEQ ID NO: 1429663 - DNA, 19 bp, Homo sapiens
ccatgggcctgggcctgct

SEQ ID NO: 1429664 - DNA, 23 bp, Homo sapiens
ccatggggaaaccctggagccat

SEQ ID NO: 1429665 - DNA, 18 bp, Homo sapiens
ccatgggggtgagaccct

SEQ ID NO: 1429666 - DNA, 17 bp, Homo sapiens
ccatggggtccttggag

SEQ ID NO: 1429667 - DNA, 16 bp, Homo sapiens
ccatggtactgtagca

SEQ ID NO: 1429668 - DNA, 20 bp, Homo sapiens
ccatggtactgtagcagggg

SEQ ID NO: 1429669 - DNA, 14 bp, Homo sapiens
ccatggtgcttgtt

SEQ ID NO: 1429670 - DNA, 15 bp, Homo sapiens
ccatggttaagtcat

SEQ ID NO: 1429671 - DNA, 23 bp, Homo sapiens
ccatgtaaatccccactgggacc

SEQ ID NO: 1429672 - DNA, 23 bp, Homo sapiens
ccatgtaaggttgtgcagggtgt

SEQ ID NO: 1429673 - DNA, 16 bp, Homo sapiens
ccatgtacatgaagaa

SEQ ID NO: 1429674 - DNA, 17 bp, Homo sapiens
ccatgtactagttttag

SEQ ID NO: 1429675 - DNA, 14 bp, Homo sapiens
ccatgtagccccct

SEQ ID NO: 1429676 - DNA, 18 bp, Homo sapiens
ccatgtattcacacaccc

SEQ ID NO: 1429677 - DNA, 14 bp, Homo sapiens
ccatgtatttgtta

SEQ ID NO: 1429678 - DNA, 14 bp, Homo sapiens
ccatgtcacctcag

SEQ ID NO: 1429679 - DNA, 13 bp, Homo sapiens
ccatgtccaaaga

SEQ ID NO: 1429680 - DNA, 14 bp, Homo sapiens
ccatgtccaaagag

SEQ ID NO: 1429681 - DNA, 20 bp, Homo sapiens
ccatgtccaaagaggctgcc

SEQ ID NO: 1429682 - DNA, 23 bp, Homo sapiens
ccatgtccaaagaggctgcccct

SEQ ID NO: 1429683 - DNA, 14 bp, Homo sapiens
ccatgtcgcttttg

SEQ ID NO: 1429684 - DNA, 20 bp, Homo sapiens
ccatgtctgcagtgtgcccc

SEQ ID NO: 1429685 - DNA, 13 bp, Homo sapiens
ccatgtgagccac

SEQ ID NO: 1429686 - DNA, 17 bp, Homo sapiens
ccatgtgagccaccgct

SEQ ID NO: 1429687 - DNA, 18 bp, Homo sapiens
ccatgtgagtccctgtga

SEQ ID NO: 1429688 - DNA, 13 bp, Homo sapiens
ccatgtgcaataa

SEQ ID NO: 1429689 - DNA, 22 bp, Homo sapiens
ccatgtgccatctgtacatatt

SEQ ID NO: 1429690 - DNA, 19 bp, Homo sapiens
ccatgtgcctgcaccagga

SEQ ID NO: 1429691 - DNA, 20 bp, Homo sapiens
ccatgtgcctgcaccaggag

SEQ ID NO: 1429692 - DNA, 12 bp, Homo sapiens
ccatgtgcctgt

SEQ ID NO: 1429693 - DNA, 21 bp, Homo sapiens
ccatgtgcctgtcacgctctg

SEQ ID NO: 1429694 - DNA, 15 bp, Homo sapiens
ccatgtgcctttctt

SEQ ID NO: 1429695 - DNA, 19 bp, Homo sapiens
ccatgtgcctttctttgcc

SEQ ID NO: 1429696 - DNA, 20 bp, Homo sapiens
ccatgtgcctttctttgcct

SEQ ID NO: 1429697 - DNA, 22 bp, Homo sapiens
ccatgtgcctttctttgcctct

SEQ ID NO: 1429698 - DNA, 15 bp, Homo sapiens
aaggccacctctgcc

SEQ ID NO: 1429699 - DNA, 17 bp, Homo sapiens
aaggccagagtggcctg

SEQ ID NO: 1429700 - DNA, 19 bp, Homo sapiens
aaggccagagtggcctggc

SEQ ID NO: 1429701 - DNA, 21 bp, Homo sapiens
aaggccagagtggcctggcca

SEQ ID NO: 1429702 - DNA, 15 bp, Homo sapiens
aaggccccagagaga

SEQ ID NO: 1429703 - DNA, 15 bp, Homo sapiens
aaggcccctgcaatg

SEQ ID NO: 1429704 - DNA, 16 bp, Homo sapiens
aaggccccttccctgg

SEQ ID NO: 1429705 - DNA, 16 bp, Homo sapiens
aaggccgaagctctgg

SEQ ID NO: 1429706 - DNA, 18 bp, Homo sapiens
aaggccgaagctctggct

SEQ ID NO: 1429707 - DNA, 16 bp, Homo sapiens
aaggcctaggattcta

SEQ ID NO: 1429708 - DNA, 18 bp, Homo sapiens
aaggcctaggattctaaa

SEQ ID NO: 1429709 - DNA, 13 bp, Homo sapiens
aaggcctctctct

SEQ ID NO: 1429710 - DNA, 18 bp, Homo sapiens
aaggcctctctctgcctg

SEQ ID NO: 1429711 - DNA, 15 bp, Homo sapiens
aaggcctcttgtgct

SEQ ID NO: 1429712 - DNA, 16 bp, Homo sapiens
aaggcctcttgtgctc

SEQ ID NO: 1429713 - DNA, 23 bp, Homo sapiens
aaggcctcttgtgctcacgctcc

SEQ ID NO: 1429714 - DNA, 17 bp, Homo sapiens
aaggcctgtgctgcatg

SEQ ID NO: 1429715 - DNA, 17 bp, Homo sapiens
aaggccttcagacacat

SEQ ID NO: 1429716 - DNA, 20 bp, Homo sapiens
aaggccttcatggccccagc

SEQ ID NO: 1429717 - DNA, 12 bp, Homo sapiens
aaggccttctcc

SEQ ID NO: 1429718 - DNA, 16 bp, Homo sapiens
aaggcgaggagagtgg

SEQ ID NO: 1429719 - DNA, 20 bp, Homo sapiens
aaggctaagcatggcctgga

SEQ ID NO: 1429720 - DNA, 15 bp, Homo sapiens
aaggctatgtaaaca

SEQ ID NO: 1429721 - DNA, 15 bp, Homo sapiens
aaggctatgtgatta

SEQ ID NO: 1429722 - DNA, 14 bp, Homo sapiens
aaggctcagaagga

SEQ ID NO: 1429723 - DNA, 17 bp, Homo sapiens
aaggctcatttaaaaca

SEQ ID NO: 1429724 - DNA, 18 bp, Homo sapiens
aaggctcatttaaaacag

SEQ ID NO: 1429725 - DNA, 21 bp, Homo sapiens
aaggctccctcgccctgtgag

SEQ ID NO: 1429726 - DNA, 22 bp, Homo sapiens
aaggctccctcgccctgtgagg

SEQ ID NO: 1429727 - DNA, 20 bp, Homo sapiens
aaggctctatgagtctagat

SEQ ID NO: 1429728 - DNA, 21 bp, Homo sapiens
aaggctctatgagtctagatg

SEQ ID NO: 1429729 - DNA, 18 bp, Homo sapiens
aaggctctgaaagccagc

SEQ ID NO: 1429730 - DNA, 21 bp, Homo sapiens
aaggctctgagagtctagatt

SEQ ID NO: 1429731 - DNA, 22 bp, Homo sapiens
aaggctctgagagtctagattc

SEQ ID NO: 1429732 - DNA, 12 bp, Homo sapiens
aaggctgaaaag

SEQ ID NO: 1429733 - DNA, 13 bp, Homo sapiens
aaggctgaaaaga

SEQ ID NO: 1429734 - DNA, 18 bp, Homo sapiens
aaggctgaactcttcaga

SEQ ID NO: 1429735 - DNA, 17 bp, Homo sapiens
aaggctgaccaagagag

SEQ ID NO: 1429736 - DNA, 22 bp, Homo sapiens
aaggctgagacagtgaatttgg

SEQ ID NO: 1429737 - DNA, 16 bp, Homo sapiens
aaggctgatgtcaatt

SEQ ID NO: 1429738 - DNA, 23 bp, Homo sapiens
aaggctgtgaccttacagccatt

SEQ ID NO: 1429739 - DNA, 20 bp, Homo sapiens
aaggctgttaaatacaggaa

SEQ ID NO: 1429740 - DNA, 21 bp, Homo sapiens
aaggctgttaaatacaggaaa

SEQ ID NO: 1429741 - DNA, 16 bp, Homo sapiens
aaggcttggctggtgt

SEQ ID NO: 1429742 - DNA, 17 bp, Homo sapiens
aaggctttttcttccct

SEQ ID NO: 1429743 - DNA, 16 bp, Homo sapiens
aagggaaaaaaaatgt

SEQ ID NO: 1429744 - DNA, 17 bp, Homo sapiens
aagggaaactgccagca

SEQ ID NO: 1429745 - DNA, 15 bp, Homo sapiens
aagggaaagcctctg

SEQ ID NO: 1429746 - DNA, 16 bp, Homo sapiens
aagggaaagcctctgg

SEQ ID NO: 1429747 - DNA, 22 bp, Homo sapiens
aagggaaagcttcattctcctt

SEQ ID NO: 1429748 - DNA, 13 bp, Homo sapiens
aagggaaatatca

SEQ ID NO: 1429749 - DNA, 14 bp, Homo sapiens
aagggaaatatcat

SEQ ID NO: 1429750 - DNA, 15 bp, Homo sapiens
aagggaacctgtgtc

SEQ ID NO: 1429751 - DNA, 15 bp, Homo sapiens
aagggaagtgaggcc

SEQ ID NO: 1429752 - DNA, 16 bp, Homo sapiens
aagggaagtgaggccc

SEQ ID NO: 1429753 - DNA, 20 bp, Homo sapiens
aagggaagtgaggcccaagg

SEQ ID NO: 1429754 - DNA, 14 bp, Homo sapiens
aagggaattgctca

SEQ ID NO: 1429755 - DNA, 19 bp, Homo sapiens
aagggacagcaagtgagca

SEQ ID NO: 1429756 - DNA, 12 bp, Homo sapiens
aagggagaagaa

SEQ ID NO: 1429757 - DNA, 21 bp, Homo sapiens
aagggagaaggaagggcagag

SEQ ID NO: 1429758 - DNA, 23 bp, Homo sapiens
aagggagaataaaattcctatct

SEQ ID NO: 1429759 - DNA, 13 bp, Homo sapiens
aagggagagaaaa

SEQ ID NO: 1429760 - DNA, 16 bp, Homo sapiens
aagggagagaaaagct

SEQ ID NO: 1429761 - DNA, 23 bp, Homo sapiens
aagggagagggcctctgcctggg

SEQ ID NO: 1429762 - DNA, 24 bp, Homo sapiens
aagggagcactgggttgactttca

SEQ ID NO: 1429763 - DNA, 20 bp, Homo sapiens
aagggagcccctcctctgag

SEQ ID NO: 1429764 - DNA, 23 bp, Homo sapiens
aagggagcccctcctctgagcag

SEQ ID NO: 1429765 - DNA, 16 bp, Homo sapiens
aagggaggcagtggct

SEQ ID NO: 1429766 - DNA, 19 bp, Homo sapiens
aagggagggtgcagccctc

SEQ ID NO: 1429767 - DNA, 12 bp, Homo sapiens
aagggagggtgg

SEQ ID NO: 1429768 - DNA, 23 bp, Homo sapiens
aagggagtggggctggggaaagg

SEQ ID NO: 1429769 - DNA, 15 bp, Homo sapiens
aagggatataaaatg

SEQ ID NO: 1429770 - DNA, 17 bp, Homo sapiens
aagggatataaaatgaa

SEQ ID NO: 1429771 - DNA, 13 bp, Homo sapiens
aagggatcctgcc

SEQ ID NO: 1429772 - DNA, 15 bp, Homo sapiens
aagggatggaaaagg

SEQ ID NO: 1429773 - DNA, 20 bp, Homo sapiens
aagggatggaaaaggaagac

SEQ ID NO: 1429774 - DNA, 23 bp, Homo sapiens
aagggcaagaaatggcgtctgct

SEQ ID NO: 1429775 - DNA, 18 bp, Homo sapiens
aagggcactcccaaccct

SEQ ID NO: 1429776 - DNA, 19 bp, Homo sapiens
aagggcagagttacttgat

SEQ ID NO: 1429777 - DNA, 21 bp, Homo sapiens
aagggcaggaaggagagcctg

SEQ ID NO: 1429778 - DNA, 11 bp, Homo sapiens
aagggccagag

SEQ ID NO: 1429779 - DNA, 13 bp, Homo sapiens
aagggccagagcc

SEQ ID NO: 1429780 - DNA, 15 bp, Homo sapiens
aagggccagagccag

SEQ ID NO: 1429781 - DNA, 17 bp, Homo sapiens
aagggccagagccaggg

SEQ ID NO: 1429782 - DNA, 14 bp, Homo sapiens
aagggccagtcctg

SEQ ID NO: 1429783 - DNA, 14 bp, Homo sapiens
aagggccagtctgg

SEQ ID NO: 1429784 - DNA, 14 bp, Homo sapiens
aagggcccagaccc

SEQ ID NO: 1429785 - DNA, 18 bp, Homo sapiens
aagggccccaggggcagc

SEQ ID NO: 1429786 - DNA, 13 bp, Homo sapiens
aagggccctggca

SEQ ID NO: 1429787 - DNA, 23 bp, Homo sapiens
aagggcctgcccagttgcactca

SEQ ID NO: 1429788 - DNA, 13 bp, Homo sapiens
aagggcctggcca

SEQ ID NO: 1429789 - DNA, 23 bp, Homo sapiens
aagggcgcctactcttcagggtc

SEQ ID NO: 1429790 - DNA, 13 bp, Homo sapiens
aagggctccagca

SEQ ID NO: 1429791 - DNA, 15 bp, Homo sapiens
aagggctccagcatc

SEQ ID NO: 1429792 - DNA, 21 bp, Homo sapiens
aagggctccagcatccagcct

SEQ ID NO: 1429793 - DNA, 23 bp, Homo sapiens
aagggctccagcatccagcctgt

SEQ ID NO: 1429794 - DNA, 15 bp, Homo sapiens
aagggctgcatgatg

SEQ ID NO: 1429795 - DNA, 11 bp, Homo sapiens
aagggctgccg

SEQ ID NO: 1429796 - DNA, 14 bp, Homo sapiens
aagggctggctgca

SEQ ID NO: 1429797 - DNA, 15 bp, Homo sapiens
aagggctggctgcaa

SEQ ID NO: 1429798 - DNA, 14 bp, Homo sapiens
aagggcttactatt

SEQ ID NO: 1429799 - DNA, 20 bp, Homo sapiens
aagggctttggttccttctc

SEQ ID NO: 1429800 - DNA, 20 bp, Homo sapiens
aagggcttttcaaaatcatt

SEQ ID NO: 1429801 - DNA, 18 bp, Homo sapiens
aaggggaagcactcgtgt

SEQ ID NO: 1429802 - DNA, 11 bp, Homo sapiens
aaggggacagc

SEQ ID NO: 1429803 - DNA, 17 bp, Homo sapiens
aaggggaggcacacttt

SEQ ID NO: 1429804 - DNA, 23 bp, Homo sapiens
aaggggaggcacactttctggca

SEQ ID NO: 1429805 - DNA, 14 bp, Homo sapiens
aaggggcacaccac

SEQ ID NO: 1429806 - DNA, 23 bp, Homo sapiens
aaggggcacaccactgccctgcc

SEQ ID NO: 1429807 - DNA, 13 bp, Homo sapiens
aaggggcagcagg

SEQ ID NO: 1429808 - DNA, 22 bp, Homo sapiens
aaggggcccaaattctttcagt

SEQ ID NO: 1429809 - DNA, 21 bp, Homo sapiens
aaggggcccaagccccatctc

SEQ ID NO: 1429810 - DNA, 16 bp, Homo sapiens
aaggggccccggggct

SEQ ID NO: 1429811 - DNA, 17 bp, Homo sapiens
aaggggccccggggctg

SEQ ID NO: 1429812 - DNA, 20 bp, Homo sapiens
aaggggccccggggctggca

SEQ ID NO: 1429813 - DNA, 21 bp, Homo sapiens
aaggggccctggtccttccag

SEQ ID NO: 1429814 - DNA, 20 bp, Homo sapiens
aaggggcggtgcccacaccg

SEQ ID NO: 1429815 - DNA, 16 bp, Homo sapiens
aaggggctgaaagaac

SEQ ID NO: 1429816 - DNA, 14 bp, Homo sapiens
aaggggctggctgg

SEQ ID NO: 1429817 - DNA, 19 bp, Homo sapiens
aagggggacgtttctggaa

SEQ ID NO: 1429818 - DNA, 13 bp, Homo sapiens
aagggggccctgc

SEQ ID NO: 1429819 - DNA, 16 bp, Homo sapiens
aagggggctctgcccc

SEQ ID NO: 1429820 - DNA, 19 bp, Homo sapiens
aagggggctctgccccagg

SEQ ID NO: 1429821 - DNA, 13 bp, Homo sapiens
aaggggggagggg

SEQ ID NO: 1429822 - DNA, 16 bp, Homo sapiens
aaggggggagggggag

SEQ ID NO: 1429823 - DNA, 14 bp, Homo sapiens
aagggggtgactgg

SEQ ID NO: 1429824 - DNA, 11 bp, Homo sapiens
aagggggtggg

SEQ ID NO: 1429825 - DNA, 17 bp, Homo sapiens
aagggggtggtgtctcc

SEQ ID NO: 1429826 - DNA, 17 bp, Homo sapiens
aaggggtgcttttatag

SEQ ID NO: 1429827 - DNA, 20 bp, Homo sapiens
aaggggtgggtcagaacatg

SEQ ID NO: 1429828 - DNA, 14 bp, Homo sapiens
aaggggttcctcaa

SEQ ID NO: 1429829 - DNA, 19 bp, Homo sapiens
aaggggttcctcaaatttt

SEQ ID NO: 1429830 - DNA, 21 bp, Homo sapiens
aagggtcgaaagctctagaat

SEQ ID NO: 1429831 - DNA, 16 bp, Homo sapiens
aagggtgaaaattatt

SEQ ID NO: 1429832 - DNA, 23 bp, Homo sapiens
aagggtgtaggggccacctcctc

SEQ ID NO: 1429833 - DNA, 18 bp, Homo sapiens
aagggtttcgactggtcc

SEQ ID NO: 1429834 - DNA, 13 bp, Homo sapiens
aagggtttctcta

SEQ ID NO: 1429835 - DNA, 21 bp, Homo sapiens
aagggttttccaccctggaat

SEQ ID NO: 1429836 - DNA, 12 bp, Homo sapiens
aagggttttctt

SEQ ID NO: 1429837 - DNA, 17 bp, Homo sapiens
aagggttttcttttctt

SEQ ID NO: 1429838 - DNA, 19 bp, Homo sapiens
aagggtttttagagaatgt

SEQ ID NO: 1429839 - DNA, 14 bp, Homo sapiens
aaggtaaaaagtta

SEQ ID NO: 1429840 - DNA, 12 bp, Homo sapiens
aaggtaattgtt

SEQ ID NO: 1429841 - DNA, 13 bp, Homo sapiens
aaggtaattgttt

SEQ ID NO: 1429842 - DNA, 19 bp, Homo sapiens
aaggtaattgttttttaaa

SEQ ID NO: 1429843 - DNA, 17 bp, Homo sapiens
aaggtacaactgtattt

SEQ ID NO: 1429844 - DNA, 20 bp, Homo sapiens
aaggtagaaatatctgaaaa

SEQ ID NO: 1429845 - DNA, 20 bp, Homo sapiens
aaggtagcattctttggagt

SEQ ID NO: 1429846 - DNA, 14 bp, Homo sapiens
aaggtagccatccc

SEQ ID NO: 1429847 - DNA, 15 bp, Homo sapiens
aaggtataataaaat

SEQ ID NO: 1429848 - DNA, 15 bp, Homo sapiens
aaggtatattgtgaa

SEQ ID NO: 1429849 - DNA, 22 bp, Homo sapiens
aaggtattaaattgatgttgct

SEQ ID NO: 1429850 - DNA, 21 bp, Homo sapiens
aaggtattaagattataattg

SEQ ID NO: 1429851 - DNA, 22 bp, Homo sapiens
aaggtattaagattataattgt

SEQ ID NO: 1429852 - DNA, 22 bp, Homo sapiens
aaggtattatacatgtgataca

SEQ ID NO: 1429853 - DNA, 23 bp, Homo sapiens
aaggtatttctccagttgggact

SEQ ID NO: 1429854 - DNA, 19 bp, Homo sapiens
aaggtcagcccgtttcaga

SEQ ID NO: 1429855 - DNA, 23 bp, Homo sapiens
aaggtcagcccgtttcagaagga

SEQ ID NO: 1429856 - DNA, 14 bp, Homo sapiens
aaggtcccctggca

SEQ ID NO: 1429857 - DNA, 21 bp, Homo sapiens
aaggtccggtgttctaagatg

SEQ ID NO: 1429858 - DNA, 14 bp, Homo sapiens
aaggtcctctcagt

SEQ ID NO: 1429859 - DNA, 19 bp, Homo sapiens
aaggtctcctaaaactggg

SEQ ID NO: 1429860 - DNA, 18 bp, Homo sapiens
aaggtctttcagtacttt

SEQ ID NO: 1429861 - DNA, 19 bp, Homo sapiens
aaggtgaaaggcatgtctt

SEQ ID NO: 1429862 - DNA, 19 bp, Homo sapiens
aaggtgacatcggaaaaat

SEQ ID NO: 1429863 - DNA, 17 bp, Homo sapiens
aaggtgagaattaagtt

SEQ ID NO: 1429864 - DNA, 21 bp, Homo sapiens
aaggtgagtttgagctgcctt

SEQ ID NO: 1429865 - DNA, 22 bp, Homo sapiens
aaggtgagtttgagctgccttc

SEQ ID NO: 1429866 - DNA, 13 bp, Homo sapiens
aaggtgatgttgt

SEQ ID NO: 1429867 - DNA, 21 bp, Homo sapiens
aaggtgccaccaccctgcccc

SEQ ID NO: 1429868 - DNA, 13 bp, Homo sapiens
aaggtgccacttt

SEQ ID NO: 1429869 - DNA, 13 bp, Homo sapiens
aaggtgcctcaga

SEQ ID NO: 1429870 - DNA, 20 bp, Homo sapiens
aaggtgcctgtgaggcaggg

SEQ ID NO: 1429871 - DNA, 14 bp, Homo sapiens
aaggtgctgagctt

SEQ ID NO: 1429872 - DNA, 21 bp, Homo sapiens
aaggtggaataaacattaatt

SEQ ID NO: 1429873 - DNA, 18 bp, Homo sapiens
aaggtggaccagaatgaa

SEQ ID NO: 1429874 - DNA, 16 bp, Homo sapiens
aaggtggagggaagga

SEQ ID NO: 1429875 - DNA, 22 bp, Homo sapiens
aaggtggattttgtttaaaaaa

SEQ ID NO: 1429876 - DNA, 22 bp, Homo sapiens
aaggtgggccttgctacctcaa

SEQ ID NO: 1429877 - DNA, 16 bp, Homo sapiens
aaggtgggctgagccc

SEQ ID NO: 1429878 - DNA, 18 bp, Homo sapiens
aaggtggggccctgcccc

SEQ ID NO: 1429879 - DNA, 15 bp, Homo sapiens
aaggtgggtccagga

SEQ ID NO: 1429880 - DNA, 21 bp, Homo sapiens
aaggtgggtccaggaaggcag

SEQ ID NO: 1429881 - DNA, 22 bp, Homo sapiens
aaggtggtatgtaatttatgca

SEQ ID NO: 1429882 - DNA, 15 bp, Homo sapiens
aaggtgtccagggtc

SEQ ID NO: 1429883 - DNA, 19 bp, Homo sapiens
aaggtgtcttttccactcc

SEQ ID NO: 1429884 - DNA, 18 bp, Homo sapiens
aaggttactgggagtgtg

SEQ ID NO: 1429885 - DNA, 18 bp, Homo sapiens
aaggttagagaataaatt

SEQ ID NO: 1429886 - DNA, 17 bp, Homo sapiens
aaggttaggatttaaca

SEQ ID NO: 1429887 - DNA, 15 bp, Homo sapiens
aaggttataattttt

SEQ ID NO: 1429888 - DNA, 22 bp, Homo sapiens
aaggttatagtaacatcaaaga

SEQ ID NO: 1429889 - DNA, 17 bp, Homo sapiens
aaggttcactaaagcag

SEQ ID NO: 1429890 - DNA, 21 bp, Homo sapiens
aaggttccaactgtatatatt

SEQ ID NO: 1429891 - DNA, 11 bp, Homo sapiens
aaggttctaag

SEQ ID NO: 1429892 - DNA, 13 bp, Homo sapiens
aaggttctaggtt

SEQ ID NO: 1429893 - DNA, 13 bp, Homo sapiens
aaggttctcagac

SEQ ID NO: 1429894 - DNA, 20 bp, Homo sapiens
aaggttcttcatccctttcc

SEQ ID NO: 1429895 - DNA, 21 bp, Homo sapiens
aaggttcttcccttttacata

SEQ ID NO: 1429896 - DNA, 13 bp, Homo sapiens
aaggttgaataat

SEQ ID NO: 1429897 - DNA, 17 bp, Homo sapiens
aaggttgaataatatat

SEQ ID NO: 1429898 - DNA, 13 bp, Homo sapiens
aaggttgcagtgc

SEQ ID NO: 1429899 - DNA, 19 bp, Homo sapiens
aaggttgccaaattgctgc

SEQ ID NO: 1429900 - DNA, 20 bp, Homo sapiens
aaggttgccaaattgctgca

SEQ ID NO: 1429901 - DNA, 16 bp, Homo sapiens
aaggttggagcccagg

SEQ ID NO: 1429902 - DNA, 14 bp, Homo sapiens
aaggttggatggat

SEQ ID NO: 1429903 - DNA, 19 bp, Homo sapiens
aaggttggcgactgtcatg

SEQ ID NO: 1429904 - DNA, 18 bp, Homo sapiens
aaggttgtatgtaaatct

SEQ ID NO: 1429905 - DNA, 14 bp, Homo sapiens
aaggtttattgtta

SEQ ID NO: 1429906 - DNA, 16 bp, Homo sapiens
aaggtttcgtttctgt

SEQ ID NO: 1429907 - DNA, 18 bp, Homo sapiens
aaggtttggaaggagcag

SEQ ID NO: 1429908 - DNA, 14 bp, Homo sapiens
aaggtttgttttca

SEQ ID NO: 1429909 - DNA, 19 bp, Homo sapiens
aaggttttaggttctaaag

SEQ ID NO: 1429910 - DNA, 23 bp, Homo sapiens
aaggttttaggttctaaagttct

SEQ ID NO: 1429911 - DNA, 12 bp, Homo sapiens
aaggttttgtct

SEQ ID NO: 1429912 - DNA, 17 bp, Homo sapiens
aaggtttttaaaagtaa

SEQ ID NO: 1429913 - DNA, 14 bp, Homo sapiens
aaggtttttgtaaa

SEQ ID NO: 1429914 - DNA, 18 bp, Homo sapiens
aaggtttttgtaaagatt

SEQ ID NO: 1429915 - DNA, 15 bp, Homo sapiens
aagtaaaaaaatatg

SEQ ID NO: 1429916 - DNA, 13 bp, Homo sapiens
aagtaaaaacact

SEQ ID NO: 1429917 - DNA, 13 bp, Homo sapiens
aagtaaaaattaa

SEQ ID NO: 1429918 - DNA, 15 bp, Homo sapiens
aagtaaaaccacagc

SEQ ID NO: 1429919 - DNA, 16 bp, Homo sapiens
aagtaaaaccacagca

SEQ ID NO: 1429920 - DNA, 12 bp, Homo sapiens
aagtaaaacttg

SEQ ID NO: 1429921 - DNA, 14 bp, Homo sapiens
aagtaaaatgaaca

SEQ ID NO: 1429922 - DNA, 13 bp, Homo sapiens
aagtaaaattgct

SEQ ID NO: 1429923 - DNA, 12 bp, Homo sapiens
aagtaaactttt

SEQ ID NO: 1429924 - DNA, 16 bp, Homo sapiens
aagtaaagtgatgttt

SEQ ID NO: 1429925 - DNA, 12 bp, Homo sapiens
aagtaaatatat

SEQ ID NO: 1429926 - DNA, 12 bp, Homo sapiens
aagtaaatgcta

SEQ ID NO: 1429927 - DNA, 19 bp, Homo sapiens
aagtaacaatctatggctt

SEQ ID NO: 1429928 - DNA, 14 bp, Homo sapiens
aagtaacacatttg

SEQ ID NO: 1429929 - DNA, 17 bp, Homo sapiens
aagtaacccctcctggc

SEQ ID NO: 1429930 - DNA, 18 bp, Homo sapiens
aagtaacccctcctggct

SEQ ID NO: 1429931 - DNA, 12 bp, Homo sapiens
aagtaactcatt

SEQ ID NO: 1429932 - DNA, 23 bp, Homo sapiens
ccatgtgcctttctttgcctctg

SEQ ID NO: 1429933 - DNA, 21 bp, Homo sapiens
ccatgtggcagaagtgctctt

SEQ ID NO: 1429934 - DNA, 23 bp, Homo sapiens
ccatgtggcagaagtgctctttg

SEQ ID NO: 1429935 - DNA, 16 bp, Homo sapiens
ccatgtgggcacggag

SEQ ID NO: 1429936 - DNA, 22 bp, Homo sapiens
ccatgtgggcgcccaccctggg

SEQ ID NO: 1429937 - DNA, 18 bp, Homo sapiens
ccatgtgggtgaccaggt

SEQ ID NO: 1429938 - DNA, 14 bp, Homo sapiens
ccatgtgtcctggt

SEQ ID NO: 1429939 - DNA, 17 bp, Homo sapiens
ccatgtgtcctggttcc

SEQ ID NO: 1429940 - DNA, 18 bp, Homo sapiens
ccatgttagtttttactt

SEQ ID NO: 1429941 - DNA, 22 bp, Homo sapiens
ccatgttcacaccgctgcactc

SEQ ID NO: 1429942 - DNA, 16 bp, Homo sapiens
ccatgttcattataat

SEQ ID NO: 1429943 - DNA, 13 bp, Homo sapiens
ccatgttgctgcc

SEQ ID NO: 1429944 - DNA, 23 bp, Homo sapiens
ccatgttggccaggctggtctca

SEQ ID NO: 1429945 - DNA, 17 bp, Homo sapiens
ccatgttgtaatgctgc

SEQ ID NO: 1429946 - DNA, 23 bp, Homo sapiens
ccatgtttatttatttccagtgg

SEQ ID NO: 1429947 - DNA, 23 bp, Homo sapiens
ccatgtttggtgtttgtctgtgt

SEQ ID NO: 1429948 - DNA, 14 bp, Homo sapiens
ccattaaaactgct

SEQ ID NO: 1429949 - DNA, 14 bp, Homo sapiens
ccattaattacata

SEQ ID NO: 1429950 - DNA, 14 bp, Homo sapiens
ccattaccaaaata

SEQ ID NO: 1429951 - DNA, 13 bp, Homo sapiens
ccattacccagtg

SEQ ID NO: 1429952 - DNA, 16 bp, Homo sapiens
ccattacctccatcca

SEQ ID NO: 1429953 - DNA, 14 bp, Homo sapiens
ccattacctgtacc

SEQ ID NO: 1429954 - DNA, 21 bp, Homo sapiens
ccattactgtgatttctggct

SEQ ID NO: 1429955 - DNA, 13 bp, Homo sapiens
ccattaggccagc

SEQ ID NO: 1429956 - DNA, 13 bp, Homo sapiens
ccattatgcaaat

SEQ ID NO: 1429957 - DNA, 14 bp, Homo sapiens
ccattattatttct

SEQ ID NO: 1429958 - DNA, 19 bp, Homo sapiens
ccattattatttctgttct

SEQ ID NO: 1429959 - DNA, 19 bp, Homo sapiens
ccattcacaataaaagctt

SEQ ID NO: 1429960 - DNA, 21 bp, Homo sapiens
ccattcactactcatgcgtga

SEQ ID NO: 1429961 - DNA, 17 bp, Homo sapiens
ccattcactcttccaga

SEQ ID NO: 1429962 - DNA, 16 bp, Homo sapiens
ccattcagacacttca

SEQ ID NO: 1429963 - DNA, 13 bp, Homo sapiens
ccattcatccttc

SEQ ID NO: 1429964 - DNA, 15 bp, Homo sapiens
ccattcatccttcca

SEQ ID NO: 1429965 - DNA, 21 bp, Homo sapiens
ccattccaaaatattatgccc

SEQ ID NO: 1429966 - DNA, 19 bp, Homo sapiens
ccattcccccatgtggctg

SEQ ID NO: 1429967 - DNA, 18 bp, Homo sapiens
ccattccctccatttttc

SEQ ID NO: 1429968 - DNA, 13 bp, Homo sapiens
ccattcctgcctt

SEQ ID NO: 1429969 - DNA, 20 bp, Homo sapiens
ccattcctggtacccagcca

SEQ ID NO: 1429970 - DNA, 24 bp, Homo sapiens
ccattcctggtacccagccatctg

SEQ ID NO: 1429971 - DNA, 16 bp, Homo sapiens
ccattcgtctgtccca

SEQ ID NO: 1429972 - DNA, 19 bp, Homo sapiens
ccattcgtctgtcccagag

SEQ ID NO: 1429973 - DNA, 23 bp, Homo sapiens
ccattctagatcctgcaccccag

SEQ ID NO: 1429974 - DNA, 15 bp, Homo sapiens
ccattctccccctct

SEQ ID NO: 1429975 - DNA, 17 bp, Homo sapiens
ccattctcctgcctcac

SEQ ID NO: 1429976 - DNA, 19 bp, Homo sapiens
ccattctcctgcctcaccc

SEQ ID NO: 1429977 - DNA, 20 bp, Homo sapiens
ccattctctctcctgtccaa

SEQ ID NO: 1429978 - DNA, 17 bp, Homo sapiens
ccattctgaccatttca

SEQ ID NO: 1429979 - DNA, 20 bp, Homo sapiens
ccattctgactcggtttctc

SEQ ID NO: 1429980 - DNA, 15 bp, Homo sapiens
ccattcttctggtgc

SEQ ID NO: 1429981 - DNA, 15 bp, Homo sapiens
ccattgaactctgag

SEQ ID NO: 1429982 - DNA, 14 bp, Homo sapiens
ccattgaccagctc

SEQ ID NO: 1429983 - DNA, 18 bp, Homo sapiens
ccattgaccagctctctt

SEQ ID NO: 1429984 - DNA, 16 bp, Homo sapiens
ccattgacctcagctg

SEQ ID NO: 1429985 - DNA, 18 bp, Homo sapiens
ccattgacctcagctgca

SEQ ID NO: 1429986 - DNA, 22 bp, Homo sapiens
ccattgacctcagctgcacatt

SEQ ID NO: 1429987 - DNA, 22 bp, Homo sapiens
ccattgacttagaggcaacagg

SEQ ID NO: 1429988 - DNA, 16 bp, Homo sapiens
ccattgagtccctgct

SEQ ID NO: 1429989 - DNA, 21 bp, Homo sapiens
ccattgattttttttttcttc

SEQ ID NO: 1429990 - DNA, 22 bp, Homo sapiens
ccattgattttttttttcttct

SEQ ID NO: 1429991 - DNA, 17 bp, Homo sapiens
ccattgccaccaggaga

SEQ ID NO: 1429992 - DNA, 15 bp, Homo sapiens
ccattggagagctgt

SEQ ID NO: 1429993 - DNA, 16 bp, Homo sapiens
ccattggatctgcaag

SEQ ID NO: 1429994 - DNA, 11 bp, Homo sapiens
ccattgggacc

SEQ ID NO: 1429995 - DNA, 20 bp, Homo sapiens
ccattgggaccctccagtgc

SEQ ID NO: 1429996 - DNA, 14 bp, Homo sapiens
ccattggtccaaga

SEQ ID NO: 1429997 - DNA, 16 bp, Homo sapiens
ccattggttggaagct

SEQ ID NO: 1429998 - DNA, 16 bp, Homo sapiens
ccattgtactccagcc

SEQ ID NO: 1429999 - DNA, 17 bp, Homo sapiens
ccattgtcctccttttc

SEQ ID NO: 1430000 - DNA, 15 bp, Homo sapiens
ccattgttcccttcc

SEQ ID NO: 1430001 - DNA, 24 bp, Homo sapiens
ccattgttcccttcctcttcctgc

SEQ ID NO: 1430002 - DNA, 12 bp, Homo sapiens
ccattgttttag

SEQ ID NO: 1430003 - DNA, 19 bp, Homo sapiens
ccatttaaatttttttcct

SEQ ID NO: 1430004 - DNA, 14 bp, Homo sapiens
ccatttacaaataa

SEQ ID NO: 1430005 - DNA, 17 bp, Homo sapiens
ccatttagaatctagaa

SEQ ID NO: 1430006 - DNA, 13 bp, Homo sapiens
ccatttagaatgg

SEQ ID NO: 1430007 - DNA, 19 bp, Homo sapiens
ccatttagttctttgttat

SEQ ID NO: 1430008 - DNA, 23 bp, Homo sapiens
ccatttcaagacagattgtgaag

SEQ ID NO: 1430009 - DNA, 17 bp, Homo sapiens
ccatttcaggaatttaa

SEQ ID NO: 1430010 - DNA, 20 bp, Homo sapiens
ccatttcaggaatttaaaat

SEQ ID NO: 1430011 - DNA, 17 bp, Homo sapiens
ccatttcatctatttct

SEQ ID NO: 1430012 - DNA, 18 bp, Homo sapiens
ccatttcccacatctttc

SEQ ID NO: 1430013 - DNA, 16 bp, Homo sapiens
ccatttcccatctgca

SEQ ID NO: 1430014 - DNA, 14 bp, Homo sapiens
ccatttccccctcc

SEQ ID NO: 1430015 - DNA, 19 bp, Homo sapiens
ccatttcctcacgtgcagg

SEQ ID NO: 1430016 - DNA, 14 bp, Homo sapiens
ccatttccttggag

SEQ ID NO: 1430017 - DNA, 14 bp, Homo sapiens
ccatttctatttat

SEQ ID NO: 1430018 - DNA, 20 bp, Homo sapiens
ccatttctgaactgttacaa

SEQ ID NO: 1430019 - DNA, 13 bp, Homo sapiens
ccatttcttcctc

SEQ ID NO: 1430020 - DNA, 15 bp, Homo sapiens
ccatttcttcctcac

SEQ ID NO: 1430021 - DNA, 16 bp, Homo sapiens
ccatttcttcctcact

SEQ ID NO: 1430022 - DNA, 13 bp, Homo sapiens
ccatttgtaataa

SEQ ID NO: 1430023 - DNA, 15 bp, Homo sapiens
ccatttgtaataaag

SEQ ID NO: 1430024 - DNA, 20 bp, Homo sapiens
ccatttgtaataaagtatat

SEQ ID NO: 1430025 - DNA, 14 bp, Homo sapiens
ccatttgtaatttg

SEQ ID NO: 1430026 - DNA, 13 bp, Homo sapiens
ccatttgtattca

SEQ ID NO: 1430027 - DNA, 20 bp, Homo sapiens
ccatttgtattcaaatttgt

SEQ ID NO: 1430028 - DNA, 14 bp, Homo sapiens
ccatttgtgccaga

SEQ ID NO: 1430029 - DNA, 15 bp, Homo sapiens
ccatttgtgccagag

SEQ ID NO: 1430030 - DNA, 20 bp, Homo sapiens
ccatttgttcctgcttccga

SEQ ID NO: 1430031 - DNA, 22 bp, Homo sapiens
ccattttaaagttagtatcttt

SEQ ID NO: 1430032 - DNA, 21 bp, Homo sapiens
ccattttaattttaaagtgca

SEQ ID NO: 1430033 - DNA, 22 bp, Homo sapiens
ccattttattaataatatttat

SEQ ID NO: 1430034 - DNA, 22 bp, Homo sapiens
ccattttcccccactactgcag

SEQ ID NO: 1430035 - DNA, 12 bp, Homo sapiens
ccattttctaaa

SEQ ID NO: 1430036 - DNA, 19 bp, Homo sapiens
ccattttgcccttccatag

SEQ ID NO: 1430037 - DNA, 18 bp, Homo sapiens
ccattttgttattgacta

SEQ ID NO: 1430038 - DNA, 16 bp, Homo sapiens
ccatttttcctctgtt

SEQ ID NO: 1430039 - DNA, 14 bp, Homo sapiens
ccatttttctcttg

SEQ ID NO: 1430040 - DNA, 15 bp, Homo sapiens
ccatttttgagccaa

SEQ ID NO: 1430041 - DNA, 21 bp, Homo sapiens
ccatttttgagccaagcttca

SEQ ID NO: 1430042 - DNA, 17 bp, Homo sapiens
ccatttttgctgaattc

SEQ ID NO: 1430043 - DNA, 14 bp, Homo sapiens
cccaaaacccaggg

SEQ ID NO: 1430044 - DNA, 17 bp, Homo sapiens
cccaaaacccagggcaa

SEQ ID NO: 1430045 - DNA, 18 bp, Homo sapiens
cccaaaaccctgaagcca

SEQ ID NO: 1430046 - DNA, 16 bp, Homo sapiens
cccaaaacctcatgac

SEQ ID NO: 1430047 - DNA, 22 bp, Homo sapiens
cccaaaagtcaaaaggtgcctg

SEQ ID NO: 1430048 - DNA, 17 bp, Homo sapiens
cccaaacaaatatgcaa

SEQ ID NO: 1430049 - DNA, 23 bp, Homo sapiens
aagtaactgggattacaggcatg

SEQ ID NO: 1430050 - DNA, 18 bp, Homo sapiens
aagtaagaaagtgaagca

SEQ ID NO: 1430051 - DNA, 20 bp, Homo sapiens
aagtaagaaagtgaagcaaa

SEQ ID NO: 1430052 - DNA, 13 bp, Homo sapiens
aagtaagaagaca

SEQ ID NO: 1430053 - DNA, 15 bp, Homo sapiens
aagtaagaagacatg

SEQ ID NO: 1430054 - DNA, 16 bp, Homo sapiens
aagtaagaatggccaa

SEQ ID NO: 1430055 - DNA, 21 bp, Homo sapiens
aagtaagagctaagttctaag

SEQ ID NO: 1430056 - DNA, 22 bp, Homo sapiens
aagtaagagctaagttctaagt

SEQ ID NO: 1430057 - DNA, 16 bp, Homo sapiens
aagtaatctttaaact

SEQ ID NO: 1430058 - DNA, 15 bp, Homo sapiens
aagtaatgatactgt

SEQ ID NO: 1430059 - DNA, 22 bp, Homo sapiens
aagtaattatcgggaacagtgt

SEQ ID NO: 1430060 - DNA, 20 bp, Homo sapiens
aagtaattattttttagata

SEQ ID NO: 1430061 - DNA, 23 bp, Homo sapiens
aagtaattattttttagataata

SEQ ID NO: 1430062 - DNA, 23 bp, Homo sapiens
aagtaatttcagtgtaaagtgtg

SEQ ID NO: 1430063 - DNA, 13 bp, Homo sapiens
aagtacaaatgaa

SEQ ID NO: 1430064 - DNA, 23 bp, Homo sapiens
aagtacaatgaactgcttttcct

SEQ ID NO: 1430065 - DNA, 14 bp, Homo sapiens
aagtacagaatttg

SEQ ID NO: 1430066 - DNA, 13 bp, Homo sapiens
aagtacattgtaa

SEQ ID NO: 1430067 - DNA, 12 bp, Homo sapiens
aagtacatttaa

SEQ ID NO: 1430068 - DNA, 13 bp, Homo sapiens
aagtacatttaat

SEQ ID NO: 1430069 - DNA, 24 bp, Homo sapiens
aagtaccaatgctgttgtaaacaa

SEQ ID NO: 1430070 - DNA, 13 bp, Homo sapiens
aagtactatgtat

SEQ ID NO: 1430071 - DNA, 24 bp, Homo sapiens
aagtactctttaacatacaagaaa

SEQ ID NO: 1430072 - DNA, 23 bp, Homo sapiens
aagtactgctgtaaataaatgct

SEQ ID NO: 1430073 - DNA, 20 bp, Homo sapiens
aagtacttaaacttccacaa

SEQ ID NO: 1430074 - DNA, 12 bp, Homo sapiens
aagtagaagagg

SEQ ID NO: 1430075 - DNA, 16 bp, Homo sapiens
aagtagaagcatgttt

SEQ ID NO: 1430076 - DNA, 19 bp, Homo sapiens
aagtagactactgttcagc

SEQ ID NO: 1430077 - DNA, 16 bp, Homo sapiens
aagtagatcacctcct

SEQ ID NO: 1430078 - DNA, 12 bp, Homo sapiens
aagtagctgcta

SEQ ID NO: 1430079 - DNA, 21 bp, Homo sapiens
aagtagctgtcagatgtcaca

SEQ ID NO: 1430080 - DNA, 15 bp, Homo sapiens
aagtaggaaaaataa

SEQ ID NO: 1430081 - DNA, 17 bp, Homo sapiens
aagtagggatgcggatc

SEQ ID NO: 1430082 - DNA, 20 bp, Homo sapiens
aagtagggatgcggatcctg

SEQ ID NO: 1430083 - DNA, 16 bp, Homo sapiens
aagtaggttctgtttt

SEQ ID NO: 1430084 - DNA, 22 bp, Homo sapiens
aagtaggttctgttttgttttg

SEQ ID NO: 1430085 - DNA, 20 bp, Homo sapiens
aagtagttgattcagccctc

SEQ ID NO: 1430086 - DNA, 12 bp, Homo sapiens
aagtatactgta

SEQ ID NO: 1430087 - DNA, 12 bp, Homo sapiens
aagtatataatg

SEQ ID NO: 1430088 - DNA, 22 bp, Homo sapiens
aagtatataatttttttatgtt

SEQ ID NO: 1430089 - DNA, 16 bp, Homo sapiens
aagtatatagtatatt

SEQ ID NO: 1430090 - DNA, 23 bp, Homo sapiens
aagtatatagtatatttatactc

SEQ ID NO: 1430091 - DNA, 20 bp, Homo sapiens
aagtatgacccacattactt

SEQ ID NO: 1430092 - DNA, 22 bp, Homo sapiens
aagtatgcattattaaattgta

SEQ ID NO: 1430093 - DNA, 19 bp, Homo sapiens
aagtatgccttaagcagaa

SEQ ID NO: 1430094 - DNA, 21 bp, Homo sapiens
aagtatgtattatttacattt

SEQ ID NO: 1430095 - DNA, 19 bp, Homo sapiens
aagtatgtgtaaaatgtga

SEQ ID NO: 1430096 - DNA, 20 bp, Homo sapiens
aagtattataaacaagaatg

SEQ ID NO: 1430097 - DNA, 15 bp, Homo sapiens
aagtattatgtctct

SEQ ID NO: 1430098 - DNA, 19 bp, Homo sapiens
aagtattcaacaatttcaa

SEQ ID NO: 1430099 - DNA, 19 bp, Homo sapiens
aagtattcctgttgctgtc

SEQ ID NO: 1430100 - DNA, 23 bp, Homo sapiens
aagtattcttatttaatgaaaga

SEQ ID NO: 1430101 - DNA, 17 bp, Homo sapiens
aagtattcttttcaatt

SEQ ID NO: 1430102 - DNA, 20 bp, Homo sapiens
aagtatttaagcctaaagat

SEQ ID NO: 1430103 - DNA, 21 bp, Homo sapiens
aagtatttaagcctaaagatt

SEQ ID NO: 1430104 - DNA, 14 bp, Homo sapiens
aagtatttatatat

SEQ ID NO: 1430105 - DNA, 17 bp, Homo sapiens
aagtatttatatattta

SEQ ID NO: 1430106 - DNA, 22 bp, Homo sapiens
aagtatttatatatttataact

SEQ ID NO: 1430107 - DNA, 23 bp, Homo sapiens
aagtatttatatatttataactc

SEQ ID NO: 1430108 - DNA, 12 bp, Homo sapiens
aagtatttccat

SEQ ID NO: 1430109 - DNA, 12 bp, Homo sapiens
aagtatttctga

SEQ ID NO: 1430110 - DNA, 18 bp, Homo sapiens
aagtatttttgattaaca

SEQ ID NO: 1430111 - DNA, 15 bp, Homo sapiens
aagtatttttttatc

SEQ ID NO: 1430112 - DNA, 14 bp, Homo sapiens
aagtcaaaaaatta

SEQ ID NO: 1430113 - DNA, 15 bp, Homo sapiens
aagtcaaaatatgta

SEQ ID NO: 1430114 - DNA, 20 bp, Homo sapiens
aagtcaaacacttgtgactt

SEQ ID NO: 1430115 - DNA, 15 bp, Homo sapiens
aagtcaacagtaaac

SEQ ID NO: 1430116 - DNA, 12 bp, Homo sapiens
aagtcaagcaca

SEQ ID NO: 1430117 - DNA, 13 bp, Homo sapiens
aagtcaagcacat

SEQ ID NO: 1430118 - DNA, 19 bp, Homo sapiens
aagtcacagctgcagctgg

SEQ ID NO: 1430119 - DNA, 14 bp, Homo sapiens
aagtcacaggaaga

SEQ ID NO: 1430120 - DNA, 16 bp, Homo sapiens
aagtcacagttaagga

SEQ ID NO: 1430121 - DNA, 16 bp, Homo sapiens
aagtcacatcacagga

SEQ ID NO: 1430122 - DNA, 20 bp, Homo sapiens
aagtcacattccacatctgt

SEQ ID NO: 1430123 - DNA, 18 bp, Homo sapiens
aagtcacccaaacacttc

SEQ ID NO: 1430124 - DNA, 20 bp, Homo sapiens
aagtcacccaaacacttctg

SEQ ID NO: 1430125 - DNA, 16 bp, Homo sapiens
aagtcacccggccccc

SEQ ID NO: 1430126 - DNA, 14 bp, Homo sapiens
aagtcaccggagct

SEQ ID NO: 1430127 - DNA, 19 bp, Homo sapiens
aagtcactcacactggcca

SEQ ID NO: 1430128 - DNA, 12 bp, Homo sapiens
aagtcactgaac

SEQ ID NO: 1430129 - DNA, 14 bp, Homo sapiens
aagtcactgaacaa

SEQ ID NO: 1430130 - DNA, 15 bp, Homo sapiens
aagtcactgaacaaa

SEQ ID NO: 1430131 - DNA, 14 bp, Homo sapiens
aagtcactgcacag

SEQ ID NO: 1430132 - DNA, 22 bp, Homo sapiens
aagtcactgcacagtgcatctc

SEQ ID NO: 1430133 - DNA, 16 bp, Homo sapiens
aagtcacttccagtgt

SEQ ID NO: 1430134 - DNA, 14 bp, Homo sapiens
aagtcacttctcca

SEQ ID NO: 1430135 - DNA, 15 bp, Homo sapiens
aagtcacttctccat

SEQ ID NO: 1430136 - DNA, 13 bp, Homo sapiens
aagtcagaagttt

SEQ ID NO: 1430137 - DNA, 16 bp, Homo sapiens
aagtcagaatcagaag

SEQ ID NO: 1430138 - DNA, 16 bp, Homo sapiens
aagtcagccacactgg

SEQ ID NO: 1430139 - DNA, 15 bp, Homo sapiens
aagtcagctccagct

SEQ ID NO: 1430140 - DNA, 22 bp, Homo sapiens
aagtcagctccagctttctgcc

SEQ ID NO: 1430141 - DNA, 17 bp, Homo sapiens
aagtcagtacccaccac

SEQ ID NO: 1430142 - DNA, 12 bp, Homo sapiens
aagtcagtcacg

SEQ ID NO: 1430143 - DNA, 20 bp, Homo sapiens
aagtcagtcacgtttccttt

SEQ ID NO: 1430144 - DNA, 20 bp, Homo sapiens
aagtcatctacttaataaat

SEQ ID NO: 1430145 - DNA, 21 bp, Homo sapiens
aagtcatctgtttaatttaca

SEQ ID NO: 1430146 - DNA, 20 bp, Homo sapiens
aagtcatcttgctaccagta

SEQ ID NO: 1430147 - DNA, 14 bp, Homo sapiens
aagtcatggcccaa

SEQ ID NO: 1430148 - DNA, 16 bp, Homo sapiens
aagtcatttttgtatt

SEQ ID NO: 1430149 - DNA, 17 bp, Homo sapiens
aagtccaagcataccaa

SEQ ID NO: 1430150 - DNA, 12 bp, Homo sapiens
aagtcccaccct

SEQ ID NO: 1430151 - DNA, 19 bp, Homo sapiens
aagtccctgactctctgtg

SEQ ID NO: 1430152 - DNA, 16 bp, Homo sapiens
aagtccctgtttggga

SEQ ID NO: 1430153 - DNA, 17 bp, Homo sapiens
aagtccctgtttgggaa

SEQ ID NO: 1430154 - DNA, 17 bp, Homo sapiens
aagtcctacaagctaaa

SEQ ID NO: 1430155 - DNA, 17 bp, Homo sapiens
aagtcctgaagaggcgg

SEQ ID NO: 1430156 - DNA, 21 bp, Homo sapiens
aagtcctgctggatcttgcct

SEQ ID NO: 1430157 - DNA, 15 bp, Homo sapiens
aagtcctggctacat

SEQ ID NO: 1430158 - DNA, 23 bp, Homo sapiens
aagtcctggctacatcccagcct

SEQ ID NO: 1430159 - DNA, 20 bp, Homo sapiens
aagtccttgacctctataaa

SEQ ID NO: 1430160 - DNA, 22 bp, Homo sapiens
aagtccttggcttgccattttt

SEQ ID NO: 1430161 - DNA, 13 bp, Homo sapiens
aagtcctttatgt

SEQ ID NO: 1430162 - DNA, 16 bp, Homo sapiens
aagtcctttatgtgga

SEQ ID NO: 1430163 - DNA, 12 bp, Homo sapiens
aagtcgccagtc

SEQ ID NO: 1430164 - DNA, 21 bp, Homo sapiens
aagtcgccagtcactgctgca

SEQ ID NO: 1430165 - DNA, 18 bp, Homo sapiens
cccaaaccctgcttctgc

SEQ ID NO: 1430166 - DNA, 22 bp, Homo sapiens
cccaaactgttcaagaaataat

SEQ ID NO: 1430167 - DNA, 21 bp, Homo sapiens
cccaaagatagacaggtcctg

SEQ ID NO: 1430168 - DNA, 14 bp, Homo sapiens
cccaaagctgagcc

SEQ ID NO: 1430169 - DNA, 18 bp, Homo sapiens
cccaaagctgagcctgca

SEQ ID NO: 1430170 - DNA, 15 bp, Homo sapiens
cccaaagctttcctg

SEQ ID NO: 1430171 - DNA, 15 bp, Homo sapiens
cccaaagggcctcct

SEQ ID NO: 1430172 - DNA, 14 bp, Homo sapiens
cccaaatcaataca

SEQ ID NO: 1430173 - DNA, 17 bp, Homo sapiens
cccaaatcttgtttaca

SEQ ID NO: 1430174 - DNA, 16 bp, Homo sapiens
cccaaatgtgtaatat

SEQ ID NO: 1430175 - DNA, 15 bp, Homo sapiens
cccaacactgtgccc

SEQ ID NO: 1430176 - DNA, 18 bp, Homo sapiens
cccaacactgtgccctgg

SEQ ID NO: 1430177 - DNA, 20 bp, Homo sapiens
cccaaccaggcacctcttcc

SEQ ID NO: 1430178 - DNA, 17 bp, Homo sapiens
cccaacccaaaccatga

SEQ ID NO: 1430179 - DNA, 12 bp, Homo sapiens
cccaacccccac

SEQ ID NO: 1430180 - DNA, 14 bp, Homo sapiens
cccaacccccctcc

SEQ ID NO: 1430181 - DNA, 17 bp, Homo sapiens
cccaacccccctcctgc

SEQ ID NO: 1430182 - DNA, 18 bp, Homo sapiens
cccaacccccctcctgct

SEQ ID NO: 1430183 - DNA, 20 bp, Homo sapiens
cccaacccccctcctgctcc

SEQ ID NO: 1430184 - DNA, 21 bp, Homo sapiens
cccaacccccctcctgctcct

SEQ ID NO: 1430185 - DNA, 20 bp, Homo sapiens
cccaaccctggcttggggtc

SEQ ID NO: 1430186 - DNA, 13 bp, Homo sapiens
cccaaccctgggc

SEQ ID NO: 1430187 - DNA, 23 bp, Homo sapiens
cccaaccctgggctggggaggag

SEQ ID NO: 1430188 - DNA, 13 bp, Homo sapiens
cccaacctcaggg

SEQ ID NO: 1430189 - DNA, 20 bp, Homo sapiens
cccaacctcagggctcccag

SEQ ID NO: 1430190 - DNA, 15 bp, Homo sapiens
cccaacgcacaggaa

SEQ ID NO: 1430191 - DNA, 22 bp, Homo sapiens
cccaacggccctgcagccagct

SEQ ID NO: 1430192 - DNA, 17 bp, Homo sapiens
cccaacgtcccctccgc

SEQ ID NO: 1430193 - DNA, 23 bp, Homo sapiens
cccaacgtgcaaagccaaggcag

SEQ ID NO: 1430194 - DNA, 15 bp, Homo sapiens
cccaactcctggaag

SEQ ID NO: 1430195 - DNA, 17 bp, Homo sapiens
cccaactcctggaagct

SEQ ID NO: 1430196 - DNA, 22 bp, Homo sapiens
cccaactctccccagtgcctgc

SEQ ID NO: 1430197 - DNA, 17 bp, Homo sapiens
cccaactgatcctgctc

SEQ ID NO: 1430198 - DNA, 18 bp, Homo sapiens
cccaactgatcctgctcc

SEQ ID NO: 1430199 - DNA, 24 bp, Homo sapiens
cccaactgtgggtccgagagggaa

SEQ ID NO: 1430200 - DNA, 16 bp, Homo sapiens
cccaacttcaccaccc

SEQ ID NO: 1430201 - DNA, 19 bp, Homo sapiens
cccaacttcaccaccccct

SEQ ID NO: 1430202 - DNA, 16 bp, Homo sapiens
cccaagaaacctgact

SEQ ID NO: 1430203 - DNA, 20 bp, Homo sapiens
cccaagacagatgccccaga

SEQ ID NO: 1430204 - DNA, 21 bp, Homo sapiens
cccaagacagatgccccagag

SEQ ID NO: 1430205 - DNA, 19 bp, Homo sapiens
cccaagactgtcattgccc

SEQ ID NO: 1430206 - DNA, 22 bp, Homo sapiens
cccaagactgtcattgcccctc

SEQ ID NO: 1430207 - DNA, 24 bp, Homo sapiens
cccaagagaactcgcgctcagtaa

SEQ ID NO: 1430208 - DNA, 17 bp, Homo sapiens
cccaagagccctgtggc

SEQ ID NO: 1430209 - DNA, 14 bp, Homo sapiens
cccaagaggtctga

SEQ ID NO: 1430210 - DNA, 18 bp, Homo sapiens
cccaagaggtctgagccc

SEQ ID NO: 1430211 - DNA, 20 bp, Homo sapiens
cccaagaggtctgagccctg

SEQ ID NO: 1430212 - DNA, 22 bp, Homo sapiens
cccaagaggtctgagccctggt

SEQ ID NO: 1430213 - DNA, 21 bp, Homo sapiens
cccaagattgagctctctgcc

SEQ ID NO: 1430214 - DNA, 12 bp, Homo sapiens
cccaagcagcca

SEQ ID NO: 1430215 - DNA, 17 bp, Homo sapiens
cccaagcagccagccag

SEQ ID NO: 1430216 - DNA, 12 bp, Homo sapiens
cccaagccccat

SEQ ID NO: 1430217 - DNA, 18 bp, Homo sapiens
cccaagcccgacttgctg

SEQ ID NO: 1430218 - DNA, 17 bp, Homo sapiens
cccaagcctgctggctg

SEQ ID NO: 1430219 - DNA, 22 bp, Homo sapiens
cccaagcctgctggctgcggcc

SEQ ID NO: 1430220 - DNA, 16 bp, Homo sapiens
cccaagcgttcctggc

SEQ ID NO: 1430221 - DNA, 19 bp, Homo sapiens
cccaagctgttttcttcta

SEQ ID NO: 1430222 - DNA, 18 bp, Homo sapiens
cccaagcttggcagccga

SEQ ID NO: 1430223 - DNA, 20 bp, Homo sapiens
cccaagcttggcagccgagc

SEQ ID NO: 1430224 - DNA, 22 bp, Homo sapiens
cccaagcttggcagccgagctc

SEQ ID NO: 1430225 - DNA, 21 bp, Homo sapiens
cccaagctttcccctctgaat

SEQ ID NO: 1430226 - DNA, 14 bp, Homo sapiens
cccaaggaaagccc

SEQ ID NO: 1430227 - DNA, 23 bp, Homo sapiens
cccaaggactgagggcagtgccc

SEQ ID NO: 1430228 - DNA, 14 bp, Homo sapiens
cccaaggagctgat

SEQ ID NO: 1430229 - DNA, 22 bp, Homo sapiens
cccaaggagcttacccaagctg

SEQ ID NO: 1430230 - DNA, 14 bp, Homo sapiens
cccaaggaggaaaa

SEQ ID NO: 1430231 - DNA, 22 bp, Homo sapiens
cccaaggaggaaaaacagacaa

SEQ ID NO: 1430232 - DNA, 17 bp, Homo sapiens
cccaaggcctctctctg

SEQ ID NO: 1430233 - DNA, 21 bp, Homo sapiens
cccaaggcctctctctgcctg

SEQ ID NO: 1430234 - DNA, 22 bp, Homo sapiens
cccaaggcgtccgcgcgccagc

SEQ ID NO: 1430235 - DNA, 23 bp, Homo sapiens
cccaagggcccagaccctgggca

SEQ ID NO: 1430236 - DNA, 12 bp, Homo sapiens
cccaagggccct

SEQ ID NO: 1430237 - DNA, 21 bp, Homo sapiens
cccaaggtgctgatgtcaaag

SEQ ID NO: 1430238 - DNA, 11 bp, Homo sapiens
cccaaggttcc

SEQ ID NO: 1430239 - DNA, 15 bp, Homo sapiens
cccaaggttggagcc

SEQ ID NO: 1430240 - DNA, 16 bp, Homo sapiens
cccaaggtttgagtcc

SEQ ID NO: 1430241 - DNA, 23 bp, Homo sapiens
cccaagtagctgggattacaggt

SEQ ID NO: 1430242 - DNA, 13 bp, Homo sapiens
cccaagtcctgaa

SEQ ID NO: 1430243 - DNA, 17 bp, Homo sapiens
cccaagtcctgaagagg

SEQ ID NO: 1430244 - DNA, 23 bp, Homo sapiens
cccaagtcctgaagaggcgggcc

SEQ ID NO: 1430245 - DNA, 18 bp, Homo sapiens
cccaagtgccagtcttgt

SEQ ID NO: 1430246 - DNA, 23 bp, Homo sapiens
cccaagtgggggcagagggcaga

SEQ ID NO: 1430247 - DNA, 14 bp, Homo sapiens
cccaataaaagtga

SEQ ID NO: 1430248 - DNA, 17 bp, Homo sapiens
cccaataaaggcagctg

SEQ ID NO: 1430249 - DNA, 13 bp, Homo sapiens
cccaataaaggtc

SEQ ID NO: 1430250 - DNA, 11 bp, Homo sapiens
cccaatattat

SEQ ID NO: 1430251 - DNA, 12 bp, Homo sapiens
cccaatattata

SEQ ID NO: 1430252 - DNA, 15 bp, Homo sapiens
cccaatattataatt

SEQ ID NO: 1430253 - DNA, 15 bp, Homo sapiens
cccaatcaaagaatt

SEQ ID NO: 1430254 - DNA, 15 bp, Homo sapiens
cccaatcagcactga

SEQ ID NO: 1430255 - DNA, 22 bp, Homo sapiens
cccaatcagcttttgttctaga

SEQ ID NO: 1430256 - DNA, 15 bp, Homo sapiens
cccaatcggactgcc

SEQ ID NO: 1430257 - DNA, 18 bp, Homo sapiens
cccaatcggactgccaaa

SEQ ID NO: 1430258 - DNA, 19 bp, Homo sapiens
cccaatcggactgccaaat

SEQ ID NO: 1430259 - DNA, 18 bp, Homo sapiens
cccaatgacacccatgcc

SEQ ID NO: 1430260 - DNA, 22 bp, Homo sapiens
cccaatgagactctagggtcca

SEQ ID NO: 1430261 - DNA, 12 bp, Homo sapiens
cccaatgcctgt

SEQ ID NO: 1430262 - DNA, 14 bp, Homo sapiens
cccaatgcctgtga

SEQ ID NO: 1430263 - DNA, 22 bp, Homo sapiens
cccaatgctttgggaggccaag

SEQ ID NO: 1430264 - DNA, 24 bp, Homo sapiens
cccaatgctttgggaggccaaggc

SEQ ID NO: 1430265 - DNA, 15 bp, Homo sapiens
cccaatttcagactc

SEQ ID NO: 1430266 - DNA, 21 bp, Homo sapiens
cccaattttaaaaaataacat

SEQ ID NO: 1430267 - DNA, 19 bp, Homo sapiens
cccacaaaatatttctaag

SEQ ID NO: 1430268 - DNA, 19 bp, Homo sapiens
cccacaacccaaaaggttt

SEQ ID NO: 1430269 - DNA, 17 bp, Homo sapiens
cccacaagctgtccctg

SEQ ID NO: 1430270 - DNA, 15 bp, Homo sapiens
cccacacactcgccc

SEQ ID NO: 1430271 - DNA, 21 bp, Homo sapiens
cccacacagctgccctagctg

SEQ ID NO: 1430272 - DNA, 22 bp, Homo sapiens
cccacacagctgccctagctga

SEQ ID NO: 1430273 - DNA, 16 bp, Homo sapiens
cccacacccaaagctg

SEQ ID NO: 1430274 - DNA, 12 bp, Homo sapiens
cccacaccctgg

SEQ ID NO: 1430275 - DNA, 16 bp, Homo sapiens
cccacaccgctggtcc

SEQ ID NO: 1430276 - DNA, 14 bp, Homo sapiens
cccacacctgcagt

SEQ ID NO: 1430277 - DNA, 15 bp, Homo sapiens
cccacacctgcctgc

SEQ ID NO: 1430278 - DNA, 22 bp, Homo sapiens
cccacaccttccagggccctag

SEQ ID NO: 1430279 - DNA, 13 bp, Homo sapiens
cccacactccact

SEQ ID NO: 1430280 - DNA, 21 bp, Homo sapiens
cccacagaaagactgagctca

SEQ ID NO: 1430281 - DNA, 15 bp, Homo sapiens
aagtcggaatgtcat

SEQ ID NO: 1430282 - DNA, 21 bp, Homo sapiens
aagtcgggtcaaaaataaaat

SEQ ID NO: 1430283 - DNA, 17 bp, Homo sapiens
aagtctaatgaagagaa

SEQ ID NO: 1430284 - DNA, 18 bp, Homo sapiens
aagtctaatgaagagaaa

SEQ ID NO: 1430285 - DNA, 20 bp, Homo sapiens
aagtctaatgaagagaaaaa

SEQ ID NO: 1430286 - DNA, 22 bp, Homo sapiens
aagtctaggagctgggaggaaa

SEQ ID NO: 1430287 - DNA, 11 bp, Homo sapiens
aagtctatgct

SEQ ID NO: 1430288 - DNA, 11 bp, Homo sapiens
aagtctatttt

SEQ ID NO: 1430289 - DNA, 19 bp, Homo sapiens
aagtctcagctaagctcac

SEQ ID NO: 1430290 - DNA, 20 bp, Homo sapiens
aagtctcataggttaaaaaa

SEQ ID NO: 1430291 - DNA, 12 bp, Homo sapiens
aagtctcattcg

SEQ ID NO: 1430292 - DNA, 22 bp, Homo sapiens
aagtctcattcgcctttgtctt

SEQ ID NO: 1430293 - DNA, 15 bp, Homo sapiens
aagtctccagcccac

SEQ ID NO: 1430294 - DNA, 12 bp, Homo sapiens
aagtctccctgc

SEQ ID NO: 1430295 - DNA, 18 bp, Homo sapiens
aagtctccctgcacagcc

SEQ ID NO: 1430296 - DNA, 17 bp, Homo sapiens
aagtctcgaatgtaatt

SEQ ID NO: 1430297 - DNA, 18 bp, Homo sapiens
aagtctcgaatgtaattg

SEQ ID NO: 1430298 - DNA, 22 bp, Homo sapiens
aagtctcgaatgtaattggaat

SEQ ID NO: 1430299 - DNA, 22 bp, Homo sapiens
aagtctctttttttggcccagg

SEQ ID NO: 1430300 - DNA, 18 bp, Homo sapiens
aagtctggatctgggacc

SEQ ID NO: 1430301 - DNA, 19 bp, Homo sapiens
aagtcttagatgtatatat

SEQ ID NO: 1430302 - DNA, 22 bp, Homo sapiens
aagtcttccctgatcaagtcac

SEQ ID NO: 1430303 - DNA, 22 bp, Homo sapiens
aagtcttccttaaatgactttt

SEQ ID NO: 1430304 - DNA, 17 bp, Homo sapiens
aagtcttgcctatattt

SEQ ID NO: 1430305 - DNA, 16 bp, Homo sapiens
aagtctttaataaata

SEQ ID NO: 1430306 - DNA, 14 bp, Homo sapiens
aagtctttcttctt

SEQ ID NO: 1430307 - DNA, 14 bp, Homo sapiens
aagtcttttctgtc

SEQ ID NO: 1430308 - DNA, 19 bp, Homo sapiens
aagtgaagaatacatcaga

SEQ ID NO: 1430309 - DNA, 14 bp, Homo sapiens
aagtgaatccttaa

SEQ ID NO: 1430310 - DNA, 15 bp, Homo sapiens
aagtgaatgctggga

SEQ ID NO: 1430311 - DNA, 14 bp, Homo sapiens
aagtgaattgaagt

SEQ ID NO: 1430312 - DNA, 14 bp, Homo sapiens
aagtgacacagaca

SEQ ID NO: 1430313 - DNA, 14 bp, Homo sapiens
aagtgagagaaaaa

SEQ ID NO: 1430314 - DNA, 12 bp, Homo sapiens
aagtgagcagaa

SEQ ID NO: 1430315 - DNA, 16 bp, Homo sapiens
aagtgagcagaacagg

SEQ ID NO: 1430316 - DNA, 18 bp, Homo sapiens
aagtgagctttgctgcta

SEQ ID NO: 1430317 - DNA, 17 bp, Homo sapiens
aagtgagtttgtaaata

SEQ ID NO: 1430318 - DNA, 14 bp, Homo sapiens
aagtgatatggtga

SEQ ID NO: 1430319 - DNA, 23 bp, Homo sapiens
aagtgatcaataaaatgtgattt

SEQ ID NO: 1430320 - DNA, 16 bp, Homo sapiens
aagtgattatctcttt

SEQ ID NO: 1430321 - DNA, 14 bp, Homo sapiens
aagtgattctaaga

SEQ ID NO: 1430322 - DNA, 14 bp, Homo sapiens
aagtgattgaaaat

SEQ ID NO: 1430323 - DNA, 15 bp, Homo sapiens
aagtgatttttggtc

SEQ ID NO: 1430324 - DNA, 17 bp, Homo sapiens
aagtgatttttttgtcc

SEQ ID NO: 1430325 - DNA, 23 bp, Homo sapiens
aagtgcaataaatctgacccagt

SEQ ID NO: 1430326 - DNA, 14 bp, Homo sapiens
aagtgcacaggagc

SEQ ID NO: 1430327 - DNA, 15 bp, Homo sapiens
aagtgcactttctaa

SEQ ID NO: 1430328 - DNA, 16 bp, Homo sapiens
aagtgcatttttctta

SEQ ID NO: 1430329 - DNA, 19 bp, Homo sapiens
aagtgcatttttcttattt

SEQ ID NO: 1430330 - DNA, 14 bp, Homo sapiens
aagtgccaaacaga

SEQ ID NO: 1430331 - DNA, 12 bp, Homo sapiens
aagtgccagaaa

SEQ ID NO: 1430332 - DNA, 15 bp, Homo sapiens
aagtgccagaggtgg

SEQ ID NO: 1430333 - DNA, 16 bp, Homo sapiens
aagtgcccaaagtggg

SEQ ID NO: 1430334 - DNA, 13 bp, Homo sapiens
aagtgcctgagct

SEQ ID NO: 1430335 - DNA, 18 bp, Homo sapiens
aagtgcctttctgcagtt

SEQ ID NO: 1430336 - DNA, 14 bp, Homo sapiens
aagtgcctttttcc

SEQ ID NO: 1430337 - DNA, 15 bp, Homo sapiens
aagtgctaaggttct

SEQ ID NO: 1430338 - DNA, 19 bp, Homo sapiens
aagtgctaaggttctaagg

SEQ ID NO: 1430339 - DNA, 20 bp, Homo sapiens
aagtgctaaggttctaaggc

SEQ ID NO: 1430340 - DNA, 21 bp, Homo sapiens
aagtgctaaggttctaaggcc

SEQ ID NO: 1430341 - DNA, 18 bp, Homo sapiens
aagtgctcagtgaagtac

SEQ ID NO: 1430342 - DNA, 20 bp, Homo sapiens
aagtgctcttggctgacccc

SEQ ID NO: 1430343 - DNA, 22 bp, Homo sapiens
aagtgctcttggctgacccctc

SEQ ID NO: 1430344 - DNA, 22 bp, Homo sapiens
aagtgctggcaaccactaagaa

SEQ ID NO: 1430345 - DNA, 23 bp, Homo sapiens
aagtgctggcaaccactaagaat

SEQ ID NO: 1430346 - DNA, 17 bp, Homo sapiens
aagtgctgttgggatat

SEQ ID NO: 1430347 - DNA, 20 bp, Homo sapiens
aagtgctgtttattaatctt

SEQ ID NO: 1430348 - DNA, 13 bp, Homo sapiens
aagtggaaatgtt

SEQ ID NO: 1430349 - DNA, 21 bp, Homo sapiens
aagtggaggaaatgttggaac

SEQ ID NO: 1430350 - DNA, 19 bp, Homo sapiens
aagtggatgggaatttgtc

SEQ ID NO: 1430351 - DNA, 12 bp, Homo sapiens
aagtggctgcct

SEQ ID NO: 1430352 - DNA, 18 bp, Homo sapiens
aagtggctgggtgccctc

SEQ ID NO: 1430353 - DNA, 23 bp, Homo sapiens
aagtggctgggtgccctctcagg

SEQ ID NO: 1430354 - DNA, 11 bp, Homo sapiens
aagtgggacat

SEQ ID NO: 1430355 - DNA, 20 bp, Homo sapiens
aagtgggaggtcaggaaact

SEQ ID NO: 1430356 - DNA, 20 bp, Homo sapiens
aagtggggagggacaaggga

SEQ ID NO: 1430357 - DNA, 23 bp, Homo sapiens
aagtggggcctccttgtccaggt

SEQ ID NO: 1430358 - DNA, 14 bp, Homo sapiens
aagtggggtgttct

SEQ ID NO: 1430359 - DNA, 20 bp, Homo sapiens
aagtggggtgttcttcttgg

SEQ ID NO: 1430360 - DNA, 16 bp, Homo sapiens
aagtggtaaatactgt

SEQ ID NO: 1430361 - DNA, 18 bp, Homo sapiens
aagtggtaatttttgtac

SEQ ID NO: 1430362 - DNA, 20 bp, Homo sapiens
aagtggtaatttttgtacat

SEQ ID NO: 1430363 - DNA, 18 bp, Homo sapiens
aagtggtttgcaggtcag

SEQ ID NO: 1430364 - DNA, 16 bp, Homo sapiens
aagtgtaaaaaatgtc

SEQ ID NO: 1430365 - DNA, 16 bp, Homo sapiens
aagtgtaacagctgag

SEQ ID NO: 1430366 - DNA, 12 bp, Homo sapiens
aagtgtaactgg

SEQ ID NO: 1430367 - DNA, 20 bp, Homo sapiens
aagtgtagatagttaaaaga

SEQ ID NO: 1430368 - DNA, 18 bp, Homo sapiens
aagtgtatatttattcat

SEQ ID NO: 1430369 - DNA, 15 bp, Homo sapiens
aagtgtatttggaaa

SEQ ID NO: 1430370 - DNA, 21 bp, Homo sapiens
aagtgtatttggaaataaagt

SEQ ID NO: 1430371 - DNA, 17 bp, Homo sapiens
aagtgtccgagaactaa

SEQ ID NO: 1430372 - DNA, 14 bp, Homo sapiens
aagtgtccttcttg

SEQ ID NO: 1430373 - DNA, 19 bp, Homo sapiens
aagtgtcttttgacatttt

SEQ ID NO: 1430374 - DNA, 20 bp, Homo sapiens
aagtgtgagtaagagctggt

SEQ ID NO: 1430375 - DNA, 10 bp, Homo sapiens
aagtgtgggt

SEQ ID NO: 1430376 - DNA, 18 bp, Homo sapiens
aagtgtgggtctgtgtgt

SEQ ID NO: 1430377 - DNA, 20 bp, Homo sapiens
aagtgtgggtctgtgtgtgt

SEQ ID NO: 1430378 - DNA, 23 bp, Homo sapiens
aagtgtgggtttggttagaggaa

SEQ ID NO: 1430379 - DNA, 21 bp, Homo sapiens
aagtgtggttttgtaatttaa

SEQ ID NO: 1430380 - DNA, 22 bp, Homo sapiens
aagtgtgtaattatgtaaatac

SEQ ID NO: 1430381 - DNA, 19 bp, Homo sapiens
aagtgttcaagaaataaaa

SEQ ID NO: 1430382 - DNA, 14 bp, Homo sapiens
aagtgttcattgtt

SEQ ID NO: 1430383 - DNA, 17 bp, Homo sapiens
aagtgttctcatgaagc

SEQ ID NO: 1430384 - DNA, 19 bp, Homo sapiens
aagtgttctcatgaagcag

SEQ ID NO: 1430385 - DNA, 12 bp, Homo sapiens
aagtgttcttag

SEQ ID NO: 1430386 - DNA, 16 bp, Homo sapiens
aagtgttcttaggttt

SEQ ID NO: 1430387 - DNA, 18 bp, Homo sapiens
aagtgttcttaggtttac

SEQ ID NO: 1430388 - DNA, 19 bp, Homo sapiens
aagtgttgctgtggctcca

SEQ ID NO: 1430389 - DNA, 23 bp, Homo sapiens
aagtgttggctaatgaagggaaa

SEQ ID NO: 1430390 - DNA, 12 bp, Homo sapiens
aagtgttgtatc

SEQ ID NO: 1430391 - DNA, 17 bp, Homo sapiens
aagtgttgtgttcctgg

SEQ ID NO: 1430392 - DNA, 21 bp, Homo sapiens
aagtgtttctcaaaagaggtt

SEQ ID NO: 1430393 - DNA, 18 bp, Homo sapiens
aagtgttttggtgttttg

SEQ ID NO: 1430394 - DNA, 14 bp, Homo sapiens
aagttaaagggaag

SEQ ID NO: 1430395 - DNA, 17 bp, Homo sapiens
aagttaaagtgaataac

SEQ ID NO: 1430396 - DNA, 15 bp, Homo sapiens
aagttaacaaggaat

SEQ ID NO: 1430397 - DNA, 17 bp, Homo sapiens
aagttaacaaggaatgc

SEQ ID NO: 1430398 - DNA, 23 bp, Homo sapiens
cccacagaaagactgagctcaag

SEQ ID NO: 1430399 - DNA, 13 bp, Homo sapiens
cccacagaacctt

SEQ ID NO: 1430400 - DNA, 12 bp, Homo sapiens
cccacagaactg

SEQ ID NO: 1430401 - DNA, 12 bp, Homo sapiens
cccacagcctcc

SEQ ID NO: 1430402 - DNA, 18 bp, Homo sapiens
cccacagcgtccctggcg

SEQ ID NO: 1430403 - DNA, 19 bp, Homo sapiens
cccacagctcagctgccca

SEQ ID NO: 1430404 - DNA, 19 bp, Homo sapiens
cccacagctcccaccccac

SEQ ID NO: 1430405 - DNA, 22 bp, Homo sapiens
cccacaggaagcctgcagtcct

SEQ ID NO: 1430406 - DNA, 19 bp, Homo sapiens
cccacaggaagctcagcct

SEQ ID NO: 1430407 - DNA, 13 bp, Homo sapiens
cccacaggagggc

SEQ ID NO: 1430408 - DNA, 16 bp, Homo sapiens
cccacagttttaataa

SEQ ID NO: 1430409 - DNA, 19 bp, Homo sapiens
cccacatagtgatggttcc

SEQ ID NO: 1430410 - DNA, 19 bp, Homo sapiens
cccacatccaactccagca

SEQ ID NO: 1430411 - DNA, 13 bp, Homo sapiens
cccacatcccagg

SEQ ID NO: 1430412 - DNA, 16 bp, Homo sapiens
cccacatcccaggctt

SEQ ID NO: 1430413 - DNA, 17 bp, Homo sapiens
cccacatcccatcgtct

SEQ ID NO: 1430414 - DNA, 20 bp, Homo sapiens
cccacatggggttcctggtt

SEQ ID NO: 1430415 - DNA, 19 bp, Homo sapiens
cccacatgtggccatggcc

SEQ ID NO: 1430416 - DNA, 22 bp, Homo sapiens
cccacatgtggccatggcctct

SEQ ID NO: 1430417 - DNA, 17 bp, Homo sapiens
cccacatttgggctcag

SEQ ID NO: 1430418 - DNA, 20 bp, Homo sapiens
cccacatttgggctcagggt

SEQ ID NO: 1430419 - DNA, 16 bp, Homo sapiens
cccaccaactctgcac

SEQ ID NO: 1430420 - DNA, 18 bp, Homo sapiens
cccaccaactctgcactc

SEQ ID NO: 1430421 - DNA, 13 bp, Homo sapiens
cccaccacctagg

SEQ ID NO: 1430422 - DNA, 22 bp, Homo sapiens
cccaccacctaggccactcctc

SEQ ID NO: 1430423 - DNA, 20 bp, Homo sapiens
cccaccacgatgtggccctg

SEQ ID NO: 1430424 - DNA, 16 bp, Homo sapiens
cccaccacgtctggct

SEQ ID NO: 1430425 - DNA, 23 bp, Homo sapiens
cccaccacgtctggctccctgcc

SEQ ID NO: 1430426 - DNA, 16 bp, Homo sapiens
cccaccagcctaagaa

SEQ ID NO: 1430427 - DNA, 20 bp, Homo sapiens
cccaccagcctaagaagctc

SEQ ID NO: 1430428 - DNA, 14 bp, Homo sapiens
cccaccagctccca

SEQ ID NO: 1430429 - DNA, 21 bp, Homo sapiens
cccaccaggggaaggaaggag

SEQ ID NO: 1430430 - DNA, 20 bp, Homo sapiens
cccaccagtcagggacagca

SEQ ID NO: 1430431 - DNA, 11 bp, Homo sapiens
cccaccagtgc

SEQ ID NO: 1430432 - DNA, 18 bp, Homo sapiens
cccacccaagcttggcag

SEQ ID NO: 1430433 - DNA, 14 bp, Homo sapiens
cccacccacacagc

SEQ ID NO: 1430434 - DNA, 18 bp, Homo sapiens
cccacccacagccataga

SEQ ID NO: 1430435 - DNA, 20 bp, Homo sapiens
cccacccacgcatacacaca

SEQ ID NO: 1430436 - DNA, 13 bp, Homo sapiens
cccacccaggagg

SEQ ID NO: 1430437 - DNA, 20 bp, Homo sapiens
cccacccagtccatgctcca

SEQ ID NO: 1430438 - DNA, 13 bp, Homo sapiens
cccaccccaactc

SEQ ID NO: 1430439 - DNA, 14 bp, Homo sapiens
cccaccccaactct

SEQ ID NO: 1430440 - DNA, 13 bp, Homo sapiens
cccaccccacact

SEQ ID NO: 1430441 - DNA, 16 bp, Homo sapiens
cccaccccactccagc

SEQ ID NO: 1430442 - DNA, 20 bp, Homo sapiens
cccacccccaaagacctgcc

SEQ ID NO: 1430443 - DNA, 20 bp, Homo sapiens
cccacccccctctctttctc

SEQ ID NO: 1430444 - DNA, 23 bp, Homo sapiens
cccacccccctctctttctctgg

SEQ ID NO: 1430445 - DNA, 17 bp, Homo sapiens
cccacccccgccatgca

SEQ ID NO: 1430446 - DNA, 13 bp, Homo sapiens
cccaccccctcaa

SEQ ID NO: 1430447 - DNA, 15 bp, Homo sapiens
cccaccccctcaagc

SEQ ID NO: 1430448 - DNA, 12 bp, Homo sapiens
cccaccccctcc

SEQ ID NO: 1430449 - DNA, 13 bp, Homo sapiens
cccaccccctcct

SEQ ID NO: 1430450 - DNA, 13 bp, Homo sapiens
cccaccccgggga

SEQ ID NO: 1430451 - DNA, 16 bp, Homo sapiens
cccacccctaagtgcc

SEQ ID NO: 1430452 - DNA, 18 bp, Homo sapiens
cccacccctaagtgccca

SEQ ID NO: 1430453 - DNA, 15 bp, Homo sapiens
cccacccctcactcc

SEQ ID NO: 1430454 - DNA, 15 bp, Homo sapiens
cccacccctccacgt

SEQ ID NO: 1430455 - DNA, 12 bp, Homo sapiens
cccacccctgca

SEQ ID NO: 1430456 - DNA, 12 bp, Homo sapiens
cccacccctgcc

SEQ ID NO: 1430457 - DNA, 14 bp, Homo sapiens
cccacccctgccca

SEQ ID NO: 1430458 - DNA, 15 bp, Homo sapiens
cccacccctgtgctc

SEQ ID NO: 1430459 - DNA, 21 bp, Homo sapiens
cccacccctgtgctccgtgcc

SEQ ID NO: 1430460 - DNA, 15 bp, Homo sapiens
cccaccccttcccca

SEQ ID NO: 1430461 - DNA, 14 bp, Homo sapiens
cccacccgatgctg

SEQ ID NO: 1430462 - DNA, 15 bp, Homo sapiens
cccacccgcccgagg

SEQ ID NO: 1430463 - DNA, 23 bp, Homo sapiens
cccacccgccgcctcccacggca

SEQ ID NO: 1430464 - DNA, 20 bp, Homo sapiens
cccacccggccacagctgct

SEQ ID NO: 1430465 - DNA, 22 bp, Homo sapiens
cccacccgtcttcaatctctgt

SEQ ID NO: 1430466 - DNA, 13 bp, Homo sapiens
cccaccctcagca

SEQ ID NO: 1430467 - DNA, 16 bp, Homo sapiens
cccaccctcagcaccc

SEQ ID NO: 1430468 - DNA, 16 bp, Homo sapiens
cccaccctccatgctc

SEQ ID NO: 1430469 - DNA, 18 bp, Homo sapiens
cccaccctccatgctcct

SEQ ID NO: 1430470 - DNA, 13 bp, Homo sapiens
cccaccctcccta

SEQ ID NO: 1430471 - DNA, 14 bp, Homo sapiens
cccaccctccggcg

SEQ ID NO: 1430472 - DNA, 23 bp, Homo sapiens
cccaccctccggcgggtgacagc

SEQ ID NO: 1430473 - DNA, 15 bp, Homo sapiens
cccaccctgctgctg

SEQ ID NO: 1430474 - DNA, 17 bp, Homo sapiens
cccaccctgctgctggt

SEQ ID NO: 1430475 - DNA, 14 bp, Homo sapiens
cccaccctgggccc

SEQ ID NO: 1430476 - DNA, 15 bp, Homo sapiens
cccaccctgggctcc

SEQ ID NO: 1430477 - DNA, 17 bp, Homo sapiens
cccaccgtccgccctgc

SEQ ID NO: 1430478 - DNA, 19 bp, Homo sapiens
cccaccgtccgccctgctc

SEQ ID NO: 1430479 - DNA, 19 bp, Homo sapiens
cccaccgtggaggaggaag

SEQ ID NO: 1430480 - DNA, 22 bp, Homo sapiens
cccaccgttaggattcaggcag

SEQ ID NO: 1430481 - DNA, 23 bp, Homo sapiens
cccaccgttaggattcaggcagc

SEQ ID NO: 1430482 - DNA, 15 bp, Homo sapiens
cccacctactgcact

SEQ ID NO: 1430483 - DNA, 18 bp, Homo sapiens
cccacctacttgtgactg

SEQ ID NO: 1430484 - DNA, 19 bp, Homo sapiens
cccacctagtgccccagac

SEQ ID NO: 1430485 - DNA, 13 bp, Homo sapiens
cccacctccaccc

SEQ ID NO: 1430486 - DNA, 14 bp, Homo sapiens
cccacctccacccc

SEQ ID NO: 1430487 - DNA, 15 bp, Homo sapiens
cccacctccccctcc

SEQ ID NO: 1430488 - DNA, 14 bp, Homo sapiens
cccacctcccttcc

SEQ ID NO: 1430489 - DNA, 13 bp, Homo sapiens
cccacctcctgca

SEQ ID NO: 1430490 - DNA, 17 bp, Homo sapiens
cccacctgacaatggca

SEQ ID NO: 1430491 - DNA, 18 bp, Homo sapiens
cccacctgacacaccagg

SEQ ID NO: 1430492 - DNA, 19 bp, Homo sapiens
cccacctgcatctggggcc

SEQ ID NO: 1430493 - DNA, 15 bp, Homo sapiens
cccacctgcctggtg

SEQ ID NO: 1430494 - DNA, 15 bp, Homo sapiens
cccacctggccacct

SEQ ID NO: 1430495 - DNA, 19 bp, Homo sapiens
cccaccttcaattcctggg

SEQ ID NO: 1430496 - DNA, 20 bp, Homo sapiens
cccaccttcaattcctgggc

SEQ ID NO: 1430497 - DNA, 22 bp, Homo sapiens
cccaccttcaattcctgggccc

SEQ ID NO: 1430498 - DNA, 17 bp, Homo sapiens
cccaccttgttggagcc

SEQ ID NO: 1430499 - DNA, 13 bp, Homo sapiens
cccacgagggctg

SEQ ID NO: 1430500 - DNA, 14 bp, Homo sapiens
cccacgagggctgg

SEQ ID NO: 1430501 - DNA, 15 bp, Homo sapiens
cccacgagggctggc

SEQ ID NO: 1430502 - DNA, 15 bp, Homo sapiens
cccacgagtcacctg

SEQ ID NO: 1430503 - DNA, 16 bp, Homo sapiens
cccacgagtcacctgc

SEQ ID NO: 1430504 - DNA, 20 bp, Homo sapiens
cccacgagtcacctgcaagc

SEQ ID NO: 1430505 - DNA, 22 bp, Homo sapiens
cccacgcacgacgtcagcctct

SEQ ID NO: 1430506 - DNA, 21 bp, Homo sapiens
cccacgcatacacacatgccc

SEQ ID NO: 1430507 - DNA, 22 bp, Homo sapiens
cccacggccctgtcagagccgc

SEQ ID NO: 1430508 - DNA, 19 bp, Homo sapiens
cccacggggcctcgggacc

SEQ ID NO: 1430509 - DNA, 16 bp, Homo sapiens
cccacggtctggaggc

SEQ ID NO: 1430510 - DNA, 16 bp, Homo sapiens
cccacgtctcctcctc

SEQ ID NO: 1430511 - DNA, 18 bp, Homo sapiens
cccacgtgagagaatctg

SEQ ID NO: 1430512 - DNA, 20 bp, Homo sapiens
cccacgtgagagaatctgcc

SEQ ID NO: 1430513 - DNA, 15 bp, Homo sapiens
cccacgttctcacac

SEQ ID NO: 1430514 - DNA, 17 bp, Homo sapiens
cccacgttctcacaccc

SEQ ID NO: 1430515 - DNA, 14 bp, Homo sapiens
aagttacagtttgc

SEQ ID NO: 1430516 - DNA, 12 bp, Homo sapiens
aagttactgaat

SEQ ID NO: 1430517 - DNA, 15 bp, Homo sapiens
aagttacttattcta

SEQ ID NO: 1430518 - DNA, 18 bp, Homo sapiens
aagttagagattttacaa

SEQ ID NO: 1430519 - DNA, 13 bp, Homo sapiens
aagttagctcagg

SEQ ID NO: 1430520 - DNA, 15 bp, Homo sapiens
aagttagctcaggag

SEQ ID NO: 1430521 - DNA, 15 bp, Homo sapiens
aagttagggggttct

SEQ ID NO: 1430522 - DNA, 22 bp, Homo sapiens
aagttagtggaaatctgaacat

SEQ ID NO: 1430523 - DNA, 23 bp, Homo sapiens
aagttagtggaaatctgaacatt

SEQ ID NO: 1430524 - DNA, 16 bp, Homo sapiens
aagttatagtatatct

SEQ ID NO: 1430525 - DNA, 17 bp, Homo sapiens
aagttatagtgaatact

SEQ ID NO: 1430526 - DNA, 13 bp, Homo sapiens
aagttatcaactt

SEQ ID NO: 1430527 - DNA, 14 bp, Homo sapiens
aagttatgtattta

SEQ ID NO: 1430528 - DNA, 14 bp, Homo sapiens
aagttattaaaatt

SEQ ID NO: 1430529 - DNA, 15 bp, Homo sapiens
aagttatttactttt

SEQ ID NO: 1430530 - DNA, 15 bp, Homo sapiens
aagttatttcccttt

SEQ ID NO: 1430531 - DNA, 15 bp, Homo sapiens
aagttatttcttgtt

SEQ ID NO: 1430532 - DNA, 21 bp, Homo sapiens
aagttattttctacagtggtt

SEQ ID NO: 1430533 - DNA, 16 bp, Homo sapiens
aagttatttttgtaca

SEQ ID NO: 1430534 - DNA, 18 bp, Homo sapiens
aagttatttttgtacatg

SEQ ID NO: 1430535 - DNA, 16 bp, Homo sapiens
aagttcagccaccctg

SEQ ID NO: 1430536 - DNA, 13 bp, Homo sapiens
aagttcatatctg

SEQ ID NO: 1430537 - DNA, 13 bp, Homo sapiens
aagttcatcttgc

SEQ ID NO: 1430538 - DNA, 14 bp, Homo sapiens
aagttcatcttgca

SEQ ID NO: 1430539 - DNA, 19 bp, Homo sapiens
aagttccaagttgctaata

SEQ ID NO: 1430540 - DNA, 20 bp, Homo sapiens
aagttccttggccatgcaga

SEQ ID NO: 1430541 - DNA, 11 bp, Homo sapiens
aagttctaaga

SEQ ID NO: 1430542 - DNA, 14 bp, Homo sapiens
aagttctaagattc

SEQ ID NO: 1430543 - DNA, 19 bp, Homo sapiens
aagttctaagattctaatg

SEQ ID NO: 1430544 - DNA, 20 bp, Homo sapiens
aagttctaagattctaatga

SEQ ID NO: 1430545 - DNA, 17 bp, Homo sapiens
aagttctaagattctga

SEQ ID NO: 1430546 - DNA, 15 bp, Homo sapiens
aagttctaagttcat

SEQ ID NO: 1430547 - DNA, 17 bp, Homo sapiens
aagttctaataatttct

SEQ ID NO: 1430548 - DNA, 18 bp, Homo sapiens
aagttctaataatttcta

SEQ ID NO: 1430549 - DNA, 21 bp, Homo sapiens
aagttctaataatttctaatg

SEQ ID NO: 1430550 - DNA, 22 bp, Homo sapiens
aagttctcagaataactacctc

SEQ ID NO: 1430551 - DNA, 17 bp, Homo sapiens
aagttctccagcttcag

SEQ ID NO: 1430552 - DNA, 22 bp, Homo sapiens
aagttctcccaacaacatgaaa

SEQ ID NO: 1430553 - DNA, 9 bp, Homo sapiens
aagttctta

SEQ ID NO: 1430554 - DNA, 11 bp, Homo sapiens
aagttcttatg

SEQ ID NO: 1430555 - DNA, 22 bp, Homo sapiens
aagttcttatgaggaggggagg

SEQ ID NO: 1430556 - DNA, 14 bp, Homo sapiens
aagttctttgattc

SEQ ID NO: 1430557 - DNA, 15 bp, Homo sapiens
aagttgaaaagccaa

SEQ ID NO: 1430558 - DNA, 13 bp, Homo sapiens
aagttgaaatgtg

SEQ ID NO: 1430559 - DNA, 18 bp, Homo sapiens
aagttgaaatgtgtaatt

SEQ ID NO: 1430560 - DNA, 18 bp, Homo sapiens
aagttgaagctaagattt

SEQ ID NO: 1430561 - DNA, 12 bp, Homo sapiens
aagttgaaggaa

SEQ ID NO: 1430562 - DNA, 14 bp, Homo sapiens
aagttgaagggaaa

SEQ ID NO: 1430563 - DNA, 16 bp, Homo sapiens
aagttgcagtgagctg

SEQ ID NO: 1430564 - DNA, 19 bp, Homo sapiens
aagttgcattcctttgtct

SEQ ID NO: 1430565 - DNA, 15 bp, Homo sapiens
aagttgctaagtgtg

SEQ ID NO: 1430566 - DNA, 18 bp, Homo sapiens
aagttgctaagtgtgctt

SEQ ID NO: 1430567 - DNA, 22 bp, Homo sapiens
aagttggaaccgtgtccagcac

SEQ ID NO: 1430568 - DNA, 13 bp, Homo sapiens
aagttggaaggat

SEQ ID NO: 1430569 - DNA, 18 bp, Homo sapiens
aagttggacttgttttaa

SEQ ID NO: 1430570 - DNA, 16 bp, Homo sapiens
aagttgggactctgga

SEQ ID NO: 1430571 - DNA, 18 bp, Homo sapiens
aagttgtaacttatattg

SEQ ID NO: 1430572 - DNA, 14 bp, Homo sapiens
aagttgtactttaa

SEQ ID NO: 1430573 - DNA, 18 bp, Homo sapiens
aagttgtactttaaaaat

SEQ ID NO: 1430574 - DNA, 16 bp, Homo sapiens
aagttgtagcagattg

SEQ ID NO: 1430575 - DNA, 12 bp, Homo sapiens
aagttgtcaaag

SEQ ID NO: 1430576 - DNA, 17 bp, Homo sapiens
aagttgtcaaagaagct

SEQ ID NO: 1430577 - DNA, 19 bp, Homo sapiens
aagttgtgcaacggccagg

SEQ ID NO: 1430578 - DNA, 22 bp, Homo sapiens
aagttgtgcaacggccagggtt

SEQ ID NO: 1430579 - DNA, 15 bp, Homo sapiens
aagttgtgcttgttt

SEQ ID NO: 1430580 - DNA, 17 bp, Homo sapiens
aagttgtgcttttctgt

SEQ ID NO: 1430581 - DNA, 14 bp, Homo sapiens
aagttgtggatatc

SEQ ID NO: 1430582 - DNA, 14 bp, Homo sapiens
aagttgttaaaaca

SEQ ID NO: 1430583 - DNA, 19 bp, Homo sapiens
aagtttaaatattaagcat

SEQ ID NO: 1430584 - DNA, 20 bp, Homo sapiens
aagtttacacctttatcttt

SEQ ID NO: 1430585 - DNA, 18 bp, Homo sapiens
aagtttacattgtaaata

SEQ ID NO: 1430586 - DNA, 13 bp, Homo sapiens
aagtttatatgcc

SEQ ID NO: 1430587 - DNA, 18 bp, Homo sapiens
aagtttatcagtaaataa

SEQ ID NO: 1430588 - DNA, 17 bp, Homo sapiens
aagtttattttttctac

SEQ ID NO: 1430589 - DNA, 19 bp, Homo sapiens
aagtttattttttctacac

SEQ ID NO: 1430590 - DNA, 20 bp, Homo sapiens
aagtttattttttctacaca

SEQ ID NO: 1430591 - DNA, 19 bp, Homo sapiens
aagtttcacaggtcaataa

SEQ ID NO: 1430592 - DNA, 20 bp, Homo sapiens
aagtttcacaggtcaataaa

SEQ ID NO: 1430593 - DNA, 13 bp, Homo sapiens
aagtttcacctgt

SEQ ID NO: 1430594 - DNA, 16 bp, Homo sapiens
aagtttcagagtatat

SEQ ID NO: 1430595 - DNA, 16 bp, Homo sapiens
aagtttctaagattct

SEQ ID NO: 1430596 - DNA, 17 bp, Homo sapiens
aagtttctaagattcta

SEQ ID NO: 1430597 - DNA, 19 bp, Homo sapiens
aagtttctaagattctaaa

SEQ ID NO: 1430598 - DNA, 20 bp, Homo sapiens
aagtttctaagattctaaag

SEQ ID NO: 1430599 - DNA, 12 bp, Homo sapiens
aagtttctattc

SEQ ID NO: 1430600 - DNA, 20 bp, Homo sapiens
aagtttctggtgccatttct

SEQ ID NO: 1430601 - DNA, 22 bp, Homo sapiens
aagtttctggtgccatttctga

SEQ ID NO: 1430602 - DNA, 14 bp, Homo sapiens
aagtttctgtttca

SEQ ID NO: 1430603 - DNA, 10 bp, Homo sapiens
aagtttgaat

SEQ ID NO: 1430604 - DNA, 15 bp, Homo sapiens
aagtttgaatttgta

SEQ ID NO: 1430605 - DNA, 12 bp, Homo sapiens
aagtttgcaatt

SEQ ID NO: 1430606 - DNA, 14 bp, Homo sapiens
aagtttgcactgta

SEQ ID NO: 1430607 - DNA, 16 bp, Homo sapiens
aagtttgcttagaaaa

SEQ ID NO: 1430608 - DNA, 13 bp, Homo sapiens
aagtttgtagcca

SEQ ID NO: 1430609 - DNA, 19 bp, Homo sapiens
aagtttgtgttctgtttgt

SEQ ID NO: 1430610 - DNA, 21 bp, Homo sapiens
aagtttgtgttctgtttgtta

SEQ ID NO: 1430611 - DNA, 13 bp, Homo sapiens
aagttttaaagtt

SEQ ID NO: 1430612 - DNA, 17 bp, Homo sapiens
aagttttaactttaata

SEQ ID NO: 1430613 - DNA, 19 bp, Homo sapiens
aagttttagggtacatgtg

SEQ ID NO: 1430614 - DNA, 13 bp, Homo sapiens
aagttttatatgc

SEQ ID NO: 1430615 - DNA, 16 bp, Homo sapiens
aagttttccctgaagt

SEQ ID NO: 1430616 - DNA, 20 bp, Homo sapiens
aagttttcctacacttgaga

SEQ ID NO: 1430617 - DNA, 19 bp, Homo sapiens
aagttttgatgaaattctt

SEQ ID NO: 1430618 - DNA, 16 bp, Homo sapiens
aagttttgtaaaagaa

SEQ ID NO: 1430619 - DNA, 12 bp, Homo sapiens
aagttttgtata

SEQ ID NO: 1430620 - DNA, 20 bp, Homo sapiens
aagttttgtataaataataa

SEQ ID NO: 1430621 - DNA, 12 bp, Homo sapiens
aagtttttgctt

SEQ ID NO: 1430622 - DNA, 14 bp, Homo sapiens
aagttttttatgcc

SEQ ID NO: 1430623 - DNA, 16 bp, Homo sapiens
aagtttttttttcctc

SEQ ID NO: 1430624 - DNA, 17 bp, Homo sapiens
aagtttttttttcctct

SEQ ID NO: 1430625 - DNA, 19 bp, Homo sapiens
aataaaaaaaaaaggatga

SEQ ID NO: 1430626 - DNA, 20 bp, Homo sapiens
aataaaaaaaagaaatgaaa

SEQ ID NO: 1430627 - DNA, 13 bp, Homo sapiens
aataaaaaatgga

SEQ ID NO: 1430628 - DNA, 19 bp, Homo sapiens
aataaaaaattatgacaat

SEQ ID NO: 1430629 - DNA, 13 bp, Homo sapiens
aataaaaacaact

SEQ ID NO: 1430630 - DNA, 14 bp, Homo sapiens
aataaaaacaactt

SEQ ID NO: 1430631 - DNA, 21 bp, Homo sapiens
aataaaaactgactccttaga

SEQ ID NO: 1430632 - DNA, 19 bp, Homo sapiens
aataaaaagatcactttct

SEQ ID NO: 1430633 - DNA, 18 bp, Homo sapiens
cccacgttctctctgcct

SEQ ID NO: 1430634 - DNA, 11 bp, Homo sapiens
cccactaaaga

SEQ ID NO: 1430635 - DNA, 18 bp, Homo sapiens
cccactagagggcccatc

SEQ ID NO: 1430636 - DNA, 17 bp, Homo sapiens
cccactcaccagcccta

SEQ ID NO: 1430637 - DNA, 17 bp, Homo sapiens
cccactcaccagggtcc

SEQ ID NO: 1430638 - DNA, 23 bp, Homo sapiens
cccactcagaactctccagggag

SEQ ID NO: 1430639 - DNA, 12 bp, Homo sapiens
cccactccagcc

SEQ ID NO: 1430640 - DNA, 14 bp, Homo sapiens
cccactccagcctg

SEQ ID NO: 1430641 - DNA, 17 bp, Homo sapiens
cccactccccaccttca

SEQ ID NO: 1430642 - DNA, 15 bp, Homo sapiens
cccactccctgccta

SEQ ID NO: 1430643 - DNA, 22 bp, Homo sapiens
cccactccctggctctcagaag

SEQ ID NO: 1430644 - DNA, 19 bp, Homo sapiens
cccactcccttgctggccc

SEQ ID NO: 1430645 - DNA, 14 bp, Homo sapiens
cccactcccttggt

SEQ ID NO: 1430646 - DNA, 17 bp, Homo sapiens
cccactccctttccaac

SEQ ID NO: 1430647 - DNA, 12 bp, Homo sapiens
cccactcctgct

SEQ ID NO: 1430648 - DNA, 13 bp, Homo sapiens
cccactcctgctg

SEQ ID NO: 1430649 - DNA, 15 bp, Homo sapiens
cccactcctgctgca

SEQ ID NO: 1430650 - DNA, 14 bp, Homo sapiens
cccactctcattcc

SEQ ID NO: 1430651 - DNA, 19 bp, Homo sapiens
cccactctcattccccagg

SEQ ID NO: 1430652 - DNA, 19 bp, Homo sapiens
cccactgaaatgaccaaga

SEQ ID NO: 1430653 - DNA, 16 bp, Homo sapiens
cccactgacagcctcc

SEQ ID NO: 1430654 - DNA, 14 bp, Homo sapiens
cccactgcactcca

SEQ ID NO: 1430655 - DNA, 16 bp, Homo sapiens
cccactgcactccagc

SEQ ID NO: 1430656 - DNA, 17 bp, Homo sapiens
cccactgcactccagcc

SEQ ID NO: 1430657 - DNA, 15 bp, Homo sapiens
cccactgcaggcccc

SEQ ID NO: 1430658 - DNA, 23 bp, Homo sapiens
cccactgcaggccccgcttgtcc

SEQ ID NO: 1430659 - DNA, 14 bp, Homo sapiens
cccactgccagcag

SEQ ID NO: 1430660 - DNA, 17 bp, Homo sapiens
cccactgcccaccccct

SEQ ID NO: 1430661 - DNA, 23 bp, Homo sapiens
cccactgctcgtggactgtgctg

SEQ ID NO: 1430662 - DNA, 12 bp, Homo sapiens
cccactgctggc

SEQ ID NO: 1430663 - DNA, 14 bp, Homo sapiens
cccactgctggctg

SEQ ID NO: 1430664 - DNA, 21 bp, Homo sapiens
cccactggggccggcggggcc

SEQ ID NO: 1430665 - DNA, 14 bp, Homo sapiens
cccactgtcctggg

SEQ ID NO: 1430666 - DNA, 15 bp, Homo sapiens
cccactgtcctgggc

SEQ ID NO: 1430667 - DNA, 16 bp, Homo sapiens
cccactgtcctgggcc

SEQ ID NO: 1430668 - DNA, 14 bp, Homo sapiens
cccacttagccgca

SEQ ID NO: 1430669 - DNA, 16 bp, Homo sapiens
cccacttagccgcacc

SEQ ID NO: 1430670 - DNA, 18 bp, Homo sapiens
cccacttagccgcaccct

SEQ ID NO: 1430671 - DNA, 20 bp, Homo sapiens
cccacttagccgtccatggc

SEQ ID NO: 1430672 - DNA, 13 bp, Homo sapiens
cccacttcagcct

SEQ ID NO: 1430673 - DNA, 17 bp, Homo sapiens
cccacttgattgagaaa

SEQ ID NO: 1430674 - DNA, 14 bp, Homo sapiens
cccacttgcctctt

SEQ ID NO: 1430675 - DNA, 21 bp, Homo sapiens
cccacttgcctcttccttgaa

SEQ ID NO: 1430676 - DNA, 13 bp, Homo sapiens
cccactttcctga

SEQ ID NO: 1430677 - DNA, 14 bp, Homo sapiens
cccactttcctgag

SEQ ID NO: 1430678 - DNA, 19 bp, Homo sapiens
cccactttcctgagctgtc

SEQ ID NO: 1430679 - DNA, 17 bp, Homo sapiens
cccagaaaacctccagt

SEQ ID NO: 1430680 - DNA, 18 bp, Homo sapiens
cccagaaaacctccagta

SEQ ID NO: 1430681 - DNA, 14 bp, Homo sapiens
cccagaaaggagac

SEQ ID NO: 1430682 - DNA, 22 bp, Homo sapiens
cccagaaagtgataagtgcagg

SEQ ID NO: 1430683 - DNA, 21 bp, Homo sapiens
cccagaaattctggcccagcc

SEQ ID NO: 1430684 - DNA, 20 bp, Homo sapiens
cccagaacatacactgtgaa

SEQ ID NO: 1430685 - DNA, 14 bp, Homo sapiens
cccagaacctgtcc

SEQ ID NO: 1430686 - DNA, 19 bp, Homo sapiens
cccagaactggactcagga

SEQ ID NO: 1430687 - DNA, 21 bp, Homo sapiens
cccagaactttgggaggccaa

SEQ ID NO: 1430688 - DNA, 13 bp, Homo sapiens
cccagaaggcagg

SEQ ID NO: 1430689 - DNA, 15 bp, Homo sapiens
cccagaatctctgag

SEQ ID NO: 1430690 - DNA, 18 bp, Homo sapiens
cccagaatgagacatcca

SEQ ID NO: 1430691 - DNA, 15 bp, Homo sapiens
cccagacaccatgtg

SEQ ID NO: 1430692 - DNA, 19 bp, Homo sapiens
cccagacagacatctctgc

SEQ ID NO: 1430693 - DNA, 20 bp, Homo sapiens
cccagacagacatctctgca

SEQ ID NO: 1430694 - DNA, 21 bp, Homo sapiens
cccagacagctccctctgcct

SEQ ID NO: 1430695 - DNA, 22 bp, Homo sapiens
cccagacagtggatatgaccca

SEQ ID NO: 1430696 - DNA, 18 bp, Homo sapiens
cccagacccctctggcca

SEQ ID NO: 1430697 - DNA, 20 bp, Homo sapiens
cccagacccctctggccagg

SEQ ID NO: 1430698 - DNA, 21 bp, Homo sapiens
cccagacccctctggccagga

SEQ ID NO: 1430699 - DNA, 13 bp, Homo sapiens
cccagaccctggg

SEQ ID NO: 1430700 - DNA, 13 bp, Homo sapiens
cccagaccggctt

SEQ ID NO: 1430701 - DNA, 19 bp, Homo sapiens
cccagacctgtcgtctctc

SEQ ID NO: 1430702 - DNA, 21 bp, Homo sapiens
cccagacctgtcgtctctccc

SEQ ID NO: 1430703 - DNA, 15 bp, Homo sapiens
cccagactacagggc

SEQ ID NO: 1430704 - DNA, 13 bp, Homo sapiens
cccagactcagac

SEQ ID NO: 1430705 - DNA, 20 bp, Homo sapiens
cccagactcagacattggca

SEQ ID NO: 1430706 - DNA, 13 bp, Homo sapiens
cccagactctttt

SEQ ID NO: 1430707 - DNA, 16 bp, Homo sapiens
cccagactgagctctc

SEQ ID NO: 1430708 - DNA, 19 bp, Homo sapiens
cccagactgagctctccag

SEQ ID NO: 1430709 - DNA, 23 bp, Homo sapiens
cccagacttgcactggggtggga

SEQ ID NO: 1430710 - DNA, 21 bp, Homo sapiens
cccagagaagctggaagcctg

SEQ ID NO: 1430711 - DNA, 22 bp, Homo sapiens
cccagagaagctggaagcctgc

SEQ ID NO: 1430712 - DNA, 22 bp, Homo sapiens
cccagagaaggacggtgccaag

SEQ ID NO: 1430713 - DNA, 13 bp, Homo sapiens
cccagagacagga

SEQ ID NO: 1430714 - DNA, 16 bp, Homo sapiens
cccagagacaggaaaa

SEQ ID NO: 1430715 - DNA, 21 bp, Homo sapiens
cccagagacatacttgaaggg

SEQ ID NO: 1430716 - DNA, 20 bp, Homo sapiens
cccagagaccaggctgtgtc

SEQ ID NO: 1430717 - DNA, 11 bp, Homo sapiens
cccagagactt

SEQ ID NO: 1430718 - DNA, 16 bp, Homo sapiens
cccagagagaccctgc

SEQ ID NO: 1430719 - DNA, 21 bp, Homo sapiens
cccagagagaggggcctgcag

SEQ ID NO: 1430720 - DNA, 22 bp, Homo sapiens
cccagagagaggggcctgcagg

SEQ ID NO: 1430721 - DNA, 15 bp, Homo sapiens
cccagagaggaatca

SEQ ID NO: 1430722 - DNA, 16 bp, Homo sapiens
cccagagatgcctcca

SEQ ID NO: 1430723 - DNA, 18 bp, Homo sapiens
cccagagcaccccctgct

SEQ ID NO: 1430724 - DNA, 19 bp, Homo sapiens
cccagagcaggaggcccct

SEQ ID NO: 1430725 - DNA, 13 bp, Homo sapiens
cccagagccacct

SEQ ID NO: 1430726 - DNA, 16 bp, Homo sapiens
cccagagccacctgga

SEQ ID NO: 1430727 - DNA, 13 bp, Homo sapiens
cccagagcccagc

SEQ ID NO: 1430728 - DNA, 17 bp, Homo sapiens
cccagagcccagctcca

SEQ ID NO: 1430729 - DNA, 11 bp, Homo sapiens
cccagagcccg

SEQ ID NO: 1430730 - DNA, 19 bp, Homo sapiens
cccagagcccgcttttgtt

SEQ ID NO: 1430731 - DNA, 18 bp, Homo sapiens
cccagagcctctgctgga

SEQ ID NO: 1430732 - DNA, 14 bp, Homo sapiens
cccagagctgtgcc

SEQ ID NO: 1430733 - DNA, 20 bp, Homo sapiens
cccagagctgtttatggcct

SEQ ID NO: 1430734 - DNA, 21 bp, Homo sapiens
cccagagctgtttatggcctc

SEQ ID NO: 1430735 - DNA, 23 bp, Homo sapiens
cccagagctgtttatggcctcag

SEQ ID NO: 1430736 - DNA, 22 bp, Homo sapiens
cccagaggagctgggagccggg

SEQ ID NO: 1430737 - DNA, 15 bp, Homo sapiens
cccagaggccctgga

SEQ ID NO: 1430738 - DNA, 17 bp, Homo sapiens
cccagaggccctggagg

SEQ ID NO: 1430739 - DNA, 14 bp, Homo sapiens
cccagaggctccca

SEQ ID NO: 1430740 - DNA, 12 bp, Homo sapiens
cccagaggtgga

SEQ ID NO: 1430741 - DNA, 21 bp, Homo sapiens
cccagaggtgggatcctccct

SEQ ID NO: 1430742 - DNA, 13 bp, Homo sapiens
cccagagtcagag

SEQ ID NO: 1430743 - DNA, 20 bp, Homo sapiens
cccagagtcagaggagaaga

SEQ ID NO: 1430744 - DNA, 21 bp, Homo sapiens
cccagagtggagtctgagtct

SEQ ID NO: 1430745 - DNA, 14 bp, Homo sapiens
cccagatctgcctg

SEQ ID NO: 1430746 - DNA, 17 bp, Homo sapiens
cccagatctgcctgggc

SEQ ID NO: 1430747 - DNA, 18 bp, Homo sapiens
cccagatctgcctgggcc

SEQ ID NO: 1430748 - DNA, 22 bp, Homo sapiens
cccagatctgcctgggcctgtg

SEQ ID NO: 1430749 - DNA, 23 bp, Homo sapiens
cccagatggctggaaggggtcca

SEQ ID NO: 1430750 - DNA, 23 bp, Homo sapiens
cccagatgttgcttttgaaaagt

SEQ ID NO: 1430751 - DNA, 19 bp, Homo sapiens
cccagattcccctgtgtca

SEQ ID NO: 1430752 - DNA, 20 bp, Homo sapiens
cccagattggctcacactga

SEQ ID NO: 1430753 - DNA, 22 bp, Homo sapiens
cccagattggctcacactgaga

SEQ ID NO: 1430754 - DNA, 15 bp, Homo sapiens
cccagcaacgcccct

SEQ ID NO: 1430755 - DNA, 18 bp, Homo sapiens
cccagcaacgcccctcca

SEQ ID NO: 1430756 - DNA, 20 bp, Homo sapiens
cccagcaacgcccctccaaa

SEQ ID NO: 1430757 - DNA, 19 bp, Homo sapiens
cccagcaagacctcatctg

SEQ ID NO: 1430758 - DNA, 16 bp, Homo sapiens
cccagcacatggccat

SEQ ID NO: 1430759 - DNA, 12 bp, Homo sapiens
cccagcacctgc

SEQ ID NO: 1430760 - DNA, 14 bp, Homo sapiens
cccagcactgagga

SEQ ID NO: 1430761 - DNA, 11 bp, Homo sapiens
cccagcactgt

SEQ ID NO: 1430762 - DNA, 14 bp, Homo sapiens
cccagcactgtgaa

SEQ ID NO: 1430763 - DNA, 18 bp, Homo sapiens
cccagcacttgtgttgtc

SEQ ID NO: 1430764 - DNA, 12 bp, Homo sapiens
cccagcactttg

SEQ ID NO: 1430765 - DNA, 23 bp, Homo sapiens
cccagcactttgagaggctgagg

SEQ ID NO: 1430766 - DNA, 17 bp, Homo sapiens
cccagcactttgggagg

SEQ ID NO: 1430767 - DNA, 18 bp, Homo sapiens
cccagcactttgggaggc

SEQ ID NO: 1430768 - DNA, 21 bp, Homo sapiens
cccagcactttgggaggcagg

SEQ ID NO: 1430769 - DNA, 20 bp, Homo sapiens
cccagcagaatggaggcagg

SEQ ID NO: 1430770 - DNA, 18 bp, Homo sapiens
cccagcagacatcctcat

SEQ ID NO: 1430771 - DNA, 17 bp, Homo sapiens
cccagcagccctaagga

SEQ ID NO: 1430772 - DNA, 13 bp, Homo sapiens
cccagcaggaagc

SEQ ID NO: 1430773 - DNA, 20 bp, Homo sapiens
cccagcaggaagccaggctg

SEQ ID NO: 1430774 - DNA, 14 bp, Homo sapiens
cccagcaggcccag

SEQ ID NO: 1430775 - DNA, 15 bp, Homo sapiens
cccagcaggcccagc

SEQ ID NO: 1430776 - DNA, 18 bp, Homo sapiens
cccagcaggcccagcatg

SEQ ID NO: 1430777 - DNA, 18 bp, Homo sapiens
cccagcagggccactccc

SEQ ID NO: 1430778 - DNA, 19 bp, Homo sapiens
cccagcagggcctcaaagt

SEQ ID NO: 1430779 - DNA, 21 bp, Homo sapiens
cccagcaggggccctcactct

SEQ ID NO: 1430780 - DNA, 17 bp, Homo sapiens
cccagcatatgggggcc

SEQ ID NO: 1430781 - DNA, 20 bp, Homo sapiens
cccagcatccctggagcagg

SEQ ID NO: 1430782 - DNA, 21 bp, Homo sapiens
cccagcatccttttctgcaga

SEQ ID NO: 1430783 - DNA, 15 bp, Homo sapiens
cccagcatgcaggtg

SEQ ID NO: 1430784 - DNA, 19 bp, Homo sapiens
cccagcattccagcccctc

SEQ ID NO: 1430785 - DNA, 15 bp, Homo sapiens
cccagcattccagct

SEQ ID NO: 1430786 - DNA, 16 bp, Homo sapiens
cccagcattccagctc

SEQ ID NO: 1430787 - DNA, 17 bp, Homo sapiens
cccagcattccagctct

SEQ ID NO: 1430788 - DNA, 15 bp, Homo sapiens
cccagccacaggcca

SEQ ID NO: 1430789 - DNA, 22 bp, Homo sapiens
cccagccaccccgggctctctg

SEQ ID NO: 1430790 - DNA, 12 bp, Homo sapiens
cccagccagaaa

SEQ ID NO: 1430791 - DNA, 14 bp, Homo sapiens
cccagccagaaagc

SEQ ID NO: 1430792 - DNA, 14 bp, Homo sapiens
cccagccaggccaa

SEQ ID NO: 1430793 - DNA, 16 bp, Homo sapiens
cccagccatctgccca

SEQ ID NO: 1430794 - DNA, 17 bp, Homo sapiens
cccagccatctgcccag

SEQ ID NO: 1430795 - DNA, 20 bp, Homo sapiens
cccagccatctgcccagggg

SEQ ID NO: 1430796 - DNA, 19 bp, Homo sapiens
cccagccattaccatggag

SEQ ID NO: 1430797 - DNA, 20 bp, Homo sapiens
cccagccattaccatggaga

SEQ ID NO: 1430798 - DNA, 12 bp, Homo sapiens
cccagcccaata

SEQ ID NO: 1430799 - DNA, 17 bp, Homo sapiens
cccagcccaataaaggt

SEQ ID NO: 1430800 - DNA, 21 bp, Homo sapiens
cccagcccaataaaggtccct

SEQ ID NO: 1430801 - DNA, 13 bp, Homo sapiens
cccagcccagctg

SEQ ID NO: 1430802 - DNA, 11 bp, Homo sapiens
cccagcccagg

SEQ ID NO: 1430803 - DNA, 18 bp, Homo sapiens
cccagcccagggctcctg

SEQ ID NO: 1430804 - DNA, 22 bp, Homo sapiens
cccagcccattctctctcctgt

SEQ ID NO: 1430805 - DNA, 16 bp, Homo sapiens
cccagcccattgctgc

SEQ ID NO: 1430806 - DNA, 14 bp, Homo sapiens
cccagccccagccc

SEQ ID NO: 1430807 - DNA, 22 bp, Homo sapiens
cccagccccgccccgttgtgag

SEQ ID NO: 1430808 - DNA, 20 bp, Homo sapiens
cccagccccggtggctgggc

SEQ ID NO: 1430809 - DNA, 20 bp, Homo sapiens
cccagcccggaccttggcag

SEQ ID NO: 1430810 - DNA, 20 bp, Homo sapiens
cccagccctccccgcagtgg

SEQ ID NO: 1430811 - DNA, 15 bp, Homo sapiens
cccagccctgctggg

SEQ ID NO: 1430812 - DNA, 17 bp, Homo sapiens
cccagccctgctgggga

SEQ ID NO: 1430813 - DNA, 18 bp, Homo sapiens
cccagcccttctgccttt

SEQ ID NO: 1430814 - DNA, 14 bp, Homo sapiens
cccagccggcctct

SEQ ID NO: 1430815 - DNA, 16 bp, Homo sapiens
cccagccggcctctct

SEQ ID NO: 1430816 - DNA, 20 bp, Homo sapiens
cccagccggcctctctggcc

SEQ ID NO: 1430817 - DNA, 21 bp, Homo sapiens
cccagccggcctctctggcct

SEQ ID NO: 1430818 - DNA, 22 bp, Homo sapiens
cccagccggcctctctggcctc

SEQ ID NO: 1430819 - DNA, 16 bp, Homo sapiens
cccagcctccctgaag

SEQ ID NO: 1430820 - DNA, 18 bp, Homo sapiens
cccagcctcgttggagag

SEQ ID NO: 1430821 - DNA, 21 bp, Homo sapiens
cccagcctggccacgcagcca

SEQ ID NO: 1430822 - DNA, 13 bp, Homo sapiens
cccagcctggggc

SEQ ID NO: 1430823 - DNA, 15 bp, Homo sapiens
cccagcgcggccagc

SEQ ID NO: 1430824 - DNA, 18 bp, Homo sapiens
cccagcgcggccagcgtc

SEQ ID NO: 1430825 - DNA, 14 bp, Homo sapiens
cccagcgctctcct

SEQ ID NO: 1430826 - DNA, 16 bp, Homo sapiens
cccagcggcctccggc

SEQ ID NO: 1430827 - DNA, 17 bp, Homo sapiens
cccagcggtttccactt

SEQ ID NO: 1430828 - DNA, 15 bp, Homo sapiens
cccagcgtggcctcc

SEQ ID NO: 1430829 - DNA, 19 bp, Homo sapiens
cccagctaagaacctggaa

SEQ ID NO: 1430830 - DNA, 22 bp, Homo sapiens
cccagctaagaacctggaactt

SEQ ID NO: 1430831 - DNA, 18 bp, Homo sapiens
cccagctaataaaccaga

SEQ ID NO: 1430832 - DNA, 18 bp, Homo sapiens
cccagctaatctgtaggg

SEQ ID NO: 1430833 - DNA, 18 bp, Homo sapiens
cccagctaattgagacca

SEQ ID NO: 1430834 - DNA, 19 bp, Homo sapiens
cccagctaattgagaccac

SEQ ID NO: 1430835 - DNA, 21 bp, Homo sapiens
cccagctaatttttgtatttt

SEQ ID NO: 1430836 - DNA, 15 bp, Homo sapiens
cccagctacattcct

SEQ ID NO: 1430837 - DNA, 21 bp, Homo sapiens
cccagctactcaagaggctga

SEQ ID NO: 1430838 - DNA, 17 bp, Homo sapiens
cccagctactcagaagc

SEQ ID NO: 1430839 - DNA, 23 bp, Homo sapiens
cccagctactcagaagcctgagg

SEQ ID NO: 1430840 - DNA, 14 bp, Homo sapiens
cccagctactcagg

SEQ ID NO: 1430841 - DNA, 22 bp, Homo sapiens
cccagctactcaggaggctgag

SEQ ID NO: 1430842 - DNA, 16 bp, Homo sapiens
cccagctactctgtcc

SEQ ID NO: 1430843 - DNA, 19 bp, Homo sapiens
cccagctactctgtccagg

SEQ ID NO: 1430844 - DNA, 20 bp, Homo sapiens
cccagctactctgtccaggc

SEQ ID NO: 1430845 - DNA, 22 bp, Homo sapiens
cccagctactctgtccaggcca

SEQ ID NO: 1430846 - DNA, 24 bp, Homo sapiens
cccagctactctgtccaggccact

SEQ ID NO: 1430847 - DNA, 16 bp, Homo sapiens
cccagctactggggag

SEQ ID NO: 1430848 - DNA, 22 bp, Homo sapiens
cccagctactggggaggctgag

SEQ ID NO: 1430849 - DNA, 23 bp, Homo sapiens
cccagctacttgggaggctgagg

SEQ ID NO: 1430850 - DNA, 22 bp, Homo sapiens
cccagctaggaagagcaggact

SEQ ID NO: 1430851 - DNA, 21 bp, Homo sapiens
cccagctatggttctctcgca

SEQ ID NO: 1430852 - DNA, 11 bp, Homo sapiens
cccagctccag

SEQ ID NO: 1430853 - DNA, 15 bp, Homo sapiens
cccagctccagggcc

SEQ ID NO: 1430854 - DNA, 14 bp, Homo sapiens
cccagctccccagg

SEQ ID NO: 1430855 - DNA, 16 bp, Homo sapiens
cccagctcgcgggacc

SEQ ID NO: 1430856 - DNA, 20 bp, Homo sapiens
cccagctcgctggctttctc

SEQ ID NO: 1430857 - DNA, 14 bp, Homo sapiens
cccagctctcagta

SEQ ID NO: 1430858 - DNA, 15 bp, Homo sapiens
cccagctctccctct

SEQ ID NO: 1430859 - DNA, 16 bp, Homo sapiens
cccagctctccctctg

SEQ ID NO: 1430860 - DNA, 17 bp, Homo sapiens
cccagctctccctctgg

SEQ ID NO: 1430861 - DNA, 23 bp, Homo sapiens
cccagctctccctctggccctgc

SEQ ID NO: 1430862 - DNA, 20 bp, Homo sapiens
cccagctctggtgagtcttg

SEQ ID NO: 1430863 - DNA, 17 bp, Homo sapiens
cccagctcttgctctct

SEQ ID NO: 1430864 - DNA, 15 bp, Homo sapiens
cccagctgacatgga

SEQ ID NO: 1430865 - DNA, 14 bp, Homo sapiens
cccagctgactgtg

SEQ ID NO: 1430866 - DNA, 23 bp, Homo sapiens
aataaaaagatcactttctcagt

SEQ ID NO: 1430867 - DNA, 15 bp, Homo sapiens
aataaaaataaattc

SEQ ID NO: 1430868 - DNA, 16 bp, Homo sapiens
aataaaaataaatttg

SEQ ID NO: 1430869 - DNA, 14 bp, Homo sapiens
aataaaaatacaca

SEQ ID NO: 1430870 - DNA, 15 bp, Homo sapiens
aataaaaatacacat

SEQ ID NO: 1430871 - DNA, 22 bp, Homo sapiens
aataaaaatattgtgttgtgaa

SEQ ID NO: 1430872 - DNA, 13 bp, Homo sapiens
aataaaaatgata

SEQ ID NO: 1430873 - DNA, 14 bp, Homo sapiens
aataaaacacacct

SEQ ID NO: 1430874 - DNA, 13 bp, Homo sapiens
aataaaaccagct

SEQ ID NO: 1430875 - DNA, 21 bp, Homo sapiens
aataaaaccgaaggtgaaaaa

SEQ ID NO: 1430876 - DNA, 23 bp, Homo sapiens
aataaaactaagctctttgagaa

SEQ ID NO: 1430877 - DNA, 11 bp, Homo sapiens
aataaaagcac

SEQ ID NO: 1430878 - DNA, 12 bp, Homo sapiens
aataaaagcaca

SEQ ID NO: 1430879 - DNA, 20 bp, Homo sapiens
aataaaagctataaagtata

SEQ ID NO: 1430880 - DNA, 22 bp, Homo sapiens
aataaaagtgaagtgaatctga

SEQ ID NO: 1430881 - DNA, 13 bp, Homo sapiens
aataaaagtgact

SEQ ID NO: 1430882 - DNA, 19 bp, Homo sapiens
aataaaagtgcacacctta

SEQ ID NO: 1430883 - DNA, 16 bp, Homo sapiens
aataaaatattcactc

SEQ ID NO: 1430884 - DNA, 21 bp, Homo sapiens
aataaaatattcactctccat

SEQ ID NO: 1430885 - DNA, 21 bp, Homo sapiens
aataaaatgtgatttttctga

SEQ ID NO: 1430886 - DNA, 13 bp, Homo sapiens
aataaaatgtgta

SEQ ID NO: 1430887 - DNA, 15 bp, Homo sapiens
aataaaatgtgtaca

SEQ ID NO: 1430888 - DNA, 18 bp, Homo sapiens
aataaaatgtgtacagtg

SEQ ID NO: 1430889 - DNA, 18 bp, Homo sapiens
aataaaatgtttcattat

SEQ ID NO: 1430890 - DNA, 16 bp, Homo sapiens
aataaaattcatttct

SEQ ID NO: 1430891 - DNA, 21 bp, Homo sapiens
aataaacactgttttatagaa

SEQ ID NO: 1430892 - DNA, 22 bp, Homo sapiens
aataaacagcttcatgcctttg

SEQ ID NO: 1430893 - DNA, 23 bp, Homo sapiens
aataaacatccttcaagaactct

SEQ ID NO: 1430894 - DNA, 18 bp, Homo sapiens
aataaacattaattttgt

SEQ ID NO: 1430895 - DNA, 21 bp, Homo sapiens
aataaacattaattttgtgca

SEQ ID NO: 1430896 - DNA, 13 bp, Homo sapiens
aataaacattttt

SEQ ID NO: 1430897 - DNA, 18 bp, Homo sapiens
aataaacattttttaaga

SEQ ID NO: 1430898 - DNA, 15 bp, Homo sapiens
aataaacctgaggca

SEQ ID NO: 1430899 - DNA, 18 bp, Homo sapiens
aataaactcaatgagctc

SEQ ID NO: 1430900 - DNA, 21 bp, Homo sapiens
aataaacttggattctctaac

SEQ ID NO: 1430901 - DNA, 20 bp, Homo sapiens
aataaacttttttttgagaa

SEQ ID NO: 1430902 - DNA, 22 bp, Homo sapiens
aataaagaactccttattttgt

SEQ ID NO: 1430903 - DNA, 18 bp, Homo sapiens
aataaagaagaaaataac

SEQ ID NO: 1430904 - DNA, 17 bp, Homo sapiens
aataaagaagataataa

SEQ ID NO: 1430905 - DNA, 13 bp, Homo sapiens
aataaagataacc

SEQ ID NO: 1430906 - DNA, 17 bp, Homo sapiens
aataaagatatttccaa

SEQ ID NO: 1430907 - DNA, 13 bp, Homo sapiens
aataaagatgagt

SEQ ID NO: 1430908 - DNA, 11 bp, Homo sapiens
aataaagcaat

SEQ ID NO: 1430909 - DNA, 10 bp, Homo sapiens
aataaagcat

SEQ ID NO: 1430910 - DNA, 12 bp, Homo sapiens
aataaagcattc

SEQ ID NO: 1430911 - DNA, 18 bp, Homo sapiens
aataaagcctttgtatct

SEQ ID NO: 1430912 - DNA, 16 bp, Homo sapiens
aataaagcttttggaa

SEQ ID NO: 1430913 - DNA, 10 bp, Homo sapiens
aataaaggca

SEQ ID NO: 1430914 - DNA, 15 bp, Homo sapiens
aataaaggcagctgc

SEQ ID NO: 1430915 - DNA, 23 bp, Homo sapiens
aataaaggcagctgcctctgctc

SEQ ID NO: 1430916 - DNA, 15 bp, Homo sapiens
aataaagtatatata

SEQ ID NO: 1430917 - DNA, 13 bp, Homo sapiens
aataaagtctatt

SEQ ID NO: 1430918 - DNA, 12 bp, Homo sapiens
aataaagtgacc

SEQ ID NO: 1430919 - DNA, 19 bp, Homo sapiens
aataaagttctgagtgttt

SEQ ID NO: 1430920 - DNA, 15 bp, Homo sapiens
aataaagttgcagat

SEQ ID NO: 1430921 - DNA, 13 bp, Homo sapiens
aataaagttgctt

SEQ ID NO: 1430922 - DNA, 15 bp, Homo sapiens
aataaagttgctttt

SEQ ID NO: 1430923 - DNA, 11 bp, Homo sapiens
aataaatatat

SEQ ID NO: 1430924 - DNA, 15 bp, Homo sapiens
aataaatatatacat

SEQ ID NO: 1430925 - DNA, 15 bp, Homo sapiens
aataaatatctgtac

SEQ ID NO: 1430926 - DNA, 16 bp, Homo sapiens
aataaatatgtaatat

SEQ ID NO: 1430927 - DNA, 16 bp, Homo sapiens
aataaatattctgcat

SEQ ID NO: 1430928 - DNA, 15 bp, Homo sapiens
aataaatcatcctca

SEQ ID NO: 1430929 - DNA, 15 bp, Homo sapiens
aataaatctgaccca

SEQ ID NO: 1430930 - DNA, 16 bp, Homo sapiens
aataaatctgacccag

SEQ ID NO: 1430931 - DNA, 20 bp, Homo sapiens
aataaatctgacccagtgcc

SEQ ID NO: 1430932 - DNA, 13 bp, Homo sapiens
aataaatgagctg

SEQ ID NO: 1430933 - DNA, 15 bp, Homo sapiens
aataaatgagctgtt

SEQ ID NO: 1430934 - DNA, 13 bp, Homo sapiens
aataaatgattat

SEQ ID NO: 1430935 - DNA, 17 bp, Homo sapiens
aataaatgattatattc

SEQ ID NO: 1430936 - DNA, 21 bp, Homo sapiens
aataaatgattatattcacag

SEQ ID NO: 1430937 - DNA, 15 bp, Homo sapiens
aataaatgccctctt

SEQ ID NO: 1430938 - DNA, 21 bp, Homo sapiens
aataaatggtatagcaaatgt

SEQ ID NO: 1430939 - DNA, 14 bp, Homo sapiens
aataaatgtacctg

SEQ ID NO: 1430940 - DNA, 22 bp, Homo sapiens
aataaatgtgaaacatcttctc

SEQ ID NO: 1430941 - DNA, 20 bp, Homo sapiens
aataaatgtgaaattctgtc

SEQ ID NO: 1430942 - DNA, 21 bp, Homo sapiens
aataaatgtgccttcattttt

SEQ ID NO: 1430943 - DNA, 15 bp, Homo sapiens
aataaatgtttgtta

SEQ ID NO: 1430944 - DNA, 21 bp, Homo sapiens
aataaatgtttgttatttaca

SEQ ID NO: 1430945 - DNA, 16 bp, Homo sapiens
aataaattagttgtta

SEQ ID NO: 1430946 - DNA, 14 bp, Homo sapiens
aataaattcagata

SEQ ID NO: 1430947 - DNA, 17 bp, Homo sapiens
aataaattcctaaactc

SEQ ID NO: 1430948 - DNA, 21 bp, Homo sapiens
aataaattcctacaacttaat

SEQ ID NO: 1430949 - DNA, 21 bp, Homo sapiens
aataaattctgacttatgaat

SEQ ID NO: 1430950 - DNA, 14 bp, Homo sapiens
aataaattggagtt

SEQ ID NO: 1430951 - DNA, 17 bp, Homo sapiens
aataaattggattattt

SEQ ID NO: 1430952 - DNA, 16 bp, Homo sapiens
aataaatttaataaat

SEQ ID NO: 1430953 - DNA, 15 bp, Homo sapiens
aataaatttcccagt

SEQ ID NO: 1430954 - DNA, 21 bp, Homo sapiens
aataaatttcccagttaaaga

SEQ ID NO: 1430955 - DNA, 22 bp, Homo sapiens
aataaatttcccagttaaagat

SEQ ID NO: 1430956 - DNA, 20 bp, Homo sapiens
aataaatttgacttttctgt

SEQ ID NO: 1430957 - DNA, 15 bp, Homo sapiens
aataaatttgtaact

SEQ ID NO: 1430958 - DNA, 16 bp, Homo sapiens
aataaatttgtaactt

SEQ ID NO: 1430959 - DNA, 19 bp, Homo sapiens
aataacaatgtgctctcgg

SEQ ID NO: 1430960 - DNA, 20 bp, Homo sapiens
aataacacacatataaacat

SEQ ID NO: 1430961 - DNA, 16 bp, Homo sapiens
aataacacagagagac

SEQ ID NO: 1430962 - DNA, 11 bp, Homo sapiens
aataacactgc

SEQ ID NO: 1430963 - DNA, 19 bp, Homo sapiens
aataacactgcagccctct

SEQ ID NO: 1430964 - DNA, 16 bp, Homo sapiens
aataacactgtatttt

SEQ ID NO: 1430965 - DNA, 17 bp, Homo sapiens
aataacactgtatttta

SEQ ID NO: 1430966 - DNA, 23 bp, Homo sapiens
aataacactgtattttaatgtac

SEQ ID NO: 1430967 - DNA, 12 bp, Homo sapiens
aataacatattc

SEQ ID NO: 1430968 - DNA, 17 bp, Homo sapiens
aataacatctgaaaaga

SEQ ID NO: 1430969 - DNA, 19 bp, Homo sapiens
aataacatgtaattaagta

SEQ ID NO: 1430970 - DNA, 22 bp, Homo sapiens
aataacatgtaattaagtacta

SEQ ID NO: 1430971 - DNA, 20 bp, Homo sapiens
aataacattcccactgccag

SEQ ID NO: 1430972 - DNA, 21 bp, Homo sapiens
aataaccacttaaaaaatgtc

SEQ ID NO: 1430973 - DNA, 15 bp, Homo sapiens
aataactacctcctc

SEQ ID NO: 1430974 - DNA, 19 bp, Homo sapiens
aataactagtgttgcttgg

SEQ ID NO: 1430975 - DNA, 13 bp, Homo sapiens
aataactctggga

SEQ ID NO: 1430976 - DNA, 23 bp, Homo sapiens
aataactgccttgggcaaggaca

SEQ ID NO: 1430977 - DNA, 18 bp, Homo sapiens
aataactggaaaacagaa

SEQ ID NO: 1430978 - DNA, 20 bp, Homo sapiens
aataactggaaaacagaaca

SEQ ID NO: 1430979 - DNA, 20 bp, Homo sapiens
aataactggaacaaattatt

SEQ ID NO: 1430980 - DNA, 15 bp, Homo sapiens
aataactgtcttctg

SEQ ID NO: 1430981 - DNA, 16 bp, Homo sapiens
aataactgtgaagttt

SEQ ID NO: 1430982 - DNA, 16 bp, Homo sapiens
aataactgtgtactgt

SEQ ID NO: 1430983 - DNA, 17 bp, Homo sapiens
cccagctgactgtggcc

SEQ ID NO: 1430984 - DNA, 12 bp, Homo sapiens
cccagctgggag

SEQ ID NO: 1430985 - DNA, 13 bp, Homo sapiens
cccagctgggagg

SEQ ID NO: 1430986 - DNA, 17 bp, Homo sapiens
cccagctgggaggcaag

SEQ ID NO: 1430987 - DNA, 18 bp, Homo sapiens
cccagctgggaggcaaga

SEQ ID NO: 1430988 - DNA, 17 bp, Homo sapiens
cccagctgggctctgcc

SEQ ID NO: 1430989 - DNA, 18 bp, Homo sapiens
cccagctgggctctgcca

SEQ ID NO: 1430990 - DNA, 16 bp, Homo sapiens
cccagctgtagccatg

SEQ ID NO: 1430991 - DNA, 19 bp, Homo sapiens
cccagctgtagccatggct

SEQ ID NO: 1430992 - DNA, 21 bp, Homo sapiens
cccagctgtagccatggctca

SEQ ID NO: 1430993 - DNA, 23 bp, Homo sapiens
cccagctgtagccatggctcagg

SEQ ID NO: 1430994 - DNA, 15 bp, Homo sapiens
cccagcttcctggtg

SEQ ID NO: 1430995 - DNA, 16 bp, Homo sapiens
cccagcttcctggtgt

SEQ ID NO: 1430996 - DNA, 23 bp, Homo sapiens
cccagcttgggcccagctgggct

SEQ ID NO: 1430997 - DNA, 16 bp, Homo sapiens
cccaggaccagctcag

SEQ ID NO: 1430998 - DNA, 13 bp, Homo sapiens
cccaggaccctga

SEQ ID NO: 1430999 - DNA, 21 bp, Homo sapiens
cccaggacctcggatgaccat

SEQ ID NO: 1431000 - DNA, 14 bp, Homo sapiens
cccaggactgggcc

SEQ ID NO: 1431001 - DNA, 15 bp, Homo sapiens
cccaggactgggcca

SEQ ID NO: 1431002 - DNA, 23 bp, Homo sapiens
cccaggagagccagccctccctg

SEQ ID NO: 1431003 - DNA, 15 bp, Homo sapiens
cccaggagctctgcg

SEQ ID NO: 1431004 - DNA, 23 bp, Homo sapiens
cccaggagctctgcgccaggcag

SEQ ID NO: 1431005 - DNA, 19 bp, Homo sapiens
cccaggagctgagtcacct

SEQ ID NO: 1431006 - DNA, 20 bp, Homo sapiens
cccaggagctgagtcacctc

SEQ ID NO: 1431007 - DNA, 21 bp, Homo sapiens
cccaggagctgagtcacctcc

SEQ ID NO: 1431008 - DNA, 23 bp, Homo sapiens
cccaggagctgagtcacctcctc

SEQ ID NO: 1431009 - DNA, 13 bp, Homo sapiens
cccaggaggctga

SEQ ID NO: 1431010 - DNA, 21 bp, Homo sapiens
cccaggaggtgcttgaggccc

SEQ ID NO: 1431011 - DNA, 23 bp, Homo sapiens
cccaggaggtgcttgaggccccg

SEQ ID NO: 1431012 - DNA, 17 bp, Homo sapiens
cccaggagtttgaggct

SEQ ID NO: 1431013 - DNA, 18 bp, Homo sapiens
cccaggagtttgaggctg

SEQ ID NO: 1431014 - DNA, 19 bp, Homo sapiens
cccaggagtttgaggctgc

SEQ ID NO: 1431015 - DNA, 19 bp, Homo sapiens
cccaggatactggcacaga

SEQ ID NO: 1431016 - DNA, 20 bp, Homo sapiens
cccaggatcactctctgctg

SEQ ID NO: 1431017 - DNA, 22 bp, Homo sapiens
cccaggatcactctctgctggc

SEQ ID NO: 1431018 - DNA, 23 bp, Homo sapiens
cccaggatgccacgcctggaagg

SEQ ID NO: 1431019 - DNA, 17 bp, Homo sapiens
cccaggattcccccagc

SEQ ID NO: 1431020 - DNA, 18 bp, Homo sapiens
cccaggattcccccagcc

SEQ ID NO: 1431021 - DNA, 14 bp, Homo sapiens
cccaggcaagcagc

SEQ ID NO: 1431022 - DNA, 14 bp, Homo sapiens
cccaggcaccacca

SEQ ID NO: 1431023 - DNA, 19 bp, Homo sapiens
cccaggcaccaccaggagc

SEQ ID NO: 1431024 - DNA, 21 bp, Homo sapiens
cccaggcaccaccaggagcag

SEQ ID NO: 1431025 - DNA, 11 bp, Homo sapiens
cccaggcaggg

SEQ ID NO: 1431026 - DNA, 13 bp, Homo sapiens
cccaggcagtctt

SEQ ID NO: 1431027 - DNA, 21 bp, Homo sapiens
cccaggcatgaaattcttcct

SEQ ID NO: 1431028 - DNA, 19 bp, Homo sapiens
cccaggccaggctccttcc

SEQ ID NO: 1431029 - DNA, 12 bp, Homo sapiens
cccaggccaggt

SEQ ID NO: 1431030 - DNA, 16 bp, Homo sapiens
cccaggccaggtccct

SEQ ID NO: 1431031 - DNA, 24 bp, Homo sapiens
cccaggccaggtccctggaccagc

SEQ ID NO: 1431032 - DNA, 23 bp, Homo sapiens
cccaggcccaccatcaccaccgc

SEQ ID NO: 1431033 - DNA, 16 bp, Homo sapiens
cccaggccccctgcat

SEQ ID NO: 1431034 - DNA, 12 bp, Homo sapiens
cccaggccctcc

SEQ ID NO: 1431035 - DNA, 15 bp, Homo sapiens
cccaggcccttggct

SEQ ID NO: 1431036 - DNA, 19 bp, Homo sapiens
cccaggccctttggcttct

SEQ ID NO: 1431037 - DNA, 15 bp, Homo sapiens
cccaggccggagccc

SEQ ID NO: 1431038 - DNA, 16 bp, Homo sapiens
cccaggccggagccca

SEQ ID NO: 1431039 - DNA, 17 bp, Homo sapiens
cccaggccggagcccag

SEQ ID NO: 1431040 - DNA, 21 bp, Homo sapiens
cccaggccggggtggagcatg

SEQ ID NO: 1431041 - DNA, 13 bp, Homo sapiens
cccaggccgttcc

SEQ ID NO: 1431042 - DNA, 14 bp, Homo sapiens
cccaggccgttccc

SEQ ID NO: 1431043 - DNA, 21 bp, Homo sapiens
cccaggccgttccccttggct

SEQ ID NO: 1431044 - DNA, 17 bp, Homo sapiens
cccaggcctgcctgcat

SEQ ID NO: 1431045 - DNA, 16 bp, Homo sapiens
cccaggctgagagcca

SEQ ID NO: 1431046 - DNA, 18 bp, Homo sapiens
cccaggctgagagccaga

SEQ ID NO: 1431047 - DNA, 13 bp, Homo sapiens
cccaggctgcact

SEQ ID NO: 1431048 - DNA, 12 bp, Homo sapiens
cccaggctggga

SEQ ID NO: 1431049 - DNA, 13 bp, Homo sapiens
cccaggctgggaa

SEQ ID NO: 1431050 - DNA, 21 bp, Homo sapiens
cccaggctgggaactcatctg

SEQ ID NO: 1431051 - DNA, 13 bp, Homo sapiens
cccaggcttcctg

SEQ ID NO: 1431052 - DNA, 22 bp, Homo sapiens
cccaggcttgtcactagcagct

SEQ ID NO: 1431053 - DNA, 15 bp, Homo sapiens
cccaggctttagcat

SEQ ID NO: 1431054 - DNA, 17 bp, Homo sapiens
cccaggctttagcatta

SEQ ID NO: 1431055 - DNA, 20 bp, Homo sapiens
cccagggaaggtggggccct

SEQ ID NO: 1431056 - DNA, 21 bp, Homo sapiens
cccagggaaggtggggccctg

SEQ ID NO: 1431057 - DNA, 14 bp, Homo sapiens
cccagggagctctg

SEQ ID NO: 1431058 - DNA, 23 bp, Homo sapiens
cccagggcaagggttaaggcctg

SEQ ID NO: 1431059 - DNA, 15 bp, Homo sapiens
cccagggccagggcc

SEQ ID NO: 1431060 - DNA, 17 bp, Homo sapiens
cccagggcccagagccc

SEQ ID NO: 1431061 - DNA, 11 bp, Homo sapiens
cccagggcccc

SEQ ID NO: 1431062 - DNA, 18 bp, Homo sapiens
cccagggcccccacaggc

SEQ ID NO: 1431063 - DNA, 17 bp, Homo sapiens
cccagggcccctccctc

SEQ ID NO: 1431064 - DNA, 21 bp, Homo sapiens
cccagggcccctccctctgcc

SEQ ID NO: 1431065 - DNA, 20 bp, Homo sapiens
cccagggccctcccagccca

SEQ ID NO: 1431066 - DNA, 14 bp, Homo sapiens
cccagggcctagag

SEQ ID NO: 1431067 - DNA, 16 bp, Homo sapiens
cccagggcctccaggg

SEQ ID NO: 1431068 - DNA, 12 bp, Homo sapiens
cccagggcctgg

SEQ ID NO: 1431069 - DNA, 18 bp, Homo sapiens
cccagggcctgggggcag

SEQ ID NO: 1431070 - DNA, 20 bp, Homo sapiens
cccagggcctgggggcagtg

SEQ ID NO: 1431071 - DNA, 17 bp, Homo sapiens
cccagggctcagcctgg

SEQ ID NO: 1431072 - DNA, 15 bp, Homo sapiens
cccagggctcctgca

SEQ ID NO: 1431073 - DNA, 15 bp, Homo sapiens
cccagggctctgcag

SEQ ID NO: 1431074 - DNA, 16 bp, Homo sapiens
cccagggctctgcagg

SEQ ID NO: 1431075 - DNA, 20 bp, Homo sapiens
cccagggctgggaggaagga

SEQ ID NO: 1431076 - DNA, 21 bp, Homo sapiens
cccagggctgggaggaaggac

SEQ ID NO: 1431077 - DNA, 17 bp, Homo sapiens
cccaggggaaaatgaag

SEQ ID NO: 1431078 - DNA, 13 bp, Homo sapiens
cccaggggagagg

SEQ ID NO: 1431079 - DNA, 23 bp, Homo sapiens
cccaggggagagggtctggagaa

SEQ ID NO: 1431080 - DNA, 24 bp, Homo sapiens
cccaggggagagggtctggagaag

SEQ ID NO: 1431081 - DNA, 15 bp, Homo sapiens
cccaggggagccagc

SEQ ID NO: 1431082 - DNA, 16 bp, Homo sapiens
cccaggggagccagct

SEQ ID NO: 1431083 - DNA, 18 bp, Homo sapiens
cccaggggagccagctgc

SEQ ID NO: 1431084 - DNA, 20 bp, Homo sapiens
cccaggggagccagctgctt

SEQ ID NO: 1431085 - DNA, 15 bp, Homo sapiens
cccaggggcagcaag

SEQ ID NO: 1431086 - DNA, 16 bp, Homo sapiens
cccaggggcagccaca

SEQ ID NO: 1431087 - DNA, 22 bp, Homo sapiens
cccaggggcatgtattggcctg

SEQ ID NO: 1431088 - DNA, 19 bp, Homo sapiens
cccaggggtctccctggct

SEQ ID NO: 1431089 - DNA, 20 bp, Homo sapiens
cccaggggtctccctggctc

SEQ ID NO: 1431090 - DNA, 17 bp, Homo sapiens
cccaggggtgccccctc

SEQ ID NO: 1431091 - DNA, 14 bp, Homo sapiens
cccagggtcctgtg

SEQ ID NO: 1431092 - DNA, 18 bp, Homo sapiens
cccagggtcttccctacc

SEQ ID NO: 1431093 - DNA, 23 bp, Homo sapiens
cccagggtcttccctacctcagg

SEQ ID NO: 1431094 - DNA, 21 bp, Homo sapiens
cccagggttggggggtgccgg

SEQ ID NO: 1431095 - DNA, 14 bp, Homo sapiens
cccaggtcatggaa

SEQ ID NO: 1431096 - DNA, 14 bp, Homo sapiens
cccaggtccagctc

SEQ ID NO: 1431097 - DNA, 20 bp, Homo sapiens
cccaggtcccccgactgcct

SEQ ID NO: 1431098 - DNA, 13 bp, Homo sapiens
cccaggtcctcac

SEQ ID NO: 1431099 - DNA, 11 bp, Homo sapiens
aataacttcta

SEQ ID NO: 1431100 - DNA, 18 bp, Homo sapiens
aataacttctatatttta

SEQ ID NO: 1431101 - DNA, 23 bp, Homo sapiens
aataacttctatattttaataga

SEQ ID NO: 1431102 - DNA, 19 bp, Homo sapiens
aataacttgtcctatgtca

SEQ ID NO: 1431103 - DNA, 21 bp, Homo sapiens
aataacttgtcctatgtcaat

SEQ ID NO: 1431104 - DNA, 15 bp, Homo sapiens
aataagacaaaaata

SEQ ID NO: 1431105 - DNA, 23 bp, Homo sapiens
aataagagttgctttgccagagc

SEQ ID NO: 1431106 - DNA, 12 bp, Homo sapiens
aataagattcta

SEQ ID NO: 1431107 - DNA, 14 bp, Homo sapiens
aataagcaggtgga

SEQ ID NO: 1431108 - DNA, 14 bp, Homo sapiens
aataagctaaagag

SEQ ID NO: 1431109 - DNA, 21 bp, Homo sapiens
aataaggacagcagctggtgc

SEQ ID NO: 1431110 - DNA, 12 bp, Homo sapiens
aataaggaggag

SEQ ID NO: 1431111 - DNA, 16 bp, Homo sapiens
aataaggcacccatct

SEQ ID NO: 1431112 - DNA, 19 bp, Homo sapiens
aataaggtgtggtctgttt

SEQ ID NO: 1431113 - DNA, 21 bp, Homo sapiens
aataagtatttctgattttgt

SEQ ID NO: 1431114 - DNA, 14 bp, Homo sapiens
aataagtcaacagt

SEQ ID NO: 1431115 - DNA, 15 bp, Homo sapiens
aataagtcaacagta

SEQ ID NO: 1431116 - DNA, 17 bp, Homo sapiens
aataagtgccaggatgg

SEQ ID NO: 1431117 - DNA, 20 bp, Homo sapiens
aataagtggattttgtattt

SEQ ID NO: 1431118 - DNA, 21 bp, Homo sapiens
aataagttcaaattcttctga

SEQ ID NO: 1431119 - DNA, 18 bp, Homo sapiens
aataataaagatgctctt

SEQ ID NO: 1431120 - DNA, 14 bp, Homo sapiens
aataataaagatgt

SEQ ID NO: 1431121 - DNA, 19 bp, Homo sapiens
aataataaagatgtgaaaa

SEQ ID NO: 1431122 - DNA, 15 bp, Homo sapiens
aataataataataat

SEQ ID NO: 1431123 - DNA, 15 bp, Homo sapiens
aataatagggaaaat

SEQ ID NO: 1431124 - DNA, 13 bp, Homo sapiens
aataatatatgtt

SEQ ID NO: 1431125 - DNA, 14 bp, Homo sapiens
aataatatatgttt

SEQ ID NO: 1431126 - DNA, 14 bp, Homo sapiens
aataatatcaaata

SEQ ID NO: 1431127 - DNA, 11 bp, Homo sapiens
aataatatgca

SEQ ID NO: 1431128 - DNA, 13 bp, Homo sapiens
aataatatgcatt

SEQ ID NO: 1431129 - DNA, 14 bp, Homo sapiens
aataatatttatgt

SEQ ID NO: 1431130 - DNA, 15 bp, Homo sapiens
aataatatttcaagt

SEQ ID NO: 1431131 - DNA, 16 bp, Homo sapiens
aataatatttcaagtg

SEQ ID NO: 1431132 - DNA, 17 bp, Homo sapiens
aataatatttcaagtgc

SEQ ID NO: 1431133 - DNA, 18 bp, Homo sapiens
aataatatttcaagtgcc

SEQ ID NO: 1431134 - DNA, 14 bp, Homo sapiens
aataatcaagattt

SEQ ID NO: 1431135 - DNA, 15 bp, Homo sapiens
aataatcaagatttt

SEQ ID NO: 1431136 - DNA, 17 bp, Homo sapiens
aataatcaagattttag

SEQ ID NO: 1431137 - DNA, 15 bp, Homo sapiens
aataatcacacacac

SEQ ID NO: 1431138 - DNA, 13 bp, Homo sapiens
aataatcggccca

SEQ ID NO: 1431139 - DNA, 13 bp, Homo sapiens
aataatggaaaaa

SEQ ID NO: 1431140 - DNA, 17 bp, Homo sapiens
aataatggaaaaatagt

SEQ ID NO: 1431141 - DNA, 20 bp, Homo sapiens
aataatggaattatgtataa

SEQ ID NO: 1431142 - DNA, 20 bp, Homo sapiens
aataatggtcccatccaggc

SEQ ID NO: 1431143 - DNA, 12 bp, Homo sapiens
aataatgtactc

SEQ ID NO: 1431144 - DNA, 18 bp, Homo sapiens
aataatgtgttaaacatg

SEQ ID NO: 1431145 - DNA, 14 bp, Homo sapiens
aataatgttctgtc

SEQ ID NO: 1431146 - DNA, 18 bp, Homo sapiens
aataattatccagagttt

SEQ ID NO: 1431147 - DNA, 19 bp, Homo sapiens
aataattattcatctaatg

SEQ ID NO: 1431148 - DNA, 17 bp, Homo sapiens
aataattccataaatct

SEQ ID NO: 1431149 - DNA, 19 bp, Homo sapiens
aataattctgagttttgtg

SEQ ID NO: 1431150 - DNA, 23 bp, Homo sapiens
aataattgaaaagattttaacaa

SEQ ID NO: 1431151 - DNA, 21 bp, Homo sapiens
aataattgatcaaattcattt

SEQ ID NO: 1431152 - DNA, 16 bp, Homo sapiens
aataattgcagaacta

SEQ ID NO: 1431153 - DNA, 14 bp, Homo sapiens
aataattgtttcca

SEQ ID NO: 1431154 - DNA, 22 bp, Homo sapiens
aataatttcccaattaggaagt

SEQ ID NO: 1431155 - DNA, 16 bp, Homo sapiens
aataatttctaatgtt

SEQ ID NO: 1431156 - DNA, 15 bp, Homo sapiens
aataatttgaatgta

SEQ ID NO: 1431157 - DNA, 15 bp, Homo sapiens
aataatttgtacaat

SEQ ID NO: 1431158 - DNA, 20 bp, Homo sapiens
aataatttgtacaatggttt

SEQ ID NO: 1431159 - DNA, 14 bp, Homo sapiens
aataattttccaag

SEQ ID NO: 1431160 - DNA, 17 bp, Homo sapiens
aataattttggaataat

SEQ ID NO: 1431161 - DNA, 14 bp, Homo sapiens
aatacaaaaaatta

SEQ ID NO: 1431162 - DNA, 21 bp, Homo sapiens
aatacaaaaaattagccgggc

SEQ ID NO: 1431163 - DNA, 19 bp, Homo sapiens
aatacaaaaagcaaaacaa

SEQ ID NO: 1431164 - DNA, 20 bp, Homo sapiens
aatacaaaaattagccgggc

SEQ ID NO: 1431165 - DNA, 13 bp, Homo sapiens
aatacaaatgtta

SEQ ID NO: 1431166 - DNA, 13 bp, Homo sapiens
aatacaacacatc

SEQ ID NO: 1431167 - DNA, 19 bp, Homo sapiens
aatacaaggtataataaaa

SEQ ID NO: 1431168 - DNA, 14 bp, Homo sapiens
aatacaatgtacaa

SEQ ID NO: 1431169 - DNA, 17 bp, Homo sapiens
aatacaatgtacaatta

SEQ ID NO: 1431170 - DNA, 18 bp, Homo sapiens
aatacaatgtacaattat

SEQ ID NO: 1431171 - DNA, 20 bp, Homo sapiens
aatacaattcacagcacagt

SEQ ID NO: 1431172 - DNA, 15 bp, Homo sapiens
aatacacaagtaaac

SEQ ID NO: 1431173 - DNA, 23 bp, Homo sapiens
aatacacatgaaaacaagaaaga

SEQ ID NO: 1431174 - DNA, 15 bp, Homo sapiens
aatacagaatcttgt

SEQ ID NO: 1431175 - DNA, 21 bp, Homo sapiens
aatacagacactaagttatag

SEQ ID NO: 1431176 - DNA, 13 bp, Homo sapiens
aatacagataaat

SEQ ID NO: 1431177 - DNA, 18 bp, Homo sapiens
aatacagataaatgattc

SEQ ID NO: 1431178 - DNA, 18 bp, Homo sapiens
aatacagcaacaatttat

SEQ ID NO: 1431179 - DNA, 15 bp, Homo sapiens
aatacaggaaacagt

SEQ ID NO: 1431180 - DNA, 17 bp, Homo sapiens
aatacagtaagcatagt

SEQ ID NO: 1431181 - DNA, 16 bp, Homo sapiens
aatacagtattataga

SEQ ID NO: 1431182 - DNA, 20 bp, Homo sapiens
aatacagtattatagacaaa

SEQ ID NO: 1431183 - DNA, 23 bp, Homo sapiens
aatacagtattatagacaaaaga

SEQ ID NO: 1431184 - DNA, 17 bp, Homo sapiens
aatacataacattcaat

SEQ ID NO: 1431185 - DNA, 16 bp, Homo sapiens
aatacatcagaaaata

SEQ ID NO: 1431186 - DNA, 20 bp, Homo sapiens
aatacatcagaaaataaaat

SEQ ID NO: 1431187 - DNA, 22 bp, Homo sapiens
aatacatgtaagtgtggttttg

SEQ ID NO: 1431188 - DNA, 15 bp, Homo sapiens
aatacattccattgt

SEQ ID NO: 1431189 - DNA, 15 bp, Homo sapiens
aatacattctgcttt

SEQ ID NO: 1431190 - DNA, 14 bp, Homo sapiens
aatacattctttgc

SEQ ID NO: 1431191 - DNA, 16 bp, Homo sapiens
aatacattctttgcta

SEQ ID NO: 1431192 - DNA, 22 bp, Homo sapiens
aatacattctttttgctctaaa

SEQ ID NO: 1431193 - DNA, 22 bp, Homo sapiens
aatacatttgtattttgtgatg

SEQ ID NO: 1431194 - DNA, 18 bp, Homo sapiens
aatacattttgtatatta

SEQ ID NO: 1431195 - DNA, 19 bp, Homo sapiens
aataccacatcaaataaga

SEQ ID NO: 1431196 - DNA, 13 bp, Homo sapiens
aataccagagcct

SEQ ID NO: 1431197 - DNA, 23 bp, Homo sapiens
aataccagagccttcaagtgcca

SEQ ID NO: 1431198 - DNA, 21 bp, Homo sapiens
aataccattaaaactgctttt

SEQ ID NO: 1431199 - DNA, 15 bp, Homo sapiens
aataccatttagtaa

SEQ ID NO: 1431200 - DNA, 23 bp, Homo sapiens
aataccattttttaaggaaacaa

SEQ ID NO: 1431201 - DNA, 18 bp, Homo sapiens
aataccgctcagtatttt

SEQ ID NO: 1431202 - DNA, 17 bp, Homo sapiens
aatacctcaatttttgt

SEQ ID NO: 1431203 - DNA, 23 bp, Homo sapiens
aatacctcttactttgcttgaga

SEQ ID NO: 1431204 - DNA, 22 bp, Homo sapiens
aatacgtgccagatataactgt

SEQ ID NO: 1431205 - DNA, 15 bp, Homo sapiens
aatactactcctgta

SEQ ID NO: 1431206 - DNA, 22 bp, Homo sapiens
aatactaggatacagaaatgca

SEQ ID NO: 1431207 - DNA, 20 bp, Homo sapiens
aatactattctcattatgtt

SEQ ID NO: 1431208 - DNA, 13 bp, Homo sapiens
aatactcaaatga

SEQ ID NO: 1431209 - DNA, 14 bp, Homo sapiens
aatactcatgtgca

SEQ ID NO: 1431210 - DNA, 23 bp, Homo sapiens
aatactcttaggaagagaaacca

SEQ ID NO: 1431211 - DNA, 14 bp, Homo sapiens
aatactcttgaaag

SEQ ID NO: 1431212 - DNA, 18 bp, Homo sapiens
aatactcttgaaaggcca

SEQ ID NO: 1431213 - DNA, 13 bp, Homo sapiens
aatactgaatttt

SEQ ID NO: 1431214 - DNA, 23 bp, Homo sapiens
aatactgctacagcaatttctaa

SEQ ID NO: 1431215 - DNA, 12 bp, Homo sapiens
aatactggactc

SEQ ID NO: 1431216 - DNA, 18 bp, Homo sapiens
cccaggtctctccactgc

SEQ ID NO: 1431217 - DNA, 22 bp, Homo sapiens
cccaggtctctccactgctctc

SEQ ID NO: 1431218 - DNA, 18 bp, Homo sapiens
cccaggtggagggcacag

SEQ ID NO: 1431219 - DNA, 21 bp, Homo sapiens
cccaggtggagggcacagccc

SEQ ID NO: 1431220 - DNA, 22 bp, Homo sapiens
cccaggtggagggcacagccct

SEQ ID NO: 1431221 - DNA, 13 bp, Homo sapiens
cccaggtggcctg

SEQ ID NO: 1431222 - DNA, 20 bp, Homo sapiens
cccaggtggcctgcgtcttt

SEQ ID NO: 1431223 - DNA, 23 bp, Homo sapiens
cccaggtggctgacccagtccct

SEQ ID NO: 1431224 - DNA, 14 bp, Homo sapiens
cccaggtgtgcctg

SEQ ID NO: 1431225 - DNA, 16 bp, Homo sapiens
cccaggtgtgcctgtg

SEQ ID NO: 1431226 - DNA, 23 bp, Homo sapiens
cccaggtgtgcctgtgctcctgc

SEQ ID NO: 1431227 - DNA, 17 bp, Homo sapiens
cccaggttcccccagca

SEQ ID NO: 1431228 - DNA, 17 bp, Homo sapiens
cccaggttcgagaccca

SEQ ID NO: 1431229 - DNA, 18 bp, Homo sapiens
cccaggttcgagacccaa

SEQ ID NO: 1431230 - DNA, 23 bp, Homo sapiens
cccaggttgaggtgcgctcacct

SEQ ID NO: 1431231 - DNA, 13 bp, Homo sapiens
cccagtagtcaga

SEQ ID NO: 1431232 - DNA, 12 bp, Homo sapiens
cccagtcagaaa

SEQ ID NO: 1431233 - DNA, 14 bp, Homo sapiens
cccagtcagaaata

SEQ ID NO: 1431234 - DNA, 23 bp, Homo sapiens
cccagtccaaatgtcctccagaa

SEQ ID NO: 1431235 - DNA, 16 bp, Homo sapiens
cccagtccatgctcca

SEQ ID NO: 1431236 - DNA, 23 bp, Homo sapiens
cccagtccatgctccagggtcag

SEQ ID NO: 1431237 - DNA, 14 bp, Homo sapiens
cccagtccccaccc

SEQ ID NO: 1431238 - DNA, 15 bp, Homo sapiens
cccagtccccacccc

SEQ ID NO: 1431239 - DNA, 19 bp, Homo sapiens
cccagtccccacccctgcc

SEQ ID NO: 1431240 - DNA, 21 bp, Homo sapiens
cccagtccccacccctgcccc

SEQ ID NO: 1431241 - DNA, 21 bp, Homo sapiens
cccagtccccacccgcctgca

SEQ ID NO: 1431242 - DNA, 13 bp, Homo sapiens
cccagtccccgtg

SEQ ID NO: 1431243 - DNA, 17 bp, Homo sapiens
cccagtccctggagctg

SEQ ID NO: 1431244 - DNA, 15 bp, Homo sapiens
cccagtcctctccca

SEQ ID NO: 1431245 - DNA, 20 bp, Homo sapiens
cccagtctcctctccatttt

SEQ ID NO: 1431246 - DNA, 15 bp, Homo sapiens
cccagtctctggcag

SEQ ID NO: 1431247 - DNA, 17 bp, Homo sapiens
cccagtctgttccccat

SEQ ID NO: 1431248 - DNA, 14 bp, Homo sapiens
cccagtgaagcctc

SEQ ID NO: 1431249 - DNA, 17 bp, Homo sapiens
cccagtgaagcctctga

SEQ ID NO: 1431250 - DNA, 18 bp, Homo sapiens
cccagtgaagcctctgag

SEQ ID NO: 1431251 - DNA, 15 bp, Homo sapiens
cccagtgacaacatc

SEQ ID NO: 1431252 - DNA, 18 bp, Homo sapiens
cccagtgaggatgctgca

SEQ ID NO: 1431253 - DNA, 12 bp, Homo sapiens
cccagtgcaaac

SEQ ID NO: 1431254 - DNA, 17 bp, Homo sapiens
cccagtgcaaatgcatg

SEQ ID NO: 1431255 - DNA, 12 bp, Homo sapiens
cccagtgcatgg

SEQ ID NO: 1431256 - DNA, 15 bp, Homo sapiens
cccagtgccactgcc

SEQ ID NO: 1431257 - DNA, 17 bp, Homo sapiens
cccagtgccctggggct

SEQ ID NO: 1431258 - DNA, 12 bp, Homo sapiens
cccagtgcctgc

SEQ ID NO: 1431259 - DNA, 13 bp, Homo sapiens
cccagtgcctgcc

SEQ ID NO: 1431260 - DNA, 12 bp, Homo sapiens
cccagtgctgcc

SEQ ID NO: 1431261 - DNA, 14 bp, Homo sapiens
cccagtgctgccat

SEQ ID NO: 1431262 - DNA, 16 bp, Homo sapiens
cccagtgctgccatgc

SEQ ID NO: 1431263 - DNA, 20 bp, Homo sapiens
cccagtgctgccatgccact

SEQ ID NO: 1431264 - DNA, 12 bp, Homo sapiens
cccagtgctgga

SEQ ID NO: 1431265 - DNA, 12 bp, Homo sapiens
cccagtgggagg

SEQ ID NO: 1431266 - DNA, 17 bp, Homo sapiens
cccagtgggaggggcag

SEQ ID NO: 1431267 - DNA, 18 bp, Homo sapiens
cccagtgggaggggcagg

SEQ ID NO: 1431268 - DNA, 20 bp, Homo sapiens
cccagtgggcatagtcagtg

SEQ ID NO: 1431269 - DNA, 17 bp, Homo sapiens
cccagtgggtctgggat

SEQ ID NO: 1431270 - DNA, 19 bp, Homo sapiens
cccagtgtatgtcttgtat

SEQ ID NO: 1431271 - DNA, 21 bp, Homo sapiens
cccagtgtgagaccccaaaga

SEQ ID NO: 1431272 - DNA, 20 bp, Homo sapiens
cccagtgtgcacgcctgcag

SEQ ID NO: 1431273 - DNA, 22 bp, Homo sapiens
cccagtgttctgcatggattca

SEQ ID NO: 1431274 - DNA, 17 bp, Homo sapiens
cccagtgttgtttgtaa

SEQ ID NO: 1431275 - DNA, 19 bp, Homo sapiens
cccagttcaggagtcccaa

SEQ ID NO: 1431276 - DNA, 16 bp, Homo sapiens
cccagttcctgtggct

SEQ ID NO: 1431277 - DNA, 19 bp, Homo sapiens
cccagttgcactcaggtga

SEQ ID NO: 1431278 - DNA, 20 bp, Homo sapiens
cccagttgcactcaggtgac

SEQ ID NO: 1431279 - DNA, 12 bp, Homo sapiens
cccataaacagc

SEQ ID NO: 1431280 - DNA, 18 bp, Homo sapiens
cccataagacaaacactg

SEQ ID NO: 1431281 - DNA, 17 bp, Homo sapiens
cccataaggccagaaac

SEQ ID NO: 1431282 - DNA, 21 bp, Homo sapiens
cccataattgctttgccaaaa

SEQ ID NO: 1431283 - DNA, 19 bp, Homo sapiens
cccataattttcttcatgc

SEQ ID NO: 1431284 - DNA, 15 bp, Homo sapiens
cccatacaatgtatg

SEQ ID NO: 1431285 - DNA, 17 bp, Homo sapiens
cccatagaaacatgaca

SEQ ID NO: 1431286 - DNA, 20 bp, Homo sapiens
cccatagcagccagttcaaa

SEQ ID NO: 1431287 - DNA, 14 bp, Homo sapiens
cccatagcagcttt

SEQ ID NO: 1431288 - DNA, 13 bp, Homo sapiens
cccatagcttcca

SEQ ID NO: 1431289 - DNA, 17 bp, Homo sapiens
cccataggccaccccct

SEQ ID NO: 1431290 - DNA, 20 bp, Homo sapiens
cccatagtggggcctgggag

SEQ ID NO: 1431291 - DNA, 14 bp, Homo sapiens
cccatatcctgcct

SEQ ID NO: 1431292 - DNA, 15 bp, Homo sapiens
cccatattgtaaaac

SEQ ID NO: 1431293 - DNA, 19 bp, Homo sapiens
cccatattgtaaaacaggt

SEQ ID NO: 1431294 - DNA, 13 bp, Homo sapiens
cccatcactggag

SEQ ID NO: 1431295 - DNA, 15 bp, Homo sapiens
cccatcactggagca

SEQ ID NO: 1431296 - DNA, 20 bp, Homo sapiens
cccatcactggagcaccagg

SEQ ID NO: 1431297 - DNA, 14 bp, Homo sapiens
cccatcagaaggag

SEQ ID NO: 1431298 - DNA, 13 bp, Homo sapiens
cccatcatccttt

SEQ ID NO: 1431299 - DNA, 20 bp, Homo sapiens
cccatcattgcacctgcagg

SEQ ID NO: 1431300 - DNA, 17 bp, Homo sapiens
cccatccagacctggct

SEQ ID NO: 1431301 - DNA, 15 bp, Homo sapiens
cccatccagcctcca

SEQ ID NO: 1431302 - DNA, 17 bp, Homo sapiens
cccatccagcctccagg

SEQ ID NO: 1431303 - DNA, 14 bp, Homo sapiens
cccatccaggcagt

SEQ ID NO: 1431304 - DNA, 21 bp, Homo sapiens
cccatccagttcatgagaatc

SEQ ID NO: 1431305 - DNA, 15 bp, Homo sapiens
cccatccattaggcc

SEQ ID NO: 1431306 - DNA, 13 bp, Homo sapiens
cccatcccacacc

SEQ ID NO: 1431307 - DNA, 14 bp, Homo sapiens
cccatccccctgcc

SEQ ID NO: 1431308 - DNA, 15 bp, Homo sapiens
cccatccccctgccc

SEQ ID NO: 1431309 - DNA, 13 bp, Homo sapiens
cccatccctcggg

SEQ ID NO: 1431310 - DNA, 23 bp, Homo sapiens
cccatccctcgggaagcagccag

SEQ ID NO: 1431311 - DNA, 13 bp, Homo sapiens
cccatcctaccct

SEQ ID NO: 1431312 - DNA, 17 bp, Homo sapiens
cccatcctaccctcggg

SEQ ID NO: 1431313 - DNA, 17 bp, Homo sapiens
cccatcctcatccctga

SEQ ID NO: 1431314 - DNA, 14 bp, Homo sapiens
cccatcctggggca

SEQ ID NO: 1431315 - DNA, 17 bp, Homo sapiens
cccatcgtccaccccag

SEQ ID NO: 1431316 - DNA, 18 bp, Homo sapiens
cccatcgtccaccccagt

SEQ ID NO: 1431317 - DNA, 16 bp, Homo sapiens
cccatctcaggtgcca

SEQ ID NO: 1431318 - DNA, 18 bp, Homo sapiens
cccatctcaggtgccact

SEQ ID NO: 1431319 - DNA, 23 bp, Homo sapiens
cccatctcaggtgccactccctg

SEQ ID NO: 1431320 - DNA, 14 bp, Homo sapiens
cccatctccccagg

SEQ ID NO: 1431321 - DNA, 15 bp, Homo sapiens
cccatctccccaggc

SEQ ID NO: 1431322 - DNA, 15 bp, Homo sapiens
cccatctccctgcct

SEQ ID NO: 1431323 - DNA, 15 bp, Homo sapiens
cccatctccttcccc

SEQ ID NO: 1431324 - DNA, 22 bp, Homo sapiens
cccatctccttcccccagccca

SEQ ID NO: 1431325 - DNA, 23 bp, Homo sapiens
cccatctctccctcccctgccat

SEQ ID NO: 1431326 - DNA, 19 bp, Homo sapiens
cccatctgcaccccttctc

SEQ ID NO: 1431327 - DNA, 15 bp, Homo sapiens
cccatctggatgtaa

SEQ ID NO: 1431328 - DNA, 13 bp, Homo sapiens
cccatctggcttt

SEQ ID NO: 1431329 - DNA, 15 bp, Homo sapiens
cccatcttactggaa

SEQ ID NO: 1431330 - DNA, 15 bp, Homo sapiens
cccatcttccacctg

SEQ ID NO: 1431331 - DNA, 17 bp, Homo sapiens
cccatcttccacctgtg

SEQ ID NO: 1431332 - DNA, 22 bp, Homo sapiens
cccatcttccacctgtgccctc

SEQ ID NO: 1431333 - DNA, 13 bp, Homo sapiens
aatactggactca

SEQ ID NO: 1431334 - DNA, 16 bp, Homo sapiens
aatactggactcagga

SEQ ID NO: 1431335 - DNA, 13 bp, Homo sapiens
aatactgggttct

SEQ ID NO: 1431336 - DNA, 13 bp, Homo sapiens
aatactggtctca

SEQ ID NO: 1431337 - DNA, 15 bp, Homo sapiens
aatactgttattctt

SEQ ID NO: 1431338 - DNA, 15 bp, Homo sapiens
aatacttaaatgtta

SEQ ID NO: 1431339 - DNA, 20 bp, Homo sapiens
aatacttaaatgttatgtat

SEQ ID NO: 1431340 - DNA, 20 bp, Homo sapiens
aatacttcatttggtgctgg

SEQ ID NO: 1431341 - DNA, 17 bp, Homo sapiens
aatacttctcaaacctg

SEQ ID NO: 1431342 - DNA, 17 bp, Homo sapiens
aatactttccatgtttt

SEQ ID NO: 1431343 - DNA, 18 bp, Homo sapiens
aatacttttactctgcct

SEQ ID NO: 1431344 - DNA, 20 bp, Homo sapiens
aatacttttactctgcctac

SEQ ID NO: 1431345 - DNA, 13 bp, Homo sapiens
aatacttttgcat

SEQ ID NO: 1431346 - DNA, 21 bp, Homo sapiens
aatacttttgcatttttcctt

SEQ ID NO: 1431347 - DNA, 14 bp, Homo sapiens
aatagaaaatggtc

SEQ ID NO: 1431348 - DNA, 21 bp, Homo sapiens
aatagaaacgtaaactatgac

SEQ ID NO: 1431349 - DNA, 13 bp, Homo sapiens
aatagaaactcac

SEQ ID NO: 1431350 - DNA, 21 bp, Homo sapiens
aatagaaactcaccatgtaaa

SEQ ID NO: 1431351 - DNA, 19 bp, Homo sapiens
aatagaaggatgtacattt

SEQ ID NO: 1431352 - DNA, 20 bp, Homo sapiens
aatagaaggatgtacatttc

SEQ ID NO: 1431353 - DNA, 17 bp, Homo sapiens
aatagaataatctatta

SEQ ID NO: 1431354 - DNA, 14 bp, Homo sapiens
aatagaatacattt

SEQ ID NO: 1431355 - DNA, 16 bp, Homo sapiens
aatagaatacattttg

SEQ ID NO: 1431356 - DNA, 15 bp, Homo sapiens
aatagacaaaaagta

SEQ ID NO: 1431357 - DNA, 16 bp, Homo sapiens
aatagacagtaaaata

SEQ ID NO: 1431358 - DNA, 15 bp, Homo sapiens
aatagacatctttaa

SEQ ID NO: 1431359 - DNA, 16 bp, Homo sapiens
aatagagctgccactg

SEQ ID NO: 1431360 - DNA, 18 bp, Homo sapiens
aatagagtatatgcactt

SEQ ID NO: 1431361 - DNA, 22 bp, Homo sapiens
aatagcacagccagacttgctt

SEQ ID NO: 1431362 - DNA, 13 bp, Homo sapiens
aatagcactaacc

SEQ ID NO: 1431363 - DNA, 18 bp, Homo sapiens
aatagcctaaatgatggt

SEQ ID NO: 1431364 - DNA, 20 bp, Homo sapiens
aatagcgatgtgcaggaaga

SEQ ID NO: 1431365 - DNA, 22 bp, Homo sapiens
aatagcgctgtttttgttgtgt

SEQ ID NO: 1431366 - DNA, 16 bp, Homo sapiens
aatagctacagtgcat

SEQ ID NO: 1431367 - DNA, 13 bp, Homo sapiens
aatagctctactg

SEQ ID NO: 1431368 - DNA, 20 bp, Homo sapiens
aatagctctactgccctccc

SEQ ID NO: 1431369 - DNA, 17 bp, Homo sapiens
aatagctgtcataaaat

SEQ ID NO: 1431370 - DNA, 22 bp, Homo sapiens
aatagctgtgatcagtgatttt

SEQ ID NO: 1431371 - DNA, 14 bp, Homo sapiens
aatagcttctgtgt

SEQ ID NO: 1431372 - DNA, 15 bp, Homo sapiens
aatagcttctgtgtg

SEQ ID NO: 1431373 - DNA, 19 bp, Homo sapiens
aatagctttaaaagggaaa

SEQ ID NO: 1431374 - DNA, 14 bp, Homo sapiens
aatagcttttcctg

SEQ ID NO: 1431375 - DNA, 12 bp, Homo sapiens
aataggaaagca

SEQ ID NO: 1431376 - DNA, 20 bp, Homo sapiens
aataggaacaatctttgctg

SEQ ID NO: 1431377 - DNA, 22 bp, Homo sapiens
aataggaatcattcagaaatgt

SEQ ID NO: 1431378 - DNA, 14 bp, Homo sapiens
aataggagtatttt

SEQ ID NO: 1431379 - DNA, 11 bp, Homo sapiens
aataggagtct

SEQ ID NO: 1431380 - DNA, 15 bp, Homo sapiens
aataggatttttaga

SEQ ID NO: 1431381 - DNA, 21 bp, Homo sapiens
aataggcagggggccctgccc

SEQ ID NO: 1431382 - DNA, 23 bp, Homo sapiens
aataggcagggggccctgcccca

SEQ ID NO: 1431383 - DNA, 21 bp, Homo sapiens
aatagggggatataatacata

SEQ ID NO: 1431384 - DNA, 17 bp, Homo sapiens
aatagggtagaatgatt

SEQ ID NO: 1431385 - DNA, 17 bp, Homo sapiens
aataggtaaatgtattt

SEQ ID NO: 1431386 - DNA, 23 bp, Homo sapiens
aataggtgggggaaaatgaattt

SEQ ID NO: 1431387 - DNA, 16 bp, Homo sapiens
aataggttataggtaa

SEQ ID NO: 1431388 - DNA, 12 bp, Homo sapiens
aatagtaatata

SEQ ID NO: 1431389 - DNA, 13 bp, Homo sapiens
aatagtaatgttt

SEQ ID NO: 1431390 - DNA, 15 bp, Homo sapiens
aatagtaattcccgt

SEQ ID NO: 1431391 - DNA, 23 bp, Homo sapiens
aatagtatttgagagttctaaat

SEQ ID NO: 1431392 - DNA, 21 bp, Homo sapiens
aatagtcaccttcatgattat

SEQ ID NO: 1431393 - DNA, 18 bp, Homo sapiens
aatagtcataactagatt

SEQ ID NO: 1431394 - DNA, 21 bp, Homo sapiens
aatagtctgattttaatgaaa

SEQ ID NO: 1431395 - DNA, 14 bp, Homo sapiens
aatagtctgtgtga

SEQ ID NO: 1431396 - DNA, 16 bp, Homo sapiens
aatagtctttgccagt

SEQ ID NO: 1431397 - DNA, 20 bp, Homo sapiens
aatagtgcaacatctctgaa

SEQ ID NO: 1431398 - DNA, 13 bp, Homo sapiens
aatagtgcttttt

SEQ ID NO: 1431399 - DNA, 19 bp, Homo sapiens
aatagtgtaagaactgtac

SEQ ID NO: 1431400 - DNA, 18 bp, Homo sapiens
aatagtgtcataaagatt

SEQ ID NO: 1431401 - DNA, 18 bp, Homo sapiens
aatagtgtcatataaact

SEQ ID NO: 1431402 - DNA, 23 bp, Homo sapiens
aatagttagatctttgtaaatgc

SEQ ID NO: 1431403 - DNA, 22 bp, Homo sapiens
aatagttcaaagccaagtttat

SEQ ID NO: 1431404 - DNA, 23 bp, Homo sapiens
aatagttcagtagaattaccatt

SEQ ID NO: 1431405 - DNA, 14 bp, Homo sapiens
aatagttctatcct

SEQ ID NO: 1431406 - DNA, 15 bp, Homo sapiens
aatagttctatcctt

SEQ ID NO: 1431407 - DNA, 22 bp, Homo sapiens
aatagttctatccttttgcctg

SEQ ID NO: 1431408 - DNA, 14 bp, Homo sapiens
aatagttctgtata

SEQ ID NO: 1431409 - DNA, 19 bp, Homo sapiens
aatagttcttagctttgaa

SEQ ID NO: 1431410 - DNA, 19 bp, Homo sapiens
aatagtttgaattcagtaa

SEQ ID NO: 1431411 - DNA, 14 bp, Homo sapiens
aatataaaacagtc

SEQ ID NO: 1431412 - DNA, 15 bp, Homo sapiens
aatataaaacagtca

SEQ ID NO: 1431413 - DNA, 17 bp, Homo sapiens
aatataaaactgtactt

SEQ ID NO: 1431414 - DNA, 14 bp, Homo sapiens
aatataaaaggcaa

SEQ ID NO: 1431415 - DNA, 17 bp, Homo sapiens
aatataaatagctaatg

SEQ ID NO: 1431416 - DNA, 18 bp, Homo sapiens
aatataaatttaagcaaa

SEQ ID NO: 1431417 - DNA, 21 bp, Homo sapiens
aatataactatgtggctgaaa

SEQ ID NO: 1431418 - DNA, 18 bp, Homo sapiens
aatataagaagcaatctt

SEQ ID NO: 1431419 - DNA, 18 bp, Homo sapiens
aatataaggaaagcaata

SEQ ID NO: 1431420 - DNA, 14 bp, Homo sapiens
aatataatgtattt

SEQ ID NO: 1431421 - DNA, 18 bp, Homo sapiens
aatataatgtattttctt

SEQ ID NO: 1431422 - DNA, 16 bp, Homo sapiens
aatataattctgtaaa

SEQ ID NO: 1431423 - DNA, 22 bp, Homo sapiens
aatatacagtttttgtaaccat

SEQ ID NO: 1431424 - DNA, 18 bp, Homo sapiens
aatatacattcaaactta

SEQ ID NO: 1431425 - DNA, 14 bp, Homo sapiens
aatataccttattt

SEQ ID NO: 1431426 - DNA, 22 bp, Homo sapiens
aatataccttttttgttccact

SEQ ID NO: 1431427 - DNA, 14 bp, Homo sapiens
aatatactgcatat

SEQ ID NO: 1431428 - DNA, 13 bp, Homo sapiens
aatatacttaaaa

SEQ ID NO: 1431429 - DNA, 17 bp, Homo sapiens
aatatacttagaaaggc

SEQ ID NO: 1431430 - DNA, 13 bp, Homo sapiens
aatatagaaacac

SEQ ID NO: 1431431 - DNA, 22 bp, Homo sapiens
aatatagaaacacgaactttag

SEQ ID NO: 1431432 - DNA, 20 bp, Homo sapiens
aatatagacattctcacata

SEQ ID NO: 1431433 - DNA, 20 bp, Homo sapiens
aatatagagacaggacagaa

SEQ ID NO: 1431434 - DNA, 21 bp, Homo sapiens
aatatagagacaggacagaat

SEQ ID NO: 1431435 - DNA, 20 bp, Homo sapiens
aatatagatgtaatttttca

SEQ ID NO: 1431436 - DNA, 22 bp, Homo sapiens
aatataggtcctgtgttaaaca

SEQ ID NO: 1431437 - DNA, 20 bp, Homo sapiens
aatatagtgaaatggccact

SEQ ID NO: 1431438 - DNA, 13 bp, Homo sapiens
aatatagttgaac

SEQ ID NO: 1431439 - DNA, 21 bp, Homo sapiens
aatatataaaaagaaaagata

SEQ ID NO: 1431440 - DNA, 23 bp, Homo sapiens
aatatatagaatgatctattgct

SEQ ID NO: 1431441 - DNA, 21 bp, Homo sapiens
aatatatagtgggtacatcaa

SEQ ID NO: 1431442 - DNA, 15 bp, Homo sapiens
aatatatatggtcat

SEQ ID NO: 1431443 - DNA, 19 bp, Homo sapiens
aatatatattttaaggttg

SEQ ID NO: 1431444 - DNA, 20 bp, Homo sapiens
aatatatctaccccagacta

SEQ ID NO: 1431445 - DNA, 18 bp, Homo sapiens
aatatatctgttggagaa

SEQ ID NO: 1431446 - DNA, 22 bp, Homo sapiens
aatatatctgttggagaaagaa

SEQ ID NO: 1431447 - DNA, 21 bp, Homo sapiens
aatatatgaagacaataattc

SEQ ID NO: 1431448 - DNA, 23 bp, Homo sapiens
aatatatgacttcctagggatct

SEQ ID NO: 1431449 - DNA, 12 bp, Homo sapiens
cccatcttcctg

SEQ ID NO: 1431450 - DNA, 15 bp, Homo sapiens
cccatcttcctgctg

SEQ ID NO: 1431451 - DNA, 16 bp, Homo sapiens
cccatcttcctgctgc

SEQ ID NO: 1431452 - DNA, 19 bp, Homo sapiens
cccatgaagacaggacagt

SEQ ID NO: 1431453 - DNA, 13 bp, Homo sapiens
cccatgacccacc

SEQ ID NO: 1431454 - DNA, 16 bp, Homo sapiens
cccatgacccacccct

SEQ ID NO: 1431455 - DNA, 18 bp, Homo sapiens
cccatgcaagcagaggac

SEQ ID NO: 1431456 - DNA, 22 bp, Homo sapiens
cccatgcacagtacaataatgt

SEQ ID NO: 1431457 - DNA, 14 bp, Homo sapiens
cccatgccaccacc

SEQ ID NO: 1431458 - DNA, 17 bp, Homo sapiens
cccatgccaccacccac

SEQ ID NO: 1431459 - DNA, 14 bp, Homo sapiens
cccatgccccagtc

SEQ ID NO: 1431460 - DNA, 13 bp, Homo sapiens
cccatgcctgtcc

SEQ ID NO: 1431461 - DNA, 19 bp, Homo sapiens
cccatgcctgtccagcctg

SEQ ID NO: 1431462 - DNA, 20 bp, Homo sapiens
cccatgcctgtccagcctgg

SEQ ID NO: 1431463 - DNA, 13 bp, Homo sapiens
cccatgcctgtct

SEQ ID NO: 1431464 - DNA, 20 bp, Homo sapiens
cccatgctcaaccactgtgg

SEQ ID NO: 1431465 - DNA, 21 bp, Homo sapiens
cccatgctcaaccactgtggc

SEQ ID NO: 1431466 - DNA, 16 bp, Homo sapiens
cccatgctctgcccca

SEQ ID NO: 1431467 - DNA, 19 bp, Homo sapiens
cccatggagccagctccct

SEQ ID NO: 1431468 - DNA, 19 bp, Homo sapiens
cccatggcccccaataaag

SEQ ID NO: 1431469 - DNA, 20 bp, Homo sapiens
cccatggcccccaataaagg

SEQ ID NO: 1431470 - DNA, 18 bp, Homo sapiens
cccatggctgaagctgga

SEQ ID NO: 1431471 - DNA, 23 bp, Homo sapiens
cccatggctgaagctggagcagc

SEQ ID NO: 1431472 - DNA, 16 bp, Homo sapiens
cccatgggagccaggc

SEQ ID NO: 1431473 - DNA, 13 bp, Homo sapiens
cccatggggtcct

SEQ ID NO: 1431474 - DNA, 14 bp, Homo sapiens
cccatggggtcctt

SEQ ID NO: 1431475 - DNA, 23 bp, Homo sapiens
cccatgggttgtgtgtttatttc

SEQ ID NO: 1431476 - DNA, 14 bp, Homo sapiens
cccatgtagccccc

SEQ ID NO: 1431477 - DNA, 22 bp, Homo sapiens
cccatgtagccccctggcctct

SEQ ID NO: 1431478 - DNA, 18 bp, Homo sapiens
cccatgtgagtccctgtg

SEQ ID NO: 1431479 - DNA, 12 bp, Homo sapiens
cccatgtgcctg

SEQ ID NO: 1431480 - DNA, 16 bp, Homo sapiens
cccatgtgggcgccca

SEQ ID NO: 1431481 - DNA, 19 bp, Homo sapiens
cccatgtgggcgcccaccc

SEQ ID NO: 1431482 - DNA, 14 bp, Homo sapiens
cccatgttgtaatg

SEQ ID NO: 1431483 - DNA, 21 bp, Homo sapiens
cccattaggacaatcagtccc

SEQ ID NO: 1431484 - DNA, 17 bp, Homo sapiens
cccattattatttctgt

SEQ ID NO: 1431485 - DNA, 18 bp, Homo sapiens
cccattattatttctgtt

SEQ ID NO: 1431486 - DNA, 13 bp, Homo sapiens
cccattcacagag

SEQ ID NO: 1431487 - DNA, 13 bp, Homo sapiens
cccattcagacac

SEQ ID NO: 1431488 - DNA, 13 bp, Homo sapiens
cccattcccacca

SEQ ID NO: 1431489 - DNA, 18 bp, Homo sapiens
cccattctagatcctgca

SEQ ID NO: 1431490 - DNA, 21 bp, Homo sapiens
cccattctagatcctgcaccc

SEQ ID NO: 1431491 - DNA, 17 bp, Homo sapiens
cccattctctctcctgt

SEQ ID NO: 1431492 - DNA, 12 bp, Homo sapiens
cccattcttcct

SEQ ID NO: 1431493 - DNA, 16 bp, Homo sapiens
cccattgtcctccttt

SEQ ID NO: 1431494 - DNA, 23 bp, Homo sapiens
cccattgtcctccttttcacttt

SEQ ID NO: 1431495 - DNA, 18 bp, Homo sapiens
cccattgttcccttcctc

SEQ ID NO: 1431496 - DNA, 17 bp, Homo sapiens
cccattgttgtcaagga

SEQ ID NO: 1431497 - DNA, 22 bp, Homo sapiens
cccatttagaatggtgatttta

SEQ ID NO: 1431498 - DNA, 12 bp, Homo sapiens
cccatttcagct

SEQ ID NO: 1431499 - DNA, 13 bp, Homo sapiens
cccatttcagctg

SEQ ID NO: 1431500 - DNA, 13 bp, Homo sapiens
cccatttcaggaa

SEQ ID NO: 1431501 - DNA, 21 bp, Homo sapiens
cccatttcaggaatttaaaat

SEQ ID NO: 1431502 - DNA, 14 bp, Homo sapiens
cccatttcccatct

SEQ ID NO: 1431503 - DNA, 16 bp, Homo sapiens
cccatttcccatctgc

SEQ ID NO: 1431504 - DNA, 14 bp, Homo sapiens
cccatttcccgcac

SEQ ID NO: 1431505 - DNA, 11 bp, Homo sapiens
cccatttcctt

SEQ ID NO: 1431506 - DNA, 15 bp, Homo sapiens
cccatttctatttat

SEQ ID NO: 1431507 - DNA, 14 bp, Homo sapiens
cccatttctctaca

SEQ ID NO: 1431508 - DNA, 22 bp, Homo sapiens
cccattttattaataatattta

SEQ ID NO: 1431509 - DNA, 19 bp, Homo sapiens
cccattttcaactgctttg

SEQ ID NO: 1431510 - DNA, 22 bp, Homo sapiens
cccattttggaagttttcagga

SEQ ID NO: 1431511 - DNA, 22 bp, Homo sapiens
cccatttttgagccaagcttca

SEQ ID NO: 1431512 - DNA, 18 bp, Homo sapiens
ccccaaacaccttccagc

SEQ ID NO: 1431513 - DNA, 22 bp, Homo sapiens
ccccaaacaccttccagctcct

SEQ ID NO: 1431514 - DNA, 12 bp, Homo sapiens
ccccaaaccctg

SEQ ID NO: 1431515 - DNA, 23 bp, Homo sapiens
ccccaaaccctgcttctgctgcc

SEQ ID NO: 1431516 - DNA, 22 bp, Homo sapiens
ccccaaagatagacaggtcctg

SEQ ID NO: 1431517 - DNA, 16 bp, Homo sapiens
ccccaaagccactgga

SEQ ID NO: 1431518 - DNA, 19 bp, Homo sapiens
ccccaaagccactggaagg

SEQ ID NO: 1431519 - DNA, 21 bp, Homo sapiens
ccccaaagctttcctgcccca

SEQ ID NO: 1431520 - DNA, 16 bp, Homo sapiens
ccccaaattgccttca

SEQ ID NO: 1431521 - DNA, 19 bp, Homo sapiens
ccccaaattgccttcagcc

SEQ ID NO: 1431522 - DNA, 21 bp, Homo sapiens
ccccaacactgtgccctggtg

SEQ ID NO: 1431523 - DNA, 22 bp, Homo sapiens
ccccaacatctccctcccacat

SEQ ID NO: 1431524 - DNA, 14 bp, Homo sapiens
ccccaacctcaggg

SEQ ID NO: 1431525 - DNA, 20 bp, Homo sapiens
ccccaacgtcccctccgccg

SEQ ID NO: 1431526 - DNA, 14 bp, Homo sapiens
ccccaactccatgg

SEQ ID NO: 1431527 - DNA, 19 bp, Homo sapiens
ccccaactccatggggttc

SEQ ID NO: 1431528 - DNA, 16 bp, Homo sapiens
ccccaactctccccag

SEQ ID NO: 1431529 - DNA, 20 bp, Homo sapiens
ccccaactctccccagtgcc

SEQ ID NO: 1431530 - DNA, 19 bp, Homo sapiens
ccccaagaccccctggggt

SEQ ID NO: 1431531 - DNA, 15 bp, Homo sapiens
ccccaagcagccagc

SEQ ID NO: 1431532 - DNA, 11 bp, Homo sapiens
ccccaagctgg

SEQ ID NO: 1431533 - DNA, 16 bp, Homo sapiens
ccccaagctgttttct

SEQ ID NO: 1431534 - DNA, 17 bp, Homo sapiens
ccccaagctgttttctt

SEQ ID NO: 1431535 - DNA, 16 bp, Homo sapiens
ccccaaggcctctctc

SEQ ID NO: 1431536 - DNA, 22 bp, Homo sapiens
ccccaaggcctctctctgcctg

SEQ ID NO: 1431537 - DNA, 17 bp, Homo sapiens
ccccaagggcccagacc

SEQ ID NO: 1431538 - DNA, 16 bp, Homo sapiens
ccccaagggccctggc

SEQ ID NO: 1431539 - DNA, 20 bp, Homo sapiens
ccccaagggccctggcaccc

SEQ ID NO: 1431540 - DNA, 13 bp, Homo sapiens
ccccaagtcctca

SEQ ID NO: 1431541 - DNA, 14 bp, Homo sapiens
ccccaataaaggca

SEQ ID NO: 1431542 - DNA, 18 bp, Homo sapiens
ccccaataaaggcagctg

SEQ ID NO: 1431543 - DNA, 23 bp, Homo sapiens
ccccaataaaggcagctgcctct

SEQ ID NO: 1431544 - DNA, 17 bp, Homo sapiens
ccccaatcggactgcca

SEQ ID NO: 1431545 - DNA, 19 bp, Homo sapiens
ccccacaagctgtccctgc

SEQ ID NO: 1431546 - DNA, 14 bp, Homo sapiens
ccccacacctcagt

SEQ ID NO: 1431547 - DNA, 17 bp, Homo sapiens
ccccacacctccctact

SEQ ID NO: 1431548 - DNA, 16 bp, Homo sapiens
ccccacactccactct

SEQ ID NO: 1431549 - DNA, 22 bp, Homo sapiens
ccccacacttgttccagctctt

SEQ ID NO: 1431550 - DNA, 22 bp, Homo sapiens
ccccacagaaccttcaacccag

SEQ ID NO: 1431551 - DNA, 13 bp, Homo sapiens
ccccacagaactg

SEQ ID NO: 1431552 - DNA, 22 bp, Homo sapiens
ccccacaggccccccgcagcac

SEQ ID NO: 1431553 - DNA, 15 bp, Homo sapiens
ccccacagtgccacc

SEQ ID NO: 1431554 - DNA, 18 bp, Homo sapiens
ccccacccaagcttggca

SEQ ID NO: 1431555 - DNA, 20 bp, Homo sapiens
ccccacccaagcttggcagc

SEQ ID NO: 1431556 - DNA, 17 bp, Homo sapiens
ccccaccccaccccacc

SEQ ID NO: 1431557 - DNA, 16 bp, Homo sapiens
ccccacccccagctca

SEQ ID NO: 1431558 - DNA, 23 bp, Homo sapiens
ccccaccccctccccaggggaga

SEQ ID NO: 1431559 - DNA, 17 bp, Homo sapiens
ccccacccccttcagtg

SEQ ID NO: 1431560 - DNA, 19 bp, Homo sapiens
ccccaccccggggaccctg

SEQ ID NO: 1431561 - DNA, 19 bp, Homo sapiens
ccccacccctacagcctgc

SEQ ID NO: 1431562 - DNA, 23 bp, Homo sapiens
ccccacccctacagcctgcacac

SEQ ID NO: 1431563 - DNA, 13 bp, Homo sapiens
ccccacccctcca

SEQ ID NO: 1431564 - DNA, 22 bp, Homo sapiens
ccccaccccttccccaggccca

SEQ ID NO: 1431565 - DNA, 20 bp, Homo sapiens
aatatatgccttgtataata

SEQ ID NO: 1431566 - DNA, 16 bp, Homo sapiens
aatatatgtatataca

SEQ ID NO: 1431567 - DNA, 12 bp, Homo sapiens
aatatatgtatt

SEQ ID NO: 1431568 - DNA, 17 bp, Homo sapiens
aatatatgtgtgcctat

SEQ ID NO: 1431569 - DNA, 13 bp, Homo sapiens
aatatatgtttac

SEQ ID NO: 1431570 - DNA, 23 bp, Homo sapiens
aatatatgtttaccttttaatta

SEQ ID NO: 1431571 - DNA, 20 bp, Homo sapiens
aatatattaccagcaagaat

SEQ ID NO: 1431572 - DNA, 13 bp, Homo sapiens
aatatattataat

SEQ ID NO: 1431573 - DNA, 16 bp, Homo sapiens
aatatattgtacaaat

SEQ ID NO: 1431574 - DNA, 14 bp, Homo sapiens
aatatatttaaaaa

SEQ ID NO: 1431575 - DNA, 19 bp, Homo sapiens
aatatatttaaagggaaat

SEQ ID NO: 1431576 - DNA, 14 bp, Homo sapiens
aatatatttaatga

SEQ ID NO: 1431577 - DNA, 13 bp, Homo sapiens
aatatatttcaga

SEQ ID NO: 1431578 - DNA, 19 bp, Homo sapiens
aatatattttgtttacaaa

SEQ ID NO: 1431579 - DNA, 17 bp, Homo sapiens
aatatcaaaagaaaatt

SEQ ID NO: 1431580 - DNA, 22 bp, Homo sapiens
aatatcactaatttcttcttta

SEQ ID NO: 1431581 - DNA, 17 bp, Homo sapiens
aatatcagctttgataa

SEQ ID NO: 1431582 - DNA, 18 bp, Homo sapiens
aatatcagctttgataat

SEQ ID NO: 1431583 - DNA, 19 bp, Homo sapiens
aatatcagtattctgacat

SEQ ID NO: 1431584 - DNA, 19 bp, Homo sapiens
aatatcagttactcagccc

SEQ ID NO: 1431585 - DNA, 21 bp, Homo sapiens
aatatcagttactcagccctg

SEQ ID NO: 1431586 - DNA, 22 bp, Homo sapiens
aatatcagttactcagccctgg

SEQ ID NO: 1431587 - DNA, 16 bp, Homo sapiens
aatatccattctgtag

SEQ ID NO: 1431588 - DNA, 22 bp, Homo sapiens
aatatcctatactggttatagt

SEQ ID NO: 1431589 - DNA, 20 bp, Homo sapiens
aatatcgctgatgcagacac

SEQ ID NO: 1431590 - DNA, 17 bp, Homo sapiens
aatatcgtacctgtccc

SEQ ID NO: 1431591 - DNA, 22 bp, Homo sapiens
aatatctaatatatatgaataa

SEQ ID NO: 1431592 - DNA, 16 bp, Homo sapiens
aatatctagtaatata

SEQ ID NO: 1431593 - DNA, 18 bp, Homo sapiens
aatatctagtaatatatt

SEQ ID NO: 1431594 - DNA, 15 bp, Homo sapiens
aatatctctaaaata

SEQ ID NO: 1431595 - DNA, 15 bp, Homo sapiens
aatatctgccccagt

SEQ ID NO: 1431596 - DNA, 14 bp, Homo sapiens
aatatctgtattta

SEQ ID NO: 1431597 - DNA, 21 bp, Homo sapiens
aatatctgtgaggtgctgatg

SEQ ID NO: 1431598 - DNA, 15 bp, Homo sapiens
aatatctgttattca

SEQ ID NO: 1431599 - DNA, 21 bp, Homo sapiens
aatatcttgctggattaatgt

SEQ ID NO: 1431600 - DNA, 15 bp, Homo sapiens
aatatgaacctattt

SEQ ID NO: 1431601 - DNA, 22 bp, Homo sapiens
aatatgaacctattttcatttg

SEQ ID NO: 1431602 - DNA, 18 bp, Homo sapiens
aatatgaatacagggcat

SEQ ID NO: 1431603 - DNA, 14 bp, Homo sapiens
aatatgaatctata

SEQ ID NO: 1431604 - DNA, 11 bp, Homo sapiens
aatatgacaat

SEQ ID NO: 1431605 - DNA, 17 bp, Homo sapiens
aatatgacctaaatcca

SEQ ID NO: 1431606 - DNA, 19 bp, Homo sapiens
aatatgacggaagaacata

SEQ ID NO: 1431607 - DNA, 21 bp, Homo sapiens
aatatgacggaagaacataga

SEQ ID NO: 1431608 - DNA, 14 bp, Homo sapiens
aatatgagcttcaa

SEQ ID NO: 1431609 - DNA, 23 bp, Homo sapiens
aatatgagcttcaatataagaag

SEQ ID NO: 1431610 - DNA, 12 bp, Homo sapiens
aatatgatttta

SEQ ID NO: 1431611 - DNA, 18 bp, Homo sapiens
aatatgcacacagtgctt

SEQ ID NO: 1431612 - DNA, 19 bp, Homo sapiens
aatatgctgccaaattttg

SEQ ID NO: 1431613 - DNA, 22 bp, Homo sapiens
aatatgctgccaaattttggcc

SEQ ID NO: 1431614 - DNA, 22 bp, Homo sapiens
aatatgctgttatgtccagaaa

SEQ ID NO: 1431615 - DNA, 14 bp, Homo sapiens
aatatggtgtattt

SEQ ID NO: 1431616 - DNA, 13 bp, Homo sapiens
aatatgtatgcac

SEQ ID NO: 1431617 - DNA, 22 bp, Homo sapiens
aatatgtatgcctgcaatatgg

SEQ ID NO: 1431618 - DNA, 17 bp, Homo sapiens
aatatgtcgtagaattc

SEQ ID NO: 1431619 - DNA, 13 bp, Homo sapiens
aatatgtcttttt

SEQ ID NO: 1431620 - DNA, 12 bp, Homo sapiens
aatatgtgattt

SEQ ID NO: 1431621 - DNA, 19 bp, Homo sapiens
aatatgtgattttttttcc

SEQ ID NO: 1431622 - DNA, 14 bp, Homo sapiens
aatatgtgccttaa

SEQ ID NO: 1431623 - DNA, 22 bp, Homo sapiens
aatatgttaacctcagtgtcat

SEQ ID NO: 1431624 - DNA, 14 bp, Homo sapiens
aatatgttcaatgc

SEQ ID NO: 1431625 - DNA, 13 bp, Homo sapiens
aatatgtttcaaa

SEQ ID NO: 1431626 - DNA, 17 bp, Homo sapiens
aatattaaaattgttaa

SEQ ID NO: 1431627 - DNA, 13 bp, Homo sapiens
aatattaaagatt

SEQ ID NO: 1431628 - DNA, 13 bp, Homo sapiens
aatattaaataca

SEQ ID NO: 1431629 - DNA, 14 bp, Homo sapiens
aatattaaatacag

SEQ ID NO: 1431630 - DNA, 17 bp, Homo sapiens
aatattaaatacagaca

SEQ ID NO: 1431631 - DNA, 20 bp, Homo sapiens
aatattaaatacagacacta

SEQ ID NO: 1431632 - DNA, 15 bp, Homo sapiens
aatattaatgccttt

SEQ ID NO: 1431633 - DNA, 21 bp, Homo sapiens
aatattactctcaaaatcttt

SEQ ID NO: 1431634 - DNA, 19 bp, Homo sapiens
aatattagctttactgttt

SEQ ID NO: 1431635 - DNA, 17 bp, Homo sapiens
aatattagtgattctga

SEQ ID NO: 1431636 - DNA, 19 bp, Homo sapiens
aatattagtgattctgatt

SEQ ID NO: 1431637 - DNA, 20 bp, Homo sapiens
aatattatattttttctata

SEQ ID NO: 1431638 - DNA, 11 bp, Homo sapiens
aatattcactc

SEQ ID NO: 1431639 - DNA, 13 bp, Homo sapiens
aatattcactctc

SEQ ID NO: 1431640 - DNA, 16 bp, Homo sapiens
aatattcactctccat

SEQ ID NO: 1431641 - DNA, 13 bp, Homo sapiens
aatattcagaaat

SEQ ID NO: 1431642 - DNA, 18 bp, Homo sapiens
aatattcagccagcttaa

SEQ ID NO: 1431643 - DNA, 24 bp, Homo sapiens
aatattcagccagcttaaacccat

SEQ ID NO: 1431644 - DNA, 20 bp, Homo sapiens
aatattcagggtaaatagga

SEQ ID NO: 1431645 - DNA, 23 bp, Homo sapiens
aatattccagatctttcagaaat

SEQ ID NO: 1431646 - DNA, 12 bp, Homo sapiens
aatattcctgaa

SEQ ID NO: 1431647 - DNA, 23 bp, Homo sapiens
aatattcctggacttacaaaatg

SEQ ID NO: 1431648 - DNA, 19 bp, Homo sapiens
aatattctacacatgtaaa

SEQ ID NO: 1431649 - DNA, 21 bp, Homo sapiens
aatattctacacatgtaaaat

SEQ ID NO: 1431650 - DNA, 21 bp, Homo sapiens
aatattctactggcctgtaat

SEQ ID NO: 1431651 - DNA, 15 bp, Homo sapiens
aatattgaaaattga

SEQ ID NO: 1431652 - DNA, 14 bp, Homo sapiens
aatattgaagttgt

SEQ ID NO: 1431653 - DNA, 24 bp, Homo sapiens
aatattgaagttgtttatcaactt

SEQ ID NO: 1431654 - DNA, 12 bp, Homo sapiens
aatattgacatt

SEQ ID NO: 1431655 - DNA, 16 bp, Homo sapiens
aatattgacatttgta

SEQ ID NO: 1431656 - DNA, 17 bp, Homo sapiens
aatattgatatgcttat

SEQ ID NO: 1431657 - DNA, 16 bp, Homo sapiens
aatattgattgggaaa

SEQ ID NO: 1431658 - DNA, 22 bp, Homo sapiens
aatattggttgaaagttagaga

SEQ ID NO: 1431659 - DNA, 21 bp, Homo sapiens
aatattgtaaatactggactc

SEQ ID NO: 1431660 - DNA, 18 bp, Homo sapiens
aatattgtgttgtgaatg

SEQ ID NO: 1431661 - DNA, 22 bp, Homo sapiens
aatattgttgacaactgtgact

SEQ ID NO: 1431662 - DNA, 16 bp, Homo sapiens
aatattgtttggtaaa

SEQ ID NO: 1431663 - DNA, 15 bp, Homo sapiens
aatatttaaaccttt

SEQ ID NO: 1431664 - DNA, 21 bp, Homo sapiens
aatatttaacattatttatat

SEQ ID NO: 1431665 - DNA, 20 bp, Homo sapiens
aatatttaagtatatagtat

SEQ ID NO: 1431666 - DNA, 17 bp, Homo sapiens
aatatttaagtgaagga

SEQ ID NO: 1431667 - DNA, 15 bp, Homo sapiens
aatatttaatgttga

SEQ ID NO: 1431668 - DNA, 19 bp, Homo sapiens
aatatttactaactaaata

SEQ ID NO: 1431669 - DNA, 12 bp, Homo sapiens
aatatttagaaa

SEQ ID NO: 1431670 - DNA, 13 bp, Homo sapiens
aatatttagaaaa

SEQ ID NO: 1431671 - DNA, 14 bp, Homo sapiens
aatatttatatatt

SEQ ID NO: 1431672 - DNA, 17 bp, Homo sapiens
aatatttatatatttat

SEQ ID NO: 1431673 - DNA, 18 bp, Homo sapiens
aatatttatatttcacta

SEQ ID NO: 1431674 - DNA, 14 bp, Homo sapiens
aatatttatgaaga

SEQ ID NO: 1431675 - DNA, 15 bp, Homo sapiens
aatatttatgaagaa

SEQ ID NO: 1431676 - DNA, 17 bp, Homo sapiens
aatatttattacctctg

SEQ ID NO: 1431677 - DNA, 14 bp, Homo sapiens
aatatttcaagaca

SEQ ID NO: 1431678 - DNA, 13 bp, Homo sapiens
aatatttcaagtg

SEQ ID NO: 1431679 - DNA, 14 bp, Homo sapiens
aatatttcaagtgc

SEQ ID NO: 1431680 - DNA, 12 bp, Homo sapiens
aatatttcctga

SEQ ID NO: 1431681 - DNA, 22 bp, Homo sapiens
aatatttcctgacttgagtgtt

SEQ ID NO: 1431682 - DNA, 13 bp, Homo sapiens
ccccacccgcctg

SEQ ID NO: 1431683 - DNA, 17 bp, Homo sapiens
ccccaccggtccagctg

SEQ ID NO: 1431684 - DNA, 19 bp, Homo sapiens
ccccaccggtccagctggc

SEQ ID NO: 1431685 - DNA, 21 bp, Homo sapiens
ccccaccggtccagctggcct

SEQ ID NO: 1431686 - DNA, 22 bp, Homo sapiens
ccccacctacccagctgatggg

SEQ ID NO: 1431687 - DNA, 23 bp, Homo sapiens
ccccacctacccagctgatgggg

SEQ ID NO: 1431688 - DNA, 13 bp, Homo sapiens
ccccacctcctgc

SEQ ID NO: 1431689 - DNA, 23 bp, Homo sapiens
ccccacctgacaatggcagctag

SEQ ID NO: 1431690 - DNA, 14 bp, Homo sapiens
ccccacctgcctgg

SEQ ID NO: 1431691 - DNA, 21 bp, Homo sapiens
ccccaccttcaattcctgggc

SEQ ID NO: 1431692 - DNA, 13 bp, Homo sapiens
ccccacgagggct

SEQ ID NO: 1431693 - DNA, 14 bp, Homo sapiens
ccccacgagggctg

SEQ ID NO: 1431694 - DNA, 15 bp, Homo sapiens
ccccacgagggctgg

SEQ ID NO: 1431695 - DNA, 17 bp, Homo sapiens
ccccacgagggctggct

SEQ ID NO: 1431696 - DNA, 19 bp, Homo sapiens
ccccacgagtcacctgcaa

SEQ ID NO: 1431697 - DNA, 20 bp, Homo sapiens
ccccacgagtcacctgcaag

SEQ ID NO: 1431698 - DNA, 21 bp, Homo sapiens
ccccacgagtcacctgcaagc

SEQ ID NO: 1431699 - DNA, 22 bp, Homo sapiens
ccccacgagtcacctgcaagcc

SEQ ID NO: 1431700 - DNA, 23 bp, Homo sapiens
ccccacgagtcacctgcaagccc

SEQ ID NO: 1431701 - DNA, 19 bp, Homo sapiens
ccccacgtgacagtgcctg

SEQ ID NO: 1431702 - DNA, 12 bp, Homo sapiens
ccccactccagc

SEQ ID NO: 1431703 - DNA, 17 bp, Homo sapiens
ccccactccagccctgt

SEQ ID NO: 1431704 - DNA, 21 bp, Homo sapiens
ccccactcccttgctggcccc

SEQ ID NO: 1431705 - DNA, 15 bp, Homo sapiens
ccccactctcattcc

SEQ ID NO: 1431706 - DNA, 15 bp, Homo sapiens
ccccactctccccac

SEQ ID NO: 1431707 - DNA, 11 bp, Homo sapiens
ccccactctgc

SEQ ID NO: 1431708 - DNA, 15 bp, Homo sapiens
ccccactgaccagaa

SEQ ID NO: 1431709 - DNA, 13 bp, Homo sapiens
ccccactgggcca

SEQ ID NO: 1431710 - DNA, 19 bp, Homo sapiens
ccccactgggccagccctg

SEQ ID NO: 1431711 - DNA, 21 bp, Homo sapiens
ccccactgggccagccctgca

SEQ ID NO: 1431712 - DNA, 13 bp, Homo sapiens
ccccacttctgtg

SEQ ID NO: 1431713 - DNA, 15 bp, Homo sapiens
ccccacttgcctctt

SEQ ID NO: 1431714 - DNA, 21 bp, Homo sapiens
ccccacttgcctcttccttga

SEQ ID NO: 1431715 - DNA, 16 bp, Homo sapiens
ccccagaaggcaggga

SEQ ID NO: 1431716 - DNA, 15 bp, Homo sapiens
ccccagactgagctc

SEQ ID NO: 1431717 - DNA, 15 bp, Homo sapiens
ccccagactgggccc

SEQ ID NO: 1431718 - DNA, 21 bp, Homo sapiens
ccccagactgggcccaggcag

SEQ ID NO: 1431719 - DNA, 23 bp, Homo sapiens
ccccagactgggcccaggcaggt

SEQ ID NO: 1431720 - DNA, 13 bp, Homo sapiens
ccccagagcccag

SEQ ID NO: 1431721 - DNA, 17 bp, Homo sapiens
ccccagagcccagctct

SEQ ID NO: 1431722 - DNA, 19 bp, Homo sapiens
ccccagagcccagctcttg

SEQ ID NO: 1431723 - DNA, 20 bp, Homo sapiens
ccccagagcccagctcttgc

SEQ ID NO: 1431724 - DNA, 16 bp, Homo sapiens
ccccagagcccccggg

SEQ ID NO: 1431725 - DNA, 11 bp, Homo sapiens
ccccagagctg

SEQ ID NO: 1431726 - DNA, 14 bp, Homo sapiens
ccccagagctgtgc

SEQ ID NO: 1431727 - DNA, 21 bp, Homo sapiens
ccccagagctgtttatggcct

SEQ ID NO: 1431728 - DNA, 16 bp, Homo sapiens
ccccagaggctcccaa

SEQ ID NO: 1431729 - DNA, 17 bp, Homo sapiens
ccccagaggctcccaat

SEQ ID NO: 1431730 - DNA, 16 bp, Homo sapiens
ccccagatctgcctgg

SEQ ID NO: 1431731 - DNA, 18 bp, Homo sapiens
ccccagatctgcctgggc

SEQ ID NO: 1431732 - DNA, 20 bp, Homo sapiens
ccccagatctgcctgggcct

SEQ ID NO: 1431733 - DNA, 11 bp, Homo sapiens
ccccagcacta

SEQ ID NO: 1431734 - DNA, 19 bp, Homo sapiens
ccccagcactaaagcagtg

SEQ ID NO: 1431735 - DNA, 15 bp, Homo sapiens
ccccagcagtttctg

SEQ ID NO: 1431736 - DNA, 14 bp, Homo sapiens
ccccagcattccag

SEQ ID NO: 1431737 - DNA, 18 bp, Homo sapiens
ccccagcattccagctct

SEQ ID NO: 1431738 - DNA, 11 bp, Homo sapiens
ccccagccaca

SEQ ID NO: 1431739 - DNA, 12 bp, Homo sapiens
ccccagccacag

SEQ ID NO: 1431740 - DNA, 16 bp, Homo sapiens
ccccagccaggctcct

SEQ ID NO: 1431741 - DNA, 12 bp, Homo sapiens
ccccagcccaga

SEQ ID NO: 1431742 - DNA, 15 bp, Homo sapiens
ccccagcccagggct

SEQ ID NO: 1431743 - DNA, 17 bp, Homo sapiens
ccccagccccagcccct

SEQ ID NO: 1431744 - DNA, 13 bp, Homo sapiens
ccccagccctgct

SEQ ID NO: 1431745 - DNA, 12 bp, Homo sapiens
ccccagccctgg

SEQ ID NO: 1431746 - DNA, 11 bp, Homo sapiens
ccccagccctt

SEQ ID NO: 1431747 - DNA, 14 bp, Homo sapiens
ccccagcccttctg

SEQ ID NO: 1431748 - DNA, 22 bp, Homo sapiens
ccccagcctggccacgcagcca

SEQ ID NO: 1431749 - DNA, 19 bp, Homo sapiens
ccccagcggtttccacttg

SEQ ID NO: 1431750 - DNA, 17 bp, Homo sapiens
ccccagctaagaacctg

SEQ ID NO: 1431751 - DNA, 19 bp, Homo sapiens
ccccagctaagaacctgga

SEQ ID NO: 1431752 - DNA, 18 bp, Homo sapiens
ccccagctaataaaccag

SEQ ID NO: 1431753 - DNA, 22 bp, Homo sapiens
ccccagctaccctttttctcca

SEQ ID NO: 1431754 - DNA, 10 bp, Homo sapiens
ccccagctcc

SEQ ID NO: 1431755 - DNA, 11 bp, Homo sapiens
ccccagctccc

SEQ ID NO: 1431756 - DNA, 17 bp, Homo sapiens
ccccagctccccaggac

SEQ ID NO: 1431757 - DNA, 23 bp, Homo sapiens
ccccagctcgctggctttctctc

SEQ ID NO: 1431758 - DNA, 18 bp, Homo sapiens
ccccagctcttctcttcc

SEQ ID NO: 1431759 - DNA, 10 bp, Homo sapiens
ccccagctgg

SEQ ID NO: 1431760 - DNA, 13 bp, Homo sapiens
ccccagctgggag

SEQ ID NO: 1431761 - DNA, 13 bp, Homo sapiens
ccccagcttcctg

SEQ ID NO: 1431762 - DNA, 15 bp, Homo sapiens
ccccagcttcctgtg

SEQ ID NO: 1431763 - DNA, 22 bp, Homo sapiens
ccccagcttggctcacaaggcc

SEQ ID NO: 1431764 - DNA, 15 bp, Homo sapiens
ccccaggaccagctc

SEQ ID NO: 1431765 - DNA, 16 bp, Homo sapiens
ccccaggactcaccct

SEQ ID NO: 1431766 - DNA, 20 bp, Homo sapiens
ccccaggatcactctctgct

SEQ ID NO: 1431767 - DNA, 21 bp, Homo sapiens
ccccaggatcactctctgctg

SEQ ID NO: 1431768 - DNA, 22 bp, Homo sapiens
ccccaggatgccacgcctggaa

SEQ ID NO: 1431769 - DNA, 15 bp, Homo sapiens
ccccaggattccccc

SEQ ID NO: 1431770 - DNA, 13 bp, Homo sapiens
ccccaggccaccc

SEQ ID NO: 1431771 - DNA, 14 bp, Homo sapiens
ccccaggccaggtc

SEQ ID NO: 1431772 - DNA, 14 bp, Homo sapiens
ccccaggccctact

SEQ ID NO: 1431773 - DNA, 14 bp, Homo sapiens
ccccaggcctccag

SEQ ID NO: 1431774 - DNA, 15 bp, Homo sapiens
ccccaggctgagagc

SEQ ID NO: 1431775 - DNA, 23 bp, Homo sapiens
ccccagggcccctccctctgccc

SEQ ID NO: 1431776 - DNA, 16 bp, Homo sapiens
ccccagggcctccagg

SEQ ID NO: 1431777 - DNA, 14 bp, Homo sapiens
ccccagggcctggg

SEQ ID NO: 1431778 - DNA, 17 bp, Homo sapiens
ccccagggcctgggggc

SEQ ID NO: 1431779 - DNA, 19 bp, Homo sapiens
ccccaggggtcccagccac

SEQ ID NO: 1431780 - DNA, 22 bp, Homo sapiens
ccccaggggtcccagccacccc

SEQ ID NO: 1431781 - DNA, 17 bp, Homo sapiens
ccccaggtctctccact

SEQ ID NO: 1431782 - DNA, 18 bp, Homo sapiens
ccccaggtctctccactg

SEQ ID NO: 1431783 - DNA, 13 bp, Homo sapiens
ccccaggtggctg

SEQ ID NO: 1431784 - DNA, 20 bp, Homo sapiens
ccccaggtggctgacccagt

SEQ ID NO: 1431785 - DNA, 21 bp, Homo sapiens
ccccaggtggctgacccagtc

SEQ ID NO: 1431786 - DNA, 20 bp, Homo sapiens
ccccagtacctccaagcaag

SEQ ID NO: 1431787 - DNA, 19 bp, Homo sapiens
ccccagtccccacccctgc

SEQ ID NO: 1431788 - DNA, 22 bp, Homo sapiens
ccccagtcgtgatgtggaggaa

SEQ ID NO: 1431789 - DNA, 19 bp, Homo sapiens
ccccagtgcctgccactct

SEQ ID NO: 1431790 - DNA, 24 bp, Homo sapiens
ccccagtgcctgccactctctggg

SEQ ID NO: 1431791 - DNA, 23 bp, Homo sapiens
ccccagtttatggatatgctgct

SEQ ID NO: 1431792 - DNA, 23 bp, Homo sapiens
ccccagtttgcagaaaagcacct

SEQ ID NO: 1431793 - DNA, 20 bp, Homo sapiens
ccccataagacaaacactgc

SEQ ID NO: 1431794 - DNA, 18 bp, Homo sapiens
ccccatccagacctggct

SEQ ID NO: 1431795 - DNA, 16 bp, Homo sapiens
ccccatcccacaccct

SEQ ID NO: 1431796 - DNA, 12 bp, Homo sapiens
ccccatccccca

SEQ ID NO: 1431797 - DNA, 16 bp, Homo sapiens
ccccatcccccactgc

SEQ ID NO: 1431798 - DNA, 13 bp, Homo sapiens
ccccatccctggg

SEQ ID NO: 1431799 - DNA, 14 bp, Homo sapiens
aatatttctattga

SEQ ID NO: 1431800 - DNA, 11 bp, Homo sapiens
aatatttctga

SEQ ID NO: 1431801 - DNA, 20 bp, Homo sapiens
aatatttcttgctgcttcta

SEQ ID NO: 1431802 - DNA, 12 bp, Homo sapiens
aatatttgtaca

SEQ ID NO: 1431803 - DNA, 14 bp, Homo sapiens
aatattttcaaaat

SEQ ID NO: 1431804 - DNA, 16 bp, Homo sapiens
aatattttcagcctac

SEQ ID NO: 1431805 - DNA, 13 bp, Homo sapiens
aatattttctatt

SEQ ID NO: 1431806 - DNA, 19 bp, Homo sapiens
aatattttctctgtacttt

SEQ ID NO: 1431807 - DNA, 23 bp, Homo sapiens
aatattttctctgtacttttcat

SEQ ID NO: 1431808 - DNA, 14 bp, Homo sapiens
aatattttcttttc

SEQ ID NO: 1431809 - DNA, 21 bp, Homo sapiens
aatattttgctaaaaaagcat

SEQ ID NO: 1431810 - DNA, 15 bp, Homo sapiens
aatattttgtatttt

SEQ ID NO: 1431811 - DNA, 19 bp, Homo sapiens
aatattttgtattttcaac

SEQ ID NO: 1431812 - DNA, 20 bp, Homo sapiens
aatatttttagactatttct

SEQ ID NO: 1431813 - DNA, 18 bp, Homo sapiens
aatatttttatatttcct

SEQ ID NO: 1431814 - DNA, 16 bp, Homo sapiens
aatatttttggggcat

SEQ ID NO: 1431815 - DNA, 23 bp, Homo sapiens
aatatttttggggcatcctggat

SEQ ID NO: 1431816 - DNA, 16 bp, Homo sapiens
aatatttttgtatttt

SEQ ID NO: 1431817 - DNA, 13 bp, Homo sapiens
aatatttttgtca

SEQ ID NO: 1431818 - DNA, 18 bp, Homo sapiens
aatatttttttctagcta

SEQ ID NO: 1431819 - DNA, 13 bp, Homo sapiens
aatcaaaattgtc

SEQ ID NO: 1431820 - DNA, 14 bp, Homo sapiens
aatcaaaattgtct

SEQ ID NO: 1431821 - DNA, 16 bp, Homo sapiens
aatcaaacattttctg

SEQ ID NO: 1431822 - DNA, 18 bp, Homo sapiens
aatcaaagaattacagta

SEQ ID NO: 1431823 - DNA, 16 bp, Homo sapiens
aatcaaatatgcaaag

SEQ ID NO: 1431824 - DNA, 13 bp, Homo sapiens
aatcaaccctctc

SEQ ID NO: 1431825 - DNA, 16 bp, Homo sapiens
aatcaacttgtgtact

SEQ ID NO: 1431826 - DNA, 16 bp, Homo sapiens
aatcaactttactgta

SEQ ID NO: 1431827 - DNA, 14 bp, Homo sapiens
aatcaagaaacaaa

SEQ ID NO: 1431828 - DNA, 13 bp, Homo sapiens
aatcaagagaaac

SEQ ID NO: 1431829 - DNA, 13 bp, Homo sapiens
aatcaagcctctg

SEQ ID NO: 1431830 - DNA, 18 bp, Homo sapiens
aatcaaggaaaggctcat

SEQ ID NO: 1431831 - DNA, 18 bp, Homo sapiens
aatcaaggttataatttt

SEQ ID NO: 1431832 - DNA, 17 bp, Homo sapiens
aatcaagtattataaac

SEQ ID NO: 1431833 - DNA, 20 bp, Homo sapiens
aatcaatacactagttgttt

SEQ ID NO: 1431834 - DNA, 21 bp, Homo sapiens
aatcaatctgcagtttaacaa

SEQ ID NO: 1431835 - DNA, 17 bp, Homo sapiens
aatcacacgactgtcat

SEQ ID NO: 1431836 - DNA, 20 bp, Homo sapiens
aatcacagcccaaaatttga

SEQ ID NO: 1431837 - DNA, 12 bp, Homo sapiens
aatcacagtgtt

SEQ ID NO: 1431838 - DNA, 23 bp, Homo sapiens
aatcacatattttaaaatttgtt

SEQ ID NO: 1431839 - DNA, 13 bp, Homo sapiens
aatcacatcctgg

SEQ ID NO: 1431840 - DNA, 14 bp, Homo sapiens
aatcaccatgtaag

SEQ ID NO: 1431841 - DNA, 20 bp, Homo sapiens
aatcacctgaaccccagagg

SEQ ID NO: 1431842 - DNA, 14 bp, Homo sapiens
aatcacctggtatt

SEQ ID NO: 1431843 - DNA, 18 bp, Homo sapiens
aatcactctaattaattg

SEQ ID NO: 1431844 - DNA, 16 bp, Homo sapiens
aatcactggattataa

SEQ ID NO: 1431845 - DNA, 21 bp, Homo sapiens
aatcactggctaccgaagtaa

SEQ ID NO: 1431846 - DNA, 22 bp, Homo sapiens
aatcacttgttttattgactgt

SEQ ID NO: 1431847 - DNA, 22 bp, Homo sapiens
aatcactttacctgcaggctcc

SEQ ID NO: 1431848 - DNA, 16 bp, Homo sapiens
aatcactttgtctaac

SEQ ID NO: 1431849 - DNA, 23 bp, Homo sapiens
aatcactttgtctaactcagaat

SEQ ID NO: 1431850 - DNA, 24 bp, Homo sapiens
aatcagaagtcatcttgctaccag

SEQ ID NO: 1431851 - DNA, 12 bp, Homo sapiens
aatcagactgac

SEQ ID NO: 1431852 - DNA, 14 bp, Homo sapiens
aatcagaggagaga

SEQ ID NO: 1431853 - DNA, 15 bp, Homo sapiens
aatcagatcatttca

SEQ ID NO: 1431854 - DNA, 15 bp, Homo sapiens
aatcagatctttatt

SEQ ID NO: 1431855 - DNA, 19 bp, Homo sapiens
aatcagcattctcactcct

SEQ ID NO: 1431856 - DNA, 15 bp, Homo sapiens
aatcagctattttgt

SEQ ID NO: 1431857 - DNA, 12 bp, Homo sapiens
aatcaggaaaaa

SEQ ID NO: 1431858 - DNA, 16 bp, Homo sapiens
aatcaggaaaaatgag

SEQ ID NO: 1431859 - DNA, 20 bp, Homo sapiens
aatcaggaatattttccaaa

SEQ ID NO: 1431860 - DNA, 14 bp, Homo sapiens
aatcagtaagaggt

SEQ ID NO: 1431861 - DNA, 14 bp, Homo sapiens
aatcagtataattc

SEQ ID NO: 1431862 - DNA, 17 bp, Homo sapiens
aatcagtataattctgt

SEQ ID NO: 1431863 - DNA, 14 bp, Homo sapiens
aatcagtcccctcc

SEQ ID NO: 1431864 - DNA, 17 bp, Homo sapiens
aatcagtgatctatgtt

SEQ ID NO: 1431865 - DNA, 12 bp, Homo sapiens
aatcagtgcagt

SEQ ID NO: 1431866 - DNA, 19 bp, Homo sapiens
aatcagttcattagaaata

SEQ ID NO: 1431867 - DNA, 23 bp, Homo sapiens
aatcagttcattagaaatatttt

SEQ ID NO: 1431868 - DNA, 23 bp, Homo sapiens
aatcagttgtttaataatttaca

SEQ ID NO: 1431869 - DNA, 15 bp, Homo sapiens
aatcataagtatttg

SEQ ID NO: 1431870 - DNA, 19 bp, Homo sapiens
aatcataatgtattattta

SEQ ID NO: 1431871 - DNA, 17 bp, Homo sapiens
aatcatccctattctgt

SEQ ID NO: 1431872 - DNA, 23 bp, Homo sapiens
aatcatccctattctgtgtttta

SEQ ID NO: 1431873 - DNA, 14 bp, Homo sapiens
aatcatctaagtca

SEQ ID NO: 1431874 - DNA, 18 bp, Homo sapiens
aatcatctgcattcctga

SEQ ID NO: 1431875 - DNA, 13 bp, Homo sapiens
aatcatgagcctg

SEQ ID NO: 1431876 - DNA, 16 bp, Homo sapiens
aatcatgagcctgctg

SEQ ID NO: 1431877 - DNA, 18 bp, Homo sapiens
aatcatgagcctgctgga

SEQ ID NO: 1431878 - DNA, 17 bp, Homo sapiens
aatcatgccagtatttt

SEQ ID NO: 1431879 - DNA, 18 bp, Homo sapiens
aatcatggtcaagttccc

SEQ ID NO: 1431880 - DNA, 20 bp, Homo sapiens
aatcatggtcaagttcccaa

SEQ ID NO: 1431881 - DNA, 18 bp, Homo sapiens
aatcatgtcgatcctggg

SEQ ID NO: 1431882 - DNA, 13 bp, Homo sapiens
aatcatgtttctt

SEQ ID NO: 1431883 - DNA, 17 bp, Homo sapiens
aatcatgtttctttgat

SEQ ID NO: 1431884 - DNA, 18 bp, Homo sapiens
aatcatgtttctttgatc

SEQ ID NO: 1431885 - DNA, 14 bp, Homo sapiens
aatcattcagaaat

SEQ ID NO: 1431886 - DNA, 17 bp, Homo sapiens
aatcatttatcttatct

SEQ ID NO: 1431887 - DNA, 19 bp, Homo sapiens
aatcatttatcttatctag

SEQ ID NO: 1431888 - DNA, 17 bp, Homo sapiens
aatcattttaattatta

SEQ ID NO: 1431889 - DNA, 20 bp, Homo sapiens
aatcattttaattattattc

SEQ ID NO: 1431890 - DNA, 22 bp, Homo sapiens
aatcattttaattattattctt

SEQ ID NO: 1431891 - DNA, 17 bp, Homo sapiens
aatcattttcattccta

SEQ ID NO: 1431892 - DNA, 19 bp, Homo sapiens
aatcattttttatatatat

SEQ ID NO: 1431893 - DNA, 21 bp, Homo sapiens
aatcattttttatatatatgc

SEQ ID NO: 1431894 - DNA, 24 bp, Homo sapiens
aatcattttttatatatatgcata

SEQ ID NO: 1431895 - DNA, 17 bp, Homo sapiens
aatccaaaacttctctt

SEQ ID NO: 1431896 - DNA, 16 bp, Homo sapiens
aatccaaaagacaaaa

SEQ ID NO: 1431897 - DNA, 11 bp, Homo sapiens
aatccaaagaa

SEQ ID NO: 1431898 - DNA, 16 bp, Homo sapiens
aatccaactttcacag

SEQ ID NO: 1431899 - DNA, 22 bp, Homo sapiens
aatccaagcctccacagcgagg

SEQ ID NO: 1431900 - DNA, 19 bp, Homo sapiens
aatccaatattttgccttt

SEQ ID NO: 1431901 - DNA, 15 bp, Homo sapiens
aatccacatctttac

SEQ ID NO: 1431902 - DNA, 17 bp, Homo sapiens
aatccagaaagaaaaaa

SEQ ID NO: 1431903 - DNA, 22 bp, Homo sapiens
aatccagaattgaccttttgac

SEQ ID NO: 1431904 - DNA, 16 bp, Homo sapiens
aatccagcaggtcaca

SEQ ID NO: 1431905 - DNA, 18 bp, Homo sapiens
aatccaggcagatccagg

SEQ ID NO: 1431906 - DNA, 22 bp, Homo sapiens
aatccaggcagatccaggacta

SEQ ID NO: 1431907 - DNA, 17 bp, Homo sapiens
aatccagtgtgcacccc

SEQ ID NO: 1431908 - DNA, 16 bp, Homo sapiens
aatccagttataagaa

SEQ ID NO: 1431909 - DNA, 15 bp, Homo sapiens
aatccagtttctttc

SEQ ID NO: 1431910 - DNA, 14 bp, Homo sapiens
aatccataaatgtg

SEQ ID NO: 1431911 - DNA, 15 bp, Homo sapiens
aatccataaatgtgt

SEQ ID NO: 1431912 - DNA, 16 bp, Homo sapiens
aatccatgtaaggtat

SEQ ID NO: 1431913 - DNA, 22 bp, Homo sapiens
aatccatgttagtttttacttt

SEQ ID NO: 1431914 - DNA, 19 bp, Homo sapiens
aatccattttctaaactgt

SEQ ID NO: 1431915 - DNA, 17 bp, Homo sapiens
aatcccacccacatgtg

SEQ ID NO: 1431916 - DNA, 14 bp, Homo sapiens
ccccatcctcatcc

SEQ ID NO: 1431917 - DNA, 19 bp, Homo sapiens
ccccatctcatcctggcac

SEQ ID NO: 1431918 - DNA, 17 bp, Homo sapiens
ccccatctccctgcctg

SEQ ID NO: 1431919 - DNA, 12 bp, Homo sapiens
ccccatctctcc

SEQ ID NO: 1431920 - DNA, 16 bp, Homo sapiens
ccccatctctccctcc

SEQ ID NO: 1431921 - DNA, 21 bp, Homo sapiens
ccccatctttgatccttctga

SEQ ID NO: 1431922 - DNA, 18 bp, Homo sapiens
ccccatgaggaaggaaca

SEQ ID NO: 1431923 - DNA, 19 bp, Homo sapiens
ccccatgcactgtgaagga

SEQ ID NO: 1431924 - DNA, 13 bp, Homo sapiens
ccccatgcccctc

SEQ ID NO: 1431925 - DNA, 18 bp, Homo sapiens
ccccatgcctgtccagcc

SEQ ID NO: 1431926 - DNA, 14 bp, Homo sapiens
ccccatgctctgcc

SEQ ID NO: 1431927 - DNA, 19 bp, Homo sapiens
ccccatggagctgggctaa

SEQ ID NO: 1431928 - DNA, 13 bp, Homo sapiens
ccccatgggcttg

SEQ ID NO: 1431929 - DNA, 14 bp, Homo sapiens
ccccatgggcttgg

SEQ ID NO: 1431930 - DNA, 21 bp, Homo sapiens
ccccatggtgctaggaagagg

SEQ ID NO: 1431931 - DNA, 17 bp, Homo sapiens
ccccatgtctctcagaa

SEQ ID NO: 1431932 - DNA, 13 bp, Homo sapiens
ccccatgtgcctg

SEQ ID NO: 1431933 - DNA, 23 bp, Homo sapiens
ccccatgtgggtgaccaggtcct

SEQ ID NO: 1431934 - DNA, 21 bp, Homo sapiens
ccccatgtgtgacccttgtca

SEQ ID NO: 1431935 - DNA, 14 bp, Homo sapiens
ccccattcacagag

SEQ ID NO: 1431936 - DNA, 16 bp, Homo sapiens
ccccattcacagagcc

SEQ ID NO: 1431937 - DNA, 20 bp, Homo sapiens
ccccattcctgatcccatgg

SEQ ID NO: 1431938 - DNA, 21 bp, Homo sapiens
ccccattcctgatcccatggc

SEQ ID NO: 1431939 - DNA, 18 bp, Homo sapiens
ccccatttcccatctgca

SEQ ID NO: 1431940 - DNA, 16 bp, Homo sapiens
ccccatttcctcacac

SEQ ID NO: 1431941 - DNA, 20 bp, Homo sapiens
ccccatttctatttatttac

SEQ ID NO: 1431942 - DNA, 22 bp, Homo sapiens
cccccaacactgtgccctggtg

SEQ ID NO: 1431943 - DNA, 21 bp, Homo sapiens
cccccaacttgagatgtatga

SEQ ID NO: 1431944 - DNA, 18 bp, Homo sapiens
cccccaaggttttggagt

SEQ ID NO: 1431945 - DNA, 12 bp, Homo sapiens
cccccaataaag

SEQ ID NO: 1431946 - DNA, 14 bp, Homo sapiens
cccccaataaaggc

SEQ ID NO: 1431947 - DNA, 17 bp, Homo sapiens
cccccaataaaggcagc

SEQ ID NO: 1431948 - DNA, 20 bp, Homo sapiens
cccccaataaaggcagctgc

SEQ ID NO: 1431949 - DNA, 22 bp, Homo sapiens
cccccaataaaggcagctgcct

SEQ ID NO: 1431950 - DNA, 23 bp, Homo sapiens
cccccaataaaggcagctgcctc

SEQ ID NO: 1431951 - DNA, 12 bp, Homo sapiens
cccccacaggcc

SEQ ID NO: 1431952 - DNA, 20 bp, Homo sapiens
cccccaccaggggaaggaag

SEQ ID NO: 1431953 - DNA, 12 bp, Homo sapiens
cccccaccccct

SEQ ID NO: 1431954 - DNA, 19 bp, Homo sapiens
cccccaccggtccagctgg

SEQ ID NO: 1431955 - DNA, 22 bp, Homo sapiens
cccccacttgcctcttccttga

SEQ ID NO: 1431956 - DNA, 15 bp, Homo sapiens
cccccagactctttt

SEQ ID NO: 1431957 - DNA, 19 bp, Homo sapiens
cccccagattccaacattt

SEQ ID NO: 1431958 - DNA, 11 bp, Homo sapiens
cccccagcact

SEQ ID NO: 1431959 - DNA, 13 bp, Homo sapiens
cccccagccagga

SEQ ID NO: 1431960 - DNA, 12 bp, Homo sapiens
cccccagcccaa

SEQ ID NO: 1431961 - DNA, 14 bp, Homo sapiens
cccccagcccaata

SEQ ID NO: 1431962 - DNA, 17 bp, Homo sapiens
cccccagcccaataaag

SEQ ID NO: 1431963 - DNA, 15 bp, Homo sapiens
cccccagcctctggc

SEQ ID NO: 1431964 - DNA, 16 bp, Homo sapiens
cccccagctggtgtcc

SEQ ID NO: 1431965 - DNA, 13 bp, Homo sapiens
cccccaggactgg

SEQ ID NO: 1431966 - DNA, 17 bp, Homo sapiens
cccccaggactgggcca

SEQ ID NO: 1431967 - DNA, 15 bp, Homo sapiens
cccccagggcctcca

SEQ ID NO: 1431968 - DNA, 19 bp, Homo sapiens
cccccagggcctccagggc

SEQ ID NO: 1431969 - DNA, 14 bp, Homo sapiens
cccccaggggcagg

SEQ ID NO: 1431970 - DNA, 15 bp, Homo sapiens
cccccaggggcagga

SEQ ID NO: 1431971 - DNA, 14 bp, Homo sapiens
cccccagtacctcc

SEQ ID NO: 1431972 - DNA, 18 bp, Homo sapiens
cccccagtatctcttcag

SEQ ID NO: 1431973 - DNA, 14 bp, Homo sapiens
cccccatccagcct

SEQ ID NO: 1431974 - DNA, 19 bp, Homo sapiens
cccccatccagcctccagg

SEQ ID NO: 1431975 - DNA, 20 bp, Homo sapiens
cccccatccagcctccaggg

SEQ ID NO: 1431976 - DNA, 12 bp, Homo sapiens
cccccatctccc

SEQ ID NO: 1431977 - DNA, 20 bp, Homo sapiens
cccccatctccccaggcctc

SEQ ID NO: 1431978 - DNA, 17 bp, Homo sapiens
cccccatcttccacctg

SEQ ID NO: 1431979 - DNA, 18 bp, Homo sapiens
cccccatgcactgtgaag

SEQ ID NO: 1431980 - DNA, 21 bp, Homo sapiens
cccccatgccaccacccaccc

SEQ ID NO: 1431981 - DNA, 15 bp, Homo sapiens
cccccatttcccgca

SEQ ID NO: 1431982 - DNA, 12 bp, Homo sapiens
cccccattttac

SEQ ID NO: 1431983 - DNA, 12 bp, Homo sapiens
ccccccactctc

SEQ ID NO: 1431984 - DNA, 12 bp, Homo sapiens
ccccccactgca

SEQ ID NO: 1431985 - DNA, 22 bp, Homo sapiens
ccccccagactctttttttgag

SEQ ID NO: 1431986 - DNA, 14 bp, Homo sapiens
ccccccagcactga

SEQ ID NO: 1431987 - DNA, 13 bp, Homo sapiens
ccccccgcccacc

SEQ ID NO: 1431988 - DNA, 12 bp, Homo sapiens
cccccctcctgc

SEQ ID NO: 1431989 - DNA, 12 bp, Homo sapiens
cccccctctgtc

SEQ ID NO: 1431990 - DNA, 12 bp, Homo sapiens
cccccctgagtg

SEQ ID NO: 1431991 - DNA, 17 bp, Homo sapiens
cccccgacactgctgca

SEQ ID NO: 1431992 - DNA, 23 bp, Homo sapiens
cccccgacactgctgcaccagag

SEQ ID NO: 1431993 - DNA, 14 bp, Homo sapiens
cccccgacggctgt

SEQ ID NO: 1431994 - DNA, 15 bp, Homo sapiens
cccccgactgcctgt

SEQ ID NO: 1431995 - DNA, 18 bp, Homo sapiens
cccccgactgcctgtctc

SEQ ID NO: 1431996 - DNA, 15 bp, Homo sapiens
cccccgaggctgcta

SEQ ID NO: 1431997 - DNA, 16 bp, Homo sapiens
cccccgcacagccacc

SEQ ID NO: 1431998 - DNA, 13 bp, Homo sapiens
cccccgcagcacc

SEQ ID NO: 1431999 - DNA, 23 bp, Homo sapiens
cccccgcagtccccagcccttct

SEQ ID NO: 1432000 - DNA, 14 bp, Homo sapiens
cccccgccacctca

SEQ ID NO: 1432001 - DNA, 23 bp, Homo sapiens
cccccgcctgggcaccgggaccc

SEQ ID NO: 1432002 - DNA, 21 bp, Homo sapiens
cccccgcgcgcgtccccctgc

SEQ ID NO: 1432003 - DNA, 19 bp, Homo sapiens
cccccgcgctcgcccagca

SEQ ID NO: 1432004 - DNA, 20 bp, Homo sapiens
cccccgcgctcgcccagcag

SEQ ID NO: 1432005 - DNA, 17 bp, Homo sapiens
cccccgcgggttctaga

SEQ ID NO: 1432006 - DNA, 19 bp, Homo sapiens
cccccgtttctccttttcc

SEQ ID NO: 1432007 - DNA, 22 bp, Homo sapiens
ccccctcaaaccctgccctcct

SEQ ID NO: 1432008 - DNA, 21 bp, Homo sapiens
ccccctcatctcattcaaacc

SEQ ID NO: 1432009 - DNA, 14 bp, Homo sapiens
ccccctccagctca

SEQ ID NO: 1432010 - DNA, 15 bp, Homo sapiens
ccccctccccccaga

SEQ ID NO: 1432011 - DNA, 16 bp, Homo sapiens
ccccctccccctcctg

SEQ ID NO: 1432012 - DNA, 13 bp, Homo sapiens
ccccctcctccag

SEQ ID NO: 1432013 - DNA, 14 bp, Homo sapiens
ccccctcctctccc

SEQ ID NO: 1432014 - DNA, 12 bp, Homo sapiens
ccccctcctgct

SEQ ID NO: 1432015 - DNA, 15 bp, Homo sapiens
ccccctcctgctgtg

SEQ ID NO: 1432016 - DNA, 12 bp, Homo sapiens
ccccctctgctg

SEQ ID NO: 1432017 - DNA, 13 bp, Homo sapiens
ccccctctgctgc

SEQ ID NO: 1432018 - DNA, 12 bp, Homo sapiens
ccccctctgctt

SEQ ID NO: 1432019 - DNA, 16 bp, Homo sapiens
ccccctgcacccaccc

SEQ ID NO: 1432020 - DNA, 16 bp, Homo sapiens
ccccctgccagtgcct

SEQ ID NO: 1432021 - DNA, 22 bp, Homo sapiens
ccccctgccccccagcctctgg

SEQ ID NO: 1432022 - DNA, 12 bp, Homo sapiens
ccccctgccctg

SEQ ID NO: 1432023 - DNA, 13 bp, Homo sapiens
ccccctgccctgc

SEQ ID NO: 1432024 - DNA, 23 bp, Homo sapiens
ccccctggatgggcattgggctg

SEQ ID NO: 1432025 - DNA, 19 bp, Homo sapiens
ccccctggcctctgtgcct

SEQ ID NO: 1432026 - DNA, 13 bp, Homo sapiens
ccccctgggctct

SEQ ID NO: 1432027 - DNA, 23 bp, Homo sapiens
ccccctggggcttctcctgaccc

SEQ ID NO: 1432028 - DNA, 16 bp, Homo sapiens
cccccttcaagcctgt

SEQ ID NO: 1432029 - DNA, 15 bp, Homo sapiens
cccccttcagtgccc

SEQ ID NO: 1432030 - DNA, 17 bp, Homo sapiens
cccccttcccctaccca

SEQ ID NO: 1432031 - DNA, 17 bp, Homo sapiens
cccccttctctgctcca

SEQ ID NO: 1432032 - DNA, 22 bp, Homo sapiens
cccccttctctgctccaccaca

SEQ ID NO: 1432033 - DNA, 15 bp, Homo sapiens
ccccctttcacactg

SEQ ID NO: 1432034 - DNA, 18 bp, Homo sapiens
aatcccacccacatgtga

SEQ ID NO: 1432035 - DNA, 14 bp, Homo sapiens
aatcccactgtatg

SEQ ID NO: 1432036 - DNA, 15 bp, Homo sapiens
aatcccagcagcaga

SEQ ID NO: 1432037 - DNA, 11 bp, Homo sapiens
aatcccagcta

SEQ ID NO: 1432038 - DNA, 15 bp, Homo sapiens
aatcccatttcccaa

SEQ ID NO: 1432039 - DNA, 16 bp, Homo sapiens
aatccccatcattact

SEQ ID NO: 1432040 - DNA, 14 bp, Homo sapiens
aatcccctcattca

SEQ ID NO: 1432041 - DNA, 19 bp, Homo sapiens
aatcccctcattcaggaaa

SEQ ID NO: 1432042 - DNA, 11 bp, Homo sapiens
aatcccctcct

SEQ ID NO: 1432043 - DNA, 19 bp, Homo sapiens
aatcccctccttgggcact

SEQ ID NO: 1432044 - DNA, 14 bp, Homo sapiens
aatccccttctccc

SEQ ID NO: 1432045 - DNA, 20 bp, Homo sapiens
aatccccttctcccctgcac

SEQ ID NO: 1432046 - DNA, 19 bp, Homo sapiens
aatccctcaccttctgagt

SEQ ID NO: 1432047 - DNA, 18 bp, Homo sapiens
aatcccttaacagttgta

SEQ ID NO: 1432048 - DNA, 21 bp, Homo sapiens
aatccgaccactaattgccaa

SEQ ID NO: 1432049 - DNA, 20 bp, Homo sapiens
aatccgttcatagaaattgt

SEQ ID NO: 1432050 - DNA, 16 bp, Homo sapiens
aatcctaacacattat

SEQ ID NO: 1432051 - DNA, 16 bp, Homo sapiens
aatcctaatttctcct

SEQ ID NO: 1432052 - DNA, 21 bp, Homo sapiens
aatcctaatttctcctccctt

SEQ ID NO: 1432053 - DNA, 24 bp, Homo sapiens
aatcctaatttctcctcccttcct

SEQ ID NO: 1432054 - DNA, 23 bp, Homo sapiens
aatcctagaaccaagcttcagag

SEQ ID NO: 1432055 - DNA, 16 bp, Homo sapiens
aatcctagccccgaga

SEQ ID NO: 1432056 - DNA, 15 bp, Homo sapiens
aatcctcactgggtg

SEQ ID NO: 1432057 - DNA, 16 bp, Homo sapiens
aatcctcactgggtgg

SEQ ID NO: 1432058 - DNA, 20 bp, Homo sapiens
aatcctccaaccaggctcct

SEQ ID NO: 1432059 - DNA, 22 bp, Homo sapiens
aatcctcccttcccaggaggtg

SEQ ID NO: 1432060 - DNA, 11 bp, Homo sapiens
aatcctcctcc

SEQ ID NO: 1432061 - DNA, 13 bp, Homo sapiens
aatcctcctccag

SEQ ID NO: 1432062 - DNA, 19 bp, Homo sapiens
aatcctctattaattactg

SEQ ID NO: 1432063 - DNA, 18 bp, Homo sapiens
aatcctctctcccctctg

SEQ ID NO: 1432064 - DNA, 15 bp, Homo sapiens
aatcctgagctcaaa

SEQ ID NO: 1432065 - DNA, 17 bp, Homo sapiens
aatcctgattcctctct

SEQ ID NO: 1432066 - DNA, 19 bp, Homo sapiens
aatcctgattcctctctaa

SEQ ID NO: 1432067 - DNA, 17 bp, Homo sapiens
aatcctgcaatgaaagg

SEQ ID NO: 1432068 - DNA, 21 bp, Homo sapiens
aatcctggagagggtattttt

SEQ ID NO: 1432069 - DNA, 19 bp, Homo sapiens
aatcctggtaaccaaatat

SEQ ID NO: 1432070 - DNA, 12 bp, Homo sapiens
aatcctgtcttt

SEQ ID NO: 1432071 - DNA, 18 bp, Homo sapiens
aatcctgttactctgtcc

SEQ ID NO: 1432072 - DNA, 18 bp, Homo sapiens
aatccttatctataaaag

SEQ ID NO: 1432073 - DNA, 12 bp, Homo sapiens
aatccttatgca

SEQ ID NO: 1432074 - DNA, 20 bp, Homo sapiens
aatccttctagtttcccaca

SEQ ID NO: 1432075 - DNA, 22 bp, Homo sapiens
aatcctttgttttctgactaat

SEQ ID NO: 1432076 - DNA, 23 bp, Homo sapiens
aatcctttgttttctgactaatt

SEQ ID NO: 1432077 - DNA, 13 bp, Homo sapiens
aatccttttcctt

SEQ ID NO: 1432078 - DNA, 14 bp, Homo sapiens
aatccttttcctta

SEQ ID NO: 1432079 - DNA, 20 bp, Homo sapiens
aatccttttgttttgaagct

SEQ ID NO: 1432080 - DNA, 13 bp, Homo sapiens
aatcggactgcca

SEQ ID NO: 1432081 - DNA, 20 bp, Homo sapiens
aatcggactgccaaattctc

SEQ ID NO: 1432082 - DNA, 23 bp, Homo sapiens
aatcggatctggggctctgggat

SEQ ID NO: 1432083 - DNA, 18 bp, Homo sapiens
aatcggcccacagctccc

SEQ ID NO: 1432084 - DNA, 23 bp, Homo sapiens
aatcgggtccagagaccacacca

SEQ ID NO: 1432085 - DNA, 14 bp, Homo sapiens
aatcgtttttaatt

SEQ ID NO: 1432086 - DNA, 19 bp, Homo sapiens
aatctaaaatttaaaatta

SEQ ID NO: 1432087 - DNA, 21 bp, Homo sapiens
aatctaaaatttaaaattaat

SEQ ID NO: 1432088 - DNA, 15 bp, Homo sapiens
aatctaaatctattt

SEQ ID NO: 1432089 - DNA, 18 bp, Homo sapiens
aatctaacaataatattt

SEQ ID NO: 1432090 - DNA, 12 bp, Homo sapiens
aatctaatctct

SEQ ID NO: 1432091 - DNA, 10 bp, Homo sapiens
aatctacacc

SEQ ID NO: 1432092 - DNA, 18 bp, Homo sapiens
aatctacaccaatgaaaa

SEQ ID NO: 1432093 - DNA, 13 bp, Homo sapiens
aatctacatttgt

SEQ ID NO: 1432094 - DNA, 14 bp, Homo sapiens
aatctacatttgtt

SEQ ID NO: 1432095 - DNA, 15 bp, Homo sapiens
aatctacatttgttt

SEQ ID NO: 1432096 - DNA, 18 bp, Homo sapiens
aatctactggaaatgtag

SEQ ID NO: 1432097 - DNA, 21 bp, Homo sapiens
aatctagaaatgttcacaagg

SEQ ID NO: 1432098 - DNA, 14 bp, Homo sapiens
aatctagaagatgt

SEQ ID NO: 1432099 - DNA, 15 bp, Homo sapiens
aatctagaagatgtg

SEQ ID NO: 1432100 - DNA, 22 bp, Homo sapiens
aatctagaagatgtgtaaacag

SEQ ID NO: 1432101 - DNA, 22 bp, Homo sapiens
aatctagagtttatacagtgta

SEQ ID NO: 1432102 - DNA, 22 bp, Homo sapiens
aatctagatatcgacttgtttt

SEQ ID NO: 1432103 - DNA, 17 bp, Homo sapiens
aatctaggtgtggctgt

SEQ ID NO: 1432104 - DNA, 19 bp, Homo sapiens
aatctaggtgtggctgtga

SEQ ID NO: 1432105 - DNA, 21 bp, Homo sapiens
aatctagttttttttgtaaac

SEQ ID NO: 1432106 - DNA, 23 bp, Homo sapiens
aatctagttttttttgtaaactg

SEQ ID NO: 1432107 - DNA, 15 bp, Homo sapiens
aatctatatttgtct

SEQ ID NO: 1432108 - DNA, 21 bp, Homo sapiens
aatctatccaaatctgaagat

SEQ ID NO: 1432109 - DNA, 20 bp, Homo sapiens
aatctatgaagtatataatg

SEQ ID NO: 1432110 - DNA, 17 bp, Homo sapiens
aatctatgccaaagatc

SEQ ID NO: 1432111 - DNA, 21 bp, Homo sapiens
aatctatggtcgggagacagc

SEQ ID NO: 1432112 - DNA, 17 bp, Homo sapiens
aatctattatactgtat

SEQ ID NO: 1432113 - DNA, 18 bp, Homo sapiens
aatctattcagacaagca

SEQ ID NO: 1432114 - DNA, 16 bp, Homo sapiens
aatctatttattaata

SEQ ID NO: 1432115 - DNA, 21 bp, Homo sapiens
aatctatttattaatatttaa

SEQ ID NO: 1432116 - DNA, 12 bp, Homo sapiens
aatctatttcta

SEQ ID NO: 1432117 - DNA, 16 bp, Homo sapiens
aatctcaaaggagaaa

SEQ ID NO: 1432118 - DNA, 20 bp, Homo sapiens
aatctcaaaggagaaaaaaa

SEQ ID NO: 1432119 - DNA, 13 bp, Homo sapiens
aatctcaaataac

SEQ ID NO: 1432120 - DNA, 12 bp, Homo sapiens
aatctcaaatag

SEQ ID NO: 1432121 - DNA, 16 bp, Homo sapiens
aatctcaaataggcta

SEQ ID NO: 1432122 - DNA, 19 bp, Homo sapiens
aatctcaatgaagccagct

SEQ ID NO: 1432123 - DNA, 16 bp, Homo sapiens
aatctcatacctctga

SEQ ID NO: 1432124 - DNA, 15 bp, Homo sapiens
aatctccactttttt

SEQ ID NO: 1432125 - DNA, 20 bp, Homo sapiens
aatctccacttttttcatag

SEQ ID NO: 1432126 - DNA, 11 bp, Homo sapiens
aatctccatta

SEQ ID NO: 1432127 - DNA, 15 bp, Homo sapiens
aatctcctaacaaaa

SEQ ID NO: 1432128 - DNA, 17 bp, Homo sapiens
aatctcctaacaaaaga

SEQ ID NO: 1432129 - DNA, 22 bp, Homo sapiens
aatctcctctctctttcctcca

SEQ ID NO: 1432130 - DNA, 18 bp, Homo sapiens
aatctctaaaattctagt

SEQ ID NO: 1432131 - DNA, 18 bp, Homo sapiens
aatctctccctcctcagt

SEQ ID NO: 1432132 - DNA, 14 bp, Homo sapiens
aatctctgttactc

SEQ ID NO: 1432133 - DNA, 14 bp, Homo sapiens
aatctctgttctgc

SEQ ID NO: 1432134 - DNA, 23 bp, Homo sapiens
aatctctgttctgtttggcactt

SEQ ID NO: 1432135 - DNA, 13 bp, Homo sapiens
aatctcttcacta

SEQ ID NO: 1432136 - DNA, 24 bp, Homo sapiens
aatctcttcatgcttgacatacct

SEQ ID NO: 1432137 - DNA, 18 bp, Homo sapiens
aatctcttcattattctc

SEQ ID NO: 1432138 - DNA, 14 bp, Homo sapiens
aatctgaattttgc

SEQ ID NO: 1432139 - DNA, 15 bp, Homo sapiens
aatctgaattttgca

SEQ ID NO: 1432140 - DNA, 18 bp, Homo sapiens
aatctgaattttgcaatg

SEQ ID NO: 1432141 - DNA, 19 bp, Homo sapiens
aatctgaattttgcaatgt

SEQ ID NO: 1432142 - DNA, 23 bp, Homo sapiens
aatctgacactaccttatcaggc

SEQ ID NO: 1432143 - DNA, 12 bp, Homo sapiens
aatctgacccag

SEQ ID NO: 1432144 - DNA, 14 bp, Homo sapiens
aatctgacccagtg

SEQ ID NO: 1432145 - DNA, 17 bp, Homo sapiens
aatctgatcaatttgaa

SEQ ID NO: 1432146 - DNA, 16 bp, Homo sapiens
aatctgcaaagcatgt

SEQ ID NO: 1432147 - DNA, 19 bp, Homo sapiens
aatctgcaaagcatgtttt

SEQ ID NO: 1432148 - DNA, 18 bp, Homo sapiens
aatctgcattttaacaag

SEQ ID NO: 1432149 - DNA, 15 bp, Homo sapiens
aatctgccaagagag

SEQ ID NO: 1432150 - DNA, 18 bp, Homo sapiens
aatctgctgcaccttgta

SEQ ID NO: 1432151 - DNA, 17 bp, Homo sapiens
ccccctttcagatgtct

SEQ ID NO: 1432152 - DNA, 18 bp, Homo sapiens
ccccctttcagatgtctt

SEQ ID NO: 1432153 - DNA, 20 bp, Homo sapiens
ccccctttcctggacactca

SEQ ID NO: 1432154 - DNA, 16 bp, Homo sapiens
ccccgaccctgccctg

SEQ ID NO: 1432155 - DNA, 14 bp, Homo sapiens
ccccgactgcctgt

SEQ ID NO: 1432156 - DNA, 15 bp, Homo sapiens
ccccgactgcctgtc

SEQ ID NO: 1432157 - DNA, 18 bp, Homo sapiens
ccccgagaagtgctcttg

SEQ ID NO: 1432158 - DNA, 19 bp, Homo sapiens
ccccgagacaccatcctga

SEQ ID NO: 1432159 - DNA, 22 bp, Homo sapiens
ccccgagacaccatcctgagcc

SEQ ID NO: 1432160 - DNA, 15 bp, Homo sapiens
ccccgaggctgcccc

SEQ ID NO: 1432161 - DNA, 23 bp, Homo sapiens
ccccgaggctgccccaggccgga

SEQ ID NO: 1432162 - DNA, 14 bp, Homo sapiens
ccccgagtctccgg

SEQ ID NO: 1432163 - DNA, 14 bp, Homo sapiens
ccccgatggactcc

SEQ ID NO: 1432164 - DNA, 17 bp, Homo sapiens
ccccgatgtcccctgcg

SEQ ID NO: 1432165 - DNA, 19 bp, Homo sapiens
ccccgatgtcccctgcggg

SEQ ID NO: 1432166 - DNA, 17 bp, Homo sapiens
ccccgcaacccacagct

SEQ ID NO: 1432167 - DNA, 15 bp, Homo sapiens
ccccgcacccggctc

SEQ ID NO: 1432168 - DNA, 13 bp, Homo sapiens
ccccgcccccacc

SEQ ID NO: 1432169 - DNA, 16 bp, Homo sapiens
ccccgcccccagtccc

SEQ ID NO: 1432170 - DNA, 17 bp, Homo sapiens
ccccgcccctgggctac

SEQ ID NO: 1432171 - DNA, 16 bp, Homo sapiens
ccccgcccgcacagct

SEQ ID NO: 1432172 - DNA, 12 bp, Homo sapiens
ccccgccgcgcc

SEQ ID NO: 1432173 - DNA, 13 bp, Homo sapiens
ccccgcctccact

SEQ ID NO: 1432174 - DNA, 14 bp, Homo sapiens
ccccgcctccactc

SEQ ID NO: 1432175 - DNA, 13 bp, Homo sapiens
ccccgcctgagtc

SEQ ID NO: 1432176 - DNA, 16 bp, Homo sapiens
ccccgcctgagtcagt

SEQ ID NO: 1432177 - DNA, 14 bp, Homo sapiens
ccccgcctgccacc

SEQ ID NO: 1432178 - DNA, 15 bp, Homo sapiens
ccccgcctgccaccg

SEQ ID NO: 1432179 - DNA, 13 bp, Homo sapiens
ccccgcctggcca

SEQ ID NO: 1432180 - DNA, 14 bp, Homo sapiens
ccccgcctggccag

SEQ ID NO: 1432181 - DNA, 17 bp, Homo sapiens
ccccgcctggccaggag

SEQ ID NO: 1432182 - DNA, 15 bp, Homo sapiens
ccccgcctgggcacc

SEQ ID NO: 1432183 - DNA, 22 bp, Homo sapiens
ccccgcgctcgcccagcaggag

SEQ ID NO: 1432184 - DNA, 18 bp, Homo sapiens
ccccgcggtgctctggcg

SEQ ID NO: 1432185 - DNA, 13 bp, Homo sapiens
ccccgctcccacc

SEQ ID NO: 1432186 - DNA, 17 bp, Homo sapiens
ccccgctcccgctccca

SEQ ID NO: 1432187 - DNA, 12 bp, Homo sapiens
ccccgcttcccc

SEQ ID NO: 1432188 - DNA, 18 bp, Homo sapiens
ccccgcttccccacagaa

SEQ ID NO: 1432189 - DNA, 15 bp, Homo sapiens
ccccgcttgtccagc

SEQ ID NO: 1432190 - DNA, 18 bp, Homo sapiens
ccccggccccagccagag

SEQ ID NO: 1432191 - DNA, 19 bp, Homo sapiens
ccccggcccccagcaggga

SEQ ID NO: 1432192 - DNA, 12 bp, Homo sapiens
ccccggcctcag

SEQ ID NO: 1432193 - DNA, 15 bp, Homo sapiens
ccccggcggcgccgg

SEQ ID NO: 1432194 - DNA, 12 bp, Homo sapiens
ccccggctgggc

SEQ ID NO: 1432195 - DNA, 17 bp, Homo sapiens
ccccgggatattataga

SEQ ID NO: 1432196 - DNA, 16 bp, Homo sapiens
ccccgggatgcgaggc

SEQ ID NO: 1432197 - DNA, 15 bp, Homo sapiens
ccccgggctctctgc

SEQ ID NO: 1432198 - DNA, 17 bp, Homo sapiens
ccccgggctctggccac

SEQ ID NO: 1432199 - DNA, 15 bp, Homo sapiens
ccccgggctggagaa

SEQ ID NO: 1432200 - DNA, 16 bp, Homo sapiens
ccccggggaccctgtg

SEQ ID NO: 1432201 - DNA, 17 bp, Homo sapiens
ccccgggtccccagctc

SEQ ID NO: 1432202 - DNA, 22 bp, Homo sapiens
ccccgggtccccagctccccag

SEQ ID NO: 1432203 - DNA, 18 bp, Homo sapiens
ccccggtggcggccccag

SEQ ID NO: 1432204 - DNA, 17 bp, Homo sapiens
ccccggtggctgggcag

SEQ ID NO: 1432205 - DNA, 21 bp, Homo sapiens
ccccgtactaggttggacagc

SEQ ID NO: 1432206 - DNA, 13 bp, Homo sapiens
ccccgtcagggag

SEQ ID NO: 1432207 - DNA, 20 bp, Homo sapiens
ccccgtctggggttcagccc

SEQ ID NO: 1432208 - DNA, 21 bp, Homo sapiens
ccccgtctggggttcagcccc

SEQ ID NO: 1432209 - DNA, 18 bp, Homo sapiens
ccccgttgcttcccgctg

SEQ ID NO: 1432210 - DNA, 21 bp, Homo sapiens
ccccgttgcttcccgctgcac

SEQ ID NO: 1432211 - DNA, 20 bp, Homo sapiens
ccccgtttctccttttccta

SEQ ID NO: 1432212 - DNA, 21 bp, Homo sapiens
cccctaaaagcactcctgctt

SEQ ID NO: 1432213 - DNA, 14 bp, Homo sapiens
cccctaagtgccca

SEQ ID NO: 1432214 - DNA, 17 bp, Homo sapiens
cccctaagtgcccaaag

SEQ ID NO: 1432215 - DNA, 15 bp, Homo sapiens
cccctacagcctgca

SEQ ID NO: 1432216 - DNA, 20 bp, Homo sapiens
cccctaccccacaccaggcc

SEQ ID NO: 1432217 - DNA, 19 bp, Homo sapiens
cccctacgggcgctgcagc

SEQ ID NO: 1432218 - DNA, 22 bp, Homo sapiens
cccctacgggcgctgcagcctc

SEQ ID NO: 1432219 - DNA, 23 bp, Homo sapiens
cccctacgggcgctgcagcctcc

SEQ ID NO: 1432220 - DNA, 12 bp, Homo sapiens
cccctactccct

SEQ ID NO: 1432221 - DNA, 14 bp, Homo sapiens
cccctagctcacca

SEQ ID NO: 1432222 - DNA, 15 bp, Homo sapiens
cccctagctcaccag

SEQ ID NO: 1432223 - DNA, 17 bp, Homo sapiens
cccctaggatgctgcag

SEQ ID NO: 1432224 - DNA, 21 bp, Homo sapiens
cccctaggatgctgcagcaga

SEQ ID NO: 1432225 - DNA, 22 bp, Homo sapiens
cccctaggatgctgcagcagag

SEQ ID NO: 1432226 - DNA, 16 bp, Homo sapiens
cccctaggtgcccagg

SEQ ID NO: 1432227 - DNA, 18 bp, Homo sapiens
cccctaggtgcccagggc

SEQ ID NO: 1432228 - DNA, 19 bp, Homo sapiens
cccctaggtgcccagggcc

SEQ ID NO: 1432229 - DNA, 18 bp, Homo sapiens
cccctatacctgagcctc

SEQ ID NO: 1432230 - DNA, 14 bp, Homo sapiens
cccctatccaccca

SEQ ID NO: 1432231 - DNA, 16 bp, Homo sapiens
cccctatccacccagc

SEQ ID NO: 1432232 - DNA, 15 bp, Homo sapiens
cccctatcctctgag

SEQ ID NO: 1432233 - DNA, 21 bp, Homo sapiens
cccctcaaacctcctcttctg

SEQ ID NO: 1432234 - DNA, 13 bp, Homo sapiens
cccctcaccctgc

SEQ ID NO: 1432235 - DNA, 16 bp, Homo sapiens
cccctcaccctgcctt

SEQ ID NO: 1432236 - DNA, 15 bp, Homo sapiens
cccctcactccccag

SEQ ID NO: 1432237 - DNA, 20 bp, Homo sapiens
cccctcatctctctgcccaa

SEQ ID NO: 1432238 - DNA, 18 bp, Homo sapiens
cccctccaaacctccagc

SEQ ID NO: 1432239 - DNA, 23 bp, Homo sapiens
cccctccaatcccaccaaccctc

SEQ ID NO: 1432240 - DNA, 18 bp, Homo sapiens
cccctccacgtgtccgtc

SEQ ID NO: 1432241 - DNA, 15 bp, Homo sapiens
cccctccagaccctg

SEQ ID NO: 1432242 - DNA, 16 bp, Homo sapiens
cccctccagcaccact

SEQ ID NO: 1432243 - DNA, 13 bp, Homo sapiens
cccctccagctca

SEQ ID NO: 1432244 - DNA, 21 bp, Homo sapiens
cccctcccaagcgttcctggc

SEQ ID NO: 1432245 - DNA, 16 bp, Homo sapiens
cccctcccaatcctct

SEQ ID NO: 1432246 - DNA, 13 bp, Homo sapiens
cccctcccacctc

SEQ ID NO: 1432247 - DNA, 18 bp, Homo sapiens
cccctcccacgcctcacc

SEQ ID NO: 1432248 - DNA, 15 bp, Homo sapiens
cccctcccacggtgc

SEQ ID NO: 1432249 - DNA, 14 bp, Homo sapiens
cccctcccagggcc

SEQ ID NO: 1432250 - DNA, 19 bp, Homo sapiens
cccctcccaggggagccag

SEQ ID NO: 1432251 - DNA, 13 bp, Homo sapiens
cccctcccatctg

SEQ ID NO: 1432252 - DNA, 15 bp, Homo sapiens
cccctccccagggga

SEQ ID NO: 1432253 - DNA, 15 bp, Homo sapiens
cccctcccccaaccc

SEQ ID NO: 1432254 - DNA, 18 bp, Homo sapiens
cccctcccccaaccccca

SEQ ID NO: 1432255 - DNA, 18 bp, Homo sapiens
cccctcccccatgggctg

SEQ ID NO: 1432256 - DNA, 21 bp, Homo sapiens
cccctccccggccctaccagc

SEQ ID NO: 1432257 - DNA, 17 bp, Homo sapiens
cccctcccctccccgtg

SEQ ID NO: 1432258 - DNA, 13 bp, Homo sapiens
cccctcccctgaa

SEQ ID NO: 1432259 - DNA, 17 bp, Homo sapiens
cccctccctctgcccca

SEQ ID NO: 1432260 - DNA, 14 bp, Homo sapiens
cccctccctgcttg

SEQ ID NO: 1432261 - DNA, 13 bp, Homo sapiens
cccctccctggct

SEQ ID NO: 1432262 - DNA, 13 bp, Homo sapiens
cccctccctgggt

SEQ ID NO: 1432263 - DNA, 14 bp, Homo sapiens
cccctccctgggtt

SEQ ID NO: 1432264 - DNA, 21 bp, Homo sapiens
cccctccgcagcagggaagct

SEQ ID NO: 1432265 - DNA, 17 bp, Homo sapiens
cccctccgccctgccac

SEQ ID NO: 1432266 - DNA, 18 bp, Homo sapiens
cccctccgccctgccact

SEQ ID NO: 1432267 - DNA, 18 bp, Homo sapiens
cccctccgccgtgccggc

SEQ ID NO: 1432268 - DNA, 11 bp, Homo sapiens
cccctcctcca

SEQ ID NO: 1432269 - DNA, 21 bp, Homo sapiens
aatctgctggttttaacaact

SEQ ID NO: 1432270 - DNA, 21 bp, Homo sapiens
aatctgcttcatccaatgtga

SEQ ID NO: 1432271 - DNA, 19 bp, Homo sapiens
aatctgctttagtttcaca

SEQ ID NO: 1432272 - DNA, 15 bp, Homo sapiens
aatctggaagaaaaa

SEQ ID NO: 1432273 - DNA, 20 bp, Homo sapiens
aatctggagaactatacctg

SEQ ID NO: 1432274 - DNA, 15 bp, Homo sapiens
aatctggagaccagg

SEQ ID NO: 1432275 - DNA, 19 bp, Homo sapiens
aatctggatgcctcattat

SEQ ID NO: 1432276 - DNA, 21 bp, Homo sapiens
aatctggatgcctcattatgt

SEQ ID NO: 1432277 - DNA, 11 bp, Homo sapiens
aatctggatta

SEQ ID NO: 1432278 - DNA, 11 bp, Homo sapiens
aatctggccca

SEQ ID NO: 1432279 - DNA, 21 bp, Homo sapiens
aatctggctcactgcagcctc

SEQ ID NO: 1432280 - DNA, 21 bp, Homo sapiens
aatctgggtggtaactgccag

SEQ ID NO: 1432281 - DNA, 14 bp, Homo sapiens
aatctggtcttgtt

SEQ ID NO: 1432282 - DNA, 11 bp, Homo sapiens
aatctgtaaac

SEQ ID NO: 1432283 - DNA, 12 bp, Homo sapiens
aatctgtaaact

SEQ ID NO: 1432284 - DNA, 18 bp, Homo sapiens
aatctgtatatgttgtaa

SEQ ID NO: 1432285 - DNA, 22 bp, Homo sapiens
aatctgtatatgttgtaataaa

SEQ ID NO: 1432286 - DNA, 22 bp, Homo sapiens
aatctgtcataagcattacttt

SEQ ID NO: 1432287 - DNA, 18 bp, Homo sapiens
aatctgtcctctgtagta

SEQ ID NO: 1432288 - DNA, 17 bp, Homo sapiens
aatctgtgggtctggga

SEQ ID NO: 1432289 - DNA, 21 bp, Homo sapiens
aatctgttgataaatccatca

SEQ ID NO: 1432290 - DNA, 18 bp, Homo sapiens
aatctgtttctctgctgt

SEQ ID NO: 1432291 - DNA, 19 bp, Homo sapiens
aatctgtttttacgtatgt

SEQ ID NO: 1432292 - DNA, 13 bp, Homo sapiens
aatcttaaacaat

SEQ ID NO: 1432293 - DNA, 16 bp, Homo sapiens
aatcttaaacaatgta

SEQ ID NO: 1432294 - DNA, 19 bp, Homo sapiens
aatcttaaacaatgtataa

SEQ ID NO: 1432295 - DNA, 14 bp, Homo sapiens
aatcttaagaaata

SEQ ID NO: 1432296 - DNA, 18 bp, Homo sapiens
aatcttaatactgttatt

SEQ ID NO: 1432297 - DNA, 18 bp, Homo sapiens
aatcttagtgtatgatta

SEQ ID NO: 1432298 - DNA, 14 bp, Homo sapiens
aatcttataattgt

SEQ ID NO: 1432299 - DNA, 15 bp, Homo sapiens
aatcttataattgtt

SEQ ID NO: 1432300 - DNA, 14 bp, Homo sapiens
aatcttatagttct

SEQ ID NO: 1432301 - DNA, 19 bp, Homo sapiens
aatcttatagttctaggca

SEQ ID NO: 1432302 - DNA, 14 bp, Homo sapiens
aatcttatggggcc

SEQ ID NO: 1432303 - DNA, 14 bp, Homo sapiens
aatcttattgttta

SEQ ID NO: 1432304 - DNA, 17 bp, Homo sapiens
aatcttcaaagccttct

SEQ ID NO: 1432305 - DNA, 17 bp, Homo sapiens
aatcttcccatgcattc

SEQ ID NO: 1432306 - DNA, 16 bp, Homo sapiens
aatcttgcttcattgt

SEQ ID NO: 1432307 - DNA, 17 bp, Homo sapiens
aatcttgcttcattgtt

SEQ ID NO: 1432308 - DNA, 15 bp, Homo sapiens
aatcttgctttcttt

SEQ ID NO: 1432309 - DNA, 18 bp, Homo sapiens
aatcttgtcatgtgtata

SEQ ID NO: 1432310 - DNA, 19 bp, Homo sapiens
aatcttgtcatgtgtataa

SEQ ID NO: 1432311 - DNA, 20 bp, Homo sapiens
aatcttgtgctagaatactt

SEQ ID NO: 1432312 - DNA, 12 bp, Homo sapiens
aatcttgttact

SEQ ID NO: 1432313 - DNA, 22 bp, Homo sapiens
aatcttgttactgctgattctt

SEQ ID NO: 1432314 - DNA, 23 bp, Homo sapiens
aatcttgttttgaaaataaccta

SEQ ID NO: 1432315 - DNA, 20 bp, Homo sapiens
aatctttacctgtatacagt

SEQ ID NO: 1432316 - DNA, 22 bp, Homo sapiens
aatctttacctgtatacagtgc

SEQ ID NO: 1432317 - DNA, 16 bp, Homo sapiens
aatctttcacttgaaa

SEQ ID NO: 1432318 - DNA, 14 bp, Homo sapiens
aatctttctacctc

SEQ ID NO: 1432319 - DNA, 14 bp, Homo sapiens
aatctttgaaataa

SEQ ID NO: 1432320 - DNA, 12 bp, Homo sapiens
aatctttgctgt

SEQ ID NO: 1432321 - DNA, 15 bp, Homo sapiens
aatctttgtataaat

SEQ ID NO: 1432322 - DNA, 15 bp, Homo sapiens
aatcttttcttattt

SEQ ID NO: 1432323 - DNA, 21 bp, Homo sapiens
aatcttttttagcataaaatt

SEQ ID NO: 1432324 - DNA, 13 bp, Homo sapiens
aatgaaaaatata

SEQ ID NO: 1432325 - DNA, 21 bp, Homo sapiens
aatgaaaaatctcaattgaaa

SEQ ID NO: 1432326 - DNA, 23 bp, Homo sapiens
aatgaaaaatctcaattgaaagc

SEQ ID NO: 1432327 - DNA, 14 bp, Homo sapiens
aatgaaaaattctc

SEQ ID NO: 1432328 - DNA, 22 bp, Homo sapiens
aatgaaaacatgtactacagct

SEQ ID NO: 1432329 - DNA, 19 bp, Homo sapiens
aatgaaaactgtaaatatt

SEQ ID NO: 1432330 - DNA, 17 bp, Homo sapiens
aatgaaaagctgaatcc

SEQ ID NO: 1432331 - DNA, 21 bp, Homo sapiens
aatgaaaataaaacacacctc

SEQ ID NO: 1432332 - DNA, 13 bp, Homo sapiens
aatgaaaatgaat

SEQ ID NO: 1432333 - DNA, 16 bp, Homo sapiens
aatgaaaatgaatatc

SEQ ID NO: 1432334 - DNA, 16 bp, Homo sapiens
aatgaaaatgcagtcc

SEQ ID NO: 1432335 - DNA, 17 bp, Homo sapiens
aatgaaacattttgtca

SEQ ID NO: 1432336 - DNA, 19 bp, Homo sapiens
aatgaaagaaaattgagtt

SEQ ID NO: 1432337 - DNA, 16 bp, Homo sapiens
aatgaaagactgtaca

SEQ ID NO: 1432338 - DNA, 17 bp, Homo sapiens
aatgaaagactgtacaa

SEQ ID NO: 1432339 - DNA, 14 bp, Homo sapiens
aatgaaagggaaac

SEQ ID NO: 1432340 - DNA, 22 bp, Homo sapiens
aatgaaagggaaactgggaaac

SEQ ID NO: 1432341 - DNA, 20 bp, Homo sapiens
aatgaaaggtactatatttg

SEQ ID NO: 1432342 - DNA, 15 bp, Homo sapiens
aatgaaagtttgcac

SEQ ID NO: 1432343 - DNA, 21 bp, Homo sapiens
aatgaaataatgtacatctgg

SEQ ID NO: 1432344 - DNA, 12 bp, Homo sapiens
aatgaaatatct

SEQ ID NO: 1432345 - DNA, 18 bp, Homo sapiens
aatgaaatcaaatgtatg

SEQ ID NO: 1432346 - DNA, 21 bp, Homo sapiens
aatgaaatccgtgaagtcaca

SEQ ID NO: 1432347 - DNA, 22 bp, Homo sapiens
aatgaaattaacacaaaggaag

SEQ ID NO: 1432348 - DNA, 17 bp, Homo sapiens
aatgaaattactacaaa

SEQ ID NO: 1432349 - DNA, 17 bp, Homo sapiens
aatgaacatctcttgaa

SEQ ID NO: 1432350 - DNA, 19 bp, Homo sapiens
aatgaacatctcttgaaac

SEQ ID NO: 1432351 - DNA, 23 bp, Homo sapiens
aatgaacattttgtggagtttgt

SEQ ID NO: 1432352 - DNA, 14 bp, Homo sapiens
aatgaacttccatt

SEQ ID NO: 1432353 - DNA, 14 bp, Homo sapiens
aatgaagaaagtca

SEQ ID NO: 1432354 - DNA, 19 bp, Homo sapiens
aatgaagaagacaaagtct

SEQ ID NO: 1432355 - DNA, 14 bp, Homo sapiens
aatgaagaatggtg

SEQ ID NO: 1432356 - DNA, 16 bp, Homo sapiens
aatgaagcttttgaat

SEQ ID NO: 1432357 - DNA, 12 bp, Homo sapiens
aatgaagggaaa

SEQ ID NO: 1432358 - DNA, 21 bp, Homo sapiens
aatgaaggttaggatttaaca

SEQ ID NO: 1432359 - DNA, 22 bp, Homo sapiens
aatgaaggttaggatttaacag

SEQ ID NO: 1432360 - DNA, 15 bp, Homo sapiens
aatgaaggtttttgt

SEQ ID NO: 1432361 - DNA, 19 bp, Homo sapiens
aatgaatatctattaatat

SEQ ID NO: 1432362 - DNA, 20 bp, Homo sapiens
aatgaatatctattaatata

SEQ ID NO: 1432363 - DNA, 14 bp, Homo sapiens
aatgaattataaca

SEQ ID NO: 1432364 - DNA, 19 bp, Homo sapiens
aatgaattataacagttat

SEQ ID NO: 1432365 - DNA, 17 bp, Homo sapiens
aatgaattgaaaaacaa

SEQ ID NO: 1432366 - DNA, 15 bp, Homo sapiens
aatgaatttatcttt

SEQ ID NO: 1432367 - DNA, 17 bp, Homo sapiens
aatgaatttatctttac

SEQ ID NO: 1432368 - DNA, 18 bp, Homo sapiens
aatgaatttatctttacc

SEQ ID NO: 1432369 - DNA, 17 bp, Homo sapiens
aatgacaacagaaaaac

SEQ ID NO: 1432370 - DNA, 15 bp, Homo sapiens
aatgacaagatgttc

SEQ ID NO: 1432371 - DNA, 12 bp, Homo sapiens
aatgacatgcac

SEQ ID NO: 1432372 - DNA, 16 bp, Homo sapiens
aatgaccgagccctgg

SEQ ID NO: 1432373 - DNA, 20 bp, Homo sapiens
aatgaccgagccctggagag

SEQ ID NO: 1432374 - DNA, 14 bp, Homo sapiens
aatgacggtgttaa

SEQ ID NO: 1432375 - DNA, 14 bp, Homo sapiens
aatgacgtttacat

SEQ ID NO: 1432376 - DNA, 17 bp, Homo sapiens
aatgactaaaaaacaaa

SEQ ID NO: 1432377 - DNA, 20 bp, Homo sapiens
aatgactaaaaaacaaagaa

SEQ ID NO: 1432378 - DNA, 24 bp, Homo sapiens
aatgactaaaaatattataactta

SEQ ID NO: 1432379 - DNA, 20 bp, Homo sapiens
aatgactcagaatattgctt

SEQ ID NO: 1432380 - DNA, 21 bp, Homo sapiens
aatgactgccctgtttctgtt

SEQ ID NO: 1432381 - DNA, 13 bp, Homo sapiens
aatgacttagaaa

SEQ ID NO: 1432382 - DNA, 21 bp, Homo sapiens
aatgacttatttctgctctgg

SEQ ID NO: 1432383 - DNA, 23 bp, Homo sapiens
aatgacttgtacaaacagtattt

SEQ ID NO: 1432384 - DNA, 15 bp, Homo sapiens
aatgacttttcttaa

SEQ ID NO: 1432385 - DNA, 14 bp, Homo sapiens
aatgagaatagaaa

SEQ ID NO: 1432386 - DNA, 12 bp, Homo sapiens
cccctcctccag

SEQ ID NO: 1432387 - DNA, 21 bp, Homo sapiens
cccctcctctagctgtggggg

SEQ ID NO: 1432388 - DNA, 13 bp, Homo sapiens
cccctcctctccc

SEQ ID NO: 1432389 - DNA, 15 bp, Homo sapiens
cccctcctcttccct

SEQ ID NO: 1432390 - DNA, 13 bp, Homo sapiens
cccctcctgctcc

SEQ ID NO: 1432391 - DNA, 14 bp, Homo sapiens
cccctcctgctgtg

SEQ ID NO: 1432392 - DNA, 14 bp, Homo sapiens
cccctcctggctgt

SEQ ID NO: 1432393 - DNA, 15 bp, Homo sapiens
cccctccttccttga

SEQ ID NO: 1432394 - DNA, 17 bp, Homo sapiens
cccctccttccttgacc

SEQ ID NO: 1432395 - DNA, 12 bp, Homo sapiens
cccctccttctc

SEQ ID NO: 1432396 - DNA, 15 bp, Homo sapiens
cccctccttgggcac

SEQ ID NO: 1432397 - DNA, 16 bp, Homo sapiens
cccctcggctctggag

SEQ ID NO: 1432398 - DNA, 17 bp, Homo sapiens
cccctcggctctggagg

SEQ ID NO: 1432399 - DNA, 12 bp, Homo sapiens
cccctctcacca

SEQ ID NO: 1432400 - DNA, 13 bp, Homo sapiens
cccctctcagtct

SEQ ID NO: 1432401 - DNA, 14 bp, Homo sapiens
cccctctctttctc

SEQ ID NO: 1432402 - DNA, 19 bp, Homo sapiens
cccctctgcacccagaaca

SEQ ID NO: 1432403 - DNA, 12 bp, Homo sapiens
cccctctgccca

SEQ ID NO: 1432404 - DNA, 15 bp, Homo sapiens
cccctctgcccagct

SEQ ID NO: 1432405 - DNA, 17 bp, Homo sapiens
cccctctgcccagcttg

SEQ ID NO: 1432406 - DNA, 22 bp, Homo sapiens
cccctctgcccagcttgggccc

SEQ ID NO: 1432407 - DNA, 12 bp, Homo sapiens
cccctctgctgc

SEQ ID NO: 1432408 - DNA, 19 bp, Homo sapiens
cccctctggtcgctcctgc

SEQ ID NO: 1432409 - DNA, 20 bp, Homo sapiens
cccctctggtcgctcctgcc

SEQ ID NO: 1432410 - DNA, 23 bp, Homo sapiens
cccctctggtcgctcctgcccac

SEQ ID NO: 1432411 - DNA, 22 bp, Homo sapiens
cccctctgtcatcactccctgg

SEQ ID NO: 1432412 - DNA, 19 bp, Homo sapiens
cccctcttcttctttcctt

SEQ ID NO: 1432413 - DNA, 23 bp, Homo sapiens
cccctcttggagaagtctcagct

SEQ ID NO: 1432414 - DNA, 21 bp, Homo sapiens
cccctgaaagtgacagagacc

SEQ ID NO: 1432415 - DNA, 21 bp, Homo sapiens
cccctgacctaccccagccag

SEQ ID NO: 1432416 - DNA, 18 bp, Homo sapiens
cccctgaggcagcccagc

SEQ ID NO: 1432417 - DNA, 20 bp, Homo sapiens
cccctgaggcagcccagctc

SEQ ID NO: 1432418 - DNA, 22 bp, Homo sapiens
cccctgaggcagcccagctcct

SEQ ID NO: 1432419 - DNA, 20 bp, Homo sapiens
cccctgagtcaactggagca

SEQ ID NO: 1432420 - DNA, 15 bp, Homo sapiens
cccctgatgcagcct

SEQ ID NO: 1432421 - DNA, 19 bp, Homo sapiens
cccctgatgcagcctgtgg

SEQ ID NO: 1432422 - DNA, 21 bp, Homo sapiens
cccctgcaacttccgctgagg

SEQ ID NO: 1432423 - DNA, 22 bp, Homo sapiens
cccctgcaacttccgctgaggg

SEQ ID NO: 1432424 - DNA, 18 bp, Homo sapiens
cccctgcacccacccctg

SEQ ID NO: 1432425 - DNA, 16 bp, Homo sapiens
cccctgcacctggcct

SEQ ID NO: 1432426 - DNA, 17 bp, Homo sapiens
cccctgcacctggcctg

SEQ ID NO: 1432427 - DNA, 11 bp, Homo sapiens
cccctgcactg

SEQ ID NO: 1432428 - DNA, 22 bp, Homo sapiens
cccctgcactggagtccagtct

SEQ ID NO: 1432429 - DNA, 16 bp, Homo sapiens
cccctgcactgtaaaa

SEQ ID NO: 1432430 - DNA, 20 bp, Homo sapiens
cccctgcagtttggccctgg

SEQ ID NO: 1432431 - DNA, 22 bp, Homo sapiens
cccctgcagtttggccctggag

SEQ ID NO: 1432432 - DNA, 14 bp, Homo sapiens
cccctgccacactg

SEQ ID NO: 1432433 - DNA, 12 bp, Homo sapiens
cccctgccacca

SEQ ID NO: 1432434 - DNA, 18 bp, Homo sapiens
cccctgccacctccctga

SEQ ID NO: 1432435 - DNA, 21 bp, Homo sapiens
cccctgccacctccctgaccc

SEQ ID NO: 1432436 - DNA, 14 bp, Homo sapiens
cccctgccagtgcc

SEQ ID NO: 1432437 - DNA, 16 bp, Homo sapiens
cccctgccagtgcctt

SEQ ID NO: 1432438 - DNA, 19 bp, Homo sapiens
cccctgccagttctctgtg

SEQ ID NO: 1432439 - DNA, 17 bp, Homo sapiens
cccctgcccccaggact

SEQ ID NO: 1432440 - DNA, 18 bp, Homo sapiens
cccctgcccccaggactg

SEQ ID NO: 1432441 - DNA, 23 bp, Homo sapiens
cccctgcccggtggtttgccatg

SEQ ID NO: 1432442 - DNA, 23 bp, Homo sapiens
cccctgccctcgtggccagcccg

SEQ ID NO: 1432443 - DNA, 13 bp, Homo sapiens
cccctgccctgca

SEQ ID NO: 1432444 - DNA, 13 bp, Homo sapiens
cccctgccctggt

SEQ ID NO: 1432445 - DNA, 17 bp, Homo sapiens
cccctgcctcctgccac

SEQ ID NO: 1432446 - DNA, 19 bp, Homo sapiens
cccctgctactcctgtgct

SEQ ID NO: 1432447 - DNA, 15 bp, Homo sapiens
cccctgctccaccag

SEQ ID NO: 1432448 - DNA, 14 bp, Homo sapiens
cccctgctcccagg

SEQ ID NO: 1432449 - DNA, 21 bp, Homo sapiens
cccctgctgtctctctgggct

SEQ ID NO: 1432450 - DNA, 22 bp, Homo sapiens
cccctggaagagcccagtctgt

SEQ ID NO: 1432451 - DNA, 15 bp, Homo sapiens
cccctggatgtcccc

SEQ ID NO: 1432452 - DNA, 21 bp, Homo sapiens
cccctggatgtcccctgtccc

SEQ ID NO: 1432453 - DNA, 11 bp, Homo sapiens
cccctggcagt

SEQ ID NO: 1432454 - DNA, 14 bp, Homo sapiens
cccctggcagtgct

SEQ ID NO: 1432455 - DNA, 17 bp, Homo sapiens
cccctggcagtgctgag

SEQ ID NO: 1432456 - DNA, 14 bp, Homo sapiens
cccctggccagctc

SEQ ID NO: 1432457 - DNA, 18 bp, Homo sapiens
cccctggccagctctgag

SEQ ID NO: 1432458 - DNA, 11 bp, Homo sapiens
cccctggccca

SEQ ID NO: 1432459 - DNA, 14 bp, Homo sapiens
cccctggcccagcg

SEQ ID NO: 1432460 - DNA, 14 bp, Homo sapiens
cccctggccctgcc

SEQ ID NO: 1432461 - DNA, 11 bp, Homo sapiens
cccctggcctc

SEQ ID NO: 1432462 - DNA, 11 bp, Homo sapiens
cccctggctct

SEQ ID NO: 1432463 - DNA, 12 bp, Homo sapiens
cccctggctctg

SEQ ID NO: 1432464 - DNA, 17 bp, Homo sapiens
cccctggctctgggccg

SEQ ID NO: 1432465 - DNA, 21 bp, Homo sapiens
cccctggctttgcctcttctt

SEQ ID NO: 1432466 - DNA, 22 bp, Homo sapiens
cccctggctttgcctcttcttt

SEQ ID NO: 1432467 - DNA, 22 bp, Homo sapiens
cccctggcttttcactgctggc

SEQ ID NO: 1432468 - DNA, 20 bp, Homo sapiens
cccctgggcatcttctggct

SEQ ID NO: 1432469 - DNA, 22 bp, Homo sapiens
cccctgggcatcttctggcttg

SEQ ID NO: 1432470 - DNA, 23 bp, Homo sapiens
cccctgggcatcttctggcttga

SEQ ID NO: 1432471 - DNA, 19 bp, Homo sapiens
cccctgggctaccatctgc

SEQ ID NO: 1432472 - DNA, 20 bp, Homo sapiens
cccctgggctaccatctgca

SEQ ID NO: 1432473 - DNA, 21 bp, Homo sapiens
cccctgggctaccatctgcat

SEQ ID NO: 1432474 - DNA, 19 bp, Homo sapiens
cccctgggctctcacccag

SEQ ID NO: 1432475 - DNA, 23 bp, Homo sapiens
cccctgggctctgccccagctct

SEQ ID NO: 1432476 - DNA, 19 bp, Homo sapiens
cccctgggcttggcctgct

SEQ ID NO: 1432477 - DNA, 21 bp, Homo sapiens
cccctggggctgagtctccag

SEQ ID NO: 1432478 - DNA, 22 bp, Homo sapiens
cccctggggctgagtctccagg

SEQ ID NO: 1432479 - DNA, 18 bp, Homo sapiens
cccctggggcttctcctg

SEQ ID NO: 1432480 - DNA, 19 bp, Homo sapiens
cccctggggcttctcctga

SEQ ID NO: 1432481 - DNA, 23 bp, Homo sapiens
cccctggggtgggatctgagctc

SEQ ID NO: 1432482 - DNA, 20 bp, Homo sapiens
cccctgggtgggtggtgggg

SEQ ID NO: 1432483 - DNA, 17 bp, Homo sapiens
cccctgggttaacaaat

SEQ ID NO: 1432484 - DNA, 20 bp, Homo sapiens
cccctggtggacagtcctgg

SEQ ID NO: 1432485 - DNA, 22 bp, Homo sapiens
cccctggtggacagtcctggga

SEQ ID NO: 1432486 - DNA, 15 bp, Homo sapiens
cccctggttctcatc

SEQ ID NO: 1432487 - DNA, 16 bp, Homo sapiens
cccctgtacccagctc

SEQ ID NO: 1432488 - DNA, 12 bp, Homo sapiens
cccctgtcccac

SEQ ID NO: 1432489 - DNA, 22 bp, Homo sapiens
cccctgtcccaccaactctgca

SEQ ID NO: 1432490 - DNA, 20 bp, Homo sapiens
cccctgtcccacccacacag

SEQ ID NO: 1432491 - DNA, 14 bp, Homo sapiens
cccctgtcccattc

SEQ ID NO: 1432492 - DNA, 20 bp, Homo sapiens
cccctgtgctcccctgccac

SEQ ID NO: 1432493 - DNA, 17 bp, Homo sapiens
cccctgtggccctggcc

SEQ ID NO: 1432494 - DNA, 18 bp, Homo sapiens
cccctgtggggatctcag

SEQ ID NO: 1432495 - DNA, 22 bp, Homo sapiens
cccctgtgtgagttgagtctcc

SEQ ID NO: 1432496 - DNA, 22 bp, Homo sapiens
ccccttaagggttgaaggcagt

SEQ ID NO: 1432497 - DNA, 13 bp, Homo sapiens
ccccttcagtgcc

SEQ ID NO: 1432498 - DNA, 16 bp, Homo sapiens
ccccttcatcctctga

SEQ ID NO: 1432499 - DNA, 16 bp, Homo sapiens
ccccttccccaggccc

SEQ ID NO: 1432500 - DNA, 10 bp, Homo sapiens
ccccttccct

SEQ ID NO: 1432501 - DNA, 15 bp, Homo sapiens
ccccttccctgggag

SEQ ID NO: 1432502 - DNA, 15 bp, Homo sapiens
aatgagaatagaaac

SEQ ID NO: 1432503 - DNA, 19 bp, Homo sapiens
aatgagagcgacacagacg

SEQ ID NO: 1432504 - DNA, 19 bp, Homo sapiens
aatgagagggcagtgtttc

SEQ ID NO: 1432505 - DNA, 18 bp, Homo sapiens
aatgagagttccttctca

SEQ ID NO: 1432506 - DNA, 15 bp, Homo sapiens
aatgagatatttgta

SEQ ID NO: 1432507 - DNA, 18 bp, Homo sapiens
aatgagccatgatttccc

SEQ ID NO: 1432508 - DNA, 16 bp, Homo sapiens
aatgagctatgtatta

SEQ ID NO: 1432509 - DNA, 13 bp, Homo sapiens
aatgagctcctgc

SEQ ID NO: 1432510 - DNA, 22 bp, Homo sapiens
aatgagctcgcatttgtcaatg

SEQ ID NO: 1432511 - DNA, 12 bp, Homo sapiens
aatgagctgttg

SEQ ID NO: 1432512 - DNA, 19 bp, Homo sapiens
aatgagcttgattaaatca

SEQ ID NO: 1432513 - DNA, 17 bp, Homo sapiens
aatgaggaaaattctta

SEQ ID NO: 1432514 - DNA, 15 bp, Homo sapiens
aatgaggaagcaaag

SEQ ID NO: 1432515 - DNA, 16 bp, Homo sapiens
aatgaggacttcaagc

SEQ ID NO: 1432516 - DNA, 15 bp, Homo sapiens
aatgaggattattga

SEQ ID NO: 1432517 - DNA, 18 bp, Homo sapiens
aatgagggaaatctgtaa

SEQ ID NO: 1432518 - DNA, 23 bp, Homo sapiens
aatgagtaaaaactagaaggctt

SEQ ID NO: 1432519 - DNA, 19 bp, Homo sapiens
aatgagtctgttgtgtgtc

SEQ ID NO: 1432520 - DNA, 14 bp, Homo sapiens
aatgagtgggaatc

SEQ ID NO: 1432521 - DNA, 23 bp, Homo sapiens
aatgagttgtcacagaaattatg

SEQ ID NO: 1432522 - DNA, 21 bp, Homo sapiens
aatgagtttttatggggctga

SEQ ID NO: 1432523 - DNA, 22 bp, Homo sapiens
aatgataaactcagatctgatc

SEQ ID NO: 1432524 - DNA, 15 bp, Homo sapiens
aatgatactgtgtgt

SEQ ID NO: 1432525 - DNA, 19 bp, Homo sapiens
aatgatagaactgtactgt

SEQ ID NO: 1432526 - DNA, 18 bp, Homo sapiens
aatgatagtaagaaaagt

SEQ ID NO: 1432527 - DNA, 17 bp, Homo sapiens
aatgatatatggataat

SEQ ID NO: 1432528 - DNA, 15 bp, Homo sapiens
aatgatcaaaacatg

SEQ ID NO: 1432529 - DNA, 16 bp, Homo sapiens
aatgatctcttctttt

SEQ ID NO: 1432530 - DNA, 21 bp, Homo sapiens
aatgatgacccactaaagagt

SEQ ID NO: 1432531 - DNA, 23 bp, Homo sapiens
aatgatgatcaattatagtttct

SEQ ID NO: 1432532 - DNA, 18 bp, Homo sapiens
aatgatggcaattttgta

SEQ ID NO: 1432533 - DNA, 19 bp, Homo sapiens
aatgatggcaattttgtaa

SEQ ID NO: 1432534 - DNA, 22 bp, Homo sapiens
aatgatgttttaaaaaaatttg

SEQ ID NO: 1432535 - DNA, 12 bp, Homo sapiens
aatgattcaaaa

SEQ ID NO: 1432536 - DNA, 21 bp, Homo sapiens
aatgattcaaattgctgcttg

SEQ ID NO: 1432537 - DNA, 18 bp, Homo sapiens
aatgatttccaaagagaa

SEQ ID NO: 1432538 - DNA, 20 bp, Homo sapiens
aatgatttccaaagagaaaa

SEQ ID NO: 1432539 - DNA, 17 bp, Homo sapiens
aatgcaaaaactctttg

SEQ ID NO: 1432540 - DNA, 13 bp, Homo sapiens
aatgcaaaaataa

SEQ ID NO: 1432541 - DNA, 17 bp, Homo sapiens
aatgcaaaatgaaataa

SEQ ID NO: 1432542 - DNA, 20 bp, Homo sapiens
aatgcaaacacacaaaggta

SEQ ID NO: 1432543 - DNA, 14 bp, Homo sapiens
aatgcaaagctgaa

SEQ ID NO: 1432544 - DNA, 17 bp, Homo sapiens
aatgcaaagctgaagac

SEQ ID NO: 1432545 - DNA, 19 bp, Homo sapiens
aatgcaaagctgaagacca

SEQ ID NO: 1432546 - DNA, 17 bp, Homo sapiens
aatgcaagctagtggct

SEQ ID NO: 1432547 - DNA, 13 bp, Homo sapiens
aatgcaataactc

SEQ ID NO: 1432548 - DNA, 16 bp, Homo sapiens
aatgcaataactctgg

SEQ ID NO: 1432549 - DNA, 21 bp, Homo sapiens
aatgcaatgtaagcatacttt

SEQ ID NO: 1432550 - DNA, 17 bp, Homo sapiens
aatgcacaagctcagaa

SEQ ID NO: 1432551 - DNA, 24 bp, Homo sapiens
aatgcacatttgtcactgaataat

SEQ ID NO: 1432552 - DNA, 16 bp, Homo sapiens
aatgcagaagcaaaca

SEQ ID NO: 1432553 - DNA, 18 bp, Homo sapiens
aatgcagaagtattcttt

SEQ ID NO: 1432554 - DNA, 23 bp, Homo sapiens
aatgcagaatacttgactcattt

SEQ ID NO: 1432555 - DNA, 16 bp, Homo sapiens
aatgcagattcctggg

SEQ ID NO: 1432556 - DNA, 17 bp, Homo sapiens
aatgcagattcctgggc

SEQ ID NO: 1432557 - DNA, 18 bp, Homo sapiens
aatgcagattcctgggcc

SEQ ID NO: 1432558 - DNA, 15 bp, Homo sapiens
aatgcagatttctct

SEQ ID NO: 1432559 - DNA, 20 bp, Homo sapiens
aatgcagtcctgaggagagg

SEQ ID NO: 1432560 - DNA, 17 bp, Homo sapiens
aatgcagtgaattgtga

SEQ ID NO: 1432561 - DNA, 20 bp, Homo sapiens
aatgcagttacaaattataa

SEQ ID NO: 1432562 - DNA, 23 bp, Homo sapiens
aatgcagttacaaattataatgt

SEQ ID NO: 1432563 - DNA, 15 bp, Homo sapiens
aatgcagtttttaaa

SEQ ID NO: 1432564 - DNA, 13 bp, Homo sapiens
aatgcatattgta

SEQ ID NO: 1432565 - DNA, 22 bp, Homo sapiens
aatgcatcacgtaccccactgg

SEQ ID NO: 1432566 - DNA, 23 bp, Homo sapiens
aatgcatcacgtaccccactggg

SEQ ID NO: 1432567 - DNA, 22 bp, Homo sapiens
aatgcattataggatcatttgt

SEQ ID NO: 1432568 - DNA, 23 bp, Homo sapiens
aatgcattataggatcatttgtt

SEQ ID NO: 1432569 - DNA, 22 bp, Homo sapiens
aatgcattattgacgaactggc

SEQ ID NO: 1432570 - DNA, 17 bp, Homo sapiens
aatgcattgtcttgtgg

SEQ ID NO: 1432571 - DNA, 12 bp, Homo sapiens
aatgcatttaaa

SEQ ID NO: 1432572 - DNA, 16 bp, Homo sapiens
aatgcatttaaaatac

SEQ ID NO: 1432573 - DNA, 21 bp, Homo sapiens
aatgccaagggggtgactgga

SEQ ID NO: 1432574 - DNA, 22 bp, Homo sapiens
aatgccaagggggtgactggaa

SEQ ID NO: 1432575 - DNA, 11 bp, Homo sapiens
aatgccagagc

SEQ ID NO: 1432576 - DNA, 22 bp, Homo sapiens
aatgccagagccaacctggact

SEQ ID NO: 1432577 - DNA, 17 bp, Homo sapiens
aatgccatctatctagt

SEQ ID NO: 1432578 - DNA, 17 bp, Homo sapiens
aatgccatgaacaaatt

SEQ ID NO: 1432579 - DNA, 21 bp, Homo sapiens
aatgccatgaacaaattcttt

SEQ ID NO: 1432580 - DNA, 19 bp, Homo sapiens
aatgccatttatttattga

SEQ ID NO: 1432581 - DNA, 20 bp, Homo sapiens
aatgccatttatttattgat

SEQ ID NO: 1432582 - DNA, 11 bp, Homo sapiens
aatgccctctt

SEQ ID NO: 1432583 - DNA, 12 bp, Homo sapiens
aatgccctgcca

SEQ ID NO: 1432584 - DNA, 13 bp, Homo sapiens
aatgcccttcact

SEQ ID NO: 1432585 - DNA, 16 bp, Homo sapiens
aatgccgctgtctctg

SEQ ID NO: 1432586 - DNA, 18 bp, Homo sapiens
aatgccggttaaattcca

SEQ ID NO: 1432587 - DNA, 19 bp, Homo sapiens
aatgccggttaaattccat

SEQ ID NO: 1432588 - DNA, 20 bp, Homo sapiens
aatgcctcttaaattatata

SEQ ID NO: 1432589 - DNA, 21 bp, Homo sapiens
aatgcctgctttttggaaagt

SEQ ID NO: 1432590 - DNA, 14 bp, Homo sapiens
aatgcctgtgaagc

SEQ ID NO: 1432591 - DNA, 13 bp, Homo sapiens
aatgcctgtgcca

SEQ ID NO: 1432592 - DNA, 14 bp, Homo sapiens
aatgcctgtgccaa

SEQ ID NO: 1432593 - DNA, 16 bp, Homo sapiens
aatgccttttgaatac

SEQ ID NO: 1432594 - DNA, 23 bp, Homo sapiens
aatgcggttataaaaaatggttc

SEQ ID NO: 1432595 - DNA, 13 bp, Homo sapiens
aatgctaagaaat

SEQ ID NO: 1432596 - DNA, 16 bp, Homo sapiens
aatgctacaattttaa

SEQ ID NO: 1432597 - DNA, 15 bp, Homo sapiens
aatgctaccaggatg

SEQ ID NO: 1432598 - DNA, 21 bp, Homo sapiens
aatgctaggttaattccaatt

SEQ ID NO: 1432599 - DNA, 14 bp, Homo sapiens
aatgctatcactgt

SEQ ID NO: 1432600 - DNA, 21 bp, Homo sapiens
aatgctatcactgtctttgac

SEQ ID NO: 1432601 - DNA, 19 bp, Homo sapiens
aatgctcagcgcttaaaaa

SEQ ID NO: 1432602 - DNA, 23 bp, Homo sapiens
aatgctcagcgcttaaaaaaaca

SEQ ID NO: 1432603 - DNA, 16 bp, Homo sapiens
aatgctccccacagcg

SEQ ID NO: 1432604 - DNA, 20 bp, Homo sapiens
aatgctccccacagcgtccc

SEQ ID NO: 1432605 - DNA, 13 bp, Homo sapiens
aatgctcttgtcc

SEQ ID NO: 1432606 - DNA, 15 bp, Homo sapiens
aatgctgaaaattgc

SEQ ID NO: 1432607 - DNA, 16 bp, Homo sapiens
aatgctgacaaaaata

SEQ ID NO: 1432608 - DNA, 13 bp, Homo sapiens
aatgctgcacttc

SEQ ID NO: 1432609 - DNA, 17 bp, Homo sapiens
aatgctgcacttcctgt

SEQ ID NO: 1432610 - DNA, 21 bp, Homo sapiens
aatgctgcattttaattttaa

SEQ ID NO: 1432611 - DNA, 14 bp, Homo sapiens
aatgctgcctgcct

SEQ ID NO: 1432612 - DNA, 15 bp, Homo sapiens
aatgctgcctgcctg

SEQ ID NO: 1432613 - DNA, 18 bp, Homo sapiens
aatgctgcctgcctgtct

SEQ ID NO: 1432614 - DNA, 23 bp, Homo sapiens
aatgctgccttttctttaacttt

SEQ ID NO: 1432615 - DNA, 17 bp, Homo sapiens
aatgctgctggccaaat

SEQ ID NO: 1432616 - DNA, 23 bp, Homo sapiens
aatgctggactggaggcccctgg

SEQ ID NO: 1432617 - DNA, 18 bp, Homo sapiens
aatgctgggtttatagat

SEQ ID NO: 1432618 - DNA, 12 bp, Homo sapiens
ccccttcctgtt

SEQ ID NO: 1432619 - DNA, 15 bp, Homo sapiens
ccccttcctgtttca

SEQ ID NO: 1432620 - DNA, 20 bp, Homo sapiens
ccccttctatgctgcttcca

SEQ ID NO: 1432621 - DNA, 18 bp, Homo sapiens
ccccttctcccctgcact

SEQ ID NO: 1432622 - DNA, 19 bp, Homo sapiens
ccccttctcccctgcactg

SEQ ID NO: 1432623 - DNA, 13 bp, Homo sapiens
ccccttctctcat

SEQ ID NO: 1432624 - DNA, 12 bp, Homo sapiens
ccccttctctgc

SEQ ID NO: 1432625 - DNA, 14 bp, Homo sapiens
ccccttctctgctc

SEQ ID NO: 1432626 - DNA, 13 bp, Homo sapiens
ccccttctgtgtt

SEQ ID NO: 1432627 - DNA, 20 bp, Homo sapiens
ccccttgaggattgtggaaa

SEQ ID NO: 1432628 - DNA, 21 bp, Homo sapiens
ccccttgatttaaacacacag

SEQ ID NO: 1432629 - DNA, 13 bp, Homo sapiens
ccccttgccccac

SEQ ID NO: 1432630 - DNA, 13 bp, Homo sapiens
ccccttgccctcc

SEQ ID NO: 1432631 - DNA, 14 bp, Homo sapiens
ccccttgccctccg

SEQ ID NO: 1432632 - DNA, 18 bp, Homo sapiens
ccccttgccctccgcctg

SEQ ID NO: 1432633 - DNA, 22 bp, Homo sapiens
ccccttggaaatgtctgctggt

SEQ ID NO: 1432634 - DNA, 21 bp, Homo sapiens
ccccttggaggagagagaccc

SEQ ID NO: 1432635 - DNA, 15 bp, Homo sapiens
ccccttgtcctttcc

SEQ ID NO: 1432636 - DNA, 18 bp, Homo sapiens
ccccttgtcctttccctt

SEQ ID NO: 1432637 - DNA, 18 bp, Homo sapiens
cccctttactcagcccag

SEQ ID NO: 1432638 - DNA, 20 bp, Homo sapiens
cccctttactcagcccagct

SEQ ID NO: 1432639 - DNA, 17 bp, Homo sapiens
ccccttttcttttctac

SEQ ID NO: 1432640 - DNA, 23 bp, Homo sapiens
ccccttttcttttctaccctagc

SEQ ID NO: 1432641 - DNA, 17 bp, Homo sapiens
ccccttttgcctggctg

SEQ ID NO: 1432642 - DNA, 18 bp, Homo sapiens
ccccttttgcctggctgt

SEQ ID NO: 1432643 - DNA, 14 bp, Homo sapiens
cccgaacagggact

SEQ ID NO: 1432644 - DNA, 17 bp, Homo sapiens
cccgaagccatcacttc

SEQ ID NO: 1432645 - DNA, 18 bp, Homo sapiens
cccgaagccatcacttct

SEQ ID NO: 1432646 - DNA, 16 bp, Homo sapiens
cccgacaccagaagct

SEQ ID NO: 1432647 - DNA, 15 bp, Homo sapiens
cccgacactgctgca

SEQ ID NO: 1432648 - DNA, 18 bp, Homo sapiens
cccgacactgctgcacca

SEQ ID NO: 1432649 - DNA, 23 bp, Homo sapiens
cccgacactgctgcaccagagtg

SEQ ID NO: 1432650 - DNA, 14 bp, Homo sapiens
cccgaccccgagtc

SEQ ID NO: 1432651 - DNA, 14 bp, Homo sapiens
cccgactcctcaaa

SEQ ID NO: 1432652 - DNA, 13 bp, Homo sapiens
cccgacttgctgt

SEQ ID NO: 1432653 - DNA, 20 bp, Homo sapiens
cccgagacaccatcctgagc

SEQ ID NO: 1432654 - DNA, 22 bp, Homo sapiens
cccgagatgtgacccaccagtg

SEQ ID NO: 1432655 - DNA, 13 bp, Homo sapiens
cccgagcccagct

SEQ ID NO: 1432656 - DNA, 14 bp, Homo sapiens
cccgagctcctctt

SEQ ID NO: 1432657 - DNA, 15 bp, Homo sapiens
cccgaggagctgggc

SEQ ID NO: 1432658 - DNA, 19 bp, Homo sapiens
cccgaggagctgggcccct

SEQ ID NO: 1432659 - DNA, 22 bp, Homo sapiens
cccgagggatggtgcccctagg

SEQ ID NO: 1432660 - DNA, 14 bp, Homo sapiens
cccgagtctccggg

SEQ ID NO: 1432661 - DNA, 17 bp, Homo sapiens
cccgagttcctctgggt

SEQ ID NO: 1432662 - DNA, 24 bp, Homo sapiens
cccgatacctcagccctggccctg

SEQ ID NO: 1432663 - DNA, 23 bp, Homo sapiens
cccgatgctgctttcccctgtgg

SEQ ID NO: 1432664 - DNA, 19 bp, Homo sapiens
cccgatggactcctgacca

SEQ ID NO: 1432665 - DNA, 20 bp, Homo sapiens
cccgatgtcgacatgttttt

SEQ ID NO: 1432666 - DNA, 15 bp, Homo sapiens
cccgcacagccaccc

SEQ ID NO: 1432667 - DNA, 18 bp, Homo sapiens
cccgcacagccacccgtg

SEQ ID NO: 1432668 - DNA, 18 bp, Homo sapiens
cccgcaccccggcctcag

SEQ ID NO: 1432669 - DNA, 13 bp, Homo sapiens
cccgcaccttcct

SEQ ID NO: 1432670 - DNA, 15 bp, Homo sapiens
cccgcactctgcccc

SEQ ID NO: 1432671 - DNA, 15 bp, Homo sapiens
cccgcagacaccttg

SEQ ID NO: 1432672 - DNA, 12 bp, Homo sapiens
cccgcagcaccc

SEQ ID NO: 1432673 - DNA, 19 bp, Homo sapiens
cccgcagcaccctgcagag

SEQ ID NO: 1432674 - DNA, 17 bp, Homo sapiens
cccgcagcccgcctgcc

SEQ ID NO: 1432675 - DNA, 22 bp, Homo sapiens
cccgcagcccgtgaagcagtgc

SEQ ID NO: 1432676 - DNA, 16 bp, Homo sapiens
cccgcaggatccctcc

SEQ ID NO: 1432677 - DNA, 23 bp, Homo sapiens
cccgcaggatccctcctgagctc

SEQ ID NO: 1432678 - DNA, 18 bp, Homo sapiens
cccgcagggccatgcaga

SEQ ID NO: 1432679 - DNA, 18 bp, Homo sapiens
cccgcagtccccagccct

SEQ ID NO: 1432680 - DNA, 19 bp, Homo sapiens
cccgcagtccccagccctt

SEQ ID NO: 1432681 - DNA, 21 bp, Homo sapiens
cccgcagtgctgggaccagag

SEQ ID NO: 1432682 - DNA, 23 bp, Homo sapiens
cccgcagtgctgggaccagagcc

SEQ ID NO: 1432683 - DNA, 15 bp, Homo sapiens
cccgccacctcaggg

SEQ ID NO: 1432684 - DNA, 16 bp, Homo sapiens
cccgccacctcagggc

SEQ ID NO: 1432685 - DNA, 15 bp, Homo sapiens
cccgccacggccacc

SEQ ID NO: 1432686 - DNA, 13 bp, Homo sapiens
cccgccagcctca

SEQ ID NO: 1432687 - DNA, 14 bp, Homo sapiens
cccgccagcctcag

SEQ ID NO: 1432688 - DNA, 11 bp, Homo sapiens
cccgccaggtc

SEQ ID NO: 1432689 - DNA, 12 bp, Homo sapiens
cccgcccactgt

SEQ ID NO: 1432690 - DNA, 19 bp, Homo sapiens
cccgcccactgtcctgggc

SEQ ID NO: 1432691 - DNA, 20 bp, Homo sapiens
cccgcccactgtcctgggcg

SEQ ID NO: 1432692 - DNA, 14 bp, Homo sapiens
cccgcccccacccc

SEQ ID NO: 1432693 - DNA, 13 bp, Homo sapiens
cccgccccgcccc

SEQ ID NO: 1432694 - DNA, 20 bp, Homo sapiens
cccgccccgttgtgagctgg

SEQ ID NO: 1432695 - DNA, 19 bp, Homo sapiens
cccgcccctcgctgctgct

SEQ ID NO: 1432696 - DNA, 22 bp, Homo sapiens
cccgcccctcgctgctgctact

SEQ ID NO: 1432697 - DNA, 17 bp, Homo sapiens
cccgccgcgccagtccc

SEQ ID NO: 1432698 - DNA, 12 bp, Homo sapiens
cccgcctccact

SEQ ID NO: 1432699 - DNA, 13 bp, Homo sapiens
cccgcctccactc

SEQ ID NO: 1432700 - DNA, 19 bp, Homo sapiens
cccgcctcccccgcaggtt

SEQ ID NO: 1432701 - DNA, 12 bp, Homo sapiens
cccgcctctccc

SEQ ID NO: 1432702 - DNA, 12 bp, Homo sapiens
cccgcctgagtc

SEQ ID NO: 1432703 - DNA, 13 bp, Homo sapiens
cccgcctgccacc

SEQ ID NO: 1432704 - DNA, 14 bp, Homo sapiens
cccgcctgccaccg

SEQ ID NO: 1432705 - DNA, 13 bp, Homo sapiens
cccgcctgccctc

SEQ ID NO: 1432706 - DNA, 19 bp, Homo sapiens
cccgcctgccgtgcatggc

SEQ ID NO: 1432707 - DNA, 12 bp, Homo sapiens
cccgcctggcca

SEQ ID NO: 1432708 - DNA, 17 bp, Homo sapiens
cccgcctggccaggagc

SEQ ID NO: 1432709 - DNA, 13 bp, Homo sapiens
cccgcctgggcac

SEQ ID NO: 1432710 - DNA, 20 bp, Homo sapiens
cccgcctgggcaccgggacc

SEQ ID NO: 1432711 - DNA, 20 bp, Homo sapiens
cccgccttccaaaacctgct

SEQ ID NO: 1432712 - DNA, 17 bp, Homo sapiens
cccgccttcctcctcca

SEQ ID NO: 1432713 - DNA, 17 bp, Homo sapiens
cccgcgcccgcgccctc

SEQ ID NO: 1432714 - DNA, 16 bp, Homo sapiens
cccgcgctcgcccagc

SEQ ID NO: 1432715 - DNA, 17 bp, Homo sapiens
cccgcgggttctagacg

SEQ ID NO: 1432716 - DNA, 15 bp, Homo sapiens
cccgcggtgctctgg

SEQ ID NO: 1432717 - DNA, 18 bp, Homo sapiens
cccgcggtgctgactgag

SEQ ID NO: 1432718 - DNA, 21 bp, Homo sapiens
cccgctagtggtagtatctcg

SEQ ID NO: 1432719 - DNA, 14 bp, Homo sapiens
cccgctcagccctc

SEQ ID NO: 1432720 - DNA, 15 bp, Homo sapiens
cccgctcagccctcc

SEQ ID NO: 1432721 - DNA, 19 bp, Homo sapiens
cccgctcagccctccctgc

SEQ ID NO: 1432722 - DNA, 19 bp, Homo sapiens
cccgctcaggggcctggag

SEQ ID NO: 1432723 - DNA, 17 bp, Homo sapiens
cccgctcccacacccct

SEQ ID NO: 1432724 - DNA, 14 bp, Homo sapiens
cccgctcccaggtt

SEQ ID NO: 1432725 - DNA, 13 bp, Homo sapiens
cccgctccccacc

SEQ ID NO: 1432726 - DNA, 16 bp, Homo sapiens
cccgctcctgccgcag

SEQ ID NO: 1432727 - DNA, 19 bp, Homo sapiens
cccgctcctgccgcagacg

SEQ ID NO: 1432728 - DNA, 21 bp, Homo sapiens
cccgctctacatcttctgcct

SEQ ID NO: 1432729 - DNA, 13 bp, Homo sapiens
cccgctctccctg

SEQ ID NO: 1432730 - DNA, 20 bp, Homo sapiens
cccgctgatggagccccacc

SEQ ID NO: 1432731 - DNA, 21 bp, Homo sapiens
cccgctgctgtgctctgggga

SEQ ID NO: 1432732 - DNA, 21 bp, Homo sapiens
cccgctgggctgagcccctac

SEQ ID NO: 1432733 - DNA, 15 bp, Homo sapiens
cccgcttccccacag

SEQ ID NO: 1432734 - DNA, 16 bp, Homo sapiens
cccgcttccccacaga

SEQ ID NO: 1432735 - DNA, 20 bp, Homo sapiens
cccgctttcttgctggttgt

SEQ ID NO: 1432736 - DNA, 18 bp, Homo sapiens
aatgctggttttcctaaa

SEQ ID NO: 1432737 - DNA, 23 bp, Homo sapiens
aatgctggttttcctaaatgcag

SEQ ID NO: 1432738 - DNA, 13 bp, Homo sapiens
aatgctgtgttaa

SEQ ID NO: 1432739 - DNA, 13 bp, Homo sapiens
aatgctgttaata

SEQ ID NO: 1432740 - DNA, 12 bp, Homo sapiens
aatgcttaaaaa

SEQ ID NO: 1432741 - DNA, 16 bp, Homo sapiens
aatgcttaaaaaataa

SEQ ID NO: 1432742 - DNA, 15 bp, Homo sapiens
aatgcttcattgaaa

SEQ ID NO: 1432743 - DNA, 15 bp, Homo sapiens
aatgctttccaaaac

SEQ ID NO: 1432744 - DNA, 15 bp, Homo sapiens
aatgctttctgtatg

SEQ ID NO: 1432745 - DNA, 13 bp, Homo sapiens
aatgctttgccat

SEQ ID NO: 1432746 - DNA, 20 bp, Homo sapiens
aatgctttgggaggccaagg

SEQ ID NO: 1432747 - DNA, 19 bp, Homo sapiens
aatgctttgtgtgattgaa

SEQ ID NO: 1432748 - DNA, 16 bp, Homo sapiens
aatgcttttagtgtgt

SEQ ID NO: 1432749 - DNA, 19 bp, Homo sapiens
aatggaaaaaaacataaaa

SEQ ID NO: 1432750 - DNA, 15 bp, Homo sapiens
aatggaaaaatagta

SEQ ID NO: 1432751 - DNA, 17 bp, Homo sapiens
aatggaaaattttctcc

SEQ ID NO: 1432752 - DNA, 17 bp, Homo sapiens
aatggaaactgaatgct

SEQ ID NO: 1432753 - DNA, 18 bp, Homo sapiens
aatggaactactgtactt

SEQ ID NO: 1432754 - DNA, 19 bp, Homo sapiens
aatggaactactgtacttt

SEQ ID NO: 1432755 - DNA, 18 bp, Homo sapiens
aatggaaggtttgtatat

SEQ ID NO: 1432756 - DNA, 20 bp, Homo sapiens
aatggaaggtttgtatattg

SEQ ID NO: 1432757 - DNA, 22 bp, Homo sapiens
aatggaataaaaggcttgaagc

SEQ ID NO: 1432758 - DNA, 19 bp, Homo sapiens
aatggacataggactcaaa

SEQ ID NO: 1432759 - DNA, 22 bp, Homo sapiens
aatggaccctttttgttatgat

SEQ ID NO: 1432760 - DNA, 22 bp, Homo sapiens
aatggagctcagtaacataact

SEQ ID NO: 1432761 - DNA, 17 bp, Homo sapiens
aatggaggaagaacaac

SEQ ID NO: 1432762 - DNA, 23 bp, Homo sapiens
aatggaggaagaacaacaaagac

SEQ ID NO: 1432763 - DNA, 20 bp, Homo sapiens
aatggatcaatacacacaca

SEQ ID NO: 1432764 - DNA, 16 bp, Homo sapiens
aatggatcacaagatg

SEQ ID NO: 1432765 - DNA, 17 bp, Homo sapiens
aatggattaattactaa

SEQ ID NO: 1432766 - DNA, 18 bp, Homo sapiens
aatggcagctagactgga

SEQ ID NO: 1432767 - DNA, 13 bp, Homo sapiens
aatggcagctagt

SEQ ID NO: 1432768 - DNA, 13 bp, Homo sapiens
aatggcatttctc

SEQ ID NO: 1432769 - DNA, 15 bp, Homo sapiens
aatggccatgcagga

SEQ ID NO: 1432770 - DNA, 18 bp, Homo sapiens
aatggccatgcaggaggt

SEQ ID NO: 1432771 - DNA, 15 bp, Homo sapiens
aatggcctcatgtgg

SEQ ID NO: 1432772 - DNA, 14 bp, Homo sapiens
aatggcctgccttg

SEQ ID NO: 1432773 - DNA, 14 bp, Homo sapiens
aatggcgtctgctc

SEQ ID NO: 1432774 - DNA, 22 bp, Homo sapiens
aatggctaataaactgtattaa

SEQ ID NO: 1432775 - DNA, 16 bp, Homo sapiens
aatggctatttttgaa

SEQ ID NO: 1432776 - DNA, 20 bp, Homo sapiens
aatggctcaagtagaaaagc

SEQ ID NO: 1432777 - DNA, 13 bp, Homo sapiens
aatggctgggtca

SEQ ID NO: 1432778 - DNA, 16 bp, Homo sapiens
aatggctgggtcaggg

SEQ ID NO: 1432779 - DNA, 20 bp, Homo sapiens
aatgggactgatgtcatctt

SEQ ID NO: 1432780 - DNA, 13 bp, Homo sapiens
aatgggcctgccc

SEQ ID NO: 1432781 - DNA, 16 bp, Homo sapiens
aatgggctcaaccaga

SEQ ID NO: 1432782 - DNA, 15 bp, Homo sapiens
aatgggctcttccaa

SEQ ID NO: 1432783 - DNA, 14 bp, Homo sapiens
aatggggattatta

SEQ ID NO: 1432784 - DNA, 17 bp, Homo sapiens
aatggggccagatccag

SEQ ID NO: 1432785 - DNA, 22 bp, Homo sapiens
aatggggccagatccagcctgg

SEQ ID NO: 1432786 - DNA, 22 bp, Homo sapiens
aatggggggcgggccagggtgg

SEQ ID NO: 1432787 - DNA, 23 bp, Homo sapiens
aatggggggcgggccagggtggg

SEQ ID NO: 1432788 - DNA, 18 bp, Homo sapiens
aatgggggtagcagctgg

SEQ ID NO: 1432789 - DNA, 19 bp, Homo sapiens
aatgggggtagcagctgga

SEQ ID NO: 1432790 - DNA, 15 bp, Homo sapiens
aatggggtgggccca

SEQ ID NO: 1432791 - DNA, 13 bp, Homo sapiens
aatggtaatagaa

SEQ ID NO: 1432792 - DNA, 17 bp, Homo sapiens
aatggtaatagaatagc

SEQ ID NO: 1432793 - DNA, 14 bp, Homo sapiens
aatggtataaaagg

SEQ ID NO: 1432794 - DNA, 17 bp, Homo sapiens
aatggtataaaaggttg

SEQ ID NO: 1432795 - DNA, 20 bp, Homo sapiens
aatggtataaaaggttgcca

SEQ ID NO: 1432796 - DNA, 15 bp, Homo sapiens
aatggtctggcaata

SEQ ID NO: 1432797 - DNA, 16 bp, Homo sapiens
aatggtgtacataatg

SEQ ID NO: 1432798 - DNA, 17 bp, Homo sapiens
aatggtgtagctgtcct

SEQ ID NO: 1432799 - DNA, 22 bp, Homo sapiens
aatggtgttttgtcagacttcc

SEQ ID NO: 1432800 - DNA, 20 bp, Homo sapiens
aatggttaatttttcctgca

SEQ ID NO: 1432801 - DNA, 23 bp, Homo sapiens
aatggttaatttttcctgcatgt

SEQ ID NO: 1432802 - DNA, 21 bp, Homo sapiens
aatggttccatgcctgagggt

SEQ ID NO: 1432803 - DNA, 17 bp, Homo sapiens
aatggttgaatgaataa

SEQ ID NO: 1432804 - DNA, 13 bp, Homo sapiens
aatggtttaacaa

SEQ ID NO: 1432805 - DNA, 14 bp, Homo sapiens
aatggtttattccc

SEQ ID NO: 1432806 - DNA, 14 bp, Homo sapiens
aatggtttcctctg

SEQ ID NO: 1432807 - DNA, 17 bp, Homo sapiens
aatggtttcctctggat

SEQ ID NO: 1432808 - DNA, 20 bp, Homo sapiens
aatggtttgtgtcaaaactg

SEQ ID NO: 1432809 - DNA, 16 bp, Homo sapiens
aatggttttcaaaata

SEQ ID NO: 1432810 - DNA, 16 bp, Homo sapiens
aatgtaaaatatttga

SEQ ID NO: 1432811 - DNA, 17 bp, Homo sapiens
aatgtaaaattcatagc

SEQ ID NO: 1432812 - DNA, 14 bp, Homo sapiens
aatgtaaaggaggg

SEQ ID NO: 1432813 - DNA, 18 bp, Homo sapiens
aatgtaaagttacactgt

SEQ ID NO: 1432814 - DNA, 20 bp, Homo sapiens
aatgtaaagttatgtattta

SEQ ID NO: 1432815 - DNA, 14 bp, Homo sapiens
aatgtaaataaact

SEQ ID NO: 1432816 - DNA, 15 bp, Homo sapiens
aatgtaaataaacta

SEQ ID NO: 1432817 - DNA, 19 bp, Homo sapiens
aatgtaaataaactattta

SEQ ID NO: 1432818 - DNA, 18 bp, Homo sapiens
aatgtaaatattctatat

SEQ ID NO: 1432819 - DNA, 20 bp, Homo sapiens
aatgtaacatcataattaca

SEQ ID NO: 1432820 - DNA, 14 bp, Homo sapiens
aatgtaacatgttt

SEQ ID NO: 1432821 - DNA, 22 bp, Homo sapiens
aatgtaactccagatagagaaa

SEQ ID NO: 1432822 - DNA, 22 bp, Homo sapiens
aatgtaagattatagattctaa

SEQ ID NO: 1432823 - DNA, 13 bp, Homo sapiens
aatgtaagcaaag

SEQ ID NO: 1432824 - DNA, 18 bp, Homo sapiens
aatgtaaggattctggaa

SEQ ID NO: 1432825 - DNA, 16 bp, Homo sapiens
aatgtaatagggaaaa

SEQ ID NO: 1432826 - DNA, 15 bp, Homo sapiens
aatgtaatataatgt

SEQ ID NO: 1432827 - DNA, 22 bp, Homo sapiens
aatgtaatataatgtattttct

SEQ ID NO: 1432828 - DNA, 13 bp, Homo sapiens
aatgtaatcattt

SEQ ID NO: 1432829 - DNA, 15 bp, Homo sapiens
aatgtaatgatcata

SEQ ID NO: 1432830 - DNA, 16 bp, Homo sapiens
aatgtaattgaataaa

SEQ ID NO: 1432831 - DNA, 15 bp, Homo sapiens
aatgtaattggaatc

SEQ ID NO: 1432832 - DNA, 20 bp, Homo sapiens
aatgtaattggaatcttcac

SEQ ID NO: 1432833 - DNA, 18 bp, Homo sapiens
aatgtacaagttttgtat

SEQ ID NO: 1432834 - DNA, 12 bp, Homo sapiens
aatgtacaatta

SEQ ID NO: 1432835 - DNA, 16 bp, Homo sapiens
aatgtacatgaagcaa

SEQ ID NO: 1432836 - DNA, 14 bp, Homo sapiens
aatgtacatgtatt

SEQ ID NO: 1432837 - DNA, 21 bp, Homo sapiens
aatgtacccctctcagtctgc

SEQ ID NO: 1432838 - DNA, 22 bp, Homo sapiens
aatgtacgctgctgcaggacat

SEQ ID NO: 1432839 - DNA, 14 bp, Homo sapiens
aatgtactgcatat

SEQ ID NO: 1432840 - DNA, 20 bp, Homo sapiens
aatgtactggtaattgtaca

SEQ ID NO: 1432841 - DNA, 22 bp, Homo sapiens
aatgtactggtaattgtacaat

SEQ ID NO: 1432842 - DNA, 23 bp, Homo sapiens
aatgtagcgacagcattttaagg

SEQ ID NO: 1432843 - DNA, 21 bp, Homo sapiens
aatgtagctggtttcctcatt

SEQ ID NO: 1432844 - DNA, 18 bp, Homo sapiens
aatgtaggccttaactat

SEQ ID NO: 1432845 - DNA, 21 bp, Homo sapiens
aatgtagggcctgcatggaga

SEQ ID NO: 1432846 - DNA, 22 bp, Homo sapiens
aatgtagttagctccataaagt

SEQ ID NO: 1432847 - DNA, 23 bp, Homo sapiens
aatgtagtttgaggaaatttgca

SEQ ID NO: 1432848 - DNA, 14 bp, Homo sapiens
aatgtataaagatt

SEQ ID NO: 1432849 - DNA, 17 bp, Homo sapiens
aatgtataaagattgta

SEQ ID NO: 1432850 - DNA, 18 bp, Homo sapiens
aatgtataaagattgtac

SEQ ID NO: 1432851 - DNA, 13 bp, Homo sapiens
aatgtataaatat

SEQ ID NO: 1432852 - DNA, 14 bp, Homo sapiens
aatgtataaatata

SEQ ID NO: 1432853 - DNA, 22 bp, Homo sapiens
cccgcttttgttcttccccaca

SEQ ID NO: 1432854 - DNA, 16 bp, Homo sapiens
cccggaagggctttgg

SEQ ID NO: 1432855 - DNA, 13 bp, Homo sapiens
cccggacctctgg

SEQ ID NO: 1432856 - DNA, 17 bp, Homo sapiens
cccggagaaacctgatg

SEQ ID NO: 1432857 - DNA, 18 bp, Homo sapiens
cccggagaaggccgctgc

SEQ ID NO: 1432858 - DNA, 20 bp, Homo sapiens
cccggagaaggccgctgccc

SEQ ID NO: 1432859 - DNA, 13 bp, Homo sapiens
cccggagcacagc

SEQ ID NO: 1432860 - DNA, 16 bp, Homo sapiens
cccggagcacagccct

SEQ ID NO: 1432861 - DNA, 17 bp, Homo sapiens
cccggagcacagccctg

SEQ ID NO: 1432862 - DNA, 18 bp, Homo sapiens
cccggagcacagccctgg

SEQ ID NO: 1432863 - DNA, 21 bp, Homo sapiens
cccggagcacagccctgggag

SEQ ID NO: 1432864 - DNA, 22 bp, Homo sapiens
cccggagcacagccctgggagg

SEQ ID NO: 1432865 - DNA, 16 bp, Homo sapiens
cccggattctgggagg

SEQ ID NO: 1432866 - DNA, 21 bp, Homo sapiens
cccggcaagcgcttctgctga

SEQ ID NO: 1432867 - DNA, 13 bp, Homo sapiens
cccggcactccag

SEQ ID NO: 1432868 - DNA, 13 bp, Homo sapiens
cccggcaggcctg

SEQ ID NO: 1432869 - DNA, 20 bp, Homo sapiens
cccggcatgagactcagtgc

SEQ ID NO: 1432870 - DNA, 23 bp, Homo sapiens
cccggcatgagactcagtgcaga

SEQ ID NO: 1432871 - DNA, 15 bp, Homo sapiens
cccggccacacccag

SEQ ID NO: 1432872 - DNA, 17 bp, Homo sapiens
cccggccacacccagcg

SEQ ID NO: 1432873 - DNA, 14 bp, Homo sapiens
cccggccacagctg

SEQ ID NO: 1432874 - DNA, 17 bp, Homo sapiens
cccggccacagctgctg

SEQ ID NO: 1432875 - DNA, 17 bp, Homo sapiens
cccggccagcgggcaca

SEQ ID NO: 1432876 - DNA, 14 bp, Homo sapiens
cccggccccagcca

SEQ ID NO: 1432877 - DNA, 16 bp, Homo sapiens
cccggcctcagggcgc

SEQ ID NO: 1432878 - DNA, 22 bp, Homo sapiens
cccggcctcctcggagagcagc

SEQ ID NO: 1432879 - DNA, 19 bp, Homo sapiens
cccggcctcttccacccat

SEQ ID NO: 1432880 - DNA, 19 bp, Homo sapiens
cccggctcgtgtatttatt

SEQ ID NO: 1432881 - DNA, 13 bp, Homo sapiens
cccggctgcctgc

SEQ ID NO: 1432882 - DNA, 14 bp, Homo sapiens
cccggctgcctgcc

SEQ ID NO: 1432883 - DNA, 15 bp, Homo sapiens
cccggctgggcctcc

SEQ ID NO: 1432884 - DNA, 17 bp, Homo sapiens
cccggctggttttgtaa

SEQ ID NO: 1432885 - DNA, 20 bp, Homo sapiens
cccggcttcctttcccaagc

SEQ ID NO: 1432886 - DNA, 20 bp, Homo sapiens
cccgggaccacagctgctgg

SEQ ID NO: 1432887 - DNA, 14 bp, Homo sapiens
cccgggagcggagg

SEQ ID NO: 1432888 - DNA, 12 bp, Homo sapiens
cccgggcccaga

SEQ ID NO: 1432889 - DNA, 16 bp, Homo sapiens
cccgggcccagaggag

SEQ ID NO: 1432890 - DNA, 18 bp, Homo sapiens
cccgggccctcccttgga

SEQ ID NO: 1432891 - DNA, 20 bp, Homo sapiens
cccgggctctggccaccctg

SEQ ID NO: 1432892 - DNA, 15 bp, Homo sapiens
cccgggctgcctggg

SEQ ID NO: 1432893 - DNA, 17 bp, Homo sapiens
cccgggctgcctgggct

SEQ ID NO: 1432894 - DNA, 13 bp, Homo sapiens
cccgggctggaga

SEQ ID NO: 1432895 - DNA, 14 bp, Homo sapiens
cccgggctggagaa

SEQ ID NO: 1432896 - DNA, 17 bp, Homo sapiens
cccgggcttcccttctc

SEQ ID NO: 1432897 - DNA, 22 bp, Homo sapiens
cccggggaaaggcaaggtccgg

SEQ ID NO: 1432898 - DNA, 16 bp, Homo sapiens
cccggggaccctgtga

SEQ ID NO: 1432899 - DNA, 18 bp, Homo sapiens
cccggggcagggcagccg

SEQ ID NO: 1432900 - DNA, 16 bp, Homo sapiens
cccggggccagcactt

SEQ ID NO: 1432901 - DNA, 23 bp, Homo sapiens
cccggggccttccttttgaggag

SEQ ID NO: 1432902 - DNA, 17 bp, Homo sapiens
cccggggctggcaagca

SEQ ID NO: 1432903 - DNA, 19 bp, Homo sapiens
cccggggtctcctggacct

SEQ ID NO: 1432904 - DNA, 17 bp, Homo sapiens
cccgggtccccagctcc

SEQ ID NO: 1432905 - DNA, 21 bp, Homo sapiens
cccgggtctctcactgttgca

SEQ ID NO: 1432906 - DNA, 15 bp, Homo sapiens
cccggttcttccagt

SEQ ID NO: 1432907 - DNA, 14 bp, Homo sapiens
cccgtatcacagtg

SEQ ID NO: 1432908 - DNA, 12 bp, Homo sapiens
cccgtcagggag

SEQ ID NO: 1432909 - DNA, 22 bp, Homo sapiens
cccgtcagggcccaagtccctg

SEQ ID NO: 1432910 - DNA, 15 bp, Homo sapiens
cccgtcctgcctgtg

SEQ ID NO: 1432911 - DNA, 17 bp, Homo sapiens
cccgtcgcgctggacag

SEQ ID NO: 1432912 - DNA, 19 bp, Homo sapiens
cccgtcggagctgcctgca

SEQ ID NO: 1432913 - DNA, 13 bp, Homo sapiens
cccgtctcagtgt

SEQ ID NO: 1432914 - DNA, 21 bp, Homo sapiens
cccgtctggggttcagcccct

SEQ ID NO: 1432915 - DNA, 19 bp, Homo sapiens
cccgtcttcaatctctgtt

SEQ ID NO: 1432916 - DNA, 17 bp, Homo sapiens
cccgtcttcagcctagc

SEQ ID NO: 1432917 - DNA, 19 bp, Homo sapiens
cccgtgacctgagatgtgt

SEQ ID NO: 1432918 - DNA, 20 bp, Homo sapiens
cccgtgacctgagatgtgtg

SEQ ID NO: 1432919 - DNA, 21 bp, Homo sapiens
cccgtgacctgagatgtgtga

SEQ ID NO: 1432920 - DNA, 16 bp, Homo sapiens
cccgtgacgaggctca

SEQ ID NO: 1432921 - DNA, 17 bp, Homo sapiens
cccgtgcagtacaggca

SEQ ID NO: 1432922 - DNA, 21 bp, Homo sapiens
cccgtgcccccgcctgccacc

SEQ ID NO: 1432923 - DNA, 15 bp, Homo sapiens
cccgtgcccgcagga

SEQ ID NO: 1432924 - DNA, 21 bp, Homo sapiens
cccgtggtggcggtggctgcc

SEQ ID NO: 1432925 - DNA, 16 bp, Homo sapiens
cccgtgtaaaaagcct

SEQ ID NO: 1432926 - DNA, 22 bp, Homo sapiens
cccgtgtaaaaagcctccttgt

SEQ ID NO: 1432927 - DNA, 16 bp, Homo sapiens
cccgttccctgtcaga

SEQ ID NO: 1432928 - DNA, 19 bp, Homo sapiens
cccgttctgctggcctgga

SEQ ID NO: 1432929 - DNA, 22 bp, Homo sapiens
cccgtttcccggttcaggacca

SEQ ID NO: 1432930 - DNA, 20 bp, Homo sapiens
ccctaaaagcactcctgctt

SEQ ID NO: 1432931 - DNA, 19 bp, Homo sapiens
ccctaaataataaaaataa

SEQ ID NO: 1432932 - DNA, 16 bp, Homo sapiens
ccctaacatagtgtct

SEQ ID NO: 1432933 - DNA, 17 bp, Homo sapiens
ccctaagaatgctttgc

SEQ ID NO: 1432934 - DNA, 17 bp, Homo sapiens
ccctaagcccccagggc

SEQ ID NO: 1432935 - DNA, 18 bp, Homo sapiens
ccctaagcccccagggcc

SEQ ID NO: 1432936 - DNA, 19 bp, Homo sapiens
ccctaaggatctctcagga

SEQ ID NO: 1432937 - DNA, 13 bp, Homo sapiens
ccctaagtgccca

SEQ ID NO: 1432938 - DNA, 15 bp, Homo sapiens
ccctaagtgcccaaa

SEQ ID NO: 1432939 - DNA, 19 bp, Homo sapiens
ccctaattctcttcgctgt

SEQ ID NO: 1432940 - DNA, 20 bp, Homo sapiens
ccctaattctcttcgctgtg

SEQ ID NO: 1432941 - DNA, 15 bp, Homo sapiens
ccctacacctccctc

SEQ ID NO: 1432942 - DNA, 13 bp, Homo sapiens
ccctacagcattg

SEQ ID NO: 1432943 - DNA, 15 bp, Homo sapiens
ccctacagcctgcac

SEQ ID NO: 1432944 - DNA, 20 bp, Homo sapiens
ccctaccagcgcccgctggg

SEQ ID NO: 1432945 - DNA, 21 bp, Homo sapiens
ccctaccagcgcccgctgggc

SEQ ID NO: 1432946 - DNA, 14 bp, Homo sapiens
ccctaccctggact

SEQ ID NO: 1432947 - DNA, 18 bp, Homo sapiens
ccctaccgagtctcttct

SEQ ID NO: 1432948 - DNA, 13 bp, Homo sapiens
ccctacctcaggc

SEQ ID NO: 1432949 - DNA, 16 bp, Homo sapiens
ccctacctcaggcagg

SEQ ID NO: 1432950 - DNA, 19 bp, Homo sapiens
ccctacctgttcagtgtcc

SEQ ID NO: 1432951 - DNA, 15 bp, Homo sapiens
ccctaccttccccag

SEQ ID NO: 1432952 - DNA, 13 bp, Homo sapiens
ccctaccttgcct

SEQ ID NO: 1432953 - DNA, 15 bp, Homo sapiens
ccctaccttgcctcc

SEQ ID NO: 1432954 - DNA, 16 bp, Homo sapiens
ccctaccttgcctcct

SEQ ID NO: 1432955 - DNA, 15 bp, Homo sapiens
ccctacgggcgctgc

SEQ ID NO: 1432956 - DNA, 20 bp, Homo sapiens
ccctactacccattgttccc

SEQ ID NO: 1432957 - DNA, 14 bp, Homo sapiens
ccctactccactgc

SEQ ID NO: 1432958 - DNA, 18 bp, Homo sapiens
ccctactccctgcagatg

SEQ ID NO: 1432959 - DNA, 21 bp, Homo sapiens
ccctactccctgcagatgcca

SEQ ID NO: 1432960 - DNA, 14 bp, Homo sapiens
ccctactgctgtga

SEQ ID NO: 1432961 - DNA, 19 bp, Homo sapiens
ccctacttcttttgctctt

SEQ ID NO: 1432962 - DNA, 20 bp, Homo sapiens
ccctactttgcttccgccac

SEQ ID NO: 1432963 - DNA, 15 bp, Homo sapiens
ccctagagagaataa

SEQ ID NO: 1432964 - DNA, 16 bp, Homo sapiens
ccctagagagaataaa

SEQ ID NO: 1432965 - DNA, 23 bp, Homo sapiens
ccctagcagcccaccctgctgct

SEQ ID NO: 1432966 - DNA, 17 bp, Homo sapiens
ccctagccagcacttgt

SEQ ID NO: 1432967 - DNA, 13 bp, Homo sapiens
ccctagccattcc

SEQ ID NO: 1432968 - DNA, 15 bp, Homo sapiens
ccctagccattcctg

SEQ ID NO: 1432969 - DNA, 18 bp, Homo sapiens
ccctagccattcctggta

SEQ ID NO: 1432970 - DNA, 16 bp, Homo sapiens
aatgtataatgtgcag

SEQ ID NO: 1432971 - DNA, 18 bp, Homo sapiens
aatgtatcaggaaatata

SEQ ID NO: 1432972 - DNA, 23 bp, Homo sapiens
aatgtatccaaggaaacatttta

SEQ ID NO: 1432973 - DNA, 15 bp, Homo sapiens
aatgtatctatttgt

SEQ ID NO: 1432974 - DNA, 20 bp, Homo sapiens
aatgtatctatttgtacaat

SEQ ID NO: 1432975 - DNA, 16 bp, Homo sapiens
aatgtatcttattcac

SEQ ID NO: 1432976 - DNA, 13 bp, Homo sapiens
aatgtatctttat

SEQ ID NO: 1432977 - DNA, 15 bp, Homo sapiens
aatgtatgtgtggct

SEQ ID NO: 1432978 - DNA, 16 bp, Homo sapiens
aatgtatgtgtggctg

SEQ ID NO: 1432979 - DNA, 17 bp, Homo sapiens
aatgtatgtgtggctgt

SEQ ID NO: 1432980 - DNA, 22 bp, Homo sapiens
aatgtattagtatggttcaaga

SEQ ID NO: 1432981 - DNA, 14 bp, Homo sapiens
aatgtattattctg

SEQ ID NO: 1432982 - DNA, 17 bp, Homo sapiens
aatgtattattctgcag

SEQ ID NO: 1432983 - DNA, 20 bp, Homo sapiens
aatgtattcatatttgtact

SEQ ID NO: 1432984 - DNA, 19 bp, Homo sapiens
aatgtattgttggtaatta

SEQ ID NO: 1432985 - DNA, 16 bp, Homo sapiens
aatgtatttagctaca

SEQ ID NO: 1432986 - DNA, 20 bp, Homo sapiens
aatgtatttagctacagctt

SEQ ID NO: 1432987 - DNA, 19 bp, Homo sapiens
aatgtatttgatttataag

SEQ ID NO: 1432988 - DNA, 12 bp, Homo sapiens
aatgtattttaa

SEQ ID NO: 1432989 - DNA, 17 bp, Homo sapiens
aatgtattttaaaataa

SEQ ID NO: 1432990 - DNA, 22 bp, Homo sapiens
aatgtattttaactatttttgt

SEQ ID NO: 1432991 - DNA, 17 bp, Homo sapiens
aatgtcaaggaagactt

SEQ ID NO: 1432992 - DNA, 19 bp, Homo sapiens
aatgtcacaaattgatcaa

SEQ ID NO: 1432993 - DNA, 17 bp, Homo sapiens
aatgtcacattctattt

SEQ ID NO: 1432994 - DNA, 15 bp, Homo sapiens
aatgtcaccaccttc

SEQ ID NO: 1432995 - DNA, 16 bp, Homo sapiens
aatgtcaccaccttcc

SEQ ID NO: 1432996 - DNA, 18 bp, Homo sapiens
aatgtcagatacaatgta

SEQ ID NO: 1432997 - DNA, 21 bp, Homo sapiens
aatgtcagatacaatgtattt

SEQ ID NO: 1432998 - DNA, 14 bp, Homo sapiens
aatgtcagatttct

SEQ ID NO: 1432999 - DNA, 17 bp, Homo sapiens
aatgtcagatttctggt

SEQ ID NO: 1433000 - DNA, 12 bp, Homo sapiens
aatgtcataaat

SEQ ID NO: 1433001 - DNA, 19 bp, Homo sapiens
aatgtcatatactgccatg

SEQ ID NO: 1433002 - DNA, 14 bp, Homo sapiens
aatgtcattgtcta

SEQ ID NO: 1433003 - DNA, 15 bp, Homo sapiens
aatgtcattgtctac

SEQ ID NO: 1433004 - DNA, 23 bp, Homo sapiens
aatgtccccattctataaattca

SEQ ID NO: 1433005 - DNA, 19 bp, Homo sapiens
aatgtccctctcttggcta

SEQ ID NO: 1433006 - DNA, 16 bp, Homo sapiens
aatgtcctgcctttta

SEQ ID NO: 1433007 - DNA, 17 bp, Homo sapiens
aatgtctaaatgctgaa

SEQ ID NO: 1433008 - DNA, 14 bp, Homo sapiens
aatgtctattttct

SEQ ID NO: 1433009 - DNA, 17 bp, Homo sapiens
aatgtctcatgtcaatg

SEQ ID NO: 1433010 - DNA, 23 bp, Homo sapiens
aatgtctcctttgctcttgccaa

SEQ ID NO: 1433011 - DNA, 18 bp, Homo sapiens
aatgtctctgtgagactc

SEQ ID NO: 1433012 - DNA, 13 bp, Homo sapiens
aatgtctgcagct

SEQ ID NO: 1433013 - DNA, 17 bp, Homo sapiens
aatgtctgctggtattt

SEQ ID NO: 1433014 - DNA, 23 bp, Homo sapiens
aatgtctgtttattaactactga

SEQ ID NO: 1433015 - DNA, 17 bp, Homo sapiens
aatgtcttttgaatatt

SEQ ID NO: 1433016 - DNA, 14 bp, Homo sapiens
aatgtgaaaaagga

SEQ ID NO: 1433017 - DNA, 15 bp, Homo sapiens
aatgtgaagacattt

SEQ ID NO: 1433018 - DNA, 23 bp, Homo sapiens
aatgtgaagaggtctgattggct

SEQ ID NO: 1433019 - DNA, 13 bp, Homo sapiens
aatgtgatgttct

SEQ ID NO: 1433020 - DNA, 14 bp, Homo sapiens
aatgtgatgttcta

SEQ ID NO: 1433021 - DNA, 15 bp, Homo sapiens
aatgtgatgttctaa

SEQ ID NO: 1433022 - DNA, 17 bp, Homo sapiens
aatgtgatgttctaagg

SEQ ID NO: 1433023 - DNA, 17 bp, Homo sapiens
aatgtgattactgctct

SEQ ID NO: 1433024 - DNA, 16 bp, Homo sapiens
aatgtgcagaaaatat

SEQ ID NO: 1433025 - DNA, 15 bp, Homo sapiens
aatgtgccttgattg

SEQ ID NO: 1433026 - DNA, 21 bp, Homo sapiens
aatgtgctgaatggttttcaa

SEQ ID NO: 1433027 - DNA, 21 bp, Homo sapiens
aatgtgctggtgaacactgtg

SEQ ID NO: 1433028 - DNA, 19 bp, Homo sapiens
aatgtggatttgattcatt

SEQ ID NO: 1433029 - DNA, 16 bp, Homo sapiens
aatgtggctgaagttg

SEQ ID NO: 1433030 - DNA, 19 bp, Homo sapiens
aatgtgggtagtcattctt

SEQ ID NO: 1433031 - DNA, 21 bp, Homo sapiens
aatgtgtaagaacaactacct

SEQ ID NO: 1433032 - DNA, 16 bp, Homo sapiens
aatgtgtacagtgaat

SEQ ID NO: 1433033 - DNA, 19 bp, Homo sapiens
aatgtgtatcggatgcttt

SEQ ID NO: 1433034 - DNA, 20 bp, Homo sapiens
aatgtgtcagaataggaaaa

SEQ ID NO: 1433035 - DNA, 23 bp, Homo sapiens
aatgtgtcctatctatcttccaa

SEQ ID NO: 1433036 - DNA, 12 bp, Homo sapiens
aatgtgttctcg

SEQ ID NO: 1433037 - DNA, 22 bp, Homo sapiens
aatgtgttctcggagtgtgtat

SEQ ID NO: 1433038 - DNA, 22 bp, Homo sapiens
aatgtgttcttttctcctttac

SEQ ID NO: 1433039 - DNA, 17 bp, Homo sapiens
aatgtgtttttctatat

SEQ ID NO: 1433040 - DNA, 14 bp, Homo sapiens
aatgttaaagtcag

SEQ ID NO: 1433041 - DNA, 23 bp, Homo sapiens
aatgttaattcagcactgatttc

SEQ ID NO: 1433042 - DNA, 19 bp, Homo sapiens
aatgttacctaattattac

SEQ ID NO: 1433043 - DNA, 16 bp, Homo sapiens
aatgttacctctgaat

SEQ ID NO: 1433044 - DNA, 23 bp, Homo sapiens
aatgttactcagatataagagaa

SEQ ID NO: 1433045 - DNA, 17 bp, Homo sapiens
aatgttagaggttttaa

SEQ ID NO: 1433046 - DNA, 22 bp, Homo sapiens
aatgttagaggttttaaagtga

SEQ ID NO: 1433047 - DNA, 16 bp, Homo sapiens
aatgttatatcatcaa

SEQ ID NO: 1433048 - DNA, 17 bp, Homo sapiens
aatgttatcttctcaag

SEQ ID NO: 1433049 - DNA, 20 bp, Homo sapiens
aatgttattttttaattatt

SEQ ID NO: 1433050 - DNA, 23 bp, Homo sapiens
aatgttcatatttattgattaaa

SEQ ID NO: 1433051 - DNA, 18 bp, Homo sapiens
aatgttccctgcaccctg

SEQ ID NO: 1433052 - DNA, 20 bp, Homo sapiens
aatgttccttttttgtatat

SEQ ID NO: 1433053 - DNA, 16 bp, Homo sapiens
aatgttctaagtttct

SEQ ID NO: 1433054 - DNA, 17 bp, Homo sapiens
aatgttgaacaaaataa

SEQ ID NO: 1433055 - DNA, 21 bp, Homo sapiens
aatgttgaacaaaataaattg

SEQ ID NO: 1433056 - DNA, 13 bp, Homo sapiens
aatgttgagaagt

SEQ ID NO: 1433057 - DNA, 14 bp, Homo sapiens
aatgttgagaagtt

SEQ ID NO: 1433058 - DNA, 23 bp, Homo sapiens
aatgttgctttaacctgaacctt

SEQ ID NO: 1433059 - DNA, 21 bp, Homo sapiens
aatgttggaactctgtgcagg

SEQ ID NO: 1433060 - DNA, 21 bp, Homo sapiens
aatgttggacacctttaggtt

SEQ ID NO: 1433061 - DNA, 13 bp, Homo sapiens
aatgttgggaaag

SEQ ID NO: 1433062 - DNA, 14 bp, Homo sapiens
aatgttggtttttt

SEQ ID NO: 1433063 - DNA, 20 bp, Homo sapiens
aatgttggttttttataaag

SEQ ID NO: 1433064 - DNA, 12 bp, Homo sapiens
aatgttgtgaat

SEQ ID NO: 1433065 - DNA, 17 bp, Homo sapiens
aatgttgtgaataatta

SEQ ID NO: 1433066 - DNA, 18 bp, Homo sapiens
aatgtttacaagtaaata

SEQ ID NO: 1433067 - DNA, 20 bp, Homo sapiens
aatgtttacactctttgtaa

SEQ ID NO: 1433068 - DNA, 13 bp, Homo sapiens
aatgtttactgta

SEQ ID NO: 1433069 - DNA, 14 bp, Homo sapiens
aatgtttactgtaa

SEQ ID NO: 1433070 - DNA, 17 bp, Homo sapiens
aatgtttactgtaaatt

SEQ ID NO: 1433071 - DNA, 16 bp, Homo sapiens
aatgtttatgagccag

SEQ ID NO: 1433072 - DNA, 18 bp, Homo sapiens
aatgtttatgagccagac

SEQ ID NO: 1433073 - DNA, 14 bp, Homo sapiens
aatgtttccactgg

SEQ ID NO: 1433074 - DNA, 12 bp, Homo sapiens
aatgtttccttt

SEQ ID NO: 1433075 - DNA, 13 bp, Homo sapiens
aatgtttccttta

SEQ ID NO: 1433076 - DNA, 20 bp, Homo sapiens
aatgtttcttcatttctctg

SEQ ID NO: 1433077 - DNA, 22 bp, Homo sapiens
aatgtttcttctaggttctaaa

SEQ ID NO: 1433078 - DNA, 17 bp, Homo sapiens
aatgtttcttttgtttg

SEQ ID NO: 1433079 - DNA, 21 bp, Homo sapiens
aatgtttcttttgtttggtaa

SEQ ID NO: 1433080 - DNA, 21 bp, Homo sapiens
aatgtttgggatattaaaaca

SEQ ID NO: 1433081 - DNA, 22 bp, Homo sapiens
aatgtttgggatattaaaacac

SEQ ID NO: 1433082 - DNA, 15 bp, Homo sapiens
aatgtttgttattta

SEQ ID NO: 1433083 - DNA, 21 bp, Homo sapiens
aatgtttgttatttacactgg

SEQ ID NO: 1433084 - DNA, 20 bp, Homo sapiens
aatgttttactgtgaaactg

SEQ ID NO: 1433085 - DNA, 12 bp, Homo sapiens
aatgttttgaca

SEQ ID NO: 1433086 - DNA, 13 bp, Homo sapiens
ccctagccctggt

SEQ ID NO: 1433087 - DNA, 20 bp, Homo sapiens
ccctagctccacaccctctc

SEQ ID NO: 1433088 - DNA, 14 bp, Homo sapiens
ccctagctgtccca

SEQ ID NO: 1433089 - DNA, 14 bp, Homo sapiens
ccctaggagaccaa

SEQ ID NO: 1433090 - DNA, 18 bp, Homo sapiens
ccctaggatgctgcagca

SEQ ID NO: 1433091 - DNA, 14 bp, Homo sapiens
ccctaggggacact

SEQ ID NO: 1433092 - DNA, 19 bp, Homo sapiens
ccctaggggacacttccct

SEQ ID NO: 1433093 - DNA, 19 bp, Homo sapiens
ccctaggtgcccagggcca

SEQ ID NO: 1433094 - DNA, 22 bp, Homo sapiens
ccctagtcccttcccctccctg

SEQ ID NO: 1433095 - DNA, 18 bp, Homo sapiens
ccctatccacccagccca

SEQ ID NO: 1433096 - DNA, 14 bp, Homo sapiens
ccctatgggcctgc

SEQ ID NO: 1433097 - DNA, 15 bp, Homo sapiens
ccctatttattgact

SEQ ID NO: 1433098 - DNA, 18 bp, Homo sapiens
ccctcaaaaaaagccttt

SEQ ID NO: 1433099 - DNA, 20 bp, Homo sapiens
ccctcaaacctcctcttctg

SEQ ID NO: 1433100 - DNA, 20 bp, Homo sapiens
ccctcaaagaagtcggaatg

SEQ ID NO: 1433101 - DNA, 20 bp, Homo sapiens
ccctcaactgagggccaggg

SEQ ID NO: 1433102 - DNA, 22 bp, Homo sapiens
ccctcaaggacaaagtctccag

SEQ ID NO: 1433103 - DNA, 13 bp, Homo sapiens
ccctcacccatcc

SEQ ID NO: 1433104 - DNA, 17 bp, Homo sapiens
ccctcacccatcctaga

SEQ ID NO: 1433105 - DNA, 21 bp, Homo sapiens
ccctcacccccaggtgttgcc

SEQ ID NO: 1433106 - DNA, 13 bp, Homo sapiens
ccctcacccctgg

SEQ ID NO: 1433107 - DNA, 13 bp, Homo sapiens
ccctcaccctgcc

SEQ ID NO: 1433108 - DNA, 17 bp, Homo sapiens
ccctcacctctgaggac

SEQ ID NO: 1433109 - DNA, 16 bp, Homo sapiens
ccctcaccttctgagt

SEQ ID NO: 1433110 - DNA, 20 bp, Homo sapiens
ccctcaccttggcaccagac

SEQ ID NO: 1433111 - DNA, 22 bp, Homo sapiens
ccctcactcaagaccaggctgc

SEQ ID NO: 1433112 - DNA, 12 bp, Homo sapiens
ccctcactcccc

SEQ ID NO: 1433113 - DNA, 13 bp, Homo sapiens
ccctcactcccca

SEQ ID NO: 1433114 - DNA, 22 bp, Homo sapiens
ccctcactcttgaagtccagga

SEQ ID NO: 1433115 - DNA, 22 bp, Homo sapiens
ccctcagagacaccaaactgcc

SEQ ID NO: 1433116 - DNA, 23 bp, Homo sapiens
ccctcagagacaccaaactgcca

SEQ ID NO: 1433117 - DNA, 18 bp, Homo sapiens
ccctcagcaccccttcca

SEQ ID NO: 1433118 - DNA, 19 bp, Homo sapiens
ccctcagccacacccaggc

SEQ ID NO: 1433119 - DNA, 20 bp, Homo sapiens
ccctcagcctgtaccggttt

SEQ ID NO: 1433120 - DNA, 16 bp, Homo sapiens
ccctcagctctctggg

SEQ ID NO: 1433121 - DNA, 21 bp, Homo sapiens
ccctcaggaattcagtgcctt

SEQ ID NO: 1433122 - DNA, 19 bp, Homo sapiens
ccctcaggcataggcctgg

SEQ ID NO: 1433123 - DNA, 22 bp, Homo sapiens
ccctcaggcataggcctgggtg

SEQ ID NO: 1433124 - DNA, 17 bp, Homo sapiens
ccctcatctctctgccc

SEQ ID NO: 1433125 - DNA, 15 bp, Homo sapiens
ccctcatggccccca

SEQ ID NO: 1433126 - DNA, 16 bp, Homo sapiens
ccctcattcaggaaaa

SEQ ID NO: 1433127 - DNA, 17 bp, Homo sapiens
ccctcatttctgccagc

SEQ ID NO: 1433128 - DNA, 15 bp, Homo sapiens
ccctccaaacctcca

SEQ ID NO: 1433129 - DNA, 16 bp, Homo sapiens
ccctccaaacctccag

SEQ ID NO: 1433130 - DNA, 19 bp, Homo sapiens
ccctccaaacctccagcct

SEQ ID NO: 1433131 - DNA, 12 bp, Homo sapiens
ccctccaaagag

SEQ ID NO: 1433132 - DNA, 16 bp, Homo sapiens
ccctccacagccgcag

SEQ ID NO: 1433133 - DNA, 16 bp, Homo sapiens
ccctccacagctgcag

SEQ ID NO: 1433134 - DNA, 19 bp, Homo sapiens
ccctccacagctgcagctg

SEQ ID NO: 1433135 - DNA, 11 bp, Homo sapiens
ccctccaccag

SEQ ID NO: 1433136 - DNA, 13 bp, Homo sapiens
ccctccaccagcc

SEQ ID NO: 1433137 - DNA, 14 bp, Homo sapiens
ccctccaccccaca

SEQ ID NO: 1433138 - DNA, 15 bp, Homo sapiens
ccctccaccccacag

SEQ ID NO: 1433139 - DNA, 16 bp, Homo sapiens
ccctccaccccacaga

SEQ ID NO: 1433140 - DNA, 12 bp, Homo sapiens
ccctccaccctg

SEQ ID NO: 1433141 - DNA, 15 bp, Homo sapiens
ccctccaccttccat

SEQ ID NO: 1433142 - DNA, 18 bp, Homo sapiens
ccctccactcctcatccc

SEQ ID NO: 1433143 - DNA, 19 bp, Homo sapiens
ccctccagaacacggctca

SEQ ID NO: 1433144 - DNA, 18 bp, Homo sapiens
ccctccagaaccaccccg

SEQ ID NO: 1433145 - DNA, 15 bp, Homo sapiens
ccctccagaccctgc

SEQ ID NO: 1433146 - DNA, 12 bp, Homo sapiens
ccctccagctca

SEQ ID NO: 1433147 - DNA, 20 bp, Homo sapiens
ccctccagctcatgacactg

SEQ ID NO: 1433148 - DNA, 11 bp, Homo sapiens
ccctccaggaa

SEQ ID NO: 1433149 - DNA, 19 bp, Homo sapiens
ccctccaggagagagccag

SEQ ID NO: 1433150 - DNA, 23 bp, Homo sapiens
ccctccaggagagagccaggatg

SEQ ID NO: 1433151 - DNA, 17 bp, Homo sapiens
ccctccaggcccatctc

SEQ ID NO: 1433152 - DNA, 18 bp, Homo sapiens
ccctccagtgctggattt

SEQ ID NO: 1433153 - DNA, 12 bp, Homo sapiens
ccctccatccca

SEQ ID NO: 1433154 - DNA, 16 bp, Homo sapiens
ccctccatcccagaca

SEQ ID NO: 1433155 - DNA, 13 bp, Homo sapiens
ccctccatgggct

SEQ ID NO: 1433156 - DNA, 13 bp, Homo sapiens
ccctcccaacagc

SEQ ID NO: 1433157 - DNA, 12 bp, Homo sapiens
ccctcccacaca

SEQ ID NO: 1433158 - DNA, 15 bp, Homo sapiens
ccctcccacagcctc

SEQ ID NO: 1433159 - DNA, 12 bp, Homo sapiens
ccctcccacccc

SEQ ID NO: 1433160 - DNA, 13 bp, Homo sapiens
ccctcccacgcct

SEQ ID NO: 1433161 - DNA, 23 bp, Homo sapiens
ccctcccaggggagccagctgct

SEQ ID NO: 1433162 - DNA, 16 bp, Homo sapiens
ccctcccatctgggag

SEQ ID NO: 1433163 - DNA, 14 bp, Homo sapiens
ccctccccaaagcc

SEQ ID NO: 1433164 - DNA, 23 bp, Homo sapiens
ccctccccaaagccactggaagg

SEQ ID NO: 1433165 - DNA, 14 bp, Homo sapiens
ccctccccatggag

SEQ ID NO: 1433166 - DNA, 15 bp, Homo sapiens
ccctcccccagcaga

SEQ ID NO: 1433167 - DNA, 18 bp, Homo sapiens
ccctcccccattccctcc

SEQ ID NO: 1433168 - DNA, 15 bp, Homo sapiens
ccctcccccccatgc

SEQ ID NO: 1433169 - DNA, 14 bp, Homo sapiens
ccctccccctcctg

SEQ ID NO: 1433170 - DNA, 17 bp, Homo sapiens
ccctccccgcccttttt

SEQ ID NO: 1433171 - DNA, 22 bp, Homo sapiens
ccctccccggccctaccagcgc

SEQ ID NO: 1433172 - DNA, 13 bp, Homo sapiens
ccctcccctgccc

SEQ ID NO: 1433173 - DNA, 14 bp, Homo sapiens
ccctcccctgccct

SEQ ID NO: 1433174 - DNA, 16 bp, Homo sapiens
ccctcccctgccctag

SEQ ID NO: 1433175 - DNA, 14 bp, Homo sapiens
ccctcccctgctcc

SEQ ID NO: 1433176 - DNA, 20 bp, Homo sapiens
ccctcccctgctcccaggtt

SEQ ID NO: 1433177 - DNA, 15 bp, Homo sapiens
ccctccctaccctaa

SEQ ID NO: 1433178 - DNA, 13 bp, Homo sapiens
ccctccctcagag

SEQ ID NO: 1433179 - DNA, 14 bp, Homo sapiens
ccctccctccttcc

SEQ ID NO: 1433180 - DNA, 13 bp, Homo sapiens
ccctccctctgcc

SEQ ID NO: 1433181 - DNA, 15 bp, Homo sapiens
ccctccctctgcccc

SEQ ID NO: 1433182 - DNA, 14 bp, Homo sapiens
ccctccctgcccct

SEQ ID NO: 1433183 - DNA, 13 bp, Homo sapiens
ccctccctgcttg

SEQ ID NO: 1433184 - DNA, 19 bp, Homo sapiens
ccctccctggctgtgagca

SEQ ID NO: 1433185 - DNA, 12 bp, Homo sapiens
ccctccctgggt

SEQ ID NO: 1433186 - DNA, 11 bp, Homo sapiens
ccctccctgtc

SEQ ID NO: 1433187 - DNA, 21 bp, Homo sapiens
ccctcccttggaaacctgccc

SEQ ID NO: 1433188 - DNA, 16 bp, Homo sapiens
ccctccctttctcccc

SEQ ID NO: 1433189 - DNA, 17 bp, Homo sapiens
ccctccgatgctgaggc

SEQ ID NO: 1433190 - DNA, 19 bp, Homo sapiens
ccctccgccctgccactca

SEQ ID NO: 1433191 - DNA, 22 bp, Homo sapiens
ccctccgccttcactccggtgt

SEQ ID NO: 1433192 - DNA, 13 bp, Homo sapiens
ccctccgccttct

SEQ ID NO: 1433193 - DNA, 18 bp, Homo sapiens
ccctccggactggtgccc

SEQ ID NO: 1433194 - DNA, 19 bp, Homo sapiens
ccctccggactggtgccct

SEQ ID NO: 1433195 - DNA, 13 bp, Homo sapiens
ccctcctcacccc

SEQ ID NO: 1433196 - DNA, 14 bp, Homo sapiens
ccctcctcaccccg

SEQ ID NO: 1433197 - DNA, 12 bp, Homo sapiens
ccctcctcacct

SEQ ID NO: 1433198 - DNA, 16 bp, Homo sapiens
ccctcctcacctctgg

SEQ ID NO: 1433199 - DNA, 21 bp, Homo sapiens
ccctcctcactcccacctgca

SEQ ID NO: 1433200 - DNA, 13 bp, Homo sapiens
ccctcctccactc

SEQ ID NO: 1433201 - DNA, 14 bp, Homo sapiens
ccctcctccactct

SEQ ID NO: 1433202 - DNA, 17 bp, Homo sapiens
ccctcctccagccgctg

SEQ ID NO: 1433203 - DNA, 23 bp, Homo sapiens
ccctcctccagccgctggcaaca

SEQ ID NO: 1433204 - DNA, 16 bp, Homo sapiens
ccctcctcccccagtg

SEQ ID NO: 1433205 - DNA, 22 bp, Homo sapiens
ccctcctcccccggctgggcct

SEQ ID NO: 1433206 - DNA, 23 bp, Homo sapiens
ccctcctcccccggctgggcctc

SEQ ID NO: 1433207 - DNA, 12 bp, Homo sapiens
ccctcctcgggc

SEQ ID NO: 1433208 - DNA, 14 bp, Homo sapiens
ccctcctcgggccg

SEQ ID NO: 1433209 - DNA, 15 bp, Homo sapiens
ccctcctctcccatc

SEQ ID NO: 1433210 - DNA, 20 bp, Homo sapiens
ccctcctctgagcagcctct

SEQ ID NO: 1433211 - DNA, 11 bp, Homo sapiens
ccctcctctgc

SEQ ID NO: 1433212 - DNA, 20 bp, Homo sapiens
ccctcctgcacacagaatgc

SEQ ID NO: 1433213 - DNA, 12 bp, Homo sapiens
ccctcctgctcc

SEQ ID NO: 1433214 - DNA, 14 bp, Homo sapiens
ccctcctgctgtgc

SEQ ID NO: 1433215 - DNA, 21 bp, Homo sapiens
ccctcctggagctctgtgggt

SEQ ID NO: 1433216 - DNA, 13 bp, Homo sapiens
ccctcctgtaaat

SEQ ID NO: 1433217 - DNA, 16 bp, Homo sapiens
ccctccttgggcactt

SEQ ID NO: 1433218 - DNA, 18 bp, Homo sapiens
ccctccttgtgccttctt

SEQ ID NO: 1433219 - DNA, 13 bp, Homo sapiens
ccctcctttccct

SEQ ID NO: 1433220 - DNA, 15 bp, Homo sapiens
ccctcctttccctta

SEQ ID NO: 1433221 - DNA, 22 bp, Homo sapiens
ccctcctttcccttattgcctc

SEQ ID NO: 1433222 - DNA, 13 bp, Homo sapiens
ccctcctttgttt

SEQ ID NO: 1433223 - DNA, 22 bp, Homo sapiens
ccctcgaaccaaggcagcctcc

SEQ ID NO: 1433224 - DNA, 15 bp, Homo sapiens
ccctcgaccctgtgc

SEQ ID NO: 1433225 - DNA, 21 bp, Homo sapiens
ccctcgatcatatttcccctt

SEQ ID NO: 1433226 - DNA, 16 bp, Homo sapiens
ccctcgccctgtgagg

SEQ ID NO: 1433227 - DNA, 13 bp, Homo sapiens
ccctcgctgctgc

SEQ ID NO: 1433228 - DNA, 14 bp, Homo sapiens
ccctcgctgctgct

SEQ ID NO: 1433229 - DNA, 15 bp, Homo sapiens
ccctcgctgcttctg

SEQ ID NO: 1433230 - DNA, 15 bp, Homo sapiens
ccctcgctgtatgat

SEQ ID NO: 1433231 - DNA, 17 bp, Homo sapiens
ccctcggaagccgtctg

SEQ ID NO: 1433232 - DNA, 23 bp, Homo sapiens
ccctcggaagccgtctgactcca

SEQ ID NO: 1433233 - DNA, 14 bp, Homo sapiens
ccctcggacccacc

SEQ ID NO: 1433234 - DNA, 20 bp, Homo sapiens
ccctcggaggtccagctggg

SEQ ID NO: 1433235 - DNA, 13 bp, Homo sapiens
ccctcggctctgg

SEQ ID NO: 1433236 - DNA, 18 bp, Homo sapiens
ccctcgggaagcagccag

SEQ ID NO: 1433237 - DNA, 19 bp, Homo sapiens
ccctcgggaagcagccagc

SEQ ID NO: 1433238 - DNA, 16 bp, Homo sapiens
ccctcgggcccacctg

SEQ ID NO: 1433239 - DNA, 19 bp, Homo sapiens
ccctcggggtgtcagaaat

SEQ ID NO: 1433240 - DNA, 23 bp, Homo sapiens
ccctcgtccacaggggcaggcct

SEQ ID NO: 1433241 - DNA, 24 bp, Homo sapiens
ccctcgtccacaggggcaggcctg

SEQ ID NO: 1433242 - DNA, 18 bp, Homo sapiens
ccctcgtccgtctgtctc

SEQ ID NO: 1433243 - DNA, 14 bp, Homo sapiens
ccctcgtcctgtcc

SEQ ID NO: 1433244 - DNA, 16 bp, Homo sapiens
ccctcgtcctgtccca

SEQ ID NO: 1433245 - DNA, 21 bp, Homo sapiens
ccctcgtcctgtcccagaggt

SEQ ID NO: 1433246 - DNA, 16 bp, Homo sapiens
ccctctaaagcaataa

SEQ ID NO: 1433247 - DNA, 16 bp, Homo sapiens
ccctctaacccagtgg

SEQ ID NO: 1433248 - DNA, 12 bp, Homo sapiens
ccctctatttat

SEQ ID NO: 1433249 - DNA, 13 bp, Homo sapiens
ccctctatttatt

SEQ ID NO: 1433250 - DNA, 20 bp, Homo sapiens
ccctctatttattagccaac

SEQ ID NO: 1433251 - DNA, 21 bp, Homo sapiens
ccctctcactccccagcccca

SEQ ID NO: 1433252 - DNA, 14 bp, Homo sapiens
ccctctcagaacat

SEQ ID NO: 1433253 - DNA, 17 bp, Homo sapiens
ccctctcagaggcctgc

SEQ ID NO: 1433254 - DNA, 13 bp, Homo sapiens
ccctctcagctcc

SEQ ID NO: 1433255 - DNA, 17 bp, Homo sapiens
ccctctcagtgccttct

SEQ ID NO: 1433256 - DNA, 16 bp, Homo sapiens
ccctctcatctcaggt

SEQ ID NO: 1433257 - DNA, 20 bp, Homo sapiens
ccctctcatctcaggtagaa

SEQ ID NO: 1433258 - DNA, 17 bp, Homo sapiens
ccctctccctctctctg

SEQ ID NO: 1433259 - DNA, 19 bp, Homo sapiens
ccctctcctatgtggcagc

SEQ ID NO: 1433260 - DNA, 23 bp, Homo sapiens
ccctctcctatgtggcagctggg

SEQ ID NO: 1433261 - DNA, 11 bp, Homo sapiens
ccctctcctgc

SEQ ID NO: 1433262 - DNA, 12 bp, Homo sapiens
ccctctcctgcc

SEQ ID NO: 1433263 - DNA, 14 bp, Homo sapiens
ccctctccttcctt

SEQ ID NO: 1433264 - DNA, 11 bp, Homo sapiens
ccctctctctg

SEQ ID NO: 1433265 - DNA, 19 bp, Homo sapiens
ccctctctcttctgctcca

SEQ ID NO: 1433266 - DNA, 12 bp, Homo sapiens
ccctctctgctc

SEQ ID NO: 1433267 - DNA, 15 bp, Homo sapiens
ccctctctgctcctt

SEQ ID NO: 1433268 - DNA, 13 bp, Homo sapiens
ccctctcttgcac

SEQ ID NO: 1433269 - DNA, 16 bp, Homo sapiens
ccctctctttctctgg

SEQ ID NO: 1433270 - DNA, 15 bp, Homo sapiens
ccctctgacctgcac

SEQ ID NO: 1433271 - DNA, 16 bp, Homo sapiens
ccctctgacctgcact

SEQ ID NO: 1433272 - DNA, 17 bp, Homo sapiens
ccctctgacctgcactg

SEQ ID NO: 1433273 - DNA, 19 bp, Homo sapiens
ccctctgacctgcactggg

SEQ ID NO: 1433274 - DNA, 15 bp, Homo sapiens
ccctctgcaaccccc

SEQ ID NO: 1433275 - DNA, 12 bp, Homo sapiens
ccctctgcccag

SEQ ID NO: 1433276 - DNA, 23 bp, Homo sapiens
ccctctgcccagcttgggcccag

SEQ ID NO: 1433277 - DNA, 20 bp, Homo sapiens
ccctctgccccaagcagcca

SEQ ID NO: 1433278 - DNA, 21 bp, Homo sapiens
ccctctgcctgaaccttccat

SEQ ID NO: 1433279 - DNA, 15 bp, Homo sapiens
ccctctgcctgcact

SEQ ID NO: 1433280 - DNA, 20 bp, Homo sapiens
ccctctgccttcaggcttct

SEQ ID NO: 1433281 - DNA, 14 bp, Homo sapiens
ccctctgctctgcc

SEQ ID NO: 1433282 - DNA, 18 bp, Homo sapiens
ccctctgctctgcctgga

SEQ ID NO: 1433283 - DNA, 14 bp, Homo sapiens
ccctctgctgccgg

SEQ ID NO: 1433284 - DNA, 13 bp, Homo sapiens
ccctctggccctg

SEQ ID NO: 1433285 - DNA, 18 bp, Homo sapiens
ccctctgggcctgttctc

SEQ ID NO: 1433286 - DNA, 19 bp, Homo sapiens
ccctctgggcctgttctct

SEQ ID NO: 1433287 - DNA, 13 bp, Homo sapiens
ccctctgtagctc

SEQ ID NO: 1433288 - DNA, 14 bp, Homo sapiens
ccctctgtagctcc

SEQ ID NO: 1433289 - DNA, 20 bp, Homo sapiens
ccctctgtagctccctcctc

SEQ ID NO: 1433290 - DNA, 22 bp, Homo sapiens
ccctctgtcatcactccctgga

SEQ ID NO: 1433291 - DNA, 13 bp, Homo sapiens
ccctctgtccaca

SEQ ID NO: 1433292 - DNA, 14 bp, Homo sapiens
ccctctgtctagga

SEQ ID NO: 1433293 - DNA, 22 bp, Homo sapiens
ccctctgtgcttcgactactgc

SEQ ID NO: 1433294 - DNA, 19 bp, Homo sapiens
ccctcttccctctccctct

SEQ ID NO: 1433295 - DNA, 17 bp, Homo sapiens
ccctcttgcgggcctgg

SEQ ID NO: 1433296 - DNA, 12 bp, Homo sapiens
ccctcttgtaag

SEQ ID NO: 1433297 - DNA, 20 bp, Homo sapiens
ccctcttgtccctttcccta

SEQ ID NO: 1433298 - DNA, 16 bp, Homo sapiens
ccctctttccctgcga

SEQ ID NO: 1433299 - DNA, 18 bp, Homo sapiens
ccctctttccctgcgaga

SEQ ID NO: 1433300 - DNA, 18 bp, Homo sapiens
ccctctttcgtctactgc

SEQ ID NO: 1433301 - DNA, 19 bp, Homo sapiens
ccctctttcgtctactgca

SEQ ID NO: 1433302 - DNA, 23 bp, Homo sapiens
ccctctttcttgtttgtcagcat

SEQ ID NO: 1433303 - DNA, 15 bp, Homo sapiens
ccctctttgctgcag

SEQ ID NO: 1433304 - DNA, 17 bp, Homo sapiens
ccctctttggctcccct

SEQ ID NO: 1433305 - DNA, 20 bp, Homo sapiens
ccctctttggctcccctgta

SEQ ID NO: 1433306 - DNA, 21 bp, Homo sapiens
ccctctttggctcccctgtac

SEQ ID NO: 1433307 - DNA, 14 bp, Homo sapiens
ccctgaaaacccag

SEQ ID NO: 1433308 - DNA, 22 bp, Homo sapiens
ccctgaaaatgtttttctgcca

SEQ ID NO: 1433309 - DNA, 14 bp, Homo sapiens
ccctgaaagcctca

SEQ ID NO: 1433310 - DNA, 20 bp, Homo sapiens
ccctgaaagtgacagagacc

SEQ ID NO: 1433311 - DNA, 15 bp, Homo sapiens
ccctgaacccctggc

SEQ ID NO: 1433312 - DNA, 17 bp, Homo sapiens
ccctgaacccctggcca

SEQ ID NO: 1433313 - DNA, 19 bp, Homo sapiens
ccctgaacgttttcttctt

SEQ ID NO: 1433314 - DNA, 15 bp, Homo sapiens
ccctgaagatttcag

SEQ ID NO: 1433315 - DNA, 20 bp, Homo sapiens
ccctgaatggttccatgcct

SEQ ID NO: 1433316 - DNA, 20 bp, Homo sapiens
ccctgacagtccctcctctc

SEQ ID NO: 1433317 - DNA, 17 bp, Homo sapiens
ccctgacctaccccagc

SEQ ID NO: 1433318 - DNA, 18 bp, Homo sapiens
ccctgacctaccccagcc

SEQ ID NO: 1433319 - DNA, 20 bp, Homo sapiens
ccctgacctaccccagccag

SEQ ID NO: 1433320 - DNA, 17 bp, Homo sapiens
ccctgacctccctctaa

SEQ ID NO: 1433321 - DNA, 19 bp, Homo sapiens
ggccgctgttcacccacag

SEQ ID NO: 1433322 - DNA, 20 bp, Homo sapiens
ggccggacgcaggtgctgcg

SEQ ID NO: 1433323 - DNA, 13 bp, Homo sapiens
ggccggagcccag

SEQ ID NO: 1433324 - DNA, 15 bp, Homo sapiens
ggccggagcccagat

SEQ ID NO: 1433325 - DNA, 12 bp, Homo sapiens
ggccggccctgt

SEQ ID NO: 1433326 - DNA, 14 bp, Homo sapiens
ggccggccctgtgt

SEQ ID NO: 1433327 - DNA, 16 bp, Homo sapiens
ggccggcctggcaccg

SEQ ID NO: 1433328 - DNA, 21 bp, Homo sapiens
ggccggcggggcccacgcacg

SEQ ID NO: 1433329 - DNA, 22 bp, Homo sapiens
ggccggcttcatgccagctact

SEQ ID NO: 1433330 - DNA, 24 bp, Homo sapiens
ggccgggaagttttacagcaaggc

SEQ ID NO: 1433331 - DNA, 17 bp, Homo sapiens
ggccgggcacagtggct

SEQ ID NO: 1433332 - DNA, 15 bp, Homo sapiens
ggccgggctgctgct

SEQ ID NO: 1433333 - DNA, 16 bp, Homo sapiens
ggccggggatggatct

SEQ ID NO: 1433334 - DNA, 17 bp, Homo sapiens
ggccggggtccaggccc

SEQ ID NO: 1433335 - DNA, 15 bp, Homo sapiens
ggccggtgctgggtt

SEQ ID NO: 1433336 - DNA, 17 bp, Homo sapiens
ggccgtaccccaccctc

SEQ ID NO: 1433337 - DNA, 21 bp, Homo sapiens
ggccgtaggggctcctgagtg

SEQ ID NO: 1433338 - DNA, 22 bp, Homo sapiens
ggccgtcctcccgggccctccc

SEQ ID NO: 1433339 - DNA, 13 bp, Homo sapiens
ggccgtctcctcc

SEQ ID NO: 1433340 - DNA, 17 bp, Homo sapiens
ggccgtctcctccctca

SEQ ID NO: 1433341 - DNA, 18 bp, Homo sapiens
ggccgtctcctccctcag

SEQ ID NO: 1433342 - DNA, 24 bp, Homo sapiens
ggccgtgtcccgcggtgctgactg

SEQ ID NO: 1433343 - DNA, 17 bp, Homo sapiens
ggccgttccccttggct

SEQ ID NO: 1433344 - DNA, 17 bp, Homo sapiens
ggcctaaaagtaaacat

SEQ ID NO: 1433345 - DNA, 23 bp, Homo sapiens
ggcctaaataaatgagctgttgg

SEQ ID NO: 1433346 - DNA, 24 bp, Homo sapiens
ggcctactagagtctgaacagctg

SEQ ID NO: 1433347 - DNA, 13 bp, Homo sapiens
ggcctagaccagc

SEQ ID NO: 1433348 - DNA, 22 bp, Homo sapiens
ggcctagcgatctctcctggcc

SEQ ID NO: 1433349 - DNA, 23 bp, Homo sapiens
ggcctagcgatctctcctggcct

SEQ ID NO: 1433350 - DNA, 13 bp, Homo sapiens
ggcctaggattct

SEQ ID NO: 1433351 - DNA, 22 bp, Homo sapiens
ggcctaggcacctccccgctct

SEQ ID NO: 1433352 - DNA, 18 bp, Homo sapiens
ggcctatctggaagccac

SEQ ID NO: 1433353 - DNA, 20 bp, Homo sapiens
ggcctatgcacatatggact

SEQ ID NO: 1433354 - DNA, 19 bp, Homo sapiens
ggcctattatattaaaata

SEQ ID NO: 1433355 - DNA, 16 bp, Homo sapiens
ggcctattccaggaat

SEQ ID NO: 1433356 - DNA, 20 bp, Homo sapiens
ggcctcaaaggcccgctcta

SEQ ID NO: 1433357 - DNA, 22 bp, Homo sapiens
ggcctcaagaacaaacactgca

SEQ ID NO: 1433358 - DNA, 18 bp, Homo sapiens
ggcctcaccgagtggggg

SEQ ID NO: 1433359 - DNA, 20 bp, Homo sapiens
ggcctcactactcgagccca

SEQ ID NO: 1433360 - DNA, 15 bp, Homo sapiens
ggcctcactggctgg

SEQ ID NO: 1433361 - DNA, 19 bp, Homo sapiens
ggcctcagctcaatgcagt

SEQ ID NO: 1433362 - DNA, 10 bp, Homo sapiens
ggcctcaggg

SEQ ID NO: 1433363 - DNA, 18 bp, Homo sapiens
ggcctcagttcccagctc

SEQ ID NO: 1433364 - DNA, 21 bp, Homo sapiens
ggcctcagtttctccatcagc

SEQ ID NO: 1433365 - DNA, 13 bp, Homo sapiens
ggcctcatccctc

SEQ ID NO: 1433366 - DNA, 19 bp, Homo sapiens
tttttggcctgtttgatgt

SEQ ID NO: 1433367 - DNA, 15 bp, Homo sapiens
tttttgggggctttc

SEQ ID NO: 1433368 - DNA, 19 bp, Homo sapiens
tttttgggttaaaagatgg

SEQ ID NO: 1433369 - DNA, 21 bp, Homo sapiens
tttttggttaaaaaaaagaat

SEQ ID NO: 1433370 - DNA, 14 bp, Homo sapiens
tttttgtaaactgt

SEQ ID NO: 1433371 - DNA, 14 bp, Homo sapiens
tttttgtaactaca

SEQ ID NO: 1433372 - DNA, 22 bp, Homo sapiens
tttttgtaataagcaatcaagg

SEQ ID NO: 1433373 - DNA, 11 bp, Homo sapiens
tttttgtacat

SEQ ID NO: 1433374 - DNA, 12 bp, Homo sapiens
tttttgtacatg

SEQ ID NO: 1433375 - DNA, 19 bp, Homo sapiens
tttttgtagagacagggtt

SEQ ID NO: 1433376 - DNA, 18 bp, Homo sapiens
tttttgtataaaatagac

SEQ ID NO: 1433377 - DNA, 22 bp, Homo sapiens
tttttgtatttctctattttca

SEQ ID NO: 1433378 - DNA, 12 bp, Homo sapiens
tttttgtcatca

SEQ ID NO: 1433379 - DNA, 13 bp, Homo sapiens
tttttgtgtatgt

SEQ ID NO: 1433380 - DNA, 14 bp, Homo sapiens
tttttgtgtatgta

SEQ ID NO: 1433381 - DNA, 17 bp, Homo sapiens
tttttgtgtatgtactt

SEQ ID NO: 1433382 - DNA, 17 bp, Homo sapiens
tttttgtgtgtatttgc

SEQ ID NO: 1433383 - DNA, 14 bp, Homo sapiens
tttttgtgttttct

SEQ ID NO: 1433384 - DNA, 14 bp, Homo sapiens
tttttgttggagtg

SEQ ID NO: 1433385 - DNA, 12 bp, Homo sapiens
tttttgtttgca

SEQ ID NO: 1433386 - DNA, 22 bp, Homo sapiens
ttttttaaaaaaagctaaatta

SEQ ID NO: 1433387 - DNA, 12 bp, Homo sapiens
ttttttaaagaa

SEQ ID NO: 1433388 - DNA, 13 bp, Homo sapiens
ttttttaaagaca

SEQ ID NO: 1433389 - DNA, 18 bp, Homo sapiens
ttttttaagttcttatga

SEQ ID NO: 1433390 - DNA, 11 bp, Homo sapiens
ttttttattat

SEQ ID NO: 1433391 - DNA, 17 bp, Homo sapiens
ttttttctgtaatgtaa

SEQ ID NO: 1433392 - DNA, 12 bp, Homo sapiens
ttttttcttaag

SEQ ID NO: 1433393 - DNA, 14 bp, Homo sapiens
ttttttcttttgta

SEQ ID NO: 1433394 - DNA, 12 bp, Homo sapiens
ttttttgaaatg

SEQ ID NO: 1433395 - DNA, 10 bp, Homo sapiens
ttttttgcag

SEQ ID NO: 1433396 - DNA, 13 bp, Homo sapiens
ttttttgggttaa

SEQ ID NO: 1433397 - DNA, 14 bp, Homo sapiens
ttttttgtgtatgt

SEQ ID NO: 1433398 - DNA, 18 bp, Homo sapiens
ttttttgttttacaatgt

SEQ ID NO: 1433399 - DNA, 14 bp, Homo sapiens
tttttttaactggt

SEQ ID NO: 1433400 - DNA, 21 bp, Homo sapiens
tttttttaatagtcattccaa

SEQ ID NO: 1433401 - DNA, 10 bp, Homo sapiens
tttttttcct

SEQ ID NO: 1433402 - DNA, 13 bp, Homo sapiens
tttttttctagct

SEQ ID NO: 1433403 - DNA, 12 bp, Homo sapiens
tttttttctatt

SEQ ID NO: 1433404 - DNA, 12 bp, Homo sapiens
tttttttggatg

SEQ ID NO: 1433405 - DNA, 14 bp, Homo sapiens
ttttttttaaacaa

SEQ ID NO: 1433406 - DNA, 13 bp, Homo sapiens
ttttttttccaaa

SEQ ID NO: 1433407 - DNA, 20 bp, Homo sapiens
ttttgatttgtactgaaaaa

SEQ ID NO: 1433408 - DNA, 21 bp, Homo sapiens
ttttgatttgtactgaaaaat

SEQ ID NO: 1433409 - DNA, 12 bp, Homo sapiens
ttttgcaaaggg

SEQ ID NO: 1433410 - DNA, 17 bp, Homo sapiens
ttttgcaaggtaaaatt

SEQ ID NO: 1433411 - DNA, 17 bp, Homo sapiens
ttttgcaataacttcta

SEQ ID NO: 1433412 - DNA, 22 bp, Homo sapiens
ttttgcaattggaataatcact

SEQ ID NO: 1433413 - DNA, 23 bp, Homo sapiens
ttttgcacagttagttgtgaaag

SEQ ID NO: 1433414 - DNA, 13 bp, Homo sapiens
ttttgcacatttt

SEQ ID NO: 1433415 - DNA, 13 bp, Homo sapiens
ttttgcagaagag

SEQ ID NO: 1433416 - DNA, 21 bp, Homo sapiens
ttttgcagcccagacaaatgt

SEQ ID NO: 1433417 - DNA, 17 bp, Homo sapiens
ttttgcataagattaaa

SEQ ID NO: 1433418 - DNA, 22 bp, Homo sapiens
ttttgcataagattaaaggaag

SEQ ID NO: 1433419 - DNA, 21 bp, Homo sapiens
ttttgcatagttctagtgcag

SEQ ID NO: 1433420 - DNA, 14 bp, Homo sapiens
ttttgccacagctt

SEQ ID NO: 1433421 - DNA, 16 bp, Homo sapiens
ttttgccacagctttt

SEQ ID NO: 1433422 - DNA, 17 bp, Homo sapiens
ttttgccagttttccct

SEQ ID NO: 1433423 - DNA, 19 bp, Homo sapiens
ttttgccagttttccctgg

SEQ ID NO: 1433424 - DNA, 15 bp, Homo sapiens
ttttgccattaaact

SEQ ID NO: 1433425 - DNA, 18 bp, Homo sapiens
ttttgcccttcacagtgt

SEQ ID NO: 1433426 - DNA, 15 bp, Homo sapiens
ttttgcctcttttct

SEQ ID NO: 1433427 - DNA, 14 bp, Homo sapiens
ttttgcctggctgt

SEQ ID NO: 1433428 - DNA, 21 bp, Homo sapiens
ttttgcgtttggtttacttgt

SEQ ID NO: 1433429 - DNA, 19 bp, Homo sapiens
ttttgctaactgggttaaa

SEQ ID NO: 1433430 - DNA, 15 bp, Homo sapiens
ttttgctaactggtt

SEQ ID NO: 1433431 - DNA, 17 bp, Homo sapiens
ttttgctaactggttaa

SEQ ID NO: 1433432 - DNA, 18 bp, Homo sapiens
ttttgctacgattccact

SEQ ID NO: 1433433 - DNA, 16 bp, Homo sapiens
ttttgctataatcatt

SEQ ID NO: 1433434 - DNA, 13 bp, Homo sapiens
ttttgctctaaaa

SEQ ID NO: 1433435 - DNA, 16 bp, Homo sapiens
ttttgctctaaaatat

SEQ ID NO: 1433436 - DNA, 15 bp, Homo sapiens
ttttgctgagttgtt

SEQ ID NO: 1433437 - DNA, 13 bp, Homo sapiens
ttttgctggaata

SEQ ID NO: 1433438 - DNA, 23 bp, Homo sapiens
ttttgctggaattcctaactttt

SEQ ID NO: 1433439 - DNA, 19 bp, Homo sapiens
ttttgctttaattccatga

SEQ ID NO: 1433440 - DNA, 21 bp, Homo sapiens
ttttgctttagagaatgccac

SEQ ID NO: 1433441 - DNA, 17 bp, Homo sapiens
ttttggaaagtcagaat

SEQ ID NO: 1433442 - DNA, 21 bp, Homo sapiens
ttttggaactaaagcaaattt

SEQ ID NO: 1433443 - DNA, 21 bp, Homo sapiens
ttttggagaaatgtcataaat

SEQ ID NO: 1433444 - DNA, 20 bp, Homo sapiens
ttttggagaaggttatcaaa

SEQ ID NO: 1433445 - DNA, 19 bp, Homo sapiens
ttttggcaaaactctactt

SEQ ID NO: 1433446 - DNA, 22 bp, Homo sapiens
ttttggcacttgccattccaaa

SEQ ID NO: 1433447 - DNA, 16 bp, Homo sapiens
ttttggccaaagtgtt

SEQ ID NO: 1433448 - DNA, 16 bp, Homo sapiens
ttttggccatgaaagc

SEQ ID NO: 1433449 - DNA, 16 bp, Homo sapiens
ttttggcctgtttgat

SEQ ID NO: 1433450 - DNA, 15 bp, Homo sapiens
ttttggctagagttt

SEQ ID NO: 1433451 - DNA, 20 bp, Homo sapiens
ttttggctagagtttccact

SEQ ID NO: 1433452 - DNA, 22 bp, Homo sapiens
ttttggctgaaattctcctgga

SEQ ID NO: 1433453 - DNA, 23 bp, Homo sapiens
ttttggggctttcccaggagaaa

SEQ ID NO: 1433454 - DNA, 18 bp, Homo sapiens
ttttggggggtaatcagc

SEQ ID NO: 1433455 - DNA, 21 bp, Homo sapiens
ttttgggtaaaatctgtaatt

SEQ ID NO: 1433456 - DNA, 19 bp, Homo sapiens
ttttgggtgtttttcatgt

SEQ ID NO: 1433457 - DNA, 19 bp, Homo sapiens
ttttggtacttattactgc

SEQ ID NO: 1433458 - DNA, 13 bp, Homo sapiens
ttttggtcaaatt

SEQ ID NO: 1433459 - DNA, 20 bp, Homo sapiens
ttttggttttgttcccctcc

SEQ ID NO: 1433460 - DNA, 12 bp, Homo sapiens
ttttgtaaaaga

SEQ ID NO: 1433461 - DNA, 11 bp, Homo sapiens
ttttgtaaaga

SEQ ID NO: 1433462 - DNA, 17 bp, Homo sapiens
ttttgtaaagaaaaata

SEQ ID NO: 1433463 - DNA, 18 bp, Homo sapiens
ttttgtaaagaaaaatat

SEQ ID NO: 1433464 - DNA, 15 bp, Homo sapiens
ttttgtaaagatgcc

SEQ ID NO: 1433465 - DNA, 13 bp, Homo sapiens
ttttgtaaccata

SEQ ID NO: 1433466 - DNA, 14 bp, Homo sapiens
ttttgtaagacaaa

SEQ ID NO: 1433467 - DNA, 17 bp, Homo sapiens
ttttgtaagacatttcc

SEQ ID NO: 1433468 - DNA, 15 bp, Homo sapiens
ttttgtaagatgctg

SEQ ID NO: 1433469 - DNA, 16 bp, Homo sapiens
ttttgtaataagcaat

SEQ ID NO: 1433470 - DNA, 18 bp, Homo sapiens
ttttgtaattgtgtaaaa

SEQ ID NO: 1433471 - DNA, 11 bp, Homo sapiens
ttttgtacatg

SEQ ID NO: 1433472 - DNA, 14 bp, Homo sapiens
ttttgtacatgtat

SEQ ID NO: 1433473 - DNA, 15 bp, Homo sapiens
ttttgtactgaattt

SEQ ID NO: 1433474 - DNA, 15 bp, Homo sapiens
ttttgtataaaatct

SEQ ID NO: 1433475 - DNA, 17 bp, Homo sapiens
ttttgtataaaatctga

SEQ ID NO: 1433476 - DNA, 18 bp, Homo sapiens
ttttgtatagtaaagtga

SEQ ID NO: 1433477 - DNA, 18 bp, Homo sapiens
ttttgtatattgtaggaa

SEQ ID NO: 1433478 - DNA, 19 bp, Homo sapiens
ttttgtatctacatctttt

SEQ ID NO: 1433479 - DNA, 14 bp, Homo sapiens
ttttgtatgctgaa

SEQ ID NO: 1433480 - DNA, 14 bp, Homo sapiens
ttttgtatgttaaa

SEQ ID NO: 1433481 - DNA, 10 bp, Homo sapiens
ttttgtattt

SEQ ID NO: 1433482 - DNA, 13 bp, Homo sapiens
ttttgtattttaa

SEQ ID NO: 1433483 - DNA, 16 bp, Homo sapiens
ttttgtattttacatg

SEQ ID NO: 1433484 - DNA, 15 bp, Homo sapiens
ttttgtatttttaat

SEQ ID NO: 1433485 - DNA, 16 bp, Homo sapiens
ttttgtcatataagat

SEQ ID NO: 1433486 - DNA, 16 bp, Homo sapiens
ttttgtcccccaactt

SEQ ID NO: 1433487 - DNA, 13 bp, Homo sapiens
ttttgtctgttta

SEQ ID NO: 1433488 - DNA, 17 bp, Homo sapiens
ttttgtcttaagtgttt

SEQ ID NO: 1433489 - DNA, 12 bp, Homo sapiens
ttttgtcttgaa

SEQ ID NO: 1433490 - DNA, 18 bp, Homo sapiens
ttttgtgaagtattcaca

SEQ ID NO: 1433491 - DNA, 19 bp, Homo sapiens
ttttgtgacccctttcact

SEQ ID NO: 1433492 - DNA, 20 bp, Homo sapiens
ttttgtgacccctttcactt

SEQ ID NO: 1433493 - DNA, 12 bp, Homo sapiens
ttttgtgatgaa

SEQ ID NO: 1433494 - DNA, 15 bp, Homo sapiens
ttttgtgctgcttct

SEQ ID NO: 1433495 - DNA, 15 bp, Homo sapiens
ttttgtgtatgtact

SEQ ID NO: 1433496 - DNA, 20 bp, Homo sapiens
ttttgtgtcctccaggagct

SEQ ID NO: 1433497 - DNA, 12 bp, Homo sapiens
ttttgtgtttat

SEQ ID NO: 1433498 - DNA, 15 bp, Homo sapiens
ttttgtgtttctaaa

SEQ ID NO: 1433499 - DNA, 13 bp, Homo sapiens
ttttgttaaagct

SEQ ID NO: 1433500 - DNA, 15 bp, Homo sapiens
ttttgttaactgatt

SEQ ID NO: 1433501 - DNA, 15 bp, Homo sapiens
ttttgttagcaaaga

SEQ ID NO: 1433502 - DNA, 12 bp, Homo sapiens
ttttgttataga

SEQ ID NO: 1433503 - DNA, 16 bp, Homo sapiens
ttttgttatagaatac

SEQ ID NO: 1433504 - DNA, 16 bp, Homo sapiens
ttttgttcaatgttcc

SEQ ID NO: 1433505 - DNA, 14 bp, Homo sapiens
ttttgttcatacat

SEQ ID NO: 1433506 - DNA, 17 bp, Homo sapiens
ttttgttcatacatatt

SEQ ID NO: 1433507 - DNA, 14 bp, Homo sapiens
ttttgttctagact

SEQ ID NO: 1433508 - DNA, 13 bp, Homo sapiens
ttttgttctctgg

SEQ ID NO: 1433509 - DNA, 13 bp, Homo sapiens
ttttgttggcata

SEQ ID NO: 1433510 - DNA, 16 bp, Homo sapiens
ttttgttgttcctcta

SEQ ID NO: 1433511 - DNA, 21 bp, Homo sapiens
ttttgttgttcctctatactt

SEQ ID NO: 1433512 - DNA, 13 bp, Homo sapiens
ttttgtttccttt

SEQ ID NO: 1433513 - DNA, 15 bp, Homo sapiens
ttttgtttgccagga

SEQ ID NO: 1433514 - DNA, 18 bp, Homo sapiens
ttttgtttggagacgttt

SEQ ID NO: 1433515 - DNA, 16 bp, Homo sapiens
ttttgttttaaaactg

SEQ ID NO: 1433516 - DNA, 16 bp, Homo sapiens
ttttgttttaaaatta

SEQ ID NO: 1433517 - DNA, 17 bp, Homo sapiens
ttttgttttttgtaact

SEQ ID NO: 1433518 - DNA, 23 bp, Homo sapiens
tttttaaaaaaaaaaacaaagca

SEQ ID NO: 1433519 - DNA, 13 bp, Homo sapiens
tttttaaaaacaa

SEQ ID NO: 1433520 - DNA, 23 bp, Homo sapiens
tttttaaaacacatgtttttata

SEQ ID NO: 1433521 - DNA, 11 bp, Homo sapiens
tttttaaaagt

SEQ ID NO: 1433522 - DNA, 17 bp, Homo sapiens
tttttaaaatatttatt

SEQ ID NO: 1433523 - DNA, 13 bp, Homo sapiens
tttttaaaattga

SEQ ID NO: 1433524 - DNA, 12 bp, Homo sapiens
tttttaaagaca

SEQ ID NO: 1433525 - DNA, 17 bp, Homo sapiens
tttttaaagacagagtc

SEQ ID NO: 1433526 - DNA, 21 bp, Homo sapiens
tttttaaagccttctggatcc

SEQ ID NO: 1433527 - DNA, 11 bp, Homo sapiens
tttttaaataa

SEQ ID NO: 1433528 - DNA, 17 bp, Homo sapiens
tttttaaataaaagcac

SEQ ID NO: 1433529 - DNA, 19 bp, Homo sapiens
tttttaaataaaagcacaa

SEQ ID NO: 1433530 - DNA, 16 bp, Homo sapiens
tttttaaatattttct

SEQ ID NO: 1433531 - DNA, 14 bp, Homo sapiens
tttttaaatgtgaa

SEQ ID NO: 1433532 - DNA, 14 bp, Homo sapiens
tttttaacagcatg

SEQ ID NO: 1433533 - DNA, 12 bp, Homo sapiens
tttttaactgat

SEQ ID NO: 1433534 - DNA, 14 bp, Homo sapiens
tttttaactggtga

SEQ ID NO: 1433535 - DNA, 15 bp, Homo sapiens
tttttaactggtgaa

SEQ ID NO: 1433536 - DNA, 16 bp, Homo sapiens
tttttaactggtgaag

SEQ ID NO: 1433537 - DNA, 16 bp, Homo sapiens
tttttaagcttcagtt

SEQ ID NO: 1433538 - DNA, 20 bp, Homo sapiens
tttttaataaagacagggtt

SEQ ID NO: 1433539 - DNA, 16 bp, Homo sapiens
tttttaatagcactaa

SEQ ID NO: 1433540 - DNA, 13 bp, Homo sapiens
tttttaatcagtt

SEQ ID NO: 1433541 - DNA, 14 bp, Homo sapiens
tttttaatgtatct

SEQ ID NO: 1433542 - DNA, 16 bp, Homo sapiens
tttttaatttacttgt

SEQ ID NO: 1433543 - DNA, 22 bp, Homo sapiens
tttttaatttgatgaaagctga

SEQ ID NO: 1433544 - DNA, 21 bp, Homo sapiens
tttttacaactatgtaattta

SEQ ID NO: 1433545 - DNA, 17 bp, Homo sapiens
tttttacagcaaaagat

SEQ ID NO: 1433546 - DNA, 15 bp, Homo sapiens
tttttacatattaaa

SEQ ID NO: 1433547 - DNA, 13 bp, Homo sapiens
tttttacatttca

SEQ ID NO: 1433548 - DNA, 16 bp, Homo sapiens
tttttactacagttgt

SEQ ID NO: 1433549 - DNA, 11 bp, Homo sapiens
tttttactgtg

SEQ ID NO: 1433550 - DNA, 13 bp, Homo sapiens
tttttactgtgtt

SEQ ID NO: 1433551 - DNA, 21 bp, Homo sapiens
tttttacttttcacactgtct

SEQ ID NO: 1433552 - DNA, 12 bp, Homo sapiens
tttttagaaagc

SEQ ID NO: 1433553 - DNA, 15 bp, Homo sapiens
tttttaggacatctt

SEQ ID NO: 1433554 - DNA, 18 bp, Homo sapiens
tttttataaaatggctgt

SEQ ID NO: 1433555 - DNA, 13 bp, Homo sapiens
tttttataaagtc

SEQ ID NO: 1433556 - DNA, 18 bp, Homo sapiens
tttttataatgttattca

SEQ ID NO: 1433557 - DNA, 23 bp, Homo sapiens
tttttataattgtacaaaattaa

SEQ ID NO: 1433558 - DNA, 20 bp, Homo sapiens
tttttatacaaacctaccaa

SEQ ID NO: 1433559 - DNA, 23 bp, Homo sapiens
tttttatacggaaaaaattgtat

SEQ ID NO: 1433560 - DNA, 13 bp, Homo sapiens
tttttataggttt

SEQ ID NO: 1433561 - DNA, 17 bp, Homo sapiens
tttttatatatatgcat

SEQ ID NO: 1433562 - DNA, 15 bp, Homo sapiens
tttttatatttcctt

SEQ ID NO: 1433563 - DNA, 14 bp, Homo sapiens
tttttatctttata

SEQ ID NO: 1433564 - DNA, 16 bp, Homo sapiens
tttttatgctatttct

SEQ ID NO: 1433565 - DNA, 10 bp, Homo sapiens
tttttatgta

SEQ ID NO: 1433566 - DNA, 12 bp, Homo sapiens
tttttatgtgat

SEQ ID NO: 1433567 - DNA, 16 bp, Homo sapiens
tttttatgtgctatgc

SEQ ID NO: 1433568 - DNA, 23 bp, Homo sapiens
tttttattaattttagtttttca

SEQ ID NO: 1433569 - DNA, 15 bp, Homo sapiens
tttttattatgcatt

SEQ ID NO: 1433570 - DNA, 17 bp, Homo sapiens
tttttattcatgtgaag

SEQ ID NO: 1433571 - DNA, 13 bp, Homo sapiens
tttttatttaaat

SEQ ID NO: 1433572 - DNA, 13 bp, Homo sapiens
tttttatttatat

SEQ ID NO: 1433573 - DNA, 18 bp, Homo sapiens
tttttatttatatgtact

SEQ ID NO: 1433574 - DNA, 21 bp, Homo sapiens
tttttcaaaatccaaaaagaa

SEQ ID NO: 1433575 - DNA, 21 bp, Homo sapiens
tttttcaagttgtaaataatt

SEQ ID NO: 1433576 - DNA, 12 bp, Homo sapiens
tttttcaatata

SEQ ID NO: 1433577 - DNA, 16 bp, Homo sapiens
tttttcaatatattga

SEQ ID NO: 1433578 - DNA, 15 bp, Homo sapiens
tttttcactttgaaa

SEQ ID NO: 1433579 - DNA, 14 bp, Homo sapiens
tttttcatctgaaa

SEQ ID NO: 1433580 - DNA, 20 bp, Homo sapiens
tttttcatcttttattttgg

SEQ ID NO: 1433581 - DNA, 12 bp, Homo sapiens
tttttcatgttt

SEQ ID NO: 1433582 - DNA, 13 bp, Homo sapiens
tttttcatgtttt

SEQ ID NO: 1433583 - DNA, 15 bp, Homo sapiens
tttttcatgttttag

SEQ ID NO: 1433584 - DNA, 21 bp, Homo sapiens
tttttccaactactaatagaa

SEQ ID NO: 1433585 - DNA, 23 bp, Homo sapiens
tttttccaactactaatagaata

SEQ ID NO: 1433586 - DNA, 21 bp, Homo sapiens
tttttccacaaggaataaatg

SEQ ID NO: 1433587 - DNA, 15 bp, Homo sapiens
tttttcccatttaga

SEQ ID NO: 1433588 - DNA, 16 bp, Homo sapiens
tttttcccatttagaa

SEQ ID NO: 1433589 - DNA, 10 bp, Homo sapiens
tttttccctt

SEQ ID NO: 1433590 - DNA, 18 bp, Homo sapiens
tttttcctcatgtaacat

SEQ ID NO: 1433591 - DNA, 12 bp, Homo sapiens
tttttcctctgt

SEQ ID NO: 1433592 - DNA, 18 bp, Homo sapiens
tttttcctgcatgttctg

SEQ ID NO: 1433593 - DNA, 14 bp, Homo sapiens
tttttcctggaatt

SEQ ID NO: 1433594 - DNA, 18 bp, Homo sapiens
tttttcctttaactgaca

SEQ ID NO: 1433595 - DNA, 13 bp, Homo sapiens
tttttcgtgtttt

SEQ ID NO: 1433596 - DNA, 16 bp, Homo sapiens
tttttctataaatcag

SEQ ID NO: 1433597 - DNA, 17 bp, Homo sapiens
tttttctgataaaagat

SEQ ID NO: 1433598 - DNA, 16 bp, Homo sapiens
tttttctgcctgagat

SEQ ID NO: 1433599 - DNA, 23 bp, Homo sapiens
tttttctgcctgagattctttaa

SEQ ID NO: 1433600 - DNA, 16 bp, Homo sapiens
tttttctgtaatgtaa

SEQ ID NO: 1433601 - DNA, 20 bp, Homo sapiens
tttttctgtaatgtaaataa

SEQ ID NO: 1433602 - DNA, 14 bp, Homo sapiens
tttttctgtaccag

SEQ ID NO: 1433603 - DNA, 11 bp, Homo sapiens
tttttctgtgg

SEQ ID NO: 1433604 - DNA, 12 bp, Homo sapiens
tttttcttaaaa

SEQ ID NO: 1433605 - DNA, 22 bp, Homo sapiens
tttttcttaaggcatactagta

SEQ ID NO: 1433606 - DNA, 14 bp, Homo sapiens
tttttcttaccaaa

SEQ ID NO: 1433607 - DNA, 11 bp, Homo sapiens
tttttcttctg

SEQ ID NO: 1433608 - DNA, 13 bp, Homo sapiens
tttttcttgtaat

SEQ ID NO: 1433609 - DNA, 13 bp, Homo sapiens
tttttctttataa

SEQ ID NO: 1433610 - DNA, 13 bp, Homo sapiens
tttttcttttgta

SEQ ID NO: 1433611 - DNA, 23 bp, Homo sapiens
tttttctttttaaccctaatctt

SEQ ID NO: 1433612 - DNA, 19 bp, Homo sapiens
tttttgaaaattatgcaaa

SEQ ID NO: 1433613 - DNA, 21 bp, Homo sapiens
tttttgaaggctttagttctg

SEQ ID NO: 1433614 - DNA, 23 bp, Homo sapiens
tttttgaagtaaattaaacattt

SEQ ID NO: 1433615 - DNA, 21 bp, Homo sapiens
tttttgaatttaaataaagtt

SEQ ID NO: 1433616 - DNA, 13 bp, Homo sapiens
tttttgacactga

SEQ ID NO: 1433617 - DNA, 19 bp, Homo sapiens
tttttgacactgaaagttt

SEQ ID NO: 1433618 - DNA, 23 bp, Homo sapiens
tttttgactttttttgtatgtgt

SEQ ID NO: 1433619 - DNA, 14 bp, Homo sapiens
tttttgagtactgt

SEQ ID NO: 1433620 - DNA, 15 bp, Homo sapiens
tttttgagtgacagc

SEQ ID NO: 1433621 - DNA, 15 bp, Homo sapiens
tttttgataaagcct

SEQ ID NO: 1433622 - DNA, 16 bp, Homo sapiens
tttttgatcaaaaact

SEQ ID NO: 1433623 - DNA, 13 bp, Homo sapiens
tttttgcatgaaa

SEQ ID NO: 1433624 - DNA, 21 bp, Homo sapiens
tttttgcatgatatcttcaag

SEQ ID NO: 1433625 - DNA, 19 bp, Homo sapiens
tttttgcatgcatgcaaat

SEQ ID NO: 1433626 - DNA, 17 bp, Homo sapiens
tttttgcatttaaaaca

SEQ ID NO: 1433627 - DNA, 21 bp, Homo sapiens
tttttgccagttttccctgga

SEQ ID NO: 1433628 - DNA, 11 bp, Homo sapiens
tttttgctata

SEQ ID NO: 1433629 - DNA, 14 bp, Homo sapiens
tttttgctctaaaa

SEQ ID NO: 1433630 - DNA, 18 bp, Homo sapiens
tttttggacttcaaagca

SEQ ID NO: 1433631 - DNA, 17 bp, Homo sapiens
tttttggagacagggtc

SEQ ID NO: 1433632 - DNA, 14 bp, Homo sapiens
ttttcatgaatgtg

SEQ ID NO: 1433633 - DNA, 18 bp, Homo sapiens
ttttcatgaatgtgctgg

SEQ ID NO: 1433634 - DNA, 16 bp, Homo sapiens
ttttcatgctccacta

SEQ ID NO: 1433635 - DNA, 13 bp, Homo sapiens
ttttcatggaagt

SEQ ID NO: 1433636 - DNA, 19 bp, Homo sapiens
ttttcatggaagtggcagt

SEQ ID NO: 1433637 - DNA, 20 bp, Homo sapiens
ttttcatggcccttcaaatt

SEQ ID NO: 1433638 - DNA, 12 bp, Homo sapiens
ttttcatgtttt

SEQ ID NO: 1433639 - DNA, 14 bp, Homo sapiens
ttttcattaaactt

SEQ ID NO: 1433640 - DNA, 17 bp, Homo sapiens
ttttcattaaacttgaa

SEQ ID NO: 1433641 - DNA, 22 bp, Homo sapiens
ttttcattaaataaatttgact

SEQ ID NO: 1433642 - DNA, 17 bp, Homo sapiens
ttttcattcctaaagaa

SEQ ID NO: 1433643 - DNA, 13 bp, Homo sapiens
ttttcatttatct

SEQ ID NO: 1433644 - DNA, 23 bp, Homo sapiens
ttttcatttgttttgcttttgtt

SEQ ID NO: 1433645 - DNA, 18 bp, Homo sapiens
ttttccaaataaacattt

SEQ ID NO: 1433646 - DNA, 12 bp, Homo sapiens
tttgttaaagct

SEQ ID NO: 1433647 - DNA, 19 bp, Homo sapiens
tttgttaaattcagtaatg

SEQ ID NO: 1433648 - DNA, 16 bp, Homo sapiens
tttgttacttccttat

SEQ ID NO: 1433649 - DNA, 23 bp, Homo sapiens
tttgttatagatttagctattta

SEQ ID NO: 1433650 - DNA, 15 bp, Homo sapiens
tttgttatttacact

SEQ ID NO: 1433651 - DNA, 17 bp, Homo sapiens
tttgttatttacactgg

SEQ ID NO: 1433652 - DNA, 17 bp, Homo sapiens
tttgttcactgaaggtg

SEQ ID NO: 1433653 - DNA, 13 bp, Homo sapiens
tttgttcatacat

SEQ ID NO: 1433654 - DNA, 12 bp, Homo sapiens
tttgttcccctc

SEQ ID NO: 1433655 - DNA, 18 bp, Homo sapiens
tttgttcccctcctccac

SEQ ID NO: 1433656 - DNA, 13 bp, Homo sapiens
tttgttctagact

SEQ ID NO: 1433657 - DNA, 21 bp, Homo sapiens
tttgttctagacttccccatc

SEQ ID NO: 1433658 - DNA, 13 bp, Homo sapiens
tttgttctctggg

SEQ ID NO: 1433659 - DNA, 22 bp, Homo sapiens
tttgttgaaaatggtttcaagt

SEQ ID NO: 1433660 - DNA, 15 bp, Homo sapiens
tttgttgaactgtta

SEQ ID NO: 1433661 - DNA, 20 bp, Homo sapiens
tttgttgacagcaaaatgtt

SEQ ID NO: 1433662 - DNA, 16 bp, Homo sapiens
tttgttgcaagatgtg

SEQ ID NO: 1433663 - DNA, 14 bp, Homo sapiens
tttgttgccccaga

SEQ ID NO: 1433664 - DNA, 15 bp, Homo sapiens
tttgttgtctacatt

SEQ ID NO: 1433665 - DNA, 14 bp, Homo sapiens
tttgttgttcctct

SEQ ID NO: 1433666 - DNA, 18 bp, Homo sapiens
tttgtttaaagaataaag

SEQ ID NO: 1433667 - DNA, 15 bp, Homo sapiens
tttgtttataatgtt

SEQ ID NO: 1433668 - DNA, 17 bp, Homo sapiens
ttttagaaatattcaca

SEQ ID NO: 1433669 - DNA, 14 bp, Homo sapiens
ttttagaaatgcat

SEQ ID NO: 1433670 - DNA, 22 bp, Homo sapiens
ttttagaaatgcatatttgcca

SEQ ID NO: 1433671 - DNA, 20 bp, Homo sapiens
ttttagagaatgtgtttcaa

SEQ ID NO: 1433672 - DNA, 22 bp, Homo sapiens
ttttagattttctggttctaac

SEQ ID NO: 1433673 - DNA, 23 bp, Homo sapiens
ttttagcaaagcgggttataatg

SEQ ID NO: 1433674 - DNA, 15 bp, Homo sapiens
ttttagcatttgtat

SEQ ID NO: 1433675 - DNA, 16 bp, Homo sapiens
ttttagcatttgtata

SEQ ID NO: 1433676 - DNA, 14 bp, Homo sapiens
ttttaggacatctt

SEQ ID NO: 1433677 - DNA, 15 bp, Homo sapiens
ttttaggacatctta

SEQ ID NO: 1433678 - DNA, 20 bp, Homo sapiens
ttttaggagctaaggctcta

SEQ ID NO: 1433679 - DNA, 23 bp, Homo sapiens
ttttaggagctaaggctctatga

SEQ ID NO: 1433680 - DNA, 21 bp, Homo sapiens
ttttagggagtggttcctgtg

SEQ ID NO: 1433681 - DNA, 15 bp, Homo sapiens
ttttaggttctaaag

SEQ ID NO: 1433682 - DNA, 19 bp, Homo sapiens
ttttagtatttatttatgt

SEQ ID NO: 1433683 - DNA, 16 bp, Homo sapiens
ttttagtgtaaaattg

SEQ ID NO: 1433684 - DNA, 19 bp, Homo sapiens
ttttagtgtaaaattgtta

SEQ ID NO: 1433685 - DNA, 13 bp, Homo sapiens
ttttagtgtatta

SEQ ID NO: 1433686 - DNA, 16 bp, Homo sapiens
ttttagtgtctgacct

SEQ ID NO: 1433687 - DNA, 18 bp, Homo sapiens
ttttagtgtgtgcataat

SEQ ID NO: 1433688 - DNA, 21 bp, Homo sapiens
ttttagtttctgaactctgac

SEQ ID NO: 1433689 - DNA, 16 bp, Homo sapiens
ttttagtttttcatta

SEQ ID NO: 1433690 - DNA, 20 bp, Homo sapiens
ttttataaaagcaaaagaga

SEQ ID NO: 1433691 - DNA, 22 bp, Homo sapiens
ttttataaaccacttgagccta

SEQ ID NO: 1433692 - DNA, 13 bp, Homo sapiens
ttttataaagtct

SEQ ID NO: 1433693 - DNA, 23 bp, Homo sapiens
ttttataaagtctaagcaagatg

SEQ ID NO: 1433694 - DNA, 13 bp, Homo sapiens
ttttataaatact

SEQ ID NO: 1433695 - DNA, 13 bp, Homo sapiens
ttttataagaaaa

SEQ ID NO: 1433696 - DNA, 19 bp, Homo sapiens
ttttataattctcattaaa

SEQ ID NO: 1433697 - DNA, 15 bp, Homo sapiens
ttttatacctgttta

SEQ ID NO: 1433698 - DNA, 16 bp, Homo sapiens
ttttatacctgtttaa

SEQ ID NO: 1433699 - DNA, 17 bp, Homo sapiens
ttttatacctgtttaaa

SEQ ID NO: 1433700 - DNA, 22 bp, Homo sapiens
ttttatagcttaactaatttga

SEQ ID NO: 1433701 - DNA, 16 bp, Homo sapiens
ttttatatatatgcat

SEQ ID NO: 1433702 - DNA, 18 bp, Homo sapiens
ttttatatatattgttaa

SEQ ID NO: 1433703 - DNA, 13 bp, Homo sapiens
ttttatatctgta

SEQ ID NO: 1433704 - DNA, 15 bp, Homo sapiens
ttttatatcttccta

SEQ ID NO: 1433705 - DNA, 20 bp, Homo sapiens
ttttatatgatgggggaaaa

SEQ ID NO: 1433706 - DNA, 9 bp, Homo sapiens
ttttatatt

SEQ ID NO: 1433707 - DNA, 17 bp, Homo sapiens
ttttatattaatgtact

SEQ ID NO: 1433708 - DNA, 20 bp, Homo sapiens
ttttatatttattgttagaa

SEQ ID NO: 1433709 - DNA, 13 bp, Homo sapiens
ttttatatttgta

SEQ ID NO: 1433710 - DNA, 15 bp, Homo sapiens
ttttatcccaaagtt

SEQ ID NO: 1433711 - DNA, 22 bp, Homo sapiens
ttttatctattctgagaaaaca

SEQ ID NO: 1433712 - DNA, 21 bp, Homo sapiens
ttttatcttaatccattaaaa

SEQ ID NO: 1433713 - DNA, 19 bp, Homo sapiens
ttttatctttcgtgataaa

SEQ ID NO: 1433714 - DNA, 16 bp, Homo sapiens
ttttatgaacattgta

SEQ ID NO: 1433715 - DNA, 12 bp, Homo sapiens
ttttatgaagaa

SEQ ID NO: 1433716 - DNA, 13 bp, Homo sapiens
ttttatgaagaaa

SEQ ID NO: 1433717 - DNA, 14 bp, Homo sapiens
ttttatgaagaaaa

SEQ ID NO: 1433718 - DNA, 20 bp, Homo sapiens
ttttatgaagaaaaagtaca

SEQ ID NO: 1433719 - DNA, 18 bp, Homo sapiens
ttttatgccagttgttaa

SEQ ID NO: 1433720 - DNA, 18 bp, Homo sapiens
ttttatgcgtgtgacagt

SEQ ID NO: 1433721 - DNA, 16 bp, Homo sapiens
ttttatgtcatactct

SEQ ID NO: 1433722 - DNA, 22 bp, Homo sapiens
ttttatgtcatactctgtgtaa

SEQ ID NO: 1433723 - DNA, 23 bp, Homo sapiens
ttttatgttaaaaagaaatccag

SEQ ID NO: 1433724 - DNA, 16 bp, Homo sapiens
ttttattaataatatt

SEQ ID NO: 1433725 - DNA, 16 bp, Homo sapiens
ttttattcatgtgaag

SEQ ID NO: 1433726 - DNA, 18 bp, Homo sapiens
ttttattcctgtatgttg

SEQ ID NO: 1433727 - DNA, 14 bp, Homo sapiens
ttttattctgactt

SEQ ID NO: 1433728 - DNA, 22 bp, Homo sapiens
ttttattgctcgcccagacacc

SEQ ID NO: 1433729 - DNA, 10 bp, Homo sapiens
ttttattgtt

SEQ ID NO: 1433730 - DNA, 13 bp, Homo sapiens
ttttatttacatt

SEQ ID NO: 1433731 - DNA, 23 bp, Homo sapiens
ttttatttccaggtaatatgtct

SEQ ID NO: 1433732 - DNA, 12 bp, Homo sapiens
ttttatttgtaa

SEQ ID NO: 1433733 - DNA, 15 bp, Homo sapiens
ttttatttgtaaagt

SEQ ID NO: 1433734 - DNA, 17 bp, Homo sapiens
ttttatttgtaaagtga

SEQ ID NO: 1433735 - DNA, 13 bp, Homo sapiens
ttttattttgctg

SEQ ID NO: 1433736 - DNA, 15 bp, Homo sapiens
ttttattttggaact

SEQ ID NO: 1433737 - DNA, 14 bp, Homo sapiens
ttttattttgtttt

SEQ ID NO: 1433738 - DNA, 18 bp, Homo sapiens
ttttatttttctaaaaaa

SEQ ID NO: 1433739 - DNA, 12 bp, Homo sapiens
ttttatttttga

SEQ ID NO: 1433740 - DNA, 17 bp, Homo sapiens
ttttcaaaataaaaatg

SEQ ID NO: 1433741 - DNA, 14 bp, Homo sapiens
ttttcaagaaactg

SEQ ID NO: 1433742 - DNA, 14 bp, Homo sapiens
ttttcaagaaatga

SEQ ID NO: 1433743 - DNA, 14 bp, Homo sapiens
ttttcaagattcta

SEQ ID NO: 1433744 - DNA, 17 bp, Homo sapiens
ttttcaaggccttcagt

SEQ ID NO: 1433745 - DNA, 14 bp, Homo sapiens
ttttcaatatattg

SEQ ID NO: 1433746 - DNA, 23 bp, Homo sapiens
ttttcaatatattgaacttttgt

SEQ ID NO: 1433747 - DNA, 14 bp, Homo sapiens
ttttcaatatttat

SEQ ID NO: 1433748 - DNA, 21 bp, Homo sapiens
ttttcacaatcttggggctga

SEQ ID NO: 1433749 - DNA, 21 bp, Homo sapiens
ttttcacactggtaaatgtta

SEQ ID NO: 1433750 - DNA, 12 bp, Homo sapiens
ttttcacatttt

SEQ ID NO: 1433751 - DNA, 19 bp, Homo sapiens
ttttcaccagatttgctaa

SEQ ID NO: 1433752 - DNA, 14 bp, Homo sapiens
ttttcactgcctgt

SEQ ID NO: 1433753 - DNA, 20 bp, Homo sapiens
ttttcactgctggctgcctt

SEQ ID NO: 1433754 - DNA, 15 bp, Homo sapiens
ttttcagaaaatatt

SEQ ID NO: 1433755 - DNA, 16 bp, Homo sapiens
ttttcagaaaatatta

SEQ ID NO: 1433756 - DNA, 22 bp, Homo sapiens
ttttcagaaaatattatgtgtt

SEQ ID NO: 1433757 - DNA, 21 bp, Homo sapiens
ttttcagaaggttattttctt

SEQ ID NO: 1433758 - DNA, 16 bp, Homo sapiens
ttttcagactcagact

SEQ ID NO: 1433759 - DNA, 19 bp, Homo sapiens
ttttcagcaaactcttttc

SEQ ID NO: 1433760 - DNA, 23 bp, Homo sapiens
ttttcagtagggctacaaaacct

SEQ ID NO: 1433761 - DNA, 19 bp, Homo sapiens
ttttcagtatactgtgtgg

SEQ ID NO: 1433762 - DNA, 20 bp, Homo sapiens
ttttcagtcccctctctctg

SEQ ID NO: 1433763 - DNA, 22 bp, Homo sapiens
ttttcatcaaaaagccttattt

SEQ ID NO: 1433764 - DNA, 16 bp, Homo sapiens
ttttcatccttcccca

SEQ ID NO: 1433765 - DNA, 19 bp, Homo sapiens
ttttcatctgaaaagcagt

SEQ ID NO: 1433766 - DNA, 21 bp, Homo sapiens
ttttcatctgaaaagcagttc

SEQ ID NO: 1433767 - DNA, 19 bp, Homo sapiens
tcttgtcttagctctggac

SEQ ID NO: 1433768 - DNA, 14 bp, Homo sapiens
tcttgtgctagaat

SEQ ID NO: 1433769 - DNA, 21 bp, Homo sapiens
tcttgtgctagaatacttttt

SEQ ID NO: 1433770 - DNA, 19 bp, Homo sapiens
tcttgtgctcacgctcccc

SEQ ID NO: 1433771 - DNA, 22 bp, Homo sapiens
tcttgtgctcagcatgattctt

SEQ ID NO: 1433772 - DNA, 22 bp, Homo sapiens
tcttgtgggagacagcagcctg

SEQ ID NO: 1433773 - DNA, 15 bp, Homo sapiens
tcttgtggggccagg

SEQ ID NO: 1433774 - DNA, 16 bp, Homo sapiens
tcttgtggttaaaaac

SEQ ID NO: 1433775 - DNA, 14 bp, Homo sapiens
tcttgtgtcctggt

SEQ ID NO: 1433776 - DNA, 17 bp, Homo sapiens
tcttgtgtcttgagagc

SEQ ID NO: 1433777 - DNA, 22 bp, Homo sapiens
tcttgttaatgtcattgctaaa

SEQ ID NO: 1433778 - DNA, 13 bp, Homo sapiens
tcttgttactgct

SEQ ID NO: 1433779 - DNA, 18 bp, Homo sapiens
tcttgttactgctgattc

SEQ ID NO: 1433780 - DNA, 17 bp, Homo sapiens
tcttgttagaaaacaaa

SEQ ID NO: 1433781 - DNA, 21 bp, Homo sapiens
tcttgttgctcaaaaaatgag

SEQ ID NO: 1433782 - DNA, 22 bp, Homo sapiens
tcttgttgctcaaaaaatgagc

SEQ ID NO: 1433783 - DNA, 17 bp, Homo sapiens
tcttgtttgtcagcatc

SEQ ID NO: 1433784 - DNA, 18 bp, Homo sapiens
tcttgtttgtcagcatct

SEQ ID NO: 1433785 - DNA, 21 bp, Homo sapiens
tcttgtttgtcagcatctgac

SEQ ID NO: 1433786 - DNA, 23 bp, Homo sapiens
tcttgtttgtcagcatctgacca

SEQ ID NO: 1433787 - DNA, 22 bp, Homo sapiens
tcttgttttgtcttgaaagtgg

SEQ ID NO: 1433788 - DNA, 17 bp, Homo sapiens
tcttgtttttaagtttg

SEQ ID NO: 1433789 - DNA, 20 bp, Homo sapiens
tcttgtttttccactactgc

SEQ ID NO: 1433790 - DNA, 16 bp, Homo sapiens
tctttaaaaaagactg

SEQ ID NO: 1433791 - DNA, 14 bp, Homo sapiens
tctttaaaagagag

SEQ ID NO: 1433792 - DNA, 18 bp, Homo sapiens
tctttaaaaggaaagaaa

SEQ ID NO: 1433793 - DNA, 17 bp, Homo sapiens
tctttaaaatacacact

SEQ ID NO: 1433794 - DNA, 21 bp, Homo sapiens
tctttaaaatttaagtatctt

SEQ ID NO: 1433795 - DNA, 11 bp, Homo sapiens
tctttaaacag

SEQ ID NO: 1433796 - DNA, 22 bp, Homo sapiens
tctttaacatacaagaaaatgt

SEQ ID NO: 1433797 - DNA, 17 bp, Homo sapiens
tctttaacatacatcta

SEQ ID NO: 1433798 - DNA, 19 bp, Homo sapiens
tctttaacatacatctaag

SEQ ID NO: 1433799 - DNA, 14 bp, Homo sapiens
tctttaacatagtc

SEQ ID NO: 1433800 - DNA, 18 bp, Homo sapiens
tctttaaccaggaatatt

SEQ ID NO: 1433801 - DNA, 15 bp, Homo sapiens
tctttaactcataaa

SEQ ID NO: 1433802 - DNA, 21 bp, Homo sapiens
tctttaactgccgtaatttaa

SEQ ID NO: 1433803 - DNA, 14 bp, Homo sapiens
tctttaagaaagta

SEQ ID NO: 1433804 - DNA, 21 bp, Homo sapiens
tctttaagaatgcttaaaaaa

SEQ ID NO: 1433805 - DNA, 15 bp, Homo sapiens
tctttaataaataac

SEQ ID NO: 1433806 - DNA, 23 bp, Homo sapiens
tctttaataacaaggagatttct

SEQ ID NO: 1433807 - DNA, 20 bp, Homo sapiens
tctttaatgttgtccaggaa

SEQ ID NO: 1433808 - DNA, 20 bp, Homo sapiens
tctttaattaaaacctggga

SEQ ID NO: 1433809 - DNA, 18 bp, Homo sapiens
tctttacctgagaccagt

SEQ ID NO: 1433810 - DNA, 20 bp, Homo sapiens
tctttaccttctaaaagcca

SEQ ID NO: 1433811 - DNA, 20 bp, Homo sapiens
tctttactcccttcctggcc

SEQ ID NO: 1433812 - DNA, 22 bp, Homo sapiens
tctttactcccttcctggcctc

SEQ ID NO: 1433813 - DNA, 19 bp, Homo sapiens
tctttactgcactcagatt

SEQ ID NO: 1433814 - DNA, 13 bp, Homo sapiens
tctttacttatct

SEQ ID NO: 1433815 - DNA, 17 bp, Homo sapiens
tctttacttatctctca

SEQ ID NO: 1433816 - DNA, 15 bp, Homo sapiens
tctttacttcatgga

SEQ ID NO: 1433817 - DNA, 12 bp, Homo sapiens
tctttactttta

SEQ ID NO: 1433818 - DNA, 13 bp, Homo sapiens
tctttagatattt

SEQ ID NO: 1433819 - DNA, 15 bp, Homo sapiens
tctttagatgccaaa

SEQ ID NO: 1433820 - DNA, 22 bp, Homo sapiens
tctttagcatttttatgcagac

SEQ ID NO: 1433821 - DNA, 15 bp, Homo sapiens
tctttaggagattta

SEQ ID NO: 1433822 - DNA, 16 bp, Homo sapiens
tctttaggccaggctt

SEQ ID NO: 1433823 - DNA, 22 bp, Homo sapiens
tctttagtttttggttgggaat

SEQ ID NO: 1433824 - DNA, 15 bp, Homo sapiens
tctttatacagctgt

SEQ ID NO: 1433825 - DNA, 16 bp, Homo sapiens
tctttatacagctgta

SEQ ID NO: 1433826 - DNA, 22 bp, Homo sapiens
tctttatagaaggaatttgtac

SEQ ID NO: 1433827 - DNA, 15 bp, Homo sapiens
tctttatatgaagaa

SEQ ID NO: 1433828 - DNA, 13 bp, Homo sapiens
tctttatattttg

SEQ ID NO: 1433829 - DNA, 21 bp, Homo sapiens
tctttatattttgggtactgg

SEQ ID NO: 1433830 - DNA, 23 bp, Homo sapiens
tctttatcaagcaacattcttgt

SEQ ID NO: 1433831 - DNA, 21 bp, Homo sapiens
tctttcaagcagtcgtgcctg

SEQ ID NO: 1433832 - DNA, 20 bp, Homo sapiens
tctttcacagctcctcccac

SEQ ID NO: 1433833 - DNA, 18 bp, Homo sapiens
tctttcacaggcatcagg

SEQ ID NO: 1433834 - DNA, 16 bp, Homo sapiens
tctttcagtacttttt

SEQ ID NO: 1433835 - DNA, 21 bp, Homo sapiens
tctttcagtacttttttaaat

SEQ ID NO: 1433836 - DNA, 10 bp, Homo sapiens
tctttcatgg

SEQ ID NO: 1433837 - DNA, 18 bp, Homo sapiens
tctttccaaaacatttct

SEQ ID NO: 1433838 - DNA, 22 bp, Homo sapiens
tctttccaaattaaaacaaata

SEQ ID NO: 1433839 - DNA, 22 bp, Homo sapiens
tctttccagaggagtttcttaa

SEQ ID NO: 1433840 - DNA, 12 bp, Homo sapiens
tctttccaggct

SEQ ID NO: 1433841 - DNA, 22 bp, Homo sapiens
tctttccaggcttccctgactt

SEQ ID NO: 1433842 - DNA, 21 bp, Homo sapiens
tctttccagtggatcataaga

SEQ ID NO: 1433843 - DNA, 12 bp, Homo sapiens
tctttcccagga

SEQ ID NO: 1433844 - DNA, 12 bp, Homo sapiens
tctcctttcctt

SEQ ID NO: 1433845 - DNA, 14 bp, Homo sapiens
tctcctttccttcc

SEQ ID NO: 1433846 - DNA, 17 bp, Homo sapiens
tctcctttccttcccag

SEQ ID NO: 1433847 - DNA, 18 bp, Homo sapiens
tctcctttccttcccagg

SEQ ID NO: 1433848 - DNA, 20 bp, Homo sapiens
tctcctttccttcccaggcc

SEQ ID NO: 1433849 - DNA, 22 bp, Homo sapiens
tctcctttgcactgagggccac

SEQ ID NO: 1433850 - DNA, 17 bp, Homo sapiens
tctcctttgcaggctca

SEQ ID NO: 1433851 - DNA, 15 bp, Homo sapiens
tctcctttgtattct

SEQ ID NO: 1433852 - DNA, 22 bp, Homo sapiens
tctcctttgtattctgtcttca

SEQ ID NO: 1433853 - DNA, 13 bp, Homo sapiens
tctccttttccta

SEQ ID NO: 1433854 - DNA, 12 bp, Homo sapiens
tctccttttgaa

SEQ ID NO: 1433855 - DNA, 15 bp, Homo sapiens
tctccttttgaactt

SEQ ID NO: 1433856 - DNA, 23 bp, Homo sapiens
tctcgaacatggaactcattcct

SEQ ID NO: 1433857 - DNA, 21 bp, Homo sapiens
tctcgacggcacgcacttgcc

SEQ ID NO: 1433858 - DNA, 12 bp, Homo sapiens
tctcgatctcct

SEQ ID NO: 1433859 - DNA, 14 bp, Homo sapiens
tctcgcacacctct

SEQ ID NO: 1433860 - DNA, 22 bp, Homo sapiens
tctcgcgcccagcatttggttt

SEQ ID NO: 1433861 - DNA, 14 bp, Homo sapiens
tctcgcgccctccc

SEQ ID NO: 1433862 - DNA, 16 bp, Homo sapiens
tctcgctcccctctgc

SEQ ID NO: 1433863 - DNA, 15 bp, Homo sapiens
tctcgctctcgctct

SEQ ID NO: 1433864 - DNA, 16 bp, Homo sapiens
tctcgctctcgctctc

SEQ ID NO: 1433865 - DNA, 12 bp, Homo sapiens
tctcgctctctc

SEQ ID NO: 1433866 - DNA, 14 bp, Homo sapiens
tctcgctctctctc

SEQ ID NO: 1433867 - DNA, 21 bp, Homo sapiens
tctcgcttcctcagcctccaa

SEQ ID NO: 1433868 - DNA, 18 bp, Homo sapiens
tctcggccttcacaatct

SEQ ID NO: 1433869 - DNA, 14 bp, Homo sapiens
tctcggggcccttg

SEQ ID NO: 1433870 - DNA, 22 bp, Homo sapiens
tctcggggcccttggggcctgg

SEQ ID NO: 1433871 - DNA, 18 bp, Homo sapiens
tctcgtaatagcttctgt

SEQ ID NO: 1433872 - DNA, 19 bp, Homo sapiens
tctcgtaatagcttctgtg

SEQ ID NO: 1433873 - DNA, 20 bp, Homo sapiens
tctcgtaatagcttctgtgt

SEQ ID NO: 1433874 - DNA, 16 bp, Homo sapiens
tctctaaaattctagt

SEQ ID NO: 1433875 - DNA, 23 bp, Homo sapiens
tctctaaaattctagtctctgat

SEQ ID NO: 1433876 - DNA, 17 bp, Homo sapiens
tctctaaccattcaaat

SEQ ID NO: 1433877 - DNA, 16 bp, Homo sapiens
tctctaaccctatcct

SEQ ID NO: 1433878 - DNA, 21 bp, Homo sapiens
tctctaactcagaaacatcag

SEQ ID NO: 1433879 - DNA, 17 bp, Homo sapiens
tctctaacttctcaagt

SEQ ID NO: 1433880 - DNA, 15 bp, Homo sapiens
tctctaagtgggcat

SEQ ID NO: 1433881 - DNA, 20 bp, Homo sapiens
tctctaagtgggcattgcca

SEQ ID NO: 1433882 - DNA, 20 bp, Homo sapiens
tctctactcctacctcagcc

SEQ ID NO: 1433883 - DNA, 23 bp, Homo sapiens
tctctactgctggactgtggagg

SEQ ID NO: 1433884 - DNA, 12 bp, Homo sapiens
tctctactgctt

SEQ ID NO: 1433885 - DNA, 22 bp, Homo sapiens
tctctacttttccctgtacttt

SEQ ID NO: 1433886 - DNA, 13 bp, Homo sapiens
tctctagaatttt

SEQ ID NO: 1433887 - DNA, 20 bp, Homo sapiens
tctctagagtttagtcctta

SEQ ID NO: 1433888 - DNA, 22 bp, Homo sapiens
tctctaggaccatggttaagag

SEQ ID NO: 1433889 - DNA, 18 bp, Homo sapiens
tctctaggcctctccagt

SEQ ID NO: 1433890 - DNA, 19 bp, Homo sapiens
tctctaggcctctccagtt

SEQ ID NO: 1433891 - DNA, 18 bp, Homo sapiens
tctctatattatgtcttc

SEQ ID NO: 1433892 - DNA, 18 bp, Homo sapiens
tctctattctctgcaatt

SEQ ID NO: 1433893 - DNA, 14 bp, Homo sapiens
tctctatttgagaa

SEQ ID NO: 1433894 - DNA, 23 bp, Homo sapiens
tctctattttcataatcagtaaa

SEQ ID NO: 1433895 - DNA, 13 bp, Homo sapiens
tctctcaaaacaa

SEQ ID NO: 1433896 - DNA, 20 bp, Homo sapiens
tctctcaaaacaatattact

SEQ ID NO: 1433897 - DNA, 13 bp, Homo sapiens
tctctcactgtgt

SEQ ID NO: 1433898 - DNA, 22 bp, Homo sapiens
tctctcactgttgcagtggcct

SEQ ID NO: 1433899 - DNA, 16 bp, Homo sapiens
tctctcagctcccagg

SEQ ID NO: 1433900 - DNA, 19 bp, Homo sapiens
tctctcagctcccaggcca

SEQ ID NO: 1433901 - DNA, 13 bp, Homo sapiens
tctctcaggagca

SEQ ID NO: 1433902 - DNA, 18 bp, Homo sapiens
tctctcaggagcacaggc

SEQ ID NO: 1433903 - DNA, 19 bp, Homo sapiens
tctctcaggagcacaggca

SEQ ID NO: 1433904 - DNA, 19 bp, Homo sapiens
tctctcatgagaagccaag

SEQ ID NO: 1433905 - DNA, 23 bp, Homo sapiens
tctctccaccccccacgtctgtc

SEQ ID NO: 1433906 - DNA, 15 bp, Homo sapiens
tctctccaccttagt

SEQ ID NO: 1433907 - DNA, 19 bp, Homo sapiens
tctctccaccttagtactt

SEQ ID NO: 1433908 - DNA, 24 bp, Homo sapiens
tctctccactgctctcagcctccc

SEQ ID NO: 1433909 - DNA, 13 bp, Homo sapiens
tctctccagatgt

SEQ ID NO: 1433910 - DNA, 18 bp, Homo sapiens
tctctccagctgactaaa

SEQ ID NO: 1433911 - DNA, 24 bp, Homo sapiens
tctctccaggaaggtagcccagca

SEQ ID NO: 1433912 - DNA, 17 bp, Homo sapiens
tctctccaggtcagcct

SEQ ID NO: 1433913 - DNA, 11 bp, Homo sapiens
tctctccatct

SEQ ID NO: 1433914 - DNA, 19 bp, Homo sapiens
tctctcccaccccggcctc

SEQ ID NO: 1433915 - DNA, 19 bp, Homo sapiens
tctctcccatcctggggca

SEQ ID NO: 1433916 - DNA, 24 bp, Homo sapiens
tctctccctccctctctcatgaga

SEQ ID NO: 1433917 - DNA, 14 bp, Homo sapiens
tctctcccttcctc

SEQ ID NO: 1433918 - DNA, 19 bp, Homo sapiens
tctctccgacttcccctgg

SEQ ID NO: 1433919 - DNA, 19 bp, Homo sapiens
tctctcctccctcctgggg

SEQ ID NO: 1433920 - DNA, 13 bp, Homo sapiens
tctctcctggcct

SEQ ID NO: 1433921 - DNA, 14 bp, Homo sapiens
tctctcctgtactt

SEQ ID NO: 1433922 - DNA, 14 bp, Homo sapiens
tctctcctttcttt

SEQ ID NO: 1433923 - DNA, 16 bp, Homo sapiens
tctctcgctgcgtcct

SEQ ID NO: 1433924 - DNA, 20 bp, Homo sapiens
tctctcggctccccatgtgt

SEQ ID NO: 1433925 - DNA, 18 bp, Homo sapiens
tctctcggttccacgtcc

SEQ ID NO: 1433926 - DNA, 23 bp, Homo sapiens
tctctcggttccacgtccccctg

SEQ ID NO: 1433927 - DNA, 17 bp, Homo sapiens
tctctctaccagtctat

SEQ ID NO: 1433928 - DNA, 22 bp, Homo sapiens
tctctctaccagtctatttcca

SEQ ID NO: 1433929 - DNA, 22 bp, Homo sapiens
tctctctaggagggagccttgt

SEQ ID NO: 1433930 - DNA, 15 bp, Homo sapiens
tctctctcacacaca

SEQ ID NO: 1433931 - DNA, 12 bp, Homo sapiens
tctctctccagg

SEQ ID NO: 1433932 - DNA, 11 bp, Homo sapiens
tctctctcctg

SEQ ID NO: 1433933 - DNA, 14 bp, Homo sapiens
tctctctctaaggt

SEQ ID NO: 1433934 - DNA, 15 bp, Homo sapiens
tctctctgagggggt

SEQ ID NO: 1433935 - DNA, 14 bp, Homo sapiens
tctctctgcccaac

SEQ ID NO: 1433936 - DNA, 13 bp, Homo sapiens
tctctctgcctga

SEQ ID NO: 1433937 - DNA, 17 bp, Homo sapiens
tctctctgggcccaggg

SEQ ID NO: 1433938 - DNA, 12 bp, Homo sapiens
tctctcttctct

SEQ ID NO: 1433939 - DNA, 16 bp, Homo sapiens
tctctcttctgctcca

SEQ ID NO: 1433940 - DNA, 20 bp, Homo sapiens
tctctcttctgctccaccct

SEQ ID NO: 1433941 - DNA, 17 bp, Homo sapiens
tctgaagcttgactccc

SEQ ID NO: 1433942 - DNA, 18 bp, Homo sapiens
tctgaaggaatagccaga

SEQ ID NO: 1433943 - DNA, 19 bp, Homo sapiens
tctgaaggacacttcctgc

SEQ ID NO: 1433944 - DNA, 21 bp, Homo sapiens
tctgaaggacacttcctgcct

SEQ ID NO: 1433945 - DNA, 20 bp, Homo sapiens
tctgaaggagaggaggaatt

SEQ ID NO: 1433946 - DNA, 23 bp, Homo sapiens
tctgaaggcgtcaacgtgcattt

SEQ ID NO: 1433947 - DNA, 13 bp, Homo sapiens
tctgaagggaccc

SEQ ID NO: 1433948 - DNA, 16 bp, Homo sapiens
tctgaagtcactgcac

SEQ ID NO: 1433949 - DNA, 22 bp, Homo sapiens
tctgaagtggtttgcaggtcag

SEQ ID NO: 1433950 - DNA, 14 bp, Homo sapiens
tctgaataaagcaa

SEQ ID NO: 1433951 - DNA, 17 bp, Homo sapiens
tctgaataaagtgtaac

SEQ ID NO: 1433952 - DNA, 18 bp, Homo sapiens
tctgaataaagtgtaaca

SEQ ID NO: 1433953 - DNA, 14 bp, Homo sapiens
tctgaataaatacc

SEQ ID NO: 1433954 - DNA, 10 bp, Homo sapiens
tctgaatatt

SEQ ID NO: 1433955 - DNA, 15 bp, Homo sapiens
tctgaatattctaga

SEQ ID NO: 1433956 - DNA, 15 bp, Homo sapiens
tctgaatattttgta

SEQ ID NO: 1433957 - DNA, 13 bp, Homo sapiens
tctgaatcctaag

SEQ ID NO: 1433958 - DNA, 20 bp, Homo sapiens
tctgaatctgcgagtagatg

SEQ ID NO: 1433959 - DNA, 13 bp, Homo sapiens
tctgaatgctgcc

SEQ ID NO: 1433960 - DNA, 18 bp, Homo sapiens
tctgaatgggagccagaa

SEQ ID NO: 1433961 - DNA, 22 bp, Homo sapiens
tctgaatgggagccagaattca

SEQ ID NO: 1433962 - DNA, 23 bp, Homo sapiens
tctgaatgggagccagaattcac

SEQ ID NO: 1433963 - DNA, 21 bp, Homo sapiens
tctgaatttacttccttgcat

SEQ ID NO: 1433964 - DNA, 20 bp, Homo sapiens
tctgaattttgcaatgtatt

SEQ ID NO: 1433965 - DNA, 20 bp, Homo sapiens
tctgacaaaatggggcagaa

SEQ ID NO: 1433966 - DNA, 23 bp, Homo sapiens
tctgacaaaatggggcagaagag

SEQ ID NO: 1433967 - DNA, 17 bp, Homo sapiens
tctgacactgtgtaaga

SEQ ID NO: 1433968 - DNA, 18 bp, Homo sapiens
tctgacagattgacaggg

SEQ ID NO: 1433969 - DNA, 13 bp, Homo sapiens
tctgacagtcctt

SEQ ID NO: 1433970 - DNA, 17 bp, Homo sapiens
tctgacagtttttctgt

SEQ ID NO: 1433971 - DNA, 23 bp, Homo sapiens
tctgacatgtaagaaaatgttac

SEQ ID NO: 1433972 - DNA, 20 bp, Homo sapiens
tctgacatgtttgtgctctg

SEQ ID NO: 1433973 - DNA, 19 bp, Homo sapiens
tctgaccacttgaggcctg

SEQ ID NO: 1433974 - DNA, 15 bp, Homo sapiens
tctgaccatctgtga

SEQ ID NO: 1433975 - DNA, 20 bp, Homo sapiens
tctgaccatctgtgactata

SEQ ID NO: 1433976 - DNA, 14 bp, Homo sapiens
tctgaccatttcag

SEQ ID NO: 1433977 - DNA, 18 bp, Homo sapiens
tctgaccatttcaggggt

SEQ ID NO: 1433978 - DNA, 11 bp, Homo sapiens
tctgacccagt

SEQ ID NO: 1433979 - DNA, 13 bp, Homo sapiens
tctgacccagtgc

SEQ ID NO: 1433980 - DNA, 17 bp, Homo sapiens
tctgacccttctacatt

SEQ ID NO: 1433981 - DNA, 15 bp, Homo sapiens
tctgaccgattcctt

SEQ ID NO: 1433982 - DNA, 17 bp, Homo sapiens
tctgaccgattccttta

SEQ ID NO: 1433983 - DNA, 19 bp, Homo sapiens
tctgacctgcaggccaaga

SEQ ID NO: 1433984 - DNA, 12 bp, Homo sapiens
tctgacctggtg

SEQ ID NO: 1433985 - DNA, 18 bp, Homo sapiens
tctgacgcttgtgacagt

SEQ ID NO: 1433986 - DNA, 22 bp, Homo sapiens
tctgacgcttgtgacagtgcct

SEQ ID NO: 1433987 - DNA, 14 bp, Homo sapiens
tctgactactttgc

SEQ ID NO: 1433988 - DNA, 14 bp, Homo sapiens
tctgactatgacat

SEQ ID NO: 1433989 - DNA, 16 bp, Homo sapiens
tctgactatgacataa

SEQ ID NO: 1433990 - DNA, 22 bp, Homo sapiens
tctgactcatccccacagctgg

SEQ ID NO: 1433991 - DNA, 16 bp, Homo sapiens
tctgactccagagtct

SEQ ID NO: 1433992 - DNA, 21 bp, Homo sapiens
tctgactccagagtctgagcc

SEQ ID NO: 1433993 - DNA, 22 bp, Homo sapiens
tctgactccagagtctgagccc

SEQ ID NO: 1433994 - DNA, 16 bp, Homo sapiens
tctgactcggtttctc

SEQ ID NO: 1433995 - DNA, 20 bp, Homo sapiens
tctgactcggtttctccaaa

SEQ ID NO: 1433996 - DNA, 13 bp, Homo sapiens
tctgactcttatt

SEQ ID NO: 1433997 - DNA, 16 bp, Homo sapiens
tctgactgccaaataa

SEQ ID NO: 1433998 - DNA, 13 bp, Homo sapiens
tctgactgccaag

SEQ ID NO: 1433999 - DNA, 14 bp, Homo sapiens
tctgactgccaagc

SEQ ID NO: 1434000 - DNA, 18 bp, Homo sapiens
tctgactgccaagccaga

SEQ ID NO: 1434001 - DNA, 21 bp, Homo sapiens
tctgactgtccaggagctaat

SEQ ID NO: 1434002 - DNA, 14 bp, Homo sapiens
tctgactgtttatt

SEQ ID NO: 1434003 - DNA, 18 bp, Homo sapiens
tctgactgtttatttaag

SEQ ID NO: 1434004 - DNA, 19 bp, Homo sapiens
tctgactgtttatttaagg

SEQ ID NO: 1434005 - DNA, 19 bp, Homo sapiens
tctgacttaagcaaaagaa

SEQ ID NO: 1434006 - DNA, 15 bp, Homo sapiens
tctgacttcctctga

SEQ ID NO: 1434007 - DNA, 12 bp, Homo sapiens
tctgacttctgc

SEQ ID NO: 1434008 - DNA, 20 bp, Homo sapiens
tctgacttctgcctggagac

SEQ ID NO: 1434009 - DNA, 14 bp, Homo sapiens
tctgactttacttg

SEQ ID NO: 1434010 - DNA, 15 bp, Homo sapiens
tctgactttacttgt

SEQ ID NO: 1434011 - DNA, 14 bp, Homo sapiens
tctgagaaaacaag

SEQ ID NO: 1434012 - DNA, 21 bp, Homo sapiens
tctgagaaacctgttgaagat

SEQ ID NO: 1434013 - DNA, 15 bp, Homo sapiens
tctgagaaagactat

SEQ ID NO: 1434014 - DNA, 22 bp, Homo sapiens
tctgagaaagactattcaaaca

SEQ ID NO: 1434015 - DNA, 18 bp, Homo sapiens
tctgagaagacacaaggt

SEQ ID NO: 1434016 - DNA, 16 bp, Homo sapiens
tctgagaagctctgaa

SEQ ID NO: 1434017 - DNA, 19 bp, Homo sapiens
tctgagaaggccctgtgcc

SEQ ID NO: 1434018 - DNA, 17 bp, Homo sapiens
tctgagaaggtccttaa

SEQ ID NO: 1434019 - DNA, 18 bp, Homo sapiens
tctgagaatcacggtggt

SEQ ID NO: 1434020 - DNA, 21 bp, Homo sapiens
tctgagaatcacggtggtaaa

SEQ ID NO: 1434021 - DNA, 22 bp, Homo sapiens
tctgagaattgttgagatactt

SEQ ID NO: 1434022 - DNA, 22 bp, Homo sapiens
tctgagagacctgtgtgaacta

SEQ ID NO: 1434023 - DNA, 21 bp, Homo sapiens
tctgagaggctctccgtgcag

SEQ ID NO: 1434024 - DNA, 14 bp, Homo sapiens
tctgagagtctaga

SEQ ID NO: 1434025 - DNA, 15 bp, Homo sapiens
tctgagagtctagat

SEQ ID NO: 1434026 - DNA, 16 bp, Homo sapiens
tctgagagtctagatt

SEQ ID NO: 1434027 - DNA, 18 bp, Homo sapiens
tctgagagtctagattct

SEQ ID NO: 1434028 - DNA, 11 bp, Homo sapiens
tctgagcagcc

SEQ ID NO: 1434029 - DNA, 13 bp, Homo sapiens
tctgagcagcctc

SEQ ID NO: 1434030 - DNA, 20 bp, Homo sapiens
tctgagcagcctctgccagg

SEQ ID NO: 1434031 - DNA, 14 bp, Homo sapiens
tctgagcccaggcc

SEQ ID NO: 1434032 - DNA, 18 bp, Homo sapiens
tctgagcccccggctagt

SEQ ID NO: 1434033 - DNA, 16 bp, Homo sapiens
tctgagcccgggctgc

SEQ ID NO: 1434034 - DNA, 24 bp, Homo sapiens
tctgagcccgggctgcctgggctg

SEQ ID NO: 1434035 - DNA, 23 bp, Homo sapiens
tctgagcggcgcagagccctcca

SEQ ID NO: 1434036 - DNA, 20 bp, Homo sapiens
tctgagctatttcatctatt

SEQ ID NO: 1434037 - DNA, 18 bp, Homo sapiens
tctgagctccacctctgg

SEQ ID NO: 1434038 - DNA, 16 bp, Homo sapiens
tctgagctggggtggg

SEQ ID NO: 1434039 - DNA, 22 bp, Homo sapiens
tctgagctggggtgggagctcc

SEQ ID NO: 1434040 - DNA, 15 bp, Homo sapiens
tctgaggaagtctta

SEQ ID NO: 1434041 - DNA, 22 bp, Homo sapiens
tctgaggaatcaacagggcagc

SEQ ID NO: 1434042 - DNA, 21 bp, Homo sapiens
tctgaggaatggacatttcta

SEQ ID NO: 1434043 - DNA, 17 bp, Homo sapiens
tctaatgacagataaat

SEQ ID NO: 1434044 - DNA, 18 bp, Homo sapiens
tctaatgccttttgaata

SEQ ID NO: 1434045 - DNA, 14 bp, Homo sapiens
tctaatgcttgttt

SEQ ID NO: 1434046 - DNA, 20 bp, Homo sapiens
tctaatgcttgtttatgata

SEQ ID NO: 1434047 - DNA, 21 bp, Homo sapiens
tctaatggggaaatgtagcta

SEQ ID NO: 1434048 - DNA, 14 bp, Homo sapiens
tctaatgttgtatc

SEQ ID NO: 1434049 - DNA, 16 bp, Homo sapiens
tctaatgtttgtgaga

SEQ ID NO: 1434050 - DNA, 15 bp, Homo sapiens
tctaattaaagatgg

SEQ ID NO: 1434051 - DNA, 12 bp, Homo sapiens
tctaattaaatg

SEQ ID NO: 1434052 - DNA, 23 bp, Homo sapiens
tctaattaaccttactaattata

SEQ ID NO: 1434053 - DNA, 17 bp, Homo sapiens
tctaattaattgtaatc

SEQ ID NO: 1434054 - DNA, 21 bp, Homo sapiens
tctaattcccattttgcaaaa

SEQ ID NO: 1434055 - DNA, 12 bp, Homo sapiens
tctaattctgat

SEQ ID NO: 1434056 - DNA, 14 bp, Homo sapiens
tctaattctgattc

SEQ ID NO: 1434057 - DNA, 12 bp, Homo sapiens
tctaattgtaag

SEQ ID NO: 1434058 - DNA, 20 bp, Homo sapiens
tctaattgtaagtgaaatta

SEQ ID NO: 1434059 - DNA, 22 bp, Homo sapiens
tctaattgtaagtgaaattaag

SEQ ID NO: 1434060 - DNA, 14 bp, Homo sapiens
tctaatttataaaa

SEQ ID NO: 1434061 - DNA, 22 bp, Homo sapiens
tctaatttcaaaaatataactt

SEQ ID NO: 1434062 - DNA, 16 bp, Homo sapiens
tctaatttttaagcaa

SEQ ID NO: 1434063 - DNA, 13 bp, Homo sapiens
tctacaaggactc

SEQ ID NO: 1434064 - DNA, 19 bp, Homo sapiens
tctacaatcagttgacttt

SEQ ID NO: 1434065 - DNA, 14 bp, Homo sapiens
tctacaatctcttt

SEQ ID NO: 1434066 - DNA, 21 bp, Homo sapiens
tctacacagcctggactttgg

SEQ ID NO: 1434067 - DNA, 23 bp, Homo sapiens
tctacacagtgggaactctgaca

SEQ ID NO: 1434068 - DNA, 16 bp, Homo sapiens
tctacaccaatgaaaa

SEQ ID NO: 1434069 - DNA, 19 bp, Homo sapiens
tctacactcttgtaataaa

SEQ ID NO: 1434070 - DNA, 23 bp, Homo sapiens
tctacagctaatcagcattctca

SEQ ID NO: 1434071 - DNA, 13 bp, Homo sapiens
tctacagtgtcct

SEQ ID NO: 1434072 - DNA, 15 bp, Homo sapiens
tctacataattgtga

SEQ ID NO: 1434073 - DNA, 17 bp, Homo sapiens
tctacataattgtgacc

SEQ ID NO: 1434074 - DNA, 16 bp, Homo sapiens
tctacatcttctgcct

SEQ ID NO: 1434075 - DNA, 20 bp, Homo sapiens
tctacatgaggaactgtaga

SEQ ID NO: 1434076 - DNA, 21 bp, Homo sapiens
tctacatgtaactatttcttc

SEQ ID NO: 1434077 - DNA, 14 bp, Homo sapiens
tctacatgtgccac

SEQ ID NO: 1434078 - DNA, 14 bp, Homo sapiens
tctacatttcttag

SEQ ID NO: 1434079 - DNA, 16 bp, Homo sapiens
tctacatttgagggcc

SEQ ID NO: 1434080 - DNA, 12 bp, Homo sapiens
tctacatttgtt

SEQ ID NO: 1434081 - DNA, 14 bp, Homo sapiens
tctaccagtctatt

SEQ ID NO: 1434082 - DNA, 19 bp, Homo sapiens
tctaccatgaacagaaaac

SEQ ID NO: 1434083 - DNA, 18 bp, Homo sapiens
tctaccattgaaggaaag

SEQ ID NO: 1434084 - DNA, 15 bp, Homo sapiens
tctaccatttcagag

SEQ ID NO: 1434085 - DNA, 12 bp, Homo sapiens
tctacccagact

SEQ ID NO: 1434086 - DNA, 17 bp, Homo sapiens
tctacccagactcagag

SEQ ID NO: 1434087 - DNA, 15 bp, Homo sapiens
tctacccatattaca

SEQ ID NO: 1434088 - DNA, 23 bp, Homo sapiens
tctaccccagactagatgtagta

SEQ ID NO: 1434089 - DNA, 12 bp, Homo sapiens
tctacccctgct

SEQ ID NO: 1434090 - DNA, 16 bp, Homo sapiens
tctaccctcccacccc

SEQ ID NO: 1434091 - DNA, 19 bp, Homo sapiens
tctaccctggcactataat

SEQ ID NO: 1434092 - DNA, 19 bp, Homo sapiens
tctaccctgtctgtccctt

SEQ ID NO: 1434093 - DNA, 23 bp, Homo sapiens
tctaccctgtctgtcccttttct

SEQ ID NO: 1434094 - DNA, 23 bp, Homo sapiens
tctgaggatagtagttaaataac

SEQ ID NO: 1434095 - DNA, 19 bp, Homo sapiens
tctgaggatgtagagagaa

SEQ ID NO: 1434096 - DNA, 13 bp, Homo sapiens
tctgagggaggag

SEQ ID NO: 1434097 - DNA, 20 bp, Homo sapiens
tctgagggaggaggccacct

SEQ ID NO: 1434098 - DNA, 22 bp, Homo sapiens
tctgaggggaggcacctccagg

SEQ ID NO: 1434099 - DNA, 12 bp, Homo sapiens
tctgagggggag

SEQ ID NO: 1434100 - DNA, 18 bp, Homo sapiens
tctgaggttggatttgct

SEQ ID NO: 1434101 - DNA, 13 bp, Homo sapiens
tctgagtacagag

SEQ ID NO: 1434102 - DNA, 16 bp, Homo sapiens
tctgagtattctcata

SEQ ID NO: 1434103 - DNA, 13 bp, Homo sapiens
tctgagtcaaatc

SEQ ID NO: 1434104 - DNA, 12 bp, Homo sapiens
tctgagtcctgt

SEQ ID NO: 1434105 - DNA, 14 bp, Homo sapiens
tctgagtcctgtct

SEQ ID NO: 1434106 - DNA, 21 bp, Homo sapiens
tctgagtcctgtctctgcctg

SEQ ID NO: 1434107 - DNA, 20 bp, Homo sapiens
tctgagtctatgttcaaaga

SEQ ID NO: 1434108 - DNA, 13 bp, Homo sapiens
tctgagtctgagt

SEQ ID NO: 1434109 - DNA, 14 bp, Homo sapiens
tctgagtttaccat

SEQ ID NO: 1434110 - DNA, 15 bp, Homo sapiens
tctgagtttaccatt

SEQ ID NO: 1434111 - DNA, 21 bp, Homo sapiens
tctgagtttaccatttgtaat

SEQ ID NO: 1434112 - DNA, 22 bp, Homo sapiens
tctgagtttaccatttgtaata

SEQ ID NO: 1434113 - DNA, 13 bp, Homo sapiens
tctgataaactga

SEQ ID NO: 1434114 - DNA, 19 bp, Homo sapiens
tctgataaagttccttaag

SEQ ID NO: 1434115 - DNA, 23 bp, Homo sapiens
tctgatagaaatggtttcctctg

SEQ ID NO: 1434116 - DNA, 14 bp, Homo sapiens
tctgatatgggact

SEQ ID NO: 1434117 - DNA, 21 bp, Homo sapiens
tctgatatgtatccatcagga

SEQ ID NO: 1434118 - DNA, 12 bp, Homo sapiens
tctgatattaat

SEQ ID NO: 1434119 - DNA, 19 bp, Homo sapiens
tctgatattaatcaaaatt

SEQ ID NO: 1434120 - DNA, 20 bp, Homo sapiens
tctgatcacattcttcaaag

SEQ ID NO: 1434121 - DNA, 15 bp, Homo sapiens
tctgatctaacaaaa

SEQ ID NO: 1434122 - DNA, 19 bp, Homo sapiens
tctgatctaacaaaataag

SEQ ID NO: 1434123 - DNA, 21 bp, Homo sapiens
tctgatcttggaaaaacagcg

SEQ ID NO: 1434124 - DNA, 17 bp, Homo sapiens
tctgatggtgagctggg

SEQ ID NO: 1434125 - DNA, 20 bp, Homo sapiens
tctgatggtgagctgggaag

SEQ ID NO: 1434126 - DNA, 16 bp, Homo sapiens
tctgatgtttcatatt

SEQ ID NO: 1434127 - DNA, 14 bp, Homo sapiens
tctgatgtttctgt

SEQ ID NO: 1434128 - DNA, 19 bp, Homo sapiens
tctgattcacctcttcctc

SEQ ID NO: 1434129 - DNA, 20 bp, Homo sapiens
tctgattcacctcttcctct

SEQ ID NO: 1434130 - DNA, 22 bp, Homo sapiens
tctgattcacctcttcctctgg

SEQ ID NO: 1434131 - DNA, 13 bp, Homo sapiens
tctgattccactt

SEQ ID NO: 1434132 - DNA, 13 bp, Homo sapiens
tctgattccatat

SEQ ID NO: 1434133 - DNA, 13 bp, Homo sapiens
tctgattctatgc

SEQ ID NO: 1434134 - DNA, 23 bp, Homo sapiens
tctgattctggctttaagccttc

SEQ ID NO: 1434135 - DNA, 12 bp, Homo sapiens
tctgattggctg

SEQ ID NO: 1434136 - DNA, 13 bp, Homo sapiens
tctgatttcagga

SEQ ID NO: 1434137 - DNA, 22 bp, Homo sapiens
tctgatttcagtttttcatttg

SEQ ID NO: 1434138 - DNA, 17 bp, Homo sapiens
tctgatttgcaaatgca

SEQ ID NO: 1434139 - DNA, 20 bp, Homo sapiens
tctgatttgtccctatgcat

SEQ ID NO: 1434140 - DNA, 15 bp, Homo sapiens
tctgattttaatgaa

SEQ ID NO: 1434141 - DNA, 19 bp, Homo sapiens
tctgattttaatgaaatca

SEQ ID NO: 1434142 - DNA, 14 bp, Homo sapiens
tctgattttgcttc

SEQ ID NO: 1434143 - DNA, 15 bp, Homo sapiens
tctgatttttctctt

SEQ ID NO: 1434144 - DNA, 24 bp, Homo sapiens
tctgcaaacaccaacatgttggga

SEQ ID NO: 1434145 - DNA, 16 bp, Homo sapiens
tctgcaacaagcatgc

SEQ ID NO: 1434146 - DNA, 17 bp, Homo sapiens
tctgcaacaagcatgca

SEQ ID NO: 1434147 - DNA, 15 bp, Homo sapiens
tctgcaactagccaa

SEQ ID NO: 1434148 - DNA, 13 bp, Homo sapiens
tctgcaagaacac

SEQ ID NO: 1434149 - DNA, 17 bp, Homo sapiens
tctgcaagcctcatgcc

SEQ ID NO: 1434150 - DNA, 18 bp, Homo sapiens
tctgcaagcttcttgctg

SEQ ID NO: 1434151 - DNA, 17 bp, Homo sapiens
tctgcaagggcccagag

SEQ ID NO: 1434152 - DNA, 16 bp, Homo sapiens
tctgcaagtttctgtt

SEQ ID NO: 1434153 - DNA, 19 bp, Homo sapiens
tctgcaattcaaaagttcc

SEQ ID NO: 1434154 - DNA, 23 bp, Homo sapiens
tctgcaattcaaaagttccaaga

SEQ ID NO: 1434155 - DNA, 16 bp, Homo sapiens
tctgcaattcccctct

SEQ ID NO: 1434156 - DNA, 20 bp, Homo sapiens
tctgcaattcccctctgctg

SEQ ID NO: 1434157 - DNA, 21 bp, Homo sapiens
tctgcaattcccctctgctgc

SEQ ID NO: 1434158 - DNA, 19 bp, Homo sapiens
tctgcaatttgtttaaaga

SEQ ID NO: 1434159 - DNA, 22 bp, Homo sapiens
tctgcacaccctccagagacaa

SEQ ID NO: 1434160 - DNA, 21 bp, Homo sapiens
tctgcacagacaagcagccct

SEQ ID NO: 1434161 - DNA, 22 bp, Homo sapiens
tctgcacagacaagcagccctt

SEQ ID NO: 1434162 - DNA, 15 bp, Homo sapiens
tctgcacagatggat

SEQ ID NO: 1434163 - DNA, 14 bp, Homo sapiens
tctgcacagtcaga

SEQ ID NO: 1434164 - DNA, 18 bp, Homo sapiens
tctgcacagtcagaagga

SEQ ID NO: 1434165 - DNA, 19 bp, Homo sapiens
tctgcacataaactctttt

SEQ ID NO: 1434166 - DNA, 16 bp, Homo sapiens
tctgcacatgtcttgt

SEQ ID NO: 1434167 - DNA, 22 bp, Homo sapiens
tctgcacatgtcttgtacatgt

SEQ ID NO: 1434168 - DNA, 15 bp, Homo sapiens
tctgcacccagaaca

SEQ ID NO: 1434169 - DNA, 22 bp, Homo sapiens
tctgcacccagtgaacacattt

SEQ ID NO: 1434170 - DNA, 15 bp, Homo sapiens
tctgcaccccttctc

SEQ ID NO: 1434171 - DNA, 13 bp, Homo sapiens
tctgcaccctcca

SEQ ID NO: 1434172 - DNA, 17 bp, Homo sapiens
tctgcaccctccaccct

SEQ ID NO: 1434173 - DNA, 18 bp, Homo sapiens
tctgcactactcctctgc

SEQ ID NO: 1434174 - DNA, 20 bp, Homo sapiens
tctgcactactgacatgtgg

SEQ ID NO: 1434175 - DNA, 15 bp, Homo sapiens
tctgcactccatggc

SEQ ID NO: 1434176 - DNA, 18 bp, Homo sapiens
tctgcactcccacctgac

SEQ ID NO: 1434177 - DNA, 19 bp, Homo sapiens
tctgcagacttcccagcta

SEQ ID NO: 1434178 - DNA, 19 bp, Homo sapiens
tctgcagagtcactcacac

SEQ ID NO: 1434179 - DNA, 22 bp, Homo sapiens
tctgcagatcttccgtggtcag

SEQ ID NO: 1434180 - DNA, 14 bp, Homo sapiens
tctgcagccagccc

SEQ ID NO: 1434181 - DNA, 16 bp, Homo sapiens
tctgcagccagcccag

SEQ ID NO: 1434182 - DNA, 17 bp, Homo sapiens
tctgcagcggcagagca

SEQ ID NO: 1434183 - DNA, 19 bp, Homo sapiens
tctgcagcggcagagcaat

SEQ ID NO: 1434184 - DNA, 22 bp, Homo sapiens
tctgcagctcaagggctggcac

SEQ ID NO: 1434185 - DNA, 13 bp, Homo sapiens
tctgcagctgacc

SEQ ID NO: 1434186 - DNA, 13 bp, Homo sapiens
tctgcagctgccg

SEQ ID NO: 1434187 - DNA, 14 bp, Homo sapiens
tctgcagctgtttc

SEQ ID NO: 1434188 - DNA, 19 bp, Homo sapiens
tctgcagctttcaagctca

SEQ ID NO: 1434189 - DNA, 19 bp, Homo sapiens
tctgcagggggtgtgtctg

SEQ ID NO: 1434190 - DNA, 12 bp, Homo sapiens
tctgcagtcctg

SEQ ID NO: 1434191 - DNA, 14 bp, Homo sapiens
tctgcagtctcatt

SEQ ID NO: 1434192 - DNA, 13 bp, Homo sapiens
tctgcagtgcctt

SEQ ID NO: 1434193 - DNA, 21 bp, Homo sapiens
tctgcatcagctgctgaaaca

SEQ ID NO: 1434194 - DNA, 16 bp, Homo sapiens
tctgcatcatctgtag

SEQ ID NO: 1434195 - DNA, 19 bp, Homo sapiens
tctgcatcatctgtagata

SEQ ID NO: 1434196 - DNA, 19 bp, Homo sapiens
tctgcatctactcccaagt

SEQ ID NO: 1434197 - DNA, 15 bp, Homo sapiens
tctgcatggattcag

SEQ ID NO: 1434198 - DNA, 16 bp, Homo sapiens
tctgcattctagtact

SEQ ID NO: 1434199 - DNA, 23 bp, Homo sapiens
tctgcattgttattgtggaagat

SEQ ID NO: 1434200 - DNA, 18 bp, Homo sapiens
tctgccaacatgaggaca

SEQ ID NO: 1434201 - DNA, 17 bp, Homo sapiens
tctgccaacctaaaact

SEQ ID NO: 1434202 - DNA, 18 bp, Homo sapiens
tctgccaacctaaaactc

SEQ ID NO: 1434203 - DNA, 17 bp, Homo sapiens
tctgccaccctacctgt

SEQ ID NO: 1434204 - DNA, 20 bp, Homo sapiens
tctgccacctcccctatcca

SEQ ID NO: 1434205 - DNA, 14 bp, Homo sapiens
tctgccactgagga

SEQ ID NO: 1434206 - DNA, 13 bp, Homo sapiens
tctgccagccagc

SEQ ID NO: 1434207 - DNA, 19 bp, Homo sapiens
tctgccagctgggcccagc

SEQ ID NO: 1434208 - DNA, 20 bp, Homo sapiens
tctgccagctgggcccagca

SEQ ID NO: 1434209 - DNA, 13 bp, Homo sapiens
tctgccaggccca

SEQ ID NO: 1434210 - DNA, 14 bp, Homo sapiens
tctgccaggcccat

SEQ ID NO: 1434211 - DNA, 17 bp, Homo sapiens
tctggctgagcccctgg

SEQ ID NO: 1434212 - DNA, 20 bp, Homo sapiens
tctggctgagcccctgggga

SEQ ID NO: 1434213 - DNA, 16 bp, Homo sapiens
tctggctgtaaggctc

SEQ ID NO: 1434214 - DNA, 18 bp, Homo sapiens
tctggctgtaaggctcta

SEQ ID NO: 1434215 - DNA, 21 bp, Homo sapiens
tctgtacagaatgctatttca

SEQ ID NO: 1434216 - DNA, 19 bp, Homo sapiens
tctgtacagattcagcctc

SEQ ID NO: 1434217 - DNA, 18 bp, Homo sapiens
tctgtacatattactgtt

SEQ ID NO: 1434218 - DNA, 22 bp, Homo sapiens
tctgtactggaggctctgttct

SEQ ID NO: 1434219 - DNA, 23 bp, Homo sapiens
tctgtactgttactgggccctga

SEQ ID NO: 1434220 - DNA, 20 bp, Homo sapiens
tctgtagctataatgagcat

SEQ ID NO: 1434221 - DNA, 15 bp, Homo sapiens
tctgtagctccctcc

SEQ ID NO: 1434222 - DNA, 16 bp, Homo sapiens
tctgtagctccctcct

SEQ ID NO: 1434223 - DNA, 18 bp, Homo sapiens
tctgtagctccctcctcc

SEQ ID NO: 1434224 - DNA, 23 bp, Homo sapiens
tctgtagctccctcctcccatct

SEQ ID NO: 1434225 - DNA, 19 bp, Homo sapiens
tctgtaggcagcagagaga

SEQ ID NO: 1434226 - DNA, 15 bp, Homo sapiens
tctgtagggctggac

SEQ ID NO: 1434227 - DNA, 15 bp, Homo sapiens
tctgtagtaatttat

SEQ ID NO: 1434228 - DNA, 23 bp, Homo sapiens
tctgtagtaatttattgtctgtc

SEQ ID NO: 1434229 - DNA, 16 bp, Homo sapiens
tctgtatatagggcac

SEQ ID NO: 1434230 - DNA, 16 bp, Homo sapiens
tctgtatatgattctc

SEQ ID NO: 1434231 - DNA, 21 bp, Homo sapiens
tctgtatatgttgtaataaaa

SEQ ID NO: 1434232 - DNA, 20 bp, Homo sapiens
tctgtatccgtgaattgctt

SEQ ID NO: 1434233 - DNA, 21 bp, Homo sapiens
tctgtatcggagacagtgatc

SEQ ID NO: 1434234 - DNA, 23 bp, Homo sapiens
tctgtatttatgtgtgaggagct

SEQ ID NO: 1434235 - DNA, 23 bp, Homo sapiens
tctgttgatgttaactgagctac

SEQ ID NO: 1434236 - DNA, 18 bp, Homo sapiens
tctgttggcaggctggcc

SEQ ID NO: 1434237 - DNA, 23 bp, Homo sapiens
tctgtttagcgaacttgtatact

SEQ ID NO: 1434238 - DNA, 23 bp, Homo sapiens
tctgtttatggccacatttaata

SEQ ID NO: 1434239 - DNA, 12 bp, Homo sapiens
tctgtttcaagg

SEQ ID NO: 1434240 - DNA, 19 bp, Homo sapiens
tctgtttcataatgcagaa

SEQ ID NO: 1434241 - DNA, 16 bp, Homo sapiens
tctgtttcctgacatt

SEQ ID NO: 1434242 - DNA, 20 bp, Homo sapiens
tctgtttcctgacattgtct

SEQ ID NO: 1434243 - DNA, 16 bp, Homo sapiens
tctgtttctctttcct

SEQ ID NO: 1434244 - DNA, 21 bp, Homo sapiens
tctgtttggactgcagaagca

SEQ ID NO: 1434245 - DNA, 17 bp, Homo sapiens
tctgtttgtctgaacaa

SEQ ID NO: 1434246 - DNA, 19 bp, Homo sapiens
tctgtttgtctgaacaaag

SEQ ID NO: 1434247 - DNA, 13 bp, Homo sapiens
tctgttttcaagt

SEQ ID NO: 1434248 - DNA, 17 bp, Homo sapiens
tctgttttcaagtgtaa

SEQ ID NO: 1434249 - DNA, 16 bp, Homo sapiens
tctgttttgtgagaac

SEQ ID NO: 1434250 - DNA, 23 bp, Homo sapiens
tctgttttgttttgttttaatct

SEQ ID NO: 1434251 - DNA, 14 bp, Homo sapiens
tctgtttttaaaaa

SEQ ID NO: 1434252 - DNA, 14 bp, Homo sapiens
tctgtttttctttt

SEQ ID NO: 1434253 - DNA, 23 bp, Homo sapiens
tctgtttttgtatctttatgctg

SEQ ID NO: 1434254 - DNA, 18 bp, Homo sapiens
tcttaaaaaaataaaata

SEQ ID NO: 1434255 - DNA, 22 bp, Homo sapiens
tcttaaaaaaataaaatatttt

SEQ ID NO: 1434256 - DNA, 18 bp, Homo sapiens
tcttaaaaaataaaaact

SEQ ID NO: 1434257 - DNA, 15 bp, Homo sapiens
tcttaaaaggagctc

SEQ ID NO: 1434258 - DNA, 20 bp, Homo sapiens
tcttaaaatacccattgccc

SEQ ID NO: 1434259 - DNA, 17 bp, Homo sapiens
tcttaaaatcaaatgta

SEQ ID NO: 1434260 - DNA, 18 bp, Homo sapiens
tcttaaaatcaaatgtaa

SEQ ID NO: 1434261 - DNA, 21 bp, Homo sapiens
tcttaaaattcaagaaaataa

SEQ ID NO: 1434262 - DNA, 17 bp, Homo sapiens
tcttaaagaaacagctt

SEQ ID NO: 1434263 - DNA, 19 bp, Homo sapiens
tcttaaataatgcttcaga

SEQ ID NO: 1434264 - DNA, 16 bp, Homo sapiens
tcttaaatgagaagta

SEQ ID NO: 1434265 - DNA, 19 bp, Homo sapiens
tcttaaattcatttctaga

SEQ ID NO: 1434266 - DNA, 20 bp, Homo sapiens
tcttaacaaaccaacatctt

SEQ ID NO: 1434267 - DNA, 23 bp, Homo sapiens
tcttaacttcttgcttctttcta

SEQ ID NO: 1434268 - DNA, 20 bp, Homo sapiens
tcttaagaaaacaaactctt

SEQ ID NO: 1434269 - DNA, 14 bp, Homo sapiens
tcttaagaaataaa

SEQ ID NO: 1434270 - DNA, 16 bp, Homo sapiens
tcttaagaaataaatc

SEQ ID NO: 1434271 - DNA, 18 bp, Homo sapiens
tcttaagatggaaataca

SEQ ID NO: 1434272 - DNA, 19 bp, Homo sapiens
tcttaagatggaaatacag

SEQ ID NO: 1434273 - DNA, 16 bp, Homo sapiens
tcttaagattctttgt

SEQ ID NO: 1434274 - DNA, 13 bp, Homo sapiens
tcttaagcagcat

SEQ ID NO: 1434275 - DNA, 16 bp, Homo sapiens
tcttaagcaggtttgt

SEQ ID NO: 1434276 - DNA, 16 bp, Homo sapiens
tcttaagtcagatttt

SEQ ID NO: 1434277 - DNA, 24 bp, Homo sapiens
tcttaataaaataaactagatatt

SEQ ID NO: 1434278 - DNA, 19 bp, Homo sapiens
tcttaatatgttcttttaa

SEQ ID NO: 1434279 - DNA, 22 bp, Homo sapiens
tcttaatcattttttatatata

SEQ ID NO: 1434280 - DNA, 15 bp, Homo sapiens
tcttaatccattaaa

SEQ ID NO: 1434281 - DNA, 16 bp, Homo sapiens
tcttaatgtaacatgt

SEQ ID NO: 1434282 - DNA, 20 bp, Homo sapiens
tcttaatgtgtgtgccaatg

SEQ ID NO: 1434283 - DNA, 15 bp, Homo sapiens
tcttaattctttgtt

SEQ ID NO: 1434284 - DNA, 18 bp, Homo sapiens
tcttaattctttgttctg

SEQ ID NO: 1434285 - DNA, 19 bp, Homo sapiens
tcttaattctttgttctgt

SEQ ID NO: 1434286 - DNA, 23 bp, Homo sapiens
tcttaatttatttcttaaccttt

SEQ ID NO: 1434287 - DNA, 19 bp, Homo sapiens
tcttacaattgcactgctg

SEQ ID NO: 1434288 - DNA, 13 bp, Homo sapiens
tcttacagagcct

SEQ ID NO: 1434289 - DNA, 16 bp, Homo sapiens
tcttaccattttattc

SEQ ID NO: 1434290 - DNA, 17 bp, Homo sapiens
tcttacctactattggc

SEQ ID NO: 1434291 - DNA, 23 bp, Homo sapiens
tcttacctgtatgtctccagtat

SEQ ID NO: 1434292 - DNA, 16 bp, Homo sapiens
tcttactaaacatttt

SEQ ID NO: 1434293 - DNA, 21 bp, Homo sapiens
tcttactattaagcagtaaaa

SEQ ID NO: 1434294 - DNA, 16 bp, Homo sapiens
tcttactctttcctat

SEQ ID NO: 1434295 - DNA, 13 bp, Homo sapiens
tcttactgaaggt

SEQ ID NO: 1434296 - DNA, 12 bp, Homo sapiens
tcttactggaaa

SEQ ID NO: 1434297 - DNA, 19 bp, Homo sapiens
tcttagaagtggaccagga

SEQ ID NO: 1434298 - DNA, 21 bp, Homo sapiens
tcttagaagtggaccaggaca

SEQ ID NO: 1434299 - DNA, 14 bp, Homo sapiens
tcttagagtcctta

SEQ ID NO: 1434300 - DNA, 16 bp, Homo sapiens
tcttagagtgtagctg

SEQ ID NO: 1434301 - DNA, 19 bp, Homo sapiens
tcttagcaataaatgcttt

SEQ ID NO: 1434302 - DNA, 16 bp, Homo sapiens
tcttagcagcttccag

SEQ ID NO: 1434303 - DNA, 15 bp, Homo sapiens
tcttagcctctggat

SEQ ID NO: 1434304 - DNA, 18 bp, Homo sapiens
tcttagcctctggatcta

SEQ ID NO: 1434305 - DNA, 18 bp, Homo sapiens
tcttagctactgtatgca

SEQ ID NO: 1434306 - DNA, 21 bp, Homo sapiens
tcttagctatcattgcttcct

SEQ ID NO: 1434307 - DNA, 18 bp, Homo sapiens
tcttagctatccttggct

SEQ ID NO: 1434308 - DNA, 13 bp, Homo sapiens
tcttagctcccct

SEQ ID NO: 1434309 - DNA, 17 bp, Homo sapiens
tcttagcttacaggaag

SEQ ID NO: 1434310 - DNA, 17 bp, Homo sapiens
tcttagggattaaatat

SEQ ID NO: 1434311 - DNA, 13 bp, Homo sapiens
tcttaggtttact

SEQ ID NO: 1434312 - DNA, 15 bp, Homo sapiens
tcttaggtttactgt

SEQ ID NO: 1434313 - DNA, 17 bp, Homo sapiens
tcttaggtttactgtga

SEQ ID NO: 1434314 - DNA, 18 bp, Homo sapiens
tcttagttcatatatcaa

SEQ ID NO: 1434315 - DNA, 23 bp, Homo sapiens
tcttagtttggattcttatgtag

SEQ ID NO: 1434316 - DNA, 15 bp, Homo sapiens
tcttatacatttgat

SEQ ID NO: 1434317 - DNA, 16 bp, Homo sapiens
tcttatacgcttttct

SEQ ID NO: 1434318 - DNA, 20 bp, Homo sapiens
tcttatagaatatttattac

SEQ ID NO: 1434319 - DNA, 13 bp, Homo sapiens
tcttatagttcta

SEQ ID NO: 1434320 - DNA, 17 bp, Homo sapiens
tcttatagttctaggca

SEQ ID NO: 1434321 - DNA, 23 bp, Homo sapiens
tcttatcaccacagtaagttcct

SEQ ID NO: 1434322 - DNA, 23 bp, Homo sapiens
tcttatctagcaagaagattcta

SEQ ID NO: 1434323 - DNA, 10 bp, Homo sapiens
tcttctcatt

SEQ ID NO: 1434324 - DNA, 12 bp, Homo sapiens
tcttctccatct

SEQ ID NO: 1434325 - DNA, 13 bp, Homo sapiens
tcttctctctggc

SEQ ID NO: 1434326 - DNA, 15 bp, Homo sapiens
tcttctctcttcaat

SEQ ID NO: 1434327 - DNA, 21 bp, Homo sapiens
tcttctcttatcctctctctc

SEQ ID NO: 1434328 - DNA, 22 bp, Homo sapiens
tcttctgaaatgaaacaaataa

SEQ ID NO: 1434329 - DNA, 24 bp, Homo sapiens
tcttctgaactcaaactgaggaat

SEQ ID NO: 1434330 - DNA, 23 bp, Homo sapiens
tcttctgaagaggaaaagtcaaa

SEQ ID NO: 1434331 - DNA, 15 bp, Homo sapiens
tcttctgacgtgcct

SEQ ID NO: 1434332 - DNA, 17 bp, Homo sapiens
tcttctgacgtgccttt

SEQ ID NO: 1434333 - DNA, 19 bp, Homo sapiens
tcttctgagcgagtgctct

SEQ ID NO: 1434334 - DNA, 19 bp, Homo sapiens
tcttctgagctatttcatc

SEQ ID NO: 1434335 - DNA, 21 bp, Homo sapiens
tcttctgagctatttcatcta

SEQ ID NO: 1434336 - DNA, 21 bp, Homo sapiens
tcttctgcaacatttgacaaa

SEQ ID NO: 1434337 - DNA, 15 bp, Homo sapiens
tcttctgcctgttat

SEQ ID NO: 1434338 - DNA, 12 bp, Homo sapiens
tcttctgctcca

SEQ ID NO: 1434339 - DNA, 13 bp, Homo sapiens
tcttctgctccac

SEQ ID NO: 1434340 - DNA, 14 bp, Homo sapiens
tcttctgctccacc

SEQ ID NO: 1434341 - DNA, 16 bp, Homo sapiens
tcttctggagaagctt

SEQ ID NO: 1434342 - DNA, 17 bp, Homo sapiens
tcttctggagatggaag

SEQ ID NO: 1434343 - DNA, 20 bp, Homo sapiens
tcttctggagatggaagctt

SEQ ID NO: 1434344 - DNA, 13 bp, Homo sapiens
tcttctggctcaa

SEQ ID NO: 1434345 - DNA, 16 bp, Homo sapiens
tcttctgggcaccctc

SEQ ID NO: 1434346 - DNA, 17 bp, Homo sapiens
tcttctgggcgtctgag

SEQ ID NO: 1434347 - DNA, 18 bp, Homo sapiens
tcttctggggcaggctgg

SEQ ID NO: 1434348 - DNA, 20 bp, Homo sapiens
tcttctggggcaggctgggc

SEQ ID NO: 1434349 - DNA, 23 bp, Homo sapiens
tcttctggtagcatattcatggt

SEQ ID NO: 1434350 - DNA, 21 bp, Homo sapiens
tcttctggtgctactccatgc

SEQ ID NO: 1434351 - DNA, 15 bp, Homo sapiens
tcttctgtgttaatt

SEQ ID NO: 1434352 - DNA, 13 bp, Homo sapiens
tcttcttcaaacc

SEQ ID NO: 1434353 - DNA, 14 bp, Homo sapiens
tcttcttcttcaga

SEQ ID NO: 1434354 - DNA, 13 bp, Homo sapiens
tcttcttgaaatt

SEQ ID NO: 1434355 - DNA, 20 bp, Homo sapiens
tcttggcttaatcattttca

SEQ ID NO: 1434356 - DNA, 16 bp, Homo sapiens
tcttgggactgggttt

SEQ ID NO: 1434357 - DNA, 22 bp, Homo sapiens
tcttgggactgggtttggaccc

SEQ ID NO: 1434358 - DNA, 23 bp, Homo sapiens
tcttgggatagtgttctgctcct

SEQ ID NO: 1434359 - DNA, 14 bp, Homo sapiens
tcttgggctactgg

SEQ ID NO: 1434360 - DNA, 21 bp, Homo sapiens
tcttgggctactggcagctcc

SEQ ID NO: 1434361 - DNA, 13 bp, Homo sapiens
tcttggggcccag

SEQ ID NO: 1434362 - DNA, 17 bp, Homo sapiens
tcttggggcccagtgca

SEQ ID NO: 1434363 - DNA, 17 bp, Homo sapiens
tcttggggctgatgaag

SEQ ID NO: 1434364 - DNA, 14 bp, Homo sapiens
tcttgggggtcagg

SEQ ID NO: 1434365 - DNA, 18 bp, Homo sapiens
tcttgggtgtattctctg

SEQ ID NO: 1434366 - DNA, 20 bp, Homo sapiens
tcttgggtgtattctctgta

SEQ ID NO: 1434367 - DNA, 21 bp, Homo sapiens
tcttgggtgtattctctgtaa

SEQ ID NO: 1434368 - DNA, 14 bp, Homo sapiens
tcttggtaagaagc

SEQ ID NO: 1434369 - DNA, 16 bp, Homo sapiens
tcttggtatgcatctt

SEQ ID NO: 1434370 - DNA, 14 bp, Homo sapiens
tcttggtccctggt

SEQ ID NO: 1434371 - DNA, 14 bp, Homo sapiens
tcttggtgtaattt

SEQ ID NO: 1434372 - DNA, 13 bp, Homo sapiens
tcttggttctaaa

SEQ ID NO: 1434373 - DNA, 18 bp, Homo sapiens
tcttggtttggggagaaa

SEQ ID NO: 1434374 - DNA, 12 bp, Homo sapiens
tcttgtaaatgt

SEQ ID NO: 1434375 - DNA, 19 bp, Homo sapiens
tcttgtacatgtgtagcct

SEQ ID NO: 1434376 - DNA, 24 bp, Homo sapiens
tcttgtacatgtgtagcctgtgca

SEQ ID NO: 1434377 - DNA, 12 bp, Homo sapiens
tcttgtacttct

SEQ ID NO: 1434378 - DNA, 14 bp, Homo sapiens
tcttgtacttctgt

SEQ ID NO: 1434379 - DNA, 16 bp, Homo sapiens
tcttgtacttctgtgt

SEQ ID NO: 1434380 - DNA, 19 bp, Homo sapiens
tcttgtacttctgtgttca

SEQ ID NO: 1434381 - DNA, 20 bp, Homo sapiens
tcttgtatttgggccaaggt

SEQ ID NO: 1434382 - DNA, 21 bp, Homo sapiens
tcttgtatttgggccaaggtg

SEQ ID NO: 1434383 - DNA, 16 bp, Homo sapiens
tcttgtcacaataaat

SEQ ID NO: 1434384 - DNA, 11 bp, Homo sapiens
tcttgtcatgt

SEQ ID NO: 1434385 - DNA, 17 bp, Homo sapiens
tcttgtcatgtgtataa

SEQ ID NO: 1434386 - DNA, 16 bp, Homo sapiens
tcttgtcctcttctgc

SEQ ID NO: 1434387 - DNA, 13 bp, Homo sapiens
tcttgtctccact

SEQ ID NO: 1434388 - DNA, 13 bp, Homo sapiens
tcttgtctctggg

SEQ ID NO: 1434389 - DNA, 16 bp, Homo sapiens
tcttgtctgatttctt

SEQ ID NO: 1434390 - DNA, 20 bp, Homo sapiens
tcgaggcaccggcgctgcag

SEQ ID NO: 1434391 - DNA, 21 bp, Homo sapiens
tcgaggcatggggcatgtcct

SEQ ID NO: 1434392 - DNA, 19 bp, Homo sapiens
tcgaggccacattgctggc

SEQ ID NO: 1434393 - DNA, 22 bp, Homo sapiens
tcgaggccacattgctggctgc

SEQ ID NO: 1434394 - DNA, 18 bp, Homo sapiens
tcgaggcccagcgacctc

SEQ ID NO: 1434395 - DNA, 22 bp, Homo sapiens
tcgaggctagaggcatttggaa

SEQ ID NO: 1434396 - DNA, 16 bp, Homo sapiens
tcgagtgaatttctaa

SEQ ID NO: 1434397 - DNA, 20 bp, Homo sapiens
tcgagtgttgtgttaaaagg

SEQ ID NO: 1434398 - DNA, 19 bp, Homo sapiens
tcgatactgcgactttctg

SEQ ID NO: 1434399 - DNA, 18 bp, Homo sapiens
tcgatataggcatttggt

SEQ ID NO: 1434400 - DNA, 19 bp, Homo sapiens
tcgatcaaaaccttccttc

SEQ ID NO: 1434401 - DNA, 13 bp, Homo sapiens
tcgatcctggatt

SEQ ID NO: 1434402 - DNA, 19 bp, Homo sapiens
tcgatcctggattcactca

SEQ ID NO: 1434403 - DNA, 20 bp, Homo sapiens
tcgatctcattcagtattaa

SEQ ID NO: 1434404 - DNA, 18 bp, Homo sapiens
tcgatgcctgcatgctga

SEQ ID NO: 1434405 - DNA, 21 bp, Homo sapiens
tcgatgcctgcatgctgaaac

SEQ ID NO: 1434406 - DNA, 22 bp, Homo sapiens
tcgatggtggcgctttctcctg

SEQ ID NO: 1434407 - DNA, 16 bp, Homo sapiens
tcgattcaaactgctc

SEQ ID NO: 1434408 - DNA, 20 bp, Homo sapiens
tcgcaccactgcactccagc

SEQ ID NO: 1434409 - DNA, 13 bp, Homo sapiens
tcgcagctaccct

SEQ ID NO: 1434410 - DNA, 19 bp, Homo sapiens
tcgcaggatccgctgccac

SEQ ID NO: 1434411 - DNA, 22 bp, Homo sapiens
tcgcaggatccgctgccaccac

SEQ ID NO: 1434412 - DNA, 14 bp, Homo sapiens
tcgcattaagcaca

SEQ ID NO: 1434413 - DNA, 22 bp, Homo sapiens
tcgcattaagcacacacatctg

SEQ ID NO: 1434414 - DNA, 22 bp, Homo sapiens
tcgccagtcactgctgcaaggt

SEQ ID NO: 1434415 - DNA, 13 bp, Homo sapiens
tcgccatgccggg

SEQ ID NO: 1434416 - DNA, 14 bp, Homo sapiens
tcgccatgccgggg

SEQ ID NO: 1434417 - DNA, 11 bp, Homo sapiens
tcgcccagcag

SEQ ID NO: 1434418 - DNA, 13 bp, Homo sapiens
tcgcccagcagga

SEQ ID NO: 1434419 - DNA, 16 bp, Homo sapiens
tcgcccagtgccctgg

SEQ ID NO: 1434420 - DNA, 22 bp, Homo sapiens
tcgccccaacactgtccttccc

SEQ ID NO: 1434421 - DNA, 23 bp, Homo sapiens
tcgccccaacactgtccttccct

SEQ ID NO: 1434422 - DNA, 15 bp, Homo sapiens
tcgccccagatcacc

SEQ ID NO: 1434423 - DNA, 16 bp, Homo sapiens
tcgccccctgcctgcc

SEQ ID NO: 1434424 - DNA, 17 bp, Homo sapiens
tcgccccctgcctgcca

SEQ ID NO: 1434425 - DNA, 13 bp, Homo sapiens
tcgcccgcccact

SEQ ID NO: 1434426 - DNA, 22 bp, Homo sapiens
tcgcccgcccactgtcctgggc

SEQ ID NO: 1434427 - DNA, 18 bp, Homo sapiens
tcgccctcctttccctta

SEQ ID NO: 1434428 - DNA, 13 bp, Homo sapiens
tcgccctgtgagg

SEQ ID NO: 1434429 - DNA, 22 bp, Homo sapiens
tcgcccttcagcccaccaccct

SEQ ID NO: 1434430 - DNA, 16 bp, Homo sapiens
tcgccgtccctcccag

SEQ ID NO: 1434431 - DNA, 23 bp, Homo sapiens
tcgccgtgtctcagcctctgcca

SEQ ID NO: 1434432 - DNA, 21 bp, Homo sapiens
tcgcctgacaaccactggtct

SEQ ID NO: 1434433 - DNA, 18 bp, Homo sapiens
tcgcctgagcccaggagg

SEQ ID NO: 1434434 - DNA, 18 bp, Homo sapiens
tcgcctgtaatgccagcg

SEQ ID NO: 1434435 - DNA, 17 bp, Homo sapiens
tcgcgagtgtaactttc

SEQ ID NO: 1434436 - DNA, 23 bp, Homo sapiens
tcgcggggcagcaaagcagctga

SEQ ID NO: 1434437 - DNA, 12 bp, Homo sapiens
tcgctagaaaaa

SEQ ID NO: 1434438 - DNA, 22 bp, Homo sapiens
tcgctatgggaggcagccgagg

SEQ ID NO: 1434439 - DNA, 22 bp, Homo sapiens
tcgctcaggtgatcaaaataaa

SEQ ID NO: 1434440 - DNA, 16 bp, Homo sapiens
tcgctcccaaaggaaa

SEQ ID NO: 1434441 - DNA, 21 bp, Homo sapiens
tcgctccctgtagctctgcct

SEQ ID NO: 1434442 - DNA, 12 bp, Homo sapiens
tcgctctctctc

SEQ ID NO: 1434443 - DNA, 15 bp, Homo sapiens
tcgctctctctcgct

SEQ ID NO: 1434444 - DNA, 13 bp, Homo sapiens
tcgctgatgcaga

SEQ ID NO: 1434445 - DNA, 19 bp, Homo sapiens
tcgctgctctagctggcag

SEQ ID NO: 1434446 - DNA, 21 bp, Homo sapiens
tcgctgctctagctggcagga

SEQ ID NO: 1434447 - DNA, 13 bp, Homo sapiens
tcgctggctttct

SEQ ID NO: 1434448 - DNA, 16 bp, Homo sapiens
tcgctggctttctctc

SEQ ID NO: 1434449 - DNA, 20 bp, Homo sapiens
tcgctggctttctctctggc

SEQ ID NO: 1434450 - DNA, 16 bp, Homo sapiens
tcgctgtcacaggcgg

SEQ ID NO: 1434451 - DNA, 15 bp, Homo sapiens
tcgctgtcccctcag

SEQ ID NO: 1434452 - DNA, 14 bp, Homo sapiens
tcgcttcttgcctc

SEQ ID NO: 1434453 - DNA, 19 bp, Homo sapiens
tcgcttcttgcctctgtgc

SEQ ID NO: 1434454 - DNA, 17 bp, Homo sapiens
tcgcttgagcccaggag

SEQ ID NO: 1434455 - DNA, 22 bp, Homo sapiens
tcgcttgccgggcctgggcctc

SEQ ID NO: 1434456 - DNA, 19 bp, Homo sapiens
tcggaaaaataatcaaaag

SEQ ID NO: 1434457 - DNA, 20 bp, Homo sapiens
tcggaacccaagcttagaac

SEQ ID NO: 1434458 - DNA, 18 bp, Homo sapiens
tcggaactgtcctttcct

SEQ ID NO: 1434459 - DNA, 19 bp, Homo sapiens
tcggaactgtcctttcctt

SEQ ID NO: 1434460 - DNA, 21 bp, Homo sapiens
tcggacaagacccccagcact

SEQ ID NO: 1434461 - DNA, 21 bp, Homo sapiens
tcggacccaccaaactgcaca

SEQ ID NO: 1434462 - DNA, 19 bp, Homo sapiens
tcggacccaccccaactct

SEQ ID NO: 1434463 - DNA, 22 bp, Homo sapiens
tcggacggccaatggtgcttcc

SEQ ID NO: 1434464 - DNA, 15 bp, Homo sapiens
tcggactccatggct

SEQ ID NO: 1434465 - DNA, 12 bp, Homo sapiens
tcggactgccaa

SEQ ID NO: 1434466 - DNA, 13 bp, Homo sapiens
tcggagagcagca

SEQ ID NO: 1434467 - DNA, 13 bp, Homo sapiens
tcggagcaccctt

SEQ ID NO: 1434468 - DNA, 21 bp, Homo sapiens
tcggagccaatgaacagctcc

SEQ ID NO: 1434469 - DNA, 19 bp, Homo sapiens
tcggagcgaagcagagagg

SEQ ID NO: 1434470 - DNA, 20 bp, Homo sapiens
tcggagcgttctctgtccta

SEQ ID NO: 1434471 - DNA, 14 bp, Homo sapiens
tcggagctgcctgc

SEQ ID NO: 1434472 - DNA, 21 bp, Homo sapiens
tcggagctgcctgcagcacat

SEQ ID NO: 1434473 - DNA, 21 bp, Homo sapiens
tcggaggaccctggaaaacag

SEQ ID NO: 1434474 - DNA, 16 bp, Homo sapiens
tcggaggtccagctgg

SEQ ID NO: 1434475 - DNA, 23 bp, Homo sapiens
tcggaggtccagctgggcctcct

SEQ ID NO: 1434476 - DNA, 15 bp, Homo sapiens
tcggatcctgtgagt

SEQ ID NO: 1434477 - DNA, 23 bp, Homo sapiens
tcggatgaccaaaccagccttcg

SEQ ID NO: 1434478 - DNA, 13 bp, Homo sapiens
tcggcatgccagg

SEQ ID NO: 1434479 - DNA, 23 bp, Homo sapiens
tcggcatgccaggacccgccagc

SEQ ID NO: 1434480 - DNA, 22 bp, Homo sapiens
tcggccaagaatacttgaagaa

SEQ ID NO: 1434481 - DNA, 19 bp, Homo sapiens
tcggccaggcattggctca

SEQ ID NO: 1434482 - DNA, 12 bp, Homo sapiens
tcggcccacagc

SEQ ID NO: 1434483 - DNA, 14 bp, Homo sapiens
tcggccccacatgg

SEQ ID NO: 1434484 - DNA, 17 bp, Homo sapiens
tcggcctccgaggctcc

SEQ ID NO: 1434485 - DNA, 20 bp, Homo sapiens
tcggcctccgaggctccccg

SEQ ID NO: 1434486 - DNA, 22 bp, Homo sapiens
tcggccttggtgaacacacacg

SEQ ID NO: 1434487 - DNA, 12 bp, Homo sapiens
tcggctctggag

SEQ ID NO: 1434488 - DNA, 13 bp, Homo sapiens
tcggctctggagg

SEQ ID NO: 1434489 - DNA, 15 bp, Homo sapiens
tcggctgaccatgct

SEQ ID NO: 1434490 - DNA, 16 bp, Homo sapiens
tcggctgaccatgctc

SEQ ID NO: 1434491 - DNA, 15 bp, Homo sapiens
tcgggaacagtgttt

SEQ ID NO: 1434492 - DNA, 16 bp, Homo sapiens
tcgggagacagcatca

SEQ ID NO: 1434493 - DNA, 18 bp, Homo sapiens
tcgggagcacccagagca

SEQ ID NO: 1434494 - DNA, 14 bp, Homo sapiens
tcgggagcagtgtc

SEQ ID NO: 1434495 - DNA, 16 bp, Homo sapiens
tcgggagcagtgtctt

SEQ ID NO: 1434496 - DNA, 19 bp, Homo sapiens
tcgggagcagtgtcttcca

SEQ ID NO: 1434497 - DNA, 13 bp, Homo sapiens
tcgggcagccagc

SEQ ID NO: 1434498 - DNA, 15 bp, Homo sapiens
tcgggcagccagcag

SEQ ID NO: 1434499 - DNA, 16 bp, Homo sapiens
tcgggcagccagcaga

SEQ ID NO: 1434500 - DNA, 17 bp, Homo sapiens
tcgggcagccagcagag

SEQ ID NO: 1434501 - DNA, 21 bp, Homo sapiens
tcgggcccacctggccacctg

SEQ ID NO: 1434502 - DNA, 16 bp, Homo sapiens
tcgggctgagaaggca

SEQ ID NO: 1434503 - DNA, 12 bp, Homo sapiens
tcgggctgtgcc

SEQ ID NO: 1434504 - DNA, 13 bp, Homo sapiens
tcggggagcctta

SEQ ID NO: 1434505 - DNA, 18 bp, Homo sapiens
tcggggcaagagaggctg

SEQ ID NO: 1434506 - DNA, 18 bp, Homo sapiens
tcggggcatgctggggca

SEQ ID NO: 1434507 - DNA, 17 bp, Homo sapiens
tcggggcccttggggcc

SEQ ID NO: 1434508 - DNA, 12 bp, Homo sapiens
tcggggcctcct

SEQ ID NO: 1434509 - DNA, 16 bp, Homo sapiens
tcgggggcctgtggtg

SEQ ID NO: 1434510 - DNA, 16 bp, Homo sapiens
tcgggggctggcctag

SEQ ID NO: 1434511 - DNA, 20 bp, Homo sapiens
tcggggtaaaaagtggctgc

SEQ ID NO: 1434512 - DNA, 21 bp, Homo sapiens
tcggtaagttgaatggcctgc

SEQ ID NO: 1434513 - DNA, 20 bp, Homo sapiens
tcggtatctggcttccctgg

SEQ ID NO: 1434514 - DNA, 14 bp, Homo sapiens
tcggtttctgagca

SEQ ID NO: 1434515 - DNA, 15 bp, Homo sapiens
tcgtaatagctcaga

SEQ ID NO: 1434516 - DNA, 18 bp, Homo sapiens
tcgtaatagcttctgtgt

SEQ ID NO: 1434517 - DNA, 15 bp, Homo sapiens
tcgtacagaaagctg

SEQ ID NO: 1434518 - DNA, 13 bp, Homo sapiens
tcgtacctgtccc

SEQ ID NO: 1434519 - DNA, 14 bp, Homo sapiens
tcgtacctgtccct

SEQ ID NO: 1434520 - DNA, 12 bp, Homo sapiens
tcgtagacacag

SEQ ID NO: 1434521 - DNA, 18 bp, Homo sapiens
tcgtaggcagccacggcc

SEQ ID NO: 1434522 - DNA, 19 bp, Homo sapiens
tcgtcacgagcacaatggt

SEQ ID NO: 1434523 - DNA, 18 bp, Homo sapiens
tcgtcactaatacacagt

SEQ ID NO: 1434524 - DNA, 19 bp, Homo sapiens
tcgtccaagggacagccca

SEQ ID NO: 1434525 - DNA, 20 bp, Homo sapiens
tcgtccacaggggcaggcct

SEQ ID NO: 1434526 - DNA, 21 bp, Homo sapiens
tcgtccacaggggcaggcctg

SEQ ID NO: 1434527 - DNA, 23 bp, Homo sapiens
tcgtccacaggggcaggcctggg

SEQ ID NO: 1434528 - DNA, 16 bp, Homo sapiens
tcgtccgtctgtctcg

SEQ ID NO: 1434529 - DNA, 13 bp, Homo sapiens
tcgtcctccccct

SEQ ID NO: 1434530 - DNA, 17 bp, Homo sapiens
tcgtcctccccctgcca

SEQ ID NO: 1434531 - DNA, 13 bp, Homo sapiens
tcgtcctgtccca

SEQ ID NO: 1434532 - DNA, 14 bp, Homo sapiens
tcgtccttcctctc

SEQ ID NO: 1434533 - DNA, 18 bp, Homo sapiens
tcgtctatatatacatat

SEQ ID NO: 1434534 - DNA, 21 bp, Homo sapiens
tcgtctcggccttcacaatct

SEQ ID NO: 1434535 - DNA, 12 bp, Homo sapiens
tcgtctgtccca

SEQ ID NO: 1434536 - DNA, 15 bp, Homo sapiens
tcgtcttcagctgca

SEQ ID NO: 1434537 - DNA, 17 bp, Homo sapiens
tcgtcttgaacgagcag

SEQ ID NO: 1434538 - DNA, 18 bp, Homo sapiens
tcgtcttgaacgagcagc

SEQ ID NO: 1434539 - DNA, 23 bp, Homo sapiens
tcgtcttgaacgagcagcccagg

SEQ ID NO: 1434540 - DNA, 15 bp, Homo sapiens
tcgtcttgttgttat

SEQ ID NO: 1434541 - DNA, 18 bp, Homo sapiens
tcgtgaaaaccaaccctg

SEQ ID NO: 1434542 - DNA, 22 bp, Homo sapiens
tcgtgaaaaccaaccctgtggg

SEQ ID NO: 1434543 - DNA, 18 bp, Homo sapiens
tcgtgacccttcagggcc

SEQ ID NO: 1434544 - DNA, 13 bp, Homo sapiens
tcgtgagctgggg

SEQ ID NO: 1434545 - DNA, 15 bp, Homo sapiens
tcgtgagctggggac

SEQ ID NO: 1434546 - DNA, 15 bp, Homo sapiens
tcgtgatgtggagga

SEQ ID NO: 1434547 - DNA, 17 bp, Homo sapiens
tcgtgccagcagcctcg

SEQ ID NO: 1434548 - DNA, 18 bp, Homo sapiens
tcgtgccagcagcctcgc

SEQ ID NO: 1434549 - DNA, 13 bp, Homo sapiens
tcgtgcctgtgtc

SEQ ID NO: 1434550 - DNA, 19 bp, Homo sapiens
tcgtgctgtgctctggcac

SEQ ID NO: 1434551 - DNA, 20 bp, Homo sapiens
tcgtggactgagtgggaagc

SEQ ID NO: 1434552 - DNA, 22 bp, Homo sapiens
tcgtggactgagtgggaagccc

SEQ ID NO: 1434553 - DNA, 19 bp, Homo sapiens
tcgtggcacgtattgctgt

SEQ ID NO: 1434554 - DNA, 15 bp, Homo sapiens
tcgtggccagcccgg

SEQ ID NO: 1434555 - DNA, 17 bp, Homo sapiens
tcgtggccagcccggct

SEQ ID NO: 1434556 - DNA, 20 bp, Homo sapiens
tcgtggccttccccagcctc

SEQ ID NO: 1434557 - DNA, 12 bp, Homo sapiens
tcgtggggaggt

SEQ ID NO: 1434558 - DNA, 18 bp, Homo sapiens
tcgtggggtgtgctggga

SEQ ID NO: 1434559 - DNA, 23 bp, Homo sapiens
tcgtgtagtggaagagcagcctg

SEQ ID NO: 1434560 - DNA, 22 bp, Homo sapiens
tcgtgtatcctggggctccctt

SEQ ID NO: 1434561 - DNA, 18 bp, Homo sapiens
tcctggtgggtcagccca

SEQ ID NO: 1434562 - DNA, 21 bp, Homo sapiens
tcctggtgggtcagcccagca

SEQ ID NO: 1434563 - DNA, 13 bp, Homo sapiens
tcctggtgtctag

SEQ ID NO: 1434564 - DNA, 16 bp, Homo sapiens
tcctggtgtctagttt

SEQ ID NO: 1434565 - DNA, 15 bp, Homo sapiens
tcctggttcccgttt

SEQ ID NO: 1434566 - DNA, 23 bp, Homo sapiens
tcctggttcccgtttctccacct

SEQ ID NO: 1434567 - DNA, 17 bp, Homo sapiens
tcctggtttcctggcag

SEQ ID NO: 1434568 - DNA, 19 bp, Homo sapiens
tcctgtaaaggttacaagc

SEQ ID NO: 1434569 - DNA, 17 bp, Homo sapiens
tcctgtaacaggtgtgg

SEQ ID NO: 1434570 - DNA, 20 bp, Homo sapiens
tcctgtacattgtgggatgt

SEQ ID NO: 1434571 - DNA, 18 bp, Homo sapiens
tcctgtactactgccttg

SEQ ID NO: 1434572 - DNA, 18 bp, Homo sapiens
tcctgtagccactggcat

SEQ ID NO: 1434573 - DNA, 16 bp, Homo sapiens
tcctgtagctctccct

SEQ ID NO: 1434574 - DNA, 14 bp, Homo sapiens
tcctgtattcttgt

SEQ ID NO: 1434575 - DNA, 19 bp, Homo sapiens
tcctgtcaagcaatcaaga

SEQ ID NO: 1434576 - DNA, 20 bp, Homo sapiens
tcctgtccaacctaacccct

SEQ ID NO: 1434577 - DNA, 12 bp, Homo sapiens
tcctgtccactc

SEQ ID NO: 1434578 - DNA, 19 bp, Homo sapiens
tcctgtccactctcggggc

SEQ ID NO: 1434579 - DNA, 16 bp, Homo sapiens
tcctgtccagctccaa

SEQ ID NO: 1434580 - DNA, 15 bp, Homo sapiens
tcctgtcccagaggt

SEQ ID NO: 1434581 - DNA, 16 bp, Homo sapiens
tcctgtccctccatcc

SEQ ID NO: 1434582 - DNA, 12 bp, Homo sapiens
tcctgtccctgt

SEQ ID NO: 1434583 - DNA, 15 bp, Homo sapiens
tcctgtccctgtagc

SEQ ID NO: 1434584 - DNA, 14 bp, Homo sapiens
tcctgtcccttttc

SEQ ID NO: 1434585 - DNA, 13 bp, Homo sapiens
tcctgtcctgctc

SEQ ID NO: 1434586 - DNA, 23 bp, Homo sapiens
tcctgtcgaaggggaggcacact

SEQ ID NO: 1434587 - DNA, 19 bp, Homo sapiens
tcctgtctcagcctcctga

SEQ ID NO: 1434588 - DNA, 20 bp, Homo sapiens
tcctgtctgccctctgggtc

SEQ ID NO: 1434589 - DNA, 21 bp, Homo sapiens
tcctgtcttatcctccaccgt

SEQ ID NO: 1434590 - DNA, 15 bp, Homo sapiens
tcctgtcttcctgca

SEQ ID NO: 1434591 - DNA, 20 bp, Homo sapiens
tcctgtgaatgccactgcct

SEQ ID NO: 1434592 - DNA, 14 bp, Homo sapiens
tcctgtgacatgta

SEQ ID NO: 1434593 - DNA, 15 bp, Homo sapiens
tcctgtgaccccacc

SEQ ID NO: 1434594 - DNA, 15 bp, Homo sapiens
tcctgtgcatgggtg

SEQ ID NO: 1434595 - DNA, 18 bp, Homo sapiens
tcctgtgcatgggtgaag

SEQ ID NO: 1434596 - DNA, 17 bp, Homo sapiens
tcctgtgcccacatccc

SEQ ID NO: 1434597 - DNA, 14 bp, Homo sapiens
tcctgtgccctaga

SEQ ID NO: 1434598 - DNA, 21 bp, Homo sapiens
tcctgtgctatttgtacaaat

SEQ ID NO: 1434599 - DNA, 23 bp, Homo sapiens
tcctgtgctatttgtacaaataa

SEQ ID NO: 1434600 - DNA, 19 bp, Homo sapiens
tcctgtggcagctgcccct

SEQ ID NO: 1434601 - DNA, 19 bp, Homo sapiens
tcctgtggcataaattgca

SEQ ID NO: 1434602 - DNA, 13 bp, Homo sapiens
tcctgtggccagg

SEQ ID NO: 1434603 - DNA, 23 bp, Homo sapiens
tcctgtggccccaccctgggccc

SEQ ID NO: 1434604 - DNA, 14 bp, Homo sapiens
tcctgtggctccct

SEQ ID NO: 1434605 - DNA, 18 bp, Homo sapiens
tcctgtggggttgttttt

SEQ ID NO: 1434606 - DNA, 22 bp, Homo sapiens
tcctgtgtaacacttggctctt

SEQ ID NO: 1434607 - DNA, 13 bp, Homo sapiens
tcctgtgtagcat

SEQ ID NO: 1434608 - DNA, 17 bp, Homo sapiens
tcctgtgttcaatattt

SEQ ID NO: 1434609 - DNA, 12 bp, Homo sapiens
tcctgtgtttct

SEQ ID NO: 1434610 - DNA, 19 bp, Homo sapiens
tcctgtgtttctagggaaa

SEQ ID NO: 1434611 - DNA, 14 bp, Homo sapiens
tcctgtgtttgtga

SEQ ID NO: 1434612 - DNA, 17 bp, Homo sapiens
tcctgttacttgcttca

SEQ ID NO: 1434613 - DNA, 15 bp, Homo sapiens
tcctgttctgcgctg

SEQ ID NO: 1434614 - DNA, 19 bp, Homo sapiens
tcctgttgatgggaaaagc

SEQ ID NO: 1434615 - DNA, 15 bp, Homo sapiens
tcctgttgccatgga

SEQ ID NO: 1434616 - DNA, 18 bp, Homo sapiens
tcctgtttcctagctgtg

SEQ ID NO: 1434617 - DNA, 21 bp, Homo sapiens
tcctgtttgaaatatcatgtt

SEQ ID NO: 1434618 - DNA, 21 bp, Homo sapiens
tccttaaaattaagttgaaaa

SEQ ID NO: 1434619 - DNA, 14 bp, Homo sapiens
tccttaaacatgaa

SEQ ID NO: 1434620 - DNA, 17 bp, Homo sapiens
tccttaaactgtgtgga

SEQ ID NO: 1434621 - DNA, 20 bp, Homo sapiens
tccttaaatgacttttctta

SEQ ID NO: 1434622 - DNA, 15 bp, Homo sapiens
tccttaacatttctc

SEQ ID NO: 1434623 - DNA, 16 bp, Homo sapiens
tccttaacatttctct

SEQ ID NO: 1434624 - DNA, 17 bp, Homo sapiens
tccttaacatttctctc

SEQ ID NO: 1434625 - DNA, 15 bp, Homo sapiens
tccttaacccacctc

SEQ ID NO: 1434626 - DNA, 20 bp, Homo sapiens
tccttaacccacctctcctg

SEQ ID NO: 1434627 - DNA, 13 bp, Homo sapiens
tccttaagaacac

SEQ ID NO: 1434628 - DNA, 20 bp, Homo sapiens
tccttaagctgcagagattt

SEQ ID NO: 1434629 - DNA, 17 bp, Homo sapiens
tccttaattcactccca

SEQ ID NO: 1434630 - DNA, 22 bp, Homo sapiens
tccttacaagttagaaaacata

SEQ ID NO: 1434631 - DNA, 20 bp, Homo sapiens
tccttaccaatagcctgaat

SEQ ID NO: 1434632 - DNA, 16 bp, Homo sapiens
tccttactctgagccc

SEQ ID NO: 1434633 - DNA, 19 bp, Homo sapiens
tccttactctgagcccagg

SEQ ID NO: 1434634 - DNA, 19 bp, Homo sapiens
tccttagaatggagggcaa

SEQ ID NO: 1434635 - DNA, 18 bp, Homo sapiens
tccttagacccgccaggt

SEQ ID NO: 1434636 - DNA, 23 bp, Homo sapiens
tccttagacctgagggacccttc

SEQ ID NO: 1434637 - DNA, 20 bp, Homo sapiens
tccttagaggtcctctggag

SEQ ID NO: 1434638 - DNA, 14 bp, Homo sapiens
tccttagcaagggg

SEQ ID NO: 1434639 - DNA, 21 bp, Homo sapiens
tccttagcttagacctcagcc

SEQ ID NO: 1434640 - DNA, 21 bp, Homo sapiens
tccttataggcctgtcccttg

SEQ ID NO: 1434641 - DNA, 13 bp, Homo sapiens
tccttatccctct

SEQ ID NO: 1434642 - DNA, 14 bp, Homo sapiens
tccttatccctctc

SEQ ID NO: 1434643 - DNA, 15 bp, Homo sapiens
tccttatctataaaa

SEQ ID NO: 1434644 - DNA, 16 bp, Homo sapiens
tccttatctataaaag

SEQ ID NO: 1434645 - DNA, 22 bp, Homo sapiens
tccttatgtatcagtgtccttt

SEQ ID NO: 1434646 - DNA, 16 bp, Homo sapiens
tccttatgtcctgtca

SEQ ID NO: 1434647 - DNA, 15 bp, Homo sapiens
tccttatttgccttc

SEQ ID NO: 1434648 - DNA, 19 bp, Homo sapiens
tccttatttgccttctact

SEQ ID NO: 1434649 - DNA, 18 bp, Homo sapiens
tccttcaagttagctcag

SEQ ID NO: 1434650 - DNA, 20 bp, Homo sapiens
tccttcaagttagctcagga

SEQ ID NO: 1434651 - DNA, 20 bp, Homo sapiens
tccttcacatcctgtgtttc

SEQ ID NO: 1434652 - DNA, 19 bp, Homo sapiens
tccttcaccagagcccatg

SEQ ID NO: 1434653 - DNA, 15 bp, Homo sapiens
tccttcactggcgcc

SEQ ID NO: 1434654 - DNA, 18 bp, Homo sapiens
tccttcactggcgccttc

SEQ ID NO: 1434655 - DNA, 19 bp, Homo sapiens
tccttcactgttccctctg

SEQ ID NO: 1434656 - DNA, 21 bp, Homo sapiens
tccttcactgttccctctggc

SEQ ID NO: 1434657 - DNA, 22 bp, Homo sapiens
tccttcactgttccctctggct

SEQ ID NO: 1434658 - DNA, 23 bp, Homo sapiens
tccttcagacaccctcaacctct

SEQ ID NO: 1434659 - DNA, 12 bp, Homo sapiens
tccttcagcacg

SEQ ID NO: 1434660 - DNA, 19 bp, Homo sapiens
tccttcagccctcacccct

SEQ ID NO: 1434661 - DNA, 21 bp, Homo sapiens
tccttcagccctcacccctgg

SEQ ID NO: 1434662 - DNA, 12 bp, Homo sapiens
tccttcaggttt

SEQ ID NO: 1434663 - DNA, 22 bp, Homo sapiens
tccttcagtcttctagaaacag

SEQ ID NO: 1434664 - DNA, 18 bp, Homo sapiens
tccttcatcgaatgctaa

SEQ ID NO: 1434665 - DNA, 19 bp, Homo sapiens
tccttcatgacagcctcca

SEQ ID NO: 1434666 - DNA, 14 bp, Homo sapiens
tccttccacctgcc

SEQ ID NO: 1434667 - DNA, 13 bp, Homo sapiens
tccttccaggccc

SEQ ID NO: 1434668 - DNA, 16 bp, Homo sapiens
tccttccaggccccca

SEQ ID NO: 1434669 - DNA, 13 bp, Homo sapiens
tccttccagtggc

SEQ ID NO: 1434670 - DNA, 13 bp, Homo sapiens
tccttccatccat

SEQ ID NO: 1434671 - DNA, 17 bp, Homo sapiens
tccttccatccctaccc

SEQ ID NO: 1434672 - DNA, 13 bp, Homo sapiens
tccttccatcttg

SEQ ID NO: 1434673 - DNA, 14 bp, Homo sapiens
tccttccattccac

SEQ ID NO: 1434674 - DNA, 15 bp, Homo sapiens
tccttcccaggccct

SEQ ID NO: 1434675 - DNA, 18 bp, Homo sapiens
tccttcccaggccctttg

SEQ ID NO: 1434676 - DNA, 20 bp, Homo sapiens
tccttcccaggccctttggc

SEQ ID NO: 1434677 - DNA, 21 bp, Homo sapiens
tccttcccatgcctgtctctg

SEQ ID NO: 1434678 - DNA, 18 bp, Homo sapiens
tccttcccatttctctac

SEQ ID NO: 1434679 - DNA, 13 bp, Homo sapiens
tccttcccccagc

SEQ ID NO: 1434680 - DNA, 15 bp, Homo sapiens
tccttcccccagccc

SEQ ID NO: 1434681 - DNA, 21 bp, Homo sapiens
tccttcccccagcccaataaa

SEQ ID NO: 1434682 - DNA, 11 bp, Homo sapiens
tccttcccctg

SEQ ID NO: 1434683 - DNA, 14 bp, Homo sapiens
tccttccctgccac

SEQ ID NO: 1434684 - DNA, 12 bp, Homo sapiens
tccttccctggg

SEQ ID NO: 1434685 - DNA, 20 bp, Homo sapiens
tccttccctgggctgtgcta

SEQ ID NO: 1434686 - DNA, 16 bp, Homo sapiens
tccttcccttctcttg

SEQ ID NO: 1434687 - DNA, 14 bp, Homo sapiens
tccttcctcttggc

SEQ ID NO: 1434688 - DNA, 15 bp, Homo sapiens
tccttcctgattgtt

SEQ ID NO: 1434689 - DNA, 15 bp, Homo sapiens
tccttcctggcctga

SEQ ID NO: 1434690 - DNA, 19 bp, Homo sapiens
tccttcctgtcttcctgca

SEQ ID NO: 1434691 - DNA, 14 bp, Homo sapiens
tccttccttcccac

SEQ ID NO: 1434692 - DNA, 19 bp, Homo sapiens
tccttccttgctgtcctag

SEQ ID NO: 1434693 - DNA, 16 bp, Homo sapiens
tccttcgaaaggcctt

SEQ ID NO: 1434694 - DNA, 16 bp, Homo sapiens
tccttcgtgtctctcc

SEQ ID NO: 1434695 - DNA, 17 bp, Homo sapiens
tccttctaccccaaggc

SEQ ID NO: 1434696 - DNA, 23 bp, Homo sapiens
tccttctaccccaaggccagtag

SEQ ID NO: 1434697 - DNA, 18 bp, Homo sapiens
tccttctagtttcccaca

SEQ ID NO: 1434698 - DNA, 13 bp, Homo sapiens
tccttctccagga

SEQ ID NO: 1434699 - DNA, 13 bp, Homo sapiens
tccttctcccctg

SEQ ID NO: 1434700 - DNA, 14 bp, Homo sapiens
tccttctcccctgc

SEQ ID NO: 1434701 - DNA, 12 bp, Homo sapiens
tccttctctggg

SEQ ID NO: 1434702 - DNA, 13 bp, Homo sapiens
tccttctctgggt

SEQ ID NO: 1434703 - DNA, 14 bp, Homo sapiens
tccttctctgggtc

SEQ ID NO: 1434704 - DNA, 17 bp, Homo sapiens
tccttctgagctccacc

SEQ ID NO: 1434705 - DNA, 18 bp, Homo sapiens
tccttctgagctccacct

SEQ ID NO: 1434706 - DNA, 22 bp, Homo sapiens
tccttctgagctccacctctgg

SEQ ID NO: 1434707 - DNA, 12 bp, Homo sapiens
tccttctgttaa

SEQ ID NO: 1434708 - DNA, 14 bp, Homo sapiens
tccttcttccactt

SEQ ID NO: 1434709 - DNA, 17 bp, Homo sapiens
tccttcttccacttctc

SEQ ID NO: 1434710 - DNA, 21 bp, Homo sapiens
tccttgaccagcagatcccag

SEQ ID NO: 1434711 - DNA, 19 bp, Homo sapiens
tccttgacctctataaact

SEQ ID NO: 1434712 - DNA, 14 bp, Homo sapiens
tccttgagctgttg

SEQ ID NO: 1434713 - DNA, 16 bp, Homo sapiens
tccttgatatcattca

SEQ ID NO: 1434714 - DNA, 13 bp, Homo sapiens
tccttgatatttg

SEQ ID NO: 1434715 - DNA, 17 bp, Homo sapiens
tccttgatatttgtatt

SEQ ID NO: 1434716 - DNA, 16 bp, Homo sapiens
tccttgatgccagagg

SEQ ID NO: 1434717 - DNA, 19 bp, Homo sapiens
tccttgatgccagagggcc

SEQ ID NO: 1434718 - DNA, 21 bp, Homo sapiens
tccttgatgccagagggccag

SEQ ID NO: 1434719 - DNA, 19 bp, Homo sapiens
tccttgatgtacagatttt

SEQ ID NO: 1434720 - DNA, 14 bp, Homo sapiens
tccttgatttcaaa

SEQ ID NO: 1434721 - DNA, 22 bp, Homo sapiens
tccttgcacactcccctgcact

SEQ ID NO: 1434722 - DNA, 17 bp, Homo sapiens
tccttgcatcaattttt

SEQ ID NO: 1434723 - DNA, 21 bp, Homo sapiens
tccttgctagccctggggtgg

SEQ ID NO: 1434724 - DNA, 17 bp, Homo sapiens
tccttgctgcagcttct

SEQ ID NO: 1434725 - DNA, 21 bp, Homo sapiens
tccttgctgtcctaggccaca

SEQ ID NO: 1434726 - DNA, 22 bp, Homo sapiens
tccttgcttatgacatcacttg

SEQ ID NO: 1434727 - DNA, 14 bp, Homo sapiens
tccttgcttcctga

SEQ ID NO: 1434728 - DNA, 13 bp, Homo sapiens
tccttggaggcca

SEQ ID NO: 1434729 - DNA, 18 bp, Homo sapiens
tccttggattttcctgaa

SEQ ID NO: 1434730 - DNA, 22 bp, Homo sapiens
tccttggattttcctgaaagtg

SEQ ID NO: 1434731 - DNA, 15 bp, Homo sapiens
tccttggcatgcctt

SEQ ID NO: 1434732 - DNA, 18 bp, Homo sapiens
tccttggcatgccttcca

SEQ ID NO: 1434733 - DNA, 23 bp, Homo sapiens
tccttggccaccagaccatgggc

SEQ ID NO: 1434734 - DNA, 16 bp, Homo sapiens
tccttggccatgcaga

SEQ ID NO: 1434735 - DNA, 17 bp, Homo sapiens
tccttggctttatgcaa

SEQ ID NO: 1434736 - DNA, 22 bp, Homo sapiens
tccttggctttatgcaaataca

SEQ ID NO: 1434737 - DNA, 18 bp, Homo sapiens
tccttggctttcagagcc

SEQ ID NO: 1434738 - DNA, 22 bp, Homo sapiens
tccttggctttcagagccagcc

SEQ ID NO: 1434739 - DNA, 18 bp, Homo sapiens
tccttgggcgtctctaat

SEQ ID NO: 1434740 - DNA, 12 bp, Homo sapiens
tccttgggctcc

SEQ ID NO: 1434741 - DNA, 22 bp, Homo sapiens
tccttgggctcctggctgccag

SEQ ID NO: 1434742 - DNA, 18 bp, Homo sapiens
tccttgggggctcccagg

SEQ ID NO: 1434743 - DNA, 14 bp, Homo sapiens
tccttggtgctgtg

SEQ ID NO: 1434744 - DNA, 19 bp, Homo sapiens
tccttggtgctgtgtgccc

SEQ ID NO: 1434745 - DNA, 21 bp, Homo sapiens
tccttggtgctgtgtgcccca

SEQ ID NO: 1434746 - DNA, 23 bp, Homo sapiens
tccttggtgctgtgtgccccact

SEQ ID NO: 1434747 - DNA, 12 bp, Homo sapiens
tccttgtaatac

SEQ ID NO: 1434748 - DNA, 16 bp, Homo sapiens
tccttgtaatacctga

SEQ ID NO: 1434749 - DNA, 15 bp, Homo sapiens
tccttgtcaccagca

SEQ ID NO: 1434750 - DNA, 19 bp, Homo sapiens
tccttgtgcaattgtcttt

SEQ ID NO: 1434751 - DNA, 13 bp, Homo sapiens
tccttgtggactg

SEQ ID NO: 1434752 - DNA, 20 bp, Homo sapiens
tccttgtggactggctgtgc

SEQ ID NO: 1434753 - DNA, 21 bp, Homo sapiens
tccttgtggactggctgtgcc

SEQ ID NO: 1434754 - DNA, 22 bp, Homo sapiens
tccttgtggactggctgtgccc

SEQ ID NO: 1434755 - DNA, 22 bp, Homo sapiens
tccttgtttcaaacacaaatgc

SEQ ID NO: 1434756 - DNA, 18 bp, Homo sapiens
tcctttaaaaaagaaaag

SEQ ID NO: 1434757 - DNA, 13 bp, Homo sapiens
tcctttaattgta

SEQ ID NO: 1434758 - DNA, 21 bp, Homo sapiens
tcctttaattttttactattt

SEQ ID NO: 1434759 - DNA, 16 bp, Homo sapiens
tcctttcacaaccttc

SEQ ID NO: 1434760 - DNA, 20 bp, Homo sapiens
tcctttcacaaccttctgtg

SEQ ID NO: 1434761 - DNA, 21 bp, Homo sapiens
tcctttcagggaatttcagga

SEQ ID NO: 1434762 - DNA, 22 bp, Homo sapiens
tcctttcagggaatttcaggaa

SEQ ID NO: 1434763 - DNA, 23 bp, Homo sapiens
tcctttcagggaatttcaggaac

SEQ ID NO: 1434764 - DNA, 17 bp, Homo sapiens
tcctttcatctctctac

SEQ ID NO: 1434765 - DNA, 18 bp, Homo sapiens
tcctttccaaggcttctc

SEQ ID NO: 1434766 - DNA, 13 bp, Homo sapiens
tcctttccatctg

SEQ ID NO: 1434767 - DNA, 13 bp, Homo sapiens
tcctttcccaagc

SEQ ID NO: 1434768 - DNA, 16 bp, Homo sapiens
tcctttcccaagcctt

SEQ ID NO: 1434769 - DNA, 12 bp, Homo sapiens
tcctttccttcc

SEQ ID NO: 1434770 - DNA, 22 bp, Homo sapiens
tcctttccttcccaggcccttt

SEQ ID NO: 1434771 - DNA, 14 bp, Homo sapiens
tcctttctaaacaa

SEQ ID NO: 1434772 - DNA, 13 bp, Homo sapiens
tcctttctcctgc

SEQ ID NO: 1434773 - DNA, 14 bp, Homo sapiens
tcctttctcctgcc

SEQ ID NO: 1434774 - DNA, 13 bp, Homo sapiens
tcctttctctggg

SEQ ID NO: 1434775 - DNA, 22 bp, Homo sapiens
tcctttctgcagacgtctgcct

SEQ ID NO: 1434776 - DNA, 19 bp, Homo sapiens
tcctttctggaagtttctg

SEQ ID NO: 1434777 - DNA, 19 bp, Homo sapiens
tcctttcttctagtatttt

SEQ ID NO: 1434778 - DNA, 20 bp, Homo sapiens
tcctttgaacgtgcttcttt

SEQ ID NO: 1434779 - DNA, 22 bp, Homo sapiens
tcctttgaacgtgcttctttgt

SEQ ID NO: 1434780 - DNA, 22 bp, Homo sapiens
tcctttgaagctttaggcagag

SEQ ID NO: 1434781 - DNA, 20 bp, Homo sapiens
tcctttgcactgagggccac

SEQ ID NO: 1434782 - DNA, 13 bp, Homo sapiens
tcctttgctcttg

SEQ ID NO: 1434783 - DNA, 13 bp, Homo sapiens
tcctttgggaaag

SEQ ID NO: 1434784 - DNA, 15 bp, Homo sapiens
tcctttgtattctgt

SEQ ID NO: 1434785 - DNA, 13 bp, Homo sapiens
tcctttgtcattt

SEQ ID NO: 1434786 - DNA, 21 bp, Homo sapiens
tcctttgtcttcaaactgtga

SEQ ID NO: 1434787 - DNA, 18 bp, Homo sapiens
tcctttgtgtggctgccc

SEQ ID NO: 1434788 - DNA, 17 bp, Homo sapiens
tcctttgtgtgtgtgtc

SEQ ID NO: 1434789 - DNA, 16 bp, Homo sapiens
tcctttgttctgagca

SEQ ID NO: 1434790 - DNA, 16 bp, Homo sapiens
tcctttgttcttacct

SEQ ID NO: 1434791 - DNA, 24 bp, Homo sapiens
tcctttgttcttacctgtatgtct

SEQ ID NO: 1434792 - DNA, 17 bp, Homo sapiens
tcctttgtttaataaag

SEQ ID NO: 1434793 - DNA, 20 bp, Homo sapiens
tcctttgttttctgactaat

SEQ ID NO: 1434794 - DNA, 12 bp, Homo sapiens
tccttttaactg

SEQ ID NO: 1434795 - DNA, 19 bp, Homo sapiens
tcctgcctttaagccaaag

SEQ ID NO: 1434796 - DNA, 20 bp, Homo sapiens
tcctgcctttaagccaaaga

SEQ ID NO: 1434797 - DNA, 12 bp, Homo sapiens
tcctgcctttta

SEQ ID NO: 1434798 - DNA, 14 bp, Homo sapiens
tcctgcgaggctat

SEQ ID NO: 1434799 - DNA, 17 bp, Homo sapiens
tcctgcgaggctatgag

SEQ ID NO: 1434800 - DNA, 20 bp, Homo sapiens
tcctgcgggcttttccccgg

SEQ ID NO: 1434801 - DNA, 15 bp, Homo sapiens
tcctgcgtcctcctc

SEQ ID NO: 1434802 - DNA, 18 bp, Homo sapiens
tcctgctactctgttcct

SEQ ID NO: 1434803 - DNA, 14 bp, Homo sapiens
tcctgctacttccc

SEQ ID NO: 1434804 - DNA, 22 bp, Homo sapiens
tcctgctacttccccagctctc

SEQ ID NO: 1434805 - DNA, 17 bp, Homo sapiens
tcctgctagctgtagaa

SEQ ID NO: 1434806 - DNA, 23 bp, Homo sapiens
tcctgctcaactctacccctgct

SEQ ID NO: 1434807 - DNA, 23 bp, Homo sapiens
tcctgctcacctgtgtgcccagc

SEQ ID NO: 1434808 - DNA, 16 bp, Homo sapiens
tcctgctcatattgtg

SEQ ID NO: 1434809 - DNA, 12 bp, Homo sapiens
tcctgctccagc

SEQ ID NO: 1434810 - DNA, 16 bp, Homo sapiens
tcctgctccgctgcct

SEQ ID NO: 1434811 - DNA, 18 bp, Homo sapiens
tcctgctccgctgcctgg

SEQ ID NO: 1434812 - DNA, 19 bp, Homo sapiens
tcctgctccgctgcctgga

SEQ ID NO: 1434813 - DNA, 14 bp, Homo sapiens
tcctgctccgtgga

SEQ ID NO: 1434814 - DNA, 18 bp, Homo sapiens
tcctgctccgtggactgc

SEQ ID NO: 1434815 - DNA, 13 bp, Homo sapiens
tcctgctcctcac

SEQ ID NO: 1434816 - DNA, 15 bp, Homo sapiens
tcctgctcctccctg

SEQ ID NO: 1434817 - DNA, 12 bp, Homo sapiens
tcctgctctggg

SEQ ID NO: 1434818 - DNA, 17 bp, Homo sapiens
tcctgctgcacaggccc

SEQ ID NO: 1434819 - DNA, 18 bp, Homo sapiens
tcctgctgcacaggccct

SEQ ID NO: 1434820 - DNA, 20 bp, Homo sapiens
tcctgctgcacaggccctgg

SEQ ID NO: 1434821 - DNA, 13 bp, Homo sapiens
tcctgctgcaccc

SEQ ID NO: 1434822 - DNA, 14 bp, Homo sapiens
tcctgctgcaccct

SEQ ID NO: 1434823 - DNA, 16 bp, Homo sapiens
tcctgctgccctccca

SEQ ID NO: 1434824 - DNA, 15 bp, Homo sapiens
tcctgctgctggggc

SEQ ID NO: 1434825 - DNA, 10 bp, Homo sapiens
tcctgctggg

SEQ ID NO: 1434826 - DNA, 13 bp, Homo sapiens
tcctgctggggcc

SEQ ID NO: 1434827 - DNA, 17 bp, Homo sapiens
tcctgctggggccgcca

SEQ ID NO: 1434828 - DNA, 13 bp, Homo sapiens
tcctgctggtacc

SEQ ID NO: 1434829 - DNA, 14 bp, Homo sapiens
tcctgctggtacct

SEQ ID NO: 1434830 - DNA, 18 bp, Homo sapiens
tcctgctgtatttcctgc

SEQ ID NO: 1434831 - DNA, 16 bp, Homo sapiens
tcctgctgtcctggtg

SEQ ID NO: 1434832 - DNA, 11 bp, Homo sapiens
tcctgctgtgc

SEQ ID NO: 1434833 - DNA, 14 bp, Homo sapiens
tcctgctgtgctgg

SEQ ID NO: 1434834 - DNA, 17 bp, Homo sapiens
tcctgcttaaacacaag

SEQ ID NO: 1434835 - DNA, 11 bp, Homo sapiens
tcctgcttccc

SEQ ID NO: 1434836 - DNA, 17 bp, Homo sapiens
tcctgcttcctcttttc

SEQ ID NO: 1434837 - DNA, 16 bp, Homo sapiens
tcctgcttgccaaggc

SEQ ID NO: 1434838 - DNA, 17 bp, Homo sapiens
tcctgcttttctgtcct

SEQ ID NO: 1434839 - DNA, 20 bp, Homo sapiens
tcctgcttttctgtcctggg

SEQ ID NO: 1434840 - DNA, 22 bp, Homo sapiens
tcctgcttttctgtcctgggca

SEQ ID NO: 1434841 - DNA, 16 bp, Homo sapiens
tcctggaaacagcatg

SEQ ID NO: 1434842 - DNA, 16 bp, Homo sapiens
tcctggaaaggctcag

SEQ ID NO: 1434843 - DNA, 22 bp, Homo sapiens
tcctggaaaggctcagtctcag

SEQ ID NO: 1434844 - DNA, 14 bp, Homo sapiens
tcctggaaccaatc

SEQ ID NO: 1434845 - DNA, 15 bp, Homo sapiens
tcctggaaccaatcc

SEQ ID NO: 1434846 - DNA, 14 bp, Homo sapiens
tcctggaagcacag

SEQ ID NO: 1434847 - DNA, 17 bp, Homo sapiens
tcctggaagcagagcaa

SEQ ID NO: 1434848 - DNA, 19 bp, Homo sapiens
tcctggaagcagagcaaaa

SEQ ID NO: 1434849 - DNA, 20 bp, Homo sapiens
tcctggaagcagagcaaaat

SEQ ID NO: 1434850 - DNA, 17 bp, Homo sapiens
tcctggaagcaggtgct

SEQ ID NO: 1434851 - DNA, 18 bp, Homo sapiens
tcctggaagccagctttc

SEQ ID NO: 1434852 - DNA, 22 bp, Homo sapiens
tcctggaagcgcgagggcctca

SEQ ID NO: 1434853 - DNA, 17 bp, Homo sapiens
tcctggaattgccagct

SEQ ID NO: 1434854 - DNA, 14 bp, Homo sapiens
tcctggacatcacc

SEQ ID NO: 1434855 - DNA, 22 bp, Homo sapiens
tcctggacctgagtcggcccca

SEQ ID NO: 1434856 - DNA, 22 bp, Homo sapiens
tcctggaccttgacagagcagc

SEQ ID NO: 1434857 - DNA, 15 bp, Homo sapiens
tcctggactcccctc

SEQ ID NO: 1434858 - DNA, 20 bp, Homo sapiens
tcctggacttacaaaatgcc

SEQ ID NO: 1434859 - DNA, 18 bp, Homo sapiens
tcctggagctctgtgggt

SEQ ID NO: 1434860 - DNA, 13 bp, Homo sapiens
tcctggaggccca

SEQ ID NO: 1434861 - DNA, 16 bp, Homo sapiens
tcctggaggtcttttc

SEQ ID NO: 1434862 - DNA, 23 bp, Homo sapiens
tcctggcacgccctactccactg

SEQ ID NO: 1434863 - DNA, 16 bp, Homo sapiens
tcctggcagcccagag

SEQ ID NO: 1434864 - DNA, 14 bp, Homo sapiens
tcctggccccgggc

SEQ ID NO: 1434865 - DNA, 14 bp, Homo sapiens
tcctggcccttcag

SEQ ID NO: 1434866 - DNA, 23 bp, Homo sapiens
tcctggcccttcagtctgctcca

SEQ ID NO: 1434867 - DNA, 14 bp, Homo sapiens
tcctggcctatccg

SEQ ID NO: 1434868 - DNA, 22 bp, Homo sapiens
tcctggcctatccgctgccagc

SEQ ID NO: 1434869 - DNA, 23 bp, Homo sapiens
tcctggcctcactggctggggca

SEQ ID NO: 1434870 - DNA, 23 bp, Homo sapiens
tcctggcctggcacatcagaaag

SEQ ID NO: 1434871 - DNA, 15 bp, Homo sapiens
tcctggccttctgaa

SEQ ID NO: 1434872 - DNA, 12 bp, Homo sapiens
tcctggcgcctg

SEQ ID NO: 1434873 - DNA, 20 bp, Homo sapiens
tcctggcgcctggcagtccg

SEQ ID NO: 1434874 - DNA, 14 bp, Homo sapiens
tcctggctacatcc

SEQ ID NO: 1434875 - DNA, 17 bp, Homo sapiens
tcctggctacatcccag

SEQ ID NO: 1434876 - DNA, 24 bp, Homo sapiens
tcctggctacatcccagcctgtgg

SEQ ID NO: 1434877 - DNA, 13 bp, Homo sapiens
tcctggctcctga

SEQ ID NO: 1434878 - DNA, 20 bp, Homo sapiens
tcctggctctaccctgtctg

SEQ ID NO: 1434879 - DNA, 22 bp, Homo sapiens
tcctggctctaccctgtctgtc

SEQ ID NO: 1434880 - DNA, 23 bp, Homo sapiens
tcctggctcttgatacccccctc

SEQ ID NO: 1434881 - DNA, 24 bp, Homo sapiens
tcctggctgatgatccagaacagt

SEQ ID NO: 1434882 - DNA, 13 bp, Homo sapiens
tcctggctgcact

SEQ ID NO: 1434883 - DNA, 22 bp, Homo sapiens
tcctggctgcggcgtctgtctg

SEQ ID NO: 1434884 - DNA, 15 bp, Homo sapiens
tcctggctgtgccca

SEQ ID NO: 1434885 - DNA, 17 bp, Homo sapiens
tcctggctgtgcccagc

SEQ ID NO: 1434886 - DNA, 18 bp, Homo sapiens
tcctggctgtgcccagca

SEQ ID NO: 1434887 - DNA, 23 bp, Homo sapiens
tcctggctgtgcccagcaggccc

SEQ ID NO: 1434888 - DNA, 23 bp, Homo sapiens
tcctgggagaacctcaggcttcc

SEQ ID NO: 1434889 - DNA, 23 bp, Homo sapiens
tcctgggcatgggtccagggcct

SEQ ID NO: 1434890 - DNA, 10 bp, Homo sapiens
tcctgggcct

SEQ ID NO: 1434891 - DNA, 15 bp, Homo sapiens
tcctgggcctgcaga

SEQ ID NO: 1434892 - DNA, 13 bp, Homo sapiens
tcctgggcctgcc

SEQ ID NO: 1434893 - DNA, 18 bp, Homo sapiens
tcctgggcgccctggaag

SEQ ID NO: 1434894 - DNA, 19 bp, Homo sapiens
tcctgggcgccctggaagc

SEQ ID NO: 1434895 - DNA, 22 bp, Homo sapiens
tcctggggaaggtggagcagct

SEQ ID NO: 1434896 - DNA, 23 bp, Homo sapiens
tcctggggaccccactccctgct

SEQ ID NO: 1434897 - DNA, 19 bp, Homo sapiens
tcctggggatgtcatagcc

SEQ ID NO: 1434898 - DNA, 19 bp, Homo sapiens
tcctggggccccgctggga

SEQ ID NO: 1434899 - DNA, 22 bp, Homo sapiens
tcctggggcctcggagcctcat

SEQ ID NO: 1434900 - DNA, 15 bp, Homo sapiens
tcctggggcctcttg

SEQ ID NO: 1434901 - DNA, 15 bp, Homo sapiens
tcctggggcgtccag

SEQ ID NO: 1434902 - DNA, 14 bp, Homo sapiens
tcctggggctccct

SEQ ID NO: 1434903 - DNA, 15 bp, Homo sapiens
tcctggggctctgtg

SEQ ID NO: 1434904 - DNA, 22 bp, Homo sapiens
tcctgggtgggtggggtacagg

SEQ ID NO: 1434905 - DNA, 16 bp, Homo sapiens
tcctggtaattcctct

SEQ ID NO: 1434906 - DNA, 15 bp, Homo sapiens
tcctggtacccagcc

SEQ ID NO: 1434907 - DNA, 13 bp, Homo sapiens
tcctggtccctca

SEQ ID NO: 1434908 - DNA, 17 bp, Homo sapiens
tcctggtcctggctgca

SEQ ID NO: 1434909 - DNA, 19 bp, Homo sapiens
tcctggtcctggctgcact

SEQ ID NO: 1434910 - DNA, 14 bp, Homo sapiens
tcctggtgctctct

SEQ ID NO: 1434911 - DNA, 21 bp, Homo sapiens
tcctggtggggctgagcctga

SEQ ID NO: 1434912 - DNA, 17 bp, Homo sapiens
tccctgttttagtttct

SEQ ID NO: 1434913 - DNA, 21 bp, Homo sapiens
tccctgttttagtttctgaac

SEQ ID NO: 1434914 - DNA, 17 bp, Homo sapiens
tcccttaactccaagaa

SEQ ID NO: 1434915 - DNA, 13 bp, Homo sapiens
tcccttacctcaa

SEQ ID NO: 1434916 - DNA, 14 bp, Homo sapiens
tcccttagccccga

SEQ ID NO: 1434917 - DNA, 16 bp, Homo sapiens
tcccttagcctctccc

SEQ ID NO: 1434918 - DNA, 18 bp, Homo sapiens
tcccttagcctctcccac

SEQ ID NO: 1434919 - DNA, 11 bp, Homo sapiens
tcccttcaacc

SEQ ID NO: 1434920 - DNA, 21 bp, Homo sapiens
tcccttcagtaccctctcagc

SEQ ID NO: 1434921 - DNA, 13 bp, Homo sapiens
tcccttccaaaga

SEQ ID NO: 1434922 - DNA, 19 bp, Homo sapiens
tcctgccaccccttcctcc

SEQ ID NO: 1434923 - DNA, 17 bp, Homo sapiens
tcctgccattcttctgg

SEQ ID NO: 1434924 - DNA, 18 bp, Homo sapiens
tcctgccattcttctggt

SEQ ID NO: 1434925 - DNA, 12 bp, Homo sapiens
tcctgcccagga

SEQ ID NO: 1434926 - DNA, 13 bp, Homo sapiens
tcctgcccaggag

SEQ ID NO: 1434927 - DNA, 14 bp, Homo sapiens
tcctgcccaggaga

SEQ ID NO: 1434928 - DNA, 14 bp, Homo sapiens
tcctgcccaggagc

SEQ ID NO: 1434929 - DNA, 17 bp, Homo sapiens
tcctgcccagtgttgtt

SEQ ID NO: 1434930 - DNA, 19 bp, Homo sapiens
tcctgccccaagggcccag

SEQ ID NO: 1434931 - DNA, 21 bp, Homo sapiens
tcctgccccaagggcccagac

SEQ ID NO: 1434932 - DNA, 14 bp, Homo sapiens
tcctgccccaggcc

SEQ ID NO: 1434933 - DNA, 13 bp, Homo sapiens
tcctgccctctgc

SEQ ID NO: 1434934 - DNA, 23 bp, Homo sapiens
tcctgccctctgctctgcctgga

SEQ ID NO: 1434935 - DNA, 12 bp, Homo sapiens
tcctgccctgcc

SEQ ID NO: 1434936 - DNA, 16 bp, Homo sapiens
tcctgccctgctgttt

SEQ ID NO: 1434937 - DNA, 10 bp, Homo sapiens
tcctgccctt

SEQ ID NO: 1434938 - DNA, 16 bp, Homo sapiens
tcctgcccttcctcag

SEQ ID NO: 1434939 - DNA, 12 bp, Homo sapiens
tcctgcccttga

SEQ ID NO: 1434940 - DNA, 13 bp, Homo sapiens
tcctgccgcagac

SEQ ID NO: 1434941 - DNA, 15 bp, Homo sapiens
tcctgccgcagagct

SEQ ID NO: 1434942 - DNA, 20 bp, Homo sapiens
tcctgccgcagagctggccg

SEQ ID NO: 1434943 - DNA, 20 bp, Homo sapiens
tcctgcctccgggcaggcaa

SEQ ID NO: 1434944 - DNA, 14 bp, Homo sapiens
tcctgcctgcccct

SEQ ID NO: 1434945 - DNA, 14 bp, Homo sapiens
tcctgcctggccag

SEQ ID NO: 1434946 - DNA, 16 bp, Homo sapiens
tcctgcctgtctgccc

SEQ ID NO: 1434947 - DNA, 19 bp, Homo sapiens
tcctgcctgtctgccccag

SEQ ID NO: 1434948 - DNA, 20 bp, Homo sapiens
tcctgcctgtctgccccagc

SEQ ID NO: 1434949 - DNA, 12 bp, Homo sapiens
tcctgcctgtgc

SEQ ID NO: 1434950 - DNA, 12 bp, Homo sapiens
tcctgcctgtgg

SEQ ID NO: 1434951 - DNA, 14 bp, Homo sapiens
tcctgcctttaagc

SEQ ID NO: 1434952 - DNA, 22 bp, Homo sapiens
tccctctcagtgccttctctca

SEQ ID NO: 1434953 - DNA, 17 bp, Homo sapiens
tccctctcatctcaggt

SEQ ID NO: 1434954 - DNA, 18 bp, Homo sapiens
tccctctccctctctctg

SEQ ID NO: 1434955 - DNA, 15 bp, Homo sapiens
tccctctcctgccta

SEQ ID NO: 1434956 - DNA, 15 bp, Homo sapiens
tccctctcgctcccc

SEQ ID NO: 1434957 - DNA, 19 bp, Homo sapiens
tccccctcctgctgtgctg

SEQ ID NO: 1434958 - DNA, 15 bp, Homo sapiens
tccccctccttgtgc

SEQ ID NO: 1434959 - DNA, 18 bp, Homo sapiens
tccccctccttgtgcctt

SEQ ID NO: 1434960 - DNA, 14 bp, Homo sapiens
tccccctctgcttc

SEQ ID NO: 1434961 - DNA, 20 bp, Homo sapiens
tccccctcttcttctgaaga

SEQ ID NO: 1434962 - DNA, 23 bp, Homo sapiens
tccccctgccctcgtggccagcc

SEQ ID NO: 1434963 - DNA, 20 bp, Homo sapiens
tccccctggggcttctcctg

SEQ ID NO: 1434964 - DNA, 18 bp, Homo sapiens
tccccctgtagactagtg

SEQ ID NO: 1434965 - DNA, 12 bp, Homo sapiens
tcccccttccca

SEQ ID NO: 1434966 - DNA, 21 bp, Homo sapiens
tcccccttgaggattgtggaa

SEQ ID NO: 1434967 - DNA, 19 bp, Homo sapiens
tccccctttcacactggat

SEQ ID NO: 1434968 - DNA, 14 bp, Homo sapiens
tcccccttttttgt

SEQ ID NO: 1434969 - DNA, 19 bp, Homo sapiens
tcccccttttttgtccccc

SEQ ID NO: 1434970 - DNA, 17 bp, Homo sapiens
tccccgaggagctgggc

SEQ ID NO: 1434971 - DNA, 13 bp, Homo sapiens
tccccgaggctgc

SEQ ID NO: 1434972 - DNA, 14 bp, Homo sapiens
tccccgaggctgcc

SEQ ID NO: 1434973 - DNA, 16 bp, Homo sapiens
tccccgaggctgcccc

SEQ ID NO: 1434974 - DNA, 17 bp, Homo sapiens
tccccgaggctgcccca

SEQ ID NO: 1434975 - DNA, 20 bp, Homo sapiens
tccccgaggctgccccaggc

SEQ ID NO: 1434976 - DNA, 22 bp, Homo sapiens
tccccgagtcagggcgacttcc

SEQ ID NO: 1434977 - DNA, 17 bp, Homo sapiens
tccccgatgctgacctc

SEQ ID NO: 1434978 - DNA, 20 bp, Homo sapiens
tccccgatgtcccctgcggg

SEQ ID NO: 1434979 - DNA, 18 bp, Homo sapiens
tccccgcaacccacagct

SEQ ID NO: 1434980 - DNA, 14 bp, Homo sapiens
tccccgcacccccc

SEQ ID NO: 1434981 - DNA, 21 bp, Homo sapiens
tccccgcagcccgcctgccgt

SEQ ID NO: 1434982 - DNA, 12 bp, Homo sapiens
tccccgcccctg

SEQ ID NO: 1434983 - DNA, 18 bp, Homo sapiens
tccccgcccctgtggccc

SEQ ID NO: 1434984 - DNA, 15 bp, Homo sapiens
tccccgcctccactc

SEQ ID NO: 1434985 - DNA, 17 bp, Homo sapiens
tccccgcctccactcta

SEQ ID NO: 1434986 - DNA, 13 bp, Homo sapiens
tccccgcctggcc

SEQ ID NO: 1434987 - DNA, 15 bp, Homo sapiens
tccccgcctggccag

SEQ ID NO: 1434988 - DNA, 22 bp, Homo sapiens
tccccgctccgtctctgtcctc

SEQ ID NO: 1434989 - DNA, 17 bp, Homo sapiens
tccccgctctccctgtc

SEQ ID NO: 1434990 - DNA, 18 bp, Homo sapiens
tccccgctctccctgtca

SEQ ID NO: 1434991 - DNA, 23 bp, Homo sapiens
tccccggcaggcctgagaatgag

SEQ ID NO: 1434992 - DNA, 15 bp, Homo sapiens
tccccggccctacca

SEQ ID NO: 1434993 - DNA, 13 bp, Homo sapiens
tccccggctcgag

SEQ ID NO: 1434994 - DNA, 23 bp, Homo sapiens
tccccgggtctctcactgttgca

SEQ ID NO: 1434995 - DNA, 23 bp, Homo sapiens
tcccctaaccctactttgcttcc

SEQ ID NO: 1434996 - DNA, 14 bp, Homo sapiens
tcccctaacctcat

SEQ ID NO: 1434997 - DNA, 16 bp, Homo sapiens
tcccctactccctctt

SEQ ID NO: 1434998 - DNA, 17 bp, Homo sapiens
tcccctactccctcttc

SEQ ID NO: 1434999 - DNA, 17 bp, Homo sapiens
tcccctagctcaccagg

SEQ ID NO: 1435000 - DNA, 16 bp, Homo sapiens
tcccctatccacccag

SEQ ID NO: 1435001 - DNA, 17 bp, Homo sapiens
tcccctatccacccagc

SEQ ID NO: 1435002 - DNA, 15 bp, Homo sapiens
tcccctatgctggta

SEQ ID NO: 1435003 - DNA, 16 bp, Homo sapiens
tcccctatgctggtag

SEQ ID NO: 1435004 - DNA, 24 bp, Homo sapiens
tcccctatgctggtagatgctgag

SEQ ID NO: 1435005 - DNA, 14 bp, Homo sapiens
tcccctcacccaaa

SEQ ID NO: 1435006 - DNA, 15 bp, Homo sapiens
tcccctcacctcctc

SEQ ID NO: 1435007 - DNA, 11 bp, Homo sapiens
tcccctcagcg

SEQ ID NO: 1435008 - DNA, 14 bp, Homo sapiens
tcccctccacagct

SEQ ID NO: 1435009 - DNA, 17 bp, Homo sapiens
tcccctcccacccacag

SEQ ID NO: 1435010 - DNA, 16 bp, Homo sapiens
tcccctcccaggggag

SEQ ID NO: 1435011 - DNA, 20 bp, Homo sapiens
tcccctcccaggggagccag

SEQ ID NO: 1435012 - DNA, 21 bp, Homo sapiens
tcccctcccaggggagccagc

SEQ ID NO: 1435013 - DNA, 20 bp, Homo sapiens
tcccctcccccactcctcta

SEQ ID NO: 1435014 - DNA, 21 bp, Homo sapiens
tcccctccctggctcccatga

SEQ ID NO: 1435015 - DNA, 14 bp, Homo sapiens
tcccctccctgtca

SEQ ID NO: 1435016 - DNA, 21 bp, Homo sapiens
tcccctccgcagcagggaagc

SEQ ID NO: 1435017 - DNA, 21 bp, Homo sapiens
tcccctccggactggtgccct

SEQ ID NO: 1435018 - DNA, 12 bp, Homo sapiens
tcccctcctcca

SEQ ID NO: 1435019 - DNA, 14 bp, Homo sapiens
tcccctcctcttcc

SEQ ID NO: 1435020 - DNA, 19 bp, Homo sapiens
tcccctcctcttcccttag

SEQ ID NO: 1435021 - DNA, 15 bp, Homo sapiens
tcccctcctgctggg

SEQ ID NO: 1435022 - DNA, 16 bp, Homo sapiens
tcccctcctgctgggc

SEQ ID NO: 1435023 - DNA, 12 bp, Homo sapiens
tcccctccttgg

SEQ ID NO: 1435024 - DNA, 14 bp, Homo sapiens
tcccctccttgggc

SEQ ID NO: 1435025 - DNA, 16 bp, Homo sapiens
tcccctcggagaagag

SEQ ID NO: 1435026 - DNA, 20 bp, Homo sapiens
tcccctcgtcctgtcccaga

SEQ ID NO: 1435027 - DNA, 15 bp, Homo sapiens
tcccctctccttcct

SEQ ID NO: 1435028 - DNA, 15 bp, Homo sapiens
tcccctctctctggg

SEQ ID NO: 1435029 - DNA, 18 bp, Homo sapiens
tcccctctgcaacccccc

SEQ ID NO: 1435030 - DNA, 20 bp, Homo sapiens
tcccctctgccggtccccca

SEQ ID NO: 1435031 - DNA, 15 bp, Homo sapiens
tcccctctgctgctg

SEQ ID NO: 1435032 - DNA, 10 bp, Homo sapiens
tcccctctgt

SEQ ID NO: 1435033 - DNA, 14 bp, Homo sapiens
tcccctctgtgctt

SEQ ID NO: 1435034 - DNA, 21 bp, Homo sapiens
tcccctgcacctggcctgggc

SEQ ID NO: 1435035 - DNA, 14 bp, Homo sapiens
tcccctgcactgga

SEQ ID NO: 1435036 - DNA, 13 bp, Homo sapiens
tcccctgcactgt

SEQ ID NO: 1435037 - DNA, 16 bp, Homo sapiens
tcccctgcactgtaaa

SEQ ID NO: 1435038 - DNA, 18 bp, Homo sapiens
tcccctgcactgtaaaat

SEQ ID NO: 1435039 - DNA, 12 bp, Homo sapiens
tcccctgccaca

SEQ ID NO: 1435040 - DNA, 16 bp, Homo sapiens
tcccctgccaccaggc

SEQ ID NO: 1435041 - DNA, 15 bp, Homo sapiens
tcccctgccccagag

SEQ ID NO: 1435042 - DNA, 16 bp, Homo sapiens
tcccctgccccagagg

SEQ ID NO: 1435043 - DNA, 13 bp, Homo sapiens
tcccctgccccca

SEQ ID NO: 1435044 - DNA, 15 bp, Homo sapiens
tcccctgcccccagg

SEQ ID NO: 1435045 - DNA, 16 bp, Homo sapiens
tcccctgcccccagga

SEQ ID NO: 1435046 - DNA, 17 bp, Homo sapiens
tcccctgcccccaggac

SEQ ID NO: 1435047 - DNA, 18 bp, Homo sapiens
tcccctgcccccaggact

SEQ ID NO: 1435048 - DNA, 22 bp, Homo sapiens
tcccctgcccccaggactgggc

SEQ ID NO: 1435049 - DNA, 13 bp, Homo sapiens
tcccctgcccggt

SEQ ID NO: 1435050 - DNA, 11 bp, Homo sapiens
tcccctgcctc

SEQ ID NO: 1435051 - DNA, 13 bp, Homo sapiens
tcccctgcctcct

SEQ ID NO: 1435052 - DNA, 14 bp, Homo sapiens
tcccctgcctcctg

SEQ ID NO: 1435053 - DNA, 19 bp, Homo sapiens
tcccctgcctcctgccacc

SEQ ID NO: 1435054 - DNA, 19 bp, Homo sapiens
tcccctgctactcctgtgc

SEQ ID NO: 1435055 - DNA, 20 bp, Homo sapiens
tcccctgctactcctgtgct

SEQ ID NO: 1435056 - DNA, 23 bp, Homo sapiens
tcccctgctactcctgtgctctg

SEQ ID NO: 1435057 - DNA, 15 bp, Homo sapiens
tcccctgctcccagg

SEQ ID NO: 1435058 - DNA, 16 bp, Homo sapiens
tcccctgctgaggcag

SEQ ID NO: 1435059 - DNA, 15 bp, Homo sapiens
tcccctggagccagc

SEQ ID NO: 1435060 - DNA, 20 bp, Homo sapiens
tcccctggagccagcagggc

SEQ ID NO: 1435061 - DNA, 12 bp, Homo sapiens
tcccctggcagt

SEQ ID NO: 1435062 - DNA, 12 bp, Homo sapiens
tcccctggcctt

SEQ ID NO: 1435063 - DNA, 21 bp, Homo sapiens
tcccctgggttaacaaatgag

SEQ ID NO: 1435064 - DNA, 16 bp, Homo sapiens
tcccctgtcccaccaa

SEQ ID NO: 1435065 - DNA, 12 bp, Homo sapiens
tcccctgtctac

SEQ ID NO: 1435066 - DNA, 18 bp, Homo sapiens
tcccctgtctctaaggag

SEQ ID NO: 1435067 - DNA, 14 bp, Homo sapiens
tccccttcctgttt

SEQ ID NO: 1435068 - DNA, 15 bp, Homo sapiens
tccccaacgtcccct

SEQ ID NO: 1435069 - DNA, 18 bp, Homo sapiens
tccccaacgtcccctccg

SEQ ID NO: 1435070 - DNA, 18 bp, Homo sapiens
tccccaagaccccctggg

SEQ ID NO: 1435071 - DNA, 23 bp, Homo sapiens
tccccaagattcacacctgactc

SEQ ID NO: 1435072 - DNA, 16 bp, Homo sapiens
tccccaaggcctctct

SEQ ID NO: 1435073 - DNA, 13 bp, Homo sapiens
tccccaagggccc

SEQ ID NO: 1435074 - DNA, 16 bp, Homo sapiens
tccccaagggccctgg

SEQ ID NO: 1435075 - DNA, 19 bp, Homo sapiens
tccccaagggccctggcac

SEQ ID NO: 1435076 - DNA, 16 bp, Homo sapiens
tccccaattctcccct

SEQ ID NO: 1435077 - DNA, 21 bp, Homo sapiens
tccccacacagggcactgact

SEQ ID NO: 1435078 - DNA, 19 bp, Homo sapiens
tccccacaccttccagggc

SEQ ID NO: 1435079 - DNA, 16 bp, Homo sapiens
tccccacactccactc

SEQ ID NO: 1435080 - DNA, 22 bp, Homo sapiens
tccccacactccactctgattc

SEQ ID NO: 1435081 - DNA, 13 bp, Homo sapiens
tccccacagaact

SEQ ID NO: 1435082 - DNA, 19 bp, Homo sapiens
tccccacagaactgcttac

SEQ ID NO: 1435083 - DNA, 13 bp, Homo sapiens
tccccacccctgc

SEQ ID NO: 1435084 - DNA, 16 bp, Homo sapiens
tccccacccctgcccc

SEQ ID NO: 1435085 - DNA, 18 bp, Homo sapiens
tccccacccgcctgcaga

SEQ ID NO: 1435086 - DNA, 19 bp, Homo sapiens
tccccacccgcctgcagag

SEQ ID NO: 1435087 - DNA, 15 bp, Homo sapiens
tccccaccctccact

SEQ ID NO: 1435088 - DNA, 19 bp, Homo sapiens
tccccaccctccactcagc

SEQ ID NO: 1435089 - DNA, 18 bp, Homo sapiens
tccccacctacccagctg

SEQ ID NO: 1435090 - DNA, 23 bp, Homo sapiens
tccccacctacccagctgatggg

SEQ ID NO: 1435091 - DNA, 18 bp, Homo sapiens
tccccaccttcaattcct

SEQ ID NO: 1435092 - DNA, 22 bp, Homo sapiens
tccccaccttcaattcctgggc

SEQ ID NO: 1435093 - DNA, 23 bp, Homo sapiens
tccccaccttcaattcctgggcc

SEQ ID NO: 1435094 - DNA, 23 bp, Homo sapiens
tccccacgagtcacctgcaagcc

SEQ ID NO: 1435095 - DNA, 13 bp, Homo sapiens
tccccactccctt

SEQ ID NO: 1435096 - DNA, 17 bp, Homo sapiens
tccccacttctgtgcca

SEQ ID NO: 1435097 - DNA, 14 bp, Homo sapiens
tccccagacttgca

SEQ ID NO: 1435098 - DNA, 18 bp, Homo sapiens
tccccagacttgcactgg

SEQ ID NO: 1435099 - DNA, 19 bp, Homo sapiens
tccccagacttgcactggg

SEQ ID NO: 1435100 - DNA, 10 bp, Homo sapiens
tccccagaga

SEQ ID NO: 1435101 - DNA, 11 bp, Homo sapiens
tccccagagaa

SEQ ID NO: 1435102 - DNA, 23 bp, Homo sapiens
tccccagagaaaggggagcccac

SEQ ID NO: 1435103 - DNA, 18 bp, Homo sapiens
tccccagagcccagctct

SEQ ID NO: 1435104 - DNA, 20 bp, Homo sapiens
tccccagagctgtgccagca

SEQ ID NO: 1435105 - DNA, 21 bp, Homo sapiens
tccccagagctgtgccagcag

SEQ ID NO: 1435106 - DNA, 20 bp, Homo sapiens
tccccagcattccagcccct

SEQ ID NO: 1435107 - DNA, 13 bp, Homo sapiens
tccccagccacag

SEQ ID NO: 1435108 - DNA, 16 bp, Homo sapiens
tccccagccagaggtg

SEQ ID NO: 1435109 - DNA, 15 bp, Homo sapiens
tccccagcccagaga

SEQ ID NO: 1435110 - DNA, 12 bp, Homo sapiens
tccccagccctt

SEQ ID NO: 1435111 - DNA, 13 bp, Homo sapiens
tccccagcccttc

SEQ ID NO: 1435112 - DNA, 14 bp, Homo sapiens
tccccagcccttct

SEQ ID NO: 1435113 - DNA, 12 bp, Homo sapiens
tccccagcctct

SEQ ID NO: 1435114 - DNA, 12 bp, Homo sapiens
tccccagctccc

SEQ ID NO: 1435115 - DNA, 14 bp, Homo sapiens
tccccagctcccca

SEQ ID NO: 1435116 - DNA, 16 bp, Homo sapiens
tccccagctccccagg

SEQ ID NO: 1435117 - DNA, 20 bp, Homo sapiens
tccccagctccccaggactc

SEQ ID NO: 1435118 - DNA, 14 bp, Homo sapiens
tccccagctctcag

SEQ ID NO: 1435119 - DNA, 20 bp, Homo sapiens
tccccagctcttctcttcct

SEQ ID NO: 1435120 - DNA, 14 bp, Homo sapiens
tccccagctggtgg

SEQ ID NO: 1435121 - DNA, 23 bp, Homo sapiens
tccccaggactcaccctcatacc

SEQ ID NO: 1435122 - DNA, 21 bp, Homo sapiens
tccccaggcccaccatcacca

SEQ ID NO: 1435123 - DNA, 12 bp, Homo sapiens
tccccaggcctc

SEQ ID NO: 1435124 - DNA, 20 bp, Homo sapiens
tccccaggcctccagcctct

SEQ ID NO: 1435125 - DNA, 22 bp, Homo sapiens
tccccaggcctccagcctctcc

SEQ ID NO: 1435126 - DNA, 15 bp, Homo sapiens
tccccagggaaggaa

SEQ ID NO: 1435127 - DNA, 17 bp, Homo sapiens
tccccagggagctctgg

SEQ ID NO: 1435128 - DNA, 11 bp, Homo sapiens
tccccagggcc

SEQ ID NO: 1435129 - DNA, 16 bp, Homo sapiens
tccccagggcccctcc

SEQ ID NO: 1435130 - DNA, 21 bp, Homo sapiens
tccccagggcccctccctctg

SEQ ID NO: 1435131 - DNA, 22 bp, Homo sapiens
tccccagggcccctccctctgc

SEQ ID NO: 1435132 - DNA, 15 bp, Homo sapiens
tccccaggggagttg

SEQ ID NO: 1435133 - DNA, 17 bp, Homo sapiens
tccccaggggtcccagc

SEQ ID NO: 1435134 - DNA, 20 bp, Homo sapiens
tccccaggggtcccagccac

SEQ ID NO: 1435135 - DNA, 15 bp, Homo sapiens
tccccaggtccagct

SEQ ID NO: 1435136 - DNA, 16 bp, Homo sapiens
tccccaggtccagctc

SEQ ID NO: 1435137 - DNA, 16 bp, Homo sapiens
tccccaggtctctcca

SEQ ID NO: 1435138 - DNA, 18 bp, Homo sapiens
tccccaggtggctgaccc

SEQ ID NO: 1435139 - DNA, 20 bp, Homo sapiens
tccccaggtggctgacccag

SEQ ID NO: 1435140 - DNA, 14 bp, Homo sapiens
tccccagtgcctgc

SEQ ID NO: 1435141 - DNA, 20 bp, Homo sapiens
tccccataagacaaacactg

SEQ ID NO: 1435142 - DNA, 22 bp, Homo sapiens
tccccataagacaaacactgcc

SEQ ID NO: 1435143 - DNA, 17 bp, Homo sapiens
tccccatccctgtcatt

SEQ ID NO: 1435144 - DNA, 21 bp, Homo sapiens
tccccatctttgatccttctg

SEQ ID NO: 1435145 - DNA, 13 bp, Homo sapiens
tccccatggagcc

SEQ ID NO: 1435146 - DNA, 15 bp, Homo sapiens
tccccatggagccag

SEQ ID NO: 1435147 - DNA, 22 bp, Homo sapiens
tccccatgtgcctgcaccagga

SEQ ID NO: 1435148 - DNA, 21 bp, Homo sapiens
tccccattagagtcagccttc

SEQ ID NO: 1435149 - DNA, 14 bp, Homo sapiens
tccccattcttcct

SEQ ID NO: 1435150 - DNA, 16 bp, Homo sapiens
tccccatttcccatct

SEQ ID NO: 1435151 - DNA, 20 bp, Homo sapiens
tccccatttcccatctgcac

SEQ ID NO: 1435152 - DNA, 16 bp, Homo sapiens
tcccccaaaccctgct

SEQ ID NO: 1435153 - DNA, 18 bp, Homo sapiens
tcccccaaaccctgcttc

SEQ ID NO: 1435154 - DNA, 18 bp, Homo sapiens
tcccccaaagggcctcct

SEQ ID NO: 1435155 - DNA, 15 bp, Homo sapiens
tcccccaacccccac

SEQ ID NO: 1435156 - DNA, 19 bp, Homo sapiens
tcccccaacccccacccca

SEQ ID NO: 1435157 - DNA, 10 bp, Homo sapiens
tcccccaaga

SEQ ID NO: 1435158 - DNA, 22 bp, Homo sapiens
tcccccaccagctaaggacatt

SEQ ID NO: 1435159 - DNA, 15 bp, Homo sapiens
tcccccacccctcca

SEQ ID NO: 1435160 - DNA, 17 bp, Homo sapiens
tcccccacccctccacg

SEQ ID NO: 1435161 - DNA, 18 bp, Homo sapiens
tcccccactactgcagca

SEQ ID NO: 1435162 - DNA, 24 bp, Homo sapiens
tcccccactactgcagcacctcca

SEQ ID NO: 1435163 - DNA, 20 bp, Homo sapiens
tcccccagcaacgcccctcc

SEQ ID NO: 1435164 - DNA, 19 bp, Homo sapiens
tcccccagccaaactgtct

SEQ ID NO: 1435165 - DNA, 14 bp, Homo sapiens
tcccccagccagga

SEQ ID NO: 1435166 - DNA, 12 bp, Homo sapiens
tcccccagccca

SEQ ID NO: 1435167 - DNA, 13 bp, Homo sapiens
tcccccagcccaa

SEQ ID NO: 1435168 - DNA, 14 bp, Homo sapiens
tcccccagcccaat

SEQ ID NO: 1435169 - DNA, 17 bp, Homo sapiens
tcccccagcccaataaa

SEQ ID NO: 1435170 - DNA, 21 bp, Homo sapiens
tcccccagcccaataaaggtc

SEQ ID NO: 1435171 - DNA, 19 bp, Homo sapiens
tcccccaggtgttgtaaca

SEQ ID NO: 1435172 - DNA, 16 bp, Homo sapiens
tcccccagtacctcca

SEQ ID NO: 1435173 - DNA, 19 bp, Homo sapiens
tcccccatcccccactgcc

SEQ ID NO: 1435174 - DNA, 12 bp, Homo sapiens
tcccccatgcca

SEQ ID NO: 1435175 - DNA, 14 bp, Homo sapiens
tcccccatgccacc

SEQ ID NO: 1435176 - DNA, 16 bp, Homo sapiens
tcccccatgccaccac

SEQ ID NO: 1435177 - DNA, 17 bp, Homo sapiens
tcccccatgggggtgag

SEQ ID NO: 1435178 - DNA, 18 bp, Homo sapiens
tcccccattccctccatt

SEQ ID NO: 1435179 - DNA, 12 bp, Homo sapiens
tccccccactct

SEQ ID NO: 1435180 - DNA, 19 bp, Homo sapiens
tccccccactgcaggcccc

SEQ ID NO: 1435181 - DNA, 23 bp, Homo sapiens
tccccccactgcaggccccgctt

SEQ ID NO: 1435182 - DNA, 12 bp, Homo sapiens
tccccccagacc

SEQ ID NO: 1435183 - DNA, 15 bp, Homo sapiens
tccccccgcccaccc

SEQ ID NO: 1435184 - DNA, 22 bp, Homo sapiens
tccccccgcctctgtctggagc

SEQ ID NO: 1435185 - DNA, 14 bp, Homo sapiens
tcccagaggagcag

SEQ ID NO: 1435186 - DNA, 23 bp, Homo sapiens
tcccagaggagccaccagttctc

SEQ ID NO: 1435187 - DNA, 23 bp, Homo sapiens
tcccagaggtgggatcctccctc

SEQ ID NO: 1435188 - DNA, 21 bp, Homo sapiens
tcccagagtcagaggagaaga

SEQ ID NO: 1435189 - DNA, 15 bp, Homo sapiens
tcccagagtgctggg

SEQ ID NO: 1435190 - DNA, 21 bp, Homo sapiens
tcccagattggctcacactga

SEQ ID NO: 1435191 - DNA, 23 bp, Homo sapiens
tcccagcaagacctcatctgtgg

SEQ ID NO: 1435192 - DNA, 16 bp, Homo sapiens
tcccagcactttggga

SEQ ID NO: 1435193 - DNA, 21 bp, Homo sapiens
tcccagcactttgggaggcca

SEQ ID NO: 1435194 - DNA, 23 bp, Homo sapiens
tcccagcactttgggaggccaag

SEQ ID NO: 1435195 - DNA, 20 bp, Homo sapiens
tcccagcagcagagaaccat

SEQ ID NO: 1435196 - DNA, 21 bp, Homo sapiens
tcccagcagccctaaggatct

SEQ ID NO: 1435197 - DNA, 22 bp, Homo sapiens
tcccagcagctcaacctaccct

SEQ ID NO: 1435198 - DNA, 18 bp, Homo sapiens
tcccagcagggccactcc

SEQ ID NO: 1435199 - DNA, 17 bp, Homo sapiens
tcccagcatccctggag

SEQ ID NO: 1435200 - DNA, 21 bp, Homo sapiens
tcccagcatccctggagcagg

SEQ ID NO: 1435201 - DNA, 12 bp, Homo sapiens
tcccagccaccc

SEQ ID NO: 1435202 - DNA, 14 bp, Homo sapiens
tcccagccaccccg

SEQ ID NO: 1435203 - DNA, 11 bp, Homo sapiens
tcccagccacg

SEQ ID NO: 1435204 - DNA, 18 bp, Homo sapiens
tcccagcccattgctgcc

SEQ ID NO: 1435205 - DNA, 22 bp, Homo sapiens
tcccagcctcttgctcagagct

SEQ ID NO: 1435206 - DNA, 23 bp, Homo sapiens
tcccagcctggggctccctctct

SEQ ID NO: 1435207 - DNA, 24 bp, Homo sapiens
tcccagcctggggctccctctctg

SEQ ID NO: 1435208 - DNA, 14 bp, Homo sapiens
tcccagcctgtggt

SEQ ID NO: 1435209 - DNA, 13 bp, Homo sapiens
tcccagctactca

SEQ ID NO: 1435210 - DNA, 17 bp, Homo sapiens
tcccagctacttgggag

SEQ ID NO: 1435211 - DNA, 18 bp, Homo sapiens
tcccagctacttgggagg

SEQ ID NO: 1435212 - DNA, 16 bp, Homo sapiens
tcccagctaggaagag

SEQ ID NO: 1435213 - DNA, 23 bp, Homo sapiens
tcccagctaggaagagcaggact

SEQ ID NO: 1435214 - DNA, 18 bp, Homo sapiens
tcccagctccccccgccc

SEQ ID NO: 1435215 - DNA, 20 bp, Homo sapiens
tcccagctccccccgcccac

SEQ ID NO: 1435216 - DNA, 21 bp, Homo sapiens
tcccagctccccccgcccacc

SEQ ID NO: 1435217 - DNA, 14 bp, Homo sapiens
tcccagctctccct

SEQ ID NO: 1435218 - DNA, 19 bp, Homo sapiens
tcccagctctccctctggc

SEQ ID NO: 1435219 - DNA, 21 bp, Homo sapiens
tcccagctctccctctggccc

SEQ ID NO: 1435220 - DNA, 22 bp, Homo sapiens
tcccagctctccctctggccct

SEQ ID NO: 1435221 - DNA, 22 bp, Homo sapiens
tcattcaccaaatgatgccact

SEQ ID NO: 1435222 - DNA, 14 bp, Homo sapiens
tcattcagagtcag

SEQ ID NO: 1435223 - DNA, 19 bp, Homo sapiens
tcattcagcagcaaatttt

SEQ ID NO: 1435224 - DNA, 20 bp, Homo sapiens
tcattcagcatctactctaa

SEQ ID NO: 1435225 - DNA, 17 bp, Homo sapiens
tcattcagtattaaagg

SEQ ID NO: 1435226 - DNA, 15 bp, Homo sapiens
tcattcattcttagc

SEQ ID NO: 1435227 - DNA, 15 bp, Homo sapiens
tcattccaattctaa

SEQ ID NO: 1435228 - DNA, 14 bp, Homo sapiens
tcattccagaggaa

SEQ ID NO: 1435229 - DNA, 19 bp, Homo sapiens
tcattccagagtgctgagg

SEQ ID NO: 1435230 - DNA, 13 bp, Homo sapiens
tcattcccagagt

SEQ ID NO: 1435231 - DNA, 23 bp, Homo sapiens
tcattccccaggtggctgaccca

SEQ ID NO: 1435232 - DNA, 16 bp, Homo sapiens
tcattcccctttgcac

SEQ ID NO: 1435233 - DNA, 18 bp, Homo sapiens
tcattcccctttgcactg

SEQ ID NO: 1435234 - DNA, 17 bp, Homo sapiens
tcattccctctcatctc

SEQ ID NO: 1435235 - DNA, 18 bp, Homo sapiens
tcattccctctcatctca

SEQ ID NO: 1435236 - DNA, 23 bp, Homo sapiens
tcattccggactggcagaagcat

SEQ ID NO: 1435237 - DNA, 15 bp, Homo sapiens
tcattccgttaggaa

SEQ ID NO: 1435238 - DNA, 16 bp, Homo sapiens
tcattccgttgtctgt

SEQ ID NO: 1435239 - DNA, 17 bp, Homo sapiens
tcattccgttgtctgtg

SEQ ID NO: 1435240 - DNA, 16 bp, Homo sapiens
tcattcctgaaagaaa

SEQ ID NO: 1435241 - DNA, 20 bp, Homo sapiens
tcattccttcactcatccag

SEQ ID NO: 1435242 - DNA, 15 bp, Homo sapiens
tcattcgggatgatt

SEQ ID NO: 1435243 - DNA, 19 bp, Homo sapiens
tcattctaaaccaaaacag

SEQ ID NO: 1435244 - DNA, 10 bp, Homo sapiens
tcattctccc

SEQ ID NO: 1435245 - DNA, 22 bp, Homo sapiens
tcattctcccgcttcctggcct

SEQ ID NO: 1435246 - DNA, 14 bp, Homo sapiens
tcattctgaattaa

SEQ ID NO: 1435247 - DNA, 16 bp, Homo sapiens
tcattctgctacttca

SEQ ID NO: 1435248 - DNA, 18 bp, Homo sapiens
tcattctgctacttcact

SEQ ID NO: 1435249 - DNA, 21 bp, Homo sapiens
tcattcttacaattgcactgc

SEQ ID NO: 1435250 - DNA, 18 bp, Homo sapiens
tcattcttgaaagctgtg

SEQ ID NO: 1435251 - DNA, 16 bp, Homo sapiens
tcattctttactgcac

SEQ ID NO: 1435252 - DNA, 18 bp, Homo sapiens
tcattctttactgcactc

SEQ ID NO: 1435253 - DNA, 13 bp, Homo sapiens
tcattctttgaac

SEQ ID NO: 1435254 - DNA, 11 bp, Homo sapiens
tcattcttttc

SEQ ID NO: 1435255 - DNA, 23 bp, Homo sapiens
tcattcttttcagcttgtttcta

SEQ ID NO: 1435256 - DNA, 20 bp, Homo sapiens
tcattgaaagcttcaaagtt

SEQ ID NO: 1435257 - DNA, 21 bp, Homo sapiens
tcattgactatcaaactgaag

SEQ ID NO: 1435258 - DNA, 16 bp, Homo sapiens
tcattgacttttataa

SEQ ID NO: 1435259 - DNA, 24 bp, Homo sapiens
tcattgacttttataaagcatgtt

SEQ ID NO: 1435260 - DNA, 19 bp, Homo sapiens
tcattgagagttttgtctt

SEQ ID NO: 1435261 - DNA, 19 bp, Homo sapiens
tcattgatggatgtcttct

SEQ ID NO: 1435262 - DNA, 23 bp, Homo sapiens
tcattgatgggatttttgtttga

SEQ ID NO: 1435263 - DNA, 17 bp, Homo sapiens
tcattgccttaactgga

SEQ ID NO: 1435264 - DNA, 15 bp, Homo sapiens
tcattgctaaaaaat

SEQ ID NO: 1435265 - DNA, 16 bp, Homo sapiens
tcattgctaaaaaata

SEQ ID NO: 1435266 - DNA, 17 bp, Homo sapiens
tcattgctaaaaaataa

SEQ ID NO: 1435267 - DNA, 23 bp, Homo sapiens
tcattgctaaaaaataaataaaa

SEQ ID NO: 1435268 - DNA, 17 bp, Homo sapiens
tcattgctaaactgatg

SEQ ID NO: 1435269 - DNA, 16 bp, Homo sapiens
tcattgctgagcctct

SEQ ID NO: 1435270 - DNA, 13 bp, Homo sapiens
tcattgctgctgc

SEQ ID NO: 1435271 - DNA, 20 bp, Homo sapiens
tcattgctgctgctaccagc

SEQ ID NO: 1435272 - DNA, 14 bp, Homo sapiens
tcattgtaaatcac

SEQ ID NO: 1435273 - DNA, 12 bp, Homo sapiens
tcattgtagaaa

SEQ ID NO: 1435274 - DNA, 20 bp, Homo sapiens
tcattgtctacatagtgaca

SEQ ID NO: 1435275 - DNA, 19 bp, Homo sapiens
tcattgtctactcctagaa

SEQ ID NO: 1435276 - DNA, 22 bp, Homo sapiens
tcattgtctctcacagatgtga

SEQ ID NO: 1435277 - DNA, 18 bp, Homo sapiens
tcattgttggacatttgg

SEQ ID NO: 1435278 - DNA, 18 bp, Homo sapiens
tcattgtttgtttgtaag

SEQ ID NO: 1435279 - DNA, 15 bp, Homo sapiens
tcattgttttgcaaa

SEQ ID NO: 1435280 - DNA, 16 bp, Homo sapiens
tcattgttttgcaaaa

SEQ ID NO: 1435281 - DNA, 18 bp, Homo sapiens
tcatttaaagctaaattt

SEQ ID NO: 1435282 - DNA, 13 bp, Homo sapiens
tcatttaaatatc

SEQ ID NO: 1435283 - DNA, 23 bp, Homo sapiens
tcatttaagtttcaaacttacta

SEQ ID NO: 1435284 - DNA, 22 bp, Homo sapiens
tcatttatatagattataactt

SEQ ID NO: 1435285 - DNA, 19 bp, Homo sapiens
tcatttatatcgctggcca

SEQ ID NO: 1435286 - DNA, 21 bp, Homo sapiens
tcatttatctataatttacct

SEQ ID NO: 1435287 - DNA, 14 bp, Homo sapiens
tcatttatgaaaag

SEQ ID NO: 1435288 - DNA, 22 bp, Homo sapiens
tcatttattgtttatgtaaatg

SEQ ID NO: 1435289 - DNA, 16 bp, Homo sapiens
tccactcgacccagaa

SEQ ID NO: 1435290 - DNA, 18 bp, Homo sapiens
tccactctaccctcccac

SEQ ID NO: 1435291 - DNA, 18 bp, Homo sapiens
tccactctagttctagat

SEQ ID NO: 1435292 - DNA, 19 bp, Homo sapiens
tccactctagttctagatg

SEQ ID NO: 1435293 - DNA, 12 bp, Homo sapiens
tccactctcccc

SEQ ID NO: 1435294 - DNA, 13 bp, Homo sapiens
tccactctccccc

SEQ ID NO: 1435295 - DNA, 16 bp, Homo sapiens
tccactctcccccacc

SEQ ID NO: 1435296 - DNA, 23 bp, Homo sapiens
tccactctccttcgtgtctctcc

SEQ ID NO: 1435297 - DNA, 14 bp, Homo sapiens
tccactctgcttct

SEQ ID NO: 1435298 - DNA, 15 bp, Homo sapiens
tccactctgcttctc

SEQ ID NO: 1435299 - DNA, 23 bp, Homo sapiens
tccactctgcttctctgacttct

SEQ ID NO: 1435300 - DNA, 24 bp, Homo sapiens
tccactctgcttctctgacttctg

SEQ ID NO: 1435301 - DNA, 16 bp, Homo sapiens
tccactcttgatctct

SEQ ID NO: 1435302 - DNA, 19 bp, Homo sapiens
tccactcttgatctctctt

SEQ ID NO: 1435303 - DNA, 20 bp, Homo sapiens
tccactcttgatctctcttg

SEQ ID NO: 1435304 - DNA, 14 bp, Homo sapiens
tccactgaacaaaa

SEQ ID NO: 1435305 - DNA, 13 bp, Homo sapiens
tccactgccctgg

SEQ ID NO: 1435306 - DNA, 21 bp, Homo sapiens
tccactgccctggcagcagca

SEQ ID NO: 1435307 - DNA, 13 bp, Homo sapiens
tccactgccttcg

SEQ ID NO: 1435308 - DNA, 14 bp, Homo sapiens
tccactgcctttgg

SEQ ID NO: 1435309 - DNA, 20 bp, Homo sapiens
tccactgctctcagcctccc

SEQ ID NO: 1435310 - DNA, 15 bp, Homo sapiens
tccactgctggacat

SEQ ID NO: 1435311 - DNA, 12 bp, Homo sapiens
tccactgtgacg

SEQ ID NO: 1435312 - DNA, 13 bp, Homo sapiens
tccactgtggcaa

SEQ ID NO: 1435313 - DNA, 23 bp, Homo sapiens
tccacttagaaattgcatttcct

SEQ ID NO: 1435314 - DNA, 11 bp, Homo sapiens
tccacttccct

SEQ ID NO: 1435315 - DNA, 15 bp, Homo sapiens
tccacttctggtata

SEQ ID NO: 1435316 - DNA, 14 bp, Homo sapiens
tccacttgtgggct

SEQ ID NO: 1435317 - DNA, 17 bp, Homo sapiens
tccacttgtttgcactg

SEQ ID NO: 1435318 - DNA, 15 bp, Homo sapiens
tccactttgtttcgt

SEQ ID NO: 1435319 - DNA, 22 bp, Homo sapiens
tccactttgtttcgtggggagg

SEQ ID NO: 1435320 - DNA, 18 bp, Homo sapiens
tccagaaaacctctcctg

SEQ ID NO: 1435321 - DNA, 15 bp, Homo sapiens
tccagaaaactgtga

SEQ ID NO: 1435322 - DNA, 13 bp, Homo sapiens
tccagaaacaaaa

SEQ ID NO: 1435323 - DNA, 20 bp, Homo sapiens
tccagaaacaaaaagcccca

SEQ ID NO: 1435324 - DNA, 14 bp, Homo sapiens
tccagaaaggatat

SEQ ID NO: 1435325 - DNA, 19 bp, Homo sapiens
tccagaaatacaattttag

SEQ ID NO: 1435326 - DNA, 21 bp, Homo sapiens
tccagaagaagagaagctgct

SEQ ID NO: 1435327 - DNA, 22 bp, Homo sapiens
tccagaagaatattcaggactt

SEQ ID NO: 1435328 - DNA, 12 bp, Homo sapiens
tccagaagctgc

SEQ ID NO: 1435329 - DNA, 13 bp, Homo sapiens
tccagaagctgct

SEQ ID NO: 1435330 - DNA, 17 bp, Homo sapiens
tccagaatcttgacttt

SEQ ID NO: 1435331 - DNA, 19 bp, Homo sapiens
tccagacatacgaaacaca

SEQ ID NO: 1435332 - DNA, 20 bp, Homo sapiens
tccagacatacgaaacacaa

SEQ ID NO: 1435333 - DNA, 20 bp, Homo sapiens
tccagaccagcctgggcaac

SEQ ID NO: 1435334 - DNA, 17 bp, Homo sapiens
tccagacccctggcttt

SEQ ID NO: 1435335 - DNA, 23 bp, Homo sapiens
tccagacccctggcttttcactg

SEQ ID NO: 1435336 - DNA, 22 bp, Homo sapiens
tccagaccctgaagatttcaga

SEQ ID NO: 1435337 - DNA, 13 bp, Homo sapiens
tccagaccctgcc

SEQ ID NO: 1435338 - DNA, 16 bp, Homo sapiens
tccagaccctgcctga

SEQ ID NO: 1435339 - DNA, 11 bp, Homo sapiens
tccagacctga

SEQ ID NO: 1435340 - DNA, 19 bp, Homo sapiens
tccagacctgatcctggag

SEQ ID NO: 1435341 - DNA, 22 bp, Homo sapiens
tccagactcaaacggaggaagc

SEQ ID NO: 1435342 - DNA, 14 bp, Homo sapiens
tccagactcagagc

SEQ ID NO: 1435343 - DNA, 23 bp, Homo sapiens
tccagactgcttccaattttctg

SEQ ID NO: 1435344 - DNA, 14 bp, Homo sapiens
tccagacttccttg

SEQ ID NO: 1435345 - DNA, 14 bp, Homo sapiens
tccagagaccacac

SEQ ID NO: 1435346 - DNA, 15 bp, Homo sapiens
tccagagaccacacc

SEQ ID NO: 1435347 - DNA, 15 bp, Homo sapiens
tccagagagtggctc

SEQ ID NO: 1435348 - DNA, 20 bp, Homo sapiens
tccagagcaaccagaaggag

SEQ ID NO: 1435349 - DNA, 16 bp, Homo sapiens
tccagagccagcctgg

SEQ ID NO: 1435350 - DNA, 20 bp, Homo sapiens
tccagagccagcctgggact

SEQ ID NO: 1435351 - DNA, 13 bp, Homo sapiens
tccagagcttgtg

SEQ ID NO: 1435352 - DNA, 18 bp, Homo sapiens
tccagagcttgtgctcct

SEQ ID NO: 1435353 - DNA, 21 bp, Homo sapiens
tccagaggaacaagcatgtct

SEQ ID NO: 1435354 - DNA, 17 bp, Homo sapiens
tccagagggacagggtg

SEQ ID NO: 1435355 - DNA, 20 bp, Homo sapiens
tccagagggacagtcagttt

SEQ ID NO: 1435356 - DNA, 14 bp, Homo sapiens
tccagaggtcctcc

SEQ ID NO: 1435357 - DNA, 17 bp, Homo sapiens
tccagaggtcctccgta

SEQ ID NO: 1435358 - DNA, 15 bp, Homo sapiens
tccagagtctgagcc

SEQ ID NO: 1435359 - DNA, 14 bp, Homo sapiens
tccagagtgattct

SEQ ID NO: 1435360 - DNA, 17 bp, Homo sapiens
tccagagtgattctagt

SEQ ID NO: 1435361 - DNA, 16 bp, Homo sapiens
tccagagttaaaatgt

SEQ ID NO: 1435362 - DNA, 17 bp, Homo sapiens
tccagagttaaaatgtt

SEQ ID NO: 1435363 - DNA, 19 bp, Homo sapiens
tccagagttaaaatgttta

SEQ ID NO: 1435364 - DNA, 18 bp, Homo sapiens
tccagataactctctttc

SEQ ID NO: 1435365 - DNA, 22 bp, Homo sapiens
tccagataactctctttccttg

SEQ ID NO: 1435366 - DNA, 16 bp, Homo sapiens
tccagatcactgccac

SEQ ID NO: 1435367 - DNA, 17 bp, Homo sapiens
tccagatggtcatccag

SEQ ID NO: 1435368 - DNA, 21 bp, Homo sapiens
tccagatggtcatccagactc

SEQ ID NO: 1435369 - DNA, 21 bp, Homo sapiens
tccagatgtaggggaagagat

SEQ ID NO: 1435370 - DNA, 13 bp, Homo sapiens
tccagattctgat

SEQ ID NO: 1435371 - DNA, 15 bp, Homo sapiens
tccagattctgatgc

SEQ ID NO: 1435372 - DNA, 21 bp, Homo sapiens
tccagcaacacagcctgggcc

SEQ ID NO: 1435373 - DNA, 14 bp, Homo sapiens
tccagcaccttgtg

SEQ ID NO: 1435374 - DNA, 14 bp, Homo sapiens
tccagcagcacacc

SEQ ID NO: 1435375 - DNA, 15 bp, Homo sapiens
tccagcagtgaatgc

SEQ ID NO: 1435376 - DNA, 19 bp, Homo sapiens
tccagcatccagcctgtgt

SEQ ID NO: 1435377 - DNA, 20 bp, Homo sapiens
tccagcatttagctggccac

SEQ ID NO: 1435378 - DNA, 21 bp, Homo sapiens
tccagcatttagctggccaca

SEQ ID NO: 1435379 - DNA, 9 bp, Homo sapiens
tccagccac

SEQ ID NO: 1435380 - DNA, 10 bp, Homo sapiens
tccagccact

SEQ ID NO: 1435381 - DNA, 11 bp, Homo sapiens
tccagccactt

SEQ ID NO: 1435382 - DNA, 21 bp, Homo sapiens
tccagccacttccccctcttc

SEQ ID NO: 1435383 - DNA, 16 bp, Homo sapiens
tccagccagctcctgg

SEQ ID NO: 1435384 - DNA, 20 bp, Homo sapiens
tccagccatagagattttaa

SEQ ID NO: 1435385 - DNA, 16 bp, Homo sapiens
tccagcccctctggtc

SEQ ID NO: 1435386 - DNA, 18 bp, Homo sapiens
tccagcccctcttggaga

SEQ ID NO: 1435387 - DNA, 20 bp, Homo sapiens
tccagcccctcttggagaag

SEQ ID NO: 1435388 - DNA, 21 bp, Homo sapiens
tccagcccctcttggagaagt

SEQ ID NO: 1435389 - DNA, 18 bp, Homo sapiens
tccagccgccattgccac

SEQ ID NO: 1435390 - DNA, 19 bp, Homo sapiens
tccagccgccattgccacc

SEQ ID NO: 1435391 - DNA, 22 bp, Homo sapiens
tccagccgccattgccaccagg

SEQ ID NO: 1435392 - DNA, 13 bp, Homo sapiens
tccagcctccctg

SEQ ID NO: 1435393 - DNA, 17 bp, Homo sapiens
tccagcctccctgtctc

SEQ ID NO: 1435394 - DNA, 22 bp, Homo sapiens
tccagcctccctgtctccagct

SEQ ID NO: 1435395 - DNA, 15 bp, Homo sapiens
tccagcctctcccgg

SEQ ID NO: 1435396 - DNA, 17 bp, Homo sapiens
tccagcctctcccggct

SEQ ID NO: 1435397 - DNA, 19 bp, Homo sapiens
tccagcctctcccggctgc

SEQ ID NO: 1435398 - DNA, 22 bp, Homo sapiens
tccagcctctcccggctgcctg

SEQ ID NO: 1435399 - DNA, 13 bp, Homo sapiens
tccagcctgagca

SEQ ID NO: 1435400 - DNA, 22 bp, Homo sapiens
tccagcctgagtgacagagcga

SEQ ID NO: 1435401 - DNA, 24 bp, Homo sapiens
tccagcctgagtgacagagcgaga

SEQ ID NO: 1435402 - DNA, 16 bp, Homo sapiens
tccagcctgccccgga

SEQ ID NO: 1435403 - DNA, 13 bp, Homo sapiens
tccagcctgggca

SEQ ID NO: 1435404 - DNA, 21 bp, Homo sapiens
tccagcctgggcgacaaaaac

SEQ ID NO: 1435405 - DNA, 20 bp, Homo sapiens
tccagcctgggcgacagagc

SEQ ID NO: 1435406 - DNA, 13 bp, Homo sapiens
tccacaaggaatc

SEQ ID NO: 1435407 - DNA, 18 bp, Homo sapiens
tccacacaacaccaggac

SEQ ID NO: 1435408 - DNA, 20 bp, Homo sapiens
tccacacaacaccaggactt

SEQ ID NO: 1435409 - DNA, 12 bp, Homo sapiens
tccacacacaga

SEQ ID NO: 1435410 - DNA, 14 bp, Homo sapiens
tccacacacagagg

SEQ ID NO: 1435411 - DNA, 15 bp, Homo sapiens
tccacacacagagga

SEQ ID NO: 1435412 - DNA, 22 bp, Homo sapiens
tccacacacagaggaagagcag

SEQ ID NO: 1435413 - DNA, 16 bp, Homo sapiens
tccacacagaatgcaa

SEQ ID NO: 1435414 - DNA, 18 bp, Homo sapiens
tccacacatctttcttga

SEQ ID NO: 1435415 - DNA, 15 bp, Homo sapiens
tccacaccagctgct

SEQ ID NO: 1435416 - DNA, 21 bp, Homo sapiens
tccacaccagctgctgctgga

SEQ ID NO: 1435417 - DNA, 14 bp, Homo sapiens
tccacaccttttat

SEQ ID NO: 1435418 - DNA, 15 bp, Homo sapiens
tccacactccactga

SEQ ID NO: 1435419 - DNA, 13 bp, Homo sapiens
tccacactgacca

SEQ ID NO: 1435420 - DNA, 19 bp, Homo sapiens
tccacactgaccaagtgct

SEQ ID NO: 1435421 - DNA, 16 bp, Homo sapiens
tccacagagtgagcca

SEQ ID NO: 1435422 - DNA, 17 bp, Homo sapiens
tccacagatgcctccac

SEQ ID NO: 1435423 - DNA, 21 bp, Homo sapiens
tccacagcacaaacacacctc

SEQ ID NO: 1435424 - DNA, 20 bp, Homo sapiens
tccacagccccaacctccca

SEQ ID NO: 1435425 - DNA, 18 bp, Homo sapiens
tccacagccgcagcctcc

SEQ ID NO: 1435426 - DNA, 17 bp, Homo sapiens
tccacagcgagggcagc

SEQ ID NO: 1435427 - DNA, 18 bp, Homo sapiens
tccacagcgagggcagct

SEQ ID NO: 1435428 - DNA, 21 bp, Homo sapiens
tccacagcgagggcagctgct

SEQ ID NO: 1435429 - DNA, 22 bp, Homo sapiens
tccacagcgagggcagctgcta

SEQ ID NO: 1435430 - DNA, 23 bp, Homo sapiens
tccacagcggaggagaccagctc

SEQ ID NO: 1435431 - DNA, 13 bp, Homo sapiens
tccacagctgccc

SEQ ID NO: 1435432 - DNA, 14 bp, Homo sapiens
tccacagctgccct

SEQ ID NO: 1435433 - DNA, 12 bp, Homo sapiens
tccacagctgga

SEQ ID NO: 1435434 - DNA, 18 bp, Homo sapiens
tccacaggcaaaactcag

SEQ ID NO: 1435435 - DNA, 14 bp, Homo sapiens
tccacagggaccag

SEQ ID NO: 1435436 - DNA, 18 bp, Homo sapiens
tccacagggaccagggcc

SEQ ID NO: 1435437 - DNA, 20 bp, Homo sapiens
tccacagggaccagggccac

SEQ ID NO: 1435438 - DNA, 13 bp, Homo sapiens
tccacaggggcag

SEQ ID NO: 1435439 - DNA, 17 bp, Homo sapiens
tccacaggggcaggcct

SEQ ID NO: 1435440 - DNA, 18 bp, Homo sapiens
tccacaggggcaggcctg

SEQ ID NO: 1435441 - DNA, 19 bp, Homo sapiens
tccacaggggcaggcctgg

SEQ ID NO: 1435442 - DNA, 22 bp, Homo sapiens
tccacaggggcaggcctgggac

SEQ ID NO: 1435443 - DNA, 16 bp, Homo sapiens
tccacaggtctagact

SEQ ID NO: 1435444 - DNA, 22 bp, Homo sapiens
tccacagtgctgcttctcttgg

SEQ ID NO: 1435445 - DNA, 18 bp, Homo sapiens
tccacatccccagagccc

SEQ ID NO: 1435446 - DNA, 20 bp, Homo sapiens
tccacatccccagagcccag

SEQ ID NO: 1435447 - DNA, 23 bp, Homo sapiens
tccacatccccagagcccagctc

SEQ ID NO: 1435448 - DNA, 15 bp, Homo sapiens
tccacatctgcctta

SEQ ID NO: 1435449 - DNA, 13 bp, Homo sapiens
tccacatgacctc

SEQ ID NO: 1435450 - DNA, 16 bp, Homo sapiens
tccacatttctaaaat

SEQ ID NO: 1435451 - DNA, 18 bp, Homo sapiens
tccacatttgtcacagaa

SEQ ID NO: 1435452 - DNA, 19 bp, Homo sapiens
tccaccaaaccccacttcc

SEQ ID NO: 1435453 - DNA, 17 bp, Homo sapiens
tccaccaagaaagcagg

SEQ ID NO: 1435454 - DNA, 14 bp, Homo sapiens
tccaccaccactgg

SEQ ID NO: 1435455 - DNA, 18 bp, Homo sapiens
tccaccaccactggccac

SEQ ID NO: 1435456 - DNA, 19 bp, Homo sapiens
tccaccaccactggccacc

SEQ ID NO: 1435457 - DNA, 22 bp, Homo sapiens
tccaccaccactggccaccagg

SEQ ID NO: 1435458 - DNA, 24 bp, Homo sapiens
tccaccacccaacccaaaccatga

SEQ ID NO: 1435459 - DNA, 14 bp, Homo sapiens
tccaccagcagcat

SEQ ID NO: 1435460 - DNA, 19 bp, Homo sapiens
tccaccagcatcacctgcc

SEQ ID NO: 1435461 - DNA, 15 bp, Homo sapiens
tccaccagcctgcac

SEQ ID NO: 1435462 - DNA, 16 bp, Homo sapiens
tccaccagcctgcact

SEQ ID NO: 1435463 - DNA, 18 bp, Homo sapiens
tccaccagcctgctgaca

SEQ ID NO: 1435464 - DNA, 19 bp, Homo sapiens
tccaccagcctgctgacag

SEQ ID NO: 1435465 - DNA, 19 bp, Homo sapiens
tccaccatccccaccccac

SEQ ID NO: 1435466 - DNA, 16 bp, Homo sapiens
tccaccatccccagct

SEQ ID NO: 1435467 - DNA, 14 bp, Homo sapiens
tccaccatgcagaa

SEQ ID NO: 1435468 - DNA, 18 bp, Homo sapiens
tcaggctatatgcagtcc

SEQ ID NO: 1435469 - DNA, 17 bp, Homo sapiens
tcaggctgcagaggcac

SEQ ID NO: 1435470 - DNA, 15 bp, Homo sapiens
tcaggcttccttggc

SEQ ID NO: 1435471 - DNA, 23 bp, Homo sapiens
tcaggcttccttggcatcacagg

SEQ ID NO: 1435472 - DNA, 16 bp, Homo sapiens
tcaggcttgaaatgca

SEQ ID NO: 1435473 - DNA, 14 bp, Homo sapiens
tcagggaagcccag

SEQ ID NO: 1435474 - DNA, 16 bp, Homo sapiens
tcagggaagcccagct

SEQ ID NO: 1435475 - DNA, 21 bp, Homo sapiens
tcagggaagcccagctccagg

SEQ ID NO: 1435476 - DNA, 23 bp, Homo sapiens
tcagggacagagacacctgcacc

SEQ ID NO: 1435477 - DNA, 16 bp, Homo sapiens
tcagggaccggtgctg

SEQ ID NO: 1435478 - DNA, 22 bp, Homo sapiens
tcagggaccggtgctgcaggag

SEQ ID NO: 1435479 - DNA, 17 bp, Homo sapiens
tcagggaccgtccaggg

SEQ ID NO: 1435480 - DNA, 23 bp, Homo sapiens
tcagggagcagggaaggcctgac

SEQ ID NO: 1435481 - DNA, 20 bp, Homo sapiens
tcagggattttttttttaaa

SEQ ID NO: 1435482 - DNA, 19 bp, Homo sapiens
tcagggccagaaggagggc

SEQ ID NO: 1435483 - DNA, 21 bp, Homo sapiens
tcagggccagaaggagggcag

SEQ ID NO: 1435484 - DNA, 22 bp, Homo sapiens
tcagggccagaaggagggcaga

SEQ ID NO: 1435485 - DNA, 19 bp, Homo sapiens
tcagggccagactggaaga

SEQ ID NO: 1435486 - DNA, 17 bp, Homo sapiens
tcagggccatgcctgcc

SEQ ID NO: 1435487 - DNA, 18 bp, Homo sapiens
tcagggccatgctgaggc

SEQ ID NO: 1435488 - DNA, 21 bp, Homo sapiens
tcagggccatgctgaggcctg

SEQ ID NO: 1435489 - DNA, 23 bp, Homo sapiens
tcagggccatgctgaggcctggg

SEQ ID NO: 1435490 - DNA, 14 bp, Homo sapiens
tcagggcccaagtc

SEQ ID NO: 1435491 - DNA, 18 bp, Homo sapiens
tcagggcccaagtccctg

SEQ ID NO: 1435492 - DNA, 16 bp, Homo sapiens
tcagggccccagcact

SEQ ID NO: 1435493 - DNA, 23 bp, Homo sapiens
tcagggccccagcactaaagcag

SEQ ID NO: 1435494 - DNA, 13 bp, Homo sapiens
tcagggcgctcag

SEQ ID NO: 1435495 - DNA, 15 bp, Homo sapiens
tcagggcgctcagac

SEQ ID NO: 1435496 - DNA, 16 bp, Homo sapiens
tcagggctcccagggg

SEQ ID NO: 1435497 - DNA, 12 bp, Homo sapiens
tcagggctggag

SEQ ID NO: 1435498 - DNA, 13 bp, Homo sapiens
tcaggggcctgga

SEQ ID NO: 1435499 - DNA, 13 bp, Homo sapiens
tcaggggggagaa

SEQ ID NO: 1435500 - DNA, 19 bp, Homo sapiens
tcaggggtcaggtgtcagg

SEQ ID NO: 1435501 - DNA, 23 bp, Homo sapiens
tcaggggtcgtcaccacctctcc

SEQ ID NO: 1435502 - DNA, 15 bp, Homo sapiens
tcagggtccagaccc

SEQ ID NO: 1435503 - DNA, 19 bp, Homo sapiens
tcagggtgaactgcaaagc

SEQ ID NO: 1435504 - DNA, 20 bp, Homo sapiens
tcagggtgaactgcaaagct

SEQ ID NO: 1435505 - DNA, 23 bp, Homo sapiens
tcagggtggtctcttcttggggc

SEQ ID NO: 1435506 - DNA, 21 bp, Homo sapiens
tcaggtaatatacctggttta

SEQ ID NO: 1435507 - DNA, 20 bp, Homo sapiens
tcaggtacagaaaacatgtt

SEQ ID NO: 1435508 - DNA, 15 bp, Homo sapiens
tcaggtaggcccttg

SEQ ID NO: 1435509 - DNA, 21 bp, Homo sapiens
tcaggtaggcccttgtcctgc

SEQ ID NO: 1435510 - DNA, 23 bp, Homo sapiens
tcaggtaggcccttgtcctgcca

SEQ ID NO: 1435511 - DNA, 16 bp, Homo sapiens
tcaggtatgttgcctt

SEQ ID NO: 1435512 - DNA, 16 bp, Homo sapiens
tcaggtcctcagagaa

SEQ ID NO: 1435513 - DNA, 22 bp, Homo sapiens
tcaggtgacgatttagctgtgg

SEQ ID NO: 1435514 - DNA, 13 bp, Homo sapiens
tcaggtgccactc

SEQ ID NO: 1435515 - DNA, 13 bp, Homo sapiens
tcaggtgctgtcc

SEQ ID NO: 1435516 - DNA, 16 bp, Homo sapiens
tcaggtgctgtccatg

SEQ ID NO: 1435517 - DNA, 19 bp, Homo sapiens
tcaggtggccagaagagct

SEQ ID NO: 1435518 - DNA, 14 bp, Homo sapiens
tcaggtgttgccaa

SEQ ID NO: 1435519 - DNA, 15 bp, Homo sapiens
tcaggttatactcct

SEQ ID NO: 1435520 - DNA, 22 bp, Homo sapiens
tcaggttgtctgaagtcactgc

SEQ ID NO: 1435521 - DNA, 16 bp, Homo sapiens
tcaggtttgagaaaaa

SEQ ID NO: 1435522 - DNA, 14 bp, Homo sapiens
tcaggttttgtaaa

SEQ ID NO: 1435523 - DNA, 22 bp, Homo sapiens
tcaggtttttcctttttttgta

SEQ ID NO: 1435524 - DNA, 22 bp, Homo sapiens
tcagtaaataacaggcatttgt

SEQ ID NO: 1435525 - DNA, 14 bp, Homo sapiens
tcagtaaatagtgt

SEQ ID NO: 1435526 - DNA, 20 bp, Homo sapiens
tcagtaaatagtgtcatata

SEQ ID NO: 1435527 - DNA, 21 bp, Homo sapiens
tcagtaacatttctgttctca

SEQ ID NO: 1435528 - DNA, 21 bp, Homo sapiens
tcagtaacccccttaaattta

SEQ ID NO: 1435529 - DNA, 23 bp, Homo sapiens
tcagtaacccccttaaatttaat

SEQ ID NO: 1435530 - DNA, 14 bp, Homo sapiens
tcagtaatttgagg

SEQ ID NO: 1435531 - DNA, 15 bp, Homo sapiens
tcagtaatttgagga

SEQ ID NO: 1435532 - DNA, 17 bp, Homo sapiens
tcagtaatttgaggaca

SEQ ID NO: 1435533 - DNA, 19 bp, Homo sapiens
tcagtacacccaattttaa

SEQ ID NO: 1435534 - DNA, 16 bp, Homo sapiens
tcagtaccctctcagc

SEQ ID NO: 1435535 - DNA, 19 bp, Homo sapiens
tcagtaccctctcagctcc

SEQ ID NO: 1435536 - DNA, 20 bp, Homo sapiens
tcagtacgatcaagttgttg

SEQ ID NO: 1435537 - DNA, 15 bp, Homo sapiens
tcagtacttgtttct

SEQ ID NO: 1435538 - DNA, 13 bp, Homo sapiens
tcagtagaattac

SEQ ID NO: 1435539 - DNA, 15 bp, Homo sapiens
tcagtagtccctgca

SEQ ID NO: 1435540 - DNA, 18 bp, Homo sapiens
tcagtagtttgagaccag

SEQ ID NO: 1435541 - DNA, 20 bp, Homo sapiens
tcagtagtttgcatttcaga

SEQ ID NO: 1435542 - DNA, 21 bp, Homo sapiens
tcagtagtttgcatttcagaa

SEQ ID NO: 1435543 - DNA, 20 bp, Homo sapiens
tcagtataattctgtactga

SEQ ID NO: 1435544 - DNA, 16 bp, Homo sapiens
tcagtataatttttta

SEQ ID NO: 1435545 - DNA, 13 bp, Homo sapiens
tcagtatactgtg

SEQ ID NO: 1435546 - DNA, 13 bp, Homo sapiens
tcagtatccaggc

SEQ ID NO: 1435547 - DNA, 14 bp, Homo sapiens
tcagtatgtggaag

SEQ ID NO: 1435548 - DNA, 18 bp, Homo sapiens
tcagtattctgacatgta

SEQ ID NO: 1435549 - DNA, 15 bp, Homo sapiens
tcagtattttttact

SEQ ID NO: 1435550 - DNA, 22 bp, Homo sapiens
tcagtcagttcccggagcacag

SEQ ID NO: 1435551 - DNA, 14 bp, Homo sapiens
tcagtcatcaaagc

SEQ ID NO: 1435552 - DNA, 14 bp, Homo sapiens
tcagtcatgtgtaa

SEQ ID NO: 1435553 - DNA, 11 bp, Homo sapiens
tcagtcccctc

SEQ ID NO: 1435554 - DNA, 12 bp, Homo sapiens
tcagtcccctcc

SEQ ID NO: 1435555 - DNA, 13 bp, Homo sapiens
tcagtcccctccc

SEQ ID NO: 1435556 - DNA, 15 bp, Homo sapiens
tcagtcccctcccat

SEQ ID NO: 1435557 - DNA, 18 bp, Homo sapiens
tcagtcccctctctctgg

SEQ ID NO: 1435558 - DNA, 20 bp, Homo sapiens
tcagtcgttttagtgtctga

SEQ ID NO: 1435559 - DNA, 23 bp, Homo sapiens
tcagtcgttttagtgtctgacct

SEQ ID NO: 1435560 - DNA, 19 bp, Homo sapiens
tcataggttactacctata

SEQ ID NO: 1435561 - DNA, 17 bp, Homo sapiens
tcataggttttaaatct

SEQ ID NO: 1435562 - DNA, 22 bp, Homo sapiens
tcataggttttaaatctgcttt

SEQ ID NO: 1435563 - DNA, 17 bp, Homo sapiens
tcatagtaataagatgg

SEQ ID NO: 1435564 - DNA, 16 bp, Homo sapiens
tcatagtagtttttac

SEQ ID NO: 1435565 - DNA, 20 bp, Homo sapiens
tcatagtatcttcactgtgt

SEQ ID NO: 1435566 - DNA, 12 bp, Homo sapiens
tcatagttttat

SEQ ID NO: 1435567 - DNA, 15 bp, Homo sapiens
tcatataaactcatt

SEQ ID NO: 1435568 - DNA, 18 bp, Homo sapiens
tcatataaattttttgtg

SEQ ID NO: 1435569 - DNA, 18 bp, Homo sapiens
tcatataagattcatatt

SEQ ID NO: 1435570 - DNA, 13 bp, Homo sapiens
tcatatacaaaca

SEQ ID NO: 1435571 - DNA, 15 bp, Homo sapiens
tcatatacaaacatg

SEQ ID NO: 1435572 - DNA, 20 bp, Homo sapiens
tcatatacaaacatgtatgt

SEQ ID NO: 1435573 - DNA, 12 bp, Homo sapiens
tcatatattaaa

SEQ ID NO: 1435574 - DNA, 15 bp, Homo sapiens
tcatatattaaaaca

SEQ ID NO: 1435575 - DNA, 20 bp, Homo sapiens
tcatatattaaacatccaca

SEQ ID NO: 1435576 - DNA, 21 bp, Homo sapiens
tcatatattaaacatccacaa

SEQ ID NO: 1435577 - DNA, 15 bp, Homo sapiens
tcatatatttaacaa

SEQ ID NO: 1435578 - DNA, 21 bp, Homo sapiens
tcatatatttaacaatgacaa

SEQ ID NO: 1435579 - DNA, 16 bp, Homo sapiens
tcatatcaaacattaa

SEQ ID NO: 1435580 - DNA, 12 bp, Homo sapiens
tcatatgaaaaa

SEQ ID NO: 1435581 - DNA, 14 bp, Homo sapiens
tcatatgtacttgt

SEQ ID NO: 1435582 - DNA, 16 bp, Homo sapiens
tcatattaagacagtg

SEQ ID NO: 1435583 - DNA, 19 bp, Homo sapiens
tcatattaatatatttcca

SEQ ID NO: 1435584 - DNA, 14 bp, Homo sapiens
tcatattcatgcaa

SEQ ID NO: 1435585 - DNA, 14 bp, Homo sapiens
tcatattgtatgta

SEQ ID NO: 1435586 - DNA, 21 bp, Homo sapiens
tcatattgtgattctgccttt

SEQ ID NO: 1435587 - DNA, 15 bp, Homo sapiens
tcatatttacttctt

SEQ ID NO: 1435588 - DNA, 21 bp, Homo sapiens
tcatatttacttcttatacat

SEQ ID NO: 1435589 - DNA, 23 bp, Homo sapiens
tcatatttacttcttatacattt

SEQ ID NO: 1435590 - DNA, 19 bp, Homo sapiens
tcatcaaaaagccttattt

SEQ ID NO: 1435591 - DNA, 17 bp, Homo sapiens
tcatcaaagcagaagtc

SEQ ID NO: 1435592 - DNA, 19 bp, Homo sapiens
tcatcaacaagatttcctt

SEQ ID NO: 1435593 - DNA, 15 bp, Homo sapiens
tcatcaactgaatga

SEQ ID NO: 1435594 - DNA, 18 bp, Homo sapiens
tcatcaagaaataggtta

SEQ ID NO: 1435595 - DNA, 16 bp, Homo sapiens
tcatcaagaagggctg

SEQ ID NO: 1435596 - DNA, 20 bp, Homo sapiens
tcatcaatatccctcttgta

SEQ ID NO: 1435597 - DNA, 14 bp, Homo sapiens
tcatcaccatttcc

SEQ ID NO: 1435598 - DNA, 20 bp, Homo sapiens
tcatcactccctggatgtgt

SEQ ID NO: 1435599 - DNA, 12 bp, Homo sapiens
tcatcactggac

SEQ ID NO: 1435600 - DNA, 15 bp, Homo sapiens
tcatcactggactgc

SEQ ID NO: 1435601 - DNA, 15 bp, Homo sapiens
tcatcactggatgaa

SEQ ID NO: 1435602 - DNA, 22 bp, Homo sapiens
tcatcactggatgaagattctc

SEQ ID NO: 1435603 - DNA, 11 bp, Homo sapiens
tcatcactgta

SEQ ID NO: 1435604 - DNA, 14 bp, Homo sapiens
tcatcactgtaaag

SEQ ID NO: 1435605 - DNA, 19 bp, Homo sapiens
tcatcactgtaaagacaaa

SEQ ID NO: 1435606 - DNA, 13 bp, Homo sapiens
tcatcagatgcct

SEQ ID NO: 1435607 - DNA, 16 bp, Homo sapiens
tcatcagccaccatcc

SEQ ID NO: 1435608 - DNA, 15 bp, Homo sapiens
tcatcaggaagcctg

SEQ ID NO: 1435609 - DNA, 13 bp, Homo sapiens
tcatcagggaggg

SEQ ID NO: 1435610 - DNA, 17 bp, Homo sapiens
tcatcaggggcctgcag

SEQ ID NO: 1435611 - DNA, 19 bp, Homo sapiens
tcatcataaaataaagtat

SEQ ID NO: 1435612 - DNA, 20 bp, Homo sapiens
tcatcatattgtatgtaagt

SEQ ID NO: 1435613 - DNA, 13 bp, Homo sapiens
tcatcatgatgga

SEQ ID NO: 1435614 - DNA, 18 bp, Homo sapiens
tcatcattaataagtgaa

SEQ ID NO: 1435615 - DNA, 19 bp, Homo sapiens
tcatcattaataagtgaag

SEQ ID NO: 1435616 - DNA, 14 bp, Homo sapiens
tcatcattccttga

SEQ ID NO: 1435617 - DNA, 15 bp, Homo sapiens
tcatcatttgcacaa

SEQ ID NO: 1435618 - DNA, 17 bp, Homo sapiens
tcatccaacttatgttt

SEQ ID NO: 1435619 - DNA, 20 bp, Homo sapiens
tcatccaatcctcactgggt

SEQ ID NO: 1435620 - DNA, 23 bp, Homo sapiens
tcatccacacaacaccaggactt

SEQ ID NO: 1435621 - DNA, 16 bp, Homo sapiens
tcatccacattgtttt

SEQ ID NO: 1435622 - DNA, 12 bp, Homo sapiens
tcatccacccca

SEQ ID NO: 1435623 - DNA, 20 bp, Homo sapiens
tcatccaccccatccctccc

SEQ ID NO: 1435624 - DNA, 19 bp, Homo sapiens
tcatccagactcagagctc

SEQ ID NO: 1435625 - DNA, 20 bp, Homo sapiens
tcatcccaacagccaagacc

SEQ ID NO: 1435626 - DNA, 14 bp, Homo sapiens
tcatcccattccag

SEQ ID NO: 1435627 - DNA, 16 bp, Homo sapiens
tcatcccattccaggc

SEQ ID NO: 1435628 - DNA, 17 bp, Homo sapiens
tcatcccattccaggca

SEQ ID NO: 1435629 - DNA, 20 bp, Homo sapiens
tcatcccattccaggcagcc

SEQ ID NO: 1435630 - DNA, 21 bp, Homo sapiens
tcatccccaggggtcccagcc

SEQ ID NO: 1435631 - DNA, 13 bp, Homo sapiens
tcatcccccctgc

SEQ ID NO: 1435632 - DNA, 15 bp, Homo sapiens
tcatcccccctgctg

SEQ ID NO: 1435633 - DNA, 15 bp, Homo sapiens
tcatcccctcgtcct

SEQ ID NO: 1435634 - DNA, 18 bp, Homo sapiens
tcatcccctcgtcctgtc

SEQ ID NO: 1435635 - DNA, 12 bp, Homo sapiens
tcatccctttcc

SEQ ID NO: 1435636 - DNA, 13 bp, Homo sapiens
tcatccctttcca

SEQ ID NO: 1435637 - DNA, 14 bp, Homo sapiens
tcatccgcactgta

SEQ ID NO: 1435638 - DNA, 14 bp, Homo sapiens
tcatccgcctgtgg

SEQ ID NO: 1435639 - DNA, 18 bp, Homo sapiens
tcatccgcctgtgggcgc

SEQ ID NO: 1435640 - DNA, 15 bp, Homo sapiens
tcatcctaagctatt

SEQ ID NO: 1435641 - DNA, 23 bp, Homo sapiens
tcatcctcaaagaaagtgtattg

SEQ ID NO: 1435642 - DNA, 13 bp, Homo sapiens
tcatcctccagta

SEQ ID NO: 1435643 - DNA, 20 bp, Homo sapiens
tcatcctcctccccagctct

SEQ ID NO: 1435644 - DNA, 15 bp, Homo sapiens
tcatcctgattttta

SEQ ID NO: 1435645 - DNA, 18 bp, Homo sapiens
tcatcctgatttttacta

SEQ ID NO: 1435646 - DNA, 16 bp, Homo sapiens
tcatcctgggggctct

SEQ ID NO: 1435647 - DNA, 15 bp, Homo sapiens
tcatcctgtgctcgg

SEQ ID NO: 1435648 - DNA, 15 bp, Homo sapiens
tcacctgctccagaa

SEQ ID NO: 1435649 - DNA, 23 bp, Homo sapiens
tcacctgctggttgttgccaggt

SEQ ID NO: 1435650 - DNA, 16 bp, Homo sapiens
tcacctggccctgctt

SEQ ID NO: 1435651 - DNA, 13 bp, Homo sapiens
tcacctgtcatca

SEQ ID NO: 1435652 - DNA, 19 bp, Homo sapiens
tcacctgtgactcctgttg

SEQ ID NO: 1435653 - DNA, 16 bp, Homo sapiens
tcacctgtgtgcccag

SEQ ID NO: 1435654 - DNA, 16 bp, Homo sapiens
tcaccttcaaaatgtt

SEQ ID NO: 1435655 - DNA, 22 bp, Homo sapiens
tcaccttcaaaatgttctattt

SEQ ID NO: 1435656 - DNA, 12 bp, Homo sapiens
tcaccttcgagt

SEQ ID NO: 1435657 - DNA, 18 bp, Homo sapiens
tcaccttggcaccagaca

SEQ ID NO: 1435658 - DNA, 14 bp, Homo sapiens
tcacctttcccatc

SEQ ID NO: 1435659 - DNA, 21 bp, Homo sapiens
tcacctttgtaagacatttgt

SEQ ID NO: 1435660 - DNA, 17 bp, Homo sapiens
tcacctttttaataaaa

SEQ ID NO: 1435661 - DNA, 21 bp, Homo sapiens
tcacctttttaataaaaatac

SEQ ID NO: 1435662 - DNA, 21 bp, Homo sapiens
tcacgaattccatcttgtaaa

SEQ ID NO: 1435663 - DNA, 16 bp, Homo sapiens
tcacgatcacaggcct

SEQ ID NO: 1435664 - DNA, 20 bp, Homo sapiens
tcacgcaggctgagtccaga

SEQ ID NO: 1435665 - DNA, 16 bp, Homo sapiens
tcacgcatgcagtgtt

SEQ ID NO: 1435666 - DNA, 22 bp, Homo sapiens
tcacgccattgtactccagcct

SEQ ID NO: 1435667 - DNA, 22 bp, Homo sapiens
tcacgccgggagaagccacctt

SEQ ID NO: 1435668 - DNA, 21 bp, Homo sapiens
tcacgccgtaattctttctgt

SEQ ID NO: 1435669 - DNA, 19 bp, Homo sapiens
tcacgcctgtaatcccagc

SEQ ID NO: 1435670 - DNA, 20 bp, Homo sapiens
tcacgcctgtaatcccagca

SEQ ID NO: 1435671 - DNA, 16 bp, Homo sapiens
tcacgcctgtgcagtg

SEQ ID NO: 1435672 - DNA, 21 bp, Homo sapiens
tcacggatggtgcatgggctc

SEQ ID NO: 1435673 - DNA, 14 bp, Homo sapiens
tcacggctgcgcac

SEQ ID NO: 1435674 - DNA, 18 bp, Homo sapiens
tcacgggcagtagctgtg

SEQ ID NO: 1435675 - DNA, 19 bp, Homo sapiens
tcacggggttggctgttcc

SEQ ID NO: 1435676 - DNA, 22 bp, Homo sapiens
tcacgtacaaaactctgtataa

SEQ ID NO: 1435677 - DNA, 21 bp, Homo sapiens
tcacgtaccccactgggccag

SEQ ID NO: 1435678 - DNA, 14 bp, Homo sapiens
tcacgtctctgccg

SEQ ID NO: 1435679 - DNA, 16 bp, Homo sapiens
tcacgtctctgccgcc

SEQ ID NO: 1435680 - DNA, 22 bp, Homo sapiens
tcacgtgaaatatttaagtata

SEQ ID NO: 1435681 - DNA, 14 bp, Homo sapiens
tcacgtgcaggaca

SEQ ID NO: 1435682 - DNA, 18 bp, Homo sapiens
tcacgtgcaggacagctc

SEQ ID NO: 1435683 - DNA, 15 bp, Homo sapiens
tcacgtgctttgtgt

SEQ ID NO: 1435684 - DNA, 13 bp, Homo sapiens
tcacgtggcctcc

SEQ ID NO: 1435685 - DNA, 20 bp, Homo sapiens
tcacgttggggtgatttaat

SEQ ID NO: 1435686 - DNA, 15 bp, Homo sapiens
tcactaaagcatgaa

SEQ ID NO: 1435687 - DNA, 23 bp, Homo sapiens
tcactaaagcatgaaatgtgaat

SEQ ID NO: 1435688 - DNA, 16 bp, Homo sapiens
tcactaaatgtaaaat

SEQ ID NO: 1435689 - DNA, 22 bp, Homo sapiens
tcactaacagggagaagtagct

SEQ ID NO: 1435690 - DNA, 22 bp, Homo sapiens
tcactaatttggctttcacatt

SEQ ID NO: 1435691 - DNA, 15 bp, Homo sapiens
tcactaatttttgta

SEQ ID NO: 1435692 - DNA, 19 bp, Homo sapiens
tcactaccctgattcttga

SEQ ID NO: 1435693 - DNA, 21 bp, Homo sapiens
tcactaccgtggaccacctag

SEQ ID NO: 1435694 - DNA, 21 bp, Homo sapiens
tcactacgggggggagaagga

SEQ ID NO: 1435695 - DNA, 19 bp, Homo sapiens
tcactactcacagtctctt

SEQ ID NO: 1435696 - DNA, 20 bp, Homo sapiens
tcactactgaacacatgtgt

SEQ ID NO: 1435697 - DNA, 15 bp, Homo sapiens
tcactagcagctgca

SEQ ID NO: 1435698 - DNA, 14 bp, Homo sapiens
tcactagccatgat

SEQ ID NO: 1435699 - DNA, 22 bp, Homo sapiens
tcactaggcccccacttgcctc

SEQ ID NO: 1435700 - DNA, 23 bp, Homo sapiens
tcactaggcccccacttgcctct

SEQ ID NO: 1435701 - DNA, 22 bp, Homo sapiens
tcactagtgaccccttccctgt

SEQ ID NO: 1435702 - DNA, 17 bp, Homo sapiens
tcactataaatggtgtt

SEQ ID NO: 1435703 - DNA, 15 bp, Homo sapiens
tcactatatatattt

SEQ ID NO: 1435704 - DNA, 21 bp, Homo sapiens
tcactatgaatctattatact

SEQ ID NO: 1435705 - DNA, 18 bp, Homo sapiens
tcactattcctaggagga

SEQ ID NO: 1435706 - DNA, 18 bp, Homo sapiens
tcactatttttatttata

SEQ ID NO: 1435707 - DNA, 14 bp, Homo sapiens
tcactcacactggc

SEQ ID NO: 1435708 - DNA, 17 bp, Homo sapiens
tcactcacactggccac

SEQ ID NO: 1435709 - DNA, 16 bp, Homo sapiens
tcactcacagagtcaa

SEQ ID NO: 1435710 - DNA, 15 bp, Homo sapiens
tcactcactcattcc

SEQ ID NO: 1435711 - DNA, 16 bp, Homo sapiens
tcactcactcattcct

SEQ ID NO: 1435712 - DNA, 18 bp, Homo sapiens
tcactcaggcctctgcag

SEQ ID NO: 1435713 - DNA, 16 bp, Homo sapiens
tcactcagtaaaacat

SEQ ID NO: 1435714 - DNA, 21 bp, Homo sapiens
tcactcatcaatggggccagt

SEQ ID NO: 1435715 - DNA, 18 bp, Homo sapiens
tcactcattaatgaatca

SEQ ID NO: 1435716 - DNA, 13 bp, Homo sapiens
tcactcattgctg

SEQ ID NO: 1435717 - DNA, 17 bp, Homo sapiens
tcactcattgctgagcc

SEQ ID NO: 1435718 - DNA, 19 bp, Homo sapiens
tcactcattgctgagcctc

SEQ ID NO: 1435719 - DNA, 20 bp, Homo sapiens
tcactcattgctgagcctct

SEQ ID NO: 1435720 - DNA, 15 bp, Homo sapiens
tcactccaccaccca

SEQ ID NO: 1435721 - DNA, 14 bp, Homo sapiens
tcactccagtgctc

SEQ ID NO: 1435722 - DNA, 16 bp, Homo sapiens
tcactccagtgctcag

SEQ ID NO: 1435723 - DNA, 19 bp, Homo sapiens
tcactcccacctgcatctg

SEQ ID NO: 1435724 - DNA, 23 bp, Homo sapiens
tcactcccacctgcatctggggc

SEQ ID NO: 1435725 - DNA, 14 bp, Homo sapiens
tcactccccagccc

SEQ ID NO: 1435726 - DNA, 14 bp, Homo sapiens
tcactccccaggga

SEQ ID NO: 1435727 - DNA, 20 bp, Homo sapiens
tcactccccagggagctctg

SEQ ID NO: 1435728 - DNA, 22 bp, Homo sapiens
tcactccccagggagctctggg

SEQ ID NO: 1435729 - DNA, 15 bp, Homo sapiens
tcactccctctgcag

SEQ ID NO: 1435730 - DNA, 12 bp, Homo sapiens
tcactccctgga

SEQ ID NO: 1435731 - DNA, 17 bp, Homo sapiens
tcactccggtgtgcctg

SEQ ID NO: 1435732 - DNA, 19 bp, Homo sapiens
tcactccggtgtgcctgca

SEQ ID NO: 1435733 - DNA, 20 bp, Homo sapiens
tcactccggtgtgcctgcag

SEQ ID NO: 1435734 - DNA, 22 bp, Homo sapiens
tcactccggtgtgcctgcagcc

SEQ ID NO: 1435735 - DNA, 23 bp, Homo sapiens
tcactccggtgtgcctgcagccc

SEQ ID NO: 1435736 - DNA, 14 bp, Homo sapiens
tcactcctgcgctg

SEQ ID NO: 1435737 - DNA, 12 bp, Homo sapiens
tcactcctgggg

SEQ ID NO: 1435738 - DNA, 20 bp, Homo sapiens
tcactcctggggcctcttgg

SEQ ID NO: 1435739 - DNA, 23 bp, Homo sapiens
tcactcgggtgcgtgtgtttgta

SEQ ID NO: 1435740 - DNA, 13 bp, Homo sapiens
tcactctctgctg

SEQ ID NO: 1435741 - DNA, 23 bp, Homo sapiens
tcactctgccctctgctgctgcc

SEQ ID NO: 1435742 - DNA, 18 bp, Homo sapiens
tcactctgtgcctttcta

SEQ ID NO: 1435743 - DNA, 17 bp, Homo sapiens
tcactcttgaagtccag

SEQ ID NO: 1435744 - DNA, 17 bp, Homo sapiens
tcactgaaaattggaca

SEQ ID NO: 1435745 - DNA, 14 bp, Homo sapiens
tcactgaaacatgg

SEQ ID NO: 1435746 - DNA, 18 bp, Homo sapiens
tcactgaaccactgcttc

SEQ ID NO: 1435747 - DNA, 19 bp, Homo sapiens
tcactgaaccactgcttct

SEQ ID NO: 1435748 - DNA, 14 bp, Homo sapiens
tcactgaactccac

SEQ ID NO: 1435749 - DNA, 14 bp, Homo sapiens
tcactgaatttata

SEQ ID NO: 1435750 - DNA, 14 bp, Homo sapiens
tcactgaccagcgg

SEQ ID NO: 1435751 - DNA, 17 bp, Homo sapiens
tcactgaccagcggctg

SEQ ID NO: 1435752 - DNA, 13 bp, Homo sapiens
tcactgagctgtg

SEQ ID NO: 1435753 - DNA, 16 bp, Homo sapiens
tcactgatgggaaaac

SEQ ID NO: 1435754 - DNA, 18 bp, Homo sapiens
tcactgatgggaaaactg

SEQ ID NO: 1435755 - DNA, 18 bp, Homo sapiens
tcactgcaacctccgcct

SEQ ID NO: 1435756 - DNA, 18 bp, Homo sapiens
tcactgcaacttctgcct

SEQ ID NO: 1435757 - DNA, 22 bp, Homo sapiens
tcactgcacagtgcatctcagc

SEQ ID NO: 1435758 - DNA, 24 bp, Homo sapiens
tcactgcacagtgcatctcagccc

SEQ ID NO: 1435759 - DNA, 14 bp, Homo sapiens
tcagaagataactt

SEQ ID NO: 1435760 - DNA, 13 bp, Homo sapiens
tcagaagatagtc

SEQ ID NO: 1435761 - DNA, 20 bp, Homo sapiens
tcagaagatagtcttggaag

SEQ ID NO: 1435762 - DNA, 18 bp, Homo sapiens
tcagaagcaggttcttga

SEQ ID NO: 1435763 - DNA, 16 bp, Homo sapiens
tcagaaggaataagca

SEQ ID NO: 1435764 - DNA, 17 bp, Homo sapiens
tcagaaggacggcagga

SEQ ID NO: 1435765 - DNA, 18 bp, Homo sapiens
tcagaaggacggcaggag

SEQ ID NO: 1435766 - DNA, 16 bp, Homo sapiens
tcagaaggagaaggaa

SEQ ID NO: 1435767 - DNA, 18 bp, Homo sapiens
tcagaaggagaaggaagg

SEQ ID NO: 1435768 - DNA, 19 bp, Homo sapiens
tcagaaggagaaggaagga

SEQ ID NO: 1435769 - DNA, 13 bp, Homo sapiens
tcagaaggccagc

SEQ ID NO: 1435770 - DNA, 22 bp, Homo sapiens
tcagaagtcatcttgctaccag

SEQ ID NO: 1435771 - DNA, 17 bp, Homo sapiens
tcagaagttagtttgta

SEQ ID NO: 1435772 - DNA, 22 bp, Homo sapiens
tcagaataactacctcctcact

SEQ ID NO: 1435773 - DNA, 14 bp, Homo sapiens
tcagaataggaaaa

SEQ ID NO: 1435774 - DNA, 16 bp, Homo sapiens
tcagaataggaaaaca

SEQ ID NO: 1435775 - DNA, 20 bp, Homo sapiens
tcagaatataacatgtaaaa

SEQ ID NO: 1435776 - DNA, 15 bp, Homo sapiens
tcagaatatcatctt

SEQ ID NO: 1435777 - DNA, 14 bp, Homo sapiens
tcagaatattttca

SEQ ID NO: 1435778 - DNA, 15 bp, Homo sapiens
tcagaatattttcaa

SEQ ID NO: 1435779 - DNA, 22 bp, Homo sapiens
tcagaatcctttacattcaact

SEQ ID NO: 1435780 - DNA, 19 bp, Homo sapiens
tcagaatctcaaataacta

SEQ ID NO: 1435781 - DNA, 21 bp, Homo sapiens
tcagaatggcagtcctggagg

SEQ ID NO: 1435782 - DNA, 16 bp, Homo sapiens
tcagaattaaactttt

SEQ ID NO: 1435783 - DNA, 18 bp, Homo sapiens
tcagaattaaacttttaa

SEQ ID NO: 1435784 - DNA, 21 bp, Homo sapiens
tcagaattgatcattttcccc

SEQ ID NO: 1435785 - DNA, 23 bp, Homo sapiens
tcagaatttctttgtcattcaag

SEQ ID NO: 1435786 - DNA, 22 bp, Homo sapiens
tcagacaacattatgatctaat

SEQ ID NO: 1435787 - DNA, 14 bp, Homo sapiens
tcagacaagcacta

SEQ ID NO: 1435788 - DNA, 22 bp, Homo sapiens
tcagacaagcactattttatat

SEQ ID NO: 1435789 - DNA, 20 bp, Homo sapiens
tcagacaataccactggtta

SEQ ID NO: 1435790 - DNA, 15 bp, Homo sapiens
tcagacaccctcaac

SEQ ID NO: 1435791 - DNA, 20 bp, Homo sapiens
tcagacacttcatggaccaa

SEQ ID NO: 1435792 - DNA, 15 bp, Homo sapiens
tcagacagaacttga

SEQ ID NO: 1435793 - DNA, 23 bp, Homo sapiens
tcagacagaacttgaatgtgtca

SEQ ID NO: 1435794 - DNA, 18 bp, Homo sapiens
tcagacatacagctgcct

SEQ ID NO: 1435795 - DNA, 19 bp, Homo sapiens
tcagacatctgaggtttta

SEQ ID NO: 1435796 - DNA, 14 bp, Homo sapiens
tcagacatgttttc

SEQ ID NO: 1435797 - DNA, 20 bp, Homo sapiens
tcagacatgttttccgtgaa

SEQ ID NO: 1435798 - DNA, 16 bp, Homo sapiens
tcagacattttctttt

SEQ ID NO: 1435799 - DNA, 20 bp, Homo sapiens
tcagacattttcttttttta

SEQ ID NO: 1435800 - DNA, 12 bp, Homo sapiens
tcagacccagag

SEQ ID NO: 1435801 - DNA, 13 bp, Homo sapiens
tcagacccagaga

SEQ ID NO: 1435802 - DNA, 22 bp, Homo sapiens
tcagacccccactctcattccc

SEQ ID NO: 1435803 - DNA, 15 bp, Homo sapiens
tcagacccccccatt

SEQ ID NO: 1435804 - DNA, 13 bp, Homo sapiens
tcagacccctgcc

SEQ ID NO: 1435805 - DNA, 14 bp, Homo sapiens
tcagacccctgcct

SEQ ID NO: 1435806 - DNA, 14 bp, Homo sapiens
tcagaccctacccc

SEQ ID NO: 1435807 - DNA, 14 bp, Homo sapiens
tcagaccctggagg

SEQ ID NO: 1435808 - DNA, 15 bp, Homo sapiens
tcagacctccagtga

SEQ ID NO: 1435809 - DNA, 14 bp, Homo sapiens
tcagacggcggcca

SEQ ID NO: 1435810 - DNA, 15 bp, Homo sapiens
tcagacggcggccag

SEQ ID NO: 1435811 - DNA, 23 bp, Homo sapiens
tcagacggcggccaggcacaggg

SEQ ID NO: 1435812 - DNA, 22 bp, Homo sapiens
tcagacgtgtgacctccatact

SEQ ID NO: 1435813 - DNA, 20 bp, Homo sapiens
tcagactagccactcctgcc

SEQ ID NO: 1435814 - DNA, 14 bp, Homo sapiens
tcagactagtgaca

SEQ ID NO: 1435815 - DNA, 22 bp, Homo sapiens
tcagactcccattcctgaagaa

SEQ ID NO: 1435816 - DNA, 22 bp, Homo sapiens
tcagactccgccctcctcgggc

SEQ ID NO: 1435817 - DNA, 18 bp, Homo sapiens
tcagactgctctttcata

SEQ ID NO: 1435818 - DNA, 14 bp, Homo sapiens
tcagactgctggga

SEQ ID NO: 1435819 - DNA, 17 bp, Homo sapiens
tcagactgctgggactg

SEQ ID NO: 1435820 - DNA, 16 bp, Homo sapiens
tcagacttccaaatcc

SEQ ID NO: 1435821 - DNA, 17 bp, Homo sapiens
tcagactttaaagaata

SEQ ID NO: 1435822 - DNA, 23 bp, Homo sapiens
tcagactttgtgttcatttcatt

SEQ ID NO: 1435823 - DNA, 20 bp, Homo sapiens
tcagagacaggtggcctagc

SEQ ID NO: 1435824 - DNA, 15 bp, Homo sapiens
tcagagaccagcact

SEQ ID NO: 1435825 - DNA, 15 bp, Homo sapiens
tcagagaccattgca

SEQ ID NO: 1435826 - DNA, 17 bp, Homo sapiens
tcagagactcagggccc

SEQ ID NO: 1435827 - DNA, 21 bp, Homo sapiens
tcagagagacccgggaaggaa

SEQ ID NO: 1435828 - DNA, 14 bp, Homo sapiens
tcagagagacctca

SEQ ID NO: 1435829 - DNA, 16 bp, Homo sapiens
tcagagaggccttttg

SEQ ID NO: 1435830 - DNA, 21 bp, Homo sapiens
tcagagagtgtacatcatgtt

SEQ ID NO: 1435831 - DNA, 16 bp, Homo sapiens
tcagagataggcctgt

SEQ ID NO: 1435832 - DNA, 21 bp, Homo sapiens
tcagagatcgtgtattgagat

SEQ ID NO: 1435833 - DNA, 21 bp, Homo sapiens
tcagagatgcaccaccaagcc

SEQ ID NO: 1435834 - DNA, 21 bp, Homo sapiens
tcagagccacccctaaagaga

SEQ ID NO: 1435835 - DNA, 11 bp, Homo sapiens
tcagagccact

SEQ ID NO: 1435836 - DNA, 12 bp, Homo sapiens
tcagagccactc

SEQ ID NO: 1435837 - DNA, 23 bp, Homo sapiens
tcagagccactctatgagttgga

SEQ ID NO: 1435838 - DNA, 16 bp, Homo sapiens
tcagagccagcctggc

SEQ ID NO: 1435839 - DNA, 14 bp, Homo sapiens
tcagagccagtgaa

SEQ ID NO: 1435840 - DNA, 14 bp, Homo sapiens
tcagagcccacatg

SEQ ID NO: 1435841 - DNA, 16 bp, Homo sapiens
tcagagcccagcccag

SEQ ID NO: 1435842 - DNA, 18 bp, Homo sapiens
tcagagcccagcccagga

SEQ ID NO: 1435843 - DNA, 19 bp, Homo sapiens
tcagagcccccagccctgg

SEQ ID NO: 1435844 - DNA, 20 bp, Homo sapiens
tcagagcccccagccctggg

SEQ ID NO: 1435845 - DNA, 12 bp, Homo sapiens
tcagagcctagc

SEQ ID NO: 1435846 - DNA, 21 bp, Homo sapiens
tcagagcctagccacctccca

SEQ ID NO: 1435847 - DNA, 16 bp, Homo sapiens
tcagagcgcacaggga

SEQ ID NO: 1435848 - DNA, 20 bp, Homo sapiens
tcagagctatggtgcttgct

SEQ ID NO: 1435849 - DNA, 13 bp, Homo sapiens
tcagagctcttaa

SEQ ID NO: 1435850 - DNA, 13 bp, Homo sapiens
tcagaggcagtga

SEQ ID NO: 1435851 - DNA, 18 bp, Homo sapiens
tcagaggcctgctgccag

SEQ ID NO: 1435852 - DNA, 23 bp, Homo sapiens
tcagaggcctggcatcttctgga

SEQ ID NO: 1435853 - DNA, 23 bp, Homo sapiens
tcagagggactgtcagctgagct

SEQ ID NO: 1435854 - DNA, 20 bp, Homo sapiens
tcagagggcccaaatggcag

SEQ ID NO: 1435855 - DNA, 16 bp, Homo sapiens
tcagagggctgatgga

SEQ ID NO: 1435856 - DNA, 23 bp, Homo sapiens
tcagaggtttacctagagaacag

SEQ ID NO: 1435857 - DNA, 16 bp, Homo sapiens
tcagagtcagccagga

SEQ ID NO: 1435858 - DNA, 17 bp, Homo sapiens
tcagagtccttaaaatg

SEQ ID NO: 1435859 - DNA, 21 bp, Homo sapiens
tcagagttgctgcaaacctga

SEQ ID NO: 1435860 - DNA, 17 bp, Homo sapiens
tcagagttgctttaaag

SEQ ID NO: 1435861 - DNA, 15 bp, Homo sapiens
tcagagtttgtgtgt

SEQ ID NO: 1435862 - DNA, 16 bp, Homo sapiens
tcagagtttgtgtgta

SEQ ID NO: 1435863 - DNA, 17 bp, Homo sapiens
tcagagtttgtgtgtat

SEQ ID NO: 1435864 - DNA, 20 bp, Homo sapiens
tcagagtttgtgtgtatttg

SEQ ID NO: 1435865 - DNA, 16 bp, Homo sapiens
tcagcgagaggcagca

SEQ ID NO: 1435866 - DNA, 21 bp, Homo sapiens
tcagcgggggccttgaagact

SEQ ID NO: 1435867 - DNA, 22 bp, Homo sapiens
tcagcgggggccttgaagactc

SEQ ID NO: 1435868 - DNA, 23 bp, Homo sapiens
tcagcgggtctcctcccagcggc

SEQ ID NO: 1435869 - DNA, 18 bp, Homo sapiens
tcagctaaagcccaacct

SEQ ID NO: 1435870 - DNA, 20 bp, Homo sapiens
tcagctaaagtaacagagca

SEQ ID NO: 1435871 - DNA, 15 bp, Homo sapiens
tcagctaagctcacg

SEQ ID NO: 1435872 - DNA, 15 bp, Homo sapiens
tcagctactaatgat

SEQ ID NO: 1435873 - DNA, 19 bp, Homo sapiens
tcagctatttactgccaaa

SEQ ID NO: 1435874 - DNA, 16 bp, Homo sapiens
tcagctcaatgcagtt

SEQ ID NO: 1435875 - DNA, 23 bp, Homo sapiens
tcagctccagggaatccaagcct

SEQ ID NO: 1435876 - DNA, 13 bp, Homo sapiens
tcagctcccaggc

SEQ ID NO: 1435877 - DNA, 15 bp, Homo sapiens
tcagctcccaggcca

SEQ ID NO: 1435878 - DNA, 18 bp, Homo sapiens
tcagctcccctcggagaa

SEQ ID NO: 1435879 - DNA, 14 bp, Homo sapiens
tcagctctctgccc

SEQ ID NO: 1435880 - DNA, 20 bp, Homo sapiens
tcagctctctgccctgtgta

SEQ ID NO: 1435881 - DNA, 21 bp, Homo sapiens
tcagctctctgggacctcctt

SEQ ID NO: 1435882 - DNA, 20 bp, Homo sapiens
tcagctgcaaggtactctgg

SEQ ID NO: 1435883 - DNA, 21 bp, Homo sapiens
tcagctgcaatccatttattt

SEQ ID NO: 1435884 - DNA, 11 bp, Homo sapiens
tcagctgccca

SEQ ID NO: 1435885 - DNA, 20 bp, Homo sapiens
tcagctgcccatcccagtcc

SEQ ID NO: 1435886 - DNA, 12 bp, Homo sapiens
tcagctgcctca

SEQ ID NO: 1435887 - DNA, 15 bp, Homo sapiens
tcagctgcctcactt

SEQ ID NO: 1435888 - DNA, 19 bp, Homo sapiens
tcagctgctccctggcatt

SEQ ID NO: 1435889 - DNA, 22 bp, Homo sapiens
tcagctgctgaaatttggaaag

SEQ ID NO: 1435890 - DNA, 23 bp, Homo sapiens
tcagctgtaagaagagactggga

SEQ ID NO: 1435891 - DNA, 17 bp, Homo sapiens
tcagctgtacttcgtct

SEQ ID NO: 1435892 - DNA, 12 bp, Homo sapiens
tcagctgtggct

SEQ ID NO: 1435893 - DNA, 15 bp, Homo sapiens
tcagctgtggctgga

SEQ ID NO: 1435894 - DNA, 22 bp, Homo sapiens
tcagctgtggctggaggagctg

SEQ ID NO: 1435895 - DNA, 22 bp, Homo sapiens
tcagctgtggggaacatggctg

SEQ ID NO: 1435896 - DNA, 16 bp, Homo sapiens
tcagctgtttgtcata

SEQ ID NO: 1435897 - DNA, 22 bp, Homo sapiens
tcagcttacatccctgagcagg

SEQ ID NO: 1435898 - DNA, 19 bp, Homo sapiens
tcagcttatctcttttata

SEQ ID NO: 1435899 - DNA, 22 bp, Homo sapiens
tcagcttcctgctgctggggcc

SEQ ID NO: 1435900 - DNA, 21 bp, Homo sapiens
tcagcttggtagttaacacat

SEQ ID NO: 1435901 - DNA, 14 bp, Homo sapiens
tcagcttgtttcta

SEQ ID NO: 1435902 - DNA, 12 bp, Homo sapiens
tcagctttaaag

SEQ ID NO: 1435903 - DNA, 20 bp, Homo sapiens
tcagctttcagagccagtga

SEQ ID NO: 1435904 - DNA, 22 bp, Homo sapiens
tcagctttcagagccagtgaag

SEQ ID NO: 1435905 - DNA, 23 bp, Homo sapiens
tcaggaaaaatgaggaatccaaa

SEQ ID NO: 1435906 - DNA, 15 bp, Homo sapiens
tcaggaaaaggttga

SEQ ID NO: 1435907 - DNA, 21 bp, Homo sapiens
tcaggaaaatgtattgattca

SEQ ID NO: 1435908 - DNA, 23 bp, Homo sapiens
tcaggaaatcaaatatgcaaagc

SEQ ID NO: 1435909 - DNA, 18 bp, Homo sapiens
tcaggaacagctatggga

SEQ ID NO: 1435910 - DNA, 22 bp, Homo sapiens
tcaggaagaaatcacagaatca

SEQ ID NO: 1435911 - DNA, 23 bp, Homo sapiens
tcaggaagaaatcacagaatcat

SEQ ID NO: 1435912 - DNA, 22 bp, Homo sapiens
tcaggaagaacaccctctaaat

SEQ ID NO: 1435913 - DNA, 11 bp, Homo sapiens
tcaggaagctc

SEQ ID NO: 1435914 - DNA, 23 bp, Homo sapiens
tcaggaatggggggcgggccagg

SEQ ID NO: 1435915 - DNA, 18 bp, Homo sapiens
tcaggaattcagtgcctt

SEQ ID NO: 1435916 - DNA, 18 bp, Homo sapiens
tcaggaattctaaataaa

SEQ ID NO: 1435917 - DNA, 22 bp, Homo sapiens
tcaggaattctaaataaatttc

SEQ ID NO: 1435918 - DNA, 18 bp, Homo sapiens
tcaggaattcttggagaa

SEQ ID NO: 1435919 - DNA, 15 bp, Homo sapiens
tcaggaattgtcaaa

SEQ ID NO: 1435920 - DNA, 15 bp, Homo sapiens
tcaggacagatgcca

SEQ ID NO: 1435921 - DNA, 15 bp, Homo sapiens
tcaggaccagatgtc

SEQ ID NO: 1435922 - DNA, 20 bp, Homo sapiens
tcaggaccagatgtccgtct

SEQ ID NO: 1435923 - DNA, 12 bp, Homo sapiens
tcaggacccagg

SEQ ID NO: 1435924 - DNA, 17 bp, Homo sapiens
tcaggacctctgtaggc

SEQ ID NO: 1435925 - DNA, 19 bp, Homo sapiens
tcaggacgagaatgagggt

SEQ ID NO: 1435926 - DNA, 20 bp, Homo sapiens
tcaggagaatagcttttact

SEQ ID NO: 1435927 - DNA, 18 bp, Homo sapiens
tcaggagagtgcagatct

SEQ ID NO: 1435928 - DNA, 22 bp, Homo sapiens
tcaggagatcgagaccatcctg

SEQ ID NO: 1435929 - DNA, 12 bp, Homo sapiens
tcaggaggcgcc

SEQ ID NO: 1435930 - DNA, 14 bp, Homo sapiens
tcaggaggcgccct

SEQ ID NO: 1435931 - DNA, 12 bp, Homo sapiens
tcaggaggctga

SEQ ID NO: 1435932 - DNA, 14 bp, Homo sapiens
tcaggaggctgaga

SEQ ID NO: 1435933 - DNA, 18 bp, Homo sapiens
tcaggaggctgaggcaga

SEQ ID NO: 1435934 - DNA, 14 bp, Homo sapiens
tcaggaggctggag

SEQ ID NO: 1435935 - DNA, 21 bp, Homo sapiens
tcaggaggctggaggaagggg

SEQ ID NO: 1435936 - DNA, 20 bp, Homo sapiens
tcaggagggtgacgcccagc

SEQ ID NO: 1435937 - DNA, 19 bp, Homo sapiens
tcaggagtcccaaggaaag

SEQ ID NO: 1435938 - DNA, 14 bp, Homo sapiens
tcaggagtctgcca

SEQ ID NO: 1435939 - DNA, 15 bp, Homo sapiens
tcaggagtctgccac

SEQ ID NO: 1435940 - DNA, 22 bp, Homo sapiens
tcaggagttagaggccagcctg

SEQ ID NO: 1435941 - DNA, 17 bp, Homo sapiens
tcaggagttcaagacta

SEQ ID NO: 1435942 - DNA, 20 bp, Homo sapiens
tcaggatactctgtcagatg

SEQ ID NO: 1435943 - DNA, 23 bp, Homo sapiens
tcaggatattagttaatgagcca

SEQ ID NO: 1435944 - DNA, 22 bp, Homo sapiens
tcaggatattggttcttcccct

SEQ ID NO: 1435945 - DNA, 17 bp, Homo sapiens
tcaggatcaagaaagtg

SEQ ID NO: 1435946 - DNA, 15 bp, Homo sapiens
tcaggatccagtctg

SEQ ID NO: 1435947 - DNA, 13 bp, Homo sapiens
tcaggatgcacat

SEQ ID NO: 1435948 - DNA, 23 bp, Homo sapiens
tcaggatgcacatttctggattg

SEQ ID NO: 1435949 - DNA, 13 bp, Homo sapiens
tcaggatgcccag

SEQ ID NO: 1435950 - DNA, 14 bp, Homo sapiens
tcaggatgcccagg

SEQ ID NO: 1435951 - DNA, 21 bp, Homo sapiens
tcaggatgtaggggttaactt

SEQ ID NO: 1435952 - DNA, 16 bp, Homo sapiens
tcaggatttaaaaact

SEQ ID NO: 1435953 - DNA, 22 bp, Homo sapiens
tcaggcaagcccctcagccctt

SEQ ID NO: 1435954 - DNA, 24 bp, Homo sapiens
tcaggcaagcccctcagcccttgc

SEQ ID NO: 1435955 - DNA, 20 bp, Homo sapiens
tcaggcagacaagagctgct

SEQ ID NO: 1435956 - DNA, 23 bp, Homo sapiens
tcaggcagacaagagctgctgtc

SEQ ID NO: 1435957 - DNA, 22 bp, Homo sapiens
tcaggcagcaccacactgggtg

SEQ ID NO: 1435958 - DNA, 16 bp, Homo sapiens
tcaggcagccttcata

SEQ ID NO: 1435959 - DNA, 21 bp, Homo sapiens
tcaggcagcgttagggctgct

SEQ ID NO: 1435960 - DNA, 15 bp, Homo sapiens
tcaggcataggcctg

SEQ ID NO: 1435961 - DNA, 17 bp, Homo sapiens
tcaggccagcccagcca

SEQ ID NO: 1435962 - DNA, 19 bp, Homo sapiens
tcaggccagcccagccagg

SEQ ID NO: 1435963 - DNA, 17 bp, Homo sapiens
tagttactgtgtaatta

SEQ ID NO: 1435964 - DNA, 19 bp, Homo sapiens
tagttactgtgtaattagt

SEQ ID NO: 1435965 - DNA, 16 bp, Homo sapiens
tagttagcatccaggc

SEQ ID NO: 1435966 - DNA, 15 bp, Homo sapiens
tagttattattgctg

SEQ ID NO: 1435967 - DNA, 19 bp, Homo sapiens
tagttcaatatttgttact

SEQ ID NO: 1435968 - DNA, 15 bp, Homo sapiens
tagttcagacacttt

SEQ ID NO: 1435969 - DNA, 19 bp, Homo sapiens
tagttcagacactttggaa

SEQ ID NO: 1435970 - DNA, 14 bp, Homo sapiens
tagttccagtttct

SEQ ID NO: 1435971 - DNA, 20 bp, Homo sapiens
tagttccctaaactttagaa

SEQ ID NO: 1435972 - DNA, 14 bp, Homo sapiens
tagttccttgcctt

SEQ ID NO: 1435973 - DNA, 15 bp, Homo sapiens
tagttctaagactca

SEQ ID NO: 1435974 - DNA, 11 bp, Homo sapiens
tagttctagat

SEQ ID NO: 1435975 - DNA, 12 bp, Homo sapiens
tagttctagatg

SEQ ID NO: 1435976 - DNA, 15 bp, Homo sapiens
tagttctaggcactg

SEQ ID NO: 1435977 - DNA, 23 bp, Homo sapiens
tagttctagtgcagctgaaattg

SEQ ID NO: 1435978 - DNA, 20 bp, Homo sapiens
tagttctatccttttgcctg

SEQ ID NO: 1435979 - DNA, 14 bp, Homo sapiens
tagttctatttcta

SEQ ID NO: 1435980 - DNA, 18 bp, Homo sapiens
tagttctatttctatctg

SEQ ID NO: 1435981 - DNA, 19 bp, Homo sapiens
tagttctgctgccctctta

SEQ ID NO: 1435982 - DNA, 11 bp, Homo sapiens
tagttctgtga

SEQ ID NO: 1435983 - DNA, 15 bp, Homo sapiens
tagttctgtgcctcc

SEQ ID NO: 1435984 - DNA, 22 bp, Homo sapiens
tagttctttcctccccctgcaa

SEQ ID NO: 1435985 - DNA, 22 bp, Homo sapiens
tagttgaattttttttaacatt

SEQ ID NO: 1435986 - DNA, 17 bp, Homo sapiens
tagttgacaacctagaa

SEQ ID NO: 1435987 - DNA, 12 bp, Homo sapiens
tagttgagcccc

SEQ ID NO: 1435988 - DNA, 13 bp, Homo sapiens
tagttgagcccca

SEQ ID NO: 1435989 - DNA, 16 bp, Homo sapiens
tagttgcactaactgc

SEQ ID NO: 1435990 - DNA, 17 bp, Homo sapiens
tagttgcagaaacattt

SEQ ID NO: 1435991 - DNA, 17 bp, Homo sapiens
tagttgcttaattttga

SEQ ID NO: 1435992 - DNA, 16 bp, Homo sapiens
tagttggaaacaaatc

SEQ ID NO: 1435993 - DNA, 15 bp, Homo sapiens
tagttggtgttcaaa

SEQ ID NO: 1435994 - DNA, 14 bp, Homo sapiens
tagttggtttgtat

SEQ ID NO: 1435995 - DNA, 16 bp, Homo sapiens
tagttggtttgtatga

SEQ ID NO: 1435996 - DNA, 18 bp, Homo sapiens
tagttgtaaaccaagtga

SEQ ID NO: 1435997 - DNA, 17 bp, Homo sapiens
tagttgtctttcctggc

SEQ ID NO: 1435998 - DNA, 15 bp, Homo sapiens
tagttgtgtttcaac

SEQ ID NO: 1435999 - DNA, 19 bp, Homo sapiens
tagtttacagaaaaatctt

SEQ ID NO: 1436000 - DNA, 13 bp, Homo sapiens
tagtttactgttt

SEQ ID NO: 1436001 - DNA, 14 bp, Homo sapiens
tagtttactgtttt

SEQ ID NO: 1436002 - DNA, 22 bp, Homo sapiens
tagtttagatcccatgtcacct

SEQ ID NO: 1436003 - DNA, 20 bp, Homo sapiens
tagtttagtacaataatctc

SEQ ID NO: 1436004 - DNA, 18 bp, Homo sapiens
tagtttattggaagtgtt

SEQ ID NO: 1436005 - DNA, 17 bp, Homo sapiens
tagtttcaaatctgtaa

SEQ ID NO: 1436006 - DNA, 15 bp, Homo sapiens
tagtttcacattgca

SEQ ID NO: 1436007 - DNA, 14 bp, Homo sapiens
tagtttcagtaaat

SEQ ID NO: 1436008 - DNA, 16 bp, Homo sapiens
tagtttctagaggcct

SEQ ID NO: 1436009 - DNA, 13 bp, Homo sapiens
tagtttctgaggc

SEQ ID NO: 1436010 - DNA, 20 bp, Homo sapiens
tagtttgaggaaatttgcag

SEQ ID NO: 1436011 - DNA, 18 bp, Homo sapiens
tagtttgcattcctgata

SEQ ID NO: 1436012 - DNA, 11 bp, Homo sapiens
tagtttggatt

SEQ ID NO: 1436013 - DNA, 16 bp, Homo sapiens
tagttttagttgcaga

SEQ ID NO: 1436014 - DNA, 13 bp, Homo sapiens
tagttttattctt

SEQ ID NO: 1436015 - DNA, 18 bp, Homo sapiens
tagttttctagatgacat

SEQ ID NO: 1436016 - DNA, 12 bp, Homo sapiens
tagttttgcata

SEQ ID NO: 1436017 - DNA, 14 bp, Homo sapiens
tagtttttcattaa

SEQ ID NO: 1436018 - DNA, 21 bp, Homo sapiens
tagtttttcattaaataaatt

SEQ ID NO: 1436019 - DNA, 20 bp, Homo sapiens
tagtttttgaaaattatgca

SEQ ID NO: 1436020 - DNA, 21 bp, Homo sapiens
tagtttttgaaaattatgcaa

SEQ ID NO: 1436021 - DNA, 21 bp, Homo sapiens
tagttttttttgtaaactgta

SEQ ID NO: 1436022 - DNA, 22 bp, Homo sapiens
tataaaaaatcatgccagtatt

SEQ ID NO: 1436023 - DNA, 15 bp, Homo sapiens
tataaaaaatggttc

SEQ ID NO: 1436024 - DNA, 17 bp, Homo sapiens
tataaaaaatggttcag

SEQ ID NO: 1436025 - DNA, 21 bp, Homo sapiens
tataaaaaatggttcagaatt

SEQ ID NO: 1436026 - DNA, 13 bp, Homo sapiens
tataaaaaatgta

SEQ ID NO: 1436027 - DNA, 11 bp, Homo sapiens
tataaaaacaa

SEQ ID NO: 1436028 - DNA, 19 bp, Homo sapiens
tataaaaagaaaagataaa

SEQ ID NO: 1436029 - DNA, 16 bp, Homo sapiens
tataaaaattatcaaa

SEQ ID NO: 1436030 - DNA, 19 bp, Homo sapiens
tataaaaattatcaaaaag

SEQ ID NO: 1436031 - DNA, 13 bp, Homo sapiens
tataaaactcagt

SEQ ID NO: 1436032 - DNA, 19 bp, Homo sapiens
tataaaactgtacttcact

SEQ ID NO: 1436033 - DNA, 15 bp, Homo sapiens
tataaaactttcctc

SEQ ID NO: 1436034 - DNA, 16 bp, Homo sapiens
tataaaagcaaaagag

SEQ ID NO: 1436035 - DNA, 20 bp, Homo sapiens
tataaaaggcaaatgtgtac

SEQ ID NO: 1436036 - DNA, 17 bp, Homo sapiens
tataaaatacataatat

SEQ ID NO: 1436037 - DNA, 19 bp, Homo sapiens
tataaaatctgaattttgc

SEQ ID NO: 1436038 - DNA, 20 bp, Homo sapiens
tataaaatctgaattttgca

SEQ ID NO: 1436039 - DNA, 23 bp, Homo sapiens
tataaaatgaaagatttttacta

SEQ ID NO: 1436040 - DNA, 21 bp, Homo sapiens
tataaaatgtgcagatgcaat

SEQ ID NO: 1436041 - DNA, 12 bp, Homo sapiens
tataaaattatg

SEQ ID NO: 1436042 - DNA, 22 bp, Homo sapiens
tataaacaagaatgaaggtttt

SEQ ID NO: 1436043 - DNA, 20 bp, Homo sapiens
tataaacaataaaaacaact

SEQ ID NO: 1436044 - DNA, 20 bp, Homo sapiens
tataaacagacaatatgtga

SEQ ID NO: 1436045 - DNA, 18 bp, Homo sapiens
tataaacatcacacacac

SEQ ID NO: 1436046 - DNA, 17 bp, Homo sapiens
tataaactaggtaaaat

SEQ ID NO: 1436047 - DNA, 15 bp, Homo sapiens
tataaagaacaaggt

SEQ ID NO: 1436048 - DNA, 22 bp, Homo sapiens
tataaagaacaaggtagttttt

SEQ ID NO: 1436049 - DNA, 17 bp, Homo sapiens
tataaagacaacaaaag

SEQ ID NO: 1436050 - DNA, 21 bp, Homo sapiens
tataaagacaacaaaagaaat

SEQ ID NO: 1436051 - DNA, 20 bp, Homo sapiens
tataaagctgttattcttgt

SEQ ID NO: 1436052 - DNA, 22 bp, Homo sapiens
tataaagctgttattcttgtta

SEQ ID NO: 1436053 - DNA, 18 bp, Homo sapiens
tataaagtagtcctgtga

SEQ ID NO: 1436054 - DNA, 20 bp, Homo sapiens
tataaagtatatattaggat

SEQ ID NO: 1436055 - DNA, 22 bp, Homo sapiens
tataaagttggttcacttcaaa

SEQ ID NO: 1436056 - DNA, 19 bp, Homo sapiens
tataaagttttatttgaat

SEQ ID NO: 1436057 - DNA, 18 bp, Homo sapiens
tataaatactgcaaatca

SEQ ID NO: 1436058 - DNA, 15 bp, Homo sapiens
tataaatatacagta

SEQ ID NO: 1436059 - DNA, 18 bp, Homo sapiens
tataaatatcagtattct

SEQ ID NO: 1436060 - DNA, 15 bp, Homo sapiens
tataaatcaatgtca

SEQ ID NO: 1436061 - DNA, 16 bp, Homo sapiens
tataaatgccagagcc

SEQ ID NO: 1436062 - DNA, 12 bp, Homo sapiens
tataaatgtata

SEQ ID NO: 1436063 - DNA, 12 bp, Homo sapiens
tataaatgttta

SEQ ID NO: 1436064 - DNA, 18 bp, Homo sapiens
tataaattactatctgtt

SEQ ID NO: 1436065 - DNA, 14 bp, Homo sapiens
tataaattcagaac

SEQ ID NO: 1436066 - DNA, 14 bp, Homo sapiens
tataacaactattt

SEQ ID NO: 1436067 - DNA, 17 bp, Homo sapiens
tataacaactatttact

SEQ ID NO: 1436068 - DNA, 17 bp, Homo sapiens
tataacaactctatttt

SEQ ID NO: 1436069 - DNA, 17 bp, Homo sapiens
tataacaatataactga

SEQ ID NO: 1436070 - DNA, 13 bp, Homo sapiens
tataacacatttt

SEQ ID NO: 1436071 - DNA, 12 bp, Homo sapiens
tatatgtatatg

SEQ ID NO: 1436072 - DNA, 21 bp, Homo sapiens
tatatgtatatttttttaatt

SEQ ID NO: 1436073 - DNA, 19 bp, Homo sapiens
tatatgtattcccttgtat

SEQ ID NO: 1436074 - DNA, 20 bp, Homo sapiens
tatatgtattcccttgtatt

SEQ ID NO: 1436075 - DNA, 15 bp, Homo sapiens
tatatgtcatttact

SEQ ID NO: 1436076 - DNA, 19 bp, Homo sapiens
tatatgtgtgtgtatgttt

SEQ ID NO: 1436077 - DNA, 22 bp, Homo sapiens
tatatgtgtgtgtatgtttgca

SEQ ID NO: 1436078 - DNA, 18 bp, Homo sapiens
tatatgtgtttttcacat

SEQ ID NO: 1436079 - DNA, 23 bp, Homo sapiens
tatatgtttaccttttaattaat

SEQ ID NO: 1436080 - DNA, 21 bp, Homo sapiens
tatattaaaattccaaattca

SEQ ID NO: 1436081 - DNA, 22 bp, Homo sapiens
tatattaaaattccaaattcat

SEQ ID NO: 1436082 - DNA, 13 bp, Homo sapiens
tatattaaacaaa

SEQ ID NO: 1436083 - DNA, 14 bp, Homo sapiens
tatattaagcagaa

SEQ ID NO: 1436084 - DNA, 17 bp, Homo sapiens
tatattaatgtacttgt

SEQ ID NO: 1436085 - DNA, 16 bp, Homo sapiens
tatattactgacattt

SEQ ID NO: 1436086 - DNA, 22 bp, Homo sapiens
tatattagatcaaatagttgca

SEQ ID NO: 1436087 - DNA, 18 bp, Homo sapiens
tatattaggatctgcaaa

SEQ ID NO: 1436088 - DNA, 23 bp, Homo sapiens
tatattaggatctgcaaacaatg

SEQ ID NO: 1436089 - DNA, 22 bp, Homo sapiens
tatattatcatgcaaatgctgt

SEQ ID NO: 1436090 - DNA, 16 bp, Homo sapiens
tatattattttactgc

SEQ ID NO: 1436091 - DNA, 16 bp, Homo sapiens
tatattcaatgcattt

SEQ ID NO: 1436092 - DNA, 18 bp, Homo sapiens
tatattccaccattcaca

SEQ ID NO: 1436093 - DNA, 18 bp, Homo sapiens
tatattccatttacataa

SEQ ID NO: 1436094 - DNA, 21 bp, Homo sapiens
tatattccgtatttaaagttg

SEQ ID NO: 1436095 - DNA, 20 bp, Homo sapiens
tatattctgaccgttaaaaa

SEQ ID NO: 1436096 - DNA, 12 bp, Homo sapiens
tatattgaactt

SEQ ID NO: 1436097 - DNA, 13 bp, Homo sapiens
tatattgaacttt

SEQ ID NO: 1436098 - DNA, 17 bp, Homo sapiens
tatattgcttagtaagt

SEQ ID NO: 1436099 - DNA, 18 bp, Homo sapiens
tatattggaattataaat

SEQ ID NO: 1436100 - DNA, 17 bp, Homo sapiens
tatattgtacaaatgta

SEQ ID NO: 1436101 - DNA, 15 bp, Homo sapiens
tatatttaaaaataa

SEQ ID NO: 1436102 - DNA, 15 bp, Homo sapiens
tatatttaaaaattg

SEQ ID NO: 1436103 - DNA, 18 bp, Homo sapiens
tatatttaaaaattgttt

SEQ ID NO: 1436104 - DNA, 21 bp, Homo sapiens
tatatttaaaaattgtttctt

SEQ ID NO: 1436105 - DNA, 19 bp, Homo sapiens
tatatttaaagggaaattg

SEQ ID NO: 1436106 - DNA, 15 bp, Homo sapiens
tatatttaacaagat

SEQ ID NO: 1436107 - DNA, 17 bp, Homo sapiens
tatatttaggaaattca

SEQ ID NO: 1436108 - DNA, 14 bp, Homo sapiens
tatatttagtaact

SEQ ID NO: 1436109 - DNA, 15 bp, Homo sapiens
tatatttataactca

SEQ ID NO: 1436110 - DNA, 16 bp, Homo sapiens
tatatttataactcat

SEQ ID NO: 1436111 - DNA, 22 bp, Homo sapiens
tatatttataactcatcataaa

SEQ ID NO: 1436112 - DNA, 23 bp, Homo sapiens
tatatttataactcatcataaaa

SEQ ID NO: 1436113 - DNA, 16 bp, Homo sapiens
tatatttattcataat

SEQ ID NO: 1436114 - DNA, 17 bp, Homo sapiens
tatatttattcataatg

SEQ ID NO: 1436115 - DNA, 12 bp, Homo sapiens
tatatttattga

SEQ ID NO: 1436116 - DNA, 12 bp, Homo sapiens
tatatttcagac

SEQ ID NO: 1436117 - DNA, 19 bp, Homo sapiens
tatatttcctttatgtgaa

SEQ ID NO: 1436118 - DNA, 14 bp, Homo sapiens
tatatttgaaatag

SEQ ID NO: 1436119 - DNA, 13 bp, Homo sapiens
tatatttgacatg

SEQ ID NO: 1436120 - DNA, 17 bp, Homo sapiens
tatatttggaaagagac

SEQ ID NO: 1436121 - DNA, 22 bp, Homo sapiens
tatatttgggcctgctccagac

SEQ ID NO: 1436122 - DNA, 13 bp, Homo sapiens
tatatttgggtta

SEQ ID NO: 1436123 - DNA, 20 bp, Homo sapiens
tatatttgtaaatttatgtg

SEQ ID NO: 1436124 - DNA, 13 bp, Homo sapiens
tatatttgtagga

SEQ ID NO: 1436125 - DNA, 14 bp, Homo sapiens
tatatttgtcttcc

SEQ ID NO: 1436126 - DNA, 21 bp, Homo sapiens
tatatttgtttcatttctgca

SEQ ID NO: 1436127 - DNA, 13 bp, Homo sapiens
tatattttaatag

SEQ ID NO: 1436128 - DNA, 16 bp, Homo sapiens
tatattttacaatttt

SEQ ID NO: 1436129 - DNA, 16 bp, Homo sapiens
tatattttatgaacat

SEQ ID NO: 1436130 - DNA, 17 bp, Homo sapiens
tatattttatgaacatt

SEQ ID NO: 1436131 - DNA, 14 bp, Homo sapiens
tatattttcttttt

SEQ ID NO: 1436132 - DNA, 14 bp, Homo sapiens
tatattttgctagc

SEQ ID NO: 1436133 - DNA, 18 bp, Homo sapiens
tatattttgtgtgaaatt

SEQ ID NO: 1436134 - DNA, 17 bp, Homo sapiens
tatattttgtttacaaa

SEQ ID NO: 1436135 - DNA, 15 bp, Homo sapiens
tatatttttcacagt

SEQ ID NO: 1436136 - DNA, 14 bp, Homo sapiens
tatatttttgtaca

SEQ ID NO: 1436137 - DNA, 21 bp, Homo sapiens
tatatttttgtacatattgtt

SEQ ID NO: 1436138 - DNA, 18 bp, Homo sapiens
tatcaaaaaacctttaca

SEQ ID NO: 1436139 - DNA, 18 bp, Homo sapiens
tatcaaaacgagggctga

SEQ ID NO: 1436140 - DNA, 19 bp, Homo sapiens
tatcaaaactttcttttct

SEQ ID NO: 1436141 - DNA, 21 bp, Homo sapiens
tatcaaaccctagccttgctt

SEQ ID NO: 1436142 - DNA, 13 bp, Homo sapiens
tatcaaactgaag

SEQ ID NO: 1436143 - DNA, 21 bp, Homo sapiens
tatcaaacttcagctgtactt

SEQ ID NO: 1436144 - DNA, 16 bp, Homo sapiens
tatcaaataaaatatc

SEQ ID NO: 1436145 - DNA, 18 bp, Homo sapiens
tatcaaataaaatatcat

SEQ ID NO: 1436146 - DNA, 15 bp, Homo sapiens
tatcaaatctaccac

SEQ ID NO: 1436147 - DNA, 14 bp, Homo sapiens
tatcaacagcttcc

SEQ ID NO: 1436148 - DNA, 16 bp, Homo sapiens
tatcaacagcttccct

SEQ ID NO: 1436149 - DNA, 22 bp, Homo sapiens
tatcaaccattagataaacaca

SEQ ID NO: 1436150 - DNA, 16 bp, Homo sapiens
tatcaactctgaagct

SEQ ID NO: 1436151 - DNA, 15 bp, Homo sapiens
tatcaactttaatca

SEQ ID NO: 1436152 - DNA, 12 bp, Homo sapiens
tatcaactttag

SEQ ID NO: 1436153 - DNA, 12 bp, Homo sapiens
tatcaagaaagt

SEQ ID NO: 1436154 - DNA, 18 bp, Homo sapiens
tatcaagtggcatgtgct

SEQ ID NO: 1436155 - DNA, 17 bp, Homo sapiens
tatcaatatctaatata

SEQ ID NO: 1436156 - DNA, 21 bp, Homo sapiens
tatcaatatctaatatatatg

SEQ ID NO: 1436157 - DNA, 18 bp, Homo sapiens
tatcaatcagtataattc

SEQ ID NO: 1436158 - DNA, 18 bp, Homo sapiens
tatcaatttttcccagta

SEQ ID NO: 1436159 - DNA, 20 bp, Homo sapiens
tatcaatttttcccagtatt

SEQ ID NO: 1436160 - DNA, 22 bp, Homo sapiens
tatcaatttttcccagtatttt

SEQ ID NO: 1436161 - DNA, 12 bp, Homo sapiens
tatcacacaata

SEQ ID NO: 1436162 - DNA, 16 bp, Homo sapiens
tatcacacctaatctt

SEQ ID NO: 1436163 - DNA, 15 bp, Homo sapiens
tatctatttgtacaa

SEQ ID NO: 1436164 - DNA, 19 bp, Homo sapiens
tatctcagaaagtgcctga

SEQ ID NO: 1436165 - DNA, 20 bp, Homo sapiens
tatctcagaaagtgcctgac

SEQ ID NO: 1436166 - DNA, 19 bp, Homo sapiens
tatctcagatatttgcacc

SEQ ID NO: 1436167 - DNA, 16 bp, Homo sapiens
tatctcatactgtctg

SEQ ID NO: 1436168 - DNA, 17 bp, Homo sapiens
tatctcatactgtctgg

SEQ ID NO: 1436169 - DNA, 20 bp, Homo sapiens
tatctcatactgtctgggat

SEQ ID NO: 1436170 - DNA, 16 bp, Homo sapiens
tatctccagcggccct

SEQ ID NO: 1436171 - DNA, 18 bp, Homo sapiens
tatctccagcggccctgt

SEQ ID NO: 1436172 - DNA, 12 bp, Homo sapiens
tatctccctggc

SEQ ID NO: 1436173 - DNA, 16 bp, Homo sapiens
tatctccctggctcac

SEQ ID NO: 1436174 - DNA, 13 bp, Homo sapiens
tatctcctgacag

SEQ ID NO: 1436175 - DNA, 22 bp, Homo sapiens
tatctcgtaatagcttctgtgt

SEQ ID NO: 1436176 - DNA, 13 bp, Homo sapiens
tatctctaaaata

SEQ ID NO: 1436177 - DNA, 14 bp, Homo sapiens
tatctctgaggcta

SEQ ID NO: 1436178 - DNA, 11 bp, Homo sapiens
tatctctgtgt

SEQ ID NO: 1436179 - DNA, 18 bp, Homo sapiens
tatctctgtgtgcacaaa

SEQ ID NO: 1436180 - DNA, 23 bp, Homo sapiens
tatctctgtgtgcacaaatattt

SEQ ID NO: 1436181 - DNA, 12 bp, Homo sapiens
tatctctgtgtt

SEQ ID NO: 1436182 - DNA, 13 bp, Homo sapiens
tatctcttcagtc

SEQ ID NO: 1436183 - DNA, 18 bp, Homo sapiens
tatctctttgatctactt

SEQ ID NO: 1436184 - DNA, 23 bp, Homo sapiens
tatctgacccactttgtaatttt

SEQ ID NO: 1436185 - DNA, 23 bp, Homo sapiens
tatctgagagacctgtgtgaact

SEQ ID NO: 1436186 - DNA, 18 bp, Homo sapiens
tatctgagggaggaggcc

SEQ ID NO: 1436187 - DNA, 16 bp, Homo sapiens
tatctgattttgtgca

SEQ ID NO: 1436188 - DNA, 22 bp, Homo sapiens
tatctgattttgtgcaaaagct

SEQ ID NO: 1436189 - DNA, 20 bp, Homo sapiens
tatctgcaaatagtttcaaa

SEQ ID NO: 1436190 - DNA, 22 bp, Homo sapiens
tatctgcaaatagtttcaaatg

SEQ ID NO: 1436191 - DNA, 15 bp, Homo sapiens
tatctgcatgtgtca

SEQ ID NO: 1436192 - DNA, 17 bp, Homo sapiens
tatctgcatgtgtcatg

SEQ ID NO: 1436193 - DNA, 23 bp, Homo sapiens
tagaatccagcaggtcacactgg

SEQ ID NO: 1436194 - DNA, 13 bp, Homo sapiens
tagaatcccagca

SEQ ID NO: 1436195 - DNA, 16 bp, Homo sapiens
tagaatcccagcagca

SEQ ID NO: 1436196 - DNA, 12 bp, Homo sapiens
tagaatctagaa

SEQ ID NO: 1436197 - DNA, 13 bp, Homo sapiens
tagaatctagaaa

SEQ ID NO: 1436198 - DNA, 15 bp, Homo sapiens
tagaatctagaaatg

SEQ ID NO: 1436199 - DNA, 22 bp, Homo sapiens
tagaatctgcaattcaaaagtt

SEQ ID NO: 1436200 - DNA, 15 bp, Homo sapiens
tagaatgcatctcat

SEQ ID NO: 1436201 - DNA, 17 bp, Homo sapiens
tagaatgcatctcatca

SEQ ID NO: 1436202 - DNA, 16 bp, Homo sapiens
tagaatgccggttaaa

SEQ ID NO: 1436203 - DNA, 22 bp, Homo sapiens
tagaatgccggttaaattccat

SEQ ID NO: 1436204 - DNA, 20 bp, Homo sapiens
tagaatggaggaagaacaac

SEQ ID NO: 1436205 - DNA, 17 bp, Homo sapiens
tagaatggtgattttaa

SEQ ID NO: 1436206 - DNA, 18 bp, Homo sapiens
tagaatggtgattttaaa

SEQ ID NO: 1436207 - DNA, 21 bp, Homo sapiens
tagaatggtgattttaaatgt

SEQ ID NO: 1436208 - DNA, 12 bp, Homo sapiens
tagaatgtagtt

SEQ ID NO: 1436209 - DNA, 14 bp, Homo sapiens
tagaatgtagtttg

SEQ ID NO: 1436210 - DNA, 10 bp, Homo sapiens
tagaatgtgg

SEQ ID NO: 1436211 - DNA, 14 bp, Homo sapiens
tagaattaaaaaag

SEQ ID NO: 1436212 - DNA, 21 bp, Homo sapiens
tagaattaaaaaagcatactt

SEQ ID NO: 1436213 - DNA, 15 bp, Homo sapiens
tagaattatctaatt

SEQ ID NO: 1436214 - DNA, 22 bp, Homo sapiens
tagaattatctaatttataaaa

SEQ ID NO: 1436215 - DNA, 12 bp, Homo sapiens
tagaattattta

SEQ ID NO: 1436216 - DNA, 19 bp, Homo sapiens
tacagcattgtctttgctg

SEQ ID NO: 1436217 - DNA, 23 bp, Homo sapiens
tacagcattgtctttgctgtact

SEQ ID NO: 1436218 - DNA, 22 bp, Homo sapiens
tacagccgagactcgactctgt

SEQ ID NO: 1436219 - DNA, 16 bp, Homo sapiens
tacagctaatcagcat

SEQ ID NO: 1436220 - DNA, 17 bp, Homo sapiens
tacagctatatttgatt

SEQ ID NO: 1436221 - DNA, 18 bp, Homo sapiens
tacagctcattaaacttt

SEQ ID NO: 1436222 - DNA, 21 bp, Homo sapiens
tacagctcattaaactttttt

SEQ ID NO: 1436223 - DNA, 16 bp, Homo sapiens
tacagctctgtagttt

SEQ ID NO: 1436224 - DNA, 17 bp, Homo sapiens
tacagctgtgttattct

SEQ ID NO: 1436225 - DNA, 15 bp, Homo sapiens
tacagcttatttttt

SEQ ID NO: 1436226 - DNA, 20 bp, Homo sapiens
tacagcttatttttttctac

SEQ ID NO: 1436227 - DNA, 15 bp, Homo sapiens
tacagcttcaccctg

SEQ ID NO: 1436228 - DNA, 15 bp, Homo sapiens
tacagcttgtttaac

SEQ ID NO: 1436229 - DNA, 18 bp, Homo sapiens
tacagctttcatgattag

SEQ ID NO: 1436230 - DNA, 19 bp, Homo sapiens
tacagctttgatccctgac

SEQ ID NO: 1436231 - DNA, 22 bp, Homo sapiens
tacaggaaaaaaaattctgttg

SEQ ID NO: 1436232 - DNA, 13 bp, Homo sapiens
tacaggaagtccc

SEQ ID NO: 1436233 - DNA, 13 bp, Homo sapiens
tacaggagaggca

SEQ ID NO: 1436234 - DNA, 14 bp, Homo sapiens
tacaggagaggcag

SEQ ID NO: 1436235 - DNA, 16 bp, Homo sapiens
tacaggagaggcagca

SEQ ID NO: 1436236 - DNA, 19 bp, Homo sapiens
tacaggagaggcagcatgc

SEQ ID NO: 1436237 - DNA, 19 bp, Homo sapiens
tacaggcaccgagaatgtt

SEQ ID NO: 1436238 - DNA, 20 bp, Homo sapiens
tacaggcaccgagaatgttg

SEQ ID NO: 1436239 - DNA, 17 bp, Homo sapiens
tacagggaatttgtacg

SEQ ID NO: 1436240 - DNA, 22 bp, Homo sapiens
tacagggagccggcggcctctc

SEQ ID NO: 1436241 - DNA, 16 bp, Homo sapiens
tacagtaactaatttt

SEQ ID NO: 1436242 - DNA, 16 bp, Homo sapiens
tacagtaactgtgact

SEQ ID NO: 1436243 - DNA, 17 bp, Homo sapiens
tacagtaactttatgtg

SEQ ID NO: 1436244 - DNA, 20 bp, Homo sapiens
tacagtaactttatgtgtaa

SEQ ID NO: 1436245 - DNA, 13 bp, Homo sapiens
tacagtacacatc

SEQ ID NO: 1436246 - DNA, 17 bp, Homo sapiens
tacagtactgttcccaa

SEQ ID NO: 1436247 - DNA, 16 bp, Homo sapiens
tacagtacttccagat

SEQ ID NO: 1436248 - DNA, 16 bp, Homo sapiens
tacagtagtgtcatca

SEQ ID NO: 1436249 - DNA, 19 bp, Homo sapiens
tacagtatccaatgtcttt

SEQ ID NO: 1436250 - DNA, 22 bp, Homo sapiens
tacagtcattggaataaggcat

SEQ ID NO: 1436251 - DNA, 13 bp, Homo sapiens
tacagtctgtcat

SEQ ID NO: 1436252 - DNA, 15 bp, Homo sapiens
tacagtctgtcatga

SEQ ID NO: 1436253 - DNA, 16 bp, Homo sapiens
tacagtctgtcatgaa

SEQ ID NO: 1436254 - DNA, 19 bp, Homo sapiens
tacagtgaattgtctttta

SEQ ID NO: 1436255 - DNA, 17 bp, Homo sapiens
tacagtgaggagggtgg

SEQ ID NO: 1436256 - DNA, 20 bp, Homo sapiens
tacagtgcagacaggccatg

SEQ ID NO: 1436257 - DNA, 11 bp, Homo sapiens
tacagtggttt

SEQ ID NO: 1436258 - DNA, 18 bp, Homo sapiens
tacagtgtacatgtacat

SEQ ID NO: 1436259 - DNA, 16 bp, Homo sapiens
tacagtgttattttct

SEQ ID NO: 1436260 - DNA, 19 bp, Homo sapiens
tacagtgttattttctttg

SEQ ID NO: 1436261 - DNA, 21 bp, Homo sapiens
tacagttctgtggtttcatgt

SEQ ID NO: 1436262 - DNA, 14 bp, Homo sapiens
tacagttctttcct

SEQ ID NO: 1436263 - DNA, 23 bp, Homo sapiens
tacagttctttcctctttctgct

SEQ ID NO: 1436264 - DNA, 23 bp, Homo sapiens
tacagtttatttttaaagataga

SEQ ID NO: 1436265 - DNA, 15 bp, Homo sapiens
tacagttttaactgt

SEQ ID NO: 1436266 - DNA, 18 bp, Homo sapiens
tacagtttttttctttgt

SEQ ID NO: 1436267 - DNA, 14 bp, Homo sapiens
tacataaaaataga

SEQ ID NO: 1436268 - DNA, 19 bp, Homo sapiens
tacataactcctgtccctt

SEQ ID NO: 1436269 - DNA, 18 bp, Homo sapiens
tacataagataaatgtgc

SEQ ID NO: 1436270 - DNA, 19 bp, Homo sapiens
tacataagataaatgtgct

SEQ ID NO: 1436271 - DNA, 16 bp, Homo sapiens
tacataaggatgactt

SEQ ID NO: 1436272 - DNA, 17 bp, Homo sapiens
tacataaggatgacttt

SEQ ID NO: 1436273 - DNA, 20 bp, Homo sapiens
tacataaggatgactttttt

SEQ ID NO: 1436274 - DNA, 18 bp, Homo sapiens
tacataatatatgacttc

SEQ ID NO: 1436275 - DNA, 15 bp, Homo sapiens
tacataattaaattt

SEQ ID NO: 1436276 - DNA, 16 bp, Homo sapiens
tacataattgtgacca

SEQ ID NO: 1436277 - DNA, 22 bp, Homo sapiens
tacataccctggccgccccctg

SEQ ID NO: 1436278 - DNA, 16 bp, Homo sapiens
tacatacgatttaagg

SEQ ID NO: 1436279 - DNA, 17 bp, Homo sapiens
tacatacgatttaaggt

SEQ ID NO: 1436280 - DNA, 18 bp, Homo sapiens
tacatactaggtgccttt

SEQ ID NO: 1436281 - DNA, 16 bp, Homo sapiens
tacatagagcaatgtt

SEQ ID NO: 1436282 - DNA, 23 bp, Homo sapiens
tacatagcatgacatttctttgt

SEQ ID NO: 1436283 - DNA, 22 bp, Homo sapiens
tacataggtctgtatggctgta

SEQ ID NO: 1436284 - DNA, 13 bp, Homo sapiens
tacatagtaaagt

SEQ ID NO: 1436285 - DNA, 17 bp, Homo sapiens
tacatagtaaagtattt

SEQ ID NO: 1436286 - DNA, 22 bp, Homo sapiens
tacatagtgctgctgtgtgctt

SEQ ID NO: 1436287 - DNA, 20 bp, Homo sapiens
tacatataaaatgtaattac

SEQ ID NO: 1436288 - DNA, 13 bp, Homo sapiens
tacatatatacat

SEQ ID NO: 1436289 - DNA, 11 bp, Homo sapiens
tacatatatat

SEQ ID NO: 1436290 - DNA, 20 bp, Homo sapiens
tacatatatgtataatatat

SEQ ID NO: 1436291 - DNA, 16 bp, Homo sapiens
tacatatcccttccag

SEQ ID NO: 1436292 - DNA, 18 bp, Homo sapiens
tacatatgctgatctttt

SEQ ID NO: 1436293 - DNA, 15 bp, Homo sapiens
tacatatgtaaaata

SEQ ID NO: 1436294 - DNA, 23 bp, Homo sapiens
tacatatgtatacatgtgccatg

SEQ ID NO: 1436295 - DNA, 19 bp, Homo sapiens
tacatattaggaaaatatg

SEQ ID NO: 1436296 - DNA, 22 bp, Homo sapiens
tacatattgttagggtcagcca

SEQ ID NO: 1436297 - DNA, 20 bp, Homo sapiens
tacatcaagtccatctgaca

SEQ ID NO: 1436298 - DNA, 15 bp, Homo sapiens
tacctactattggcc

SEQ ID NO: 1436299 - DNA, 17 bp, Homo sapiens
tacctactattggccct

SEQ ID NO: 1436300 - DNA, 18 bp, Homo sapiens
tacctactgtgtcttgga

SEQ ID NO: 1436301 - DNA, 21 bp, Homo sapiens
tacctactgtgtgccaggggc

SEQ ID NO: 1436302 - DNA, 14 bp, Homo sapiens
tacctactttgact

SEQ ID NO: 1436303 - DNA, 16 bp, Homo sapiens
tacctagatttacagc

SEQ ID NO: 1436304 - DNA, 16 bp, Homo sapiens
tacctatcatcttaag

SEQ ID NO: 1436305 - DNA, 18 bp, Homo sapiens
tacctatggctgcctgca

SEQ ID NO: 1436306 - DNA, 17 bp, Homo sapiens
tacctattttatatgat

SEQ ID NO: 1436307 - DNA, 17 bp, Homo sapiens
tacctcaacctatggta

SEQ ID NO: 1436308 - DNA, 18 bp, Homo sapiens
tacctcaagccccatttc

SEQ ID NO: 1436309 - DNA, 14 bp, Homo sapiens
tacctcaatttttg

SEQ ID NO: 1436310 - DNA, 15 bp, Homo sapiens
tacctcaatttttgt

SEQ ID NO: 1436311 - DNA, 15 bp, Homo sapiens
tacctcactggggtc

SEQ ID NO: 1436312 - DNA, 21 bp, Homo sapiens
tacctcagccctggccctgcc

SEQ ID NO: 1436313 - DNA, 14 bp, Homo sapiens
tacctcaggcagct

SEQ ID NO: 1436314 - DNA, 18 bp, Homo sapiens
tacctcaggcagctcaag

SEQ ID NO: 1436315 - DNA, 14 bp, Homo sapiens
tacctcaggcagga

SEQ ID NO: 1436316 - DNA, 11 bp, Homo sapiens
tacctccaccc

SEQ ID NO: 1436317 - DNA, 15 bp, Homo sapiens
tacctccattaaatg

SEQ ID NO: 1436318 - DNA, 23 bp, Homo sapiens
tacctcctcacttggctgtctga

SEQ ID NO: 1436319 - DNA, 18 bp, Homo sapiens
tacctcctcctttgttta

SEQ ID NO: 1436320 - DNA, 15 bp, Homo sapiens
tacctcgtttctaca

SEQ ID NO: 1436321 - DNA, 21 bp, Homo sapiens
tacctctctgtcccttgctgt

SEQ ID NO: 1436322 - DNA, 12 bp, Homo sapiens
tacctctgtgtg

SEQ ID NO: 1436323 - DNA, 18 bp, Homo sapiens
tacctcttactttgcttg

SEQ ID NO: 1436324 - DNA, 13 bp, Homo sapiens
tacctcttggctg

SEQ ID NO: 1436325 - DNA, 16 bp, Homo sapiens
tacctgaacaggaatc

SEQ ID NO: 1436326 - DNA, 18 bp, Homo sapiens
tacctgaacaggaatcct

SEQ ID NO: 1436327 - DNA, 13 bp, Homo sapiens
tacctgacacaag

SEQ ID NO: 1436328 - DNA, 16 bp, Homo sapiens
tacctgagttgaagag

SEQ ID NO: 1436329 - DNA, 17 bp, Homo sapiens
tacctgattgtattttt

SEQ ID NO: 1436330 - DNA, 14 bp, Homo sapiens
tacctgcaaaaatg

SEQ ID NO: 1436331 - DNA, 19 bp, Homo sapiens
tacctgctgccccagctga

SEQ ID NO: 1436332 - DNA, 16 bp, Homo sapiens
tacctgcttctggttt

SEQ ID NO: 1436333 - DNA, 16 bp, Homo sapiens
tacctggacggtgcgc

SEQ ID NO: 1436334 - DNA, 19 bp, Homo sapiens
tacctggagaagaatggct

SEQ ID NO: 1436335 - DNA, 17 bp, Homo sapiens
tacctggcttttacttt

SEQ ID NO: 1436336 - DNA, 11 bp, Homo sapiens
tacctgggaaa

SEQ ID NO: 1436337 - DNA, 14 bp, Homo sapiens
tacctgtccctcca

SEQ ID NO: 1436338 - DNA, 15 bp, Homo sapiens
tacctgtccctccag

SEQ ID NO: 1436339 - DNA, 18 bp, Homo sapiens
tacctgtctgctgccagc

SEQ ID NO: 1436340 - DNA, 12 bp, Homo sapiens
tacctgtgcctg

SEQ ID NO: 1436341 - DNA, 20 bp, Homo sapiens
tacctgtgcgttactaattg

SEQ ID NO: 1436342 - DNA, 22 bp, Homo sapiens
tacctgtgtattttttaaagct

SEQ ID NO: 1436343 - DNA, 16 bp, Homo sapiens
tacctgttatttatca

SEQ ID NO: 1436344 - DNA, 17 bp, Homo sapiens
tagcagatctgttttgt

SEQ ID NO: 1436345 - DNA, 14 bp, Homo sapiens
tagcagatggtttc

SEQ ID NO: 1436346 - DNA, 14 bp, Homo sapiens
tagcagattttaat

SEQ ID NO: 1436347 - DNA, 14 bp, Homo sapiens
tagcagcacctcct

SEQ ID NO: 1436348 - DNA, 17 bp, Homo sapiens
tagcagcaggctcaggc

SEQ ID NO: 1436349 - DNA, 16 bp, Homo sapiens
tagcagccagttcaaa

SEQ ID NO: 1436350 - DNA, 18 bp, Homo sapiens
tagcagccagttcaaaaa

SEQ ID NO: 1436351 - DNA, 17 bp, Homo sapiens
tagcagcccaccctgct

SEQ ID NO: 1436352 - DNA, 21 bp, Homo sapiens
tagcagcccaccctgctgctg

SEQ ID NO: 1436353 - DNA, 13 bp, Homo sapiens
tagcagctgcagt

SEQ ID NO: 1436354 - DNA, 12 bp, Homo sapiens
tagcagctggac

SEQ ID NO: 1436355 - DNA, 14 bp, Homo sapiens
tagcagcttccaga

SEQ ID NO: 1436356 - DNA, 20 bp, Homo sapiens
tagctcttaattgttcattt

SEQ ID NO: 1436357 - DNA, 16 bp, Homo sapiens
tagctgaacctgtctg

SEQ ID NO: 1436358 - DNA, 15 bp, Homo sapiens
tagctgaagaattga

SEQ ID NO: 1436359 - DNA, 21 bp, Homo sapiens
tagctgaagaattgaaaagtt

SEQ ID NO: 1436360 - DNA, 18 bp, Homo sapiens
tagctgacagtcagctgt

SEQ ID NO: 1436361 - DNA, 21 bp, Homo sapiens
tagctgacagtcagctgtggg

SEQ ID NO: 1436362 - DNA, 15 bp, Homo sapiens
tagctgcaaaaataa

SEQ ID NO: 1436363 - DNA, 12 bp, Homo sapiens
tagctgcagaac

SEQ ID NO: 1436364 - DNA, 21 bp, Homo sapiens
tagctgcatcctccaagaatc

SEQ ID NO: 1436365 - DNA, 13 bp, Homo sapiens
tagctggcaggac

SEQ ID NO: 1436366 - DNA, 18 bp, Homo sapiens
tagctgggaaagcataaa

SEQ ID NO: 1436367 - DNA, 14 bp, Homo sapiens
tagctgggactaca

SEQ ID NO: 1436368 - DNA, 22 bp, Homo sapiens
tagctgggactacagatgtggg

SEQ ID NO: 1436369 - DNA, 22 bp, Homo sapiens
tagctggtttcctcattcctga

SEQ ID NO: 1436370 - DNA, 19 bp, Homo sapiens
tagctgtaagggcagtgcc

SEQ ID NO: 1436371 - DNA, 21 bp, Homo sapiens
tagctgtaagggcagtgccca

SEQ ID NO: 1436372 - DNA, 17 bp, Homo sapiens
tagctgtactataagta

SEQ ID NO: 1436373 - DNA, 15 bp, Homo sapiens
tagctgtctagagta

SEQ ID NO: 1436374 - DNA, 11 bp, Homo sapiens
tagctgtgaaa

SEQ ID NO: 1436375 - DNA, 16 bp, Homo sapiens
tagctgtgatcagtga

SEQ ID NO: 1436376 - DNA, 14 bp, Homo sapiens
tagctgtgggggtg

SEQ ID NO: 1436377 - DNA, 13 bp, Homo sapiens
tagctgttgagct

SEQ ID NO: 1436378 - DNA, 16 bp, Homo sapiens
tagctgttgagctgtt

SEQ ID NO: 1436379 - DNA, 17 bp, Homo sapiens
tagcttaaaccaacaat

SEQ ID NO: 1436380 - DNA, 15 bp, Homo sapiens
tagcttaactaattt

SEQ ID NO: 1436381 - DNA, 18 bp, Homo sapiens
tagcttacactgaggact

SEQ ID NO: 1436382 - DNA, 15 bp, Homo sapiens
tagcttacctgacac

SEQ ID NO: 1436383 - DNA, 16 bp, Homo sapiens
tagcttacctgacaca

SEQ ID NO: 1436384 - DNA, 15 bp, Homo sapiens
tagcttagacctcag

SEQ ID NO: 1436385 - DNA, 21 bp, Homo sapiens
tagcttctaccatgaacagaa

SEQ ID NO: 1436386 - DNA, 16 bp, Homo sapiens
tagcttctgcttttct

SEQ ID NO: 1436387 - DNA, 18 bp, Homo sapiens
tagcttctgtgtgtgagc

SEQ ID NO: 1436388 - DNA, 17 bp, Homo sapiens
tagcttgaagcccaaga

SEQ ID NO: 1436389 - DNA, 16 bp, Homo sapiens
tagcttgcaccttgtc

SEQ ID NO: 1436390 - DNA, 14 bp, Homo sapiens
tagctttaaaaggg

SEQ ID NO: 1436391 - DNA, 15 bp, Homo sapiens
tagctttaccctcag

SEQ ID NO: 1436392 - DNA, 16 bp, Homo sapiens
tagctttagaccctgg

SEQ ID NO: 1436393 - DNA, 13 bp, Homo sapiens
tagctttattctt

SEQ ID NO: 1436394 - DNA, 13 bp, Homo sapiens
tagctttcctggt

SEQ ID NO: 1436395 - DNA, 12 bp, Homo sapiens
tagctttggaaa

SEQ ID NO: 1436396 - DNA, 14 bp, Homo sapiens
tagcttttaggaaa

SEQ ID NO: 1436397 - DNA, 20 bp, Homo sapiens
tagcttttaggaaaatcact

SEQ ID NO: 1436398 - DNA, 19 bp, Homo sapiens
taggaaaagtacatttaat

SEQ ID NO: 1436399 - DNA, 21 bp, Homo sapiens
taggaaaatcactttgtctaa

SEQ ID NO: 1436400 - DNA, 14 bp, Homo sapiens
taggaaactgaagc

SEQ ID NO: 1436401 - DNA, 23 bp, Homo sapiens
taggaaatggctttgtgattcaa

SEQ ID NO: 1436402 - DNA, 15 bp, Homo sapiens
taggaacttcagaga

SEQ ID NO: 1436403 - DNA, 16 bp, Homo sapiens
taggaagaaagatttg

SEQ ID NO: 1436404 - DNA, 15 bp, Homo sapiens
taggaagagaaacca

SEQ ID NO: 1436405 - DNA, 19 bp, Homo sapiens
taggaagagaaaccaggga

SEQ ID NO: 1436406 - DNA, 19 bp, Homo sapiens
taggaagatcgttccacct

SEQ ID NO: 1436407 - DNA, 17 bp, Homo sapiens
taggaagttttttctac

SEQ ID NO: 1436408 - DNA, 16 bp, Homo sapiens
taggaataaaattatg

SEQ ID NO: 1436409 - DNA, 15 bp, Homo sapiens
taggaataacactgc

SEQ ID NO: 1436410 - DNA, 17 bp, Homo sapiens
taggaatcattcagaaa

SEQ ID NO: 1436411 - DNA, 20 bp, Homo sapiens
taggaatcattcagaaatgt

SEQ ID NO: 1436412 - DNA, 21 bp, Homo sapiens
taggaatcccagaggtgggat

SEQ ID NO: 1436413 - DNA, 22 bp, Homo sapiens
taggaatgtccaccatgaactt

SEQ ID NO: 1436414 - DNA, 16 bp, Homo sapiens
taggaatttgtataaa

SEQ ID NO: 1436415 - DNA, 20 bp, Homo sapiens
taggacataaattagaggtc

SEQ ID NO: 1436416 - DNA, 13 bp, Homo sapiens
taggacccttccc

SEQ ID NO: 1436417 - DNA, 21 bp, Homo sapiens
taggacctgcatccttcctgg

SEQ ID NO: 1436418 - DNA, 22 bp, Homo sapiens
taggacctttccaccacagcca

SEQ ID NO: 1436419 - DNA, 23 bp, Homo sapiens
taggacgcatgaaggtcactcgt

SEQ ID NO: 1436420 - DNA, 13 bp, Homo sapiens
taggacgtattta

SEQ ID NO: 1436421 - DNA, 14 bp, Homo sapiens
taggactctgaggc

SEQ ID NO: 1436422 - DNA, 15 bp, Homo sapiens
taggactctgaggct

SEQ ID NO: 1436423 - DNA, 19 bp, Homo sapiens
taggagaaagcaaaataca

SEQ ID NO: 1436424 - DNA, 12 bp, Homo sapiens
taggagaagcca

SEQ ID NO: 1436425 - DNA, 16 bp, Homo sapiens
taggagaatagcagag

SEQ ID NO: 1436426 - DNA, 14 bp, Homo sapiens
taggagaccaaggc

SEQ ID NO: 1436427 - DNA, 17 bp, Homo sapiens
taggagacttgccagag

SEQ ID NO: 1436428 - DNA, 23 bp, Homo sapiens
taggagacttgccagagccgggc

SEQ ID NO: 1436429 - DNA, 16 bp, Homo sapiens
taggagataccaggtt

SEQ ID NO: 1436430 - DNA, 13 bp, Homo sapiens
taggagccccagc

SEQ ID NO: 1436431 - DNA, 15 bp, Homo sapiens
taggagccccagctt

SEQ ID NO: 1436432 - DNA, 17 bp, Homo sapiens
taggagctaaggctcta

SEQ ID NO: 1436433 - DNA, 21 bp, Homo sapiens
taggagctggctggcaggtgt

SEQ ID NO: 1436434 - DNA, 22 bp, Homo sapiens
taggaggaaacagttctcactg

SEQ ID NO: 1436435 - DNA, 20 bp, Homo sapiens
taggaggctgcatgctctgg

SEQ ID NO: 1436436 - DNA, 22 bp, Homo sapiens
taggaggctgcatgctctggaa

SEQ ID NO: 1436437 - DNA, 18 bp, Homo sapiens
taggagggagactgtggt

SEQ ID NO: 1436438 - DNA, 22 bp, Homo sapiens
taggagtggttctcatttggtc

SEQ ID NO: 1436439 - DNA, 23 bp, Homo sapiens
taggagttcgagaccagcctggc

SEQ ID NO: 1436440 - DNA, 18 bp, Homo sapiens
taggatagctaactgtaa

SEQ ID NO: 1436441 - DNA, 15 bp, Homo sapiens
taggatagttagttt

SEQ ID NO: 1436442 - DNA, 20 bp, Homo sapiens
taggatcatttgttggaatg

SEQ ID NO: 1436443 - DNA, 15 bp, Homo sapiens
taggatcccactggc

SEQ ID NO: 1436444 - DNA, 18 bp, Homo sapiens
taggatgaaaagattctt

SEQ ID NO: 1436445 - DNA, 15 bp, Homo sapiens
taggatgggggagag

SEQ ID NO: 1436446 - DNA, 14 bp, Homo sapiens
taggatgtgatgat

SEQ ID NO: 1436447 - DNA, 15 bp, Homo sapiens
taggatgtgatgatg

SEQ ID NO: 1436448 - DNA, 14 bp, Homo sapiens
taggattctaaaat

SEQ ID NO: 1436449 - DNA, 21 bp, Homo sapiens
taggatttaacagtcatttaa

SEQ ID NO: 1436450 - DNA, 13 bp, Homo sapiens
taggattttcaca

SEQ ID NO: 1436451 - DNA, 19 bp, Homo sapiens
taggcaaggctatgtgatt

SEQ ID NO: 1436452 - DNA, 19 bp, Homo sapiens
taggcacctccccgctctc

SEQ ID NO: 1436453 - DNA, 21 bp, Homo sapiens
taggcacctccccgctctccc

SEQ ID NO: 1436454 - DNA, 18 bp, Homo sapiens
taggcactgtagttctaa

SEQ ID NO: 1436455 - DNA, 19 bp, Homo sapiens
taggcactgtagttctaag

SEQ ID NO: 1436456 - DNA, 12 bp, Homo sapiens
taggcagcctct

SEQ ID NO: 1436457 - DNA, 22 bp, Homo sapiens
taggcaggaagcccaattgctg

SEQ ID NO: 1436458 - DNA, 14 bp, Homo sapiens
taggcagggggccc

SEQ ID NO: 1436459 - DNA, 15 bp, Homo sapiens
taggcagggggccct

SEQ ID NO: 1436460 - DNA, 17 bp, Homo sapiens
taggcagggggccctgc

SEQ ID NO: 1436461 - DNA, 21 bp, Homo sapiens
taggcagggggccctgcccca

SEQ ID NO: 1436462 - DNA, 14 bp, Homo sapiens
taggcatcccaggg

SEQ ID NO: 1436463 - DNA, 21 bp, Homo sapiens
taggcatgagggatcacaggg

SEQ ID NO: 1436464 - DNA, 16 bp, Homo sapiens
taggcatgtcccaccc

SEQ ID NO: 1436465 - DNA, 20 bp, Homo sapiens
taggcattaacacaaaggag

SEQ ID NO: 1436466 - DNA, 16 bp, Homo sapiens
taggcatttcctgctg

SEQ ID NO: 1436467 - DNA, 14 bp, Homo sapiens
taggccactcctcc

SEQ ID NO: 1436468 - DNA, 14 bp, Homo sapiens
taggccccagaggc

SEQ ID NO: 1436469 - DNA, 17 bp, Homo sapiens
taggccccagaggccct

SEQ ID NO: 1436470 - DNA, 21 bp, Homo sapiens
taggccccagaggccctggag

SEQ ID NO: 1436471 - DNA, 22 bp, Homo sapiens
taggccccagaggccctggagg

SEQ ID NO: 1436472 - DNA, 21 bp, Homo sapiens
taggcccccacttgcctcttc

SEQ ID NO: 1436473 - DNA, 18 bp, Homo sapiens
taggccctggttcctgct

SEQ ID NO: 1436474 - DNA, 19 bp, Homo sapiens
taggcccttgtcctgccag

SEQ ID NO: 1436475 - DNA, 17 bp, Homo sapiens
taggccgctgatgatat

SEQ ID NO: 1436476 - DNA, 16 bp, Homo sapiens
taggcctgggtgctgg

SEQ ID NO: 1436477 - DNA, 15 bp, Homo sapiens
taggcctgtcccttg

SEQ ID NO: 1436478 - DNA, 17 bp, Homo sapiens
taggcctgtcccttgcc

SEQ ID NO: 1436479 - DNA, 20 bp, Homo sapiens
taggcctgtcccttgcctct

SEQ ID NO: 1436480 - DNA, 21 bp, Homo sapiens
taggcctgtcccttgcctctg

SEQ ID NO: 1436481 - DNA, 19 bp, Homo sapiens
taggccttaacacactggc

SEQ ID NO: 1436482 - DNA, 21 bp, Homo sapiens
taggccttcctctctccagat

SEQ ID NO: 1436483 - DNA, 16 bp, Homo sapiens
taggcgggaaggaggg

SEQ ID NO: 1436484 - DNA, 18 bp, Homo sapiens
taggcggtcatgtgtgca

SEQ ID NO: 1436485 - DNA, 18 bp, Homo sapiens
taggctatttgtaaatct

SEQ ID NO: 1436486 - DNA, 21 bp, Homo sapiens
taggctctgcacagatggatt

SEQ ID NO: 1436487 - DNA, 16 bp, Homo sapiens
taggctcttaagcagc

SEQ ID NO: 1436488 - DNA, 21 bp, Homo sapiens
taggctcttatgtgtgccttt

SEQ ID NO: 1436489 - DNA, 22 bp, Homo sapiens
taggctgccccgggtccccagc

SEQ ID NO: 1436490 - DNA, 23 bp, Homo sapiens
taggctgccccgggtccccagct

SEQ ID NO: 1436491 - DNA, 20 bp, Homo sapiens
taggcttctatgtccaacag

SEQ ID NO: 1436492 - DNA, 16 bp, Homo sapiens
tagggaaaagttcata

SEQ ID NO: 1436493 - DNA, 16 bp, Homo sapiens
tagggaaaccttggag

SEQ ID NO: 1436494 - DNA, 21 bp, Homo sapiens
tagggaatgagagttccttct

SEQ ID NO: 1436495 - DNA, 18 bp, Homo sapiens
tagggacaggtggaggtg

SEQ ID NO: 1436496 - DNA, 20 bp, Homo sapiens
tagggactacccatagacat

SEQ ID NO: 1436497 - DNA, 13 bp, Homo sapiens
tagggacttaaaa

SEQ ID NO: 1436498 - DNA, 23 bp, Homo sapiens
tagggagacagggtaggaaaggg

SEQ ID NO: 1436499 - DNA, 12 bp, Homo sapiens
tagggagagaga

SEQ ID NO: 1436500 - DNA, 20 bp, Homo sapiens
tagggagagagaagcaggca

SEQ ID NO: 1436501 - DNA, 17 bp, Homo sapiens
tagggagccatttgaga

SEQ ID NO: 1436502 - DNA, 18 bp, Homo sapiens
tagggagggcggcagggg

SEQ ID NO: 1436503 - DNA, 18 bp, Homo sapiens
tagggagtggttcctgtg

SEQ ID NO: 1436504 - DNA, 22 bp, Homo sapiens
tagggagttcatctggagggtt

SEQ ID NO: 1436505 - DNA, 21 bp, Homo sapiens
tagggatgaactttttcctgg

SEQ ID NO: 1436506 - DNA, 16 bp, Homo sapiens
tagggatgcctccttt

SEQ ID NO: 1436507 - DNA, 15 bp, Homo sapiens
tagggattcaggctg

SEQ ID NO: 1436508 - DNA, 16 bp, Homo sapiens
tagggattcaggctgc

SEQ ID NO: 1436509 - DNA, 15 bp, Homo sapiens
tagggcaccaggggt

SEQ ID NO: 1436510 - DNA, 16 bp, Homo sapiens
tagggcactgggctgt

SEQ ID NO: 1436511 - DNA, 13 bp, Homo sapiens
tagggccttggtt

SEQ ID NO: 1436512 - DNA, 23 bp, Homo sapiens
tagggctacaaaacctgatgtta

SEQ ID NO: 1436513 - DNA, 14 bp, Homo sapiens
tagggctggaccta

SEQ ID NO: 1436514 - DNA, 13 bp, Homo sapiens
tagggcttttatt

SEQ ID NO: 1436515 - DNA, 20 bp, Homo sapiens
taggggccacctcctccccc

SEQ ID NO: 1436516 - DNA, 21 bp, Homo sapiens
taggggccacctcctccccct

SEQ ID NO: 1436517 - DNA, 20 bp, Homo sapiens
tagggtcactttgccattat

SEQ ID NO: 1436518 - DNA, 14 bp, Homo sapiens
tagggtcagccatt

SEQ ID NO: 1436519 - DNA, 13 bp, Homo sapiens
tagggtcaggcgg

SEQ ID NO: 1436520 - DNA, 15 bp, Homo sapiens
tagggtcggaaccca

SEQ ID NO: 1436521 - DNA, 16 bp, Homo sapiens
tagggtcttgggggtc

SEQ ID NO: 1436522 - DNA, 21 bp, Homo sapiens
tagggtgtgtgttcaccttca

SEQ ID NO: 1436523 - DNA, 15 bp, Homo sapiens
tagggtgttctggct

SEQ ID NO: 1436524 - DNA, 17 bp, Homo sapiens
tagggtgttctggcttt

SEQ ID NO: 1436525 - DNA, 17 bp, Homo sapiens
taggtaaactaacctgg

SEQ ID NO: 1436526 - DNA, 14 bp, Homo sapiens
taggtacacagctc

SEQ ID NO: 1436527 - DNA, 15 bp, Homo sapiens
taggtagactttgct

SEQ ID NO: 1436528 - DNA, 14 bp, Homo sapiens
taggtaggaagagc

SEQ ID NO: 1436529 - DNA, 20 bp, Homo sapiens
taggtatatagaacacaagg

SEQ ID NO: 1436530 - DNA, 20 bp, Homo sapiens
taggtatatctcccagtgct

SEQ ID NO: 1436531 - DNA, 15 bp, Homo sapiens
taggtcactcctggg

SEQ ID NO: 1436532 - DNA, 14 bp, Homo sapiens
taggtcagatcccc

SEQ ID NO: 1436533 - DNA, 15 bp, Homo sapiens
taggtccaagggcca

SEQ ID NO: 1436534 - DNA, 20 bp, Homo sapiens
taggtcctcacttctgtctc

SEQ ID NO: 1436535 - DNA, 21 bp, Homo sapiens
taggtcctcacttctgtctcc

SEQ ID NO: 1436536 - DNA, 15 bp, Homo sapiens
taggtcctcagaaag

SEQ ID NO: 1436537 - DNA, 16 bp, Homo sapiens
taggtctcatctcttc

SEQ ID NO: 1436538 - DNA, 18 bp, Homo sapiens
taggtctcatctcttcag

SEQ ID NO: 1436539 - DNA, 21 bp, Homo sapiens
taggtctcctcagggtggggg

SEQ ID NO: 1436540 - DNA, 12 bp, Homo sapiens
taggtctggttg

SEQ ID NO: 1436541 - DNA, 22 bp, Homo sapiens
taggtgatgtttccagctgcca

SEQ ID NO: 1436542 - DNA, 22 bp, Homo sapiens
taggtgcaatttcaaggttcta

SEQ ID NO: 1436543 - DNA, 13 bp, Homo sapiens
taggtgcccaggg

SEQ ID NO: 1436544 - DNA, 18 bp, Homo sapiens
taggtgctacaaaaacac

SEQ ID NO: 1436545 - DNA, 21 bp, Homo sapiens
taggtgctttagagataattg

SEQ ID NO: 1436546 - DNA, 16 bp, Homo sapiens
taggtggatcacctga

SEQ ID NO: 1436547 - DNA, 20 bp, Homo sapiens
taggtggctctgggaatggg

SEQ ID NO: 1436548 - DNA, 13 bp, Homo sapiens
taggtgtccccaa

SEQ ID NO: 1436549 - DNA, 14 bp, Homo sapiens
taggtgtccccaac

SEQ ID NO: 1436550 - DNA, 17 bp, Homo sapiens
taggtgttcaggccagt

SEQ ID NO: 1436551 - DNA, 22 bp, Homo sapiens
taggttatcaaaactgttgtca

SEQ ID NO: 1436552 - DNA, 15 bp, Homo sapiens
taggttatttaaaat

SEQ ID NO: 1436553 - DNA, 21 bp, Homo sapiens
taggttctaaagttctaagat

SEQ ID NO: 1436554 - DNA, 17 bp, Homo sapiens
taggttggacagccccc

SEQ ID NO: 1436555 - DNA, 13 bp, Homo sapiens
taggttgggacac

SEQ ID NO: 1436556 - DNA, 15 bp, Homo sapiens
taggtttactgtgaa

SEQ ID NO: 1436557 - DNA, 17 bp, Homo sapiens
taggtttctctcttccc

SEQ ID NO: 1436558 - DNA, 21 bp, Homo sapiens
taggtttttcctactgtcctc

SEQ ID NO: 1436559 - DNA, 15 bp, Homo sapiens
taggtttttgtttgt

SEQ ID NO: 1436560 - DNA, 15 bp, Homo sapiens
taggtttttttgtat

SEQ ID NO: 1436561 - DNA, 22 bp, Homo sapiens
tagtaaaagtggtctctgctgg

SEQ ID NO: 1436562 - DNA, 19 bp, Homo sapiens
tagtaaaatgcttacagga

SEQ ID NO: 1436563 - DNA, 21 bp, Homo sapiens
tagtaaagtatttttgattaa

SEQ ID NO: 1436564 - DNA, 22 bp, Homo sapiens
tagtaacactaatatatttaaa

SEQ ID NO: 1436565 - DNA, 21 bp, Homo sapiens
tagtaactactttttatactc

SEQ ID NO: 1436566 - DNA, 22 bp, Homo sapiens
tagtaactactttttatactcc

SEQ ID NO: 1436567 - DNA, 22 bp, Homo sapiens
tagtaagaataccacatcaaat

SEQ ID NO: 1436568 - DNA, 21 bp, Homo sapiens
tagtaagattgatatctataa

SEQ ID NO: 1436569 - DNA, 16 bp, Homo sapiens
tagtaagtatttccat

SEQ ID NO: 1436570 - DNA, 20 bp, Homo sapiens
tagtaagtttttcttcatga

SEQ ID NO: 1436571 - DNA, 14 bp, Homo sapiens
tagtaatataatac

SEQ ID NO: 1436572 - DNA, 15 bp, Homo sapiens
tagtaatataataca

SEQ ID NO: 1436573 - DNA, 19 bp, Homo sapiens
tagtaatatatttaaaggg

SEQ ID NO: 1436574 - DNA, 14 bp, Homo sapiens
tagtaatcacagtt

SEQ ID NO: 1436575 - DNA, 18 bp, Homo sapiens
tagtaatgctctgaccaa

SEQ ID NO: 1436576 - DNA, 22 bp, Homo sapiens
tagtaattgcctagaaatatct

SEQ ID NO: 1436577 - DNA, 21 bp, Homo sapiens
tagtaatttattgtctgtcta

SEQ ID NO: 1436578 - DNA, 23 bp, Homo sapiens
tagtaatttattgtctgtctaca

SEQ ID NO: 1436579 - DNA, 14 bp, Homo sapiens
tagtaatttctttt

SEQ ID NO: 1436580 - DNA, 23 bp, Homo sapiens
tagtaccaatcattttaattatt

SEQ ID NO: 1436581 - DNA, 19 bp, Homo sapiens
tagtaccctatagagaggg

SEQ ID NO: 1436582 - DNA, 16 bp, Homo sapiens
tagtacctgaaaagta

SEQ ID NO: 1436583 - DNA, 15 bp, Homo sapiens
tagtactaagcattt

SEQ ID NO: 1436584 - DNA, 16 bp, Homo sapiens
tagtactatttcttaa

SEQ ID NO: 1436585 - DNA, 14 bp, Homo sapiens
tagtactcaatgtt

SEQ ID NO: 1436586 - DNA, 17 bp, Homo sapiens
tagtactcaatgtttct

SEQ ID NO: 1436587 - DNA, 23 bp, Homo sapiens
tagtactcaatgtttctggacat

SEQ ID NO: 1436588 - DNA, 19 bp, Homo sapiens
tagtactcctgcaaaattt

SEQ ID NO: 1436589 - DNA, 17 bp, Homo sapiens
tagtaggaatgtacatg

SEQ ID NO: 1436590 - DNA, 14 bp, Homo sapiens
tagtataaagaaaa

SEQ ID NO: 1436591 - DNA, 15 bp, Homo sapiens
tagtatacattgtct

SEQ ID NO: 1436592 - DNA, 16 bp, Homo sapiens
tagtatatctggacaa

SEQ ID NO: 1436593 - DNA, 14 bp, Homo sapiens
tagtatcttgaaat

SEQ ID NO: 1436594 - DNA, 15 bp, Homo sapiens
tagtatggttctcag

SEQ ID NO: 1436595 - DNA, 14 bp, Homo sapiens
tagtatgtctgttt

SEQ ID NO: 1436596 - DNA, 16 bp, Homo sapiens
tagtattaaaagttgc

SEQ ID NO: 1436597 - DNA, 16 bp, Homo sapiens
tagtattaaaatctac

SEQ ID NO: 1436598 - DNA, 23 bp, Homo sapiens
tagtattatcttgttcaggaaaa

SEQ ID NO: 1436599 - DNA, 17 bp, Homo sapiens
tagtattcattctgcat

SEQ ID NO: 1436600 - DNA, 18 bp, Homo sapiens
tagtatttatttatgtac

SEQ ID NO: 1436601 - DNA, 20 bp, Homo sapiens
tagtatttcagtgttttcat

SEQ ID NO: 1436602 - DNA, 15 bp, Homo sapiens
tagtatttctcagga

SEQ ID NO: 1436603 - DNA, 17 bp, Homo sapiens
tagtatttctcaggaag

SEQ ID NO: 1436604 - DNA, 9 bp, Homo sapiens
tagtatttt

SEQ ID NO: 1436605 - DNA, 21 bp, Homo sapiens
tagtatttttttcttaccaaa

SEQ ID NO: 1436606 - DNA, 22 bp, Homo sapiens
tagtatttttttcttaccaaaa

SEQ ID NO: 1436607 - DNA, 23 bp, Homo sapiens
tagtcactgcctgcagaggtctg

SEQ ID NO: 1436608 - DNA, 17 bp, Homo sapiens
tagtcattttcaagact

SEQ ID NO: 1436609 - DNA, 23 bp, Homo sapiens
tagtcccagctacttgggaggct

SEQ ID NO: 1436610 - DNA, 16 bp, Homo sapiens
tagtccccaaggcctc

SEQ ID NO: 1436611 - DNA, 22 bp, Homo sapiens
tagtccccaaggcctctctctg

SEQ ID NO: 1436612 - DNA, 18 bp, Homo sapiens
tagtccctcatgcaaatc

SEQ ID NO: 1436613 - DNA, 20 bp, Homo sapiens
tagtcccttcccctccctgg

SEQ ID NO: 1436614 - DNA, 17 bp, Homo sapiens
tagtcctatggaaaaaa

SEQ ID NO: 1436615 - DNA, 12 bp, Homo sapiens
tagtcctgtgaa

SEQ ID NO: 1436616 - DNA, 19 bp, Homo sapiens
tagtctaaaaacttctttt

SEQ ID NO: 1436617 - DNA, 23 bp, Homo sapiens
tagtctaaggatgctaaacctta

SEQ ID NO: 1436618 - DNA, 14 bp, Homo sapiens
tagtctattagcca

SEQ ID NO: 1436619 - DNA, 19 bp, Homo sapiens
tagtctcactgcttgaact

SEQ ID NO: 1436620 - DNA, 11 bp, Homo sapiens
tagtctcagtt

SEQ ID NO: 1436621 - DNA, 19 bp, Homo sapiens
tagtctcctttgcactgag

SEQ ID NO: 1436622 - DNA, 16 bp, Homo sapiens
tagtctctttaaaagg

SEQ ID NO: 1436623 - DNA, 19 bp, Homo sapiens
tagtctgagcttctttagc

SEQ ID NO: 1436624 - DNA, 19 bp, Homo sapiens
tagtctgattttaatgaaa

SEQ ID NO: 1436625 - DNA, 19 bp, Homo sapiens
tagtcttccagtttaatga

SEQ ID NO: 1436626 - DNA, 16 bp, Homo sapiens
tagtcttgaaatgaaa

SEQ ID NO: 1436627 - DNA, 22 bp, Homo sapiens
tagtcttgaaatgaaagggaaa

SEQ ID NO: 1436628 - DNA, 23 bp, Homo sapiens
tagtcttggaagctgtttggaaa

SEQ ID NO: 1436629 - DNA, 21 bp, Homo sapiens
tagtcttgtcttagctctgga

SEQ ID NO: 1436630 - DNA, 14 bp, Homo sapiens
tagtcttttgcttt

SEQ ID NO: 1436631 - DNA, 19 bp, Homo sapiens
tagtcttttgtaatatcaa

SEQ ID NO: 1436632 - DNA, 24 bp, Homo sapiens
tagtgaaaccccatctctactgaa

SEQ ID NO: 1436633 - DNA, 23 bp, Homo sapiens
tagtgaaatggctggggccgctg

SEQ ID NO: 1436634 - DNA, 16 bp, Homo sapiens
tagtgaagttgtgcaa

SEQ ID NO: 1436635 - DNA, 18 bp, Homo sapiens
tagtgaatttctgaaaga

SEQ ID NO: 1436636 - DNA, 17 bp, Homo sapiens
tagtgacaagtgaagaa

SEQ ID NO: 1436637 - DNA, 16 bp, Homo sapiens
tagtgacttgtgtccc

SEQ ID NO: 1436638 - DNA, 12 bp, Homo sapiens
tagtgagccaag

SEQ ID NO: 1436639 - DNA, 17 bp, Homo sapiens
tagtgagtcagcacctt

SEQ ID NO: 1436640 - DNA, 14 bp, Homo sapiens
tagtgattctgatt

SEQ ID NO: 1436641 - DNA, 15 bp, Homo sapiens
tagtgcaagctgaag

SEQ ID NO: 1436642 - DNA, 21 bp, Homo sapiens
tagtgcagctgaaattgaaaa

SEQ ID NO: 1436643 - DNA, 22 bp, Homo sapiens
tagtgcagctgaaattgaaaag

SEQ ID NO: 1436644 - DNA, 13 bp, Homo sapiens
tagtgccacccac

SEQ ID NO: 1436645 - DNA, 17 bp, Homo sapiens
tagtgccccagactgag

SEQ ID NO: 1436646 - DNA, 14 bp, Homo sapiens
tagtgcccgcctag

SEQ ID NO: 1436647 - DNA, 17 bp, Homo sapiens
tagtgccctccacagcc

SEQ ID NO: 1436648 - DNA, 23 bp, Homo sapiens
tagtgcctaaaattgtatgaaaa

SEQ ID NO: 1436649 - DNA, 22 bp, Homo sapiens
tagtgcctgagagtatttaggc

SEQ ID NO: 1436650 - DNA, 19 bp, Homo sapiens
tagtgcggacaagttttaa

SEQ ID NO: 1436651 - DNA, 17 bp, Homo sapiens
tagtgctattctgtgtt

SEQ ID NO: 1436652 - DNA, 21 bp, Homo sapiens
tagtgcttaaaaatcattgat

SEQ ID NO: 1436653 - DNA, 15 bp, Homo sapiens
tagtgcttcagagtt

SEQ ID NO: 1436654 - DNA, 17 bp, Homo sapiens
tagtggaagagcagcct

SEQ ID NO: 1436655 - DNA, 19 bp, Homo sapiens
tagtggaagagcagcctga

SEQ ID NO: 1436656 - DNA, 13 bp, Homo sapiens
tagtggagccagg

SEQ ID NO: 1436657 - DNA, 15 bp, Homo sapiens
tagtggatgttctga

SEQ ID NO: 1436658 - DNA, 18 bp, Homo sapiens
tagtggccccctcctccc

SEQ ID NO: 1436659 - DNA, 14 bp, Homo sapiens
tagtggcttcaaaa

SEQ ID NO: 1436660 - DNA, 18 bp, Homo sapiens
tagtgggcaccccactgc

SEQ ID NO: 1436661 - DNA, 14 bp, Homo sapiens
tagtgggcaggtgg

SEQ ID NO: 1436662 - DNA, 15 bp, Homo sapiens
tagtgggcaggtggc

SEQ ID NO: 1436663 - DNA, 20 bp, Homo sapiens
tagtgggccctctctctggg

SEQ ID NO: 1436664 - DNA, 18 bp, Homo sapiens
tagtggggtctccctctc

SEQ ID NO: 1436665 - DNA, 22 bp, Homo sapiens
tagtggggtctccctctcctgc

SEQ ID NO: 1436666 - DNA, 15 bp, Homo sapiens
tagtgggtacatcaa

SEQ ID NO: 1436667 - DNA, 12 bp, Homo sapiens
tagtgggttgac

SEQ ID NO: 1436668 - DNA, 15 bp, Homo sapiens
tagtggtagtatctc

SEQ ID NO: 1436669 - DNA, 13 bp, Homo sapiens
tagtgtaaaattg

SEQ ID NO: 1436670 - DNA, 14 bp, Homo sapiens
tagtgtaagaactg

SEQ ID NO: 1436671 - DNA, 15 bp, Homo sapiens
tagtgtaagaactgt

SEQ ID NO: 1436672 - DNA, 17 bp, Homo sapiens
tagtgtaagaactgtac

SEQ ID NO: 1436673 - DNA, 18 bp, Homo sapiens
tagtgtacatttctataa

SEQ ID NO: 1436674 - DNA, 23 bp, Homo sapiens
tagtgtacatttctataaataga

SEQ ID NO: 1436675 - DNA, 23 bp, Homo sapiens
tagtgtacctcctctcagtgttt

SEQ ID NO: 1436676 - DNA, 23 bp, Homo sapiens
tagtgtagctgtgtggctttcct

SEQ ID NO: 1436677 - DNA, 19 bp, Homo sapiens
tagtgtatgattactggcc

SEQ ID NO: 1436678 - DNA, 17 bp, Homo sapiens
tagtgtgaaatatatta

SEQ ID NO: 1436679 - DNA, 19 bp, Homo sapiens
tagtgtgagtggcagccat

SEQ ID NO: 1436680 - DNA, 23 bp, Homo sapiens
tagtgtgtgtgcagagtccattt

SEQ ID NO: 1436681 - DNA, 15 bp, Homo sapiens
tagtgtgtgtgcatg

SEQ ID NO: 1436682 - DNA, 16 bp, Homo sapiens
tagtgtgtgtgcatgt

SEQ ID NO: 1436683 - DNA, 15 bp, Homo sapiens
tagtgttcacaaact

SEQ ID NO: 1436684 - DNA, 18 bp, Homo sapiens
tagtgttcacaaactgtg

SEQ ID NO: 1436685 - DNA, 13 bp, Homo sapiens
tagtgttctagat

SEQ ID NO: 1436686 - DNA, 22 bp, Homo sapiens
tagtgttctagattatgtcttt

SEQ ID NO: 1436687 - DNA, 19 bp, Homo sapiens
tagtgttctgctcctgctt

SEQ ID NO: 1436688 - DNA, 23 bp, Homo sapiens
tagtgttctgctcctgcttttct

SEQ ID NO: 1436689 - DNA, 15 bp, Homo sapiens
tagtgttctgtttgt

SEQ ID NO: 1436690 - DNA, 22 bp, Homo sapiens
tagttaaaagactgcagctgct

SEQ ID NO: 1436691 - DNA, 13 bp, Homo sapiens
tagttaaagaaag

SEQ ID NO: 1436692 - DNA, 17 bp, Homo sapiens
tagttaaagaaaggaaa

SEQ ID NO: 1436693 - DNA, 21 bp, Homo sapiens
tagttaaagaaaggaaaagaa

SEQ ID NO: 1436694 - DNA, 14 bp, Homo sapiens
tagttaacacatca

SEQ ID NO: 1436695 - DNA, 16 bp, Homo sapiens
tataactcatcataaa

SEQ ID NO: 1436696 - DNA, 18 bp, Homo sapiens
tataactcatcataaaat

SEQ ID NO: 1436697 - DNA, 19 bp, Homo sapiens
tataactcatcataaaata

SEQ ID NO: 1436698 - DNA, 21 bp, Homo sapiens
tataactgtcttgtttcagtg

SEQ ID NO: 1436699 - DNA, 18 bp, Homo sapiens
tataacttaaaaaaatga

SEQ ID NO: 1436700 - DNA, 22 bp, Homo sapiens
tataacttaaaaatgtaaatat

SEQ ID NO: 1436701 - DNA, 18 bp, Homo sapiens
tataacttaaaatatttt

SEQ ID NO: 1436702 - DNA, 16 bp, Homo sapiens
tataagaagcaatctt

SEQ ID NO: 1436703 - DNA, 13 bp, Homo sapiens
tataagaagcctt

SEQ ID NO: 1436704 - DNA, 18 bp, Homo sapiens
tataagagaagtctcatt

SEQ ID NO: 1436705 - DNA, 19 bp, Homo sapiens
tataagatcctagatccta

SEQ ID NO: 1436706 - DNA, 21 bp, Homo sapiens
tataagcccttgattggaagg

SEQ ID NO: 1436707 - DNA, 22 bp, Homo sapiens
tataaggaaagcaataaatgaa

SEQ ID NO: 1436708 - DNA, 16 bp, Homo sapiens
tataaggtgctctctt

SEQ ID NO: 1436709 - DNA, 14 bp, Homo sapiens
tataaggttgtctg

SEQ ID NO: 1436710 - DNA, 15 bp, Homo sapiens
tataaggttttaagt

SEQ ID NO: 1436711 - DNA, 16 bp, Homo sapiens
tataagtagtaaatca

SEQ ID NO: 1436712 - DNA, 20 bp, Homo sapiens
tataagtagttggtttgtat

SEQ ID NO: 1436713 - DNA, 23 bp, Homo sapiens
tataagtagttggtttgtatgag

SEQ ID NO: 1436714 - DNA, 16 bp, Homo sapiens
tataagtattctaaat

SEQ ID NO: 1436715 - DNA, 13 bp, Homo sapiens
tataagtcaagca

SEQ ID NO: 1436716 - DNA, 15 bp, Homo sapiens
tataagtcaagcaca

SEQ ID NO: 1436717 - DNA, 14 bp, Homo sapiens
tataagtgaagtga

SEQ ID NO: 1436718 - DNA, 13 bp, Homo sapiens
tataagtgacttt

SEQ ID NO: 1436719 - DNA, 22 bp, Homo sapiens
tataagtgagatggtatgaaat

SEQ ID NO: 1436720 - DNA, 22 bp, Homo sapiens
tataagttatttttgtacatgt

SEQ ID NO: 1436721 - DNA, 23 bp, Homo sapiens
tataagttctattttactgtctt

SEQ ID NO: 1436722 - DNA, 16 bp, Homo sapiens
tataagttgaaggaaa

SEQ ID NO: 1436723 - DNA, 14 bp, Homo sapiens
tataataaatatat

SEQ ID NO: 1436724 - DNA, 16 bp, Homo sapiens
tataatacacaaaatc

SEQ ID NO: 1436725 - DNA, 18 bp, Homo sapiens
tataatacacaaaatcaa

SEQ ID NO: 1436726 - DNA, 20 bp, Homo sapiens
tataatacagaatcttgttt

SEQ ID NO: 1436727 - DNA, 23 bp, Homo sapiens
tataataggaacaatctttgctg

SEQ ID NO: 1436728 - DNA, 20 bp, Homo sapiens
tataatatactatatttatg

SEQ ID NO: 1436729 - DNA, 19 bp, Homo sapiens
tataatattgaaaattgaa

SEQ ID NO: 1436730 - DNA, 15 bp, Homo sapiens
tataatcattagttt

SEQ ID NO: 1436731 - DNA, 21 bp, Homo sapiens
tataatcattagttttagagg

SEQ ID NO: 1436732 - DNA, 21 bp, Homo sapiens
tataatctcaaaggagaaaaa

SEQ ID NO: 1436733 - DNA, 17 bp, Homo sapiens
tataatcttataattgt

SEQ ID NO: 1436734 - DNA, 16 bp, Homo sapiens
tataatggagttaacg

SEQ ID NO: 1436735 - DNA, 16 bp, Homo sapiens
tataatggtaatagaa

SEQ ID NO: 1436736 - DNA, 19 bp, Homo sapiens
tataatgtaagctctactg

SEQ ID NO: 1436737 - DNA, 19 bp, Homo sapiens
tataatgtattcatatttg

SEQ ID NO: 1436738 - DNA, 19 bp, Homo sapiens
tataatgttgataatatat

SEQ ID NO: 1436739 - DNA, 21 bp, Homo sapiens
tataattcagaaggatcttca

SEQ ID NO: 1436740 - DNA, 13 bp, Homo sapiens
tataattccctat

SEQ ID NO: 1436741 - DNA, 21 bp, Homo sapiens
tataattcctatatcctgtga

SEQ ID NO: 1436742 - DNA, 22 bp, Homo sapiens
tataattcctatatcctgtgac

SEQ ID NO: 1436743 - DNA, 17 bp, Homo sapiens
tataattctactttgag

SEQ ID NO: 1436744 - DNA, 16 bp, Homo sapiens
tataattctcattaaa

SEQ ID NO: 1436745 - DNA, 13 bp, Homo sapiens
tataattctgtaa

SEQ ID NO: 1436746 - DNA, 14 bp, Homo sapiens
tataattctgtaaa

SEQ ID NO: 1436747 - DNA, 16 bp, Homo sapiens
tataattctgtaaatg

SEQ ID NO: 1436748 - DNA, 17 bp, Homo sapiens
tataattggatttccta

SEQ ID NO: 1436749 - DNA, 18 bp, Homo sapiens
tataattggatttcctaa

SEQ ID NO: 1436750 - DNA, 20 bp, Homo sapiens
tataattggatttcctaata

SEQ ID NO: 1436751 - DNA, 22 bp, Homo sapiens
tataattggatttcctaatact

SEQ ID NO: 1436752 - DNA, 13 bp, Homo sapiens
tataattgtacaa

SEQ ID NO: 1436753 - DNA, 21 bp, Homo sapiens
tataattgtgtagcccctttt

SEQ ID NO: 1436754 - DNA, 12 bp, Homo sapiens
tataattgtgtg

SEQ ID NO: 1436755 - DNA, 23 bp, Homo sapiens
tataattgtgtgatatttcagaa

SEQ ID NO: 1436756 - DNA, 21 bp, Homo sapiens
tataattgttctcagaatccc

SEQ ID NO: 1436757 - DNA, 11 bp, Homo sapiens
tataatttaat

SEQ ID NO: 1436758 - DNA, 20 bp, Homo sapiens
tataatttaataaaaaggaa

SEQ ID NO: 1436759 - DNA, 22 bp, Homo sapiens
tataatttaataaaaaggaata

SEQ ID NO: 1436760 - DNA, 14 bp, Homo sapiens
tataatttgacttg

SEQ ID NO: 1436761 - DNA, 17 bp, Homo sapiens
tataattttatgaatgt

SEQ ID NO: 1436762 - DNA, 22 bp, Homo sapiens
tataattttccagtataaaaca

SEQ ID NO: 1436763 - DNA, 23 bp, Homo sapiens
tataattttccagtataaaacaa

SEQ ID NO: 1436764 - DNA, 13 bp, Homo sapiens
tataattttgcct

SEQ ID NO: 1436765 - DNA, 21 bp, Homo sapiens
tataatttttttcaatattta

SEQ ID NO: 1436766 - DNA, 21 bp, Homo sapiens
tatacaaaataagaacgagga

SEQ ID NO: 1436767 - DNA, 14 bp, Homo sapiens
tatacaaagtgtac

SEQ ID NO: 1436768 - DNA, 19 bp, Homo sapiens
tatacaaggcaagcatttt

SEQ ID NO: 1436769 - DNA, 15 bp, Homo sapiens
tatacaagtaatttc

SEQ ID NO: 1436770 - DNA, 13 bp, Homo sapiens
tatacaatgttct

SEQ ID NO: 1436771 - DNA, 14 bp, Homo sapiens
tatacacacacaca

SEQ ID NO: 1436772 - DNA, 20 bp, Homo sapiens
tatacagtaactttatgtgt

SEQ ID NO: 1436773 - DNA, 16 bp, Homo sapiens
tatacagtgtacatgt

SEQ ID NO: 1436774 - DNA, 19 bp, Homo sapiens
tatacagtgtacatgtaca

SEQ ID NO: 1436775 - DNA, 21 bp, Homo sapiens
tatacagtttttgtaaccata

SEQ ID NO: 1436776 - DNA, 18 bp, Homo sapiens
tatacatagaaactttgt

SEQ ID NO: 1436777 - DNA, 15 bp, Homo sapiens
tatacatattgtata

SEQ ID NO: 1436778 - DNA, 13 bp, Homo sapiens
tatacatgccagt

SEQ ID NO: 1436779 - DNA, 14 bp, Homo sapiens
tatacatgtgtaca

SEQ ID NO: 1436780 - DNA, 23 bp, Homo sapiens
tatacatgtgtacatatatgtat

SEQ ID NO: 1436781 - DNA, 15 bp, Homo sapiens
tatacatgtttatgt

SEQ ID NO: 1436782 - DNA, 20 bp, Homo sapiens
tatacatgtttatgtaaaca

SEQ ID NO: 1436783 - DNA, 17 bp, Homo sapiens
tatacattctttatctt

SEQ ID NO: 1436784 - DNA, 15 bp, Homo sapiens
tatacattgtcttga

SEQ ID NO: 1436785 - DNA, 18 bp, Homo sapiens
tatacattgtgtgaaaaa

SEQ ID NO: 1436786 - DNA, 22 bp, Homo sapiens
tatacattttctaaataaaaat

SEQ ID NO: 1436787 - DNA, 13 bp, Homo sapiens
tataccaataaag

SEQ ID NO: 1436788 - DNA, 24 bp, Homo sapiens
tatacccccaggaaactagctttt

SEQ ID NO: 1436789 - DNA, 20 bp, Homo sapiens
tataccctggtgcaatcaca

SEQ ID NO: 1436790 - DNA, 13 bp, Homo sapiens
tatacctggttta

SEQ ID NO: 1436791 - DNA, 16 bp, Homo sapiens
tatacctggtttactt

SEQ ID NO: 1436792 - DNA, 15 bp, Homo sapiens
tataccttttttgtt

SEQ ID NO: 1436793 - DNA, 15 bp, Homo sapiens
tatacgcttttcttt

SEQ ID NO: 1436794 - DNA, 17 bp, Homo sapiens
tatacggaaaaaattgt

SEQ ID NO: 1436795 - DNA, 15 bp, Homo sapiens
tatacgtataaatat

SEQ ID NO: 1436796 - DNA, 13 bp, Homo sapiens
tatactatgaaat

SEQ ID NO: 1436797 - DNA, 13 bp, Homo sapiens
tatactctcccag

SEQ ID NO: 1436798 - DNA, 16 bp, Homo sapiens
tatactctcccagatt

SEQ ID NO: 1436799 - DNA, 17 bp, Homo sapiens
tatactcttttttcatg

SEQ ID NO: 1436800 - DNA, 16 bp, Homo sapiens
tatactgaagtctttt

SEQ ID NO: 1436801 - DNA, 15 bp, Homo sapiens
tatactgatttaatt

SEQ ID NO: 1436802 - DNA, 17 bp, Homo sapiens
tatactgcatacttttt

SEQ ID NO: 1436803 - DNA, 20 bp, Homo sapiens
tatactgctatttacactat

SEQ ID NO: 1436804 - DNA, 19 bp, Homo sapiens
tatactggttatagttgat

SEQ ID NO: 1436805 - DNA, 21 bp, Homo sapiens
tatactggttatagttgatat

SEQ ID NO: 1436806 - DNA, 15 bp, Homo sapiens
tatactggttattga

SEQ ID NO: 1436807 - DNA, 17 bp, Homo sapiens
tatactgtattaagagt

SEQ ID NO: 1436808 - DNA, 20 bp, Homo sapiens
tatactgtttgtaatataca

SEQ ID NO: 1436809 - DNA, 20 bp, Homo sapiens
tatacttgtttttgtaaaga

SEQ ID NO: 1436810 - DNA, 20 bp, Homo sapiens
tatactttaatgttttaact

SEQ ID NO: 1436811 - DNA, 15 bp, Homo sapiens
taataaatctggtag

SEQ ID NO: 1436812 - DNA, 19 bp, Homo sapiens
taataaatgtacattaatt

SEQ ID NO: 1436813 - DNA, 14 bp, Homo sapiens
taataaattcaaaa

SEQ ID NO: 1436814 - DNA, 13 bp, Homo sapiens
taataaattcaga

SEQ ID NO: 1436815 - DNA, 21 bp, Homo sapiens
taataaattgtttggcttcct

SEQ ID NO: 1436816 - DNA, 15 bp, Homo sapiens
taataacatatctaa

SEQ ID NO: 1436817 - DNA, 17 bp, Homo sapiens
taataactgtgtactgt

SEQ ID NO: 1436818 - DNA, 14 bp, Homo sapiens
taataagatggctg

SEQ ID NO: 1436819 - DNA, 18 bp, Homo sapiens
taataagctaaagaggct

SEQ ID NO: 1436820 - DNA, 15 bp, Homo sapiens
taataagggaaaaat

SEQ ID NO: 1436821 - DNA, 21 bp, Homo sapiens
taataagtgaagaatacatca

SEQ ID NO: 1436822 - DNA, 16 bp, Homo sapiens
taataatatatgttta

SEQ ID NO: 1436823 - DNA, 23 bp, Homo sapiens
taataatatgtactaagaatgtc

SEQ ID NO: 1436824 - DNA, 13 bp, Homo sapiens
taataatttctaa

SEQ ID NO: 1436825 - DNA, 14 bp, Homo sapiens
taataatttctaat

SEQ ID NO: 1436826 - DNA, 21 bp, Homo sapiens
taataatttttacctaatctc

SEQ ID NO: 1436827 - DNA, 14 bp, Homo sapiens
taatacacagtact

SEQ ID NO: 1436828 - DNA, 22 bp, Homo sapiens
taatacacagtactttattgta

SEQ ID NO: 1436829 - DNA, 19 bp, Homo sapiens
taatacactccacttgaag

SEQ ID NO: 1436830 - DNA, 22 bp, Homo sapiens
taataccattttttaaggaaac

SEQ ID NO: 1436831 - DNA, 16 bp, Homo sapiens
taatacccatgctttg

SEQ ID NO: 1436832 - DNA, 14 bp, Homo sapiens
taatacctctgtgt

SEQ ID NO: 1436833 - DNA, 15 bp, Homo sapiens
taatacctctgtgtg

SEQ ID NO: 1436834 - DNA, 19 bp, Homo sapiens
taatacctgattgatcaca

SEQ ID NO: 1436835 - DNA, 20 bp, Homo sapiens
taatacctgattgatcacac

SEQ ID NO: 1436836 - DNA, 18 bp, Homo sapiens
taatactcaaatgagtaa

SEQ ID NO: 1436837 - DNA, 21 bp, Homo sapiens
taatactcaaatgagtaacat

SEQ ID NO: 1436838 - DNA, 21 bp, Homo sapiens
taatactggtatttttactta

SEQ ID NO: 1436839 - DNA, 17 bp, Homo sapiens
taatacttcatttggtg

SEQ ID NO: 1436840 - DNA, 16 bp, Homo sapiens
taatagaataaaggca

SEQ ID NO: 1436841 - DNA, 17 bp, Homo sapiens
taatagactaaatgaaa

SEQ ID NO: 1436842 - DNA, 12 bp, Homo sapiens
taatagagcaaa

SEQ ID NO: 1436843 - DNA, 21 bp, Homo sapiens
taatagagcaaaattgatgtg

SEQ ID NO: 1436844 - DNA, 18 bp, Homo sapiens
taatagcactaaccaatg

SEQ ID NO: 1436845 - DNA, 21 bp, Homo sapiens
taatagcagcctttctctctt

SEQ ID NO: 1436846 - DNA, 12 bp, Homo sapiens
taatagctcaga

SEQ ID NO: 1436847 - DNA, 22 bp, Homo sapiens
taataggaacaatctttgctgt

SEQ ID NO: 1436848 - DNA, 23 bp, Homo sapiens
taataggaacaatctttgctgta

SEQ ID NO: 1436849 - DNA, 15 bp, Homo sapiens
taataggagtatttt

SEQ ID NO: 1436850 - DNA, 14 bp, Homo sapiens
taatagggaatata

SEQ ID NO: 1436851 - DNA, 13 bp, Homo sapiens
taatagtgctttt

SEQ ID NO: 1436852 - DNA, 15 bp, Homo sapiens
taatagttagccctc

SEQ ID NO: 1436853 - DNA, 19 bp, Homo sapiens
taatagttagccctcagtc

SEQ ID NO: 1436854 - DNA, 20 bp, Homo sapiens
taatagttcagtagaattac

SEQ ID NO: 1436855 - DNA, 19 bp, Homo sapiens
taatagtttgtctatttta

SEQ ID NO: 1436856 - DNA, 16 bp, Homo sapiens
taatatactatattta

SEQ ID NO: 1436857 - DNA, 14 bp, Homo sapiens
taatatataaacaa

SEQ ID NO: 1436858 - DNA, 14 bp, Homo sapiens
taatatatatgaat

SEQ ID NO: 1436859 - DNA, 15 bp, Homo sapiens
taatatattaaaatt

SEQ ID NO: 1436860 - DNA, 16 bp, Homo sapiens
taatatattaaaattc

SEQ ID NO: 1436861 - DNA, 14 bp, Homo sapiens
taatatattgtaca

SEQ ID NO: 1436862 - DNA, 15 bp, Homo sapiens
taatatattgtacaa

SEQ ID NO: 1436863 - DNA, 17 bp, Homo sapiens
taatatatttaaaaata

SEQ ID NO: 1436864 - DNA, 15 bp, Homo sapiens
taatatatttaaagg

SEQ ID NO: 1436865 - DNA, 18 bp, Homo sapiens
taatatatttaaagggaa

SEQ ID NO: 1436866 - DNA, 22 bp, Homo sapiens
taatatatttaaagggaaattg

SEQ ID NO: 1436867 - DNA, 22 bp, Homo sapiens
taatatatttcagacattttca

SEQ ID NO: 1436868 - DNA, 15 bp, Homo sapiens
taatatcaaaagaaa

SEQ ID NO: 1436869 - DNA, 15 bp, Homo sapiens
taatatcacttaaat

SEQ ID NO: 1436870 - DNA, 21 bp, Homo sapiens
taatatctgtgaggtgctgat

SEQ ID NO: 1436871 - DNA, 23 bp, Homo sapiens
taatatgagatttctacttcgga

SEQ ID NO: 1436872 - DNA, 18 bp, Homo sapiens
taatatgcttaaaataag

SEQ ID NO: 1436873 - DNA, 16 bp, Homo sapiens
taatatggtgtatttt

SEQ ID NO: 1436874 - DNA, 12 bp, Homo sapiens
taatatgtcttt

SEQ ID NO: 1436875 - DNA, 18 bp, Homo sapiens
taatatgtgccttaagtt

SEQ ID NO: 1436876 - DNA, 23 bp, Homo sapiens
taatatgttaacctcagtgtcat

SEQ ID NO: 1436877 - DNA, 21 bp, Homo sapiens
taatattactgtctttattct

SEQ ID NO: 1436878 - DNA, 16 bp, Homo sapiens
taatattagtgattct

SEQ ID NO: 1436879 - DNA, 17 bp, Homo sapiens
taatattagtgattctg

SEQ ID NO: 1436880 - DNA, 21 bp, Homo sapiens
taatattcagccagcttaaac

SEQ ID NO: 1436881 - DNA, 20 bp, Homo sapiens
taatattcagggtaaatagg

SEQ ID NO: 1436882 - DNA, 21 bp, Homo sapiens
taatattcagggtaaatagga

SEQ ID NO: 1436883 - DNA, 22 bp, Homo sapiens
taatattgaaaattgaaaagta

SEQ ID NO: 1436884 - DNA, 14 bp, Homo sapiens
taatattgagaaag

SEQ ID NO: 1436885 - DNA, 21 bp, Homo sapiens
taatattgatatgcttataca

SEQ ID NO: 1436886 - DNA, 20 bp, Homo sapiens
taatattgtttggtaaatgt

SEQ ID NO: 1436887 - DNA, 14 bp, Homo sapiens
taatatttaatgga

SEQ ID NO: 1436888 - DNA, 15 bp, Homo sapiens
taatatttaccaaag

SEQ ID NO: 1436889 - DNA, 16 bp, Homo sapiens
taatatttaccaaagt

SEQ ID NO: 1436890 - DNA, 14 bp, Homo sapiens
taatatttactgtt

SEQ ID NO: 1436891 - DNA, 18 bp, Homo sapiens
taatatttactgttagaa

SEQ ID NO: 1436892 - DNA, 14 bp, Homo sapiens
taatatttcaagtg

SEQ ID NO: 1436893 - DNA, 18 bp, Homo sapiens
taatatttcaagtgccta

SEQ ID NO: 1436894 - DNA, 14 bp, Homo sapiens
taatatttgctgac

SEQ ID NO: 1436895 - DNA, 19 bp, Homo sapiens
taatatttttgtatttctc

SEQ ID NO: 1436896 - DNA, 14 bp, Homo sapiens
taatatttttgtca

SEQ ID NO: 1436897 - DNA, 15 bp, Homo sapiens
taatcaaaattgtct

SEQ ID NO: 1436898 - DNA, 12 bp, Homo sapiens
taatcaaagcta

SEQ ID NO: 1436899 - DNA, 13 bp, Homo sapiens
taatcaagagaaa

SEQ ID NO: 1436900 - DNA, 16 bp, Homo sapiens
taatcaagagaaactt

SEQ ID NO: 1436901 - DNA, 13 bp, Homo sapiens
taatcaagatttt

SEQ ID NO: 1436902 - DNA, 19 bp, Homo sapiens
taatcaagatttttttcct

SEQ ID NO: 1436903 - DNA, 14 bp, Homo sapiens
taatcaagcctctg

SEQ ID NO: 1436904 - DNA, 18 bp, Homo sapiens
taatcaatgtttcttcta

SEQ ID NO: 1436905 - DNA, 22 bp, Homo sapiens
taatcacgagtaagattaagag

SEQ ID NO: 1436906 - DNA, 20 bp, Homo sapiens
taatcactctaattaattgt

SEQ ID NO: 1436907 - DNA, 17 bp, Homo sapiens
taatcaggaaaaatgag

SEQ ID NO: 1436908 - DNA, 23 bp, Homo sapiens
taatcagtgtgtctaaatttgaa

SEQ ID NO: 1436909 - DNA, 13 bp, Homo sapiens
taatcatgaaatt

SEQ ID NO: 1436910 - DNA, 17 bp, Homo sapiens
taatcatgaaattactt

SEQ ID NO: 1436911 - DNA, 16 bp, Homo sapiens
taatcatgaatgtgta

SEQ ID NO: 1436912 - DNA, 14 bp, Homo sapiens
taatcatttatctt

SEQ ID NO: 1436913 - DNA, 23 bp, Homo sapiens
taatcatttatcttatctagcaa

SEQ ID NO: 1436914 - DNA, 12 bp, Homo sapiens
taatcattttca

SEQ ID NO: 1436915 - DNA, 18 bp, Homo sapiens
taatcattttcattccta

SEQ ID NO: 1436916 - DNA, 13 bp, Homo sapiens
taatcccagcact

SEQ ID NO: 1436917 - DNA, 21 bp, Homo sapiens
taatcccagcactttgggagg

SEQ ID NO: 1436918 - DNA, 23 bp, Homo sapiens
taatcccagcactttgggaggcc

SEQ ID NO: 1436919 - DNA, 14 bp, Homo sapiens
taatcccagctact

SEQ ID NO: 1436920 - DNA, 17 bp, Homo sapiens
taatccccttctcccct

SEQ ID NO: 1436921 - DNA, 17 bp, Homo sapiens
taatcccgattcaccct

SEQ ID NO: 1436922 - DNA, 21 bp, Homo sapiens
taatccctgctttttgtgttt

SEQ ID NO: 1436923 - DNA, 16 bp, Homo sapiens
taatccgttcatagaa

SEQ ID NO: 1436924 - DNA, 19 bp, Homo sapiens
taatccgttcatagaaatt

SEQ ID NO: 1436925 - DNA, 21 bp, Homo sapiens
taatcctagcactttgggagg

SEQ ID NO: 1436926 - DNA, 20 bp, Homo sapiens
taatcctagccccgagacac

SEQ ID NO: 1436927 - DNA, 21 bp, Homo sapiens
taatcctattaaaacacagct

SEQ ID NO: 1436928 - DNA, 23 bp, Homo sapiens
taatcctttgttttctgactaat

SEQ ID NO: 1436929 - DNA, 14 bp, Homo sapiens
taatccttttcctt

SEQ ID NO: 1436930 - DNA, 23 bp, Homo sapiens
taatccttttccttatttgcctt

SEQ ID NO: 1436931 - DNA, 22 bp, Homo sapiens
taatcggcccacagctcccacc

SEQ ID NO: 1436932 - DNA, 19 bp, Homo sapiens
taatctaaaagctctgttc

SEQ ID NO: 1436933 - DNA, 14 bp, Homo sapiens
taatctagaacaca

SEQ ID NO: 1436934 - DNA, 17 bp, Homo sapiens
taatctagatatcgact

SEQ ID NO: 1436935 - DNA, 18 bp, Homo sapiens
taatctaggtgtggctgt

SEQ ID NO: 1436936 - DNA, 17 bp, Homo sapiens
taatctagtttacagaa

SEQ ID NO: 1436937 - DNA, 18 bp, Homo sapiens
taatctagtttacagaaa

SEQ ID NO: 1436938 - DNA, 22 bp, Homo sapiens
taatctattcctgtaaataaga

SEQ ID NO: 1436939 - DNA, 17 bp, Homo sapiens
taatctatttctatgag

SEQ ID NO: 1436940 - DNA, 19 bp, Homo sapiens
taatctatttctatgagaa

SEQ ID NO: 1436941 - DNA, 15 bp, Homo sapiens
taatctcaaaggaga

SEQ ID NO: 1436942 - DNA, 17 bp, Homo sapiens
taatctcaaaggagaaa

SEQ ID NO: 1436943 - DNA, 18 bp, Homo sapiens
taatctcctcttttatct

SEQ ID NO: 1436944 - DNA, 20 bp, Homo sapiens
taatctctaaaattctagtc

SEQ ID NO: 1436945 - DNA, 19 bp, Homo sapiens
taatctctctgcagctgcc

SEQ ID NO: 1436946 - DNA, 22 bp, Homo sapiens
taatctctgattaaatttaata

SEQ ID NO: 1436947 - DNA, 14 bp, Homo sapiens
taatctcttattct

SEQ ID NO: 1436948 - DNA, 12 bp, Homo sapiens
taatctggatgt

SEQ ID NO: 1436949 - DNA, 20 bp, Homo sapiens
taatctgtagggctggacct

SEQ ID NO: 1436950 - DNA, 13 bp, Homo sapiens
taatcttagtgta

SEQ ID NO: 1436951 - DNA, 22 bp, Homo sapiens
taatcttataattgttctcaga

SEQ ID NO: 1436952 - DNA, 17 bp, Homo sapiens
taatcttattttatctt

SEQ ID NO: 1436953 - DNA, 16 bp, Homo sapiens
taatcttcagttttat

SEQ ID NO: 1436954 - DNA, 18 bp, Homo sapiens
taatcttgcttcattgtt

SEQ ID NO: 1436955 - DNA, 19 bp, Homo sapiens
taatcttgcttcattgtta

SEQ ID NO: 1436956 - DNA, 19 bp, Homo sapiens
taatctttacctgtataca

SEQ ID NO: 1436957 - DNA, 17 bp, Homo sapiens
taatctttcacttgaaa

SEQ ID NO: 1436958 - DNA, 20 bp, Homo sapiens
taatctttcacttgaaagat

SEQ ID NO: 1436959 - DNA, 22 bp, Homo sapiens
taatctttcacttgaaagattt

SEQ ID NO: 1436960 - DNA, 23 bp, Homo sapiens
taatctttctttacctgagacca

SEQ ID NO: 1436961 - DNA, 22 bp, Homo sapiens
taatctttgggtaacttcaaaa

SEQ ID NO: 1436962 - DNA, 22 bp, Homo sapiens
taatcttttttttaaaaaaact

SEQ ID NO: 1436963 - DNA, 16 bp, Homo sapiens
taatgaaaaggaagtt

SEQ ID NO: 1436964 - DNA, 18 bp, Homo sapiens
taatgaaaataaaacaca

SEQ ID NO: 1436965 - DNA, 21 bp, Homo sapiens
taatgaaaataaaacacacct

SEQ ID NO: 1436966 - DNA, 14 bp, Homo sapiens
taatgaaaatgtca

SEQ ID NO: 1436967 - DNA, 17 bp, Homo sapiens
taatgaaagactgtaca

SEQ ID NO: 1436968 - DNA, 20 bp, Homo sapiens
taatgaaagggtttgtaata

SEQ ID NO: 1436969 - DNA, 15 bp, Homo sapiens
taatgaaataatcag

SEQ ID NO: 1436970 - DNA, 17 bp, Homo sapiens
taatgaaataatcagtg

SEQ ID NO: 1436971 - DNA, 19 bp, Homo sapiens
taatgaactaccatctgat

SEQ ID NO: 1436972 - DNA, 21 bp, Homo sapiens
taatgaactaccatctgatgt

SEQ ID NO: 1436973 - DNA, 12 bp, Homo sapiens
taatgaagagaa

SEQ ID NO: 1436974 - DNA, 17 bp, Homo sapiens
taatgaatgaaacattt

SEQ ID NO: 1436975 - DNA, 14 bp, Homo sapiens
taatgacttagaaa

SEQ ID NO: 1436976 - DNA, 19 bp, Homo sapiens
taatgacttgtacaaacag

SEQ ID NO: 1436977 - DNA, 16 bp, Homo sapiens
taatgactttatgtat

SEQ ID NO: 1436978 - DNA, 15 bp, Homo sapiens
taatgagaatagaaa

SEQ ID NO: 1436979 - DNA, 19 bp, Homo sapiens
taatgagagcaaatgcaaa

SEQ ID NO: 1436980 - DNA, 17 bp, Homo sapiens
taatgagatatttgtat

SEQ ID NO: 1436981 - DNA, 24 bp, Homo sapiens
taatgagtgcacctgcctccacca

SEQ ID NO: 1436982 - DNA, 15 bp, Homo sapiens
taatgatcaaaacat

SEQ ID NO: 1436983 - DNA, 17 bp, Homo sapiens
taatgatcaaaacatgc

SEQ ID NO: 1436984 - DNA, 20 bp, Homo sapiens
taatgatctcggatgaccaa

SEQ ID NO: 1436985 - DNA, 12 bp, Homo sapiens
taatgatttctt

SEQ ID NO: 1436986 - DNA, 22 bp, Homo sapiens
taatgcactgagtatgcaatgc

SEQ ID NO: 1436987 - DNA, 18 bp, Homo sapiens
taatgcagaagtattctt

SEQ ID NO: 1436988 - DNA, 15 bp, Homo sapiens
taatgctacaatttt

SEQ ID NO: 1436989 - DNA, 15 bp, Homo sapiens
taatgctactgtctc

SEQ ID NO: 1436990 - DNA, 17 bp, Homo sapiens
taatgctatttgaacaa

SEQ ID NO: 1436991 - DNA, 20 bp, Homo sapiens
taatgctcacctttatcacc

SEQ ID NO: 1436992 - DNA, 20 bp, Homo sapiens
taatgctcccatctcctgat

SEQ ID NO: 1436993 - DNA, 16 bp, Homo sapiens
taatgctgcacttcct

SEQ ID NO: 1436994 - DNA, 12 bp, Homo sapiens
taatgctgcctt

SEQ ID NO: 1436995 - DNA, 15 bp, Homo sapiens
taatgctgtttctaa

SEQ ID NO: 1436996 - DNA, 20 bp, Homo sapiens
taatgctgtttctaagaaaa

SEQ ID NO: 1436997 - DNA, 14 bp, Homo sapiens
taatgcttcagata

SEQ ID NO: 1436998 - DNA, 19 bp, Homo sapiens
taatgcttgtttatgatat

SEQ ID NO: 1436999 - DNA, 17 bp, Homo sapiens
taatgctttcacaacat

SEQ ID NO: 1437000 - DNA, 15 bp, Homo sapiens
taatggaaaaatagt

SEQ ID NO: 1437001 - DNA, 20 bp, Homo sapiens
taatggaaacatttacaata

SEQ ID NO: 1437002 - DNA, 14 bp, Homo sapiens
taatggaaaccaag

SEQ ID NO: 1437003 - DNA, 19 bp, Homo sapiens
taatggaactgaccccctc

SEQ ID NO: 1437004 - DNA, 19 bp, Homo sapiens
taatggaagtgtatttatt

SEQ ID NO: 1437005 - DNA, 15 bp, Homo sapiens
taatggaattatgta

SEQ ID NO: 1437006 - DNA, 21 bp, Homo sapiens
taatggatcatagaattgcag

SEQ ID NO: 1437007 - DNA, 15 bp, Homo sapiens
taatggcatttctct

SEQ ID NO: 1437008 - DNA, 13 bp, Homo sapiens
taatgggaaaaac

SEQ ID NO: 1437009 - DNA, 16 bp, Homo sapiens
taatggggcagacaca

SEQ ID NO: 1437010 - DNA, 16 bp, Homo sapiens
taatgggtaattctga

SEQ ID NO: 1437011 - DNA, 15 bp, Homo sapiens
taatggtcccatcca

SEQ ID NO: 1437012 - DNA, 13 bp, Homo sapiens
taatggtgtagaa

SEQ ID NO: 1437013 - DNA, 19 bp, Homo sapiens
taatggtgtagaacactaa

SEQ ID NO: 1437014 - DNA, 14 bp, Homo sapiens
taatggtgttttaa

SEQ ID NO: 1437015 - DNA, 15 bp, Homo sapiens
taatgtaaataaact

SEQ ID NO: 1437016 - DNA, 15 bp, Homo sapiens
taatgtaacatgttt

SEQ ID NO: 1437017 - DNA, 16 bp, Homo sapiens
taatgtaagctctact

SEQ ID NO: 1437018 - DNA, 19 bp, Homo sapiens
taatgtaatcatttatctt

SEQ ID NO: 1437019 - DNA, 16 bp, Homo sapiens
taatgtacaagttttg

SEQ ID NO: 1437020 - DNA, 18 bp, Homo sapiens
taatgtacaagttttgta

SEQ ID NO: 1437021 - DNA, 21 bp, Homo sapiens
taatgtacaagttttgtataa

SEQ ID NO: 1437022 - DNA, 14 bp, Homo sapiens
taatgtactcacat

SEQ ID NO: 1437023 - DNA, 19 bp, Homo sapiens
taatgtactgatttcagta

SEQ ID NO: 1437024 - DNA, 13 bp, Homo sapiens
taatgtactgcat

SEQ ID NO: 1437025 - DNA, 18 bp, Homo sapiens
taatgtatcatgaagaaa

SEQ ID NO: 1437026 - DNA, 15 bp, Homo sapiens
taatgtatctatttg

SEQ ID NO: 1437027 - DNA, 17 bp, Homo sapiens
taatgtatgttaccaaa

SEQ ID NO: 1437028 - DNA, 18 bp, Homo sapiens
taatgtattcatatttgt

SEQ ID NO: 1437029 - DNA, 19 bp, Homo sapiens
taatgtattcatatttgta

SEQ ID NO: 1437030 - DNA, 20 bp, Homo sapiens
taatgtattcatatttgtac

SEQ ID NO: 1437031 - DNA, 16 bp, Homo sapiens
taatgtcattgctaaa

SEQ ID NO: 1437032 - DNA, 18 bp, Homo sapiens
taatgtcattgctaaaaa

SEQ ID NO: 1437033 - DNA, 20 bp, Homo sapiens
taatgtccctctcttggcta

SEQ ID NO: 1437034 - DNA, 11 bp, Homo sapiens
taatgtctctg

SEQ ID NO: 1437035 - DNA, 22 bp, Homo sapiens
taatgtgaggaactcacatact

SEQ ID NO: 1437036 - DNA, 18 bp, Homo sapiens
taatgtgcagaaaatatt

SEQ ID NO: 1437037 - DNA, 15 bp, Homo sapiens
taatgtgtggattgc

SEQ ID NO: 1437038 - DNA, 23 bp, Homo sapiens
taatgtgtggattgcctctgaaa

SEQ ID NO: 1437039 - DNA, 18 bp, Homo sapiens
taatgttaaacaccattt

SEQ ID NO: 1437040 - DNA, 16 bp, Homo sapiens
taatgttctttaatgt

SEQ ID NO: 1437041 - DNA, 13 bp, Homo sapiens
taatgttgaacaa

SEQ ID NO: 1437042 - DNA, 18 bp, Homo sapiens
taatgttgaacaaaataa

SEQ ID NO: 1437043 - DNA, 14 bp, Homo sapiens
taatgttgtgaata

SEQ ID NO: 1437044 - DNA, 18 bp, Homo sapiens
taatgttgtgaataatta

SEQ ID NO: 1437045 - DNA, 19 bp, Homo sapiens
taatgttgtgaataattac

SEQ ID NO: 1437046 - DNA, 23 bp, Homo sapiens
taatgttgtgaataattacagtg

SEQ ID NO: 1437047 - DNA, 15 bp, Homo sapiens
taatgtttatgagcc

SEQ ID NO: 1437048 - DNA, 16 bp, Homo sapiens
taatgtttatgagcca

SEQ ID NO: 1437049 - DNA, 17 bp, Homo sapiens
taatgtttatgagccag

SEQ ID NO: 1437050 - DNA, 19 bp, Homo sapiens
taatgtttccctcaagaac

SEQ ID NO: 1437051 - DNA, 12 bp, Homo sapiens
taatgtttgcta

SEQ ID NO: 1437052 - DNA, 13 bp, Homo sapiens
taatgtttgctat

SEQ ID NO: 1437053 - DNA, 14 bp, Homo sapiens
taatgtttgtgaga

SEQ ID NO: 1437054 - DNA, 14 bp, Homo sapiens
taatgttttcaaaa

SEQ ID NO: 1437055 - DNA, 21 bp, Homo sapiens
taatgttttttgccacagctt

SEQ ID NO: 1437056 - DNA, 20 bp, Homo sapiens
taattaaaagaatattttaa

SEQ ID NO: 1437057 - DNA, 18 bp, Homo sapiens
taattaaaagcaaatcat

SEQ ID NO: 1437058 - DNA, 22 bp, Homo sapiens
taattaaataaatcattaatac

SEQ ID NO: 1437059 - DNA, 23 bp, Homo sapiens
taattaaatccaactttcacagt

SEQ ID NO: 1437060 - DNA, 23 bp, Homo sapiens
taattaaattttgagttctacat

SEQ ID NO: 1437061 - DNA, 19 bp, Homo sapiens
taattaaccttactaatta

SEQ ID NO: 1437062 - DNA, 20 bp, Homo sapiens
taattaatatattaaaattc

SEQ ID NO: 1437063 - DNA, 22 bp, Homo sapiens
taattaatatattaaaattcca

SEQ ID NO: 1437064 - DNA, 21 bp, Homo sapiens
taattaatcatgaatgtgtaa

SEQ ID NO: 1437065 - DNA, 19 bp, Homo sapiens
taattaatgaaatatctgt

SEQ ID NO: 1437066 - DNA, 23 bp, Homo sapiens
taattacagaatatacttagaaa

SEQ ID NO: 1437067 - DNA, 22 bp, Homo sapiens
taattacagtgcctaaaataag

SEQ ID NO: 1437068 - DNA, 17 bp, Homo sapiens
taattaccaacctgtta

SEQ ID NO: 1437069 - DNA, 17 bp, Homo sapiens
taattactgccttgaaa

SEQ ID NO: 1437070 - DNA, 22 bp, Homo sapiens
taattacttattgtatttatgt

SEQ ID NO: 1437071 - DNA, 21 bp, Homo sapiens
taattactttcagaatatttt

SEQ ID NO: 1437072 - DNA, 13 bp, Homo sapiens
taattagctgtgc

SEQ ID NO: 1437073 - DNA, 22 bp, Homo sapiens
taattaggcaaggctatgtgat

SEQ ID NO: 1437074 - DNA, 21 bp, Homo sapiens
taattagtgccacttaatgta

SEQ ID NO: 1437075 - DNA, 21 bp, Homo sapiens
taattataaacccacattctt

SEQ ID NO: 1437076 - DNA, 17 bp, Homo sapiens
taattatataactgtat

SEQ ID NO: 1437077 - DNA, 16 bp, Homo sapiens
taattatatattttgt

SEQ ID NO: 1437078 - DNA, 19 bp, Homo sapiens
taattatcgggaacagtgt

SEQ ID NO: 1437079 - DNA, 21 bp, Homo sapiens
taattatgacagttatactgt

SEQ ID NO: 1437080 - DNA, 13 bp, Homo sapiens
taattattattaa

SEQ ID NO: 1437081 - DNA, 12 bp, Homo sapiens
taattattattc

SEQ ID NO: 1437082 - DNA, 17 bp, Homo sapiens
taattattatttatata

SEQ ID NO: 1437083 - DNA, 22 bp, Homo sapiens
taattattatttatatatgtat

SEQ ID NO: 1437084 - DNA, 19 bp, Homo sapiens
taattattgtaatgtaata

SEQ ID NO: 1437085 - DNA, 20 bp, Homo sapiens
taattattttggtactttta

SEQ ID NO: 1437086 - DNA, 13 bp, Homo sapiens
taattcaacattt

SEQ ID NO: 1437087 - DNA, 19 bp, Homo sapiens
taattcacagaatagcaca

SEQ ID NO: 1437088 - DNA, 16 bp, Homo sapiens
taattcaccaaagtat

SEQ ID NO: 1437089 - DNA, 13 bp, Homo sapiens
taattcacgtgct

SEQ ID NO: 1437090 - DNA, 12 bp, Homo sapiens
taattcagcact

SEQ ID NO: 1437091 - DNA, 14 bp, Homo sapiens
taattcaggttttt

SEQ ID NO: 1437092 - DNA, 16 bp, Homo sapiens
taattcaggtttttcc

SEQ ID NO: 1437093 - DNA, 15 bp, Homo sapiens
taattcatgtttctt

SEQ ID NO: 1437094 - DNA, 14 bp, Homo sapiens
taattcatttgtat

SEQ ID NO: 1437095 - DNA, 16 bp, Homo sapiens
taattcatttgtattg

SEQ ID NO: 1437096 - DNA, 16 bp, Homo sapiens
taattcccattttgca

SEQ ID NO: 1437097 - DNA, 21 bp, Homo sapiens
taattcccattttgcaaaatt

SEQ ID NO: 1437098 - DNA, 19 bp, Homo sapiens
taattcctacctccctgca

SEQ ID NO: 1437099 - DNA, 17 bp, Homo sapiens
taattcctctccaggcc

SEQ ID NO: 1437100 - DNA, 15 bp, Homo sapiens
taattcctcttttta

SEQ ID NO: 1437101 - DNA, 18 bp, Homo sapiens
taattcctgttgctctgt

SEQ ID NO: 1437102 - DNA, 12 bp, Homo sapiens
taattccttggt

SEQ ID NO: 1437103 - DNA, 19 bp, Homo sapiens
taattctaagttatttact

SEQ ID NO: 1437104 - DNA, 14 bp, Homo sapiens
taattctcattaaa

SEQ ID NO: 1437105 - DNA, 22 bp, Homo sapiens
taattctgcttgtgacattaaa

SEQ ID NO: 1437106 - DNA, 18 bp, Homo sapiens
taattcttcacctttgta

SEQ ID NO: 1437107 - DNA, 14 bp, Homo sapiens
taattctttctgtc

SEQ ID NO: 1437108 - DNA, 15 bp, Homo sapiens
taattctttctgtct

SEQ ID NO: 1437109 - DNA, 13 bp, Homo sapiens
taattctttgcaa

SEQ ID NO: 1437110 - DNA, 17 bp, Homo sapiens
taattctttgcaaaaat

SEQ ID NO: 1437111 - DNA, 15 bp, Homo sapiens
taattctttgttctg

SEQ ID NO: 1437112 - DNA, 15 bp, Homo sapiens
taattcttttctgag

SEQ ID NO: 1437113 - DNA, 20 bp, Homo sapiens
taattgaaaagattttaaca

SEQ ID NO: 1437114 - DNA, 14 bp, Homo sapiens
taattgatttcaag

SEQ ID NO: 1437115 - DNA, 21 bp, Homo sapiens
taattgcaaaaacatagaaat

SEQ ID NO: 1437116 - DNA, 22 bp, Homo sapiens
taattgcactttttaagtttga

SEQ ID NO: 1437117 - DNA, 18 bp, Homo sapiens
taattgcatctcaaaatt

SEQ ID NO: 1437118 - DNA, 17 bp, Homo sapiens
taattgcatttctgctc

SEQ ID NO: 1437119 - DNA, 18 bp, Homo sapiens
taattgcctacaataaaa

SEQ ID NO: 1437120 - DNA, 22 bp, Homo sapiens
taattgcctacaataaaaagaa

SEQ ID NO: 1437121 - DNA, 14 bp, Homo sapiens
taattgcctttgag

SEQ ID NO: 1437122 - DNA, 22 bp, Homo sapiens
taattgctgtgtgtcccaggca

SEQ ID NO: 1437123 - DNA, 21 bp, Homo sapiens
taattgcttacatttttacaa

SEQ ID NO: 1437124 - DNA, 17 bp, Homo sapiens
taattgctttgccaaaa

SEQ ID NO: 1437125 - DNA, 14 bp, Homo sapiens
taattggatgttca

SEQ ID NO: 1437126 - DNA, 17 bp, Homo sapiens
taattggtttagttctt

SEQ ID NO: 1437127 - DNA, 21 bp, Homo sapiens
taattgtgaaaaagttaaaca

SEQ ID NO: 1437128 - DNA, 18 bp, Homo sapiens
taattgtgaccaatacat

SEQ ID NO: 1437129 - DNA, 19 bp, Homo sapiens
taattgtgaccaatacatt

SEQ ID NO: 1437130 - DNA, 20 bp, Homo sapiens
taattgtgaccaatacattt

SEQ ID NO: 1437131 - DNA, 17 bp, Homo sapiens
taattgtggattaatgt

SEQ ID NO: 1437132 - DNA, 19 bp, Homo sapiens
taattgtgtaaaaaatgga

SEQ ID NO: 1437133 - DNA, 20 bp, Homo sapiens
taattgtgtaaaaaatggaa

SEQ ID NO: 1437134 - DNA, 21 bp, Homo sapiens
taattgtgtaaaaaatggaaa

SEQ ID NO: 1437135 - DNA, 23 bp, Homo sapiens
taattgtgtagccccttttcttt

SEQ ID NO: 1437136 - DNA, 23 bp, Homo sapiens
taattgtgtatatgttggtttaa

SEQ ID NO: 1437137 - DNA, 19 bp, Homo sapiens
taattgtgtgatatttcag

SEQ ID NO: 1437138 - DNA, 21 bp, Homo sapiens
taattgtgtgatatttcagaa

SEQ ID NO: 1437139 - DNA, 16 bp, Homo sapiens
taattgttctcagaat

SEQ ID NO: 1437140 - DNA, 12 bp, Homo sapiens
taattgtttcca

SEQ ID NO: 1437141 - DNA, 18 bp, Homo sapiens
taattgtttccaacttgt

SEQ ID NO: 1437142 - DNA, 20 bp, Homo sapiens
taattgtttccaacttgtct

SEQ ID NO: 1437143 - DNA, 18 bp, Homo sapiens
taattgttttgcactttt

SEQ ID NO: 1437144 - DNA, 15 bp, Homo sapiens
taattgttttggaat

SEQ ID NO: 1437145 - DNA, 20 bp, Homo sapiens
taattgttttttaaagcaag

SEQ ID NO: 1437146 - DNA, 22 bp, Homo sapiens
taatttaaaaagtgctatacta

SEQ ID NO: 1437147 - DNA, 19 bp, Homo sapiens
taatttaaacacctcctca

SEQ ID NO: 1437148 - DNA, 19 bp, Homo sapiens
taatttaaacaggcccagc

SEQ ID NO: 1437149 - DNA, 20 bp, Homo sapiens
taatttaaacatttgttcct

SEQ ID NO: 1437150 - DNA, 21 bp, Homo sapiens
taatttaaacatttgttcctg

SEQ ID NO: 1437151 - DNA, 12 bp, Homo sapiens
taatttaaagcc

SEQ ID NO: 1437152 - DNA, 19 bp, Homo sapiens
taatttaaagccacaacca

SEQ ID NO: 1437153 - DNA, 12 bp, Homo sapiens
taatttaaatga

SEQ ID NO: 1437154 - DNA, 11 bp, Homo sapiens
taatttaactt

SEQ ID NO: 1437155 - DNA, 18 bp, Homo sapiens
taatttaaggtctgtttg

SEQ ID NO: 1437156 - DNA, 23 bp, Homo sapiens
taatttaaggtctgtttgctgtt

SEQ ID NO: 1437157 - DNA, 17 bp, Homo sapiens
taatttaataaaaagga

SEQ ID NO: 1437158 - DNA, 22 bp, Homo sapiens
taatttacctaagattacaaat

SEQ ID NO: 1437159 - DNA, 14 bp, Homo sapiens
taaaacattatttc

SEQ ID NO: 1437160 - DNA, 17 bp, Homo sapiens
taaaacatttgtttccc

SEQ ID NO: 1437161 - DNA, 15 bp, Homo sapiens
taaaacattttgact

SEQ ID NO: 1437162 - DNA, 11 bp, Homo sapiens
taaaaccaaag

SEQ ID NO: 1437163 - DNA, 21 bp, Homo sapiens
taaaaccatcagatatttctt

SEQ ID NO: 1437164 - DNA, 19 bp, Homo sapiens
taaaaccccatctctacta

SEQ ID NO: 1437165 - DNA, 17 bp, Homo sapiens
taaaactaaatttcact

SEQ ID NO: 1437166 - DNA, 14 bp, Homo sapiens
taaaactaagcaca

SEQ ID NO: 1437167 - DNA, 21 bp, Homo sapiens
taaaactaagctctttgagaa

SEQ ID NO: 1437168 - DNA, 22 bp, Homo sapiens
taaaactatattcatttccact

SEQ ID NO: 1437169 - DNA, 18 bp, Homo sapiens
taaaactatggttcccaa

SEQ ID NO: 1437170 - DNA, 21 bp, Homo sapiens
taaaactatggttcccaataa

SEQ ID NO: 1437171 - DNA, 23 bp, Homo sapiens
taaaactatggttcccaataaaa

SEQ ID NO: 1437172 - DNA, 13 bp, Homo sapiens
taaaactcagaat

SEQ ID NO: 1437173 - DNA, 13 bp, Homo sapiens
taaaactgctttt

SEQ ID NO: 1437174 - DNA, 23 bp, Homo sapiens
taaaactgggattaagaaacctt

SEQ ID NO: 1437175 - DNA, 20 bp, Homo sapiens
taaaactgtgactaggcata

SEQ ID NO: 1437176 - DNA, 22 bp, Homo sapiens
taaaacttcagtttcacagaaa

SEQ ID NO: 1437177 - DNA, 16 bp, Homo sapiens
taaaactttgctgcca

SEQ ID NO: 1437178 - DNA, 19 bp, Homo sapiens
taaaactttggcaacatct

SEQ ID NO: 1437179 - DNA, 18 bp, Homo sapiens
taaaagaaatatattttt

SEQ ID NO: 1437180 - DNA, 18 bp, Homo sapiens
taaaagaacagtaaacat

SEQ ID NO: 1437181 - DNA, 23 bp, Homo sapiens
taaaagaatattttaacttcctt

SEQ ID NO: 1437182 - DNA, 13 bp, Homo sapiens
taaaagaattttt

SEQ ID NO: 1437183 - DNA, 18 bp, Homo sapiens
taaaagactgcagctgct

SEQ ID NO: 1437184 - DNA, 20 bp, Homo sapiens
taaaagactgcagctgctga

SEQ ID NO: 1437185 - DNA, 18 bp, Homo sapiens
taaaagagatttcaagag

SEQ ID NO: 1437186 - DNA, 18 bp, Homo sapiens
taaaagatcaccttgtat

SEQ ID NO: 1437187 - DNA, 13 bp, Homo sapiens
taaaagatcgcag

SEQ ID NO: 1437188 - DNA, 13 bp, Homo sapiens
taaaagatgcaga

SEQ ID NO: 1437189 - DNA, 19 bp, Homo sapiens
taaaagatggttgtagcat

SEQ ID NO: 1437190 - DNA, 19 bp, Homo sapiens
taaaagattcatttttaat

SEQ ID NO: 1437191 - DNA, 19 bp, Homo sapiens
taaaagatttacattccac

SEQ ID NO: 1437192 - DNA, 18 bp, Homo sapiens
taaaagcataaatgcaaa

SEQ ID NO: 1437193 - DNA, 19 bp, Homo sapiens
taaaagcctaggtctattt

SEQ ID NO: 1437194 - DNA, 12 bp, Homo sapiens
taaaagccttgg

SEQ ID NO: 1437195 - DNA, 21 bp, Homo sapiens
taaaagccttggcctcagagg

SEQ ID NO: 1437196 - DNA, 20 bp, Homo sapiens
taaaagcgacctctcttgag

SEQ ID NO: 1437197 - DNA, 18 bp, Homo sapiens
taaaagctagatactgga

SEQ ID NO: 1437198 - DNA, 19 bp, Homo sapiens
taaaagctataaagtatat

SEQ ID NO: 1437199 - DNA, 12 bp, Homo sapiens
taaaaggaaaag

SEQ ID NO: 1437200 - DNA, 21 bp, Homo sapiens
taaaaggaaagaaaacatctt

SEQ ID NO: 1437201 - DNA, 21 bp, Homo sapiens
taaaaggaaatctcaccccat

SEQ ID NO: 1437202 - DNA, 14 bp, Homo sapiens
taaaaggagagaag

SEQ ID NO: 1437203 - DNA, 16 bp, Homo sapiens
taaaaggagagaagaa

SEQ ID NO: 1437204 - DNA, 20 bp, Homo sapiens
taaaagggctctttagccag

SEQ ID NO: 1437205 - DNA, 21 bp, Homo sapiens
taaaaggtatgcaatcaaatc

SEQ ID NO: 1437206 - DNA, 15 bp, Homo sapiens
taaaagtctatttta

SEQ ID NO: 1437207 - DNA, 20 bp, Homo sapiens
taaaagtctattttattatg

SEQ ID NO: 1437208 - DNA, 13 bp, Homo sapiens
taaaagtgatcaa

SEQ ID NO: 1437209 - DNA, 19 bp, Homo sapiens
taaaagtggtctctgctgg

SEQ ID NO: 1437210 - DNA, 19 bp, Homo sapiens
taaaagtgttgattacata

SEQ ID NO: 1437211 - DNA, 19 bp, Homo sapiens
taaaagttgaaaagccaaa

SEQ ID NO: 1437212 - DNA, 17 bp, Homo sapiens
taaaagttttatatgct

SEQ ID NO: 1437213 - DNA, 13 bp, Homo sapiens
taaaataaaaatg

SEQ ID NO: 1437214 - DNA, 17 bp, Homo sapiens
taaaataaaataaaaat

SEQ ID NO: 1437215 - DNA, 17 bp, Homo sapiens
taaaataaagtatatat

SEQ ID NO: 1437216 - DNA, 16 bp, Homo sapiens
taaaataacttgcatc

SEQ ID NO: 1437217 - DNA, 16 bp, Homo sapiens
taaaataagcaggtgg

SEQ ID NO: 1437218 - DNA, 18 bp, Homo sapiens
taaaataatttctctaca

SEQ ID NO: 1437219 - DNA, 19 bp, Homo sapiens
taaaatactcaccaaaata

SEQ ID NO: 1437220 - DNA, 19 bp, Homo sapiens
taaaatagaaattttgtaa

SEQ ID NO: 1437221 - DNA, 22 bp, Homo sapiens
taaaatagaaattttgtaagaa

SEQ ID NO: 1437222 - DNA, 14 bp, Homo sapiens
taaaatagaataat

SEQ ID NO: 1437223 - DNA, 23 bp, Homo sapiens
taaaatagacctaactgaataca

SEQ ID NO: 1437224 - DNA, 21 bp, Homo sapiens
taaaatagagtgtagtttaca

SEQ ID NO: 1437225 - DNA, 15 bp, Homo sapiens
taaaatagatataaa

SEQ ID NO: 1437226 - DNA, 18 bp, Homo sapiens
taaaatagatataaattt

SEQ ID NO: 1437227 - DNA, 19 bp, Homo sapiens
taaaataggggatatttaa

SEQ ID NO: 1437228 - DNA, 18 bp, Homo sapiens
taaaatagtctctttaaa

SEQ ID NO: 1437229 - DNA, 20 bp, Homo sapiens
taaaatatcataaagcattt

SEQ ID NO: 1437230 - DNA, 14 bp, Homo sapiens
taaaatatggctat

SEQ ID NO: 1437231 - DNA, 17 bp, Homo sapiens
taaaatattcactctcc

SEQ ID NO: 1437232 - DNA, 12 bp, Homo sapiens
taaaatatttat

SEQ ID NO: 1437233 - DNA, 14 bp, Homo sapiens
taaaatatttatga

SEQ ID NO: 1437234 - DNA, 16 bp, Homo sapiens
taaaatatttatgaag

SEQ ID NO: 1437235 - DNA, 13 bp, Homo sapiens
taaaatatttatt

SEQ ID NO: 1437236 - DNA, 19 bp, Homo sapiens
taaaatcaaatgtaaatca

SEQ ID NO: 1437237 - DNA, 13 bp, Homo sapiens
taaaatcatttct

SEQ ID NO: 1437238 - DNA, 15 bp, Homo sapiens
taaaatcccaccaga

SEQ ID NO: 1437239 - DNA, 15 bp, Homo sapiens
taaaatcctgtgcaa

SEQ ID NO: 1437240 - DNA, 23 bp, Homo sapiens
taaaatctgaattttgcaatgta

SEQ ID NO: 1437241 - DNA, 18 bp, Homo sapiens
taaaatctgtaaaccata

SEQ ID NO: 1437242 - DNA, 23 bp, Homo sapiens
tacaagtggtaatttttgtacat

SEQ ID NO: 1437243 - DNA, 15 bp, Homo sapiens
tacaagttagaaaac

SEQ ID NO: 1437244 - DNA, 12 bp, Homo sapiens
tacaagtttcag

SEQ ID NO: 1437245 - DNA, 13 bp, Homo sapiens
tacaagtttcaga

SEQ ID NO: 1437246 - DNA, 13 bp, Homo sapiens
tacaataaaaaga

SEQ ID NO: 1437247 - DNA, 12 bp, Homo sapiens
tacaataaacta

SEQ ID NO: 1437248 - DNA, 19 bp, Homo sapiens
tacaataaactattggaaa

SEQ ID NO: 1437249 - DNA, 19 bp, Homo sapiens
tacaataatgtactcacat

SEQ ID NO: 1437250 - DNA, 13 bp, Homo sapiens
tacaatacaatgt

SEQ ID NO: 1437251 - DNA, 21 bp, Homo sapiens
tacaatatgtacatttctaag

SEQ ID NO: 1437252 - DNA, 14 bp, Homo sapiens
tacaatattgattg

SEQ ID NO: 1437253 - DNA, 15 bp, Homo sapiens
tacaatattgattgg

SEQ ID NO: 1437254 - DNA, 20 bp, Homo sapiens
tacaatcagcccagtgcaaa

SEQ ID NO: 1437255 - DNA, 20 bp, Homo sapiens
tacaatcatggtcaagttcc

SEQ ID NO: 1437256 - DNA, 19 bp, Homo sapiens
tacaatgaactgcttttcc

SEQ ID NO: 1437257 - DNA, 14 bp, Homo sapiens
tacaatggaataaa

SEQ ID NO: 1437258 - DNA, 14 bp, Homo sapiens
tacaatgtacaatt

SEQ ID NO: 1437259 - DNA, 17 bp, Homo sapiens
tacaatgtacaattatg

SEQ ID NO: 1437260 - DNA, 17 bp, Homo sapiens
tacaatgtatctttatt

SEQ ID NO: 1437261 - DNA, 21 bp, Homo sapiens
tacaatgtatgtaatttgttt

SEQ ID NO: 1437262 - DNA, 14 bp, Homo sapiens
tacaatgtatgtac

SEQ ID NO: 1437263 - DNA, 15 bp, Homo sapiens
tacaatgtatgtaca

SEQ ID NO: 1437264 - DNA, 17 bp, Homo sapiens
tacaatgtatttattta

SEQ ID NO: 1437265 - DNA, 21 bp, Homo sapiens
tacaattaatagtttgtctat

SEQ ID NO: 1437266 - DNA, 18 bp, Homo sapiens
tacaattactaaattgta

SEQ ID NO: 1437267 - DNA, 19 bp, Homo sapiens
tacaattactaaattgtat

SEQ ID NO: 1437268 - DNA, 15 bp, Homo sapiens
tacaattatatcagt

SEQ ID NO: 1437269 - DNA, 15 bp, Homo sapiens
tacaattatgtctct

SEQ ID NO: 1437270 - DNA, 17 bp, Homo sapiens
tacaattatgtctcttg

SEQ ID NO: 1437271 - DNA, 21 bp, Homo sapiens
tacaattcattgttttgcaaa

SEQ ID NO: 1437272 - DNA, 13 bp, Homo sapiens
tacaattgaaatg

SEQ ID NO: 1437273 - DNA, 14 bp, Homo sapiens
tacaattgaaatga

SEQ ID NO: 1437274 - DNA, 17 bp, Homo sapiens
tacaattgcactgctgt

SEQ ID NO: 1437275 - DNA, 18 bp, Homo sapiens
tacaattgcactgctgtt

SEQ ID NO: 1437276 - DNA, 16 bp, Homo sapiens
tacaattttctgtaag

SEQ ID NO: 1437277 - DNA, 19 bp, Homo sapiens
tacaatttttaataaattg

SEQ ID NO: 1437278 - DNA, 18 bp, Homo sapiens
tacacaaagaacttgctg

SEQ ID NO: 1437279 - DNA, 14 bp, Homo sapiens
tacacaagtaaaca

SEQ ID NO: 1437280 - DNA, 14 bp, Homo sapiens
tacacaatacagta

SEQ ID NO: 1437281 - DNA, 12 bp, Homo sapiens
tacacacaaaaa

SEQ ID NO: 1437282 - DNA, 22 bp, Homo sapiens
tacacacacacagacatatata

SEQ ID NO: 1437283 - DNA, 16 bp, Homo sapiens
tacacacatgccctcc

SEQ ID NO: 1437284 - DNA, 16 bp, Homo sapiens
tacacactcaaatcaa

SEQ ID NO: 1437285 - DNA, 14 bp, Homo sapiens
tacacagaaacact

SEQ ID NO: 1437286 - DNA, 15 bp, Homo sapiens
tacacagaaatgctg

SEQ ID NO: 1437287 - DNA, 17 bp, Homo sapiens
tacacagaaatgctgct

SEQ ID NO: 1437288 - DNA, 20 bp, Homo sapiens
tacacagaaatgctgctggc

SEQ ID NO: 1437289 - DNA, 23 bp, Homo sapiens
tacacagaaatgctgctggccaa

SEQ ID NO: 1437290 - DNA, 14 bp, Homo sapiens
tacacagagaaggc

SEQ ID NO: 1437291 - DNA, 19 bp, Homo sapiens
tacacagattctgccttgt

SEQ ID NO: 1437292 - DNA, 15 bp, Homo sapiens
tacacagcctggact

SEQ ID NO: 1437293 - DNA, 18 bp, Homo sapiens
tacacagtaagtcattta

SEQ ID NO: 1437294 - DNA, 19 bp, Homo sapiens
tacacagtaagtcatttaa

SEQ ID NO: 1437295 - DNA, 23 bp, Homo sapiens
tacacagtactttattgtacaga

SEQ ID NO: 1437296 - DNA, 20 bp, Homo sapiens
tacacagttctggtgttcct

SEQ ID NO: 1437297 - DNA, 22 bp, Homo sapiens
tacacataagaccgtgtcccaa

SEQ ID NO: 1437298 - DNA, 23 bp, Homo sapiens
tacacatagcatgtaatggtatc

SEQ ID NO: 1437299 - DNA, 16 bp, Homo sapiens
tacacatggagtgctt

SEQ ID NO: 1437300 - DNA, 23 bp, Homo sapiens
tacacatgtaaaatatgtaaaac

SEQ ID NO: 1437301 - DNA, 16 bp, Homo sapiens
tacacatgttgccttg

SEQ ID NO: 1437302 - DNA, 17 bp, Homo sapiens
tacacatgttgccttgc

SEQ ID NO: 1437303 - DNA, 14 bp, Homo sapiens
tacaccaatgaaaa

SEQ ID NO: 1437304 - DNA, 14 bp, Homo sapiens
tacacccaaagagg

SEQ ID NO: 1437305 - DNA, 23 bp, Homo sapiens
tacacctggctgaggttcctctg

SEQ ID NO: 1437306 - DNA, 14 bp, Homo sapiens
tacaccttgccttg

SEQ ID NO: 1437307 - DNA, 23 bp, Homo sapiens
tacacctttatctttccatggga

SEQ ID NO: 1437308 - DNA, 13 bp, Homo sapiens
tacacgtgtcctg

SEQ ID NO: 1437309 - DNA, 13 bp, Homo sapiens
tacactaaattat

SEQ ID NO: 1437310 - DNA, 14 bp, Homo sapiens
tacactaaattatt

SEQ ID NO: 1437311 - DNA, 15 bp, Homo sapiens
tacactaaattatta

SEQ ID NO: 1437312 - DNA, 21 bp, Homo sapiens
tacactaaattattagcattt

SEQ ID NO: 1437313 - DNA, 23 bp, Homo sapiens
tacactaccaaacactcagtcca

SEQ ID NO: 1437314 - DNA, 18 bp, Homo sapiens
tacactcaggctttcact

SEQ ID NO: 1437315 - DNA, 15 bp, Homo sapiens
tacactccagcctga

SEQ ID NO: 1437316 - DNA, 16 bp, Homo sapiens
tacactccagcctgag

SEQ ID NO: 1437317 - DNA, 17 bp, Homo sapiens
tacactccagcctgagc

SEQ ID NO: 1437318 - DNA, 16 bp, Homo sapiens
tacactctttgtaaga

SEQ ID NO: 1437319 - DNA, 15 bp, Homo sapiens
tacactgaaaggaaa

SEQ ID NO: 1437320 - DNA, 12 bp, Homo sapiens
tacactgaggac

SEQ ID NO: 1437321 - DNA, 12 bp, Homo sapiens
tacactgggctg

SEQ ID NO: 1437322 - DNA, 18 bp, Homo sapiens
tacactggtctaatgttt

SEQ ID NO: 1437323 - DNA, 17 bp, Homo sapiens
tacactgtatctaaaaa

SEQ ID NO: 1437324 - DNA, 15 bp, Homo sapiens
tacactgtgaactca

SEQ ID NO: 1437325 - DNA, 22 bp, Homo sapiens
tacactgtgacttaagaagcct

SEQ ID NO: 1437326 - DNA, 23 bp, Homo sapiens
tacacttataaaataacttgcat

SEQ ID NO: 1437327 - DNA, 15 bp, Homo sapiens
tacacttatttgtca

SEQ ID NO: 1437328 - DNA, 22 bp, Homo sapiens
tacactttatgccggatgtgct

SEQ ID NO: 1437329 - DNA, 14 bp, Homo sapiens
tacactttgttgca

SEQ ID NO: 1437330 - DNA, 12 bp, Homo sapiens
tacattaatgtt

SEQ ID NO: 1437331 - DNA, 23 bp, Homo sapiens
tacattaatgttaattcagcact

SEQ ID NO: 1437332 - DNA, 22 bp, Homo sapiens
tacattaattattattgctgtt

SEQ ID NO: 1437333 - DNA, 23 bp, Homo sapiens
tacattaattattattgctgttg

SEQ ID NO: 1437334 - DNA, 17 bp, Homo sapiens
tacattacactaaatta

SEQ ID NO: 1437335 - DNA, 18 bp, Homo sapiens
tacattacactaaattat

SEQ ID NO: 1437336 - DNA, 19 bp, Homo sapiens
tacattagcagtttgcttt

SEQ ID NO: 1437337 - DNA, 19 bp, Homo sapiens
tacattatttcttcccaga

SEQ ID NO: 1437338 - DNA, 14 bp, Homo sapiens
tacattcaactttt

SEQ ID NO: 1437339 - DNA, 14 bp, Homo sapiens
tacattcatcaata

SEQ ID NO: 1437340 - DNA, 15 bp, Homo sapiens
tacattccattgttt

SEQ ID NO: 1437341 - DNA, 14 bp, Homo sapiens
tacattcctcagct

SEQ ID NO: 1437342 - DNA, 17 bp, Homo sapiens
tacattcctcagctgcc

SEQ ID NO: 1437343 - DNA, 23 bp, Homo sapiens
tacattcctcagctgccaagcac

SEQ ID NO: 1437344 - DNA, 22 bp, Homo sapiens
tacattctaaagagagtgagca

SEQ ID NO: 1437345 - DNA, 22 bp, Homo sapiens
tacattctaatttgcattgtgt

SEQ ID NO: 1437346 - DNA, 15 bp, Homo sapiens
tacattctttgctag

SEQ ID NO: 1437347 - DNA, 12 bp, Homo sapiens
tacattgaaaac

SEQ ID NO: 1437348 - DNA, 19 bp, Homo sapiens
tacattgagcatttgaaag

SEQ ID NO: 1437349 - DNA, 18 bp, Homo sapiens
tacattgtaaaataaagt

SEQ ID NO: 1437350 - DNA, 19 bp, Homo sapiens
tacattgtacgaagagtat

SEQ ID NO: 1437351 - DNA, 23 bp, Homo sapiens
tacattgtacgaagagtattttt

SEQ ID NO: 1437352 - DNA, 23 bp, Homo sapiens
tacattgtcttgatgttttttct

SEQ ID NO: 1437353 - DNA, 16 bp, Homo sapiens
tacattgtgaaacttc

SEQ ID NO: 1437354 - DNA, 15 bp, Homo sapiens
tacattgtgactgtg

SEQ ID NO: 1437355 - DNA, 17 bp, Homo sapiens
tacatttaaaattgcta

SEQ ID NO: 1437356 - DNA, 11 bp, Homo sapiens
tacatttaata

SEQ ID NO: 1437357 - DNA, 17 bp, Homo sapiens
tacatttaataaaactg

SEQ ID NO: 1437358 - DNA, 13 bp, Homo sapiens
tacatttaataca

SEQ ID NO: 1437359 - DNA, 17 bp, Homo sapiens
tacatttatttatccag

SEQ ID NO: 1437360 - DNA, 21 bp, Homo sapiens
tacatttcacctactttgtaa

SEQ ID NO: 1437361 - DNA, 15 bp, Homo sapiens
tacatttcatacaac

SEQ ID NO: 1437362 - DNA, 18 bp, Homo sapiens
tacatttcatacaacaga

SEQ ID NO: 1437363 - DNA, 23 bp, Homo sapiens
tacatttctcctttgataaaata

SEQ ID NO: 1437364 - DNA, 23 bp, Homo sapiens
tacatttgagggcccagccagga

SEQ ID NO: 1437365 - DNA, 19 bp, Homo sapiens
tacatttgatgcatgtctt

SEQ ID NO: 1437366 - DNA, 23 bp, Homo sapiens
tacatttggagacacaactattt

SEQ ID NO: 1437367 - DNA, 15 bp, Homo sapiens
tacattttagtttct

SEQ ID NO: 1437368 - DNA, 19 bp, Homo sapiens
tacattttatatttttgta

SEQ ID NO: 1437369 - DNA, 21 bp, Homo sapiens
tacattttatatttttgtaca

SEQ ID NO: 1437370 - DNA, 23 bp, Homo sapiens
tacattttatatttttgtacata

SEQ ID NO: 1437371 - DNA, 13 bp, Homo sapiens
tacattttctaaa

SEQ ID NO: 1437372 - DNA, 23 bp, Homo sapiens
tacattttgaggttttgtaaaac

SEQ ID NO: 1437373 - DNA, 14 bp, Homo sapiens
tacattttgtggct

SEQ ID NO: 1437374 - DNA, 13 bp, Homo sapiens
tacattttttgaa

SEQ ID NO: 1437375 - DNA, 22 bp, Homo sapiens
tacattttttgaaatgctgaaa

SEQ ID NO: 1437376 - DNA, 11 bp, Homo sapiens
taccaaaataa

SEQ ID NO: 1437377 - DNA, 19 bp, Homo sapiens
taccaaaattcactaatct

SEQ ID NO: 1437378 - DNA, 17 bp, Homo sapiens
taccaaacaaggaagcc

SEQ ID NO: 1437379 - DNA, 21 bp, Homo sapiens
taccaaacaaggaagccaaag

SEQ ID NO: 1437380 - DNA, 13 bp, Homo sapiens
taccaaacactca

SEQ ID NO: 1437381 - DNA, 17 bp, Homo sapiens
taccaaacattacaaaa

SEQ ID NO: 1437382 - DNA, 18 bp, Homo sapiens
taccaaaccgccagcgaa

SEQ ID NO: 1437383 - DNA, 21 bp, Homo sapiens
taccaaagtgtcttttgacat

SEQ ID NO: 1437384 - DNA, 22 bp, Homo sapiens
taccaaagtgtcttttgacatt

SEQ ID NO: 1437385 - DNA, 16 bp, Homo sapiens
taccaacacgagcagg

SEQ ID NO: 1437386 - DNA, 21 bp, Homo sapiens
taccaaggtacaactgtattt

SEQ ID NO: 1437387 - DNA, 16 bp, Homo sapiens
taccaagttttattgt

SEQ ID NO: 1437388 - DNA, 14 bp, Homo sapiens
taccaataaagtga

SEQ ID NO: 1437389 - DNA, 16 bp, Homo sapiens
taccaatagcctgaat

SEQ ID NO: 1437390 - DNA, 20 bp, Homo sapiens
taccaattacccataaacag

SEQ ID NO: 1437391 - DNA, 19 bp, Homo sapiens
taccacaaaccctgctgaa

SEQ ID NO: 1437392 - DNA, 20 bp, Homo sapiens
taccacaaaccctgctgaac

SEQ ID NO: 1437393 - DNA, 21 bp, Homo sapiens
taccacaaaccctgctgaaca

SEQ ID NO: 1437394 - DNA, 12 bp, Homo sapiens
taccacaagcct

SEQ ID NO: 1437395 - DNA, 17 bp, Homo sapiens
taccacaagcctgagaa

SEQ ID NO: 1437396 - DNA, 18 bp, Homo sapiens
taccacaagcctgagaac

SEQ ID NO: 1437397 - DNA, 19 bp, Homo sapiens
taccacagacttgcactga

SEQ ID NO: 1437398 - DNA, 17 bp, Homo sapiens
taccacctaatgtttat

SEQ ID NO: 1437399 - DNA, 21 bp, Homo sapiens
taccacctaatgtttatagga

SEQ ID NO: 1437400 - DNA, 16 bp, Homo sapiens
taccactatttaagtt

SEQ ID NO: 1437401 - DNA, 14 bp, Homo sapiens
taccactcaggcca

SEQ ID NO: 1437402 - DNA, 19 bp, Homo sapiens
taccactcttttgctgtgc

SEQ ID NO: 1437403 - DNA, 16 bp, Homo sapiens
taccacttcctgaggc

SEQ ID NO: 1437404 - DNA, 13 bp, Homo sapiens
taccagaaagctc

SEQ ID NO: 1437405 - DNA, 23 bp, Homo sapiens
taccagacggttcaccagcctct

SEQ ID NO: 1437406 - DNA, 18 bp, Homo sapiens
taccagagccttcaagtg

SEQ ID NO: 1437407 - DNA, 21 bp, Homo sapiens
taccagagccttcaagtgcca

SEQ ID NO: 1437408 - DNA, 20 bp, Homo sapiens
taccagagctctatccccat

SEQ ID NO: 1437409 - DNA, 22 bp, Homo sapiens
taccagaggaagttatggcagt

SEQ ID NO: 1437410 - DNA, 12 bp, Homo sapiens
taccagccagcc

SEQ ID NO: 1437411 - DNA, 19 bp, Homo sapiens
taccagcgcccgctgggct

SEQ ID NO: 1437412 - DNA, 14 bp, Homo sapiens
taccagctcccagg

SEQ ID NO: 1437413 - DNA, 21 bp, Homo sapiens
taccagctgcgcttgcttttc

SEQ ID NO: 1437414 - DNA, 16 bp, Homo sapiens
taccagcttaaaacac

SEQ ID NO: 1437415 - DNA, 19 bp, Homo sapiens
taccagcttaatagctgta

SEQ ID NO: 1437416 - DNA, 15 bp, Homo sapiens
taccaggatgctaaa

SEQ ID NO: 1437417 - DNA, 14 bp, Homo sapiens
taccaggcaacctc

SEQ ID NO: 1437418 - DNA, 20 bp, Homo sapiens
taccagggactatctttgct

SEQ ID NO: 1437419 - DNA, 15 bp, Homo sapiens
taccagtatttagaa

SEQ ID NO: 1437420 - DNA, 18 bp, Homo sapiens
taccagtatttagaagcc

SEQ ID NO: 1437421 - DNA, 19 bp, Homo sapiens
taccagtatttagaagcca

SEQ ID NO: 1437422 - DNA, 15 bp, Homo sapiens
taccagtctatttcc

SEQ ID NO: 1437423 - DNA, 18 bp, Homo sapiens
taccagtgagtggcccca

SEQ ID NO: 1437424 - DNA, 23 bp, Homo sapiens
taccagtggtgctcaatgcaaat

SEQ ID NO: 1437425 - DNA, 18 bp, Homo sapiens
taccagttaatttttcca

SEQ ID NO: 1437426 - DNA, 16 bp, Homo sapiens
taccagttgcctttta

SEQ ID NO: 1437427 - DNA, 15 bp, Homo sapiens
taccagttgttcatt

SEQ ID NO: 1437428 - DNA, 22 bp, Homo sapiens
taccataacaccgtcccagggc

SEQ ID NO: 1437429 - DNA, 15 bp, Homo sapiens
taccatcaataaagt

SEQ ID NO: 1437430 - DNA, 16 bp, Homo sapiens
taccatcaataaagta

SEQ ID NO: 1437431 - DNA, 22 bp, Homo sapiens
taccatctgtcttgccagccag

SEQ ID NO: 1437432 - DNA, 15 bp, Homo sapiens
taccatgaaacaaag

SEQ ID NO: 1437433 - DNA, 20 bp, Homo sapiens
taccatgagaagagggcctg

SEQ ID NO: 1437434 - DNA, 16 bp, Homo sapiens
taccatgccatttaaa

SEQ ID NO: 1437435 - DNA, 13 bp, Homo sapiens
taccatgctgctt

SEQ ID NO: 1437436 - DNA, 16 bp, Homo sapiens
taccattaaaactgct

SEQ ID NO: 1437437 - DNA, 18 bp, Homo sapiens
taccattaaaactgcttt

SEQ ID NO: 1437438 - DNA, 13 bp, Homo sapiens
taccattcagatc

SEQ ID NO: 1437439 - DNA, 15 bp, Homo sapiens
taccattgtcactcg

SEQ ID NO: 1437440 - DNA, 18 bp, Homo sapiens
taccatttagtaagaata

SEQ ID NO: 1437441 - DNA, 20 bp, Homo sapiens
taccatttgtaataaagtat

SEQ ID NO: 1437442 - DNA, 22 bp, Homo sapiens
taccatttgtaataaagtatat

SEQ ID NO: 1437443 - DNA, 21 bp, Homo sapiens
taccattttttaaggaaacaa

SEQ ID NO: 1437444 - DNA, 14 bp, Homo sapiens
tacccaaactgctt

SEQ ID NO: 1437445 - DNA, 14 bp, Homo sapiens
tacccaaccctgcc

SEQ ID NO: 1437446 - DNA, 12 bp, Homo sapiens
taaatgtttctt

SEQ ID NO: 1437447 - DNA, 18 bp, Homo sapiens
taaatgtttcttttccct

SEQ ID NO: 1437448 - DNA, 17 bp, Homo sapiens
taaattaaacatttttc

SEQ ID NO: 1437449 - DNA, 19 bp, Homo sapiens
taaattaatacttcatttg

SEQ ID NO: 1437450 - DNA, 19 bp, Homo sapiens
taaattacaattgtcattt

SEQ ID NO: 1437451 - DNA, 17 bp, Homo sapiens
taaattacaattttatc

SEQ ID NO: 1437452 - DNA, 23 bp, Homo sapiens
taaattacaattttatctgtttc

SEQ ID NO: 1437453 - DNA, 19 bp, Homo sapiens
taaattactatctgttgaa

SEQ ID NO: 1437454 - DNA, 20 bp, Homo sapiens
taaattactatctgttgaaa

SEQ ID NO: 1437455 - DNA, 22 bp, Homo sapiens
taaattactgttttgccaagaa

SEQ ID NO: 1437456 - DNA, 19 bp, Homo sapiens
taaattagaatgaatttat

SEQ ID NO: 1437457 - DNA, 23 bp, Homo sapiens
taaattagatttggcatctcctg

SEQ ID NO: 1437458 - DNA, 19 bp, Homo sapiens
taaattagctatttctgct

SEQ ID NO: 1437459 - DNA, 20 bp, Homo sapiens
taaattagctatttctgctc

SEQ ID NO: 1437460 - DNA, 22 bp, Homo sapiens
taaattaggaataaataaaaat

SEQ ID NO: 1437461 - DNA, 17 bp, Homo sapiens
taaattataacttaaaa

SEQ ID NO: 1437462 - DNA, 22 bp, Homo sapiens
taaattataacttaaaatattt

SEQ ID NO: 1437463 - DNA, 17 bp, Homo sapiens
taaattatggcatttct

SEQ ID NO: 1437464 - DNA, 19 bp, Homo sapiens
taaattatggcatttctat

SEQ ID NO: 1437465 - DNA, 18 bp, Homo sapiens
taaattatgtaatgcaaa

SEQ ID NO: 1437466 - DNA, 23 bp, Homo sapiens
taaattattagagattttctctt

SEQ ID NO: 1437467 - DNA, 20 bp, Homo sapiens
taaattattagcatttgttt

SEQ ID NO: 1437468 - DNA, 22 bp, Homo sapiens
taaattattagcatttgtttta

SEQ ID NO: 1437469 - DNA, 11 bp, Homo sapiens
taaattatttt

SEQ ID NO: 1437470 - DNA, 21 bp, Homo sapiens
taaattcaacacttattttct

SEQ ID NO: 1437471 - DNA, 23 bp, Homo sapiens
taaattcaacacttattttctga

SEQ ID NO: 1437472 - DNA, 23 bp, Homo sapiens
taaattcaaccactgtaaaatga

SEQ ID NO: 1437473 - DNA, 19 bp, Homo sapiens
taaattcaactttgtaaaa

SEQ ID NO: 1437474 - DNA, 19 bp, Homo sapiens
taaattcaataaaaacctt

SEQ ID NO: 1437475 - DNA, 22 bp, Homo sapiens
taaattcacctagtctaaggat

SEQ ID NO: 1437476 - DNA, 12 bp, Homo sapiens
taaattcagaca

SEQ ID NO: 1437477 - DNA, 16 bp, Homo sapiens
taaattcagacaacat

SEQ ID NO: 1437478 - DNA, 19 bp, Homo sapiens
taaattcagacaacattat

SEQ ID NO: 1437479 - DNA, 22 bp, Homo sapiens
taaattcagacaacattatgat

SEQ ID NO: 1437480 - DNA, 18 bp, Homo sapiens
taaattcagatatatttt

SEQ ID NO: 1437481 - DNA, 18 bp, Homo sapiens
taaattcagtcctaagaa

SEQ ID NO: 1437482 - DNA, 15 bp, Homo sapiens
taaattcatttctag

SEQ ID NO: 1437483 - DNA, 13 bp, Homo sapiens
taaattccactgg

SEQ ID NO: 1437484 - DNA, 17 bp, Homo sapiens
taaattctgagcctgat

SEQ ID NO: 1437485 - DNA, 21 bp, Homo sapiens
taaattgaataggtagtatca

SEQ ID NO: 1437486 - DNA, 19 bp, Homo sapiens
taacattgaccaagaactg

SEQ ID NO: 1437487 - DNA, 14 bp, Homo sapiens
taacattgacttct

SEQ ID NO: 1437488 - DNA, 13 bp, Homo sapiens
taacattggtgaa

SEQ ID NO: 1437489 - DNA, 16 bp, Homo sapiens
taacatttctgttctc

SEQ ID NO: 1437490 - DNA, 17 bp, Homo sapiens
taacatttgctgtttta

SEQ ID NO: 1437491 - DNA, 17 bp, Homo sapiens
taaccaatgccttttta

SEQ ID NO: 1437492 - DNA, 19 bp, Homo sapiens
taaccacaaagcacagttt

SEQ ID NO: 1437493 - DNA, 18 bp, Homo sapiens
taaccagccacagtacat

SEQ ID NO: 1437494 - DNA, 21 bp, Homo sapiens
taaccagccacagtacatatg

SEQ ID NO: 1437495 - DNA, 23 bp, Homo sapiens
taaccagccacagtacatatgta

SEQ ID NO: 1437496 - DNA, 15 bp, Homo sapiens
taaccagtgtacagg

SEQ ID NO: 1437497 - DNA, 17 bp, Homo sapiens
taaccatcactggttgc

SEQ ID NO: 1437498 - DNA, 16 bp, Homo sapiens
taaccattttaaccta

SEQ ID NO: 1437499 - DNA, 21 bp, Homo sapiens
taacccacctctcctgccctg

SEQ ID NO: 1437500 - DNA, 19 bp, Homo sapiens
taacccaggcctgtctgac

SEQ ID NO: 1437501 - DNA, 13 bp, Homo sapiens
taaccccagctcc

SEQ ID NO: 1437502 - DNA, 19 bp, Homo sapiens
taacccccttaaatttaat

SEQ ID NO: 1437503 - DNA, 16 bp, Homo sapiens
taaccccttacccatc

SEQ ID NO: 1437504 - DNA, 18 bp, Homo sapiens
taaccctgtgctgtcaga

SEQ ID NO: 1437505 - DNA, 20 bp, Homo sapiens
taacccttcatcttcctgtg

SEQ ID NO: 1437506 - DNA, 21 bp, Homo sapiens
taacccttcatcttcctgtgt

SEQ ID NO: 1437507 - DNA, 20 bp, Homo sapiens
taaccctttggtttttttct

SEQ ID NO: 1437508 - DNA, 20 bp, Homo sapiens
taaccgtcctcgagcaactg

SEQ ID NO: 1437509 - DNA, 13 bp, Homo sapiens
taacctagttaaa

SEQ ID NO: 1437510 - DNA, 20 bp, Homo sapiens
taacctcagtgtcatttatg

SEQ ID NO: 1437511 - DNA, 16 bp, Homo sapiens
taacctcgggcctgct

SEQ ID NO: 1437512 - DNA, 17 bp, Homo sapiens
taacctcttttctgcat

SEQ ID NO: 1437513 - DNA, 18 bp, Homo sapiens
taacctgggcattgttga

SEQ ID NO: 1437514 - DNA, 19 bp, Homo sapiens
taacctgtacttcaagtta

SEQ ID NO: 1437515 - DNA, 20 bp, Homo sapiens
taaccttaaaattgatatta

SEQ ID NO: 1437516 - DNA, 19 bp, Homo sapiens
taaccttgaatgctgccag

SEQ ID NO: 1437517 - DNA, 14 bp, Homo sapiens
taacgcaaccaagt

SEQ ID NO: 1437518 - DNA, 17 bp, Homo sapiens
taacgcgtcttcctgag

SEQ ID NO: 1437519 - DNA, 13 bp, Homo sapiens
taacggctccagg

SEQ ID NO: 1437520 - DNA, 16 bp, Homo sapiens
taacgtcatctcaggg

SEQ ID NO: 1437521 - DNA, 14 bp, Homo sapiens
taactaaaaggtat

SEQ ID NO: 1437522 - DNA, 13 bp, Homo sapiens
taactaaaattaa

SEQ ID NO: 1437523 - DNA, 19 bp, Homo sapiens
taactaagatatagaaact

SEQ ID NO: 1437524 - DNA, 15 bp, Homo sapiens
taactaatttgtggt

SEQ ID NO: 1437525 - DNA, 17 bp, Homo sapiens
taactacaaaaggcaat

SEQ ID NO: 1437526 - DNA, 21 bp, Homo sapiens
taactacaaagctttgctaca

SEQ ID NO: 1437527 - DNA, 14 bp, Homo sapiens
taactacctcctca

SEQ ID NO: 1437528 - DNA, 15 bp, Homo sapiens
taactacctcctcac

SEQ ID NO: 1437529 - DNA, 14 bp, Homo sapiens
taactactaagaat

SEQ ID NO: 1437530 - DNA, 15 bp, Homo sapiens
taactactaagaata

SEQ ID NO: 1437531 - DNA, 17 bp, Homo sapiens
taactactttataacta

SEQ ID NO: 1437532 - DNA, 21 bp, Homo sapiens
taactagaattagtatgtctg

SEQ ID NO: 1437533 - DNA, 22 bp, Homo sapiens
taactagaattagtatgtctgt

SEQ ID NO: 1437534 - DNA, 23 bp, Homo sapiens
taactagaattagtatgtctgtt

SEQ ID NO: 1437535 - DNA, 18 bp, Homo sapiens
taactagaatttattcaa

SEQ ID NO: 1437536 - DNA, 17 bp, Homo sapiens
taactagacaccaaagt

SEQ ID NO: 1437537 - DNA, 21 bp, Homo sapiens
taactagacaccaaagttcta

SEQ ID NO: 1437538 - DNA, 15 bp, Homo sapiens
taactataaggtgcc

SEQ ID NO: 1437539 - DNA, 16 bp, Homo sapiens
taactatcgaaatgac

SEQ ID NO: 1437540 - DNA, 13 bp, Homo sapiens
taactatttttgt

SEQ ID NO: 1437541 - DNA, 18 bp, Homo sapiens
taactcaaatacacattt

SEQ ID NO: 1437542 - DNA, 22 bp, Homo sapiens
taactcaaggataccttcttat

SEQ ID NO: 1437543 - DNA, 15 bp, Homo sapiens
taactcaccagcccc

SEQ ID NO: 1437544 - DNA, 16 bp, Homo sapiens
taactcaccagcccca

SEQ ID NO: 1437545 - DNA, 21 bp, Homo sapiens
taactcaccagccccactgcc

SEQ ID NO: 1437546 - DNA, 13 bp, Homo sapiens
taactcactgcct

SEQ ID NO: 1437547 - DNA, 22 bp, Homo sapiens
taactcagaaacatcagttact

SEQ ID NO: 1437548 - DNA, 16 bp, Homo sapiens
taactcataatttttg

SEQ ID NO: 1437549 - DNA, 14 bp, Homo sapiens
taactcatcataaa

SEQ ID NO: 1437550 - DNA, 16 bp, Homo sapiens
taactcatcataaaat

SEQ ID NO: 1437551 - DNA, 14 bp, Homo sapiens
taactcatctgtta

SEQ ID NO: 1437552 - DNA, 20 bp, Homo sapiens
taactcatttgttaaaatta

SEQ ID NO: 1437553 - DNA, 11 bp, Homo sapiens
taactccacca

SEQ ID NO: 1437554 - DNA, 19 bp, Homo sapiens
taactccagatagagaaat

SEQ ID NO: 1437555 - DNA, 17 bp, Homo sapiens
taactccctccaccagc

SEQ ID NO: 1437556 - DNA, 17 bp, Homo sapiens
taactctaaaagatcct

SEQ ID NO: 1437557 - DNA, 15 bp, Homo sapiens
taactctctttcctt

SEQ ID NO: 1437558 - DNA, 22 bp, Homo sapiens
taactctctttccttgagctgt

SEQ ID NO: 1437559 - DNA, 19 bp, Homo sapiens
taactcttagaagtgttgt

SEQ ID NO: 1437560 - DNA, 21 bp, Homo sapiens
taactcttagaagtgttgtaa

SEQ ID NO: 1437561 - DNA, 14 bp, Homo sapiens
taactcttgtctat

SEQ ID NO: 1437562 - DNA, 18 bp, Homo sapiens
taactcttgttttctggt

SEQ ID NO: 1437563 - DNA, 16 bp, Homo sapiens
taactgaaggagaagg

SEQ ID NO: 1437564 - DNA, 18 bp, Homo sapiens
taactgaatacagtctca

SEQ ID NO: 1437565 - DNA, 22 bp, Homo sapiens
taactgactattcttgatgtaa

SEQ ID NO: 1437566 - DNA, 16 bp, Homo sapiens
taactgagttatattg

SEQ ID NO: 1437567 - DNA, 16 bp, Homo sapiens
taactgatgaaggatt

SEQ ID NO: 1437568 - DNA, 21 bp, Homo sapiens
taacttgctgaatttcaggca

SEQ ID NO: 1437569 - DNA, 15 bp, Homo sapiens
taacttggctttcat

SEQ ID NO: 1437570 - DNA, 17 bp, Homo sapiens
taacttggtcagagcca

SEQ ID NO: 1437571 - DNA, 16 bp, Homo sapiens
taacttgtctaaataa

SEQ ID NO: 1437572 - DNA, 15 bp, Homo sapiens
taactttaaatcttt

SEQ ID NO: 1437573 - DNA, 22 bp, Homo sapiens
taactttaaatcttttcttcaa

SEQ ID NO: 1437574 - DNA, 16 bp, Homo sapiens
taactttaatgttttt

SEQ ID NO: 1437575 - DNA, 17 bp, Homo sapiens
taactttataaatccag

SEQ ID NO: 1437576 - DNA, 15 bp, Homo sapiens
taactttatgtgtaa

SEQ ID NO: 1437577 - DNA, 17 bp, Homo sapiens
taactttcataccactt

SEQ ID NO: 1437578 - DNA, 13 bp, Homo sapiens
taactttctttac

SEQ ID NO: 1437579 - DNA, 20 bp, Homo sapiens
taacttttcaatgacatttt

SEQ ID NO: 1437580 - DNA, 18 bp, Homo sapiens
taacttttgtaagacaaa

SEQ ID NO: 1437581 - DNA, 16 bp, Homo sapiens
taacttttttgtgtat

SEQ ID NO: 1437582 - DNA, 20 bp, Homo sapiens
taacttttttttctctcttt

SEQ ID NO: 1437583 - DNA, 22 bp, Homo sapiens
taacttttttttctctcttttg

SEQ ID NO: 1437584 - DNA, 14 bp, Homo sapiens
taagaaaaaaaatg

SEQ ID NO: 1437585 - DNA, 20 bp, Homo sapiens
taagaaaaaataacacacat

SEQ ID NO: 1437586 - DNA, 15 bp, Homo sapiens
taagaaaaacatgtc

SEQ ID NO: 1437587 - DNA, 17 bp, Homo sapiens
taagaaaaacatgtcat

SEQ ID NO: 1437588 - DNA, 20 bp, Homo sapiens
taagaaaaacttttttggtt

SEQ ID NO: 1437589 - DNA, 14 bp, Homo sapiens
taagaaaaatcatg

SEQ ID NO: 1437590 - DNA, 22 bp, Homo sapiens
taagaaaagcctgaactattta

SEQ ID NO: 1437591 - DNA, 15 bp, Homo sapiens
taagaaaataaatgt

SEQ ID NO: 1437592 - DNA, 21 bp, Homo sapiens
taagaaaatatattctttcaa

SEQ ID NO: 1437593 - DNA, 23 bp, Homo sapiens
taagaaaatatattctttcaaag

SEQ ID NO: 1437594 - DNA, 23 bp, Homo sapiens
taagaaaatgttacggcatcaca

SEQ ID NO: 1437595 - DNA, 24 bp, Homo sapiens
taagaaacttatttctcatatcaa

SEQ ID NO: 1437596 - DNA, 20 bp, Homo sapiens
taagaaagcacttaaacaga

SEQ ID NO: 1437597 - DNA, 22 bp, Homo sapiens
taagaaaggaagcattgtaaaa

SEQ ID NO: 1437598 - DNA, 18 bp, Homo sapiens
taagaaagtgaagcaaat

SEQ ID NO: 1437599 - DNA, 13 bp, Homo sapiens
taagaaatagaat

SEQ ID NO: 1437600 - DNA, 18 bp, Homo sapiens
taagaacaaaagcgaccc

SEQ ID NO: 1437601 - DNA, 17 bp, Homo sapiens
taagaacataaggcagg

SEQ ID NO: 1437602 - DNA, 21 bp, Homo sapiens
taagaactacaaacaaaattt

SEQ ID NO: 1437603 - DNA, 15 bp, Homo sapiens
taagaactgtacatt

SEQ ID NO: 1437604 - DNA, 21 bp, Homo sapiens
taagaactgtacattgtgagc

SEQ ID NO: 1437605 - DNA, 22 bp, Homo sapiens
taagaagaaaattgctgtgcct

SEQ ID NO: 1437606 - DNA, 13 bp, Homo sapiens
taagaagaaagca

SEQ ID NO: 1437607 - DNA, 14 bp, Homo sapiens
taagaagacatgaa

SEQ ID NO: 1437608 - DNA, 13 bp, Homo sapiens
taagaagacattt

SEQ ID NO: 1437609 - DNA, 14 bp, Homo sapiens
taagaagacatttt

SEQ ID NO: 1437610 - DNA, 17 bp, Homo sapiens
taagaagaggagcctca

SEQ ID NO: 1437611 - DNA, 22 bp, Homo sapiens
taagaagcaatctttgaaataa

SEQ ID NO: 1437612 - DNA, 23 bp, Homo sapiens
taagaagccttaatttgcacagt

SEQ ID NO: 1437613 - DNA, 11 bp, Homo sapiens
taagaagctct

SEQ ID NO: 1437614 - DNA, 22 bp, Homo sapiens
taagaagtttgttatagattta

SEQ ID NO: 1437615 - DNA, 22 bp, Homo sapiens
taagaataccacatcaaataag

SEQ ID NO: 1437616 - DNA, 19 bp, Homo sapiens
taagaatatctgtaatggt

SEQ ID NO: 1437617 - DNA, 16 bp, Homo sapiens
taagaatgaagttctg

SEQ ID NO: 1437618 - DNA, 20 bp, Homo sapiens
taagaatgagtttcttagac

SEQ ID NO: 1437619 - DNA, 22 bp, Homo sapiens
taagaatgctggttttcctaaa

SEQ ID NO: 1437620 - DNA, 23 bp, Homo sapiens
taagaatgctggttttcctaaat

SEQ ID NO: 1437621 - DNA, 20 bp, Homo sapiens
taagaattgtttttgaattt

SEQ ID NO: 1437622 - DNA, 13 bp, Homo sapiens
taagaatttctgc

SEQ ID NO: 1437623 - DNA, 14 bp, Homo sapiens
taagaattttgctt

SEQ ID NO: 1437624 - DNA, 13 bp, Homo sapiens
taagacaaacact

SEQ ID NO: 1437625 - DNA, 16 bp, Homo sapiens
taagacaaacactgcc

SEQ ID NO: 1437626 - DNA, 18 bp, Homo sapiens
taagacaaacactgccat

SEQ ID NO: 1437627 - DNA, 13 bp, Homo sapiens
taagacaaatggg

SEQ ID NO: 1437628 - DNA, 21 bp, Homo sapiens
taagacaaatgggactgatgt

SEQ ID NO: 1437629 - DNA, 20 bp, Homo sapiens
taagacaagagatctacaca

SEQ ID NO: 1437630 - DNA, 17 bp, Homo sapiens
taagacagagtatcctg

SEQ ID NO: 1437631 - DNA, 18 bp, Homo sapiens
taagacagtgccctgaga

SEQ ID NO: 1437632 - DNA, 14 bp, Homo sapiens
taagacagtgtaca

SEQ ID NO: 1437633 - DNA, 18 bp, Homo sapiens
taagacagtgtacaaaac

SEQ ID NO: 1437634 - DNA, 23 bp, Homo sapiens
taagacagtgtacaaaactgtaa

SEQ ID NO: 1437635 - DNA, 20 bp, Homo sapiens
taagacatgtgaggaggaaa

SEQ ID NO: 1437636 - DNA, 21 bp, Homo sapiens
taagacatgtgaggaggaaaa

SEQ ID NO: 1437637 - DNA, 13 bp, Homo sapiens
taagacatttgta

SEQ ID NO: 1437638 - DNA, 13 bp, Homo sapiens
taagaccagcctg

SEQ ID NO: 1437639 - DNA, 15 bp, Homo sapiens
taagaccccatctct

SEQ ID NO: 1437640 - DNA, 19 bp, Homo sapiens
taagaccctgtgtcctcca

SEQ ID NO: 1437641 - DNA, 14 bp, Homo sapiens
taagacctactgtt

SEQ ID NO: 1437642 - DNA, 16 bp, Homo sapiens
taagacctactgttct

SEQ ID NO: 1437643 - DNA, 11 bp, Homo sapiens
taagacctggc

SEQ ID NO: 1437644 - DNA, 17 bp, Homo sapiens
taagacctggcagctct

SEQ ID NO: 1437645 - DNA, 18 bp, Homo sapiens
taagacctggcagctctg

SEQ ID NO: 1437646 - DNA, 20 bp, Homo sapiens
taagactatatatataaatg

SEQ ID NO: 1437647 - DNA, 23 bp, Homo sapiens
taagactatatatataaatgtat

SEQ ID NO: 1437648 - DNA, 18 bp, Homo sapiens
taagagaaaagagagaaa

SEQ ID NO: 1437649 - DNA, 16 bp, Homo sapiens
taagagaaaatattac

SEQ ID NO: 1437650 - DNA, 18 bp, Homo sapiens
taagagaagtctcattcg

SEQ ID NO: 1437651 - DNA, 14 bp, Homo sapiens
taagagaagtgagt

SEQ ID NO: 1437652 - DNA, 15 bp, Homo sapiens
taagagaagttgtaa

SEQ ID NO: 1437653 - DNA, 15 bp, Homo sapiens
taagagaatgttcct

SEQ ID NO: 1437654 - DNA, 21 bp, Homo sapiens
taagagaattatatatttcta

SEQ ID NO: 1437655 - DNA, 17 bp, Homo sapiens
taagagcagagtctccc

SEQ ID NO: 1437656 - DNA, 18 bp, Homo sapiens
taagaggagcagagggca

SEQ ID NO: 1437657 - DNA, 21 bp, Homo sapiens
taagaggagtaggccctggtt

SEQ ID NO: 1437658 - DNA, 17 bp, Homo sapiens
taagagggcatatacag

SEQ ID NO: 1437659 - DNA, 20 bp, Homo sapiens
taagagtgagctctggtgga

SEQ ID NO: 1437660 - DNA, 14 bp, Homo sapiens
taagagtgctgggc

SEQ ID NO: 1437661 - DNA, 16 bp, Homo sapiens
taagagtggaggagga

SEQ ID NO: 1437662 - DNA, 22 bp, Homo sapiens
taagagttgctttgccagagca

SEQ ID NO: 1437663 - DNA, 17 bp, Homo sapiens
taagataaatgtgctga

SEQ ID NO: 1437664 - DNA, 18 bp, Homo sapiens
taagataacttactgtat

SEQ ID NO: 1437665 - DNA, 14 bp, Homo sapiens
taagataataatat

SEQ ID NO: 1437666 - DNA, 22 bp, Homo sapiens
taagataataatatatgtttac

SEQ ID NO: 1437667 - DNA, 14 bp, Homo sapiens
taagatagaacaca

SEQ ID NO: 1437668 - DNA, 20 bp, Homo sapiens
taagatagtgtaacttgctt

SEQ ID NO: 1437669 - DNA, 16 bp, Homo sapiens
taagatatccatcttt

SEQ ID NO: 1437670 - DNA, 17 bp, Homo sapiens
taagatctatgggaaga

SEQ ID NO: 1437671 - DNA, 14 bp, Homo sapiens
taagatctgactgc

SEQ ID NO: 1437672 - DNA, 21 bp, Homo sapiens
taagatgagatttgccagcac

SEQ ID NO: 1437673 - DNA, 19 bp, Homo sapiens
taagatgatcatctaattt

SEQ ID NO: 1437674 - DNA, 23 bp, Homo sapiens
taagatggctgtggcatttccaa

SEQ ID NO: 1437675 - DNA, 12 bp, Homo sapiens
taagatgtgaaa

SEQ ID NO: 1437676 - DNA, 13 bp, Homo sapiens
taagatgtgaaaa

SEQ ID NO: 1437677 - DNA, 14 bp, Homo sapiens
taagatgtgatatt

SEQ ID NO: 1437678 - DNA, 19 bp, Homo sapiens
taagatgtgatattctaag

SEQ ID NO: 1437679 - DNA, 17 bp, Homo sapiens
taagatgttcactgtgg

SEQ ID NO: 1437680 - DNA, 17 bp, Homo sapiens
taagattaaaggaagga

SEQ ID NO: 1437681 - DNA, 12 bp, Homo sapiens
taagattctaac

SEQ ID NO: 1437682 - DNA, 13 bp, Homo sapiens
taagattctaacg

SEQ ID NO: 1437683 - DNA, 17 bp, Homo sapiens
taagattctaacggtct

SEQ ID NO: 1437684 - DNA, 13 bp, Homo sapiens
taagattctaatg

SEQ ID NO: 1437685 - DNA, 11 bp, Homo sapiens
taagattctag

SEQ ID NO: 1437686 - DNA, 21 bp, Homo sapiens
taagattctagatcagatgct

SEQ ID NO: 1437687 - DNA, 13 bp, Homo sapiens
taagattctgatt

SEQ ID NO: 1437688 - DNA, 17 bp, Homo sapiens
taagattctgattttag

SEQ ID NO: 1437689 - DNA, 22 bp, Homo sapiens
taagattgatatctataaaata

SEQ ID NO: 1437690 - DNA, 14 bp, Homo sapiens
taagattggaaatg

SEQ ID NO: 1437691 - DNA, 19 bp, Homo sapiens
taagcaaaggggacagctg

SEQ ID NO: 1437692 - DNA, 14 bp, Homo sapiens
taagcaaatgttaa

SEQ ID NO: 1437693 - DNA, 23 bp, Homo sapiens
taagcaacatctagcaaatgtta

SEQ ID NO: 1437694 - DNA, 14 bp, Homo sapiens
taagcaagaatgca

SEQ ID NO: 1437695 - DNA, 23 bp, Homo sapiens
taagcaagaatgcagtacagaat

SEQ ID NO: 1437696 - DNA, 20 bp, Homo sapiens
taagcaaggtgtccctgcct

SEQ ID NO: 1437697 - DNA, 21 bp, Homo sapiens
taagcaaggtgtccctgcctt

SEQ ID NO: 1437698 - DNA, 22 bp, Homo sapiens
taagcacacacatctggccctg

SEQ ID NO: 1437699 - DNA, 15 bp, Homo sapiens
taagcagaaatcctg

SEQ ID NO: 1437700 - DNA, 16 bp, Homo sapiens
taagcagaacaaatgt

SEQ ID NO: 1437701 - DNA, 17 bp, Homo sapiens
taagcagaacactgcag

SEQ ID NO: 1437702 - DNA, 12 bp, Homo sapiens
taagcagcaaca

SEQ ID NO: 1437703 - DNA, 16 bp, Homo sapiens
taagcagcatggaaaa

SEQ ID NO: 1437704 - DNA, 17 bp, Homo sapiens
taagcagcatggaaaaa

SEQ ID NO: 1437705 - DNA, 18 bp, Homo sapiens
taagcagcatggaaaaat

SEQ ID NO: 1437706 - DNA, 21 bp, Homo sapiens
taagcaggtggatctatttca

SEQ ID NO: 1437707 - DNA, 22 bp, Homo sapiens
taagcaggtggatctatttcat

SEQ ID NO: 1437708 - DNA, 22 bp, Homo sapiens
taagcaggtttgttttcagcac

SEQ ID NO: 1437709 - DNA, 21 bp, Homo sapiens
taagcagtatattagtattat

SEQ ID NO: 1437710 - DNA, 20 bp, Homo sapiens
taagcagttttgtaaatgta

SEQ ID NO: 1437711 - DNA, 22 bp, Homo sapiens
taagcagttttgtaaatgtact

SEQ ID NO: 1437712 - DNA, 18 bp, Homo sapiens
taagcatactttgtaaat

SEQ ID NO: 1437713 - DNA, 19 bp, Homo sapiens
taagcatactttgtaaata

SEQ ID NO: 1437714 - DNA, 16 bp, Homo sapiens
taagcatggcctggac

SEQ ID NO: 1437715 - DNA, 15 bp, Homo sapiens
taagcattactttat

SEQ ID NO: 1437716 - DNA, 19 bp, Homo sapiens
taagcattttgaaacaaag

SEQ ID NO: 1437717 - DNA, 20 bp, Homo sapiens
taagcattttgaaacaaagt

SEQ ID NO: 1437718 - DNA, 16 bp, Homo sapiens
taagccaaagaaacaa

SEQ ID NO: 1437719 - DNA, 17 bp, Homo sapiens
taagccaaagaaacaag

SEQ ID NO: 1437720 - DNA, 13 bp, Homo sapiens
taagccagagcct

SEQ ID NO: 1437721 - DNA, 17 bp, Homo sapiens
taagccagttcacttag

SEQ ID NO: 1437722 - DNA, 16 bp, Homo sapiens
taagccatcagaagtt

SEQ ID NO: 1437723 - DNA, 16 bp, Homo sapiens
taagcccccagggcct

SEQ ID NO: 1437724 - DNA, 21 bp, Homo sapiens
taagcccccagggcctccagg

SEQ ID NO: 1437725 - DNA, 18 bp, Homo sapiens
taagccctcgaaccaagg

SEQ ID NO: 1437726 - DNA, 21 bp, Homo sapiens
taagccctcgaaccaaggcag

SEQ ID NO: 1437727 - DNA, 22 bp, Homo sapiens
taagccctgtcgagacacttgc

SEQ ID NO: 1437728 - DNA, 15 bp, Homo sapiens
taagccctttgctct

SEQ ID NO: 1437729 - DNA, 17 bp, Homo sapiens
taagccctttgctctgg

SEQ ID NO: 1437730 - DNA, 14 bp, Homo sapiens
taagcctccattta

SEQ ID NO: 1437731 - DNA, 14 bp, Homo sapiens
taagcctgaagagc

SEQ ID NO: 1437732 - DNA, 17 bp, Homo sapiens
taagccttacaaaggga

SEQ ID NO: 1437733 - DNA, 21 bp, Homo sapiens
taagcgaagtctttgccttct

SEQ ID NO: 1437734 - DNA, 23 bp, Homo sapiens
taagcgaagtctttgccttctct

SEQ ID NO: 1437735 - DNA, 18 bp, Homo sapiens
taagcggtggtttgtaat

SEQ ID NO: 1437736 - DNA, 22 bp, Homo sapiens
taagctaacccccttctactga

SEQ ID NO: 1437737 - DNA, 21 bp, Homo sapiens
taagctacttattcatagttt

SEQ ID NO: 1437738 - DNA, 22 bp, Homo sapiens
taagctatcacctagcagcctc

SEQ ID NO: 1437739 - DNA, 22 bp, Homo sapiens
taagctcacgtcctgagaaagc

SEQ ID NO: 1437740 - DNA, 15 bp, Homo sapiens
taagctcagaatcca

SEQ ID NO: 1437741 - DNA, 20 bp, Homo sapiens
taagctccttgagtaaaaag

SEQ ID NO: 1437742 - DNA, 21 bp, Homo sapiens
taagctccttgagtaaaaagg

SEQ ID NO: 1437743 - DNA, 12 bp, Homo sapiens
taagctctctgg

SEQ ID NO: 1437744 - DNA, 21 bp, Homo sapiens
taagctgatattatttcttct

SEQ ID NO: 1437745 - DNA, 23 bp, Homo sapiens
taagctgcaaatctgatggcctt

SEQ ID NO: 1437746 - DNA, 18 bp, Homo sapiens
taagctggagctcttgga

SEQ ID NO: 1437747 - DNA, 13 bp, Homo sapiens
taagctgtgtctg

SEQ ID NO: 1437748 - DNA, 16 bp, Homo sapiens
taagctgtttccatag

SEQ ID NO: 1437749 - DNA, 14 bp, Homo sapiens
taagcttatttcta

SEQ ID NO: 1437750 - DNA, 11 bp, Homo sapiens
taaggaaacaa

SEQ ID NO: 1437751 - DNA, 21 bp, Homo sapiens
taaggaaagcaataaatgaat

SEQ ID NO: 1437752 - DNA, 15 bp, Homo sapiens
taaggaaccttcctt

SEQ ID NO: 1437753 - DNA, 15 bp, Homo sapiens
taaggacacactaat

SEQ ID NO: 1437754 - DNA, 14 bp, Homo sapiens
taaggacagcagct

SEQ ID NO: 1437755 - DNA, 18 bp, Homo sapiens
taaggacatttcccaggg

SEQ ID NO: 1437756 - DNA, 21 bp, Homo sapiens
taaggaccgtggccctgccct

SEQ ID NO: 1437757 - DNA, 16 bp, Homo sapiens
taaggaccttaagaca

SEQ ID NO: 1437758 - DNA, 18 bp, Homo sapiens
taaggaggaggagggaga

SEQ ID NO: 1437759 - DNA, 19 bp, Homo sapiens
taaggatatgattaatatt

SEQ ID NO: 1437760 - DNA, 20 bp, Homo sapiens
taaggatgagggaagcgaag

SEQ ID NO: 1437761 - DNA, 12 bp, Homo sapiens
taaggatggatg

SEQ ID NO: 1437762 - DNA, 14 bp, Homo sapiens
taaggatggatggc

SEQ ID NO: 1437763 - DNA, 18 bp, Homo sapiens
taaggatggatggcaccc

SEQ ID NO: 1437764 - DNA, 21 bp, Homo sapiens
taaggatggatggcaccctgg

SEQ ID NO: 1437765 - DNA, 17 bp, Homo sapiens
taaggcacagtgggagc

SEQ ID NO: 1437766 - DNA, 19 bp, Homo sapiens
taaggccagaaactccttt

SEQ ID NO: 1437767 - DNA, 15 bp, Homo sapiens
taaggccatttcctt

SEQ ID NO: 1437768 - DNA, 21 bp, Homo sapiens
taaggcctaggattctaaaat

SEQ ID NO: 1437769 - DNA, 15 bp, Homo sapiens
taaggcctctggact

SEQ ID NO: 1437770 - DNA, 16 bp, Homo sapiens
taaggcctgtgggggg

SEQ ID NO: 1437771 - DNA, 22 bp, Homo sapiens
taaggctctatgagtctagatg

SEQ ID NO: 1437772 - DNA, 14 bp, Homo sapiens
taaggctctgagag

SEQ ID NO: 1437773 - DNA, 13 bp, Homo sapiens
taagggaagaatt

SEQ ID NO: 1437774 - DNA, 16 bp, Homo sapiens
taagggaagatcactg

SEQ ID NO: 1437775 - DNA, 16 bp, Homo sapiens
taagggactgatgttt

SEQ ID NO: 1437776 - DNA, 17 bp, Homo sapiens
taagggactgatgtttg

SEQ ID NO: 1437777 - DNA, 12 bp, Homo sapiens
taagggagagct

SEQ ID NO: 1437778 - DNA, 23 bp, Homo sapiens
taagggagtaggctgtattttct

SEQ ID NO: 1437779 - DNA, 23 bp, Homo sapiens
taagggcagtgcccatgtgtaca

SEQ ID NO: 1437780 - DNA, 12 bp, Homo sapiens
taagggccgggg

SEQ ID NO: 1437781 - DNA, 21 bp, Homo sapiens
taagggccggggatggatctt

SEQ ID NO: 1437782 - DNA, 16 bp, Homo sapiens
taaggggaagaatgaa

SEQ ID NO: 1437783 - DNA, 18 bp, Homo sapiens
taagggggaaaactgttc

SEQ ID NO: 1437784 - DNA, 23 bp, Homo sapiens
taaggggtgggtcagaacatgtt

SEQ ID NO: 1437785 - DNA, 20 bp, Homo sapiens
taagggtctttggtgttttt

SEQ ID NO: 1437786 - DNA, 20 bp, Homo sapiens
taagggttagtttacaatca

SEQ ID NO: 1437787 - DNA, 20 bp, Homo sapiens
taaggtatatcattctaaag

SEQ ID NO: 1437788 - DNA, 20 bp, Homo sapiens
taaggtccaacaagaatgca

SEQ ID NO: 1437789 - DNA, 17 bp, Homo sapiens
taaggtccggtgttcta

SEQ ID NO: 1437790 - DNA, 21 bp, Homo sapiens
taaggtccggtgttctaagat

SEQ ID NO: 1437791 - DNA, 18 bp, Homo sapiens
taaggtctgtttgctgtt

SEQ ID NO: 1437792 - DNA, 10 bp, Homo sapiens
gttttaacac

SEQ ID NO: 1437793 - DNA, 19 bp, Homo sapiens
gttttaactagaatttatt

SEQ ID NO: 1437794 - DNA, 17 bp, Homo sapiens
gttttaactttaataca

SEQ ID NO: 1437795 - DNA, 19 bp, Homo sapiens
gttttaactttaatacagc

SEQ ID NO: 1437796 - DNA, 17 bp, Homo sapiens
gttttaagctaaaatgt

SEQ ID NO: 1437797 - DNA, 21 bp, Homo sapiens
gttttaataaaagatttacat

SEQ ID NO: 1437798 - DNA, 16 bp, Homo sapiens
gttttaataaacagta

SEQ ID NO: 1437799 - DNA, 21 bp, Homo sapiens
gttttaatcttagcttttaat

SEQ ID NO: 1437800 - DNA, 15 bp, Homo sapiens
gttttaatgtaattt

SEQ ID NO: 1437801 - DNA, 14 bp, Homo sapiens
gttttaatttaaac

SEQ ID NO: 1437802 - DNA, 21 bp, Homo sapiens
gttttaatttaaacacctcct

SEQ ID NO: 1437803 - DNA, 23 bp, Homo sapiens
gttttacagagaggatacattta

SEQ ID NO: 1437804 - DNA, 13 bp, Homo sapiens
gttttaccagctc

SEQ ID NO: 1437805 - DNA, 14 bp, Homo sapiens
gttttactaaagaa

SEQ ID NO: 1437806 - DNA, 14 bp, Homo sapiens
gttttactgtgaaa

SEQ ID NO: 1437807 - DNA, 15 bp, Homo sapiens
gttttactgttttaa

SEQ ID NO: 1437808 - DNA, 18 bp, Homo sapiens
gttttacttttaaactgt

SEQ ID NO: 1437809 - DNA, 21 bp, Homo sapiens
gttttagaataaggaggagga

SEQ ID NO: 1437810 - DNA, 15 bp, Homo sapiens
gttttagcatttgta

SEQ ID NO: 1437811 - DNA, 15 bp, Homo sapiens
gttttaggttctaaa

SEQ ID NO: 1437812 - DNA, 16 bp, Homo sapiens
gttttagtgtctgacc

SEQ ID NO: 1437813 - DNA, 14 bp, Homo sapiens
gttttagttgcaga

SEQ ID NO: 1437814 - DNA, 21 bp, Homo sapiens
gttttatactgaaggaaaaac

SEQ ID NO: 1437815 - DNA, 20 bp, Homo sapiens
gttttatggttacttcttct

SEQ ID NO: 1437816 - DNA, 19 bp, Homo sapiens
gttttatgtcatactctgt

SEQ ID NO: 1437817 - DNA, 20 bp, Homo sapiens
gttttattctgacttcctct

SEQ ID NO: 1437818 - DNA, 22 bp, Homo sapiens
gttttattgtccttcagagctc

SEQ ID NO: 1437819 - DNA, 15 bp, Homo sapiens
gttttatttgtatta

SEQ ID NO: 1437820 - DNA, 15 bp, Homo sapiens
gttttatttgtcagt

SEQ ID NO: 1437821 - DNA, 17 bp, Homo sapiens
gttttatttgtcagttt

SEQ ID NO: 1437822 - DNA, 18 bp, Homo sapiens
gttttcaaactgctgcat

SEQ ID NO: 1437823 - DNA, 17 bp, Homo sapiens
gttttcacttgtattga

SEQ ID NO: 1437824 - DNA, 19 bp, Homo sapiens
gttttcacttgtattgact

SEQ ID NO: 1437825 - DNA, 23 bp, Homo sapiens
gttttcataacttgctgaatttc

SEQ ID NO: 1437826 - DNA, 17 bp, Homo sapiens
gttttcccctccctggg

SEQ ID NO: 1437827 - DNA, 12 bp, Homo sapiens
gttttcccctgg

SEQ ID NO: 1437828 - DNA, 21 bp, Homo sapiens
gttttccctgacctccctcta

SEQ ID NO: 1437829 - DNA, 15 bp, Homo sapiens
gttttccctgcactg

SEQ ID NO: 1437830 - DNA, 16 bp, Homo sapiens
gttttcccttgcctta

SEQ ID NO: 1437831 - DNA, 17 bp, Homo sapiens
gttttcctaaatgcagt

SEQ ID NO: 1437832 - DNA, 22 bp, Homo sapiens
gttttcctataatataataaat

SEQ ID NO: 1437833 - DNA, 13 bp, Homo sapiens
gttttctactttg

SEQ ID NO: 1437834 - DNA, 16 bp, Homo sapiens
gttttctagatgacat

SEQ ID NO: 1437835 - DNA, 17 bp, Homo sapiens
gttttctcagaacagct

SEQ ID NO: 1437836 - DNA, 19 bp, Homo sapiens
gttttctcctgcctgtgct

SEQ ID NO: 1437837 - DNA, 17 bp, Homo sapiens
gttttctgaaacacacg

SEQ ID NO: 1437838 - DNA, 23 bp, Homo sapiens
gttttctgagaaagactattcaa

SEQ ID NO: 1437839 - DNA, 11 bp, Homo sapiens
gttttctggaa

SEQ ID NO: 1437840 - DNA, 19 bp, Homo sapiens
gttttcttctttccctgga

SEQ ID NO: 1437841 - DNA, 22 bp, Homo sapiens
gttttcttctttccctggacag

SEQ ID NO: 1437842 - DNA, 19 bp, Homo sapiens
gttttcttgtaaatgtttc

SEQ ID NO: 1437843 - DNA, 20 bp, Homo sapiens
gttttcttgtaaatgtttct

SEQ ID NO: 1437844 - DNA, 13 bp, Homo sapiens
gttttgaaatgct

SEQ ID NO: 1437845 - DNA, 22 bp, Homo sapiens
gttttgaactaataaaagcata

SEQ ID NO: 1437846 - DNA, 18 bp, Homo sapiens
gttttgaatggtgttgta

SEQ ID NO: 1437847 - DNA, 12 bp, Homo sapiens
gttttgaatttt

SEQ ID NO: 1437848 - DNA, 21 bp, Homo sapiens
gttttgaattttgtttttatt

SEQ ID NO: 1437849 - DNA, 13 bp, Homo sapiens
gttttgagcagac

SEQ ID NO: 1437850 - DNA, 19 bp, Homo sapiens
gttttgatggctgggtcct

SEQ ID NO: 1437851 - DNA, 23 bp, Homo sapiens
gttttgatgtttgtggcctcaga

SEQ ID NO: 1437852 - DNA, 22 bp, Homo sapiens
gttttgatttgtagcactgagg

SEQ ID NO: 1437853 - DNA, 13 bp, Homo sapiens
gttttgcaaaggg

SEQ ID NO: 1437854 - DNA, 15 bp, Homo sapiens
gttttgcacagccaa

SEQ ID NO: 1437855 - DNA, 19 bp, Homo sapiens
gttttgcacgtcttgctat

SEQ ID NO: 1437856 - DNA, 15 bp, Homo sapiens
gttttggagagtttg

SEQ ID NO: 1437857 - DNA, 16 bp, Homo sapiens
gttttggggactcatt

SEQ ID NO: 1437858 - DNA, 15 bp, Homo sapiens
gttttgggtatgttt

SEQ ID NO: 1437859 - DNA, 16 bp, Homo sapiens
gttttggttaataaaa

SEQ ID NO: 1437860 - DNA, 12 bp, Homo sapiens
gttttgtaaatg

SEQ ID NO: 1437861 - DNA, 13 bp, Homo sapiens
gttttgtaaatgt

SEQ ID NO: 1437862 - DNA, 15 bp, Homo sapiens
gttttgtaaatgtac

SEQ ID NO: 1437863 - DNA, 16 bp, Homo sapiens
gttttgtaaatgtact

SEQ ID NO: 1437864 - DNA, 23 bp, Homo sapiens
gttttgtaagatgctgggttggt

SEQ ID NO: 1437865 - DNA, 15 bp, Homo sapiens
gttttgtataaaatc

SEQ ID NO: 1437866 - DNA, 22 bp, Homo sapiens
gttttgtataaaatctgaattt

SEQ ID NO: 1437867 - DNA, 17 bp, Homo sapiens
gttttgtcaaactgtag

SEQ ID NO: 1437868 - DNA, 15 bp, Homo sapiens
gttttgtctgagcct

SEQ ID NO: 1437869 - DNA, 17 bp, Homo sapiens
gttttgtggtttggaat

SEQ ID NO: 1437870 - DNA, 16 bp, Homo sapiens
gttttgtgttgtgtct

SEQ ID NO: 1437871 - DNA, 15 bp, Homo sapiens
gttttgttcccctcc

SEQ ID NO: 1437872 - DNA, 17 bp, Homo sapiens
gttttgttcccctcctc

SEQ ID NO: 1437873 - DNA, 20 bp, Homo sapiens
gttttgttcccctcctccac

SEQ ID NO: 1437874 - DNA, 21 bp, Homo sapiens
gttttgttcccctcctccact

SEQ ID NO: 1437875 - DNA, 15 bp, Homo sapiens
gttttgtttctgaaa

SEQ ID NO: 1437876 - DNA, 20 bp, Homo sapiens
gttttgtttggcaaggaaag

SEQ ID NO: 1437877 - DNA, 12 bp, Homo sapiens
gttttgttttgg

SEQ ID NO: 1437878 - DNA, 19 bp, Homo sapiens
gtttttaaaaaatgttttc

SEQ ID NO: 1437879 - DNA, 15 bp, Homo sapiens
gtttttaaaaattag

SEQ ID NO: 1437880 - DNA, 17 bp, Homo sapiens
gtttttaagaaaaacat

SEQ ID NO: 1437881 - DNA, 19 bp, Homo sapiens
gtttttaagctgtttccat

SEQ ID NO: 1437882 - DNA, 14 bp, Homo sapiens
gtttttaagggccg

SEQ ID NO: 1437883 - DNA, 17 bp, Homo sapiens
gtttttaagtttgcact

SEQ ID NO: 1437884 - DNA, 18 bp, Homo sapiens
gtttttaatataaagcct

SEQ ID NO: 1437885 - DNA, 21 bp, Homo sapiens
gtttttaatttaaactgtgtt

SEQ ID NO: 1437886 - DNA, 12 bp, Homo sapiens
gtttttgctctc

SEQ ID NO: 1437887 - DNA, 12 bp, Homo sapiens
gtttttgtaaag

SEQ ID NO: 1437888 - DNA, 13 bp, Homo sapiens
gtttttgtaaaga

SEQ ID NO: 1437889 - DNA, 22 bp, Homo sapiens
gtttttgtaaagatttctgttc

SEQ ID NO: 1437890 - DNA, 13 bp, Homo sapiens
gtttttgtatctt

SEQ ID NO: 1437891 - DNA, 20 bp, Homo sapiens
gtttttgtatctttatgctg

SEQ ID NO: 1437892 - DNA, 17 bp, Homo sapiens
gtttttgtttttgcatg

SEQ ID NO: 1437893 - DNA, 18 bp, Homo sapiens
gttttttaagatagtgta

SEQ ID NO: 1437894 - DNA, 15 bp, Homo sapiens
gttttttcctcagtg

SEQ ID NO: 1437895 - DNA, 20 bp, Homo sapiens
gttttttcctcagtgcattt

SEQ ID NO: 1437896 - DNA, 14 bp, Homo sapiens
gttttttcctttat

SEQ ID NO: 1437897 - DNA, 18 bp, Homo sapiens
gttttttctgtaatgtaa

SEQ ID NO: 1437898 - DNA, 19 bp, Homo sapiens
gttttttctttcccatgta

SEQ ID NO: 1437899 - DNA, 12 bp, Homo sapiens
gttttttggagg

SEQ ID NO: 1437900 - DNA, 18 bp, Homo sapiens
gttttttgtaactacaaa

SEQ ID NO: 1437901 - DNA, 22 bp, Homo sapiens
gttttttgttggagtgtttcta

SEQ ID NO: 1437902 - DNA, 19 bp, Homo sapiens
gtttttttatttggcataa

SEQ ID NO: 1437903 - DNA, 11 bp, Homo sapiens
gtttttttgcc

SEQ ID NO: 1437904 - DNA, 19 bp, Homo sapiens
gtttttttgtatagtaaag

SEQ ID NO: 1437905 - DNA, 20 bp, Homo sapiens
gttttttttgactaaagcta

SEQ ID NO: 1437906 - DNA, 14 bp, Homo sapiens
gtttttttttcctc

SEQ ID NO: 1437907 - DNA, 21 bp, Homo sapiens
gtttttttttttttaaataat

SEQ ID NO: 1437908 - DNA, 19 bp, Homo sapiens
gttttttttttttttttgg

SEQ ID NO: 1437909 - DNA, 15 bp, Homo sapiens
taaaaaaaaaaacaa

SEQ ID NO: 1437910 - DNA, 16 bp, Homo sapiens
taaaaaaaaaaagtac

SEQ ID NO: 1437911 - DNA, 19 bp, Homo sapiens
taaaaaaaaaaggatgaaa

SEQ ID NO: 1437912 - DNA, 15 bp, Homo sapiens
taaaaaaaaattgta

SEQ ID NO: 1437913 - DNA, 23 bp, Homo sapiens
taaaaaaactggatatttcaatc

SEQ ID NO: 1437914 - DNA, 15 bp, Homo sapiens
taaaaaaataacatc

SEQ ID NO: 1437915 - DNA, 13 bp, Homo sapiens
taaaaaaatgaca

SEQ ID NO: 1437916 - DNA, 12 bp, Homo sapiens
taaaaaaatttg

SEQ ID NO: 1437917 - DNA, 19 bp, Homo sapiens
taaaaaacaaagaagacaa

SEQ ID NO: 1437918 - DNA, 18 bp, Homo sapiens
taaaaaagactgaacatg

SEQ ID NO: 1437919 - DNA, 21 bp, Homo sapiens
taaaaaagactgaacatgttt

SEQ ID NO: 1437920 - DNA, 17 bp, Homo sapiens
taaaaaagatcccaaat

SEQ ID NO: 1437921 - DNA, 18 bp, Homo sapiens
taaaaaagcatacttcta

SEQ ID NO: 1437922 - DNA, 18 bp, Homo sapiens
taaaaaagcgaggtggcc

SEQ ID NO: 1437923 - DNA, 14 bp, Homo sapiens
taaaaaataacata

SEQ ID NO: 1437924 - DNA, 12 bp, Homo sapiens
taaaaaataact

SEQ ID NO: 1437925 - DNA, 14 bp, Homo sapiens
taaaaaataactgt

SEQ ID NO: 1437926 - DNA, 15 bp, Homo sapiens
taaaaaataatacaa

SEQ ID NO: 1437927 - DNA, 17 bp, Homo sapiens
taaaaaataatctattt

SEQ ID NO: 1437928 - DNA, 14 bp, Homo sapiens
taaaaaatattttc

SEQ ID NO: 1437929 - DNA, 23 bp, Homo sapiens
taaaaaatcctcaacactattgt

SEQ ID NO: 1437930 - DNA, 13 bp, Homo sapiens
taaaaaatggaaa

SEQ ID NO: 1437931 - DNA, 12 bp, Homo sapiens
taaaaaatggtt

SEQ ID NO: 1437932 - DNA, 15 bp, Homo sapiens
taaaaaatgtaacat

SEQ ID NO: 1437933 - DNA, 16 bp, Homo sapiens
taaaaaatgtaacatc

SEQ ID NO: 1437934 - DNA, 18 bp, Homo sapiens
taaaaaattatgacaatg

SEQ ID NO: 1437935 - DNA, 14 bp, Homo sapiens
taaaaaattttaaa

SEQ ID NO: 1437936 - DNA, 17 bp, Homo sapiens
taaaaacaagtcatttt

SEQ ID NO: 1437937 - DNA, 16 bp, Homo sapiens
taaaaacagcattgct

SEQ ID NO: 1437938 - DNA, 20 bp, Homo sapiens
taaaaacagcattgctttct

SEQ ID NO: 1437939 - DNA, 15 bp, Homo sapiens
taaaaacataacata

SEQ ID NO: 1437940 - DNA, 17 bp, Homo sapiens
taaaaacataacataaa

SEQ ID NO: 1437941 - DNA, 17 bp, Homo sapiens
taaaaactaatttcata

SEQ ID NO: 1437942 - DNA, 17 bp, Homo sapiens
taaaaacttgtactatg

SEQ ID NO: 1437943 - DNA, 22 bp, Homo sapiens
taaaaagaaaaaaatggaaaaa

SEQ ID NO: 1437944 - DNA, 18 bp, Homo sapiens
taaaaagaaaaagagata

SEQ ID NO: 1437945 - DNA, 21 bp, Homo sapiens
taaaaagaaaacaaaaccaaa

SEQ ID NO: 1437946 - DNA, 17 bp, Homo sapiens
taaaaagaaaagataaa

SEQ ID NO: 1437947 - DNA, 18 bp, Homo sapiens
taaaaagaaacaagatgc

SEQ ID NO: 1437948 - DNA, 19 bp, Homo sapiens
taaaaagaaacaagatgct

SEQ ID NO: 1437949 - DNA, 13 bp, Homo sapiens
taaaaagaaggaa

SEQ ID NO: 1437950 - DNA, 20 bp, Homo sapiens
taaaaagaaggaaaatgatc

SEQ ID NO: 1437951 - DNA, 21 bp, Homo sapiens
taaaaagacattcttccaaaa

SEQ ID NO: 1437952 - DNA, 15 bp, Homo sapiens
taaaaagagtaattt

SEQ ID NO: 1437953 - DNA, 16 bp, Homo sapiens
taaaaagagtaatttc

SEQ ID NO: 1437954 - DNA, 19 bp, Homo sapiens
taaaaagagtaatttcatt

SEQ ID NO: 1437955 - DNA, 23 bp, Homo sapiens
taaaaagcagaattttaatgtga

SEQ ID NO: 1437956 - DNA, 14 bp, Homo sapiens
taaaaagcctcctt

SEQ ID NO: 1437957 - DNA, 22 bp, Homo sapiens
taaaaagcctgcaatttcatat

SEQ ID NO: 1437958 - DNA, 15 bp, Homo sapiens
taaaaaggccaaaga

SEQ ID NO: 1437959 - DNA, 17 bp, Homo sapiens
taaaaaggccaaagata

SEQ ID NO: 1437960 - DNA, 21 bp, Homo sapiens
taaaaagtaatgacttagaaa

SEQ ID NO: 1437961 - DNA, 16 bp, Homo sapiens
taaaaagtatatgtta

SEQ ID NO: 1437962 - DNA, 14 bp, Homo sapiens
taaaaagtattttt

SEQ ID NO: 1437963 - DNA, 15 bp, Homo sapiens
taaaaagtgacacag

SEQ ID NO: 1437964 - DNA, 11 bp, Homo sapiens
taaaaagtggc

SEQ ID NO: 1437965 - DNA, 16 bp, Homo sapiens
taaaaagttgttcttt

SEQ ID NO: 1437966 - DNA, 23 bp, Homo sapiens
taaaaagttgttctttgtttcca

SEQ ID NO: 1437967 - DNA, 19 bp, Homo sapiens
taaaaataaaaaagatccc

SEQ ID NO: 1437968 - DNA, 19 bp, Homo sapiens
taaaaataaatcccatgga

SEQ ID NO: 1437969 - DNA, 17 bp, Homo sapiens
taaaaatagcagtatta

SEQ ID NO: 1437970 - DNA, 16 bp, Homo sapiens
taaaaatatacatgtt

SEQ ID NO: 1437971 - DNA, 16 bp, Homo sapiens
taaaaatatccttgat

SEQ ID NO: 1437972 - DNA, 16 bp, Homo sapiens
taaaaatatgtaattt

SEQ ID NO: 1437973 - DNA, 17 bp, Homo sapiens
taaaaatatttcagata

SEQ ID NO: 1437974 - DNA, 14 bp, Homo sapiens
taaaaatcacactg

SEQ ID NO: 1437975 - DNA, 16 bp, Homo sapiens
taaagaatatgacttt

SEQ ID NO: 1437976 - DNA, 23 bp, Homo sapiens
taaagaatccttatctataaaag

SEQ ID NO: 1437977 - DNA, 18 bp, Homo sapiens
taaagaattaatgactta

SEQ ID NO: 1437978 - DNA, 19 bp, Homo sapiens
taaagacaaaaatccttgt

SEQ ID NO: 1437979 - DNA, 11 bp, Homo sapiens
taaagacaaag

SEQ ID NO: 1437980 - DNA, 20 bp, Homo sapiens
taaagacaaagacaaattct

SEQ ID NO: 1437981 - DNA, 16 bp, Homo sapiens
taaagacaaataaatg

SEQ ID NO: 1437982 - DNA, 16 bp, Homo sapiens
taaagacaacaaaaga

SEQ ID NO: 1437983 - DNA, 17 bp, Homo sapiens
taaagacaacaaaagaa

SEQ ID NO: 1437984 - DNA, 17 bp, Homo sapiens
taaagacaatcactgcc

SEQ ID NO: 1437985 - DNA, 15 bp, Homo sapiens
taaagacacctactg

SEQ ID NO: 1437986 - DNA, 21 bp, Homo sapiens
taaagaccctaaatctgagga

SEQ ID NO: 1437987 - DNA, 23 bp, Homo sapiens
taaagaccctcctattctataaa

SEQ ID NO: 1437988 - DNA, 17 bp, Homo sapiens
taaagacgatttgtcag

SEQ ID NO: 1437989 - DNA, 18 bp, Homo sapiens
taaagactacctgggacc

SEQ ID NO: 1437990 - DNA, 21 bp, Homo sapiens
taaagactgtggaaatgccaa

SEQ ID NO: 1437991 - DNA, 12 bp, Homo sapiens
taaagagagaat

SEQ ID NO: 1437992 - DNA, 16 bp, Homo sapiens
taaagagcccttgcct

SEQ ID NO: 1437993 - DNA, 22 bp, Homo sapiens
taaagaggcatcttttctagag

SEQ ID NO: 1437994 - DNA, 17 bp, Homo sapiens
taaagaggctgaaagag

SEQ ID NO: 1437995 - DNA, 13 bp, Homo sapiens
taaagagtctaga

SEQ ID NO: 1437996 - DNA, 15 bp, Homo sapiens
taaagagtctagatt

SEQ ID NO: 1437997 - DNA, 19 bp, Homo sapiens
taaagagtctagattcaaa

SEQ ID NO: 1437998 - DNA, 21 bp, Homo sapiens
taaagataaaatatcctcagg

SEQ ID NO: 1437999 - DNA, 20 bp, Homo sapiens
taaagataacccttattcca

SEQ ID NO: 1438000 - DNA, 21 bp, Homo sapiens
taaagataacccttattccat

SEQ ID NO: 1438001 - DNA, 21 bp, Homo sapiens
taaagatatttttatctttat

SEQ ID NO: 1438002 - DNA, 13 bp, Homo sapiens
taaagatgagttg

SEQ ID NO: 1438003 - DNA, 13 bp, Homo sapiens
taaagatggaaaa

SEQ ID NO: 1438004 - DNA, 17 bp, Homo sapiens
taaagatggtttatgca

SEQ ID NO: 1438005 - DNA, 13 bp, Homo sapiens
taaagatgtgaaa

SEQ ID NO: 1438006 - DNA, 14 bp, Homo sapiens
taaagatgtgaaaa

SEQ ID NO: 1438007 - DNA, 15 bp, Homo sapiens
taaagatgtgaaaac

SEQ ID NO: 1438008 - DNA, 15 bp, Homo sapiens
taaagatgttaaaaa

SEQ ID NO: 1438009 - DNA, 19 bp, Homo sapiens
taaagattataatatgtgc

SEQ ID NO: 1438010 - DNA, 11 bp, Homo sapiens
taaagattatt

SEQ ID NO: 1438011 - DNA, 19 bp, Homo sapiens
taaagattctatagttcta

SEQ ID NO: 1438012 - DNA, 20 bp, Homo sapiens
taaagattctatagttctag

SEQ ID NO: 1438013 - DNA, 21 bp, Homo sapiens
taaagattctatagttctaga

SEQ ID NO: 1438014 - DNA, 24 bp, Homo sapiens
taaagattctatagttctagacat

SEQ ID NO: 1438015 - DNA, 16 bp, Homo sapiens
taaagcactttgcact

SEQ ID NO: 1438016 - DNA, 13 bp, Homo sapiens
taaagcagtattt

SEQ ID NO: 1438017 - DNA, 14 bp, Homo sapiens
taaagcagtatttt

SEQ ID NO: 1438018 - DNA, 17 bp, Homo sapiens
taaagcagtatttttct

SEQ ID NO: 1438019 - DNA, 20 bp, Homo sapiens
taaagcatcctcctcctgga

SEQ ID NO: 1438020 - DNA, 15 bp, Homo sapiens
taaagcattactctt

SEQ ID NO: 1438021 - DNA, 15 bp, Homo sapiens
taaagccacttctgg

SEQ ID NO: 1438022 - DNA, 23 bp, Homo sapiens
taaagccacttctggcttcagcc

SEQ ID NO: 1438023 - DNA, 22 bp, Homo sapiens
taaagcccataaggccagaaac

SEQ ID NO: 1438024 - DNA, 21 bp, Homo sapiens
taaagcctcaaggttttaggt

SEQ ID NO: 1438025 - DNA, 12 bp, Homo sapiens
taaagcctcctc

SEQ ID NO: 1438026 - DNA, 13 bp, Homo sapiens
taaagccttctgg

SEQ ID NO: 1438027 - DNA, 13 bp, Homo sapiens
taaagctaaattt

SEQ ID NO: 1438028 - DNA, 16 bp, Homo sapiens
taaagctatgttacat

SEQ ID NO: 1438029 - DNA, 15 bp, Homo sapiens
taaagctcaaatgaa

SEQ ID NO: 1438030 - DNA, 17 bp, Homo sapiens
taaagctcaaatgaaat

SEQ ID NO: 1438031 - DNA, 15 bp, Homo sapiens
taaagctcaggaggg

SEQ ID NO: 1438032 - DNA, 17 bp, Homo sapiens
taaagctgttattcttg

SEQ ID NO: 1438033 - DNA, 11 bp, Homo sapiens
taaagcttcag

SEQ ID NO: 1438034 - DNA, 22 bp, Homo sapiens
taaagctttggacaagtccttg

SEQ ID NO: 1438035 - DNA, 14 bp, Homo sapiens
taaaggaaggaaaa

SEQ ID NO: 1438036 - DNA, 13 bp, Homo sapiens
taaaggagggaga

SEQ ID NO: 1438037 - DNA, 17 bp, Homo sapiens
taaaggatgttggtgtt

SEQ ID NO: 1438038 - DNA, 21 bp, Homo sapiens
taaaggcaatggtttgtgtca

SEQ ID NO: 1438039 - DNA, 22 bp, Homo sapiens
taaaggcagctgcctctgctcc

SEQ ID NO: 1438040 - DNA, 23 bp, Homo sapiens
taaaggcagctgcctctgctccc

SEQ ID NO: 1438041 - DNA, 20 bp, Homo sapiens
taaaggcatccttgtctttt

SEQ ID NO: 1438042 - DNA, 12 bp, Homo sapiens
taaataatgaaa

SEQ ID NO: 1438043 - DNA, 16 bp, Homo sapiens
taaatacaatttgtac

SEQ ID NO: 1438044 - DNA, 15 bp, Homo sapiens
taaatacagacacta

SEQ ID NO: 1438045 - DNA, 19 bp, Homo sapiens
taaatacagacactaagtt

SEQ ID NO: 1438046 - DNA, 20 bp, Homo sapiens
taaatacagcatacttcaaa

SEQ ID NO: 1438047 - DNA, 17 bp, Homo sapiens
taaatacaggaaacagt

SEQ ID NO: 1438048 - DNA, 18 bp, Homo sapiens
taaatacaggaaacagtt

SEQ ID NO: 1438049 - DNA, 22 bp, Homo sapiens
taaatacatgtatttaaaaaaa

SEQ ID NO: 1438050 - DNA, 16 bp, Homo sapiens
taaatactgcaaatca

SEQ ID NO: 1438051 - DNA, 17 bp, Homo sapiens
taaatactgtgaaatac

SEQ ID NO: 1438052 - DNA, 16 bp, Homo sapiens
taaatactttccatgt

SEQ ID NO: 1438053 - DNA, 19 bp, Homo sapiens
taaatactttccatgtttt

SEQ ID NO: 1438054 - DNA, 18 bp, Homo sapiens
taaatagagtatatgcac

SEQ ID NO: 1438055 - DNA, 16 bp, Homo sapiens
taaatagatgatttca

SEQ ID NO: 1438056 - DNA, 20 bp, Homo sapiens
taaatagatgatttcaatag

SEQ ID NO: 1438057 - DNA, 12 bp, Homo sapiens
taaataggattt

SEQ ID NO: 1438058 - DNA, 12 bp, Homo sapiens
taaatataaaaa

SEQ ID NO: 1438059 - DNA, 17 bp, Homo sapiens
taaatataaatgtttaa

SEQ ID NO: 1438060 - DNA, 13 bp, Homo sapiens
taaatataattct

SEQ ID NO: 1438061 - DNA, 19 bp, Homo sapiens
taaatatacatctgtgtat

SEQ ID NO: 1438062 - DNA, 14 bp, Homo sapiens
taaatatataaaaa

SEQ ID NO: 1438063 - DNA, 14 bp, Homo sapiens
taaatatatatggt

SEQ ID NO: 1438064 - DNA, 14 bp, Homo sapiens
taaatatatctacc

SEQ ID NO: 1438065 - DNA, 18 bp, Homo sapiens
taaatatatctaccccag

SEQ ID NO: 1438066 - DNA, 20 bp, Homo sapiens
taaatatatctaccccagac

SEQ ID NO: 1438067 - DNA, 22 bp, Homo sapiens
taaatatatttaagataattat

SEQ ID NO: 1438068 - DNA, 16 bp, Homo sapiens
taaatatccatttatc

SEQ ID NO: 1438069 - DNA, 17 bp, Homo sapiens
taaatatcttctgattt

SEQ ID NO: 1438070 - DNA, 18 bp, Homo sapiens
taaatatcttctgatttg

SEQ ID NO: 1438071 - DNA, 17 bp, Homo sapiens
taaatatgaatgaacaa

SEQ ID NO: 1438072 - DNA, 13 bp, Homo sapiens
taaatatgtaata

SEQ ID NO: 1438073 - DNA, 15 bp, Homo sapiens
taaatatgtaatata

SEQ ID NO: 1438074 - DNA, 14 bp, Homo sapiens
taaatatgtagatc

SEQ ID NO: 1438075 - DNA, 18 bp, Homo sapiens
taaatatgttagcaaaga

SEQ ID NO: 1438076 - DNA, 14 bp, Homo sapiens
taaatattaagcat

SEQ ID NO: 1438077 - DNA, 19 bp, Homo sapiens
taaatattcacacttgaac

SEQ ID NO: 1438078 - DNA, 10 bp, Homo sapiens
taaatattta

SEQ ID NO: 1438079 - DNA, 16 bp, Homo sapiens
taaatatttatgtaga

SEQ ID NO: 1438080 - DNA, 17 bp, Homo sapiens
taaatatttatttatgt

SEQ ID NO: 1438081 - DNA, 13 bp, Homo sapiens
taaatatttcaag

SEQ ID NO: 1438082 - DNA, 14 bp, Homo sapiens
taaatatttcaaga

SEQ ID NO: 1438083 - DNA, 14 bp, Homo sapiens
taaatattttctat

SEQ ID NO: 1438084 - DNA, 16 bp, Homo sapiens
taaatattttgctaac

SEQ ID NO: 1438085 - DNA, 18 bp, Homo sapiens
taaatattttgctaactg

SEQ ID NO: 1438086 - DNA, 22 bp, Homo sapiens
taaatcaaccacctatttttga

SEQ ID NO: 1438087 - DNA, 23 bp, Homo sapiens
taaatcaatgtcacttaaaggct

SEQ ID NO: 1438088 - DNA, 19 bp, Homo sapiens
taaatcagaaagtaacaat

SEQ ID NO: 1438089 - DNA, 22 bp, Homo sapiens
taaatcagaaagtaacaatcta

SEQ ID NO: 1438090 - DNA, 16 bp, Homo sapiens
taaatcagttggagtt

SEQ ID NO: 1438091 - DNA, 16 bp, Homo sapiens
taaatcataaagtcag

SEQ ID NO: 1438092 - DNA, 21 bp, Homo sapiens
taaatccatcactataataaa

SEQ ID NO: 1438093 - DNA, 15 bp, Homo sapiens
taaatccattttcta

SEQ ID NO: 1438094 - DNA, 16 bp, Homo sapiens
taaatccattttctaa

SEQ ID NO: 1438095 - DNA, 15 bp, Homo sapiens
taaatccgacttgaa

SEQ ID NO: 1438096 - DNA, 17 bp, Homo sapiens
taaatcctgccatttaa

SEQ ID NO: 1438097 - DNA, 20 bp, Homo sapiens
taaatccttaacatttctct

SEQ ID NO: 1438098 - DNA, 21 bp, Homo sapiens
taaatccttaacatttctctc

SEQ ID NO: 1438099 - DNA, 17 bp, Homo sapiens
taaatcctttactgtta

SEQ ID NO: 1438100 - DNA, 19 bp, Homo sapiens
taaatccttttgttttgaa

SEQ ID NO: 1438101 - DNA, 19 bp, Homo sapiens
taaatcctttttctttata

SEQ ID NO: 1438102 - DNA, 19 bp, Homo sapiens
taaatcgaggcagaaagat

SEQ ID NO: 1438103 - DNA, 19 bp, Homo sapiens
taaatctaaatctatttat

SEQ ID NO: 1438104 - DNA, 20 bp, Homo sapiens
gttctgcccacgatcccctc

SEQ ID NO: 1438105 - DNA, 17 bp, Homo sapiens
gttctgccctgcctgag

SEQ ID NO: 1438106 - DNA, 18 bp, Homo sapiens
gttctgccctgcctgagg

SEQ ID NO: 1438107 - DNA, 19 bp, Homo sapiens
gttctgccctgcctgagga

SEQ ID NO: 1438108 - DNA, 15 bp, Homo sapiens
gttctgcctgccagc

SEQ ID NO: 1438109 - DNA, 17 bp, Homo sapiens
gttctgctaaatttcaa

SEQ ID NO: 1438110 - DNA, 22 bp, Homo sapiens
gttctgctcctgcttttctgtc

SEQ ID NO: 1438111 - DNA, 18 bp, Homo sapiens
gttctgctgaccaaatgg

SEQ ID NO: 1438112 - DNA, 15 bp, Homo sapiens
gttctgctgcccctg

SEQ ID NO: 1438113 - DNA, 17 bp, Homo sapiens
gttctgctgcccctgca

SEQ ID NO: 1438114 - DNA, 20 bp, Homo sapiens
gttctgctgcccctgcagtt

SEQ ID NO: 1438115 - DNA, 23 bp, Homo sapiens
gttctgcttcaaggcttccactg

SEQ ID NO: 1438116 - DNA, 18 bp, Homo sapiens
gttctgctttctgcctct

SEQ ID NO: 1438117 - DNA, 22 bp, Homo sapiens
gttctggactacacccaagcct

SEQ ID NO: 1438118 - DNA, 22 bp, Homo sapiens
gttctggctgccccaacctgct

SEQ ID NO: 1438119 - DNA, 16 bp, Homo sapiens
gttctggggggaccca

SEQ ID NO: 1438120 - DNA, 21 bp, Homo sapiens
gttctggggggacccagtgca

SEQ ID NO: 1438121 - DNA, 17 bp, Homo sapiens
gttctggtcctttttgg

SEQ ID NO: 1438122 - DNA, 20 bp, Homo sapiens
gttctggttcatgcagacaa

SEQ ID NO: 1438123 - DNA, 22 bp, Homo sapiens
gttctggttccatttttcctct

SEQ ID NO: 1438124 - DNA, 18 bp, Homo sapiens
gttctgtattctggcgga

SEQ ID NO: 1438125 - DNA, 19 bp, Homo sapiens
gttctgtctagactggcct

SEQ ID NO: 1438126 - DNA, 12 bp, Homo sapiens
gttctgtgaaga

SEQ ID NO: 1438127 - DNA, 16 bp, Homo sapiens
gttctgtgacccatct

SEQ ID NO: 1438128 - DNA, 18 bp, Homo sapiens
gttctgtgacccatctgt

SEQ ID NO: 1438129 - DNA, 21 bp, Homo sapiens
gttctgtgacccatctgtagt

SEQ ID NO: 1438130 - DNA, 16 bp, Homo sapiens
gttctgtgactaggaa

SEQ ID NO: 1438131 - DNA, 22 bp, Homo sapiens
gttctgtgactgaagaagatga

SEQ ID NO: 1438132 - DNA, 20 bp, Homo sapiens
gttctgtgcctccccccaga

SEQ ID NO: 1438133 - DNA, 22 bp, Homo sapiens
gttctgtgcctccccccagacc

SEQ ID NO: 1438134 - DNA, 14 bp, Homo sapiens
gttctgtggttcct

SEQ ID NO: 1438135 - DNA, 18 bp, Homo sapiens
gttctgtggttcctctgc

SEQ ID NO: 1438136 - DNA, 19 bp, Homo sapiens
gttctgtggtttcatgtta

SEQ ID NO: 1438137 - DNA, 21 bp, Homo sapiens
gttctgtggttttcccctccc

SEQ ID NO: 1438138 - DNA, 23 bp, Homo sapiens
gttctgtggttttcccctccctg

SEQ ID NO: 1438139 - DNA, 16 bp, Homo sapiens
gttctgtgtacttttt

SEQ ID NO: 1438140 - DNA, 13 bp, Homo sapiens
gttctgtgtcttt

SEQ ID NO: 1438141 - DNA, 18 bp, Homo sapiens
gttctgttgacctgtgca

SEQ ID NO: 1438142 - DNA, 15 bp, Homo sapiens
gttctgttgtctgcg

SEQ ID NO: 1438143 - DNA, 14 bp, Homo sapiens
gttctgtttcaagg

SEQ ID NO: 1438144 - DNA, 15 bp, Homo sapiens
gttctgtttgttaaa

SEQ ID NO: 1438145 - DNA, 18 bp, Homo sapiens
gttctgtttgttattgtt

SEQ ID NO: 1438146 - DNA, 18 bp, Homo sapiens
gttcttaaaaaaataaaa

SEQ ID NO: 1438147 - DNA, 13 bp, Homo sapiens
gttcttaggttta

SEQ ID NO: 1438148 - DNA, 20 bp, Homo sapiens
gttcttaggtttactgtgaa

SEQ ID NO: 1438149 - DNA, 13 bp, Homo sapiens
gttcttattttag

SEQ ID NO: 1438150 - DNA, 23 bp, Homo sapiens
gttcttattttgcattccagaat

SEQ ID NO: 1438151 - DNA, 15 bp, Homo sapiens
gttcttgtgtcctgg

SEQ ID NO: 1438152 - DNA, 20 bp, Homo sapiens
gttctttccataataaaagg

SEQ ID NO: 1438153 - DNA, 19 bp, Homo sapiens
gttctttcctccccctgca

SEQ ID NO: 1438154 - DNA, 20 bp, Homo sapiens
gttctttcctccccctgcaa

SEQ ID NO: 1438155 - DNA, 18 bp, Homo sapiens
gttctttcctctttctgc

SEQ ID NO: 1438156 - DNA, 23 bp, Homo sapiens
gttctttgctgcattctgcctct

SEQ ID NO: 1438157 - DNA, 14 bp, Homo sapiens
gttctttggattct

SEQ ID NO: 1438158 - DNA, 16 bp, Homo sapiens
gttctttgggccagac

SEQ ID NO: 1438159 - DNA, 13 bp, Homo sapiens
gttctttgttcat

SEQ ID NO: 1438160 - DNA, 15 bp, Homo sapiens
gttcttttaagccca

SEQ ID NO: 1438161 - DNA, 13 bp, Homo sapiens
gttgaaaaatcta

SEQ ID NO: 1438162 - DNA, 16 bp, Homo sapiens
gttgaaaaatctagtt

SEQ ID NO: 1438163 - DNA, 20 bp, Homo sapiens
gttgaaaaatctagtttttt

SEQ ID NO: 1438164 - DNA, 15 bp, Homo sapiens
gttgaaaagccaaag

SEQ ID NO: 1438165 - DNA, 22 bp, Homo sapiens
gttgaaaatggtttcaagttat

SEQ ID NO: 1438166 - DNA, 13 bp, Homo sapiens
gttgaaacaaacc

SEQ ID NO: 1438167 - DNA, 15 bp, Homo sapiens
gttgaaagacatcaa

SEQ ID NO: 1438168 - DNA, 17 bp, Homo sapiens
gttgaaagacatcaatg

SEQ ID NO: 1438169 - DNA, 19 bp, Homo sapiens
gttgaaagacatcaatgaa

SEQ ID NO: 1438170 - DNA, 18 bp, Homo sapiens
gttgaaaggcctcaagaa

SEQ ID NO: 1438171 - DNA, 20 bp, Homo sapiens
gttgaaattatgtatgttta

SEQ ID NO: 1438172 - DNA, 17 bp, Homo sapiens
gttgaactgttagaatg

SEQ ID NO: 1438173 - DNA, 15 bp, Homo sapiens
gttgaacttagaact

SEQ ID NO: 1438174 - DNA, 22 bp, Homo sapiens
gttgaagctaagatttagagat

SEQ ID NO: 1438175 - DNA, 14 bp, Homo sapiens
gttgaagctctggt

SEQ ID NO: 1438176 - DNA, 15 bp, Homo sapiens
gttgaagggaggtga

SEQ ID NO: 1438177 - DNA, 16 bp, Homo sapiens
gttgaatggcctgcct

SEQ ID NO: 1438178 - DNA, 17 bp, Homo sapiens
gttgaattggtgaataa

SEQ ID NO: 1438179 - DNA, 20 bp, Homo sapiens
gttgaattttgttctctggg

SEQ ID NO: 1438180 - DNA, 21 bp, Homo sapiens
gttgaattttgttctctggga

SEQ ID NO: 1438181 - DNA, 22 bp, Homo sapiens
gttgaattttgttctctgggag

SEQ ID NO: 1438182 - DNA, 23 bp, Homo sapiens
gttgaattttttttaacattcct

SEQ ID NO: 1438183 - DNA, 18 bp, Homo sapiens
gttgacaacctagaatgt

SEQ ID NO: 1438184 - DNA, 15 bp, Homo sapiens
gttgacaactgtgac

SEQ ID NO: 1438185 - DNA, 16 bp, Homo sapiens
gttgacagcaaaatgt

SEQ ID NO: 1438186 - DNA, 17 bp, Homo sapiens
gttgacattcggggtga

SEQ ID NO: 1438187 - DNA, 22 bp, Homo sapiens
gttgacttccaggcacggtttg

SEQ ID NO: 1438188 - DNA, 21 bp, Homo sapiens
gttgagcttcatataccagca

SEQ ID NO: 1438189 - DNA, 21 bp, Homo sapiens
gttgaggcagggcaaatgaca

SEQ ID NO: 1438190 - DNA, 20 bp, Homo sapiens
gttgaggccgaggataaaga

SEQ ID NO: 1438191 - DNA, 17 bp, Homo sapiens
gttgagggaacagacag

SEQ ID NO: 1438192 - DNA, 20 bp, Homo sapiens
gttgaggtggaagccctcct

SEQ ID NO: 1438193 - DNA, 23 bp, Homo sapiens
gttgaggtggaagccctccttcc

SEQ ID NO: 1438194 - DNA, 22 bp, Homo sapiens
gttgagtctcctctctgagact

SEQ ID NO: 1438195 - DNA, 15 bp, Homo sapiens
gttgagtctgtacta

SEQ ID NO: 1438196 - DNA, 13 bp, Homo sapiens
gttgagtgtgtgg

SEQ ID NO: 1438197 - DNA, 12 bp, Homo sapiens
gttgataaatcc

SEQ ID NO: 1438198 - DNA, 22 bp, Homo sapiens
gttgatagcaagtgaatttttc

SEQ ID NO: 1438199 - DNA, 20 bp, Homo sapiens
gttgatatttcgaaagctgc

SEQ ID NO: 1438200 - DNA, 20 bp, Homo sapiens
gttgatcactggcaatgaaa

SEQ ID NO: 1438201 - DNA, 19 bp, Homo sapiens
gttgatctggaacccagac

SEQ ID NO: 1438202 - DNA, 22 bp, Homo sapiens
gttgatctggaacccagactca

SEQ ID NO: 1438203 - DNA, 13 bp, Homo sapiens
gttgatggaaaat

SEQ ID NO: 1438204 - DNA, 14 bp, Homo sapiens
gttgatggaaaata

SEQ ID NO: 1438205 - DNA, 19 bp, Homo sapiens
gttgatgtatggtatcttt

SEQ ID NO: 1438206 - DNA, 15 bp, Homo sapiens
gttgcaaactcagtt

SEQ ID NO: 1438207 - DNA, 17 bp, Homo sapiens
gttgcaaattattctag

SEQ ID NO: 1438208 - DNA, 13 bp, Homo sapiens
gttgcaagactcg

SEQ ID NO: 1438209 - DNA, 14 bp, Homo sapiens
gttgcaagatgtga

SEQ ID NO: 1438210 - DNA, 17 bp, Homo sapiens
gttgcaagatgtgaatt

SEQ ID NO: 1438211 - DNA, 18 bp, Homo sapiens
gttgcaagatgtgaatta

SEQ ID NO: 1438212 - DNA, 15 bp, Homo sapiens
gttgcaaggccgctg

SEQ ID NO: 1438213 - DNA, 16 bp, Homo sapiens
gttgcaaggccgctgt

SEQ ID NO: 1438214 - DNA, 12 bp, Homo sapiens
gttgcacacagt

SEQ ID NO: 1438215 - DNA, 20 bp, Homo sapiens
gttgcagtgagccgagatca

SEQ ID NO: 1438216 - DNA, 16 bp, Homo sapiens
gttgcatagcagtata

SEQ ID NO: 1438217 - DNA, 20 bp, Homo sapiens
gttgcatgtagtaacactaa

SEQ ID NO: 1438218 - DNA, 20 bp, Homo sapiens
gttgccaaatatgtcctggg

SEQ ID NO: 1438219 - DNA, 23 bp, Homo sapiens
gttgccaaattgctgcatatttg

SEQ ID NO: 1438220 - DNA, 20 bp, Homo sapiens
gtcctggtggggctgagcct

SEQ ID NO: 1438221 - DNA, 19 bp, Homo sapiens
gtcctggtgggtcagccca

SEQ ID NO: 1438222 - DNA, 21 bp, Homo sapiens
gtcctgtagttgcgtggactc

SEQ ID NO: 1438223 - DNA, 23 bp, Homo sapiens
gtcctgtagttgcgtggactctg

SEQ ID NO: 1438224 - DNA, 15 bp, Homo sapiens
gtcctgtcccagagg

SEQ ID NO: 1438225 - DNA, 14 bp, Homo sapiens
gtcctgtcctgctc

SEQ ID NO: 1438226 - DNA, 23 bp, Homo sapiens
gtcctgtcgaaggggaggcacac

SEQ ID NO: 1438227 - DNA, 21 bp, Homo sapiens
gtcctgttaacgtcatctcag

SEQ ID NO: 1438228 - DNA, 22 bp, Homo sapiens
gtcctgttaacgtcatctcagg

SEQ ID NO: 1438229 - DNA, 19 bp, Homo sapiens
gtccttaaaaatcacactg

SEQ ID NO: 1438230 - DNA, 18 bp, Homo sapiens
gtccttaggcctctgaga

SEQ ID NO: 1438231 - DNA, 22 bp, Homo sapiens
gtccttcactggcgccttctcg

SEQ ID NO: 1438232 - DNA, 13 bp, Homo sapiens
gtccttcagagct

SEQ ID NO: 1438233 - DNA, 14 bp, Homo sapiens
gtccttcagagctc

SEQ ID NO: 1438234 - DNA, 15 bp, Homo sapiens
gtccttccacctgcc

SEQ ID NO: 1438235 - DNA, 15 bp, Homo sapiens
gtccttccctgccac

SEQ ID NO: 1438236 - DNA, 16 bp, Homo sapiens
gtccttccctgccact

SEQ ID NO: 1438237 - DNA, 16 bp, Homo sapiens
gtccttcctctcaagc

SEQ ID NO: 1438238 - DNA, 16 bp, Homo sapiens
gtccttgatgccagag

SEQ ID NO: 1438239 - DNA, 20 bp, Homo sapiens
gtccttgatgccagagggcc

SEQ ID NO: 1438240 - DNA, 12 bp, Homo sapiens
gtccttgcacac

SEQ ID NO: 1438241 - DNA, 14 bp, Homo sapiens
gtccttgcacctgc

SEQ ID NO: 1438242 - DNA, 17 bp, Homo sapiens
gtccttgcacctgcatc

SEQ ID NO: 1438243 - DNA, 13 bp, Homo sapiens
gtccttgggcctg

SEQ ID NO: 1438244 - DNA, 14 bp, Homo sapiens
gtccttgggcctgg

SEQ ID NO: 1438245 - DNA, 15 bp, Homo sapiens
gtccttgggcctggc

SEQ ID NO: 1438246 - DNA, 13 bp, Homo sapiens
gtccttgggcgtc

SEQ ID NO: 1438247 - DNA, 21 bp, Homo sapiens
gtcctttacactcaggctttc

SEQ ID NO: 1438248 - DNA, 20 bp, Homo sapiens
gtcctttccaaggcttctcc

SEQ ID NO: 1438249 - DNA, 21 bp, Homo sapiens
gtcctttccatctgtccacat

SEQ ID NO: 1438250 - DNA, 18 bp, Homo sapiens
gtcctttcccaccattcc

SEQ ID NO: 1438251 - DNA, 21 bp, Homo sapiens
gtcctttcccaccattcctgc

SEQ ID NO: 1438252 - DNA, 22 bp, Homo sapiens
gtccttttatttctccatcttt

SEQ ID NO: 1438253 - DNA, 15 bp, Homo sapiens
gtccttttcactaca

SEQ ID NO: 1438254 - DNA, 15 bp, Homo sapiens
gtccttttcagaagt

SEQ ID NO: 1438255 - DNA, 15 bp, Homo sapiens
gtccttttgacactg

SEQ ID NO: 1438256 - DNA, 19 bp, Homo sapiens
gtcctttttcactttgaaa

SEQ ID NO: 1438257 - DNA, 21 bp, Homo sapiens
gtcctttttcactttgaaaag

SEQ ID NO: 1438258 - DNA, 17 bp, Homo sapiens
gtcgaccccaaaggaac

SEQ ID NO: 1438259 - DNA, 18 bp, Homo sapiens
gtcgaccccaaaggaaca

SEQ ID NO: 1438260 - DNA, 22 bp, Homo sapiens
gtcgagaaagaggcaccaggaa

SEQ ID NO: 1438261 - DNA, 19 bp, Homo sapiens
gtcgagcatttcttctact

SEQ ID NO: 1438262 - DNA, 23 bp, Homo sapiens
gtcgaggccacattgctggctgc

SEQ ID NO: 1438263 - DNA, 17 bp, Homo sapiens
gtcgaggctgcagtcag

SEQ ID NO: 1438264 - DNA, 19 bp, Homo sapiens
gtcgcagaccagagctgtc

SEQ ID NO: 1438265 - DNA, 19 bp, Homo sapiens
gtcgcagctaccctcagcc

SEQ ID NO: 1438266 - DNA, 20 bp, Homo sapiens
gtcgcaggatccgctgccac

SEQ ID NO: 1438267 - DNA, 22 bp, Homo sapiens
gtcgcaggatccgctgccacca

SEQ ID NO: 1438268 - DNA, 18 bp, Homo sapiens
gtcgccagtcactgctgc

SEQ ID NO: 1438269 - DNA, 22 bp, Homo sapiens
gtcgccagtcactgctgcaagg

SEQ ID NO: 1438270 - DNA, 14 bp, Homo sapiens
gtcgctatgtgact

SEQ ID NO: 1438271 - DNA, 15 bp, Homo sapiens
gtcgctatgtgactt

SEQ ID NO: 1438272 - DNA, 21 bp, Homo sapiens
gtcgctcatgtgtgcaacagg

SEQ ID NO: 1438273 - DNA, 15 bp, Homo sapiens
gtcgctcctgcccac

SEQ ID NO: 1438274 - DNA, 14 bp, Homo sapiens
gtcggagctgcctg

SEQ ID NO: 1438275 - DNA, 17 bp, Homo sapiens
gtcggctgaccatgctc

SEQ ID NO: 1438276 - DNA, 18 bp, Homo sapiens
gtcggctgaccatgctca

SEQ ID NO: 1438277 - DNA, 22 bp, Homo sapiens
gtcgggcagtggaggctgctgt

SEQ ID NO: 1438278 - DNA, 22 bp, Homo sapiens
gtcgggcatggtggctcatgcc

SEQ ID NO: 1438279 - DNA, 14 bp, Homo sapiens
gtcgggggagagag

SEQ ID NO: 1438280 - DNA, 19 bp, Homo sapiens
gtcggggtgggggtgggaa

SEQ ID NO: 1438281 - DNA, 23 bp, Homo sapiens
gtcgggttttattgtttaaaatc

SEQ ID NO: 1438282 - DNA, 19 bp, Homo sapiens
gtcgtcactaatacacagt

SEQ ID NO: 1438283 - DNA, 13 bp, Homo sapiens
gtcgtgcctgtgt

SEQ ID NO: 1438284 - DNA, 15 bp, Homo sapiens
gtcgtgcctgtgtcc

SEQ ID NO: 1438285 - DNA, 14 bp, Homo sapiens
gtcgtgggatggca

SEQ ID NO: 1438286 - DNA, 13 bp, Homo sapiens
gtcgttttagtgt

SEQ ID NO: 1438287 - DNA, 18 bp, Homo sapiens
gtcgttttagtgtctgac

SEQ ID NO: 1438288 - DNA, 19 bp, Homo sapiens
gtcgttttagtgtctgacc

SEQ ID NO: 1438289 - DNA, 12 bp, Homo sapiens
gtctaaaaacac

SEQ ID NO: 1438290 - DNA, 16 bp, Homo sapiens
gtctaaatatttcctt

SEQ ID NO: 1438291 - DNA, 13 bp, Homo sapiens
gtctaaatttgaa

SEQ ID NO: 1438292 - DNA, 21 bp, Homo sapiens
gtctaagatagtaacaatgaa

SEQ ID NO: 1438293 - DNA, 16 bp, Homo sapiens
gtctaagattctagat

SEQ ID NO: 1438294 - DNA, 20 bp, Homo sapiens
gtctaagcaagatgttttgt

SEQ ID NO: 1438295 - DNA, 21 bp, Homo sapiens
gtctaagcagttttgtaaatg

SEQ ID NO: 1438296 - DNA, 22 bp, Homo sapiens
gtctaatgtttgtgagaagctt

SEQ ID NO: 1438297 - DNA, 14 bp, Homo sapiens
gtctaattgtcccc

SEQ ID NO: 1438298 - DNA, 21 bp, Homo sapiens
gtctacgggggcacttggagg

SEQ ID NO: 1438299 - DNA, 16 bp, Homo sapiens
gtctactcatccagac

SEQ ID NO: 1438300 - DNA, 15 bp, Homo sapiens
gtctactgcaagagc

SEQ ID NO: 1438301 - DNA, 19 bp, Homo sapiens
gtctactgtggtgatctgt

SEQ ID NO: 1438302 - DNA, 12 bp, Homo sapiens
gtctagaatgtg

SEQ ID NO: 1438303 - DNA, 21 bp, Homo sapiens
gtctagattcaaaggttctag

SEQ ID NO: 1438304 - DNA, 15 bp, Homo sapiens
gtctaggactgcagt

SEQ ID NO: 1438305 - DNA, 17 bp, Homo sapiens
gtctaggattgggcctc

SEQ ID NO: 1438306 - DNA, 15 bp, Homo sapiens
gtctaggtctcctca

SEQ ID NO: 1438307 - DNA, 16 bp, Homo sapiens
gtctaggtctcctcag

SEQ ID NO: 1438308 - DNA, 22 bp, Homo sapiens
gtctagtcacgcatgcagtgtt

SEQ ID NO: 1438309 - DNA, 21 bp, Homo sapiens
gtctataatcccagcactttg

SEQ ID NO: 1438310 - DNA, 16 bp, Homo sapiens
gtctataccttaagaa

SEQ ID NO: 1438311 - DNA, 17 bp, Homo sapiens
gtctatatgaaaaacaa

SEQ ID NO: 1438312 - DNA, 20 bp, Homo sapiens
gtctatcctagtcttcacaa

SEQ ID NO: 1438313 - DNA, 16 bp, Homo sapiens
gtctatgaagttgctg

SEQ ID NO: 1438314 - DNA, 15 bp, Homo sapiens
gttgccaacagttgt

SEQ ID NO: 1438315 - DNA, 19 bp, Homo sapiens
gttgccaactaagccctcg

SEQ ID NO: 1438316 - DNA, 18 bp, Homo sapiens
gttgccaagctccaagcc

SEQ ID NO: 1438317 - DNA, 18 bp, Homo sapiens
gttgccaggttgcagctg

SEQ ID NO: 1438318 - DNA, 20 bp, Homo sapiens
gttgccaggttgcagctgct

SEQ ID NO: 1438319 - DNA, 23 bp, Homo sapiens
gttgccatcctaccgtcttttcc

SEQ ID NO: 1438320 - DNA, 15 bp, Homo sapiens
gttgccatggattca

SEQ ID NO: 1438321 - DNA, 16 bp, Homo sapiens
gttgcccagtgtgagg

SEQ ID NO: 1438322 - DNA, 18 bp, Homo sapiens
gttgcctgcacccttccc

SEQ ID NO: 1438323 - DNA, 19 bp, Homo sapiens
gttgcctgcacccttccct

SEQ ID NO: 1438324 - DNA, 20 bp, Homo sapiens
gttgcctgcacccttccctc

SEQ ID NO: 1438325 - DNA, 15 bp, Homo sapiens
gttgccttgcatttg

SEQ ID NO: 1438326 - DNA, 17 bp, Homo sapiens
gttgcgacggagagaaa

SEQ ID NO: 1438327 - DNA, 22 bp, Homo sapiens
gttgctaagaagcgagcactga

SEQ ID NO: 1438328 - DNA, 18 bp, Homo sapiens
gttgctcaaaaaatgagc

SEQ ID NO: 1438329 - DNA, 23 bp, Homo sapiens
gttgctgatccctgctctctgag

SEQ ID NO: 1438330 - DNA, 23 bp, Homo sapiens
gttgctgatgaactcttaatcaa

SEQ ID NO: 1438331 - DNA, 21 bp, Homo sapiens
gttgctgatgggtagtacctg

SEQ ID NO: 1438332 - DNA, 17 bp, Homo sapiens
gttgctgtgccgtgtcc

SEQ ID NO: 1438333 - DNA, 14 bp, Homo sapiens
gttgcttgtcttct

SEQ ID NO: 1438334 - DNA, 20 bp, Homo sapiens
gttgctttaaagtacctgta

SEQ ID NO: 1438335 - DNA, 13 bp, Homo sapiens
gttggaaccgtgt

SEQ ID NO: 1438336 - DNA, 23 bp, Homo sapiens
gttggaaccgtgtccagcacaga

SEQ ID NO: 1438337 - DNA, 22 bp, Homo sapiens
gttggaactctgtgcaggtgct

SEQ ID NO: 1438338 - DNA, 15 bp, Homo sapiens
gttggaagaaaagaa

SEQ ID NO: 1438339 - DNA, 18 bp, Homo sapiens
gttggaagaaaagaatca

SEQ ID NO: 1438340 - DNA, 15 bp, Homo sapiens
gttggaagaggaaca

SEQ ID NO: 1438341 - DNA, 17 bp, Homo sapiens
gttggaaggatctgctg

SEQ ID NO: 1438342 - DNA, 22 bp, Homo sapiens
gttggaatgaattaaataaacc

SEQ ID NO: 1438343 - DNA, 22 bp, Homo sapiens
gttggaatggatttttctttaa

SEQ ID NO: 1438344 - DNA, 17 bp, Homo sapiens
gttggaccagaggaagc

SEQ ID NO: 1438345 - DNA, 14 bp, Homo sapiens
gttggacttcagtc

SEQ ID NO: 1438346 - DNA, 12 bp, Homo sapiens
gttggagccact

SEQ ID NO: 1438347 - DNA, 14 bp, Homo sapiens
gttggagcctgcag

SEQ ID NO: 1438348 - DNA, 16 bp, Homo sapiens
gttggagcctgcaggg

SEQ ID NO: 1438349 - DNA, 22 bp, Homo sapiens
gttggaggtgattccagtgaag

SEQ ID NO: 1438350 - DNA, 20 bp, Homo sapiens
gttggagtagaatgtagttt

SEQ ID NO: 1438351 - DNA, 14 bp, Homo sapiens
gttggagtgcagtg

SEQ ID NO: 1438352 - DNA, 13 bp, Homo sapiens
gttggcaggccca

SEQ ID NO: 1438353 - DNA, 16 bp, Homo sapiens
gttggcaggcccactc

SEQ ID NO: 1438354 - DNA, 20 bp, Homo sapiens
gttggccgtggtccagctct

SEQ ID NO: 1438355 - DNA, 12 bp, Homo sapiens
gttggctgctgc

SEQ ID NO: 1438356 - DNA, 15 bp, Homo sapiens
gttggctgctgcggc

SEQ ID NO: 1438357 - DNA, 19 bp, Homo sapiens
gttggctgtgtgacagaat

SEQ ID NO: 1438358 - DNA, 16 bp, Homo sapiens
gttggctgttccagac

SEQ ID NO: 1438359 - DNA, 14 bp, Homo sapiens
gttgggactcagga

SEQ ID NO: 1438360 - DNA, 14 bp, Homo sapiens
gttgggagcactgg

SEQ ID NO: 1438361 - DNA, 16 bp, Homo sapiens
gttgggattcctgacc

SEQ ID NO: 1438362 - DNA, 15 bp, Homo sapiens
gttgggcccagatct

SEQ ID NO: 1438363 - DNA, 18 bp, Homo sapiens
gttgggcccctgaggagc

SEQ ID NO: 1438364 - DNA, 17 bp, Homo sapiens
gttggggagggatgaag

SEQ ID NO: 1438365 - DNA, 14 bp, Homo sapiens
gttggggaggggcg

SEQ ID NO: 1438366 - DNA, 18 bp, Homo sapiens
gttgggggacagccttca

SEQ ID NO: 1438367 - DNA, 18 bp, Homo sapiens
gttgggggctcctgtttc

SEQ ID NO: 1438368 - DNA, 13 bp, Homo sapiens
gttggggggtgcc

SEQ ID NO: 1438369 - DNA, 21 bp, Homo sapiens
gttgggtgtctccttaagctg

SEQ ID NO: 1438370 - DNA, 15 bp, Homo sapiens
gttggtagccatttg

SEQ ID NO: 1438371 - DNA, 18 bp, Homo sapiens
gttggtatattttatatt

SEQ ID NO: 1438372 - DNA, 13 bp, Homo sapiens
gttggtctgtgta

SEQ ID NO: 1438373 - DNA, 20 bp, Homo sapiens
gttggtctttgtctgcaggt

SEQ ID NO: 1438374 - DNA, 14 bp, Homo sapiens
gttggtgactgaaa

SEQ ID NO: 1438375 - DNA, 22 bp, Homo sapiens
gttggtggggggtccagtctgt

SEQ ID NO: 1438376 - DNA, 18 bp, Homo sapiens
gttggtgttccacgtgtt

SEQ ID NO: 1438377 - DNA, 16 bp, Homo sapiens
gttggtttgtatgaga

SEQ ID NO: 1438378 - DNA, 18 bp, Homo sapiens
gttgtaaataatttattt

SEQ ID NO: 1438379 - DNA, 17 bp, Homo sapiens
gttgtaacctgctgtga

SEQ ID NO: 1438380 - DNA, 22 bp, Homo sapiens
gttgtacgttttgcacattttg

SEQ ID NO: 1438381 - DNA, 13 bp, Homo sapiens
gttgtactttaaa

SEQ ID NO: 1438382 - DNA, 18 bp, Homo sapiens
gttgtactttggaattct

SEQ ID NO: 1438383 - DNA, 18 bp, Homo sapiens
gttgtatcagcacgtgtg

SEQ ID NO: 1438384 - DNA, 13 bp, Homo sapiens
gttgtatgtttgc

SEQ ID NO: 1438385 - DNA, 15 bp, Homo sapiens
gttgtcaaggaagaa

SEQ ID NO: 1438386 - DNA, 16 bp, Homo sapiens
gttgtcaaggaagaag

SEQ ID NO: 1438387 - DNA, 17 bp, Homo sapiens
gttgtcaagtctctgct

SEQ ID NO: 1438388 - DNA, 19 bp, Homo sapiens
gttgtcaatattaaataca

SEQ ID NO: 1438389 - DNA, 23 bp, Homo sapiens
gttgtcaatattaaatacagaca

SEQ ID NO: 1438390 - DNA, 20 bp, Homo sapiens
gttgtcacagaaattatgat

SEQ ID NO: 1438391 - DNA, 18 bp, Homo sapiens
gttgtcaccattgcacaa

SEQ ID NO: 1438392 - DNA, 17 bp, Homo sapiens
gttgtccttaaatttgt

SEQ ID NO: 1438393 - DNA, 13 bp, Homo sapiens
gttgtctacatta

SEQ ID NO: 1438394 - DNA, 18 bp, Homo sapiens
gttgtctacgggggcact

SEQ ID NO: 1438395 - DNA, 20 bp, Homo sapiens
gttgtctattctgagccttg

SEQ ID NO: 1438396 - DNA, 14 bp, Homo sapiens
gttgtctggcaagg

SEQ ID NO: 1438397 - DNA, 16 bp, Homo sapiens
gttgtctggcaaggac

SEQ ID NO: 1438398 - DNA, 14 bp, Homo sapiens
gttgtcttattgca

SEQ ID NO: 1438399 - DNA, 14 bp, Homo sapiens
gttgtgaataatta

SEQ ID NO: 1438400 - DNA, 23 bp, Homo sapiens
gttgtgactttttagccagtgac

SEQ ID NO: 1438401 - DNA, 16 bp, Homo sapiens
gttgtgcccctttcca

SEQ ID NO: 1438402 - DNA, 17 bp, Homo sapiens
gttgtggatgctccagg

SEQ ID NO: 1438403 - DNA, 13 bp, Homo sapiens
gttgtggtactgt

SEQ ID NO: 1438404 - DNA, 13 bp, Homo sapiens
gttgtgtgtggga

SEQ ID NO: 1438405 - DNA, 13 bp, Homo sapiens
gttgtgttcctgg

SEQ ID NO: 1438406 - DNA, 23 bp, Homo sapiens
gttgtgttgttttttgttcaatg

SEQ ID NO: 1438407 - DNA, 17 bp, Homo sapiens
gttgttaatgaaaatgt

SEQ ID NO: 1438408 - DNA, 19 bp, Homo sapiens
gttgttaatgaaaatgtca

SEQ ID NO: 1438409 - DNA, 22 bp, Homo sapiens
gttgttaattttattgcaaagt

SEQ ID NO: 1438410 - DNA, 19 bp, Homo sapiens
gttgttatattatttacat

SEQ ID NO: 1438411 - DNA, 19 bp, Homo sapiens
gttgttcctctatactttg

SEQ ID NO: 1438412 - DNA, 17 bp, Homo sapiens
gttgttctttctcttct

SEQ ID NO: 1438413 - DNA, 19 bp, Homo sapiens
gttgttgcaccatctgctt

SEQ ID NO: 1438414 - DNA, 14 bp, Homo sapiens
gttgttgctgctgt

SEQ ID NO: 1438415 - DNA, 24 bp, Homo sapiens
gttgttgttaatgaaaatgtcaga

SEQ ID NO: 1438416 - DNA, 15 bp, Homo sapiens
gttgttgttgctgct

SEQ ID NO: 1438417 - DNA, 20 bp, Homo sapiens
gttgtttacttaaagattta

SEQ ID NO: 1438418 - DNA, 12 bp, Homo sapiens
gttgtttgcatg

SEQ ID NO: 1438419 - DNA, 14 bp, Homo sapiens
gttgtttgcttctt

SEQ ID NO: 1438420 - DNA, 16 bp, Homo sapiens
gttgttttctactttg

SEQ ID NO: 1438421 - DNA, 22 bp, Homo sapiens
gtttaaaactcagaatataaca

SEQ ID NO: 1438422 - DNA, 10 bp, Homo sapiens
gtttaaaatc

SEQ ID NO: 1438423 - DNA, 21 bp, Homo sapiens
gtttaaaatgtaatttaaatg

SEQ ID NO: 1438424 - DNA, 16 bp, Homo sapiens
gtttaaactgattcat

SEQ ID NO: 1438425 - DNA, 13 bp, Homo sapiens
gtttaaagaaagt

SEQ ID NO: 1438426 - DNA, 15 bp, Homo sapiens
gtttaaagaaagtgt

SEQ ID NO: 1438427 - DNA, 20 bp, Homo sapiens
gtttaaatagcctaaatgat

SEQ ID NO: 1438428 - DNA, 18 bp, Homo sapiens
gtttaacaaaagatttgt

SEQ ID NO: 1438429 - DNA, 12 bp, Homo sapiens
gtttaagtgttg

SEQ ID NO: 1438430 - DNA, 12 bp, Homo sapiens
gtttaataaagg

SEQ ID NO: 1438431 - DNA, 21 bp, Homo sapiens
gtttaatgggtatgctcaggt

SEQ ID NO: 1438432 - DNA, 21 bp, Homo sapiens
gtttacactgcggaagccaaa

SEQ ID NO: 1438433 - DNA, 18 bp, Homo sapiens
gtttacagaaaaatcttg

SEQ ID NO: 1438434 - DNA, 17 bp, Homo sapiens
gtttacaggtggacaca

SEQ ID NO: 1438435 - DNA, 18 bp, Homo sapiens
gtttacataagagaaaga

SEQ ID NO: 1438436 - DNA, 20 bp, Homo sapiens
gtttacattgtcctgtagct

SEQ ID NO: 1438437 - DNA, 18 bp, Homo sapiens
gtttaccagttgcctttt

SEQ ID NO: 1438438 - DNA, 16 bp, Homo sapiens
gtttaccatttgtaat

SEQ ID NO: 1438439 - DNA, 18 bp, Homo sapiens
gtttaccatttgtaataa

SEQ ID NO: 1438440 - DNA, 19 bp, Homo sapiens
gtttaccggttgtttagaa

SEQ ID NO: 1438441 - DNA, 23 bp, Homo sapiens
gtttaccggttgtttagaaacag

SEQ ID NO: 1438442 - DNA, 21 bp, Homo sapiens
gtttactatgtgccagttcct

SEQ ID NO: 1438443 - DNA, 14 bp, Homo sapiens
gtttactgtaaatt

SEQ ID NO: 1438444 - DNA, 15 bp, Homo sapiens
gtttactgtaaattt

SEQ ID NO: 1438445 - DNA, 13 bp, Homo sapiens
gtttactgtgaag

SEQ ID NO: 1438446 - DNA, 14 bp, Homo sapiens
gtttactgtgaaga

SEQ ID NO: 1438447 - DNA, 22 bp, Homo sapiens
gtttacttaaagatttatcaaa

SEQ ID NO: 1438448 - DNA, 22 bp, Homo sapiens
gtttacttctttagcattttta

SEQ ID NO: 1438449 - DNA, 14 bp, Homo sapiens
gtttactttaactt

SEQ ID NO: 1438450 - DNA, 16 bp, Homo sapiens
gtttagaaaaaacaat

SEQ ID NO: 1438451 - DNA, 23 bp, Homo sapiens
gtttagagagcctgtcaccagag

SEQ ID NO: 1438452 - DNA, 17 bp, Homo sapiens
gtttagagccctcccta

SEQ ID NO: 1438453 - DNA, 15 bp, Homo sapiens
gtttagttctgttga

SEQ ID NO: 1438454 - DNA, 21 bp, Homo sapiens
gtttatacagtgtacatgtac

SEQ ID NO: 1438455 - DNA, 22 bp, Homo sapiens
gtttatatacagtacacagata

SEQ ID NO: 1438456 - DNA, 14 bp, Homo sapiens
gtttatcagtaaat

SEQ ID NO: 1438457 - DNA, 17 bp, Homo sapiens
gtttatcccttaagaat

SEQ ID NO: 1438458 - DNA, 18 bp, Homo sapiens
gtttatgagatgctggtt

SEQ ID NO: 1438459 - DNA, 21 bp, Homo sapiens
gtttatgagatgctggttttc

SEQ ID NO: 1438460 - DNA, 18 bp, Homo sapiens
gtttatggatatgctgct

SEQ ID NO: 1438461 - DNA, 13 bp, Homo sapiens
gtttatggcctca

SEQ ID NO: 1438462 - DNA, 14 bp, Homo sapiens
gtttatggcctcag

SEQ ID NO: 1438463 - DNA, 18 bp, Homo sapiens
gtttatggcctcagctgc

SEQ ID NO: 1438464 - DNA, 18 bp, Homo sapiens
gtttatgtaaatgtttgt

SEQ ID NO: 1438465 - DNA, 17 bp, Homo sapiens
gtttatgtgttatgaac

SEQ ID NO: 1438466 - DNA, 14 bp, Homo sapiens
gtttattaatctta

SEQ ID NO: 1438467 - DNA, 20 bp, Homo sapiens
gtttattaatcttagtgtat

SEQ ID NO: 1438468 - DNA, 22 bp, Homo sapiens
gtttattaatcttagtgtatga

SEQ ID NO: 1438469 - DNA, 13 bp, Homo sapiens
gtttattcccaag

SEQ ID NO: 1438470 - DNA, 20 bp, Homo sapiens
gtttattcttccagaatgct

SEQ ID NO: 1438471 - DNA, 15 bp, Homo sapiens
gtttattcttctaga

SEQ ID NO: 1438472 - DNA, 16 bp, Homo sapiens
gtttattcttctagag

SEQ ID NO: 1438473 - DNA, 16 bp, Homo sapiens
gtttattcttgatgaa

SEQ ID NO: 1438474 - DNA, 20 bp, Homo sapiens
gtttattggaagtgttcaag

SEQ ID NO: 1438475 - DNA, 18 bp, Homo sapiens
gtttatttaaggatggat

SEQ ID NO: 1438476 - DNA, 21 bp, Homo sapiens
gtttatttaaggatggatggc

SEQ ID NO: 1438477 - DNA, 22 bp, Homo sapiens
gtttatttaaggatggatggca

SEQ ID NO: 1438478 - DNA, 23 bp, Homo sapiens
gtttatttaaggatggatggcac

SEQ ID NO: 1438479 - DNA, 16 bp, Homo sapiens
gtttatttatcagtga

SEQ ID NO: 1438480 - DNA, 15 bp, Homo sapiens
gtttatttattcact

SEQ ID NO: 1438481 - DNA, 18 bp, Homo sapiens
gtttcaaacacaaatgca

SEQ ID NO: 1438482 - DNA, 13 bp, Homo sapiens
gtttcaaagcaca

SEQ ID NO: 1438483 - DNA, 23 bp, Homo sapiens
gtttcaaccaagtcatgtgcatt

SEQ ID NO: 1438484 - DNA, 18 bp, Homo sapiens
gtttcaacggaaagtgct

SEQ ID NO: 1438485 - DNA, 19 bp, Homo sapiens
gtttcaaggcactctagat

SEQ ID NO: 1438486 - DNA, 16 bp, Homo sapiens
gtttcaagttattcaa

SEQ ID NO: 1438487 - DNA, 17 bp, Homo sapiens
gtttcaagttattcaaa

SEQ ID NO: 1438488 - DNA, 19 bp, Homo sapiens
gtttcaagttattcaaatt

SEQ ID NO: 1438489 - DNA, 22 bp, Homo sapiens
gtttcagacagggtctgaagga

SEQ ID NO: 1438490 - DNA, 22 bp, Homo sapiens
gtttcagcaacaagactgccag

SEQ ID NO: 1438491 - DNA, 20 bp, Homo sapiens
gtttcagtgaagatgctgta

SEQ ID NO: 1438492 - DNA, 22 bp, Homo sapiens
gtttcagtgaagatgctgtaaa

SEQ ID NO: 1438493 - DNA, 12 bp, Homo sapiens
gtttcagtttga

SEQ ID NO: 1438494 - DNA, 22 bp, Homo sapiens
gtttcatattcatgcaagtatt

SEQ ID NO: 1438495 - DNA, 21 bp, Homo sapiens
gtttcatgttagttaccttat

SEQ ID NO: 1438496 - DNA, 22 bp, Homo sapiens
gtttccatttctcaatcagtgc

SEQ ID NO: 1438497 - DNA, 14 bp, Homo sapiens
gtttcccaggccca

SEQ ID NO: 1438498 - DNA, 13 bp, Homo sapiens
gtttcccataatt

SEQ ID NO: 1438499 - DNA, 15 bp, Homo sapiens
gtttcccataatttt

SEQ ID NO: 1438500 - DNA, 23 bp, Homo sapiens
gtttcccattggttcacctgtga

SEQ ID NO: 1438501 - DNA, 23 bp, Homo sapiens
gtttccctcaaatgcgcgtgtgc

SEQ ID NO: 1438502 - DNA, 11 bp, Homo sapiens
gtttccctgct

SEQ ID NO: 1438503 - DNA, 16 bp, Homo sapiens
gtttcctatttaatac

SEQ ID NO: 1438504 - DNA, 18 bp, Homo sapiens
gtttcctctagttctttg

SEQ ID NO: 1438505 - DNA, 13 bp, Homo sapiens
gtttcctctgttc

SEQ ID NO: 1438506 - DNA, 14 bp, Homo sapiens
gtttcctcttccaa

SEQ ID NO: 1438507 - DNA, 17 bp, Homo sapiens
gtttcctgacattgtct

SEQ ID NO: 1438508 - DNA, 21 bp, Homo sapiens
gtttcctgagggttttctcat

SEQ ID NO: 1438509 - DNA, 20 bp, Homo sapiens
gtttcctggaagcagagcaa

SEQ ID NO: 1438510 - DNA, 15 bp, Homo sapiens
gtttccttaaacatg

SEQ ID NO: 1438511 - DNA, 21 bp, Homo sapiens
gtttccttttggaacatttct

SEQ ID NO: 1438512 - DNA, 22 bp, Homo sapiens
gtttccttttggaacatttctt

SEQ ID NO: 1438513 - DNA, 17 bp, Homo sapiens
gtttcgactggtccagc

SEQ ID NO: 1438514 - DNA, 18 bp, Homo sapiens
gtttcgactggtccagct

SEQ ID NO: 1438515 - DNA, 20 bp, Homo sapiens
gtttcgactggtccagctct

SEQ ID NO: 1438516 - DNA, 21 bp, Homo sapiens
gtttcgactggtccagctctg

SEQ ID NO: 1438517 - DNA, 22 bp, Homo sapiens
gtttcgactggtccagctctga

SEQ ID NO: 1438518 - DNA, 22 bp, Homo sapiens
gtttcgtatgcactcccttgag

SEQ ID NO: 1438519 - DNA, 23 bp, Homo sapiens
gtttcgtggggaggtctaatcta

SEQ ID NO: 1438520 - DNA, 16 bp, Homo sapiens
gtttcgtttctgtata

SEQ ID NO: 1438521 - DNA, 18 bp, Homo sapiens
gtttctaagaaaatgtag

SEQ ID NO: 1438522 - DNA, 11 bp, Homo sapiens
gtttctaaggt

SEQ ID NO: 1438523 - DNA, 13 bp, Homo sapiens
gtttctatactgt

SEQ ID NO: 1438524 - DNA, 20 bp, Homo sapiens
gtttctatactgtttgtaat

SEQ ID NO: 1438525 - DNA, 21 bp, Homo sapiens
gtttctatactgtttgtaata

SEQ ID NO: 1438526 - DNA, 18 bp, Homo sapiens
gtttctcaaaagaggtta

SEQ ID NO: 1438527 - DNA, 18 bp, Homo sapiens
gtttctcacattgctgta

SEQ ID NO: 1438528 - DNA, 19 bp, Homo sapiens
gtttctcagatccttgttt

SEQ ID NO: 1438529 - DNA, 18 bp, Homo sapiens
gtttctccaaactgaagc

SEQ ID NO: 1438530 - DNA, 22 bp, Homo sapiens
gtttctccccctgggctctgcc

SEQ ID NO: 1438531 - DNA, 21 bp, Homo sapiens
gtttctctcttcccttctccc

SEQ ID NO: 1438532 - DNA, 21 bp, Homo sapiens
gtttctggagtgattctagag

SEQ ID NO: 1438533 - DNA, 23 bp, Homo sapiens
gtttctgggtcctgaagaattaa

SEQ ID NO: 1438534 - DNA, 12 bp, Homo sapiens
gtttctgtatat

SEQ ID NO: 1438535 - DNA, 21 bp, Homo sapiens
gtttctgtatatgattctctg

SEQ ID NO: 1438536 - DNA, 14 bp, Homo sapiens
gtttctgttggata

SEQ ID NO: 1438537 - DNA, 22 bp, Homo sapiens
gtttcttaaccctttccagagt

SEQ ID NO: 1438538 - DNA, 13 bp, Homo sapiens
gtttcttcattct

SEQ ID NO: 1438539 - DNA, 16 bp, Homo sapiens
gtttcttcctgccagc

SEQ ID NO: 1438540 - DNA, 17 bp, Homo sapiens
gtttcttcctgccagca

SEQ ID NO: 1438541 - DNA, 11 bp, Homo sapiens
gtttcttcttc

SEQ ID NO: 1438542 - DNA, 17 bp, Homo sapiens
gtttcttctttctagag

SEQ ID NO: 1438543 - DNA, 15 bp, Homo sapiens
gtttcttgacaagct

SEQ ID NO: 1438544 - DNA, 13 bp, Homo sapiens
gtttctttcccca

SEQ ID NO: 1438545 - DNA, 19 bp, Homo sapiens
gtttctttctgtctgcttt

SEQ ID NO: 1438546 - DNA, 14 bp, Homo sapiens
gtttcttttaaaga

SEQ ID NO: 1438547 - DNA, 20 bp, Homo sapiens
gtttcttttaatgtgaggaa

SEQ ID NO: 1438548 - DNA, 21 bp, Homo sapiens
gtttgaaaacaaaaaaaatgt

SEQ ID NO: 1438549 - DNA, 17 bp, Homo sapiens
gtttgaaagattatgat

SEQ ID NO: 1438550 - DNA, 18 bp, Homo sapiens
gtttgaagacacagcctc

SEQ ID NO: 1438551 - DNA, 21 bp, Homo sapiens
gtttgaagacacagcctcccc

SEQ ID NO: 1438552 - DNA, 22 bp, Homo sapiens
gtttgaagacacagcctccccc

SEQ ID NO: 1438553 - DNA, 16 bp, Homo sapiens
gtttgaaggaaacagt

SEQ ID NO: 1438554 - DNA, 14 bp, Homo sapiens
gtttgaattcagta

SEQ ID NO: 1438555 - DNA, 21 bp, Homo sapiens
gtttgaattcctcctctattt

SEQ ID NO: 1438556 - DNA, 20 bp, Homo sapiens
gtttgaatttgtattaaaaa

SEQ ID NO: 1438557 - DNA, 19 bp, Homo sapiens
gtttgacaattttgtctta

SEQ ID NO: 1438558 - DNA, 13 bp, Homo sapiens
gtttgactcagtt

SEQ ID NO: 1438559 - DNA, 20 bp, Homo sapiens
gtttgagaagaaaacatcta

SEQ ID NO: 1438560 - DNA, 20 bp, Homo sapiens
gtttgagacaagccctggca

SEQ ID NO: 1438561 - DNA, 21 bp, Homo sapiens
gtttgagacaagccctggcaa

SEQ ID NO: 1438562 - DNA, 18 bp, Homo sapiens
gtttgagacactggttta

SEQ ID NO: 1438563 - DNA, 15 bp, Homo sapiens
gtttgagctcagacc

SEQ ID NO: 1438564 - DNA, 16 bp, Homo sapiens
gtttgagctcagaccc

SEQ ID NO: 1438565 - DNA, 13 bp, Homo sapiens
gtttgagctgcct

SEQ ID NO: 1438566 - DNA, 18 bp, Homo sapiens
gtttgaggaaatttgcag

SEQ ID NO: 1438567 - DNA, 14 bp, Homo sapiens
gtttgaggaatatt

SEQ ID NO: 1438568 - DNA, 16 bp, Homo sapiens
gtttgagtccctccaa

SEQ ID NO: 1438569 - DNA, 23 bp, Homo sapiens
gtttgagtccctccaaagggcag

SEQ ID NO: 1438570 - DNA, 19 bp, Homo sapiens
gtttgatgctatttatgca

SEQ ID NO: 1438571 - DNA, 14 bp, Homo sapiens
gtttgatgtatgtg

SEQ ID NO: 1438572 - DNA, 19 bp, Homo sapiens
gtttgatgtatgtgtgaaa

SEQ ID NO: 1438573 - DNA, 16 bp, Homo sapiens
gtttgattgaggagct

SEQ ID NO: 1438574 - DNA, 18 bp, Homo sapiens
gtttgattgaggagctgc

SEQ ID NO: 1438575 - DNA, 15 bp, Homo sapiens
gtttgatttcattaa

SEQ ID NO: 1438576 - DNA, 18 bp, Homo sapiens
gtttgcaaaaaatgtttt

SEQ ID NO: 1438577 - DNA, 16 bp, Homo sapiens
gtttgcaaataggcag

SEQ ID NO: 1438578 - DNA, 21 bp, Homo sapiens
gtttgcaactcgaactgcttt

SEQ ID NO: 1438579 - DNA, 13 bp, Homo sapiens
gtttgcactccac

SEQ ID NO: 1438580 - DNA, 20 bp, Homo sapiens
gtttgcactgtatgctggac

SEQ ID NO: 1438581 - DNA, 21 bp, Homo sapiens
gtttgcagaaaagcacctgcc

SEQ ID NO: 1438582 - DNA, 11 bp, Homo sapiens
gtttgcagcct

SEQ ID NO: 1438583 - DNA, 19 bp, Homo sapiens
gtttgcagctgtgagaagt

SEQ ID NO: 1438584 - DNA, 15 bp, Homo sapiens
gtttgcatttcagaa

SEQ ID NO: 1438585 - DNA, 21 bp, Homo sapiens
gtttgcatttggatgtgtaaa

SEQ ID NO: 1438586 - DNA, 15 bp, Homo sapiens
gtttgccatactttg

SEQ ID NO: 1438587 - DNA, 21 bp, Homo sapiens
gtttgctatgactacattttg

SEQ ID NO: 1438588 - DNA, 17 bp, Homo sapiens
gtttgctattagagcat

SEQ ID NO: 1438589 - DNA, 18 bp, Homo sapiens
gtttgctcaaaattgctt

SEQ ID NO: 1438590 - DNA, 17 bp, Homo sapiens
gtttggaaaagtggcgt

SEQ ID NO: 1438591 - DNA, 15 bp, Homo sapiens
gtttggaccccagct

SEQ ID NO: 1438592 - DNA, 17 bp, Homo sapiens
gtttggaccccagctgg

SEQ ID NO: 1438593 - DNA, 19 bp, Homo sapiens
gtttggaccccagctggga

SEQ ID NO: 1438594 - DNA, 18 bp, Homo sapiens
gtttggaggcccctgggc

SEQ ID NO: 1438595 - DNA, 15 bp, Homo sapiens
gtttggcaaggaaag

SEQ ID NO: 1438596 - DNA, 21 bp, Homo sapiens
gtttggcatggtgagtgttgg

SEQ ID NO: 1438597 - DNA, 17 bp, Homo sapiens
gtttggccctggagcca

SEQ ID NO: 1438598 - DNA, 21 bp, Homo sapiens
gtttggcctttcttggggaga

SEQ ID NO: 1438599 - DNA, 16 bp, Homo sapiens
gtttgggaaagatgga

SEQ ID NO: 1438600 - DNA, 22 bp, Homo sapiens
gtttggggaatgcggccgcatt

SEQ ID NO: 1438601 - DNA, 12 bp, Homo sapiens
gtttggggagaa

SEQ ID NO: 1438602 - DNA, 18 bp, Homo sapiens
gtttgggggcgccctctc

SEQ ID NO: 1438603 - DNA, 19 bp, Homo sapiens
gtttgggggcgccctctct

SEQ ID NO: 1438604 - DNA, 19 bp, Homo sapiens
gtttggtaaatgtttcttt

SEQ ID NO: 1438605 - DNA, 15 bp, Homo sapiens
gtttggtcctgtagg

SEQ ID NO: 1438606 - DNA, 16 bp, Homo sapiens
gtttggttagaggaag

SEQ ID NO: 1438607 - DNA, 13 bp, Homo sapiens
gtttgtaaatgcc

SEQ ID NO: 1438608 - DNA, 22 bp, Homo sapiens
gtttgtaccttccttaagccag

SEQ ID NO: 1438609 - DNA, 14 bp, Homo sapiens
gtttgtagccaggt

SEQ ID NO: 1438610 - DNA, 15 bp, Homo sapiens
gtttgtagccaggta

SEQ ID NO: 1438611 - DNA, 14 bp, Homo sapiens
gtttgtatgtctgt

SEQ ID NO: 1438612 - DNA, 16 bp, Homo sapiens
gtttgtatgtctgtgt

SEQ ID NO: 1438613 - DNA, 13 bp, Homo sapiens
gtttgtatgtgtg

SEQ ID NO: 1438614 - DNA, 12 bp, Homo sapiens
gtttgtattcat

SEQ ID NO: 1438615 - DNA, 20 bp, Homo sapiens
gtttgtattttttatttaca

SEQ ID NO: 1438616 - DNA, 15 bp, Homo sapiens
gtttgtcacaagtgg

SEQ ID NO: 1438617 - DNA, 15 bp, Homo sapiens
gtttgtcagcatctg

SEQ ID NO: 1438618 - DNA, 16 bp, Homo sapiens
gtttgtcagcatctga

SEQ ID NO: 1438619 - DNA, 21 bp, Homo sapiens
gtttgtcctttttcactttga

SEQ ID NO: 1438620 - DNA, 13 bp, Homo sapiens
gtttgtctatttt

SEQ ID NO: 1438621 - DNA, 15 bp, Homo sapiens
gtttgtctattttaa

SEQ ID NO: 1438622 - DNA, 15 bp, Homo sapiens
gtttgtctgaacaaa

SEQ ID NO: 1438623 - DNA, 11 bp, Homo sapiens
gtttgtctgtt

SEQ ID NO: 1438624 - DNA, 16 bp, Homo sapiens
gtttgtctgtttgttt

SEQ ID NO: 1438625 - DNA, 22 bp, Homo sapiens
gtttgtgagcatgggtgtgccc

SEQ ID NO: 1438626 - DNA, 19 bp, Homo sapiens
gtttgtgcatatctgcctc

SEQ ID NO: 1438627 - DNA, 22 bp, Homo sapiens
gtttgtgccttaaaaggagaga

SEQ ID NO: 1438628 - DNA, 19 bp, Homo sapiens
gtttgtgctgtaaagagtt

SEQ ID NO: 1438629 - DNA, 15 bp, Homo sapiens
gtttgtggcctcaga

SEQ ID NO: 1438630 - DNA, 13 bp, Homo sapiens
gtttgtggctggg

SEQ ID NO: 1438631 - DNA, 17 bp, Homo sapiens
gtttgtgggacacaaca

SEQ ID NO: 1438632 - DNA, 13 bp, Homo sapiens
gtttgtgggactg

SEQ ID NO: 1438633 - DNA, 15 bp, Homo sapiens
taaaattatgagatt

SEQ ID NO: 1438634 - DNA, 19 bp, Homo sapiens
taaaattcaagaaaataaa

SEQ ID NO: 1438635 - DNA, 23 bp, Homo sapiens
taaaattcaagaaaataaaacta

SEQ ID NO: 1438636 - DNA, 14 bp, Homo sapiens
taaaattcatttct

SEQ ID NO: 1438637 - DNA, 21 bp, Homo sapiens
taaaattctctagatttatta

SEQ ID NO: 1438638 - DNA, 18 bp, Homo sapiens
taaaattctgatgtttct

SEQ ID NO: 1438639 - DNA, 13 bp, Homo sapiens
taaaattgaaagg

SEQ ID NO: 1438640 - DNA, 12 bp, Homo sapiens
taaaattgatat

SEQ ID NO: 1438641 - DNA, 18 bp, Homo sapiens
taaaattgctatgttact

SEQ ID NO: 1438642 - DNA, 14 bp, Homo sapiens
taaaattgtatgaa

SEQ ID NO: 1438643 - DNA, 15 bp, Homo sapiens
taaaattgttaacct

SEQ ID NO: 1438644 - DNA, 15 bp, Homo sapiens
taaaatttaaaatta

SEQ ID NO: 1438645 - DNA, 23 bp, Homo sapiens
taaaatttaaatggcttttgcca

SEQ ID NO: 1438646 - DNA, 15 bp, Homo sapiens
taaaatttacattta

SEQ ID NO: 1438647 - DNA, 16 bp, Homo sapiens
taaaatttacatttaa

SEQ ID NO: 1438648 - DNA, 22 bp, Homo sapiens
taaaatttacatttaatacaga

SEQ ID NO: 1438649 - DNA, 23 bp, Homo sapiens
taaaatttacatttaatacagat

SEQ ID NO: 1438650 - DNA, 19 bp, Homo sapiens
taaaatttccttcaggttt

SEQ ID NO: 1438651 - DNA, 13 bp, Homo sapiens
taaaatttcgttg

SEQ ID NO: 1438652 - DNA, 14 bp, Homo sapiens
taaaatttgtaata

SEQ ID NO: 1438653 - DNA, 21 bp, Homo sapiens
taaaattttaggcaagttttc

SEQ ID NO: 1438654 - DNA, 21 bp, Homo sapiens
taaaattttgcttttaattaa

SEQ ID NO: 1438655 - DNA, 16 bp, Homo sapiens
taaaattttgtatgtt

SEQ ID NO: 1438656 - DNA, 20 bp, Homo sapiens
taaacaaaagcaaagatgca

SEQ ID NO: 1438657 - DNA, 18 bp, Homo sapiens
taaacaaaccacagcagg

SEQ ID NO: 1438658 - DNA, 18 bp, Homo sapiens
taaacaaagattcatgat

SEQ ID NO: 1438659 - DNA, 21 bp, Homo sapiens
taaacaaattcatattctgtc

SEQ ID NO: 1438660 - DNA, 22 bp, Homo sapiens
taaacaacgcattgccacggaa

SEQ ID NO: 1438661 - DNA, 16 bp, Homo sapiens
taaacaagaaatctga

SEQ ID NO: 1438662 - DNA, 20 bp, Homo sapiens
taaacaagattttaaagaca

SEQ ID NO: 1438663 - DNA, 15 bp, Homo sapiens
taaacaatgaagtga

SEQ ID NO: 1438664 - DNA, 16 bp, Homo sapiens
taaacaatgtataaag

SEQ ID NO: 1438665 - DNA, 16 bp, Homo sapiens
taaacacaagaaggaa

SEQ ID NO: 1438666 - DNA, 12 bp, Homo sapiens
taaacacacaga

SEQ ID NO: 1438667 - DNA, 14 bp, Homo sapiens
taaacacacagata

SEQ ID NO: 1438668 - DNA, 15 bp, Homo sapiens
taaacacaggctgtc

SEQ ID NO: 1438669 - DNA, 20 bp, Homo sapiens
taaacacagggaaagcattt

SEQ ID NO: 1438670 - DNA, 13 bp, Homo sapiens
taaacactgtaat

SEQ ID NO: 1438671 - DNA, 17 bp, Homo sapiens
taaacagacaaaaacaa

SEQ ID NO: 1438672 - DNA, 21 bp, Homo sapiens
taaacagatataaatggctgg

SEQ ID NO: 1438673 - DNA, 18 bp, Homo sapiens
taaacagatttttacaaa

SEQ ID NO: 1438674 - DNA, 20 bp, Homo sapiens
taaacagatttttacaaatg

SEQ ID NO: 1438675 - DNA, 14 bp, Homo sapiens
taaacagcacacct

SEQ ID NO: 1438676 - DNA, 16 bp, Homo sapiens
taaacagcacacctgt

SEQ ID NO: 1438677 - DNA, 20 bp, Homo sapiens
taaacagcacacctgtgtcc

SEQ ID NO: 1438678 - DNA, 21 bp, Homo sapiens
taaacagcagcactttttagt

SEQ ID NO: 1438679 - DNA, 12 bp, Homo sapiens
taaacaggccca

SEQ ID NO: 1438680 - DNA, 14 bp, Homo sapiens
taaacaggcccagc

SEQ ID NO: 1438681 - DNA, 23 bp, Homo sapiens
taaacaggcccagcattgctggt

SEQ ID NO: 1438682 - DNA, 22 bp, Homo sapiens
taaacaggtgcctgaactagtt

SEQ ID NO: 1438683 - DNA, 17 bp, Homo sapiens
taaacagtaaaccttaa

SEQ ID NO: 1438684 - DNA, 12 bp, Homo sapiens
taaacagtgcct

SEQ ID NO: 1438685 - DNA, 18 bp, Homo sapiens
taaacagtgcctgctgaa

SEQ ID NO: 1438686 - DNA, 17 bp, Homo sapiens
taaacagttatttctgt

SEQ ID NO: 1438687 - DNA, 15 bp, Homo sapiens
taaacataattgtgg

SEQ ID NO: 1438688 - DNA, 21 bp, Homo sapiens
taaacatatttttatacttta

SEQ ID NO: 1438689 - DNA, 22 bp, Homo sapiens
taaacatatttttatactttat

SEQ ID NO: 1438690 - DNA, 23 bp, Homo sapiens
taaacatatttttatactttatt

SEQ ID NO: 1438691 - DNA, 15 bp, Homo sapiens
taaacatcacacaca

SEQ ID NO: 1438692 - DNA, 19 bp, Homo sapiens
taaacattaaacactgtaa

SEQ ID NO: 1438693 - DNA, 20 bp, Homo sapiens
taaacattaaacactgtaat

SEQ ID NO: 1438694 - DNA, 14 bp, Homo sapiens
taaacatttgttcc

SEQ ID NO: 1438695 - DNA, 21 bp, Homo sapiens
taaacatttgttcctggagtt

SEQ ID NO: 1438696 - DNA, 14 bp, Homo sapiens
taaacattttttct

SEQ ID NO: 1438697 - DNA, 18 bp, Homo sapiens
taaacattttttcttcaa

SEQ ID NO: 1438698 - DNA, 16 bp, Homo sapiens
taaaccaatgaagaag

SEQ ID NO: 1438699 - DNA, 17 bp, Homo sapiens
taaaccacttgagccta

SEQ ID NO: 1438700 - DNA, 15 bp, Homo sapiens
taaacccatacaatg

SEQ ID NO: 1438701 - DNA, 19 bp, Homo sapiens
taaacccatacaatgtatg

SEQ ID NO: 1438702 - DNA, 16 bp, Homo sapiens
taaaccggaccatctc

SEQ ID NO: 1438703 - DNA, 15 bp, Homo sapiens
taaacctcagttatt

SEQ ID NO: 1438704 - DNA, 14 bp, Homo sapiens
taaacctgttttgc

SEQ ID NO: 1438705 - DNA, 20 bp, Homo sapiens
taaacctgtttttttttcat

SEQ ID NO: 1438706 - DNA, 20 bp, Homo sapiens
taaacctttttcttgatctt

SEQ ID NO: 1438707 - DNA, 15 bp, Homo sapiens
taaacgtggtcacct

SEQ ID NO: 1438708 - DNA, 12 bp, Homo sapiens
taaactaaaaaa

SEQ ID NO: 1438709 - DNA, 13 bp, Homo sapiens
taaactaaatgtg

SEQ ID NO: 1438710 - DNA, 15 bp, Homo sapiens
taaactaagagaaac

SEQ ID NO: 1438711 - DNA, 19 bp, Homo sapiens
taaactaggattggagtat

SEQ ID NO: 1438712 - DNA, 15 bp, Homo sapiens
taaactaggtaaaat

SEQ ID NO: 1438713 - DNA, 12 bp, Homo sapiens
taaactagtttc

SEQ ID NO: 1438714 - DNA, 16 bp, Homo sapiens
taaactagtttccagt

SEQ ID NO: 1438715 - DNA, 18 bp, Homo sapiens
taaactagtttccagtgg

SEQ ID NO: 1438716 - DNA, 20 bp, Homo sapiens
taaactatgttcctaacaaa

SEQ ID NO: 1438717 - DNA, 18 bp, Homo sapiens
taaactatttatatcaca

SEQ ID NO: 1438718 - DNA, 14 bp, Homo sapiens
taaactcagatctg

SEQ ID NO: 1438719 - DNA, 20 bp, Homo sapiens
taaactccttaacttcaggg

SEQ ID NO: 1438720 - DNA, 15 bp, Homo sapiens
taaactccttcctgg

SEQ ID NO: 1438721 - DNA, 18 bp, Homo sapiens
taaactctgaatttatct

SEQ ID NO: 1438722 - DNA, 13 bp, Homo sapiens
taaactgactttt

SEQ ID NO: 1438723 - DNA, 18 bp, Homo sapiens
taaactggcatctgctct

SEQ ID NO: 1438724 - DNA, 20 bp, Homo sapiens
taaactgtatcaaatctgta

SEQ ID NO: 1438725 - DNA, 22 bp, Homo sapiens
taaactgtatcaaatctgtata

SEQ ID NO: 1438726 - DNA, 17 bp, Homo sapiens
taaactgtattaaatct

SEQ ID NO: 1438727 - DNA, 12 bp, Homo sapiens
taaactgtgaaa

SEQ ID NO: 1438728 - DNA, 22 bp, Homo sapiens
taaactgtgtattccaagacat

SEQ ID NO: 1438729 - DNA, 20 bp, Homo sapiens
taaactgtgtggactgtgat

SEQ ID NO: 1438730 - DNA, 22 bp, Homo sapiens
taaactgtgtggactgtgatgc

SEQ ID NO: 1438731 - DNA, 14 bp, Homo sapiens
taaactgtgtttta

SEQ ID NO: 1438732 - DNA, 20 bp, Homo sapiens
taaactgtgttttagtgtaa

SEQ ID NO: 1438733 - DNA, 16 bp, Homo sapiens
taaactgttttcatgt

SEQ ID NO: 1438734 - DNA, 17 bp, Homo sapiens
taaactgttttcatgtg

SEQ ID NO: 1438735 - DNA, 18 bp, Homo sapiens
taaacttagaggaaaatg

SEQ ID NO: 1438736 - DNA, 15 bp, Homo sapiens
taaacttccaaagaa

SEQ ID NO: 1438737 - DNA, 21 bp, Homo sapiens
taaacttccaaagaaagttct

SEQ ID NO: 1438738 - DNA, 22 bp, Homo sapiens
taaacttctgcaacaagcatgc

SEQ ID NO: 1438739 - DNA, 17 bp, Homo sapiens
taaacttgaaatatata

SEQ ID NO: 1438740 - DNA, 16 bp, Homo sapiens
taaacttgaagcagtc

SEQ ID NO: 1438741 - DNA, 21 bp, Homo sapiens
taaacttgattatattgtttt

SEQ ID NO: 1438742 - DNA, 23 bp, Homo sapiens
taaacttggaagggggagacagg

SEQ ID NO: 1438743 - DNA, 15 bp, Homo sapiens
taaactttatcactt

SEQ ID NO: 1438744 - DNA, 15 bp, Homo sapiens
taaagaaaaatattt

SEQ ID NO: 1438745 - DNA, 20 bp, Homo sapiens
taaagaaaaatatttaatgt

SEQ ID NO: 1438746 - DNA, 15 bp, Homo sapiens
taaagaaacagcttt

SEQ ID NO: 1438747 - DNA, 11 bp, Homo sapiens
taaagaaagat

SEQ ID NO: 1438748 - DNA, 11 bp, Homo sapiens
taaagaaagtg

SEQ ID NO: 1438749 - DNA, 14 bp, Homo sapiens
taaagaaagtgtat

SEQ ID NO: 1438750 - DNA, 22 bp, Homo sapiens
gtccctgggggaagccctggat

SEQ ID NO: 1438751 - DNA, 13 bp, Homo sapiens
gtccctggtccct

SEQ ID NO: 1438752 - DNA, 15 bp, Homo sapiens
gtccctggtccctcg

SEQ ID NO: 1438753 - DNA, 13 bp, Homo sapiens
gtccctggtcctt

SEQ ID NO: 1438754 - DNA, 14 bp, Homo sapiens
gtccctggtccttc

SEQ ID NO: 1438755 - DNA, 15 bp, Homo sapiens
gtccctgtagctcag

SEQ ID NO: 1438756 - DNA, 22 bp, Homo sapiens
gtccctgtcattcactcgggtg

SEQ ID NO: 1438757 - DNA, 16 bp, Homo sapiens
gtccctgtccctctag

SEQ ID NO: 1438758 - DNA, 17 bp, Homo sapiens
gtccctgtgatggccag

SEQ ID NO: 1438759 - DNA, 18 bp, Homo sapiens
gtccctgtgatggccagg

SEQ ID NO: 1438760 - DNA, 18 bp, Homo sapiens
gtccctgtgctgatcctg

SEQ ID NO: 1438761 - DNA, 21 bp, Homo sapiens
gtccctgtgctgatcctgctg

SEQ ID NO: 1438762 - DNA, 15 bp, Homo sapiens
gtccctgtttgggaa

SEQ ID NO: 1438763 - DNA, 23 bp, Homo sapiens
gtcccttaatattgaggctgcag

SEQ ID NO: 1438764 - DNA, 11 bp, Homo sapiens
gtcccttcagt

SEQ ID NO: 1438765 - DNA, 19 bp, Homo sapiens
gtcccttcccctccctggc

SEQ ID NO: 1438766 - DNA, 14 bp, Homo sapiens
gtcccttgagacct

SEQ ID NO: 1438767 - DNA, 16 bp, Homo sapiens
gtcccttgagacctca

SEQ ID NO: 1438768 - DNA, 22 bp, Homo sapiens
gtcccttgagacctcagccatg

SEQ ID NO: 1438769 - DNA, 19 bp, Homo sapiens
gtcccttgcctcaatgcca

SEQ ID NO: 1438770 - DNA, 23 bp, Homo sapiens
gtcccttgcctctgccctggatt

SEQ ID NO: 1438771 - DNA, 24 bp, Homo sapiens
gtccctttttctccacactccact

SEQ ID NO: 1438772 - DNA, 13 bp, Homo sapiens
gtccgcaccagct

SEQ ID NO: 1438773 - DNA, 23 bp, Homo sapiens
gtccgcaccagctgctctgcccc

SEQ ID NO: 1438774 - DNA, 15 bp, Homo sapiens
gtccgcatccctgct

SEQ ID NO: 1438775 - DNA, 23 bp, Homo sapiens
gtccgccctgctcctccctggct

SEQ ID NO: 1438776 - DNA, 23 bp, Homo sapiens
gtccgcgcgccagcacagaaaca

SEQ ID NO: 1438777 - DNA, 16 bp, Homo sapiens
gtccggaaggatggga

SEQ ID NO: 1438778 - DNA, 15 bp, Homo sapiens
gtccggcctcttttt

SEQ ID NO: 1438779 - DNA, 16 bp, Homo sapiens
gtccggtgttctaaga

SEQ ID NO: 1438780 - DNA, 15 bp, Homo sapiens
gtccggtttacttta

SEQ ID NO: 1438781 - DNA, 17 bp, Homo sapiens
gtccggtttactttaac

SEQ ID NO: 1438782 - DNA, 17 bp, Homo sapiens
gtccgtccacccttcca

SEQ ID NO: 1438783 - DNA, 12 bp, Homo sapiens
gtccgtctctct

SEQ ID NO: 1438784 - DNA, 14 bp, Homo sapiens
gtccgtctctcttg

SEQ ID NO: 1438785 - DNA, 17 bp, Homo sapiens
gtccgtctctcttgctt

SEQ ID NO: 1438786 - DNA, 14 bp, Homo sapiens
gtccgtctgtctcg

SEQ ID NO: 1438787 - DNA, 17 bp, Homo sapiens
gtccgtgcccaggccct

SEQ ID NO: 1438788 - DNA, 22 bp, Homo sapiens
gtcctaacctcgggcctgctgc

SEQ ID NO: 1438789 - DNA, 16 bp, Homo sapiens
gtcctagctcttacac

SEQ ID NO: 1438790 - DNA, 22 bp, Homo sapiens
gtcctaggccacaccatctcct

SEQ ID NO: 1438791 - DNA, 16 bp, Homo sapiens
gtcctagttgttcagc

SEQ ID NO: 1438792 - DNA, 17 bp, Homo sapiens
gtcctcactcccagtcc

SEQ ID NO: 1438793 - DNA, 19 bp, Homo sapiens
gtcctcacttctgtctcct

SEQ ID NO: 1438794 - DNA, 21 bp, Homo sapiens
gtcctcacttctgtctcctgt

SEQ ID NO: 1438795 - DNA, 12 bp, Homo sapiens
gtcctcagcctt

SEQ ID NO: 1438796 - DNA, 21 bp, Homo sapiens
gtcctcagccttgccagagat

SEQ ID NO: 1438797 - DNA, 16 bp, Homo sapiens
gtcctcagggagcagg

SEQ ID NO: 1438798 - DNA, 22 bp, Homo sapiens
gtcctcagggagcagggaaggc

SEQ ID NO: 1438799 - DNA, 18 bp, Homo sapiens
gtcctcattgaatcctca

SEQ ID NO: 1438800 - DNA, 20 bp, Homo sapiens
gtcctccaaagactgaagga

SEQ ID NO: 1438801 - DNA, 19 bp, Homo sapiens
gtcctccaccatgcactca

SEQ ID NO: 1438802 - DNA, 20 bp, Homo sapiens
gtcctccactcgacccagaa

SEQ ID NO: 1438803 - DNA, 20 bp, Homo sapiens
gtcctccagaagcctctggc

SEQ ID NO: 1438804 - DNA, 23 bp, Homo sapiens
gtcctccatcccaacagccatgc

SEQ ID NO: 1438805 - DNA, 21 bp, Homo sapiens
gtcctcccaatttcagactcc

SEQ ID NO: 1438806 - DNA, 20 bp, Homo sapiens
gtcctccccctgccagtgcc

SEQ ID NO: 1438807 - DNA, 21 bp, Homo sapiens
gtcctccccctgccagtgcct

SEQ ID NO: 1438808 - DNA, 15 bp, Homo sapiens
gtcctcccctcaagg

SEQ ID NO: 1438809 - DNA, 15 bp, Homo sapiens
gtcctccccttgggc

SEQ ID NO: 1438810 - DNA, 22 bp, Homo sapiens
gtcctcccgagctcctcttcca

SEQ ID NO: 1438811 - DNA, 12 bp, Homo sapiens
gtcctcccgggc

SEQ ID NO: 1438812 - DNA, 17 bp, Homo sapiens
gtcctcccgggccctcc

SEQ ID NO: 1438813 - DNA, 21 bp, Homo sapiens
gtcctcccgggccctcccttg

SEQ ID NO: 1438814 - DNA, 19 bp, Homo sapiens
gtcctccctgatcccaccc

SEQ ID NO: 1438815 - DNA, 16 bp, Homo sapiens
gtcctccgtagggtct

SEQ ID NO: 1438816 - DNA, 15 bp, Homo sapiens
gtcctcctcacctca

SEQ ID NO: 1438817 - DNA, 17 bp, Homo sapiens
gtcctcctcacctcatg

SEQ ID NO: 1438818 - DNA, 21 bp, Homo sapiens
gtcctcctcacctcatgccca

SEQ ID NO: 1438819 - DNA, 22 bp, Homo sapiens
gtcctcctcggatcaccgagag

SEQ ID NO: 1438820 - DNA, 12 bp, Homo sapiens
gtcctcctgtgc

SEQ ID NO: 1438821 - DNA, 12 bp, Homo sapiens
gtcctcctttct

SEQ ID NO: 1438822 - DNA, 16 bp, Homo sapiens
gtcctcgtggcggggc

SEQ ID NO: 1438823 - DNA, 23 bp, Homo sapiens
gtcctctagcccactccctgcct

SEQ ID NO: 1438824 - DNA, 19 bp, Homo sapiens
gtcctctcagaactcctgt

SEQ ID NO: 1438825 - DNA, 21 bp, Homo sapiens
gtcctctcagaactcctgtgt

SEQ ID NO: 1438826 - DNA, 10 bp, Homo sapiens
gtcctctctg

SEQ ID NO: 1438827 - DNA, 11 bp, Homo sapiens
gtcctctctga

SEQ ID NO: 1438828 - DNA, 19 bp, Homo sapiens
gtcctctctgagtcaaatc

SEQ ID NO: 1438829 - DNA, 22 bp, Homo sapiens
gtcctctctgagtcaaatccag

SEQ ID NO: 1438830 - DNA, 16 bp, Homo sapiens
gtcctctgctccagca

SEQ ID NO: 1438831 - DNA, 21 bp, Homo sapiens
gtcctctgctccagcaactgc

SEQ ID NO: 1438832 - DNA, 12 bp, Homo sapiens
gtcctcttctgc

SEQ ID NO: 1438833 - DNA, 15 bp, Homo sapiens
gtcctcttctgctct

SEQ ID NO: 1438834 - DNA, 13 bp, Homo sapiens
gtcctcttctggg

SEQ ID NO: 1438835 - DNA, 17 bp, Homo sapiens
gtcctctttagtttttg

SEQ ID NO: 1438836 - DNA, 20 bp, Homo sapiens
gtcctgaagaggcgggccag

SEQ ID NO: 1438837 - DNA, 23 bp, Homo sapiens
gtcctgaagaggcgggccagcca

SEQ ID NO: 1438838 - DNA, 16 bp, Homo sapiens
gtcctgaagctgctgg

SEQ ID NO: 1438839 - DNA, 15 bp, Homo sapiens
gtcctgaccaccctc

SEQ ID NO: 1438840 - DNA, 15 bp, Homo sapiens
gtcctgacctgtctc

SEQ ID NO: 1438841 - DNA, 14 bp, Homo sapiens
gtcctgacgccctg

SEQ ID NO: 1438842 - DNA, 16 bp, Homo sapiens
gtcctgacgccctgcg

SEQ ID NO: 1438843 - DNA, 17 bp, Homo sapiens
gtcctgacgccctgcgt

SEQ ID NO: 1438844 - DNA, 16 bp, Homo sapiens
gtcctgacggcgcccc

SEQ ID NO: 1438845 - DNA, 16 bp, Homo sapiens
gtcctgagaaagctca

SEQ ID NO: 1438846 - DNA, 23 bp, Homo sapiens
gtcctgagccccctgcacccacc

SEQ ID NO: 1438847 - DNA, 16 bp, Homo sapiens
gtcctgaggagaggag

SEQ ID NO: 1438848 - DNA, 16 bp, Homo sapiens
gtcctgaggagccctg

SEQ ID NO: 1438849 - DNA, 21 bp, Homo sapiens
gtcctgaggagccctgaggac

SEQ ID NO: 1438850 - DNA, 16 bp, Homo sapiens
gtcctgcagaagaagc

SEQ ID NO: 1438851 - DNA, 17 bp, Homo sapiens
gtcctgcagaagaagct

SEQ ID NO: 1438852 - DNA, 16 bp, Homo sapiens
gtcctgcagaggacca

SEQ ID NO: 1438853 - DNA, 20 bp, Homo sapiens
gtcctgcagcaaacactcca

SEQ ID NO: 1438854 - DNA, 14 bp, Homo sapiens
gtcctgcccatgcc

SEQ ID NO: 1438855 - DNA, 15 bp, Homo sapiens
gtcctgccctgcccc

SEQ ID NO: 1438856 - DNA, 17 bp, Homo sapiens
gtcctgcctgcaatatt

SEQ ID NO: 1438857 - DNA, 13 bp, Homo sapiens
gtcctgcctggcc

SEQ ID NO: 1438858 - DNA, 19 bp, Homo sapiens
gtcctgcctggtcctccct

SEQ ID NO: 1438859 - DNA, 15 bp, Homo sapiens
gtcctgcctgtctgc

SEQ ID NO: 1438860 - DNA, 15 bp, Homo sapiens
gtcctgctcacctgt

SEQ ID NO: 1438861 - DNA, 16 bp, Homo sapiens
gtcctgctcacctgtg

SEQ ID NO: 1438862 - DNA, 15 bp, Homo sapiens
gtcctgctccgctgc

SEQ ID NO: 1438863 - DNA, 21 bp, Homo sapiens
gtcctgctccgctgcctggaa

SEQ ID NO: 1438864 - DNA, 17 bp, Homo sapiens
gtcctgctctcttcagg

SEQ ID NO: 1438865 - DNA, 20 bp, Homo sapiens
gtcctgctctcttcaggagg

SEQ ID NO: 1438866 - DNA, 16 bp, Homo sapiens
gtcatggcctgagatg

SEQ ID NO: 1438867 - DNA, 15 bp, Homo sapiens
gtcatggcttaatgt

SEQ ID NO: 1438868 - DNA, 15 bp, Homo sapiens
gtcatgtagctgttt

SEQ ID NO: 1438869 - DNA, 15 bp, Homo sapiens
gtcatgtgacaggta

SEQ ID NO: 1438870 - DNA, 19 bp, Homo sapiens
gtcatgtgcatctggtgta

SEQ ID NO: 1438871 - DNA, 20 bp, Homo sapiens
gtcatgtgtgcatgtgagca

SEQ ID NO: 1438872 - DNA, 19 bp, Homo sapiens
gtcattaaaatggaagtgg

SEQ ID NO: 1438873 - DNA, 11 bp, Homo sapiens
gtcattaaatg

SEQ ID NO: 1438874 - DNA, 21 bp, Homo sapiens
gtcattatgagaggcaatgat

SEQ ID NO: 1438875 - DNA, 14 bp, Homo sapiens
gtcattcactcggg

SEQ ID NO: 1438876 - DNA, 14 bp, Homo sapiens
gtcattcagagtca

SEQ ID NO: 1438877 - DNA, 15 bp, Homo sapiens
gtcattgctgctgct

SEQ ID NO: 1438878 - DNA, 12 bp, Homo sapiens
gtcattgtaatg

SEQ ID NO: 1438879 - DNA, 21 bp, Homo sapiens
gtcattgtaatgttgtgaata

SEQ ID NO: 1438880 - DNA, 14 bp, Homo sapiens
gtcatttataaaac

SEQ ID NO: 1438881 - DNA, 19 bp, Homo sapiens
gtcattttgcactgtaaat

SEQ ID NO: 1438882 - DNA, 14 bp, Homo sapiens
gtcatttttaatgt

SEQ ID NO: 1438883 - DNA, 23 bp, Homo sapiens
gtcatttttaatgtatctatttg

SEQ ID NO: 1438884 - DNA, 24 bp, Homo sapiens
gtcatttttaatgtatctatttgt

SEQ ID NO: 1438885 - DNA, 12 bp, Homo sapiens
gtcatttttgta

SEQ ID NO: 1438886 - DNA, 17 bp, Homo sapiens
gtccaaaaaaaggaaaa

SEQ ID NO: 1438887 - DNA, 21 bp, Homo sapiens
gtccaaaaaaaggaaaaataa

SEQ ID NO: 1438888 - DNA, 18 bp, Homo sapiens
gtccaaaagattgctgaa

SEQ ID NO: 1438889 - DNA, 22 bp, Homo sapiens
gtccaaagtgcgtgtgtgtatg

SEQ ID NO: 1438890 - DNA, 20 bp, Homo sapiens
gtccaaataaattcaataaa

SEQ ID NO: 1438891 - DNA, 15 bp, Homo sapiens
gtccaacaagaatgc

SEQ ID NO: 1438892 - DNA, 22 bp, Homo sapiens
gtccaacaagaatgcattccct

SEQ ID NO: 1438893 - DNA, 15 bp, Homo sapiens
gtccaacagagtgga

SEQ ID NO: 1438894 - DNA, 15 bp, Homo sapiens
gtccaaccagaaaca

SEQ ID NO: 1438895 - DNA, 14 bp, Homo sapiens
gtccaacctaaccc

SEQ ID NO: 1438896 - DNA, 15 bp, Homo sapiens
gtccaacgccgcctt

SEQ ID NO: 1438897 - DNA, 16 bp, Homo sapiens
gtccaacgccgccttg

SEQ ID NO: 1438898 - DNA, 16 bp, Homo sapiens
gtccaagattccggat

SEQ ID NO: 1438899 - DNA, 24 bp, Homo sapiens
gtccaagcataccaacacgagcag

SEQ ID NO: 1438900 - DNA, 17 bp, Homo sapiens
gtccaagggacagccca

SEQ ID NO: 1438901 - DNA, 21 bp, Homo sapiens
gtccaagggccatacttttga

SEQ ID NO: 1438902 - DNA, 21 bp, Homo sapiens
gtccaaggtttaaagagtcta

SEQ ID NO: 1438903 - DNA, 15 bp, Homo sapiens
gtccaatacacgcgt

SEQ ID NO: 1438904 - DNA, 22 bp, Homo sapiens
gtccaatcatgggccacaaggc

SEQ ID NO: 1438905 - DNA, 19 bp, Homo sapiens
gtccaatttgtaaaaacag

SEQ ID NO: 1438906 - DNA, 13 bp, Homo sapiens
gtccacagctgga

SEQ ID NO: 1438907 - DNA, 16 bp, Homo sapiens
gtccacaggggcaggc

SEQ ID NO: 1438908 - DNA, 19 bp, Homo sapiens
gtccacaggggcaggcctg

SEQ ID NO: 1438909 - DNA, 17 bp, Homo sapiens
gtccacatccccagagc

SEQ ID NO: 1438910 - DNA, 18 bp, Homo sapiens
gtccacatccccagagcc

SEQ ID NO: 1438911 - DNA, 16 bp, Homo sapiens
gtccacatgacctcca

SEQ ID NO: 1438912 - DNA, 17 bp, Homo sapiens
gtccacatgacctccat

SEQ ID NO: 1438913 - DNA, 12 bp, Homo sapiens
gtccacccaggc

SEQ ID NO: 1438914 - DNA, 13 bp, Homo sapiens
gtccacccaggct

SEQ ID NO: 1438915 - DNA, 14 bp, Homo sapiens
gtccacccaggctg

SEQ ID NO: 1438916 - DNA, 21 bp, Homo sapiens
gtccacccaggctgcactgca

SEQ ID NO: 1438917 - DNA, 17 bp, Homo sapiens
gtccacccttccatcag

SEQ ID NO: 1438918 - DNA, 18 bp, Homo sapiens
gtccacccttccatcagc

SEQ ID NO: 1438919 - DNA, 13 bp, Homo sapiens
gtccacctggaga

SEQ ID NO: 1438920 - DNA, 20 bp, Homo sapiens
gtccacgcctctgctgtagc

SEQ ID NO: 1438921 - DNA, 22 bp, Homo sapiens
gtccactgagactttcccctct

SEQ ID NO: 1438922 - DNA, 14 bp, Homo sapiens
gtccagaaacaaaa

SEQ ID NO: 1438923 - DNA, 21 bp, Homo sapiens
gtccagaaactcctgtttctc

SEQ ID NO: 1438924 - DNA, 19 bp, Homo sapiens
gtccagagacatgggcctc

SEQ ID NO: 1438925 - DNA, 21 bp, Homo sapiens
gtccagagacatgggcctccc

SEQ ID NO: 1438926 - DNA, 16 bp, Homo sapiens
gtccagagaccacacc

SEQ ID NO: 1438927 - DNA, 12 bp, Homo sapiens
gtccagagcttg

SEQ ID NO: 1438928 - DNA, 22 bp, Homo sapiens
gtccagagtagtttctttctgt

SEQ ID NO: 1438929 - DNA, 23 bp, Homo sapiens
gtccagcaccttgtgcctggggt

SEQ ID NO: 1438930 - DNA, 13 bp, Homo sapiens
gtccagcagctgc

SEQ ID NO: 1438931 - DNA, 15 bp, Homo sapiens
gtccagcagctgcgg

SEQ ID NO: 1438932 - DNA, 13 bp, Homo sapiens
gtccagccagctc

SEQ ID NO: 1438933 - DNA, 23 bp, Homo sapiens
gtccagcctgccccggagctgga

SEQ ID NO: 1438934 - DNA, 13 bp, Homo sapiens
gtccagcctgggc

SEQ ID NO: 1438935 - DNA, 21 bp, Homo sapiens
gtccagcgtcactccagtgct

SEQ ID NO: 1438936 - DNA, 14 bp, Homo sapiens
gtccagctccaacc

SEQ ID NO: 1438937 - DNA, 11 bp, Homo sapiens
gtccagctcta

SEQ ID NO: 1438938 - DNA, 14 bp, Homo sapiens
gtccagctctgaca

SEQ ID NO: 1438939 - DNA, 15 bp, Homo sapiens
gtccagctctgacat

SEQ ID NO: 1438940 - DNA, 12 bp, Homo sapiens
gtccagctctgg

SEQ ID NO: 1438941 - DNA, 21 bp, Homo sapiens
gtccagctctggaggggaggg

SEQ ID NO: 1438942 - DNA, 19 bp, Homo sapiens
gtccagctcttggcccctg

SEQ ID NO: 1438943 - DNA, 19 bp, Homo sapiens
gtccagctggcctggacag

SEQ ID NO: 1438944 - DNA, 11 bp, Homo sapiens
gtccagctggg

SEQ ID NO: 1438945 - DNA, 17 bp, Homo sapiens
gtccagcttccaaagcc

SEQ ID NO: 1438946 - DNA, 18 bp, Homo sapiens
gtccaggaaggcagctgc

SEQ ID NO: 1438947 - DNA, 14 bp, Homo sapiens
gtccaggccactgt

SEQ ID NO: 1438948 - DNA, 18 bp, Homo sapiens
gtccaggccactgtggcc

SEQ ID NO: 1438949 - DNA, 20 bp, Homo sapiens
gtccaggccccaccggccag

SEQ ID NO: 1438950 - DNA, 23 bp, Homo sapiens
gtccaggccccaccggccaggcc

SEQ ID NO: 1438951 - DNA, 18 bp, Homo sapiens
gtccaggcccgtgggcgc

SEQ ID NO: 1438952 - DNA, 17 bp, Homo sapiens
gtccaggccctgtggca

SEQ ID NO: 1438953 - DNA, 14 bp, Homo sapiens
gtccaggctgccgt

SEQ ID NO: 1438954 - DNA, 15 bp, Homo sapiens
gtccagggaagctgg

SEQ ID NO: 1438955 - DNA, 20 bp, Homo sapiens
gtccagggccctgagctcgg

SEQ ID NO: 1438956 - DNA, 14 bp, Homo sapiens
gtccagggcctgac

SEQ ID NO: 1438957 - DNA, 12 bp, Homo sapiens
gtccaggtgagg

SEQ ID NO: 1438958 - DNA, 20 bp, Homo sapiens
gtccaggtggtgaattttcc

SEQ ID NO: 1438959 - DNA, 15 bp, Homo sapiens
gtccagtctgtgatc

SEQ ID NO: 1438960 - DNA, 20 bp, Homo sapiens
gtccagtgcattttgtttct

SEQ ID NO: 1438961 - DNA, 23 bp, Homo sapiens
gtccagtgcattttgtttctgta

SEQ ID NO: 1438962 - DNA, 15 bp, Homo sapiens
gtccatctgacaaaa

SEQ ID NO: 1438963 - DNA, 15 bp, Homo sapiens
gtccatgctccaggg

SEQ ID NO: 1438964 - DNA, 13 bp, Homo sapiens
gtccatggcacca

SEQ ID NO: 1438965 - DNA, 15 bp, Homo sapiens
gtccatggcaccagc

SEQ ID NO: 1438966 - DNA, 17 bp, Homo sapiens
gtccatggcaccagccc

SEQ ID NO: 1438967 - DNA, 22 bp, Homo sapiens
gtccatttggcaggggtggctg

SEQ ID NO: 1438968 - DNA, 19 bp, Homo sapiens
gtcccaaacagctgcctct

SEQ ID NO: 1438969 - DNA, 16 bp, Homo sapiens
gtcccaaggaaagccc

SEQ ID NO: 1438970 - DNA, 23 bp, Homo sapiens
gtcccaaggagctgatttccagg

SEQ ID NO: 1438971 - DNA, 15 bp, Homo sapiens
gtcccaatagctcta

SEQ ID NO: 1438972 - DNA, 17 bp, Homo sapiens
gtcccacaaaatatttc

SEQ ID NO: 1438973 - DNA, 23 bp, Homo sapiens
gtcccacaccgctggtccctgcc

SEQ ID NO: 1438974 - DNA, 18 bp, Homo sapiens
gtcccacactttgaagca

SEQ ID NO: 1438975 - DNA, 17 bp, Homo sapiens
gtcccaccaactctgca

SEQ ID NO: 1438976 - DNA, 20 bp, Homo sapiens
gtcccaccaactctgcactc

SEQ ID NO: 1438977 - DNA, 14 bp, Homo sapiens
gtcccacccacaca

SEQ ID NO: 1438978 - DNA, 23 bp, Homo sapiens
gtcccacccacacagctgcccta

SEQ ID NO: 1438979 - DNA, 12 bp, Homo sapiens
gtcccacccacc

SEQ ID NO: 1438980 - DNA, 22 bp, Homo sapiens
gtcccacccccacccccagctc

SEQ ID NO: 1438981 - DNA, 23 bp, Homo sapiens
gtcccacccccacccccagctca

SEQ ID NO: 1438982 - DNA, 18 bp, Homo sapiens
gtcccagagcacctcacc

SEQ ID NO: 1438983 - DNA, 16 bp, Homo sapiens
gtcccagagcaggagg

SEQ ID NO: 1438984 - DNA, 21 bp, Homo sapiens
gtcccagagcttattggccac

SEQ ID NO: 1438985 - DNA, 13 bp, Homo sapiens
gtcccagatgctg

SEQ ID NO: 1438986 - DNA, 15 bp, Homo sapiens
gtcccagatgctgtc

SEQ ID NO: 1438987 - DNA, 17 bp, Homo sapiens
gtcccagatgctgtcat

SEQ ID NO: 1438988 - DNA, 18 bp, Homo sapiens
gtcccagcatccctggag

SEQ ID NO: 1438989 - DNA, 19 bp, Homo sapiens
gtcccagcatccctggagc

SEQ ID NO: 1438990 - DNA, 15 bp, Homo sapiens
gtcccagccaccccg

SEQ ID NO: 1438991 - DNA, 14 bp, Homo sapiens
gtcccagccacgca

SEQ ID NO: 1438992 - DNA, 20 bp, Homo sapiens
gtcccagcctggggctccct

SEQ ID NO: 1438993 - DNA, 22 bp, Homo sapiens
gtcccagctactcagaagcctg

SEQ ID NO: 1438994 - DNA, 21 bp, Homo sapiens
gtcccagctgaaggcagtggc

SEQ ID NO: 1438995 - DNA, 19 bp, Homo sapiens
gtcccaggagctgcccaga

SEQ ID NO: 1438996 - DNA, 20 bp, Homo sapiens
gtcccaggagctgcccagag

SEQ ID NO: 1438997 - DNA, 16 bp, Homo sapiens
gtcccaggcagggaga

SEQ ID NO: 1438998 - DNA, 21 bp, Homo sapiens
gtcccagggccctcccagccc

SEQ ID NO: 1438999 - DNA, 12 bp, Homo sapiens
gtcccagggctc

SEQ ID NO: 1439000 - DNA, 15 bp, Homo sapiens
gtcccaggggcagcc

SEQ ID NO: 1439001 - DNA, 17 bp, Homo sapiens
gtcccagtcagaaataa

SEQ ID NO: 1439002 - DNA, 20 bp, Homo sapiens
gtcccagtgggaggggcagg

SEQ ID NO: 1439003 - DNA, 14 bp, Homo sapiens
gtcccatatcctgc

SEQ ID NO: 1439004 - DNA, 15 bp, Homo sapiens
gtcccatatcctgcc

SEQ ID NO: 1439005 - DNA, 16 bp, Homo sapiens
gtcccatatcctgcct

SEQ ID NO: 1439006 - DNA, 18 bp, Homo sapiens
gtcccatgacccacccct

SEQ ID NO: 1439007 - DNA, 20 bp, Homo sapiens
gtcccatgacccacccctgt

SEQ ID NO: 1439008 - DNA, 17 bp, Homo sapiens
gtcccatgatccctgtg

SEQ ID NO: 1439009 - DNA, 17 bp, Homo sapiens
gtcccatggctgaagct

SEQ ID NO: 1439010 - DNA, 20 bp, Homo sapiens
gtcccatggctgaagctgga

SEQ ID NO: 1439011 - DNA, 23 bp, Homo sapiens
gtcccatggctgaagctggagca

SEQ ID NO: 1439012 - DNA, 20 bp, Homo sapiens
gtcccattcatattaagaca

SEQ ID NO: 1439013 - DNA, 14 bp, Homo sapiens
gtcccattctagat

SEQ ID NO: 1439014 - DNA, 16 bp, Homo sapiens
gtcccattctagatcc

SEQ ID NO: 1439015 - DNA, 18 bp, Homo sapiens
gtcccattctagatcctg

SEQ ID NO: 1439016 - DNA, 13 bp, Homo sapiens
gtcccatttcctt

SEQ ID NO: 1439017 - DNA, 14 bp, Homo sapiens
gtcccatttccttg

SEQ ID NO: 1439018 - DNA, 15 bp, Homo sapiens
gtcccatttccttgg

SEQ ID NO: 1439019 - DNA, 22 bp, Homo sapiens
gtccccaaccgtgtctgtctgg

SEQ ID NO: 1439020 - DNA, 20 bp, Homo sapiens
gtccccaacgtcccctccgc

SEQ ID NO: 1439021 - DNA, 21 bp, Homo sapiens
gtccccaagattcacacctga

SEQ ID NO: 1439022 - DNA, 13 bp, Homo sapiens
gtccccaaggcct

SEQ ID NO: 1439023 - DNA, 15 bp, Homo sapiens
gtccccaaggcctct

SEQ ID NO: 1439024 - DNA, 18 bp, Homo sapiens
gtccccaaggcctctctc

SEQ ID NO: 1439025 - DNA, 19 bp, Homo sapiens
gtccccaaggcctctctct

SEQ ID NO: 1439026 - DNA, 12 bp, Homo sapiens
gtccccacccct

SEQ ID NO: 1439027 - DNA, 14 bp, Homo sapiens
gtccccacccctgc

SEQ ID NO: 1439028 - DNA, 17 bp, Homo sapiens
gtccccaccctccactc

SEQ ID NO: 1439029 - DNA, 12 bp, Homo sapiens
gtccccactccc

SEQ ID NO: 1439030 - DNA, 14 bp, Homo sapiens
gtccccagctcccc

SEQ ID NO: 1439031 - DNA, 12 bp, Homo sapiens
gtccccagggcc

SEQ ID NO: 1439032 - DNA, 13 bp, Homo sapiens
gtccccagggccc

SEQ ID NO: 1439033 - DNA, 22 bp, Homo sapiens
gtccccagggcccctccctctg

SEQ ID NO: 1439034 - DNA, 18 bp, Homo sapiens
gtccccagtttgcagaaa

SEQ ID NO: 1439035 - DNA, 23 bp, Homo sapiens
gtccccattctataaattcaaca

SEQ ID NO: 1439036 - DNA, 14 bp, Homo sapiens
gtcccccagctctg

SEQ ID NO: 1439037 - DNA, 16 bp, Homo sapiens
gtcccccatgccacca

SEQ ID NO: 1439038 - DNA, 18 bp, Homo sapiens
gtcccccatgccaccacc

SEQ ID NO: 1439039 - DNA, 11 bp, Homo sapiens
gtccccccacc

SEQ ID NO: 1439040 - DNA, 15 bp, Homo sapiens
gtcccccccagtgca

SEQ ID NO: 1439041 - DNA, 13 bp, Homo sapiens
gtcccccctgagt

SEQ ID NO: 1439042 - DNA, 19 bp, Homo sapiens
gtcccccctgagtgggctg

SEQ ID NO: 1439043 - DNA, 17 bp, Homo sapiens
gtcccccgactgcctgt

SEQ ID NO: 1439044 - DNA, 16 bp, Homo sapiens
gtcccccgccgcgcca

SEQ ID NO: 1439045 - DNA, 14 bp, Homo sapiens
gtccccgaggagct

SEQ ID NO: 1439046 - DNA, 19 bp, Homo sapiens
gtccccgagtgcctaggtt

SEQ ID NO: 1439047 - DNA, 22 bp, Homo sapiens
gtccccggggttccccacacag

SEQ ID NO: 1439048 - DNA, 20 bp, Homo sapiens
gtcccctactccctcttcac

SEQ ID NO: 1439049 - DNA, 14 bp, Homo sapiens
gtcccctcctcagt

SEQ ID NO: 1439050 - DNA, 14 bp, Homo sapiens
gtcccctctctctg

SEQ ID NO: 1439051 - DNA, 21 bp, Homo sapiens
gtcccctctgtcatcactccc

SEQ ID NO: 1439052 - DNA, 22 bp, Homo sapiens
gtcccctctgtcatcactccct

SEQ ID NO: 1439053 - DNA, 14 bp, Homo sapiens
gtcccctctgtgct

SEQ ID NO: 1439054 - DNA, 16 bp, Homo sapiens
gtcccctgccccagag

SEQ ID NO: 1439055 - DNA, 23 bp, Homo sapiens
gtcccctgctactcctgtgctct

SEQ ID NO: 1439056 - DNA, 13 bp, Homo sapiens
gtcccctgtccca

SEQ ID NO: 1439057 - DNA, 12 bp, Homo sapiens
gtccccttctct

SEQ ID NO: 1439058 - DNA, 19 bp, Homo sapiens
gtccccttctctcatctct

SEQ ID NO: 1439059 - DNA, 23 bp, Homo sapiens
gtccccttttcttttctacccta

SEQ ID NO: 1439060 - DNA, 14 bp, Homo sapiens
gtcccgcactctgc

SEQ ID NO: 1439061 - DNA, 16 bp, Homo sapiens
gtcccgcactctgccc

SEQ ID NO: 1439062 - DNA, 14 bp, Homo sapiens
gtcccgccttcctc

SEQ ID NO: 1439063 - DNA, 19 bp, Homo sapiens
gtcccgccttcctcctcca

SEQ ID NO: 1439064 - DNA, 21 bp, Homo sapiens
gtcccgccttcctcctccaca

SEQ ID NO: 1439065 - DNA, 18 bp, Homo sapiens
gtcccgcggtgctgactg

SEQ ID NO: 1439066 - DNA, 17 bp, Homo sapiens
gtcccgctgctgtgctc

SEQ ID NO: 1439067 - DNA, 15 bp, Homo sapiens
gtcccggccagctct

SEQ ID NO: 1439068 - DNA, 17 bp, Homo sapiens
gtcccggccagctctgg

SEQ ID NO: 1439069 - DNA, 15 bp, Homo sapiens
gtcccggggccagca

SEQ ID NO: 1439070 - DNA, 17 bp, Homo sapiens
gtcccggggccagcact

SEQ ID NO: 1439071 - DNA, 22 bp, Homo sapiens
gtcccggggccagcacttccat

SEQ ID NO: 1439072 - DNA, 15 bp, Homo sapiens
gtcccggggctccac

SEQ ID NO: 1439073 - DNA, 21 bp, Homo sapiens
gtcccggttcagacccctgcc

SEQ ID NO: 1439074 - DNA, 15 bp, Homo sapiens
gtccctaattctctt

SEQ ID NO: 1439075 - DNA, 21 bp, Homo sapiens
gtccctaattctcttcgctgt

SEQ ID NO: 1439076 - DNA, 21 bp, Homo sapiens
gtccctacacccctcccctgc

SEQ ID NO: 1439077 - DNA, 20 bp, Homo sapiens
gtccctagcagcccaccctg

SEQ ID NO: 1439078 - DNA, 19 bp, Homo sapiens
gtccctcactccacagagt

SEQ ID NO: 1439079 - DNA, 16 bp, Homo sapiens
gtccctccatcccaga

SEQ ID NO: 1439080 - DNA, 20 bp, Homo sapiens
gtccctctcagtgccttctc

SEQ ID NO: 1439081 - DNA, 21 bp, Homo sapiens
gtccctctcagtgccttctct

SEQ ID NO: 1439082 - DNA, 23 bp, Homo sapiens
gtccctctcagtgccttctctca

SEQ ID NO: 1439083 - DNA, 14 bp, Homo sapiens
gtccctctgtggct

SEQ ID NO: 1439084 - DNA, 13 bp, Homo sapiens
gtccctctgtgta

SEQ ID NO: 1439085 - DNA, 22 bp, Homo sapiens
gtccctctgtgtatttgctttt

SEQ ID NO: 1439086 - DNA, 20 bp, Homo sapiens
gtccctgactctctgtgacc

SEQ ID NO: 1439087 - DNA, 22 bp, Homo sapiens
gtccctgaggatgggtcagagc

SEQ ID NO: 1439088 - DNA, 21 bp, Homo sapiens
gtccctgcagggccatctgac

SEQ ID NO: 1439089 - DNA, 14 bp, Homo sapiens
gtccctgccctccc

SEQ ID NO: 1439090 - DNA, 18 bp, Homo sapiens
gtccctgccctcccctgc

SEQ ID NO: 1439091 - DNA, 22 bp, Homo sapiens
gtccctgccctcccctgctccc

SEQ ID NO: 1439092 - DNA, 12 bp, Homo sapiens
gtccctgccttc

SEQ ID NO: 1439093 - DNA, 12 bp, Homo sapiens
gtccctggacac

SEQ ID NO: 1439094 - DNA, 14 bp, Homo sapiens
gtccctggacacag

SEQ ID NO: 1439095 - DNA, 16 bp, Homo sapiens
gtccctggacacagct

SEQ ID NO: 1439096 - DNA, 17 bp, Homo sapiens
gtccctggacacagctc

SEQ ID NO: 1439097 - DNA, 19 bp, Homo sapiens
gtccctggaccagcctcct

SEQ ID NO: 1439098 - DNA, 13 bp, Homo sapiens
gtccctggagctg

SEQ ID NO: 1439099 - DNA, 17 bp, Homo sapiens
gtccctggcgcaggtgg

SEQ ID NO: 1439100 - DNA, 19 bp, Homo sapiens
ggtttcgactggtccagct

SEQ ID NO: 1439101 - DNA, 21 bp, Homo sapiens
ggtttcgactggtccagctct

SEQ ID NO: 1439102 - DNA, 22 bp, Homo sapiens
ggtttcgactggtccagctctg

SEQ ID NO: 1439103 - DNA, 17 bp, Homo sapiens
ggtttcgtttctgtata

SEQ ID NO: 1439104 - DNA, 11 bp, Homo sapiens
ggtttctcaga

SEQ ID NO: 1439105 - DNA, 20 bp, Homo sapiens
ggtttctcagaatccaaaga

SEQ ID NO: 1439106 - DNA, 21 bp, Homo sapiens
ggtttctcagaatccaaagat

SEQ ID NO: 1439107 - DNA, 16 bp, Homo sapiens
ggtttctcattaaagt

SEQ ID NO: 1439108 - DNA, 20 bp, Homo sapiens
ggtttctctattaaaatgca

SEQ ID NO: 1439109 - DNA, 12 bp, Homo sapiens
ggtttctctctt

SEQ ID NO: 1439110 - DNA, 20 bp, Homo sapiens
ggtttctctcttcccttctc

SEQ ID NO: 1439111 - DNA, 21 bp, Homo sapiens
ggtttctctcttcccttctcc

SEQ ID NO: 1439112 - DNA, 21 bp, Homo sapiens
ggtttctctgtgctctgaatg

SEQ ID NO: 1439113 - DNA, 22 bp, Homo sapiens
ggtttctttttgaatctttaat

SEQ ID NO: 1439114 - DNA, 20 bp, Homo sapiens
ggtttctttttttttccttt

SEQ ID NO: 1439115 - DNA, 23 bp, Homo sapiens
ggtttgaagacacagcctccccc

SEQ ID NO: 1439116 - DNA, 11 bp, Homo sapiens
ggtttgacaat

SEQ ID NO: 1439117 - DNA, 18 bp, Homo sapiens
ggtttgacaattttgtct

SEQ ID NO: 1439118 - DNA, 13 bp, Homo sapiens
ggtttggaagagt

SEQ ID NO: 1439119 - DNA, 19 bp, Homo sapiens
ggtttggaccccagctggg

SEQ ID NO: 1439120 - DNA, 20 bp, Homo sapiens
ggtttggaccccagctggga

SEQ ID NO: 1439121 - DNA, 17 bp, Homo sapiens
ggtttggggagaaataa

SEQ ID NO: 1439122 - DNA, 13 bp, Homo sapiens
ggtttgtatattg

SEQ ID NO: 1439123 - DNA, 23 bp, Homo sapiens
ggtttgtcgggcaccagccagcg

SEQ ID NO: 1439124 - DNA, 14 bp, Homo sapiens
ggtttgtgttgagc

SEQ ID NO: 1439125 - DNA, 17 bp, Homo sapiens
ggtttgtttttcaaagc

SEQ ID NO: 1439126 - DNA, 17 bp, Homo sapiens
ggttttaagttgtttgc

SEQ ID NO: 1439127 - DNA, 14 bp, Homo sapiens
ggttttacacagga

SEQ ID NO: 1439128 - DNA, 17 bp, Homo sapiens
ggttttaggtagaaaaa

SEQ ID NO: 1439129 - DNA, 15 bp, Homo sapiens
ggttttaggttctaa

SEQ ID NO: 1439130 - DNA, 15 bp, Homo sapiens
ggttttatattttta

SEQ ID NO: 1439131 - DNA, 19 bp, Homo sapiens
ggttttattgtccttcaga

SEQ ID NO: 1439132 - DNA, 19 bp, Homo sapiens
ggttttattgtttaaaatc

SEQ ID NO: 1439133 - DNA, 21 bp, Homo sapiens
ggttttctctaacttctcaag

SEQ ID NO: 1439134 - DNA, 14 bp, Homo sapiens
ggttttcttcccat

SEQ ID NO: 1439135 - DNA, 14 bp, Homo sapiens
ggttttggagtcag

SEQ ID NO: 1439136 - DNA, 21 bp, Homo sapiens
ggttttggcaaacgctaaaga

SEQ ID NO: 1439137 - DNA, 19 bp, Homo sapiens
ggttttgtaagatgctggg

SEQ ID NO: 1439138 - DNA, 15 bp, Homo sapiens
ggttttgtattcttt

SEQ ID NO: 1439139 - DNA, 13 bp, Homo sapiens
ggttttgtgccat

SEQ ID NO: 1439140 - DNA, 14 bp, Homo sapiens
ggttttgttcccct

SEQ ID NO: 1439141 - DNA, 19 bp, Homo sapiens
ggttttgttcccctcctcc

SEQ ID NO: 1439142 - DNA, 18 bp, Homo sapiens
ggtttttagagaatgtgt

SEQ ID NO: 1439143 - DNA, 13 bp, Homo sapiens
ggtttttgctctc

SEQ ID NO: 1439144 - DNA, 16 bp, Homo sapiens
ggtttttggctctttc

SEQ ID NO: 1439145 - DNA, 20 bp, Homo sapiens
ggtttttggctctttcagag

SEQ ID NO: 1439146 - DNA, 17 bp, Homo sapiens
ggttttttaaaaggaaa

SEQ ID NO: 1439147 - DNA, 18 bp, Homo sapiens
ggttttttataaagtcta

SEQ ID NO: 1439148 - DNA, 11 bp, Homo sapiens
gtaaaaaaagc

SEQ ID NO: 1439149 - DNA, 15 bp, Homo sapiens
gtaaaaaaagcaaaa

SEQ ID NO: 1439150 - DNA, 11 bp, Homo sapiens
gtaaaaaatgg

SEQ ID NO: 1439151 - DNA, 22 bp, Homo sapiens
gtaaaaaatgtctcatgtcaat

SEQ ID NO: 1439152 - DNA, 13 bp, Homo sapiens
gtaaaaaatttat

SEQ ID NO: 1439153 - DNA, 21 bp, Homo sapiens
gtaaaaacagcattgctttct

SEQ ID NO: 1439154 - DNA, 14 bp, Homo sapiens
gtaaaaagaaaaca

SEQ ID NO: 1439155 - DNA, 19 bp, Homo sapiens
gtaaaaagtattttttcaa

SEQ ID NO: 1439156 - DNA, 12 bp, Homo sapiens
gtaaaaagtggc

SEQ ID NO: 1439157 - DNA, 16 bp, Homo sapiens
gtaaaaagtggctgcg

SEQ ID NO: 1439158 - DNA, 18 bp, Homo sapiens
gtaaaaatgctgctctca

SEQ ID NO: 1439159 - DNA, 23 bp, Homo sapiens
gtaaaaattaaaaaatgaaatta

SEQ ID NO: 1439160 - DNA, 14 bp, Homo sapiens
gtaaaaccacagca

SEQ ID NO: 1439161 - DNA, 15 bp, Homo sapiens
gtaaaaccacagcag

SEQ ID NO: 1439162 - DNA, 16 bp, Homo sapiens
gtaaaaccacagcagt

SEQ ID NO: 1439163 - DNA, 20 bp, Homo sapiens
gtaaaagaaatcatgtccat

SEQ ID NO: 1439164 - DNA, 12 bp, Homo sapiens
gtaaaatacttt

SEQ ID NO: 1439165 - DNA, 16 bp, Homo sapiens
gtaaaatcttgtcatg

SEQ ID NO: 1439166 - DNA, 22 bp, Homo sapiens
gtaaaatcttgtcatgtgtata

SEQ ID NO: 1439167 - DNA, 16 bp, Homo sapiens
gtaaaatgaacatttt

SEQ ID NO: 1439168 - DNA, 23 bp, Homo sapiens
gtaaaatgtgggattatgggtca

SEQ ID NO: 1439169 - DNA, 16 bp, Homo sapiens
gtaaaattcatagcat

SEQ ID NO: 1439170 - DNA, 16 bp, Homo sapiens
gtaaaattgaaaggca

SEQ ID NO: 1439171 - DNA, 12 bp, Homo sapiens
gtaaaatttatt

SEQ ID NO: 1439172 - DNA, 19 bp, Homo sapiens
gtaaacaaaccacagcagg

SEQ ID NO: 1439173 - DNA, 20 bp, Homo sapiens
gtaaacagtgcctgctgaat

SEQ ID NO: 1439174 - DNA, 22 bp, Homo sapiens
gtaaacagtgcctgctgaatga

SEQ ID NO: 1439175 - DNA, 20 bp, Homo sapiens
gtaaacataaaaactgattt

SEQ ID NO: 1439176 - DNA, 19 bp, Homo sapiens
gtaaacattaagtaaatgc

SEQ ID NO: 1439177 - DNA, 22 bp, Homo sapiens
gtaaaccaaaccctataaacct

SEQ ID NO: 1439178 - DNA, 18 bp, Homo sapiens
gtaaaccactgaaaaaat

SEQ ID NO: 1439179 - DNA, 22 bp, Homo sapiens
gtaaaccactgaaaaaatatat

SEQ ID NO: 1439180 - DNA, 15 bp, Homo sapiens
gtaaactacaaagta

SEQ ID NO: 1439181 - DNA, 16 bp, Homo sapiens
gtaaactatttatctg

SEQ ID NO: 1439182 - DNA, 21 bp, Homo sapiens
gtaaactatttatctgtgttt

SEQ ID NO: 1439183 - DNA, 17 bp, Homo sapiens
gtaaagaaaaatattta

SEQ ID NO: 1439184 - DNA, 23 bp, Homo sapiens
gtaaagtatgtattatttacatt

SEQ ID NO: 1439185 - DNA, 20 bp, Homo sapiens
gtaaagtatttttgattaac

SEQ ID NO: 1439186 - DNA, 18 bp, Homo sapiens
gtaaagtgataatttctg

SEQ ID NO: 1439187 - DNA, 12 bp, Homo sapiens
gtaaagtgctta

SEQ ID NO: 1439188 - DNA, 17 bp, Homo sapiens
gtaaagttatgtattta

SEQ ID NO: 1439189 - DNA, 13 bp, Homo sapiens
gtaaataaaaaga

SEQ ID NO: 1439190 - DNA, 17 bp, Homo sapiens
gtaaataaaatgtgtac

SEQ ID NO: 1439191 - DNA, 13 bp, Homo sapiens
gtaaatgatttta

SEQ ID NO: 1439192 - DNA, 22 bp, Homo sapiens
gtaaatggtatgatcaataaag

SEQ ID NO: 1439193 - DNA, 17 bp, Homo sapiens
gtaaatgtttaggtttt

SEQ ID NO: 1439194 - DNA, 11 bp, Homo sapiens
gtaaatgtttc

SEQ ID NO: 1439195 - DNA, 13 bp, Homo sapiens
gtaaatgtttctt

SEQ ID NO: 1439196 - DNA, 22 bp, Homo sapiens
gtaaatgtttcttttcccttaa

SEQ ID NO: 1439197 - DNA, 21 bp, Homo sapiens
gtaaatgtttgttaaaaataa

SEQ ID NO: 1439198 - DNA, 22 bp, Homo sapiens
gtaaattacagtaatcccattt

SEQ ID NO: 1439199 - DNA, 20 bp, Homo sapiens
gtaaattgtcgggggagaga

SEQ ID NO: 1439200 - DNA, 12 bp, Homo sapiens
gtaaatttaact

SEQ ID NO: 1439201 - DNA, 14 bp, Homo sapiens
gtaaatttaactgc

SEQ ID NO: 1439202 - DNA, 19 bp, Homo sapiens
gtaaatttagcatatcaat

SEQ ID NO: 1439203 - DNA, 13 bp, Homo sapiens
gtaaatttgtact

SEQ ID NO: 1439204 - DNA, 22 bp, Homo sapiens
gtaaatttgtactatttaactg

SEQ ID NO: 1439205 - DNA, 18 bp, Homo sapiens
gtaaattttgtatgaaaa

SEQ ID NO: 1439206 - DNA, 13 bp, Homo sapiens
gtaacaaatgaac

SEQ ID NO: 1439207 - DNA, 12 bp, Homo sapiens
gtaacaagaaaa

SEQ ID NO: 1439208 - DNA, 14 bp, Homo sapiens
gtaacaagaaaaca

SEQ ID NO: 1439209 - DNA, 15 bp, Homo sapiens
gtaacaagaaaacat

SEQ ID NO: 1439210 - DNA, 17 bp, Homo sapiens
gtaacaatacaaatgga

SEQ ID NO: 1439211 - DNA, 21 bp, Homo sapiens
gtaacacatttggccacaaaa

SEQ ID NO: 1439212 - DNA, 17 bp, Homo sapiens
gtaacactaatatattt

SEQ ID NO: 1439213 - DNA, 22 bp, Homo sapiens
gtaacactaatatatttaaaaa

SEQ ID NO: 1439214 - DNA, 19 bp, Homo sapiens
gtaacactttgctttctga

SEQ ID NO: 1439215 - DNA, 16 bp, Homo sapiens
gtaacagctgaggtct

SEQ ID NO: 1439216 - DNA, 19 bp, Homo sapiens
gtaacaggaaaattttaaa

SEQ ID NO: 1439217 - DNA, 14 bp, Homo sapiens
gtaacaggtctcct

SEQ ID NO: 1439218 - DNA, 21 bp, Homo sapiens
gtaacaggtctcctcttaaaa

SEQ ID NO: 1439219 - DNA, 17 bp, Homo sapiens
gtaacagttcatgtttg

SEQ ID NO: 1439220 - DNA, 22 bp, Homo sapiens
gtaacagttcatgtttgcttca

SEQ ID NO: 1439221 - DNA, 16 bp, Homo sapiens
gtaacagttggtgatt

SEQ ID NO: 1439222 - DNA, 20 bp, Homo sapiens
gtaacatcataattacattc

SEQ ID NO: 1439223 - DNA, 16 bp, Homo sapiens
gtaacatccaagccag

SEQ ID NO: 1439224 - DNA, 17 bp, Homo sapiens
gtaacatccaagccaga

SEQ ID NO: 1439225 - DNA, 18 bp, Homo sapiens
gtaacatccaagccagag

SEQ ID NO: 1439226 - DNA, 15 bp, Homo sapiens
gtaacatttctgttc

SEQ ID NO: 1439227 - DNA, 19 bp, Homo sapiens
gtaacatttgctgttttaa

SEQ ID NO: 1439228 - DNA, 22 bp, Homo sapiens
gtaacatttgctgttttaaaca

SEQ ID NO: 1439229 - DNA, 14 bp, Homo sapiens
gtaaccagccacag

SEQ ID NO: 1439230 - DNA, 21 bp, Homo sapiens
gtaaccagccacagtacatat

SEQ ID NO: 1439231 - DNA, 23 bp, Homo sapiens
gtaaccagccacagtacatatgt

SEQ ID NO: 1439232 - DNA, 13 bp, Homo sapiens
gtaacctgattca

SEQ ID NO: 1439233 - DNA, 17 bp, Homo sapiens
gtaacgcgtcttcctga

SEQ ID NO: 1439234 - DNA, 21 bp, Homo sapiens
gtaactaattttgttgaaaat

SEQ ID NO: 1439235 - DNA, 21 bp, Homo sapiens
gtaactacaaagctttgctac

SEQ ID NO: 1439236 - DNA, 12 bp, Homo sapiens
gtaactacttta

SEQ ID NO: 1439237 - DNA, 14 bp, Homo sapiens
gtaactactttata

SEQ ID NO: 1439238 - DNA, 23 bp, Homo sapiens
gtaactactttttatactccata

SEQ ID NO: 1439239 - DNA, 18 bp, Homo sapiens
gtaactatttcttcagag

SEQ ID NO: 1439240 - DNA, 18 bp, Homo sapiens
gtaactccagatagagaa

SEQ ID NO: 1439241 - DNA, 13 bp, Homo sapiens
gtaactctttctt

SEQ ID NO: 1439242 - DNA, 14 bp, Homo sapiens
gtaactgagagaaa

SEQ ID NO: 1439243 - DNA, 12 bp, Homo sapiens
gtaactgctgag

SEQ ID NO: 1439244 - DNA, 22 bp, Homo sapiens
gtaactggtagtgttcagtaaa

SEQ ID NO: 1439245 - DNA, 15 bp, Homo sapiens
gtaactgtcctgtcc

SEQ ID NO: 1439246 - DNA, 16 bp, Homo sapiens
gtaactgtcctgtcct

SEQ ID NO: 1439247 - DNA, 17 bp, Homo sapiens
gtaactgtcctgtcctg

SEQ ID NO: 1439248 - DNA, 21 bp, Homo sapiens
gtaactgtcctgtcctgctca

SEQ ID NO: 1439249 - DNA, 14 bp, Homo sapiens
gtaacttaaaatag

SEQ ID NO: 1439250 - DNA, 19 bp, Homo sapiens
gtaacttatattgaagaca

SEQ ID NO: 1439251 - DNA, 12 bp, Homo sapiens
gtaacttcctgc

SEQ ID NO: 1439252 - DNA, 17 bp, Homo sapiens
gtaacttcctgctgcac

SEQ ID NO: 1439253 - DNA, 14 bp, Homo sapiens
gtaactttatgtgt

SEQ ID NO: 1439254 - DNA, 22 bp, Homo sapiens
gtaacttttttgtgtatgtact

SEQ ID NO: 1439255 - DNA, 13 bp, Homo sapiens
gtaagaactgtac

SEQ ID NO: 1439256 - DNA, 16 bp, Homo sapiens
gtaagaactgtacatt

SEQ ID NO: 1439257 - DNA, 17 bp, Homo sapiens
gtaagaactgtacattg

SEQ ID NO: 1439258 - DNA, 20 bp, Homo sapiens
gtaagaactgtacattgtga

SEQ ID NO: 1439259 - DNA, 15 bp, Homo sapiens
gtaagaagacatgaa

SEQ ID NO: 1439260 - DNA, 11 bp, Homo sapiens
gtaagaagccg

SEQ ID NO: 1439261 - DNA, 16 bp, Homo sapiens
gtaagaagctgtgaat

SEQ ID NO: 1439262 - DNA, 22 bp, Homo sapiens
gtaagaagtttcttaaacattg

SEQ ID NO: 1439263 - DNA, 19 bp, Homo sapiens
gtaagagaaaagagagaaa

SEQ ID NO: 1439264 - DNA, 15 bp, Homo sapiens
gtaagagaaaatatt

SEQ ID NO: 1439265 - DNA, 16 bp, Homo sapiens
gtaagagcttgctcca

SEQ ID NO: 1439266 - DNA, 14 bp, Homo sapiens
gtaagaggagcaga

SEQ ID NO: 1439267 - DNA, 18 bp, Homo sapiens
gtaagatacaagtttcag

SEQ ID NO: 1439268 - DNA, 11 bp, Homo sapiens
gtaagatgctg

SEQ ID NO: 1439269 - DNA, 12 bp, Homo sapiens
gtaagatgctgg

SEQ ID NO: 1439270 - DNA, 21 bp, Homo sapiens
gtaagattatagattctaaag

SEQ ID NO: 1439271 - DNA, 17 bp, Homo sapiens
gtaagccatcagaagtt

SEQ ID NO: 1439272 - DNA, 16 bp, Homo sapiens
gtaagcgatttgaaac

SEQ ID NO: 1439273 - DNA, 18 bp, Homo sapiens
gtaagcgatttgaaacac

SEQ ID NO: 1439274 - DNA, 17 bp, Homo sapiens
gtaagggattccttgtt

SEQ ID NO: 1439275 - DNA, 24 bp, Homo sapiens
gtaagggggtccctgtgctgatcc

SEQ ID NO: 1439276 - DNA, 12 bp, Homo sapiens
gtaaggtgcctt

SEQ ID NO: 1439277 - DNA, 16 bp, Homo sapiens
gtactttattgtacag

SEQ ID NO: 1439278 - DNA, 14 bp, Homo sapiens
gtactttctgttaa

SEQ ID NO: 1439279 - DNA, 21 bp, Homo sapiens
gtactttctgttatgggcttt

SEQ ID NO: 1439280 - DNA, 20 bp, Homo sapiens
gtactttgtcccgtggcatt

SEQ ID NO: 1439281 - DNA, 20 bp, Homo sapiens
gtacttttatgatgtatatt

SEQ ID NO: 1439282 - DNA, 22 bp, Homo sapiens
gtacttttatgatgtatattta

SEQ ID NO: 1439283 - DNA, 16 bp, Homo sapiens
gtacttttttcttaag

SEQ ID NO: 1439284 - DNA, 20 bp, Homo sapiens
gtacttttttcttaaggcat

SEQ ID NO: 1439285 - DNA, 22 bp, Homo sapiens
gtagaaaaaggggcctgagtgg

SEQ ID NO: 1439286 - DNA, 14 bp, Homo sapiens
gtagaaaatgagga

SEQ ID NO: 1439287 - DNA, 23 bp, Homo sapiens
gtagaaagatccttcgggtgctg

SEQ ID NO: 1439288 - DNA, 16 bp, Homo sapiens
gtagaaataatatgca

SEQ ID NO: 1439289 - DNA, 23 bp, Homo sapiens
gtagaaatatctgaaaatgtatg

SEQ ID NO: 1439290 - DNA, 14 bp, Homo sapiens
gtagaacaaaaaac

SEQ ID NO: 1439291 - DNA, 15 bp, Homo sapiens
gtagaacactaattc

SEQ ID NO: 1439292 - DNA, 18 bp, Homo sapiens
gtagaacgtaaccacgga

SEQ ID NO: 1439293 - DNA, 19 bp, Homo sapiens
gtagaacgtaaccacggaa

SEQ ID NO: 1439294 - DNA, 18 bp, Homo sapiens
gtagaactcactctgggc

SEQ ID NO: 1439295 - DNA, 20 bp, Homo sapiens
gtagaactcactctgggctg

SEQ ID NO: 1439296 - DNA, 20 bp, Homo sapiens
gtagaactttattaagtaaa

SEQ ID NO: 1439297 - DNA, 15 bp, Homo sapiens
gtagaataggcaggg

SEQ ID NO: 1439298 - DNA, 21 bp, Homo sapiens
gtagaatctcttcatgcttga

SEQ ID NO: 1439299 - DNA, 19 bp, Homo sapiens
gtagaatgattaatcaaag

SEQ ID NO: 1439300 - DNA, 17 bp, Homo sapiens
gtagaattatctaattt

SEQ ID NO: 1439301 - DNA, 15 bp, Homo sapiens
gtagacatttataac

SEQ ID NO: 1439302 - DNA, 14 bp, Homo sapiens
gtagactactgttc

SEQ ID NO: 1439303 - DNA, 10 bp, Homo sapiens
gtagactagt

SEQ ID NO: 1439304 - DNA, 20 bp, Homo sapiens
gtagacttcctttataatat

SEQ ID NO: 1439305 - DNA, 15 bp, Homo sapiens
gtagacttggagctg

SEQ ID NO: 1439306 - DNA, 16 bp, Homo sapiens
gtagagacccccaggc

SEQ ID NO: 1439307 - DNA, 14 bp, Homo sapiens
gtagagaggcccgc

SEQ ID NO: 1439308 - DNA, 15 bp, Homo sapiens
gtagagccagaggtc

SEQ ID NO: 1439309 - DNA, 17 bp, Homo sapiens
gtagagctagctgccac

SEQ ID NO: 1439310 - DNA, 15 bp, Homo sapiens
gtagaggcttgttta

SEQ ID NO: 1439311 - DNA, 19 bp, Homo sapiens
gtagaggtataattgtgtg

SEQ ID NO: 1439312 - DNA, 17 bp, Homo sapiens
gtagatatgtattcttt

SEQ ID NO: 1439313 - DNA, 16 bp, Homo sapiens
gtagatattgttttct

SEQ ID NO: 1439314 - DNA, 20 bp, Homo sapiens
gtagatcgcttgagcccagg

SEQ ID NO: 1439315 - DNA, 13 bp, Homo sapiens
gtagatgttcttt

SEQ ID NO: 1439316 - DNA, 21 bp, Homo sapiens
gtagatgttcttttctattta

SEQ ID NO: 1439317 - DNA, 13 bp, Homo sapiens
gtagattctgtgg

SEQ ID NO: 1439318 - DNA, 19 bp, Homo sapiens
gtagatttctggcatatgt

SEQ ID NO: 1439319 - DNA, 21 bp, Homo sapiens
gtagcagttacagctctgtag

SEQ ID NO: 1439320 - DNA, 13 bp, Homo sapiens
gtagcatacattt

SEQ ID NO: 1439321 - DNA, 21 bp, Homo sapiens
gtagcattctttggagttaaa

SEQ ID NO: 1439322 - DNA, 20 bp, Homo sapiens
gtagcatttaaaatggaaaa

SEQ ID NO: 1439323 - DNA, 13 bp, Homo sapiens
gtagccagctgtg

SEQ ID NO: 1439324 - DNA, 23 bp, Homo sapiens
gtagccagggtgtggccctgcca

SEQ ID NO: 1439325 - DNA, 18 bp, Homo sapiens
gtagccatggctcaggca

SEQ ID NO: 1439326 - DNA, 23 bp, Homo sapiens
gtagccatggctcaggcaagccc

SEQ ID NO: 1439327 - DNA, 14 bp, Homo sapiens
gtagccatggctgg

SEQ ID NO: 1439328 - DNA, 15 bp, Homo sapiens
gtagccatggctggg

SEQ ID NO: 1439329 - DNA, 13 bp, Homo sapiens
gtagcccagcact

SEQ ID NO: 1439330 - DNA, 14 bp, Homo sapiens
gtagcccagcactg

SEQ ID NO: 1439331 - DNA, 17 bp, Homo sapiens
gtagcccatccttccct

SEQ ID NO: 1439332 - DNA, 18 bp, Homo sapiens
gtagccccctggcctctg

SEQ ID NO: 1439333 - DNA, 23 bp, Homo sapiens
gtagccccctggcctctgtgcct

SEQ ID NO: 1439334 - DNA, 15 bp, Homo sapiens
gtagccgccctgaga

SEQ ID NO: 1439335 - DNA, 16 bp, Homo sapiens
gtagcctaaagggcag

SEQ ID NO: 1439336 - DNA, 20 bp, Homo sapiens
gtagcctaaagggcagggcc

SEQ ID NO: 1439337 - DNA, 20 bp, Homo sapiens
gtagcctccgtttatgggcc

SEQ ID NO: 1439338 - DNA, 22 bp, Homo sapiens
gtagcctccgtttatgggcctt

SEQ ID NO: 1439339 - DNA, 23 bp, Homo sapiens
gtagcctccgtttatgggccttg

SEQ ID NO: 1439340 - DNA, 17 bp, Homo sapiens
gtagcctgggctcactg

SEQ ID NO: 1439341 - DNA, 20 bp, Homo sapiens
gtagcctgggctcactgtgc

SEQ ID NO: 1439342 - DNA, 15 bp, Homo sapiens
gtagccttattcacc

SEQ ID NO: 1439343 - DNA, 23 bp, Homo sapiens
gtagcggaaaagttgtcttaaaa

SEQ ID NO: 1439344 - DNA, 20 bp, Homo sapiens
gtagctccagcgatggtgct

SEQ ID NO: 1439345 - DNA, 20 bp, Homo sapiens
gtattacttaggttattttg

SEQ ID NO: 1439346 - DNA, 23 bp, Homo sapiens
gtattacttaggttattttgctt

SEQ ID NO: 1439347 - DNA, 14 bp, Homo sapiens
gtattagtttttga

SEQ ID NO: 1439348 - DNA, 23 bp, Homo sapiens
gtattataaacaagaatgaaggt

SEQ ID NO: 1439349 - DNA, 23 bp, Homo sapiens
gtattatagacaaaagaataaga

SEQ ID NO: 1439350 - DNA, 16 bp, Homo sapiens
gtattatcaaagggat

SEQ ID NO: 1439351 - DNA, 19 bp, Homo sapiens
gtattatcattgctcccct

SEQ ID NO: 1439352 - DNA, 13 bp, Homo sapiens
gtattatgagcca

SEQ ID NO: 1439353 - DNA, 21 bp, Homo sapiens
gtattatgcctgagttataaa

SEQ ID NO: 1439354 - DNA, 15 bp, Homo sapiens
gtattattctgcagc

SEQ ID NO: 1439355 - DNA, 12 bp, Homo sapiens
gtattatttata

SEQ ID NO: 1439356 - DNA, 16 bp, Homo sapiens
gtattcaaatttgtgt

SEQ ID NO: 1439357 - DNA, 18 bp, Homo sapiens
gtattcaaatttgtgtca

SEQ ID NO: 1439358 - DNA, 18 bp, Homo sapiens
gtattcaataccgctcag

SEQ ID NO: 1439359 - DNA, 21 bp, Homo sapiens
gtattcacgccattggttgga

SEQ ID NO: 1439360 - DNA, 13 bp, Homo sapiens
gtattcagaggca

SEQ ID NO: 1439361 - DNA, 23 bp, Homo sapiens
gtattcatatttgtactttctgt

SEQ ID NO: 1439362 - DNA, 24 bp, Homo sapiens
gtattctaaattttatatcttgta

SEQ ID NO: 1439363 - DNA, 18 bp, Homo sapiens
gtattctcataggagact

SEQ ID NO: 1439364 - DNA, 16 bp, Homo sapiens
gtattctctttacctt

SEQ ID NO: 1439365 - DNA, 22 bp, Homo sapiens
gtattctctttaccttctaaaa

SEQ ID NO: 1439366 - DNA, 15 bp, Homo sapiens
gtattctgtcttcat

SEQ ID NO: 1439367 - DNA, 15 bp, Homo sapiens
gtattcttgtttgaa

SEQ ID NO: 1439368 - DNA, 20 bp, Homo sapiens
gtattcttttccaagctcct

SEQ ID NO: 1439369 - DNA, 15 bp, Homo sapiens
gtattgaaaacactt

SEQ ID NO: 1439370 - DNA, 13 bp, Homo sapiens
gtattgactttat

SEQ ID NO: 1439371 - DNA, 16 bp, Homo sapiens
gtattgagatttctta

SEQ ID NO: 1439372 - DNA, 16 bp, Homo sapiens
gtattgcttattttat

SEQ ID NO: 1439373 - DNA, 17 bp, Homo sapiens
gtattgtctgaacttgc

SEQ ID NO: 1439374 - DNA, 12 bp, Homo sapiens
gtatttaaagtt

SEQ ID NO: 1439375 - DNA, 21 bp, Homo sapiens
gtatttaacagaaattgtata

SEQ ID NO: 1439376 - DNA, 12 bp, Homo sapiens
gtatttaagcct

SEQ ID NO: 1439377 - DNA, 19 bp, Homo sapiens
gtatttaagcctaaagatt

SEQ ID NO: 1439378 - DNA, 13 bp, Homo sapiens
gtatttataaata

SEQ ID NO: 1439379 - DNA, 12 bp, Homo sapiens
gtatttataata

SEQ ID NO: 1439380 - DNA, 18 bp, Homo sapiens
gtatttatatttggaaag

SEQ ID NO: 1439381 - DNA, 21 bp, Homo sapiens
gtatttatatttggaaagaga

SEQ ID NO: 1439382 - DNA, 13 bp, Homo sapiens
gtatttatttaaa

SEQ ID NO: 1439383 - DNA, 14 bp, Homo sapiens
gtatttatttatgt

SEQ ID NO: 1439384 - DNA, 12 bp, Homo sapiens
gtatttcccagc

SEQ ID NO: 1439385 - DNA, 11 bp, Homo sapiens
gtatttccctt

SEQ ID NO: 1439386 - DNA, 12 bp, Homo sapiens
gtatttcctgct

SEQ ID NO: 1439387 - DNA, 11 bp, Homo sapiens
gtatttctcag

SEQ ID NO: 1439388 - DNA, 22 bp, Homo sapiens
gtatttctctattttcataatc

SEQ ID NO: 1439389 - DNA, 19 bp, Homo sapiens
gtatttgaaaattttactt

SEQ ID NO: 1439390 - DNA, 13 bp, Homo sapiens
gtatttgcagttc

SEQ ID NO: 1439391 - DNA, 11 bp, Homo sapiens
gtatttgctaa

SEQ ID NO: 1439392 - DNA, 13 bp, Homo sapiens
gtatttgctgttg

SEQ ID NO: 1439393 - DNA, 22 bp, Homo sapiens
gtatttgcttttttgttttggc

SEQ ID NO: 1439394 - DNA, 21 bp, Homo sapiens
gtatttggtccaaaaaaagga

SEQ ID NO: 1439395 - DNA, 13 bp, Homo sapiens
gtatttgtaatta

SEQ ID NO: 1439396 - DNA, 15 bp, Homo sapiens
gtatttgtattaata

SEQ ID NO: 1439397 - DNA, 18 bp, Homo sapiens
gtatttgtattaataaag

SEQ ID NO: 1439398 - DNA, 21 bp, Homo sapiens
gtatttgtattaataaagcat

SEQ ID NO: 1439399 - DNA, 16 bp, Homo sapiens
gtatttgttatatata

SEQ ID NO: 1439400 - DNA, 21 bp, Homo sapiens
gtattttaagagaaaactgca

SEQ ID NO: 1439401 - DNA, 12 bp, Homo sapiens
gtattttacatg

SEQ ID NO: 1439402 - DNA, 19 bp, Homo sapiens
gtattttacatgggccagt

SEQ ID NO: 1439403 - DNA, 19 bp, Homo sapiens
gtattttcatgaaaatacc

SEQ ID NO: 1439404 - DNA, 16 bp, Homo sapiens
gtattttcttctctgt

SEQ ID NO: 1439405 - DNA, 22 bp, Homo sapiens
gtattttcttttatatctgtaa

SEQ ID NO: 1439406 - DNA, 20 bp, Homo sapiens
gtcacacgcttttgaattat

SEQ ID NO: 1439407 - DNA, 14 bp, Homo sapiens
gtcacagctgcagc

SEQ ID NO: 1439408 - DNA, 15 bp, Homo sapiens
gtcacagctgcagct

SEQ ID NO: 1439409 - DNA, 20 bp, Homo sapiens
gtcacagctgcagctgggcc

SEQ ID NO: 1439410 - DNA, 13 bp, Homo sapiens
gtcacaggaagaa

SEQ ID NO: 1439411 - DNA, 20 bp, Homo sapiens
gtcacataaatggattaatt

SEQ ID NO: 1439412 - DNA, 22 bp, Homo sapiens
gtcacatcagtgaggagggatg

SEQ ID NO: 1439413 - DNA, 19 bp, Homo sapiens
gtcacatccatccctccat

SEQ ID NO: 1439414 - DNA, 21 bp, Homo sapiens
gtcacatggcctatgcacata

SEQ ID NO: 1439415 - DNA, 22 bp, Homo sapiens
gtcacattgatgtaaggactgt

SEQ ID NO: 1439416 - DNA, 13 bp, Homo sapiens
gtcaccacctctc

SEQ ID NO: 1439417 - DNA, 15 bp, Homo sapiens
gtcaccaccttccca

SEQ ID NO: 1439418 - DNA, 17 bp, Homo sapiens
gtcaccaccttcccagc

SEQ ID NO: 1439419 - DNA, 19 bp, Homo sapiens
gtcaccacgactggccagg

SEQ ID NO: 1439420 - DNA, 14 bp, Homo sapiens
gtcaccacgtgcag

SEQ ID NO: 1439421 - DNA, 21 bp, Homo sapiens
gtcaccagagcttctctgggc

SEQ ID NO: 1439422 - DNA, 22 bp, Homo sapiens
gtcaccagagcttctctgggct

SEQ ID NO: 1439423 - DNA, 23 bp, Homo sapiens
gtcaccagagcttctctgggctg

SEQ ID NO: 1439424 - DNA, 15 bp, Homo sapiens
gtcaccagcaacatc

SEQ ID NO: 1439425 - DNA, 14 bp, Homo sapiens
gtcaccagctgctg

SEQ ID NO: 1439426 - DNA, 16 bp, Homo sapiens
gtcaccagctgctgtg

SEQ ID NO: 1439427 - DNA, 16 bp, Homo sapiens
gtcaccaggggaggag

SEQ ID NO: 1439428 - DNA, 18 bp, Homo sapiens
gtcaccaggggaggagcc

SEQ ID NO: 1439429 - DNA, 13 bp, Homo sapiens
gtcacccaaacac

SEQ ID NO: 1439430 - DNA, 20 bp, Homo sapiens
gtcacccaaacacttctgct

SEQ ID NO: 1439431 - DNA, 15 bp, Homo sapiens
gtcacccatcaggac

SEQ ID NO: 1439432 - DNA, 15 bp, Homo sapiens
gtcacccggccccca

SEQ ID NO: 1439433 - DNA, 16 bp, Homo sapiens
gtcaccgacagcggcc

SEQ ID NO: 1439434 - DNA, 22 bp, Homo sapiens
gtcaccgggatgaacctatcct

SEQ ID NO: 1439435 - DNA, 22 bp, Homo sapiens
gtcacctagaacgtgcatcctt

SEQ ID NO: 1439436 - DNA, 15 bp, Homo sapiens
gtcacctagcaagct

SEQ ID NO: 1439437 - DNA, 22 bp, Homo sapiens
gtcacctcgtctccctggtgcc

SEQ ID NO: 1439438 - DNA, 14 bp, Homo sapiens
gtcacctgcaagcc

SEQ ID NO: 1439439 - DNA, 19 bp, Homo sapiens
gtcacctgcaagccccagg

SEQ ID NO: 1439440 - DNA, 22 bp, Homo sapiens
gtcacctgcaagccccagggcc

SEQ ID NO: 1439441 - DNA, 23 bp, Homo sapiens
gtcacctgcaagccccagggcct

SEQ ID NO: 1439442 - DNA, 14 bp, Homo sapiens
gtcacctgctccag

SEQ ID NO: 1439443 - DNA, 16 bp, Homo sapiens
gtcacgagcacaatgg

SEQ ID NO: 1439444 - DNA, 23 bp, Homo sapiens
gtcacgctcatgtcctgtcctgg

SEQ ID NO: 1439445 - DNA, 20 bp, Homo sapiens
gtcacggctgcgcactgtgt

SEQ ID NO: 1439446 - DNA, 17 bp, Homo sapiens
gtcacgtgtaggagtga

SEQ ID NO: 1439447 - DNA, 23 bp, Homo sapiens
gtcacgttcttggatcctcagaa

SEQ ID NO: 1439448 - DNA, 14 bp, Homo sapiens
gtcactaatacaca

SEQ ID NO: 1439449 - DNA, 17 bp, Homo sapiens
gtcactactcacagtct

SEQ ID NO: 1439450 - DNA, 16 bp, Homo sapiens
gtcactagcagctgca

SEQ ID NO: 1439451 - DNA, 18 bp, Homo sapiens
gtcactaggatgcagatg

SEQ ID NO: 1439452 - DNA, 15 bp, Homo sapiens
gtcactcacactggc

SEQ ID NO: 1439453 - DNA, 18 bp, Homo sapiens
gtcactcacactggccac

SEQ ID NO: 1439454 - DNA, 23 bp, Homo sapiens
gtcactcagctgagaaggccagc

SEQ ID NO: 1439455 - DNA, 14 bp, Homo sapiens
gtcactcaggcctc

SEQ ID NO: 1439456 - DNA, 16 bp, Homo sapiens
gtcactcaggcctctg

SEQ ID NO: 1439457 - DNA, 23 bp, Homo sapiens
gtcactcattgctgagcctctgc

SEQ ID NO: 1439458 - DNA, 15 bp, Homo sapiens
gtcactccagtgctc

SEQ ID NO: 1439459 - DNA, 17 bp, Homo sapiens
gtcactccagtgctcag

SEQ ID NO: 1439460 - DNA, 17 bp, Homo sapiens
gtcactcgtaggggatg

SEQ ID NO: 1439461 - DNA, 16 bp, Homo sapiens
gtcactctgccctctg

SEQ ID NO: 1439462 - DNA, 14 bp, Homo sapiens
gtcactgaacaaaa

SEQ ID NO: 1439463 - DNA, 15 bp, Homo sapiens
gtcactgaaccactg

SEQ ID NO: 1439464 - DNA, 21 bp, Homo sapiens
gtcactgaaccactgcttctc

SEQ ID NO: 1439465 - DNA, 15 bp, Homo sapiens
gtcactgagctgtgt

SEQ ID NO: 1439466 - DNA, 23 bp, Homo sapiens
gtcactgcacagtgcatctcagc

SEQ ID NO: 1439467 - DNA, 21 bp, Homo sapiens
gtcactgccgacatccctccc

SEQ ID NO: 1439468 - DNA, 18 bp, Homo sapiens
gtcactgcctgcagaggt

SEQ ID NO: 1439469 - DNA, 12 bp, Homo sapiens
gtcactggaaag

SEQ ID NO: 1439470 - DNA, 18 bp, Homo sapiens
gtcactggaggttgaagc

SEQ ID NO: 1439471 - DNA, 16 bp, Homo sapiens
gtcactggcagcctgc

SEQ ID NO: 1439472 - DNA, 12 bp, Homo sapiens
gtcactggctct

SEQ ID NO: 1439473 - DNA, 15 bp, Homo sapiens
gtcactggctctcca

SEQ ID NO: 1439474 - DNA, 16 bp, Homo sapiens
gtcactggctctccaa

SEQ ID NO: 1439475 - DNA, 17 bp, Homo sapiens
gtcactggctctccaag

SEQ ID NO: 1439476 - DNA, 20 bp, Homo sapiens
gtcactggctctccaagtgc

SEQ ID NO: 1439477 - DNA, 19 bp, Homo sapiens
gtcactgtttattttttta

SEQ ID NO: 1439478 - DNA, 21 bp, Homo sapiens
gtcacttaactataaggtgcc

SEQ ID NO: 1439479 - DNA, 15 bp, Homo sapiens
gtcacttatttcata

SEQ ID NO: 1439480 - DNA, 14 bp, Homo sapiens
gtcacttccagtgt

SEQ ID NO: 1439481 - DNA, 12 bp, Homo sapiens
gtcacttctcca

SEQ ID NO: 1439482 - DNA, 15 bp, Homo sapiens
gtcactttttttctt

SEQ ID NO: 1439483 - DNA, 19 bp, Homo sapiens
gtcactttttttctttttc

SEQ ID NO: 1439484 - DNA, 22 bp, Homo sapiens
gtcactttttttttttttcccc

SEQ ID NO: 1439485 - DNA, 13 bp, Homo sapiens
gtcagaaataaaa

SEQ ID NO: 1439486 - DNA, 12 bp, Homo sapiens
gtcagaacatgt

SEQ ID NO: 1439487 - DNA, 19 bp, Homo sapiens
gtcagaaccagagggcatg

SEQ ID NO: 1439488 - DNA, 14 bp, Homo sapiens
gtcagactgctggg

SEQ ID NO: 1439489 - DNA, 15 bp, Homo sapiens
gtcagactgctggga

SEQ ID NO: 1439490 - DNA, 22 bp, Homo sapiens
gtcagactggctggctgcagtg

SEQ ID NO: 1439491 - DNA, 23 bp, Homo sapiens
gtcagacttccaaatcctggaag

SEQ ID NO: 1439492 - DNA, 23 bp, Homo sapiens
gtcagactttgtgttcatttcat

SEQ ID NO: 1439493 - DNA, 23 bp, Homo sapiens
gtcagagagacccgggaaggaag

SEQ ID NO: 1439494 - DNA, 21 bp, Homo sapiens
gtcagagagacctcatcctgc

SEQ ID NO: 1439495 - DNA, 16 bp, Homo sapiens
gtcagagatgggctga

SEQ ID NO: 1439496 - DNA, 14 bp, Homo sapiens
gtcagagcccagcc

SEQ ID NO: 1439497 - DNA, 14 bp, Homo sapiens
gtcagaggagaaga

SEQ ID NO: 1439498 - DNA, 15 bp, Homo sapiens
gtcagagggactgtc

SEQ ID NO: 1439499 - DNA, 23 bp, Homo sapiens
gtcagagggactgtcagctgagc

SEQ ID NO: 1439500 - DNA, 13 bp, Homo sapiens
gtcagagtgccac

SEQ ID NO: 1439501 - DNA, 15 bp, Homo sapiens
gtcagatttctggtt

SEQ ID NO: 1439502 - DNA, 13 bp, Homo sapiens
gtcagatttttat

SEQ ID NO: 1439503 - DNA, 18 bp, Homo sapiens
gtcagcaccttggcccag

SEQ ID NO: 1439504 - DNA, 19 bp, Homo sapiens
gtcagcaccttggcccagg

SEQ ID NO: 1439505 - DNA, 10 bp, Homo sapiens
gtcagcatct

SEQ ID NO: 1439506 - DNA, 18 bp, Homo sapiens
gtcagcatctgaccatct

SEQ ID NO: 1439507 - DNA, 22 bp, Homo sapiens
gtcagcatctgaccatctgtga

SEQ ID NO: 1439508 - DNA, 22 bp, Homo sapiens
gtcagcatctggctgtctagaa

SEQ ID NO: 1439509 - DNA, 13 bp, Homo sapiens
gtcagccacactg

SEQ ID NO: 1439510 - DNA, 15 bp, Homo sapiens
gtcagccacactggg

SEQ ID NO: 1439511 - DNA, 17 bp, Homo sapiens
gtcagccacactgggcc

SEQ ID NO: 1439512 - DNA, 15 bp, Homo sapiens
gtcagccaggagctg

SEQ ID NO: 1439513 - DNA, 15 bp, Homo sapiens
gtcagcccagcacct

SEQ ID NO: 1439514 - DNA, 13 bp, Homo sapiens
gtcagcctggaag

SEQ ID NO: 1439515 - DNA, 20 bp, Homo sapiens
gtcagcctggaagggacagt

SEQ ID NO: 1439516 - DNA, 21 bp, Homo sapiens
gtcagcctggaagggacagta

SEQ ID NO: 1439517 - DNA, 22 bp, Homo sapiens
gtcagcctggaagggacagtat

SEQ ID NO: 1439518 - DNA, 22 bp, Homo sapiens
gtcagccttccccctcccaggg

SEQ ID NO: 1439519 - DNA, 21 bp, Homo sapiens
gtcagcgttctaccaggcaaa

SEQ ID NO: 1439520 - DNA, 12 bp, Homo sapiens
gtcagctaattg

SEQ ID NO: 1439521 - DNA, 19 bp, Homo sapiens
gtcagctactaatgatgtt

SEQ ID NO: 1439522 - DNA, 22 bp, Homo sapiens
gtcagctcccctcggagaagag

SEQ ID NO: 1439523 - DNA, 16 bp, Homo sapiens
gtcagctctctgccct

SEQ ID NO: 1439524 - DNA, 17 bp, Homo sapiens
gtcagctctctgccctg

SEQ ID NO: 1439525 - DNA, 21 bp, Homo sapiens
gtcagctctctgccctgtgta

SEQ ID NO: 1439526 - DNA, 21 bp, Homo sapiens
gtcagctgagcttgagctccc

SEQ ID NO: 1439527 - DNA, 12 bp, Homo sapiens
gtcagctgaggc

SEQ ID NO: 1439528 - DNA, 20 bp, Homo sapiens
gtcagctgctccctggcatt

SEQ ID NO: 1439529 - DNA, 18 bp, Homo sapiens
gtcagcttttgttgttta

SEQ ID NO: 1439530 - DNA, 21 bp, Homo sapiens
gtcaggagatcgagaccatcc

SEQ ID NO: 1439531 - DNA, 16 bp, Homo sapiens
gtcaggagtgtagttg

SEQ ID NO: 1439532 - DNA, 23 bp, Homo sapiens
gtcaggagttagaggccagcctg

SEQ ID NO: 1439533 - DNA, 13 bp, Homo sapiens
gtcaggagttcct

SEQ ID NO: 1439534 - DNA, 16 bp, Homo sapiens
gtcaggagttgtgtct

SEQ ID NO: 1439535 - DNA, 21 bp, Homo sapiens
gtcaggatgcacatttctgga

SEQ ID NO: 1439536 - DNA, 13 bp, Homo sapiens
gtcaggcaggttt

SEQ ID NO: 1439537 - DNA, 20 bp, Homo sapiens
gtcaggcccgtcggagctgc

SEQ ID NO: 1439538 - DNA, 22 bp, Homo sapiens
gtcaggcccgtcggagctgcct

SEQ ID NO: 1439539 - DNA, 21 bp, Homo sapiens
gtcaggccctctgcctgcact

SEQ ID NO: 1439540 - DNA, 22 bp, Homo sapiens
gtcaggcccttattttcaagaa

SEQ ID NO: 1439541 - DNA, 16 bp, Homo sapiens
gtcaggcggagctgct

SEQ ID NO: 1439542 - DNA, 19 bp, Homo sapiens
gtcagggacagcagcctcc

SEQ ID NO: 1439543 - DNA, 13 bp, Homo sapiens
gtcagggagaggt

SEQ ID NO: 1439544 - DNA, 21 bp, Homo sapiens
gtcagggagaggtcaccagct

SEQ ID NO: 1439545 - DNA, 13 bp, Homo sapiens
gtcagggccagac

SEQ ID NO: 1439546 - DNA, 20 bp, Homo sapiens
gtcagggccagactggaaga

SEQ ID NO: 1439547 - DNA, 14 bp, Homo sapiens
gtcagggccaggtg

SEQ ID NO: 1439548 - DNA, 17 bp, Homo sapiens
gtcaggtaatatacctg

SEQ ID NO: 1439549 - DNA, 19 bp, Homo sapiens
gtcagtaggtccaagggcc

SEQ ID NO: 1439550 - DNA, 14 bp, Homo sapiens
gtcagtatgacatt

SEQ ID NO: 1439551 - DNA, 12 bp, Homo sapiens
gtcagtctttag

SEQ ID NO: 1439552 - DNA, 17 bp, Homo sapiens
gtcagtctttgctcagt

SEQ ID NO: 1439553 - DNA, 18 bp, Homo sapiens
gtcagtgcaaatgtcaga

SEQ ID NO: 1439554 - DNA, 23 bp, Homo sapiens
gtcagtgctataaatgccagagc

SEQ ID NO: 1439555 - DNA, 16 bp, Homo sapiens
gtcagtggagcctggg

SEQ ID NO: 1439556 - DNA, 22 bp, Homo sapiens
gtcagtgggaacgtgactgccc

SEQ ID NO: 1439557 - DNA, 16 bp, Homo sapiens
gtcagtgtggagaggg

SEQ ID NO: 1439558 - DNA, 19 bp, Homo sapiens
gtcagtgtggagaggggtg

SEQ ID NO: 1439559 - DNA, 22 bp, Homo sapiens
gtcagttcccggagcacagccc

SEQ ID NO: 1439560 - DNA, 14 bp, Homo sapiens
gtcagtttggaatg

SEQ ID NO: 1439561 - DNA, 22 bp, Homo sapiens
gtcataacggttaagaaagcac

SEQ ID NO: 1439562 - DNA, 18 bp, Homo sapiens
gtcataactaaataaagc

SEQ ID NO: 1439563 - DNA, 13 bp, Homo sapiens
gtcatagaaatat

SEQ ID NO: 1439564 - DNA, 22 bp, Homo sapiens
gtcatagaaattacacccaaag

SEQ ID NO: 1439565 - DNA, 23 bp, Homo sapiens
gtcatagccaaagccaggcctga

SEQ ID NO: 1439566 - DNA, 17 bp, Homo sapiens
gtcatagtcttgaaatg

SEQ ID NO: 1439567 - DNA, 21 bp, Homo sapiens
gtcatataagattcatattta

SEQ ID NO: 1439568 - DNA, 15 bp, Homo sapiens
gtcatatacatattg

SEQ ID NO: 1439569 - DNA, 15 bp, Homo sapiens
gtcatcaaagcagaa

SEQ ID NO: 1439570 - DNA, 14 bp, Homo sapiens
gtcatcaccaccct

SEQ ID NO: 1439571 - DNA, 15 bp, Homo sapiens
gtcatcaccaccctt

SEQ ID NO: 1439572 - DNA, 23 bp, Homo sapiens
gtcatcatgaactggcttgtaca

SEQ ID NO: 1439573 - DNA, 22 bp, Homo sapiens
gtcatccacacaacaccaggac

SEQ ID NO: 1439574 - DNA, 23 bp, Homo sapiens
gtcatccacacaacaccaggact

SEQ ID NO: 1439575 - DNA, 22 bp, Homo sapiens
gtcatccacctgtcttggcctc

SEQ ID NO: 1439576 - DNA, 21 bp, Homo sapiens
gtcatcccatcattttccata

SEQ ID NO: 1439577 - DNA, 22 bp, Homo sapiens
gtcatcctcaaagaaagtgtat

SEQ ID NO: 1439578 - DNA, 13 bp, Homo sapiens
gtcatctagcatt

SEQ ID NO: 1439579 - DNA, 18 bp, Homo sapiens
gtcatctcattccactgt

SEQ ID NO: 1439580 - DNA, 13 bp, Homo sapiens
gtcatctctgttc

SEQ ID NO: 1439581 - DNA, 20 bp, Homo sapiens
gtcatctggcggaggtctct

SEQ ID NO: 1439582 - DNA, 17 bp, Homo sapiens
gtcatctgtaagagctt

SEQ ID NO: 1439583 - DNA, 21 bp, Homo sapiens
gtcatctgtaagagcttgctc

SEQ ID NO: 1439584 - DNA, 21 bp, Homo sapiens
gtcatcttgtgagtggataat

SEQ ID NO: 1439585 - DNA, 16 bp, Homo sapiens
gtcatgatctccctgc

SEQ ID NO: 1439586 - DNA, 21 bp, Homo sapiens
gtcatgctcagccttgctgct

SEQ ID NO: 1439587 - DNA, 16 bp, Homo sapiens
gggtggtgggtgctgg

SEQ ID NO: 1439588 - DNA, 17 bp, Homo sapiens
gggtggttattggactc

SEQ ID NO: 1439589 - DNA, 19 bp, Homo sapiens
gggtgtcctgcctgtctgc

SEQ ID NO: 1439590 - DNA, 17 bp, Homo sapiens
gggtgtgaacatgttct

SEQ ID NO: 1439591 - DNA, 13 bp, Homo sapiens
gggtgtgctggga

SEQ ID NO: 1439592 - DNA, 12 bp, Homo sapiens
gggtgtggcagt

SEQ ID NO: 1439593 - DNA, 13 bp, Homo sapiens
gggtgtggccagc

SEQ ID NO: 1439594 - DNA, 22 bp, Homo sapiens
gggtgtggtatgagggggtggt

SEQ ID NO: 1439595 - DNA, 20 bp, Homo sapiens
gggttaaatattttgctaac

SEQ ID NO: 1439596 - DNA, 18 bp, Homo sapiens
gggttaagtctcctgtct

SEQ ID NO: 1439597 - DNA, 17 bp, Homo sapiens
gggttagaggagtctgt

SEQ ID NO: 1439598 - DNA, 18 bp, Homo sapiens
gggttagatgttgccatg

SEQ ID NO: 1439599 - DNA, 22 bp, Homo sapiens
gggttaggggttcattctcccg

SEQ ID NO: 1439600 - DNA, 13 bp, Homo sapiens
gggttatctctgt

SEQ ID NO: 1439601 - DNA, 19 bp, Homo sapiens
gggttatttttattaaatg

SEQ ID NO: 1439602 - DNA, 15 bp, Homo sapiens
gggttcaagcccagg

SEQ ID NO: 1439603 - DNA, 19 bp, Homo sapiens
gggttcagaaatgctgcct

SEQ ID NO: 1439604 - DNA, 20 bp, Homo sapiens
gggttcataggtcactggct

SEQ ID NO: 1439605 - DNA, 14 bp, Homo sapiens
gggttcatttgtgt

SEQ ID NO: 1439606 - DNA, 11 bp, Homo sapiens
gggttccaaat

SEQ ID NO: 1439607 - DNA, 23 bp, Homo sapiens
gggttccagaggtattcctctct

SEQ ID NO: 1439608 - DNA, 19 bp, Homo sapiens
gggttccccacacagggca

SEQ ID NO: 1439609 - DNA, 22 bp, Homo sapiens
gggttcctggttgttcctgcat

SEQ ID NO: 1439610 - DNA, 13 bp, Homo sapiens
gggttgaaagaca

SEQ ID NO: 1439611 - DNA, 22 bp, Homo sapiens
gggttgaaggcagtctgaaccc

SEQ ID NO: 1439612 - DNA, 18 bp, Homo sapiens
gggttgcagtggagaggg

SEQ ID NO: 1439613 - DNA, 12 bp, Homo sapiens
gggttggctttt

SEQ ID NO: 1439614 - DNA, 14 bp, Homo sapiens
gggttgggcccaga

SEQ ID NO: 1439615 - DNA, 23 bp, Homo sapiens
gggttggtcaggagaatgaaaca

SEQ ID NO: 1439616 - DNA, 15 bp, Homo sapiens
gggttgtgtgtctgt

SEQ ID NO: 1439617 - DNA, 20 bp, Homo sapiens
gggtttcactgtgttagcca

SEQ ID NO: 1439618 - DNA, 17 bp, Homo sapiens
gggtttcgactggtcca

SEQ ID NO: 1439619 - DNA, 20 bp, Homo sapiens
gggtttcgactggtccagct

SEQ ID NO: 1439620 - DNA, 19 bp, Homo sapiens
gggtttggaccccagctgg

SEQ ID NO: 1439621 - DNA, 23 bp, Homo sapiens
gggttttattgtccttcagagct

SEQ ID NO: 1439622 - DNA, 16 bp, Homo sapiens
gggttttccaccctgg

SEQ ID NO: 1439623 - DNA, 21 bp, Homo sapiens
gggttttgcaataacttctat

SEQ ID NO: 1439624 - DNA, 13 bp, Homo sapiens
gggttttgtaatg

SEQ ID NO: 1439625 - DNA, 18 bp, Homo sapiens
gggtttttagagaatgtg

SEQ ID NO: 1439626 - DNA, 19 bp, Homo sapiens
gggtttttagagaatgtgt

SEQ ID NO: 1439627 - DNA, 14 bp, Homo sapiens
ggtaaaaaatttat

SEQ ID NO: 1439628 - DNA, 16 bp, Homo sapiens
ggtaaaaaatttataa

SEQ ID NO: 1439629 - DNA, 18 bp, Homo sapiens
ggtaaaacagggccacat

SEQ ID NO: 1439630 - DNA, 23 bp, Homo sapiens
ggtaaaatacttttactctgcct

SEQ ID NO: 1439631 - DNA, 15 bp, Homo sapiens
ggtaaataaaaagaa

SEQ ID NO: 1439632 - DNA, 10 bp, Homo sapiens
ggtaaatgtt

SEQ ID NO: 1439633 - DNA, 13 bp, Homo sapiens
ggtaaatgtttct

SEQ ID NO: 1439634 - DNA, 13 bp, Homo sapiens
ggtaaattcagac

SEQ ID NO: 1439635 - DNA, 14 bp, Homo sapiens
ggtaaattcagaca

SEQ ID NO: 1439636 - DNA, 22 bp, Homo sapiens
ggtaaattcagacaacattatg

SEQ ID NO: 1439637 - DNA, 23 bp, Homo sapiens
ggtaaattcagacaacattatga

SEQ ID NO: 1439638 - DNA, 23 bp, Homo sapiens
ggtaacactttgctttctgaatt

SEQ ID NO: 1439639 - DNA, 22 bp, Homo sapiens
ggtaaccttagggacaggtgga

SEQ ID NO: 1439640 - DNA, 22 bp, Homo sapiens
ggtaacgagggcaacagggagc

SEQ ID NO: 1439641 - DNA, 13 bp, Homo sapiens
ggtaagaagaaag

SEQ ID NO: 1439642 - DNA, 14 bp, Homo sapiens
ggtaagaagaaagc

SEQ ID NO: 1439643 - DNA, 23 bp, Homo sapiens
ggtaagaagttttaaaaagccag

SEQ ID NO: 1439644 - DNA, 23 bp, Homo sapiens
ggtaagtgttctcatgaagcagg

SEQ ID NO: 1439645 - DNA, 14 bp, Homo sapiens
ggtaataagggaaa

SEQ ID NO: 1439646 - DNA, 13 bp, Homo sapiens
ggtaatatacctg

SEQ ID NO: 1439647 - DNA, 20 bp, Homo sapiens
ggtaatccaggcacagctga

SEQ ID NO: 1439648 - DNA, 12 bp, Homo sapiens
ggtaatctacac

SEQ ID NO: 1439649 - DNA, 20 bp, Homo sapiens
ggtaatcttgctctgcttga

SEQ ID NO: 1439650 - DNA, 17 bp, Homo sapiens
ggtaattgtacaataaa

SEQ ID NO: 1439651 - DNA, 21 bp, Homo sapiens
ggtaatttataaagaaaaata

SEQ ID NO: 1439652 - DNA, 14 bp, Homo sapiens
ggtacaagagatgg

SEQ ID NO: 1439653 - DNA, 16 bp, Homo sapiens
ggtacagcttctggag

SEQ ID NO: 1439654 - DNA, 13 bp, Homo sapiens
ggtacaggagagg

SEQ ID NO: 1439655 - DNA, 18 bp, Homo sapiens
ggtacatggtgtttgtgg

SEQ ID NO: 1439656 - DNA, 16 bp, Homo sapiens
ggtacatttatcactg

SEQ ID NO: 1439657 - DNA, 16 bp, Homo sapiens
ggtaccaaacaaggaa

SEQ ID NO: 1439658 - DNA, 15 bp, Homo sapiens
ggtaccagctgcgct

SEQ ID NO: 1439659 - DNA, 12 bp, Homo sapiens
ggtacccagcca

SEQ ID NO: 1439660 - DNA, 14 bp, Homo sapiens
ggtaccctcctggc

SEQ ID NO: 1439661 - DNA, 13 bp, Homo sapiens
ggtaccgatttct

SEQ ID NO: 1439662 - DNA, 16 bp, Homo sapiens
ggtacctcaagcccca

SEQ ID NO: 1439663 - DNA, 22 bp, Homo sapiens
ggtacctcaagccccatttcct

SEQ ID NO: 1439664 - DNA, 12 bp, Homo sapiens
ggtacctgccct

SEQ ID NO: 1439665 - DNA, 13 bp, Homo sapiens
ggtacctgccctc

SEQ ID NO: 1439666 - DNA, 13 bp, Homo sapiens
ggtacctgtgctt

SEQ ID NO: 1439667 - DNA, 18 bp, Homo sapiens
ggtaccttgaacactggg

SEQ ID NO: 1439668 - DNA, 16 bp, Homo sapiens
ggtactgacccaggac

SEQ ID NO: 1439669 - DNA, 19 bp, Homo sapiens
ggtactgcattctctccca

SEQ ID NO: 1439670 - DNA, 22 bp, Homo sapiens
ggtactgcattctctcccatcc

SEQ ID NO: 1439671 - DNA, 20 bp, Homo sapiens
ggtacttcaggggcacttca

SEQ ID NO: 1439672 - DNA, 16 bp, Homo sapiens
ggtacttcttgaaggt

SEQ ID NO: 1439673 - DNA, 21 bp, Homo sapiens
ggtactttattcttgctgggc

SEQ ID NO: 1439674 - DNA, 22 bp, Homo sapiens
ggtacttttatgatgtatattt

SEQ ID NO: 1439675 - DNA, 13 bp, Homo sapiens
ggtagaaaaacat

SEQ ID NO: 1439676 - DNA, 22 bp, Homo sapiens
ggtagaaatatctgaaaatgta

SEQ ID NO: 1439677 - DNA, 16 bp, Homo sapiens
ggtagaatgattaatc

SEQ ID NO: 1439678 - DNA, 14 bp, Homo sapiens
ggtagagaccccca

SEQ ID NO: 1439679 - DNA, 15 bp, Homo sapiens
ggtagagacccccag

SEQ ID NO: 1439680 - DNA, 15 bp, Homo sapiens
ggtagagctgatcca

SEQ ID NO: 1439681 - DNA, 19 bp, Homo sapiens
ggtagatcgcttgagccca

SEQ ID NO: 1439682 - DNA, 20 bp, Homo sapiens
ggtagatcgcttgagcccag

SEQ ID NO: 1439683 - DNA, 22 bp, Homo sapiens
ggtagatcgcttgagcccagga

SEQ ID NO: 1439684 - DNA, 18 bp, Homo sapiens
ggtagatgctgaggcccc

SEQ ID NO: 1439685 - DNA, 13 bp, Homo sapiens
ggtagcagctgga

SEQ ID NO: 1439686 - DNA, 17 bp, Homo sapiens
ggtagccatcaagcact

SEQ ID NO: 1439687 - DNA, 23 bp, Homo sapiens
ggtagccatgatttgtcccagcc

SEQ ID NO: 1439688 - DNA, 15 bp, Homo sapiens
ggtagcccagcactg

SEQ ID NO: 1439689 - DNA, 14 bp, Homo sapiens
ggtaggcccttgtc

SEQ ID NO: 1439690 - DNA, 17 bp, Homo sapiens
ggtaggggagggcaggc

SEQ ID NO: 1439691 - DNA, 13 bp, Homo sapiens
ggtaggggcaggg

SEQ ID NO: 1439692 - DNA, 14 bp, Homo sapiens
ggtaggggcaggga

SEQ ID NO: 1439693 - DNA, 16 bp, Homo sapiens
ggtagggtaaatcagt

SEQ ID NO: 1439694 - DNA, 15 bp, Homo sapiens
ggtagggtgttctgg

SEQ ID NO: 1439695 - DNA, 13 bp, Homo sapiens
ggtaggtaaatct

SEQ ID NO: 1439696 - DNA, 19 bp, Homo sapiens
ggtaggttcagccaaggtt

SEQ ID NO: 1439697 - DNA, 22 bp, Homo sapiens
ggtagtactcctgcaaaatttt

SEQ ID NO: 1439698 - DNA, 21 bp, Homo sapiens
ggtagtatctcgtaatagctt

SEQ ID NO: 1439699 - DNA, 18 bp, Homo sapiens
ggtagttctgtgcctccc

SEQ ID NO: 1439700 - DNA, 21 bp, Homo sapiens
ggtagttctgtgcctcccccc

SEQ ID NO: 1439701 - DNA, 14 bp, Homo sapiens
ggtagttggaaaca

SEQ ID NO: 1439702 - DNA, 21 bp, Homo sapiens
ggtataaaactttcctcgcct

SEQ ID NO: 1439703 - DNA, 12 bp, Homo sapiens
ggtataaagaca

SEQ ID NO: 1439704 - DNA, 20 bp, Homo sapiens
ggtatacatgtgtacatata

SEQ ID NO: 1439705 - DNA, 13 bp, Homo sapiens
ggtataggtctca

SEQ ID NO: 1439706 - DNA, 13 bp, Homo sapiens
ggtatatatacat

SEQ ID NO: 1439707 - DNA, 17 bp, Homo sapiens
ggtatatcattctaaag

SEQ ID NO: 1439708 - DNA, 19 bp, Homo sapiens
ggtatcattcaactctcca

SEQ ID NO: 1439709 - DNA, 18 bp, Homo sapiens
ggtatccccccatcttgc

SEQ ID NO: 1439710 - DNA, 12 bp, Homo sapiens
ggtatcctgccc

SEQ ID NO: 1439711 - DNA, 21 bp, Homo sapiens
ggtatctgctgcctctgaaaa

SEQ ID NO: 1439712 - DNA, 17 bp, Homo sapiens
ggtatctggcttccctg

SEQ ID NO: 1439713 - DNA, 19 bp, Homo sapiens
ggtatctggcttccctgga

SEQ ID NO: 1439714 - DNA, 16 bp, Homo sapiens
ggtatgatcaataaag

SEQ ID NO: 1439715 - DNA, 21 bp, Homo sapiens
ggtatggaagggtttgtggct

SEQ ID NO: 1439716 - DNA, 18 bp, Homo sapiens
ggtatggtggggatattt

SEQ ID NO: 1439717 - DNA, 22 bp, Homo sapiens
ggtattaactttatacacttgg

SEQ ID NO: 1439718 - DNA, 19 bp, Homo sapiens
ggtattcccactcaccagc

SEQ ID NO: 1439719 - DNA, 22 bp, Homo sapiens
ggtattcccactcaccagccct

SEQ ID NO: 1439720 - DNA, 16 bp, Homo sapiens
ggtattttgaatacca

SEQ ID NO: 1439721 - DNA, 19 bp, Homo sapiens
ggtcaaacaggctgtaatt

SEQ ID NO: 1439722 - DNA, 21 bp, Homo sapiens
ggtcaacttaaggtatattta

SEQ ID NO: 1439723 - DNA, 18 bp, Homo sapiens
ggtcaagaaacagccagc

SEQ ID NO: 1439724 - DNA, 23 bp, Homo sapiens
ggtcaaggcagtagaactccagg

SEQ ID NO: 1439725 - DNA, 20 bp, Homo sapiens
ggtcaagtaagaagacatga

SEQ ID NO: 1439726 - DNA, 21 bp, Homo sapiens
ggtcaataaacttagaggaaa

SEQ ID NO: 1439727 - DNA, 18 bp, Homo sapiens
ggtcaataacactgtatt

SEQ ID NO: 1439728 - DNA, 19 bp, Homo sapiens
ggtcaataacactgtattt

SEQ ID NO: 1439729 - DNA, 20 bp, Homo sapiens
ggtcaataacactgtatttt

SEQ ID NO: 1439730 - DNA, 14 bp, Homo sapiens
ggtcaccaggggag

SEQ ID NO: 1439731 - DNA, 14 bp, Homo sapiens
ggtcaccatgaaac

SEQ ID NO: 1439732 - DNA, 15 bp, Homo sapiens
ggtcacccatcagga

SEQ ID NO: 1439733 - DNA, 19 bp, Homo sapiens
ggtcacccttaatatttat

SEQ ID NO: 1439734 - DNA, 20 bp, Homo sapiens
ggtcactctccccaaaatat

SEQ ID NO: 1439735 - DNA, 20 bp, Homo sapiens
ggtcactctgccctctgctg

SEQ ID NO: 1439736 - DNA, 23 bp, Homo sapiens
ggtcactgaaccactgcttctct

SEQ ID NO: 1439737 - DNA, 17 bp, Homo sapiens
ggtcactggctctccaa

SEQ ID NO: 1439738 - DNA, 13 bp, Homo sapiens
ggtcactgtcact

SEQ ID NO: 1439739 - DNA, 20 bp, Homo sapiens
ggtcagagagacctcatcct

SEQ ID NO: 1439740 - DNA, 19 bp, Homo sapiens
ggtcagagatgggctgaac

SEQ ID NO: 1439741 - DNA, 16 bp, Homo sapiens
ggtcagagtgccactg

SEQ ID NO: 1439742 - DNA, 18 bp, Homo sapiens
ggtcagattagttggctt

SEQ ID NO: 1439743 - DNA, 15 bp, Homo sapiens
ggtcagccattttta

SEQ ID NO: 1439744 - DNA, 19 bp, Homo sapiens
ggtcaggatgcacatttct

SEQ ID NO: 1439745 - DNA, 22 bp, Homo sapiens
ggtcaggatgcacatttctgga

SEQ ID NO: 1439746 - DNA, 20 bp, Homo sapiens
ggtcagggccagactggaag

SEQ ID NO: 1439747 - DNA, 15 bp, Homo sapiens
ggtcaggtgtcaggc

SEQ ID NO: 1439748 - DNA, 19 bp, Homo sapiens
ggtcaggtgttcaagacca

SEQ ID NO: 1439749 - DNA, 18 bp, Homo sapiens
ggtcagtctttgctcagt

SEQ ID NO: 1439750 - DNA, 17 bp, Homo sapiens
ggtcagtgcagcagagg

SEQ ID NO: 1439751 - DNA, 19 bp, Homo sapiens
ggtcagtgtggagaggggt

SEQ ID NO: 1439752 - DNA, 23 bp, Homo sapiens
ggtcatatacatattgtatatat

SEQ ID NO: 1439753 - DNA, 14 bp, Homo sapiens
ggtcatcatttgtc

SEQ ID NO: 1439754 - DNA, 17 bp, Homo sapiens
ggtcatcgattcaaact

SEQ ID NO: 1439755 - DNA, 22 bp, Homo sapiens
ggtcatcgattcaaactgctcc

SEQ ID NO: 1439756 - DNA, 21 bp, Homo sapiens
ggtcatctggcggaggtctct

SEQ ID NO: 1439757 - DNA, 23 bp, Homo sapiens
ggtcatcttggaaaggggaggag

SEQ ID NO: 1439758 - DNA, 18 bp, Homo sapiens
ggtcatgcagttcctggc

SEQ ID NO: 1439759 - DNA, 18 bp, Homo sapiens
ggtcatgctcagccttgc

SEQ ID NO: 1439760 - DNA, 22 bp, Homo sapiens
ggtcatgctcagccttgctgct

SEQ ID NO: 1439761 - DNA, 14 bp, Homo sapiens
ggtcatgtgtgcat

SEQ ID NO: 1439762 - DNA, 16 bp, Homo sapiens
ggtcatgtgtgcatgt

SEQ ID NO: 1439763 - DNA, 17 bp, Homo sapiens
ggtccaaaaaaaggaaa

SEQ ID NO: 1439764 - DNA, 18 bp, Homo sapiens
ggtccaaaaaaaggaaaa

SEQ ID NO: 1439765 - DNA, 14 bp, Homo sapiens
ggtccaagggccat

SEQ ID NO: 1439766 - DNA, 17 bp, Homo sapiens
ggtccaattagtttcct

SEQ ID NO: 1439767 - DNA, 18 bp, Homo sapiens
ggtccaattagtttcctt

SEQ ID NO: 1439768 - DNA, 13 bp, Homo sapiens
ggtccacagctgg

SEQ ID NO: 1439769 - DNA, 12 bp, Homo sapiens
ggtccacctgga

SEQ ID NO: 1439770 - DNA, 14 bp, Homo sapiens
ggtccagaagagaa

SEQ ID NO: 1439771 - DNA, 22 bp, Homo sapiens
ggtccagcctcgttggaagagg

SEQ ID NO: 1439772 - DNA, 21 bp, Homo sapiens
ggtccagctctgacatccctt

SEQ ID NO: 1439773 - DNA, 17 bp, Homo sapiens
ggtccagcttgctcttc

SEQ ID NO: 1439774 - DNA, 14 bp, Homo sapiens
ggtccaggaaggca

SEQ ID NO: 1439775 - DNA, 19 bp, Homo sapiens
ggtccaggaaggcagctgc

SEQ ID NO: 1439776 - DNA, 21 bp, Homo sapiens
ggtccaggaaggcagctgctc

SEQ ID NO: 1439777 - DNA, 22 bp, Homo sapiens
ggtccaggaaggcagctgctct

SEQ ID NO: 1439778 - DNA, 15 bp, Homo sapiens
ggtccaggagaagtg

SEQ ID NO: 1439779 - DNA, 21 bp, Homo sapiens
ggtccaggagaagtgctccct

SEQ ID NO: 1439780 - DNA, 18 bp, Homo sapiens
ggtccaggccctgtggca

SEQ ID NO: 1439781 - DNA, 16 bp, Homo sapiens
ggtccagggcctgaca

SEQ ID NO: 1439782 - DNA, 17 bp, Homo sapiens
ggtccagtcgggaggag

SEQ ID NO: 1439783 - DNA, 19 bp, Homo sapiens
ggtccatgtaaatactttc

SEQ ID NO: 1439784 - DNA, 20 bp, Homo sapiens
ggtcccaaacagctgcctct

SEQ ID NO: 1439785 - DNA, 14 bp, Homo sapiens
ggtcccagccaccc

SEQ ID NO: 1439786 - DNA, 14 bp, Homo sapiens
ggtcccaggcagag

SEQ ID NO: 1439787 - DNA, 15 bp, Homo sapiens
ggtcccagtgggagg

SEQ ID NO: 1439788 - DNA, 20 bp, Homo sapiens
ggtcccagtgggaggggcag

SEQ ID NO: 1439789 - DNA, 23 bp, Homo sapiens
ggtcccagtgggaggggcaggct

SEQ ID NO: 1439790 - DNA, 23 bp, Homo sapiens
ggtcccagttttgttgccccaga

SEQ ID NO: 1439791 - DNA, 17 bp, Homo sapiens
ggtcccatccaggcagt

SEQ ID NO: 1439792 - DNA, 14 bp, Homo sapiens
ggtcccccctgagt

SEQ ID NO: 1439793 - DNA, 21 bp, Homo sapiens
ggtcccccgactgcctgtctc

SEQ ID NO: 1439794 - DNA, 13 bp, Homo sapiens
ggtccccctcagc

SEQ ID NO: 1439795 - DNA, 18 bp, Homo sapiens
ggtcccctcctcagtgac

SEQ ID NO: 1439796 - DNA, 15 bp, Homo sapiens
ggtcccggccgcgcc

SEQ ID NO: 1439797 - DNA, 19 bp, Homo sapiens
ggtcccggccgcgccgccg

SEQ ID NO: 1439798 - DNA, 20 bp, Homo sapiens
ggtccctaattctcttcgct

SEQ ID NO: 1439799 - DNA, 20 bp, Homo sapiens
ggtccctcacccccatggcc

SEQ ID NO: 1439800 - DNA, 14 bp, Homo sapiens
ggtccctccacccc

SEQ ID NO: 1439801 - DNA, 20 bp, Homo sapiens
ggtccctccagaaccacccc

SEQ ID NO: 1439802 - DNA, 12 bp, Homo sapiens
ggtccctgccct

SEQ ID NO: 1439803 - DNA, 17 bp, Homo sapiens
ggtccctgccctcccct

SEQ ID NO: 1439804 - DNA, 18 bp, Homo sapiens
ggtccctgccctcccctg

SEQ ID NO: 1439805 - DNA, 13 bp, Homo sapiens
ggtccctgggagg

SEQ ID NO: 1439806 - DNA, 19 bp, Homo sapiens
ggtcccttgagacctcagc

SEQ ID NO: 1439807 - DNA, 16 bp, Homo sapiens
ggtccgcaccagctgc

SEQ ID NO: 1439808 - DNA, 18 bp, Homo sapiens
ggtccgcaccagctgctc

SEQ ID NO: 1439809 - DNA, 17 bp, Homo sapiens
ggtccggtgtccttttc

SEQ ID NO: 1439810 - DNA, 16 bp, Homo sapiens
ggtccggtgttctaag

SEQ ID NO: 1439811 - DNA, 20 bp, Homo sapiens
ggtccgtcttcacactgcgc

SEQ ID NO: 1439812 - DNA, 18 bp, Homo sapiens
ggtccgtgcccaggccct

SEQ ID NO: 1439813 - DNA, 19 bp, Homo sapiens
ggtccgtgcccaggccctt

SEQ ID NO: 1439814 - DNA, 22 bp, Homo sapiens
ggtcctcacttctgtctcctgt

SEQ ID NO: 1439815 - DNA, 21 bp, Homo sapiens
ggtcctccgcctactgtccct

SEQ ID NO: 1439816 - DNA, 22 bp, Homo sapiens
ggtcctcctatctccctggctc

SEQ ID NO: 1439817 - DNA, 12 bp, Homo sapiens
ggtcctcctgtg

SEQ ID NO: 1439818 - DNA, 14 bp, Homo sapiens
ggtcctcctgtgct

SEQ ID NO: 1439819 - DNA, 18 bp, Homo sapiens
ggtcctcgggatgccgtt

SEQ ID NO: 1439820 - DNA, 22 bp, Homo sapiens
ggtcctcgggatgccgttctgt

SEQ ID NO: 1439821 - DNA, 12 bp, Homo sapiens
ggtcctctcagt

SEQ ID NO: 1439822 - DNA, 14 bp, Homo sapiens
ggtcctctctctgt

SEQ ID NO: 1439823 - DNA, 22 bp, Homo sapiens
ggtcctctctctgtggggctga

SEQ ID NO: 1439824 - DNA, 11 bp, Homo sapiens
ggtcctctctg

SEQ ID NO: 1439825 - DNA, 12 bp, Homo sapiens
ggtcctctctga

SEQ ID NO: 1439826 - DNA, 20 bp, Homo sapiens
ggtcctctctgagtcaaatc

SEQ ID NO: 1439827 - DNA, 23 bp, Homo sapiens
ggtcctctctgagtcaaatccag

SEQ ID NO: 1439828 - DNA, 24 bp, Homo sapiens
ggtcctctctgagtcaaatccagt

SEQ ID NO: 1439829 - DNA, 13 bp, Homo sapiens
ggtcctctggagc

SEQ ID NO: 1439830 - DNA, 15 bp, Homo sapiens
ggtcctctggagccc

SEQ ID NO: 1439831 - DNA, 22 bp, Homo sapiens
ggtcctcttctgggcctgacca

SEQ ID NO: 1439832 - DNA, 16 bp, Homo sapiens
ggtcctgatgcccgtt

SEQ ID NO: 1439833 - DNA, 14 bp, Homo sapiens
ggtcctgcaggtcc

SEQ ID NO: 1439834 - DNA, 15 bp, Homo sapiens
ggtcctgcaggtcct

SEQ ID NO: 1439835 - DNA, 19 bp, Homo sapiens
ggtcctgctccgctgcctg

SEQ ID NO: 1439836 - DNA, 21 bp, Homo sapiens
ggtcctggagcagaccacccc

SEQ ID NO: 1439837 - DNA, 16 bp, Homo sapiens
ggtcctgggcaggtgg

SEQ ID NO: 1439838 - DNA, 12 bp, Homo sapiens
ggtcctggggcc

SEQ ID NO: 1439839 - DNA, 22 bp, Homo sapiens
ggtcctggggctctgtgcaggg

SEQ ID NO: 1439840 - DNA, 21 bp, Homo sapiens
ggtcctggtgggtcagcccag

SEQ ID NO: 1439841 - DNA, 15 bp, Homo sapiens
ggtcctgtgcctgga

SEQ ID NO: 1439842 - DNA, 16 bp, Homo sapiens
ggtccttccaggcccc

SEQ ID NO: 1439843 - DNA, 14 bp, Homo sapiens
ggtccttctccaca

SEQ ID NO: 1439844 - DNA, 18 bp, Homo sapiens
ggtccttgatgccagagg

SEQ ID NO: 1439845 - DNA, 23 bp, Homo sapiens
ggtccttgatgccagagggccag

SEQ ID NO: 1439846 - DNA, 21 bp, Homo sapiens
ggtcctttgggaaaggagaag

SEQ ID NO: 1439847 - DNA, 16 bp, Homo sapiens
ggtcgcagctaccctc

SEQ ID NO: 1439848 - DNA, 20 bp, Homo sapiens
ggtcgcagctaccctcagcc

SEQ ID NO: 1439849 - DNA, 24 bp, Homo sapiens
ggtcgcagctaccctcagcctcca

SEQ ID NO: 1439850 - DNA, 12 bp, Homo sapiens
ggtcgctcctgc

SEQ ID NO: 1439851 - DNA, 13 bp, Homo sapiens
ggtcgctcctgcc

SEQ ID NO: 1439852 - DNA, 14 bp, Homo sapiens
ggtcgctcctgccc

SEQ ID NO: 1439853 - DNA, 17 bp, Homo sapiens
ggtcggagtgcctggag

SEQ ID NO: 1439854 - DNA, 15 bp, Homo sapiens
ggtcggatctcacag

SEQ ID NO: 1439855 - DNA, 18 bp, Homo sapiens
ggtcgggcagtggaggct

SEQ ID NO: 1439856 - DNA, 13 bp, Homo sapiens
ggtctaatgtttg

SEQ ID NO: 1439857 - DNA, 15 bp, Homo sapiens
ggtctactctagaag

SEQ ID NO: 1439858 - DNA, 23 bp, Homo sapiens
ggtctatgtcgagagctggccaa

SEQ ID NO: 1439859 - DNA, 21 bp, Homo sapiens
ggtctcacagtgttgcccagg

SEQ ID NO: 1439860 - DNA, 22 bp, Homo sapiens
ggtctcactacttgaccattct

SEQ ID NO: 1439861 - DNA, 15 bp, Homo sapiens
ggtctcatctcttca

SEQ ID NO: 1439862 - DNA, 15 bp, Homo sapiens
ggtctccaggggcct

SEQ ID NO: 1439863 - DNA, 21 bp, Homo sapiens
ggtctccaggggcctgcagaa

SEQ ID NO: 1439864 - DNA, 20 bp, Homo sapiens
ggtctccccaattctcccct

SEQ ID NO: 1439865 - DNA, 14 bp, Homo sapiens
ggtctccctctcct

SEQ ID NO: 1439866 - DNA, 15 bp, Homo sapiens
ggtctccctctcctg

SEQ ID NO: 1439867 - DNA, 22 bp, Homo sapiens
ggtctccctctcctgcctactc

SEQ ID NO: 1439868 - DNA, 15 bp, Homo sapiens
ggtctccctggctcc

SEQ ID NO: 1439869 - DNA, 23 bp, Homo sapiens
ggtctccctggtggggtgtgcat

SEQ ID NO: 1439870 - DNA, 18 bp, Homo sapiens
ggtctcctcagggtgggg

SEQ ID NO: 1439871 - DNA, 23 bp, Homo sapiens
ggtctccttactctgagcccagg

SEQ ID NO: 1439872 - DNA, 19 bp, Homo sapiens
ggtctcgaactcctggcct

SEQ ID NO: 1439873 - DNA, 15 bp, Homo sapiens
ggtctcgcagcctga

SEQ ID NO: 1439874 - DNA, 23 bp, Homo sapiens
ggtctcgcagcctgaagcctgga

SEQ ID NO: 1439875 - DNA, 16 bp, Homo sapiens
ggtctctccactgctc

SEQ ID NO: 1439876 - DNA, 17 bp, Homo sapiens
ggtctctctccaggtca

SEQ ID NO: 1439877 - DNA, 12 bp, Homo sapiens
ggtctctgaagg

SEQ ID NO: 1439878 - DNA, 13 bp, Homo sapiens
ggtctctgcccca

SEQ ID NO: 1439879 - DNA, 16 bp, Homo sapiens
ggtctctgccccagcc

SEQ ID NO: 1439880 - DNA, 13 bp, Homo sapiens
ggtctctgctggg

SEQ ID NO: 1439881 - DNA, 20 bp, Homo sapiens
ggtctctgctggggaagggt

SEQ ID NO: 1439882 - DNA, 14 bp, Homo sapiens
ggtctctgggagcc

SEQ ID NO: 1439883 - DNA, 17 bp, Homo sapiens
ggtctctgggagcccag

SEQ ID NO: 1439884 - DNA, 18 bp, Homo sapiens
ggtctctgggagcccaga

SEQ ID NO: 1439885 - DNA, 22 bp, Homo sapiens
ggtctcttctgaataaagcaat

SEQ ID NO: 1439886 - DNA, 18 bp, Homo sapiens
ggtctcttcttctttctg

SEQ ID NO: 1439887 - DNA, 22 bp, Homo sapiens
ggtctcttcttctttctggttg

SEQ ID NO: 1439888 - DNA, 13 bp, Homo sapiens
ggtctgaaatgga

SEQ ID NO: 1439889 - DNA, 15 bp, Homo sapiens
ggtctgaaggactgg

SEQ ID NO: 1439890 - DNA, 13 bp, Homo sapiens
ggtctgagcatga

SEQ ID NO: 1439891 - DNA, 12 bp, Homo sapiens
ggtctgagccct

SEQ ID NO: 1439892 - DNA, 16 bp, Homo sapiens
ggtctgagccctggtg

SEQ ID NO: 1439893 - DNA, 17 bp, Homo sapiens
ggtctgattttctcact

SEQ ID NO: 1439894 - DNA, 18 bp, Homo sapiens
ggtctgcaagggcccaga

SEQ ID NO: 1439895 - DNA, 19 bp, Homo sapiens
ggtctgctctttctctgcc

SEQ ID NO: 1439896 - DNA, 15 bp, Homo sapiens
ggtctggtgctgagg

SEQ ID NO: 1439897 - DNA, 14 bp, Homo sapiens
ggtctgtagggatt

SEQ ID NO: 1439898 - DNA, 14 bp, Homo sapiens
ggtctgtcccacca

SEQ ID NO: 1439899 - DNA, 15 bp, Homo sapiens
ggtctgtcccaccag

SEQ ID NO: 1439900 - DNA, 15 bp, Homo sapiens
ggtctgtgactggat

SEQ ID NO: 1439901 - DNA, 16 bp, Homo sapiens
ggtctgtgactggatc

SEQ ID NO: 1439902 - DNA, 19 bp, Homo sapiens
ggtctgtgctgtgcctgct

SEQ ID NO: 1439903 - DNA, 20 bp, Homo sapiens
ggtctgtgctgtgcctgcta

SEQ ID NO: 1439904 - DNA, 22 bp, Homo sapiens
ggtctgtgtaacatccaagcca

SEQ ID NO: 1439905 - DNA, 15 bp, Homo sapiens
ggtctgttcttgaat

SEQ ID NO: 1439906 - DNA, 18 bp, Homo sapiens
ggtctgttggcaggctgg

SEQ ID NO: 1439907 - DNA, 17 bp, Homo sapiens
ggtcttagttctggttg

SEQ ID NO: 1439908 - DNA, 19 bp, Homo sapiens
ggtcttatctgttcagtgt

SEQ ID NO: 1439909 - DNA, 17 bp, Homo sapiens
ggtcttccctacctcag

SEQ ID NO: 1439910 - DNA, 20 bp, Homo sapiens
ggtcttccctacctcaggca

SEQ ID NO: 1439911 - DNA, 18 bp, Homo sapiens
ggtcttccttctacccca

SEQ ID NO: 1439912 - DNA, 16 bp, Homo sapiens
ggtcttcttggcagct

SEQ ID NO: 1439913 - DNA, 21 bp, Homo sapiens
ggtcttgaactcctggactca

SEQ ID NO: 1439914 - DNA, 13 bp, Homo sapiens
ggtcttgatctcc

SEQ ID NO: 1439915 - DNA, 16 bp, Homo sapiens
ggtcttgggctactgg

SEQ ID NO: 1439916 - DNA, 18 bp, Homo sapiens
ggtcttgggctactggca

SEQ ID NO: 1439917 - DNA, 20 bp, Homo sapiens
ggtcttgggctactggcagc

SEQ ID NO: 1439918 - DNA, 20 bp, Homo sapiens
ggtctttcagtactttttta

SEQ ID NO: 1439919 - DNA, 15 bp, Homo sapiens
ggtgaacactgtgac

SEQ ID NO: 1439920 - DNA, 21 bp, Homo sapiens
ggtgaactgagctgggcagga

SEQ ID NO: 1439921 - DNA, 15 bp, Homo sapiens
ggtgaactgcaaagc

SEQ ID NO: 1439922 - DNA, 22 bp, Homo sapiens
ggtgaagaggaggggaagaggc

SEQ ID NO: 1439923 - DNA, 18 bp, Homo sapiens
ggtgaatatggtggaaaa

SEQ ID NO: 1439924 - DNA, 23 bp, Homo sapiens
ggtgacaaaccatttccaacagc

SEQ ID NO: 1439925 - DNA, 13 bp, Homo sapiens
ggtgacaccagcc

SEQ ID NO: 1439926 - DNA, 15 bp, Homo sapiens
ggtgacacctccccc

SEQ ID NO: 1439927 - DNA, 15 bp, Homo sapiens
ggtgacagagtgagt

SEQ ID NO: 1439928 - DNA, 20 bp, Homo sapiens
ggtgacagctccgggatcag

SEQ ID NO: 1439929 - DNA, 14 bp, Homo sapiens
ggtgacctctagag

SEQ ID NO: 1439930 - DNA, 12 bp, Homo sapiens
ggtgacgcccag

SEQ ID NO: 1439931 - DNA, 14 bp, Homo sapiens
ggtgacgcccagct

SEQ ID NO: 1439932 - DNA, 17 bp, Homo sapiens
ggtgactggaagttgtg

SEQ ID NO: 1439933 - DNA, 16 bp, Homo sapiens
ggtgagaacccagaga

SEQ ID NO: 1439934 - DNA, 12 bp, Homo sapiens
ggtgagaactct

SEQ ID NO: 1439935 - DNA, 24 bp, Homo sapiens
ggtgagcaggcagggctgggccag

SEQ ID NO: 1439936 - DNA, 14 bp, Homo sapiens
ggtgagccaaggac

SEQ ID NO: 1439937 - DNA, 16 bp, Homo sapiens
ggtgagctgcacctga

SEQ ID NO: 1439938 - DNA, 18 bp, Homo sapiens
ggtgaggggcaggtctag

SEQ ID NO: 1439939 - DNA, 18 bp, Homo sapiens
ggtgagtcccctactccc

SEQ ID NO: 1439940 - DNA, 14 bp, Homo sapiens
ggtgataagggaaa

SEQ ID NO: 1439941 - DNA, 15 bp, Homo sapiens
ggtgataagggaaaa

SEQ ID NO: 1439942 - DNA, 15 bp, Homo sapiens
ggtgatcctgttctg

SEQ ID NO: 1439943 - DNA, 19 bp, Homo sapiens
ggtgatcctgttctgcgct

SEQ ID NO: 1439944 - DNA, 21 bp, Homo sapiens
ggtgatcctgttctgcgctgt

SEQ ID NO: 1439945 - DNA, 17 bp, Homo sapiens
ggtgatgggggcatggg

SEQ ID NO: 1439946 - DNA, 20 bp, Homo sapiens
ggtgattcctcccaggaggt

SEQ ID NO: 1439947 - DNA, 14 bp, Homo sapiens
ggtgattggctcct

SEQ ID NO: 1439948 - DNA, 13 bp, Homo sapiens
ggtgcaaggaaaa

SEQ ID NO: 1439949 - DNA, 16 bp, Homo sapiens
ggtgcacaggcctctg

SEQ ID NO: 1439950 - DNA, 20 bp, Homo sapiens
ggtgcacaggcctctgcctg

SEQ ID NO: 1439951 - DNA, 14 bp, Homo sapiens
ggtgcacccacctg

SEQ ID NO: 1439952 - DNA, 20 bp, Homo sapiens
ggtgcacccactcaccaggg

SEQ ID NO: 1439953 - DNA, 19 bp, Homo sapiens
ggtgcagagtgcccagaac

SEQ ID NO: 1439954 - DNA, 15 bp, Homo sapiens
ggtgcatctcctccc

SEQ ID NO: 1439955 - DNA, 22 bp, Homo sapiens
ggtgcattgctgtgtgaatcca

SEQ ID NO: 1439956 - DNA, 15 bp, Homo sapiens
ggtgcattgttattt

SEQ ID NO: 1439957 - DNA, 24 bp, Homo sapiens
ggtgcatttcccccgcagtgcata

SEQ ID NO: 1439958 - DNA, 18 bp, Homo sapiens
ggtgccaaatagccccag

SEQ ID NO: 1439959 - DNA, 12 bp, Homo sapiens
ggtgccaagggc

SEQ ID NO: 1439960 - DNA, 14 bp, Homo sapiens
ggtgccaccaccct

SEQ ID NO: 1439961 - DNA, 15 bp, Homo sapiens
ggtgccaccaccctg

SEQ ID NO: 1439962 - DNA, 15 bp, Homo sapiens
ggtgccactccctga

SEQ ID NO: 1439963 - DNA, 17 bp, Homo sapiens
ggtgccactccctgagc

SEQ ID NO: 1439964 - DNA, 23 bp, Homo sapiens
ggtgccacttcttaaaggcctgg

SEQ ID NO: 1439965 - DNA, 14 bp, Homo sapiens
ggtgccagagaggg

SEQ ID NO: 1439966 - DNA, 16 bp, Homo sapiens
ggtgccagggctgcag

SEQ ID NO: 1439967 - DNA, 15 bp, Homo sapiens
ggtgccagttatggc

SEQ ID NO: 1439968 - DNA, 16 bp, Homo sapiens
ggtgccatgcctgctc

SEQ ID NO: 1439969 - DNA, 18 bp, Homo sapiens
ggtgccatgtctgcagtg

SEQ ID NO: 1439970 - DNA, 16 bp, Homo sapiens
ggtgccatttctgaac

SEQ ID NO: 1439971 - DNA, 21 bp, Homo sapiens
ggtgcccaagccagaggctgg

SEQ ID NO: 1439972 - DNA, 15 bp, Homo sapiens
ggtgcccagggccag

SEQ ID NO: 1439973 - DNA, 20 bp, Homo sapiens
ggtgccccacctgcctggtg

SEQ ID NO: 1439974 - DNA, 13 bp, Homo sapiens
ggtgccccaggac

SEQ ID NO: 1439975 - DNA, 16 bp, Homo sapiens
ggtgccccaggaccag

SEQ ID NO: 1439976 - DNA, 21 bp, Homo sapiens
ggtgccccaggaccagctcag

SEQ ID NO: 1439977 - DNA, 22 bp, Homo sapiens
ggtgccccaggaccagctcagg

SEQ ID NO: 1439978 - DNA, 23 bp, Homo sapiens
ggtgccccaggaccagctcagga

SEQ ID NO: 1439979 - DNA, 13 bp, Homo sapiens
ggtgccctctcca

SEQ ID NO: 1439980 - DNA, 17 bp, Homo sapiens
ggtgccctttagccaga

SEQ ID NO: 1439981 - DNA, 22 bp, Homo sapiens
ggtgcctcagactccgccctcc

SEQ ID NO: 1439982 - DNA, 17 bp, Homo sapiens
ggtgcctcagttttcct

SEQ ID NO: 1439983 - DNA, 17 bp, Homo sapiens
ggtgcctccaggtgtgc

SEQ ID NO: 1439984 - DNA, 16 bp, Homo sapiens
ggtgcctctgtgcaca

SEQ ID NO: 1439985 - DNA, 23 bp, Homo sapiens
ggtgcctctgtgcacagtggctt

SEQ ID NO: 1439986 - DNA, 17 bp, Homo sapiens
ggtgcctgagaggcagg

SEQ ID NO: 1439987 - DNA, 18 bp, Homo sapiens
ggtgcctgagaggcaggc

SEQ ID NO: 1439988 - DNA, 10 bp, Homo sapiens
ggtgcctggc

SEQ ID NO: 1439989 - DNA, 22 bp, Homo sapiens
ggtgcctgggtggggctgctcc

SEQ ID NO: 1439990 - DNA, 13 bp, Homo sapiens
ggtgcctgtccca

SEQ ID NO: 1439991 - DNA, 17 bp, Homo sapiens
ggtgcctgtcccacccc

SEQ ID NO: 1439992 - DNA, 21 bp, Homo sapiens
ggtgcctgtccttgaaaaaca

SEQ ID NO: 1439993 - DNA, 18 bp, Homo sapiens
ggtgcctgtgaggcaggg

SEQ ID NO: 1439994 - DNA, 21 bp, Homo sapiens
ggtgcctgtgaggcaggggcg

SEQ ID NO: 1439995 - DNA, 20 bp, Homo sapiens
ggtgccttacatcttttcta

SEQ ID NO: 1439996 - DNA, 13 bp, Homo sapiens
ggtgcgggcctgg

SEQ ID NO: 1439997 - DNA, 21 bp, Homo sapiens
ggtgcgggcctggccctcact

SEQ ID NO: 1439998 - DNA, 14 bp, Homo sapiens
ggtgcgtctccagt

SEQ ID NO: 1439999 - DNA, 20 bp, Homo sapiens
ggtgcgtgttcagcagaacc

SEQ ID NO: 1440000 - DNA, 21 bp, Homo sapiens
ggtgcgtgttcagcagaacct

SEQ ID NO: 1440001 - DNA, 22 bp, Homo sapiens
ggtgctcaagggttctttcctc

SEQ ID NO: 1440002 - DNA, 13 bp, Homo sapiens
ggtgctctctctg

SEQ ID NO: 1440003 - DNA, 16 bp, Homo sapiens
ggtgctctctctgagg

SEQ ID NO: 1440004 - DNA, 10 bp, Homo sapiens
ggtgctctgg

SEQ ID NO: 1440005 - DNA, 19 bp, Homo sapiens
ggtgctctggcggcttcct

SEQ ID NO: 1440006 - DNA, 20 bp, Homo sapiens
ggtgctctggcggcttcctg

SEQ ID NO: 1440007 - DNA, 20 bp, Homo sapiens
ggtgctgacggccagggaga

SEQ ID NO: 1440008 - DNA, 16 bp, Homo sapiens
ggtgctgactgaggcc

SEQ ID NO: 1440009 - DNA, 16 bp, Homo sapiens
ggtgctgagcttagcc

SEQ ID NO: 1440010 - DNA, 12 bp, Homo sapiens
ggtgctgcagga

SEQ ID NO: 1440011 - DNA, 22 bp, Homo sapiens
ggtgctgctaattctttgcaaa

SEQ ID NO: 1440012 - DNA, 14 bp, Homo sapiens
ggtgctgctctctc

SEQ ID NO: 1440013 - DNA, 21 bp, Homo sapiens
ggtgctggaagtctccatgaa

SEQ ID NO: 1440014 - DNA, 12 bp, Homo sapiens
ggtgctgggact

SEQ ID NO: 1440015 - DNA, 19 bp, Homo sapiens
ggtgctgggactgagccag

SEQ ID NO: 1440016 - DNA, 11 bp, Homo sapiens
ggtgctgtcca

SEQ ID NO: 1440017 - DNA, 17 bp, Homo sapiens
ggtgctgtgagggaggg

SEQ ID NO: 1440018 - DNA, 14 bp, Homo sapiens
ggtgctgtgtgccc

SEQ ID NO: 1440019 - DNA, 15 bp, Homo sapiens
ggtgctgtgtgcccc

SEQ ID NO: 1440020 - DNA, 22 bp, Homo sapiens
ggtgctgtgtgccccactccag

SEQ ID NO: 1440021 - DNA, 19 bp, Homo sapiens
ggtgcttccaacaaggaca

SEQ ID NO: 1440022 - DNA, 13 bp, Homo sapiens
ggtgcttccccca

SEQ ID NO: 1440023 - DNA, 17 bp, Homo sapiens
ggtggaaaacagggtgc

SEQ ID NO: 1440024 - DNA, 18 bp, Homo sapiens
ggtggaaataatttgaat

SEQ ID NO: 1440025 - DNA, 19 bp, Homo sapiens
ggtggaagaagggagaaga

SEQ ID NO: 1440026 - DNA, 20 bp, Homo sapiens
ggtggaagccctccttccac

SEQ ID NO: 1440027 - DNA, 13 bp, Homo sapiens
ggtggacacacaa

SEQ ID NO: 1440028 - DNA, 14 bp, Homo sapiens
ggtggacagtcctg

SEQ ID NO: 1440029 - DNA, 18 bp, Homo sapiens
ggtggacagtcctgggag

SEQ ID NO: 1440030 - DNA, 20 bp, Homo sapiens
ggtggacctggcagtggtgg

SEQ ID NO: 1440031 - DNA, 20 bp, Homo sapiens
ggtggacttcagtgtgtgta

SEQ ID NO: 1440032 - DNA, 13 bp, Homo sapiens
ggtggagaaggga

SEQ ID NO: 1440033 - DNA, 19 bp, Homo sapiens
ggtggagcagccagagctg

SEQ ID NO: 1440034 - DNA, 14 bp, Homo sapiens
ggtggagccagggc

SEQ ID NO: 1440035 - DNA, 13 bp, Homo sapiens
ggtggagggcaca

SEQ ID NO: 1440036 - DNA, 20 bp, Homo sapiens
ggtggaggttgcagtgagcc

SEQ ID NO: 1440037 - DNA, 22 bp, Homo sapiens
ggtggagtgaggttagttctgt

SEQ ID NO: 1440038 - DNA, 23 bp, Homo sapiens
ggtggatcacacctcagtgggaa

SEQ ID NO: 1440039 - DNA, 15 bp, Homo sapiens
ggtggatcacagagg

SEQ ID NO: 1440040 - DNA, 17 bp, Homo sapiens
ggtggatcacagaggct

SEQ ID NO: 1440041 - DNA, 18 bp, Homo sapiens
ggtggatctaagaagggc

SEQ ID NO: 1440042 - DNA, 15 bp, Homo sapiens
ggtgtgcgtgcgtgt

SEQ ID NO: 1440043 - DNA, 19 bp, Homo sapiens
ggtgtggccctgccatctt

SEQ ID NO: 1440044 - DNA, 15 bp, Homo sapiens
ggtgtgggacacctg

SEQ ID NO: 1440045 - DNA, 14 bp, Homo sapiens
ggtgtggggggctg

SEQ ID NO: 1440046 - DNA, 19 bp, Homo sapiens
ggtgtgggtgtcctgcctg

SEQ ID NO: 1440047 - DNA, 22 bp, Homo sapiens
ggtgtgggtgtcctgcctgtct

SEQ ID NO: 1440048 - DNA, 21 bp, Homo sapiens
ggtgtgtccctggacacagct

SEQ ID NO: 1440049 - DNA, 22 bp, Homo sapiens
ggtgtgtggccgcctggcaggt

SEQ ID NO: 1440050 - DNA, 14 bp, Homo sapiens
ggtgtgtgttcacc

SEQ ID NO: 1440051 - DNA, 22 bp, Homo sapiens
ggtgttatttggaaccttgttt

SEQ ID NO: 1440052 - DNA, 18 bp, Homo sapiens
ggtgttcctaccaggact

SEQ ID NO: 1440053 - DNA, 13 bp, Homo sapiens
ggtgttcctgaag

SEQ ID NO: 1440054 - DNA, 16 bp, Homo sapiens
ggtgttcctggaagca

SEQ ID NO: 1440055 - DNA, 19 bp, Homo sapiens
gtaatccaggcacagctga

SEQ ID NO: 1440056 - DNA, 16 bp, Homo sapiens
gtaatcccagcacttt

SEQ ID NO: 1440057 - DNA, 15 bp, Homo sapiens
gtaatcccagctact

SEQ ID NO: 1440058 - DNA, 18 bp, Homo sapiens
gtaatcccagctactcag

SEQ ID NO: 1440059 - DNA, 18 bp, Homo sapiens
gtaatccctgctttttgt

SEQ ID NO: 1440060 - DNA, 11 bp, Homo sapiens
gtaatctacac

SEQ ID NO: 1440061 - DNA, 22 bp, Homo sapiens
gtaatctacaccaatgaaaaca

SEQ ID NO: 1440062 - DNA, 22 bp, Homo sapiens
gtaatctattcctgtaaataag

SEQ ID NO: 1440063 - DNA, 14 bp, Homo sapiens
gtaatctctctgca

SEQ ID NO: 1440064 - DNA, 19 bp, Homo sapiens
gtaatctctctgcagctgc

SEQ ID NO: 1440065 - DNA, 14 bp, Homo sapiens
gtaatctctgatta

SEQ ID NO: 1440066 - DNA, 16 bp, Homo sapiens
gtaatctttaaactgg

SEQ ID NO: 1440067 - DNA, 18 bp, Homo sapiens
gtaatgaggaaaaaatgg

SEQ ID NO: 1440068 - DNA, 14 bp, Homo sapiens
gtaatgatactgtg

SEQ ID NO: 1440069 - DNA, 15 bp, Homo sapiens
gtaatgatttcttga

SEQ ID NO: 1440070 - DNA, 16 bp, Homo sapiens
gtaatgggcctgccca

SEQ ID NO: 1440071 - DNA, 23 bp, Homo sapiens
gtaatggtactgactttgcttgc

SEQ ID NO: 1440072 - DNA, 15 bp, Homo sapiens
gtaatggtgtagaac

SEQ ID NO: 1440073 - DNA, 18 bp, Homo sapiens
gtaatgtaaataaactat

SEQ ID NO: 1440074 - DNA, 19 bp, Homo sapiens
gtaatgtcaccaccttccc

SEQ ID NO: 1440075 - DNA, 20 bp, Homo sapiens
gtaatgtcaccaccttccca

SEQ ID NO: 1440076 - DNA, 15 bp, Homo sapiens
gtaatgttgtgaata

SEQ ID NO: 1440077 - DNA, 17 bp, Homo sapiens
gtaatgttgtgaataat

SEQ ID NO: 1440078 - DNA, 18 bp, Homo sapiens
gtaattaaaagcaaatca

SEQ ID NO: 1440079 - DNA, 17 bp, Homo sapiens
gtaattaagtactatgt

SEQ ID NO: 1440080 - DNA, 20 bp, Homo sapiens
gtaattaagtactatgtatc

SEQ ID NO: 1440081 - DNA, 21 bp, Homo sapiens
gtaattagtgccacttaatgt

SEQ ID NO: 1440082 - DNA, 15 bp, Homo sapiens
gtaattatttgaatg

SEQ ID NO: 1440083 - DNA, 17 bp, Homo sapiens
gtaattattttggtact

SEQ ID NO: 1440084 - DNA, 14 bp, Homo sapiens
gtaattctaaatga

SEQ ID NO: 1440085 - DNA, 15 bp, Homo sapiens
gtaattctaaatgaa

SEQ ID NO: 1440086 - DNA, 18 bp, Homo sapiens
gtaattctaaatgaatgt

SEQ ID NO: 1440087 - DNA, 21 bp, Homo sapiens
gtaattctgaaccagaattac

SEQ ID NO: 1440088 - DNA, 17 bp, Homo sapiens
gtaattgcatttctgct

SEQ ID NO: 1440089 - DNA, 15 bp, Homo sapiens
gtaattgcttacatt

SEQ ID NO: 1440090 - DNA, 17 bp, Homo sapiens
gtaattgcttacatttt

SEQ ID NO: 1440091 - DNA, 13 bp, Homo sapiens
gtaattggaatct

SEQ ID NO: 1440092 - DNA, 13 bp, Homo sapiens
gtaattgtacaat

SEQ ID NO: 1440093 - DNA, 17 bp, Homo sapiens
gtaattgtacaataaat

SEQ ID NO: 1440094 - DNA, 9 bp, Homo sapiens
gtaattgtg

SEQ ID NO: 1440095 - DNA, 13 bp, Homo sapiens
gtaattgtgaaaa

SEQ ID NO: 1440096 - DNA, 17 bp, Homo sapiens
gtaattgtgtaaaaaat

SEQ ID NO: 1440097 - DNA, 21 bp, Homo sapiens
gtaattgttgctaatcttctt

SEQ ID NO: 1440098 - DNA, 10 bp, Homo sapiens
gtaatttaaa

SEQ ID NO: 1440099 - DNA, 21 bp, Homo sapiens
gtaatttaaaataattatata

SEQ ID NO: 1440100 - DNA, 19 bp, Homo sapiens
gtaatttaaacaggcccag

SEQ ID NO: 1440101 - DNA, 20 bp, Homo sapiens
gtaatttaaacaggcccagc

SEQ ID NO: 1440102 - DNA, 21 bp, Homo sapiens
gtaatttaaacaggcccagca

SEQ ID NO: 1440103 - DNA, 21 bp, Homo sapiens
gtaatttaagtgacacagaca

SEQ ID NO: 1440104 - DNA, 12 bp, Homo sapiens
gtaatttatgca

SEQ ID NO: 1440105 - DNA, 13 bp, Homo sapiens
gtaatttattgtc

SEQ ID NO: 1440106 - DNA, 21 bp, Homo sapiens
gtaatttattgtctgtctaca

SEQ ID NO: 1440107 - DNA, 14 bp, Homo sapiens
gtaatttcatttaa

SEQ ID NO: 1440108 - DNA, 21 bp, Homo sapiens
gtaatttctttttttcctttt

SEQ ID NO: 1440109 - DNA, 13 bp, Homo sapiens
gtaatttgaagat

SEQ ID NO: 1440110 - DNA, 23 bp, Homo sapiens
gtaatttgagagaaatatgaaga

SEQ ID NO: 1440111 - DNA, 22 bp, Homo sapiens
gtaatttgtttcccctagctta

SEQ ID NO: 1440112 - DNA, 22 bp, Homo sapiens
gtaattttaaaagtctatttta

SEQ ID NO: 1440113 - DNA, 23 bp, Homo sapiens
gtaattttatttgttctttttct

SEQ ID NO: 1440114 - DNA, 20 bp, Homo sapiens
gtaattttattttaaaattt

SEQ ID NO: 1440115 - DNA, 12 bp, Homo sapiens
gtaatttttgta

SEQ ID NO: 1440116 - DNA, 22 bp, Homo sapiens
gtaattttttttgttttttgta

SEQ ID NO: 1440117 - DNA, 19 bp, Homo sapiens
gtacaaaaaaaaagtttta

SEQ ID NO: 1440118 - DNA, 20 bp, Homo sapiens
gtacaaaatccagctatgaa

SEQ ID NO: 1440119 - DNA, 17 bp, Homo sapiens
gtacaaacccaaaaaag

SEQ ID NO: 1440120 - DNA, 12 bp, Homo sapiens
gtacaaataaac

SEQ ID NO: 1440121 - DNA, 23 bp, Homo sapiens
gtacaacggaggcctgcgaccct

SEQ ID NO: 1440122 - DNA, 15 bp, Homo sapiens
gtacaactgtattta

SEQ ID NO: 1440123 - DNA, 14 bp, Homo sapiens
gtacaagagatggg

SEQ ID NO: 1440124 - DNA, 18 bp, Homo sapiens
gtacaaggtaattgtttt

SEQ ID NO: 1440125 - DNA, 23 bp, Homo sapiens
gtacaagtggtaatttttgtaca

SEQ ID NO: 1440126 - DNA, 21 bp, Homo sapiens
gtacaagttttgtataaataa

SEQ ID NO: 1440127 - DNA, 10 bp, Homo sapiens
gtacaataaa

SEQ ID NO: 1440128 - DNA, 17 bp, Homo sapiens
gtacaataatgtactca

SEQ ID NO: 1440129 - DNA, 18 bp, Homo sapiens
gtacaataatgtactcac

SEQ ID NO: 1440130 - DNA, 17 bp, Homo sapiens
gtacaatacaatgtaca

SEQ ID NO: 1440131 - DNA, 18 bp, Homo sapiens
gtacaatacaatgtacaa

SEQ ID NO: 1440132 - DNA, 19 bp, Homo sapiens
gtacaatacaatgtacaat

SEQ ID NO: 1440133 - DNA, 15 bp, Homo sapiens
gtacaatctggctca

SEQ ID NO: 1440134 - DNA, 20 bp, Homo sapiens
gtacaatgaactgcttttcc

SEQ ID NO: 1440135 - DNA, 14 bp, Homo sapiens
gtactcattaaaaa

SEQ ID NO: 1440136 - DNA, 11 bp, Homo sapiens
gtactccagcc

SEQ ID NO: 1440137 - DNA, 13 bp, Homo sapiens
gtactccagcctg

SEQ ID NO: 1440138 - DNA, 14 bp, Homo sapiens
gtactccagcctgg

SEQ ID NO: 1440139 - DNA, 17 bp, Homo sapiens
gtactccagcctgggca

SEQ ID NO: 1440140 - DNA, 15 bp, Homo sapiens
gtactccctctcagg

SEQ ID NO: 1440141 - DNA, 21 bp, Homo sapiens
gtactcctgcaaaattttata

SEQ ID NO: 1440142 - DNA, 21 bp, Homo sapiens
gtactctctgctctagccagg

SEQ ID NO: 1440143 - DNA, 21 bp, Homo sapiens
gtactctgttgagtaaaacac

SEQ ID NO: 1440144 - DNA, 21 bp, Homo sapiens
gtactcttccgatgtttgtgt

SEQ ID NO: 1440145 - DNA, 15 bp, Homo sapiens
gtactctttatttct

SEQ ID NO: 1440146 - DNA, 23 bp, Homo sapiens
gtactctttatttctagcagagt

SEQ ID NO: 1440147 - DNA, 12 bp, Homo sapiens
gtactgaatttt

SEQ ID NO: 1440148 - DNA, 23 bp, Homo sapiens
gtactgacccaggaccatcctgg

SEQ ID NO: 1440149 - DNA, 20 bp, Homo sapiens
gtactgactttctgattact

SEQ ID NO: 1440150 - DNA, 17 bp, Homo sapiens
gtactgactttgcttgc

SEQ ID NO: 1440151 - DNA, 18 bp, Homo sapiens
gtactgactttgcttgct

SEQ ID NO: 1440152 - DNA, 12 bp, Homo sapiens
gtactgcatgtg

SEQ ID NO: 1440153 - DNA, 20 bp, Homo sapiens
gtactgcattctctcccatc

SEQ ID NO: 1440154 - DNA, 19 bp, Homo sapiens
gtactgccccccatgagga

SEQ ID NO: 1440155 - DNA, 14 bp, Homo sapiens
gtactgggacattg

SEQ ID NO: 1440156 - DNA, 23 bp, Homo sapiens
gtactgtgtacagaattctgcta

SEQ ID NO: 1440157 - DNA, 20 bp, Homo sapiens
gtactgttcccaactcagct

SEQ ID NO: 1440158 - DNA, 15 bp, Homo sapiens
gtactgttctgtgtc

SEQ ID NO: 1440159 - DNA, 18 bp, Homo sapiens
gtactgttctgtgtcttt

SEQ ID NO: 1440160 - DNA, 16 bp, Homo sapiens
gtactgttgctttaat

SEQ ID NO: 1440161 - DNA, 20 bp, Homo sapiens
gtactgttgctttaatatga

SEQ ID NO: 1440162 - DNA, 18 bp, Homo sapiens
gtactgttttctgggcca

SEQ ID NO: 1440163 - DNA, 19 bp, Homo sapiens
gtacttaaatgaaagcatg

SEQ ID NO: 1440164 - DNA, 22 bp, Homo sapiens
gtacttagccagttcaaagtgt

SEQ ID NO: 1440165 - DNA, 15 bp, Homo sapiens
gtacttattactgct

SEQ ID NO: 1440166 - DNA, 12 bp, Homo sapiens
gtacttccagat

SEQ ID NO: 1440167 - DNA, 13 bp, Homo sapiens
gtacttccagatg

SEQ ID NO: 1440168 - DNA, 13 bp, Homo sapiens
gtacttcccgggc

SEQ ID NO: 1440169 - DNA, 20 bp, Homo sapiens
gtacttcccgggccagggct

SEQ ID NO: 1440170 - DNA, 21 bp, Homo sapiens
gtacttcccgggccagggctg

SEQ ID NO: 1440171 - DNA, 20 bp, Homo sapiens
gtacttcctcctgatggcca

SEQ ID NO: 1440172 - DNA, 21 bp, Homo sapiens
gtacttcctcctgatggccaa

SEQ ID NO: 1440173 - DNA, 13 bp, Homo sapiens
gtacttcctgtgt

SEQ ID NO: 1440174 - DNA, 12 bp, Homo sapiens
gtacttctgtgt

SEQ ID NO: 1440175 - DNA, 23 bp, Homo sapiens
gtacttgaaaaatgtttttattt

SEQ ID NO: 1440176 - DNA, 23 bp, Homo sapiens
gtacttgaagtctaaaagcagaa

SEQ ID NO: 1440177 - DNA, 20 bp, Homo sapiens
gtacttgtgaaacacagctg

SEQ ID NO: 1440178 - DNA, 16 bp, Homo sapiens
ggaggttgaagccaag

SEQ ID NO: 1440179 - DNA, 21 bp, Homo sapiens
ggaggttgattttcatgattc

SEQ ID NO: 1440180 - DNA, 17 bp, Homo sapiens
ggaggttgcagggagcc

SEQ ID NO: 1440181 - DNA, 14 bp, Homo sapiens
ggaggttggtgact

SEQ ID NO: 1440182 - DNA, 13 bp, Homo sapiens
ggaggttgtggat

SEQ ID NO: 1440183 - DNA, 16 bp, Homo sapiens
ggagtaagacaagtgg

SEQ ID NO: 1440184 - DNA, 15 bp, Homo sapiens
ggagtacaaaacaat

SEQ ID NO: 1440185 - DNA, 17 bp, Homo sapiens
ggagtaccatgtggcaa

SEQ ID NO: 1440186 - DNA, 13 bp, Homo sapiens
ggagtacctgctg

SEQ ID NO: 1440187 - DNA, 13 bp, Homo sapiens
ggagtagccaagc

SEQ ID NO: 1440188 - DNA, 13 bp, Homo sapiens
ggagtagctagtt

SEQ ID NO: 1440189 - DNA, 18 bp, Homo sapiens
ggagtatttgaacacagt

SEQ ID NO: 1440190 - DNA, 13 bp, Homo sapiens
ggagtcacacagt

SEQ ID NO: 1440191 - DNA, 19 bp, Homo sapiens
ggagtcacatcagtgagga

SEQ ID NO: 1440192 - DNA, 23 bp, Homo sapiens
ggagtcacatcagtgaggaggga

SEQ ID NO: 1440193 - DNA, 19 bp, Homo sapiens
ggagtcagccaggagctgt

SEQ ID NO: 1440194 - DNA, 21 bp, Homo sapiens
ggagtcagtaggtccaagggc

SEQ ID NO: 1440195 - DNA, 15 bp, Homo sapiens
ggagtccagctctac

SEQ ID NO: 1440196 - DNA, 16 bp, Homo sapiens
ggagtcccaaggaaag

SEQ ID NO: 1440197 - DNA, 16 bp, Homo sapiens
ggagtcccaggggcag

SEQ ID NO: 1440198 - DNA, 17 bp, Homo sapiens
ggagtcccaggggcagc

SEQ ID NO: 1440199 - DNA, 21 bp, Homo sapiens
ggagtcccaggggcagccaca

SEQ ID NO: 1440200 - DNA, 22 bp, Homo sapiens
ggagtcccaggggcagccacac

SEQ ID NO: 1440201 - DNA, 21 bp, Homo sapiens
ggagtcccctccccggcccta

SEQ ID NO: 1440202 - DNA, 14 bp, Homo sapiens
ggagtctgagtctg

SEQ ID NO: 1440203 - DNA, 16 bp, Homo sapiens
ggagtctgtgctcttt

SEQ ID NO: 1440204 - DNA, 18 bp, Homo sapiens
ggagtcttcagacccaga

SEQ ID NO: 1440205 - DNA, 20 bp, Homo sapiens
ggagtgaagaggggcagccc

SEQ ID NO: 1440206 - DNA, 23 bp, Homo sapiens
ggagtgaagaggggcagcccttg

SEQ ID NO: 1440207 - DNA, 23 bp, Homo sapiens
ggagtgaggaatagttgagcccc

SEQ ID NO: 1440208 - DNA, 20 bp, Homo sapiens
ggagtgaggcttccaggctc

SEQ ID NO: 1440209 - DNA, 22 bp, Homo sapiens
ggagtgaggcttccaggctctt

SEQ ID NO: 1440210 - DNA, 16 bp, Homo sapiens
ggagtgccaggaccag

SEQ ID NO: 1440211 - DNA, 17 bp, Homo sapiens
ggagtgccaggaccagc

SEQ ID NO: 1440212 - DNA, 11 bp, Homo sapiens
ggagtggccaa

SEQ ID NO: 1440213 - DNA, 20 bp, Homo sapiens
ggagtgtatgactgcacatg

SEQ ID NO: 1440214 - DNA, 24 bp, Homo sapiens
ggagtgtcctcttccctctctgca

SEQ ID NO: 1440215 - DNA, 15 bp, Homo sapiens
ggagtgtcctgccca

SEQ ID NO: 1440216 - DNA, 14 bp, Homo sapiens
ggagtgtgcagaca

SEQ ID NO: 1440217 - DNA, 11 bp, Homo sapiens
ggagtgtgtaa

SEQ ID NO: 1440218 - DNA, 15 bp, Homo sapiens
ggagttaagacctgg

SEQ ID NO: 1440219 - DNA, 22 bp, Homo sapiens
ggagttacattaatgttaattc

SEQ ID NO: 1440220 - DNA, 16 bp, Homo sapiens
ggagttagaggccagc

SEQ ID NO: 1440221 - DNA, 21 bp, Homo sapiens
ggagttcaccttggaagggcg

SEQ ID NO: 1440222 - DNA, 22 bp, Homo sapiens
ggagttccttatccctctcttc

SEQ ID NO: 1440223 - DNA, 18 bp, Homo sapiens
ggagttcgagaccagcct

SEQ ID NO: 1440224 - DNA, 19 bp, Homo sapiens
ggagttgagtacagtgagg

SEQ ID NO: 1440225 - DNA, 17 bp, Homo sapiens
ggagttgatctggaacc

SEQ ID NO: 1440226 - DNA, 20 bp, Homo sapiens
ggagttgcttaaaatagact

SEQ ID NO: 1440227 - DNA, 18 bp, Homo sapiens
ggagttggagtagaatgt

SEQ ID NO: 1440228 - DNA, 17 bp, Homo sapiens
ggagttggtctgagtga

SEQ ID NO: 1440229 - DNA, 22 bp, Homo sapiens
ggagttggtgaatcggttgttc

SEQ ID NO: 1440230 - DNA, 19 bp, Homo sapiens
ggagtttaagaccagcctg

SEQ ID NO: 1440231 - DNA, 19 bp, Homo sapiens
ggagtttattacaatgtat

SEQ ID NO: 1440232 - DNA, 17 bp, Homo sapiens
ggagtttgagacaagcc

SEQ ID NO: 1440233 - DNA, 15 bp, Homo sapiens
ggagtttgaggctgc

SEQ ID NO: 1440234 - DNA, 20 bp, Homo sapiens
ggagtttgaggctgcagcga

SEQ ID NO: 1440235 - DNA, 20 bp, Homo sapiens
ggagttttgtctgtctccct

SEQ ID NO: 1440236 - DNA, 15 bp, Homo sapiens
ggataaactgagcct

SEQ ID NO: 1440237 - DNA, 18 bp, Homo sapiens
ggataaatcataaagtca

SEQ ID NO: 1440238 - DNA, 12 bp, Homo sapiens
ggataagaaagc

SEQ ID NO: 1440239 - DNA, 21 bp, Homo sapiens
ggatacgcatcagacagatgg

SEQ ID NO: 1440240 - DNA, 18 bp, Homo sapiens
ggatactggcacagaggt

SEQ ID NO: 1440241 - DNA, 23 bp, Homo sapiens
ggatacttagtggtatgtctctt

SEQ ID NO: 1440242 - DNA, 13 bp, Homo sapiens
ggatagatgctgg

SEQ ID NO: 1440243 - DNA, 14 bp, Homo sapiens
ggatagatgtgtgg

SEQ ID NO: 1440244 - DNA, 16 bp, Homo sapiens
ggatagtatgagccct

SEQ ID NO: 1440245 - DNA, 15 bp, Homo sapiens
ggatagtgttctgct

SEQ ID NO: 1440246 - DNA, 16 bp, Homo sapiens
ggatagtgttctgctc

SEQ ID NO: 1440247 - DNA, 18 bp, Homo sapiens
ggatagtgttctgctcct

SEQ ID NO: 1440248 - DNA, 12 bp, Homo sapiens
ggatataaaatg

SEQ ID NO: 1440249 - DNA, 12 bp, Homo sapiens
ggatatatttga

SEQ ID NO: 1440250 - DNA, 13 bp, Homo sapiens
ggatatcagggta

SEQ ID NO: 1440251 - DNA, 16 bp, Homo sapiens
ggatatctgaaaatat

SEQ ID NO: 1440252 - DNA, 20 bp, Homo sapiens
ggatatgctgaacgcagaag

SEQ ID NO: 1440253 - DNA, 13 bp, Homo sapiens
ggatatgctgctt

SEQ ID NO: 1440254 - DNA, 17 bp, Homo sapiens
ggatatggctgcccagg

SEQ ID NO: 1440255 - DNA, 20 bp, Homo sapiens
ggatatggctgcccaggaga

SEQ ID NO: 1440256 - DNA, 13 bp, Homo sapiens
ggatattaaaaca

SEQ ID NO: 1440257 - DNA, 16 bp, Homo sapiens
ggatattatagaaaat

SEQ ID NO: 1440258 - DNA, 17 bp, Homo sapiens
ggatattatagaaaatt

SEQ ID NO: 1440259 - DNA, 11 bp, Homo sapiens
ggatatttaag

SEQ ID NO: 1440260 - DNA, 12 bp, Homo sapiens
ggatatttaagg

SEQ ID NO: 1440261 - DNA, 17 bp, Homo sapiens
ggatatttactgctctt

SEQ ID NO: 1440262 - DNA, 23 bp, Homo sapiens
ggatatttactgctctttattgc

SEQ ID NO: 1440263 - DNA, 14 bp, Homo sapiens
ggatatttcaatct

SEQ ID NO: 1440264 - DNA, 12 bp, Homo sapiens
ggatatttccta

SEQ ID NO: 1440265 - DNA, 19 bp, Homo sapiens
ggatcaattttcattaaac

SEQ ID NO: 1440266 - DNA, 22 bp, Homo sapiens
ggatcaattttcattaaacttg

SEQ ID NO: 1440267 - DNA, 14 bp, Homo sapiens
ggatcacaagatgg

SEQ ID NO: 1440268 - DNA, 18 bp, Homo sapiens
ggatcacacctcagtggg

SEQ ID NO: 1440269 - DNA, 16 bp, Homo sapiens
ggatcactctctgctg

SEQ ID NO: 1440270 - DNA, 19 bp, Homo sapiens
ggatcagccctcattttgt

SEQ ID NO: 1440271 - DNA, 21 bp, Homo sapiens
ggatccaattgatgtatatgt

SEQ ID NO: 1440272 - DNA, 21 bp, Homo sapiens
ggatccagccacttccccctc

SEQ ID NO: 1440273 - DNA, 15 bp, Homo sapiens
ggatccatgggggga

SEQ ID NO: 1440274 - DNA, 13 bp, Homo sapiens
ggatcccaaagca

SEQ ID NO: 1440275 - DNA, 21 bp, Homo sapiens
ggatcccaagcctcctgctgc

SEQ ID NO: 1440276 - DNA, 16 bp, Homo sapiens
ggatccccgcctggcc

SEQ ID NO: 1440277 - DNA, 19 bp, Homo sapiens
ggatccccgcctggccagg

SEQ ID NO: 1440278 - DNA, 20 bp, Homo sapiens
ggcaaagggagcagaactga

SEQ ID NO: 1440279 - DNA, 18 bp, Homo sapiens
ggcaaagttttacagaga

SEQ ID NO: 1440280 - DNA, 19 bp, Homo sapiens
ggcaaataatggaaaaata

SEQ ID NO: 1440281 - DNA, 11 bp, Homo sapiens
ggcaaatagcc

SEQ ID NO: 1440282 - DNA, 16 bp, Homo sapiens
ggcaaatattgaagtt

SEQ ID NO: 1440283 - DNA, 13 bp, Homo sapiens
ggcaaatggctga

SEQ ID NO: 1440284 - DNA, 15 bp, Homo sapiens
ggcaaatggctgaga

SEQ ID NO: 1440285 - DNA, 20 bp, Homo sapiens
ggcaacacagcgagactccg

SEQ ID NO: 1440286 - DNA, 12 bp, Homo sapiens
ggcaacagagca

SEQ ID NO: 1440287 - DNA, 19 bp, Homo sapiens
ggcaacagagcaagatcct

SEQ ID NO: 1440288 - DNA, 14 bp, Homo sapiens
ggcaacagatctgg

SEQ ID NO: 1440289 - DNA, 19 bp, Homo sapiens
ggcaacagatctggaacct

SEQ ID NO: 1440290 - DNA, 16 bp, Homo sapiens
ggcaaccactaagaat

SEQ ID NO: 1440291 - DNA, 15 bp, Homo sapiens
ggcaaccttgtctct

SEQ ID NO: 1440292 - DNA, 15 bp, Homo sapiens
ggcaacgaagaaaaa

SEQ ID NO: 1440293 - DNA, 17 bp, Homo sapiens
ggcaacgaagaaaaaaa

SEQ ID NO: 1440294 - DNA, 20 bp, Homo sapiens
ggcaacgaagaaaaaaaata

SEQ ID NO: 1440295 - DNA, 21 bp, Homo sapiens
ggcaactctggctccaggcag

SEQ ID NO: 1440296 - DNA, 18 bp, Homo sapiens
ggcaagaacccaagtgcc

SEQ ID NO: 1440297 - DNA, 24 bp, Homo sapiens
ggcaagacagaaaagtgcctgagc

SEQ ID NO: 1440298 - DNA, 17 bp, Homo sapiens
ggcaagagggtgacagc

SEQ ID NO: 1440299 - DNA, 17 bp, Homo sapiens
ggcaagcccctcagccc

SEQ ID NO: 1440300 - DNA, 18 bp, Homo sapiens
ggcaagcccctcagccct

SEQ ID NO: 1440301 - DNA, 20 bp, Homo sapiens
ggcaagcccctcagcccttg

SEQ ID NO: 1440302 - DNA, 22 bp, Homo sapiens
ggcaagcccctcagcccttgcc

SEQ ID NO: 1440303 - DNA, 21 bp, Homo sapiens
ggcaagctaggccccagaggc

SEQ ID NO: 1440304 - DNA, 23 bp, Homo sapiens
ggcaagctaggccccagaggccc

SEQ ID NO: 1440305 - DNA, 17 bp, Homo sapiens
ggcaagcttgaggccaa

SEQ ID NO: 1440306 - DNA, 17 bp, Homo sapiens
ggcaagggttaaggcct

SEQ ID NO: 1440307 - DNA, 16 bp, Homo sapiens
ggcaaggtctccttac

SEQ ID NO: 1440308 - DNA, 18 bp, Homo sapiens
ggcaaggtgggtgattcc

SEQ ID NO: 1440309 - DNA, 23 bp, Homo sapiens
ggcaaggtgggtgattcctccca

SEQ ID NO: 1440310 - DNA, 19 bp, Homo sapiens
ggcaaggttggcgactgtc

SEQ ID NO: 1440311 - DNA, 23 bp, Homo sapiens
ggcaagtccctgactctctgtga

SEQ ID NO: 1440312 - DNA, 20 bp, Homo sapiens
ggcaagtcgagagggctgtt

SEQ ID NO: 1440313 - DNA, 19 bp, Homo sapiens
ggcaagtgatatcacctct

SEQ ID NO: 1440314 - DNA, 13 bp, Homo sapiens
ggcaagtgattga

SEQ ID NO: 1440315 - DNA, 18 bp, Homo sapiens
ggcaatttcctggccctc

SEQ ID NO: 1440316 - DNA, 14 bp, Homo sapiens
ggcaattttgtaac

SEQ ID NO: 1440317 - DNA, 21 bp, Homo sapiens
ggcacaagtaaaggcattgtc

SEQ ID NO: 1440318 - DNA, 23 bp, Homo sapiens
ggcacaagtcctggatgttgtgt

SEQ ID NO: 1440319 - DNA, 11 bp, Homo sapiens
ggcacaataaa

SEQ ID NO: 1440320 - DNA, 14 bp, Homo sapiens
ggcacacagactgg

SEQ ID NO: 1440321 - DNA, 20 bp, Homo sapiens
ggcacacagagattctggat

SEQ ID NO: 1440322 - DNA, 14 bp, Homo sapiens
ggcacacagctact

SEQ ID NO: 1440323 - DNA, 20 bp, Homo sapiens
ggcacaccactgccctgcct

SEQ ID NO: 1440324 - DNA, 21 bp, Homo sapiens
ggcacaccactgccctgcctg

SEQ ID NO: 1440325 - DNA, 22 bp, Homo sapiens
ggcacaccactgccctgcctgc

SEQ ID NO: 1440326 - DNA, 14 bp, Homo sapiens
ggcacacccctggg

SEQ ID NO: 1440327 - DNA, 23 bp, Homo sapiens
ggcacagacacgctcgcgggcag

SEQ ID NO: 1440328 - DNA, 22 bp, Homo sapiens
ggcacagacttctggaaggctg

SEQ ID NO: 1440329 - DNA, 15 bp, Homo sapiens
ggcacagcagctgca

SEQ ID NO: 1440330 - DNA, 13 bp, Homo sapiens
ggcacagccctcc

SEQ ID NO: 1440331 - DNA, 15 bp, Homo sapiens
ggcacagccctgagt

SEQ ID NO: 1440332 - DNA, 17 bp, Homo sapiens
ggcacagccctgagtgt

SEQ ID NO: 1440333 - DNA, 21 bp, Homo sapiens
ggcacagccctgagtgtccca

SEQ ID NO: 1440334 - DNA, 22 bp, Homo sapiens
ggcacaggactgattctgggat

SEQ ID NO: 1440335 - DNA, 19 bp, Homo sapiens
ggcacaggagtgtcctctt

SEQ ID NO: 1440336 - DNA, 15 bp, Homo sapiens
ggcacaggccccctt

SEQ ID NO: 1440337 - DNA, 20 bp, Homo sapiens
ggcacagggcaccagaggcc

SEQ ID NO: 1440338 - DNA, 22 bp, Homo sapiens
ggcacagggcaccagaggccga

SEQ ID NO: 1440339 - DNA, 21 bp, Homo sapiens
ggcacagggcccgcagtgctg

SEQ ID NO: 1440340 - DNA, 12 bp, Homo sapiens
ggcacagggtct

SEQ ID NO: 1440341 - DNA, 13 bp, Homo sapiens
ggcacagtgggag

SEQ ID NO: 1440342 - DNA, 20 bp, Homo sapiens
ggcacagtgggcctgtgtgt

SEQ ID NO: 1440343 - DNA, 23 bp, Homo sapiens
ggcacagttgtctattctgagcc

SEQ ID NO: 1440344 - DNA, 20 bp, Homo sapiens
ggcacatgaacagcttgcca

SEQ ID NO: 1440345 - DNA, 17 bp, Homo sapiens
ggcacattaactccctc

SEQ ID NO: 1440346 - DNA, 22 bp, Homo sapiens
ggcacattaactccctccacca

SEQ ID NO: 1440347 - DNA, 18 bp, Homo sapiens
ggcacattgcccatggct

SEQ ID NO: 1440348 - DNA, 16 bp, Homo sapiens
ggcaccaaagccacca

SEQ ID NO: 1440349 - DNA, 18 bp, Homo sapiens
ggcaccaccaggagcagc

SEQ ID NO: 1440350 - DNA, 22 bp, Homo sapiens
ggcaccaccaggagcagcagcc

SEQ ID NO: 1440351 - DNA, 23 bp, Homo sapiens
ggcaccaccaggagcagcagcca

SEQ ID NO: 1440352 - DNA, 22 bp, Homo sapiens
ggcaccactgcactccagcctg

SEQ ID NO: 1440353 - DNA, 16 bp, Homo sapiens
ggcaccagacacccag

SEQ ID NO: 1440354 - DNA, 19 bp, Homo sapiens
ggcaccagacacccaggac

SEQ ID NO: 1440355 - DNA, 20 bp, Homo sapiens
ggcaccagacacccaggact

SEQ ID NO: 1440356 - DNA, 14 bp, Homo sapiens
ggcaccagaggccg

SEQ ID NO: 1440357 - DNA, 14 bp, Homo sapiens
ggcaccagccagcg

SEQ ID NO: 1440358 - DNA, 14 bp, Homo sapiens
ggcaccagccccct

SEQ ID NO: 1440359 - DNA, 17 bp, Homo sapiens
ggcaccagccccctgga

SEQ ID NO: 1440360 - DNA, 19 bp, Homo sapiens
ggcaccagccccctggatg

SEQ ID NO: 1440361 - DNA, 19 bp, Homo sapiens
ggcaccagctctgtggcct

SEQ ID NO: 1440362 - DNA, 19 bp, Homo sapiens
ggcacccaggcctccctgc

SEQ ID NO: 1440363 - DNA, 21 bp, Homo sapiens
ggcacccaggcctccctgcag

SEQ ID NO: 1440364 - DNA, 24 bp, Homo sapiens
ggcacccccacaagctgtccctgc

SEQ ID NO: 1440365 - DNA, 18 bp, Homo sapiens
ggcaccccttgtttctgt

SEQ ID NO: 1440366 - DNA, 14 bp, Homo sapiens
ggcaccgagaatgt

SEQ ID NO: 1440367 - DNA, 17 bp, Homo sapiens
ggcaccgggaccccctc

SEQ ID NO: 1440368 - DNA, 20 bp, Homo sapiens
ggcaccgggaccccctcacc

SEQ ID NO: 1440369 - DNA, 17 bp, Homo sapiens
ggcaccgtccaggcccc

SEQ ID NO: 1440370 - DNA, 12 bp, Homo sapiens
ggcacctccagg

SEQ ID NO: 1440371 - DNA, 14 bp, Homo sapiens
ggcacctccaggca

SEQ ID NO: 1440372 - DNA, 17 bp, Homo sapiens
ggcacctccccgctctc

SEQ ID NO: 1440373 - DNA, 18 bp, Homo sapiens
ggcacctccccgctctcc

SEQ ID NO: 1440374 - DNA, 21 bp, Homo sapiens
ggcacctccccgctctccctg

SEQ ID NO: 1440375 - DNA, 13 bp, Homo sapiens
ggcacctcctgag

SEQ ID NO: 1440376 - DNA, 20 bp, Homo sapiens
ggcacctcggggacaccaga

SEQ ID NO: 1440377 - DNA, 12 bp, Homo sapiens
ggcacctcttcc

SEQ ID NO: 1440378 - DNA, 13 bp, Homo sapiens
ggcacctggcctg

SEQ ID NO: 1440379 - DNA, 19 bp, Homo sapiens
ggcacctgtgttccagccc

SEQ ID NO: 1440380 - DNA, 18 bp, Homo sapiens
ggcaccttccgacatccc

SEQ ID NO: 1440381 - DNA, 18 bp, Homo sapiens
ggcacgaacccacctgct

SEQ ID NO: 1440382 - DNA, 13 bp, Homo sapiens
ggcacgcacttgc

SEQ ID NO: 1440383 - DNA, 17 bp, Homo sapiens
ggcacgcacttgcctgt

SEQ ID NO: 1440384 - DNA, 18 bp, Homo sapiens
ggcacgcacttgcctgtt

SEQ ID NO: 1440385 - DNA, 18 bp, Homo sapiens
ggcacggagagaaggccc

SEQ ID NO: 1440386 - DNA, 20 bp, Homo sapiens
ggcacggcgggatcctccac

SEQ ID NO: 1440387 - DNA, 17 bp, Homo sapiens
ggcacgtccttgggcgt

SEQ ID NO: 1440388 - DNA, 23 bp, Homo sapiens
ggcactaacgttgagcccctgga

SEQ ID NO: 1440389 - DNA, 22 bp, Homo sapiens
ggcactcacagacctggagccc

SEQ ID NO: 1440390 - DNA, 15 bp, Homo sapiens
ggcactgactgatag

SEQ ID NO: 1440391 - DNA, 23 bp, Homo sapiens
ggcactgagcccccccaacactg

SEQ ID NO: 1440392 - DNA, 12 bp, Homo sapiens
ggcactgggctg

SEQ ID NO: 1440393 - DNA, 22 bp, Homo sapiens
ggcactgggctgttgttccatt

SEQ ID NO: 1440394 - DNA, 16 bp, Homo sapiens
ggcactggtggcatcg

SEQ ID NO: 1440395 - DNA, 17 bp, Homo sapiens
ggcactgtagttctaag

SEQ ID NO: 1440396 - DNA, 15 bp, Homo sapiens
ggcacttaagcacaa

SEQ ID NO: 1440397 - DNA, 21 bp, Homo sapiens
ggcacttaagtgcactttttt

SEQ ID NO: 1440398 - DNA, 14 bp, Homo sapiens
ggcacttgcctggg

SEQ ID NO: 1440399 - DNA, 15 bp, Homo sapiens
ggcacttgcctgggt

SEQ ID NO: 1440400 - DNA, 11 bp, Homo sapiens
ggcacttgtat

SEQ ID NO: 1440401 - DNA, 14 bp, Homo sapiens
ggcactttttaatt

SEQ ID NO: 1440402 - DNA, 17 bp, Homo sapiens
ggcagaaaattgcacaa

SEQ ID NO: 1440403 - DNA, 22 bp, Homo sapiens
ggcagaaagcaaatgtgacctg

SEQ ID NO: 1440404 - DNA, 14 bp, Homo sapiens
ggcagaaagtggcc

SEQ ID NO: 1440405 - DNA, 20 bp, Homo sapiens
ggcagaaatcgagagtgtgc

SEQ ID NO: 1440406 - DNA, 20 bp, Homo sapiens
ggcagaacagccgctcctgt

SEQ ID NO: 1440407 - DNA, 19 bp, Homo sapiens
ggcagaagcattgcctgga

SEQ ID NO: 1440408 - DNA, 16 bp, Homo sapiens
ggcagaaggccaagag

SEQ ID NO: 1440409 - DNA, 11 bp, Homo sapiens
ggcagaaggga

SEQ ID NO: 1440410 - DNA, 19 bp, Homo sapiens
ggcagaataatctttgggt

SEQ ID NO: 1440411 - DNA, 19 bp, Homo sapiens
ggcagacaagagctgctgt

SEQ ID NO: 1440412 - DNA, 12 bp, Homo sapiens
ggcagacacaac

SEQ ID NO: 1440413 - DNA, 11 bp, Homo sapiens
ggcagacacac

SEQ ID NO: 1440414 - DNA, 21 bp, Homo sapiens
ggcagacacaccgcggccagg

SEQ ID NO: 1440415 - DNA, 14 bp, Homo sapiens
ggcagacagcagct

SEQ ID NO: 1440416 - DNA, 20 bp, Homo sapiens
ggcagacagcagctcaggca

SEQ ID NO: 1440417 - DNA, 16 bp, Homo sapiens
ggcagaccctggaccc

SEQ ID NO: 1440418 - DNA, 21 bp, Homo sapiens
ggcagacctcttagagtcctt

SEQ ID NO: 1440419 - DNA, 14 bp, Homo sapiens
ggcagagaatcata

SEQ ID NO: 1440420 - DNA, 21 bp, Homo sapiens
ggcagagcaattccaggctga

SEQ ID NO: 1440421 - DNA, 13 bp, Homo sapiens
ggcagagccaggc

SEQ ID NO: 1440422 - DNA, 12 bp, Homo sapiens
ggcagagctgag

SEQ ID NO: 1440423 - DNA, 18 bp, Homo sapiens
ggcagagctgagggccct

SEQ ID NO: 1440424 - DNA, 19 bp, Homo sapiens
ggcagagctgagggccctg

SEQ ID NO: 1440425 - DNA, 14 bp, Homo sapiens
ggcagaggcctggg

SEQ ID NO: 1440426 - DNA, 18 bp, Homo sapiens
ggcagaggcctgggctgg

SEQ ID NO: 1440427 - DNA, 19 bp, Homo sapiens
ggcagaggctggaggcagg

SEQ ID NO: 1440428 - DNA, 21 bp, Homo sapiens
ggcagaggctggaggcagggc

SEQ ID NO: 1440429 - DNA, 16 bp, Homo sapiens
ggcagagggcagaggc

SEQ ID NO: 1440430 - DNA, 13 bp, Homo sapiens
ggcagagggctgg

SEQ ID NO: 1440431 - DNA, 14 bp, Homo sapiens
ggcagagggctgga

SEQ ID NO: 1440432 - DNA, 21 bp, Homo sapiens
ggcagagggctggaggcccag

SEQ ID NO: 1440433 - DNA, 17 bp, Homo sapiens
ggcagaggggcagccgc

SEQ ID NO: 1440434 - DNA, 21 bp, Homo sapiens
ggcagaggttgcagtgagccg

SEQ ID NO: 1440435 - DNA, 13 bp, Homo sapiens
ggcagagttacag

SEQ ID NO: 1440436 - DNA, 14 bp, Homo sapiens
ggcagagttacttg

SEQ ID NO: 1440437 - DNA, 14 bp, Homo sapiens
ggcagatccaggac

SEQ ID NO: 1440438 - DNA, 16 bp, Homo sapiens
ggcagatctgtgcccc

SEQ ID NO: 1440439 - DNA, 17 bp, Homo sapiens
ggcagatctgtgcccca

SEQ ID NO: 1440440 - DNA, 22 bp, Homo sapiens
ggcagatgtggggctgagctgg

SEQ ID NO: 1440441 - DNA, 17 bp, Homo sapiens
ggcagatgtttgcctca

SEQ ID NO: 1440442 - DNA, 15 bp, Homo sapiens
ggcagcaaggctgct

SEQ ID NO: 1440443 - DNA, 22 bp, Homo sapiens
ggcagcaccactgacgtttctg

SEQ ID NO: 1440444 - DNA, 23 bp, Homo sapiens
ggcagcactccccagagctgtgc

SEQ ID NO: 1440445 - DNA, 13 bp, Homo sapiens
ggcagcagcaggt

SEQ ID NO: 1440446 - DNA, 11 bp, Homo sapiens
ggcagcagcca

SEQ ID NO: 1440447 - DNA, 12 bp, Homo sapiens
ggcagcagccag

SEQ ID NO: 1440448 - DNA, 14 bp, Homo sapiens
ggcagcagtgtctg

SEQ ID NO: 1440449 - DNA, 18 bp, Homo sapiens
ggcagcatgcttgggctg

SEQ ID NO: 1440450 - DNA, 19 bp, Homo sapiens
ggcagcatgcttgggctga

SEQ ID NO: 1440451 - DNA, 12 bp, Homo sapiens
ggcagccaccca

SEQ ID NO: 1440452 - DNA, 14 bp, Homo sapiens
ggcagccacccaag

SEQ ID NO: 1440453 - DNA, 16 bp, Homo sapiens
ggcagccacccaagcc

SEQ ID NO: 1440454 - DNA, 13 bp, Homo sapiens
ggcagccagacca

SEQ ID NO: 1440455 - DNA, 14 bp, Homo sapiens
ggcagccagaccag

SEQ ID NO: 1440456 - DNA, 15 bp, Homo sapiens
ggcagccagaccagc

SEQ ID NO: 1440457 - DNA, 12 bp, Homo sapiens
ggcagccaggct

SEQ ID NO: 1440458 - DNA, 13 bp, Homo sapiens
ggcagccaggctg

SEQ ID NO: 1440459 - DNA, 11 bp, Homo sapiens
ggcagccatgc

SEQ ID NO: 1440460 - DNA, 19 bp, Homo sapiens
ggcagccatgcctcatgcc

SEQ ID NO: 1440461 - DNA, 18 bp, Homo sapiens
ggcagcccaacagcactt

SEQ ID NO: 1440462 - DNA, 21 bp, Homo sapiens
ggcagcccagagactttgtag

SEQ ID NO: 1440463 - DNA, 22 bp, Homo sapiens
ggcagcccagagactttgtaga

SEQ ID NO: 1440464 - DNA, 17 bp, Homo sapiens
ggcagccccttctggcc

SEQ ID NO: 1440465 - DNA, 18 bp, Homo sapiens
ggcagccccttctggccg

SEQ ID NO: 1440466 - DNA, 20 bp, Homo sapiens
ggcagccccttctggccggt

SEQ ID NO: 1440467 - DNA, 21 bp, Homo sapiens
ggcagccctcacctctgagga

SEQ ID NO: 1440468 - DNA, 17 bp, Homo sapiens
ggcagccctccacttct

SEQ ID NO: 1440469 - DNA, 11 bp, Homo sapiens
ggcagcccttg

SEQ ID NO: 1440470 - DNA, 15 bp, Homo sapiens
ggcagccgaggcctg

SEQ ID NO: 1440471 - DNA, 16 bp, Homo sapiens
ggcagccgaggcctgg

SEQ ID NO: 1440472 - DNA, 18 bp, Homo sapiens
ggcagccgaggcctggcc

SEQ ID NO: 1440473 - DNA, 17 bp, Homo sapiens
ggcagccgctaggagag

SEQ ID NO: 1440474 - DNA, 21 bp, Homo sapiens
ggcagccgctaggagagactg

SEQ ID NO: 1440475 - DNA, 20 bp, Homo sapiens
ggcagccgtcccaggccacc

SEQ ID NO: 1440476 - DNA, 13 bp, Homo sapiens
ggcagcctccaga

SEQ ID NO: 1440477 - DNA, 14 bp, Homo sapiens
ggcagcctccagag

SEQ ID NO: 1440478 - DNA, 18 bp, Homo sapiens
ggcagcctccagagccag

SEQ ID NO: 1440479 - DNA, 21 bp, Homo sapiens
ggcagcctccagagccagcct

SEQ ID NO: 1440480 - DNA, 14 bp, Homo sapiens
ggcagcctgcacct

SEQ ID NO: 1440481 - DNA, 18 bp, Homo sapiens
ggcagcctggctcccagg

SEQ ID NO: 1440482 - DNA, 13 bp, Homo sapiens
ggcagcgacccca

SEQ ID NO: 1440483 - DNA, 14 bp, Homo sapiens
ggcagcgaccccag

SEQ ID NO: 1440484 - DNA, 19 bp, Homo sapiens
ggcagcgaccccaggacct

SEQ ID NO: 1440485 - DNA, 17 bp, Homo sapiens
ggcagcgcatgtgtgca

SEQ ID NO: 1440486 - DNA, 19 bp, Homo sapiens
ggcagcgggatctcgtatc

SEQ ID NO: 1440487 - DNA, 14 bp, Homo sapiens
ggcagcgggccagg

SEQ ID NO: 1440488 - DNA, 15 bp, Homo sapiens
ggcagcgggccaggc

SEQ ID NO: 1440489 - DNA, 21 bp, Homo sapiens
ggcagctaagatagaaagctg

SEQ ID NO: 1440490 - DNA, 23 bp, Homo sapiens
ggcagctaagatagaaagctgga

SEQ ID NO: 1440491 - DNA, 15 bp, Homo sapiens
ggcagctagtgcctt

SEQ ID NO: 1440492 - DNA, 16 bp, Homo sapiens
ggcagctagtgccttt

SEQ ID NO: 1440493 - DNA, 16 bp, Homo sapiens
ggcagctcctctcctt

SEQ ID NO: 1440494 - DNA, 19 bp, Homo sapiens
ggcagctcctctccttggg

SEQ ID NO: 1440495 - DNA, 20 bp, Homo sapiens
ggcagctctggacagcccca

SEQ ID NO: 1440496 - DNA, 21 bp, Homo sapiens
ggcagctgaactattggaggg

SEQ ID NO: 1440497 - DNA, 12 bp, Homo sapiens
ggcagctgcccc

SEQ ID NO: 1440498 - DNA, 19 bp, Homo sapiens
ggcagctgcccctggcacc

SEQ ID NO: 1440499 - DNA, 11 bp, Homo sapiens
ggcagctgcct

SEQ ID NO: 1440500 - DNA, 12 bp, Homo sapiens
ggcagctgcctc

SEQ ID NO: 1440501 - DNA, 15 bp, Homo sapiens
ggcagctgctcttag

SEQ ID NO: 1440502 - DNA, 16 bp, Homo sapiens
ggcagctggatgagac

SEQ ID NO: 1440503 - DNA, 13 bp, Homo sapiens
ggcagctgggccc

SEQ ID NO: 1440504 - DNA, 16 bp, Homo sapiens
ggcagctggggggctg

SEQ ID NO: 1440505 - DNA, 14 bp, Homo sapiens
ggcagctgtttctc

SEQ ID NO: 1440506 - DNA, 13 bp, Homo sapiens
ggcagcttgcccc

SEQ ID NO: 1440507 - DNA, 15 bp, Homo sapiens
ggcagcttgccccgg

SEQ ID NO: 1440508 - DNA, 18 bp, Homo sapiens
ggcagcttgccccggccc

SEQ ID NO: 1440509 - DNA, 12 bp, Homo sapiens
ggcaggacacat

SEQ ID NO: 1440510 - DNA, 22 bp, Homo sapiens
ggcaggacacatcccggcctct

SEQ ID NO: 1440511 - DNA, 15 bp, Homo sapiens
ggcaggaccgccatg

SEQ ID NO: 1440512 - DNA, 21 bp, Homo sapiens
ggcaggaccttcgggctgtgc

SEQ ID NO: 1440513 - DNA, 23 bp, Homo sapiens
ggcaggaccttcgggctgtgccc

SEQ ID NO: 1440514 - DNA, 11 bp, Homo sapiens
ggcaggactga

SEQ ID NO: 1440515 - DNA, 17 bp, Homo sapiens
ggcaggactgagtcccc

SEQ ID NO: 1440516 - DNA, 21 bp, Homo sapiens
ggcaggactgttgtggtactg

SEQ ID NO: 1440517 - DNA, 19 bp, Homo sapiens
ggcaggagaatcacttgaa

SEQ ID NO: 1440518 - DNA, 16 bp, Homo sapiens
ggcaggagccttcctt

SEQ ID NO: 1440519 - DNA, 17 bp, Homo sapiens
ggcaggagtgccaggac

SEQ ID NO: 1440520 - DNA, 23 bp, Homo sapiens
ggcaggagtgccaggaccagcct

SEQ ID NO: 1440521 - DNA, 15 bp, Homo sapiens
ggcaggatgaccctg

SEQ ID NO: 1440522 - DNA, 20 bp, Homo sapiens
ggcaggattcttcccgctcc

SEQ ID NO: 1440523 - DNA, 17 bp, Homo sapiens
ggcaggcagttctagaa

SEQ ID NO: 1440524 - DNA, 15 bp, Homo sapiens
ggcaggcatggccct

SEQ ID NO: 1440525 - DNA, 14 bp, Homo sapiens
ggcaggcattcctg

SEQ ID NO: 1440526 - DNA, 11 bp, Homo sapiens
ggcaggcccac

SEQ ID NO: 1440527 - DNA, 19 bp, Homo sapiens
ggcaggcctgggacccagc

SEQ ID NO: 1440528 - DNA, 12 bp, Homo sapiens
ggcaggctgggc

SEQ ID NO: 1440529 - DNA, 15 bp, Homo sapiens
ggcaggctgggccat

SEQ ID NO: 1440530 - DNA, 22 bp, Homo sapiens
ggcaggctgggccatgtccaaa

SEQ ID NO: 1440531 - DNA, 16 bp, Homo sapiens
ggcaggctgggtgacc

SEQ ID NO: 1440532 - DNA, 16 bp, Homo sapiens
ggcaggcttggggaaa

SEQ ID NO: 1440533 - DNA, 18 bp, Homo sapiens
ggcagggaaggacaggac

SEQ ID NO: 1440534 - DNA, 22 bp, Homo sapiens
ggcagggacccggggtctcctg

SEQ ID NO: 1440535 - DNA, 18 bp, Homo sapiens
ggcagggacctgagagca

SEQ ID NO: 1440536 - DNA, 14 bp, Homo sapiens
ggcagggagtgtct

SEQ ID NO: 1440537 - DNA, 16 bp, Homo sapiens
ggcagggagtgtctgc

SEQ ID NO: 1440538 - DNA, 19 bp, Homo sapiens
ggcagggagtgtctgcagt

SEQ ID NO: 1440539 - DNA, 14 bp, Homo sapiens
ggcagggcagaggg

SEQ ID NO: 1440540 - DNA, 23 bp, Homo sapiens
ggcagggccactcaacagagagg

SEQ ID NO: 1440541 - DNA, 13 bp, Homo sapiens
ggcagggcctggg

SEQ ID NO: 1440542 - DNA, 19 bp, Homo sapiens
ggcagggccttgcccagag

SEQ ID NO: 1440543 - DNA, 17 bp, Homo sapiens
ggcagggctcccacaga

SEQ ID NO: 1440544 - DNA, 21 bp, Homo sapiens
ggcagggctcccacagagaca

SEQ ID NO: 1440545 - DNA, 16 bp, Homo sapiens
ggcagggctgggccag

SEQ ID NO: 1440546 - DNA, 14 bp, Homo sapiens
ggcaggggcctgga

SEQ ID NO: 1440547 - DNA, 16 bp, Homo sapiens
ggcaggggctggaggg

SEQ ID NO: 1440548 - DNA, 22 bp, Homo sapiens
ggcagggggccccgccagggct

SEQ ID NO: 1440549 - DNA, 13 bp, Homo sapiens
ggcagggggccct

SEQ ID NO: 1440550 - DNA, 17 bp, Homo sapiens
ggcagggggccctgccc

SEQ ID NO: 1440551 - DNA, 15 bp, Homo sapiens
ggcaggggtgctgtg

SEQ ID NO: 1440552 - DNA, 14 bp, Homo sapiens
ggcaggggtggggg

SEQ ID NO: 1440553 - DNA, 16 bp, Homo sapiens
ggcaggggtgggggtg

SEQ ID NO: 1440554 - DNA, 17 bp, Homo sapiens
ggcaggtgagaacccag

SEQ ID NO: 1440555 - DNA, 13 bp, Homo sapiens
ggcaggtgcctcc

SEQ ID NO: 1440556 - DNA, 14 bp, Homo sapiens
ggcaggtgcctcca

SEQ ID NO: 1440557 - DNA, 18 bp, Homo sapiens
ggcaggtgcctccaggtg

SEQ ID NO: 1440558 - DNA, 17 bp, Homo sapiens
ggcaggtggactgactg

SEQ ID NO: 1440559 - DNA, 21 bp, Homo sapiens
ggcaggtggactgactgtgtt

SEQ ID NO: 1440560 - DNA, 13 bp, Homo sapiens
ggcaggtggccag

SEQ ID NO: 1440561 - DNA, 20 bp, Homo sapiens
ggcaggtggccgcccctgag

SEQ ID NO: 1440562 - DNA, 13 bp, Homo sapiens
ggcaggtgggagc

SEQ ID NO: 1440563 - DNA, 15 bp, Homo sapiens
ggcaggtgggagctg

SEQ ID NO: 1440564 - DNA, 23 bp, Homo sapiens
ggcaggtgggctgcctgctgtgt

SEQ ID NO: 1440565 - DNA, 14 bp, Homo sapiens
ggcaggtggtggca

SEQ ID NO: 1440566 - DNA, 13 bp, Homo sapiens
ggcaggtgtggga

SEQ ID NO: 1440567 - DNA, 21 bp, Homo sapiens
ggcaggtgtgggatctgggga

SEQ ID NO: 1440568 - DNA, 17 bp, Homo sapiens
ggcaggtgttgggacct

SEQ ID NO: 1440569 - DNA, 22 bp, Homo sapiens
ggcaggtgttgggacctgctgc

SEQ ID NO: 1440570 - DNA, 14 bp, Homo sapiens
ggcagtaataaaaa

SEQ ID NO: 1440571 - DNA, 13 bp, Homo sapiens
ggcagtacctggg

SEQ ID NO: 1440572 - DNA, 19 bp, Homo sapiens
ggcagtaggtgtcccccac

SEQ ID NO: 1440573 - DNA, 14 bp, Homo sapiens
ggcagtccagccag

SEQ ID NO: 1440574 - DNA, 16 bp, Homo sapiens
ggcagtccagccagct

SEQ ID NO: 1440575 - DNA, 17 bp, Homo sapiens
ggcagtccagccagctc

SEQ ID NO: 1440576 - DNA, 18 bp, Homo sapiens
ggcagtccagccagctcc

SEQ ID NO: 1440577 - DNA, 19 bp, Homo sapiens
ggcagtccagccagctcct

SEQ ID NO: 1440578 - DNA, 11 bp, Homo sapiens
ggcagtccctt

SEQ ID NO: 1440579 - DNA, 13 bp, Homo sapiens
ggcagtcctggag

SEQ ID NO: 1440580 - DNA, 14 bp, Homo sapiens
ggcagtcctggagg

SEQ ID NO: 1440581 - DNA, 16 bp, Homo sapiens
ggcagtcctggaggca

SEQ ID NO: 1440582 - DNA, 18 bp, Homo sapiens
ggcagtcgggggctggcc

SEQ ID NO: 1440583 - DNA, 21 bp, Homo sapiens
ggcagtcgggggctggcctag

SEQ ID NO: 1440584 - DNA, 19 bp, Homo sapiens
ggcagtctctatattatgt

SEQ ID NO: 1440585 - DNA, 22 bp, Homo sapiens
ggcagtctctatattatgtctt

SEQ ID NO: 1440586 - DNA, 18 bp, Homo sapiens
ggcagtgactggcaggtg

SEQ ID NO: 1440587 - DNA, 14 bp, Homo sapiens
ggcagtgcccatgt

SEQ ID NO: 1440588 - DNA, 14 bp, Homo sapiens
ggcagtgccctttg

SEQ ID NO: 1440589 - DNA, 21 bp, Homo sapiens
ggcagtgccctttgagatctg

SEQ ID NO: 1440590 - DNA, 15 bp, Homo sapiens
ggcagtggaggctgc

SEQ ID NO: 1440591 - DNA, 16 bp, Homo sapiens
ggcagtggaggctgct

SEQ ID NO: 1440592 - DNA, 18 bp, Homo sapiens
ggcagtggaggctgctgt

SEQ ID NO: 1440593 - DNA, 13 bp, Homo sapiens
ggcagtggccagg

SEQ ID NO: 1440594 - DNA, 13 bp, Homo sapiens
ggcagtgttttgg

SEQ ID NO: 1440595 - DNA, 17 bp, Homo sapiens
ggcagttggccaggctc

SEQ ID NO: 1440596 - DNA, 16 bp, Homo sapiens
ggcataagacagagaa

SEQ ID NO: 1440597 - DNA, 21 bp, Homo sapiens
ggcatacgcctgtagtcctag

SEQ ID NO: 1440598 - DNA, 15 bp, Homo sapiens
ggcataggcctgggt

SEQ ID NO: 1440599 - DNA, 21 bp, Homo sapiens
ggccaccgggacagacctgga

SEQ ID NO: 1440600 - DNA, 17 bp, Homo sapiens
ggccacctatgccagtg

SEQ ID NO: 1440601 - DNA, 22 bp, Homo sapiens
ggccacctcccactcctgctgc

SEQ ID NO: 1440602 - DNA, 13 bp, Homo sapiens
ggccacctcccca

SEQ ID NO: 1440603 - DNA, 17 bp, Homo sapiens
ggccacctccccagcat

SEQ ID NO: 1440604 - DNA, 11 bp, Homo sapiens
ggccacctcct

SEQ ID NO: 1440605 - DNA, 12 bp, Homo sapiens
ggccacctcctc

SEQ ID NO: 1440606 - DNA, 16 bp, Homo sapiens
ggccacctcctccccc

SEQ ID NO: 1440607 - DNA, 17 bp, Homo sapiens
ggccacctcctccccct

SEQ ID NO: 1440608 - DNA, 19 bp, Homo sapiens
ggccacctcctccccctgt

SEQ ID NO: 1440609 - DNA, 14 bp, Homo sapiens
ggccacctctccaa

SEQ ID NO: 1440610 - DNA, 14 bp, Homo sapiens
ggccacctctgcct

SEQ ID NO: 1440611 - DNA, 15 bp, Homo sapiens
ggccacctctgcctc

SEQ ID NO: 1440612 - DNA, 16 bp, Homo sapiens
ggccacctctgcctct

SEQ ID NO: 1440613 - DNA, 17 bp, Homo sapiens
ggccacctgaggtgggc

SEQ ID NO: 1440614 - DNA, 19 bp, Homo sapiens
ggccacctgaggtgggccc

SEQ ID NO: 1440615 - DNA, 17 bp, Homo sapiens
ggccacgcactgggcca

SEQ ID NO: 1440616 - DNA, 23 bp, Homo sapiens
ggccacgcactgggccacggagg

SEQ ID NO: 1440617 - DNA, 14 bp, Homo sapiens
ggccacgcagccag

SEQ ID NO: 1440618 - DNA, 18 bp, Homo sapiens
ggccacgctccagctgcc

SEQ ID NO: 1440619 - DNA, 22 bp, Homo sapiens
ggccacggaggagggatgctgc

SEQ ID NO: 1440620 - DNA, 20 bp, Homo sapiens
ggccacgggggcagtgtgag

SEQ ID NO: 1440621 - DNA, 21 bp, Homo sapiens
ggccacgggggcagtgtgagg

SEQ ID NO: 1440622 - DNA, 12 bp, Homo sapiens
ggccacgtgcca

SEQ ID NO: 1440623 - DNA, 16 bp, Homo sapiens
ggccacgtgccaggcc

SEQ ID NO: 1440624 - DNA, 14 bp, Homo sapiens
ggccactaaagctt

SEQ ID NO: 1440625 - DNA, 15 bp, Homo sapiens
ggccactaaagcttc

SEQ ID NO: 1440626 - DNA, 18 bp, Homo sapiens
ggccactaaagcttcaga

SEQ ID NO: 1440627 - DNA, 19 bp, Homo sapiens
ggccactaaagcttcagac

SEQ ID NO: 1440628 - DNA, 17 bp, Homo sapiens
ggccactccagacccct

SEQ ID NO: 1440629 - DNA, 20 bp, Homo sapiens
ggccactctgcctctgcctg

SEQ ID NO: 1440630 - DNA, 13 bp, Homo sapiens
ggccactggggac

SEQ ID NO: 1440631 - DNA, 14 bp, Homo sapiens
ggccactggggact

SEQ ID NO: 1440632 - DNA, 15 bp, Homo sapiens
ggccactgtggccag

SEQ ID NO: 1440633 - DNA, 14 bp, Homo sapiens
ggagaagggctggg

SEQ ID NO: 1440634 - DNA, 18 bp, Homo sapiens
ggagaagggctggggccg

SEQ ID NO: 1440635 - DNA, 19 bp, Homo sapiens
ggagaagggggctctgccc

SEQ ID NO: 1440636 - DNA, 22 bp, Homo sapiens
ggagaagggggctctgccccag

SEQ ID NO: 1440637 - DNA, 22 bp, Homo sapiens
ggagaagtctcagctaagctca

SEQ ID NO: 1440638 - DNA, 16 bp, Homo sapiens
ggagaagtgctccctg

SEQ ID NO: 1440639 - DNA, 22 bp, Homo sapiens
ggagaagtgctccctggaggca

SEQ ID NO: 1440640 - DNA, 15 bp, Homo sapiens
ggagaataaatttgg

SEQ ID NO: 1440641 - DNA, 15 bp, Homo sapiens
ggagaatagcagaga

SEQ ID NO: 1440642 - DNA, 17 bp, Homo sapiens
ggagaatatttactaac

SEQ ID NO: 1440643 - DNA, 13 bp, Homo sapiens
ggagaattgaaac

SEQ ID NO: 1440644 - DNA, 17 bp, Homo sapiens
ggagacactggcccctc

SEQ ID NO: 1440645 - DNA, 20 bp, Homo sapiens
ggagacactggcccctcaaa

SEQ ID NO: 1440646 - DNA, 14 bp, Homo sapiens
ggagacagaaagcc

SEQ ID NO: 1440647 - DNA, 14 bp, Homo sapiens
ggagacagcatcag

SEQ ID NO: 1440648 - DNA, 17 bp, Homo sapiens
ggagacaggagcctagc

SEQ ID NO: 1440649 - DNA, 19 bp, Homo sapiens
ggagaccaagtcctggcta

SEQ ID NO: 1440650 - DNA, 15 bp, Homo sapiens
ggagaccagctcaga

SEQ ID NO: 1440651 - DNA, 15 bp, Homo sapiens
ggagaccgcttcacc

SEQ ID NO: 1440652 - DNA, 19 bp, Homo sapiens
ggagaccgcttcacccctg

SEQ ID NO: 1440653 - DNA, 15 bp, Homo sapiens
ggagacctgtgctag

SEQ ID NO: 1440654 - DNA, 22 bp, Homo sapiens
ggagacgtttataaacagaaat

SEQ ID NO: 1440655 - DNA, 16 bp, Homo sapiens
ggagactaagccctgt

SEQ ID NO: 1440656 - DNA, 19 bp, Homo sapiens
ggagactagattgcctttg

SEQ ID NO: 1440657 - DNA, 17 bp, Homo sapiens
ggagactcctgccctgt

SEQ ID NO: 1440658 - DNA, 16 bp, Homo sapiens
ggagactcctggtctg

SEQ ID NO: 1440659 - DNA, 20 bp, Homo sapiens
ggagactctgtggggccttg

SEQ ID NO: 1440660 - DNA, 22 bp, Homo sapiens
ggagacttgccagagccgggca

SEQ ID NO: 1440661 - DNA, 15 bp, Homo sapiens
ggagactttctgaag

SEQ ID NO: 1440662 - DNA, 13 bp, Homo sapiens
ggagagaaaaaag

SEQ ID NO: 1440663 - DNA, 15 bp, Homo sapiens
ggagagaaaaaagaa

SEQ ID NO: 1440664 - DNA, 18 bp, Homo sapiens
ggagagaaatattttaat

SEQ ID NO: 1440665 - DNA, 20 bp, Homo sapiens
ggagagactgaaagcagcag

SEQ ID NO: 1440666 - DNA, 21 bp, Homo sapiens
ggagagactgaaagcagcagc

SEQ ID NO: 1440667 - DNA, 17 bp, Homo sapiens
ggagagactgagcagcc

SEQ ID NO: 1440668 - DNA, 19 bp, Homo sapiens
ggagagactgagcagccgc

SEQ ID NO: 1440669 - DNA, 12 bp, Homo sapiens
ggagagacttgt

SEQ ID NO: 1440670 - DNA, 16 bp, Homo sapiens
ggagagagaagcaggc

SEQ ID NO: 1440671 - DNA, 17 bp, Homo sapiens
ggagagagaagcaggca

SEQ ID NO: 1440672 - DNA, 19 bp, Homo sapiens
ggagagagaagcaggcaga

SEQ ID NO: 1440673 - DNA, 19 bp, Homo sapiens
ggagagagagagagagagg

SEQ ID NO: 1440674 - DNA, 13 bp, Homo sapiens
ggagagagaggct

SEQ ID NO: 1440675 - DNA, 14 bp, Homo sapiens
ggagagagccaaga

SEQ ID NO: 1440676 - DNA, 15 bp, Homo sapiens
ggagagagccaagac

SEQ ID NO: 1440677 - DNA, 17 bp, Homo sapiens
ggagagagggactcaag

SEQ ID NO: 1440678 - DNA, 12 bp, Homo sapiens
ggagagagggga

SEQ ID NO: 1440679 - DNA, 21 bp, Homo sapiens
ggagagaggggaataatagaa

SEQ ID NO: 1440680 - DNA, 22 bp, Homo sapiens
ggagagatccctgcagaaccca

SEQ ID NO: 1440681 - DNA, 17 bp, Homo sapiens
ggagagcaagaaggaaa

SEQ ID NO: 1440682 - DNA, 14 bp, Homo sapiens
ggagagcagcagca

SEQ ID NO: 1440683 - DNA, 21 bp, Homo sapiens
ggagagcagcaggtgctgtgc

SEQ ID NO: 1440684 - DNA, 12 bp, Homo sapiens
ggagagcccagc

SEQ ID NO: 1440685 - DNA, 21 bp, Homo sapiens
ggagagccccatggtgggtag

SEQ ID NO: 1440686 - DNA, 22 bp, Homo sapiens
ggagagctgattgcagaaagga

SEQ ID NO: 1440687 - DNA, 18 bp, Homo sapiens
ggagagctggtgcccgga

SEQ ID NO: 1440688 - DNA, 14 bp, Homo sapiens
ggagaggcagcatg

SEQ ID NO: 1440689 - DNA, 15 bp, Homo sapiens
ggagaggcagcatgc

SEQ ID NO: 1440690 - DNA, 23 bp, Homo sapiens
ggagaggcattgccttctctgcc

SEQ ID NO: 1440691 - DNA, 17 bp, Homo sapiens
ggagagggcctctgcct

SEQ ID NO: 1440692 - DNA, 22 bp, Homo sapiens
ggagaggggaagggccagtctg

SEQ ID NO: 1440693 - DNA, 21 bp, Homo sapiens
ggagagggtctggagaagcag

SEQ ID NO: 1440694 - DNA, 14 bp, Homo sapiens
ggagaggtcaccag

SEQ ID NO: 1440695 - DNA, 20 bp, Homo sapiens
ggagagtcccagagcaggag

SEQ ID NO: 1440696 - DNA, 21 bp, Homo sapiens
ggagagtgtgtgggcagggtt

SEQ ID NO: 1440697 - DNA, 18 bp, Homo sapiens
ggagagtttcctgaaaca

SEQ ID NO: 1440698 - DNA, 21 bp, Homo sapiens
ggagatattataagggagagc

SEQ ID NO: 1440699 - DNA, 14 bp, Homo sapiens
ggagatcagcagcg

SEQ ID NO: 1440700 - DNA, 18 bp, Homo sapiens
ggagatcgcttttctcag

SEQ ID NO: 1440701 - DNA, 17 bp, Homo sapiens
ggagatgaccagggatg

SEQ ID NO: 1440702 - DNA, 18 bp, Homo sapiens
ggagatgcagctactgga

SEQ ID NO: 1440703 - DNA, 20 bp, Homo sapiens
ggagatgcagctactggaat

SEQ ID NO: 1440704 - DNA, 19 bp, Homo sapiens
ggagatggaggaaagtgat

SEQ ID NO: 1440705 - DNA, 13 bp, Homo sapiens
ggagatggagttc

SEQ ID NO: 1440706 - DNA, 18 bp, Homo sapiens
ggagatgggccttttgga

SEQ ID NO: 1440707 - DNA, 12 bp, Homo sapiens
ggagattataat

SEQ ID NO: 1440708 - DNA, 12 bp, Homo sapiens
ggagattgcttt

SEQ ID NO: 1440709 - DNA, 17 bp, Homo sapiens
ggagattggacggcctg

SEQ ID NO: 1440710 - DNA, 20 bp, Homo sapiens
ggagcaaaatcgatgcagtg

SEQ ID NO: 1440711 - DNA, 13 bp, Homo sapiens
ggagcaatcagaa

SEQ ID NO: 1440712 - DNA, 15 bp, Homo sapiens
ggagcacagccctgg

SEQ ID NO: 1440713 - DNA, 18 bp, Homo sapiens
ggagcacagccctgggag

SEQ ID NO: 1440714 - DNA, 13 bp, Homo sapiens
ggagcacaggcag

SEQ ID NO: 1440715 - DNA, 15 bp, Homo sapiens
ggagcacaggcagct

SEQ ID NO: 1440716 - DNA, 16 bp, Homo sapiens
ggagcaccagcggtcc

SEQ ID NO: 1440717 - DNA, 17 bp, Homo sapiens
ggagcaccaggcacgaa

SEQ ID NO: 1440718 - DNA, 14 bp, Homo sapiens
ggagcacccagagc

SEQ ID NO: 1440719 - DNA, 13 bp, Homo sapiens
ggagcacctgaac

SEQ ID NO: 1440720 - DNA, 12 bp, Homo sapiens
ggagcacctgtc

SEQ ID NO: 1440721 - DNA, 13 bp, Homo sapiens
ggagcactggagt

SEQ ID NO: 1440722 - DNA, 18 bp, Homo sapiens
ggagcactggggtggggg

SEQ ID NO: 1440723 - DNA, 18 bp, Homo sapiens
ggagcacttgcgtcctgc

SEQ ID NO: 1440724 - DNA, 19 bp, Homo sapiens
ggagcacttgcgtcctgca

SEQ ID NO: 1440725 - DNA, 21 bp, Homo sapiens
ggagcagagctctcccctcct

SEQ ID NO: 1440726 - DNA, 16 bp, Homo sapiens
ggagcagagggcaggg

SEQ ID NO: 1440727 - DNA, 16 bp, Homo sapiens
ggagcagcagccagca

SEQ ID NO: 1440728 - DNA, 21 bp, Homo sapiens
ggagcagccaaggccgccagc

SEQ ID NO: 1440729 - DNA, 12 bp, Homo sapiens
ggagcagccaga

SEQ ID NO: 1440730 - DNA, 16 bp, Homo sapiens
ggagcagccagagctg

SEQ ID NO: 1440731 - DNA, 11 bp, Homo sapiens
ggagcagctgt

SEQ ID NO: 1440732 - DNA, 16 bp, Homo sapiens
ggagcagctgtgctgc

SEQ ID NO: 1440733 - DNA, 16 bp, Homo sapiens
ggagcagggaaggcct

SEQ ID NO: 1440734 - DNA, 17 bp, Homo sapiens
ggagcagggaaggcctg

SEQ ID NO: 1440735 - DNA, 24 bp, Homo sapiens
ggagcaggttccccaagggccctg

SEQ ID NO: 1440736 - DNA, 16 bp, Homo sapiens
ggagcagttttcccct

SEQ ID NO: 1440737 - DNA, 17 bp, Homo sapiens
ggagcatgcgcagaggc

SEQ ID NO: 1440738 - DNA, 22 bp, Homo sapiens
ggagcattggcccctgagccca

SEQ ID NO: 1440739 - DNA, 15 bp, Homo sapiens
ggagcattgggacct

SEQ ID NO: 1440740 - DNA, 21 bp, Homo sapiens
ggagcatttaatggcagctag

SEQ ID NO: 1440741 - DNA, 23 bp, Homo sapiens
ggagccaaaggcatccaggccag

SEQ ID NO: 1440742 - DNA, 23 bp, Homo sapiens
ggagccaaatgaccgagccctgg

SEQ ID NO: 1440743 - DNA, 19 bp, Homo sapiens
ggagccaacgaagccggac

SEQ ID NO: 1440744 - DNA, 20 bp, Homo sapiens
ggagccaatgaacagctcct

SEQ ID NO: 1440745 - DNA, 16 bp, Homo sapiens
ggagccaatggagact

SEQ ID NO: 1440746 - DNA, 14 bp, Homo sapiens
ggagccaccagttc

SEQ ID NO: 1440747 - DNA, 15 bp, Homo sapiens
ggagccaccagttct

SEQ ID NO: 1440748 - DNA, 20 bp, Homo sapiens
ggagccactcctgtcccgcc

SEQ ID NO: 1440749 - DNA, 21 bp, Homo sapiens
ggagccagctccctctattta

SEQ ID NO: 1440750 - DNA, 23 bp, Homo sapiens
ggaggagccttgctgggccaggg

SEQ ID NO: 1440751 - DNA, 13 bp, Homo sapiens
ggaggaggaaggc

SEQ ID NO: 1440752 - DNA, 15 bp, Homo sapiens
ggaggaggaaggcaa

SEQ ID NO: 1440753 - DNA, 12 bp, Homo sapiens
ggaggaggacac

SEQ ID NO: 1440754 - DNA, 15 bp, Homo sapiens
ggaggaggaggagga

SEQ ID NO: 1440755 - DNA, 19 bp, Homo sapiens
ggaggaggccacctctcca

SEQ ID NO: 1440756 - DNA, 12 bp, Homo sapiens
ggaggagggaga

SEQ ID NO: 1440757 - DNA, 17 bp, Homo sapiens
ggaggagggagaagaga

SEQ ID NO: 1440758 - DNA, 15 bp, Homo sapiens
ggaggagggatgctg

SEQ ID NO: 1440759 - DNA, 20 bp, Homo sapiens
ggaggaggggaaggggctga

SEQ ID NO: 1440760 - DNA, 15 bp, Homo sapiens
ggaggagggggccgg

SEQ ID NO: 1440761 - DNA, 17 bp, Homo sapiens
ggaggatacagaggaga

SEQ ID NO: 1440762 - DNA, 17 bp, Homo sapiens
ggaggatcactggagcc

SEQ ID NO: 1440763 - DNA, 21 bp, Homo sapiens
ggaggatcactggagcccagg

SEQ ID NO: 1440764 - DNA, 18 bp, Homo sapiens
ggaggattcgagcatcag

SEQ ID NO: 1440765 - DNA, 19 bp, Homo sapiens
ggaggattctttccccaga

SEQ ID NO: 1440766 - DNA, 22 bp, Homo sapiens
ggaggattgcttgagcccagga

SEQ ID NO: 1440767 - DNA, 17 bp, Homo sapiens
ggaggcaaagctggctc

SEQ ID NO: 1440768 - DNA, 21 bp, Homo sapiens
ggaggcaaagctggctcacct

SEQ ID NO: 1440769 - DNA, 21 bp, Homo sapiens
ggaggcaacactgctgtccac

SEQ ID NO: 1440770 - DNA, 20 bp, Homo sapiens
ggaggcaagagactgggagc

SEQ ID NO: 1440771 - DNA, 23 bp, Homo sapiens
ggaggcaagagactgggagccac

SEQ ID NO: 1440772 - DNA, 15 bp, Homo sapiens
ggaggcacactttct

SEQ ID NO: 1440773 - DNA, 17 bp, Homo sapiens
ggaggcaccagctctgt

SEQ ID NO: 1440774 - DNA, 19 bp, Homo sapiens
ggaggcacctccaggcagg

SEQ ID NO: 1440775 - DNA, 21 bp, Homo sapiens
ggaggcagccgaggcctggcc

SEQ ID NO: 1440776 - DNA, 13 bp, Homo sapiens
ggaggcagggcct

SEQ ID NO: 1440777 - DNA, 22 bp, Homo sapiens
ggaggcagggggtgaggggcag

SEQ ID NO: 1440778 - DNA, 15 bp, Homo sapiens
ggaggccaaccagcc

SEQ ID NO: 1440779 - DNA, 15 bp, Homo sapiens
ggaggccaaggcagg

SEQ ID NO: 1440780 - DNA, 12 bp, Homo sapiens
ggaggccacctc

SEQ ID NO: 1440781 - DNA, 18 bp, Homo sapiens
ggaggccacctctccaag

SEQ ID NO: 1440782 - DNA, 21 bp, Homo sapiens
ggaggccacctctccaagggc

SEQ ID NO: 1440783 - DNA, 20 bp, Homo sapiens
ggaggcccaggctgggaact

SEQ ID NO: 1440784 - DNA, 19 bp, Homo sapiens
ggaggcccagttcaccctg

SEQ ID NO: 1440785 - DNA, 15 bp, Homo sapiens
ggaggccccaggctg

SEQ ID NO: 1440786 - DNA, 22 bp, Homo sapiens
ggaggcccctgaggcagcccag

SEQ ID NO: 1440787 - DNA, 19 bp, Homo sapiens
ggaggcccctggcccagcg

SEQ ID NO: 1440788 - DNA, 23 bp, Homo sapiens
ggaggcccctggcccagcggccc

SEQ ID NO: 1440789 - DNA, 21 bp, Homo sapiens
ggaggccctggtgtcaggcag

SEQ ID NO: 1440790 - DNA, 18 bp, Homo sapiens
ggaggccctgttccctgg

SEQ ID NO: 1440791 - DNA, 20 bp, Homo sapiens
ggaggccgagtggctgccgg

SEQ ID NO: 1440792 - DNA, 13 bp, Homo sapiens
ggaggcctcgccc

SEQ ID NO: 1440793 - DNA, 17 bp, Homo sapiens
ggaggccttccagctgc

SEQ ID NO: 1440794 - DNA, 18 bp, Homo sapiens
ggaggcgatgccagcctt

SEQ ID NO: 1440795 - DNA, 16 bp, Homo sapiens
ggaggcgctcctccct

SEQ ID NO: 1440796 - DNA, 13 bp, Homo sapiens
ggaggcggcccgg

SEQ ID NO: 1440797 - DNA, 17 bp, Homo sapiens
ggaggcggcccggccag

SEQ ID NO: 1440798 - DNA, 18 bp, Homo sapiens
ggaggcggcccggccagc

SEQ ID NO: 1440799 - DNA, 19 bp, Homo sapiens
ggaggcggcccggccagcg

SEQ ID NO: 1440800 - DNA, 16 bp, Homo sapiens
ggaggcgtgcccccct

SEQ ID NO: 1440801 - DNA, 18 bp, Homo sapiens
ggaggcgtgcccccctcc

SEQ ID NO: 1440802 - DNA, 20 bp, Homo sapiens
ggaggcgtggagggtgacca

SEQ ID NO: 1440803 - DNA, 11 bp, Homo sapiens
ggaggctctct

SEQ ID NO: 1440804 - DNA, 12 bp, Homo sapiens
ggaggctgaggc

SEQ ID NO: 1440805 - DNA, 20 bp, Homo sapiens
ggaggctgcagagctgaccc

SEQ ID NO: 1440806 - DNA, 21 bp, Homo sapiens
ggaggctgcagagctgaccca

SEQ ID NO: 1440807 - DNA, 12 bp, Homo sapiens
ggaggctgcagc

SEQ ID NO: 1440808 - DNA, 16 bp, Homo sapiens
ggaggctgcatgctct

SEQ ID NO: 1440809 - DNA, 23 bp, Homo sapiens
ggaggctgcatgctctggaagcc

SEQ ID NO: 1440810 - DNA, 17 bp, Homo sapiens
ggaggctgcgtgccagt

SEQ ID NO: 1440811 - DNA, 23 bp, Homo sapiens
ggaggctgctgtgaaaactctgg

SEQ ID NO: 1440812 - DNA, 20 bp, Homo sapiens
ggaggctggaggaagggggg

SEQ ID NO: 1440813 - DNA, 13 bp, Homo sapiens
ggaggctggccaa

SEQ ID NO: 1440814 - DNA, 20 bp, Homo sapiens
ggaggctggccaaggtgtcc

SEQ ID NO: 1440815 - DNA, 21 bp, Homo sapiens
ggaggctttgggtggctcact

SEQ ID NO: 1440816 - DNA, 17 bp, Homo sapiens
ggagggaccgcgcaggc

SEQ ID NO: 1440817 - DNA, 12 bp, Homo sapiens
ggagggagactg

SEQ ID NO: 1440818 - DNA, 13 bp, Homo sapiens
ggagggagctgct

SEQ ID NO: 1440819 - DNA, 13 bp, Homo sapiens
ggagggaggcgct

SEQ ID NO: 1440820 - DNA, 19 bp, Homo sapiens
ggagggaggctgggcgggt

SEQ ID NO: 1440821 - DNA, 17 bp, Homo sapiens
ggagggattctggttcc

SEQ ID NO: 1440822 - DNA, 22 bp, Homo sapiens
ggagggcacattaactccctcc

SEQ ID NO: 1440823 - DNA, 13 bp, Homo sapiens
ggagggcagagcc

SEQ ID NO: 1440824 - DNA, 19 bp, Homo sapiens
ggagggcccctgcgtgggg

SEQ ID NO: 1440825 - DNA, 20 bp, Homo sapiens
ggagggccgtaccccaccct

SEQ ID NO: 1440826 - DNA, 17 bp, Homo sapiens
ggagggcgtgactcacc

SEQ ID NO: 1440827 - DNA, 22 bp, Homo sapiens
ggagggctaattatatattttg

SEQ ID NO: 1440828 - DNA, 15 bp, Homo sapiens
ggaggggaagggctg

SEQ ID NO: 1440829 - DNA, 18 bp, Homo sapiens
ggaggggaggcagatgga

SEQ ID NO: 1440830 - DNA, 14 bp, Homo sapiens
ggaggggcaggctg

SEQ ID NO: 1440831 - DNA, 16 bp, Homo sapiens
ggaggggcccacccac

SEQ ID NO: 1440832 - DNA, 14 bp, Homo sapiens
ggaggggcctggca

SEQ ID NO: 1440833 - DNA, 15 bp, Homo sapiens
ggaggggcctgggca

SEQ ID NO: 1440834 - DNA, 16 bp, Homo sapiens
ggaggggcgctggccc

SEQ ID NO: 1440835 - DNA, 17 bp, Homo sapiens
ggaggggcggcaggagg

SEQ ID NO: 1440836 - DNA, 18 bp, Homo sapiens
ggagggggaatgtagtga

SEQ ID NO: 1440837 - DNA, 14 bp, Homo sapiens
ggagggggatccga

SEQ ID NO: 1440838 - DNA, 21 bp, Homo sapiens
ggagggggcgctcaggaccca

SEQ ID NO: 1440839 - DNA, 16 bp, Homo sapiens
ggagggggcttgaagc

SEQ ID NO: 1440840 - DNA, 14 bp, Homo sapiens
ggaggggggtggga

SEQ ID NO: 1440841 - DNA, 15 bp, Homo sapiens
ggaggggtggggagc

SEQ ID NO: 1440842 - DNA, 20 bp, Homo sapiens
ggagggtaaataaaccactg

SEQ ID NO: 1440843 - DNA, 16 bp, Homo sapiens
ggagggtcaccaggtt

SEQ ID NO: 1440844 - DNA, 17 bp, Homo sapiens
ggagggtgacgcccagc

SEQ ID NO: 1440845 - DNA, 14 bp, Homo sapiens
ggagggtgggaagg

SEQ ID NO: 1440846 - DNA, 20 bp, Homo sapiens
ggaggtagaggttgtggtga

SEQ ID NO: 1440847 - DNA, 15 bp, Homo sapiens
ggaggtcactccacc

SEQ ID NO: 1440848 - DNA, 17 bp, Homo sapiens
ggaggtcactggaaagg

SEQ ID NO: 1440849 - DNA, 19 bp, Homo sapiens
ggaggtcatctggcggagg

SEQ ID NO: 1440850 - DNA, 21 bp, Homo sapiens
ggaggtcatctggcggaggtc

SEQ ID NO: 1440851 - DNA, 18 bp, Homo sapiens
ggaggtccaagcagagtg

SEQ ID NO: 1440852 - DNA, 14 bp, Homo sapiens
ggaggtccagctgg

SEQ ID NO: 1440853 - DNA, 18 bp, Homo sapiens
ggaggtccagctgggcct

SEQ ID NO: 1440854 - DNA, 13 bp, Homo sapiens
ggaggtctccagg

SEQ ID NO: 1440855 - DNA, 22 bp, Homo sapiens
ggaggtctccaggggcctgcag

SEQ ID NO: 1440856 - DNA, 12 bp, Homo sapiens
ggaggtctctgg

SEQ ID NO: 1440857 - DNA, 20 bp, Homo sapiens
ggaggtctctgggagcccag

SEQ ID NO: 1440858 - DNA, 14 bp, Homo sapiens
ggaggtctggctga

SEQ ID NO: 1440859 - DNA, 14 bp, Homo sapiens
ggaggtgaagaggc

SEQ ID NO: 1440860 - DNA, 22 bp, Homo sapiens
ggaggtgcgtgttcagcagaac

SEQ ID NO: 1440861 - DNA, 18 bp, Homo sapiens
ggaggtgcttgaggcccc

SEQ ID NO: 1440862 - DNA, 19 bp, Homo sapiens
ggaggtggagcttgcagtg

SEQ ID NO: 1440863 - DNA, 20 bp, Homo sapiens
ggaggtggagcttgcagtga

SEQ ID NO: 1440864 - DNA, 20 bp, Homo sapiens
ggaggtggaggttgcagtga

SEQ ID NO: 1440865 - DNA, 23 bp, Homo sapiens
ggaaagacaactgttttaataaa

SEQ ID NO: 1440866 - DNA, 16 bp, Homo sapiens
ggaaagacactgcctg

SEQ ID NO: 1440867 - DNA, 20 bp, Homo sapiens
ggaaagacactgcctgggct

SEQ ID NO: 1440868 - DNA, 22 bp, Homo sapiens
ggaaagatggataaactgagcc

SEQ ID NO: 1440869 - DNA, 23 bp, Homo sapiens
ggaaagatggtgtgggtgtcctg

SEQ ID NO: 1440870 - DNA, 19 bp, Homo sapiens
ggaaagatgttaagcattt

SEQ ID NO: 1440871 - DNA, 20 bp, Homo sapiens
ggaaagatttgtgaactgga

SEQ ID NO: 1440872 - DNA, 19 bp, Homo sapiens
ggaaagcatcacctcaggc

SEQ ID NO: 1440873 - DNA, 14 bp, Homo sapiens
ggaaagcctctggc

SEQ ID NO: 1440874 - DNA, 15 bp, Homo sapiens
ggaaagcctctggcc

SEQ ID NO: 1440875 - DNA, 16 bp, Homo sapiens
ggaaagcggcgccaca

SEQ ID NO: 1440876 - DNA, 12 bp, Homo sapiens
ggaaaggaccca

SEQ ID NO: 1440877 - DNA, 21 bp, Homo sapiens
ggaaaggcaagcttgaggcca

SEQ ID NO: 1440878 - DNA, 19 bp, Homo sapiens
ggaaaggctcagtctcagg

SEQ ID NO: 1440879 - DNA, 20 bp, Homo sapiens
ggaaaggctctgaaagccag

SEQ ID NO: 1440880 - DNA, 18 bp, Homo sapiens
ggaaaggggacaaggaag

SEQ ID NO: 1440881 - DNA, 15 bp, Homo sapiens
ggaaaggggcgagca

SEQ ID NO: 1440882 - DNA, 22 bp, Homo sapiens
ggaaagtacattttttgaaatg

SEQ ID NO: 1440883 - DNA, 20 bp, Homo sapiens
ggaaagtgtgagctcttccc

SEQ ID NO: 1440884 - DNA, 18 bp, Homo sapiens
ggaaagttactgtaaatg

SEQ ID NO: 1440885 - DNA, 19 bp, Homo sapiens
ggaaagttactgtaaatgc

SEQ ID NO: 1440886 - DNA, 20 bp, Homo sapiens
ggaaagttgggcccctgagg

SEQ ID NO: 1440887 - DNA, 23 bp, Homo sapiens
ggaaataaagcgtcctctcagta

SEQ ID NO: 1440888 - DNA, 17 bp, Homo sapiens
ggaaataacagagagaa

SEQ ID NO: 1440889 - DNA, 20 bp, Homo sapiens
ggaaataataaagatgctct

SEQ ID NO: 1440890 - DNA, 22 bp, Homo sapiens
ggaaatatcagttactcagccc

SEQ ID NO: 1440891 - DNA, 16 bp, Homo sapiens
ggaaatcaaccctctc

SEQ ID NO: 1440892 - DNA, 19 bp, Homo sapiens
ggaaatcaaccctctcctg

SEQ ID NO: 1440893 - DNA, 16 bp, Homo sapiens
ggaaatcataccagtt

SEQ ID NO: 1440894 - DNA, 12 bp, Homo sapiens
ggaaatccagat

SEQ ID NO: 1440895 - DNA, 18 bp, Homo sapiens
ggaaatctcaccccatcc

SEQ ID NO: 1440896 - DNA, 17 bp, Homo sapiens
ggaaatgtcaacaagta

SEQ ID NO: 1440897 - DNA, 15 bp, Homo sapiens
ggaaatgtctgctgg

SEQ ID NO: 1440898 - DNA, 19 bp, Homo sapiens
ggaaattaatgctgagatg

SEQ ID NO: 1440899 - DNA, 23 bp, Homo sapiens
ggaaattcaaagcataaaacttt

SEQ ID NO: 1440900 - DNA, 20 bp, Homo sapiens
ggaaatttgtttgtattttt

SEQ ID NO: 1440901 - DNA, 17 bp, Homo sapiens
ggaacaaattagaggag

SEQ ID NO: 1440902 - DNA, 18 bp, Homo sapiens
ggaacaagacagccttca

SEQ ID NO: 1440903 - DNA, 18 bp, Homo sapiens
ggaacaatagaataatct

SEQ ID NO: 1440904 - DNA, 12 bp, Homo sapiens
ggaacacagcta

SEQ ID NO: 1440905 - DNA, 17 bp, Homo sapiens
ggaacactcatgtctgg

SEQ ID NO: 1440906 - DNA, 14 bp, Homo sapiens
ggaacactggcctg

SEQ ID NO: 1440907 - DNA, 22 bp, Homo sapiens
ggaacactggcttgaaggactg

SEQ ID NO: 1440908 - DNA, 19 bp, Homo sapiens
ggaacagaaggatgaatga

SEQ ID NO: 1440909 - DNA, 16 bp, Homo sapiens
ggaacagaatgtttta

SEQ ID NO: 1440910 - DNA, 19 bp, Homo sapiens
ggaacagcgggagacctgt

SEQ ID NO: 1440911 - DNA, 23 bp, Homo sapiens
ggaacaggctcagatctcatggg

SEQ ID NO: 1440912 - DNA, 19 bp, Homo sapiens
ggaacagtattacagtgtc

SEQ ID NO: 1440913 - DNA, 23 bp, Homo sapiens
ggaacagtgtttcccataatttt

SEQ ID NO: 1440914 - DNA, 23 bp, Homo sapiens
ggaacatcctaagacagaggaac

SEQ ID NO: 1440915 - DNA, 18 bp, Homo sapiens
ggaacatgacccagcctg

SEQ ID NO: 1440916 - DNA, 14 bp, Homo sapiens
ggaacatgccccct

SEQ ID NO: 1440917 - DNA, 17 bp, Homo sapiens
ggaacatgctggaaata

SEQ ID NO: 1440918 - DNA, 17 bp, Homo sapiens
ggaacatggctggcctg

SEQ ID NO: 1440919 - DNA, 20 bp, Homo sapiens
ggaacatggctggcctggta

SEQ ID NO: 1440920 - DNA, 22 bp, Homo sapiens
ggaacatttgatatttttccat

SEQ ID NO: 1440921 - DNA, 13 bp, Homo sapiens
ggaaccacctgga

SEQ ID NO: 1440922 - DNA, 14 bp, Homo sapiens
ggaaccactcccac

SEQ ID NO: 1440923 - DNA, 19 bp, Homo sapiens
ggaaccagactcttgcctg

SEQ ID NO: 1440924 - DNA, 16 bp, Homo sapiens
ggaaccccgcagcccg

SEQ ID NO: 1440925 - DNA, 17 bp, Homo sapiens
ggaaccgtagactagga

SEQ ID NO: 1440926 - DNA, 17 bp, Homo sapiens
ggaaccgtgtccagcac

SEQ ID NO: 1440927 - DNA, 18 bp, Homo sapiens
ggaacctagtactctctg

SEQ ID NO: 1440928 - DNA, 20 bp, Homo sapiens
ggaacctagtactctctgct

SEQ ID NO: 1440929 - DNA, 22 bp, Homo sapiens
ggaacctagtactctctgctct

SEQ ID NO: 1440930 - DNA, 14 bp, Homo sapiens
ggaacctcagcctg

SEQ ID NO: 1440931 - DNA, 19 bp, Homo sapiens
ggaacctcagcctggccag

SEQ ID NO: 1440932 - DNA, 20 bp, Homo sapiens
ggaacctcagcctggccaga

SEQ ID NO: 1440933 - DNA, 22 bp, Homo sapiens
ggaacctcagcctggccagaca

SEQ ID NO: 1440934 - DNA, 23 bp, Homo sapiens
ggaacctcattgctaccacagac

SEQ ID NO: 1440935 - DNA, 13 bp, Homo sapiens
ggaacgagcactg

SEQ ID NO: 1440936 - DNA, 16 bp, Homo sapiens
ggaacgagcactggcc

SEQ ID NO: 1440937 - DNA, 19 bp, Homo sapiens
ggaacgagcactggccaga

SEQ ID NO: 1440938 - DNA, 22 bp, Homo sapiens
ggaacgagcactggccagagag

SEQ ID NO: 1440939 - DNA, 20 bp, Homo sapiens
ggaacggtaaatttctgtgg

SEQ ID NO: 1440940 - DNA, 16 bp, Homo sapiens
ggaacgtgactgcccc

SEQ ID NO: 1440941 - DNA, 16 bp, Homo sapiens
ggaactactgtacttt

SEQ ID NO: 1440942 - DNA, 15 bp, Homo sapiens
ggaactagataacat

SEQ ID NO: 1440943 - DNA, 21 bp, Homo sapiens
ggaactatgaagacttaaaag

SEQ ID NO: 1440944 - DNA, 15 bp, Homo sapiens
ggaactcctggaaat

SEQ ID NO: 1440945 - DNA, 15 bp, Homo sapiens
ggaactcgcctcagc

SEQ ID NO: 1440946 - DNA, 13 bp, Homo sapiens
ggaactctgacaa

SEQ ID NO: 1440947 - DNA, 17 bp, Homo sapiens
ggaactctgtgcaggtg

SEQ ID NO: 1440948 - DNA, 19 bp, Homo sapiens
ggaactctgtgcaggtgct

SEQ ID NO: 1440949 - DNA, 20 bp, Homo sapiens
ggaactgaccccctcccctg

SEQ ID NO: 1440950 - DNA, 12 bp, Homo sapiens
ggaactgtccca

SEQ ID NO: 1440951 - DNA, 23 bp, Homo sapiens
ggaactgtctgaatattctagaa

SEQ ID NO: 1440952 - DNA, 21 bp, Homo sapiens
ggaacttgagcgtgaatctgt

SEQ ID NO: 1440953 - DNA, 22 bp, Homo sapiens
ggaactttctggtcccttcagt

SEQ ID NO: 1440954 - DNA, 15 bp, Homo sapiens
ggaagaaactttttt

SEQ ID NO: 1440955 - DNA, 13 bp, Homo sapiens
ggaagaaagcaga

SEQ ID NO: 1440956 - DNA, 16 bp, Homo sapiens
ggaagaaattcaggta

SEQ ID NO: 1440957 - DNA, 18 bp, Homo sapiens
ggaagaaattcaggtaca

SEQ ID NO: 1440958 - DNA, 14 bp, Homo sapiens
ggaagaaccactgt

SEQ ID NO: 1440959 - DNA, 14 bp, Homo sapiens
ggaagaagcaaggg

SEQ ID NO: 1440960 - DNA, 17 bp, Homo sapiens
ggaagaagtgagcagtg

SEQ ID NO: 1440961 - DNA, 22 bp, Homo sapiens
ggaagacacttcagatctgagg

SEQ ID NO: 1440962 - DNA, 15 bp, Homo sapiens
ggaagacagtggccc

SEQ ID NO: 1440963 - DNA, 16 bp, Homo sapiens
ggaagaccagaattcc

SEQ ID NO: 1440964 - DNA, 15 bp, Homo sapiens
ggaagaccccaccca

SEQ ID NO: 1440965 - DNA, 23 bp, Homo sapiens
ggaagaccccacccaagcttggc

SEQ ID NO: 1440966 - DNA, 16 bp, Homo sapiens
ggaagactcaggagtc

SEQ ID NO: 1440967 - DNA, 20 bp, Homo sapiens
ggaagactcaggagtctgcc

SEQ ID NO: 1440968 - DNA, 19 bp, Homo sapiens
ggaagacttgaagcacaga

SEQ ID NO: 1440969 - DNA, 21 bp, Homo sapiens
ggaagagaagagggcccagcc

SEQ ID NO: 1440970 - DNA, 22 bp, Homo sapiens
ggaagagaagagggcccagccc

SEQ ID NO: 1440971 - DNA, 11 bp, Homo sapiens
ggaagagagag

SEQ ID NO: 1440972 - DNA, 14 bp, Homo sapiens
ggaagagcagcctg

SEQ ID NO: 1440973 - DNA, 19 bp, Homo sapiens
ggaagagcagcctgatggc

SEQ ID NO: 1440974 - DNA, 14 bp, Homo sapiens
ggaagagcaggcac

SEQ ID NO: 1440975 - DNA, 21 bp, Homo sapiens
ggaagagcaggcacatggagg

SEQ ID NO: 1440976 - DNA, 21 bp, Homo sapiens
ggaagagcaggtgactgtgct

SEQ ID NO: 1440977 - DNA, 13 bp, Homo sapiens
ggaagagccacct

SEQ ID NO: 1440978 - DNA, 15 bp, Homo sapiens
ggaagagccacctgc

SEQ ID NO: 1440979 - DNA, 16 bp, Homo sapiens
ggaagagccacctgca

SEQ ID NO: 1440980 - DNA, 13 bp, Homo sapiens
ggacatcctcctc

SEQ ID NO: 1440981 - DNA, 16 bp, Homo sapiens
ggacatcctcctccca

SEQ ID NO: 1440982 - DNA, 16 bp, Homo sapiens
ggacatcgtaggcagc

SEQ ID NO: 1440983 - DNA, 14 bp, Homo sapiens
ggacatgaaggaaa

SEQ ID NO: 1440984 - DNA, 22 bp, Homo sapiens
ggacatgatggggaaggagtac

SEQ ID NO: 1440985 - DNA, 16 bp, Homo sapiens
ggacatgcaataaaat

SEQ ID NO: 1440986 - DNA, 19 bp, Homo sapiens
ggacatgcaataaaattta

SEQ ID NO: 1440987 - DNA, 18 bp, Homo sapiens
ggacattgtatgcaggga

SEQ ID NO: 1440988 - DNA, 20 bp, Homo sapiens
ggacattgtatgcagggagc

SEQ ID NO: 1440989 - DNA, 20 bp, Homo sapiens
ggaccaaccctggggaagga

SEQ ID NO: 1440990 - DNA, 11 bp, Homo sapiens
ggaccaagaat

SEQ ID NO: 1440991 - DNA, 23 bp, Homo sapiens
ggaccaaggcaaggcaggtgcct

SEQ ID NO: 1440992 - DNA, 16 bp, Homo sapiens
ggaccaattctggaca

SEQ ID NO: 1440993 - DNA, 11 bp, Homo sapiens
ggactacacaa

SEQ ID NO: 1440994 - DNA, 15 bp, Homo sapiens
ggactaccgcaggcc

SEQ ID NO: 1440995 - DNA, 18 bp, Homo sapiens
ggactagaagattagaaa

SEQ ID NO: 1440996 - DNA, 20 bp, Homo sapiens
ggactaggacctgagcctgg

SEQ ID NO: 1440997 - DNA, 18 bp, Homo sapiens
ggactagtgagtcagcac

SEQ ID NO: 1440998 - DNA, 20 bp, Homo sapiens
ggactagtgagtcagcacct

SEQ ID NO: 1440999 - DNA, 21 bp, Homo sapiens
ggactatgatgagaggccagc

SEQ ID NO: 1441000 - DNA, 21 bp, Homo sapiens
ggactcaccaacttgccacat

SEQ ID NO: 1441001 - DNA, 23 bp, Homo sapiens
ggactcaccctcataccatctgc

SEQ ID NO: 1441002 - DNA, 15 bp, Homo sapiens
gctttctgccatcta

SEQ ID NO: 1441003 - DNA, 17 bp, Homo sapiens
gctttctggggcctagc

SEQ ID NO: 1441004 - DNA, 23 bp, Homo sapiens
gctttctggggcctagcgatctc

SEQ ID NO: 1441005 - DNA, 14 bp, Homo sapiens
gctttcttgctggt

SEQ ID NO: 1441006 - DNA, 13 bp, Homo sapiens
gctttctttagaa

SEQ ID NO: 1441007 - DNA, 20 bp, Homo sapiens
gctttgaaagaagcaagaca

SEQ ID NO: 1441008 - DNA, 14 bp, Homo sapiens
gctttgagaagcct

SEQ ID NO: 1441009 - DNA, 16 bp, Homo sapiens
gctttgagaagccttc

SEQ ID NO: 1441010 - DNA, 22 bp, Homo sapiens
gctttgagaagccttcagctcc

SEQ ID NO: 1441011 - DNA, 17 bp, Homo sapiens
gctttgagttgacttct

SEQ ID NO: 1441012 - DNA, 22 bp, Homo sapiens
gctttgagttgacttctgacaa

SEQ ID NO: 1441013 - DNA, 14 bp, Homo sapiens
gctttgatccctga

SEQ ID NO: 1441014 - DNA, 18 bp, Homo sapiens
gctttgcaccgtggtcag

SEQ ID NO: 1441015 - DNA, 17 bp, Homo sapiens
gctttgcaggctctggg

SEQ ID NO: 1441016 - DNA, 23 bp, Homo sapiens
gctttgccaaaataccagagcct

SEQ ID NO: 1441017 - DNA, 19 bp, Homo sapiens
gctttgccaagttgctgtc

SEQ ID NO: 1441018 - DNA, 15 bp, Homo sapiens
gctttgcccacccct

SEQ ID NO: 1441019 - DNA, 17 bp, Homo sapiens
gctttgcccacccctca

SEQ ID NO: 1441020 - DNA, 12 bp, Homo sapiens
gctttgcctctt

SEQ ID NO: 1441021 - DNA, 16 bp, Homo sapiens
gctttgctccgctccc

SEQ ID NO: 1441022 - DNA, 17 bp, Homo sapiens
gctttgctccgctccca

SEQ ID NO: 1441023 - DNA, 21 bp, Homo sapiens
gctttgcttatggtaataaaa

SEQ ID NO: 1441024 - DNA, 21 bp, Homo sapiens
gctttggaaagttactgtaaa

SEQ ID NO: 1441025 - DNA, 22 bp, Homo sapiens
gctttggaaagttactgtaaat

SEQ ID NO: 1441026 - DNA, 18 bp, Homo sapiens
gctttggcagtgttttgg

SEQ ID NO: 1441027 - DNA, 20 bp, Homo sapiens
gctttgggcagttggccagg

SEQ ID NO: 1441028 - DNA, 16 bp, Homo sapiens
gctttgggctgccctg

SEQ ID NO: 1441029 - DNA, 20 bp, Homo sapiens
gctttgggctttgcaggctc

SEQ ID NO: 1441030 - DNA, 22 bp, Homo sapiens
gctttgggctttgcaggctctg

SEQ ID NO: 1441031 - DNA, 19 bp, Homo sapiens
gctttggggacagttggca

SEQ ID NO: 1441032 - DNA, 23 bp, Homo sapiens
gctttggggacagttggcagaga

SEQ ID NO: 1441033 - DNA, 23 bp, Homo sapiens
gctttgggggagtgggcgcagtg

SEQ ID NO: 1441034 - DNA, 19 bp, Homo sapiens
gctttgggtgcctttgcca

SEQ ID NO: 1441035 - DNA, 15 bp, Homo sapiens
gctttggttccttct

SEQ ID NO: 1441036 - DNA, 22 bp, Homo sapiens
gctttggttccttctctgggtc

SEQ ID NO: 1441037 - DNA, 18 bp, Homo sapiens
gctttgtgtcgtcttgaa

SEQ ID NO: 1441038 - DNA, 14 bp, Homo sapiens
gctttgttttatat

SEQ ID NO: 1441039 - DNA, 16 bp, Homo sapiens
gcttttaaaaatgttt

SEQ ID NO: 1441040 - DNA, 23 bp, Homo sapiens
gcttttaaatgaccaaagatgac

SEQ ID NO: 1441041 - DNA, 15 bp, Homo sapiens
gcttttaattaaata

SEQ ID NO: 1441042 - DNA, 15 bp, Homo sapiens
gcttttaattctcat

SEQ ID NO: 1441043 - DNA, 17 bp, Homo sapiens
gcttttaccctttttct

SEQ ID NO: 1441044 - DNA, 13 bp, Homo sapiens
gcttttactgttt

SEQ ID NO: 1441045 - DNA, 14 bp, Homo sapiens
gcttttactttatt

SEQ ID NO: 1441046 - DNA, 20 bp, Homo sapiens
gcttttattttttcttttgt

SEQ ID NO: 1441047 - DNA, 21 bp, Homo sapiens
gcttttattttttcttttgta

SEQ ID NO: 1441048 - DNA, 14 bp, Homo sapiens
gcttttcactgcct

SEQ ID NO: 1441049 - DNA, 13 bp, Homo sapiens
gcttttcactgct

SEQ ID NO: 1441050 - DNA, 22 bp, Homo sapiens
gcttttcactgctggctgcctt

SEQ ID NO: 1441051 - DNA, 16 bp, Homo sapiens
gcttttcatggaagtg

SEQ ID NO: 1441052 - DNA, 14 bp, Homo sapiens
gcttttcatgtaga

SEQ ID NO: 1441053 - DNA, 22 bp, Homo sapiens
gcttttcatgtagaactcagca

SEQ ID NO: 1441054 - DNA, 15 bp, Homo sapiens
gcttttccaggatcc

SEQ ID NO: 1441055 - DNA, 18 bp, Homo sapiens
gcttttccccggtccctt

SEQ ID NO: 1441056 - DNA, 21 bp, Homo sapiens
gcttttctgcctgctcctgct

SEQ ID NO: 1441057 - DNA, 13 bp, Homo sapiens
gcttttgaaaagt

SEQ ID NO: 1441058 - DNA, 18 bp, Homo sapiens
gcttttgaggctcagtga

SEQ ID NO: 1441059 - DNA, 21 bp, Homo sapiens
gcttttgcacaccttttcccc

SEQ ID NO: 1441060 - DNA, 18 bp, Homo sapiens
gcttttgccactttggct

SEQ ID NO: 1441061 - DNA, 17 bp, Homo sapiens
gcttttgcctgtaagaa

SEQ ID NO: 1441062 - DNA, 23 bp, Homo sapiens
gcttttgctagatggaatggaaa

SEQ ID NO: 1441063 - DNA, 14 bp, Homo sapiens
gcttttgcttgcaa

SEQ ID NO: 1441064 - DNA, 11 bp, Homo sapiens
gcttttggaag

SEQ ID NO: 1441065 - DNA, 13 bp, Homo sapiens
gcttttgttctag

SEQ ID NO: 1441066 - DNA, 15 bp, Homo sapiens
gcttttgttctagac

SEQ ID NO: 1441067 - DNA, 16 bp, Homo sapiens
gcttttgttctagact

SEQ ID NO: 1441068 - DNA, 18 bp, Homo sapiens
gcttttgttgtgactttt

SEQ ID NO: 1441069 - DNA, 13 bp, Homo sapiens
gcttttgtttttt

SEQ ID NO: 1441070 - DNA, 13 bp, Homo sapiens
gctttttaaaatt

SEQ ID NO: 1441071 - DNA, 16 bp, Homo sapiens
gctttttaatagcact

SEQ ID NO: 1441072 - DNA, 15 bp, Homo sapiens
gctttttctgccact

SEQ ID NO: 1441073 - DNA, 13 bp, Homo sapiens
gctttttggaatc

SEQ ID NO: 1441074 - DNA, 16 bp, Homo sapiens
gctttttgtgtttttt

SEQ ID NO: 1441075 - DNA, 17 bp, Homo sapiens
gctttttgttcagaatt

SEQ ID NO: 1441076 - DNA, 13 bp, Homo sapiens
gctttttttgaaa

SEQ ID NO: 1441077 - DNA, 21 bp, Homo sapiens
gctttttttgaaactttgaga

SEQ ID NO: 1441078 - DNA, 15 bp, Homo sapiens
gcttttttttttcca

SEQ ID NO: 1441079 - DNA, 17 bp, Homo sapiens
gcttttttttttccagc

SEQ ID NO: 1441080 - DNA, 17 bp, Homo sapiens
ggaaaaaataaaaagag

SEQ ID NO: 1441081 - DNA, 13 bp, Homo sapiens
ggaaaaaattgta

SEQ ID NO: 1441082 - DNA, 20 bp, Homo sapiens
ggaaaaaattgtattgaaaa

SEQ ID NO: 1441083 - DNA, 19 bp, Homo sapiens
ggaaaaactttggaaccag

SEQ ID NO: 1441084 - DNA, 20 bp, Homo sapiens
ggaaaaataatcaagatttt

SEQ ID NO: 1441085 - DNA, 15 bp, Homo sapiens
ggaaaaatccagaaa

SEQ ID NO: 1441086 - DNA, 19 bp, Homo sapiens
ggaaaaatgggagccagga

SEQ ID NO: 1441087 - DNA, 13 bp, Homo sapiens
ggaaaaatggttg

SEQ ID NO: 1441088 - DNA, 22 bp, Homo sapiens
ggaaaaccaagccgtggcttcc

SEQ ID NO: 1441089 - DNA, 12 bp, Homo sapiens
ggaaaaccagga

SEQ ID NO: 1441090 - DNA, 20 bp, Homo sapiens
ggaaaactccaccttcccac

SEQ ID NO: 1441091 - DNA, 15 bp, Homo sapiens
ggaaaagaagttgca

SEQ ID NO: 1441092 - DNA, 14 bp, Homo sapiens
ggaaaagaatacag

SEQ ID NO: 1441093 - DNA, 22 bp, Homo sapiens
ggaaaagagcgcatcaggcctg

SEQ ID NO: 1441094 - DNA, 17 bp, Homo sapiens
ggaaaagatccccaaga

SEQ ID NO: 1441095 - DNA, 16 bp, Homo sapiens
ggaaaagcaacttcat

SEQ ID NO: 1441096 - DNA, 22 bp, Homo sapiens
ggaaaagcaacttcatttgaca

SEQ ID NO: 1441097 - DNA, 14 bp, Homo sapiens
ggaaaaggaggagg

SEQ ID NO: 1441098 - DNA, 14 bp, Homo sapiens
ggaaaagggagcta

SEQ ID NO: 1441099 - DNA, 15 bp, Homo sapiens
ggaaaaggttgaata

SEQ ID NO: 1441100 - DNA, 18 bp, Homo sapiens
ggaaaagttaaactaaaa

SEQ ID NO: 1441101 - DNA, 21 bp, Homo sapiens
ggaaaatgagtatttggtcca

SEQ ID NO: 1441102 - DNA, 22 bp, Homo sapiens
ggaaaatgagtatttggtccaa

SEQ ID NO: 1441103 - DNA, 17 bp, Homo sapiens
ggaaaatggccatgcag

SEQ ID NO: 1441104 - DNA, 21 bp, Homo sapiens
ggaaaatggccatgcaggagg

SEQ ID NO: 1441105 - DNA, 17 bp, Homo sapiens
ggaaaatgtattgattc

SEQ ID NO: 1441106 - DNA, 14 bp, Homo sapiens
ggaaaattgcccca

SEQ ID NO: 1441107 - DNA, 13 bp, Homo sapiens
ggaaacaagaaga

SEQ ID NO: 1441108 - DNA, 12 bp, Homo sapiens
ggaaacaatata

SEQ ID NO: 1441109 - DNA, 16 bp, Homo sapiens
ggaaacagcatgaata

SEQ ID NO: 1441110 - DNA, 15 bp, Homo sapiens
ggaaacaggaccaca

SEQ ID NO: 1441111 - DNA, 19 bp, Homo sapiens
ggaaaccacagtcagtgga

SEQ ID NO: 1441112 - DNA, 18 bp, Homo sapiens
ggaaacccacctctctgg

SEQ ID NO: 1441113 - DNA, 21 bp, Homo sapiens
ggaaacccacctctctggaag

SEQ ID NO: 1441114 - DNA, 13 bp, Homo sapiens
ggaaacctgccct

SEQ ID NO: 1441115 - DNA, 17 bp, Homo sapiens
ggaaacctgccctgcct

SEQ ID NO: 1441116 - DNA, 19 bp, Homo sapiens
ggaaacctgccctgcctga

SEQ ID NO: 1441117 - DNA, 20 bp, Homo sapiens
ggaaactgggtttctcatta

SEQ ID NO: 1441118 - DNA, 22 bp, Homo sapiens
ggaaactgggtttctcattaaa

SEQ ID NO: 1441119 - DNA, 11 bp, Homo sapiens
gcttgaagctg

SEQ ID NO: 1441120 - DNA, 16 bp, Homo sapiens
gcttgaaggccctgct

SEQ ID NO: 1441121 - DNA, 20 bp, Homo sapiens
gcttgaaggccctgctgagt

SEQ ID NO: 1441122 - DNA, 14 bp, Homo sapiens
gcttgacataccta

SEQ ID NO: 1441123 - DNA, 21 bp, Homo sapiens
gcttgacatacctaccagtat

SEQ ID NO: 1441124 - DNA, 21 bp, Homo sapiens
gcttgagagccctgaggccta

SEQ ID NO: 1441125 - DNA, 15 bp, Homo sapiens
gcttgagcccaggag

SEQ ID NO: 1441126 - DNA, 20 bp, Homo sapiens
gcttgagcctcccccaaagc

SEQ ID NO: 1441127 - DNA, 13 bp, Homo sapiens
gcttgagctcagg

SEQ ID NO: 1441128 - DNA, 14 bp, Homo sapiens
gcttgagtctcaag

SEQ ID NO: 1441129 - DNA, 22 bp, Homo sapiens
gcttgagtgagaagagcttgca

SEQ ID NO: 1441130 - DNA, 18 bp, Homo sapiens
gcttgataatatataaac

SEQ ID NO: 1441131 - DNA, 20 bp, Homo sapiens
gcttgataatatataaacaa

SEQ ID NO: 1441132 - DNA, 14 bp, Homo sapiens
gcttgcacacttcc

SEQ ID NO: 1441133 - DNA, 15 bp, Homo sapiens
gcttgcacacttccc

SEQ ID NO: 1441134 - DNA, 17 bp, Homo sapiens
gcttgcacacttcccca

SEQ ID NO: 1441135 - DNA, 15 bp, Homo sapiens
gcttgcataataagc

SEQ ID NO: 1441136 - DNA, 14 bp, Homo sapiens
gcttgccaaagtac

SEQ ID NO: 1441137 - DNA, 21 bp, Homo sapiens
gcttgccaaagtacagaattt

SEQ ID NO: 1441138 - DNA, 22 bp, Homo sapiens
gcttgccaaagtacagaatttg

SEQ ID NO: 1441139 - DNA, 19 bp, Homo sapiens
gcttgccagggatgggcag

SEQ ID NO: 1441140 - DNA, 17 bp, Homo sapiens
gcttgccatttttcaaa

SEQ ID NO: 1441141 - DNA, 23 bp, Homo sapiens
gcttgcccagtacatttaaattt

SEQ ID NO: 1441142 - DNA, 12 bp, Homo sapiens
gcttgccccggc

SEQ ID NO: 1441143 - DNA, 14 bp, Homo sapiens
gcttgcctgcaggg

SEQ ID NO: 1441144 - DNA, 17 bp, Homo sapiens
gcttgcctgcagggcca

SEQ ID NO: 1441145 - DNA, 15 bp, Homo sapiens
gcttgctccagggtc

SEQ ID NO: 1441146 - DNA, 12 bp, Homo sapiens
gcttgcttgcag

SEQ ID NO: 1441147 - DNA, 21 bp, Homo sapiens
gcttggaacccggtgctccct

SEQ ID NO: 1441148 - DNA, 23 bp, Homo sapiens
gcttggactacacaatacagtat

SEQ ID NO: 1441149 - DNA, 18 bp, Homo sapiens
gcttggacttcctggggc

SEQ ID NO: 1441150 - DNA, 18 bp, Homo sapiens
gcttggatccatacaaaa

SEQ ID NO: 1441151 - DNA, 19 bp, Homo sapiens
gcttggatcctgggctggg

SEQ ID NO: 1441152 - DNA, 17 bp, Homo sapiens
gcttggattctctgaga

SEQ ID NO: 1441153 - DNA, 13 bp, Homo sapiens
gcttggcagccga

SEQ ID NO: 1441154 - DNA, 17 bp, Homo sapiens
gcttggcccggccggcc

SEQ ID NO: 1441155 - DNA, 22 bp, Homo sapiens
gcttggctcacaaggcccagga

SEQ ID NO: 1441156 - DNA, 20 bp, Homo sapiens
gcttgggaagtcgaggctgc

SEQ ID NO: 1441157 - DNA, 14 bp, Homo sapiens
gcttgggccctgca

SEQ ID NO: 1441158 - DNA, 21 bp, Homo sapiens
gcttgggccctgcacagatat

SEQ ID NO: 1441159 - DNA, 23 bp, Homo sapiens
gcttgggccctgcattggcctgg

SEQ ID NO: 1441160 - DNA, 21 bp, Homo sapiens
gcttgggctgacccagcatct

SEQ ID NO: 1441161 - DNA, 23 bp, Homo sapiens
gcttgggctgacccagcatctcc

SEQ ID NO: 1441162 - DNA, 21 bp, Homo sapiens
gcttggggattgtacacggga

SEQ ID NO: 1441163 - DNA, 20 bp, Homo sapiens
gcttggggccaccaaagctg

SEQ ID NO: 1441164 - DNA, 22 bp, Homo sapiens
gcttggggccaccaaagctgcc

SEQ ID NO: 1441165 - DNA, 16 bp, Homo sapiens
gcttggggctcgggcc

SEQ ID NO: 1441166 - DNA, 16 bp, Homo sapiens
gcttggggcttcctaa

SEQ ID NO: 1441167 - DNA, 24 bp, Homo sapiens
gcttgggggatgactagaggcagg

SEQ ID NO: 1441168 - DNA, 22 bp, Homo sapiens
gcttgggtgtaacaggtctcct

SEQ ID NO: 1441169 - DNA, 16 bp, Homo sapiens
gcttggtggggctcgt

SEQ ID NO: 1441170 - DNA, 18 bp, Homo sapiens
gcttggtggggctcgtgg

SEQ ID NO: 1441171 - DNA, 19 bp, Homo sapiens
gcttggtggggctcgtggc

SEQ ID NO: 1441172 - DNA, 21 bp, Homo sapiens
gcttggtggggctcgtggcct

SEQ ID NO: 1441173 - DNA, 18 bp, Homo sapiens
gcttggtgtcttggcact

SEQ ID NO: 1441174 - DNA, 15 bp, Homo sapiens
gcttggttggctggc

SEQ ID NO: 1441175 - DNA, 14 bp, Homo sapiens
gcttggtttgcaac

SEQ ID NO: 1441176 - DNA, 15 bp, Homo sapiens
gcttgtaacaagaaa

SEQ ID NO: 1441177 - DNA, 21 bp, Homo sapiens
gcttgtacatttttaaattct

SEQ ID NO: 1441178 - DNA, 22 bp, Homo sapiens
gcttgtagaactcactctgggc

SEQ ID NO: 1441179 - DNA, 21 bp, Homo sapiens
gcttgtcactagcagctgcag

SEQ ID NO: 1441180 - DNA, 23 bp, Homo sapiens
gcttgtcatccacacaacaccag

SEQ ID NO: 1441181 - DNA, 18 bp, Homo sapiens
gcttgtcattaccagacg

SEQ ID NO: 1441182 - DNA, 20 bp, Homo sapiens
gcttgtctatactccttccc

SEQ ID NO: 1441183 - DNA, 14 bp, Homo sapiens
gcttgtgacagtgc

SEQ ID NO: 1441184 - DNA, 22 bp, Homo sapiens
gcttgtgacagtgcctcttcca

SEQ ID NO: 1441185 - DNA, 16 bp, Homo sapiens
gcttgtgtcctgtcct

SEQ ID NO: 1441186 - DNA, 23 bp, Homo sapiens
gcttgttaatgctttctgaagct

SEQ ID NO: 1441187 - DNA, 17 bp, Homo sapiens
gcttgttatattaagca

SEQ ID NO: 1441188 - DNA, 22 bp, Homo sapiens
gcttgttgaaaacccagactgt

SEQ ID NO: 1441189 - DNA, 21 bp, Homo sapiens
gcttgttgggattcctgaccc

SEQ ID NO: 1441190 - DNA, 23 bp, Homo sapiens
gcttgttgggattcctgacccag

SEQ ID NO: 1441191 - DNA, 24 bp, Homo sapiens
gcttgttgggattcctgacccagg

SEQ ID NO: 1441192 - DNA, 13 bp, Homo sapiens
gcttgtttacagc

SEQ ID NO: 1441193 - DNA, 20 bp, Homo sapiens
gcttgtttacagcactactc

SEQ ID NO: 1441194 - DNA, 22 bp, Homo sapiens
gcttgtttctatactgtttgta

SEQ ID NO: 1441195 - DNA, 17 bp, Homo sapiens
gcttgtttgatttcaac

SEQ ID NO: 1441196 - DNA, 20 bp, Homo sapiens
gcttgtttgatttcaacatg

SEQ ID NO: 1441197 - DNA, 13 bp, Homo sapiens
gctttaaaacaag

SEQ ID NO: 1441198 - DNA, 19 bp, Homo sapiens
gctttaaaacaagtgtgat

SEQ ID NO: 1441199 - DNA, 13 bp, Homo sapiens
gctttaaatctta

SEQ ID NO: 1441200 - DNA, 14 bp, Homo sapiens
gctttaagccttca

SEQ ID NO: 1441201 - DNA, 21 bp, Homo sapiens
gctttaatgagaatagaaacg

SEQ ID NO: 1441202 - DNA, 18 bp, Homo sapiens
gctttacgctcatcacct

SEQ ID NO: 1441203 - DNA, 13 bp, Homo sapiens
gctttaggcagag

SEQ ID NO: 1441204 - DNA, 16 bp, Homo sapiens
gctttatgcaaataca

SEQ ID NO: 1441205 - DNA, 18 bp, Homo sapiens
gctttatgcaaatacaat

SEQ ID NO: 1441206 - DNA, 21 bp, Homo sapiens
gctttatgggggggagggagg

SEQ ID NO: 1441207 - DNA, 12 bp, Homo sapiens
gctttatgttca

SEQ ID NO: 1441208 - DNA, 13 bp, Homo sapiens
gctttatttttta

SEQ ID NO: 1441209 - DNA, 18 bp, Homo sapiens
gctttcaaagcatttaca

SEQ ID NO: 1441210 - DNA, 23 bp, Homo sapiens
gctttcaaaggagctcgaaggat

SEQ ID NO: 1441211 - DNA, 15 bp, Homo sapiens
gctttcaagtgcctt

SEQ ID NO: 1441212 - DNA, 20 bp, Homo sapiens
gctttcacatttaaatggtt

SEQ ID NO: 1441213 - DNA, 17 bp, Homo sapiens
gctttcactatttcctt

SEQ ID NO: 1441214 - DNA, 16 bp, Homo sapiens
gctttcagagccagtg

SEQ ID NO: 1441215 - DNA, 15 bp, Homo sapiens
gctttcagcaactga

SEQ ID NO: 1441216 - DNA, 21 bp, Homo sapiens
gctttcccacttcccaccctg

SEQ ID NO: 1441217 - DNA, 16 bp, Homo sapiens
gctttcccagaggaca

SEQ ID NO: 1441218 - DNA, 20 bp, Homo sapiens
gctttcccagtcccattcct

SEQ ID NO: 1441219 - DNA, 22 bp, Homo sapiens
gctttccccgggggaggaaggg

SEQ ID NO: 1441220 - DNA, 14 bp, Homo sapiens
gctttcccctgtgg

SEQ ID NO: 1441221 - DNA, 17 bp, Homo sapiens
gctttcccctgtgggga

SEQ ID NO: 1441222 - DNA, 14 bp, Homo sapiens
gctttccctgagga

SEQ ID NO: 1441223 - DNA, 15 bp, Homo sapiens
gctttccctgaggaa

SEQ ID NO: 1441224 - DNA, 17 bp, Homo sapiens
gctttcctacttgcact

SEQ ID NO: 1441225 - DNA, 12 bp, Homo sapiens
gctttcctgaat

SEQ ID NO: 1441226 - DNA, 22 bp, Homo sapiens
gctttcctgaatccaaactaat

SEQ ID NO: 1441227 - DNA, 21 bp, Homo sapiens
gctttctagcaaatatgctgt

SEQ ID NO: 1441228 - DNA, 12 bp, Homo sapiens
gctttctcaatg

SEQ ID NO: 1441229 - DNA, 12 bp, Homo sapiens
gctttctcaggg

SEQ ID NO: 1441230 - DNA, 23 bp, Homo sapiens
gctttctccggggtctgtgctgt

SEQ ID NO: 1441231 - DNA, 23 bp, Homo sapiens
gctttctctccgacttcccctgg

SEQ ID NO: 1441232 - DNA, 15 bp, Homo sapiens
gctttctcttcatat

SEQ ID NO: 1441233 - DNA, 13 bp, Homo sapiens
gctttctcttccc

SEQ ID NO: 1441234 - DNA, 22 bp, Homo sapiens
gcttcctcacacccctgtccca

SEQ ID NO: 1441235 - DNA, 20 bp, Homo sapiens
gcttcctcccaacaagcagc

SEQ ID NO: 1441236 - DNA, 19 bp, Homo sapiens
gcttcctccgtccacccag

SEQ ID NO: 1441237 - DNA, 21 bp, Homo sapiens
gcttcctccgtccacccaggc

SEQ ID NO: 1441238 - DNA, 23 bp, Homo sapiens
gcttcctctagaagccaagggaa

SEQ ID NO: 1441239 - DNA, 14 bp, Homo sapiens
gcttcctcttcttg

SEQ ID NO: 1441240 - DNA, 19 bp, Homo sapiens
gcttcctgcatggtaggga

SEQ ID NO: 1441241 - DNA, 15 bp, Homo sapiens
gcttcctggcctccc

SEQ ID NO: 1441242 - DNA, 14 bp, Homo sapiens
gcttcctgggtcct

SEQ ID NO: 1441243 - DNA, 22 bp, Homo sapiens
gcttcctgggtcctgcctggtc

SEQ ID NO: 1441244 - DNA, 12 bp, Homo sapiens
gcttcctggtgt

SEQ ID NO: 1441245 - DNA, 23 bp, Homo sapiens
gcttccttcagtttgtaaagtcg

SEQ ID NO: 1441246 - DNA, 22 bp, Homo sapiens
gcttccttctgtgaaagtacat

SEQ ID NO: 1441247 - DNA, 23 bp, Homo sapiens
gcttcctttcctgtgtgtactct

SEQ ID NO: 1441248 - DNA, 12 bp, Homo sapiens
gcttcctttctc

SEQ ID NO: 1441249 - DNA, 19 bp, Homo sapiens
gcttcgactactgctcctg

SEQ ID NO: 1441250 - DNA, 21 bp, Homo sapiens
gcttcgactactgctcctgtg

SEQ ID NO: 1441251 - DNA, 24 bp, Homo sapiens
gcttcgactactgctcctgtggca

SEQ ID NO: 1441252 - DNA, 21 bp, Homo sapiens
gcttcgaggcccagcgacctc

SEQ ID NO: 1441253 - DNA, 12 bp, Homo sapiens
gcttcggacagt

SEQ ID NO: 1441254 - DNA, 15 bp, Homo sapiens
gcttcggggcctcct

SEQ ID NO: 1441255 - DNA, 16 bp, Homo sapiens
gcttcgtttattttca

SEQ ID NO: 1441256 - DNA, 13 bp, Homo sapiens
gcttctaaaacaa

SEQ ID NO: 1441257 - DNA, 13 bp, Homo sapiens
gcttctaaagcag

SEQ ID NO: 1441258 - DNA, 17 bp, Homo sapiens
gcttctaccatgaacag

SEQ ID NO: 1441259 - DNA, 14 bp, Homo sapiens
gcttctacctggaa

SEQ ID NO: 1441260 - DNA, 15 bp, Homo sapiens
gcttctactttcatc

SEQ ID NO: 1441261 - DNA, 18 bp, Homo sapiens
gcttctagtttgcaactt

SEQ ID NO: 1441262 - DNA, 12 bp, Homo sapiens
gcttctatccca

SEQ ID NO: 1441263 - DNA, 21 bp, Homo sapiens
gcttctatgtccaacagagtg

SEQ ID NO: 1441264 - DNA, 16 bp, Homo sapiens
gcttctccaagcatca

SEQ ID NO: 1441265 - DNA, 14 bp, Homo sapiens
gcttctccacctcc

SEQ ID NO: 1441266 - DNA, 23 bp, Homo sapiens
gcttctcccagtgtgagacccca

SEQ ID NO: 1441267 - DNA, 14 bp, Homo sapiens
gcttctccgccagc

SEQ ID NO: 1441268 - DNA, 16 bp, Homo sapiens
gcttctccgccagcct

SEQ ID NO: 1441269 - DNA, 17 bp, Homo sapiens
gcttctccgccagcctc

SEQ ID NO: 1441270 - DNA, 20 bp, Homo sapiens
gcttctccgccagcctcctc

SEQ ID NO: 1441271 - DNA, 23 bp, Homo sapiens
gcttctccgccagcctcctctgg

SEQ ID NO: 1441272 - DNA, 24 bp, Homo sapiens
gcttctccgccagcctcctctgga

SEQ ID NO: 1441273 - DNA, 12 bp, Homo sapiens
gcttctcctgac

SEQ ID NO: 1441274 - DNA, 14 bp, Homo sapiens
gcttctcctgaccc

SEQ ID NO: 1441275 - DNA, 16 bp, Homo sapiens
gcttctcctgtgaccc

SEQ ID NO: 1441276 - DNA, 17 bp, Homo sapiens
gcttctctccacagtgt

SEQ ID NO: 1441277 - DNA, 14 bp, Homo sapiens
gcttctctctccag

SEQ ID NO: 1441278 - DNA, 17 bp, Homo sapiens
gcttctctctctctcac

SEQ ID NO: 1441279 - DNA, 15 bp, Homo sapiens
gcttctctcttttcc

SEQ ID NO: 1441280 - DNA, 20 bp, Homo sapiens
gcttctctcttttcctcctc

SEQ ID NO: 1441281 - DNA, 23 bp, Homo sapiens
gcttctcttgggaactccactct

SEQ ID NO: 1441282 - DNA, 22 bp, Homo sapiens
gcttctgaaagcaggatgaatt

SEQ ID NO: 1441283 - DNA, 23 bp, Homo sapiens
gcttctgaactcaagctgcgttt

SEQ ID NO: 1441284 - DNA, 18 bp, Homo sapiens
gcttctgatttttctctt

SEQ ID NO: 1441285 - DNA, 17 bp, Homo sapiens
gcttctgcaccctccac

SEQ ID NO: 1441286 - DNA, 19 bp, Homo sapiens
gcttctgcaccctccaccc

SEQ ID NO: 1441287 - DNA, 15 bp, Homo sapiens
gcttctgctgccctg

SEQ ID NO: 1441288 - DNA, 13 bp, Homo sapiens
gcttctgcttttc

SEQ ID NO: 1441289 - DNA, 19 bp, Homo sapiens
gcttctgcttttctgccct

SEQ ID NO: 1441290 - DNA, 23 bp, Homo sapiens
gcttctgcttttctgccctggct

SEQ ID NO: 1441291 - DNA, 17 bp, Homo sapiens
gcttctggaatttgttc

SEQ ID NO: 1441292 - DNA, 23 bp, Homo sapiens
gcttctggaatttgttcaagttt

SEQ ID NO: 1441293 - DNA, 12 bp, Homo sapiens
gcttctggagcc

SEQ ID NO: 1441294 - DNA, 20 bp, Homo sapiens
gcttctgtagtactccttaa

SEQ ID NO: 1441295 - DNA, 16 bp, Homo sapiens
gcttctgtgatgagct

SEQ ID NO: 1441296 - DNA, 13 bp, Homo sapiens
gcttctgtgtgtg

SEQ ID NO: 1441297 - DNA, 15 bp, Homo sapiens
gcttcttaaagagtt

SEQ ID NO: 1441298 - DNA, 16 bp, Homo sapiens
gcttcttcagatcagt

SEQ ID NO: 1441299 - DNA, 12 bp, Homo sapiens
gcttcttgcctc

SEQ ID NO: 1441300 - DNA, 17 bp, Homo sapiens
gcttcttgcctctgtgc

SEQ ID NO: 1441301 - DNA, 18 bp, Homo sapiens
gcttcttgcctctgtgct

SEQ ID NO: 1441302 - DNA, 20 bp, Homo sapiens
gcttcttgcctctgtgctgt

SEQ ID NO: 1441303 - DNA, 21 bp, Homo sapiens
gcttcttgcctctgtgctgtg

SEQ ID NO: 1441304 - DNA, 14 bp, Homo sapiens
gcttcttggacctt

SEQ ID NO: 1441305 - DNA, 20 bp, Homo sapiens
gcttcttggagctttggaat

SEQ ID NO: 1441306 - DNA, 16 bp, Homo sapiens
gcttcttgtttccttg

SEQ ID NO: 1441307 - DNA, 15 bp, Homo sapiens
gcttctttctagaaa

SEQ ID NO: 1441308 - DNA, 15 bp, Homo sapiens
gcttctttgtaatga

SEQ ID NO: 1441309 - DNA, 23 bp, Homo sapiens
gcttcttttagttgtatctcttt

SEQ ID NO: 1441310 - DNA, 20 bp, Homo sapiens
gcttgaacctgggaggcaga

SEQ ID NO: 1441311 - DNA, 22 bp, Homo sapiens
gcttgaagatcgttagtatcta

SEQ ID NO: 1441312 - DNA, 15 bp, Homo sapiens
gcttgaagccaaaga

SEQ ID NO: 1441313 - DNA, 19 bp, Homo sapiens
gctcgctcgctctcgctct

SEQ ID NO: 1441314 - DNA, 19 bp, Homo sapiens
gctcgctggctttctctct

SEQ ID NO: 1441315 - DNA, 16 bp, Homo sapiens
gctcggacccacccca

SEQ ID NO: 1441316 - DNA, 15 bp, Homo sapiens
gctcggagcaccctt

SEQ ID NO: 1441317 - DNA, 20 bp, Homo sapiens
gctcggagcacccttgcccg

SEQ ID NO: 1441318 - DNA, 16 bp, Homo sapiens
gctcggaggaccctgg

SEQ ID NO: 1441319 - DNA, 18 bp, Homo sapiens
gctcggggggctctgcct

SEQ ID NO: 1441320 - DNA, 20 bp, Homo sapiens
gctcggggggctctgccttc

SEQ ID NO: 1441321 - DNA, 21 bp, Homo sapiens
gctcgtggactgtgctggtgc

SEQ ID NO: 1441322 - DNA, 16 bp, Homo sapiens
gctcgtgtatcctggg

SEQ ID NO: 1441323 - DNA, 17 bp, Homo sapiens
gctcgtgtatcctgggg

SEQ ID NO: 1441324 - DNA, 17 bp, Homo sapiens
gctcgtgtatttattac

SEQ ID NO: 1441325 - DNA, 23 bp, Homo sapiens
gctctaaagtagcaactgctggt

SEQ ID NO: 1441326 - DNA, 20 bp, Homo sapiens
gctctaactggacatgaagg

SEQ ID NO: 1441327 - DNA, 23 bp, Homo sapiens
gctctaactggacatgaaggaaa

SEQ ID NO: 1441328 - DNA, 16 bp, Homo sapiens
gctctaattcacagtg

SEQ ID NO: 1441329 - DNA, 18 bp, Homo sapiens
gctctaattcacagtgct

SEQ ID NO: 1441330 - DNA, 20 bp, Homo sapiens
gctctacagctaatcagcat

SEQ ID NO: 1441331 - DNA, 22 bp, Homo sapiens
gctctacagctaatcagcattc

SEQ ID NO: 1441332 - DNA, 17 bp, Homo sapiens
gctctacatcttctgcc

SEQ ID NO: 1441333 - DNA, 18 bp, Homo sapiens
gctctacatcttctgcct

SEQ ID NO: 1441334 - DNA, 19 bp, Homo sapiens
gctctacatcttctgcctt

SEQ ID NO: 1441335 - DNA, 14 bp, Homo sapiens
gctctaccctgtct

SEQ ID NO: 1441336 - DNA, 17 bp, Homo sapiens
gctctaccctgtctgtc

SEQ ID NO: 1441337 - DNA, 18 bp, Homo sapiens
gctctaccctgtctgtcc

SEQ ID NO: 1441338 - DNA, 20 bp, Homo sapiens
gctctaccctgtctgtccct

SEQ ID NO: 1441339 - DNA, 19 bp, Homo sapiens
gctctactgaggtgctatg

SEQ ID NO: 1441340 - DNA, 18 bp, Homo sapiens
gctctactgccctcccct

SEQ ID NO: 1441341 - DNA, 19 bp, Homo sapiens
gctctactgccctcccctt

SEQ ID NO: 1441342 - DNA, 21 bp, Homo sapiens
gctctactggtcttgtggaat

SEQ ID NO: 1441343 - DNA, 15 bp, Homo sapiens
gctctagattcataa

SEQ ID NO: 1441344 - DNA, 20 bp, Homo sapiens
gctctagccaggagtctgtg

SEQ ID NO: 1441345 - DNA, 13 bp, Homo sapiens
gctctagctggca

SEQ ID NO: 1441346 - DNA, 14 bp, Homo sapiens
gctctagctggcag

SEQ ID NO: 1441347 - DNA, 16 bp, Homo sapiens
gctctagctggcagga

SEQ ID NO: 1441348 - DNA, 19 bp, Homo sapiens
gctctagctggcaggacac

SEQ ID NO: 1441349 - DNA, 22 bp, Homo sapiens
gctctagggactgccaggctgt

SEQ ID NO: 1441350 - DNA, 14 bp, Homo sapiens
gctctagtgggaca

SEQ ID NO: 1441351 - DNA, 20 bp, Homo sapiens
gctctagtgggacagcccag

SEQ ID NO: 1441352 - DNA, 13 bp, Homo sapiens
gctctagttcaaa

SEQ ID NO: 1441353 - DNA, 19 bp, Homo sapiens
gctctagttttcagccttg

SEQ ID NO: 1441354 - DNA, 22 bp, Homo sapiens
gctctagttttcagccttggga

SEQ ID NO: 1441355 - DNA, 16 bp, Homo sapiens
gctctatgtctgcctt

SEQ ID NO: 1441356 - DNA, 13 bp, Homo sapiens
gctctcaatttta

SEQ ID NO: 1441357 - DNA, 16 bp, Homo sapiens
gctctcacccagtccc

SEQ ID NO: 1441358 - DNA, 19 bp, Homo sapiens
gctctcacccagtccccac

SEQ ID NO: 1441359 - DNA, 14 bp, Homo sapiens
gctctcacccccat

SEQ ID NO: 1441360 - DNA, 18 bp, Homo sapiens
gctctcacccccatccct

SEQ ID NO: 1441361 - DNA, 11 bp, Homo sapiens
gctctcagaag

SEQ ID NO: 1441362 - DNA, 22 bp, Homo sapiens
gctctcagcaagtgcccagtgg

SEQ ID NO: 1441363 - DNA, 12 bp, Homo sapiens
gctctcagcctc

SEQ ID NO: 1441364 - DNA, 14 bp, Homo sapiens
gctctcagcctccc

SEQ ID NO: 1441365 - DNA, 21 bp, Homo sapiens
gctctcagcctcccaacccca

SEQ ID NO: 1441366 - DNA, 21 bp, Homo sapiens
gctctccaaaggggctgctgg

SEQ ID NO: 1441367 - DNA, 16 bp, Homo sapiens
gctctccaagtgccag

SEQ ID NO: 1441368 - DNA, 17 bp, Homo sapiens
gctctccaagtgccaga

SEQ ID NO: 1441369 - DNA, 14 bp, Homo sapiens
gctctccacctcag

SEQ ID NO: 1441370 - DNA, 20 bp, Homo sapiens
gctctccacctcagccttgg

SEQ ID NO: 1441371 - DNA, 12 bp, Homo sapiens
gctctccaggcc

SEQ ID NO: 1441372 - DNA, 13 bp, Homo sapiens
gctctccaggcca

SEQ ID NO: 1441373 - DNA, 17 bp, Homo sapiens
gctctccaggccaggtg

SEQ ID NO: 1441374 - DNA, 18 bp, Homo sapiens
gctctccaggccaggtgg

SEQ ID NO: 1441375 - DNA, 13 bp, Homo sapiens
gctctccaggccc

SEQ ID NO: 1441376 - DNA, 16 bp, Homo sapiens
gctctcccctcctgct

SEQ ID NO: 1441377 - DNA, 22 bp, Homo sapiens
gctctccctaccttgcctcctt

SEQ ID NO: 1441378 - DNA, 15 bp, Homo sapiens
gcccagggggcctgg

SEQ ID NO: 1441379 - DNA, 17 bp, Homo sapiens
gcccagggggcctggag

SEQ ID NO: 1441380 - DNA, 17 bp, Homo sapiens
gcccaggggtgccccct

SEQ ID NO: 1441381 - DNA, 19 bp, Homo sapiens
gcccaggggtgccccctcc

SEQ ID NO: 1441382 - DNA, 15 bp, Homo sapiens
gcccagggtcctgtg

SEQ ID NO: 1441383 - DNA, 17 bp, Homo sapiens
gcccagggtcctgtgcc

SEQ ID NO: 1441384 - DNA, 19 bp, Homo sapiens
gcccaggttggagtgcagt

SEQ ID NO: 1441385 - DNA, 22 bp, Homo sapiens
gcccagtacatttaaatttttt

SEQ ID NO: 1441386 - DNA, 15 bp, Homo sapiens
gcccagtagaccttg

SEQ ID NO: 1441387 - DNA, 15 bp, Homo sapiens
gcccagtctgttgag

SEQ ID NO: 1441388 - DNA, 12 bp, Homo sapiens
gcccagtgcatg

SEQ ID NO: 1441389 - DNA, 20 bp, Homo sapiens
gcccagtgcatggtggccag

SEQ ID NO: 1441390 - DNA, 16 bp, Homo sapiens
gcccagtgttttcttt

SEQ ID NO: 1441391 - DNA, 22 bp, Homo sapiens
gcccagtgttttctttgaggac

SEQ ID NO: 1441392 - DNA, 20 bp, Homo sapiens
gcccataaggccagaaactc

SEQ ID NO: 1441393 - DNA, 21 bp, Homo sapiens
gcccatacccgtgacagtggc

SEQ ID NO: 1441394 - DNA, 19 bp, Homo sapiens
gcccatacttttggctcct

SEQ ID NO: 1441395 - DNA, 23 bp, Homo sapiens
gcccatacttttggctcctctag

SEQ ID NO: 1441396 - DNA, 23 bp, Homo sapiens
gcccatagaaacatgacactgac

SEQ ID NO: 1441397 - DNA, 22 bp, Homo sapiens
gcccatcacagggttgggccca

SEQ ID NO: 1441398 - DNA, 13 bp, Homo sapiens
gcccatcaggcag

SEQ ID NO: 1441399 - DNA, 15 bp, Homo sapiens
gcccatcaggcagtg

SEQ ID NO: 1441400 - DNA, 14 bp, Homo sapiens
gcccatcccagtcc

SEQ ID NO: 1441401 - DNA, 18 bp, Homo sapiens
gcccatcccagtccctcg

SEQ ID NO: 1441402 - DNA, 14 bp, Homo sapiens
gcccatcctgacca

SEQ ID NO: 1441403 - DNA, 12 bp, Homo sapiens
gcccatccttcc

SEQ ID NO: 1441404 - DNA, 17 bp, Homo sapiens
gcccatcgtgaagaagc

SEQ ID NO: 1441405 - DNA, 17 bp, Homo sapiens
gcccatctcaggtgcca

SEQ ID NO: 1441406 - DNA, 18 bp, Homo sapiens
gcccatctcaggtgccac

SEQ ID NO: 1441407 - DNA, 20 bp, Homo sapiens
gcccatctcaggtgccactc

SEQ ID NO: 1441408 - DNA, 23 bp, Homo sapiens
gcccatctcaggtgccactccct

SEQ ID NO: 1441409 - DNA, 19 bp, Homo sapiens
gcccatgcccacctgccca

SEQ ID NO: 1441410 - DNA, 22 bp, Homo sapiens
gcccatgccctccactccactg

SEQ ID NO: 1441411 - DNA, 21 bp, Homo sapiens
gcccatgctcaaccactgtgg

SEQ ID NO: 1441412 - DNA, 22 bp, Homo sapiens
gcccatgctcaaccactgtggc

SEQ ID NO: 1441413 - DNA, 14 bp, Homo sapiens
gcccatggccccca

SEQ ID NO: 1441414 - DNA, 20 bp, Homo sapiens
gcccatggcccccaataaag

SEQ ID NO: 1441415 - DNA, 21 bp, Homo sapiens
gcccatggttgagaaatgaat

SEQ ID NO: 1441416 - DNA, 20 bp, Homo sapiens
gcccatgtgtacattctgcc

SEQ ID NO: 1441417 - DNA, 21 bp, Homo sapiens
gcccatgtgtacattctgcct

SEQ ID NO: 1441418 - DNA, 21 bp, Homo sapiens
gcccattcgtctgtcccagag

SEQ ID NO: 1441419 - DNA, 23 bp, Homo sapiens
gcccattcgtctgtcccagagct

SEQ ID NO: 1441420 - DNA, 14 bp, Homo sapiens
gcccattctctctc

SEQ ID NO: 1441421 - DNA, 17 bp, Homo sapiens
gcccattctctctcctg

SEQ ID NO: 1441422 - DNA, 19 bp, Homo sapiens
gcccattctctctcctgtc

SEQ ID NO: 1441423 - DNA, 20 bp, Homo sapiens
gcccattctctctcctgtcc

SEQ ID NO: 1441424 - DNA, 17 bp, Homo sapiens
gcccatttgggctctgg

SEQ ID NO: 1441425 - DNA, 18 bp, Homo sapiens
gccccaaacaaatatgca

SEQ ID NO: 1441426 - DNA, 15 bp, Homo sapiens
gccccaacctcccac

SEQ ID NO: 1441427 - DNA, 19 bp, Homo sapiens
gccccaagcagccagccag

SEQ ID NO: 1441428 - DNA, 13 bp, Homo sapiens
gccccaagtcctg

SEQ ID NO: 1441429 - DNA, 16 bp, Homo sapiens
gccccaagtcctgaag

SEQ ID NO: 1441430 - DNA, 20 bp, Homo sapiens
gccccacacggaggcatctg

SEQ ID NO: 1441431 - DNA, 21 bp, Homo sapiens
gccccacagggcaaggacaca

SEQ ID NO: 1441432 - DNA, 14 bp, Homo sapiens
gccccaccacctag

SEQ ID NO: 1441433 - DNA, 18 bp, Homo sapiens
gccccaccacctaggcca

SEQ ID NO: 1441434 - DNA, 23 bp, Homo sapiens
gccccaccacctaggccactcct

SEQ ID NO: 1441435 - DNA, 12 bp, Homo sapiens
gccccacccagg

SEQ ID NO: 1441436 - DNA, 20 bp, Homo sapiens
gccccacccctaagtgccca

SEQ ID NO: 1441437 - DNA, 16 bp, Homo sapiens
gccccaccctgggccc

SEQ ID NO: 1441438 - DNA, 22 bp, Homo sapiens
gccccaccctgggccctgggct

SEQ ID NO: 1441439 - DNA, 24 bp, Homo sapiens
gccccaccctgggccctgggctgg

SEQ ID NO: 1441440 - DNA, 19 bp, Homo sapiens
gccgtaccccaccctcagc

SEQ ID NO: 1441441 - DNA, 22 bp, Homo sapiens
gccgtaccccaccctcagcacc

SEQ ID NO: 1441442 - DNA, 20 bp, Homo sapiens
gccgtagggagtacctgctg

SEQ ID NO: 1441443 - DNA, 13 bp, Homo sapiens
gccgtaggggctc

SEQ ID NO: 1441444 - DNA, 15 bp, Homo sapiens
gccgtaggggctcct

SEQ ID NO: 1441445 - DNA, 18 bp, Homo sapiens
gccgtagggtggcactgg

SEQ ID NO: 1441446 - DNA, 20 bp, Homo sapiens
gccgtagggtggcactggga

SEQ ID NO: 1441447 - DNA, 14 bp, Homo sapiens
gccgtccatggcac

SEQ ID NO: 1441448 - DNA, 23 bp, Homo sapiens
gccgtccatggcaccagccccct

SEQ ID NO: 1441449 - DNA, 14 bp, Homo sapiens
gccgtcccaggcca

SEQ ID NO: 1441450 - DNA, 16 bp, Homo sapiens
gccgtcccaggccacc

SEQ ID NO: 1441451 - DNA, 20 bp, Homo sapiens
gccgtcccaggccaccccca

SEQ ID NO: 1441452 - DNA, 12 bp, Homo sapiens
gccgtccctccc

SEQ ID NO: 1441453 - DNA, 14 bp, Homo sapiens
gccgtccctcccag

SEQ ID NO: 1441454 - DNA, 14 bp, Homo sapiens
gccgtcctcccggg

SEQ ID NO: 1441455 - DNA, 14 bp, Homo sapiens
gccgtctcctccct

SEQ ID NO: 1441456 - DNA, 17 bp, Homo sapiens
gccgtctgactccagag

SEQ ID NO: 1441457 - DNA, 18 bp, Homo sapiens
gccgtctgactccagagt

SEQ ID NO: 1441458 - DNA, 13 bp, Homo sapiens
gccgtgacctatt

SEQ ID NO: 1441459 - DNA, 14 bp, Homo sapiens
gccgtgccttcagc

SEQ ID NO: 1441460 - DNA, 15 bp, Homo sapiens
gccgtgccttcagct

SEQ ID NO: 1441461 - DNA, 21 bp, Homo sapiens
gccgtggattgcacgtggcct

SEQ ID NO: 1441462 - DNA, 15 bp, Homo sapiens
gccgtggcttcccgc

SEQ ID NO: 1441463 - DNA, 12 bp, Homo sapiens
gccgtggcttgg

SEQ ID NO: 1441464 - DNA, 13 bp, Homo sapiens
gccgtggcttggg

SEQ ID NO: 1441465 - DNA, 21 bp, Homo sapiens
gccgtggtccaaccaggagct

SEQ ID NO: 1441466 - DNA, 14 bp, Homo sapiens
gccgtggtccctga

SEQ ID NO: 1441467 - DNA, 15 bp, Homo sapiens
gccgtggtccctgag

SEQ ID NO: 1441468 - DNA, 22 bp, Homo sapiens
gccgtgtcccgcggtgctgact

SEQ ID NO: 1441469 - DNA, 14 bp, Homo sapiens
gccgttactctcca

SEQ ID NO: 1441470 - DNA, 20 bp, Homo sapiens
gccgttactctccaacctgg

SEQ ID NO: 1441471 - DNA, 15 bp, Homo sapiens
gccgttcagcctgtc

SEQ ID NO: 1441472 - DNA, 21 bp, Homo sapiens
gccgttctgttccaacctcct

SEQ ID NO: 1441473 - DNA, 22 bp, Homo sapiens
gccgttctgttccaacctcctg

SEQ ID NO: 1441474 - DNA, 18 bp, Homo sapiens
gccgttgaagaggaaggg

SEQ ID NO: 1441475 - DNA, 13 bp, Homo sapiens
gccgttgtttact

SEQ ID NO: 1441476 - DNA, 14 bp, Homo sapiens
gcctaaaaatgcaa

SEQ ID NO: 1441477 - DNA, 17 bp, Homo sapiens
gcctaaaaatgcaactt

SEQ ID NO: 1441478 - DNA, 20 bp, Homo sapiens
gcctaaaattgtatgaaaat

SEQ ID NO: 1441479 - DNA, 13 bp, Homo sapiens
gcctaaagggcag

SEQ ID NO: 1441480 - DNA, 18 bp, Homo sapiens
gcctaaattaaattgggc

SEQ ID NO: 1441481 - DNA, 20 bp, Homo sapiens
gcctaaattaaattgggctt

SEQ ID NO: 1441482 - DNA, 18 bp, Homo sapiens
gcctaaatttaatgctgc

SEQ ID NO: 1441483 - DNA, 19 bp, Homo sapiens
gcctaaatttaatgctgcc

SEQ ID NO: 1441484 - DNA, 20 bp, Homo sapiens
gcctaagacatgtgaggagg

SEQ ID NO: 1441485 - DNA, 12 bp, Homo sapiens
gcctaaggccct

SEQ ID NO: 1441486 - DNA, 16 bp, Homo sapiens
gcctaagtggctgctg

SEQ ID NO: 1441487 - DNA, 23 bp, Homo sapiens
gcctaatccctgggcattgcttt

SEQ ID NO: 1441488 - DNA, 21 bp, Homo sapiens
gcctacaaaacctcaaaccag

SEQ ID NO: 1441489 - DNA, 17 bp, Homo sapiens
gcctacaataaaaagaa

SEQ ID NO: 1441490 - DNA, 17 bp, Homo sapiens
gcctacacacacagcct

SEQ ID NO: 1441491 - DNA, 21 bp, Homo sapiens
gcctacagaacttcagaaaga

SEQ ID NO: 1441492 - DNA, 14 bp, Homo sapiens
gcctacagatgaac

SEQ ID NO: 1441493 - DNA, 18 bp, Homo sapiens
gcctacattttagtttct

SEQ ID NO: 1441494 - DNA, 20 bp, Homo sapiens
gcctacattttagtttctaa

SEQ ID NO: 1441495 - DNA, 14 bp, Homo sapiens
gcctaccccctgaa

SEQ ID NO: 1441496 - DNA, 15 bp, Homo sapiens
gcctaccccctgaaa

SEQ ID NO: 1441497 - DNA, 17 bp, Homo sapiens
gcctaccccgcagacac

SEQ ID NO: 1441498 - DNA, 14 bp, Homo sapiens
gcctacctgtatgt

SEQ ID NO: 1441499 - DNA, 18 bp, Homo sapiens
gcctactggacgctgccc

SEQ ID NO: 1441500 - DNA, 15 bp, Homo sapiens
gcctactgtccctct

SEQ ID NO: 1441501 - DNA, 21 bp, Homo sapiens
gcctactgtccctctcagtgc

SEQ ID NO: 1441502 - DNA, 14 bp, Homo sapiens
gcctagaccagcag

SEQ ID NO: 1441503 - DNA, 16 bp, Homo sapiens
gcctagaccagcagac

SEQ ID NO: 1441504 - DNA, 14 bp, Homo sapiens
gcctagagtgtagc

SEQ ID NO: 1441505 - DNA, 15 bp, Homo sapiens
gcctagagtgtagcc

SEQ ID NO: 1441506 - DNA, 13 bp, Homo sapiens
gcctagcaggcac

SEQ ID NO: 1441507 - DNA, 19 bp, Homo sapiens
gcctagccacctcccaccc

SEQ ID NO: 1441508 - DNA, 15 bp, Homo sapiens
gcctagccgacctca

SEQ ID NO: 1441509 - DNA, 21 bp, Homo sapiens
gcctagcgatctctcctggcc

SEQ ID NO: 1441510 - DNA, 20 bp, Homo sapiens
gcctagcggagcccagcctg

SEQ ID NO: 1441511 - DNA, 17 bp, Homo sapiens
gcctaggaattcccagc

SEQ ID NO: 1441512 - DNA, 14 bp, Homo sapiens
gcctaggagctggc

SEQ ID NO: 1441513 - DNA, 15 bp, Homo sapiens
gcctaggagctggct

SEQ ID NO: 1441514 - DNA, 21 bp, Homo sapiens
gcctaggagctggctggcagg

SEQ ID NO: 1441515 - DNA, 17 bp, Homo sapiens
gcctaggaggctggcca

SEQ ID NO: 1441516 - DNA, 18 bp, Homo sapiens
gcctaggaggctggccaa

SEQ ID NO: 1441517 - DNA, 13 bp, Homo sapiens
gcctaggattcta

SEQ ID NO: 1441518 - DNA, 15 bp, Homo sapiens
gcctaggattctaaa

SEQ ID NO: 1441519 - DNA, 12 bp, Homo sapiens
gcctaggcacct

SEQ ID NO: 1441520 - DNA, 14 bp, Homo sapiens
gcctaggcacctcc

SEQ ID NO: 1441521 - DNA, 15 bp, Homo sapiens
gcctaggcacctccc

SEQ ID NO: 1441522 - DNA, 20 bp, Homo sapiens
gcctagggagccgcaccttg

SEQ ID NO: 1441523 - DNA, 22 bp, Homo sapiens
gcctagtggggtctccctctcc

SEQ ID NO: 1441524 - DNA, 21 bp, Homo sapiens
gcctagttcatccaatcctca

SEQ ID NO: 1441525 - DNA, 22 bp, Homo sapiens
gcctagttcctgtggccaggag

SEQ ID NO: 1441526 - DNA, 19 bp, Homo sapiens
gcctataaaattaaatgcc

SEQ ID NO: 1441527 - DNA, 15 bp, Homo sapiens
gcctatatctgagag

SEQ ID NO: 1441528 - DNA, 18 bp, Homo sapiens
gcctatgatcccagcact

SEQ ID NO: 1441529 - DNA, 20 bp, Homo sapiens
gcctatgcacatatggactc

SEQ ID NO: 1441530 - DNA, 22 bp, Homo sapiens
gcctatgcacatatggactctg

SEQ ID NO: 1441531 - DNA, 23 bp, Homo sapiens
gcctatgcacatatggactctgc

SEQ ID NO: 1441532 - DNA, 16 bp, Homo sapiens
gcctatggcagaaaaa

SEQ ID NO: 1441533 - DNA, 21 bp, Homo sapiens
gcctattatctgtcagctgca

SEQ ID NO: 1441534 - DNA, 13 bp, Homo sapiens
gcctatttgtgtg

SEQ ID NO: 1441535 - DNA, 20 bp, Homo sapiens
gcctcaaaacgggtcagtat

SEQ ID NO: 1441536 - DNA, 15 bp, Homo sapiens
gcctcaaaggcccgc

SEQ ID NO: 1441537 - DNA, 20 bp, Homo sapiens
gcctcaaggttttaggttct

SEQ ID NO: 1441538 - DNA, 14 bp, Homo sapiens
gcctcaatgccagt

SEQ ID NO: 1441539 - DNA, 22 bp, Homo sapiens
gcctcaatgtgaatcagaccct

SEQ ID NO: 1441540 - DNA, 13 bp, Homo sapiens
gcctcacagaaga

SEQ ID NO: 1441541 - DNA, 15 bp, Homo sapiens
gcctcacccacccct

SEQ ID NO: 1441542 - DNA, 19 bp, Homo sapiens
gcctcacccacccctgcac

SEQ ID NO: 1441543 - DNA, 22 bp, Homo sapiens
gcctcacggggttggctgttcc

SEQ ID NO: 1441544 - DNA, 20 bp, Homo sapiens
gcctcacgtatttcacagag

SEQ ID NO: 1441545 - DNA, 22 bp, Homo sapiens
gcctcacgtatttcacagagca

SEQ ID NO: 1441546 - DNA, 19 bp, Homo sapiens
gcctcactaatttttgtat

SEQ ID NO: 1441547 - DNA, 12 bp, Homo sapiens
gcctcactgaaa

SEQ ID NO: 1441548 - DNA, 21 bp, Homo sapiens
gctaaactgtgaaaaatcaga

SEQ ID NO: 1441549 - DNA, 22 bp, Homo sapiens
gctaaagagcccttgcctcccc

SEQ ID NO: 1441550 - DNA, 21 bp, Homo sapiens
gctaaagcactttgcacttaa

SEQ ID NO: 1441551 - DNA, 18 bp, Homo sapiens
gctaaagccaaccagcct

SEQ ID NO: 1441552 - DNA, 13 bp, Homo sapiens
gctaaataaacat

SEQ ID NO: 1441553 - DNA, 18 bp, Homo sapiens
gctaaattttgttactga

SEQ ID NO: 1441554 - DNA, 20 bp, Homo sapiens
gctaacatggtgaaaccccg

SEQ ID NO: 1441555 - DNA, 22 bp, Homo sapiens
gctaaccccaagctgcctctgg

SEQ ID NO: 1441556 - DNA, 19 bp, Homo sapiens
gctaacctgttacactggg

SEQ ID NO: 1441557 - DNA, 22 bp, Homo sapiens
gctaacctgttacactgggctg

SEQ ID NO: 1441558 - DNA, 15 bp, Homo sapiens
gctaactccgagagc

SEQ ID NO: 1441559 - DNA, 13 bp, Homo sapiens
gctaactggttaa

SEQ ID NO: 1441560 - DNA, 14 bp, Homo sapiens
gctaactgtaaatc

SEQ ID NO: 1441561 - DNA, 18 bp, Homo sapiens
gctaacttggagccccag

SEQ ID NO: 1441562 - DNA, 20 bp, Homo sapiens
gctaacttggagccccagtg

SEQ ID NO: 1441563 - DNA, 16 bp, Homo sapiens
gctaagaacctggaac

SEQ ID NO: 1441564 - DNA, 17 bp, Homo sapiens
gctaagaccctgtgtcc

SEQ ID NO: 1441565 - DNA, 18 bp, Homo sapiens
gctaagagctagcgctgc

SEQ ID NO: 1441566 - DNA, 22 bp, Homo sapiens
gctaagatagaaagctggactg

SEQ ID NO: 1441567 - DNA, 20 bp, Homo sapiens
gctaagctcacgtcctgaga

SEQ ID NO: 1441568 - DNA, 17 bp, Homo sapiens
gctaaggttctaaggcc

SEQ ID NO: 1441569 - DNA, 13 bp, Homo sapiens
gctaagtgaaaag

SEQ ID NO: 1441570 - DNA, 13 bp, Homo sapiens
gctaagttctaag

SEQ ID NO: 1441571 - DNA, 22 bp, Homo sapiens
gctaagttctaagttcatgttt

SEQ ID NO: 1441572 - DNA, 11 bp, Homo sapiens
gctaataaacc

SEQ ID NO: 1441573 - DNA, 15 bp, Homo sapiens
gctaataaactgtat

SEQ ID NO: 1441574 - DNA, 20 bp, Homo sapiens
gctaataaactgtattaaat

SEQ ID NO: 1441575 - DNA, 21 bp, Homo sapiens
gctaatacctcttactttgct

SEQ ID NO: 1441576 - DNA, 20 bp, Homo sapiens
gctaatatcaatagaaggat

SEQ ID NO: 1441577 - DNA, 14 bp, Homo sapiens
gctaatcaaaactt

SEQ ID NO: 1441578 - DNA, 23 bp, Homo sapiens
gctaatcatgtgggtgagccagt

SEQ ID NO: 1441579 - DNA, 19 bp, Homo sapiens
gctaatctgtagggctgga

SEQ ID NO: 1441580 - DNA, 20 bp, Homo sapiens
gctaatctgtagggctggac

SEQ ID NO: 1441581 - DNA, 15 bp, Homo sapiens
gctaatgtaatcatt

SEQ ID NO: 1441582 - DNA, 17 bp, Homo sapiens
gctaattcaaggaattt

SEQ ID NO: 1441583 - DNA, 22 bp, Homo sapiens
gctaattctttgacctgttggg

SEQ ID NO: 1441584 - DNA, 13 bp, Homo sapiens
gctaattctttgc

SEQ ID NO: 1441585 - DNA, 15 bp, Homo sapiens
gctaattctttgcaa

SEQ ID NO: 1441586 - DNA, 17 bp, Homo sapiens
gctaattctttgcaaaa

SEQ ID NO: 1441587 - DNA, 18 bp, Homo sapiens
gctaattgagaccacagg

SEQ ID NO: 1441588 - DNA, 11 bp, Homo sapiens
gctaattgtgt

SEQ ID NO: 1441589 - DNA, 19 bp, Homo sapiens
gctaattgtgtatatgttg

SEQ ID NO: 1441590 - DNA, 17 bp, Homo sapiens
gctacaaaaacacagca

SEQ ID NO: 1441591 - DNA, 19 bp, Homo sapiens
gctacaaatttatgcattt

SEQ ID NO: 1441592 - DNA, 19 bp, Homo sapiens
gctacaaccctaccctggc

SEQ ID NO: 1441593 - DNA, 17 bp, Homo sapiens
gctacagcaatttctaa

SEQ ID NO: 1441594 - DNA, 21 bp, Homo sapiens
gctacaggaagcaccccatgc

SEQ ID NO: 1441595 - DNA, 22 bp, Homo sapiens
gctacaggaagcaccccatgcc

SEQ ID NO: 1441596 - DNA, 23 bp, Homo sapiens
gctacaggggaaggtggcctctg

SEQ ID NO: 1441597 - DNA, 16 bp, Homo sapiens
gctacatcagactcta

SEQ ID NO: 1441598 - DNA, 22 bp, Homo sapiens
gctacatcagactctagaaaaa

SEQ ID NO: 1441599 - DNA, 16 bp, Homo sapiens
gctacatgctggggtc

SEQ ID NO: 1441600 - DNA, 18 bp, Homo sapiens
gctacattcacacactca

SEQ ID NO: 1441601 - DNA, 11 bp, Homo sapiens
gctacattcct

SEQ ID NO: 1441602 - DNA, 22 bp, Homo sapiens
gctaccaagtcagacaccaagg

SEQ ID NO: 1441603 - DNA, 13 bp, Homo sapiens
gctaccacagact

SEQ ID NO: 1441604 - DNA, 13 bp, Homo sapiens
gctaccactggta

SEQ ID NO: 1441605 - DNA, 22 bp, Homo sapiens
gctaccagcgccaaatgttcat

SEQ ID NO: 1441606 - DNA, 16 bp, Homo sapiens
gctaccaggatgctaa

SEQ ID NO: 1441607 - DNA, 21 bp, Homo sapiens
gctaccagtatttagaagcca

SEQ ID NO: 1441608 - DNA, 22 bp, Homo sapiens
gctaccagtatttagaagccaa

SEQ ID NO: 1441609 - DNA, 11 bp, Homo sapiens
gctaccatctg

SEQ ID NO: 1441610 - DNA, 13 bp, Homo sapiens
gctaccatctgca

SEQ ID NO: 1441611 - DNA, 14 bp, Homo sapiens
gctaccatctgcat

SEQ ID NO: 1441612 - DNA, 16 bp, Homo sapiens
gctaccctcagcctcc

SEQ ID NO: 1441613 - DNA, 16 bp, Homo sapiens
gctaccctttttctcc

SEQ ID NO: 1441614 - DNA, 19 bp, Homo sapiens
gctaccgtggatctccttc

SEQ ID NO: 1441615 - DNA, 21 bp, Homo sapiens
gctaccgtggatctccttccc

SEQ ID NO: 1441616 - DNA, 21 bp, Homo sapiens
gctacctaaaaaaagatgttt

SEQ ID NO: 1441617 - DNA, 15 bp, Homo sapiens
gctacctcacctggg

SEQ ID NO: 1441618 - DNA, 15 bp, Homo sapiens
gctacctctctgtcc

SEQ ID NO: 1441619 - DNA, 21 bp, Homo sapiens
gctacctctctgtcccttgct

SEQ ID NO: 1441620 - DNA, 20 bp, Homo sapiens
gctacctgctcagccctgca

SEQ ID NO: 1441621 - DNA, 17 bp, Homo sapiens
gctacgcctcttctgtc

SEQ ID NO: 1441622 - DNA, 16 bp, Homo sapiens
gctactaatgatgttt

SEQ ID NO: 1441623 - DNA, 18 bp, Homo sapiens
gctactaatgatgttttc

SEQ ID NO: 1441624 - DNA, 19 bp, Homo sapiens
gctactacccgagcccagc

SEQ ID NO: 1441625 - DNA, 16 bp, Homo sapiens
gctactataaagagaa

SEQ ID NO: 1441626 - DNA, 17 bp, Homo sapiens
gctactcaagaggctga

SEQ ID NO: 1441627 - DNA, 21 bp, Homo sapiens
gctactcaagaggctgaggca

SEQ ID NO: 1441628 - DNA, 14 bp, Homo sapiens
gctcacactgagaa

SEQ ID NO: 1441629 - DNA, 13 bp, Homo sapiens
gctcacagttcct

SEQ ID NO: 1441630 - DNA, 16 bp, Homo sapiens
gctcacagttcctcgc

SEQ ID NO: 1441631 - DNA, 19 bp, Homo sapiens
gctcacagttcctcgccct

SEQ ID NO: 1441632 - DNA, 13 bp, Homo sapiens
gctcaccaggcct

SEQ ID NO: 1441633 - DNA, 17 bp, Homo sapiens
gctcaccaggcctggcc

SEQ ID NO: 1441634 - DNA, 19 bp, Homo sapiens
gctcaccaggcctggcctc

SEQ ID NO: 1441635 - DNA, 15 bp, Homo sapiens
gctcaccctgcccgc

SEQ ID NO: 1441636 - DNA, 18 bp, Homo sapiens
gctcaccctgcccgctcc

SEQ ID NO: 1441637 - DNA, 20 bp, Homo sapiens
gctcaccctgcccgctccca

SEQ ID NO: 1441638 - DNA, 15 bp, Homo sapiens
gctcacctcagagca

SEQ ID NO: 1441639 - DNA, 20 bp, Homo sapiens
gctcacctcagagcagggcc

SEQ ID NO: 1441640 - DNA, 12 bp, Homo sapiens
gctcacctctgc

SEQ ID NO: 1441641 - DNA, 13 bp, Homo sapiens
gctcacctgcagc

SEQ ID NO: 1441642 - DNA, 17 bp, Homo sapiens
gctcacctgcagcccct

SEQ ID NO: 1441643 - DNA, 19 bp, Homo sapiens
gctcacctgcagcccctcc

SEQ ID NO: 1441644 - DNA, 20 bp, Homo sapiens
gctcacctgtgtgcccagca

SEQ ID NO: 1441645 - DNA, 22 bp, Homo sapiens
gctcacgctcccccgcagtccc

SEQ ID NO: 1441646 - DNA, 23 bp, Homo sapiens
gctcacgctcccccgcagtcccc

SEQ ID NO: 1441647 - DNA, 15 bp, Homo sapiens
gctcacgtctctgcc

SEQ ID NO: 1441648 - DNA, 18 bp, Homo sapiens
gctcacgtctctgccgcc

SEQ ID NO: 1441649 - DNA, 21 bp, Homo sapiens
gctcacgtctctgccgcctgc

SEQ ID NO: 1441650 - DNA, 12 bp, Homo sapiens
gctcactactga

SEQ ID NO: 1441651 - DNA, 14 bp, Homo sapiens
gctcactactgaac

SEQ ID NO: 1441652 - DNA, 22 bp, Homo sapiens
gctcactcccaagggacagcaa

SEQ ID NO: 1441653 - DNA, 20 bp, Homo sapiens
gctcactgcaagctctgcct

SEQ ID NO: 1441654 - DNA, 16 bp, Homo sapiens
gctcactgcagcctcc

SEQ ID NO: 1441655 - DNA, 21 bp, Homo sapiens
gctcactgccaggccagcctc

SEQ ID NO: 1441656 - DNA, 24 bp, Homo sapiens
gctcacttctaataactgcagtgt

SEQ ID NO: 1441657 - DNA, 23 bp, Homo sapiens
gctcacttttcatccttccccaa

SEQ ID NO: 1441658 - DNA, 20 bp, Homo sapiens
gctcagaacaccccgctctg

SEQ ID NO: 1441659 - DNA, 23 bp, Homo sapiens
gctcagaacaccccgctctggca

SEQ ID NO: 1441660 - DNA, 15 bp, Homo sapiens
gctcagaagtgacca

SEQ ID NO: 1441661 - DNA, 21 bp, Homo sapiens
gctcagacatgttttccgtga

SEQ ID NO: 1441662 - DNA, 14 bp, Homo sapiens
gctcagacattttc

SEQ ID NO: 1441663 - DNA, 15 bp, Homo sapiens
gctcagacccccact

SEQ ID NO: 1441664 - DNA, 16 bp, Homo sapiens
gctcagacggcggcca

SEQ ID NO: 1441665 - DNA, 17 bp, Homo sapiens
gctcagacggcggccag

SEQ ID NO: 1441666 - DNA, 20 bp, Homo sapiens
gctcagacggcggccaggca

SEQ ID NO: 1441667 - DNA, 17 bp, Homo sapiens
gctcagacttgccaggc

SEQ ID NO: 1441668 - DNA, 22 bp, Homo sapiens
gctcagacttgccaggctccct

SEQ ID NO: 1441669 - DNA, 15 bp, Homo sapiens
gctcagagctaggcc

SEQ ID NO: 1441670 - DNA, 15 bp, Homo sapiens
gctcagaggcccagg

SEQ ID NO: 1441671 - DNA, 19 bp, Homo sapiens
gctcagcaaggggctctgc

SEQ ID NO: 1441672 - DNA, 12 bp, Homo sapiens
gctcagcagcca

SEQ ID NO: 1441673 - DNA, 15 bp, Homo sapiens
gctcagcagccagtc

SEQ ID NO: 1441674 - DNA, 18 bp, Homo sapiens
gctcagcagccagtctca

SEQ ID NO: 1441675 - DNA, 20 bp, Homo sapiens
gctcagcagccagtctcaga

SEQ ID NO: 1441676 - DNA, 23 bp, Homo sapiens
gctcagcagccagtctcagagac

SEQ ID NO: 1441677 - DNA, 17 bp, Homo sapiens
gctcagccaaatttcct

SEQ ID NO: 1441678 - DNA, 15 bp, Homo sapiens
gctcagccacagcct

SEQ ID NO: 1441679 - DNA, 14 bp, Homo sapiens
gctcagccagtggg

SEQ ID NO: 1441680 - DNA, 18 bp, Homo sapiens
gctcagcccgctgagtgg

SEQ ID NO: 1441681 - DNA, 18 bp, Homo sapiens
gctcagcctggtgggcct

SEQ ID NO: 1441682 - DNA, 20 bp, Homo sapiens
gctcagcctggtgggcctcc

SEQ ID NO: 1441683 - DNA, 19 bp, Homo sapiens
gctcagccttctcctccca

SEQ ID NO: 1441684 - DNA, 20 bp, Homo sapiens
gctcagccttgctgctctgc

SEQ ID NO: 1441685 - DNA, 20 bp, Homo sapiens
gctcagctctggtccaggcc

SEQ ID NO: 1441686 - DNA, 12 bp, Homo sapiens
gctcagctgtgg

SEQ ID NO: 1441687 - DNA, 20 bp, Homo sapiens
gctcaggacagatgccacac

SEQ ID NO: 1441688 - DNA, 13 bp, Homo sapiens
gctcaggacccag

SEQ ID NO: 1441689 - DNA, 16 bp, Homo sapiens
gctcaggacccaggcc

SEQ ID NO: 1441690 - DNA, 18 bp, Homo sapiens
gctcaggacccaggccct

SEQ ID NO: 1441691 - DNA, 19 bp, Homo sapiens
gctcaggacccaggccctc

SEQ ID NO: 1441692 - DNA, 16 bp, Homo sapiens
gctcaggcaagcccct

SEQ ID NO: 1441693 - DNA, 20 bp, Homo sapiens
gctcaggcaagcccctcagc

SEQ ID NO: 1441694 - DNA, 23 bp, Homo sapiens
gctcaggcaagcccctcagccct

SEQ ID NO: 1441695 - DNA, 22 bp, Homo sapiens
gctcaggcagacaagagctgct

SEQ ID NO: 1441696 - DNA, 22 bp, Homo sapiens
gctcaggcagcgttagggctgc

SEQ ID NO: 1441697 - DNA, 22 bp, Homo sapiens
gctcaggcgatccacctgtctc

SEQ ID NO: 1441698 - DNA, 14 bp, Homo sapiens
gctcagggctggag

SEQ ID NO: 1441699 - DNA, 13 bp, Homo sapiens
gctcaggggcctg

SEQ ID NO: 1441700 - DNA, 15 bp, Homo sapiens
gctcaggggcctgga

SEQ ID NO: 1441701 - DNA, 23 bp, Homo sapiens
gcctcttgtcttcctatttcaga

SEQ ID NO: 1441702 - DNA, 16 bp, Homo sapiens
gcctcttgttgcagag

SEQ ID NO: 1441703 - DNA, 15 bp, Homo sapiens
gcctgaaaaatggga

SEQ ID NO: 1441704 - DNA, 22 bp, Homo sapiens
gcctgaaagatacaggggatca

SEQ ID NO: 1441705 - DNA, 22 bp, Homo sapiens
gcctgaacactcagttgcaggg

SEQ ID NO: 1441706 - DNA, 14 bp, Homo sapiens
gcctgaacatcctt

SEQ ID NO: 1441707 - DNA, 15 bp, Homo sapiens
gcctgaaccttccat

SEQ ID NO: 1441708 - DNA, 16 bp, Homo sapiens
gcctgaagccagctgc

SEQ ID NO: 1441709 - DNA, 20 bp, Homo sapiens
gcctgaagtcttctcctcca

SEQ ID NO: 1441710 - DNA, 17 bp, Homo sapiens
gcctgaatcatgagcct

SEQ ID NO: 1441711 - DNA, 23 bp, Homo sapiens
gcctgaatcatgagcctgctgga

SEQ ID NO: 1441712 - DNA, 10 bp, Homo sapiens
gcctgaattt

SEQ ID NO: 1441713 - DNA, 17 bp, Homo sapiens
gcctgacaccccctccc

SEQ ID NO: 1441714 - DNA, 21 bp, Homo sapiens
gcctgacaccccctccccgcc

SEQ ID NO: 1441715 - DNA, 15 bp, Homo sapiens
gcctgaccaaacagc

SEQ ID NO: 1441716 - DNA, 21 bp, Homo sapiens
gcctgactaatttttgtattt

SEQ ID NO: 1441717 - DNA, 15 bp, Homo sapiens
gcctgactcctgggt

SEQ ID NO: 1441718 - DNA, 14 bp, Homo sapiens
gcctgactgctcag

SEQ ID NO: 1441719 - DNA, 13 bp, Homo sapiens
gcctgagaatgag

SEQ ID NO: 1441720 - DNA, 16 bp, Homo sapiens
gcctgagaggcaggca

SEQ ID NO: 1441721 - DNA, 19 bp, Homo sapiens
gcctgagaggcaggcatag

SEQ ID NO: 1441722 - DNA, 20 bp, Homo sapiens
gcctgagaggcaggcataga

SEQ ID NO: 1441723 - DNA, 13 bp, Homo sapiens
gcctgagagtatt

SEQ ID NO: 1441724 - DNA, 19 bp, Homo sapiens
gcctgagattctttaagga

SEQ ID NO: 1441725 - DNA, 22 bp, Homo sapiens
gcctgagattctttaaggagat

SEQ ID NO: 1441726 - DNA, 18 bp, Homo sapiens
gcctgagatttcatctgc

SEQ ID NO: 1441727 - DNA, 23 bp, Homo sapiens
gcctgagcgctcctgccgcagag

SEQ ID NO: 1441728 - DNA, 13 bp, Homo sapiens
gcctgagctcctg

SEQ ID NO: 1441729 - DNA, 17 bp, Homo sapiens
gcctgagctcctgctgc

SEQ ID NO: 1441730 - DNA, 19 bp, Homo sapiens
gcctgagctcctgctgcgg

SEQ ID NO: 1441731 - DNA, 15 bp, Homo sapiens
gcctgagctggggaa

SEQ ID NO: 1441732 - DNA, 12 bp, Homo sapiens
gcctgaggagga

SEQ ID NO: 1441733 - DNA, 20 bp, Homo sapiens
gcctgaggatgagctggaag

SEQ ID NO: 1441734 - DNA, 13 bp, Homo sapiens
gcctgaggctgag

SEQ ID NO: 1441735 - DNA, 13 bp, Homo sapiens
gcctgaggctgta

SEQ ID NO: 1441736 - DNA, 15 bp, Homo sapiens
gcctgagggcccctc

SEQ ID NO: 1441737 - DNA, 20 bp, Homo sapiens
gcctgagggcccctctgccc

SEQ ID NO: 1441738 - DNA, 16 bp, Homo sapiens
gcctgagggtccacct

SEQ ID NO: 1441739 - DNA, 16 bp, Homo sapiens
gcctgagtcagtgctc

SEQ ID NO: 1441740 - DNA, 20 bp, Homo sapiens
gcctgagtgacagagcaaga

SEQ ID NO: 1441741 - DNA, 18 bp, Homo sapiens
gcctgagttataaatatt

SEQ ID NO: 1441742 - DNA, 20 bp, Homo sapiens
gcctgagttataaatatttt

SEQ ID NO: 1441743 - DNA, 13 bp, Homo sapiens
gcctgagtttcca

SEQ ID NO: 1441744 - DNA, 14 bp, Homo sapiens
gcctgatactttag

SEQ ID NO: 1441745 - DNA, 21 bp, Homo sapiens
gcctgatccctgaacccctgg

SEQ ID NO: 1441746 - DNA, 22 bp, Homo sapiens
gcctgatccctgaacccctggc

SEQ ID NO: 1441747 - DNA, 16 bp, Homo sapiens
gcctgatcctccaaca

SEQ ID NO: 1441748 - DNA, 15 bp, Homo sapiens
gcctgatcttgcctg

SEQ ID NO: 1441749 - DNA, 19 bp, Homo sapiens
gcctgatgagatttttaaa

SEQ ID NO: 1441750 - DNA, 16 bp, Homo sapiens
gcctgatgctccctcc

SEQ ID NO: 1441751 - DNA, 14 bp, Homo sapiens
gcctgatgctgccc

SEQ ID NO: 1441752 - DNA, 15 bp, Homo sapiens
gcctgatggccaagg

SEQ ID NO: 1441753 - DNA, 16 bp, Homo sapiens
gcctgatggccaaggg

SEQ ID NO: 1441754 - DNA, 19 bp, Homo sapiens
gcctgatggccaagggggt

SEQ ID NO: 1441755 - DNA, 20 bp, Homo sapiens
gcctgattcatagtaaaata

SEQ ID NO: 1441756 - DNA, 18 bp, Homo sapiens
gcctgattcggacggcca

SEQ ID NO: 1441757 - DNA, 21 bp, Homo sapiens
gcctgatttggggtttcttca

SEQ ID NO: 1441758 - DNA, 10 bp, Homo sapiens
gcctgcacac

SEQ ID NO: 1441759 - DNA, 15 bp, Homo sapiens
gcctgcacccttccc

SEQ ID NO: 1441760 - DNA, 15 bp, Homo sapiens
gcctgcacctggtgg

SEQ ID NO: 1441761 - DNA, 22 bp, Homo sapiens
gcctgcactccctggccttgcc

SEQ ID NO: 1441762 - DNA, 19 bp, Homo sapiens
gcctgcactgagagggcaa

SEQ ID NO: 1441763 - DNA, 21 bp, Homo sapiens
gcctgcagaggtctgtgctga

SEQ ID NO: 1441764 - DNA, 13 bp, Homo sapiens
gcctgcagcagga

SEQ ID NO: 1441765 - DNA, 10 bp, Homo sapiens
gcctgcagcc

SEQ ID NO: 1441766 - DNA, 11 bp, Homo sapiens
gcctgcagccc

SEQ ID NO: 1441767 - DNA, 18 bp, Homo sapiens
gcctgcaggctggagact

SEQ ID NO: 1441768 - DNA, 20 bp, Homo sapiens
gcctgcaggctggagactgg

SEQ ID NO: 1441769 - DNA, 15 bp, Homo sapiens
gcctgcagggaagcc

SEQ ID NO: 1441770 - DNA, 14 bp, Homo sapiens
gcctgcagggccat

SEQ ID NO: 1441771 - DNA, 21 bp, Homo sapiens
gcctgcagggccatggctcag

SEQ ID NO: 1441772 - DNA, 20 bp, Homo sapiens
gcctgcaggggcaaggggct

SEQ ID NO: 1441773 - DNA, 13 bp, Homo sapiens
gcctgcatgagct

SEQ ID NO: 1441774 - DNA, 14 bp, Homo sapiens
gcctgcatgagctg

SEQ ID NO: 1441775 - DNA, 14 bp, Homo sapiens
gcctgcatgctgaa

SEQ ID NO: 1441776 - DNA, 20 bp, Homo sapiens
gcctgcatggcatcagacta

SEQ ID NO: 1441777 - DNA, 15 bp, Homo sapiens
gcctgccactctctg

SEQ ID NO: 1441778 - DNA, 16 bp, Homo sapiens
gcctgccactctctgg

SEQ ID NO: 1441779 - DNA, 18 bp, Homo sapiens
gcctgccactctctggga

SEQ ID NO: 1441780 - DNA, 20 bp, Homo sapiens
gcctgccactctctgggact

SEQ ID NO: 1441781 - DNA, 14 bp, Homo sapiens
gcctgccagctgca

SEQ ID NO: 1441782 - DNA, 18 bp, Homo sapiens
gcctgccagctgcactga

SEQ ID NO: 1441783 - DNA, 16 bp, Homo sapiens
gcctgccatcttctcc

SEQ ID NO: 1441784 - DNA, 21 bp, Homo sapiens
gcctgccatgtagttggggca

SEQ ID NO: 1441785 - DNA, 17 bp, Homo sapiens
gcctgcccaatgctttg

SEQ ID NO: 1441786 - DNA, 21 bp, Homo sapiens
gcctgccccgcccccagtccc

SEQ ID NO: 1441787 - DNA, 12 bp, Homo sapiens
gcctgcccctgt

SEQ ID NO: 1441788 - DNA, 20 bp, Homo sapiens
gcctgcccgcaccctggcct

SEQ ID NO: 1441789 - DNA, 21 bp, Homo sapiens
gcctgcccgcaccctggcctg

SEQ ID NO: 1441790 - DNA, 23 bp, Homo sapiens
gcctgcccgcaccctggcctggt

SEQ ID NO: 1441791 - DNA, 20 bp, Homo sapiens
gcctgccctcatggcccctc

SEQ ID NO: 1441792 - DNA, 15 bp, Homo sapiens
gcctgccctcccgca

SEQ ID NO: 1441793 - DNA, 22 bp, Homo sapiens
gcctgccctcccgcaccttcct

SEQ ID NO: 1441794 - DNA, 16 bp, Homo sapiens
gcctgccctctgcccc

SEQ ID NO: 1441795 - DNA, 20 bp, Homo sapiens
gcctgccctctgccccatca

SEQ ID NO: 1441796 - DNA, 21 bp, Homo sapiens
gcctgccgcccccgcctgggc

SEQ ID NO: 1441797 - DNA, 17 bp, Homo sapiens
gcctgccgggctgaggg

SEQ ID NO: 1441798 - DNA, 20 bp, Homo sapiens
gcctgccgggctgagggcct

SEQ ID NO: 1441799 - DNA, 12 bp, Homo sapiens
gcctgccgtgca

SEQ ID NO: 1441800 - DNA, 11 bp, Homo sapiens
gcctgcctcca

SEQ ID NO: 1441801 - DNA, 17 bp, Homo sapiens
gcctgcctccagggctg

SEQ ID NO: 1441802 - DNA, 13 bp, Homo sapiens
gcctgcctcccaa

SEQ ID NO: 1441803 - DNA, 18 bp, Homo sapiens
gcctgcctcccaaggtcc

SEQ ID NO: 1441804 - DNA, 22 bp, Homo sapiens
gcctgcctcccctgcctcacca

SEQ ID NO: 1441805 - DNA, 13 bp, Homo sapiens
gcctgcctcctgg

SEQ ID NO: 1441806 - DNA, 13 bp, Homo sapiens
gcgaccctggggg

SEQ ID NO: 1441807 - DNA, 13 bp, Homo sapiens
gcgaccgccccct

SEQ ID NO: 1441808 - DNA, 10 bp, Homo sapiens
gcgacctcct

SEQ ID NO: 1441809 - DNA, 15 bp, Homo sapiens
gcgaccttggccgca

SEQ ID NO: 1441810 - DNA, 20 bp, Homo sapiens
gcgactgtcatgtggcttgg

SEQ ID NO: 1441811 - DNA, 19 bp, Homo sapiens
gcgacttccacagcagcag

SEQ ID NO: 1441812 - DNA, 14 bp, Homo sapiens
gcgagactccatct

SEQ ID NO: 1441813 - DNA, 15 bp, Homo sapiens
gcgagactccatctc

SEQ ID NO: 1441814 - DNA, 17 bp, Homo sapiens
gcgagagagtttcaaaa

SEQ ID NO: 1441815 - DNA, 14 bp, Homo sapiens
gcgagaggcagcaa

SEQ ID NO: 1441816 - DNA, 21 bp, Homo sapiens
gcgagatcggggtagaaatgc

SEQ ID NO: 1441817 - DNA, 13 bp, Homo sapiens
gcgagcacacaca

SEQ ID NO: 1441818 - DNA, 16 bp, Homo sapiens
gcgagcatgggggctg

SEQ ID NO: 1441819 - DNA, 20 bp, Homo sapiens
gcgagcatgggggctgccag

SEQ ID NO: 1441820 - DNA, 14 bp, Homo sapiens
gcgagccaggcaag

SEQ ID NO: 1441821 - DNA, 16 bp, Homo sapiens
gcgagcggcaaaggcc

SEQ ID NO: 1441822 - DNA, 17 bp, Homo sapiens
gcgaggctcggagcacc

SEQ ID NO: 1441823 - DNA, 14 bp, Homo sapiens
gcgagggcagctgc

SEQ ID NO: 1441824 - DNA, 15 bp, Homo sapiens
gcgagggcagctgct

SEQ ID NO: 1441825 - DNA, 20 bp, Homo sapiens
gcgagggccgcccgctccct

SEQ ID NO: 1441826 - DNA, 13 bp, Homo sapiens
gcgaggggaaagg

SEQ ID NO: 1441827 - DNA, 19 bp, Homo sapiens
gcgaggtcaacagagaagg

SEQ ID NO: 1441828 - DNA, 17 bp, Homo sapiens
gcgagttgtggaaagcc

SEQ ID NO: 1441829 - DNA, 16 bp, Homo sapiens
gcgatccacctgtctc

SEQ ID NO: 1441830 - DNA, 17 bp, Homo sapiens
gcgatccacctgtctca

SEQ ID NO: 1441831 - DNA, 17 bp, Homo sapiens
gccccctcctctcccat

SEQ ID NO: 1441832 - DNA, 21 bp, Homo sapiens
gccccctcctctcccatcccc

SEQ ID NO: 1441833 - DNA, 12 bp, Homo sapiens
gccccctcctga

SEQ ID NO: 1441834 - DNA, 12 bp, Homo sapiens
gccccctctcgg

SEQ ID NO: 1441835 - DNA, 21 bp, Homo sapiens
gccccctctttgtagctccta

SEQ ID NO: 1441836 - DNA, 19 bp, Homo sapiens
gccccctgcacccacccct

SEQ ID NO: 1441837 - DNA, 21 bp, Homo sapiens
gccccctgcacccacccctgc

SEQ ID NO: 1441838 - DNA, 16 bp, Homo sapiens
gccccctggatgtccc

SEQ ID NO: 1441839 - DNA, 23 bp, Homo sapiens
gccccctggtggacagtcctggg

SEQ ID NO: 1441840 - DNA, 14 bp, Homo sapiens
gcccccttgccctc

SEQ ID NO: 1441841 - DNA, 16 bp, Homo sapiens
gcccccttgccctccg

SEQ ID NO: 1441842 - DNA, 18 bp, Homo sapiens
gccccctttcagatgtct

SEQ ID NO: 1441843 - DNA, 23 bp, Homo sapiens
gccccctttcagatgtcttctgc

SEQ ID NO: 1441844 - DNA, 19 bp, Homo sapiens
gccccgagacaccatcctg

SEQ ID NO: 1441845 - DNA, 21 bp, Homo sapiens
gccccgagacaccatcctgag

SEQ ID NO: 1441846 - DNA, 22 bp, Homo sapiens
gccccgagacaccatcctgagc

SEQ ID NO: 1441847 - DNA, 14 bp, Homo sapiens
gccccgccagggct

SEQ ID NO: 1441848 - DNA, 14 bp, Homo sapiens
gccccgcccccacc

SEQ ID NO: 1441849 - DNA, 16 bp, Homo sapiens
gccccgcccccacccc

SEQ ID NO: 1441850 - DNA, 20 bp, Homo sapiens
gccccgcccccacccctaca

SEQ ID NO: 1441851 - DNA, 21 bp, Homo sapiens
gccccgcccccagtccccacc

SEQ ID NO: 1441852 - DNA, 14 bp, Homo sapiens
gccccgcccctccc

SEQ ID NO: 1441853 - DNA, 16 bp, Homo sapiens
gccccgcccctcccac

SEQ ID NO: 1441854 - DNA, 23 bp, Homo sapiens
gccccgcccctcccacgcctcac

SEQ ID NO: 1441855 - DNA, 18 bp, Homo sapiens
gccccgcctgcctgccac

SEQ ID NO: 1441856 - DNA, 13 bp, Homo sapiens
gccccgctgggat

SEQ ID NO: 1441857 - DNA, 16 bp, Homo sapiens
gccccgcttccccaca

SEQ ID NO: 1441858 - DNA, 20 bp, Homo sapiens
gccccgcttccccacagaac

SEQ ID NO: 1441859 - DNA, 19 bp, Homo sapiens
gccccggcaactctggctc

SEQ ID NO: 1441860 - DNA, 13 bp, Homo sapiens
gccccggccccgg

SEQ ID NO: 1441861 - DNA, 19 bp, Homo sapiens
gccccgggctctggccacc

SEQ ID NO: 1441862 - DNA, 20 bp, Homo sapiens
gccccgggctctggccaccc

SEQ ID NO: 1441863 - DNA, 22 bp, Homo sapiens
gccccgggctctggccaccctg

SEQ ID NO: 1441864 - DNA, 19 bp, Homo sapiens
gccccgggctggagaaaga

SEQ ID NO: 1441865 - DNA, 22 bp, Homo sapiens
gccccgggctggagaaagagct

SEQ ID NO: 1441866 - DNA, 17 bp, Homo sapiens
gccccgggcttcccttc

SEQ ID NO: 1441867 - DNA, 17 bp, Homo sapiens
gccccggggctggcaag

SEQ ID NO: 1441868 - DNA, 19 bp, Homo sapiens
gccccggggctggcaagca

SEQ ID NO: 1441869 - DNA, 19 bp, Homo sapiens
gccccgggtccccagctcc

SEQ ID NO: 1441870 - DNA, 16 bp, Homo sapiens
gccccggtgtgcggtg

SEQ ID NO: 1441871 - DNA, 15 bp, Homo sapiens
gcccctaatctctgt

SEQ ID NO: 1441872 - DNA, 18 bp, Homo sapiens
gcccctaccctggacttg

SEQ ID NO: 1441873 - DNA, 17 bp, Homo sapiens
gcccctacgggcgctgc

SEQ ID NO: 1441874 - DNA, 14 bp, Homo sapiens
gcccctactgctgt

SEQ ID NO: 1441875 - DNA, 19 bp, Homo sapiens
gcccctaggatgctgcagc

SEQ ID NO: 1441876 - DNA, 22 bp, Homo sapiens
gcccctaggatgctgcagcaga

SEQ ID NO: 1441877 - DNA, 19 bp, Homo sapiens
gcccctagtgctattctgt

SEQ ID NO: 1441878 - DNA, 18 bp, Homo sapiens
gcccctcaccctgcctta

SEQ ID NO: 1441879 - DNA, 18 bp, Homo sapiens
gcccctcagcccttgccc

SEQ ID NO: 1441880 - DNA, 21 bp, Homo sapiens
gcccctcatctctctgcccaa

SEQ ID NO: 1441881 - DNA, 17 bp, Homo sapiens
gcccctccaaacctcca

SEQ ID NO: 1441882 - DNA, 18 bp, Homo sapiens
gcccctccaaacctccag

SEQ ID NO: 1441883 - DNA, 18 bp, Homo sapiens
gcccctccagaccctgcc

SEQ ID NO: 1441884 - DNA, 23 bp, Homo sapiens
gcccctccagaccctgcctgagc

SEQ ID NO: 1441885 - DNA, 23 bp, Homo sapiens
gcccctcccacacccaaagctga

SEQ ID NO: 1441886 - DNA, 23 bp, Homo sapiens
gcccctcccccaacccccacccc

SEQ ID NO: 1441887 - DNA, 21 bp, Homo sapiens
gcccctccctctgccccaagc

SEQ ID NO: 1441888 - DNA, 12 bp, Homo sapiens
gcccctcccttc

SEQ ID NO: 1441889 - DNA, 17 bp, Homo sapiens
gcccctcctagacccag

SEQ ID NO: 1441890 - DNA, 12 bp, Homo sapiens
gcccctcctctg

SEQ ID NO: 1441891 - DNA, 14 bp, Homo sapiens
gcccctcctctgcc

SEQ ID NO: 1441892 - DNA, 16 bp, Homo sapiens
gcccctcctctgccac

SEQ ID NO: 1441893 - DNA, 18 bp, Homo sapiens
gcccctcctctgccacct

SEQ ID NO: 1441894 - DNA, 21 bp, Homo sapiens
gcccctcctctgccacctccc

SEQ ID NO: 1441895 - DNA, 22 bp, Homo sapiens
gcccctcctctgccacctcccc

SEQ ID NO: 1441896 - DNA, 23 bp, Homo sapiens
gcccctccttctcccctgccggt

SEQ ID NO: 1441897 - DNA, 18 bp, Homo sapiens
gcccctcgaccctgtgca

SEQ ID NO: 1441898 - DNA, 13 bp, Homo sapiens
gcccctcggctct

SEQ ID NO: 1441899 - DNA, 11 bp, Homo sapiens
gcccctctgcc

SEQ ID NO: 1441900 - DNA, 12 bp, Homo sapiens
gcccctctgccc

SEQ ID NO: 1441901 - DNA, 16 bp, Homo sapiens
gcccctctgcccagct

SEQ ID NO: 1441902 - DNA, 21 bp, Homo sapiens
gcccctctgcccagcttgggc

SEQ ID NO: 1441903 - DNA, 17 bp, Homo sapiens
gcccctcttggagaagt

SEQ ID NO: 1441904 - DNA, 23 bp, Homo sapiens
gcccctcttggagaagtctcagc

SEQ ID NO: 1441905 - DNA, 22 bp, Homo sapiens
gcccctgagagtggtgccctgg

SEQ ID NO: 1441906 - DNA, 20 bp, Homo sapiens
gcccctgagcaatgtctgtg

SEQ ID NO: 1441907 - DNA, 23 bp, Homo sapiens
gcccctgagcaatgtctgtgcta

SEQ ID NO: 1441908 - DNA, 15 bp, Homo sapiens
gcccctgaggactgg

SEQ ID NO: 1441909 - DNA, 15 bp, Homo sapiens
gcccctgaggagctt

SEQ ID NO: 1441910 - DNA, 20 bp, Homo sapiens
gcccctgaggagctttgtgt

SEQ ID NO: 1441911 - DNA, 18 bp, Homo sapiens
gcccctgaggcagcccag

SEQ ID NO: 1441912 - DNA, 19 bp, Homo sapiens
gcccctgaggcttcacgcc

SEQ ID NO: 1441913 - DNA, 23 bp, Homo sapiens
gcccctgatgcagcctgtggctt

SEQ ID NO: 1441914 - DNA, 16 bp, Homo sapiens
gcccctgcacaggcac

SEQ ID NO: 1441915 - DNA, 17 bp, Homo sapiens
gcccctgcacaggcaca

SEQ ID NO: 1441916 - DNA, 23 bp, Homo sapiens
gcccctgcagtttggccctggag

SEQ ID NO: 1441917 - DNA, 18 bp, Homo sapiens
gcccctgccacctccctg

SEQ ID NO: 1441918 - DNA, 21 bp, Homo sapiens
gcccctgcgtgggggccagtc

SEQ ID NO: 1441919 - DNA, 13 bp, Homo sapiens
gcccctggcactc

SEQ ID NO: 1441920 - DNA, 11 bp, Homo sapiens
gcccctggccc

SEQ ID NO: 1441921 - DNA, 15 bp, Homo sapiens
gcccctggcccagag

SEQ ID NO: 1441922 - DNA, 16 bp, Homo sapiens
gcccctggcccagcgg

SEQ ID NO: 1441923 - DNA, 23 bp, Homo sapiens
gcccctggcccagcggcccctcc

SEQ ID NO: 1441924 - DNA, 20 bp, Homo sapiens
gcccctggccccgcctgcct

SEQ ID NO: 1441925 - DNA, 22 bp, Homo sapiens
gcccctggccccgcctgcctgc

SEQ ID NO: 1441926 - DNA, 16 bp, Homo sapiens
gcccctggctttgcct

SEQ ID NO: 1441927 - DNA, 18 bp, Homo sapiens
gcccctggctttgcctct

SEQ ID NO: 1441928 - DNA, 19 bp, Homo sapiens
gcccctggctttgcctctt

SEQ ID NO: 1441929 - DNA, 23 bp, Homo sapiens
gcccctgggctaccatctgcatg

SEQ ID NO: 1441930 - DNA, 18 bp, Homo sapiens
gccctcacccctggttct

SEQ ID NO: 1441931 - DNA, 21 bp, Homo sapiens
gccctcacccctggttctcat

SEQ ID NO: 1441932 - DNA, 22 bp, Homo sapiens
gccctcacccctggttctcatc

SEQ ID NO: 1441933 - DNA, 20 bp, Homo sapiens
gccctcacctctgaggacag

SEQ ID NO: 1441934 - DNA, 13 bp, Homo sapiens
gccctcactcaag

SEQ ID NO: 1441935 - DNA, 20 bp, Homo sapiens
gccctcactccctctgcaga

SEQ ID NO: 1441936 - DNA, 16 bp, Homo sapiens
gccctcactcttgaag

SEQ ID NO: 1441937 - DNA, 21 bp, Homo sapiens
gccctcagagctcttgctgtt

SEQ ID NO: 1441938 - DNA, 16 bp, Homo sapiens
gccctcagctcctggg

SEQ ID NO: 1441939 - DNA, 23 bp, Homo sapiens
gccctcagtcagttcccggagca

SEQ ID NO: 1441940 - DNA, 14 bp, Homo sapiens
gccctccacagccg

SEQ ID NO: 1441941 - DNA, 23 bp, Homo sapiens
gccctccacagccgcagcctccc

SEQ ID NO: 1441942 - DNA, 23 bp, Homo sapiens
gccctccactccactgcctttgg

SEQ ID NO: 1441943 - DNA, 20 bp, Homo sapiens
gccctccactccagctctga

SEQ ID NO: 1441944 - DNA, 20 bp, Homo sapiens
gccctccaggcctgcagggg

SEQ ID NO: 1441945 - DNA, 14 bp, Homo sapiens
gccctccatgggct

SEQ ID NO: 1441946 - DNA, 14 bp, Homo sapiens
gccctcccaagtcc

SEQ ID NO: 1441947 - DNA, 17 bp, Homo sapiens
gccctcccacagcctcc

SEQ ID NO: 1441948 - DNA, 15 bp, Homo sapiens
gccctcccagcccat

SEQ ID NO: 1441949 - DNA, 20 bp, Homo sapiens
gccctcccagcccattgctg

SEQ ID NO: 1441950 - DNA, 23 bp, Homo sapiens
gccctcccagcccattgctgcca

SEQ ID NO: 1441951 - DNA, 19 bp, Homo sapiens
gccctccccatggagccag

SEQ ID NO: 1441952 - DNA, 16 bp, Homo sapiens
gccctcccctgctccc

SEQ ID NO: 1441953 - DNA, 17 bp, Homo sapiens
gccctcccctgctccca

SEQ ID NO: 1441954 - DNA, 16 bp, Homo sapiens
gccctcccgcaccttc

SEQ ID NO: 1441955 - DNA, 14 bp, Homo sapiens
gccctccctctccc

SEQ ID NO: 1441956 - DNA, 18 bp, Homo sapiens
gccctccctgtcctcctc

SEQ ID NO: 1441957 - DNA, 18 bp, Homo sapiens
gccctccctgttccccag

SEQ ID NO: 1441958 - DNA, 20 bp, Homo sapiens
gccctccctgttccccagag

SEQ ID NO: 1441959 - DNA, 19 bp, Homo sapiens
gccctcccttggaaacctg

SEQ ID NO: 1441960 - DNA, 22 bp, Homo sapiens
gccctccgaccacttccagggg

SEQ ID NO: 1441961 - DNA, 13 bp, Homo sapiens
gccctccgcctgg

SEQ ID NO: 1441962 - DNA, 21 bp, Homo sapiens
gccctcctcagcgagaggcag

SEQ ID NO: 1441963 - DNA, 14 bp, Homo sapiens
gccctcctcgggcc

SEQ ID NO: 1441964 - DNA, 16 bp, Homo sapiens
gccctcctctgcactc

SEQ ID NO: 1441965 - DNA, 17 bp, Homo sapiens
gccctcgaaccaaggca

SEQ ID NO: 1441966 - DNA, 19 bp, Homo sapiens
gccctcgaaccaaggcagc

SEQ ID NO: 1441967 - DNA, 21 bp, Homo sapiens
gccctcgaaccaaggcagcct

SEQ ID NO: 1441968 - DNA, 23 bp, Homo sapiens
gccctcgaaccaaggcagcctcc

SEQ ID NO: 1441969 - DNA, 16 bp, Homo sapiens
gccctcgcccccgccc

SEQ ID NO: 1441970 - DNA, 16 bp, Homo sapiens
gccctcgctgcttctg

SEQ ID NO: 1441971 - DNA, 20 bp, Homo sapiens
gccctcggaggtccagctgg

SEQ ID NO: 1441972 - DNA, 22 bp, Homo sapiens
gccctcggaggtccagctgggc

SEQ ID NO: 1441973 - DNA, 13 bp, Homo sapiens
gccctcggcctcc

SEQ ID NO: 1441974 - DNA, 17 bp, Homo sapiens
gccctcgtggccagccc

SEQ ID NO: 1441975 - DNA, 20 bp, Homo sapiens
gccctcgtggccagcccggc

SEQ ID NO: 1441976 - DNA, 15 bp, Homo sapiens
gccctctatttatta

SEQ ID NO: 1441977 - DNA, 16 bp, Homo sapiens
gccctctgccccatca

SEQ ID NO: 1441978 - DNA, 14 bp, Homo sapiens
gccctctgcctgca

SEQ ID NO: 1441979 - DNA, 16 bp, Homo sapiens
gccctctgcctgcact

SEQ ID NO: 1441980 - DNA, 18 bp, Homo sapiens
gccctctgcctgcactcc

SEQ ID NO: 1441981 - DNA, 19 bp, Homo sapiens
gccctctgctctgcctgga

SEQ ID NO: 1441982 - DNA, 23 bp, Homo sapiens
gccctctgctctgcctggagtgt

SEQ ID NO: 1441983 - DNA, 14 bp, Homo sapiens
gccctctgctgagc

SEQ ID NO: 1441984 - DNA, 13 bp, Homo sapiens
gccctctgctgct

SEQ ID NO: 1441985 - DNA, 14 bp, Homo sapiens
gccctctgctgctg

SEQ ID NO: 1441986 - DNA, 15 bp, Homo sapiens
gccctctgctgctgc

SEQ ID NO: 1441987 - DNA, 17 bp, Homo sapiens
gccctctgctgctgccc

SEQ ID NO: 1441988 - DNA, 18 bp, Homo sapiens
gccctctgctgctgcccg

SEQ ID NO: 1441989 - DNA, 19 bp, Homo sapiens
gccctctgctgctgcccgg

SEQ ID NO: 1441990 - DNA, 19 bp, Homo sapiens
gccctctgggtccctcctc

SEQ ID NO: 1441991 - DNA, 16 bp, Homo sapiens
gccctcttaagatctg

SEQ ID NO: 1441992 - DNA, 17 bp, Homo sapiens
gccctcttaagatctga

SEQ ID NO: 1441993 - DNA, 17 bp, Homo sapiens
gccctcttgcgggcctg

SEQ ID NO: 1441994 - DNA, 19 bp, Homo sapiens
gccctcttgcgggcctgga

SEQ ID NO: 1441995 - DNA, 13 bp, Homo sapiens
gccctctttccct

SEQ ID NO: 1441996 - DNA, 15 bp, Homo sapiens
gccctctttccctgc

SEQ ID NO: 1441997 - DNA, 17 bp, Homo sapiens
gccctctttccctgcga

SEQ ID NO: 1441998 - DNA, 20 bp, Homo sapiens
gccctctttccctgcgagac

SEQ ID NO: 1441999 - DNA, 15 bp, Homo sapiens
gccctgaaagggccc

SEQ ID NO: 1442000 - DNA, 17 bp, Homo sapiens
gccctgacttctggaga

SEQ ID NO: 1442001 - DNA, 23 bp, Homo sapiens
gccctgaggacctctcagcatag

SEQ ID NO: 1442002 - DNA, 14 bp, Homo sapiens
gccctgaggtgtgg

SEQ ID NO: 1442003 - DNA, 21 bp, Homo sapiens
gccctgaggtgtgggggctgc

SEQ ID NO: 1442004 - DNA, 24 bp, Homo sapiens
gccctgaggtgtgggggctgcagc

SEQ ID NO: 1442005 - DNA, 19 bp, Homo sapiens
gccctgagtgtcccaagcc

SEQ ID NO: 1442006 - DNA, 22 bp, Homo sapiens
gccctgatgcgtctacccagac

SEQ ID NO: 1442007 - DNA, 22 bp, Homo sapiens
gccctgcaccatgctgctgggg

SEQ ID NO: 1442008 - DNA, 15 bp, Homo sapiens
gccctgcagcatccc

SEQ ID NO: 1442009 - DNA, 12 bp, Homo sapiens
gccctgccatta

SEQ ID NO: 1442010 - DNA, 21 bp, Homo sapiens
gccctgccccaccccacctca

SEQ ID NO: 1442011 - DNA, 23 bp, Homo sapiens
gccctgccccaccccacctcaca

SEQ ID NO: 1442012 - DNA, 20 bp, Homo sapiens
gccctgcccccatctcccca

SEQ ID NO: 1442013 - DNA, 22 bp, Homo sapiens
gccctgcccccatctccccagg

SEQ ID NO: 1442014 - DNA, 13 bp, Homo sapiens
gccctgcccctag

SEQ ID NO: 1442015 - DNA, 17 bp, Homo sapiens
gccctgccctagctcca

SEQ ID NO: 1442016 - DNA, 14 bp, Homo sapiens
gccctgccctccca

SEQ ID NO: 1442017 - DNA, 16 bp, Homo sapiens
gccctgccctcccaag

SEQ ID NO: 1442018 - DNA, 19 bp, Homo sapiens
gccgagcctaatgaaaggg

SEQ ID NO: 1442019 - DNA, 22 bp, Homo sapiens
gccgaggacatgcatgacactt

SEQ ID NO: 1442020 - DNA, 17 bp, Homo sapiens
gccgaggaccaccagca

SEQ ID NO: 1442021 - DNA, 22 bp, Homo sapiens
gccgaggaccaccagcaggcag

SEQ ID NO: 1442022 - DNA, 19 bp, Homo sapiens
gccgaggcccagcgggcag

SEQ ID NO: 1442023 - DNA, 12 bp, Homo sapiens
gccgaggcctgg

SEQ ID NO: 1442024 - DNA, 15 bp, Homo sapiens
gccgagggcgtcaga

SEQ ID NO: 1442025 - DNA, 16 bp, Homo sapiens
gccgagggtcctggct

SEQ ID NO: 1442026 - DNA, 15 bp, Homo sapiens
gccgaggtgggcaga

SEQ ID NO: 1442027 - DNA, 23 bp, Homo sapiens
gccgagtaatgacgtgtgtggct

SEQ ID NO: 1442028 - DNA, 16 bp, Homo sapiens
gccgagtcacacccgg

SEQ ID NO: 1442029 - DNA, 21 bp, Homo sapiens
gccgatagagggacggccaag

SEQ ID NO: 1442030 - DNA, 16 bp, Homo sapiens
gccgatgccaccggcc

SEQ ID NO: 1442031 - DNA, 17 bp, Homo sapiens
gccgcaagctctcagca

SEQ ID NO: 1442032 - DNA, 15 bp, Homo sapiens
gccgcaccctgcacc

SEQ ID NO: 1442033 - DNA, 22 bp, Homo sapiens
gccgcaccctgcacctgctgcg

SEQ ID NO: 1442034 - DNA, 16 bp, Homo sapiens
gccgcagacgggcaca

SEQ ID NO: 1442035 - DNA, 18 bp, Homo sapiens
gccgcagcctccctctga

SEQ ID NO: 1442036 - DNA, 17 bp, Homo sapiens
gccgcatcttctccatc

SEQ ID NO: 1442037 - DNA, 15 bp, Homo sapiens
gccgcattccctgag

SEQ ID NO: 1442038 - DNA, 12 bp, Homo sapiens
gccgccaccccc

SEQ ID NO: 1442039 - DNA, 16 bp, Homo sapiens
gccgccacccccatct

SEQ ID NO: 1442040 - DNA, 20 bp, Homo sapiens
gccgccacccccatcttcca

SEQ ID NO: 1442041 - DNA, 21 bp, Homo sapiens
gccgccacccccatcttccac

SEQ ID NO: 1442042 - DNA, 18 bp, Homo sapiens
gccgccacggcctggctg

SEQ ID NO: 1442043 - DNA, 14 bp, Homo sapiens
gccgccactaggtg

SEQ ID NO: 1442044 - DNA, 21 bp, Homo sapiens
gccgccactaggtgtccccaa

SEQ ID NO: 1442045 - DNA, 21 bp, Homo sapiens
gccgccagcgtgtggagcaga

SEQ ID NO: 1442046 - DNA, 11 bp, Homo sapiens
gccgccagctg

SEQ ID NO: 1442047 - DNA, 16 bp, Homo sapiens
gccgcccccgcctggg

SEQ ID NO: 1442048 - DNA, 19 bp, Homo sapiens
gccgcccccgcctgggcac

SEQ ID NO: 1442049 - DNA, 15 bp, Homo sapiens
gccgccccctcctga

SEQ ID NO: 1442050 - DNA, 23 bp, Homo sapiens
gccgcccgctcccttcctgccac

SEQ ID NO: 1442051 - DNA, 16 bp, Homo sapiens
gccgcccgggcccaga

SEQ ID NO: 1442052 - DNA, 13 bp, Homo sapiens
gccgccgcctctt

SEQ ID NO: 1442053 - DNA, 14 bp, Homo sapiens
gccgccgctgccct

SEQ ID NO: 1442054 - DNA, 21 bp, Homo sapiens
gccgccgtgacctattcaccc

SEQ ID NO: 1442055 - DNA, 16 bp, Homo sapiens
gccgcctactggacgc

SEQ ID NO: 1442056 - DNA, 16 bp, Homo sapiens
gccgcctccaggagcc

SEQ ID NO: 1442057 - DNA, 13 bp, Homo sapiens
gccgcctcccacg

SEQ ID NO: 1442058 - DNA, 16 bp, Homo sapiens
gccgcctcccacggca

SEQ ID NO: 1442059 - DNA, 19 bp, Homo sapiens
gccgcctgcgggctgcccc

SEQ ID NO: 1442060 - DNA, 12 bp, Homo sapiens
gccgcctgctcc

SEQ ID NO: 1442061 - DNA, 19 bp, Homo sapiens
gccgcctgctcctcactgg

SEQ ID NO: 1442062 - DNA, 13 bp, Homo sapiens
gccgcctggcagg

SEQ ID NO: 1442063 - DNA, 14 bp, Homo sapiens
gccgcctggcaggt

SEQ ID NO: 1442064 - DNA, 15 bp, Homo sapiens
gccgcctggcaggtg

SEQ ID NO: 1442065 - DNA, 17 bp, Homo sapiens
gccgccttggccttgca

SEQ ID NO: 1442066 - DNA, 18 bp, Homo sapiens
gccgccttggccttgcag

SEQ ID NO: 1442067 - DNA, 17 bp, Homo sapiens
gccgcgccagtccccgc

SEQ ID NO: 1442068 - DNA, 15 bp, Homo sapiens
gccgcgcccagcaga

SEQ ID NO: 1442069 - DNA, 18 bp, Homo sapiens
gccgcgcgcccctgcccg

SEQ ID NO: 1442070 - DNA, 14 bp, Homo sapiens
gccgcgtccctgcc

SEQ ID NO: 1442071 - DNA, 16 bp, Homo sapiens
gccgctacctccctcc

SEQ ID NO: 1442072 - DNA, 13 bp, Homo sapiens
gccgctagaggcc

SEQ ID NO: 1442073 - DNA, 19 bp, Homo sapiens
gccgctaggagagactgaa

SEQ ID NO: 1442074 - DNA, 22 bp, Homo sapiens
gccgctaggagagactgaaagc

SEQ ID NO: 1442075 - DNA, 15 bp, Homo sapiens
gccgctccaccagca

SEQ ID NO: 1442076 - DNA, 21 bp, Homo sapiens
gccgctccgtgttcctcggtg

SEQ ID NO: 1442077 - DNA, 11 bp, Homo sapiens
gccgctgcagg

SEQ ID NO: 1442078 - DNA, 20 bp, Homo sapiens
gccgctgcagggctcccatg

SEQ ID NO: 1442079 - DNA, 22 bp, Homo sapiens
gccgctgcagggctcccatggg

SEQ ID NO: 1442080 - DNA, 12 bp, Homo sapiens
gccgctgccacg

SEQ ID NO: 1442081 - DNA, 19 bp, Homo sapiens
gccgctgcttccaggctgg

SEQ ID NO: 1442082 - DNA, 11 bp, Homo sapiens
gccgctggggt

SEQ ID NO: 1442083 - DNA, 22 bp, Homo sapiens
gccgctggggtccgtcttcaca

SEQ ID NO: 1442084 - DNA, 16 bp, Homo sapiens
gccgctgtctctgagg

SEQ ID NO: 1442085 - DNA, 20 bp, Homo sapiens
gccgctttgtgattccatgg

SEQ ID NO: 1442086 - DNA, 22 bp, Homo sapiens
gccggaaggaatgtcagggcca

SEQ ID NO: 1442087 - DNA, 23 bp, Homo sapiens
gccggaaggaatgtcagggccag

SEQ ID NO: 1442088 - DNA, 23 bp, Homo sapiens
gccggacacggcttcactgacca

SEQ ID NO: 1442089 - DNA, 16 bp, Homo sapiens
gccggacagagtgggg

SEQ ID NO: 1442090 - DNA, 15 bp, Homo sapiens
gccggacagctgccc

SEQ ID NO: 1442091 - DNA, 23 bp, Homo sapiens
gccggacagctgcccagacacat

SEQ ID NO: 1442092 - DNA, 13 bp, Homo sapiens
gccggacgcaggt

SEQ ID NO: 1442093 - DNA, 22 bp, Homo sapiens
gccggacgcaggtgctgcggcg

SEQ ID NO: 1442094 - DNA, 15 bp, Homo sapiens
gccggacgcatctca

SEQ ID NO: 1442095 - DNA, 13 bp, Homo sapiens
gccggagcccaga

SEQ ID NO: 1442096 - DNA, 13 bp, Homo sapiens
gccggcacagggt

SEQ ID NO: 1442097 - DNA, 21 bp, Homo sapiens
gccggcacagggtctgctctt

SEQ ID NO: 1442098 - DNA, 23 bp, Homo sapiens
gccggcacctacatccccaggtc

SEQ ID NO: 1442099 - DNA, 21 bp, Homo sapiens
gccggcatctcccctagctca

SEQ ID NO: 1442100 - DNA, 13 bp, Homo sapiens
gccggccctggct

SEQ ID NO: 1442101 - DNA, 15 bp, Homo sapiens
gccggccctgtgtgc

SEQ ID NO: 1442102 - DNA, 16 bp, Homo sapiens
gccggccctgtgtgca

SEQ ID NO: 1442103 - DNA, 17 bp, Homo sapiens
gccggccctgtgtgcag

SEQ ID NO: 1442104 - DNA, 12 bp, Homo sapiens
gccggcctctct

SEQ ID NO: 1442105 - DNA, 13 bp, Homo sapiens
gccggcctctctg

SEQ ID NO: 1442106 - DNA, 14 bp, Homo sapiens
gccggcctctctgg

SEQ ID NO: 1442107 - DNA, 15 bp, Homo sapiens
gccggcctctctggc

SEQ ID NO: 1442108 - DNA, 20 bp, Homo sapiens
gccggcctctctggcctccc

SEQ ID NO: 1442109 - DNA, 23 bp, Homo sapiens
gccggcctctctggcctcccacc

SEQ ID NO: 1442110 - DNA, 14 bp, Homo sapiens
gccggcggcctctc

SEQ ID NO: 1442111 - DNA, 15 bp, Homo sapiens
gccggctctgggcct

SEQ ID NO: 1442112 - DNA, 18 bp, Homo sapiens
gccggctctgggcctgag

SEQ ID NO: 1442113 - DNA, 14 bp, Homo sapiens
gccggctgagtggc

SEQ ID NO: 1442114 - DNA, 18 bp, Homo sapiens
gccgggaccaccctgagc

SEQ ID NO: 1442115 - DNA, 20 bp, Homo sapiens
gccgggaccaccctgagccg

SEQ ID NO: 1442116 - DNA, 22 bp, Homo sapiens
gccgggaccaccctgagccggc

SEQ ID NO: 1442117 - DNA, 17 bp, Homo sapiens
gccgggagaagccacct

SEQ ID NO: 1442118 - DNA, 20 bp, Homo sapiens
gccgggatggttcttctcca

SEQ ID NO: 1442119 - DNA, 20 bp, Homo sapiens
gccgggcacagtggctcacg

SEQ ID NO: 1442120 - DNA, 21 bp, Homo sapiens
gccgggcacagtggctcacgc

SEQ ID NO: 1442121 - DNA, 17 bp, Homo sapiens
gccgggcccctgggctt

SEQ ID NO: 1442122 - DNA, 17 bp, Homo sapiens
gccgggccctctgtagc

SEQ ID NO: 1442123 - DNA, 18 bp, Homo sapiens
gccgggccctctgtagct

SEQ ID NO: 1442124 - DNA, 13 bp, Homo sapiens
gccgggcctccca

SEQ ID NO: 1442125 - DNA, 12 bp, Homo sapiens
gccgggcctggg

SEQ ID NO: 1442126 - DNA, 22 bp, Homo sapiens
gccgggcgtggtggcgggcacc

SEQ ID NO: 1442127 - DNA, 13 bp, Homo sapiens
gccgggctgctgc

SEQ ID NO: 1442128 - DNA, 18 bp, Homo sapiens
gccgggcttgggccctgc

SEQ ID NO: 1442129 - DNA, 21 bp, Homo sapiens
gccggggatggatcttttcta

SEQ ID NO: 1442130 - DNA, 23 bp, Homo sapiens
gccggggccttatcgggctccag

SEQ ID NO: 1442131 - DNA, 15 bp, Homo sapiens
gccggggctgagact

SEQ ID NO: 1442132 - DNA, 22 bp, Homo sapiens
gccgggggttcataggtcactg

SEQ ID NO: 1442133 - DNA, 22 bp, Homo sapiens
gccggggtgtaacttcctgctg

SEQ ID NO: 1442134 - DNA, 23 bp, Homo sapiens
gccggggtgtaacttcctgctgc

SEQ ID NO: 1442135 - DNA, 20 bp, Homo sapiens
gcccactccccagccccagc

SEQ ID NO: 1442136 - DNA, 14 bp, Homo sapiens
gcccactccctgcc

SEQ ID NO: 1442137 - DNA, 15 bp, Homo sapiens
gcccactccctgcct

SEQ ID NO: 1442138 - DNA, 23 bp, Homo sapiens
gcccactgcccaccccctcaagc

SEQ ID NO: 1442139 - DNA, 16 bp, Homo sapiens
gcccactgcctgcctc

SEQ ID NO: 1442140 - DNA, 15 bp, Homo sapiens
gcccactgctggctg

SEQ ID NO: 1442141 - DNA, 16 bp, Homo sapiens
gcccactgtcctgggc

SEQ ID NO: 1442142 - DNA, 24 bp, Homo sapiens
gcccactgtcctgggcctgcagaa

SEQ ID NO: 1442143 - DNA, 17 bp, Homo sapiens
gcccactgtcctgggcg

SEQ ID NO: 1442144 - DNA, 19 bp, Homo sapiens
gcccactgtcctgggcgcc

SEQ ID NO: 1442145 - DNA, 21 bp, Homo sapiens
gcccactgtcctgggcgccct

SEQ ID NO: 1442146 - DNA, 20 bp, Homo sapiens
gcccacttgattgagaaaga

SEQ ID NO: 1442147 - DNA, 21 bp, Homo sapiens
gcccactttcctgagctgtcg

SEQ ID NO: 1442148 - DNA, 17 bp, Homo sapiens
gcccagaaaacctccag

SEQ ID NO: 1442149 - DNA, 12 bp, Homo sapiens
gcccagacacat

SEQ ID NO: 1442150 - DNA, 18 bp, Homo sapiens
gcccagacaccatgtgca

SEQ ID NO: 1442151 - DNA, 21 bp, Homo sapiens
gcccagacccctctggccagg

SEQ ID NO: 1442152 - DNA, 20 bp, Homo sapiens
gcccagaccggcttctcggc

SEQ ID NO: 1442153 - DNA, 21 bp, Homo sapiens
gcccagagaagctggaagcct

SEQ ID NO: 1442154 - DNA, 20 bp, Homo sapiens
gcccagagacatacttgaag

SEQ ID NO: 1442155 - DNA, 18 bp, Homo sapiens
gcccagagatgcctccac

SEQ ID NO: 1442156 - DNA, 14 bp, Homo sapiens
gcccagagccacct

SEQ ID NO: 1442157 - DNA, 16 bp, Homo sapiens
gcccagagcccagctc

SEQ ID NO: 1442158 - DNA, 14 bp, Homo sapiens
gcccagagcccggt

SEQ ID NO: 1442159 - DNA, 13 bp, Homo sapiens
gcccagagcctgg

SEQ ID NO: 1442160 - DNA, 20 bp, Homo sapiens
gcccagaggactcccaaccc

SEQ ID NO: 1442161 - DNA, 20 bp, Homo sapiens
gcccagatacgggggctgtg

SEQ ID NO: 1442162 - DNA, 21 bp, Homo sapiens
gcccagatacgggggctgtga

SEQ ID NO: 1442163 - DNA, 13 bp, Homo sapiens
gcccagcacctgg

SEQ ID NO: 1442164 - DNA, 13 bp, Homo sapiens
gcccagcactgtg

SEQ ID NO: 1442165 - DNA, 13 bp, Homo sapiens
gcccagcagctca

SEQ ID NO: 1442166 - DNA, 14 bp, Homo sapiens
gcccagcaggagag

SEQ ID NO: 1442167 - DNA, 14 bp, Homo sapiens
gcccagcaggccca

SEQ ID NO: 1442168 - DNA, 15 bp, Homo sapiens
gcccagcaggcccag

SEQ ID NO: 1442169 - DNA, 16 bp, Homo sapiens
gcccagcaggcccagc

SEQ ID NO: 1442170 - DNA, 20 bp, Homo sapiens
gcccagcaggcccagcatgc

SEQ ID NO: 1442171 - DNA, 21 bp, Homo sapiens
gcccagcaggcccagcatgca

SEQ ID NO: 1442172 - DNA, 14 bp, Homo sapiens
gcccagcaggggcc

SEQ ID NO: 1442173 - DNA, 17 bp, Homo sapiens
gcccagcatgcaggtgg

SEQ ID NO: 1442174 - DNA, 17 bp, Homo sapiens
gcccagccaaaccctgt

SEQ ID NO: 1442175 - DNA, 20 bp, Homo sapiens
gcccagccattaccatggag

SEQ ID NO: 1442176 - DNA, 23 bp, Homo sapiens
gcccagccattaccatggagaca

SEQ ID NO: 1442177 - DNA, 11 bp, Homo sapiens
gcccagcccag

SEQ ID NO: 1442178 - DNA, 15 bp, Homo sapiens
gcccagcccagctgg

SEQ ID NO: 1442179 - DNA, 20 bp, Homo sapiens
gcccagcccaggagtttgag

SEQ ID NO: 1442180 - DNA, 19 bp, Homo sapiens
gcccagcccatttgggctc

SEQ ID NO: 1442181 - DNA, 22 bp, Homo sapiens
gcccagcccatttgggctctgg

SEQ ID NO: 1442182 - DNA, 15 bp, Homo sapiens
gcccagcccctgccc

SEQ ID NO: 1442183 - DNA, 16 bp, Homo sapiens
gcccagcccctgcccc

SEQ ID NO: 1442184 - DNA, 18 bp, Homo sapiens
gcccagcccctgccccta

SEQ ID NO: 1442185 - DNA, 18 bp, Homo sapiens
gcccagcccggaccttgg

SEQ ID NO: 1442186 - DNA, 18 bp, Homo sapiens
gcccagccggcctctctg

SEQ ID NO: 1442187 - DNA, 13 bp, Homo sapiens
gcccagccgggca

SEQ ID NO: 1442188 - DNA, 16 bp, Homo sapiens
gcccagccgggcacag

SEQ ID NO: 1442189 - DNA, 14 bp, Homo sapiens
gcccagcctgggag

SEQ ID NO: 1442190 - DNA, 15 bp, Homo sapiens
gcccagcgctctcct

SEQ ID NO: 1442191 - DNA, 22 bp, Homo sapiens
gcccagctaatttttgtatttt

SEQ ID NO: 1442192 - DNA, 21 bp, Homo sapiens
gcccagctacattcctcagct

SEQ ID NO: 1442193 - DNA, 12 bp, Homo sapiens
gcccagctccag

SEQ ID NO: 1442194 - DNA, 16 bp, Homo sapiens
gcccagctccagggcc

SEQ ID NO: 1442195 - DNA, 18 bp, Homo sapiens
gcccagctccgcctgctg

SEQ ID NO: 1442196 - DNA, 21 bp, Homo sapiens
gcccagctccgcctgctggga

SEQ ID NO: 1442197 - DNA, 18 bp, Homo sapiens
gcccagctcctgaataaa

SEQ ID NO: 1442198 - DNA, 15 bp, Homo sapiens
gcccagctctctgac

SEQ ID NO: 1442199 - DNA, 16 bp, Homo sapiens
gcccagctcttgctct

SEQ ID NO: 1442200 - DNA, 21 bp, Homo sapiens
gcccagctcttgctctcttgt

SEQ ID NO: 1442201 - DNA, 12 bp, Homo sapiens
gcccagctgagt

SEQ ID NO: 1442202 - DNA, 13 bp, Homo sapiens
gcccagctgcacc

SEQ ID NO: 1442203 - DNA, 15 bp, Homo sapiens
gcccagctgcacctg

SEQ ID NO: 1442204 - DNA, 13 bp, Homo sapiens
gcccaagccctga

SEQ ID NO: 1442205 - DNA, 15 bp, Homo sapiens
gcccaagctggagtg

SEQ ID NO: 1442206 - DNA, 14 bp, Homo sapiens
gcccaagcttccct

SEQ ID NO: 1442207 - DNA, 21 bp, Homo sapiens
gcccaaggagcttacccaagc

SEQ ID NO: 1442208 - DNA, 14 bp, Homo sapiens
gcccaaggctcccg

SEQ ID NO: 1442209 - DNA, 15 bp, Homo sapiens
gcccaaggctcccgg

SEQ ID NO: 1442210 - DNA, 17 bp, Homo sapiens
gcccaagtccctgtttt

SEQ ID NO: 1442211 - DNA, 20 bp, Homo sapiens
gcccaagttcatgcagctgt

SEQ ID NO: 1442212 - DNA, 11 bp, Homo sapiens
gcccaataaag

SEQ ID NO: 1442213 - DNA, 12 bp, Homo sapiens
gcccaataaagg

SEQ ID NO: 1442214 - DNA, 23 bp, Homo sapiens
gcccaataaaggtcccttagccc

SEQ ID NO: 1442215 - DNA, 12 bp, Homo sapiens
gcccaatatatt

SEQ ID NO: 1442216 - DNA, 14 bp, Homo sapiens
gcccaatgaaatga

SEQ ID NO: 1442217 - DNA, 22 bp, Homo sapiens
gcccaatgctttgggaggccaa

SEQ ID NO: 1442218 - DNA, 13 bp, Homo sapiens
gcccacagctccc

SEQ ID NO: 1442219 - DNA, 18 bp, Homo sapiens
gcccacaggaagctcagc

SEQ ID NO: 1442220 - DNA, 14 bp, Homo sapiens
gcccacagtctttc

SEQ ID NO: 1442221 - DNA, 12 bp, Homo sapiens
gcccacatattc

SEQ ID NO: 1442222 - DNA, 14 bp, Homo sapiens
gcccacatattcta

SEQ ID NO: 1442223 - DNA, 20 bp, Homo sapiens
gcccacatttgggctcaggg

SEQ ID NO: 1442224 - DNA, 17 bp, Homo sapiens
gcccaccaacatcccat

SEQ ID NO: 1442225 - DNA, 18 bp, Homo sapiens
gcccaccagggacacctc

SEQ ID NO: 1442226 - DNA, 19 bp, Homo sapiens
gcccaccatcaccaccgcc

SEQ ID NO: 1442227 - DNA, 14 bp, Homo sapiens
gcccacccagggaa

SEQ ID NO: 1442228 - DNA, 20 bp, Homo sapiens
gcccacccccctccccaact

SEQ ID NO: 1442229 - DNA, 14 bp, Homo sapiens
gcccaccccctgcc

SEQ ID NO: 1442230 - DNA, 15 bp, Homo sapiens
gcccaccccctgccc

SEQ ID NO: 1442231 - DNA, 22 bp, Homo sapiens
gcccacccctcactccccaggg

SEQ ID NO: 1442232 - DNA, 16 bp, Homo sapiens
gcccacccgcccgagg

SEQ ID NO: 1442233 - DNA, 18 bp, Homo sapiens
gcccacccggtgggaccc

SEQ ID NO: 1442234 - DNA, 13 bp, Homo sapiens
gcccaccctgggc

SEQ ID NO: 1442235 - DNA, 16 bp, Homo sapiens
gcccaccctgggctcc

SEQ ID NO: 1442236 - DNA, 18 bp, Homo sapiens
gcccaccgttaggattca

SEQ ID NO: 1442237 - DNA, 14 bp, Homo sapiens
gcccacctggccac

SEQ ID NO: 1442238 - DNA, 16 bp, Homo sapiens
gcccacctggccacct

SEQ ID NO: 1442239 - DNA, 20 bp, Homo sapiens
gcccacgatcccctccccca

SEQ ID NO: 1442240 - DNA, 21 bp, Homo sapiens
gcccacgccctccctctccca

SEQ ID NO: 1442241 - DNA, 18 bp, Homo sapiens
gcccacgttctctctgcc

SEQ ID NO: 1442242 - DNA, 22 bp, Homo sapiens
gcccactagagggcccatcagg

SEQ ID NO: 1442243 - DNA, 23 bp, Homo sapiens
gcccactagagggcccatcaggc

SEQ ID NO: 1442244 - DNA, 19 bp, Homo sapiens
gcccactccccagccccag

SEQ ID NO: 1442245 - DNA, 14 bp, Homo sapiens
gcagagaggtggag

SEQ ID NO: 1442246 - DNA, 19 bp, Homo sapiens
gcagagaggtggagaactg

SEQ ID NO: 1442247 - DNA, 16 bp, Homo sapiens
gcagagatgtactgca

SEQ ID NO: 1442248 - DNA, 22 bp, Homo sapiens
gcagagatgtactgcaaagtcg

SEQ ID NO: 1442249 - DNA, 17 bp, Homo sapiens
gcagagcaaatgaggga

SEQ ID NO: 1442250 - DNA, 19 bp, Homo sapiens
gcagagcaaatgagggagg

SEQ ID NO: 1442251 - DNA, 21 bp, Homo sapiens
gcagagcaattccaggctgag

SEQ ID NO: 1442252 - DNA, 14 bp, Homo sapiens
gcagagcaggggca

SEQ ID NO: 1442253 - DNA, 20 bp, Homo sapiens
gcagagccatgggcctgggc

SEQ ID NO: 1442254 - DNA, 21 bp, Homo sapiens
gcagagccatgggcctgggcc

SEQ ID NO: 1442255 - DNA, 14 bp, Homo sapiens
gcagagccttctca

SEQ ID NO: 1442256 - DNA, 19 bp, Homo sapiens
gcagagctctcccctcctg

SEQ ID NO: 1442257 - DNA, 22 bp, Homo sapiens
gcagaggacagtctggagaagg

SEQ ID NO: 1442258 - DNA, 21 bp, Homo sapiens
gcagaggaccacagtgggtgg

SEQ ID NO: 1442259 - DNA, 14 bp, Homo sapiens
gcagaggaccaggg

SEQ ID NO: 1442260 - DNA, 17 bp, Homo sapiens
gcagaggaccagggcct

SEQ ID NO: 1442261 - DNA, 15 bp, Homo sapiens
gcagaggccagaggc

SEQ ID NO: 1442262 - DNA, 13 bp, Homo sapiens
gcagaggcctggg

SEQ ID NO: 1442263 - DNA, 23 bp, Homo sapiens
gcagaggcgtactacccagctct

SEQ ID NO: 1442264 - DNA, 17 bp, Homo sapiens
gcagagggaatgttccc

SEQ ID NO: 1442265 - DNA, 22 bp, Homo sapiens
gcagagggaatgttccctgcac

SEQ ID NO: 1442266 - DNA, 16 bp, Homo sapiens
gcagagggcagaggct

SEQ ID NO: 1442267 - DNA, 17 bp, Homo sapiens
gcagagggctggaggcc

SEQ ID NO: 1442268 - DNA, 17 bp, Homo sapiens
gcagaggggcagccgct

SEQ ID NO: 1442269 - DNA, 18 bp, Homo sapiens
gcagaggggcagccgcta

SEQ ID NO: 1442270 - DNA, 21 bp, Homo sapiens
gcagaggggcagccgctagga

SEQ ID NO: 1442271 - DNA, 19 bp, Homo sapiens
gcagaggggctttctggag

SEQ ID NO: 1442272 - DNA, 14 bp, Homo sapiens
gcagaggtaccctg

SEQ ID NO: 1442273 - DNA, 17 bp, Homo sapiens
gcagaggtaccctgggt

SEQ ID NO: 1442274 - DNA, 18 bp, Homo sapiens
gcagaggtaccctgggtg

SEQ ID NO: 1442275 - DNA, 13 bp, Homo sapiens
gcagaggtgcaag

SEQ ID NO: 1442276 - DNA, 20 bp, Homo sapiens
gcagaggttttaatgtctgt

SEQ ID NO: 1442277 - DNA, 22 bp, Homo sapiens
gcagaggttttaatgtctgttt

SEQ ID NO: 1442278 - DNA, 23 bp, Homo sapiens
gcagaggttttaatgtctgttta

SEQ ID NO: 1442279 - DNA, 20 bp, Homo sapiens
gcagagtgagcaagggggcc

SEQ ID NO: 1442280 - DNA, 15 bp, Homo sapiens
gcagagtgcacagct

SEQ ID NO: 1442281 - DNA, 17 bp, Homo sapiens
gcagagttacagttctg

SEQ ID NO: 1442282 - DNA, 12 bp, Homo sapiens
gcagagttttca

SEQ ID NO: 1442283 - DNA, 18 bp, Homo sapiens
gcagataagttggagcag

SEQ ID NO: 1442284 - DNA, 21 bp, Homo sapiens
gcagataagttggagcagggg

SEQ ID NO: 1442285 - DNA, 15 bp, Homo sapiens
gcagatccaggacta

SEQ ID NO: 1442286 - DNA, 15 bp, Homo sapiens
gcagatcccagctca

SEQ ID NO: 1442287 - DNA, 13 bp, Homo sapiens
gcagatctgtgcc

SEQ ID NO: 1442288 - DNA, 20 bp, Homo sapiens
gcagatctgtgccccatgcc

SEQ ID NO: 1442289 - DNA, 22 bp, Homo sapiens
gcagatgacacgcgctctccac

SEQ ID NO: 1442290 - DNA, 12 bp, Homo sapiens
gcagatgggctg

SEQ ID NO: 1442291 - DNA, 13 bp, Homo sapiens
gcagatgttcaaa

SEQ ID NO: 1442292 - DNA, 20 bp, Homo sapiens
gcagattcatttttctttct

SEQ ID NO: 1442293 - DNA, 13 bp, Homo sapiens
gcagattcctggg

SEQ ID NO: 1442294 - DNA, 17 bp, Homo sapiens
gcagattcctgggcctg

SEQ ID NO: 1442295 - DNA, 21 bp, Homo sapiens
gcagattcctgggcctgtccc

SEQ ID NO: 1442296 - DNA, 14 bp, Homo sapiens
gcagattctatttc

SEQ ID NO: 1442297 - DNA, 22 bp, Homo sapiens
gcagcaaacactccaccctcca

SEQ ID NO: 1442298 - DNA, 11 bp, Homo sapiens
gcagcaaggct

SEQ ID NO: 1442299 - DNA, 18 bp, Homo sapiens
gcagcaagggacctgctc

SEQ ID NO: 1442300 - DNA, 23 bp, Homo sapiens
gcagcaatatattaccagcaaga

SEQ ID NO: 1442301 - DNA, 19 bp, Homo sapiens
gcagcacacctcagcccca

SEQ ID NO: 1442302 - DNA, 22 bp, Homo sapiens
gcagcacacctcagccccactg

SEQ ID NO: 1442303 - DNA, 14 bp, Homo sapiens
gcagcaccacactg

SEQ ID NO: 1442304 - DNA, 16 bp, Homo sapiens
gcagcaccgaggggcc

SEQ ID NO: 1442305 - DNA, 16 bp, Homo sapiens
gcagcacctccaggcc

SEQ ID NO: 1442306 - DNA, 17 bp, Homo sapiens
gcagcacctccaggcct

SEQ ID NO: 1442307 - DNA, 18 bp, Homo sapiens
gcagcacctccaggcctg

SEQ ID NO: 1442308 - DNA, 12 bp, Homo sapiens
gcagcacctcct

SEQ ID NO: 1442309 - DNA, 12 bp, Homo sapiens
gcagcactcccc

SEQ ID NO: 1442310 - DNA, 12 bp, Homo sapiens
gcagcagaaggg

SEQ ID NO: 1442311 - DNA, 20 bp, Homo sapiens
gcagcagagagagaggacag

SEQ ID NO: 1442312 - DNA, 13 bp, Homo sapiens
gcagcagcaggtg

SEQ ID NO: 1442313 - DNA, 14 bp, Homo sapiens
gcagcagcccaagc

SEQ ID NO: 1442314 - DNA, 20 bp, Homo sapiens
gcagcagcccaagcttccct

SEQ ID NO: 1442315 - DNA, 14 bp, Homo sapiens
gcagcagcccagct

SEQ ID NO: 1442316 - DNA, 19 bp, Homo sapiens
gcagcagccccccttgccc

SEQ ID NO: 1442317 - DNA, 12 bp, Homo sapiens
gcagcagctagg

SEQ ID NO: 1442318 - DNA, 17 bp, Homo sapiens
gcagcagctaggactga

SEQ ID NO: 1442319 - DNA, 18 bp, Homo sapiens
gcagcagctgggacccct

SEQ ID NO: 1442320 - DNA, 22 bp, Homo sapiens
gcagcagctgggacccctccca

SEQ ID NO: 1442321 - DNA, 23 bp, Homo sapiens
gcagcagctgggacccctcccaa

SEQ ID NO: 1442322 - DNA, 18 bp, Homo sapiens
gcagcgttagggctgctt

SEQ ID NO: 1442323 - DNA, 15 bp, Homo sapiens
gcagctaactccgag

SEQ ID NO: 1442324 - DNA, 21 bp, Homo sapiens
gcagctaagatagaaagctgg

SEQ ID NO: 1442325 - DNA, 14 bp, Homo sapiens
gcagctaccctcag

SEQ ID NO: 1442326 - DNA, 16 bp, Homo sapiens
gcagctaccctcagcc

SEQ ID NO: 1442327 - DNA, 20 bp, Homo sapiens
gcagctaccctcagcctcca

SEQ ID NO: 1442328 - DNA, 14 bp, Homo sapiens
gcagctagactgga

SEQ ID NO: 1442329 - DNA, 19 bp, Homo sapiens
gcagctagactggagtgag

SEQ ID NO: 1442330 - DNA, 14 bp, Homo sapiens
gcagctaggactga

SEQ ID NO: 1442331 - DNA, 16 bp, Homo sapiens
gcagctaggactgagg

SEQ ID NO: 1442332 - DNA, 17 bp, Homo sapiens
gcagctaggactgagga

SEQ ID NO: 1442333 - DNA, 18 bp, Homo sapiens
gcagctaggactgaggag

SEQ ID NO: 1442334 - DNA, 13 bp, Homo sapiens
gcagctagtgcct

SEQ ID NO: 1442335 - DNA, 15 bp, Homo sapiens
gcagctagtgccttt

SEQ ID NO: 1442336 - DNA, 17 bp, Homo sapiens
gcagctatatatttccc

SEQ ID NO: 1442337 - DNA, 14 bp, Homo sapiens
gcagctcactgctg

SEQ ID NO: 1442338 - DNA, 20 bp, Homo sapiens
gcagctccttcctagccttg

SEQ ID NO: 1442339 - DNA, 14 bp, Homo sapiens
gcagctcttgccct

SEQ ID NO: 1442340 - DNA, 18 bp, Homo sapiens
gcagctgcccctggcacc

SEQ ID NO: 1442341 - DNA, 22 bp, Homo sapiens
gcagctgcccctggcacctgtg

SEQ ID NO: 1442342 - DNA, 10 bp, Homo sapiens
gcagctgcct

SEQ ID NO: 1442343 - DNA, 12 bp, Homo sapiens
gcagctgcctct

SEQ ID NO: 1442344 - DNA, 13 bp, Homo sapiens
gcagctgcctctg

SEQ ID NO: 1442345 - DNA, 15 bp, Homo sapiens
gcagctgcctctgct

SEQ ID NO: 1442346 - DNA, 18 bp, Homo sapiens
gcagctgcctctgctccc

SEQ ID NO: 1442347 - DNA, 19 bp, Homo sapiens
gcagctgcctctgctccct

SEQ ID NO: 1442348 - DNA, 15 bp, Homo sapiens
gcagctgctccccag

SEQ ID NO: 1442349 - DNA, 15 bp, Homo sapiens
gcagctggactaccc

SEQ ID NO: 1442350 - DNA, 12 bp, Homo sapiens
gcagctggccca

SEQ ID NO: 1442351 - DNA, 13 bp, Homo sapiens
gcagctgggcccc

SEQ ID NO: 1442352 - DNA, 17 bp, Homo sapiens
gcagctgggccccacct

SEQ ID NO: 1442353 - DNA, 20 bp, Homo sapiens
gcagctggggggctgtcctg

SEQ ID NO: 1442354 - DNA, 23 bp, Homo sapiens
gcagctggtcagtctttgctcag

SEQ ID NO: 1442355 - DNA, 14 bp, Homo sapiens
gcagctgtttctca

SEQ ID NO: 1442356 - DNA, 13 bp, Homo sapiens
gcagcttgccccg

SEQ ID NO: 1442357 - DNA, 14 bp, Homo sapiens
gcagcttgccccgg

SEQ ID NO: 1442358 - DNA, 20 bp, Homo sapiens
gcagcttttggtctccttgg

SEQ ID NO: 1442359 - DNA, 14 bp, Homo sapiens
gcaggaacgagcac

SEQ ID NO: 1442360 - DNA, 18 bp, Homo sapiens
gcaggaacgagcactggc

SEQ ID NO: 1442361 - DNA, 13 bp, Homo sapiens
gcaggaagccagg

SEQ ID NO: 1442362 - DNA, 15 bp, Homo sapiens
gcaggaagccaggct

SEQ ID NO: 1442363 - DNA, 12 bp, Homo sapiens
gcaggaaggaga

SEQ ID NO: 1442364 - DNA, 19 bp, Homo sapiens
gcaggaatatatgtgtgcc

SEQ ID NO: 1442365 - DNA, 17 bp, Homo sapiens
gcaggaatgtgtggcag

SEQ ID NO: 1442366 - DNA, 20 bp, Homo sapiens
gcaggacacatcccggcctc

SEQ ID NO: 1442367 - DNA, 16 bp, Homo sapiens
gcaagtttctgtttca

SEQ ID NO: 1442368 - DNA, 12 bp, Homo sapiens
gcaataaaattt

SEQ ID NO: 1442369 - DNA, 14 bp, Homo sapiens
gcaataaaatttaa

SEQ ID NO: 1442370 - DNA, 15 bp, Homo sapiens
gcaataaaatttaaa

SEQ ID NO: 1442371 - DNA, 19 bp, Homo sapiens
gcaataaaatttaaaaaat

SEQ ID NO: 1442372 - DNA, 21 bp, Homo sapiens
gcaataaaatttaaaaaataa

SEQ ID NO: 1442373 - DNA, 13 bp, Homo sapiens
gcaataaagtata

SEQ ID NO: 1442374 - DNA, 18 bp, Homo sapiens
gcaataaatctgacccag

SEQ ID NO: 1442375 - DNA, 12 bp, Homo sapiens
gcaataaatgaa

SEQ ID NO: 1442376 - DNA, 20 bp, Homo sapiens
gcaataacctcaaagtgact

SEQ ID NO: 1442377 - DNA, 12 bp, Homo sapiens
gcaataactatt

SEQ ID NO: 1442378 - DNA, 20 bp, Homo sapiens
gcaataacttctatatttta

SEQ ID NO: 1442379 - DNA, 13 bp, Homo sapiens
gcaataagataca

SEQ ID NO: 1442380 - DNA, 23 bp, Homo sapiens
gcaataatggtcccatccaggca

SEQ ID NO: 1442381 - DNA, 16 bp, Homo sapiens
gcaataattgtttcca

SEQ ID NO: 1442382 - DNA, 16 bp, Homo sapiens
gcaataatttgtacaa

SEQ ID NO: 1442383 - DNA, 22 bp, Homo sapiens
gcaataatttgtacaatggttt

SEQ ID NO: 1442384 - DNA, 18 bp, Homo sapiens
gcaatacgtttgtgcaga

SEQ ID NO: 1442385 - DNA, 19 bp, Homo sapiens
gcaatacgtttgtgcagaa

SEQ ID NO: 1442386 - DNA, 18 bp, Homo sapiens
gcaatagattactgatgt

SEQ ID NO: 1442387 - DNA, 21 bp, Homo sapiens
gcaataggtaaatggggccca

SEQ ID NO: 1442388 - DNA, 22 bp, Homo sapiens
gcaatagtgcaacatctctgaa

SEQ ID NO: 1442389 - DNA, 13 bp, Homo sapiens
gcaatataagcat

SEQ ID NO: 1442390 - DNA, 21 bp, Homo sapiens
gcaatattaatgcctttaaag

SEQ ID NO: 1442391 - DNA, 17 bp, Homo sapiens
gcaatcaaatctgcttt

SEQ ID NO: 1442392 - DNA, 19 bp, Homo sapiens
gcaatcagacaccctctcc

SEQ ID NO: 1442393 - DNA, 20 bp, Homo sapiens
gcaatccatgttagttttta

SEQ ID NO: 1442394 - DNA, 22 bp, Homo sapiens
gcaatccatgttagtttttact

SEQ ID NO: 1442395 - DNA, 22 bp, Homo sapiens
gcaatctgaccctatgggtcta

SEQ ID NO: 1442396 - DNA, 22 bp, Homo sapiens
gcaatctgggtggtaactgcca

SEQ ID NO: 1442397 - DNA, 13 bp, Homo sapiens
gcaatctttgaaa

SEQ ID NO: 1442398 - DNA, 16 bp, Homo sapiens
gcaatctttgaaataa

SEQ ID NO: 1442399 - DNA, 16 bp, Homo sapiens
gcaatgaaaaatactt

SEQ ID NO: 1442400 - DNA, 16 bp, Homo sapiens
gcaatgaaaggtacta

SEQ ID NO: 1442401 - DNA, 16 bp, Homo sapiens
gcaatgacatcttcaa

SEQ ID NO: 1442402 - DNA, 21 bp, Homo sapiens
gcaatgactcgttacctgccg

SEQ ID NO: 1442403 - DNA, 23 bp, Homo sapiens
gcaatgactcgttacctgccgcc

SEQ ID NO: 1442404 - DNA, 15 bp, Homo sapiens
gcaatgatgtccaga

SEQ ID NO: 1442405 - DNA, 22 bp, Homo sapiens
gcaatgctatcactgtctttga

SEQ ID NO: 1442406 - DNA, 21 bp, Homo sapiens
gcaatgtcacaacctctctga

SEQ ID NO: 1442407 - DNA, 15 bp, Homo sapiens
gcaatgtctgtgcta

SEQ ID NO: 1442408 - DNA, 18 bp, Homo sapiens
gcaatgtgccttgattga

SEQ ID NO: 1442409 - DNA, 23 bp, Homo sapiens
gcaatgtggagcagcagccactg

SEQ ID NO: 1442410 - DNA, 22 bp, Homo sapiens
gcaatgtggtgacacctccccc

SEQ ID NO: 1442411 - DNA, 20 bp, Homo sapiens
gcaatgttggttttttataa

SEQ ID NO: 1442412 - DNA, 21 bp, Homo sapiens
gcaattaaacttccaaagaaa

SEQ ID NO: 1442413 - DNA, 20 bp, Homo sapiens
gcaattacaacggagtcaaa

SEQ ID NO: 1442414 - DNA, 18 bp, Homo sapiens
gcaattaggtagcacagc

SEQ ID NO: 1442415 - DNA, 19 bp, Homo sapiens
gcaattaggtagcacagca

SEQ ID NO: 1442416 - DNA, 17 bp, Homo sapiens
gcaattagtctgaaact

SEQ ID NO: 1442417 - DNA, 13 bp, Homo sapiens
gcaattattttgg

SEQ ID NO: 1442418 - DNA, 16 bp, Homo sapiens
gcaattcaaaagttcc

SEQ ID NO: 1442419 - DNA, 15 bp, Homo sapiens
gcaattccaggctga

SEQ ID NO: 1442420 - DNA, 22 bp, Homo sapiens
gcaattccaggctgagccatga

SEQ ID NO: 1442421 - DNA, 13 bp, Homo sapiens
gcaattctgactg

SEQ ID NO: 1442422 - DNA, 18 bp, Homo sapiens
gcaattgaattaaattag

SEQ ID NO: 1442423 - DNA, 14 bp, Homo sapiens
gcaattgctcccat

SEQ ID NO: 1442424 - DNA, 22 bp, Homo sapiens
gcaattgttacaagtgttctta

SEQ ID NO: 1442425 - DNA, 16 bp, Homo sapiens
gcaatttatacaatat

SEQ ID NO: 1442426 - DNA, 13 bp, Homo sapiens
gcaatttcaaggt

SEQ ID NO: 1442427 - DNA, 18 bp, Homo sapiens
gcaatttcctggccctcc

SEQ ID NO: 1442428 - DNA, 17 bp, Homo sapiens
gcaatttgtttaaagaa

SEQ ID NO: 1442429 - DNA, 18 bp, Homo sapiens
gcaatttgtttaaagaat

SEQ ID NO: 1442430 - DNA, 20 bp, Homo sapiens
gcaatttgtttaaagaataa

SEQ ID NO: 1442431 - DNA, 19 bp, Homo sapiens
gcaattttaattgattatt

SEQ ID NO: 1442432 - DNA, 13 bp, Homo sapiens
gcaattttagtgt

SEQ ID NO: 1442433 - DNA, 17 bp, Homo sapiens
gcaattttctttgtttc

SEQ ID NO: 1442434 - DNA, 14 bp, Homo sapiens
gcacaaaaaatgag

SEQ ID NO: 1442435 - DNA, 14 bp, Homo sapiens
gcacaaatatttat

SEQ ID NO: 1442436 - DNA, 15 bp, Homo sapiens
gcacaaatatttatt

SEQ ID NO: 1442437 - DNA, 22 bp, Homo sapiens
gcacaagcagagtgcacagctg

SEQ ID NO: 1442438 - DNA, 12 bp, Homo sapiens
gcacaagccagg

SEQ ID NO: 1442439 - DNA, 13 bp, Homo sapiens
gcacaagccaggg

SEQ ID NO: 1442440 - DNA, 12 bp, Homo sapiens
gcacaagctcag

SEQ ID NO: 1442441 - DNA, 13 bp, Homo sapiens
gcacaagctcaga

SEQ ID NO: 1442442 - DNA, 20 bp, Homo sapiens
gcacaatattgaactttttt

SEQ ID NO: 1442443 - DNA, 14 bp, Homo sapiens
gcacaattctgttt

SEQ ID NO: 1442444 - DNA, 14 bp, Homo sapiens
gcacaatttgcact

SEQ ID NO: 1442445 - DNA, 19 bp, Homo sapiens
gcacaatttgcactaaatc

SEQ ID NO: 1442446 - DNA, 23 bp, Homo sapiens
gcacacacaaacctactgcccac

SEQ ID NO: 1442447 - DNA, 10 bp, Homo sapiens
gcacacacac

SEQ ID NO: 1442448 - DNA, 14 bp, Homo sapiens
gcacacacagctcc

SEQ ID NO: 1442449 - DNA, 15 bp, Homo sapiens
gcacacacagctcct

SEQ ID NO: 1442450 - DNA, 14 bp, Homo sapiens
gcacacacatctgg

SEQ ID NO: 1442451 - DNA, 20 bp, Homo sapiens
gcacacacatctggccctga

SEQ ID NO: 1442452 - DNA, 15 bp, Homo sapiens
gcacacacctgcctg

SEQ ID NO: 1442453 - DNA, 13 bp, Homo sapiens
gcacacacctgta

SEQ ID NO: 1442454 - DNA, 15 bp, Homo sapiens
gcacacactcagtgc

SEQ ID NO: 1442455 - DNA, 18 bp, Homo sapiens
gcacacagaatgctcagg

SEQ ID NO: 1442456 - DNA, 13 bp, Homo sapiens
gcacacagagatt

SEQ ID NO: 1442457 - DNA, 22 bp, Homo sapiens
gcacacagctgagcacttagca

SEQ ID NO: 1442458 - DNA, 12 bp, Homo sapiens
gcacacaggaca

SEQ ID NO: 1442459 - DNA, 13 bp, Homo sapiens
gcacaccactgcc

SEQ ID NO: 1442460 - DNA, 16 bp, Homo sapiens
gcacaccactgccctg

SEQ ID NO: 1442461 - DNA, 19 bp, Homo sapiens
gcacaccactgccctgcct

SEQ ID NO: 1442462 - DNA, 22 bp, Homo sapiens
gcacaccactgccctgcctgcc

SEQ ID NO: 1442463 - DNA, 12 bp, Homo sapiens
gcacaccagccg

SEQ ID NO: 1442464 - DNA, 15 bp, Homo sapiens
gcacacccctggggc

SEQ ID NO: 1442465 - DNA, 14 bp, Homo sapiens
gcacacccgtgtgc

SEQ ID NO: 1442466 - DNA, 18 bp, Homo sapiens
gcacacctcagccccact

SEQ ID NO: 1442467 - DNA, 14 bp, Homo sapiens
gcacacctgtgtcc

SEQ ID NO: 1442468 - DNA, 15 bp, Homo sapiens
gcacacctgtgtcca

SEQ ID NO: 1442469 - DNA, 18 bp, Homo sapiens
gcacaccttttccccagg

SEQ ID NO: 1442470 - DNA, 22 bp, Homo sapiens
gcacaccttttccccaggagca

SEQ ID NO: 1442471 - DNA, 21 bp, Homo sapiens
gcacacggctggtcactctgc

SEQ ID NO: 1442472 - DNA, 19 bp, Homo sapiens
gcacactcatgcacacaga

SEQ ID NO: 1442473 - DNA, 20 bp, Homo sapiens
gcacactcccctgcactgga

SEQ ID NO: 1442474 - DNA, 12 bp, Homo sapiens
gcacactgtagc

SEQ ID NO: 1442475 - DNA, 21 bp, Homo sapiens
gcactcaactctgagcccata

SEQ ID NO: 1442476 - DNA, 17 bp, Homo sapiens
gcactcacagacctgga

SEQ ID NO: 1442477 - DNA, 19 bp, Homo sapiens
gcactcacagacctggagc

SEQ ID NO: 1442478 - DNA, 23 bp, Homo sapiens
gcactcagcctcattcagcatgg

SEQ ID NO: 1442479 - DNA, 14 bp, Homo sapiens
gcactccacacatc

SEQ ID NO: 1442480 - DNA, 11 bp, Homo sapiens
gcactccagcc

SEQ ID NO: 1442481 - DNA, 12 bp, Homo sapiens
gcactccagcct

SEQ ID NO: 1442482 - DNA, 14 bp, Homo sapiens
gcactccagcctga

SEQ ID NO: 1442483 - DNA, 14 bp, Homo sapiens
gcactccagtctgg

SEQ ID NO: 1442484 - DNA, 15 bp, Homo sapiens
gcactccatgcttag

SEQ ID NO: 1442485 - DNA, 13 bp, Homo sapiens
gcactccatggcc

SEQ ID NO: 1442486 - DNA, 15 bp, Homo sapiens
gcactccatggccac

SEQ ID NO: 1442487 - DNA, 15 bp, Homo sapiens
gcactcccaaccctg

SEQ ID NO: 1442488 - DNA, 17 bp, Homo sapiens
gcactcccacctgacac

SEQ ID NO: 1442489 - DNA, 22 bp, Homo sapiens
gcactcccacctgacacaccag

SEQ ID NO: 1442490 - DNA, 20 bp, Homo sapiens
gcactccccagagctgtgcc

SEQ ID NO: 1442491 - DNA, 21 bp, Homo sapiens
gcactccccagagctgtgcca

SEQ ID NO: 1442492 - DNA, 22 bp, Homo sapiens
gcactccccagagctgtgccag

SEQ ID NO: 1442493 - DNA, 14 bp, Homo sapiens
gcactccctggcct

SEQ ID NO: 1442494 - DNA, 16 bp, Homo sapiens
gcactcgagaccatcc

SEQ ID NO: 1442495 - DNA, 18 bp, Homo sapiens
gcactcgagaccatcctg

SEQ ID NO: 1442496 - DNA, 21 bp, Homo sapiens
gcactcgagaccatcctggcc

SEQ ID NO: 1442497 - DNA, 15 bp, Homo sapiens
gcactctagattcca

SEQ ID NO: 1442498 - DNA, 20 bp, Homo sapiens
gcactctctaaatcttcctt

SEQ ID NO: 1442499 - DNA, 24 bp, Homo sapiens
gcactctctaaatcttccttgtga

SEQ ID NO: 1442500 - DNA, 22 bp, Homo sapiens
gcactctggatgatggattcca

SEQ ID NO: 1442501 - DNA, 23 bp, Homo sapiens
gcactgaagccggacagctgccc

SEQ ID NO: 1442502 - DNA, 17 bp, Homo sapiens
gcactgacccttccaga

SEQ ID NO: 1442503 - DNA, 21 bp, Homo sapiens
gcactgacccttccagacata

SEQ ID NO: 1442504 - DNA, 14 bp, Homo sapiens
gcactgagagggca

SEQ ID NO: 1442505 - DNA, 11 bp, Homo sapiens
gcactgagccc

SEQ ID NO: 1442506 - DNA, 13 bp, Homo sapiens
gcactgaggaaga

SEQ ID NO: 1442507 - DNA, 18 bp, Homo sapiens
gattttaatttatttgtt

SEQ ID NO: 1442508 - DNA, 16 bp, Homo sapiens
gattttacaaaagatg

SEQ ID NO: 1442509 - DNA, 12 bp, Homo sapiens
gattttaccaaa

SEQ ID NO: 1442510 - DNA, 18 bp, Homo sapiens
gattttcaaagctttttc

SEQ ID NO: 1442511 - DNA, 18 bp, Homo sapiens
gattttcaagattctaaa

SEQ ID NO: 1442512 - DNA, 19 bp, Homo sapiens
gattttcaagattctaaag

SEQ ID NO: 1442513 - DNA, 19 bp, Homo sapiens
gattttcacattcttggct

SEQ ID NO: 1442514 - DNA, 20 bp, Homo sapiens
gattttctcactgaactcca

SEQ ID NO: 1442515 - DNA, 14 bp, Homo sapiens
gatggcccctccag

SEQ ID NO: 1442516 - DNA, 14 bp, Homo sapiens
gatggccgggctgc

SEQ ID NO: 1442517 - DNA, 22 bp, Homo sapiens
gatggcgcgggaggcaccagct

SEQ ID NO: 1442518 - DNA, 19 bp, Homo sapiens
gatggcgtgggctgcgtga

SEQ ID NO: 1442519 - DNA, 17 bp, Homo sapiens
gatggctcaagacaagg

SEQ ID NO: 1442520 - DNA, 18 bp, Homo sapiens
gatggctcccaaggttcc

SEQ ID NO: 1442521 - DNA, 12 bp, Homo sapiens
gatggctgctgc

SEQ ID NO: 1442522 - DNA, 16 bp, Homo sapiens
gatggctgtcgcctgt

SEQ ID NO: 1442523 - DNA, 16 bp, Homo sapiens
gatggcttacaaaaag

SEQ ID NO: 1442524 - DNA, 20 bp, Homo sapiens
gatgggaatagggagacagg

SEQ ID NO: 1442525 - DNA, 14 bp, Homo sapiens
gatgggatttttgt

SEQ ID NO: 1442526 - DNA, 22 bp, Homo sapiens
gatgggcagcccaacagcactt

SEQ ID NO: 1442527 - DNA, 17 bp, Homo sapiens
gatgggcccctggcccc

SEQ ID NO: 1442528 - DNA, 19 bp, Homo sapiens
gatgggcggacggctgtgg

SEQ ID NO: 1442529 - DNA, 17 bp, Homo sapiens
gatgggctcccaccctc

SEQ ID NO: 1442530 - DNA, 18 bp, Homo sapiens
gatgggcttgttttcttg

SEQ ID NO: 1442531 - DNA, 17 bp, Homo sapiens
gatggggaatccgtgtg

SEQ ID NO: 1442532 - DNA, 21 bp, Homo sapiens
gatggggaatccgtgtgtgtg

SEQ ID NO: 1442533 - DNA, 13 bp, Homo sapiens
gatggggagaaag

SEQ ID NO: 1442534 - DNA, 14 bp, Homo sapiens
gatggggagaaagg

SEQ ID NO: 1442535 - DNA, 16 bp, Homo sapiens
gatggggcaagacaga

SEQ ID NO: 1442536 - DNA, 22 bp, Homo sapiens
gatggggcaagacagaaaagtg

SEQ ID NO: 1442537 - DNA, 21 bp, Homo sapiens
gatggggctggcatgttttct

SEQ ID NO: 1442538 - DNA, 19 bp, Homo sapiens
gatgggggaactcagatcc

SEQ ID NO: 1442539 - DNA, 20 bp, Homo sapiens
gatgggggcagggctgtgct

SEQ ID NO: 1442540 - DNA, 19 bp, Homo sapiens
gatggggtctgtgactgga

SEQ ID NO: 1442541 - DNA, 15 bp, Homo sapiens
gatggggttctggaa

SEQ ID NO: 1442542 - DNA, 17 bp, Homo sapiens
gatggggtttcaccatg

SEQ ID NO: 1442543 - DNA, 15 bp, Homo sapiens
gatgggtcagagcta

SEQ ID NO: 1442544 - DNA, 14 bp, Homo sapiens
gatggtaagagaaa

SEQ ID NO: 1442545 - DNA, 15 bp, Homo sapiens
gatggtaagagaaaa

SEQ ID NO: 1442546 - DNA, 23 bp, Homo sapiens
gatggtatctgggtaagaagaaa

SEQ ID NO: 1442547 - DNA, 21 bp, Homo sapiens
gatggtccgtgcccaggccct

SEQ ID NO: 1442548 - DNA, 21 bp, Homo sapiens
gatggtcctggggctctgtgc

SEQ ID NO: 1442549 - DNA, 15 bp, Homo sapiens
gatggtgagctggga

SEQ ID NO: 1442550 - DNA, 15 bp, Homo sapiens
gatggtgcccctagg

SEQ ID NO: 1442551 - DNA, 17 bp, Homo sapiens
gatggtgctgcccaggc

SEQ ID NO: 1442552 - DNA, 17 bp, Homo sapiens
gatggtgggcaggatct

SEQ ID NO: 1442553 - DNA, 17 bp, Homo sapiens
gatggtgtgggtgtcct

SEQ ID NO: 1442554 - DNA, 18 bp, Homo sapiens
gatggttcccctgttcac

SEQ ID NO: 1442555 - DNA, 14 bp, Homo sapiens
gatggttctgtgac

SEQ ID NO: 1442556 - DNA, 20 bp, Homo sapiens
gatgtaaaatcttgtcatgt

SEQ ID NO: 1442557 - DNA, 13 bp, Homo sapiens
gatgtaaacaatg

SEQ ID NO: 1442558 - DNA, 20 bp, Homo sapiens
gatgtaaacagtgcctgctg

SEQ ID NO: 1442559 - DNA, 21 bp, Homo sapiens
gatgtaaacagtgcctgctga

SEQ ID NO: 1442560 - DNA, 16 bp, Homo sapiens
gatgtaaccaagctgt

SEQ ID NO: 1442561 - DNA, 17 bp, Homo sapiens
gatgtacagattttatt

SEQ ID NO: 1442562 - DNA, 16 bp, Homo sapiens
gatgtacagtctgtca

SEQ ID NO: 1442563 - DNA, 19 bp, Homo sapiens
gatgtacagtctgtcatga

SEQ ID NO: 1442564 - DNA, 22 bp, Homo sapiens
gatgtacatttccaaattcaca

SEQ ID NO: 1442565 - DNA, 22 bp, Homo sapiens
gatgtactgcaaagtcgccagt

SEQ ID NO: 1442566 - DNA, 13 bp, Homo sapiens
gatgtagaaagtt

SEQ ID NO: 1442567 - DNA, 12 bp, Homo sapiens
gatgtagaactt

SEQ ID NO: 1442568 - DNA, 17 bp, Homo sapiens
gatgtaggcattctgga

SEQ ID NO: 1442569 - DNA, 20 bp, Homo sapiens
gatgtagggtaaggtgcctt

SEQ ID NO: 1442570 - DNA, 21 bp, Homo sapiens
gatgtagggtaaggtgccttc

SEQ ID NO: 1442571 - DNA, 15 bp, Homo sapiens
gatgtagtctgaggc

SEQ ID NO: 1442572 - DNA, 21 bp, Homo sapiens
gatgtatgtgtgaaacaatgt

SEQ ID NO: 1442573 - DNA, 21 bp, Homo sapiens
gatgtcaaagtgtaacagata

SEQ ID NO: 1442574 - DNA, 15 bp, Homo sapiens
gatgtcaatttctgt

SEQ ID NO: 1442575 - DNA, 20 bp, Homo sapiens
gatgtcacagtccaaccaga

SEQ ID NO: 1442576 - DNA, 13 bp, Homo sapiens
gatgtcatcttga

SEQ ID NO: 1442577 - DNA, 20 bp, Homo sapiens
gatgtcatgtacttcctgtg

SEQ ID NO: 1442578 - DNA, 21 bp, Homo sapiens
gatgtcatgtacttcctgtgt

SEQ ID NO: 1442579 - DNA, 22 bp, Homo sapiens
gatgtcatgtacttcctgtgta

SEQ ID NO: 1442580 - DNA, 17 bp, Homo sapiens
gatgtccacagatgcct

SEQ ID NO: 1442581 - DNA, 16 bp, Homo sapiens
gatgtccagggggaga

SEQ ID NO: 1442582 - DNA, 21 bp, Homo sapiens
gatgtccctttcttggccagt

SEQ ID NO: 1442583 - DNA, 22 bp, Homo sapiens
gatgtcctctttactcccttcc

SEQ ID NO: 1442584 - DNA, 13 bp, Homo sapiens
gatgtctcttgta

SEQ ID NO: 1442585 - DNA, 16 bp, Homo sapiens
gatgtctcttgtagaa

SEQ ID NO: 1442586 - DNA, 21 bp, Homo sapiens
gatgtctgccaatttttgcct

SEQ ID NO: 1442587 - DNA, 20 bp, Homo sapiens
gatgtcttaacgaataaagg

SEQ ID NO: 1442588 - DNA, 13 bp, Homo sapiens
gatgtcttctgcc

SEQ ID NO: 1442589 - DNA, 15 bp, Homo sapiens
gatgtcttctgcctg

SEQ ID NO: 1442590 - DNA, 24 bp, Homo sapiens
gatgtcttttttaaggctctgtgc

SEQ ID NO: 1442591 - DNA, 22 bp, Homo sapiens
gatgtgaaattcatttgtggca

SEQ ID NO: 1442592 - DNA, 23 bp, Homo sapiens
gatgtgaataggttatatgcaag

SEQ ID NO: 1442593 - DNA, 20 bp, Homo sapiens
gatgtgacccaccagtgcct

SEQ ID NO: 1442594 - DNA, 15 bp, Homo sapiens
gatgtgatattctaa

SEQ ID NO: 1442595 - DNA, 18 bp, Homo sapiens
gatgtgcaatacattttt

SEQ ID NO: 1442596 - DNA, 15 bp, Homo sapiens
gatgtgcaggaagaa

SEQ ID NO: 1442597 - DNA, 23 bp, Homo sapiens
gatgtgcatttttgtgaaatgaa

SEQ ID NO: 1442598 - DNA, 13 bp, Homo sapiens
gatgtgctcagcc

SEQ ID NO: 1442599 - DNA, 11 bp, Homo sapiens
gatgtgctttt

SEQ ID NO: 1442600 - DNA, 14 bp, Homo sapiens
gatgtggaggaaga

SEQ ID NO: 1442601 - DNA, 12 bp, Homo sapiens
gatgtggccctg

SEQ ID NO: 1442602 - DNA, 20 bp, Homo sapiens
gatgtggccctggcctgctg

SEQ ID NO: 1442603 - DNA, 19 bp, Homo sapiens
gatgtggggctgagctggg

SEQ ID NO: 1442604 - DNA, 16 bp, Homo sapiens
gatgtgggtaagagga

SEQ ID NO: 1442605 - DNA, 14 bp, Homo sapiens
gatgtgggtgtcct

SEQ ID NO: 1442606 - DNA, 12 bp, Homo sapiens
gatgtgtaaaca

SEQ ID NO: 1442607 - DNA, 21 bp, Homo sapiens
gatgtgtcctgataagctgag

SEQ ID NO: 1442608 - DNA, 16 bp, Homo sapiens
gatgtgtgatttttag

SEQ ID NO: 1442609 - DNA, 18 bp, Homo sapiens
gatgtgtggactgtggca

SEQ ID NO: 1442610 - DNA, 18 bp, Homo sapiens
gatgtgttcattcaagct

SEQ ID NO: 1442611 - DNA, 20 bp, Homo sapiens
gatgtgttcattcaagctat

SEQ ID NO: 1442612 - DNA, 18 bp, Homo sapiens
gatgttatgaacagctgt

SEQ ID NO: 1442613 - DNA, 13 bp, Homo sapiens
gatgttcaaatat

SEQ ID NO: 1442614 - DNA, 18 bp, Homo sapiens
gatgttcactgtggcatt

SEQ ID NO: 1442615 - DNA, 17 bp, Homo sapiens
gatgttcagcactgtcc

SEQ ID NO: 1442616 - DNA, 14 bp, Homo sapiens
gatgttcatttaga

SEQ ID NO: 1442617 - DNA, 19 bp, Homo sapiens
gatgttctaaggctctgag

SEQ ID NO: 1442618 - DNA, 20 bp, Homo sapiens
gatgttctaaggctctgaga

SEQ ID NO: 1442619 - DNA, 13 bp, Homo sapiens
gatgttgccatgt

SEQ ID NO: 1442620 - DNA, 19 bp, Homo sapiens
gatgttgcttttgaaaagt

SEQ ID NO: 1442621 - DNA, 22 bp, Homo sapiens
gatgttgcttttgaaaagttga

SEQ ID NO: 1442622 - DNA, 23 bp, Homo sapiens
gatgtttattcttctagagttca

SEQ ID NO: 1442623 - DNA, 17 bp, Homo sapiens
gatgtttcaactgtgct

SEQ ID NO: 1442624 - DNA, 15 bp, Homo sapiens
gatgtttccagctgc

SEQ ID NO: 1442625 - DNA, 13 bp, Homo sapiens
gatgtttcctgga

SEQ ID NO: 1442626 - DNA, 16 bp, Homo sapiens
gatgtttgtggcctca

SEQ ID NO: 1442627 - DNA, 13 bp, Homo sapiens
gattaaagactgt

SEQ ID NO: 1442628 - DNA, 13 bp, Homo sapiens
gattaaaggaagg

SEQ ID NO: 1442629 - DNA, 19 bp, Homo sapiens
gattctggataaagccact

SEQ ID NO: 1442630 - DNA, 23 bp, Homo sapiens
gattctgggaagcttgagcctcc

SEQ ID NO: 1442631 - DNA, 17 bp, Homo sapiens
gattctggttccagggt

SEQ ID NO: 1442632 - DNA, 21 bp, Homo sapiens
gattctgtgtcagagcccagc

SEQ ID NO: 1442633 - DNA, 15 bp, Homo sapiens
gagggttcccctggc

SEQ ID NO: 1442634 - DNA, 15 bp, Homo sapiens
gagggttctaagtgg

SEQ ID NO: 1442635 - DNA, 13 bp, Homo sapiens
gagggttgtgcta

SEQ ID NO: 1442636 - DNA, 13 bp, Homo sapiens
gaggtagagaaac

SEQ ID NO: 1442637 - DNA, 19 bp, Homo sapiens
gaggtagccgagtcacacc

SEQ ID NO: 1442638 - DNA, 15 bp, Homo sapiens
gaggtataaagacaa

SEQ ID NO: 1442639 - DNA, 15 bp, Homo sapiens
gaggtataattgtgt

SEQ ID NO: 1442640 - DNA, 15 bp, Homo sapiens
gaggtatggcagagg

SEQ ID NO: 1442641 - DNA, 19 bp, Homo sapiens
gaggtatttatctttactt

SEQ ID NO: 1442642 - DNA, 23 bp, Homo sapiens
gaggtcaacagagaaggcaggaa

SEQ ID NO: 1442643 - DNA, 15 bp, Homo sapiens
gaggtcaccagctgc

SEQ ID NO: 1442644 - DNA, 22 bp, Homo sapiens
gaggtcaccagctgctgtgccc

SEQ ID NO: 1442645 - DNA, 21 bp, Homo sapiens
gaggtcactccaccatcccca

SEQ ID NO: 1442646 - DNA, 11 bp, Homo sapiens
gaggtcactgc

SEQ ID NO: 1442647 - DNA, 21 bp, Homo sapiens
gaggtcactggaaaggggaga

SEQ ID NO: 1442648 - DNA, 22 bp, Homo sapiens
gaggtcaggaaacttttaactg

SEQ ID NO: 1442649 - DNA, 23 bp, Homo sapiens
gaggtcataaaatgtctcgagtc

SEQ ID NO: 1442650 - DNA, 16 bp, Homo sapiens
gaggtcatctggcgga

SEQ ID NO: 1442651 - DNA, 24 bp, Homo sapiens
gaggtcatctggcggaggtctctg

SEQ ID NO: 1442652 - DNA, 13 bp, Homo sapiens
gaggtccagaccc

SEQ ID NO: 1442653 - DNA, 17 bp, Homo sapiens
gaggtccagctgggcct

SEQ ID NO: 1442654 - DNA, 20 bp, Homo sapiens
gaggtccagctgggcctcct

SEQ ID NO: 1442655 - DNA, 23 bp, Homo sapiens
gaggtcccacttgcaacttcttt

SEQ ID NO: 1442656 - DNA, 23 bp, Homo sapiens
gaggtcctccgtagggtctttct

SEQ ID NO: 1442657 - DNA, 14 bp, Homo sapiens
gaggtcctctggag

SEQ ID NO: 1442658 - DNA, 20 bp, Homo sapiens
gaggtcgggagttcgagacc

SEQ ID NO: 1442659 - DNA, 15 bp, Homo sapiens
gagtgtttaataaag

SEQ ID NO: 1442660 - DNA, 22 bp, Homo sapiens
gagtgtttctaataaacttgga

SEQ ID NO: 1442661 - DNA, 13 bp, Homo sapiens
gagttaaaatgca

SEQ ID NO: 1442662 - DNA, 12 bp, Homo sapiens
gagttaaataaa

SEQ ID NO: 1442663 - DNA, 18 bp, Homo sapiens
gagttaacgggtgaataa

SEQ ID NO: 1442664 - DNA, 16 bp, Homo sapiens
gagttacagttctgtg

SEQ ID NO: 1442665 - DNA, 21 bp, Homo sapiens
gagttacttgtctgaggcctc

SEQ ID NO: 1442666 - DNA, 21 bp, Homo sapiens
gagttagcatgtatgaatgta

SEQ ID NO: 1442667 - DNA, 18 bp, Homo sapiens
gagttaggctattcacaa

SEQ ID NO: 1442668 - DNA, 14 bp, Homo sapiens
gagttagggagaga

SEQ ID NO: 1442669 - DNA, 15 bp, Homo sapiens
gagttagggagagag

SEQ ID NO: 1442670 - DNA, 18 bp, Homo sapiens
gagttaggggccttaggg

SEQ ID NO: 1442671 - DNA, 14 bp, Homo sapiens
gagttatcaggtgc

SEQ ID NO: 1442672 - DNA, 17 bp, Homo sapiens
gagttatgatgtaatct

SEQ ID NO: 1442673 - DNA, 22 bp, Homo sapiens
gagttatgatgtaatctctctg

SEQ ID NO: 1442674 - DNA, 23 bp, Homo sapiens
gagttattttaattatcttttct

SEQ ID NO: 1442675 - DNA, 22 bp, Homo sapiens
gagttccttatccctctcttcc

SEQ ID NO: 1442676 - DNA, 13 bp, Homo sapiens
gagttccttctca

SEQ ID NO: 1442677 - DNA, 17 bp, Homo sapiens
gagttcgagaccagcct

SEQ ID NO: 1442678 - DNA, 14 bp, Homo sapiens
gagttctgtgaaga

SEQ ID NO: 1442679 - DNA, 15 bp, Homo sapiens
gagttcttgtgccat

SEQ ID NO: 1442680 - DNA, 19 bp, Homo sapiens
gagttgatctggaacccag

SEQ ID NO: 1442681 - DNA, 15 bp, Homo sapiens
gagttgctttgccag

SEQ ID NO: 1442682 - DNA, 19 bp, Homo sapiens
gagttgctttgccagagca

SEQ ID NO: 1442683 - DNA, 17 bp, Homo sapiens
gagttggagtagaatgt

SEQ ID NO: 1442684 - DNA, 13 bp, Homo sapiens
gagttggctggga

SEQ ID NO: 1442685 - DNA, 14 bp, Homo sapiens
gagttgtcacagaa

SEQ ID NO: 1442686 - DNA, 20 bp, Homo sapiens
gagttgtggaaagcctctgc

SEQ ID NO: 1442687 - DNA, 22 bp, Homo sapiens
gagttgttttcagactcagact

SEQ ID NO: 1442688 - DNA, 23 bp, Homo sapiens
gagtttaaaaaaataacatctga

SEQ ID NO: 1442689 - DNA, 13 bp, Homo sapiens
gagtttaaagcaa

SEQ ID NO: 1442690 - DNA, 19 bp, Homo sapiens
gagtttaagaccagcctgg

SEQ ID NO: 1442691 - DNA, 23 bp, Homo sapiens
gagtttaccatttgtaataaagt

SEQ ID NO: 1442692 - DNA, 16 bp, Homo sapiens
gagtttatacagtgta

SEQ ID NO: 1442693 - DNA, 19 bp, Homo sapiens
gagtttatacagtgtacat

SEQ ID NO: 1442694 - DNA, 21 bp, Homo sapiens
gagtttatacagtgtacatgt

SEQ ID NO: 1442695 - DNA, 22 bp, Homo sapiens
gagtttatacagtgtacatgta

SEQ ID NO: 1442696 - DNA, 17 bp, Homo sapiens
gagtttattacaatgta

SEQ ID NO: 1442697 - DNA, 20 bp, Homo sapiens
gagtttattacaatgtatct

SEQ ID NO: 1442698 - DNA, 21 bp, Homo sapiens
gagtttcactgtactgcatgt

SEQ ID NO: 1442699 - DNA, 16 bp, Homo sapiens
gagtttccaaaaccag

SEQ ID NO: 1442700 - DNA, 13 bp, Homo sapiens
gagtttctaaggt

SEQ ID NO: 1442701 - DNA, 17 bp, Homo sapiens
gagtttgcaatgtcaca

SEQ ID NO: 1442702 - DNA, 20 bp, Homo sapiens
gagtttgctgttgaggtggc

SEQ ID NO: 1442703 - DNA, 18 bp, Homo sapiens
gagtttgtcgctcatgtg

SEQ ID NO: 1442704 - DNA, 12 bp, Homo sapiens
gagttttaacac

SEQ ID NO: 1442705 - DNA, 16 bp, Homo sapiens
gagttttcattaaatc

SEQ ID NO: 1442706 - DNA, 18 bp, Homo sapiens
gagttttgatttggtgga

SEQ ID NO: 1442707 - DNA, 13 bp, Homo sapiens
gagttttgtgttt

SEQ ID NO: 1442708 - DNA, 13 bp, Homo sapiens
gagttttgtttta

SEQ ID NO: 1442709 - DNA, 19 bp, Homo sapiens
gagttttgttttaaaatta

SEQ ID NO: 1442710 - DNA, 21 bp, Homo sapiens
gagtttttaaagccttctgga

SEQ ID NO: 1442711 - DNA, 16 bp, Homo sapiens
gataaaaggtttcttt

SEQ ID NO: 1442712 - DNA, 13 bp, Homo sapiens
gataaaatcataa

SEQ ID NO: 1442713 - DNA, 16 bp, Homo sapiens
gataaacacaggcagg

SEQ ID NO: 1442714 - DNA, 15 bp, Homo sapiens
gataaacattaaaca

SEQ ID NO: 1442715 - DNA, 18 bp, Homo sapiens
gataaagaaaagacattt

SEQ ID NO: 1442716 - DNA, 16 bp, Homo sapiens
gataaagaccagaaat

SEQ ID NO: 1442717 - DNA, 11 bp, Homo sapiens
gataaagatga

SEQ ID NO: 1442718 - DNA, 12 bp, Homo sapiens
gataaagatgat

SEQ ID NO: 1442719 - DNA, 13 bp, Homo sapiens
gataaagattgtg

SEQ ID NO: 1442720 - DNA, 21 bp, Homo sapiens
gataaagattgtgtggtgttt

SEQ ID NO: 1442721 - DNA, 13 bp, Homo sapiens
gataaagatttct

SEQ ID NO: 1442722 - DNA, 15 bp, Homo sapiens
gataaagtttctcag

SEQ ID NO: 1442723 - DNA, 12 bp, Homo sapiens
gataaatattca

SEQ ID NO: 1442724 - DNA, 17 bp, Homo sapiens
gataaatcataaagtca

SEQ ID NO: 1442725 - DNA, 20 bp, Homo sapiens
gataaatccttaacatttct

SEQ ID NO: 1442726 - DNA, 12 bp, Homo sapiens
gataaatgaaat

SEQ ID NO: 1442727 - DNA, 15 bp, Homo sapiens
gataaatgagctttc

SEQ ID NO: 1442728 - DNA, 20 bp, Homo sapiens
gataaatgattcaaaaagtc

SEQ ID NO: 1442729 - DNA, 15 bp, Homo sapiens
gataacaaaaaataa

SEQ ID NO: 1442730 - DNA, 16 bp, Homo sapiens
gataacaaaaaataaa

SEQ ID NO: 1442731 - DNA, 19 bp, Homo sapiens
gataacaaccttttacatt

SEQ ID NO: 1442732 - DNA, 21 bp, Homo sapiens
gataacctgtacttcaagtta

SEQ ID NO: 1442733 - DNA, 14 bp, Homo sapiens
gataactagccaga

SEQ ID NO: 1442734 - DNA, 19 bp, Homo sapiens
gataactctctttccttga

SEQ ID NO: 1442735 - DNA, 21 bp, Homo sapiens
gataactgcaattttaattga

SEQ ID NO: 1442736 - DNA, 14 bp, Homo sapiens
gataacttactgta

SEQ ID NO: 1442737 - DNA, 11 bp, Homo sapiens
gataagaaaag

SEQ ID NO: 1442738 - DNA, 16 bp, Homo sapiens
gataagggaaaagata

SEQ ID NO: 1442739 - DNA, 16 bp, Homo sapiens
gataagttcatacatt

SEQ ID NO: 1442740 - DNA, 18 bp, Homo sapiens
gataagttggagcagggg

SEQ ID NO: 1442741 - DNA, 13 bp, Homo sapiens
gataataataata

SEQ ID NO: 1442742 - DNA, 16 bp, Homo sapiens
gataataatatatgtt

SEQ ID NO: 1442743 - DNA, 12 bp, Homo sapiens
gataatatataa

SEQ ID NO: 1442744 - DNA, 17 bp, Homo sapiens
gataatatgagatttct

SEQ ID NO: 1442745 - DNA, 13 bp, Homo sapiens
gataatcaggaaa

SEQ ID NO: 1442746 - DNA, 14 bp, Homo sapiens
gataatcaggaaaa

SEQ ID NO: 1442747 - DNA, 18 bp, Homo sapiens
gataatcaggaaaaatga

SEQ ID NO: 1442748 - DNA, 21 bp, Homo sapiens
gataatcagtgtgtctaaatt

SEQ ID NO: 1442749 - DNA, 16 bp, Homo sapiens
gataatgaaataatca

SEQ ID NO: 1442750 - DNA, 12 bp, Homo sapiens
gataattcattt

SEQ ID NO: 1442751 - DNA, 18 bp, Homo sapiens
gataattcatttgtattg

SEQ ID NO: 1442752 - DNA, 17 bp, Homo sapiens
gatacaaatgtctatca

SEQ ID NO: 1442753 - DNA, 21 bp, Homo sapiens
gatacacccaaagtatcagga

SEQ ID NO: 1442754 - DNA, 19 bp, Homo sapiens
gatacaccgggcctggaga

SEQ ID NO: 1442755 - DNA, 22 bp, Homo sapiens
gatacactgtatctaaaaaata

SEQ ID NO: 1442756 - DNA, 16 bp, Homo sapiens
gatacagaaatgcaaa

SEQ ID NO: 1442757 - DNA, 17 bp, Homo sapiens
gatacagaaatgcaaaa

SEQ ID NO: 1442758 - DNA, 15 bp, Homo sapiens
gatacagctcttctc

SEQ ID NO: 1442759 - DNA, 20 bp, Homo sapiens
gaggcctgcctccagggctg

SEQ ID NO: 1442760 - DNA, 22 bp, Homo sapiens
gaggcctgcctccagggctgga

SEQ ID NO: 1442761 - DNA, 16 bp, Homo sapiens
gaggcctgcgaccctg

SEQ ID NO: 1442762 - DNA, 20 bp, Homo sapiens
gaggcctgctgccagtgcag

SEQ ID NO: 1442763 - DNA, 14 bp, Homo sapiens
gaggcctgcttccc

SEQ ID NO: 1442764 - DNA, 19 bp, Homo sapiens
gaggcctggactttcctgc

SEQ ID NO: 1442765 - DNA, 20 bp, Homo sapiens
gaggcctggagcccacaacc

SEQ ID NO: 1442766 - DNA, 16 bp, Homo sapiens
gaggcctgggccgctg

SEQ ID NO: 1442767 - DNA, 21 bp, Homo sapiens
gaggcctgggccgctgccacg

SEQ ID NO: 1442768 - DNA, 18 bp, Homo sapiens
gaggcctgggctgggaaa

SEQ ID NO: 1442769 - DNA, 18 bp, Homo sapiens
gaggccttatcattcatt

SEQ ID NO: 1442770 - DNA, 18 bp, Homo sapiens
gaggccttccagctgctg

SEQ ID NO: 1442771 - DNA, 20 bp, Homo sapiens
gaggccttccagctgctgtc

SEQ ID NO: 1442772 - DNA, 15 bp, Homo sapiens
gaggccttgagaggc

SEQ ID NO: 1442773 - DNA, 22 bp, Homo sapiens
gaggccttgtgtgtcaggccct

SEQ ID NO: 1442774 - DNA, 13 bp, Homo sapiens
gaggcgagccagg

SEQ ID NO: 1442775 - DNA, 16 bp, Homo sapiens
gaggcgagccaggcaa

SEQ ID NO: 1442776 - DNA, 23 bp, Homo sapiens
gaggcggcccggccagcgggcac

SEQ ID NO: 1442777 - DNA, 16 bp, Homo sapiens
gaggcgggccagccag

SEQ ID NO: 1442778 - DNA, 21 bp, Homo sapiens
gaggcgtactacccagctctg

SEQ ID NO: 1442779 - DNA, 20 bp, Homo sapiens
gaggcgtgcccccctcctcc

SEQ ID NO: 1442780 - DNA, 19 bp, Homo sapiens
gaggctaagatgagatttg

SEQ ID NO: 1442781 - DNA, 23 bp, Homo sapiens
gaggctaagatgagatttgccag

SEQ ID NO: 1442782 - DNA, 16 bp, Homo sapiens
gaggctacctcacctg

SEQ ID NO: 1442783 - DNA, 18 bp, Homo sapiens
gaggctacctcacctggg

SEQ ID NO: 1442784 - DNA, 16 bp, Homo sapiens
gaggctcactgagtga

SEQ ID NO: 1442785 - DNA, 23 bp, Homo sapiens
gaggctcactgagtgatacttta

SEQ ID NO: 1442786 - DNA, 14 bp, Homo sapiens
gaggctccccgcct

SEQ ID NO: 1442787 - DNA, 20 bp, Homo sapiens
gaggctccccgcctccactc

SEQ ID NO: 1442788 - DNA, 21 bp, Homo sapiens
gaggctccccgcctccactct

SEQ ID NO: 1442789 - DNA, 22 bp, Homo sapiens
gaggctccccgcctccactcta

SEQ ID NO: 1442790 - DNA, 20 bp, Homo sapiens
gaggctcggagcacccttgc

SEQ ID NO: 1442791 - DNA, 16 bp, Homo sapiens
gaggctctttctgggc

SEQ ID NO: 1442792 - DNA, 20 bp, Homo sapiens
gaggctgaaagaggccaatg

SEQ ID NO: 1442793 - DNA, 19 bp, Homo sapiens
gaggctgacgtgtgaggga

SEQ ID NO: 1442794 - DNA, 13 bp, Homo sapiens
gaggctgagacag

SEQ ID NO: 1442795 - DNA, 21 bp, Homo sapiens
gaggctgagacaggagaatca

SEQ ID NO: 1442796 - DNA, 22 bp, Homo sapiens
gaggctgagcctacagatgaac

SEQ ID NO: 1442797 - DNA, 13 bp, Homo sapiens
gaggctgaggcag

SEQ ID NO: 1442798 - DNA, 21 bp, Homo sapiens
gaggctgaggcaggagaatca

SEQ ID NO: 1442799 - DNA, 16 bp, Homo sapiens
gaggctgcagagctga

SEQ ID NO: 1442800 - DNA, 13 bp, Homo sapiens
gaggctgcagcag

SEQ ID NO: 1442801 - DNA, 20 bp, Homo sapiens
gaggctgcagcaggtgctgg

SEQ ID NO: 1442802 - DNA, 19 bp, Homo sapiens
gaggctgcatgctctggaa

SEQ ID NO: 1442803 - DNA, 17 bp, Homo sapiens
gaggctgccccaggccg

SEQ ID NO: 1442804 - DNA, 19 bp, Homo sapiens
gaggctgccccaggccgga

SEQ ID NO: 1442805 - DNA, 22 bp, Homo sapiens
gaggctgccccaggccggagcc

SEQ ID NO: 1442806 - DNA, 23 bp, Homo sapiens
gaggctgccccaggccggagccc

SEQ ID NO: 1442807 - DNA, 14 bp, Homo sapiens
gaggctgcccctct

SEQ ID NO: 1442808 - DNA, 16 bp, Homo sapiens
gaggctgcctcagcca

SEQ ID NO: 1442809 - DNA, 14 bp, Homo sapiens
gaggctgctgccat

SEQ ID NO: 1442810 - DNA, 13 bp, Homo sapiens
gaggctgctgtga

SEQ ID NO: 1442811 - DNA, 14 bp, Homo sapiens
gaggctgctgtgaa

SEQ ID NO: 1442812 - DNA, 16 bp, Homo sapiens
gaggctgcttcccaga

SEQ ID NO: 1442813 - DNA, 23 bp, Homo sapiens
gaggctgctttctgcccttctcc

SEQ ID NO: 1442814 - DNA, 15 bp, Homo sapiens
gaggctggaggcagg

SEQ ID NO: 1442815 - DNA, 16 bp, Homo sapiens
gaggctggaggcaggg

SEQ ID NO: 1442816 - DNA, 17 bp, Homo sapiens
gaggctggaggcagggc

SEQ ID NO: 1442817 - DNA, 13 bp, Homo sapiens
gaggctggcaggt

SEQ ID NO: 1442818 - DNA, 23 bp, Homo sapiens
gaggctgtcagtgtatggggcag

SEQ ID NO: 1442819 - DNA, 22 bp, Homo sapiens
gaggctgtcttctcaggctctg

SEQ ID NO: 1442820 - DNA, 18 bp, Homo sapiens
gaggcttcacgccgggag

SEQ ID NO: 1442821 - DNA, 21 bp, Homo sapiens
gaggcttccaggctcttcctg

SEQ ID NO: 1442822 - DNA, 13 bp, Homo sapiens
gaggcttcctgcg

SEQ ID NO: 1442823 - DNA, 21 bp, Homo sapiens
gaggcttcctgcgtcctcctc

SEQ ID NO: 1442824 - DNA, 18 bp, Homo sapiens
gaggcttctccgccagcc

SEQ ID NO: 1442825 - DNA, 19 bp, Homo sapiens
gaggcttctccgccagcct

SEQ ID NO: 1442826 - DNA, 20 bp, Homo sapiens
gaggcttctccgccagcctc

SEQ ID NO: 1442827 - DNA, 21 bp, Homo sapiens
gaggcttctccgccagcctcc

SEQ ID NO: 1442828 - DNA, 22 bp, Homo sapiens
gaggcttctccgccagcctcct

SEQ ID NO: 1442829 - DNA, 16 bp, Homo sapiens
gaggcttcttcagatc

SEQ ID NO: 1442830 - DNA, 23 bp, Homo sapiens
gaggcttggctgctcttccagcg

SEQ ID NO: 1442831 - DNA, 20 bp, Homo sapiens
gagggaaatctgtaaagcca

SEQ ID NO: 1442832 - DNA, 19 bp, Homo sapiens
gagggaacagacaggagaa

SEQ ID NO: 1442833 - DNA, 16 bp, Homo sapiens
gagggaactagggcac

SEQ ID NO: 1442834 - DNA, 15 bp, Homo sapiens
gagggaaggagccca

SEQ ID NO: 1442835 - DNA, 20 bp, Homo sapiens
gagggaagggtttctctatt

SEQ ID NO: 1442836 - DNA, 11 bp, Homo sapiens
gagtcacctgc

SEQ ID NO: 1442837 - DNA, 16 bp, Homo sapiens
gagtcacctgcaagcc

SEQ ID NO: 1442838 - DNA, 13 bp, Homo sapiens
gagtcacctgctc

SEQ ID NO: 1442839 - DNA, 14 bp, Homo sapiens
gagtcacctgctcc

SEQ ID NO: 1442840 - DNA, 16 bp, Homo sapiens
gagtcacctgctccag

SEQ ID NO: 1442841 - DNA, 17 bp, Homo sapiens
gagtcactacgcctggc

SEQ ID NO: 1442842 - DNA, 20 bp, Homo sapiens
gagtcagaatgtgaaaaagg

SEQ ID NO: 1442843 - DNA, 12 bp, Homo sapiens
gagtcagcacct

SEQ ID NO: 1442844 - DNA, 11 bp, Homo sapiens
gagtcagcctt

SEQ ID NO: 1442845 - DNA, 16 bp, Homo sapiens
gagtcagggtgaactg

SEQ ID NO: 1442846 - DNA, 14 bp, Homo sapiens
gagtcagtctcttg

SEQ ID NO: 1442847 - DNA, 21 bp, Homo sapiens
gagtcataacggttaagaaag

SEQ ID NO: 1442848 - DNA, 20 bp, Homo sapiens
gagtcatcttgtgagtggat

SEQ ID NO: 1442849 - DNA, 19 bp, Homo sapiens
gagtcatgatctccctgcc

SEQ ID NO: 1442850 - DNA, 20 bp, Homo sapiens
gagtcatgatctccctgccg

SEQ ID NO: 1442851 - DNA, 21 bp, Homo sapiens
gagtcattttgtgttgaagag

SEQ ID NO: 1442852 - DNA, 19 bp, Homo sapiens
gagtccaaggtttaaagag

SEQ ID NO: 1442853 - DNA, 22 bp, Homo sapiens
gagtccactttgtttcgtgggg

SEQ ID NO: 1442854 - DNA, 12 bp, Homo sapiens
gagtccagctct

SEQ ID NO: 1442855 - DNA, 17 bp, Homo sapiens
gagtccaggtaaatggt

SEQ ID NO: 1442856 - DNA, 16 bp, Homo sapiens
gagtccattctcccag

SEQ ID NO: 1442857 - DNA, 17 bp, Homo sapiens
gagtccattctcccagg

SEQ ID NO: 1442858 - DNA, 15 bp, Homo sapiens
gagtcccaaggaaag

SEQ ID NO: 1442859 - DNA, 18 bp, Homo sapiens
gagtcccaaggaaagccc

SEQ ID NO: 1442860 - DNA, 20 bp, Homo sapiens
gagtcccaggagctgcccag

SEQ ID NO: 1442861 - DNA, 18 bp, Homo sapiens
gagtcccctactccctct

SEQ ID NO: 1442862 - DNA, 17 bp, Homo sapiens
gagtcccctcacctcct

SEQ ID NO: 1442863 - DNA, 14 bp, Homo sapiens
gagtcccgtcagga

SEQ ID NO: 1442864 - DNA, 12 bp, Homo sapiens
gagtccctccaa

SEQ ID NO: 1442865 - DNA, 14 bp, Homo sapiens
gagtccctgccatc

SEQ ID NO: 1442866 - DNA, 16 bp, Homo sapiens
gagtccggatttctaa

SEQ ID NO: 1442867 - DNA, 17 bp, Homo sapiens
gagtcctctagcaggcc

SEQ ID NO: 1442868 - DNA, 14 bp, Homo sapiens
gagtcctgggaggt

SEQ ID NO: 1442869 - DNA, 22 bp, Homo sapiens
gagtcctggtttcctggcagcc

SEQ ID NO: 1442870 - DNA, 18 bp, Homo sapiens
gagtcctgtctctgcctg

SEQ ID NO: 1442871 - DNA, 17 bp, Homo sapiens
gagtcctgttcttccta

SEQ ID NO: 1442872 - DNA, 17 bp, Homo sapiens
gagtcgtacagaaagct

SEQ ID NO: 1442873 - DNA, 22 bp, Homo sapiens
gagtcgtacagaaagctgcctg

SEQ ID NO: 1442874 - DNA, 22 bp, Homo sapiens
gagtcgtggggtgtgctgggag

SEQ ID NO: 1442875 - DNA, 13 bp, Homo sapiens
gagtctaaagatg

SEQ ID NO: 1442876 - DNA, 21 bp, Homo sapiens
gagtctaaagatggagtttct

SEQ ID NO: 1442877 - DNA, 11 bp, Homo sapiens
gagtctagatg

SEQ ID NO: 1442878 - DNA, 22 bp, Homo sapiens
gagtctagattcaaaggttcta

SEQ ID NO: 1442879 - DNA, 14 bp, Homo sapiens
gagtctagattctc

SEQ ID NO: 1442880 - DNA, 16 bp, Homo sapiens
gagtctatgttcaaag

SEQ ID NO: 1442881 - DNA, 16 bp, Homo sapiens
gagtctcctctctgag

SEQ ID NO: 1442882 - DNA, 20 bp, Homo sapiens
gagtctcctctctgagactg

SEQ ID NO: 1442883 - DNA, 15 bp, Homo sapiens
gagtctcttctccac

SEQ ID NO: 1442884 - DNA, 16 bp, Homo sapiens
gagtctcttctccact

SEQ ID NO: 1442885 - DNA, 18 bp, Homo sapiens
gagtctgagtctgagtcc

SEQ ID NO: 1442886 - DNA, 20 bp, Homo sapiens
gagtctggctctgtcgccca

SEQ ID NO: 1442887 - DNA, 20 bp, Homo sapiens
gagtctgttgtgtgtcatgc

SEQ ID NO: 1442888 - DNA, 22 bp, Homo sapiens
gagtctgttgtgtgtcatgcca

SEQ ID NO: 1442889 - DNA, 14 bp, Homo sapiens
gagtcttaataaaa

SEQ ID NO: 1442890 - DNA, 16 bp, Homo sapiens
gagtcttcagacccag

SEQ ID NO: 1442891 - DNA, 17 bp, Homo sapiens
gagtcttcagacccaga

SEQ ID NO: 1442892 - DNA, 17 bp, Homo sapiens
gagtcttggttctaaag

SEQ ID NO: 1442893 - DNA, 20 bp, Homo sapiens
gagtctttgagactaaattc

SEQ ID NO: 1442894 - DNA, 15 bp, Homo sapiens
gagtctttggttcta

SEQ ID NO: 1442895 - DNA, 16 bp, Homo sapiens
gagtctttggttctaa

SEQ ID NO: 1442896 - DNA, 14 bp, Homo sapiens
gagtgaaagggcta

SEQ ID NO: 1442897 - DNA, 19 bp, Homo sapiens
gagtgaaagggctatggca

SEQ ID NO: 1442898 - DNA, 22 bp, Homo sapiens
gagtgaaagggctatggcaagg

SEQ ID NO: 1442899 - DNA, 14 bp, Homo sapiens
gagtgaagaatctt

SEQ ID NO: 1442900 - DNA, 14 bp, Homo sapiens
gagtgaagaggggc

SEQ ID NO: 1442901 - DNA, 15 bp, Homo sapiens
gagtgaagaggggca

SEQ ID NO: 1442902 - DNA, 19 bp, Homo sapiens
gagtgaagaggggcagccc

SEQ ID NO: 1442903 - DNA, 20 bp, Homo sapiens
gagtgaagaggggcagccct

SEQ ID NO: 1442904 - DNA, 21 bp, Homo sapiens
gagtgacagagcgagactcca

SEQ ID NO: 1442905 - DNA, 17 bp, Homo sapiens
gagtgacagctttctgg

SEQ ID NO: 1442906 - DNA, 19 bp, Homo sapiens
gagtgacagtggattgcat

SEQ ID NO: 1442907 - DNA, 20 bp, Homo sapiens
gagtgacatagcctcatgtt

SEQ ID NO: 1442908 - DNA, 23 bp, Homo sapiens
gagtgagaaagaataggggctga

SEQ ID NO: 1442909 - DNA, 13 bp, Homo sapiens
gagtgagaccctg

SEQ ID NO: 1442910 - DNA, 18 bp, Homo sapiens
gagtgagactccacctca

SEQ ID NO: 1442911 - DNA, 19 bp, Homo sapiens
gagtgagatgtagaaagtt

SEQ ID NO: 1442912 - DNA, 19 bp, Homo sapiens
gagtgagcaagggggccca

SEQ ID NO: 1442913 - DNA, 21 bp, Homo sapiens
gagtgagcacacccgtgtgca

SEQ ID NO: 1442914 - DNA, 23 bp, Homo sapiens
gagtgagccacagaccacctgct

SEQ ID NO: 1442915 - DNA, 14 bp, Homo sapiens
gagtgagctctggt

SEQ ID NO: 1442916 - DNA, 15 bp, Homo sapiens
gagtgaggcttccag

SEQ ID NO: 1442917 - DNA, 19 bp, Homo sapiens
gagtgaggcttccaggctc

SEQ ID NO: 1442918 - DNA, 14 bp, Homo sapiens
gagtgagtcacctg

SEQ ID NO: 1442919 - DNA, 16 bp, Homo sapiens
gagtgagtcacctgct

SEQ ID NO: 1442920 - DNA, 19 bp, Homo sapiens
gagtgagtcacctgctcca

SEQ ID NO: 1442921 - DNA, 17 bp, Homo sapiens
gagtgatactttaagtt

SEQ ID NO: 1442922 - DNA, 12 bp, Homo sapiens
gagtgattgcag

SEQ ID NO: 1442923 - DNA, 20 bp, Homo sapiens
gagtgattgcagctttatgt

SEQ ID NO: 1442924 - DNA, 19 bp, Homo sapiens
gagtgcaatgacacagtct

SEQ ID NO: 1442925 - DNA, 12 bp, Homo sapiens
gagtgcacagct

SEQ ID NO: 1442926 - DNA, 13 bp, Homo sapiens
gagtgcacagctg

SEQ ID NO: 1442927 - DNA, 15 bp, Homo sapiens
gagtgcacagctgtc

SEQ ID NO: 1442928 - DNA, 16 bp, Homo sapiens
gagtgcacagctgtcc

SEQ ID NO: 1442929 - DNA, 23 bp, Homo sapiens
gagtgcacctgcctccaccagca

SEQ ID NO: 1442930 - DNA, 12 bp, Homo sapiens
gagtgccaggac

SEQ ID NO: 1442931 - DNA, 16 bp, Homo sapiens
gagtgccaggaccagc

SEQ ID NO: 1442932 - DNA, 17 bp, Homo sapiens
gagtgccaggaccagcc

SEQ ID NO: 1442933 - DNA, 14 bp, Homo sapiens
gagtgcccagaact

SEQ ID NO: 1442934 - DNA, 19 bp, Homo sapiens
gagtgctgaaggaatggaa

SEQ ID NO: 1442935 - DNA, 13 bp, Homo sapiens
gagtggaatgcag

SEQ ID NO: 1442936 - DNA, 17 bp, Homo sapiens
gagtggaatgcagggaa

SEQ ID NO: 1442937 - DNA, 13 bp, Homo sapiens
gagtggactcttc

SEQ ID NO: 1442938 - DNA, 18 bp, Homo sapiens
gagtggactcttccctct

SEQ ID NO: 1442939 - DNA, 12 bp, Homo sapiens
gagtggaggcat

SEQ ID NO: 1442940 - DNA, 20 bp, Homo sapiens
gagtggaggtgggctgggcc

SEQ ID NO: 1442941 - DNA, 23 bp, Homo sapiens
gagtggagtctgagtctgagtcc

SEQ ID NO: 1442942 - DNA, 18 bp, Homo sapiens
gagtggatgatgtttcgt

SEQ ID NO: 1442943 - DNA, 16 bp, Homo sapiens
gagtggcagcagcccc

SEQ ID NO: 1442944 - DNA, 23 bp, Homo sapiens
gagtggccaaataggagggagac

SEQ ID NO: 1442945 - DNA, 14 bp, Homo sapiens
gagtggcctccctg

SEQ ID NO: 1442946 - DNA, 17 bp, Homo sapiens
gagtggcctccctgctg

SEQ ID NO: 1442947 - DNA, 14 bp, Homo sapiens
gagtggcctggcca

SEQ ID NO: 1442948 - DNA, 18 bp, Homo sapiens
gagtggcctggccaggag

SEQ ID NO: 1442949 - DNA, 15 bp, Homo sapiens
gagtggctgccggag

SEQ ID NO: 1442950 - DNA, 17 bp, Homo sapiens
gagtgggaaggacttgg

SEQ ID NO: 1442951 - DNA, 21 bp, Homo sapiens
gagtgggaggcgtgcccccct

SEQ ID NO: 1442952 - DNA, 16 bp, Homo sapiens
gagtgggccccgggct

SEQ ID NO: 1442953 - DNA, 21 bp, Homo sapiens
gagcaattccaggctgagcca

SEQ ID NO: 1442954 - DNA, 17 bp, Homo sapiens
gagcacacccgtgtgca

SEQ ID NO: 1442955 - DNA, 13 bp, Homo sapiens
gagcacactgtag

SEQ ID NO: 1442956 - DNA, 15 bp, Homo sapiens
gagcacactgtagca

SEQ ID NO: 1442957 - DNA, 16 bp, Homo sapiens
gagcacagccctggga

SEQ ID NO: 1442958 - DNA, 19 bp, Homo sapiens
gagcacagccctgggaggg

SEQ ID NO: 1442959 - DNA, 15 bp, Homo sapiens
gagcacaggcagctg

SEQ ID NO: 1442960 - DNA, 15 bp, Homo sapiens
gagcacatactacct

SEQ ID NO: 1442961 - DNA, 21 bp, Homo sapiens
gagcacatactacctagaagt

SEQ ID NO: 1442962 - DNA, 14 bp, Homo sapiens
gagcacccagagca

SEQ ID NO: 1442963 - DNA, 22 bp, Homo sapiens
gagcacccagagcaccccctgc

SEQ ID NO: 1442964 - DNA, 15 bp, Homo sapiens
gagcaccctctggat

SEQ ID NO: 1442965 - DNA, 22 bp, Homo sapiens
gagcaccgtgtcaagctgctct

SEQ ID NO: 1442966 - DNA, 23 bp, Homo sapiens
gagcaccgtgtcaagctgctctg

SEQ ID NO: 1442967 - DNA, 17 bp, Homo sapiens
gagcacctccagcctga

SEQ ID NO: 1442968 - DNA, 13 bp, Homo sapiens
gagcacctgaacc

SEQ ID NO: 1442969 - DNA, 19 bp, Homo sapiens
gagcacgagctggaaccca

SEQ ID NO: 1442970 - DNA, 17 bp, Homo sapiens
gagcacgcctgccatct

SEQ ID NO: 1442971 - DNA, 23 bp, Homo sapiens
gagcacgcctgccatcttctccc

SEQ ID NO: 1442972 - DNA, 20 bp, Homo sapiens
gagcactggagtgcagggag

SEQ ID NO: 1442973 - DNA, 13 bp, Homo sapiens
gagcactggccag

SEQ ID NO: 1442974 - DNA, 17 bp, Homo sapiens
gagcactggccagagag

SEQ ID NO: 1442975 - DNA, 18 bp, Homo sapiens
gagcactggccagagagg

SEQ ID NO: 1442976 - DNA, 13 bp, Homo sapiens
gagcactgggttg

SEQ ID NO: 1442977 - DNA, 20 bp, Homo sapiens
gagcacttgcgtcctgcaga

SEQ ID NO: 1442978 - DNA, 14 bp, Homo sapiens
gagcagaaattctg

SEQ ID NO: 1442979 - DNA, 16 bp, Homo sapiens
gagcagaacaggtagt

SEQ ID NO: 1442980 - DNA, 18 bp, Homo sapiens
gagcagaatactggtctc

SEQ ID NO: 1442981 - DNA, 18 bp, Homo sapiens
gagcagaatgttgtactt

SEQ ID NO: 1442982 - DNA, 21 bp, Homo sapiens
gagcagagacactaacgactt

SEQ ID NO: 1442983 - DNA, 13 bp, Homo sapiens
gagcagaggcagc

SEQ ID NO: 1442984 - DNA, 18 bp, Homo sapiens
gagcagagggcaggggtg

SEQ ID NO: 1442985 - DNA, 11 bp, Homo sapiens
gagcagcagcc

SEQ ID NO: 1442986 - DNA, 15 bp, Homo sapiens
gagcagcagccagca

SEQ ID NO: 1442987 - DNA, 17 bp, Homo sapiens
gagcagccaaggccgcc

SEQ ID NO: 1442988 - DNA, 15 bp, Homo sapiens
gagcagccagagctg

SEQ ID NO: 1442989 - DNA, 11 bp, Homo sapiens
gagcagcccag

SEQ ID NO: 1442990 - DNA, 12 bp, Homo sapiens
gagcagcccagg

SEQ ID NO: 1442991 - DNA, 16 bp, Homo sapiens
gagcagcccagggcct

SEQ ID NO: 1442992 - DNA, 19 bp, Homo sapiens
gagcagcccccgggccgct

SEQ ID NO: 1442993 - DNA, 13 bp, Homo sapiens
gagcagcctccac

SEQ ID NO: 1442994 - DNA, 16 bp, Homo sapiens
gagcagcctccactgt

SEQ ID NO: 1442995 - DNA, 22 bp, Homo sapiens
gagcagcctccactgtgtccag

SEQ ID NO: 1442996 - DNA, 19 bp, Homo sapiens
gagcagcctctgccaggcc

SEQ ID NO: 1442997 - DNA, 21 bp, Homo sapiens
gagcagcctctgccaggcctg

SEQ ID NO: 1442998 - DNA, 14 bp, Homo sapiens
gagcagcctgatgg

SEQ ID NO: 1442999 - DNA, 19 bp, Homo sapiens
gagcagcctgatggccaag

SEQ ID NO: 1443000 - DNA, 15 bp, Homo sapiens
gagcagcctgtggca

SEQ ID NO: 1443001 - DNA, 16 bp, Homo sapiens
gagcagcctgtggcat

SEQ ID NO: 1443002 - DNA, 19 bp, Homo sapiens
gagcagcggattgctctgg

SEQ ID NO: 1443003 - DNA, 23 bp, Homo sapiens
gagcagcggattgctctggagca

SEQ ID NO: 1443004 - DNA, 16 bp, Homo sapiens
gagcagctaaagatga

SEQ ID NO: 1443005 - DNA, 19 bp, Homo sapiens
gagcagctgagatgtggac

SEQ ID NO: 1443006 - DNA, 18 bp, Homo sapiens
gagcagctgggaactgac

SEQ ID NO: 1443007 - DNA, 18 bp, Homo sapiens
gagcagcttttggtctcc

SEQ ID NO: 1443008 - DNA, 21 bp, Homo sapiens
gagcagcttttggtctccttg

SEQ ID NO: 1443009 - DNA, 24 bp, Homo sapiens
gagcagcttttggtctccttgggc

SEQ ID NO: 1443010 - DNA, 13 bp, Homo sapiens
gagcaggaagccg

SEQ ID NO: 1443011 - DNA, 12 bp, Homo sapiens
gagggcccagcc

SEQ ID NO: 1443012 - DNA, 19 bp, Homo sapiens
gagggcccagccaggagca

SEQ ID NO: 1443013 - DNA, 14 bp, Homo sapiens
gagggcccagccca

SEQ ID NO: 1443014 - DNA, 15 bp, Homo sapiens
gagggcccagcccag

SEQ ID NO: 1443015 - DNA, 18 bp, Homo sapiens
gagggcccagcccagagc

SEQ ID NO: 1443016 - DNA, 20 bp, Homo sapiens
gagggcccagctgtagccat

SEQ ID NO: 1443017 - DNA, 16 bp, Homo sapiens
gagggcccaggcaggc

SEQ ID NO: 1443018 - DNA, 15 bp, Homo sapiens
gagggcccatcaggc

SEQ ID NO: 1443019 - DNA, 11 bp, Homo sapiens
gagggcccctc

SEQ ID NO: 1443020 - DNA, 12 bp, Homo sapiens
gagggcccctct

SEQ ID NO: 1443021 - DNA, 15 bp, Homo sapiens
gagggcccctctgcc

SEQ ID NO: 1443022 - DNA, 17 bp, Homo sapiens
gagggcccctctgccca

SEQ ID NO: 1443023 - DNA, 22 bp, Homo sapiens
gagggccctgtggagtccagct

SEQ ID NO: 1443024 - DNA, 15 bp, Homo sapiens
gagggccgcccgctc

SEQ ID NO: 1443025 - DNA, 17 bp, Homo sapiens
gagggccgtaccccacc

SEQ ID NO: 1443026 - DNA, 18 bp, Homo sapiens
gagggccgtaccccaccc

SEQ ID NO: 1443027 - DNA, 14 bp, Homo sapiens
gagggcctctgcct

SEQ ID NO: 1443028 - DNA, 20 bp, Homo sapiens
gagggcctgctggaggcctc

SEQ ID NO: 1443029 - DNA, 21 bp, Homo sapiens
gagggcctgctggaggcctca

SEQ ID NO: 1443030 - DNA, 14 bp, Homo sapiens
gagggcctggacct

SEQ ID NO: 1443031 - DNA, 19 bp, Homo sapiens
gagggcctgtgggagcctg

SEQ ID NO: 1443032 - DNA, 18 bp, Homo sapiens
gagggcgcccattcgtct

SEQ ID NO: 1443033 - DNA, 23 bp, Homo sapiens
gagggcggcaggggcctggagat

SEQ ID NO: 1443034 - DNA, 21 bp, Homo sapiens
gagggctcgaggggtgggctg

SEQ ID NO: 1443035 - DNA, 23 bp, Homo sapiens
gagggctctgatctaacaaaata

SEQ ID NO: 1443036 - DNA, 23 bp, Homo sapiens
gagggctgatggattccaaacca

SEQ ID NO: 1443037 - DNA, 13 bp, Homo sapiens
gagggctgccctg

SEQ ID NO: 1443038 - DNA, 10 bp, Homo sapiens
gagggctgga

SEQ ID NO: 1443039 - DNA, 19 bp, Homo sapiens
gagggctggaggcccaggc

SEQ ID NO: 1443040 - DNA, 10 bp, Homo sapiens
gagggctggc

SEQ ID NO: 1443041 - DNA, 13 bp, Homo sapiens
gagggctggctgg

SEQ ID NO: 1443042 - DNA, 21 bp, Homo sapiens
gagggctgttggacagctgct

SEQ ID NO: 1443043 - DNA, 16 bp, Homo sapiens
gagggcttggcccagc

SEQ ID NO: 1443044 - DNA, 15 bp, Homo sapiens
gaggggaaaggcctg

SEQ ID NO: 1443045 - DNA, 19 bp, Homo sapiens
gaggggacaaaacccacct

SEQ ID NO: 1443046 - DNA, 21 bp, Homo sapiens
gaggggaccaattctggacag

SEQ ID NO: 1443047 - DNA, 12 bp, Homo sapiens
gaggggagagag

SEQ ID NO: 1443048 - DNA, 19 bp, Homo sapiens
gaggggagagagggactca

SEQ ID NO: 1443049 - DNA, 11 bp, Homo sapiens
gaggggagagg

SEQ ID NO: 1443050 - DNA, 21 bp, Homo sapiens
gaggggaggatcactggagcc

SEQ ID NO: 1443051 - DNA, 13 bp, Homo sapiens
gaggggaggcaga

SEQ ID NO: 1443052 - DNA, 11 bp, Homo sapiens
gaggggagggg

SEQ ID NO: 1443053 - DNA, 23 bp, Homo sapiens
gaggggcaagctaggccccagag

SEQ ID NO: 1443054 - DNA, 15 bp, Homo sapiens
gaggggcagcccttg

SEQ ID NO: 1443055 - DNA, 13 bp, Homo sapiens
gaggggcagccgc

SEQ ID NO: 1443056 - DNA, 13 bp, Homo sapiens
gaggggcagcgca

SEQ ID NO: 1443057 - DNA, 21 bp, Homo sapiens
gaggggcagcgcatgtgtgca

SEQ ID NO: 1443058 - DNA, 15 bp, Homo sapiens
gaggggcagggaagg

SEQ ID NO: 1443059 - DNA, 20 bp, Homo sapiens
gaggggcagggaaggacagg

SEQ ID NO: 1443060 - DNA, 17 bp, Homo sapiens
gaggggccggccctgtg

SEQ ID NO: 1443061 - DNA, 22 bp, Homo sapiens
gaggggccggccctgtgtgcag

SEQ ID NO: 1443062 - DNA, 13 bp, Homo sapiens
gaggggcctggca

SEQ ID NO: 1443063 - DNA, 14 bp, Homo sapiens
gaggggcctggcag

SEQ ID NO: 1443064 - DNA, 13 bp, Homo sapiens
gaggggcgctggc

SEQ ID NO: 1443065 - DNA, 14 bp, Homo sapiens
gaggggcgctggcc

SEQ ID NO: 1443066 - DNA, 13 bp, Homo sapiens
gaggggctccccg

SEQ ID NO: 1443067 - DNA, 14 bp, Homo sapiens
gaggggctcctgga

SEQ ID NO: 1443068 - DNA, 15 bp, Homo sapiens
gagggggagtagcca

SEQ ID NO: 1443069 - DNA, 14 bp, Homo sapiens
gagggggccgggcg

SEQ ID NO: 1443070 - DNA, 16 bp, Homo sapiens
gagggggcgctcagga

SEQ ID NO: 1443071 - DNA, 21 bp, Homo sapiens
gagggggctatagctacagga

SEQ ID NO: 1443072 - DNA, 12 bp, Homo sapiens
gagggggctctc

SEQ ID NO: 1443073 - DNA, 14 bp, Homo sapiens
gagggggctctcca

SEQ ID NO: 1443074 - DNA, 12 bp, Homo sapiens
gaggggggaaga

SEQ ID NO: 1443075 - DNA, 21 bp, Homo sapiens
gaggggggtgctggcccccag

SEQ ID NO: 1443076 - DNA, 14 bp, Homo sapiens
gagggggtggaggg

SEQ ID NO: 1443077 - DNA, 14 bp, Homo sapiens
gaggggtggggagc

SEQ ID NO: 1443078 - DNA, 21 bp, Homo sapiens
gaggggtgtggctccttccca

SEQ ID NO: 1443079 - DNA, 17 bp, Homo sapiens
gaggggttgagggaagg

SEQ ID NO: 1443080 - DNA, 15 bp, Homo sapiens
gagggtaaataaacc

SEQ ID NO: 1443081 - DNA, 19 bp, Homo sapiens
gagggtaagacaatatgaa

SEQ ID NO: 1443082 - DNA, 15 bp, Homo sapiens
gagggtccacctgga

SEQ ID NO: 1443083 - DNA, 16 bp, Homo sapiens
gagggtccacctggag

SEQ ID NO: 1443084 - DNA, 13 bp, Homo sapiens
gagggtccctaat

SEQ ID NO: 1443085 - DNA, 19 bp, Homo sapiens
gagggtccctaattctctt

SEQ ID NO: 1443086 - DNA, 20 bp, Homo sapiens
gagggtctcgaactcctggc

SEQ ID NO: 1443087 - DNA, 20 bp, Homo sapiens
gagggtgaaggaggtcaggc

SEQ ID NO: 1443088 - DNA, 15 bp, Homo sapiens
gagggtgacgcccag

SEQ ID NO: 1443089 - DNA, 16 bp, Homo sapiens
gagggtgcagccctct

SEQ ID NO: 1443090 - DNA, 23 bp, Homo sapiens
gagggtggaggaaggtgctgagc

SEQ ID NO: 1443091 - DNA, 18 bp, Homo sapiens
gagggtgggagagcccag

SEQ ID NO: 1443092 - DNA, 13 bp, Homo sapiens
gagggttcccctg

SEQ ID NO: 1443093 - DNA, 14 bp, Homo sapiens
gagggttcccctgg

SEQ ID NO: 1443094 - DNA, 12 bp, Homo sapiens
gagaggagcacc

SEQ ID NO: 1443095 - DNA, 15 bp, Homo sapiens
gagaggatacattta

SEQ ID NO: 1443096 - DNA, 14 bp, Homo sapiens
gagaggcaatgatt

SEQ ID NO: 1443097 - DNA, 15 bp, Homo sapiens
gagaggcaatggcca

SEQ ID NO: 1443098 - DNA, 22 bp, Homo sapiens
gagaggcagacttccctgaatg

SEQ ID NO: 1443099 - DNA, 12 bp, Homo sapiens
gagaggcagcaa

SEQ ID NO: 1443100 - DNA, 21 bp, Homo sapiens
gagaggcaggcatagaggctt

SEQ ID NO: 1443101 - DNA, 15 bp, Homo sapiens
gagaggcccgcccgc

SEQ ID NO: 1443102 - DNA, 14 bp, Homo sapiens
gagaggcctggagc

SEQ ID NO: 1443103 - DNA, 22 bp, Homo sapiens
gagaggctgagtacggatggga

SEQ ID NO: 1443104 - DNA, 21 bp, Homo sapiens
gagaggctgcctcagccagtg

SEQ ID NO: 1443105 - DNA, 19 bp, Homo sapiens
gagagggacactcctcctc

SEQ ID NO: 1443106 - DNA, 15 bp, Homo sapiens
gagagggacaggcac

SEQ ID NO: 1443107 - DNA, 19 bp, Homo sapiens
gagagggagagcagagaaa

SEQ ID NO: 1443108 - DNA, 21 bp, Homo sapiens
gagagggcatgcgcacaaggc

SEQ ID NO: 1443109 - DNA, 19 bp, Homo sapiens
gagagggcctctgcctggg

SEQ ID NO: 1443110 - DNA, 22 bp, Homo sapiens
gagagggcggtgggtatgcgag

SEQ ID NO: 1443111 - DNA, 18 bp, Homo sapiens
gagagggctggtccttat

SEQ ID NO: 1443112 - DNA, 12 bp, Homo sapiens
gagagggctgtg

SEQ ID NO: 1443113 - DNA, 23 bp, Homo sapiens
gagagggctgttggacagctgct

SEQ ID NO: 1443114 - DNA, 15 bp, Homo sapiens
gagaggggaaagtgt

SEQ ID NO: 1443115 - DNA, 21 bp, Homo sapiens
gagaggggacaaaacccacct

SEQ ID NO: 1443116 - DNA, 14 bp, Homo sapiens
gagaggggtttggg

SEQ ID NO: 1443117 - DNA, 13 bp, Homo sapiens
gagagggtctgga

SEQ ID NO: 1443118 - DNA, 18 bp, Homo sapiens
gagagggtctggagaagc

SEQ ID NO: 1443119 - DNA, 16 bp, Homo sapiens
gagagggtgaaggagg

SEQ ID NO: 1443120 - DNA, 21 bp, Homo sapiens
gagaggtggagaactgggatt

SEQ ID NO: 1443121 - DNA, 19 bp, Homo sapiens
gagaggttataggtcactc

SEQ ID NO: 1443122 - DNA, 19 bp, Homo sapiens
gagagtacatttgctttaa

SEQ ID NO: 1443123 - DNA, 15 bp, Homo sapiens
gagagtagaacagat

SEQ ID NO: 1443124 - DNA, 18 bp, Homo sapiens
gagagtagccgagagcct

SEQ ID NO: 1443125 - DNA, 21 bp, Homo sapiens
gagagtagccgagagcctgct

SEQ ID NO: 1443126 - DNA, 21 bp, Homo sapiens
gagagtcagctctctgccctg

SEQ ID NO: 1443127 - DNA, 23 bp, Homo sapiens
gagagtcagctctctgccctgtg

SEQ ID NO: 1443128 - DNA, 16 bp, Homo sapiens
gagagtctagattctc

SEQ ID NO: 1443129 - DNA, 15 bp, Homo sapiens
gagagtggcaggtgg

SEQ ID NO: 1443130 - DNA, 16 bp, Homo sapiens
gagagtggctcctccc

SEQ ID NO: 1443131 - DNA, 14 bp, Homo sapiens
gagagtggtgccct

SEQ ID NO: 1443132 - DNA, 20 bp, Homo sapiens
gagagtgtgaaatagacatt

SEQ ID NO: 1443133 - DNA, 17 bp, Homo sapiens
gagagttaaaagcagca

SEQ ID NO: 1443134 - DNA, 21 bp, Homo sapiens
gagagttaataggagtatttt

SEQ ID NO: 1443135 - DNA, 14 bp, Homo sapiens
gagagttccgggaa

SEQ ID NO: 1443136 - DNA, 21 bp, Homo sapiens
gagataaaacagaatcttctg

SEQ ID NO: 1443137 - DNA, 19 bp, Homo sapiens
gagataaaagcaattctga

SEQ ID NO: 1443138 - DNA, 15 bp, Homo sapiens
gagataaatgagctt

SEQ ID NO: 1443139 - DNA, 18 bp, Homo sapiens
gagataaatgagctttcc

SEQ ID NO: 1443140 - DNA, 12 bp, Homo sapiens
gagataagaaaa

SEQ ID NO: 1443141 - DNA, 21 bp, Homo sapiens
gagataatgttagaggtttta

SEQ ID NO: 1443142 - DNA, 15 bp, Homo sapiens
gagatacttcccaaa

SEQ ID NO: 1443143 - DNA, 21 bp, Homo sapiens
gagatagacgggttgaaagac

SEQ ID NO: 1443144 - DNA, 17 bp, Homo sapiens
gagatatggcagcgaaa

SEQ ID NO: 1443145 - DNA, 22 bp, Homo sapiens
gagatatttacatgaattgcat

SEQ ID NO: 1443146 - DNA, 16 bp, Homo sapiens
gagatatttgtattta

SEQ ID NO: 1443147 - DNA, 13 bp, Homo sapiens
gagatcaaagatg

SEQ ID NO: 1443148 - DNA, 14 bp, Homo sapiens
gagatcaaagatga

SEQ ID NO: 1443149 - DNA, 15 bp, Homo sapiens
gagatcaaagatgaa

SEQ ID NO: 1443150 - DNA, 20 bp, Homo sapiens
gagatcacgccactgcactc

SEQ ID NO: 1443151 - DNA, 22 bp, Homo sapiens
gagatcacgccattgtactcca

SEQ ID NO: 1443152 - DNA, 11 bp, Homo sapiens
gagatcagcat

SEQ ID NO: 1443153 - DNA, 10 bp, Homo sapiens
gagatccagt

SEQ ID NO: 1443154 - DNA, 11 bp, Homo sapiens
gagatccagtg

SEQ ID NO: 1443155 - DNA, 15 bp, Homo sapiens
ctgctacctctgaga

SEQ ID NO: 1443156 - DNA, 20 bp, Homo sapiens
ctgctacctctgagaagaca

SEQ ID NO: 1443157 - DNA, 17 bp, Homo sapiens
ctgctactacccgagcc

SEQ ID NO: 1443158 - DNA, 22 bp, Homo sapiens
ctgctactcataagttggacca

SEQ ID NO: 1443159 - DNA, 20 bp, Homo sapiens
ctgctacttccccagctctc

SEQ ID NO: 1443160 - DNA, 13 bp, Homo sapiens
ctgctagaaagtt

SEQ ID NO: 1443161 - DNA, 13 bp, Homo sapiens
ctgctagactcct

SEQ ID NO: 1443162 - DNA, 16 bp, Homo sapiens
ctgctagactcctcag

SEQ ID NO: 1443163 - DNA, 18 bp, Homo sapiens
ctgctagactcctcagga

SEQ ID NO: 1443164 - DNA, 14 bp, Homo sapiens
ctgctagagcaacc

SEQ ID NO: 1443165 - DNA, 16 bp, Homo sapiens
ctgctagagcaacccc

SEQ ID NO: 1443166 - DNA, 14 bp, Homo sapiens
ctgctagcacttgg

SEQ ID NO: 1443167 - DNA, 21 bp, Homo sapiens
ctgctagcacttggagccaag

SEQ ID NO: 1443168 - DNA, 15 bp, Homo sapiens
ctgctagctgtagaa

SEQ ID NO: 1443169 - DNA, 14 bp, Homo sapiens
ctgctagtagtgtt

SEQ ID NO: 1443170 - DNA, 21 bp, Homo sapiens
ctgctagtgaaatggctgggg

SEQ ID NO: 1443171 - DNA, 21 bp, Homo sapiens
ctgctataaataggtttatat

SEQ ID NO: 1443172 - DNA, 21 bp, Homo sapiens
ctgctatacttatcacatttt

SEQ ID NO: 1443173 - DNA, 22 bp, Homo sapiens
ctgctatacttatcacatttta

SEQ ID NO: 1443174 - DNA, 16 bp, Homo sapiens
ctgctatttacactat

SEQ ID NO: 1443175 - DNA, 20 bp, Homo sapiens
ctgctatttattttcctaaa

SEQ ID NO: 1443176 - DNA, 15 bp, Homo sapiens
ctgctatttctcttg

SEQ ID NO: 1443177 - DNA, 16 bp, Homo sapiens
ctgctatttctcttgc

SEQ ID NO: 1443178 - DNA, 17 bp, Homo sapiens
ctgctatttctcttgct

SEQ ID NO: 1443179 - DNA, 23 bp, Homo sapiens
ctgctcaagccgcaagctctcag

SEQ ID NO: 1443180 - DNA, 14 bp, Homo sapiens
ctgctcacgtctct

SEQ ID NO: 1443181 - DNA, 15 bp, Homo sapiens
ctgctcacgtctctg

SEQ ID NO: 1443182 - DNA, 17 bp, Homo sapiens
ctgctcacgtctctgcc

SEQ ID NO: 1443183 - DNA, 12 bp, Homo sapiens
ctgctcacttta

SEQ ID NO: 1443184 - DNA, 18 bp, Homo sapiens
ctgctcagaacttgctgc

SEQ ID NO: 1443185 - DNA, 14 bp, Homo sapiens
ctgctcagccctgc

SEQ ID NO: 1443186 - DNA, 18 bp, Homo sapiens
ctgctcagccctgcacca

SEQ ID NO: 1443187 - DNA, 18 bp, Homo sapiens
ctgctcagcctcatcctg

SEQ ID NO: 1443188 - DNA, 15 bp, Homo sapiens
ctgctcagctctggt

SEQ ID NO: 1443189 - DNA, 21 bp, Homo sapiens
ctgctcatcatattccaaccc

SEQ ID NO: 1443190 - DNA, 12 bp, Homo sapiens
ctgctcatcatt

SEQ ID NO: 1443191 - DNA, 18 bp, Homo sapiens
ctgctcatggccctcgga

SEQ ID NO: 1443192 - DNA, 17 bp, Homo sapiens
ctgctcattttgacaaa

SEQ ID NO: 1443193 - DNA, 14 bp, Homo sapiens
ctgctccaagtggt

SEQ ID NO: 1443194 - DNA, 13 bp, Homo sapiens
ctgctccaccagc

SEQ ID NO: 1443195 - DNA, 16 bp, Homo sapiens
ctgctccaccagcagc

SEQ ID NO: 1443196 - DNA, 18 bp, Homo sapiens
ctgctccaccagcagcat

SEQ ID NO: 1443197 - DNA, 13 bp, Homo sapiens
ctgctccaccctt

SEQ ID NO: 1443198 - DNA, 18 bp, Homo sapiens
ctgctccacccttggcct

SEQ ID NO: 1443199 - DNA, 20 bp, Homo sapiens
ctgctccacccttggcctgt

SEQ ID NO: 1443200 - DNA, 15 bp, Homo sapiens
ctgctccagaagatg

SEQ ID NO: 1443201 - DNA, 14 bp, Homo sapiens
ctgctccagacctg

SEQ ID NO: 1443202 - DNA, 22 bp, Homo sapiens
ctgctccagacctgatcctgga

SEQ ID NO: 1443203 - DNA, 21 bp, Homo sapiens
ctgctccagcaactgcccttc

SEQ ID NO: 1443204 - DNA, 14 bp, Homo sapiens
ctgctccagcagca

SEQ ID NO: 1443205 - DNA, 16 bp, Homo sapiens
ctgctccagcagcaca

SEQ ID NO: 1443206 - DNA, 13 bp, Homo sapiens
ctgctccatgact

SEQ ID NO: 1443207 - DNA, 20 bp, Homo sapiens
ctgctccatgcagactgtta

SEQ ID NO: 1443208 - DNA, 22 bp, Homo sapiens
ctgctccatggatgcatgccct

SEQ ID NO: 1443209 - DNA, 15 bp, Homo sapiens
ctgctcccagcagcc

SEQ ID NO: 1443210 - DNA, 22 bp, Homo sapiens
ctgctcccagcagccctaagga

SEQ ID NO: 1443211 - DNA, 13 bp, Homo sapiens
ctgctcccagcct

SEQ ID NO: 1443212 - DNA, 18 bp, Homo sapiens
ctgctcccagcctcttgc

SEQ ID NO: 1443213 - DNA, 19 bp, Homo sapiens
ctgctcccagcctcttgct

SEQ ID NO: 1443214 - DNA, 11 bp, Homo sapiens
ctgctcccagg

SEQ ID NO: 1443215 - DNA, 14 bp, Homo sapiens
ctgctcccagtggg

SEQ ID NO: 1443216 - DNA, 17 bp, Homo sapiens
ctgctcccattcctccc

SEQ ID NO: 1443217 - DNA, 18 bp, Homo sapiens
ctgctcccattcctccct

SEQ ID NO: 1443218 - DNA, 16 bp, Homo sapiens
ctgctccccaggccac

SEQ ID NO: 1443219 - DNA, 16 bp, Homo sapiens
ctgctccccaggggag

SEQ ID NO: 1443220 - DNA, 22 bp, Homo sapiens
ctgctcccccaccccctcccca

SEQ ID NO: 1443221 - DNA, 11 bp, Homo sapiens
ctgctccctgt

SEQ ID NO: 1443222 - DNA, 19 bp, Homo sapiens
ctgctccctgtagggtcca

SEQ ID NO: 1443223 - DNA, 12 bp, Homo sapiens
ctgctccctgtc

SEQ ID NO: 1443224 - DNA, 15 bp, Homo sapiens
ctgctccctgtctgt

SEQ ID NO: 1443225 - DNA, 22 bp, Homo sapiens
ctgctccctgtctgtgtcccag

SEQ ID NO: 1443226 - DNA, 15 bp, Homo sapiens
ctgctccgcccgctc

SEQ ID NO: 1443227 - DNA, 14 bp, Homo sapiens
ctgctccgctgcct

SEQ ID NO: 1443228 - DNA, 17 bp, Homo sapiens
ctgctccgctgcctgga

SEQ ID NO: 1443229 - DNA, 19 bp, Homo sapiens
ctgctccgctgcctggaac

SEQ ID NO: 1443230 - DNA, 18 bp, Homo sapiens
ctgctccggtttgggctg

SEQ ID NO: 1443231 - DNA, 13 bp, Homo sapiens
ctgctcctcactg

SEQ ID NO: 1443232 - DNA, 18 bp, Homo sapiens
ctgctcctcactggagga

SEQ ID NO: 1443233 - DNA, 14 bp, Homo sapiens
ctgctcctccctgc

SEQ ID NO: 1443234 - DNA, 14 bp, Homo sapiens
ctgctcctccctgg

SEQ ID NO: 1443235 - DNA, 17 bp, Homo sapiens
ctgctcctccctggctg

SEQ ID NO: 1443236 - DNA, 19 bp, Homo sapiens
ctgctcctccctggctgcc

SEQ ID NO: 1443237 - DNA, 20 bp, Homo sapiens
ctgctcctccctggctgccc

SEQ ID NO: 1443238 - DNA, 11 bp, Homo sapiens
ctgctcctgct

SEQ ID NO: 1443239 - DNA, 13 bp, Homo sapiens
ctgctcctgcttt

SEQ ID NO: 1443240 - DNA, 17 bp, Homo sapiens
ctgctcctgcttttctg

SEQ ID NO: 1443241 - DNA, 23 bp, Homo sapiens
ctgctcctgcttttctgtcctgg

SEQ ID NO: 1443242 - DNA, 14 bp, Homo sapiens
ctgctcctgtggca

SEQ ID NO: 1443243 - DNA, 18 bp, Homo sapiens
ctgctcctgtggcaggag

SEQ ID NO: 1443244 - DNA, 18 bp, Homo sapiens
ctgctccttcactgttcc

SEQ ID NO: 1443245 - DNA, 19 bp, Homo sapiens
ctgctccttcactgttccc

SEQ ID NO: 1443246 - DNA, 16 bp, Homo sapiens
ctgctcctttaccctc

SEQ ID NO: 1443247 - DNA, 19 bp, Homo sapiens
ctgctcctttaccctcttg

SEQ ID NO: 1443248 - DNA, 13 bp, Homo sapiens
gagaccagcctgg

SEQ ID NO: 1443249 - DNA, 14 bp, Homo sapiens
gagaccagcctggc

SEQ ID NO: 1443250 - DNA, 16 bp, Homo sapiens
gagaccagcctggcca

SEQ ID NO: 1443251 - DNA, 12 bp, Homo sapiens
gagaccagctca

SEQ ID NO: 1443252 - DNA, 16 bp, Homo sapiens
gagaccagctcagagg

SEQ ID NO: 1443253 - DNA, 21 bp, Homo sapiens
gagaccagctcagaggcccag

SEQ ID NO: 1443254 - DNA, 14 bp, Homo sapiens
gagaccaggctggg

SEQ ID NO: 1443255 - DNA, 12 bp, Homo sapiens
gagaccagggct

SEQ ID NO: 1443256 - DNA, 21 bp, Homo sapiens
gagaccagttgggagcactgg

SEQ ID NO: 1443257 - DNA, 12 bp, Homo sapiens
gagaccatcctg

SEQ ID NO: 1443258 - DNA, 18 bp, Homo sapiens
gagaccatcctggcccct

SEQ ID NO: 1443259 - DNA, 23 bp, Homo sapiens
gagaccatcctggcccctccaga

SEQ ID NO: 1443260 - DNA, 15 bp, Homo sapiens
gagacccaaaccccc

SEQ ID NO: 1443261 - DNA, 18 bp, Homo sapiens
gagacccagatctcatgg

SEQ ID NO: 1443262 - DNA, 19 bp, Homo sapiens
gagacccagatctcatgga

SEQ ID NO: 1443263 - DNA, 20 bp, Homo sapiens
gagaccccaaagactctgga

SEQ ID NO: 1443264 - DNA, 14 bp, Homo sapiens
gagacccccacacc

SEQ ID NO: 1443265 - DNA, 13 bp, Homo sapiens
gagacccccaggc

SEQ ID NO: 1443266 - DNA, 17 bp, Homo sapiens
gagacccccatccagcc

SEQ ID NO: 1443267 - DNA, 21 bp, Homo sapiens
gagacccccatccagcctcca

SEQ ID NO: 1443268 - DNA, 12 bp, Homo sapiens
gagaccctcact

SEQ ID NO: 1443269 - DNA, 18 bp, Homo sapiens
gagaccctggaattcagc

SEQ ID NO: 1443270 - DNA, 22 bp, Homo sapiens
gagaccctggaattcagcaccc

SEQ ID NO: 1443271 - DNA, 20 bp, Homo sapiens
gagaccgcttcacccctgca

SEQ ID NO: 1443272 - DNA, 11 bp, Homo sapiens
gagacctcagc

SEQ ID NO: 1443273 - DNA, 19 bp, Homo sapiens
gagacctgccctctctgcg

SEQ ID NO: 1443274 - DNA, 19 bp, Homo sapiens
gagacctggaaccagagcc

SEQ ID NO: 1443275 - DNA, 17 bp, Homo sapiens
gagacgaggcaggggct

SEQ ID NO: 1443276 - DNA, 11 bp, Homo sapiens
gagacgaggtc

SEQ ID NO: 1443277 - DNA, 21 bp, Homo sapiens
gagacgcacacagctgagcac

SEQ ID NO: 1443278 - DNA, 16 bp, Homo sapiens
gagactaagccctgtc

SEQ ID NO: 1443279 - DNA, 16 bp, Homo sapiens
gagactagattgcctt

SEQ ID NO: 1443280 - DNA, 14 bp, Homo sapiens
gagactatggagcc

SEQ ID NO: 1443281 - DNA, 18 bp, Homo sapiens
gagactcacctctgcctc

SEQ ID NO: 1443282 - DNA, 23 bp, Homo sapiens
gagactcagtgcagatggagaga

SEQ ID NO: 1443283 - DNA, 21 bp, Homo sapiens
gagactccagaatctgctgtt

SEQ ID NO: 1443284 - DNA, 14 bp, Homo sapiens
gagactccatctct

SEQ ID NO: 1443285 - DNA, 14 bp, Homo sapiens
gagactccatcttg

SEQ ID NO: 1443286 - DNA, 15 bp, Homo sapiens
gagactcctggtctg

SEQ ID NO: 1443287 - DNA, 23 bp, Homo sapiens
gagactcctggtctgtgaagagc

SEQ ID NO: 1443288 - DNA, 16 bp, Homo sapiens
gagactcgactctgtg

SEQ ID NO: 1443289 - DNA, 14 bp, Homo sapiens
gagactcgagaact

SEQ ID NO: 1443290 - DNA, 16 bp, Homo sapiens
gagactcgagaacttt

SEQ ID NO: 1443291 - DNA, 20 bp, Homo sapiens
gagactcgagaactttcatt

SEQ ID NO: 1443292 - DNA, 20 bp, Homo sapiens
gagactctagggtccagtgg

SEQ ID NO: 1443293 - DNA, 23 bp, Homo sapiens
gagactctgtggggccttggttc

SEQ ID NO: 1443294 - DNA, 15 bp, Homo sapiens
gagactgaaagcagc

SEQ ID NO: 1443295 - DNA, 22 bp, Homo sapiens
gagactgccccacggccctgtc

SEQ ID NO: 1443296 - DNA, 23 bp, Homo sapiens
gagactgcgggatggtcctgggg

SEQ ID NO: 1443297 - DNA, 23 bp, Homo sapiens
gagactgcttcccatcctaccct

SEQ ID NO: 1443298 - DNA, 14 bp, Homo sapiens
gagactgggctctg

SEQ ID NO: 1443299 - DNA, 16 bp, Homo sapiens
gagactgggctctggc

SEQ ID NO: 1443300 - DNA, 22 bp, Homo sapiens
gagactgtccctgaaacctagt

SEQ ID NO: 1443301 - DNA, 15 bp, Homo sapiens
gagactgtggtaggg

SEQ ID NO: 1443302 - DNA, 20 bp, Homo sapiens
gagacttccaaacctgacag

SEQ ID NO: 1443303 - DNA, 18 bp, Homo sapiens
gagagaaaaagtgcccct

SEQ ID NO: 1443304 - DNA, 15 bp, Homo sapiens
gagagaaaagctgga

SEQ ID NO: 1443305 - DNA, 19 bp, Homo sapiens
gagagaaagagagaagcca

SEQ ID NO: 1443306 - DNA, 20 bp, Homo sapiens
gagagaaagagagaagccag

SEQ ID NO: 1443307 - DNA, 15 bp, Homo sapiens
gagagaagaaagtgt

SEQ ID NO: 1443308 - DNA, 11 bp, Homo sapiens
gagagaagcca

SEQ ID NO: 1443309 - DNA, 15 bp, Homo sapiens
gagagaagccagcca

SEQ ID NO: 1443310 - DNA, 16 bp, Homo sapiens
gagagaagccagccac

SEQ ID NO: 1443311 - DNA, 19 bp, Homo sapiens
gagagaagccagccacaga

SEQ ID NO: 1443312 - DNA, 11 bp, Homo sapiens
gagagaataaa

SEQ ID NO: 1443313 - DNA, 21 bp, Homo sapiens
gagagaataaattggattatt

SEQ ID NO: 1443314 - DNA, 15 bp, Homo sapiens
ctggagatcctcctg

SEQ ID NO: 1443315 - DNA, 20 bp, Homo sapiens
ctggagatcctcctgcagac

SEQ ID NO: 1443316 - DNA, 15 bp, Homo sapiens
ctggagatggaagct

SEQ ID NO: 1443317 - DNA, 16 bp, Homo sapiens
ctggagatggaagctt

SEQ ID NO: 1443318 - DNA, 23 bp, Homo sapiens
ctggagatggaagcttgttgaaa

SEQ ID NO: 1443319 - DNA, 18 bp, Homo sapiens
ctggagatgttttagagt

SEQ ID NO: 1443320 - DNA, 20 bp, Homo sapiens
ctggagcaacctactgtcta

SEQ ID NO: 1443321 - DNA, 23 bp, Homo sapiens
ctggagcaagaaggaaggaggca

SEQ ID NO: 1443322 - DNA, 13 bp, Homo sapiens
ctggagcaccagg

SEQ ID NO: 1443323 - DNA, 20 bp, Homo sapiens
ctggagcagaactttccagg

SEQ ID NO: 1443324 - DNA, 15 bp, Homo sapiens
ctggagcagaccacc

SEQ ID NO: 1443325 - DNA, 18 bp, Homo sapiens
ctggagcagaccaccccg

SEQ ID NO: 1443326 - DNA, 15 bp, Homo sapiens
ctggagccagcaggg

SEQ ID NO: 1443327 - DNA, 18 bp, Homo sapiens
ctggagccagggcagagg

SEQ ID NO: 1443328 - DNA, 21 bp, Homo sapiens
ctggagccagggcagaggaat

SEQ ID NO: 1443329 - DNA, 21 bp, Homo sapiens
ctggagccccatcctgtgtta

SEQ ID NO: 1443330 - DNA, 15 bp, Homo sapiens
ctggagcccctgggt

SEQ ID NO: 1443331 - DNA, 17 bp, Homo sapiens
ctggagcccgaggcacc

SEQ ID NO: 1443332 - DNA, 23 bp, Homo sapiens
ctggagcctccgacgctgcctct

SEQ ID NO: 1443333 - DNA, 14 bp, Homo sapiens
ctggagcctgatgt

SEQ ID NO: 1443334 - DNA, 19 bp, Homo sapiens
ctggagcctgcagatgaga

SEQ ID NO: 1443335 - DNA, 15 bp, Homo sapiens
ctggagctctgtggg

SEQ ID NO: 1443336 - DNA, 14 bp, Homo sapiens
ctggagctcttgga

SEQ ID NO: 1443337 - DNA, 16 bp, Homo sapiens
ctggagctcttggaag

SEQ ID NO: 1443338 - DNA, 22 bp, Homo sapiens
ctggagctcttggaagagctct

SEQ ID NO: 1443339 - DNA, 22 bp, Homo sapiens
ctggagcttttaaaaatgtttg

SEQ ID NO: 1443340 - DNA, 22 bp, Homo sapiens
ctggaggaaggggggttgcagt

SEQ ID NO: 1443341 - DNA, 13 bp, Homo sapiens
ctggaggagctgg

SEQ ID NO: 1443342 - DNA, 15 bp, Homo sapiens
ctggaggagctggcc

SEQ ID NO: 1443343 - DNA, 18 bp, Homo sapiens
ctggaggagctggcctgt

SEQ ID NO: 1443344 - DNA, 12 bp, Homo sapiens
ctggaggcaggg

SEQ ID NO: 1443345 - DNA, 14 bp, Homo sapiens
ctggaggcagggcc

SEQ ID NO: 1443346 - DNA, 14 bp, Homo sapiens
ctggaggcccaggc

SEQ ID NO: 1443347 - DNA, 17 bp, Homo sapiens
ctggaggcccaggctgg

SEQ ID NO: 1443348 - DNA, 14 bp, Homo sapiens
ctggaggcccagtt

SEQ ID NO: 1443349 - DNA, 15 bp, Homo sapiens
ctggaggcccagttc

SEQ ID NO: 1443350 - DNA, 14 bp, Homo sapiens
ctggaggccccaac

SEQ ID NO: 1443351 - DNA, 17 bp, Homo sapiens
ctggaggcccctggagc

SEQ ID NO: 1443352 - DNA, 15 bp, Homo sapiens
ctggaggcctcaggt

SEQ ID NO: 1443353 - DNA, 21 bp, Homo sapiens
ctggaggccttccagctgctg

SEQ ID NO: 1443354 - DNA, 23 bp, Homo sapiens
ctggaggggagagctttgtgctt

SEQ ID NO: 1443355 - DNA, 14 bp, Homo sapiens
ctggaggggcacca

SEQ ID NO: 1443356 - DNA, 18 bp, Homo sapiens
ctggaggggcccacccac

SEQ ID NO: 1443357 - DNA, 18 bp, Homo sapiens
ctggagggggagcaccag

SEQ ID NO: 1443358 - DNA, 23 bp, Homo sapiens
ctggagggggagcaccagcggtc

SEQ ID NO: 1443359 - DNA, 13 bp, Homo sapiens
ctggaggggtggg

SEQ ID NO: 1443360 - DNA, 17 bp, Homo sapiens
ctggaggggtggggagc

SEQ ID NO: 1443361 - DNA, 15 bp, Homo sapiens
ctggaggtctccagg

SEQ ID NO: 1443362 - DNA, 18 bp, Homo sapiens
ctggaggtctccaggggc

SEQ ID NO: 1443363 - DNA, 24 bp, Homo sapiens
ctggaggtctccaggggcctgcag

SEQ ID NO: 1443364 - DNA, 14 bp, Homo sapiens
ctggaggtctggct

SEQ ID NO: 1443365 - DNA, 20 bp, Homo sapiens
ctggaggtggggttgggatt

SEQ ID NO: 1443366 - DNA, 17 bp, Homo sapiens
ctggaggttgaagccaa

SEQ ID NO: 1443367 - DNA, 19 bp, Homo sapiens
ctggaggttgaagccaagt

SEQ ID NO: 1443368 - DNA, 14 bp, Homo sapiens
ctggagtcacatca

SEQ ID NO: 1443369 - DNA, 16 bp, Homo sapiens
ctggagtcccctcctc

SEQ ID NO: 1443370 - DNA, 15 bp, Homo sapiens
ctggagtctcagagc

SEQ ID NO: 1443371 - DNA, 17 bp, Homo sapiens
ctggagtctcagagcac

SEQ ID NO: 1443372 - DNA, 19 bp, Homo sapiens
ctggagtctcagagcacag

SEQ ID NO: 1443373 - DNA, 15 bp, Homo sapiens
ctggagtgaaccaga

SEQ ID NO: 1443374 - DNA, 16 bp, Homo sapiens
ctggagtgagcactca

SEQ ID NO: 1443375 - DNA, 22 bp, Homo sapiens
ctggagtgaggcttccaggctc

SEQ ID NO: 1443376 - DNA, 18 bp, Homo sapiens
ctggagtgattctagagg

SEQ ID NO: 1443377 - DNA, 12 bp, Homo sapiens
ctggagtgcagg

SEQ ID NO: 1443378 - DNA, 17 bp, Homo sapiens
ctggagtgcgctcttgg

SEQ ID NO: 1443379 - DNA, 18 bp, Homo sapiens
ctggagtgcgctcttggt

SEQ ID NO: 1443380 - DNA, 23 bp, Homo sapiens
ctggagtgtcggatcctgtgagt

SEQ ID NO: 1443381 - DNA, 13 bp, Homo sapiens
ctggagtttaata

SEQ ID NO: 1443382 - DNA, 14 bp, Homo sapiens
ctggatagacttgg

SEQ ID NO: 1443383 - DNA, 16 bp, Homo sapiens
ctggatagacttggga

SEQ ID NO: 1443384 - DNA, 19 bp, Homo sapiens
ctggatatttcaatctttt

SEQ ID NO: 1443385 - DNA, 23 bp, Homo sapiens
gagaatggtgtgaacccgggagc

SEQ ID NO: 1443386 - DNA, 16 bp, Homo sapiens
gagaatgtaagaacta

SEQ ID NO: 1443387 - DNA, 21 bp, Homo sapiens
gagaatgtagatattgtgaag

SEQ ID NO: 1443388 - DNA, 15 bp, Homo sapiens
gagaatgtattctgt

SEQ ID NO: 1443389 - DNA, 17 bp, Homo sapiens
gagaatgtattctgtat

SEQ ID NO: 1443390 - DNA, 21 bp, Homo sapiens
gagaatgtattttcatagatg

SEQ ID NO: 1443391 - DNA, 17 bp, Homo sapiens
gagaatgtgtttcaaaa

SEQ ID NO: 1443392 - DNA, 22 bp, Homo sapiens
gagaatgtttgaaaattagaga

SEQ ID NO: 1443393 - DNA, 18 bp, Homo sapiens
gagaattcttacatgttt

SEQ ID NO: 1443394 - DNA, 22 bp, Homo sapiens
gagaattcttacatgttttctt

SEQ ID NO: 1443395 - DNA, 16 bp, Homo sapiens
gagaattgactgaagc

SEQ ID NO: 1443396 - DNA, 20 bp, Homo sapiens
gagaattgactgaagcacag

SEQ ID NO: 1443397 - DNA, 13 bp, Homo sapiens
gagaattgcttga

SEQ ID NO: 1443398 - DNA, 18 bp, Homo sapiens
gagaattgtatgtcatgt

SEQ ID NO: 1443399 - DNA, 16 bp, Homo sapiens
gagaattttaaattat

SEQ ID NO: 1443400 - DNA, 16 bp, Homo sapiens
gagacaaatggaggcc

SEQ ID NO: 1443401 - DNA, 20 bp, Homo sapiens
gagacaagaaaggcagacac

SEQ ID NO: 1443402 - DNA, 14 bp, Homo sapiens
gagacaagccctgg

SEQ ID NO: 1443403 - DNA, 18 bp, Homo sapiens
gagacacatacagagtgg

SEQ ID NO: 1443404 - DNA, 14 bp, Homo sapiens
gagacacattggac

SEQ ID NO: 1443405 - DNA, 22 bp, Homo sapiens
gagacacattggaccagatgag

SEQ ID NO: 1443406 - DNA, 20 bp, Homo sapiens
gagacaccatcctgagccag

SEQ ID NO: 1443407 - DNA, 16 bp, Homo sapiens
gagacaccctctgggg

SEQ ID NO: 1443408 - DNA, 13 bp, Homo sapiens
gagacacctgcac

SEQ ID NO: 1443409 - DNA, 19 bp, Homo sapiens
gagacacgacagcacacac

SEQ ID NO: 1443410 - DNA, 16 bp, Homo sapiens
gagacacggagcccag

SEQ ID NO: 1443411 - DNA, 20 bp, Homo sapiens
gagacactaacgacttcagg

SEQ ID NO: 1443412 - DNA, 17 bp, Homo sapiens
gagacacttgccttctt

SEQ ID NO: 1443413 - DNA, 15 bp, Homo sapiens
gagacagagaatctt

SEQ ID NO: 1443414 - DNA, 19 bp, Homo sapiens
gagacagagccaagcactg

SEQ ID NO: 1443415 - DNA, 14 bp, Homo sapiens
gagacagcagcctg

SEQ ID NO: 1443416 - DNA, 18 bp, Homo sapiens
gagacagccacttggttt

SEQ ID NO: 1443417 - DNA, 13 bp, Homo sapiens
gagacagcccagg

SEQ ID NO: 1443418 - DNA, 20 bp, Homo sapiens
gagacaggaaaatcctctgg

SEQ ID NO: 1443419 - DNA, 21 bp, Homo sapiens
gagacaggaaaatcctctggc

SEQ ID NO: 1443420 - DNA, 16 bp, Homo sapiens
gagacaggagcctagc

SEQ ID NO: 1443421 - DNA, 17 bp, Homo sapiens
gagacagtgatctccat

SEQ ID NO: 1443422 - DNA, 16 bp, Homo sapiens
gagacagttcaagaaa

SEQ ID NO: 1443423 - DNA, 15 bp, Homo sapiens
gagacatacttgaag

SEQ ID NO: 1443424 - DNA, 18 bp, Homo sapiens
gagacatacttgaagggc

SEQ ID NO: 1443425 - DNA, 20 bp, Homo sapiens
gagacatacttgaagggcca

SEQ ID NO: 1443426 - DNA, 13 bp, Homo sapiens
gagacatgtacct

SEQ ID NO: 1443427 - DNA, 13 bp, Homo sapiens
gagacattgctct

SEQ ID NO: 1443428 - DNA, 17 bp, Homo sapiens
gagaccaacctgaccaa

SEQ ID NO: 1443429 - DNA, 22 bp, Homo sapiens
gagaccaagactctgaaatctc

SEQ ID NO: 1443430 - DNA, 19 bp, Homo sapiens
ctgctgtgccatgctgggc

SEQ ID NO: 1443431 - DNA, 10 bp, Homo sapiens
ctgctgtgct

SEQ ID NO: 1443432 - DNA, 14 bp, Homo sapiens
ctgctgtgctctgg

SEQ ID NO: 1443433 - DNA, 17 bp, Homo sapiens
ctgctgtgctctgggga

SEQ ID NO: 1443434 - DNA, 13 bp, Homo sapiens
ctgctgtgctgga

SEQ ID NO: 1443435 - DNA, 23 bp, Homo sapiens
ctgctgtgctggaattccacagg

SEQ ID NO: 1443436 - DNA, 23 bp, Homo sapiens
ctgctgtgtgctttttttgtgtg

SEQ ID NO: 1443437 - DNA, 18 bp, Homo sapiens
ctgctgttgccatagccc

SEQ ID NO: 1443438 - DNA, 17 bp, Homo sapiens
ctgctgttttatgtcat

SEQ ID NO: 1443439 - DNA, 24 bp, Homo sapiens
ctgctgttttatgtcatactctgt

SEQ ID NO: 1443440 - DNA, 23 bp, Homo sapiens
ctgcttaaactggaaaggatctg

SEQ ID NO: 1443441 - DNA, 15 bp, Homo sapiens
ctgcttacccttcac

SEQ ID NO: 1443442 - DNA, 17 bp, Homo sapiens
ctgcttactagccctgc

SEQ ID NO: 1443443 - DNA, 15 bp, Homo sapiens
ctgcttacttggtga

SEQ ID NO: 1443444 - DNA, 18 bp, Homo sapiens
ctgcttaggtctcatgga

SEQ ID NO: 1443445 - DNA, 17 bp, Homo sapiens
ctgcttcagtgcagtga

SEQ ID NO: 1443446 - DNA, 19 bp, Homo sapiens
ctgcttcatccaatgtgaa

SEQ ID NO: 1443447 - DNA, 21 bp, Homo sapiens
ctgcttcatccaatgtgaagt

SEQ ID NO: 1443448 - DNA, 12 bp, Homo sapiens
ctgcttcccact

SEQ ID NO: 1443449 - DNA, 13 bp, Homo sapiens
ctgcttcccactg

SEQ ID NO: 1443450 - DNA, 14 bp, Homo sapiens
ctgcttcccactgg

SEQ ID NO: 1443451 - DNA, 19 bp, Homo sapiens
ctgcttcccatcctaccct

SEQ ID NO: 1443452 - DNA, 24 bp, Homo sapiens
ctgcttcccatcctaccctcgggc

SEQ ID NO: 1443453 - DNA, 23 bp, Homo sapiens
ctgcttcccattgagtaatcata

SEQ ID NO: 1443454 - DNA, 23 bp, Homo sapiens
ctgcttccccctccccctcctgc

SEQ ID NO: 1443455 - DNA, 21 bp, Homo sapiens
ctgcttcccttactttgctga

SEQ ID NO: 1443456 - DNA, 14 bp, Homo sapiens
ctgcttcctgcttg

SEQ ID NO: 1443457 - DNA, 13 bp, Homo sapiens
ctgcttccttcag

SEQ ID NO: 1443458 - DNA, 14 bp, Homo sapiens
ctgcttccttcagt

SEQ ID NO: 1443459 - DNA, 15 bp, Homo sapiens
ctgcttccttcagtt

SEQ ID NO: 1443460 - DNA, 20 bp, Homo sapiens
ctgcttctaggagaactttt

SEQ ID NO: 1443461 - DNA, 11 bp, Homo sapiens
ctgcttctcca

SEQ ID NO: 1443462 - DNA, 13 bp, Homo sapiens
ctgcttctccaag

SEQ ID NO: 1443463 - DNA, 13 bp, Homo sapiens
ctgcttctccacc

SEQ ID NO: 1443464 - DNA, 14 bp, Homo sapiens
ctgcttctctgact

SEQ ID NO: 1443465 - DNA, 20 bp, Homo sapiens
ctgcttctctgacttctgcc

SEQ ID NO: 1443466 - DNA, 22 bp, Homo sapiens
ctgcttctctgacttctgcctg

SEQ ID NO: 1443467 - DNA, 12 bp, Homo sapiens
ctgcttctcttt

SEQ ID NO: 1443468 - DNA, 15 bp, Homo sapiens
ctgcttctgaactca

SEQ ID NO: 1443469 - DNA, 10 bp, Homo sapiens
ctgcttctgc

SEQ ID NO: 1443470 - DNA, 14 bp, Homo sapiens
ctgcttctgctgcc

SEQ ID NO: 1443471 - DNA, 15 bp, Homo sapiens
ctgcttctgctgccc

SEQ ID NO: 1443472 - DNA, 12 bp, Homo sapiens
ctgcttctggcg

SEQ ID NO: 1443473 - DNA, 15 bp, Homo sapiens
ctgcttcttggagct

SEQ ID NO: 1443474 - DNA, 23 bp, Homo sapiens
ctgcttcttggagctttggaata

SEQ ID NO: 1443475 - DNA, 17 bp, Homo sapiens
ctgcttgacaacatctg

SEQ ID NO: 1443476 - DNA, 16 bp, Homo sapiens
ctgcttgagttgcctg

SEQ ID NO: 1443477 - DNA, 20 bp, Homo sapiens
ctgcttgcacacttccccat

SEQ ID NO: 1443478 - DNA, 22 bp, Homo sapiens
ctgcttgcacacttccccatct

SEQ ID NO: 1443479 - DNA, 23 bp, Homo sapiens
ctgcttgccaaggcagaggcctg

SEQ ID NO: 1443480 - DNA, 20 bp, Homo sapiens
ctgcttgcttgctttttaat

SEQ ID NO: 1443481 - DNA, 13 bp, Homo sapiens
ctgcttgtgggcc

SEQ ID NO: 1443482 - DNA, 12 bp, Homo sapiens
ctgctttagttt

SEQ ID NO: 1443483 - DNA, 17 bp, Homo sapiens
ctgctttagtttcacat

SEQ ID NO: 1443484 - DNA, 23 bp, Homo sapiens
ctgctttcgtccatgtttctcac

SEQ ID NO: 1443485 - DNA, 17 bp, Homo sapiens
ctgctttgcgctggtgg

SEQ ID NO: 1443486 - DNA, 17 bp, Homo sapiens
ctgctttgggctgccct

SEQ ID NO: 1443487 - DNA, 20 bp, Homo sapiens
ctgctttgggctgccctggt

SEQ ID NO: 1443488 - DNA, 18 bp, Homo sapiens
ctgcttttcattagcagt

SEQ ID NO: 1443489 - DNA, 23 bp, Homo sapiens
ctgcttttcattagcagttgctc

SEQ ID NO: 1443490 - DNA, 13 bp, Homo sapiens
ctgcttttccagg

SEQ ID NO: 1443491 - DNA, 14 bp, Homo sapiens
ctgcttttccagga

SEQ ID NO: 1443492 - DNA, 16 bp, Homo sapiens
ctgcttttccaggatc

SEQ ID NO: 1443493 - DNA, 18 bp, Homo sapiens
ctgcttttccctttgtga

SEQ ID NO: 1443494 - DNA, 18 bp, Homo sapiens
ctgcttttcctcaagcaa

SEQ ID NO: 1443495 - DNA, 20 bp, Homo sapiens
ctgcttttcctcaagcaata

SEQ ID NO: 1443496 - DNA, 17 bp, Homo sapiens
ctgcttttctgccctgg

SEQ ID NO: 1443497 - DNA, 18 bp, Homo sapiens
ctgcttttctgccctggc

SEQ ID NO: 1443498 - DNA, 24 bp, Homo sapiens
ctgcttttctgccctggctgctgc

SEQ ID NO: 1443499 - DNA, 19 bp, Homo sapiens
ctgcttttctgtcctgggc

SEQ ID NO: 1443500 - DNA, 20 bp, Homo sapiens
ctgcttttctgtcctgggca

SEQ ID NO: 1443501 - DNA, 11 bp, Homo sapiens
ctgcttttctt

SEQ ID NO: 1443502 - DNA, 12 bp, Homo sapiens
ctgcttttgcat

SEQ ID NO: 1443503 - DNA, 22 bp, Homo sapiens
ctgctttttaaagaatgctctt

SEQ ID NO: 1443504 - DNA, 22 bp, Homo sapiens
ctgctttttccaactcagaaat

SEQ ID NO: 1443505 - DNA, 17 bp, Homo sapiens
ctgctttttggcacagt

SEQ ID NO: 1443506 - DNA, 15 bp, Homo sapiens
ctgctttttttctta

SEQ ID NO: 1443507 - DNA, 18 bp, Homo sapiens
ctgcttttttttttccag

SEQ ID NO: 1443508 - DNA, 23 bp, Homo sapiens
ctgcttttttttttccagcaagt

SEQ ID NO: 1443509 - DNA, 22 bp, Homo sapiens
ctggaaaaaaatacaaaaagca

SEQ ID NO: 1443510 - DNA, 14 bp, Homo sapiens
ctggaaaacagaac

SEQ ID NO: 1443511 - DNA, 16 bp, Homo sapiens
ctggaaaacagaacac

SEQ ID NO: 1443512 - DNA, 16 bp, Homo sapiens
ctggaaaacagacggg

SEQ ID NO: 1443513 - DNA, 19 bp, Homo sapiens
ctggaaaacagacgggtct

SEQ ID NO: 1443514 - DNA, 13 bp, Homo sapiens
ctggaaaagaaga

SEQ ID NO: 1443515 - DNA, 17 bp, Homo sapiens
ctggaaaagttagtatt

SEQ ID NO: 1443516 - DNA, 22 bp, Homo sapiens
ctggaaaagttagtattaaaat

SEQ ID NO: 1443517 - DNA, 13 bp, Homo sapiens
ctggaaacagcat

SEQ ID NO: 1443518 - DNA, 14 bp, Homo sapiens
ctggaaacagcatg

SEQ ID NO: 1443519 - DNA, 17 bp, Homo sapiens
ctggaaacccacctctc

SEQ ID NO: 1443520 - DNA, 20 bp, Homo sapiens
ctggaaacccacctctctgg

SEQ ID NO: 1443521 - DNA, 17 bp, Homo sapiens
ctggaaaccttccaccc

SEQ ID NO: 1443522 - DNA, 20 bp, Homo sapiens
ctggaaaccttccacccagt

SEQ ID NO: 1443523 - DNA, 21 bp, Homo sapiens
ctggaaacttttgttagggct

SEQ ID NO: 1443524 - DNA, 22 bp, Homo sapiens
ctggaaacttttgttagggctg

SEQ ID NO: 1443525 - DNA, 19 bp, Homo sapiens
ctggaaagcccgctagaag

SEQ ID NO: 1443526 - DNA, 22 bp, Homo sapiens
ctggaaaggatctgtgattggc

SEQ ID NO: 1443527 - DNA, 14 bp, Homo sapiens
ctggaaaggctcag

SEQ ID NO: 1443528 - DNA, 17 bp, Homo sapiens
ctggaaaggctcagtct

SEQ ID NO: 1443529 - DNA, 21 bp, Homo sapiens
ctggaaaggctcagtctcagg

SEQ ID NO: 1443530 - DNA, 22 bp, Homo sapiens
ctggaaaggctcagtctcagga

SEQ ID NO: 1443531 - DNA, 15 bp, Homo sapiens
ctggaaaggggagag

SEQ ID NO: 1443532 - DNA, 20 bp, Homo sapiens
ctggaaagttgggcccctga

SEQ ID NO: 1443533 - DNA, 16 bp, Homo sapiens
ctggaaatattaagaa

SEQ ID NO: 1443534 - DNA, 15 bp, Homo sapiens
ctggaacaacttgta

SEQ ID NO: 1443535 - DNA, 20 bp, Homo sapiens
ctggaacatggctagccttt

SEQ ID NO: 1443536 - DNA, 15 bp, Homo sapiens
ctggaacatttgata

SEQ ID NO: 1443537 - DNA, 20 bp, Homo sapiens
ctggaacatttgatattttt

SEQ ID NO: 1443538 - DNA, 15 bp, Homo sapiens
ctggaaccacctgga

SEQ ID NO: 1443539 - DNA, 13 bp, Homo sapiens
ctggaaccaggga

SEQ ID NO: 1443540 - DNA, 20 bp, Homo sapiens
ctggaaccagggaggagagg

SEQ ID NO: 1443541 - DNA, 16 bp, Homo sapiens
ctggaacccagactca

SEQ ID NO: 1443542 - DNA, 19 bp, Homo sapiens
ctggaaccgggaagggtgg

SEQ ID NO: 1443543 - DNA, 15 bp, Homo sapiens
ctggaacctcagcct

SEQ ID NO: 1443544 - DNA, 16 bp, Homo sapiens
ctggaacctcagcctg

SEQ ID NO: 1443545 - DNA, 22 bp, Homo sapiens
ctggaacggtgaaggtgacagc

SEQ ID NO: 1443546 - DNA, 16 bp, Homo sapiens
ctggaactcctggcct

SEQ ID NO: 1443547 - DNA, 14 bp, Homo sapiens
ctggaacttgggga

SEQ ID NO: 1443548 - DNA, 16 bp, Homo sapiens
ctggaagaacaggcct

SEQ ID NO: 1443549 - DNA, 17 bp, Homo sapiens
ctggaagaacaggcctc

SEQ ID NO: 1443550 - DNA, 19 bp, Homo sapiens
ctggaagaacaggcctctc

SEQ ID NO: 1443551 - DNA, 17 bp, Homo sapiens
ctggaagacacttcaga

SEQ ID NO: 1443552 - DNA, 20 bp, Homo sapiens
ctggaagacacttcagatct

SEQ ID NO: 1443553 - DNA, 19 bp, Homo sapiens
ctggaagactgtgcagaag

SEQ ID NO: 1443554 - DNA, 12 bp, Homo sapiens
ctggaagagagg

SEQ ID NO: 1443555 - DNA, 13 bp, Homo sapiens
ctggaagagccaa

SEQ ID NO: 1443556 - DNA, 14 bp, Homo sapiens
ctggaagagccaaa

SEQ ID NO: 1443557 - DNA, 17 bp, Homo sapiens
ctggaagagccaaagaa

SEQ ID NO: 1443558 - DNA, 23 bp, Homo sapiens
ctggaagagccaaagaatattcc

SEQ ID NO: 1443559 - DNA, 14 bp, Homo sapiens
ctggaagagcccag

SEQ ID NO: 1443560 - DNA, 15 bp, Homo sapiens
ctggaagagcccagt

SEQ ID NO: 1443561 - DNA, 17 bp, Homo sapiens
ctggaagattcttactg

SEQ ID NO: 1443562 - DNA, 13 bp, Homo sapiens
ctggaagcagagc

SEQ ID NO: 1443563 - DNA, 15 bp, Homo sapiens
ctggaagcagagcaa

SEQ ID NO: 1443564 - DNA, 22 bp, Homo sapiens
ctggaagcccagcccctactgc

SEQ ID NO: 1443565 - DNA, 22 bp, Homo sapiens
ctggaagccggcggcccaagcc

SEQ ID NO: 1443566 - DNA, 16 bp, Homo sapiens
ctggaagcctggactc

SEQ ID NO: 1443567 - DNA, 21 bp, Homo sapiens
ctggaagctctccgagctctg

SEQ ID NO: 1443568 - DNA, 13 bp, Homo sapiens
ctggaaggacaca

SEQ ID NO: 1443569 - DNA, 15 bp, Homo sapiens
ctggaaggacacagt

SEQ ID NO: 1443570 - DNA, 18 bp, Homo sapiens
ctggaaggacacagtgat

SEQ ID NO: 1443571 - DNA, 17 bp, Homo sapiens
ctggaaggagtgagagg

SEQ ID NO: 1443572 - DNA, 15 bp, Homo sapiens
ctggaaggcagggca

SEQ ID NO: 1443573 - DNA, 17 bp, Homo sapiens
ctggaaggctggctgag

SEQ ID NO: 1443574 - DNA, 20 bp, Homo sapiens
ctggaagggaggaaggcctt

SEQ ID NO: 1443575 - DNA, 22 bp, Homo sapiens
ctggaagggaggaaggcctttc

SEQ ID NO: 1443576 - DNA, 20 bp, Homo sapiens
ctggaagggccggcttctgc

SEQ ID NO: 1443577 - DNA, 14 bp, Homo sapiens
ctggaaggggcagc

SEQ ID NO: 1443578 - DNA, 15 bp, Homo sapiens
ctggaagttgtggat

SEQ ID NO: 1443579 - DNA, 16 bp, Homo sapiens
ctggaagttgtggata

SEQ ID NO: 1443580 - DNA, 16 bp, Homo sapiens
ctggaataaagttgca

SEQ ID NO: 1443581 - DNA, 17 bp, Homo sapiens
ctggaatattgtgattc

SEQ ID NO: 1443582 - DNA, 16 bp, Homo sapiens
ctggaatattgtttct

SEQ ID NO: 1443583 - DNA, 17 bp, Homo sapiens
ctggaatctggagacca

SEQ ID NO: 1443584 - DNA, 19 bp, Homo sapiens
ctggaatctggagaccagg

SEQ ID NO: 1443585 - DNA, 16 bp, Homo sapiens
ctggaatggtgttttg

SEQ ID NO: 1443586 - DNA, 22 bp, Homo sapiens
ctggaatggtgttttgtcagac

SEQ ID NO: 1443587 - DNA, 15 bp, Homo sapiens
ctggaattcagcacc

SEQ ID NO: 1443588 - DNA, 20 bp, Homo sapiens
ctggaattccacagggacca

SEQ ID NO: 1443589 - DNA, 23 bp, Homo sapiens
ctggaattcctaacttttcaatg

SEQ ID NO: 1443590 - DNA, 17 bp, Homo sapiens
ctggaattcttctgcaa

SEQ ID NO: 1443591 - DNA, 17 bp, Homo sapiens
ctggaattgccagctga

SEQ ID NO: 1443592 - DNA, 11 bp, Homo sapiens
ctggacacagc

SEQ ID NO: 1443593 - DNA, 18 bp, Homo sapiens
ctggacacagctcttcat

SEQ ID NO: 1443594 - DNA, 22 bp, Homo sapiens
ctggacacagctcttcattcca

SEQ ID NO: 1443595 - DNA, 17 bp, Homo sapiens
ctggacaccgggccagt

SEQ ID NO: 1443596 - DNA, 22 bp, Homo sapiens
ctggacactagggtcaggcggg

SEQ ID NO: 1443597 - DNA, 14 bp, Homo sapiens
ctggacagccccac

SEQ ID NO: 1443598 - DNA, 13 bp, Homo sapiens
ctggacaggcagc

SEQ ID NO: 1443599 - DNA, 20 bp, Homo sapiens
ctggacaggcagcctccttt

SEQ ID NO: 1443600 - DNA, 16 bp, Homo sapiens
ctggacatgaaggaaa

SEQ ID NO: 1443601 - DNA, 13 bp, Homo sapiens
ctggacattctct

SEQ ID NO: 1443602 - DNA, 12 bp, Homo sapiens
ctggaccaaagg

SEQ ID NO: 1443603 - DNA, 17 bp, Homo sapiens
ctggaccaccagcccca

SEQ ID NO: 1443604 - DNA, 20 bp, Homo sapiens
ctggaccaccagccccagca

SEQ ID NO: 1443605 - DNA, 14 bp, Homo sapiens
ctggaccagcctcc

SEQ ID NO: 1443606 - DNA, 16 bp, Homo sapiens
ctggaccagcctcctg

SEQ ID NO: 1443607 - DNA, 12 bp, Homo sapiens
ctggaccaggtc

SEQ ID NO: 1443608 - DNA, 19 bp, Homo sapiens
ctggaccccgtttcatttt

SEQ ID NO: 1443609 - DNA, 20 bp, Homo sapiens
ctggaccccgtttcattttt

SEQ ID NO: 1443610 - DNA, 17 bp, Homo sapiens
ctggaccgctgactgca

SEQ ID NO: 1443611 - DNA, 20 bp, Homo sapiens
ctggacctatgtcctaagga

SEQ ID NO: 1443612 - DNA, 13 bp, Homo sapiens
ctggacctgagtc

SEQ ID NO: 1443613 - DNA, 12 bp, Homo sapiens
ctggacctgcct

SEQ ID NO: 1443614 - DNA, 19 bp, Homo sapiens
ctggacctttgggttcttt

SEQ ID NO: 1443615 - DNA, 22 bp, Homo sapiens
ctggaccttttcccttgctgta

SEQ ID NO: 1443616 - DNA, 18 bp, Homo sapiens
ctggacgctgccctgcat

SEQ ID NO: 1443617 - DNA, 14 bp, Homo sapiens
ctggacggcaggct

SEQ ID NO: 1443618 - DNA, 13 bp, Homo sapiens
ctggacgtgaaat

SEQ ID NO: 1443619 - DNA, 14 bp, Homo sapiens
ctggactattgtgc

SEQ ID NO: 1443620 - DNA, 21 bp, Homo sapiens
ctggactattgtgccaactgc

SEQ ID NO: 1443621 - DNA, 19 bp, Homo sapiens
ctggactcccactctttga

SEQ ID NO: 1443622 - DNA, 22 bp, Homo sapiens
ctggactctaagctggagctct

SEQ ID NO: 1443623 - DNA, 18 bp, Homo sapiens
ctggactctgccccaatc

SEQ ID NO: 1443624 - DNA, 16 bp, Homo sapiens
ctggactgaagcctgc

SEQ ID NO: 1443625 - DNA, 15 bp, Homo sapiens
ctggactgaccaaag

SEQ ID NO: 1443626 - DNA, 13 bp, Homo sapiens
ctggactgactgc

SEQ ID NO: 1443627 - DNA, 19 bp, Homo sapiens
ctggactgactgcagcccc

SEQ ID NO: 1443628 - DNA, 16 bp, Homo sapiens
ctggactgaggcctga

SEQ ID NO: 1443629 - DNA, 18 bp, Homo sapiens
ctggactgaggcctgagc

SEQ ID NO: 1443630 - DNA, 20 bp, Homo sapiens
ctggactgcatggggaggca

SEQ ID NO: 1443631 - DNA, 22 bp, Homo sapiens
ctggactgcatggggaggcagc

SEQ ID NO: 1443632 - DNA, 23 bp, Homo sapiens
ctggactgcatggggaggcagca

SEQ ID NO: 1443633 - DNA, 19 bp, Homo sapiens
ctggactggaggcccctgg

SEQ ID NO: 1443634 - DNA, 14 bp, Homo sapiens
ctggactggcctgt

SEQ ID NO: 1443635 - DNA, 19 bp, Homo sapiens
ctggactgtcatagaaatt

SEQ ID NO: 1443636 - DNA, 20 bp, Homo sapiens
ctggactgtcatagaaatta

SEQ ID NO: 1443637 - DNA, 22 bp, Homo sapiens
ctggacttaagcatctggctct

SEQ ID NO: 1443638 - DNA, 23 bp, Homo sapiens
ctggacttaagcatctggctcta

SEQ ID NO: 1443639 - DNA, 13 bp, Homo sapiens
ctggacttacaaa

SEQ ID NO: 1443640 - DNA, 16 bp, Homo sapiens
ctggacttcctgtcat

SEQ ID NO: 1443641 - DNA, 20 bp, Homo sapiens
ctggacttctacctgccctc

SEQ ID NO: 1443642 - DNA, 13 bp, Homo sapiens
ctggacttgagct

SEQ ID NO: 1443643 - DNA, 20 bp, Homo sapiens
ctggacttgagcttggcagc

SEQ ID NO: 1443644 - DNA, 15 bp, Homo sapiens
ctggacttgcctctg

SEQ ID NO: 1443645 - DNA, 16 bp, Homo sapiens
ctggacttgcctctgc

SEQ ID NO: 1443646 - DNA, 22 bp, Homo sapiens
ctggactttggttctctccagg

SEQ ID NO: 1443647 - DNA, 23 bp, Homo sapiens
ctggactttggttctctccagga

SEQ ID NO: 1443648 - DNA, 12 bp, Homo sapiens
ctggagaaagag

SEQ ID NO: 1443649 - DNA, 17 bp, Homo sapiens
ctggagaaagagctgcc

SEQ ID NO: 1443650 - DNA, 21 bp, Homo sapiens
ctggagaaagagctgcctgga

SEQ ID NO: 1443651 - DNA, 23 bp, Homo sapiens
ctggagaaagagctgcctggatg

SEQ ID NO: 1443652 - DNA, 24 bp, Homo sapiens
ctggagaaagagctgcctggatga

SEQ ID NO: 1443653 - DNA, 14 bp, Homo sapiens
ctggagaacagtgg

SEQ ID NO: 1443654 - DNA, 14 bp, Homo sapiens
ctggagaactagag

SEQ ID NO: 1443655 - DNA, 22 bp, Homo sapiens
ctggagaaggtattagcaaagc

SEQ ID NO: 1443656 - DNA, 19 bp, Homo sapiens
ctggagaattgactgaagc

SEQ ID NO: 1443657 - DNA, 20 bp, Homo sapiens
ctggagaattgactgaagca

SEQ ID NO: 1443658 - DNA, 23 bp, Homo sapiens
ctggagaccgcttcacccctgca

SEQ ID NO: 1443659 - DNA, 15 bp, Homo sapiens
ctggagacttagggc

SEQ ID NO: 1443660 - DNA, 21 bp, Homo sapiens
ctggagacttagggcaccagg

SEQ ID NO: 1443661 - DNA, 20 bp, Homo sapiens
ctggagagcacagcatgcct

SEQ ID NO: 1443662 - DNA, 22 bp, Homo sapiens
ctgcctgcctcccctccgcagc

SEQ ID NO: 1443663 - DNA, 15 bp, Homo sapiens
ctgcctgcctgtctg

SEQ ID NO: 1443664 - DNA, 20 bp, Homo sapiens
ctgcctgcgttctccccatg

SEQ ID NO: 1443665 - DNA, 14 bp, Homo sapiens
ctgcctgcttggcc

SEQ ID NO: 1443666 - DNA, 12 bp, Homo sapiens
ctgcctgctttg

SEQ ID NO: 1443667 - DNA, 12 bp, Homo sapiens
ctgcctggactt

SEQ ID NO: 1443668 - DNA, 22 bp, Homo sapiens
ctgcctggagacaaggtgctaa

SEQ ID NO: 1443669 - DNA, 19 bp, Homo sapiens
ctgcctggatgagaaacag

SEQ ID NO: 1443670 - DNA, 15 bp, Homo sapiens
ctgcctggccaggca

SEQ ID NO: 1443671 - DNA, 17 bp, Homo sapiens
ctgcctggccaggccct

SEQ ID NO: 1443672 - DNA, 11 bp, Homo sapiens
ctgcctggccc

SEQ ID NO: 1443673 - DNA, 23 bp, Homo sapiens
ctgcctggcccccaacctcaggg

SEQ ID NO: 1443674 - DNA, 14 bp, Homo sapiens
ctgcctggcctggc

SEQ ID NO: 1443675 - DNA, 15 bp, Homo sapiens
ctgcctgggcctgtg

SEQ ID NO: 1443676 - DNA, 22 bp, Homo sapiens
ctgcctgggcctgtgcagcagc

SEQ ID NO: 1443677 - DNA, 24 bp, Homo sapiens
ctgcctgggcctgtgcagcagccc

SEQ ID NO: 1443678 - DNA, 11 bp, Homo sapiens
ctgcctgggct

SEQ ID NO: 1443679 - DNA, 12 bp, Homo sapiens
ctgcctgggctg

SEQ ID NO: 1443680 - DNA, 18 bp, Homo sapiens
ctgcctgggctgttggca

SEQ ID NO: 1443681 - DNA, 17 bp, Homo sapiens
ctgcctggggcctccag

SEQ ID NO: 1443682 - DNA, 19 bp, Homo sapiens
ctgcctggggcctccagaa

SEQ ID NO: 1443683 - DNA, 20 bp, Homo sapiens
ctgcctggggcctccagaag

SEQ ID NO: 1443684 - DNA, 20 bp, Homo sapiens
ctgcctggtatatccaaaag

SEQ ID NO: 1443685 - DNA, 17 bp, Homo sapiens
ctgcctggtcctccctc

SEQ ID NO: 1443686 - DNA, 16 bp, Homo sapiens
ctgcctggtctgtctg

SEQ ID NO: 1443687 - DNA, 18 bp, Homo sapiens
ctgcctggtctgtctgga

SEQ ID NO: 1443688 - DNA, 21 bp, Homo sapiens
ctgcctggtctgtctggatcc

SEQ ID NO: 1443689 - DNA, 19 bp, Homo sapiens
ctgcctggtgcattgctgt

SEQ ID NO: 1443690 - DNA, 20 bp, Homo sapiens
ctgcctggtgcattgctgtg

SEQ ID NO: 1443691 - DNA, 20 bp, Homo sapiens
ctgcctgtatttgagagact

SEQ ID NO: 1443692 - DNA, 21 bp, Homo sapiens
ctgcctgtatttgagagactg

SEQ ID NO: 1443693 - DNA, 13 bp, Homo sapiens
ctgcctgtatttt

SEQ ID NO: 1443694 - DNA, 14 bp, Homo sapiens
ctgcctgtattttc

SEQ ID NO: 1443695 - DNA, 21 bp, Homo sapiens
ctgcctgtccccccgcacttt

SEQ ID NO: 1443696 - DNA, 13 bp, Homo sapiens
ctgcctgtctcct

SEQ ID NO: 1443697 - DNA, 14 bp, Homo sapiens
ctgcctgtctgccc

SEQ ID NO: 1443698 - DNA, 18 bp, Homo sapiens
ctgcctgtctgccccagc

SEQ ID NO: 1443699 - DNA, 15 bp, Homo sapiens
ctgcctgtgagccag

SEQ ID NO: 1443700 - DNA, 14 bp, Homo sapiens
ctgcctgtgctgtg

SEQ ID NO: 1443701 - DNA, 21 bp, Homo sapiens
ctgcctgtggccttgcccgcc

SEQ ID NO: 1443702 - DNA, 12 bp, Homo sapiens
ctgcctgtggcg

SEQ ID NO: 1443703 - DNA, 13 bp, Homo sapiens
ctgcctgtgggct

SEQ ID NO: 1443704 - DNA, 15 bp, Homo sapiens
ctgcctgtgggcttc

SEQ ID NO: 1443705 - DNA, 20 bp, Homo sapiens
ctgcctgttataactctgca

SEQ ID NO: 1443706 - DNA, 22 bp, Homo sapiens
ctgcctgttataactctgcact

SEQ ID NO: 1443707 - DNA, 19 bp, Homo sapiens
ctgccttaaaaccaaagag

SEQ ID NO: 1443708 - DNA, 22 bp, Homo sapiens
ctgccttaaaaccaaagagggc

SEQ ID NO: 1443709 - DNA, 20 bp, Homo sapiens
ctgccttactggtttcccca

SEQ ID NO: 1443710 - DNA, 16 bp, Homo sapiens
ctgccttagtctcagt

SEQ ID NO: 1443711 - DNA, 17 bp, Homo sapiens
ctgccttatcttgcacc

SEQ ID NO: 1443712 - DNA, 15 bp, Homo sapiens
ctgccttccctagct

SEQ ID NO: 1443713 - DNA, 16 bp, Homo sapiens
ctgccttccctagctt

SEQ ID NO: 1443714 - DNA, 16 bp, Homo sapiens
ctgccttcctcatccc

SEQ ID NO: 1443715 - DNA, 17 bp, Homo sapiens
ctgccttcgcttcttgc

SEQ ID NO: 1443716 - DNA, 20 bp, Homo sapiens
ctgccttcgcttcttgcctc

SEQ ID NO: 1443717 - DNA, 20 bp, Homo sapiens
ctgccttcgttaactgtgta

SEQ ID NO: 1443718 - DNA, 18 bp, Homo sapiens
ctgccttctcaggccccg

SEQ ID NO: 1443719 - DNA, 14 bp, Homo sapiens
ctgccttctttcca

SEQ ID NO: 1443720 - DNA, 20 bp, Homo sapiens
ctgccttgaagccactgaag

SEQ ID NO: 1443721 - DNA, 14 bp, Homo sapiens
ctgccttgagctaa

SEQ ID NO: 1443722 - DNA, 20 bp, Homo sapiens
ctgccttgctgacaataaag

SEQ ID NO: 1443723 - DNA, 23 bp, Homo sapiens
ctgccttgcttctgtatttcctt

SEQ ID NO: 1443724 - DNA, 23 bp, Homo sapiens
ctgccttggactgtgtttttcct

SEQ ID NO: 1443725 - DNA, 14 bp, Homo sapiens
ctgccttggcctcc

SEQ ID NO: 1443726 - DNA, 18 bp, Homo sapiens
ctgccttgtccctctcac

SEQ ID NO: 1443727 - DNA, 16 bp, Homo sapiens
ctgcctttaagccaaa

SEQ ID NO: 1443728 - DNA, 17 bp, Homo sapiens
ctgcctttctcccccga

SEQ ID NO: 1443729 - DNA, 18 bp, Homo sapiens
ctgcctttgatgttacag

SEQ ID NO: 1443730 - DNA, 21 bp, Homo sapiens
ctgcgaagaccctcttgccca

SEQ ID NO: 1443731 - DNA, 17 bp, Homo sapiens
ctgcgaaggggccctgg

SEQ ID NO: 1443732 - DNA, 20 bp, Homo sapiens
ctgcgacaaaacattttgaa

SEQ ID NO: 1443733 - DNA, 14 bp, Homo sapiens
ctgcgaccctgggg

SEQ ID NO: 1443734 - DNA, 22 bp, Homo sapiens
ctgcgaccctgggggcacagga

SEQ ID NO: 1443735 - DNA, 18 bp, Homo sapiens
ctgcgactttctgcctgg

SEQ ID NO: 1443736 - DNA, 20 bp, Homo sapiens
ctgcgactttctgcctggag

SEQ ID NO: 1443737 - DNA, 23 bp, Homo sapiens
ctgcgagacgcacacagctgagc

SEQ ID NO: 1443738 - DNA, 15 bp, Homo sapiens
ctgcgcacaggtggg

SEQ ID NO: 1443739 - DNA, 17 bp, Homo sapiens
ctgcgcaggtctcttct

SEQ ID NO: 1443740 - DNA, 15 bp, Homo sapiens
ctgcgccaggcagag

SEQ ID NO: 1443741 - DNA, 23 bp, Homo sapiens
ctgcgccaggcagagctgagggc

SEQ ID NO: 1443742 - DNA, 13 bp, Homo sapiens
ctgcgcctccaga

SEQ ID NO: 1443743 - DNA, 15 bp, Homo sapiens
ctgcgctgtgtacaa

SEQ ID NO: 1443744 - DNA, 15 bp, Homo sapiens
ctgcggaagccaaag

SEQ ID NO: 1443745 - DNA, 20 bp, Homo sapiens
ctgcggaagccaaaggcagc

SEQ ID NO: 1443746 - DNA, 18 bp, Homo sapiens
ctgcggagtgaagagggg

SEQ ID NO: 1443747 - DNA, 19 bp, Homo sapiens
ctgcggagtgaagaggggc

SEQ ID NO: 1443748 - DNA, 17 bp, Homo sapiens
ctgcggcgcgggcccct

SEQ ID NO: 1443749 - DNA, 20 bp, Homo sapiens
ctgcggctttcactgctgag

SEQ ID NO: 1443750 - DNA, 19 bp, Homo sapiens
ctgcgggatggtcctgggg

SEQ ID NO: 1443751 - DNA, 16 bp, Homo sapiens
ctgcgggcccagctga

SEQ ID NO: 1443752 - DNA, 17 bp, Homo sapiens
ctgcgggcccagctgag

SEQ ID NO: 1443753 - DNA, 17 bp, Homo sapiens
ctgcgggtctgaaggaa

SEQ ID NO: 1443754 - DNA, 22 bp, Homo sapiens
ctgcggtcactcaggcctctgc

SEQ ID NO: 1443755 - DNA, 19 bp, Homo sapiens
ctgcggtgtttggcaatgc

SEQ ID NO: 1443756 - DNA, 17 bp, Homo sapiens
ctgcgtccccactccct

SEQ ID NO: 1443757 - DNA, 19 bp, Homo sapiens
ctgcgtcctcatttcccct

SEQ ID NO: 1443758 - DNA, 17 bp, Homo sapiens
ctgcgtcctcctcacct

SEQ ID NO: 1443759 - DNA, 19 bp, Homo sapiens
ctgcgtcctgacgccctgc

SEQ ID NO: 1443760 - DNA, 16 bp, Homo sapiens
ctgcgtctatcctgtg

SEQ ID NO: 1443761 - DNA, 18 bp, Homo sapiens
ctgcgtctatcctgtgta

SEQ ID NO: 1443762 - DNA, 22 bp, Homo sapiens
ctgcgtgggtgtgtgcgtgttt

SEQ ID NO: 1443763 - DNA, 14 bp, Homo sapiens
ctgcgttggagcca

SEQ ID NO: 1443764 - DNA, 15 bp, Homo sapiens
ctgcgttggagccac

SEQ ID NO: 1443765 - DNA, 21 bp, Homo sapiens
ctgcgttggagccactcctgt

SEQ ID NO: 1443766 - DNA, 22 bp, Homo sapiens
ctgcgttggagccactcctgtc

SEQ ID NO: 1443767 - DNA, 21 bp, Homo sapiens
ctgccatgccactgccaggca

SEQ ID NO: 1443768 - DNA, 22 bp, Homo sapiens
ctgccatgccactgccaggcac

SEQ ID NO: 1443769 - DNA, 14 bp, Homo sapiens
ctgccatgccagga

SEQ ID NO: 1443770 - DNA, 16 bp, Homo sapiens
ctgccatgccaggaac

SEQ ID NO: 1443771 - DNA, 23 bp, Homo sapiens
ctgccatgccaggaacctgtcct

SEQ ID NO: 1443772 - DNA, 23 bp, Homo sapiens
ctgccatgtggcagaagtgctct

SEQ ID NO: 1443773 - DNA, 22 bp, Homo sapiens
ctgccatgtttagtgaatgact

SEQ ID NO: 1443774 - DNA, 23 bp, Homo sapiens
ctgccattaaatccgcaaacagc

SEQ ID NO: 1443775 - DNA, 19 bp, Homo sapiens
ctgccattgggaccctcca

SEQ ID NO: 1443776 - DNA, 15 bp, Homo sapiens
ctgcatgctgaaaca

SEQ ID NO: 1443777 - DNA, 22 bp, Homo sapiens
ctgcatgctgcccagccactcc

SEQ ID NO: 1443778 - DNA, 16 bp, Homo sapiens
ctgcatggggaggcag

SEQ ID NO: 1443779 - DNA, 17 bp, Homo sapiens
ctgcatggggaggcagc

SEQ ID NO: 1443780 - DNA, 18 bp, Homo sapiens
ctgcatggggaggcagca

SEQ ID NO: 1443781 - DNA, 20 bp, Homo sapiens
ctgcatggtagggagagaca

SEQ ID NO: 1443782 - DNA, 17 bp, Homo sapiens
ctgcatgtctactcagc

SEQ ID NO: 1443783 - DNA, 15 bp, Homo sapiens
ctgcatgtgacttct

SEQ ID NO: 1443784 - DNA, 13 bp, Homo sapiens
ctgcatgttacat

SEQ ID NO: 1443785 - DNA, 13 bp, Homo sapiens
ctgcattagaaaa

SEQ ID NO: 1443786 - DNA, 14 bp, Homo sapiens
ctgcattagaaaaa

SEQ ID NO: 1443787 - DNA, 15 bp, Homo sapiens
ctgcattagaaaaag

SEQ ID NO: 1443788 - DNA, 22 bp, Homo sapiens
ctgcattcacccagacagctcc

SEQ ID NO: 1443789 - DNA, 15 bp, Homo sapiens
ctgcattcctgtgcc

SEQ ID NO: 1443790 - DNA, 14 bp, Homo sapiens
ctgcattctctccc

SEQ ID NO: 1443791 - DNA, 20 bp, Homo sapiens
ctgcattctctcccatcctg

SEQ ID NO: 1443792 - DNA, 19 bp, Homo sapiens
ctgcattctgccgtgtgcc

SEQ ID NO: 1443793 - DNA, 18 bp, Homo sapiens
ctgcattcttctgagcac

SEQ ID NO: 1443794 - DNA, 22 bp, Homo sapiens
ctgcattcttctgagcactgtt

SEQ ID NO: 1443795 - DNA, 17 bp, Homo sapiens
ctgcattgagcttgcat

SEQ ID NO: 1443796 - DNA, 14 bp, Homo sapiens
ctgcattggcctgg

SEQ ID NO: 1443797 - DNA, 20 bp, Homo sapiens
ctgcattgttattgtggaag

SEQ ID NO: 1443798 - DNA, 15 bp, Homo sapiens
ctgcatttacagtgt

SEQ ID NO: 1443799 - DNA, 18 bp, Homo sapiens
ctgcattttcaccccacc

SEQ ID NO: 1443800 - DNA, 21 bp, Homo sapiens
ctgcattttcctcttgtcctg

SEQ ID NO: 1443801 - DNA, 18 bp, Homo sapiens
ctgcatttttagaccatt

SEQ ID NO: 1443802 - DNA, 22 bp, Homo sapiens
ctgccaaaatggtacagcttct

SEQ ID NO: 1443803 - DNA, 12 bp, Homo sapiens
ctgccaaacaca

SEQ ID NO: 1443804 - DNA, 13 bp, Homo sapiens
ctgccaaacacat

SEQ ID NO: 1443805 - DNA, 21 bp, Homo sapiens
ctgccaaagggaaatatcatt

SEQ ID NO: 1443806 - DNA, 22 bp, Homo sapiens
ctgccaaataaatcatcctcat

SEQ ID NO: 1443807 - DNA, 20 bp, Homo sapiens
ctgccaaattttggccaaag

SEQ ID NO: 1443808 - DNA, 17 bp, Homo sapiens
ctgccaacatgaggaca

SEQ ID NO: 1443809 - DNA, 18 bp, Homo sapiens
ctgccaacatgaggacag

SEQ ID NO: 1443810 - DNA, 21 bp, Homo sapiens
ctgccaacatgaggacagaag

SEQ ID NO: 1443811 - DNA, 24 bp, Homo sapiens
ctgccaacatgaggacagaaggac

SEQ ID NO: 1443812 - DNA, 21 bp, Homo sapiens
ctgccaaccataccttccttc

SEQ ID NO: 1443813 - DNA, 19 bp, Homo sapiens
ctgccaagactcctcaggc

SEQ ID NO: 1443814 - DNA, 18 bp, Homo sapiens
ctgccaaggccagagtgg

SEQ ID NO: 1443815 - DNA, 21 bp, Homo sapiens
ctgccaaggccagagtggcct

SEQ ID NO: 1443816 - DNA, 19 bp, Homo sapiens
ctgccaagtctcagaagag

SEQ ID NO: 1443817 - DNA, 19 bp, Homo sapiens
ctgccacaaaccaccagga

SEQ ID NO: 1443818 - DNA, 20 bp, Homo sapiens
ctgccacaaccagccaggca

SEQ ID NO: 1443819 - DNA, 15 bp, Homo sapiens
ctgccacaccctccc

SEQ ID NO: 1443820 - DNA, 22 bp, Homo sapiens
ctgccacacttcaggctcttct

SEQ ID NO: 1443821 - DNA, 23 bp, Homo sapiens
ctgccacagagaagtttgtagcc

SEQ ID NO: 1443822 - DNA, 23 bp, Homo sapiens
ctgccacagtaatactcattcct

SEQ ID NO: 1443823 - DNA, 16 bp, Homo sapiens
ctgccacatggagccc

SEQ ID NO: 1443824 - DNA, 19 bp, Homo sapiens
ctgccacatggagccccct

SEQ ID NO: 1443825 - DNA, 23 bp, Homo sapiens
ctgccacatggagccccctctgc

SEQ ID NO: 1443826 - DNA, 14 bp, Homo sapiens
ctgccaccacgtct

SEQ ID NO: 1443827 - DNA, 17 bp, Homo sapiens
ctgccaccacgtctgcc

SEQ ID NO: 1443828 - DNA, 18 bp, Homo sapiens
ctgccaccacgtctgcca

SEQ ID NO: 1443829 - DNA, 13 bp, Homo sapiens
ctgccaccaggcc

SEQ ID NO: 1443830 - DNA, 18 bp, Homo sapiens
ctgccaccaggccacctc

SEQ ID NO: 1443831 - DNA, 20 bp, Homo sapiens
ctgccacccccttccctggg

SEQ ID NO: 1443832 - DNA, 21 bp, Homo sapiens
ctgccacccccttccctggga

SEQ ID NO: 1443833 - DNA, 15 bp, Homo sapiens
ctgccaccccttcct

SEQ ID NO: 1443834 - DNA, 19 bp, Homo sapiens
ctgccaccccttcctcccc

SEQ ID NO: 1443835 - DNA, 22 bp, Homo sapiens
ctgccaccctgccccttgccat

SEQ ID NO: 1443836 - DNA, 17 bp, Homo sapiens
ctgccacctccctgacc

SEQ ID NO: 1443837 - DNA, 18 bp, Homo sapiens
ctgccacctccctgaccc

SEQ ID NO: 1443838 - DNA, 22 bp, Homo sapiens
ctgccacgggtgagagagcagg

SEQ ID NO: 1443839 - DNA, 16 bp, Homo sapiens
ctgccactcactaggc

SEQ ID NO: 1443840 - DNA, 21 bp, Homo sapiens
ctgccactctctgggactctc

SEQ ID NO: 1443841 - DNA, 14 bp, Homo sapiens
ctgccactgaggag

SEQ ID NO: 1443842 - DNA, 20 bp, Homo sapiens
ctgccactgaggagacagaa

SEQ ID NO: 1443843 - DNA, 23 bp, Homo sapiens
ctgccactgaggagacagaaagc

SEQ ID NO: 1443844 - DNA, 14 bp, Homo sapiens
ctgccactgggcac

SEQ ID NO: 1443845 - DNA, 22 bp, Homo sapiens
ctgccacttcaacccccagcta

SEQ ID NO: 1443846 - DNA, 23 bp, Homo sapiens
ctgccacttcaacccccagctaa

SEQ ID NO: 1443847 - DNA, 22 bp, Homo sapiens
ctgccactttcacgtggcctcc

SEQ ID NO: 1443848 - DNA, 23 bp, Homo sapiens
ctgccactttggtacatggccag

SEQ ID NO: 1443849 - DNA, 19 bp, Homo sapiens
ctgccagaggatgctcttt

SEQ ID NO: 1443850 - DNA, 23 bp, Homo sapiens
ctgccagaggatgctctttccca

SEQ ID NO: 1443851 - DNA, 11 bp, Homo sapiens
ctgccagcagc

SEQ ID NO: 1443852 - DNA, 12 bp, Homo sapiens
ctgccagccagc

SEQ ID NO: 1443853 - DNA, 23 bp, Homo sapiens
ctgccagccagcagccagctctc

SEQ ID NO: 1443854 - DNA, 19 bp, Homo sapiens
ctgccagcctggcttctgg

SEQ ID NO: 1443855 - DNA, 11 bp, Homo sapiens
ctgccagctgc

SEQ ID NO: 1443856 - DNA, 16 bp, Homo sapiens
ctgccagctgcactga

SEQ ID NO: 1443857 - DNA, 15 bp, Homo sapiens
ctgccagctgccttc

SEQ ID NO: 1443858 - DNA, 23 bp, Homo sapiens
ctgccagctgccttcctcatccc

SEQ ID NO: 1443859 - DNA, 14 bp, Homo sapiens
ctgccagctgggcc

SEQ ID NO: 1443860 - DNA, 15 bp, Homo sapiens
ctgccaggcaggggt

SEQ ID NO: 1443861 - DNA, 17 bp, Homo sapiens
ctgccaggcaggggtgg

SEQ ID NO: 1443862 - DNA, 20 bp, Homo sapiens
ctgccaggcaggggtggggg

SEQ ID NO: 1443863 - DNA, 20 bp, Homo sapiens
ctgccaggccagcctccgag

SEQ ID NO: 1443864 - DNA, 23 bp, Homo sapiens
ctgccaggccagcctccgagagg

SEQ ID NO: 1443865 - DNA, 12 bp, Homo sapiens
ctgccaggccca

SEQ ID NO: 1443866 - DNA, 22 bp, Homo sapiens
ctgccaggcccatctcaggtgc

SEQ ID NO: 1443867 - DNA, 21 bp, Homo sapiens
ctgccaggcgttggtgccact

SEQ ID NO: 1443868 - DNA, 23 bp, Homo sapiens
ctgccaggcgttggtgccacttc

SEQ ID NO: 1443869 - DNA, 16 bp, Homo sapiens
ctgccaggctgcctcc

SEQ ID NO: 1443870 - DNA, 19 bp, Homo sapiens
ctgccaggctgcctcctgc

SEQ ID NO: 1443871 - DNA, 12 bp, Homo sapiens
ctgccagggagc

SEQ ID NO: 1443872 - DNA, 20 bp, Homo sapiens
ctgccagggccgcggccgcc

SEQ ID NO: 1443873 - DNA, 19 bp, Homo sapiens
ctgccagtgacagacaggc

SEQ ID NO: 1443874 - DNA, 21 bp, Homo sapiens
ctgccagtgacagacaggctc

SEQ ID NO: 1443875 - DNA, 16 bp, Homo sapiens
ctgccagtgcagccac

SEQ ID NO: 1443876 - DNA, 18 bp, Homo sapiens
ctgccagtgccttacctc

SEQ ID NO: 1443877 - DNA, 21 bp, Homo sapiens
ctgccagtggggaaggaggcc

SEQ ID NO: 1443878 - DNA, 16 bp, Homo sapiens
ctgccagttctctgtg

SEQ ID NO: 1443879 - DNA, 17 bp, Homo sapiens
ctgccatattgtgtaat

SEQ ID NO: 1443880 - DNA, 20 bp, Homo sapiens
ctgccatccttgctgcagct

SEQ ID NO: 1443881 - DNA, 13 bp, Homo sapiens
ctgccatcttcag

SEQ ID NO: 1443882 - DNA, 14 bp, Homo sapiens
ctgccatcttcagg

SEQ ID NO: 1443883 - DNA, 15 bp, Homo sapiens
ctgccatcttcccag

SEQ ID NO: 1443884 - DNA, 18 bp, Homo sapiens
ctgccatcttcccagcag

SEQ ID NO: 1443885 - DNA, 21 bp, Homo sapiens
ctgccatcttctccccgaggc

SEQ ID NO: 1443886 - DNA, 15 bp, Homo sapiens
ctgccatgatagctg

SEQ ID NO: 1443887 - DNA, 21 bp, Homo sapiens
ctgccatgatagctggggctt

SEQ ID NO: 1443888 - DNA, 13 bp, Homo sapiens
ctgccatgccact

SEQ ID NO: 1443889 - DNA, 16 bp, Homo sapiens
ctgccatgccactgcc

SEQ ID NO: 1443890 - DNA, 20 bp, Homo sapiens
ctgccatgccactgccaggc

SEQ ID NO: 1443891 - DNA, 13 bp, Homo sapiens
ttttttgtattat

SEQ ID NO: 1443892 - DNA, 13 bp, Homo sapiens
ttttttgtttgtt

SEQ ID NO: 1443893 - DNA, 13 bp, Homo sapiens
tttttttccagca

SEQ ID NO: 1443894 - DNA, 12 bp, Homo sapiens
tttttttccatt

SEQ ID NO: 1443895 - DNA, 11 bp, Homo sapiens
tttttttggat

SEQ ID NO: 1443896 - DNA, 13 bp, Homo sapiens
tttttttgtaaac

SEQ ID NO: 1443897 - DNA, 14 bp, Homo sapiens
tttttttgttttgt

SEQ ID NO: 1443898 - DNA, 19 bp, Homo sapiens
ctgcaacctcacctcccgg

SEQ ID NO: 1443899 - DNA, 16 bp, Homo sapiens
ctgcaacctccacctc

SEQ ID NO: 1443900 - DNA, 16 bp, Homo sapiens
ctgcaacctctgcctc

SEQ ID NO: 1443901 - DNA, 15 bp, Homo sapiens
ctgcaactagccaag

SEQ ID NO: 1443902 - DNA, 23 bp, Homo sapiens
ctgcaactcaaggactttgcagc

SEQ ID NO: 1443903 - DNA, 21 bp, Homo sapiens
ctgcaactgctcagctctggt

SEQ ID NO: 1443904 - DNA, 20 bp, Homo sapiens
ctgcaacttccgcctcctgt

SEQ ID NO: 1443905 - DNA, 14 bp, Homo sapiens
ctgcaagagccttg

SEQ ID NO: 1443906 - DNA, 15 bp, Homo sapiens
ctgcaagagccttgg

SEQ ID NO: 1443907 - DNA, 17 bp, Homo sapiens
ctgcaagagccttggtg

SEQ ID NO: 1443908 - DNA, 13 bp, Homo sapiens
ctgcaagatggac

SEQ ID NO: 1443909 - DNA, 13 bp, Homo sapiens
ctgcaagcagaac

SEQ ID NO: 1443910 - DNA, 13 bp, Homo sapiens
ctgcaagccccag

SEQ ID NO: 1443911 - DNA, 14 bp, Homo sapiens
ctgcaagccccagg

SEQ ID NO: 1443912 - DNA, 18 bp, Homo sapiens
ctgcaagccccagggcct

SEQ ID NO: 1443913 - DNA, 22 bp, Homo sapiens
ctgcaagccccagggcctgggg

SEQ ID NO: 1443914 - DNA, 19 bp, Homo sapiens
ctgcaagccgactacacct

SEQ ID NO: 1443915 - DNA, 16 bp, Homo sapiens
ctgcaagctctgcctc

SEQ ID NO: 1443916 - DNA, 16 bp, Homo sapiens
ctgcaagggcccagag

SEQ ID NO: 1443917 - DNA, 19 bp, Homo sapiens
ctgcaaggtactctggtga

SEQ ID NO: 1443918 - DNA, 18 bp, Homo sapiens
ctgcaaggtggcctctgc

SEQ ID NO: 1443919 - DNA, 12 bp, Homo sapiens
ctgcaatagaga

SEQ ID NO: 1443920 - DNA, 14 bp, Homo sapiens
ctgcaatagagact

SEQ ID NO: 1443921 - DNA, 19 bp, Homo sapiens
ctgcaatagagactgtaga

SEQ ID NO: 1443922 - DNA, 21 bp, Homo sapiens
ctgcaatagagactgtagatt

SEQ ID NO: 1443923 - DNA, 18 bp, Homo sapiens
ctgcaatatttgaatttt

SEQ ID NO: 1443924 - DNA, 16 bp, Homo sapiens
ctgcaatcctgtcttt

SEQ ID NO: 1443925 - DNA, 14 bp, Homo sapiens
ctgcaatctgggtg

SEQ ID NO: 1443926 - DNA, 15 bp, Homo sapiens
ctgcaatgagccatg

SEQ ID NO: 1443927 - DNA, 21 bp, Homo sapiens
ctgcaattcaaaagttccaag

SEQ ID NO: 1443928 - DNA, 20 bp, Homo sapiens
ttttgcatctcacaaacata

SEQ ID NO: 1443929 - DNA, 12 bp, Homo sapiens
ttttgcatgaaa

SEQ ID NO: 1443930 - DNA, 19 bp, Homo sapiens
ttttgcatgcatgcaaatg

SEQ ID NO: 1443931 - DNA, 21 bp, Homo sapiens
ttttgcatgcatgcaaatgag

SEQ ID NO: 1443932 - DNA, 20 bp, Homo sapiens
ttttgcattccagaatcttg

SEQ ID NO: 1443933 - DNA, 22 bp, Homo sapiens
ttttgcatttctcttcctaaat

SEQ ID NO: 1443934 - DNA, 13 bp, Homo sapiens
ttttgcctgtaag

SEQ ID NO: 1443935 - DNA, 14 bp, Homo sapiens
ttttgcctgtaaga

SEQ ID NO: 1443936 - DNA, 17 bp, Homo sapiens
ttttgccttcattacct

SEQ ID NO: 1443937 - DNA, 13 bp, Homo sapiens
ttttgctaactgg

SEQ ID NO: 1443938 - DNA, 13 bp, Homo sapiens
ttttgctagatgg

SEQ ID NO: 1443939 - DNA, 15 bp, Homo sapiens
ttttgctctaaaata

SEQ ID NO: 1443940 - DNA, 17 bp, Homo sapiens
ttttgctgaattcatct

SEQ ID NO: 1443941 - DNA, 11 bp, Homo sapiens
ttttgctgtct

SEQ ID NO: 1443942 - DNA, 15 bp, Homo sapiens
ttttgctgtctttct

SEQ ID NO: 1443943 - DNA, 17 bp, Homo sapiens
ttttgctgtctttctct

SEQ ID NO: 1443944 - DNA, 17 bp, Homo sapiens
ttttgctttaattttag

SEQ ID NO: 1443945 - DNA, 13 bp, Homo sapiens
ttttgctttggtt

SEQ ID NO: 1443946 - DNA, 21 bp, Homo sapiens
ttttgcttttggcaaaactct

SEQ ID NO: 1443947 - DNA, 12 bp, Homo sapiens
ttttgcttttgt

SEQ ID NO: 1443948 - DNA, 14 bp, Homo sapiens
ttttggaaagtcag

SEQ ID NO: 1443949 - DNA, 11 bp, Homo sapiens
ttttggatgcc

SEQ ID NO: 1443950 - DNA, 19 bp, Homo sapiens
ttttggcactgagatattt

SEQ ID NO: 1443951 - DNA, 17 bp, Homo sapiens
ttttggcgaatctcaaa

SEQ ID NO: 1443952 - DNA, 19 bp, Homo sapiens
ttttggctcaaataaaatt

SEQ ID NO: 1443953 - DNA, 15 bp, Homo sapiens
ttttggggagccaga

SEQ ID NO: 1443954 - DNA, 13 bp, Homo sapiens
ttttgggggcttt

SEQ ID NO: 1443955 - DNA, 19 bp, Homo sapiens
ttttgggggtcatcttgga

SEQ ID NO: 1443956 - DNA, 17 bp, Homo sapiens
ttttgggtactggagct

SEQ ID NO: 1443957 - DNA, 19 bp, Homo sapiens
ttttggtgttgcttttcaa

SEQ ID NO: 1443958 - DNA, 14 bp, Homo sapiens
ttttggtttacctg

SEQ ID NO: 1443959 - DNA, 16 bp, Homo sapiens
ttttggttttgttccc

SEQ ID NO: 1443960 - DNA, 12 bp, Homo sapiens
ttttgtaaaaca

SEQ ID NO: 1443961 - DNA, 15 bp, Homo sapiens
ttttgtaaaacaatg

SEQ ID NO: 1443962 - DNA, 16 bp, Homo sapiens
ttttgtaaagaaaaat

SEQ ID NO: 1443963 - DNA, 14 bp, Homo sapiens
ttttgtaaagattt

SEQ ID NO: 1443964 - DNA, 16 bp, Homo sapiens
ttttgtaaagatttct

SEQ ID NO: 1443965 - DNA, 11 bp, Homo sapiens
ttttgtaaatg

SEQ ID NO: 1443966 - DNA, 15 bp, Homo sapiens
ttttgtaaatgtact

SEQ ID NO: 1443967 - DNA, 15 bp, Homo sapiens
ttttgtaacaaatga

SEQ ID NO: 1443968 - DNA, 23 bp, Homo sapiens
ttttgtaaccatatgattgaaaa

SEQ ID NO: 1443969 - DNA, 11 bp, Homo sapiens
ttttgtaacta

SEQ ID NO: 1443970 - DNA, 20 bp, Homo sapiens
ttttgtaagatgctgggttg

SEQ ID NO: 1443971 - DNA, 17 bp, Homo sapiens
ttttgtacaattactaa

SEQ ID NO: 1443972 - DNA, 23 bp, Homo sapiens
ttttgtacattacactaaattat

SEQ ID NO: 1443973 - DNA, 16 bp, Homo sapiens
ttttgtacttggaagt

SEQ ID NO: 1443974 - DNA, 19 bp, Homo sapiens
ttttgtagcactgacagat

SEQ ID NO: 1443975 - DNA, 20 bp, Homo sapiens
ttttgtagttttatttgtat

SEQ ID NO: 1443976 - DNA, 16 bp, Homo sapiens
ttttgtataattggat

SEQ ID NO: 1443977 - DNA, 17 bp, Homo sapiens
ttttgtatagtaaagtg

SEQ ID NO: 1443978 - DNA, 17 bp, Homo sapiens
ttttgtatgttaaagag

SEQ ID NO: 1443979 - DNA, 20 bp, Homo sapiens
ttttgtattacatctaatgc

SEQ ID NO: 1443980 - DNA, 20 bp, Homo sapiens
ttttgtattatttcaccagc

SEQ ID NO: 1443981 - DNA, 18 bp, Homo sapiens
ttttgtattttcatgaaa

SEQ ID NO: 1443982 - DNA, 17 bp, Homo sapiens
ttttgtcagacttccaa

SEQ ID NO: 1443983 - DNA, 17 bp, Homo sapiens
ttttgtcccatttcctt

SEQ ID NO: 1443984 - DNA, 10 bp, Homo sapiens
ttttgtctgt

SEQ ID NO: 1443985 - DNA, 21 bp, Homo sapiens
ttttgtcttaagtgtttctca

SEQ ID NO: 1443986 - DNA, 13 bp, Homo sapiens
ttttgtcttatat

SEQ ID NO: 1443987 - DNA, 14 bp, Homo sapiens
ttttgtgaactttt

SEQ ID NO: 1443988 - DNA, 19 bp, Homo sapiens
ttttgtgaagtgaaggatt

SEQ ID NO: 1443989 - DNA, 14 bp, Homo sapiens
ttttgtgaattagg

SEQ ID NO: 1443990 - DNA, 21 bp, Homo sapiens
ttttgtgacccctttcactta

SEQ ID NO: 1443991 - DNA, 13 bp, Homo sapiens
ttttgtgatgaac

SEQ ID NO: 1443992 - DNA, 22 bp, Homo sapiens
ttttgtgcaaaagcttcaaatt

SEQ ID NO: 1443993 - DNA, 15 bp, Homo sapiens
ttttgtggaggggag

SEQ ID NO: 1443994 - DNA, 21 bp, Homo sapiens
ttttgtggtcattaagcattg

SEQ ID NO: 1443995 - DNA, 17 bp, Homo sapiens
ttttgtggtttggaata

SEQ ID NO: 1443996 - DNA, 17 bp, Homo sapiens
ttttgtgtaatgaaaat

SEQ ID NO: 1443997 - DNA, 13 bp, Homo sapiens
ttttgtgtacagt

SEQ ID NO: 1443998 - DNA, 16 bp, Homo sapiens
ttttgtgtaggtgtct

SEQ ID NO: 1443999 - DNA, 12 bp, Homo sapiens
ttttgtgtatgt

SEQ ID NO: 1444000 - DNA, 16 bp, Homo sapiens
ttttgtgtatgtactt

SEQ ID NO: 1444001 - DNA, 11 bp, Homo sapiens
ttttgtgtcct

SEQ ID NO: 1444002 - DNA, 15 bp, Homo sapiens
ttttgtgtgaaattg

SEQ ID NO: 1444003 - DNA, 22 bp, Homo sapiens
ttttgtgtgagacttaaaacat

SEQ ID NO: 1444004 - DNA, 22 bp, Homo sapiens
ctgatcctgctccagcagcaca

SEQ ID NO: 1444005 - DNA, 12 bp, Homo sapiens
ctgatcctgctg

SEQ ID NO: 1444006 - DNA, 21 bp, Homo sapiens
ctgatcctggaggcccagttc

SEQ ID NO: 1444007 - DNA, 17 bp, Homo sapiens
ctgatcgtgctaaattt

SEQ ID NO: 1444008 - DNA, 20 bp, Homo sapiens
ctgatctcagggaagcccag

SEQ ID NO: 1444009 - DNA, 17 bp, Homo sapiens
ctgatctcccttggtct

SEQ ID NO: 1444010 - DNA, 17 bp, Homo sapiens
ctgatctctcagcccca

SEQ ID NO: 1444011 - DNA, 22 bp, Homo sapiens
ctgatctctgtagtggccccct

SEQ ID NO: 1444012 - DNA, 19 bp, Homo sapiens
ctgatctgcggatctcagc

SEQ ID NO: 1444013 - DNA, 15 bp, Homo sapiens
ctgatctggctgcag

SEQ ID NO: 1444014 - DNA, 12 bp, Homo sapiens
ctgatcttggaa

SEQ ID NO: 1444015 - DNA, 20 bp, Homo sapiens
ctgatcttggaaaaacagcg

SEQ ID NO: 1444016 - DNA, 16 bp, Homo sapiens
ctgatcttgtgctcag

SEQ ID NO: 1444017 - DNA, 15 bp, Homo sapiens
ctgatctttctagag

SEQ ID NO: 1444018 - DNA, 13 bp, Homo sapiens
ctgatcttttaaa

SEQ ID NO: 1444019 - DNA, 17 bp, Homo sapiens
ctgatcttttaaaatca

SEQ ID NO: 1444020 - DNA, 12 bp, Homo sapiens
ctgatgaaaaca

SEQ ID NO: 1444021 - DNA, 19 bp, Homo sapiens
ctgatgaaatctgctagaa

SEQ ID NO: 1444022 - DNA, 12 bp, Homo sapiens
ctgatgaacagt

SEQ ID NO: 1444023 - DNA, 20 bp, Homo sapiens
ctgatgaagaagggggtggg

SEQ ID NO: 1444024 - DNA, 14 bp, Homo sapiens
ctgatgaatctcaa

SEQ ID NO: 1444025 - DNA, 15 bp, Homo sapiens
ctgatgacccaggct

SEQ ID NO: 1444026 - DNA, 22 bp, Homo sapiens
ctgatgagtgattgacacacag

SEQ ID NO: 1444027 - DNA, 19 bp, Homo sapiens
ctgatgagtttcactgtac

SEQ ID NO: 1444028 - DNA, 23 bp, Homo sapiens
ctgatgagtttcactgtactgca

SEQ ID NO: 1444029 - DNA, 20 bp, Homo sapiens
ctgatgatcaaaacctgtgc

SEQ ID NO: 1444030 - DNA, 23 bp, Homo sapiens
ctgatgatcaaaacctgtgccag

SEQ ID NO: 1444031 - DNA, 16 bp, Homo sapiens
ctgatgatccagaaca

SEQ ID NO: 1444032 - DNA, 13 bp, Homo sapiens
ctgatgatgtctc

SEQ ID NO: 1444033 - DNA, 16 bp, Homo sapiens
ctgatgattttccttt

SEQ ID NO: 1444034 - DNA, 19 bp, Homo sapiens
ctgatgattttcctttttc

SEQ ID NO: 1444035 - DNA, 22 bp, Homo sapiens
ctgatgattttcctttttcttc

SEQ ID NO: 1444036 - DNA, 12 bp, Homo sapiens
ctgatgcagaca

SEQ ID NO: 1444037 - DNA, 16 bp, Homo sapiens
ctgatgcagccgtcca

SEQ ID NO: 1444038 - DNA, 14 bp, Homo sapiens
ctgatgcagcctgt

SEQ ID NO: 1444039 - DNA, 17 bp, Homo sapiens
ctgatgcagcctgtggc

SEQ ID NO: 1444040 - DNA, 20 bp, Homo sapiens
ctgatgccgtgatcctgagc

SEQ ID NO: 1444041 - DNA, 12 bp, Homo sapiens
ctgatgctccct

SEQ ID NO: 1444042 - DNA, 18 bp, Homo sapiens
ctgatgctccctcccctg

SEQ ID NO: 1444043 - DNA, 12 bp, Homo sapiens
ctgatgctgccc

SEQ ID NO: 1444044 - DNA, 21 bp, Homo sapiens
tttttaacctatgttacacca

SEQ ID NO: 1444045 - DNA, 12 bp, Homo sapiens
tttttaagaaaa

SEQ ID NO: 1444046 - DNA, 14 bp, Homo sapiens
tttttaagaatatt

SEQ ID NO: 1444047 - DNA, 11 bp, Homo sapiens
tttttaagata

SEQ ID NO: 1444048 - DNA, 20 bp, Homo sapiens
tttttaagataataatatat

SEQ ID NO: 1444049 - DNA, 20 bp, Homo sapiens
tttttaaggctctgtgcctt

SEQ ID NO: 1444050 - DNA, 18 bp, Homo sapiens
tttttaagtgtatcttaa

SEQ ID NO: 1444051 - DNA, 16 bp, Homo sapiens
tttttaagttgtcaaa

SEQ ID NO: 1444052 - DNA, 20 bp, Homo sapiens
tttttaataaaaatacacat

SEQ ID NO: 1444053 - DNA, 22 bp, Homo sapiens
tttttaataaaaatacacatga

SEQ ID NO: 1444054 - DNA, 17 bp, Homo sapiens
tttttaataaagacagg

SEQ ID NO: 1444055 - DNA, 14 bp, Homo sapiens
tttttaatatgctt

SEQ ID NO: 1444056 - DNA, 15 bp, Homo sapiens
tttttaatcatgaaa

SEQ ID NO: 1444057 - DNA, 13 bp, Homo sapiens
tttttaatggaaa

SEQ ID NO: 1444058 - DNA, 19 bp, Homo sapiens
tttttaattcaccaaagta

SEQ ID NO: 1444059 - DNA, 11 bp, Homo sapiens
tttttaattta

SEQ ID NO: 1444060 - DNA, 17 bp, Homo sapiens
tttttaatttgatgaaa

SEQ ID NO: 1444061 - DNA, 19 bp, Homo sapiens
tttttaattttgatataca

SEQ ID NO: 1444062 - DNA, 13 bp, Homo sapiens
tttttacagctgt

SEQ ID NO: 1444063 - DNA, 20 bp, Homo sapiens
tttttaccaaagtgtctttt

SEQ ID NO: 1444064 - DNA, 21 bp, Homo sapiens
tttttaccggttgattgaaat

SEQ ID NO: 1444065 - DNA, 17 bp, Homo sapiens
tttttacttttcacact

SEQ ID NO: 1444066 - DNA, 16 bp, Homo sapiens
tttttagactatttct

SEQ ID NO: 1444067 - DNA, 18 bp, Homo sapiens
tttttagagcttccaaat

SEQ ID NO: 1444068 - DNA, 21 bp, Homo sapiens
tttttagataataactgtctt

SEQ ID NO: 1444069 - DNA, 17 bp, Homo sapiens
tttttaggtgctttaga

SEQ ID NO: 1444070 - DNA, 20 bp, Homo sapiens
tttttataaaagcaaaagag

SEQ ID NO: 1444071 - DNA, 24 bp, Homo sapiens
tttttataacaatataactgagtt

SEQ ID NO: 1444072 - DNA, 18 bp, Homo sapiens
tttttataattgtacaaa

SEQ ID NO: 1444073 - DNA, 17 bp, Homo sapiens
tttttataccattcaga

SEQ ID NO: 1444074 - DNA, 21 bp, Homo sapiens
tttttatacctgtttaaattg

SEQ ID NO: 1444075 - DNA, 17 bp, Homo sapiens
tttttatactccataca

SEQ ID NO: 1444076 - DNA, 14 bp, Homo sapiens
tttttatactttat

SEQ ID NO: 1444077 - DNA, 15 bp, Homo sapiens
tttttatactttatt

SEQ ID NO: 1444078 - DNA, 23 bp, Homo sapiens
tttttatgggtgaaaataagaca

SEQ ID NO: 1444079 - DNA, 12 bp, Homo sapiens
tttttattgttg

SEQ ID NO: 1444080 - DNA, 14 bp, Homo sapiens
tttttatttgtaaa

SEQ ID NO: 1444081 - DNA, 13 bp, Homo sapiens
tttttcaaaagaa

SEQ ID NO: 1444082 - DNA, 19 bp, Homo sapiens
tttttcaagttgtaaataa

SEQ ID NO: 1444083 - DNA, 15 bp, Homo sapiens
tttttcaataccagg

SEQ ID NO: 1444084 - DNA, 20 bp, Homo sapiens
tttttcacaatgtgaaactg

SEQ ID NO: 1444085 - DNA, 22 bp, Homo sapiens
tttttcacaatgtgaaactgaa

SEQ ID NO: 1444086 - DNA, 20 bp, Homo sapiens
tttttcaggagcgcaagata

SEQ ID NO: 1444087 - DNA, 22 bp, Homo sapiens
tttttcattaaataaatttgac

SEQ ID NO: 1444088 - DNA, 22 bp, Homo sapiens
tttttcatttattgtttatgta

SEQ ID NO: 1444089 - DNA, 10 bp, Homo sapiens
tttttccagt

SEQ ID NO: 1444090 - DNA, 13 bp, Homo sapiens
tttttccccccaa

SEQ ID NO: 1444091 - DNA, 12 bp, Homo sapiens
tttttccccctt

SEQ ID NO: 1444092 - DNA, 11 bp, Homo sapiens
tttttcccttt

SEQ ID NO: 1444093 - DNA, 16 bp, Homo sapiens
tttttcctctaagtgc

SEQ ID NO: 1444094 - DNA, 22 bp, Homo sapiens
tttttcctttgaacgtgcttct

SEQ ID NO: 1444095 - DNA, 18 bp, Homo sapiens
tttttctaccataagtga

SEQ ID NO: 1444096 - DNA, 14 bp, Homo sapiens
tttttctagctata

SEQ ID NO: 1444097 - DNA, 11 bp, Homo sapiens
tttttctatat

SEQ ID NO: 1444098 - DNA, 11 bp, Homo sapiens
tttttctctaa

SEQ ID NO: 1444099 - DNA, 13 bp, Homo sapiens
tttttcttaccaa

SEQ ID NO: 1444100 - DNA, 13 bp, Homo sapiens
tttttcttcaaat

SEQ ID NO: 1444101 - DNA, 16 bp, Homo sapiens
tttttcttctgtattt

SEQ ID NO: 1444102 - DNA, 14 bp, Homo sapiens
tttttcttgatctt

SEQ ID NO: 1444103 - DNA, 16 bp, Homo sapiens
tttttctttataaact

SEQ ID NO: 1444104 - DNA, 17 bp, Homo sapiens
tttttctttataaactt

SEQ ID NO: 1444105 - DNA, 23 bp, Homo sapiens
tttttctttttccagtgttctat

SEQ ID NO: 1444106 - DNA, 18 bp, Homo sapiens
tttttgaaaaagagattt

SEQ ID NO: 1444107 - DNA, 13 bp, Homo sapiens
tttttgacagaat

SEQ ID NO: 1444108 - DNA, 21 bp, Homo sapiens
tttttgataaagtttctcaga

SEQ ID NO: 1444109 - DNA, 14 bp, Homo sapiens
tttttgatagcttt

SEQ ID NO: 1444110 - DNA, 14 bp, Homo sapiens
tttttgatgtatat

SEQ ID NO: 1444111 - DNA, 18 bp, Homo sapiens
tttttgattaacaatgta

SEQ ID NO: 1444112 - DNA, 14 bp, Homo sapiens
tttttgcagtaact

SEQ ID NO: 1444113 - DNA, 22 bp, Homo sapiens
tttttgcctaaatccaaagaaa

SEQ ID NO: 1444114 - DNA, 14 bp, Homo sapiens
tttttgcgctgcta

SEQ ID NO: 1444115 - DNA, 18 bp, Homo sapiens
tttttgctataatcatta

SEQ ID NO: 1444116 - DNA, 13 bp, Homo sapiens
tttttgctgaatt

SEQ ID NO: 1444117 - DNA, 19 bp, Homo sapiens
tttttgctgaattcatcta

SEQ ID NO: 1444118 - DNA, 15 bp, Homo sapiens
tttttggaaagtcag

SEQ ID NO: 1444119 - DNA, 17 bp, Homo sapiens
tttttggaaagtcagaa

SEQ ID NO: 1444120 - DNA, 19 bp, Homo sapiens
tttttggagaaatgtcata

SEQ ID NO: 1444121 - DNA, 21 bp, Homo sapiens
tttttggagaaggttatcaaa

SEQ ID NO: 1444122 - DNA, 17 bp, Homo sapiens
tttttggcctgtttgat

SEQ ID NO: 1444123 - DNA, 21 bp, Homo sapiens
ctgagacaggagaatcacctg

SEQ ID NO: 1444124 - DNA, 14 bp, Homo sapiens
ctgagaccctactg

SEQ ID NO: 1444125 - DNA, 20 bp, Homo sapiens
ctgagacctgggatttgaga

SEQ ID NO: 1444126 - DNA, 21 bp, Homo sapiens
ctgagacctgggatttgagat

SEQ ID NO: 1444127 - DNA, 14 bp, Homo sapiens
ctgagactccagaa

SEQ ID NO: 1444128 - DNA, 19 bp, Homo sapiens
ctgagactccggggagcgc

SEQ ID NO: 1444129 - DNA, 20 bp, Homo sapiens
ctgagactttcccctctcgc

SEQ ID NO: 1444130 - DNA, 19 bp, Homo sapiens
ctgagagacctgccctctc

SEQ ID NO: 1444131 - DNA, 21 bp, Homo sapiens
ctgagagacctgccctctctg

SEQ ID NO: 1444132 - DNA, 19 bp, Homo sapiens
ctgagagacctgtgtgaac

SEQ ID NO: 1444133 - DNA, 20 bp, Homo sapiens
ctgagagacctgtgtgaact

SEQ ID NO: 1444134 - DNA, 20 bp, Homo sapiens
ctgagagagaatagagctgc

SEQ ID NO: 1444135 - DNA, 22 bp, Homo sapiens
ctgagagagaatagagctgcca

SEQ ID NO: 1444136 - DNA, 20 bp, Homo sapiens
ctgagagcatctcaggaggg

SEQ ID NO: 1444137 - DNA, 14 bp, Homo sapiens
ctgagagccccagc

SEQ ID NO: 1444138 - DNA, 15 bp, Homo sapiens
ctgagagccccagct

SEQ ID NO: 1444139 - DNA, 12 bp, Homo sapiens
ctgagaggcagg

SEQ ID NO: 1444140 - DNA, 13 bp, Homo sapiens
ctgagaggcaggc

SEQ ID NO: 1444141 - DNA, 14 bp, Homo sapiens
ctgagaggcaggca

SEQ ID NO: 1444142 - DNA, 16 bp, Homo sapiens
ctgagaggcctggagc

SEQ ID NO: 1444143 - DNA, 17 bp, Homo sapiens
ctgagagggctcgaggg

SEQ ID NO: 1444144 - DNA, 17 bp, Homo sapiens
ctgagagtcagctctct

SEQ ID NO: 1444145 - DNA, 21 bp, Homo sapiens
ctgagagttggctcaggcaga

SEQ ID NO: 1444146 - DNA, 13 bp, Homo sapiens
ctgagataagaaa

SEQ ID NO: 1444147 - DNA, 17 bp, Homo sapiens
ctgagataagaaaagcc

SEQ ID NO: 1444148 - DNA, 15 bp, Homo sapiens
ctgagatacttccca

SEQ ID NO: 1444149 - DNA, 18 bp, Homo sapiens
ctgagatacttcccaaag

SEQ ID NO: 1444150 - DNA, 19 bp, Homo sapiens
ctgagatcgtgctactgca

SEQ ID NO: 1444151 - DNA, 20 bp, Homo sapiens
ctgagatctgcacagtcaga

SEQ ID NO: 1444152 - DNA, 20 bp, Homo sapiens
ctgagatgtgaacacatcag

SEQ ID NO: 1444153 - DNA, 13 bp, Homo sapiens
ctgagatgtgtga

SEQ ID NO: 1444154 - DNA, 14 bp, Homo sapiens
ctgagattctaaga

SEQ ID NO: 1444155 - DNA, 23 bp, Homo sapiens
ctgagattctttaaggagataga

SEQ ID NO: 1444156 - DNA, 20 bp, Homo sapiens
ctgagcaagactctttcaaa

SEQ ID NO: 1444157 - DNA, 21 bp, Homo sapiens
ctgagcaagatcttgtctcca

SEQ ID NO: 1444158 - DNA, 14 bp, Homo sapiens
ctgagcaaggagtt

SEQ ID NO: 1444159 - DNA, 15 bp, Homo sapiens
ctgagcaatgtctgt

SEQ ID NO: 1444160 - DNA, 15 bp, Homo sapiens
ctgagcaccctctgg

SEQ ID NO: 1444161 - DNA, 20 bp, Homo sapiens
ctgagcaccctctggattct

SEQ ID NO: 1444162 - DNA, 23 bp, Homo sapiens
ctgagcaccgtgtcaagctgctc

SEQ ID NO: 1444163 - DNA, 16 bp, Homo sapiens
ctgagcacctcccagc

SEQ ID NO: 1444164 - DNA, 20 bp, Homo sapiens
ctgagcactgtttatacact

SEQ ID NO: 1444165 - DNA, 19 bp, Homo sapiens
ctgagcagaatactggtct

SEQ ID NO: 1444166 - DNA, 11 bp, Homo sapiens
ctgagcagccg

SEQ ID NO: 1444167 - DNA, 14 bp, Homo sapiens
ctgagcagccgcca

SEQ ID NO: 1444168 - DNA, 15 bp, Homo sapiens
ctgagcagccgccag

SEQ ID NO: 1444169 - DNA, 17 bp, Homo sapiens
ctgagcagccgccagct

SEQ ID NO: 1444170 - DNA, 18 bp, Homo sapiens
ctgagcagccgccagctg

SEQ ID NO: 1444171 - DNA, 19 bp, Homo sapiens
ctgagcagccgccagctgg

SEQ ID NO: 1444172 - DNA, 20 bp, Homo sapiens
ctgagcagccgccagctggg

SEQ ID NO: 1444173 - DNA, 22 bp, Homo sapiens
ctgagcagccgccagctgggag

SEQ ID NO: 1444174 - DNA, 21 bp, Homo sapiens
ctgagcagcctctgccaggcc

SEQ ID NO: 1444175 - DNA, 22 bp, Homo sapiens
ctgagcagggtccacagctgga

SEQ ID NO: 1444176 - DNA, 16 bp, Homo sapiens
ctgagcataatgctcc

SEQ ID NO: 1444177 - DNA, 21 bp, Homo sapiens
tttgtaatgaccaaggtaccg

SEQ ID NO: 1444178 - DNA, 17 bp, Homo sapiens
tttgtaattcctgatct

SEQ ID NO: 1444179 - DNA, 20 bp, Homo sapiens
tttgtaattgcttacatttt

SEQ ID NO: 1444180 - DNA, 13 bp, Homo sapiens
tttgtaattgtgt

SEQ ID NO: 1444181 - DNA, 14 bp, Homo sapiens
tttgtaatttttgc

SEQ ID NO: 1444182 - DNA, 15 bp, Homo sapiens
tttgtaatttttgct

SEQ ID NO: 1444183 - DNA, 23 bp, Homo sapiens
tttgtacaaaaaaaaagttttat

SEQ ID NO: 1444184 - DNA, 17 bp, Homo sapiens
tttgtacaaataaacct

SEQ ID NO: 1444185 - DNA, 16 bp, Homo sapiens
tttgtacaatggttta

SEQ ID NO: 1444186 - DNA, 19 bp, Homo sapiens
tttgtacaattttaaagtt

SEQ ID NO: 1444187 - DNA, 14 bp, Homo sapiens
tttgtacatattgt

SEQ ID NO: 1444188 - DNA, 15 bp, Homo sapiens
tttgtacattacact

SEQ ID NO: 1444189 - DNA, 20 bp, Homo sapiens
tttgtacattacactaaatt

SEQ ID NO: 1444190 - DNA, 18 bp, Homo sapiens
tttgtacatttgggagtt

SEQ ID NO: 1444191 - DNA, 14 bp, Homo sapiens
tttgtactgaaaaa

SEQ ID NO: 1444192 - DNA, 22 bp, Homo sapiens
tttgtactgaatttttttgtaa

SEQ ID NO: 1444193 - DNA, 23 bp, Homo sapiens
tttgtacttgctccttttgctct

SEQ ID NO: 1444194 - DNA, 18 bp, Homo sapiens
tttgtactttctgttaaa

SEQ ID NO: 1444195 - DNA, 18 bp, Homo sapiens
tttgtacttttttcttaa

SEQ ID NO: 1444196 - DNA, 15 bp, Homo sapiens
tttgtagagacaggg

SEQ ID NO: 1444197 - DNA, 17 bp, Homo sapiens
tttgtagcactgacaga

SEQ ID NO: 1444198 - DNA, 14 bp, Homo sapiens
tttgtataaaagtg

SEQ ID NO: 1444199 - DNA, 13 bp, Homo sapiens
tttgtataaaatc

SEQ ID NO: 1444200 - DNA, 14 bp, Homo sapiens
tttgtatagaccaa

SEQ ID NO: 1444201 - DNA, 19 bp, Homo sapiens
tttgtatagtgtaaactga

SEQ ID NO: 1444202 - DNA, 12 bp, Homo sapiens
tttgtatattgt

SEQ ID NO: 1444203 - DNA, 18 bp, Homo sapiens
tttgtatctttatgctgt

SEQ ID NO: 1444204 - DNA, 21 bp, Homo sapiens
tttgtatctttatgctgtatt

SEQ ID NO: 1444205 - DNA, 18 bp, Homo sapiens
tttgtatgaaattataat

SEQ ID NO: 1444206 - DNA, 22 bp, Homo sapiens
tttgtatgccaagtgagaagat

SEQ ID NO: 1444207 - DNA, 14 bp, Homo sapiens
tttgtatggagtta

SEQ ID NO: 1444208 - DNA, 15 bp, Homo sapiens
tttgtatgtctgtgt

SEQ ID NO: 1444209 - DNA, 16 bp, Homo sapiens
tttgtattaagaaagg

SEQ ID NO: 1444210 - DNA, 11 bp, Homo sapiens
tttgtattaat

SEQ ID NO: 1444211 - DNA, 12 bp, Homo sapiens
tttgtattaata

SEQ ID NO: 1444212 - DNA, 17 bp, Homo sapiens
tttgtattaataaagca

SEQ ID NO: 1444213 - DNA, 18 bp, Homo sapiens
tttgtattaataaagcat

SEQ ID NO: 1444214 - DNA, 13 bp, Homo sapiens
tttgtattcatga

SEQ ID NO: 1444215 - DNA, 12 bp, Homo sapiens
tttgtattgctt

SEQ ID NO: 1444216 - DNA, 13 bp, Homo sapiens
tttgtatttattc

SEQ ID NO: 1444217 - DNA, 22 bp, Homo sapiens
tttgtattttacatgggccagt

SEQ ID NO: 1444218 - DNA, 13 bp, Homo sapiens
tttgtattttcat

SEQ ID NO: 1444219 - DNA, 15 bp, Homo sapiens
tttgtattttgcata

SEQ ID NO: 1444220 - DNA, 14 bp, Homo sapiens
tttgtatttttaat

SEQ ID NO: 1444221 - DNA, 19 bp, Homo sapiens
tttgtatttttagtagaga

SEQ ID NO: 1444222 - DNA, 19 bp, Homo sapiens
tttgtattttttatttaca

SEQ ID NO: 1444223 - DNA, 16 bp, Homo sapiens
tttgtcaaactgtaga

SEQ ID NO: 1444224 - DNA, 14 bp, Homo sapiens
tttgtcactttttc

SEQ ID NO: 1444225 - DNA, 15 bp, Homo sapiens
tttgtcagcatctga

SEQ ID NO: 1444226 - DNA, 23 bp, Homo sapiens
tttgtcagcatctgaccatctgt

SEQ ID NO: 1444227 - DNA, 23 bp, Homo sapiens
tttgtcattcaagcctgtgaata

SEQ ID NO: 1444228 - DNA, 13 bp, Homo sapiens
tttgtcattcaga

SEQ ID NO: 1444229 - DNA, 18 bp, Homo sapiens
tttgtccatcagattctg

SEQ ID NO: 1444230 - DNA, 14 bp, Homo sapiens
tttgtcccagcctg

SEQ ID NO: 1444231 - DNA, 19 bp, Homo sapiens
tttgtcccagcctggggct

SEQ ID NO: 1444232 - DNA, 12 bp, Homo sapiens
tttgtcccaggt

SEQ ID NO: 1444233 - DNA, 19 bp, Homo sapiens
tttgtcccagtcagaaata

SEQ ID NO: 1444234 - DNA, 15 bp, Homo sapiens
tttgtcccccaactt

SEQ ID NO: 1444235 - DNA, 13 bp, Homo sapiens
tttgtcccttcta

SEQ ID NO: 1444236 - DNA, 22 bp, Homo sapiens
tttgtccgattaatttgaaatc

SEQ ID NO: 1444237 - DNA, 19 bp, Homo sapiens
tttgtcgctcatgtgtgca

SEQ ID NO: 1444238 - DNA, 22 bp, Homo sapiens
ctgaggagcccttaccctccca

SEQ ID NO: 1444239 - DNA, 20 bp, Homo sapiens
ctgaggaggaggacacagca

SEQ ID NO: 1444240 - DNA, 22 bp, Homo sapiens
ctgaggagtattaagaatgcag

SEQ ID NO: 1444241 - DNA, 15 bp, Homo sapiens
ctgaggataactcaa

SEQ ID NO: 1444242 - DNA, 13 bp, Homo sapiens
ctgaggatgagct

SEQ ID NO: 1444243 - DNA, 15 bp, Homo sapiens
ctgaggatgagctgg

SEQ ID NO: 1444244 - DNA, 18 bp, Homo sapiens
ctgaggatgggtcagagc

SEQ ID NO: 1444245 - DNA, 22 bp, Homo sapiens
ctgaggatttaagggatggaaa

SEQ ID NO: 1444246 - DNA, 14 bp, Homo sapiens
ctgaggatttcaag

SEQ ID NO: 1444247 - DNA, 21 bp, Homo sapiens
ctgaggcaccgtccaggcccc

SEQ ID NO: 1444248 - DNA, 14 bp, Homo sapiens
ctgaggcagacagc

SEQ ID NO: 1444249 - DNA, 13 bp, Homo sapiens
ctgaggcaggaga

SEQ ID NO: 1444250 - DNA, 20 bp, Homo sapiens
ctgaggcaggagaatcactt

SEQ ID NO: 1444251 - DNA, 14 bp, Homo sapiens
ctgaggcaggtgag

SEQ ID NO: 1444252 - DNA, 20 bp, Homo sapiens
ctgaggccacccactgaccc

SEQ ID NO: 1444253 - DNA, 17 bp, Homo sapiens
ctgaggccacccagagg

SEQ ID NO: 1444254 - DNA, 15 bp, Homo sapiens
ctgaggcccagtgca

SEQ ID NO: 1444255 - DNA, 21 bp, Homo sapiens
ctgaggcctaaaagtaaacat

SEQ ID NO: 1444256 - DNA, 23 bp, Homo sapiens
ctgaggcctaaaagtaaacatta

SEQ ID NO: 1444257 - DNA, 17 bp, Homo sapiens
ctgaggcctagactctg

SEQ ID NO: 1444258 - DNA, 12 bp, Homo sapiens
ctgaggcctcac

SEQ ID NO: 1444259 - DNA, 14 bp, Homo sapiens
ctgaggcctcatcc

SEQ ID NO: 1444260 - DNA, 22 bp, Homo sapiens
ctgaggcctcattttgggggtc

SEQ ID NO: 1444261 - DNA, 22 bp, Homo sapiens
ctgaggcctgagcgctcctgcc

SEQ ID NO: 1444262 - DNA, 12 bp, Homo sapiens
ctgaggcctgct

SEQ ID NO: 1444263 - DNA, 19 bp, Homo sapiens
ctgaggcctgggccgctgc

SEQ ID NO: 1444264 - DNA, 18 bp, Homo sapiens
ctgaggccttatcattca

SEQ ID NO: 1444265 - DNA, 12 bp, Homo sapiens
ctgaggccttgt

SEQ ID NO: 1444266 - DNA, 20 bp, Homo sapiens
ctgaggctctttctgggcca

SEQ ID NO: 1444267 - DNA, 17 bp, Homo sapiens
ctgaggctgtggtcaca

SEQ ID NO: 1444268 - DNA, 17 bp, Homo sapiens
ctgaggcttaggcctct

SEQ ID NO: 1444269 - DNA, 16 bp, Homo sapiens
ctgagggacaggatct

SEQ ID NO: 1444270 - DNA, 13 bp, Homo sapiens
ctgagggaccagc

SEQ ID NO: 1444271 - DNA, 20 bp, Homo sapiens
ctgagggaccgagcccagca

SEQ ID NO: 1444272 - DNA, 23 bp, Homo sapiens
ctgagggaccgagcccagcagat

SEQ ID NO: 1444273 - DNA, 15 bp, Homo sapiens
ctgagggaccttgga

SEQ ID NO: 1444274 - DNA, 16 bp, Homo sapiens
ctgagggaccttggag

SEQ ID NO: 1444275 - DNA, 15 bp, Homo sapiens
ctgagggaggaggcc

SEQ ID NO: 1444276 - DNA, 16 bp, Homo sapiens
ctgagggaggaggcca

SEQ ID NO: 1444277 - DNA, 19 bp, Homo sapiens
ctgagggaggaggccacct

SEQ ID NO: 1444278 - DNA, 18 bp, Homo sapiens
ctgagggattgaggggcc

SEQ ID NO: 1444279 - DNA, 13 bp, Homo sapiens
ctgagggcagtgc

SEQ ID NO: 1444280 - DNA, 15 bp, Homo sapiens
ctgagggcagtgccc

SEQ ID NO: 1444281 - DNA, 15 bp, Homo sapiens
ctgagggccacacta

SEQ ID NO: 1444282 - DNA, 18 bp, Homo sapiens
ctgagggccagggaccca

SEQ ID NO: 1444283 - DNA, 23 bp, Homo sapiens
ctgagggccagggacccaggtgt

SEQ ID NO: 1444284 - DNA, 13 bp, Homo sapiens
ctgagggcccctc

SEQ ID NO: 1444285 - DNA, 15 bp, Homo sapiens
ctgagggcccctctg

SEQ ID NO: 1444286 - DNA, 17 bp, Homo sapiens
ctgagggcccctctgcc

SEQ ID NO: 1444287 - DNA, 18 bp, Homo sapiens
ctgagggcccctctgccc

SEQ ID NO: 1444288 - DNA, 16 bp, Homo sapiens
ctgagggcctgctgga

SEQ ID NO: 1444289 - DNA, 15 bp, Homo sapiens
ctgagggctctgttt

SEQ ID NO: 1444290 - DNA, 21 bp, Homo sapiens
ctgaggggaggcacctccagg

SEQ ID NO: 1444291 - DNA, 22 bp, Homo sapiens
ctgaggggaggcacctccaggc

SEQ ID NO: 1444292 - DNA, 16 bp, Homo sapiens
ctgaggggcatctgcc

SEQ ID NO: 1444293 - DNA, 13 bp, Homo sapiens
ctgagggggagcc

SEQ ID NO: 1444294 - DNA, 18 bp, Homo sapiens
ctgagggggtgggggtgc

SEQ ID NO: 1444295 - DNA, 20 bp, Homo sapiens
ctgagggggtgggggtgctg

SEQ ID NO: 1444296 - DNA, 22 bp, Homo sapiens
tttgttgacagcttggaaaggg

SEQ ID NO: 1444297 - DNA, 18 bp, Homo sapiens
tttgttgcaagatgtgaa

SEQ ID NO: 1444298 - DNA, 15 bp, Homo sapiens
tttgttgctttctta

SEQ ID NO: 1444299 - DNA, 18 bp, Homo sapiens
tttgttgtacttaaatgg

SEQ ID NO: 1444300 - DNA, 14 bp, Homo sapiens
tttgtttaaaaagg

SEQ ID NO: 1444301 - DNA, 14 bp, Homo sapiens
tttgtttaaaagga

SEQ ID NO: 1444302 - DNA, 21 bp, Homo sapiens
tttgtttagcctgaaaacctt

SEQ ID NO: 1444303 - DNA, 22 bp, Homo sapiens
tttgtttagcctgaaaaccttt

SEQ ID NO: 1444304 - DNA, 19 bp, Homo sapiens
tttgtttcccccacagttt

SEQ ID NO: 1444305 - DNA, 14 bp, Homo sapiens
tttgtttgaagttg

SEQ ID NO: 1444306 - DNA, 12 bp, Homo sapiens
tttgtttgtctg

SEQ ID NO: 1444307 - DNA, 16 bp, Homo sapiens
tttgttttaataaaca

SEQ ID NO: 1444308 - DNA, 18 bp, Homo sapiens
tttgttttacaatgtcat

SEQ ID NO: 1444309 - DNA, 18 bp, Homo sapiens
tttgtttttatttaaatt

SEQ ID NO: 1444310 - DNA, 21 bp, Homo sapiens
tttgtttttcaagaaatgatt

SEQ ID NO: 1444311 - DNA, 20 bp, Homo sapiens
tttgtttttcgtcattttat

SEQ ID NO: 1444312 - DNA, 18 bp, Homo sapiens
tttgtttttgcatgaaat

SEQ ID NO: 1444313 - DNA, 13 bp, Homo sapiens
tttgtttttgctt

SEQ ID NO: 1444314 - DNA, 16 bp, Homo sapiens
tttgtttttgcttgtt

SEQ ID NO: 1444315 - DNA, 13 bp, Homo sapiens
tttgttttttgta

SEQ ID NO: 1444316 - DNA, 16 bp, Homo sapiens
tttgttttttgtaact

SEQ ID NO: 1444317 - DNA, 20 bp, Homo sapiens
tttgttttttgtaactacaa

SEQ ID NO: 1444318 - DNA, 21 bp, Homo sapiens
tttgttttttgtaactacaaa

SEQ ID NO: 1444319 - DNA, 14 bp, Homo sapiens
tttgtttttttcct

SEQ ID NO: 1444320 - DNA, 15 bp, Homo sapiens
tttgtttttttgcca

SEQ ID NO: 1444321 - DNA, 21 bp, Homo sapiens
ttttaaaaaaatttttgcaaa

SEQ ID NO: 1444322 - DNA, 16 bp, Homo sapiens
ttttaaaaaataacat

SEQ ID NO: 1444323 - DNA, 21 bp, Homo sapiens
ttttaaaaaataacatattct

SEQ ID NO: 1444324 - DNA, 20 bp, Homo sapiens
ttttaaaaaatgttttctgg

SEQ ID NO: 1444325 - DNA, 21 bp, Homo sapiens
ttttaaaaaatgttttctggg

SEQ ID NO: 1444326 - DNA, 12 bp, Homo sapiens
ttttaaaaatga

SEQ ID NO: 1444327 - DNA, 11 bp, Homo sapiens
ttttaaaacac

SEQ ID NO: 1444328 - DNA, 12 bp, Homo sapiens
ttttaaaacatt

SEQ ID NO: 1444329 - DNA, 17 bp, Homo sapiens
ttttaaaactggacctg

SEQ ID NO: 1444330 - DNA, 21 bp, Homo sapiens
ttttaaaaggtattttgaata

SEQ ID NO: 1444331 - DNA, 18 bp, Homo sapiens
ttttaaaagtctatttta

SEQ ID NO: 1444332 - DNA, 18 bp, Homo sapiens
ttttaaaatagaaatttt

SEQ ID NO: 1444333 - DNA, 23 bp, Homo sapiens
ttttaaaatagaaattttgtaag

SEQ ID NO: 1444334 - DNA, 16 bp, Homo sapiens
ttttaaaatcaactta

SEQ ID NO: 1444335 - DNA, 14 bp, Homo sapiens
ttttaaaatcagct

SEQ ID NO: 1444336 - DNA, 12 bp, Homo sapiens
ttttaaaatgta

SEQ ID NO: 1444337 - DNA, 17 bp, Homo sapiens
ttttaaaattcaaaagt

SEQ ID NO: 1444338 - DNA, 15 bp, Homo sapiens
ttttaaaattgattt

SEQ ID NO: 1444339 - DNA, 12 bp, Homo sapiens
ttttaaaattta

SEQ ID NO: 1444340 - DNA, 20 bp, Homo sapiens
ttttaaaatttgttcttgta

SEQ ID NO: 1444341 - DNA, 19 bp, Homo sapiens
ttttaaacatgagaataaa

SEQ ID NO: 1444342 - DNA, 23 bp, Homo sapiens
ttttaaacattaatagcagcctt

SEQ ID NO: 1444343 - DNA, 23 bp, Homo sapiens
ttttaaagaatatgactttttat

SEQ ID NO: 1444344 - DNA, 11 bp, Homo sapiens
ttttaaagaca

SEQ ID NO: 1444345 - DNA, 23 bp, Homo sapiens
ttttaaagaccctcctattctat

SEQ ID NO: 1444346 - DNA, 15 bp, Homo sapiens
ttttaaagcaagtca

SEQ ID NO: 1444347 - DNA, 19 bp, Homo sapiens
ttttaaagccttctggatc

SEQ ID NO: 1444348 - DNA, 16 bp, Homo sapiens
ttttaaagtatatatt

SEQ ID NO: 1444349 - DNA, 22 bp, Homo sapiens
ttttaaagtatgttattgcata

SEQ ID NO: 1444350 - DNA, 19 bp, Homo sapiens
ttttaaagtgattaaacgt

SEQ ID NO: 1444351 - DNA, 22 bp, Homo sapiens
ttttaaagttcttattttagta

SEQ ID NO: 1444352 - DNA, 15 bp, Homo sapiens
ttttaaataaaagca

SEQ ID NO: 1444353 - DNA, 14 bp, Homo sapiens
ttttatagaaaacc

SEQ ID NO: 1444354 - DNA, 20 bp, Homo sapiens
ttttatagcctggactgcta

SEQ ID NO: 1444355 - DNA, 20 bp, Homo sapiens
ttttataggggctttgctga

SEQ ID NO: 1444356 - DNA, 16 bp, Homo sapiens
ttttatatctgtaaat

SEQ ID NO: 1444357 - DNA, 13 bp, Homo sapiens
ttttatatgcttt

SEQ ID NO: 1444358 - DNA, 16 bp, Homo sapiens
ttttatatgtatggat

SEQ ID NO: 1444359 - DNA, 11 bp, Homo sapiens
ttttatattct

SEQ ID NO: 1444360 - DNA, 12 bp, Homo sapiens
ttttatatttgt

SEQ ID NO: 1444361 - DNA, 16 bp, Homo sapiens
ttttatcagccatgtt

SEQ ID NO: 1444362 - DNA, 13 bp, Homo sapiens
ttttatcatgaat

SEQ ID NO: 1444363 - DNA, 16 bp, Homo sapiens
ttttatcatgcatgtc

SEQ ID NO: 1444364 - DNA, 19 bp, Homo sapiens
ttttatcattaaaaattac

SEQ ID NO: 1444365 - DNA, 12 bp, Homo sapiens
ttttatcctgta

SEQ ID NO: 1444366 - DNA, 18 bp, Homo sapiens
ttttatcgtttttgttta

SEQ ID NO: 1444367 - DNA, 15 bp, Homo sapiens
ttttatctgtttcct

SEQ ID NO: 1444368 - DNA, 13 bp, Homo sapiens
ttttatgatcagt

SEQ ID NO: 1444369 - DNA, 22 bp, Homo sapiens
ttttatgatggagcaactgaaa

SEQ ID NO: 1444370 - DNA, 24 bp, Homo sapiens
ttttatgcagaagcatattttgct

SEQ ID NO: 1444371 - DNA, 22 bp, Homo sapiens
ttttatgcagacagtctgttat

SEQ ID NO: 1444372 - DNA, 16 bp, Homo sapiens
ttttatgggtgaaaat

SEQ ID NO: 1444373 - DNA, 21 bp, Homo sapiens
ttttatgtattctttctgcct

SEQ ID NO: 1444374 - DNA, 18 bp, Homo sapiens
ttttatgtcatagaaata

SEQ ID NO: 1444375 - DNA, 14 bp, Homo sapiens
ttttatgtgctatg

SEQ ID NO: 1444376 - DNA, 17 bp, Homo sapiens
ttttatgtgctatgcaa

SEQ ID NO: 1444377 - DNA, 20 bp, Homo sapiens
ttttatgtgctatgcaaaat

SEQ ID NO: 1444378 - DNA, 12 bp, Homo sapiens
ttttatgtttaa

SEQ ID NO: 1444379 - DNA, 22 bp, Homo sapiens
ttttattaagctttttggaatc

SEQ ID NO: 1444380 - DNA, 13 bp, Homo sapiens
ttttattaataat

SEQ ID NO: 1444381 - DNA, 14 bp, Homo sapiens
ttttattattttct

SEQ ID NO: 1444382 - DNA, 16 bp, Homo sapiens
ttttattcttatttca

SEQ ID NO: 1444383 - DNA, 19 bp, Homo sapiens
ttttattgagaattttaaa

SEQ ID NO: 1444384 - DNA, 13 bp, Homo sapiens
ttttattgttgta

SEQ ID NO: 1444385 - DNA, 19 bp, Homo sapiens
ttttatttaacagtgcaaa

SEQ ID NO: 1444386 - DNA, 17 bp, Homo sapiens
ttttatttataaactag

SEQ ID NO: 1444387 - DNA, 13 bp, Homo sapiens
ttttatttctgac

SEQ ID NO: 1444388 - DNA, 14 bp, Homo sapiens
ttttatttgtaatt

SEQ ID NO: 1444389 - DNA, 13 bp, Homo sapiens
ttttatttgtatt

SEQ ID NO: 1444390 - DNA, 13 bp, Homo sapiens
ttttatttgtcag

SEQ ID NO: 1444391 - DNA, 14 bp, Homo sapiens
ttttattttcaaga

SEQ ID NO: 1444392 - DNA, 12 bp, Homo sapiens
ttttattttgct

SEQ ID NO: 1444393 - DNA, 22 bp, Homo sapiens
ttttatttttgaacccctgtgt

SEQ ID NO: 1444394 - DNA, 18 bp, Homo sapiens
ttttattttttcttttgt

SEQ ID NO: 1444395 - DNA, 14 bp, Homo sapiens
ttttcaaaaaccag

SEQ ID NO: 1444396 - DNA, 14 bp, Homo sapiens
ttttcaaaagaaag

SEQ ID NO: 1444397 - DNA, 20 bp, Homo sapiens
ttttcaaaatccaaaaagaa

SEQ ID NO: 1444398 - DNA, 17 bp, Homo sapiens
ttttcaaacctcaaata

SEQ ID NO: 1444399 - DNA, 17 bp, Homo sapiens
ttttcaaatgagtttaa

SEQ ID NO: 1444400 - DNA, 21 bp, Homo sapiens
ttttcaaatgtttgaaaacaa

SEQ ID NO: 1444401 - DNA, 19 bp, Homo sapiens
ttttcaacctctagaattt

SEQ ID NO: 1444402 - DNA, 21 bp, Homo sapiens
ttttcaacgcagccctgcttt

SEQ ID NO: 1444403 - DNA, 22 bp, Homo sapiens
ttttcaacgcagccctgctttg

SEQ ID NO: 1444404 - DNA, 15 bp, Homo sapiens
ttttcaagaaactga

SEQ ID NO: 1444405 - DNA, 18 bp, Homo sapiens
ttttcaagattctaaagc

SEQ ID NO: 1444406 - DNA, 22 bp, Homo sapiens
ttttcaagcagcatcttctggt

SEQ ID NO: 1444407 - DNA, 20 bp, Homo sapiens
ttttcaaggcatttgtcttt

SEQ ID NO: 1444408 - DNA, 15 bp, Homo sapiens
ttttcaaggccttca

SEQ ID NO: 1444409 - DNA, 21 bp, Homo sapiens
ttttcaaggccttcagtttat

SEQ ID NO: 1444410 - DNA, 20 bp, Homo sapiens
ttttcaatatattgaacttt

SEQ ID NO: 1444411 - DNA, 23 bp, Homo sapiens
ttttcaatcaactttactgtaat

SEQ ID NO: 1444412 - DNA, 15 bp, Homo sapiens
ttttcacaatgtgaa

SEQ ID NO: 1444413 - DNA, 21 bp, Homo sapiens
ttttcacaatgtgaaactgaa

SEQ ID NO: 1444414 - DNA, 22 bp, Homo sapiens
ttttcacatataaatagatgat

SEQ ID NO: 1444415 - DNA, 13 bp, Homo sapiens
ttttcactgcctg

SEQ ID NO: 1444416 - DNA, 21 bp, Homo sapiens
ttttcactggagttacattaa

SEQ ID NO: 1444417 - DNA, 16 bp, Homo sapiens
ttttcactgtagaatg

SEQ ID NO: 1444418 - DNA, 23 bp, Homo sapiens
ttttcacttagaacctttctgtg

SEQ ID NO: 1444419 - DNA, 19 bp, Homo sapiens
ctgaggggtgggggtgccg

SEQ ID NO: 1444420 - DNA, 22 bp, Homo sapiens
ctgaggggtgggggtgccgctg

SEQ ID NO: 1444421 - DNA, 15 bp, Homo sapiens
ctgagggtccacctg

SEQ ID NO: 1444422 - DNA, 20 bp, Homo sapiens
ctgagggtccacctggagag

SEQ ID NO: 1444423 - DNA, 16 bp, Homo sapiens
ctgagggtctgggatc

SEQ ID NO: 1444424 - DNA, 17 bp, Homo sapiens
ctgagggtgggaggcaa

SEQ ID NO: 1444425 - DNA, 17 bp, Homo sapiens
ctgaggtataaagacaa

SEQ ID NO: 1444426 - DNA, 21 bp, Homo sapiens
ctgaggtctcttgagggagct

SEQ ID NO: 1444427 - DNA, 18 bp, Homo sapiens
ctgaggtgaacaaggtaa

SEQ ID NO: 1444428 - DNA, 21 bp, Homo sapiens
ctgaggtgcaggggaagacca

SEQ ID NO: 1444429 - DNA, 19 bp, Homo sapiens
ctgaggtgcctgtcccacc

SEQ ID NO: 1444430 - DNA, 20 bp, Homo sapiens
ctgaggtgggcccaggacca

SEQ ID NO: 1444431 - DNA, 23 bp, Homo sapiens
ctgaggtgggcccaggaccagct

SEQ ID NO: 1444432 - DNA, 16 bp, Homo sapiens
ctgaggttcctctgcc

SEQ ID NO: 1444433 - DNA, 20 bp, Homo sapiens
ctgaggttcctctgcctgcc

SEQ ID NO: 1444434 - DNA, 23 bp, Homo sapiens
ctgaggttcctctgcctgccccg

SEQ ID NO: 1444435 - DNA, 14 bp, Homo sapiens
ctgagtaaacataa

SEQ ID NO: 1444436 - DNA, 20 bp, Homo sapiens
ctgagtagctgggattacag

SEQ ID NO: 1444437 - DNA, 13 bp, Homo sapiens
ctgagtcaaatcc

SEQ ID NO: 1444438 - DNA, 16 bp, Homo sapiens
ctgagtcaaatccagt

SEQ ID NO: 1444439 - DNA, 17 bp, Homo sapiens
ctgagtcaaatccagtg

SEQ ID NO: 1444440 - DNA, 18 bp, Homo sapiens
ctgagtcaaatccagtgg

SEQ ID NO: 1444441 - DNA, 19 bp, Homo sapiens
ctgagtcaaatccagtggt

SEQ ID NO: 1444442 - DNA, 23 bp, Homo sapiens
ctgagtcaaatccagtggtgggt

SEQ ID NO: 1444443 - DNA, 16 bp, Homo sapiens
ctgagtcaactggagc

SEQ ID NO: 1444444 - DNA, 17 bp, Homo sapiens
ctgagtcaccaggaatg

SEQ ID NO: 1444445 - DNA, 22 bp, Homo sapiens
ctgagtcacccatgaagacagg

SEQ ID NO: 1444446 - DNA, 23 bp, Homo sapiens
ctgagtcaccctacctgtgcctg

SEQ ID NO: 1444447 - DNA, 14 bp, Homo sapiens
ctgagtcacctcct

SEQ ID NO: 1444448 - DNA, 18 bp, Homo sapiens
ctgagtcacctcctccac

SEQ ID NO: 1444449 - DNA, 14 bp, Homo sapiens
ctgagtcagtgctc

SEQ ID NO: 1444450 - DNA, 23 bp, Homo sapiens
ctgagtcagtgctctcagctggc

SEQ ID NO: 1444451 - DNA, 21 bp, Homo sapiens
ctgagtcatcttgtgagtgga

SEQ ID NO: 1444452 - DNA, 19 bp, Homo sapiens
ctgagtcatgatctccctg

SEQ ID NO: 1444453 - DNA, 17 bp, Homo sapiens
ctgagtccagagcttgt

SEQ ID NO: 1444454 - DNA, 19 bp, Homo sapiens
ctgagtcccctccaggaag

SEQ ID NO: 1444455 - DNA, 12 bp, Homo sapiens
ctgagtcctggt

SEQ ID NO: 1444456 - DNA, 19 bp, Homo sapiens
ctgagtcctggtttcctgg

SEQ ID NO: 1444457 - DNA, 13 bp, Homo sapiens
ctgagtcctgtct

SEQ ID NO: 1444458 - DNA, 19 bp, Homo sapiens
ctgagtcctgtctctgcct

SEQ ID NO: 1444459 - DNA, 15 bp, Homo sapiens
ctgagtcctttgcta

SEQ ID NO: 1444460 - DNA, 21 bp, Homo sapiens
ctgagtcggccccacatggga

SEQ ID NO: 1444461 - DNA, 17 bp, Homo sapiens
ctgagtcgtacagaaag

SEQ ID NO: 1444462 - DNA, 23 bp, Homo sapiens
ctgagtcgtacagaaagctgcct

SEQ ID NO: 1444463 - DNA, 22 bp, Homo sapiens
ctgagtctccagggccccccaa

SEQ ID NO: 1444464 - DNA, 13 bp, Homo sapiens
ctgagtctcctgt

SEQ ID NO: 1444465 - DNA, 15 bp, Homo sapiens
ctgagtctcctgtgc

SEQ ID NO: 1444466 - DNA, 16 bp, Homo sapiens
ctgagtctgagtcctg

SEQ ID NO: 1444467 - DNA, 17 bp, Homo sapiens
ttttcctaaagagagta

SEQ ID NO: 1444468 - DNA, 17 bp, Homo sapiens
ttttcctactgtcctca

SEQ ID NO: 1444469 - DNA, 16 bp, Homo sapiens
ttttcctcaagcaata

SEQ ID NO: 1444470 - DNA, 18 bp, Homo sapiens
ttttcctcatgtaacatt

SEQ ID NO: 1444471 - DNA, 16 bp, Homo sapiens
ttttcctctgttcaca

SEQ ID NO: 1444472 - DNA, 18 bp, Homo sapiens
ttttcctcttctattttg

SEQ ID NO: 1444473 - DNA, 17 bp, Homo sapiens
ttttccttaactaaatg

SEQ ID NO: 1444474 - DNA, 16 bp, Homo sapiens
ttttccttctgttaaa

SEQ ID NO: 1444475 - DNA, 21 bp, Homo sapiens
ttttcctttgaacgtgcttct

SEQ ID NO: 1444476 - DNA, 20 bp, Homo sapiens
ttttcctttttcttcgctgg

SEQ ID NO: 1444477 - DNA, 17 bp, Homo sapiens
ttttcgtgcactctgct

SEQ ID NO: 1444478 - DNA, 13 bp, Homo sapiens
ttttctaaactgt

SEQ ID NO: 1444479 - DNA, 15 bp, Homo sapiens
ttttctaaatgttat

SEQ ID NO: 1444480 - DNA, 15 bp, Homo sapiens
ttttctaagagaagt

SEQ ID NO: 1444481 - DNA, 14 bp, Homo sapiens
ttttctacagtggt

SEQ ID NO: 1444482 - DNA, 13 bp, Homo sapiens
ttttctacagtta

SEQ ID NO: 1444483 - DNA, 18 bp, Homo sapiens
ttttctatatagttcctt

SEQ ID NO: 1444484 - DNA, 19 bp, Homo sapiens
ttttctattatttttataa

SEQ ID NO: 1444485 - DNA, 18 bp, Homo sapiens
ttttctcagaacagctga

SEQ ID NO: 1444486 - DNA, 20 bp, Homo sapiens
ttttctcagactcaccaact

SEQ ID NO: 1444487 - DNA, 21 bp, Homo sapiens
ttttctccaatatcagtgctc

SEQ ID NO: 1444488 - DNA, 14 bp, Homo sapiens
ttttctcccaagaa

SEQ ID NO: 1444489 - DNA, 14 bp, Homo sapiens
ttttctcctcccag

SEQ ID NO: 1444490 - DNA, 11 bp, Homo sapiens
ttttctctcca

SEQ ID NO: 1444491 - DNA, 21 bp, Homo sapiens
ttttctctcgttaattttcct

SEQ ID NO: 1444492 - DNA, 17 bp, Homo sapiens
ttttctctttctctcct

SEQ ID NO: 1444493 - DNA, 12 bp, Homo sapiens
ttttctgaaaca

SEQ ID NO: 1444494 - DNA, 14 bp, Homo sapiens
ttttctgaattatg

SEQ ID NO: 1444495 - DNA, 13 bp, Homo sapiens
ttttctgactaat

SEQ ID NO: 1444496 - DNA, 15 bp, Homo sapiens
ttttctgagaaagac

SEQ ID NO: 1444497 - DNA, 23 bp, Homo sapiens
ttttctgaggatagtagttaaat

SEQ ID NO: 1444498 - DNA, 21 bp, Homo sapiens
ttttctgcatcatctgtagat

SEQ ID NO: 1444499 - DNA, 15 bp, Homo sapiens
ttttctgccctggct

SEQ ID NO: 1444500 - DNA, 16 bp, Homo sapiens
ttttctgccctggctg

SEQ ID NO: 1444501 - DNA, 14 bp, Homo sapiens
ttttctgcctgaga

SEQ ID NO: 1444502 - DNA, 17 bp, Homo sapiens
ttttctggaatacatga

SEQ ID NO: 1444503 - DNA, 21 bp, Homo sapiens
ttttctggaatacatgaaata

SEQ ID NO: 1444504 - DNA, 13 bp, Homo sapiens
ttttctggattct

SEQ ID NO: 1444505 - DNA, 20 bp, Homo sapiens
ttttctggtggggctgtcct

SEQ ID NO: 1444506 - DNA, 22 bp, Homo sapiens
ttttctgtaatcttttatttaa

SEQ ID NO: 1444507 - DNA, 14 bp, Homo sapiens
ttttctgtaatgta

SEQ ID NO: 1444508 - DNA, 14 bp, Homo sapiens
ttttctgtaccagt

SEQ ID NO: 1444509 - DNA, 23 bp, Homo sapiens
ttttctgttactttgttttttaa

SEQ ID NO: 1444510 - DNA, 21 bp, Homo sapiens
ttttctgttgtacgtaaagct

SEQ ID NO: 1444511 - DNA, 22 bp, Homo sapiens
ttttcttaagtaatgatactgt

SEQ ID NO: 1444512 - DNA, 21 bp, Homo sapiens
ttttcttacccagattgtgta

SEQ ID NO: 1444513 - DNA, 16 bp, Homo sapiens
ttttcttcatgcaatg

SEQ ID NO: 1444514 - DNA, 15 bp, Homo sapiens
ttttcttctcagtct

SEQ ID NO: 1444515 - DNA, 14 bp, Homo sapiens
ttttcttcttccct

SEQ ID NO: 1444516 - DNA, 15 bp, Homo sapiens
ttttcttcttccctc

SEQ ID NO: 1444517 - DNA, 16 bp, Homo sapiens
ttttcttcttgggata

SEQ ID NO: 1444518 - DNA, 16 bp, Homo sapiens
ttttcttgatcttaaa

SEQ ID NO: 1444519 - DNA, 19 bp, Homo sapiens
ttttctttcccatgtattt

SEQ ID NO: 1444520 - DNA, 23 bp, Homo sapiens
ttttctttcctgtaaagaaacat

SEQ ID NO: 1444521 - DNA, 13 bp, Homo sapiens
ttttctttctatg

SEQ ID NO: 1444522 - DNA, 18 bp, Homo sapiens
ttttctttctatgtagaa

SEQ ID NO: 1444523 - DNA, 13 bp, Homo sapiens
ttttctttgtgta

SEQ ID NO: 1444524 - DNA, 19 bp, Homo sapiens
ttttctttgtgtagctttg

SEQ ID NO: 1444525 - DNA, 12 bp, Homo sapiens
ttttctttgttt

SEQ ID NO: 1444526 - DNA, 16 bp, Homo sapiens
ttttcttttatatctg

SEQ ID NO: 1444527 - DNA, 16 bp, Homo sapiens
ttttctttttctttct

SEQ ID NO: 1444528 - DNA, 14 bp, Homo sapiens
ttttgaaaattatg

SEQ ID NO: 1444529 - DNA, 22 bp, Homo sapiens
ttttgaaaattatgcaaaagca

SEQ ID NO: 1444530 - DNA, 13 bp, Homo sapiens
ttttgaaacaaag

SEQ ID NO: 1444531 - DNA, 22 bp, Homo sapiens
ttttgaaacaaagtactcttta

SEQ ID NO: 1444532 - DNA, 10 bp, Homo sapiens
ttttgaaatc

SEQ ID NO: 1444533 - DNA, 13 bp, Homo sapiens
ttttgaagcatag

SEQ ID NO: 1444534 - DNA, 22 bp, Homo sapiens
ttttgaatcatccctattctgt

SEQ ID NO: 1444535 - DNA, 18 bp, Homo sapiens
ttttgaatggtgttgtat

SEQ ID NO: 1444536 - DNA, 14 bp, Homo sapiens
ttttgaatgtcaca

SEQ ID NO: 1444537 - DNA, 14 bp, Homo sapiens
ctcttagatggatt

SEQ ID NO: 1444538 - DNA, 18 bp, Homo sapiens
ctcttagcaaaaacatgt

SEQ ID NO: 1444539 - DNA, 18 bp, Homo sapiens
ctcttagcagcttccaga

SEQ ID NO: 1444540 - DNA, 19 bp, Homo sapiens
ctcttagcagcttccagat

SEQ ID NO: 1444541 - DNA, 16 bp, Homo sapiens
ctcttagcccatgctg

SEQ ID NO: 1444542 - DNA, 16 bp, Homo sapiens
ctcttagcctctggat

SEQ ID NO: 1444543 - DNA, 17 bp, Homo sapiens
ctcttagcttacaggaa

SEQ ID NO: 1444544 - DNA, 19 bp, Homo sapiens
ctcttaggaagagaaacca

SEQ ID NO: 1444545 - DNA, 18 bp, Homo sapiens
ctcttagtctaggtcctt

SEQ ID NO: 1444546 - DNA, 15 bp, Homo sapiens
ctcttagtgcccgcc

SEQ ID NO: 1444547 - DNA, 21 bp, Homo sapiens
ctcttagtgcccgcctaggag

SEQ ID NO: 1444548 - DNA, 17 bp, Homo sapiens
ctcttatagaatattta

SEQ ID NO: 1444549 - DNA, 21 bp, Homo sapiens
ctcttatagaatatttattac

SEQ ID NO: 1444550 - DNA, 14 bp, Homo sapiens
ctcttattctaata

SEQ ID NO: 1444551 - DNA, 21 bp, Homo sapiens
ctcttcactaccctgattctt

SEQ ID NO: 1444552 - DNA, 20 bp, Homo sapiens
ctcttcactgtggccacagc

SEQ ID NO: 1444553 - DNA, 13 bp, Homo sapiens
ctcttcaggaggc

SEQ ID NO: 1444554 - DNA, 17 bp, Homo sapiens
ctcttcagtgactcctg

SEQ ID NO: 1444555 - DNA, 20 bp, Homo sapiens
ctcttcagtgactcctgctg

SEQ ID NO: 1444556 - DNA, 21 bp, Homo sapiens
tttaatatctggcactgttaa

SEQ ID NO: 1444557 - DNA, 14 bp, Homo sapiens
tttaatatgagctt

SEQ ID NO: 1444558 - DNA, 18 bp, Homo sapiens
tttaatatgagcttcaat

SEQ ID NO: 1444559 - DNA, 21 bp, Homo sapiens
tttaatatgagcttcaatata

SEQ ID NO: 1444560 - DNA, 14 bp, Homo sapiens
tttaatattttgca

SEQ ID NO: 1444561 - DNA, 17 bp, Homo sapiens
tttaatattttgtattt

SEQ ID NO: 1444562 - DNA, 21 bp, Homo sapiens
tttaatccagaattgaccttt

SEQ ID NO: 1444563 - DNA, 16 bp, Homo sapiens
tttaatcccagcactt

SEQ ID NO: 1444564 - DNA, 18 bp, Homo sapiens
tttaatctgttatgtact

SEQ ID NO: 1444565 - DNA, 12 bp, Homo sapiens
tttaatcttagc

SEQ ID NO: 1444566 - DNA, 14 bp, Homo sapiens
tttaatcttagctt

SEQ ID NO: 1444567 - DNA, 15 bp, Homo sapiens
tttaatcttagcttt

SEQ ID NO: 1444568 - DNA, 16 bp, Homo sapiens
tttaatgaaagactgt

SEQ ID NO: 1444569 - DNA, 16 bp, Homo sapiens
tttaatgagaatagaa

SEQ ID NO: 1444570 - DNA, 13 bp, Homo sapiens
tttaatgctgcct

SEQ ID NO: 1444571 - DNA, 20 bp, Homo sapiens
tttaatgggggtagcagctg

SEQ ID NO: 1444572 - DNA, 14 bp, Homo sapiens
tttaatgtaaaatt

SEQ ID NO: 1444573 - DNA, 21 bp, Homo sapiens
tttaatgtaatagggaaaatt

SEQ ID NO: 1444574 - DNA, 15 bp, Homo sapiens
tttaatgtatctatt

SEQ ID NO: 1444575 - DNA, 22 bp, Homo sapiens
tttaatgtatctatttgtacaa

SEQ ID NO: 1444576 - DNA, 22 bp, Homo sapiens
tttaattaataatatgtactaa

SEQ ID NO: 1444577 - DNA, 22 bp, Homo sapiens
tttaattaatcatgaatgtgta

SEQ ID NO: 1444578 - DNA, 21 bp, Homo sapiens
tttaattatgaaaactagcat

SEQ ID NO: 1444579 - DNA, 14 bp, Homo sapiens
tttaattattattc

SEQ ID NO: 1444580 - DNA, 23 bp, Homo sapiens
tttaattattatttatatatgta

SEQ ID NO: 1444581 - DNA, 14 bp, Homo sapiens
tttaattctagtat

SEQ ID NO: 1444582 - DNA, 20 bp, Homo sapiens
tttaattctgtcttgttcat

SEQ ID NO: 1444583 - DNA, 17 bp, Homo sapiens
tttaattcttcaccttt

SEQ ID NO: 1444584 - DNA, 12 bp, Homo sapiens
tttaattgtaaa

SEQ ID NO: 1444585 - DNA, 21 bp, Homo sapiens
tttaattgtaaagtaaaagct

SEQ ID NO: 1444586 - DNA, 22 bp, Homo sapiens
tttaatttaaactgtgttttag

SEQ ID NO: 1444587 - DNA, 13 bp, Homo sapiens
tttaatttaaagc

SEQ ID NO: 1444588 - DNA, 16 bp, Homo sapiens
tttaatttatgagttt

SEQ ID NO: 1444589 - DNA, 12 bp, Homo sapiens
tttaatttcagg

SEQ ID NO: 1444590 - DNA, 13 bp, Homo sapiens
tttaatttcagga

SEQ ID NO: 1444591 - DNA, 22 bp, Homo sapiens
tttaatttgatgaaagctgatt

SEQ ID NO: 1444592 - DNA, 15 bp, Homo sapiens
tttaattttaatgct

SEQ ID NO: 1444593 - DNA, 22 bp, Homo sapiens
tttaattttgatatacattgtg

SEQ ID NO: 1444594 - DNA, 17 bp, Homo sapiens
tttaatttttaaatgca

SEQ ID NO: 1444595 - DNA, 11 bp, Homo sapiens
tttacaaaaga

SEQ ID NO: 1444596 - DNA, 17 bp, Homo sapiens
tttacaaaccattacct

SEQ ID NO: 1444597 - DNA, 17 bp, Homo sapiens
tttacaataaatattct

SEQ ID NO: 1444598 - DNA, 15 bp, Homo sapiens
tttacacagaaacac

SEQ ID NO: 1444599 - DNA, 19 bp, Homo sapiens
tttacacagaaacactgcc

SEQ ID NO: 1444600 - DNA, 18 bp, Homo sapiens
tttacacgtatctcttgg

SEQ ID NO: 1444601 - DNA, 14 bp, Homo sapiens
tttacactggtcta

SEQ ID NO: 1444602 - DNA, 11 bp, Homo sapiens
tttacagaaaa

SEQ ID NO: 1444603 - DNA, 13 bp, Homo sapiens
tttacagaaaaag

SEQ ID NO: 1444604 - DNA, 22 bp, Homo sapiens
tttacagagaggatacatttaa

SEQ ID NO: 1444605 - DNA, 15 bp, Homo sapiens
tttacagatttctca

SEQ ID NO: 1444606 - DNA, 15 bp, Homo sapiens
tttacagcactactc

SEQ ID NO: 1444607 - DNA, 19 bp, Homo sapiens
tttacagcattgtctttgc

SEQ ID NO: 1444608 - DNA, 22 bp, Homo sapiens
tttacagcattgtctttgctgt

SEQ ID NO: 1444609 - DNA, 23 bp, Homo sapiens
tttacagctttcatgattagcaa

SEQ ID NO: 1444610 - DNA, 14 bp, Homo sapiens
tttacaggaaaaaa

SEQ ID NO: 1444611 - DNA, 21 bp, Homo sapiens
tttacaggaggttgtggatgc

SEQ ID NO: 1444612 - DNA, 14 bp, Homo sapiens
tttacagttactgc

SEQ ID NO: 1444613 - DNA, 18 bp, Homo sapiens
tttacataagagaaagag

SEQ ID NO: 1444614 - DNA, 16 bp, Homo sapiens
tttacattcaactttt

SEQ ID NO: 1444615 - DNA, 18 bp, Homo sapiens
tttaccaaaaaccatgtt

SEQ ID NO: 1444616 - DNA, 17 bp, Homo sapiens
tttaccagttgcctttt

SEQ ID NO: 1444617 - DNA, 16 bp, Homo sapiens
tttaccataatcttat

SEQ ID NO: 1444618 - DNA, 20 bp, Homo sapiens
tttaccatgcccctgagcaa

SEQ ID NO: 1444619 - DNA, 19 bp, Homo sapiens
tttaccatttgtaataaag

SEQ ID NO: 1444620 - DNA, 20 bp, Homo sapiens
tttaccatttgtaataaagt

SEQ ID NO: 1444621 - DNA, 12 bp, Homo sapiens
tttaccctccac

SEQ ID NO: 1444622 - DNA, 13 bp, Homo sapiens
tttacccttggct

SEQ ID NO: 1444623 - DNA, 23 bp, Homo sapiens
tttaccggttgtttagaaacaga

SEQ ID NO: 1444624 - DNA, 18 bp, Homo sapiens
tttacctaccacagtgtc

SEQ ID NO: 1444625 - DNA, 21 bp, Homo sapiens
tttacctactgtgtcttggaa

SEQ ID NO: 1444626 - DNA, 16 bp, Homo sapiens
tttacctgagaccagt

SEQ ID NO: 1444627 - DNA, 13 bp, Homo sapiens
tttacctgtttaa

SEQ ID NO: 1444628 - DNA, 14 bp, Homo sapiens
tttacgttcatcac

SEQ ID NO: 1444629 - DNA, 15 bp, Homo sapiens
tttactaaagaaaga

SEQ ID NO: 1444630 - DNA, 17 bp, Homo sapiens
tttactaaagaaagatt

SEQ ID NO: 1444631 - DNA, 20 bp, Homo sapiens
tttactaaagatatcagagc

SEQ ID NO: 1444632 - DNA, 14 bp, Homo sapiens
tttactaactaaat

SEQ ID NO: 1444633 - DNA, 14 bp, Homo sapiens
tttactaatatata

SEQ ID NO: 1444634 - DNA, 16 bp, Homo sapiens
tttactaatatatatt

SEQ ID NO: 1444635 - DNA, 19 bp, Homo sapiens
tttactacaatatgtacat

SEQ ID NO: 1444636 - DNA, 21 bp, Homo sapiens
tttactacataattaaatttt

SEQ ID NO: 1444637 - DNA, 19 bp, Homo sapiens
tttactatcacacatgaat

SEQ ID NO: 1444638 - DNA, 20 bp, Homo sapiens
tttactatcacacatgaata

SEQ ID NO: 1444639 - DNA, 16 bp, Homo sapiens
tttactcaaaatctgt

SEQ ID NO: 1444640 - DNA, 21 bp, Homo sapiens
tttactctctccgatttgctt

SEQ ID NO: 1444641 - DNA, 16 bp, Homo sapiens
tttactctttctaact

SEQ ID NO: 1444642 - DNA, 17 bp, Homo sapiens
tttactgagcttctctg

SEQ ID NO: 1444643 - DNA, 18 bp, Homo sapiens
tttactgagcttctctgt

SEQ ID NO: 1444644 - DNA, 15 bp, Homo sapiens
tttactgctctgaga

SEQ ID NO: 1444645 - DNA, 13 bp, Homo sapiens
tttactgcttttc

SEQ ID NO: 1444646 - DNA, 23 bp, Homo sapiens
tttactgtaatataaagtattca

SEQ ID NO: 1444647 - DNA, 20 bp, Homo sapiens
tttactgtcaaaataatttt

SEQ ID NO: 1444648 - DNA, 16 bp, Homo sapiens
tttactgtgaagagaa

SEQ ID NO: 1444649 - DNA, 21 bp, Homo sapiens
tttactgttatttaattgaaa

SEQ ID NO: 1444650 - DNA, 15 bp, Homo sapiens
tttactgttgaactt

SEQ ID NO: 1444651 - DNA, 15 bp, Homo sapiens
tttacttcttataca

SEQ ID NO: 1444652 - DNA, 23 bp, Homo sapiens
ctcttgtaccatagaaaaatgta

SEQ ID NO: 1444653 - DNA, 12 bp, Homo sapiens
ctcttgtagaag

SEQ ID NO: 1444654 - DNA, 20 bp, Homo sapiens
ctcttgtcctcttctgctct

SEQ ID NO: 1444655 - DNA, 13 bp, Homo sapiens
ctcttgtcctggc

SEQ ID NO: 1444656 - DNA, 17 bp, Homo sapiens
ctcttgtcggggtgggg

SEQ ID NO: 1444657 - DNA, 23 bp, Homo sapiens
ctcttgtcttcctatttcagaag

SEQ ID NO: 1444658 - DNA, 23 bp, Homo sapiens
ctcttgtttttattaatttatat

SEQ ID NO: 1444659 - DNA, 21 bp, Homo sapiens
ctcttgtttttgcataactgg

SEQ ID NO: 1444660 - DNA, 17 bp, Homo sapiens
ctctttaaaaacatttt

SEQ ID NO: 1444661 - DNA, 18 bp, Homo sapiens
ctctttaaaaacattttc

SEQ ID NO: 1444662 - DNA, 17 bp, Homo sapiens
ctctttaaaaactcact

SEQ ID NO: 1444663 - DNA, 20 bp, Homo sapiens
ctctttaaaaggaaagaaaa

SEQ ID NO: 1444664 - DNA, 23 bp, Homo sapiens
ctctttaaaaggaaagaaaacat

SEQ ID NO: 1444665 - DNA, 19 bp, Homo sapiens
ctctttaagttttgattaa

SEQ ID NO: 1444666 - DNA, 16 bp, Homo sapiens
ctctttaccttctaaa

SEQ ID NO: 1444667 - DNA, 17 bp, Homo sapiens
ctctttatgactgtttt

SEQ ID NO: 1444668 - DNA, 19 bp, Homo sapiens
ctctttatttctagcagag

SEQ ID NO: 1444669 - DNA, 16 bp, Homo sapiens
ctctttcacattgttt

SEQ ID NO: 1444670 - DNA, 17 bp, Homo sapiens
ctctttcagagaggtct

SEQ ID NO: 1444671 - DNA, 14 bp, Homo sapiens
ctctttcccaggac

SEQ ID NO: 1444672 - DNA, 12 bp, Homo sapiens
ctctttccctgc

SEQ ID NO: 1444673 - DNA, 22 bp, Homo sapiens
ctctttccttgagctgttgtga

SEQ ID NO: 1444674 - DNA, 13 bp, Homo sapiens
tttagatgctgat

SEQ ID NO: 1444675 - DNA, 22 bp, Homo sapiens
tttagattgaaaacttttctca

SEQ ID NO: 1444676 - DNA, 13 bp, Homo sapiens
tttagcaccccca

SEQ ID NO: 1444677 - DNA, 16 bp, Homo sapiens
tttagcataaaatttt

SEQ ID NO: 1444678 - DNA, 15 bp, Homo sapiens
tttagcctagttcat

SEQ ID NO: 1444679 - DNA, 21 bp, Homo sapiens
tttagccttccaacatttctt

SEQ ID NO: 1444680 - DNA, 15 bp, Homo sapiens
tttagctttggaaag

SEQ ID NO: 1444681 - DNA, 13 bp, Homo sapiens
tttaggaaaatca

SEQ ID NO: 1444682 - DNA, 22 bp, Homo sapiens
tttaggaaaatcactttgtcta

SEQ ID NO: 1444683 - DNA, 17 bp, Homo sapiens
tttaggaacttcagaga

SEQ ID NO: 1444684 - DNA, 18 bp, Homo sapiens
tttaggaatcctttggtg

SEQ ID NO: 1444685 - DNA, 23 bp, Homo sapiens
tttaggagctaaggctctatgag

SEQ ID NO: 1444686 - DNA, 15 bp, Homo sapiens
tttagggcagcttgc

SEQ ID NO: 1444687 - DNA, 16 bp, Homo sapiens
tttagggccttttctg

SEQ ID NO: 1444688 - DNA, 12 bp, Homo sapiens
tttaggttctaa

SEQ ID NO: 1444689 - DNA, 14 bp, Homo sapiens
tttaggttctaaag

SEQ ID NO: 1444690 - DNA, 23 bp, Homo sapiens
tttaggttctaaagttctaagat

SEQ ID NO: 1444691 - DNA, 22 bp, Homo sapiens
tttaggtttttgtttgtttcct

SEQ ID NO: 1444692 - DNA, 13 bp, Homo sapiens
tttagtaatttct

SEQ ID NO: 1444693 - DNA, 15 bp, Homo sapiens
tttagtaatttcttt

SEQ ID NO: 1444694 - DNA, 12 bp, Homo sapiens
tttagtacaata

SEQ ID NO: 1444695 - DNA, 21 bp, Homo sapiens
tttagtacctgaaaagtaact

SEQ ID NO: 1444696 - DNA, 12 bp, Homo sapiens
tttagtactcaa

SEQ ID NO: 1444697 - DNA, 20 bp, Homo sapiens
tttagtactcaatgtttctg

SEQ ID NO: 1444698 - DNA, 16 bp, Homo sapiens
tttagtagagacaggg

SEQ ID NO: 1444699 - DNA, 19 bp, Homo sapiens
tttagtatacgtataaata

SEQ ID NO: 1444700 - DNA, 13 bp, Homo sapiens
tttagtattcatt

SEQ ID NO: 1444701 - DNA, 17 bp, Homo sapiens
tttagtcattaatgtgt

SEQ ID NO: 1444702 - DNA, 19 bp, Homo sapiens
tttagtctttagaactcta

SEQ ID NO: 1444703 - DNA, 20 bp, Homo sapiens
tttagtggccatcatttctg

SEQ ID NO: 1444704 - DNA, 15 bp, Homo sapiens
tttagtgtaaaattg

SEQ ID NO: 1444705 - DNA, 14 bp, Homo sapiens
tttagtgtctgacc

SEQ ID NO: 1444706 - DNA, 19 bp, Homo sapiens
tttagtgtgtgtgcagagt

SEQ ID NO: 1444707 - DNA, 15 bp, Homo sapiens
tttagttccacaaat

SEQ ID NO: 1444708 - DNA, 19 bp, Homo sapiens
tttagttgcagaaacattt

SEQ ID NO: 1444709 - DNA, 16 bp, Homo sapiens
tttagtttaatagttt

SEQ ID NO: 1444710 - DNA, 20 bp, Homo sapiens
tttagtttctgaactctgac

SEQ ID NO: 1444711 - DNA, 13 bp, Homo sapiens
tttagttttctct

SEQ ID NO: 1444712 - DNA, 15 bp, Homo sapiens
tttagttttctctta

SEQ ID NO: 1444713 - DNA, 16 bp, Homo sapiens
tttagtttttaacaat

SEQ ID NO: 1444714 - DNA, 17 bp, Homo sapiens
tttataaaatataaaca

SEQ ID NO: 1444715 - DNA, 12 bp, Homo sapiens
tttataaacaga

SEQ ID NO: 1444716 - DNA, 15 bp, Homo sapiens
tttataaacagaaat

SEQ ID NO: 1444717 - DNA, 23 bp, Homo sapiens
tttataaacagacaatatgtgag

SEQ ID NO: 1444718 - DNA, 17 bp, Homo sapiens
tttataaatactgcaaa

SEQ ID NO: 1444719 - DNA, 20 bp, Homo sapiens
tttataacatctttattgaa

SEQ ID NO: 1444720 - DNA, 20 bp, Homo sapiens
tttataactcatcataaaat

SEQ ID NO: 1444721 - DNA, 17 bp, Homo sapiens
tttataagaaaaacttt

SEQ ID NO: 1444722 - DNA, 13 bp, Homo sapiens
tttataagaattt

SEQ ID NO: 1444723 - DNA, 17 bp, Homo sapiens
tttataagtcattgtat

SEQ ID NO: 1444724 - DNA, 15 bp, Homo sapiens
tttataattggctta

SEQ ID NO: 1444725 - DNA, 17 bp, Homo sapiens
tttataattgtacaaaa

SEQ ID NO: 1444726 - DNA, 21 bp, Homo sapiens
tttatacacttggatttcatt

SEQ ID NO: 1444727 - DNA, 13 bp, Homo sapiens
tttatacagctgt

SEQ ID NO: 1444728 - DNA, 19 bp, Homo sapiens
tttatacagtgtacatgta

SEQ ID NO: 1444729 - DNA, 22 bp, Homo sapiens
tttataccagcttaatagctgt

SEQ ID NO: 1444730 - DNA, 17 bp, Homo sapiens
tttatacctgtttaaat

SEQ ID NO: 1444731 - DNA, 14 bp, Homo sapiens
tttatacggaaaaa

SEQ ID NO: 1444732 - DNA, 21 bp, Homo sapiens
tttatactctagaacatgcac

SEQ ID NO: 1444733 - DNA, 15 bp, Homo sapiens
tttatactgcacagt

SEQ ID NO: 1444734 - DNA, 13 bp, Homo sapiens
tttatactttatt

SEQ ID NO: 1444735 - DNA, 15 bp, Homo sapiens
tttatactttattga

SEQ ID NO: 1444736 - DNA, 21 bp, Homo sapiens
tttatactttgcaatccaaat

SEQ ID NO: 1444737 - DNA, 16 bp, Homo sapiens
tttatagctcagttta

SEQ ID NO: 1444738 - DNA, 18 bp, Homo sapiens
tttataggtgagaaaaaa

SEQ ID NO: 1444739 - DNA, 20 bp, Homo sapiens
tttatatactgctatttaca

SEQ ID NO: 1444740 - DNA, 13 bp, Homo sapiens
tttatatatacag

SEQ ID NO: 1444741 - DNA, 15 bp, Homo sapiens
tttatatatatatgt

SEQ ID NO: 1444742 - DNA, 20 bp, Homo sapiens
tttatatatatatgtatatg

SEQ ID NO: 1444743 - DNA, 16 bp, Homo sapiens
tttatatatttataac

SEQ ID NO: 1444744 - DNA, 17 bp, Homo sapiens
tttatatcagcctgagt

SEQ ID NO: 1444745 - DNA, 12 bp, Homo sapiens
tttatatctaat

SEQ ID NO: 1444746 - DNA, 21 bp, Homo sapiens
tttatatgaagaaaatcactt

SEQ ID NO: 1444747 - DNA, 20 bp, Homo sapiens
tttatatgcttactgatata

SEQ ID NO: 1444748 - DNA, 12 bp, Homo sapiens
tttatatgcttt

SEQ ID NO: 1444749 - DNA, 23 bp, Homo sapiens
tttatatggatgattcagaaatt

SEQ ID NO: 1444750 - DNA, 21 bp, Homo sapiens
tttatatgtatggatctatat

SEQ ID NO: 1444751 - DNA, 14 bp, Homo sapiens
tttatattactctc

SEQ ID NO: 1444752 - DNA, 16 bp, Homo sapiens
tttatattactctcat

SEQ ID NO: 1444753 - DNA, 18 bp, Homo sapiens
tttatattccatttacat

SEQ ID NO: 1444754 - DNA, 18 bp, Homo sapiens
tttatattgcagattgaa

SEQ ID NO: 1444755 - DNA, 16 bp, Homo sapiens
tttatattgtagcagt

SEQ ID NO: 1444756 - DNA, 20 bp, Homo sapiens
tttatatttaaaaattgttt

SEQ ID NO: 1444757 - DNA, 13 bp, Homo sapiens
tttatatttagat

SEQ ID NO: 1444758 - DNA, 15 bp, Homo sapiens
tttatatttattgtt

SEQ ID NO: 1444759 - DNA, 16 bp, Homo sapiens
tttatatttattgtta

SEQ ID NO: 1444760 - DNA, 22 bp, Homo sapiens
tttatatttcctttatgtgaat

SEQ ID NO: 1444761 - DNA, 14 bp, Homo sapiens
tttatatttggaaa

SEQ ID NO: 1444762 - DNA, 21 bp, Homo sapiens
tttatatttggaaagagacca

SEQ ID NO: 1444763 - DNA, 15 bp, Homo sapiens
tttatcaactttggt

SEQ ID NO: 1444764 - DNA, 18 bp, Homo sapiens
tttatcacacttctgtga

SEQ ID NO: 1444765 - DNA, 17 bp, Homo sapiens
tttatcacctcattctg

SEQ ID NO: 1444766 - DNA, 14 bp, Homo sapiens
tttatcagaattct

SEQ ID NO: 1444767 - DNA, 21 bp, Homo sapiens
tttcatgattagcaagttaca

SEQ ID NO: 1444768 - DNA, 16 bp, Homo sapiens
tttcatgctatctctg

SEQ ID NO: 1444769 - DNA, 19 bp, Homo sapiens
tttcatgctatctctgtgt

SEQ ID NO: 1444770 - DNA, 18 bp, Homo sapiens
tttcatgctccactattt

SEQ ID NO: 1444771 - DNA, 12 bp, Homo sapiens
tttcatggaagt

SEQ ID NO: 1444772 - DNA, 19 bp, Homo sapiens
tttcatggcccttcaaatt

SEQ ID NO: 1444773 - DNA, 18 bp, Homo sapiens
tttcatgtcccagaactt

SEQ ID NO: 1444774 - DNA, 17 bp, Homo sapiens
tttcatgtgttgcaaat

SEQ ID NO: 1444775 - DNA, 16 bp, Homo sapiens
tttcatgttttagcat

SEQ ID NO: 1444776 - DNA, 17 bp, Homo sapiens
tttcattaaataaattt

SEQ ID NO: 1444777 - DNA, 18 bp, Homo sapiens
tttcattaaataaatttg

SEQ ID NO: 1444778 - DNA, 16 bp, Homo sapiens
tttcattaaatccttt

SEQ ID NO: 1444779 - DNA, 22 bp, Homo sapiens
tttcattagcagttgctcacat

SEQ ID NO: 1444780 - DNA, 18 bp, Homo sapiens
tttcattatgtaaaatgt

SEQ ID NO: 1444781 - DNA, 16 bp, Homo sapiens
tttcattcaaatcagt

SEQ ID NO: 1444782 - DNA, 21 bp, Homo sapiens
tttcattcaaatcagtgatct

SEQ ID NO: 1444783 - DNA, 19 bp, Homo sapiens
tttcatttacaaaagattt

SEQ ID NO: 1444784 - DNA, 14 bp, Homo sapiens
tttcatttatctat

SEQ ID NO: 1444785 - DNA, 14 bp, Homo sapiens
tttcatttgtacaa

SEQ ID NO: 1444786 - DNA, 19 bp, Homo sapiens
tttcatttgtacaaggtaa

SEQ ID NO: 1444787 - DNA, 16 bp, Homo sapiens
tttcatttgttttgct

SEQ ID NO: 1444788 - DNA, 22 bp, Homo sapiens
tttcattttgggccttgctaaa

SEQ ID NO: 1444789 - DNA, 22 bp, Homo sapiens
tttcattttgtaacaaatgaac

SEQ ID NO: 1444790 - DNA, 21 bp, Homo sapiens
tttccaaaacaatttcttttt

SEQ ID NO: 1444791 - DNA, 22 bp, Homo sapiens
tttccaaaacctcagttaaact

SEQ ID NO: 1444792 - DNA, 23 bp, Homo sapiens
tttccaaaagtggctagtcctca

SEQ ID NO: 1444793 - DNA, 23 bp, Homo sapiens
tttccaaattcacaagttgtgtt

SEQ ID NO: 1444794 - DNA, 15 bp, Homo sapiens
tttccaacaccacag

SEQ ID NO: 1444795 - DNA, 20 bp, Homo sapiens
tttccaacaccacagacaca

SEQ ID NO: 1444796 - DNA, 23 bp, Homo sapiens
tttccaacaccacagacacacac

SEQ ID NO: 1444797 - DNA, 19 bp, Homo sapiens
tggtctataccttaagaat

SEQ ID NO: 1444798 - DNA, 17 bp, Homo sapiens
tggtctattttgatttt

SEQ ID NO: 1444799 - DNA, 16 bp, Homo sapiens
tggtctcaaactcctg

SEQ ID NO: 1444800 - DNA, 22 bp, Homo sapiens
tggtctccccaattctcccctc

SEQ ID NO: 1444801 - DNA, 23 bp, Homo sapiens
tggtctccccaattctcccctcc

SEQ ID NO: 1444802 - DNA, 20 bp, Homo sapiens
tggtctcgaactcctggcct

SEQ ID NO: 1444803 - DNA, 18 bp, Homo sapiens
tggtctctgccccagcct

SEQ ID NO: 1444804 - DNA, 20 bp, Homo sapiens
tggtctctgccccagcctgt

SEQ ID NO: 1444805 - DNA, 22 bp, Homo sapiens
tggtctctgctgaaggttgtaa

SEQ ID NO: 1444806 - DNA, 14 bp, Homo sapiens
tggtctgccagaat

SEQ ID NO: 1444807 - DNA, 21 bp, Homo sapiens
tggtctgcttaaagcttccct

SEQ ID NO: 1444808 - DNA, 21 bp, Homo sapiens
tggaggagcagcttccttctg

SEQ ID NO: 1444809 - DNA, 14 bp, Homo sapiens
tggaggagctggcc

SEQ ID NO: 1444810 - DNA, 15 bp, Homo sapiens
tggaggagctggcct

SEQ ID NO: 1444811 - DNA, 20 bp, Homo sapiens
tggaggagctggcctgtggc

SEQ ID NO: 1444812 - DNA, 14 bp, Homo sapiens
tggaggaggaaggc

SEQ ID NO: 1444813 - DNA, 15 bp, Homo sapiens
tggaggaggaaggca

SEQ ID NO: 1444814 - DNA, 16 bp, Homo sapiens
tggaggaggaggagga

SEQ ID NO: 1444815 - DNA, 21 bp, Homo sapiens
tggaggatcccctccaagcct

SEQ ID NO: 1444816 - DNA, 15 bp, Homo sapiens
tggaggatggagaga

SEQ ID NO: 1444817 - DNA, 20 bp, Homo sapiens
tggaggatggagagagggga

SEQ ID NO: 1444818 - DNA, 13 bp, Homo sapiens
tggaggattgcta

SEQ ID NO: 1444819 - DNA, 23 bp, Homo sapiens
tggaggatttcctacccccgtcc

SEQ ID NO: 1444820 - DNA, 16 bp, Homo sapiens
tggaggcacgcaccac

SEQ ID NO: 1444821 - DNA, 22 bp, Homo sapiens
tggaggcagggccttgcccaga

SEQ ID NO: 1444822 - DNA, 18 bp, Homo sapiens
tggaggcccctgggctct

SEQ ID NO: 1444823 - DNA, 21 bp, Homo sapiens
tggaggccgaggaccaccagc

SEQ ID NO: 1444824 - DNA, 18 bp, Homo sapiens
tggaggcctgatgctgcc

SEQ ID NO: 1444825 - DNA, 19 bp, Homo sapiens
tggaggcctgatgctgccc

SEQ ID NO: 1444826 - DNA, 17 bp, Homo sapiens
tggaggccttccagctg

SEQ ID NO: 1444827 - DNA, 21 bp, Homo sapiens
tggaggccttccagctgctgt

SEQ ID NO: 1444828 - DNA, 19 bp, Homo sapiens
tggaggctctgttctgcct

SEQ ID NO: 1444829 - DNA, 14 bp, Homo sapiens
tggaggctgagttc

SEQ ID NO: 1444830 - DNA, 14 bp, Homo sapiens
tggaggctgtcttc

SEQ ID NO: 1444831 - DNA, 23 bp, Homo sapiens
tggaggctgtcttctcaggctct

SEQ ID NO: 1444832 - DNA, 15 bp, Homo sapiens
tggaggcttttcact

SEQ ID NO: 1444833 - DNA, 16 bp, Homo sapiens
tggaggcttttcactg

SEQ ID NO: 1444834 - DNA, 12 bp, Homo sapiens
tggagggaagcc

SEQ ID NO: 1444835 - DNA, 22 bp, Homo sapiens
tggagggaaggataaagccact

SEQ ID NO: 1444836 - DNA, 11 bp, Homo sapiens
tggagggaggc

SEQ ID NO: 1444837 - DNA, 16 bp, Homo sapiens
tggagggaggccccag

SEQ ID NO: 1444838 - DNA, 18 bp, Homo sapiens
tggagggaggccccaggg

SEQ ID NO: 1444839 - DNA, 19 bp, Homo sapiens
tggagggaggccccagggg

SEQ ID NO: 1444840 - DNA, 13 bp, Homo sapiens
tggagggagggaa

SEQ ID NO: 1444841 - DNA, 15 bp, Homo sapiens
tggagggcacagccc

SEQ ID NO: 1444842 - DNA, 15 bp, Homo sapiens
tggagggcttggccc

SEQ ID NO: 1444843 - DNA, 22 bp, Homo sapiens
tggaggggcagcctgtgcctgc

SEQ ID NO: 1444844 - DNA, 16 bp, Homo sapiens
tggaggggctggggac

SEQ ID NO: 1444845 - DNA, 14 bp, Homo sapiens
tggaggggtgggga

SEQ ID NO: 1444846 - DNA, 15 bp, Homo sapiens
tggaggggtggggag

SEQ ID NO: 1444847 - DNA, 13 bp, Homo sapiens
tggaggggtgtgg

SEQ ID NO: 1444848 - DNA, 19 bp, Homo sapiens
tggaggggtgtggcagtgg

SEQ ID NO: 1444849 - DNA, 15 bp, Homo sapiens
tggagggtgaccaca

SEQ ID NO: 1444850 - DNA, 16 bp, Homo sapiens
tggaggtcatctggcg

SEQ ID NO: 1444851 - DNA, 22 bp, Homo sapiens
tggaggtctccaggggcctgca

SEQ ID NO: 1444852 - DNA, 14 bp, Homo sapiens
tggaggtctggctg

SEQ ID NO: 1444853 - DNA, 19 bp, Homo sapiens
tggaggtctggctgagccc

SEQ ID NO: 1444854 - DNA, 13 bp, Homo sapiens
tggaggtgggcaa

SEQ ID NO: 1444855 - DNA, 22 bp, Homo sapiens
tggaggtgggcattggcggggc

SEQ ID NO: 1444856 - DNA, 14 bp, Homo sapiens
tggaggtgtgggag

SEQ ID NO: 1444857 - DNA, 21 bp, Homo sapiens
tgtttgttaaaactggcatct

SEQ ID NO: 1444858 - DNA, 12 bp, Homo sapiens
tgtttgttatgg

SEQ ID NO: 1444859 - DNA, 15 bp, Homo sapiens
tgtttgttcatctgt

SEQ ID NO: 1444860 - DNA, 16 bp, Homo sapiens
tgtttgttgacagctt

SEQ ID NO: 1444861 - DNA, 22 bp, Homo sapiens
tgtttgtttctccccctgggct

SEQ ID NO: 1444862 - DNA, 22 bp, Homo sapiens
tgttttaaacattaatagcagc

SEQ ID NO: 1444863 - DNA, 19 bp, Homo sapiens
tgttttaaagaatatgact

SEQ ID NO: 1444864 - DNA, 13 bp, Homo sapiens
tgttttaatctta

SEQ ID NO: 1444865 - DNA, 15 bp, Homo sapiens
tgttttaccagctcc

SEQ ID NO: 1444866 - DNA, 16 bp, Homo sapiens
tgttttagaaccagcc

SEQ ID NO: 1444867 - DNA, 17 bp, Homo sapiens
tgttttagcattaccta

SEQ ID NO: 1444868 - DNA, 23 bp, Homo sapiens
tgttttaggttaaaaaaaggcat

SEQ ID NO: 1444869 - DNA, 18 bp, Homo sapiens
tgttttagtgtaaaattg

SEQ ID NO: 1444870 - DNA, 16 bp, Homo sapiens
tgttttatctctgtga

SEQ ID NO: 1444871 - DNA, 22 bp, Homo sapiens
tgttttcaagcacaacccacca

SEQ ID NO: 1444872 - DNA, 16 bp, Homo sapiens
tgttttcacttgtatt

SEQ ID NO: 1444873 - DNA, 13 bp, Homo sapiens
tgttttcagcact

SEQ ID NO: 1444874 - DNA, 22 bp, Homo sapiens
tgttttcattaaattagctatt

SEQ ID NO: 1444875 - DNA, 15 bp, Homo sapiens
tgttttcccccagca

SEQ ID NO: 1444876 - DNA, 12 bp, Homo sapiens
tgttttccctga

SEQ ID NO: 1444877 - DNA, 22 bp, Homo sapiens
tgttttctgaaacacacgagca

SEQ ID NO: 1444878 - DNA, 12 bp, Homo sapiens
tgttttctgggg

SEQ ID NO: 1444879 - DNA, 16 bp, Homo sapiens
tgttttctgtaaataa

SEQ ID NO: 1444880 - DNA, 22 bp, Homo sapiens
tgttttcttgtaaatgtttctt

SEQ ID NO: 1444881 - DNA, 17 bp, Homo sapiens
tgttttgaaatcaatgc

SEQ ID NO: 1444882 - DNA, 16 bp, Homo sapiens
tgttttgaaatgatat

SEQ ID NO: 1444883 - DNA, 14 bp, Homo sapiens
tgttttgaattttg

SEQ ID NO: 1444884 - DNA, 16 bp, Homo sapiens
tgttttgagctttcca

SEQ ID NO: 1444885 - DNA, 18 bp, Homo sapiens
tgttttgagctttccatg

SEQ ID NO: 1444886 - DNA, 22 bp, Homo sapiens
tgttttgcacgtcttgctattt

SEQ ID NO: 1444887 - DNA, 13 bp, Homo sapiens
tgttttgcacttt

SEQ ID NO: 1444888 - DNA, 15 bp, Homo sapiens
tgttttgcttttgtt

SEQ ID NO: 1444889 - DNA, 23 bp, Homo sapiens
tgttttgcttttgtttttttcct

SEQ ID NO: 1444890 - DNA, 13 bp, Homo sapiens
tgttttggaataa

SEQ ID NO: 1444891 - DNA, 19 bp, Homo sapiens
tgttttggactccatctct

SEQ ID NO: 1444892 - DNA, 17 bp, Homo sapiens
tgttttggatggcttgt

SEQ ID NO: 1444893 - DNA, 15 bp, Homo sapiens
tgttttggttaataa

SEQ ID NO: 1444894 - DNA, 17 bp, Homo sapiens
tgttttgtacaattact

SEQ ID NO: 1444895 - DNA, 15 bp, Homo sapiens
tgttttgtacagatg

SEQ ID NO: 1444896 - DNA, 16 bp, Homo sapiens
tgttttgtacagatgt

SEQ ID NO: 1444897 - DNA, 16 bp, Homo sapiens
tgttttgtctgagcct

SEQ ID NO: 1444898 - DNA, 17 bp, Homo sapiens
tgttttgtcttacaaag

SEQ ID NO: 1444899 - DNA, 22 bp, Homo sapiens
tgttttgtgtctggtgcagaat

SEQ ID NO: 1444900 - DNA, 16 bp, Homo sapiens
tgttttgttctgtggt

SEQ ID NO: 1444901 - DNA, 13 bp, Homo sapiens
tgttttgtttctg

SEQ ID NO: 1444902 - DNA, 10 bp, Homo sapiens
tgtttttaaa

SEQ ID NO: 1444903 - DNA, 12 bp, Homo sapiens
tgtttttaaaag

SEQ ID NO: 1444904 - DNA, 14 bp, Homo sapiens
tgtttttaagctgt

SEQ ID NO: 1444905 - DNA, 20 bp, Homo sapiens
tgtttttaagctgtttccat

SEQ ID NO: 1444906 - DNA, 16 bp, Homo sapiens
tgtttttaagtttgca

SEQ ID NO: 1444907 - DNA, 21 bp, Homo sapiens
tgtttttatacaaaataagaa

SEQ ID NO: 1444908 - DNA, 13 bp, Homo sapiens
tgtttttcatgtt

SEQ ID NO: 1444909 - DNA, 15 bp, Homo sapiens
tgtttttcatgtttt

SEQ ID NO: 1444910 - DNA, 21 bp, Homo sapiens
tgtttttcatgttttagcatt

SEQ ID NO: 1444911 - DNA, 21 bp, Homo sapiens
tgtttttgaatttaaataaag

SEQ ID NO: 1444912 - DNA, 23 bp, Homo sapiens
tgtttttgcgtgggagtgtgtgc

SEQ ID NO: 1444913 - DNA, 23 bp, Homo sapiens
tgtttttgggaagaagaagacct

SEQ ID NO: 1444914 - DNA, 16 bp, Homo sapiens
tgtttttggtctttta

SEQ ID NO: 1444915 - DNA, 16 bp, Homo sapiens
tgtttttgtatcttta

SEQ ID NO: 1444916 - DNA, 14 bp, Homo sapiens
tgttttttaaagca

SEQ ID NO: 1444917 - DNA, 21 bp, Homo sapiens
tgttttttaagatagtgtaac

SEQ ID NO: 1444918 - DNA, 19 bp, Homo sapiens
tgttttttaagatggcaat

SEQ ID NO: 1444919 - DNA, 13 bp, Homo sapiens
tgttttttatgtt

SEQ ID NO: 1444920 - DNA, 13 bp, Homo sapiens
tgttttttctgta

SEQ ID NO: 1444921 - DNA, 19 bp, Homo sapiens
tgttttttgaaaacatggt

SEQ ID NO: 1444922 - DNA, 18 bp, Homo sapiens
tgttttttgccacagctt

SEQ ID NO: 1444923 - DNA, 16 bp, Homo sapiens
tgttttttggtctttt

SEQ ID NO: 1444924 - DNA, 16 bp, Homo sapiens
tgttttttgttcaatg

SEQ ID NO: 1444925 - DNA, 23 bp, Homo sapiens
tgttttttgttcaatgttccatt

SEQ ID NO: 1444926 - DNA, 22 bp, Homo sapiens
tgtttttttcctcatgtaacat

SEQ ID NO: 1444927 - DNA, 22 bp, Homo sapiens
tgtttttttctttttttataaa

SEQ ID NO: 1444928 - DNA, 21 bp, Homo sapiens
tgttttttttgactaaagcta

SEQ ID NO: 1444929 - DNA, 19 bp, Homo sapiens
tgttttttttttccactta

SEQ ID NO: 1444930 - DNA, 15 bp, Homo sapiens
ttaaaaaaaaaagtc

SEQ ID NO: 1444931 - DNA, 22 bp, Homo sapiens
ttaaaaaaacaaattggacagc

SEQ ID NO: 1444932 - DNA, 18 bp, Homo sapiens
ttaaaaaaagctaaatta

SEQ ID NO: 1444933 - DNA, 19 bp, Homo sapiens
ttaaaaaaaggcattgttt

SEQ ID NO: 1444934 - DNA, 21 bp, Homo sapiens
ttaaaaaaaggcattgtttga

SEQ ID NO: 1444935 - DNA, 12 bp, Homo sapiens
ttaaaaaaataa

SEQ ID NO: 1444936 - DNA, 12 bp, Homo sapiens
ttaaaaaaatca

SEQ ID NO: 1444937 - DNA, 20 bp, Homo sapiens
ttaaaaaaatttttataaat

SEQ ID NO: 1444938 - DNA, 11 bp, Homo sapiens
ttaaaaaacaa

SEQ ID NO: 1444939 - DNA, 19 bp, Homo sapiens
ttaaaaaagactgaacatg

SEQ ID NO: 1444940 - DNA, 13 bp, Homo sapiens
ttaaaaaataaca

SEQ ID NO: 1444941 - DNA, 14 bp, Homo sapiens
ttaaaaaataacat

SEQ ID NO: 1444942 - DNA, 20 bp, Homo sapiens
ttaaaaaatattttctctgt

SEQ ID NO: 1444943 - DNA, 16 bp, Homo sapiens
ttaaaaaatggaacat

SEQ ID NO: 1444944 - DNA, 14 bp, Homo sapiens
ttaaaaacattttc

SEQ ID NO: 1444945 - DNA, 12 bp, Homo sapiens
ttaaaaacctgc

SEQ ID NO: 1444946 - DNA, 14 bp, Homo sapiens
ttaaaaacctgcct

SEQ ID NO: 1444947 - DNA, 15 bp, Homo sapiens
ttaaaaactcctttt

SEQ ID NO: 1444948 - DNA, 20 bp, Homo sapiens
ttaaaaagaaacaagatgct

SEQ ID NO: 1444949 - DNA, 15 bp, Homo sapiens
ttaaaaagagtaatt

SEQ ID NO: 1444950 - DNA, 21 bp, Homo sapiens
ttaaaaaggaaatttgtttgt

SEQ ID NO: 1444951 - DNA, 18 bp, Homo sapiens
ttaaaaaggaattttgta

SEQ ID NO: 1444952 - DNA, 20 bp, Homo sapiens
ttaaaaaggcagtttgcaaa

SEQ ID NO: 1444953 - DNA, 22 bp, Homo sapiens
ttaaaaaggcagtttgcaaaaa

SEQ ID NO: 1444954 - DNA, 14 bp, Homo sapiens
ttaaaaaggccaaa

SEQ ID NO: 1444955 - DNA, 16 bp, Homo sapiens
ttaaaaaggccaaaga

SEQ ID NO: 1444956 - DNA, 17 bp, Homo sapiens
ttaaaaaggccaaagat

SEQ ID NO: 1444957 - DNA, 19 bp, Homo sapiens
ttaaaaagttgttctttgt

SEQ ID NO: 1444958 - DNA, 16 bp, Homo sapiens
ttaaaaataaatccca

SEQ ID NO: 1444959 - DNA, 20 bp, Homo sapiens
ttaaaaatggctcaagtaga

SEQ ID NO: 1444960 - DNA, 13 bp, Homo sapiens
ttaaaaatgtaaa

SEQ ID NO: 1444961 - DNA, 12 bp, Homo sapiens
ttaaaaatgttt

SEQ ID NO: 1444962 - DNA, 23 bp, Homo sapiens
ttaaaaatttactacaatatgta

SEQ ID NO: 1444963 - DNA, 20 bp, Homo sapiens
ttaaaacaaaagggtgtata

SEQ ID NO: 1444964 - DNA, 20 bp, Homo sapiens
ttaaaacacatgtttttata

SEQ ID NO: 1444965 - DNA, 15 bp, Homo sapiens
ttaaaacaggcaaag

SEQ ID NO: 1444966 - DNA, 13 bp, Homo sapiens
ttaaaacatgtaa

SEQ ID NO: 1444967 - DNA, 13 bp, Homo sapiens
ttaaaacattttt

SEQ ID NO: 1444968 - DNA, 22 bp, Homo sapiens
ttaaaactgcttttttttttcc

SEQ ID NO: 1444969 - DNA, 16 bp, Homo sapiens
ttaaaactggacctgt

SEQ ID NO: 1444970 - DNA, 14 bp, Homo sapiens
ttaaaactgttatt

SEQ ID NO: 1444971 - DNA, 12 bp, Homo sapiens
ttaaaagaaata

SEQ ID NO: 1444972 - DNA, 11 bp, Homo sapiens
ttaaaagagag

SEQ ID NO: 1444973 - DNA, 23 bp, Homo sapiens
ttaaaagagagagagagaaaaaa

SEQ ID NO: 1444974 - DNA, 12 bp, Homo sapiens
ctaagattctga

SEQ ID NO: 1444975 - DNA, 18 bp, Homo sapiens
ctaagattctgattttag

SEQ ID NO: 1444976 - DNA, 14 bp, Homo sapiens
ctaagatttctgtc

SEQ ID NO: 1444977 - DNA, 23 bp, Homo sapiens
ctaagatttggtttgggatcaat

SEQ ID NO: 1444978 - DNA, 15 bp, Homo sapiens
ctaagcaatgcaaat

SEQ ID NO: 1444979 - DNA, 23 bp, Homo sapiens
ctaagcagttatggtgatgactt

SEQ ID NO: 1444980 - DNA, 18 bp, Homo sapiens
ctaagcagttttgtaaat

SEQ ID NO: 1444981 - DNA, 15 bp, Homo sapiens
ctaagcatggcctgg

SEQ ID NO: 1444982 - DNA, 14 bp, Homo sapiens
ctaagcccccaggg

SEQ ID NO: 1444983 - DNA, 19 bp, Homo sapiens
ctaagcccccagggcctcc

SEQ ID NO: 1444984 - DNA, 22 bp, Homo sapiens
ctaagcccccagggcctccagg

SEQ ID NO: 1444985 - DNA, 20 bp, Homo sapiens
ctaagccctcgaaccaaggc

SEQ ID NO: 1444986 - DNA, 22 bp, Homo sapiens
ctaagccctcgaaccaaggcag

SEQ ID NO: 1444987 - DNA, 12 bp, Homo sapiens
ctaagccctgtc

SEQ ID NO: 1444988 - DNA, 21 bp, Homo sapiens
ctaagccctgtcgagacactt

SEQ ID NO: 1444989 - DNA, 23 bp, Homo sapiens
ctaagccctgttctcctgtccct

SEQ ID NO: 1444990 - DNA, 20 bp, Homo sapiens
ctaagcggctgtttactgct

SEQ ID NO: 1444991 - DNA, 14 bp, Homo sapiens
ctaagctaggaatg

SEQ ID NO: 1444992 - DNA, 19 bp, Homo sapiens
ctaagctattcagtaataa

SEQ ID NO: 1444993 - DNA, 21 bp, Homo sapiens
ctaagctattcagtaataact

SEQ ID NO: 1444994 - DNA, 16 bp, Homo sapiens
ctaagctcacgtcctg

SEQ ID NO: 1444995 - DNA, 13 bp, Homo sapiens
ctaagctctctgg

SEQ ID NO: 1444996 - DNA, 15 bp, Homo sapiens
ctaagctctctgggc

SEQ ID NO: 1444997 - DNA, 15 bp, Homo sapiens
ctaagctctttgaga

SEQ ID NO: 1444998 - DNA, 22 bp, Homo sapiens
ctaagctgatattatttcttct

SEQ ID NO: 1444999 - DNA, 15 bp, Homo sapiens
ctaagctggagctct

SEQ ID NO: 1445000 - DNA, 23 bp, Homo sapiens
ctaagctggagctcttggaagag

SEQ ID NO: 1445001 - DNA, 13 bp, Homo sapiens
ctaagctggctct

SEQ ID NO: 1445002 - DNA, 18 bp, Homo sapiens
ctaagctggctctgtttg

SEQ ID NO: 1445003 - DNA, 12 bp, Homo sapiens
ctaagcttattt

SEQ ID NO: 1445004 - DNA, 16 bp, Homo sapiens
ctaagcttatttctaa

SEQ ID NO: 1445005 - DNA, 14 bp, Homo sapiens
ctaaggaaccttcc

SEQ ID NO: 1445006 - DNA, 15 bp, Homo sapiens
ctaaggaaccttcct

SEQ ID NO: 1445007 - DNA, 12 bp, Homo sapiens
ctaaggacacac

SEQ ID NO: 1445008 - DNA, 19 bp, Homo sapiens
ctaaggacctgaaattcca

SEQ ID NO: 1445009 - DNA, 22 bp, Homo sapiens
ctaaggacctgaaattccaaag

SEQ ID NO: 1445010 - DNA, 12 bp, Homo sapiens
ctaaggatctct

SEQ ID NO: 1445011 - DNA, 18 bp, Homo sapiens
ctaaggatgctaaacctt

SEQ ID NO: 1445012 - DNA, 20 bp, Homo sapiens
ctaaggatttttcaagagat

SEQ ID NO: 1445013 - DNA, 20 bp, Homo sapiens
ctaaggcacccacaaataaa

SEQ ID NO: 1445014 - DNA, 20 bp, Homo sapiens
ctaaggcatctatctgtgct

SEQ ID NO: 1445015 - DNA, 21 bp, Homo sapiens
ctaaggcctaggattctaaaa

SEQ ID NO: 1445016 - DNA, 16 bp, Homo sapiens
ctaaggctcctccttg

SEQ ID NO: 1445017 - DNA, 22 bp, Homo sapiens
ctaaggctctatgagtctagat

SEQ ID NO: 1445018 - DNA, 19 bp, Homo sapiens
ctaaggctctgagagtcta

SEQ ID NO: 1445019 - DNA, 20 bp, Homo sapiens
ctaagggaagatcactgtag

SEQ ID NO: 1445020 - DNA, 17 bp, Homo sapiens
ctaagggagagtggtat

SEQ ID NO: 1445021 - DNA, 20 bp, Homo sapiens
ctaaggtccggtgttctaag

SEQ ID NO: 1445022 - DNA, 22 bp, Homo sapiens
ctaaggtccggtgttctaagat

SEQ ID NO: 1445023 - DNA, 12 bp, Homo sapiens
ctaaggttctaa

SEQ ID NO: 1445024 - DNA, 14 bp, Homo sapiens
ctaaggttctaagg

SEQ ID NO: 1445025 - DNA, 21 bp, Homo sapiens
ctaaggttgtctacgggggca

SEQ ID NO: 1445026 - DNA, 18 bp, Homo sapiens
ctaagtaaaaccacagca

SEQ ID NO: 1445027 - DNA, 19 bp, Homo sapiens
ctaagtaaaaccacagcag

SEQ ID NO: 1445028 - DNA, 20 bp, Homo sapiens
ctaagtaaaaccacagcagt

SEQ ID NO: 1445029 - DNA, 19 bp, Homo sapiens
ctaagtaggggcagtgatg

SEQ ID NO: 1445030 - DNA, 20 bp, Homo sapiens
ctaagtaggggcagtgatgg

SEQ ID NO: 1445031 - DNA, 15 bp, Homo sapiens
ctaagtcagtaccca

SEQ ID NO: 1445032 - DNA, 15 bp, Homo sapiens
ctaagtcctttatgt

SEQ ID NO: 1445033 - DNA, 21 bp, Homo sapiens
ctaagtgcccaaagtggggag

SEQ ID NO: 1445034 - DNA, 12 bp, Homo sapiens
ctaagtgggaga

SEQ ID NO: 1445035 - DNA, 20 bp, Homo sapiens
ctaagttatagtatatctgg

SEQ ID NO: 1445036 - DNA, 12 bp, Homo sapiens
ctaagttctccc

SEQ ID NO: 1445037 - DNA, 13 bp, Homo sapiens
ctaagtttcagtt

SEQ ID NO: 1445038 - DNA, 19 bp, Homo sapiens
ctaagtttcagttgatttt

SEQ ID NO: 1445039 - DNA, 12 bp, Homo sapiens
ctaagtttctaa

SEQ ID NO: 1445040 - DNA, 13 bp, Homo sapiens
ctaagtttctaag

SEQ ID NO: 1445041 - DNA, 14 bp, Homo sapiens
ctaagtttctaaga

SEQ ID NO: 1445042 - DNA, 22 bp, Homo sapiens
ctaagtttctaagattctaaag

SEQ ID NO: 1445043 - DNA, 13 bp, Homo sapiens
ctaataaacactg

SEQ ID NO: 1445044 - DNA, 16 bp, Homo sapiens
ctaataaacactgttt

SEQ ID NO: 1445045 - DNA, 16 bp, Homo sapiens
ctaataaactgtatta

SEQ ID NO: 1445046 - DNA, 13 bp, Homo sapiens
ctaataaacttta

SEQ ID NO: 1445047 - DNA, 21 bp, Homo sapiens
ctaataaatatactatgaaat

SEQ ID NO: 1445048 - DNA, 22 bp, Homo sapiens
ctaataaattttagtgtgcctt

SEQ ID NO: 1445049 - DNA, 16 bp, Homo sapiens
ctaatacctctgtgtg

SEQ ID NO: 1445050 - DNA, 19 bp, Homo sapiens
ctaatacgtgccagatata

SEQ ID NO: 1445051 - DNA, 23 bp, Homo sapiens
ctaatacgtgccagatataactg

SEQ ID NO: 1445052 - DNA, 20 bp, Homo sapiens
ctaatagaactcagttttaa

SEQ ID NO: 1445053 - DNA, 20 bp, Homo sapiens
ctaatagaataaaggcagtt

SEQ ID NO: 1445054 - DNA, 17 bp, Homo sapiens
ctaatatatatgaataa

SEQ ID NO: 1445055 - DNA, 15 bp, Homo sapiens
ctaatatatttaaaa

SEQ ID NO: 1445056 - DNA, 17 bp, Homo sapiens
ctaatatatttaaaaat

SEQ ID NO: 1445057 - DNA, 13 bp, Homo sapiens
ctaatcaaaactt

SEQ ID NO: 1445058 - DNA, 20 bp, Homo sapiens
ctaatcaaaactttcgttgt

SEQ ID NO: 1445059 - DNA, 13 bp, Homo sapiens
ctaatcacagtgt

SEQ ID NO: 1445060 - DNA, 16 bp, Homo sapiens
ctaatcacagtgttgc

SEQ ID NO: 1445061 - DNA, 21 bp, Homo sapiens
ctaatcacagtttttcctgga

SEQ ID NO: 1445062 - DNA, 19 bp, Homo sapiens
ctaatcagggaggtcattt

SEQ ID NO: 1445063 - DNA, 17 bp, Homo sapiens
ctaatccaggcagatcc

SEQ ID NO: 1445064 - DNA, 21 bp, Homo sapiens
ctaatccctgggcattgcttt

SEQ ID NO: 1445065 - DNA, 23 bp, Homo sapiens
ctaatccctgggcattgctttcc

SEQ ID NO: 1445066 - DNA, 14 bp, Homo sapiens
ctaatccttttcct

SEQ ID NO: 1445067 - DNA, 15 bp, Homo sapiens
ctaatcgaactatga

SEQ ID NO: 1445068 - DNA, 16 bp, Homo sapiens
ctaatctactttctgt

SEQ ID NO: 1445069 - DNA, 19 bp, Homo sapiens
ctaatctagatatcgactt

SEQ ID NO: 1445070 - DNA, 18 bp, Homo sapiens
ctaatctatggtcgggag

SEQ ID NO: 1445071 - DNA, 20 bp, Homo sapiens
ctaatctatggtcgggagac

SEQ ID NO: 1445072 - DNA, 15 bp, Homo sapiens
ctaatctcatacctc

SEQ ID NO: 1445073 - DNA, 16 bp, Homo sapiens
ctaatctcttattcta

SEQ ID NO: 1445074 - DNA, 23 bp, Homo sapiens
ctaatctgaccgttctattgtgt

SEQ ID NO: 1445075 - DNA, 13 bp, Homo sapiens
ctaatctgtaggg

SEQ ID NO: 1445076 - DNA, 21 bp, Homo sapiens
ctaatctgtagggctggacct

SEQ ID NO: 1445077 - DNA, 23 bp, Homo sapiens
ctaatcttaaccctgtgctgtca

SEQ ID NO: 1445078 - DNA, 22 bp, Homo sapiens
ctaatctttcacttgaaagatt

SEQ ID NO: 1445079 - DNA, 15 bp, Homo sapiens
ctaatgaagagaaaa

SEQ ID NO: 1445080 - DNA, 18 bp, Homo sapiens
ctaatgaagggaaaggat

SEQ ID NO: 1445081 - DNA, 13 bp, Homo sapiens
ctaatgatgcttt

SEQ ID NO: 1445082 - DNA, 17 bp, Homo sapiens
ctaatgcttgtttatga

SEQ ID NO: 1445083 - DNA, 15 bp, Homo sapiens
ctaatgtacgctgct

SEQ ID NO: 1445084 - DNA, 14 bp, Homo sapiens
ctaatgtactgcat

SEQ ID NO: 1445085 - DNA, 18 bp, Homo sapiens
ctaatgtattatgagcca

SEQ ID NO: 1445086 - DNA, 18 bp, Homo sapiens
ctaatgtttatgagccag

SEQ ID NO: 1445087 - DNA, 15 bp, Homo sapiens
ctaattaatatatta

SEQ ID NO: 1445088 - DNA, 18 bp, Homo sapiens
ctaattatactactttgt

SEQ ID NO: 1445089 - DNA, 21 bp, Homo sapiens
ctaattatactactttgttag

SEQ ID NO: 1445090 - DNA, 17 bp, Homo sapiens
ttaaaagattcattttt

SEQ ID NO: 1445091 - DNA, 21 bp, Homo sapiens
ttaaaagattcatttttaatc

SEQ ID NO: 1445092 - DNA, 18 bp, Homo sapiens
ttaaaaggaaaaataaca

SEQ ID NO: 1445093 - DNA, 16 bp, Homo sapiens
ttaaaaggatgtataa

SEQ ID NO: 1445094 - DNA, 17 bp, Homo sapiens
ttaaaaggatttttatc

SEQ ID NO: 1445095 - DNA, 20 bp, Homo sapiens
ttaaaagtactttaaaaagg

SEQ ID NO: 1445096 - DNA, 15 bp, Homo sapiens
ttaaaagttgcattt

SEQ ID NO: 1445097 - DNA, 15 bp, Homo sapiens
ttaaaataattatat

SEQ ID NO: 1445098 - DNA, 18 bp, Homo sapiens
ttaaaataccactgtaat

SEQ ID NO: 1445099 - DNA, 23 bp, Homo sapiens
ttaaaataggggatatttaaggt

SEQ ID NO: 1445100 - DNA, 12 bp, Homo sapiens
ttaaaatatttc

SEQ ID NO: 1445101 - DNA, 21 bp, Homo sapiens
ttaaaatatttgtctttaaac

SEQ ID NO: 1445102 - DNA, 12 bp, Homo sapiens
ttaaaatatttt

SEQ ID NO: 1445103 - DNA, 17 bp, Homo sapiens
ttaaaatcaaatgtaaa

SEQ ID NO: 1445104 - DNA, 14 bp, Homo sapiens
ttaaaatcatttct

SEQ ID NO: 1445105 - DNA, 17 bp, Homo sapiens
ttaaaatctacagaact

SEQ ID NO: 1445106 - DNA, 21 bp, Homo sapiens
ttaaaatgtaatttaaatgaa

SEQ ID NO: 1445107 - DNA, 16 bp, Homo sapiens
ttaaaatgtacactgg

SEQ ID NO: 1445108 - DNA, 15 bp, Homo sapiens
ttaaaatgtacatgt

SEQ ID NO: 1445109 - DNA, 20 bp, Homo sapiens
ttaaaatgtttactgtaaat

SEQ ID NO: 1445110 - DNA, 19 bp, Homo sapiens
ttaaaattaagtagaacaa

SEQ ID NO: 1445111 - DNA, 20 bp, Homo sapiens
ttaaaattaagttgaaaaag

SEQ ID NO: 1445112 - DNA, 14 bp, Homo sapiens
ttaaaattagtctt

SEQ ID NO: 1445113 - DNA, 19 bp, Homo sapiens
ttaaaattctgatgtttct

SEQ ID NO: 1445114 - DNA, 23 bp, Homo sapiens
ttaaaattctgatgtttctgtga

SEQ ID NO: 1445115 - DNA, 22 bp, Homo sapiens
ttaaaattgatttttctcttca

SEQ ID NO: 1445116 - DNA, 23 bp, Homo sapiens
ttaaaattgatttttctcttcat

SEQ ID NO: 1445117 - DNA, 13 bp, Homo sapiens
ttaaaattgtgat

SEQ ID NO: 1445118 - DNA, 18 bp, Homo sapiens
ttaaaatttcgttgtcca

SEQ ID NO: 1445119 - DNA, 16 bp, Homo sapiens
ttaaaattttgtatgt

SEQ ID NO: 1445120 - DNA, 17 bp, Homo sapiens
ttaaacaaaaaactatc

SEQ ID NO: 1445121 - DNA, 17 bp, Homo sapiens
ttaaacaaagtttcaga

SEQ ID NO: 1445122 - DNA, 14 bp, Homo sapiens
ttaaacaatgtata

SEQ ID NO: 1445123 - DNA, 19 bp, Homo sapiens
ttaaacaatgtataaagat

SEQ ID NO: 1445124 - DNA, 12 bp, Homo sapiens
ttaaacacacag

SEQ ID NO: 1445125 - DNA, 22 bp, Homo sapiens
ttaaacacacagatacacacac

SEQ ID NO: 1445126 - DNA, 16 bp, Homo sapiens
ttaaacacctcctcat

SEQ ID NO: 1445127 - DNA, 14 bp, Homo sapiens
ttaaacactgtaat

SEQ ID NO: 1445128 - DNA, 16 bp, Homo sapiens
ttaaacactgtaatct

SEQ ID NO: 1445129 - DNA, 21 bp, Homo sapiens
ttaaacacttatcttctggat

SEQ ID NO: 1445130 - DNA, 22 bp, Homo sapiens
ttaaacagaagcagcaaatgaa

SEQ ID NO: 1445131 - DNA, 18 bp, Homo sapiens
ttaaacatacataataca

SEQ ID NO: 1445132 - DNA, 13 bp, Homo sapiens
ttaaacattgaag

SEQ ID NO: 1445133 - DNA, 20 bp, Homo sapiens
ttaaaccaatgaagaagaca

SEQ ID NO: 1445134 - DNA, 23 bp, Homo sapiens
ttaaaccaatgaagaagacaaag

SEQ ID NO: 1445135 - DNA, 20 bp, Homo sapiens
ttaaaccatttttgctgaat

SEQ ID NO: 1445136 - DNA, 15 bp, Homo sapiens
ttaaacccatacaat

SEQ ID NO: 1445137 - DNA, 19 bp, Homo sapiens
ttaaacccatacaatgtat

SEQ ID NO: 1445138 - DNA, 20 bp, Homo sapiens
ttaaacccatacaatgtatg

SEQ ID NO: 1445139 - DNA, 22 bp, Homo sapiens
ttaaacccatacaatgtatgta

SEQ ID NO: 1445140 - DNA, 16 bp, Homo sapiens
ttaaactatcttgtgt

SEQ ID NO: 1445141 - DNA, 22 bp, Homo sapiens
ttaaactattagagtatttccc

SEQ ID NO: 1445142 - DNA, 16 bp, Homo sapiens
ttaaactctggacact

SEQ ID NO: 1445143 - DNA, 20 bp, Homo sapiens
ttaaactctggacactctat

SEQ ID NO: 1445144 - DNA, 21 bp, Homo sapiens
ttaaactgtgtggactgtgat

SEQ ID NO: 1445145 - DNA, 12 bp, Homo sapiens
ttaaacttacaa

SEQ ID NO: 1445146 - DNA, 17 bp, Homo sapiens
ttaaacttccaaagaaa

SEQ ID NO: 1445147 - DNA, 15 bp, Homo sapiens
ttaaacttgaaatat

SEQ ID NO: 1445148 - DNA, 21 bp, Homo sapiens
ttaaacttgaaatatataata

SEQ ID NO: 1445149 - DNA, 15 bp, Homo sapiens
ttaaacttttttaac

SEQ ID NO: 1445150 - DNA, 13 bp, Homo sapiens
ttaaagaaaaata

SEQ ID NO: 1445151 - DNA, 14 bp, Homo sapiens
ttaaagaaaggaaa

SEQ ID NO: 1445152 - DNA, 12 bp, Homo sapiens
ttaaagaaagtg

SEQ ID NO: 1445153 - DNA, 12 bp, Homo sapiens
ttaaagaataaa

SEQ ID NO: 1445154 - DNA, 21 bp, Homo sapiens
ttaaagaataaagtccaaagt

SEQ ID NO: 1445155 - DNA, 14 bp, Homo sapiens
ttaaagagaatgag

SEQ ID NO: 1445156 - DNA, 16 bp, Homo sapiens
ttaaagagcatggaaa

SEQ ID NO: 1445157 - DNA, 15 bp, Homo sapiens
ttaaagagtctagat

SEQ ID NO: 1445158 - DNA, 17 bp, Homo sapiens
ttaaagatgctatggaa

SEQ ID NO: 1445159 - DNA, 14 bp, Homo sapiens
ttaaagattctctt

SEQ ID NO: 1445160 - DNA, 22 bp, Homo sapiens
ttaaagccacaaccacatacaa

SEQ ID NO: 1445161 - DNA, 13 bp, Homo sapiens
ttaaagctaaatt

SEQ ID NO: 1445162 - DNA, 20 bp, Homo sapiens
ttaaagcttattaaaactca

SEQ ID NO: 1445163 - DNA, 17 bp, Homo sapiens
ttaaaggatgttggtgt

SEQ ID NO: 1445164 - DNA, 21 bp, Homo sapiens
ttaaaggcagtattttgtgtc

SEQ ID NO: 1445165 - DNA, 15 bp, Homo sapiens
ttaaagggaaattga

SEQ ID NO: 1445166 - DNA, 15 bp, Homo sapiens
ttaaagggaagaaaa

SEQ ID NO: 1445167 - DNA, 22 bp, Homo sapiens
ttaaagggaagaaaacactgtt

SEQ ID NO: 1445168 - DNA, 17 bp, Homo sapiens
ttaaagggcccaatgaa

SEQ ID NO: 1445169 - DNA, 19 bp, Homo sapiens
ttaaagggtgtacttatat

SEQ ID NO: 1445170 - DNA, 13 bp, Homo sapiens
ttaaagtatatat

SEQ ID NO: 1445171 - DNA, 18 bp, Homo sapiens
ttaaagtatgttattgca

SEQ ID NO: 1445172 - DNA, 14 bp, Homo sapiens
ttaaagtattttct

SEQ ID NO: 1445173 - DNA, 19 bp, Homo sapiens
ttaaagtcacatccctgta

SEQ ID NO: 1445174 - DNA, 18 bp, Homo sapiens
ttaaagtcaggtccaatt

SEQ ID NO: 1445175 - DNA, 12 bp, Homo sapiens
ttaaagtgatta

SEQ ID NO: 1445176 - DNA, 22 bp, Homo sapiens
ttaaagtgctaaggttctaagg

SEQ ID NO: 1445177 - DNA, 18 bp, Homo sapiens
ttaaagttcttattttag

SEQ ID NO: 1445178 - DNA, 17 bp, Homo sapiens
ttaaagttgtttcccac

SEQ ID NO: 1445179 - DNA, 13 bp, Homo sapiens
ttaaataaaagct

SEQ ID NO: 1445180 - DNA, 13 bp, Homo sapiens
ttaaataaaagtg

SEQ ID NO: 1445181 - DNA, 20 bp, Homo sapiens
ttaaataaaagtgatcaata

SEQ ID NO: 1445182 - DNA, 13 bp, Homo sapiens
ttaaataaacaca

SEQ ID NO: 1445183 - DNA, 13 bp, Homo sapiens
ttaaataaatttg

SEQ ID NO: 1445184 - DNA, 17 bp, Homo sapiens
ttaaataagattctaac

SEQ ID NO: 1445185 - DNA, 23 bp, Homo sapiens
ttaaataattgcatcagttcatt

SEQ ID NO: 1445186 - DNA, 17 bp, Homo sapiens
ttaaatacagacactaa

SEQ ID NO: 1445187 - DNA, 16 bp, Homo sapiens
ttaaatacagataatt

SEQ ID NO: 1445188 - DNA, 15 bp, Homo sapiens
ttaaatacaggaaac

SEQ ID NO: 1445189 - DNA, 19 bp, Homo sapiens
ttaaatagagtatatgcac

SEQ ID NO: 1445190 - DNA, 12 bp, Homo sapiens
ttaaatataaag

SEQ ID NO: 1445191 - DNA, 16 bp, Homo sapiens
ttaaatataaatagct

SEQ ID NO: 1445192 - DNA, 12 bp, Homo sapiens
ttaaatataatt

SEQ ID NO: 1445193 - DNA, 13 bp, Homo sapiens
ttaaatataattc

SEQ ID NO: 1445194 - DNA, 19 bp, Homo sapiens
ttaaatataattctgtaaa

SEQ ID NO: 1445195 - DNA, 15 bp, Homo sapiens
ttaaatatgaatgaa

SEQ ID NO: 1445196 - DNA, 13 bp, Homo sapiens
ttaaatatgtata

SEQ ID NO: 1445197 - DNA, 22 bp, Homo sapiens
ttaaatattaactcaaaagttg

SEQ ID NO: 1445198 - DNA, 15 bp, Homo sapiens
ttaaatatttcaaga

SEQ ID NO: 1445199 - DNA, 14 bp, Homo sapiens
ttaaatattttgct

SEQ ID NO: 1445200 - DNA, 17 bp, Homo sapiens
ttaaatattttgctaac

SEQ ID NO: 1445201 - DNA, 19 bp, Homo sapiens
ttaaatattttgctaactg

SEQ ID NO: 1445202 - DNA, 21 bp, Homo sapiens
ttaaatattttgctaactggt

SEQ ID NO: 1445203 - DNA, 14 bp, Homo sapiens
ttaaatcaaagata

SEQ ID NO: 1445204 - DNA, 23 bp, Homo sapiens
ttaaatcacagcccaaaatttga

SEQ ID NO: 1445205 - DNA, 12 bp, Homo sapiens
ttaaatccagtt

SEQ ID NO: 1445206 - DNA, 13 bp, Homo sapiens
ttaaatcctttta

SEQ ID NO: 1445207 - DNA, 16 bp, Homo sapiens
ctaattcaaggaattt

SEQ ID NO: 1445208 - DNA, 20 bp, Homo sapiens
ctaattcaaggaatttctta

SEQ ID NO: 1445209 - DNA, 22 bp, Homo sapiens
ctaattcacagtgctcttttct

SEQ ID NO: 1445210 - DNA, 10 bp, Homo sapiens
ctaattcata

SEQ ID NO: 1445211 - DNA, 14 bp, Homo sapiens
ctaattctaatgtg

SEQ ID NO: 1445212 - DNA, 20 bp, Homo sapiens
ctaattctattaaagtgcta

SEQ ID NO: 1445213 - DNA, 18 bp, Homo sapiens
ctaattcttctgtcctga

SEQ ID NO: 1445214 - DNA, 21 bp, Homo sapiens
ctaattctttgacctgttggg

SEQ ID NO: 1445215 - DNA, 19 bp, Homo sapiens
ctaattggcctctttaaga

SEQ ID NO: 1445216 - DNA, 15 bp, Homo sapiens
ctaattggtactttt

SEQ ID NO: 1445217 - DNA, 16 bp, Homo sapiens
ctaattgtaagtgaaa

SEQ ID NO: 1445218 - DNA, 18 bp, Homo sapiens
ctaattgtaagtgaaatt

SEQ ID NO: 1445219 - DNA, 20 bp, Homo sapiens
ctaattgtactaatctgaga

SEQ ID NO: 1445220 - DNA, 20 bp, Homo sapiens
ctaatttaaagatgctgtcg

SEQ ID NO: 1445221 - DNA, 11 bp, Homo sapiens
ctaatttaaca

SEQ ID NO: 1445222 - DNA, 12 bp, Homo sapiens
ctaatttataaa

SEQ ID NO: 1445223 - DNA, 13 bp, Homo sapiens
ctaatttataaaa

SEQ ID NO: 1445224 - DNA, 14 bp, Homo sapiens
ctaatttataaaaa

SEQ ID NO: 1445225 - DNA, 21 bp, Homo sapiens
ctaatttatcctgaaatttca

SEQ ID NO: 1445226 - DNA, 23 bp, Homo sapiens
ctaatttatcctgaaatttcaga

SEQ ID NO: 1445227 - DNA, 20 bp, Homo sapiens
ctaatttctcctcccttcct

SEQ ID NO: 1445228 - DNA, 15 bp, Homo sapiens
ctaatttgatgttta

SEQ ID NO: 1445229 - DNA, 19 bp, Homo sapiens
ctaatttgttttggatata

SEQ ID NO: 1445230 - DNA, 19 bp, Homo sapiens
ctaattttaaataatttct

SEQ ID NO: 1445231 - DNA, 20 bp, Homo sapiens
ctaattttacacattagatt

SEQ ID NO: 1445232 - DNA, 15 bp, Homo sapiens
ctaattttagtattc

SEQ ID NO: 1445233 - DNA, 12 bp, Homo sapiens
ctaattttctat

SEQ ID NO: 1445234 - DNA, 19 bp, Homo sapiens
ctaatttttggtgctgatt

SEQ ID NO: 1445235 - DNA, 18 bp, Homo sapiens
ctaatttttgtattattt

SEQ ID NO: 1445236 - DNA, 15 bp, Homo sapiens
ctaatttttgtattt

SEQ ID NO: 1445237 - DNA, 17 bp, Homo sapiens
ctaattttttgtgtttt

SEQ ID NO: 1445238 - DNA, 23 bp, Homo sapiens
ctacaaaaaattagaaattggct

SEQ ID NO: 1445239 - DNA, 16 bp, Homo sapiens
ctacaaaaacacagca

SEQ ID NO: 1445240 - DNA, 20 bp, Homo sapiens
ctacaaaacctgatgttaaa

SEQ ID NO: 1445241 - DNA, 17 bp, Homo sapiens
ctacaaaatttgaaatt

SEQ ID NO: 1445242 - DNA, 21 bp, Homo sapiens
ctacaaacaaaatttctatta

SEQ ID NO: 1445243 - DNA, 19 bp, Homo sapiens
ctacaaagctttgctacaa

SEQ ID NO: 1445244 - DNA, 16 bp, Homo sapiens
ctacaaagtaaaatga

SEQ ID NO: 1445245 - DNA, 17 bp, Homo sapiens
ctacaaagtaaaatgaa

SEQ ID NO: 1445246 - DNA, 16 bp, Homo sapiens
ctacaaatttatgcat

SEQ ID NO: 1445247 - DNA, 20 bp, Homo sapiens
ctacaaatttatgcatttca

SEQ ID NO: 1445248 - DNA, 12 bp, Homo sapiens
ctacaaccaatt

SEQ ID NO: 1445249 - DNA, 17 bp, Homo sapiens
ctacaagagcagcctgt

SEQ ID NO: 1445250 - DNA, 21 bp, Homo sapiens
ctacaagagcagcctgtggca

SEQ ID NO: 1445251 - DNA, 22 bp, Homo sapiens
ctacaagagcagcctgtggcat

SEQ ID NO: 1445252 - DNA, 15 bp, Homo sapiens
ctacaatatatatta

SEQ ID NO: 1445253 - DNA, 13 bp, Homo sapiens
ctacaatcatggt

SEQ ID NO: 1445254 - DNA, 13 bp, Homo sapiens
ctacaatctcttt

SEQ ID NO: 1445255 - DNA, 13 bp, Homo sapiens
ctacacaaagcag

SEQ ID NO: 1445256 - DNA, 14 bp, Homo sapiens
ctacacaatacagt

SEQ ID NO: 1445257 - DNA, 22 bp, Homo sapiens
ctacacactgtcatgcttcatc

SEQ ID NO: 1445258 - DNA, 13 bp, Homo sapiens
ctacacagcacac

SEQ ID NO: 1445259 - DNA, 17 bp, Homo sapiens
ctacacagcacaccagc

SEQ ID NO: 1445260 - DNA, 13 bp, Homo sapiens
ctacacagcctgg

SEQ ID NO: 1445261 - DNA, 14 bp, Homo sapiens
ctacacagcctgga

SEQ ID NO: 1445262 - DNA, 16 bp, Homo sapiens
ctacacagcctggact

SEQ ID NO: 1445263 - DNA, 23 bp, Homo sapiens
ctacacaggagtcttcagaccca

SEQ ID NO: 1445264 - DNA, 22 bp, Homo sapiens
ctacacagtgggaactctgaca

SEQ ID NO: 1445265 - DNA, 23 bp, Homo sapiens
ctacacagtgggaactctgacaa

SEQ ID NO: 1445266 - DNA, 14 bp, Homo sapiens
ctacaccaatgaaa

SEQ ID NO: 1445267 - DNA, 22 bp, Homo sapiens
ctacacccctcccctgccctag

SEQ ID NO: 1445268 - DNA, 17 bp, Homo sapiens
ctacacccctgtgctcc

SEQ ID NO: 1445269 - DNA, 16 bp, Homo sapiens
ctacactccagcctga

SEQ ID NO: 1445270 - DNA, 19 bp, Homo sapiens
ctacagaaatactgctctg

SEQ ID NO: 1445271 - DNA, 20 bp, Homo sapiens
ctacagaaatactgctctga

SEQ ID NO: 1445272 - DNA, 20 bp, Homo sapiens
ctacagaactacatatttgt

SEQ ID NO: 1445273 - DNA, 15 bp, Homo sapiens
ctacagacctggctc

SEQ ID NO: 1445274 - DNA, 19 bp, Homo sapiens
ctacagactccatctcttc

SEQ ID NO: 1445275 - DNA, 23 bp, Homo sapiens
ctacagactccatctcttctgca

SEQ ID NO: 1445276 - DNA, 22 bp, Homo sapiens
ctacagagaggaaattctccac

SEQ ID NO: 1445277 - DNA, 14 bp, Homo sapiens
ctacagatgagtca

SEQ ID NO: 1445278 - DNA, 23 bp, Homo sapiens
ctacagatgatagaggattttat

SEQ ID NO: 1445279 - DNA, 15 bp, Homo sapiens
ctacagcctgcacac

SEQ ID NO: 1445280 - DNA, 19 bp, Homo sapiens
ctacagccttgtccccctc

SEQ ID NO: 1445281 - DNA, 22 bp, Homo sapiens
ctacagctaatcagcattctca

SEQ ID NO: 1445282 - DNA, 15 bp, Homo sapiens
ctacagcttgtttaa

SEQ ID NO: 1445283 - DNA, 21 bp, Homo sapiens
ctacaggatggtgggcaggat

SEQ ID NO: 1445284 - DNA, 22 bp, Homo sapiens
ctacagggcgagactctgtctc

SEQ ID NO: 1445285 - DNA, 21 bp, Homo sapiens
ctacaggggttagcctggact

SEQ ID NO: 1445286 - DNA, 23 bp, Homo sapiens
ctacagttagggttgagttactt

SEQ ID NO: 1445287 - DNA, 21 bp, Homo sapiens
ctacagttatgttcagtcaca

SEQ ID NO: 1445288 - DNA, 22 bp, Homo sapiens
ctacagttgttttttgaaaaca

SEQ ID NO: 1445289 - DNA, 15 bp, Homo sapiens
ctacagttttaactg

SEQ ID NO: 1445290 - DNA, 22 bp, Homo sapiens
ctacataagtaattcaagaaaa

SEQ ID NO: 1445291 - DNA, 13 bp, Homo sapiens
ctacataattgtg

SEQ ID NO: 1445292 - DNA, 18 bp, Homo sapiens
ctacatactatggaattt

SEQ ID NO: 1445293 - DNA, 18 bp, Homo sapiens
ctacatatcccttccaga

SEQ ID NO: 1445294 - DNA, 15 bp, Homo sapiens
ctacatcccagcctg

SEQ ID NO: 1445295 - DNA, 17 bp, Homo sapiens
ctacatcccagcctgtg

SEQ ID NO: 1445296 - DNA, 13 bp, Homo sapiens
ctacatccccagg

SEQ ID NO: 1445297 - DNA, 16 bp, Homo sapiens
ctacatccccaggtct

SEQ ID NO: 1445298 - DNA, 18 bp, Homo sapiens
ctacatcttttttcacaa

SEQ ID NO: 1445299 - DNA, 14 bp, Homo sapiens
ctacatgctggggt

SEQ ID NO: 1445300 - DNA, 13 bp, Homo sapiens
ctacatgtgagtg

SEQ ID NO: 1445301 - DNA, 10 bp, Homo sapiens
ctacattcct

SEQ ID NO: 1445302 - DNA, 14 bp, Homo sapiens
ctacattcctcagc

SEQ ID NO: 1445303 - DNA, 16 bp, Homo sapiens
ctacattcctcagctg

SEQ ID NO: 1445304 - DNA, 17 bp, Homo sapiens
ctacattcctcagctgc

SEQ ID NO: 1445305 - DNA, 18 bp, Homo sapiens
ctacattgagcatttgaa

SEQ ID NO: 1445306 - DNA, 23 bp, Homo sapiens
ctacatttcacctactttgtaag

SEQ ID NO: 1445307 - DNA, 15 bp, Homo sapiens
ctacatttctgcaga

SEQ ID NO: 1445308 - DNA, 17 bp, Homo sapiens
ctacatttgtttgtatt

SEQ ID NO: 1445309 - DNA, 18 bp, Homo sapiens
ctacatttgtttgtattc

SEQ ID NO: 1445310 - DNA, 22 bp, Homo sapiens
ctacatttgtttgtattcatgt

SEQ ID NO: 1445311 - DNA, 20 bp, Homo sapiens
ctacattttgaggttttgta

SEQ ID NO: 1445312 - DNA, 22 bp, Homo sapiens
ctacattttgaggttttgtaaa

SEQ ID NO: 1445313 - DNA, 12 bp, Homo sapiens
ctaccaaaatgg

SEQ ID NO: 1445314 - DNA, 20 bp, Homo sapiens
ctaccactggtacttccttt

SEQ ID NO: 1445315 - DNA, 18 bp, Homo sapiens
ctaccagccagcctcaga

SEQ ID NO: 1445316 - DNA, 22 bp, Homo sapiens
ctaccagcgcccgctgggctga

SEQ ID NO: 1445317 - DNA, 12 bp, Homo sapiens
ctaccaggactc

SEQ ID NO: 1445318 - DNA, 13 bp, Homo sapiens
ctaccagtattta

SEQ ID NO: 1445319 - DNA, 16 bp, Homo sapiens
ctaccagtctatttcc

SEQ ID NO: 1445320 - DNA, 16 bp, Homo sapiens
ctaccatctgcatggg

SEQ ID NO: 1445321 - DNA, 20 bp, Homo sapiens
ctaccattgaaggaaagcta

SEQ ID NO: 1445322 - DNA, 15 bp, Homo sapiens
ctacccaaccactca

SEQ ID NO: 1445323 - DNA, 23 bp, Homo sapiens
ttaaatcgaggcagaaagataca

SEQ ID NO: 1445324 - DNA, 20 bp, Homo sapiens
ttaaatctaaacaaaaaata

SEQ ID NO: 1445325 - DNA, 14 bp, Homo sapiens
ttaaatctgcttta

SEQ ID NO: 1445326 - DNA, 20 bp, Homo sapiens
ttaaatctgctttagtttca

SEQ ID NO: 1445327 - DNA, 16 bp, Homo sapiens
ttaaatctgtgatgat

SEQ ID NO: 1445328 - DNA, 19 bp, Homo sapiens
ttaaatcttaaacaatgta

SEQ ID NO: 1445329 - DNA, 17 bp, Homo sapiens
ttaaatgccttgtataa

SEQ ID NO: 1445330 - DNA, 18 bp, Homo sapiens
ttaaatgcttattttaaa

SEQ ID NO: 1445331 - DNA, 23 bp, Homo sapiens
ttaaatgggctactttgtccttt

SEQ ID NO: 1445332 - DNA, 14 bp, Homo sapiens
ttaaatgtaaaatt

SEQ ID NO: 1445333 - DNA, 17 bp, Homo sapiens
ttaaatgtaaagatatt

SEQ ID NO: 1445334 - DNA, 14 bp, Homo sapiens
ttaaatgtaactta

SEQ ID NO: 1445335 - DNA, 12 bp, Homo sapiens
ttaaatgtgaat

SEQ ID NO: 1445336 - DNA, 16 bp, Homo sapiens
ttaaatgtgaattttt

SEQ ID NO: 1445337 - DNA, 17 bp, Homo sapiens
ttaaatgttacctctga

SEQ ID NO: 1445338 - DNA, 18 bp, Homo sapiens
ttaaattaattgaatcta

SEQ ID NO: 1445339 - DNA, 18 bp, Homo sapiens
ttaaattacatttgtaat

SEQ ID NO: 1445340 - DNA, 14 bp, Homo sapiens
ttaaattagaatga

SEQ ID NO: 1445341 - DNA, 21 bp, Homo sapiens
ttaaattcagtcctaagaaag

SEQ ID NO: 1445342 - DNA, 19 bp, Homo sapiens
ttaaattcccgttttgtca

SEQ ID NO: 1445343 - DNA, 22 bp, Homo sapiens
ttaaattcccgttttgtcactt

SEQ ID NO: 1445344 - DNA, 14 bp, Homo sapiens
ttaaattgctcaca

SEQ ID NO: 1445345 - DNA, 15 bp, Homo sapiens
ttaaatttaatacca

SEQ ID NO: 1445346 - DNA, 16 bp, Homo sapiens
ttaaatttaatatact

SEQ ID NO: 1445347 - DNA, 21 bp, Homo sapiens
ttaaatttaatatactgcata

SEQ ID NO: 1445348 - DNA, 15 bp, Homo sapiens
ttaaatttctaccgc

SEQ ID NO: 1445349 - DNA, 22 bp, Homo sapiens
ttaaatttcttggcaaatttta

SEQ ID NO: 1445350 - DNA, 23 bp, Homo sapiens
ttaaatttcttggcaaattttaa

SEQ ID NO: 1445351 - DNA, 17 bp, Homo sapiens
ttaaatttgttctttgt

SEQ ID NO: 1445352 - DNA, 20 bp, Homo sapiens
ttaaatttgttctttgttta

SEQ ID NO: 1445353 - DNA, 18 bp, Homo sapiens
ttaaattttaatgtaaaa

SEQ ID NO: 1445354 - DNA, 16 bp, Homo sapiens
ttaaattttaatttat

SEQ ID NO: 1445355 - DNA, 15 bp, Homo sapiens
ttaacaaaagatttg

SEQ ID NO: 1445356 - DNA, 18 bp, Homo sapiens
ttaacaaaagatttgttt

SEQ ID NO: 1445357 - DNA, 10 bp, Homo sapiens
ttaacaaatg

SEQ ID NO: 1445358 - DNA, 21 bp, Homo sapiens
ttaacaacaataacactgtct

SEQ ID NO: 1445359 - DNA, 13 bp, Homo sapiens
ttaacaacatggc

SEQ ID NO: 1445360 - DNA, 20 bp, Homo sapiens
ttaacaaggaatgcctgtgc

SEQ ID NO: 1445361 - DNA, 22 bp, Homo sapiens
ttaacaaggaatgcctgtgcca

SEQ ID NO: 1445362 - DNA, 16 bp, Homo sapiens
ttaacaataataaaaa

SEQ ID NO: 1445363 - DNA, 17 bp, Homo sapiens
ttaacaatgatatatgg

SEQ ID NO: 1445364 - DNA, 16 bp, Homo sapiens
ttaacaattccaaagg

SEQ ID NO: 1445365 - DNA, 20 bp, Homo sapiens
ttaacactggttaaattaac

SEQ ID NO: 1445366 - DNA, 19 bp, Homo sapiens
ttaacacttaaatttcttg

SEQ ID NO: 1445367 - DNA, 14 bp, Homo sapiens
ttaacactttgtat

SEQ ID NO: 1445368 - DNA, 13 bp, Homo sapiens
ttaacagaaattg

SEQ ID NO: 1445369 - DNA, 16 bp, Homo sapiens
ttaacagaaattgtat

SEQ ID NO: 1445370 - DNA, 21 bp, Homo sapiens
ttaacagcatgctgctttgcc

SEQ ID NO: 1445371 - DNA, 15 bp, Homo sapiens
ttaacagtcatttaa

SEQ ID NO: 1445372 - DNA, 13 bp, Homo sapiens
ttaacagttgtat

SEQ ID NO: 1445373 - DNA, 15 bp, Homo sapiens
ttaacatagtcctgt

SEQ ID NO: 1445374 - DNA, 22 bp, Homo sapiens
ttaacatctagcctaaagtata

SEQ ID NO: 1445375 - DNA, 20 bp, Homo sapiens
ttaacatgggctcttcacta

SEQ ID NO: 1445376 - DNA, 22 bp, Homo sapiens
ttaacattaggaccttagaatt

SEQ ID NO: 1445377 - DNA, 23 bp, Homo sapiens
ttaacattaggaccttagaattt

SEQ ID NO: 1445378 - DNA, 13 bp, Homo sapiens
ttaacattccaag

SEQ ID NO: 1445379 - DNA, 11 bp, Homo sapiens
ttaacattcct

SEQ ID NO: 1445380 - DNA, 17 bp, Homo sapiens
ttaacatttctctccac

SEQ ID NO: 1445381 - DNA, 22 bp, Homo sapiens
ttaacatttgtgtaatatgaaa

SEQ ID NO: 1445382 - DNA, 15 bp, Homo sapiens
ttaaccattttaacc

SEQ ID NO: 1445383 - DNA, 15 bp, Homo sapiens
ttaaccctttttcca

SEQ ID NO: 1445384 - DNA, 21 bp, Homo sapiens
ttaacctatgatattttctgt

SEQ ID NO: 1445385 - DNA, 15 bp, Homo sapiens
ttaacctcagtgtca

SEQ ID NO: 1445386 - DNA, 12 bp, Homo sapiens
ttaacctctgca

SEQ ID NO: 1445387 - DNA, 20 bp, Homo sapiens
ttaacctgggcattgttgag

SEQ ID NO: 1445388 - DNA, 15 bp, Homo sapiens
ttaaccttaaaattg

SEQ ID NO: 1445389 - DNA, 14 bp, Homo sapiens
ttaacgatgtccaa

SEQ ID NO: 1445390 - DNA, 13 bp, Homo sapiens
ttaacggtgctaa

SEQ ID NO: 1445391 - DNA, 14 bp, Homo sapiens
ttaacggtgctaaa

SEQ ID NO: 1445392 - DNA, 20 bp, Homo sapiens
ttaactaaattttaaagcca

SEQ ID NO: 1445393 - DNA, 17 bp, Homo sapiens
ttaactactaagaataa

SEQ ID NO: 1445394 - DNA, 20 bp, Homo sapiens
ttaactactatattgattgt

SEQ ID NO: 1445395 - DNA, 15 bp, Homo sapiens
ttaactagaatttat

SEQ ID NO: 1445396 - DNA, 16 bp, Homo sapiens
ttaactagaatttatt

SEQ ID NO: 1445397 - DNA, 21 bp, Homo sapiens
ttaactagaatttattcaatt

SEQ ID NO: 1445398 - DNA, 18 bp, Homo sapiens
ttaactataacaatcact

SEQ ID NO: 1445399 - DNA, 14 bp, Homo sapiens
ttaactatttcaca

SEQ ID NO: 1445400 - DNA, 14 bp, Homo sapiens
ttaactccctccac

SEQ ID NO: 1445401 - DNA, 15 bp, Homo sapiens
ttaactccctccacc

SEQ ID NO: 1445402 - DNA, 14 bp, Homo sapiens
ttaactcttttgga

SEQ ID NO: 1445403 - DNA, 15 bp, Homo sapiens
ttaactcttttggac

SEQ ID NO: 1445404 - DNA, 18 bp, Homo sapiens
ttaactgaggagaagctg

SEQ ID NO: 1445405 - DNA, 15 bp, Homo sapiens
ttaactgcatataga

SEQ ID NO: 1445406 - DNA, 21 bp, Homo sapiens
ttaactgtagtgcctcctaat

SEQ ID NO: 1445407 - DNA, 16 bp, Homo sapiens
ttaactgtgaaatacc

SEQ ID NO: 1445408 - DNA, 17 bp, Homo sapiens
ttaacttgaagaaaccg

SEQ ID NO: 1445409 - DNA, 16 bp, Homo sapiens
ttaacttggtcagagc

SEQ ID NO: 1445410 - DNA, 17 bp, Homo sapiens
ttaacttggtcagagcc

SEQ ID NO: 1445411 - DNA, 11 bp, Homo sapiens
ttaacttgtat

SEQ ID NO: 1445412 - DNA, 16 bp, Homo sapiens
ttaacttgtcaaaaaa

SEQ ID NO: 1445413 - DNA, 22 bp, Homo sapiens
ttaacttgtcaaaaaacaaaaa

SEQ ID NO: 1445414 - DNA, 18 bp, Homo sapiens
ttaactttatcacattat

SEQ ID NO: 1445415 - DNA, 18 bp, Homo sapiens
ttaagaaaaaagtgttga

SEQ ID NO: 1445416 - DNA, 21 bp, Homo sapiens
ttaagaaaaaataacacacat

SEQ ID NO: 1445417 - DNA, 16 bp, Homo sapiens
ttaagaaaaacatgtc

SEQ ID NO: 1445418 - DNA, 20 bp, Homo sapiens
ttaagaaaaacatgtcatgt

SEQ ID NO: 1445419 - DNA, 17 bp, Homo sapiens
ttaagaaaatacaataa

SEQ ID NO: 1445420 - DNA, 17 bp, Homo sapiens
ttaagaaatctggccca

SEQ ID NO: 1445421 - DNA, 22 bp, Homo sapiens
ttaagaaatctggcccagggtg

SEQ ID NO: 1445422 - DNA, 20 bp, Homo sapiens
ttaagaaattccatacttct

SEQ ID NO: 1445423 - DNA, 16 bp, Homo sapiens
ttaagaacacaaagcg

SEQ ID NO: 1445424 - DNA, 12 bp, Homo sapiens
ttaagaactgtg

SEQ ID NO: 1445425 - DNA, 10 bp, Homo sapiens
ttaagaatat

SEQ ID NO: 1445426 - DNA, 22 bp, Homo sapiens
ttaagaatgagtttcttagact

SEQ ID NO: 1445427 - DNA, 14 bp, Homo sapiens
ttaagacagagtct

SEQ ID NO: 1445428 - DNA, 20 bp, Homo sapiens
ttaagacagtgtacaaaact

SEQ ID NO: 1445429 - DNA, 15 bp, Homo sapiens
ttaagaccagcctgg

SEQ ID NO: 1445430 - DNA, 20 bp, Homo sapiens
ttaagaggcagaaaattgca

SEQ ID NO: 1445431 - DNA, 16 bp, Homo sapiens
ttaagataattataat

SEQ ID NO: 1445432 - DNA, 22 bp, Homo sapiens
ttaagatatccatctttttctt

SEQ ID NO: 1445433 - DNA, 22 bp, Homo sapiens
ttaagatctgtgttttagttta

SEQ ID NO: 1445434 - DNA, 12 bp, Homo sapiens
ttaagatgtgaa

SEQ ID NO: 1445435 - DNA, 23 bp, Homo sapiens
ttaagcacacacatctggccctg

SEQ ID NO: 1445436 - DNA, 22 bp, Homo sapiens
ttaagcagcatggaaaaatggt

SEQ ID NO: 1445437 - DNA, 15 bp, Homo sapiens
ttaagcatgacagaa

SEQ ID NO: 1445438 - DNA, 20 bp, Homo sapiens
ttaagcattgggtgggtaaa

SEQ ID NO: 1445439 - DNA, 20 bp, Homo sapiens
ttaagccaaactcaggccca

SEQ ID NO: 1445440 - DNA, 16 bp, Homo sapiens
ctacccaaccactcaa

SEQ ID NO: 1445441 - DNA, 13 bp, Homo sapiens
ctacccagctctg

SEQ ID NO: 1445442 - DNA, 12 bp, Homo sapiens
ctacccagctga

SEQ ID NO: 1445443 - DNA, 16 bp, Homo sapiens
ctacccagctgatggg

SEQ ID NO: 1445444 - DNA, 17 bp, Homo sapiens
ctacccagctgatgggg

SEQ ID NO: 1445445 - DNA, 19 bp, Homo sapiens
ctacccaggaggctgaggt

SEQ ID NO: 1445446 - DNA, 19 bp, Homo sapiens
ctacccattgttcccttcc

SEQ ID NO: 1445447 - DNA, 19 bp, Homo sapiens
ctaccccagccaggctcct

SEQ ID NO: 1445448 - DNA, 12 bp, Homo sapiens
ctaccccagtcc

SEQ ID NO: 1445449 - DNA, 13 bp, Homo sapiens
ctaccccagtccc

SEQ ID NO: 1445450 - DNA, 19 bp, Homo sapiens
ctaccccatggtgctagga

SEQ ID NO: 1445451 - DNA, 17 bp, Homo sapiens
ctaccccctaagagcca

SEQ ID NO: 1445452 - DNA, 15 bp, Homo sapiens
ctaccccgcagacac

SEQ ID NO: 1445453 - DNA, 23 bp, Homo sapiens
ctacccctgctcccattcctccc

SEQ ID NO: 1445454 - DNA, 21 bp, Homo sapiens
ctaccccttggaaatgtctgc

SEQ ID NO: 1445455 - DNA, 12 bp, Homo sapiens
ctaccctcagcc

SEQ ID NO: 1445456 - DNA, 12 bp, Homo sapiens
ctaccctcccac

SEQ ID NO: 1445457 - DNA, 19 bp, Homo sapiens
ctaccctcccacccccttc

SEQ ID NO: 1445458 - DNA, 15 bp, Homo sapiens
ctaccctcgggccca

SEQ ID NO: 1445459 - DNA, 17 bp, Homo sapiens
ctaccctcgggcccacc

SEQ ID NO: 1445460 - DNA, 20 bp, Homo sapiens
ctaccctcgggcccacctgg

SEQ ID NO: 1445461 - DNA, 22 bp, Homo sapiens
ctaccctcgggcccacctggcc

SEQ ID NO: 1445462 - DNA, 22 bp, Homo sapiens
ctaccctgagatctgcacagtc

SEQ ID NO: 1445463 - DNA, 13 bp, Homo sapiens
ctaccctggactt

SEQ ID NO: 1445464 - DNA, 12 bp, Homo sapiens
ctaccctggcag

SEQ ID NO: 1445465 - DNA, 12 bp, Homo sapiens
ctacccttctcc

SEQ ID NO: 1445466 - DNA, 14 bp, Homo sapiens
ctacccttctcctt

SEQ ID NO: 1445467 - DNA, 15 bp, Homo sapiens
ctacccttctccttt

SEQ ID NO: 1445468 - DNA, 18 bp, Homo sapiens
ctacccttctcctttcct

SEQ ID NO: 1445469 - DNA, 20 bp, Homo sapiens
ctacccttctcctttccttc

SEQ ID NO: 1445470 - DNA, 18 bp, Homo sapiens
ctaccgcaggcccggact

SEQ ID NO: 1445471 - DNA, 17 bp, Homo sapiens
ctaccgctggccctgcc

SEQ ID NO: 1445472 - DNA, 18 bp, Homo sapiens
ctaccgtggatctccttc

SEQ ID NO: 1445473 - DNA, 19 bp, Homo sapiens
ctaccgtggatctccttcc

SEQ ID NO: 1445474 - DNA, 22 bp, Homo sapiens
ctaccgtggatctccttccctt

SEQ ID NO: 1445475 - DNA, 21 bp, Homo sapiens
ctacctacgtttgcaccgcct

SEQ ID NO: 1445476 - DNA, 22 bp, Homo sapiens
ctacctacgtttgcaccgcctg

SEQ ID NO: 1445477 - DNA, 20 bp, Homo sapiens
ctacctcaaagggcagtttt

SEQ ID NO: 1445478 - DNA, 15 bp, Homo sapiens
ctacctcacctgggc

SEQ ID NO: 1445479 - DNA, 14 bp, Homo sapiens
ctacctcagcctag

SEQ ID NO: 1445480 - DNA, 15 bp, Homo sapiens
ctacctcagcctaga

SEQ ID NO: 1445481 - DNA, 20 bp, Homo sapiens
ctacctcaggcaggaagggc

SEQ ID NO: 1445482 - DNA, 12 bp, Homo sapiens
ctacctccctcc

SEQ ID NO: 1445483 - DNA, 15 bp, Homo sapiens
ctacctcccttgcct

SEQ ID NO: 1445484 - DNA, 16 bp, Homo sapiens
ctacctctgagaagac

SEQ ID NO: 1445485 - DNA, 17 bp, Homo sapiens
ctacctctgagaagaca

SEQ ID NO: 1445486 - DNA, 17 bp, Homo sapiens
ctacctcttttgagact

SEQ ID NO: 1445487 - DNA, 20 bp, Homo sapiens
ctacctgattggtgcaaccc

SEQ ID NO: 1445488 - DNA, 16 bp, Homo sapiens
ctacctgcagtgggaa

SEQ ID NO: 1445489 - DNA, 12 bp, Homo sapiens
ctacctgccctc

SEQ ID NO: 1445490 - DNA, 16 bp, Homo sapiens
ctacctgccctcaagg

SEQ ID NO: 1445491 - DNA, 12 bp, Homo sapiens
ctacctgggacc

SEQ ID NO: 1445492 - DNA, 13 bp, Homo sapiens
ctacctgtgcctg

SEQ ID NO: 1445493 - DNA, 20 bp, Homo sapiens
ctacctgttcagtgtcccgg

SEQ ID NO: 1445494 - DNA, 22 bp, Homo sapiens
ctacctgttcagtgtcccgggc

SEQ ID NO: 1445495 - DNA, 19 bp, Homo sapiens
ctaccttaaaatgtaaaac

SEQ ID NO: 1445496 - DNA, 14 bp, Homo sapiens
ctaccttatcaggc

SEQ ID NO: 1445497 - DNA, 15 bp, Homo sapiens
ctaccttatcaggca

SEQ ID NO: 1445498 - DNA, 19 bp, Homo sapiens
ctaccttccccagacttgc

SEQ ID NO: 1445499 - DNA, 17 bp, Homo sapiens
ctaccttctctacccat

SEQ ID NO: 1445500 - DNA, 16 bp, Homo sapiens
ctaccttgggggaacc

SEQ ID NO: 1445501 - DNA, 14 bp, Homo sapiens
ctacgattccactg

SEQ ID NO: 1445502 - DNA, 19 bp, Homo sapiens
ctacgcctcttctgtccct

SEQ ID NO: 1445503 - DNA, 19 bp, Homo sapiens
ctacgggcgctgcagcctc

SEQ ID NO: 1445504 - DNA, 22 bp, Homo sapiens
ctacgggcgctgcagcctccct

SEQ ID NO: 1445505 - DNA, 21 bp, Homo sapiens
ctacgtgaattagctttttct

SEQ ID NO: 1445506 - DNA, 16 bp, Homo sapiens
ctactaaaaatacaaa

SEQ ID NO: 1445507 - DNA, 21 bp, Homo sapiens
ctactaaggggcttgtgttct

SEQ ID NO: 1445508 - DNA, 17 bp, Homo sapiens
ctactaatagaataaag

SEQ ID NO: 1445509 - DNA, 18 bp, Homo sapiens
ctactaatagaataaagg

SEQ ID NO: 1445510 - DNA, 13 bp, Homo sapiens
ctactaatgatgt

SEQ ID NO: 1445511 - DNA, 19 bp, Homo sapiens
ctactaccacaaggaaaat

SEQ ID NO: 1445512 - DNA, 15 bp, Homo sapiens
ctactacccgagccc

SEQ ID NO: 1445513 - DNA, 16 bp, Homo sapiens
ctactacccgagccca

SEQ ID NO: 1445514 - DNA, 22 bp, Homo sapiens
ctactagagtctgaacagctgt

SEQ ID NO: 1445515 - DNA, 15 bp, Homo sapiens
ctactagatgtcttt

SEQ ID NO: 1445516 - DNA, 15 bp, Homo sapiens
ctactagattgacta

SEQ ID NO: 1445517 - DNA, 14 bp, Homo sapiens
ctactattggccct

SEQ ID NO: 1445518 - DNA, 16 bp, Homo sapiens
ctactcaagaggctga

SEQ ID NO: 1445519 - DNA, 15 bp, Homo sapiens
ctactcacagtctct

SEQ ID NO: 1445520 - DNA, 17 bp, Homo sapiens
ctactcacagtctcttt

SEQ ID NO: 1445521 - DNA, 17 bp, Homo sapiens
ctactcagaagcctgag

SEQ ID NO: 1445522 - DNA, 16 bp, Homo sapiens
ctactcagcagccctc

SEQ ID NO: 1445523 - DNA, 17 bp, Homo sapiens
ctactcagcagccctcc

SEQ ID NO: 1445524 - DNA, 20 bp, Homo sapiens
ctactcagcagccctcctca

SEQ ID NO: 1445525 - DNA, 22 bp, Homo sapiens
ctactcagcagccctcctcacc

SEQ ID NO: 1445526 - DNA, 17 bp, Homo sapiens
ctactcagcatttgatt

SEQ ID NO: 1445527 - DNA, 20 bp, Homo sapiens
ctactcaggaggctgaggca

SEQ ID NO: 1445528 - DNA, 19 bp, Homo sapiens
ctactcataagttggacca

SEQ ID NO: 1445529 - DNA, 14 bp, Homo sapiens
ctactccactgccc

SEQ ID NO: 1445530 - DNA, 17 bp, Homo sapiens
ctactccactgccctgg

SEQ ID NO: 1445531 - DNA, 18 bp, Homo sapiens
ctactccactgccctggc

SEQ ID NO: 1445532 - DNA, 19 bp, Homo sapiens
ctactccactgccctggca

SEQ ID NO: 1445533 - DNA, 20 bp, Homo sapiens
ctactccactgccctggcag

SEQ ID NO: 1445534 - DNA, 13 bp, Homo sapiens
ctactcccctggg

SEQ ID NO: 1445535 - DNA, 16 bp, Homo sapiens
ctactccctcttcact

SEQ ID NO: 1445536 - DNA, 17 bp, Homo sapiens
ctactccctgcagatgc

SEQ ID NO: 1445537 - DNA, 16 bp, Homo sapiens
ctactcctacctcagc

SEQ ID NO: 1445538 - DNA, 18 bp, Homo sapiens
ctactcctacctcagcct

SEQ ID NO: 1445539 - DNA, 21 bp, Homo sapiens
ctactcctacctcagcctaga

SEQ ID NO: 1445540 - DNA, 21 bp, Homo sapiens
ctactcctctgcagtgccttg

SEQ ID NO: 1445541 - DNA, 14 bp, Homo sapiens
ctactcctgtgctc

SEQ ID NO: 1445542 - DNA, 19 bp, Homo sapiens
ctactcgagcccacccagc

SEQ ID NO: 1445543 - DNA, 12 bp, Homo sapiens
ctactctagaag

SEQ ID NO: 1445544 - DNA, 17 bp, Homo sapiens
ctactctccccacgagg

SEQ ID NO: 1445545 - DNA, 20 bp, Homo sapiens
ctactctccccacgagggct

SEQ ID NO: 1445546 - DNA, 17 bp, Homo sapiens
ctactctcctcggcccc

SEQ ID NO: 1445547 - DNA, 22 bp, Homo sapiens
ctactctggaggtttgtttaga

SEQ ID NO: 1445548 - DNA, 19 bp, Homo sapiens
ctactctgtccaggccact

SEQ ID NO: 1445549 - DNA, 14 bp, Homo sapiens
ctactctgtgccag

SEQ ID NO: 1445550 - DNA, 21 bp, Homo sapiens
ctactcttgagagctcaggca

SEQ ID NO: 1445551 - DNA, 12 bp, Homo sapiens
ctactgaaacag

SEQ ID NO: 1445552 - DNA, 18 bp, Homo sapiens
ctactgaacacatgtgta

SEQ ID NO: 1445553 - DNA, 14 bp, Homo sapiens
ctactgacagggag

SEQ ID NO: 1445554 - DNA, 15 bp, Homo sapiens
ctactgacccaactg

SEQ ID NO: 1445555 - DNA, 22 bp, Homo sapiens
ctactgacggagtcctgtgttt

SEQ ID NO: 1445556 - DNA, 11 bp, Homo sapiens
ctactgagact

SEQ ID NO: 1445557 - DNA, 18 bp, Homo sapiens
ttaagccctttgctctgg

SEQ ID NO: 1445558 - DNA, 16 bp, Homo sapiens
ttaagcctaaagattt

SEQ ID NO: 1445559 - DNA, 19 bp, Homo sapiens
ttaagccttacaaagggaa

SEQ ID NO: 1445560 - DNA, 15 bp, Homo sapiens
ttaagctaaaatgtt

SEQ ID NO: 1445561 - DNA, 16 bp, Homo sapiens
ttaagctaaaatgtta

SEQ ID NO: 1445562 - DNA, 18 bp, Homo sapiens
ttaaggagaatcatgttt

SEQ ID NO: 1445563 - DNA, 21 bp, Homo sapiens
ttaaggagaatcatgtttctt

SEQ ID NO: 1445564 - DNA, 17 bp, Homo sapiens
ttaaggagcaaaaatct

SEQ ID NO: 1445565 - DNA, 19 bp, Homo sapiens
ttaaggatggatggcaccc

SEQ ID NO: 1445566 - DNA, 22 bp, Homo sapiens
ttaaggatggatggcaccctgg

SEQ ID NO: 1445567 - DNA, 19 bp, Homo sapiens
ttaaggctctgtgccttgg

SEQ ID NO: 1445568 - DNA, 22 bp, Homo sapiens
ttaagggccggggatggatctt

SEQ ID NO: 1445569 - DNA, 24 bp, Homo sapiens
ttaaggggaggaaccagagtgctg

SEQ ID NO: 1445570 - DNA, 15 bp, Homo sapiens
ttaagggggaaaact

SEQ ID NO: 1445571 - DNA, 16 bp, Homo sapiens
ttaaggtctttcagta

SEQ ID NO: 1445572 - DNA, 19 bp, Homo sapiens
ttaaggtgtgcaaagatct

SEQ ID NO: 1445573 - DNA, 17 bp, Homo sapiens
ttaaggttgcacacagt

SEQ ID NO: 1445574 - DNA, 18 bp, Homo sapiens
ttaaggtttgcaaattaa

SEQ ID NO: 1445575 - DNA, 14 bp, Homo sapiens
ttaagtaaaaaaga

SEQ ID NO: 1445576 - DNA, 14 bp, Homo sapiens
ttaagtaagacttt

SEQ ID NO: 1445577 - DNA, 23 bp, Homo sapiens
ttaagtaagacttttattaataa

SEQ ID NO: 1445578 - DNA, 16 bp, Homo sapiens
ttaagtagaacaaaaa

SEQ ID NO: 1445579 - DNA, 19 bp, Homo sapiens
ttaagtatatagtatattt

SEQ ID NO: 1445580 - DNA, 21 bp, Homo sapiens
ttaagtatatagtatatttat

SEQ ID NO: 1445581 - DNA, 14 bp, Homo sapiens
ttaagtatgtgtaa

SEQ ID NO: 1445582 - DNA, 17 bp, Homo sapiens
ttaagtatttatatatt

SEQ ID NO: 1445583 - DNA, 19 bp, Homo sapiens
ttaagtctaaatatttcct

SEQ ID NO: 1445584 - DNA, 15 bp, Homo sapiens
ttaagtctcgaatgt

SEQ ID NO: 1445585 - DNA, 14 bp, Homo sapiens
ttaagtgagcagaa

SEQ ID NO: 1445586 - DNA, 18 bp, Homo sapiens
ttaagtgagcagaacagg

SEQ ID NO: 1445587 - DNA, 22 bp, Homo sapiens
ttaagtgagtcctgttcttcct

SEQ ID NO: 1445588 - DNA, 15 bp, Homo sapiens
ttaagttacagtttg

SEQ ID NO: 1445589 - DNA, 14 bp, Homo sapiens
ttaagttgaaaaag

SEQ ID NO: 1445590 - DNA, 18 bp, Homo sapiens
ttaagttgtcaaagaagc

SEQ ID NO: 1445591 - DNA, 16 bp, Homo sapiens
ttaagttgtttgcatg

SEQ ID NO: 1445592 - DNA, 19 bp, Homo sapiens
ttaagttgtttgcatgtga

SEQ ID NO: 1445593 - DNA, 16 bp, Homo sapiens
ttaagtttcaaactta

SEQ ID NO: 1445594 - DNA, 22 bp, Homo sapiens
ttaagtttcaaacttactattt

SEQ ID NO: 1445595 - DNA, 17 bp, Homo sapiens
ttaagtttctctgcaga

SEQ ID NO: 1445596 - DNA, 17 bp, Homo sapiens
ttaagtttctcttcacc

SEQ ID NO: 1445597 - DNA, 13 bp, Homo sapiens
ttaataaaaatac

SEQ ID NO: 1445598 - DNA, 16 bp, Homo sapiens
ttaataaaaatacaca

SEQ ID NO: 1445599 - DNA, 19 bp, Homo sapiens
ttaataaaaatacacatga

SEQ ID NO: 1445600 - DNA, 12 bp, Homo sapiens
ttaataaaacaa

SEQ ID NO: 1445601 - DNA, 12 bp, Homo sapiens
ttaataaaactg

SEQ ID NO: 1445602 - DNA, 23 bp, Homo sapiens
ttaataaaactgcgaggacatca

SEQ ID NO: 1445603 - DNA, 19 bp, Homo sapiens
ttaataaaagatttacatt

SEQ ID NO: 1445604 - DNA, 22 bp, Homo sapiens
ttaataaacttttttttgagaa

SEQ ID NO: 1445605 - DNA, 14 bp, Homo sapiens
ttaataaagacagg

SEQ ID NO: 1445606 - DNA, 15 bp, Homo sapiens
ttaataaagatgagt

SEQ ID NO: 1445607 - DNA, 16 bp, Homo sapiens
ttaataaagatgagtt

SEQ ID NO: 1445608 - DNA, 13 bp, Homo sapiens
ttaataaagcatt

SEQ ID NO: 1445609 - DNA, 14 bp, Homo sapiens
ttaataaagcattc

SEQ ID NO: 1445610 - DNA, 22 bp, Homo sapiens
ttaataaaggtttaaagctgaa

SEQ ID NO: 1445611 - DNA, 22 bp, Homo sapiens
ttaataaatttaataaatattg

SEQ ID NO: 1445612 - DNA, 13 bp, Homo sapiens
ttaataagaacag

SEQ ID NO: 1445613 - DNA, 21 bp, Homo sapiens
ttaataagtaattccttctct

SEQ ID NO: 1445614 - DNA, 14 bp, Homo sapiens
ttaataatatgtac

SEQ ID NO: 1445615 - DNA, 14 bp, Homo sapiens
ttaataatgcttta

SEQ ID NO: 1445616 - DNA, 19 bp, Homo sapiens
ttaatacaaggtataataa

SEQ ID NO: 1445617 - DNA, 23 bp, Homo sapiens
ttaatacaaggtataataaaatt

SEQ ID NO: 1445618 - DNA, 13 bp, Homo sapiens
ttaatacagataa

SEQ ID NO: 1445619 - DNA, 21 bp, Homo sapiens
ttaatacagataagtgttctt

SEQ ID NO: 1445620 - DNA, 19 bp, Homo sapiens
ttaataccctgcaatgtaa

SEQ ID NO: 1445621 - DNA, 18 bp, Homo sapiens
ttaatactgttattcttt

SEQ ID NO: 1445622 - DNA, 20 bp, Homo sapiens
ttaatagaaataaattccta

SEQ ID NO: 1445623 - DNA, 12 bp, Homo sapiens
ttaatagcacta

SEQ ID NO: 1445624 - DNA, 16 bp, Homo sapiens
ttaatagcagcctttc

SEQ ID NO: 1445625 - DNA, 16 bp, Homo sapiens
ttaatagcctgtcata

SEQ ID NO: 1445626 - DNA, 16 bp, Homo sapiens
ttaatagctgtgatca

SEQ ID NO: 1445627 - DNA, 21 bp, Homo sapiens
ttaatagctgtgatcagtgat

SEQ ID NO: 1445628 - DNA, 23 bp, Homo sapiens
ttaatagtcaccttcatgattat

SEQ ID NO: 1445629 - DNA, 19 bp, Homo sapiens
ttaatagtcattccaaata

SEQ ID NO: 1445630 - DNA, 14 bp, Homo sapiens
ttaatagtgctttt

SEQ ID NO: 1445631 - DNA, 13 bp, Homo sapiens
ttaatagtgtcat

SEQ ID NO: 1445632 - DNA, 23 bp, Homo sapiens
ttaatagtgtcataaagattata

SEQ ID NO: 1445633 - DNA, 22 bp, Homo sapiens
ttaatataaagtagtcctgtga

SEQ ID NO: 1445634 - DNA, 20 bp, Homo sapiens
ttaatatactgcatatcctg

SEQ ID NO: 1445635 - DNA, 21 bp, Homo sapiens
ttaatatatagtccagacact

SEQ ID NO: 1445636 - DNA, 16 bp, Homo sapiens
ttaatatattaaaatt

SEQ ID NO: 1445637 - DNA, 14 bp, Homo sapiens
ttaatatatttcca

SEQ ID NO: 1445638 - DNA, 22 bp, Homo sapiens
ttaatatcaaaagaaaattgat

SEQ ID NO: 1445639 - DNA, 21 bp, Homo sapiens
ttaatatgagcttcaatataa

SEQ ID NO: 1445640 - DNA, 20 bp, Homo sapiens
ttaatatgcttaaaataagc

SEQ ID NO: 1445641 - DNA, 23 bp, Homo sapiens
ttaatatgttaacctcagtgtca

SEQ ID NO: 1445642 - DNA, 15 bp, Homo sapiens
ttaatattactgtct

SEQ ID NO: 1445643 - DNA, 16 bp, Homo sapiens
ttaatattactgtctt

SEQ ID NO: 1445644 - DNA, 18 bp, Homo sapiens
ttaatattactgtcttta

SEQ ID NO: 1445645 - DNA, 18 bp, Homo sapiens
ttaatattcccattttat

SEQ ID NO: 1445646 - DNA, 12 bp, Homo sapiens
ttaatatttaac

SEQ ID NO: 1445647 - DNA, 13 bp, Homo sapiens
ttaatatttacca

SEQ ID NO: 1445648 - DNA, 17 bp, Homo sapiens
ttaatatttaccaaagt

SEQ ID NO: 1445649 - DNA, 15 bp, Homo sapiens
ttaatatttctaaaa

SEQ ID NO: 1445650 - DNA, 19 bp, Homo sapiens
ttaatatttgctgacagct

SEQ ID NO: 1445651 - DNA, 10 bp, Homo sapiens
ttaatcaaag

SEQ ID NO: 1445652 - DNA, 17 bp, Homo sapiens
ttaatcaagagaaactt

SEQ ID NO: 1445653 - DNA, 19 bp, Homo sapiens
ttaatcaagagaaacttca

SEQ ID NO: 1445654 - DNA, 21 bp, Homo sapiens
ttaatcaagatttttttcctg

SEQ ID NO: 1445655 - DNA, 20 bp, Homo sapiens
ttaatcaggtcctcagagaa

SEQ ID NO: 1445656 - DNA, 15 bp, Homo sapiens
ttaatcatctataaa

SEQ ID NO: 1445657 - DNA, 13 bp, Homo sapiens
ttaatcattttca

SEQ ID NO: 1445658 - DNA, 22 bp, Homo sapiens
ttaatcattttgcctcttttct

SEQ ID NO: 1445659 - DNA, 19 bp, Homo sapiens
ttaatccagttataagaag

SEQ ID NO: 1445660 - DNA, 14 bp, Homo sapiens
ttaatccttctagt

SEQ ID NO: 1445661 - DNA, 20 bp, Homo sapiens
ttaatccttctagtttccca

SEQ ID NO: 1445662 - DNA, 15 bp, Homo sapiens
ttaatctctaaaatt

SEQ ID NO: 1445663 - DNA, 13 bp, Homo sapiens
ttaatcttagctt

SEQ ID NO: 1445664 - DNA, 15 bp, Homo sapiens
ttaatcttagctttt

SEQ ID NO: 1445665 - DNA, 16 bp, Homo sapiens
ttaatcttagctttta

SEQ ID NO: 1445666 - DNA, 14 bp, Homo sapiens
ttaatcttagtgta

SEQ ID NO: 1445667 - DNA, 18 bp, Homo sapiens
ttaatcttcaaagccttc

SEQ ID NO: 1445668 - DNA, 17 bp, Homo sapiens
ttaatcttcagttttat

SEQ ID NO: 1445669 - DNA, 12 bp, Homo sapiens
ttaatcttgctt

SEQ ID NO: 1445670 - DNA, 16 bp, Homo sapiens
ttaatcttgcttcatt

SEQ ID NO: 1445671 - DNA, 14 bp, Homo sapiens
ttaatcttgctttc

SEQ ID NO: 1445672 - DNA, 17 bp, Homo sapiens
ttaatgaaatatctgta

SEQ ID NO: 1445673 - DNA, 21 bp, Homo sapiens
ttaatgaaatatctgtattta

SEQ ID NO: 1445674 - DNA, 18 bp, Homo sapiens
ttcccccaccagctaagg

SEQ ID NO: 1445675 - DNA, 23 bp, Homo sapiens
ttcccccaccggtccagctggcc

SEQ ID NO: 1445676 - DNA, 18 bp, Homo sapiens
ttcccccactactgcagc

SEQ ID NO: 1445677 - DNA, 12 bp, Homo sapiens
ttcccccagccc

SEQ ID NO: 1445678 - DNA, 18 bp, Homo sapiens
ttcccccatgtggctgaa

SEQ ID NO: 1445679 - DNA, 19 bp, Homo sapiens
ttccccccactctccccac

SEQ ID NO: 1445680 - DNA, 21 bp, Homo sapiens
ttccccccatgttgtaatgct

SEQ ID NO: 1445681 - DNA, 17 bp, Homo sapiens
ttccccctccccctcct

SEQ ID NO: 1445682 - DNA, 23 bp, Homo sapiens
ttccccctccccctcctgctgtg

SEQ ID NO: 1445683 - DNA, 16 bp, Homo sapiens
ttcccccttcccattt

SEQ ID NO: 1445684 - DNA, 13 bp, Homo sapiens
ttcccccttcccg

SEQ ID NO: 1445685 - DNA, 19 bp, Homo sapiens
ttccccgatgtcccctgcg

SEQ ID NO: 1445686 - DNA, 19 bp, Homo sapiens
ttccccgcaacccacagct

SEQ ID NO: 1445687 - DNA, 19 bp, Homo sapiens
ttcccctaacctcattccc

SEQ ID NO: 1445688 - DNA, 23 bp, Homo sapiens
ttcccctccaagaccctgtgttc

SEQ ID NO: 1445689 - DNA, 19 bp, Homo sapiens
ttcccctcccacctctcct

SEQ ID NO: 1445690 - DNA, 15 bp, Homo sapiens
ttcccctcctccact

SEQ ID NO: 1445691 - DNA, 15 bp, Homo sapiens
ttcccctctgctgct

SEQ ID NO: 1445692 - DNA, 11 bp, Homo sapiens
ttcccctggcc

SEQ ID NO: 1445693 - DNA, 15 bp, Homo sapiens
ttcccctgtgtcatc

SEQ ID NO: 1445694 - DNA, 13 bp, Homo sapiens
ttccccttccctt

SEQ ID NO: 1445695 - DNA, 23 bp, Homo sapiens
ttccccttgcccagggctcagcc

SEQ ID NO: 1445696 - DNA, 14 bp, Homo sapiens
ttccccttggcttc

SEQ ID NO: 1445697 - DNA, 19 bp, Homo sapiens
ttcccctttactcagccca

SEQ ID NO: 1445698 - DNA, 14 bp, Homo sapiens
ttcccctttcctgt

SEQ ID NO: 1445699 - DNA, 17 bp, Homo sapiens
ttccccttttgcctggc

SEQ ID NO: 1445700 - DNA, 18 bp, Homo sapiens
ttccccttttgcctggct

SEQ ID NO: 1445701 - DNA, 20 bp, Homo sapiens
ttccccttttgcctggctgt

SEQ ID NO: 1445702 - DNA, 16 bp, Homo sapiens
ttcccgaagtaaaata

SEQ ID NO: 1445703 - DNA, 14 bp, Homo sapiens
ttcccgccttccaa

SEQ ID NO: 1445704 - DNA, 22 bp, Homo sapiens
ttcccgctcagccctccctgcc

SEQ ID NO: 1445705 - DNA, 15 bp, Homo sapiens
ttcccgctccccacc

SEQ ID NO: 1445706 - DNA, 19 bp, Homo sapiens
ttcccggagcacagccctg

SEQ ID NO: 1445707 - DNA, 15 bp, Homo sapiens
ttcccggcccttacc

SEQ ID NO: 1445708 - DNA, 22 bp, Homo sapiens
ttcccggcccttacctttcctg

SEQ ID NO: 1445709 - DNA, 17 bp, Homo sapiens
ttcccgggccagggctg

SEQ ID NO: 1445710 - DNA, 19 bp, Homo sapiens
ttcccggttcaggaccact

SEQ ID NO: 1445711 - DNA, 16 bp, Homo sapiens
ttcccgtagctgccag

SEQ ID NO: 1445712 - DNA, 20 bp, Homo sapiens
ttcccgtcccatatcctgcc

SEQ ID NO: 1445713 - DNA, 21 bp, Homo sapiens
ttcccgtcccatatcctgcct

SEQ ID NO: 1445714 - DNA, 14 bp, Homo sapiens
ttcccgtttctcca

SEQ ID NO: 1445715 - DNA, 19 bp, Homo sapiens
ttccctacagcctagggca

SEQ ID NO: 1445716 - DNA, 20 bp, Homo sapiens
ttccctacagcctagggcag

SEQ ID NO: 1445717 - DNA, 13 bp, Homo sapiens
ttccctacctcag

SEQ ID NO: 1445718 - DNA, 19 bp, Homo sapiens
ttccctacttgataatatt

SEQ ID NO: 1445719 - DNA, 10 bp, Homo sapiens
ttccctagag

SEQ ID NO: 1445720 - DNA, 15 bp, Homo sapiens
ttccctagagagaat

SEQ ID NO: 1445721 - DNA, 18 bp, Homo sapiens
ttccctaggggacacttc

SEQ ID NO: 1445722 - DNA, 19 bp, Homo sapiens
ttccctaggggacacttcc

SEQ ID NO: 1445723 - DNA, 21 bp, Homo sapiens
ttccctaggggacacttccct

SEQ ID NO: 1445724 - DNA, 12 bp, Homo sapiens
ttccctccattt

SEQ ID NO: 1445725 - DNA, 20 bp, Homo sapiens
ttccctccatttttctccca

SEQ ID NO: 1445726 - DNA, 19 bp, Homo sapiens
ttccctcccagaggagcca

SEQ ID NO: 1445727 - DNA, 13 bp, Homo sapiens
ttccctccccctc

SEQ ID NO: 1445728 - DNA, 15 bp, Homo sapiens
ttccctccccctcct

SEQ ID NO: 1445729 - DNA, 15 bp, Homo sapiens
ttccctcgtccgtct

SEQ ID NO: 1445730 - DNA, 16 bp, Homo sapiens
ttccctcgtccgtctg

SEQ ID NO: 1445731 - DNA, 13 bp, Homo sapiens
ttccctctccctc

SEQ ID NO: 1445732 - DNA, 14 bp, Homo sapiens
ttccctctccctgt

SEQ ID NO: 1445733 - DNA, 18 bp, Homo sapiens
ttccctctcctgcttcct

SEQ ID NO: 1445734 - DNA, 13 bp, Homo sapiens
ttccctctggctt

SEQ ID NO: 1445735 - DNA, 14 bp, Homo sapiens
ttccctctggcttc

SEQ ID NO: 1445736 - DNA, 19 bp, Homo sapiens
ttccctcttccctctccct

SEQ ID NO: 1445737 - DNA, 21 bp, Homo sapiens
ttccctcttgtccctttccct

SEQ ID NO: 1445738 - DNA, 20 bp, Homo sapiens
ttccctctttggctcccctg

SEQ ID NO: 1445739 - DNA, 15 bp, Homo sapiens
ttccctgaatgtatt

SEQ ID NO: 1445740 - DNA, 17 bp, Homo sapiens
ttccctgacttgcttta

SEQ ID NO: 1445741 - DNA, 11 bp, Homo sapiens
ttccctgagga

SEQ ID NO: 1445742 - DNA, 12 bp, Homo sapiens
ttccctgaggaa

SEQ ID NO: 1445743 - DNA, 15 bp, Homo sapiens
ttccctgaggaatga

SEQ ID NO: 1445744 - DNA, 19 bp, Homo sapiens
ttccctgagtcaccaggaa

SEQ ID NO: 1445745 - DNA, 12 bp, Homo sapiens
ttccctgcaacc

SEQ ID NO: 1445746 - DNA, 16 bp, Homo sapiens
ttccctgcaccctgga

SEQ ID NO: 1445747 - DNA, 15 bp, Homo sapiens
ttccctgccttgctg

SEQ ID NO: 1445748 - DNA, 23 bp, Homo sapiens
ttccctgccttgctgacaataaa

SEQ ID NO: 1445749 - DNA, 22 bp, Homo sapiens
ttccctgcgagacgcacacagc

SEQ ID NO: 1445750 - DNA, 19 bp, Homo sapiens
ttccctgcgcctgtgatgc

SEQ ID NO: 1445751 - DNA, 23 bp, Homo sapiens
ctccccgcccctgtggccctggc

SEQ ID NO: 1445752 - DNA, 14 bp, Homo sapiens
ctccccgcctccac

SEQ ID NO: 1445753 - DNA, 17 bp, Homo sapiens
ctccccgctcaggggcc

SEQ ID NO: 1445754 - DNA, 21 bp, Homo sapiens
ctccccgctcaggggcctgga

SEQ ID NO: 1445755 - DNA, 22 bp, Homo sapiens
ctccccgctccgtctctgtcct

SEQ ID NO: 1445756 - DNA, 22 bp, Homo sapiens
ctccccggcaggcctgagaatg

SEQ ID NO: 1445757 - DNA, 22 bp, Homo sapiens
ctccccgtgtcctctccctgcc

SEQ ID NO: 1445758 - DNA, 18 bp, Homo sapiens
ctcccctatccacccagc

SEQ ID NO: 1445759 - DNA, 23 bp, Homo sapiens
ctcccctatccacccagcccatt

SEQ ID NO: 1445760 - DNA, 19 bp, Homo sapiens
ctcccctatgctggtagat

SEQ ID NO: 1445761 - DNA, 13 bp, Homo sapiens
ctcccctcccacc

SEQ ID NO: 1445762 - DNA, 22 bp, Homo sapiens
ctcccctcccaggggagccagc

SEQ ID NO: 1445763 - DNA, 16 bp, Homo sapiens
ctcccctcctgctggg

SEQ ID NO: 1445764 - DNA, 16 bp, Homo sapiens
ctcccctctccttcct

SEQ ID NO: 1445765 - DNA, 21 bp, Homo sapiens
ctcccctctgcaaccccccag

SEQ ID NO: 1445766 - DNA, 19 bp, Homo sapiens
ctcccctgaggatggcctg

SEQ ID NO: 1445767 - DNA, 18 bp, Homo sapiens
ctcccctgcactgtaaaa

SEQ ID NO: 1445768 - DNA, 12 bp, Homo sapiens
ctcccctgccac

SEQ ID NO: 1445769 - DNA, 16 bp, Homo sapiens
ctcccctgccacactg

SEQ ID NO: 1445770 - DNA, 13 bp, Homo sapiens
ctcccctgccccc

SEQ ID NO: 1445771 - DNA, 16 bp, Homo sapiens
ctcccctgcccccagg

SEQ ID NO: 1445772 - DNA, 18 bp, Homo sapiens
ctcccctgcccccaggac

SEQ ID NO: 1445773 - DNA, 20 bp, Homo sapiens
ctcccctgcccccaggactg

SEQ ID NO: 1445774 - DNA, 14 bp, Homo sapiens
ctcccctgccggtg

SEQ ID NO: 1445775 - DNA, 14 bp, Homo sapiens
ctcccctgctccca

SEQ ID NO: 1445776 - DNA, 13 bp, Homo sapiens
ctcccctggagcc

SEQ ID NO: 1445777 - DNA, 16 bp, Homo sapiens
ctcccctggagccagc

SEQ ID NO: 1445778 - DNA, 20 bp, Homo sapiens
ctccccttttttcttctatt

SEQ ID NO: 1445779 - DNA, 16 bp, Homo sapiens
ctcccctttttttccc

SEQ ID NO: 1445780 - DNA, 12 bp, Homo sapiens
ctcccgagctcc

SEQ ID NO: 1445781 - DNA, 18 bp, Homo sapiens
ctcccgagctcctcttcc

SEQ ID NO: 1445782 - DNA, 19 bp, Homo sapiens
ctcccgagctcctcttcca

SEQ ID NO: 1445783 - DNA, 14 bp, Homo sapiens
ctcccgcaccaggc

SEQ ID NO: 1445784 - DNA, 13 bp, Homo sapiens
ctcccgcaccttc

SEQ ID NO: 1445785 - DNA, 18 bp, Homo sapiens
ctcccgcaccttcctcct

SEQ ID NO: 1445786 - DNA, 15 bp, Homo sapiens
ctcccgcccttccat

SEQ ID NO: 1445787 - DNA, 19 bp, Homo sapiens
ctcccgcccttccatgtgc

SEQ ID NO: 1445788 - DNA, 14 bp, Homo sapiens
ctcccgcctcagcc

SEQ ID NO: 1445789 - DNA, 11 bp, Homo sapiens
ctcccgcggtg

SEQ ID NO: 1445790 - DNA, 14 bp, Homo sapiens
ctcccgctgctgct

SEQ ID NO: 1445791 - DNA, 15 bp, Homo sapiens
ctcccgctgctgctg

SEQ ID NO: 1445792 - DNA, 20 bp, Homo sapiens
ctcccggaggttgggtgggc

SEQ ID NO: 1445793 - DNA, 15 bp, Homo sapiens
ctcccgggccctccc

SEQ ID NO: 1445794 - DNA, 22 bp, Homo sapiens
ctcccgggccctcccttggaaa

SEQ ID NO: 1445795 - DNA, 18 bp, Homo sapiens
ctcccggggcagggcagc

SEQ ID NO: 1445796 - DNA, 19 bp, Homo sapiens
ctcccgggttcaagtgatt

SEQ ID NO: 1445797 - DNA, 13 bp, Homo sapiens
ctccctaccttgc

SEQ ID NO: 1445798 - DNA, 16 bp, Homo sapiens
ctccctaccttgcctc

SEQ ID NO: 1445799 - DNA, 23 bp, Homo sapiens
ctccctagaggggcaccttttca

SEQ ID NO: 1445800 - DNA, 14 bp, Homo sapiens
ctccctagctcctc

SEQ ID NO: 1445801 - DNA, 15 bp, Homo sapiens
ctccctcaaagcaca

SEQ ID NO: 1445802 - DNA, 15 bp, Homo sapiens
ctccctcaactgaag

SEQ ID NO: 1445803 - DNA, 16 bp, Homo sapiens
ctccctcaactgaagg

SEQ ID NO: 1445804 - DNA, 17 bp, Homo sapiens
ctccctccaccagcctg

SEQ ID NO: 1445805 - DNA, 19 bp, Homo sapiens
ctccctccaccagcctgct

SEQ ID NO: 1445806 - DNA, 20 bp, Homo sapiens
ctccctccaccagcctgctg

SEQ ID NO: 1445807 - DNA, 12 bp, Homo sapiens
ctccctcccaca

SEQ ID NO: 1445808 - DNA, 19 bp, Homo sapiens
ctccctcccctctcagaac

SEQ ID NO: 1445809 - DNA, 14 bp, Homo sapiens
ctccctcccctgcc

SEQ ID NO: 1445810 - DNA, 18 bp, Homo sapiens
ctccctcccctgccattt

SEQ ID NO: 1445811 - DNA, 15 bp, Homo sapiens
ctccctcctcacctc

SEQ ID NO: 1445812 - DNA, 17 bp, Homo sapiens
ctccctcctcacctctg

SEQ ID NO: 1445813 - DNA, 15 bp, Homo sapiens
ctccctcctccaggc

SEQ ID NO: 1445814 - DNA, 16 bp, Homo sapiens
ctccctcctccaggcc

SEQ ID NO: 1445815 - DNA, 12 bp, Homo sapiens
ctccctcctcct

SEQ ID NO: 1445816 - DNA, 21 bp, Homo sapiens
ctccctcctgcaggctggctg

SEQ ID NO: 1445817 - DNA, 21 bp, Homo sapiens
ctccctcctggagctctgtgg

SEQ ID NO: 1445818 - DNA, 20 bp, Homo sapiens
ctccctccttccttcttgct

SEQ ID NO: 1445819 - DNA, 12 bp, Homo sapiens
ctccctcgctgt

SEQ ID NO: 1445820 - DNA, 14 bp, Homo sapiens
ctccctcgctgtat

SEQ ID NO: 1445821 - DNA, 19 bp, Homo sapiens
ctccctcgtcttcagctgc

SEQ ID NO: 1445822 - DNA, 16 bp, Homo sapiens
ctccctctcccaggcc

SEQ ID NO: 1445823 - DNA, 17 bp, Homo sapiens
ctccctctcccaggccc

SEQ ID NO: 1445824 - DNA, 22 bp, Homo sapiens
ctccctctcctgtagccactgg

SEQ ID NO: 1445825 - DNA, 11 bp, Homo sapiens
ctccctctctc

SEQ ID NO: 1445826 - DNA, 14 bp, Homo sapiens
ctccctctctctgg

SEQ ID NO: 1445827 - DNA, 16 bp, Homo sapiens
ctccctctctcttctg

SEQ ID NO: 1445828 - DNA, 15 bp, Homo sapiens
ctccctctctgtgca

SEQ ID NO: 1445829 - DNA, 14 bp, Homo sapiens
ctccctctgacctg

SEQ ID NO: 1445830 - DNA, 17 bp, Homo sapiens
ctccctctgacctgcag

SEQ ID NO: 1445831 - DNA, 13 bp, Homo sapiens
ctccctctgcccc

SEQ ID NO: 1445832 - DNA, 20 bp, Homo sapiens
ctccctctgccccaagcagc

SEQ ID NO: 1445833 - DNA, 21 bp, Homo sapiens
ctccctctgccccaagcagcc

SEQ ID NO: 1445834 - DNA, 22 bp, Homo sapiens
ctccctctggtctactctagaa

SEQ ID NO: 1445835 - DNA, 21 bp, Homo sapiens
ctccctctttctcagttcctc

SEQ ID NO: 1445836 - DNA, 21 bp, Homo sapiens
ctccctgaaaatgtttttctg

SEQ ID NO: 1445837 - DNA, 18 bp, Homo sapiens
ctccctgaagcctttgca

SEQ ID NO: 1445838 - DNA, 16 bp, Homo sapiens
ctccctgacccgtcta

SEQ ID NO: 1445839 - DNA, 16 bp, Homo sapiens
ctccctgatcccagac

SEQ ID NO: 1445840 - DNA, 19 bp, Homo sapiens
ttgattatcttcagcccag

SEQ ID NO: 1445841 - DNA, 16 bp, Homo sapiens
ttgattattagccagg

SEQ ID NO: 1445842 - DNA, 12 bp, Homo sapiens
ttgattattctg

SEQ ID NO: 1445843 - DNA, 23 bp, Homo sapiens
ttgattattttttttttcttctt

SEQ ID NO: 1445844 - DNA, 18 bp, Homo sapiens
ttgattcagccctcagaa

SEQ ID NO: 1445845 - DNA, 14 bp, Homo sapiens
ttgattcagtcttc

SEQ ID NO: 1445846 - DNA, 18 bp, Homo sapiens
ttgattcagtcttctgga

SEQ ID NO: 1445847 - DNA, 15 bp, Homo sapiens
ttgattcattttcct

SEQ ID NO: 1445848 - DNA, 12 bp, Homo sapiens
ttgattcctggt

SEQ ID NO: 1445849 - DNA, 15 bp, Homo sapiens
ttgattgagaaagat

SEQ ID NO: 1445850 - DNA, 19 bp, Homo sapiens
ttgattgaggagctgcact

SEQ ID NO: 1445851 - DNA, 21 bp, Homo sapiens
ttgattggtgattaggtggtg

SEQ ID NO: 1445852 - DNA, 21 bp, Homo sapiens
ttgattgtcagctactaatga

SEQ ID NO: 1445853 - DNA, 18 bp, Homo sapiens
ttgatttaaacacacaga

SEQ ID NO: 1445854 - DNA, 21 bp, Homo sapiens
ttgatttctttccttcccaat

SEQ ID NO: 1445855 - DNA, 18 bp, Homo sapiens
ttgatttgattgggatga

SEQ ID NO: 1445856 - DNA, 18 bp, Homo sapiens
ttgattttccatctaaaa

SEQ ID NO: 1445857 - DNA, 19 bp, Homo sapiens
ttgattttccatctaaaaa

SEQ ID NO: 1445858 - DNA, 17 bp, Homo sapiens
ttgatttttactgtgtt

SEQ ID NO: 1445859 - DNA, 14 bp, Homo sapiens
ttgatttttctctt

SEQ ID NO: 1445860 - DNA, 16 bp, Homo sapiens
ttgatttttctcttca

SEQ ID NO: 1445861 - DNA, 15 bp, Homo sapiens
ttgatttttgtctca

SEQ ID NO: 1445862 - DNA, 23 bp, Homo sapiens
ttgattttttttttcttctaaac

SEQ ID NO: 1445863 - DNA, 19 bp, Homo sapiens
ttgcaaaaaatgtttttgg

SEQ ID NO: 1445864 - DNA, 15 bp, Homo sapiens
ttgcaaaatttccag

SEQ ID NO: 1445865 - DNA, 21 bp, Homo sapiens
ttgcaaaatttccagtacctt

SEQ ID NO: 1445866 - DNA, 12 bp, Homo sapiens
ttgcaaatagtc

SEQ ID NO: 1445867 - DNA, 19 bp, Homo sapiens
ttgcaaattattctagtca

SEQ ID NO: 1445868 - DNA, 19 bp, Homo sapiens
ttgcaacaggggaggaaaa

SEQ ID NO: 1445869 - DNA, 21 bp, Homo sapiens
ttgcaagatgtgaattattga

SEQ ID NO: 1445870 - DNA, 22 bp, Homo sapiens
ttgcaagatgtgaattattgac

SEQ ID NO: 1445871 - DNA, 23 bp, Homo sapiens
ttgcaagatgtgaattattgaca

SEQ ID NO: 1445872 - DNA, 14 bp, Homo sapiens
ttgcaataatactt

SEQ ID NO: 1445873 - DNA, 20 bp, Homo sapiens
ttgcaataatacttctcaaa

SEQ ID NO: 1445874 - DNA, 13 bp, Homo sapiens
ttgcaatgtattt

SEQ ID NO: 1445875 - DNA, 19 bp, Homo sapiens
ttgcaattaaacttccaaa

SEQ ID NO: 1445876 - DNA, 14 bp, Homo sapiens
ttgcacaattttgt

SEQ ID NO: 1445877 - DNA, 11 bp, Homo sapiens
ttgcacacagt

SEQ ID NO: 1445878 - DNA, 23 bp, Homo sapiens
ttgcacaccttttccccaggagc

SEQ ID NO: 1445879 - DNA, 16 bp, Homo sapiens
ttgcacagttagcaaa

SEQ ID NO: 1445880 - DNA, 12 bp, Homo sapiens
ttgcacatgtga

SEQ ID NO: 1445881 - DNA, 13 bp, Homo sapiens
ttgcacatgtgac

SEQ ID NO: 1445882 - DNA, 15 bp, Homo sapiens
ttgcacatgtgacca

SEQ ID NO: 1445883 - DNA, 20 bp, Homo sapiens
ttgcaccatactccttgctt

SEQ ID NO: 1445884 - DNA, 23 bp, Homo sapiens
ttgcaccatactccttgcttcct

SEQ ID NO: 1445885 - DNA, 17 bp, Homo sapiens
ttgcaccgcctgccctc

SEQ ID NO: 1445886 - DNA, 19 bp, Homo sapiens
ttgcaccgcctgccctccc

SEQ ID NO: 1445887 - DNA, 18 bp, Homo sapiens
ttgcaccgtggtcagagg

SEQ ID NO: 1445888 - DNA, 16 bp, Homo sapiens
ttgcacctgtccccac

SEQ ID NO: 1445889 - DNA, 16 bp, Homo sapiens
ttgcactatttccaca

SEQ ID NO: 1445890 - DNA, 16 bp, Homo sapiens
ttgcactcaaatctta

SEQ ID NO: 1445891 - DNA, 18 bp, Homo sapiens
ttgcactcaaatcttaag

SEQ ID NO: 1445892 - DNA, 14 bp, Homo sapiens
ttgcactccagcct

SEQ ID NO: 1445893 - DNA, 23 bp, Homo sapiens
ttgcactgaagccggacagctgc

SEQ ID NO: 1445894 - DNA, 13 bp, Homo sapiens
ttgcactgagggc

SEQ ID NO: 1445895 - DNA, 16 bp, Homo sapiens
ttgcactgagggccac

SEQ ID NO: 1445896 - DNA, 21 bp, Homo sapiens
ttgcactgatgtccggagaga

SEQ ID NO: 1445897 - DNA, 13 bp, Homo sapiens
ttgcactgctgtt

SEQ ID NO: 1445898 - DNA, 14 bp, Homo sapiens
ttgcactgtaatga

SEQ ID NO: 1445899 - DNA, 22 bp, Homo sapiens
ttgcactgtaatgaggaaaaaa

SEQ ID NO: 1445900 - DNA, 20 bp, Homo sapiens
ttgcacttgtgattatttat

SEQ ID NO: 1445901 - DNA, 17 bp, Homo sapiens
ttgcactttttcttaat

SEQ ID NO: 1445902 - DNA, 22 bp, Homo sapiens
ttgcagaaacattttgtggtca

SEQ ID NO: 1445903 - DNA, 21 bp, Homo sapiens
ttgcagaactaaactcattta

SEQ ID NO: 1445904 - DNA, 19 bp, Homo sapiens
ttgcagagatttcctccat

SEQ ID NO: 1445905 - DNA, 12 bp, Homo sapiens
ttgcagattcta

SEQ ID NO: 1445906 - DNA, 20 bp, Homo sapiens
ttgcagcatgagactttctg

SEQ ID NO: 1445907 - DNA, 14 bp, Homo sapiens
ttgcagcatttact

SEQ ID NO: 1445908 - DNA, 16 bp, Homo sapiens
ttgcagcatttactat

SEQ ID NO: 1445909 - DNA, 17 bp, Homo sapiens
ttgcagcatttactatg

SEQ ID NO: 1445910 - DNA, 18 bp, Homo sapiens
ttgcagctcactgctgct

SEQ ID NO: 1445911 - DNA, 18 bp, Homo sapiens
ttgcagctgatgcctgaa

SEQ ID NO: 1445912 - DNA, 22 bp, Homo sapiens
ttgcagctggcccactgctggc

SEQ ID NO: 1445913 - DNA, 15 bp, Homo sapiens
ttgcaggattccctt

SEQ ID NO: 1445914 - DNA, 22 bp, Homo sapiens
ttgcaggattcccttctgggct

SEQ ID NO: 1445915 - DNA, 17 bp, Homo sapiens
ttgcagggtcctcttct

SEQ ID NO: 1445916 - DNA, 13 bp, Homo sapiens
ttgcaggtcagcc

SEQ ID NO: 1445917 - DNA, 13 bp, Homo sapiens
ttgcagtaactgt

SEQ ID NO: 1445918 - DNA, 15 bp, Homo sapiens
ttgcagtaactgttt

SEQ ID NO: 1445919 - DNA, 16 bp, Homo sapiens
ttgcagtggcctggcc

SEQ ID NO: 1445920 - DNA, 20 bp, Homo sapiens
ttgcagtgtggtgagatcat

SEQ ID NO: 1445921 - DNA, 16 bp, Homo sapiens
ttgcagttcaaatcct

SEQ ID NO: 1445922 - DNA, 16 bp, Homo sapiens
ttgcagttcagcacca

SEQ ID NO: 1445923 - DNA, 17 bp, Homo sapiens
ttgcataagattaaagg

SEQ ID NO: 1445924 - DNA, 22 bp, Homo sapiens
ttgcataagattaaaggaagga

SEQ ID NO: 1445925 - DNA, 22 bp, Homo sapiens
ttgcatagtaccaatcatttta

SEQ ID NO: 1445926 - DNA, 17 bp, Homo sapiens
ttgcatagttctagtgc

SEQ ID NO: 1445927 - DNA, 19 bp, Homo sapiens
ttgcatatcacccttccct

SEQ ID NO: 1445928 - DNA, 13 bp, Homo sapiens
ttgcatcaatttt

SEQ ID NO: 1445929 - DNA, 19 bp, Homo sapiens
ttgcatcagaaagctttat

SEQ ID NO: 1445930 - DNA, 14 bp, Homo sapiens
ttgcatccattgtt

SEQ ID NO: 1445931 - DNA, 17 bp, Homo sapiens
ttgcatctcaaaattat

SEQ ID NO: 1445932 - DNA, 18 bp, Homo sapiens
ttgcatctcaaaattatt

SEQ ID NO: 1445933 - DNA, 14 bp, Homo sapiens
ttgcatctgaaata

SEQ ID NO: 1445934 - DNA, 11 bp, Homo sapiens
ttgcatgaaat

SEQ ID NO: 1445935 - DNA, 11 bp, Homo sapiens
ttgcatgcatg

SEQ ID NO: 1445936 - DNA, 16 bp, Homo sapiens
ttgcatgcatgcaaat

SEQ ID NO: 1445937 - DNA, 19 bp, Homo sapiens
ttgcatggctccagaaatg

SEQ ID NO: 1445938 - DNA, 17 bp, Homo sapiens
ttgcatgtaaaagccta

SEQ ID NO: 1445939 - DNA, 13 bp, Homo sapiens
ttgcatgtagtaa

SEQ ID NO: 1445940 - DNA, 22 bp, Homo sapiens
ttgcatgtattagctcactgaa

SEQ ID NO: 1445941 - DNA, 14 bp, Homo sapiens
ttgcatgtgaaaat

SEQ ID NO: 1445942 - DNA, 15 bp, Homo sapiens
ttgcatgtggatcaa

SEQ ID NO: 1445943 - DNA, 20 bp, Homo sapiens
ttgcatttacttttaataaa

SEQ ID NO: 1445944 - DNA, 14 bp, Homo sapiens
ttgcatttctgctc

SEQ ID NO: 1445945 - DNA, 15 bp, Homo sapiens
ttgcatttggtcaag

SEQ ID NO: 1445946 - DNA, 21 bp, Homo sapiens
ttgcatttttattaaagcatt

SEQ ID NO: 1445947 - DNA, 19 bp, Homo sapiens
ttgccaaaataccagagcc

SEQ ID NO: 1445948 - DNA, 22 bp, Homo sapiens
ttgccaaagttttgctgtctct

SEQ ID NO: 1445949 - DNA, 15 bp, Homo sapiens
ttgccaacagttgta

SEQ ID NO: 1445950 - DNA, 16 bp, Homo sapiens
ttgccaactaagccct

SEQ ID NO: 1445951 - DNA, 22 bp, Homo sapiens
ttgccaagaaaatgaagggatt

SEQ ID NO: 1445952 - DNA, 17 bp, Homo sapiens
ttgccaagaatatagtt

SEQ ID NO: 1445953 - DNA, 20 bp, Homo sapiens
ttgccaagaatatagttatt

SEQ ID NO: 1445954 - DNA, 23 bp, Homo sapiens
ttgccaagaatatagttattatt

SEQ ID NO: 1445955 - DNA, 22 bp, Homo sapiens
ttgccaagctccaagccccatc

SEQ ID NO: 1445956 - DNA, 16 bp, Homo sapiens
ttgccaaggcagaggc

SEQ ID NO: 1445957 - DNA, 19 bp, Homo sapiens
ctccctgcacaagccaggg

SEQ ID NO: 1445958 - DNA, 20 bp, Homo sapiens
ctccctgcacaagccagggt

SEQ ID NO: 1445959 - DNA, 16 bp, Homo sapiens
ctccctgcacagcctc

SEQ ID NO: 1445960 - DNA, 22 bp, Homo sapiens
ctccctgcactccctcctggag

SEQ ID NO: 1445961 - DNA, 23 bp, Homo sapiens
ctccctgccccccaaggttctgg

SEQ ID NO: 1445962 - DNA, 13 bp, Homo sapiens
ctccctgcccctc

SEQ ID NO: 1445963 - DNA, 17 bp, Homo sapiens
ctccctgcccctccctt

SEQ ID NO: 1445964 - DNA, 18 bp, Homo sapiens
ctccctgccgcctcaatg

SEQ ID NO: 1445965 - DNA, 19 bp, Homo sapiens
ctccctgccgcctcaatgt

SEQ ID NO: 1445966 - DNA, 15 bp, Homo sapiens
ctccctgcctggccc

SEQ ID NO: 1445967 - DNA, 15 bp, Homo sapiens
ctccctgctgtgcca

SEQ ID NO: 1445968 - DNA, 22 bp, Homo sapiens
ctccctgctgtgccatgctggg

SEQ ID NO: 1445969 - DNA, 18 bp, Homo sapiens
ctccctgcttgcacactt

SEQ ID NO: 1445970 - DNA, 12 bp, Homo sapiens
ctccctggaagc

SEQ ID NO: 1445971 - DNA, 19 bp, Homo sapiens
ctccctggaagctggaaga

SEQ ID NO: 1445972 - DNA, 12 bp, Homo sapiens
ctccctggaggc

SEQ ID NO: 1445973 - DNA, 16 bp, Homo sapiens
ctccctggaggcacgc

SEQ ID NO: 1445974 - DNA, 21 bp, Homo sapiens
ctccctggaggcacgcaccac

SEQ ID NO: 1445975 - DNA, 16 bp, Homo sapiens
ctccctggctcactgg

SEQ ID NO: 1445976 - DNA, 19 bp, Homo sapiens
ctccctggctcactggcag

SEQ ID NO: 1445977 - DNA, 20 bp, Homo sapiens
ctccctggctcactggcagg

SEQ ID NO: 1445978 - DNA, 12 bp, Homo sapiens
ctccctggctcc

SEQ ID NO: 1445979 - DNA, 20 bp, Homo sapiens
ctccctggctctcagaaggt

SEQ ID NO: 1445980 - DNA, 15 bp, Homo sapiens
ctccctggctgccct

SEQ ID NO: 1445981 - DNA, 19 bp, Homo sapiens
ctccctggctgccctggcc

SEQ ID NO: 1445982 - DNA, 10 bp, Homo sapiens
ctccctgggc

SEQ ID NO: 1445983 - DNA, 20 bp, Homo sapiens
ctccctggggaccaggagct

SEQ ID NO: 1445984 - DNA, 21 bp, Homo sapiens
ctccctggggaccaggagcta

SEQ ID NO: 1445985 - DNA, 20 bp, Homo sapiens
ctccctgtcactcagctgag

SEQ ID NO: 1445986 - DNA, 15 bp, Homo sapiens
ctccctgtcccaggg

SEQ ID NO: 1445987 - DNA, 17 bp, Homo sapiens
ctccctgtcccagggcc

SEQ ID NO: 1445988 - DNA, 14 bp, Homo sapiens
ctccctgtcctcct

SEQ ID NO: 1445989 - DNA, 16 bp, Homo sapiens
ctccctgtcctcctcg

SEQ ID NO: 1445990 - DNA, 13 bp, Homo sapiens
ctccctgtctcca

SEQ ID NO: 1445991 - DNA, 14 bp, Homo sapiens
ctccctgtctccag

SEQ ID NO: 1445992 - DNA, 17 bp, Homo sapiens
ctccctgtctccagctg

SEQ ID NO: 1445993 - DNA, 19 bp, Homo sapiens
ctccctgtctccagctgcc

SEQ ID NO: 1445994 - DNA, 21 bp, Homo sapiens
ctccctgtctccagctgcctg

SEQ ID NO: 1445995 - DNA, 22 bp, Homo sapiens
ctccctgtctccagctgcctgg

SEQ ID NO: 1445996 - DNA, 12 bp, Homo sapiens
ctccctgtctgt

SEQ ID NO: 1445997 - DNA, 13 bp, Homo sapiens
ctccctgtctgtg

SEQ ID NO: 1445998 - DNA, 19 bp, Homo sapiens
ctccctgtctgtgtcccag

SEQ ID NO: 1445999 - DNA, 22 bp, Homo sapiens
ctccctgtggcactcagggagc

SEQ ID NO: 1446000 - DNA, 18 bp, Homo sapiens
ctccctgtggggcaggag

SEQ ID NO: 1446001 - DNA, 17 bp, Homo sapiens
ctccctgttatttttct

SEQ ID NO: 1446002 - DNA, 21 bp, Homo sapiens
ctcccttcaaccattccccat

SEQ ID NO: 1446003 - DNA, 20 bp, Homo sapiens
ctcccttcaagacgaggggc

SEQ ID NO: 1446004 - DNA, 14 bp, Homo sapiens
ctcccttcccacct

SEQ ID NO: 1446005 - DNA, 19 bp, Homo sapiens
ctcccttccctccatagcc

SEQ ID NO: 1446006 - DNA, 19 bp, Homo sapiens
ctcccttcctctctcctta

SEQ ID NO: 1446007 - DNA, 17 bp, Homo sapiens
ctcccttcctggcctca

SEQ ID NO: 1446008 - DNA, 18 bp, Homo sapiens
ctcccttcctggcctcac

SEQ ID NO: 1446009 - DNA, 19 bp, Homo sapiens
ctcccttccttttccctgc

SEQ ID NO: 1446010 - DNA, 20 bp, Homo sapiens
ctcccttccttttccctgct

SEQ ID NO: 1446011 - DNA, 11 bp, Homo sapiens
ctcccttctcc

SEQ ID NO: 1446012 - DNA, 18 bp, Homo sapiens
ctcccttctcctttctaa

SEQ ID NO: 1446013 - DNA, 15 bp, Homo sapiens
ctcccttctctctct

SEQ ID NO: 1446014 - DNA, 15 bp, Homo sapiens
ctcccttctgggaaa

SEQ ID NO: 1446015 - DNA, 12 bp, Homo sapiens
ctcccttgctgg

SEQ ID NO: 1446016 - DNA, 15 bp, Homo sapiens
ctcccttgctggccc

SEQ ID NO: 1446017 - DNA, 23 bp, Homo sapiens
ctcccttgctggccccagccctg

SEQ ID NO: 1446018 - DNA, 18 bp, Homo sapiens
ctcccttggaaacctgcc

SEQ ID NO: 1446019 - DNA, 19 bp, Homo sapiens
ctcccttggaaacctgccc

SEQ ID NO: 1446020 - DNA, 22 bp, Homo sapiens
ctcccttggaaacctgccctgc

SEQ ID NO: 1446021 - DNA, 17 bp, Homo sapiens
ctcccttggtcttccat

SEQ ID NO: 1446022 - DNA, 19 bp, Homo sapiens
ctcccttgtcctgcttggg

SEQ ID NO: 1446023 - DNA, 15 bp, Homo sapiens
ctccctttctctctc

SEQ ID NO: 1446024 - DNA, 21 bp, Homo sapiens
ctccctttttatatcccattt

SEQ ID NO: 1446025 - DNA, 19 bp, Homo sapiens
ctccgaaattccaaggccc

SEQ ID NO: 1446026 - DNA, 16 bp, Homo sapiens
ctccgaccctcatggc

SEQ ID NO: 1446027 - DNA, 19 bp, Homo sapiens
ctccgactctgcacccgcc

SEQ ID NO: 1446028 - DNA, 17 bp, Homo sapiens
ctccgagaggtgggcca

SEQ ID NO: 1446029 - DNA, 22 bp, Homo sapiens
ctccgagaggtgggccagtctg

SEQ ID NO: 1446030 - DNA, 14 bp, Homo sapiens
ctccgagctctggt

SEQ ID NO: 1446031 - DNA, 14 bp, Homo sapiens
ctccgaggctcccc

SEQ ID NO: 1446032 - DNA, 17 bp, Homo sapiens
ctccgaggctccccgcc

SEQ ID NO: 1446033 - DNA, 16 bp, Homo sapiens
ctccgatgctgaggcc

SEQ ID NO: 1446034 - DNA, 20 bp, Homo sapiens
ctccgatgctgaggccaccc

SEQ ID NO: 1446035 - DNA, 21 bp, Homo sapiens
ctccgccagcctcctctggac

SEQ ID NO: 1446036 - DNA, 23 bp, Homo sapiens
ctccgccattctcaagccctgca

SEQ ID NO: 1446037 - DNA, 13 bp, Homo sapiens
ctccgcccctgcc

SEQ ID NO: 1446038 - DNA, 23 bp, Homo sapiens
ctccgcccgctcctgccgcagac

SEQ ID NO: 1446039 - DNA, 12 bp, Homo sapiens
ctccgccctcct

SEQ ID NO: 1446040 - DNA, 15 bp, Homo sapiens
ctccgccctcctcgg

SEQ ID NO: 1446041 - DNA, 16 bp, Homo sapiens
ctccgccctcctcggg

SEQ ID NO: 1446042 - DNA, 14 bp, Homo sapiens
ctccgccctgccac

SEQ ID NO: 1446043 - DNA, 17 bp, Homo sapiens
ctccgccctgccactca

SEQ ID NO: 1446044 - DNA, 14 bp, Homo sapiens
ctccgctcccaccg

SEQ ID NO: 1446045 - DNA, 14 bp, Homo sapiens
ctccgctgcctgga

SEQ ID NO: 1446046 - DNA, 13 bp, Homo sapiens
ctccgctgggctt

SEQ ID NO: 1446047 - DNA, 16 bp, Homo sapiens
ctccggactggtgccc

SEQ ID NO: 1446048 - DNA, 17 bp, Homo sapiens
ctccggaggactcacca

SEQ ID NO: 1446049 - DNA, 17 bp, Homo sapiens
ctccggccatactgcct

SEQ ID NO: 1446050 - DNA, 19 bp, Homo sapiens
ctccggccatactgccttt

SEQ ID NO: 1446051 - DNA, 14 bp, Homo sapiens
ctccggcctcccct

SEQ ID NO: 1446052 - DNA, 19 bp, Homo sapiens
ctccggcctctgcctttgc

SEQ ID NO: 1446053 - DNA, 21 bp, Homo sapiens
ctccggcgggtgacagctccg

SEQ ID NO: 1446054 - DNA, 18 bp, Homo sapiens
ctccggcttgacctgttt

SEQ ID NO: 1446055 - DNA, 22 bp, Homo sapiens
ctccgggaccattgacctcagc

SEQ ID NO: 1446056 - DNA, 23 bp, Homo sapiens
ctccgggaccattgacctcagct

SEQ ID NO: 1446057 - DNA, 14 bp, Homo sapiens
ctccgggcaggcaa

SEQ ID NO: 1446058 - DNA, 16 bp, Homo sapiens
ctccgggcaggcaagg

SEQ ID NO: 1446059 - DNA, 18 bp, Homo sapiens
ctccggggagcgcccgcg

SEQ ID NO: 1446060 - DNA, 23 bp, Homo sapiens
ctccggggaggcaggggtcctgc

SEQ ID NO: 1446061 - DNA, 19 bp, Homo sapiens
ctccggtgtgcctgcagcc

SEQ ID NO: 1446062 - DNA, 19 bp, Homo sapiens
ctccggtttgggctgtctt

SEQ ID NO: 1446063 - DNA, 20 bp, Homo sapiens
ctccggtttgggctgtctta

SEQ ID NO: 1446064 - DNA, 22 bp, Homo sapiens
ctccgtccagccgccattgcca

SEQ ID NO: 1446065 - DNA, 23 bp, Homo sapiens
ctccgtccatatcagaactgtgc

SEQ ID NO: 1446066 - DNA, 15 bp, Homo sapiens
ctccgtctctgtcct

SEQ ID NO: 1446067 - DNA, 15 bp, Homo sapiens
ctccgtgaggctgct

SEQ ID NO: 1446068 - DNA, 18 bp, Homo sapiens
ctccgtgaggctgctgcc

SEQ ID NO: 1446069 - DNA, 15 bp, Homo sapiens
ctccgtgatccatcc

SEQ ID NO: 1446070 - DNA, 13 bp, Homo sapiens
ctccgtgcctcca

SEQ ID NO: 1446071 - DNA, 16 bp, Homo sapiens
ctccgtgcctccacca

SEQ ID NO: 1446072 - DNA, 13 bp, Homo sapiens
ctccgtggactgc

SEQ ID NO: 1446073 - DNA, 23 bp, Homo sapiens
ttgccaagggcccaaagaaagag

SEQ ID NO: 1446074 - DNA, 16 bp, Homo sapiens
ttgccaagttgctgtc

SEQ ID NO: 1446075 - DNA, 22 bp, Homo sapiens
ttgccaagttgctgtcactgtt

SEQ ID NO: 1446076 - DNA, 21 bp, Homo sapiens
ttgccaatgaggtctgaaatg

SEQ ID NO: 1446077 - DNA, 15 bp, Homo sapiens
ttgccacaaccctgt

SEQ ID NO: 1446078 - DNA, 22 bp, Homo sapiens
ttgccacagatgatacttccaa

SEQ ID NO: 1446079 - DNA, 12 bp, Homo sapiens
ttgccacagctt

SEQ ID NO: 1446080 - DNA, 13 bp, Homo sapiens
ttgccacagcttt

SEQ ID NO: 1446081 - DNA, 15 bp, Homo sapiens
ttgccaccaggagaa

SEQ ID NO: 1446082 - DNA, 19 bp, Homo sapiens
ttgccacccccagttccta

SEQ ID NO: 1446083 - DNA, 12 bp, Homo sapiens
ttgccactaatt

SEQ ID NO: 1446084 - DNA, 14 bp, Homo sapiens
ttgccactttggct

SEQ ID NO: 1446085 - DNA, 11 bp, Homo sapiens
ttgccagagca

SEQ ID NO: 1446086 - DNA, 21 bp, Homo sapiens
ttgccagagcaggagcccctg

SEQ ID NO: 1446087 - DNA, 17 bp, Homo sapiens
ttgccagcacaggggcc

SEQ ID NO: 1446088 - DNA, 18 bp, Homo sapiens
ttgccagctgacatcttg

SEQ ID NO: 1446089 - DNA, 17 bp, Homo sapiens
ttgccaggacatgcaat

SEQ ID NO: 1446090 - DNA, 19 bp, Homo sapiens
ttgccaggctggagtgcag

SEQ ID NO: 1446091 - DNA, 21 bp, Homo sapiens
ttgccagggatgggcagccca

SEQ ID NO: 1446092 - DNA, 14 bp, Homo sapiens
ttgccaggttgcag

SEQ ID NO: 1446093 - DNA, 18 bp, Homo sapiens
ttgccaggttgcagctgc

SEQ ID NO: 1446094 - DNA, 19 bp, Homo sapiens
ttgccaggttgcagctgct

SEQ ID NO: 1446095 - DNA, 15 bp, Homo sapiens
ttgccagtgaagact

SEQ ID NO: 1446096 - DNA, 14 bp, Homo sapiens
ttgccagttggaca

SEQ ID NO: 1446097 - DNA, 17 bp, Homo sapiens
ttgccagttttccctgg

SEQ ID NO: 1446098 - DNA, 17 bp, Homo sapiens
ttgccatccattctgga

SEQ ID NO: 1446099 - DNA, 21 bp, Homo sapiens
ttgccatcctaaaagccaccc

SEQ ID NO: 1446100 - DNA, 16 bp, Homo sapiens
ttgccatgtagacccc

SEQ ID NO: 1446101 - DNA, 14 bp, Homo sapiens
ttgccatgtgtttt

SEQ ID NO: 1446102 - DNA, 14 bp, Homo sapiens
ttgccatgttgcca

SEQ ID NO: 1446103 - DNA, 21 bp, Homo sapiens
ttgccattctcttgcattgtg

SEQ ID NO: 1446104 - DNA, 15 bp, Homo sapiens
ttgccatttctctgc

SEQ ID NO: 1446105 - DNA, 18 bp, Homo sapiens
ttgccatttgtagctttg

SEQ ID NO: 1446106 - DNA, 16 bp, Homo sapiens
ttgcccagagatgcct

SEQ ID NO: 1446107 - DNA, 19 bp, Homo sapiens
ttgcccagagatgcctcca

SEQ ID NO: 1446108 - DNA, 20 bp, Homo sapiens
ttgcccagggtcctgtgcct

SEQ ID NO: 1446109 - DNA, 14 bp, Homo sapiens
ttgcccatcctgac

SEQ ID NO: 1446110 - DNA, 11 bp, Homo sapiens
ttgccccactc

SEQ ID NO: 1446111 - DNA, 15 bp, Homo sapiens
ttgccccactctgcc

SEQ ID NO: 1446112 - DNA, 20 bp, Homo sapiens
ttgccccactctgcctgcct

SEQ ID NO: 1446113 - DNA, 14 bp, Homo sapiens
ttgcccccatccct

SEQ ID NO: 1446114 - DNA, 15 bp, Homo sapiens
ttgcccccatccctc

SEQ ID NO: 1446115 - DNA, 13 bp, Homo sapiens
ttgcccccatggg

SEQ ID NO: 1446116 - DNA, 15 bp, Homo sapiens
ttgccccctctcact

SEQ ID NO: 1446117 - DNA, 12 bp, Homo sapiens
ttgcccctggct

SEQ ID NO: 1446118 - DNA, 13 bp, Homo sapiens
ttgcccctggctt

SEQ ID NO: 1446119 - DNA, 19 bp, Homo sapiens
ttgcccctggctttgcctc

SEQ ID NO: 1446120 - DNA, 20 bp, Homo sapiens
ttgcccctggctttgcctct

SEQ ID NO: 1446121 - DNA, 16 bp, Homo sapiens
ttgcccctttcagtat

SEQ ID NO: 1446122 - DNA, 19 bp, Homo sapiens
ttgcccggattctgggagg

SEQ ID NO: 1446123 - DNA, 14 bp, Homo sapiens
ttgcccttcacagt

SEQ ID NO: 1446124 - DNA, 11 bp, Homo sapiens
ttgcccttccc

SEQ ID NO: 1446125 - DNA, 22 bp, Homo sapiens
ttgcctaaatttaatgctgcct

SEQ ID NO: 1446126 - DNA, 18 bp, Homo sapiens
ttgcctaactaactggca

SEQ ID NO: 1446127 - DNA, 19 bp, Homo sapiens
ttgcctaataaacatcctt

SEQ ID NO: 1446128 - DNA, 19 bp, Homo sapiens
ttgcctacaataaaaagaa

SEQ ID NO: 1446129 - DNA, 20 bp, Homo sapiens
ttgcctacaataaaaagaaa

SEQ ID NO: 1446130 - DNA, 14 bp, Homo sapiens
ttgcctagacagct

SEQ ID NO: 1446131 - DNA, 12 bp, Homo sapiens
ttgcctccaggt

SEQ ID NO: 1446132 - DNA, 15 bp, Homo sapiens
ttgcctccaggtgca

SEQ ID NO: 1446133 - DNA, 12 bp, Homo sapiens
ttgcctcccagg

SEQ ID NO: 1446134 - DNA, 19 bp, Homo sapiens
ttgcctcccaggcaagcag

SEQ ID NO: 1446135 - DNA, 21 bp, Homo sapiens
ttgcctcccaggcaagcagct

SEQ ID NO: 1446136 - DNA, 20 bp, Homo sapiens
ttgcctccccatttcccatc

SEQ ID NO: 1446137 - DNA, 21 bp, Homo sapiens
ttgcctccccatttcccatct

SEQ ID NO: 1446138 - DNA, 18 bp, Homo sapiens
ttgcctccttttttctta

SEQ ID NO: 1446139 - DNA, 19 bp, Homo sapiens
ttgcctctgcagtctcatt

SEQ ID NO: 1446140 - DNA, 16 bp, Homo sapiens
ttgcctctgccctgga

SEQ ID NO: 1446141 - DNA, 17 bp, Homo sapiens
ttgcctcttccagtctt

SEQ ID NO: 1446142 - DNA, 19 bp, Homo sapiens
ttgcctgaacatccttcct

SEQ ID NO: 1446143 - DNA, 23 bp, Homo sapiens
ttgcctgaacatccttccttccc

SEQ ID NO: 1446144 - DNA, 16 bp, Homo sapiens
ttgcctgatataaatg

SEQ ID NO: 1446145 - DNA, 22 bp, Homo sapiens
ttgcctgcgttttggaagctct

SEQ ID NO: 1446146 - DNA, 20 bp, Homo sapiens
ttgcctggctgtggaggcct

SEQ ID NO: 1446147 - DNA, 15 bp, Homo sapiens
ttgcctgtaagaaaa

SEQ ID NO: 1446148 - DNA, 12 bp, Homo sapiens
ttgcctgtgcca

SEQ ID NO: 1446149 - DNA, 16 bp, Homo sapiens
ttgcctgttctgcttc

SEQ ID NO: 1446150 - DNA, 16 bp, Homo sapiens
ttgcctgttggctgct

SEQ ID NO: 1446151 - DNA, 19 bp, Homo sapiens
ttgcctgttggctgctgcg

SEQ ID NO: 1446152 - DNA, 17 bp, Homo sapiens
ttgccttaataaatatg

SEQ ID NO: 1446153 - DNA, 15 bp, Homo sapiens
ttgccttatgggctg

SEQ ID NO: 1446154 - DNA, 15 bp, Homo sapiens
ttgccttatttgtct

SEQ ID NO: 1446155 - DNA, 20 bp, Homo sapiens
ttgccttccatttcccctct

SEQ ID NO: 1446156 - DNA, 15 bp, Homo sapiens
ttgccttctactccc

SEQ ID NO: 1446157 - DNA, 17 bp, Homo sapiens
ttgccttctacttttaa

SEQ ID NO: 1446158 - DNA, 21 bp, Homo sapiens
ttgccttctctgttcccttgc

SEQ ID NO: 1446159 - DNA, 21 bp, Homo sapiens
ttgcctttcctgctacatttg

SEQ ID NO: 1446160 - DNA, 14 bp, Homo sapiens
ttgcctttctgtgt

SEQ ID NO: 1446161 - DNA, 17 bp, Homo sapiens
ttgcctttgaagagtga

SEQ ID NO: 1446162 - DNA, 19 bp, Homo sapiens
ttgccttttgcaaccagga

SEQ ID NO: 1446163 - DNA, 22 bp, Homo sapiens
ttgccttttttctatatcaaaa

SEQ ID NO: 1446164 - DNA, 17 bp, Homo sapiens
ttgcgaatggttccatt

SEQ ID NO: 1446165 - DNA, 19 bp, Homo sapiens
ttgcgacggagagaaaaaa

SEQ ID NO: 1446166 - DNA, 20 bp, Homo sapiens
ttgcgacggagagaaaaaag

SEQ ID NO: 1446167 - DNA, 22 bp, Homo sapiens
ttgcgacggagagaaaaaagaa

SEQ ID NO: 1446168 - DNA, 21 bp, Homo sapiens
ttgcgcctcggtatctggctt

SEQ ID NO: 1446169 - DNA, 22 bp, Homo sapiens
ttgcgcctcggtatctggcttc

SEQ ID NO: 1446170 - DNA, 17 bp, Homo sapiens
ttgcggcaaaaggaaag

SEQ ID NO: 1446171 - DNA, 13 bp, Homo sapiens
ttgcgtagaggct

SEQ ID NO: 1446172 - DNA, 14 bp, Homo sapiens
ttgcgttcaaagag

SEQ ID NO: 1446173 - DNA, 16 bp, Homo sapiens
ttgctaaaaaagcata

SEQ ID NO: 1446174 - DNA, 22 bp, Homo sapiens
ttgctaaagcactttgcactta

SEQ ID NO: 1446175 - DNA, 23 bp, Homo sapiens
ttgctaaagcactttgcacttaa

SEQ ID NO: 1446176 - DNA, 17 bp, Homo sapiens
ttgctaaccactgtctg

SEQ ID NO: 1446177 - DNA, 16 bp, Homo sapiens
ttgctaactgggttaa

SEQ ID NO: 1446178 - DNA, 12 bp, Homo sapiens
ttgctaactggt

SEQ ID NO: 1446179 - DNA, 14 bp, Homo sapiens
ttgctaactggtta

SEQ ID NO: 1446180 - DNA, 21 bp, Homo sapiens
ttgctacaaatttatgcattt

SEQ ID NO: 1446181 - DNA, 15 bp, Homo sapiens
ttgctaccacagact

SEQ ID NO: 1446182 - DNA, 16 bp, Homo sapiens
ttgctaccacagactt

SEQ ID NO: 1446183 - DNA, 23 bp, Homo sapiens
ttgctaccagtatttagaagcca

SEQ ID NO: 1446184 - DNA, 21 bp, Homo sapiens
ttgctaccctgagttcatcca

SEQ ID NO: 1446185 - DNA, 18 bp, Homo sapiens
ttgctagactctagacaa

SEQ ID NO: 1446186 - DNA, 18 bp, Homo sapiens
ttgctaggagccccagct

SEQ ID NO: 1446187 - DNA, 17 bp, Homo sapiens
ttgctagtatcttgggt

SEQ ID NO: 1446188 - DNA, 18 bp, Homo sapiens
ttgctagtgatacactgt

SEQ ID NO: 1446189 - DNA, 23 bp, Homo sapiens
ttgctagtgatacactgtatcta

SEQ ID NO: 1446190 - DNA, 16 bp, Homo sapiens
ctccgttagctcctgt

SEQ ID NO: 1446191 - DNA, 21 bp, Homo sapiens
ctccgttagctcctgtggccc

SEQ ID NO: 1446192 - DNA, 22 bp, Homo sapiens
ctccgttagctcctgtggcccc

SEQ ID NO: 1446193 - DNA, 12 bp, Homo sapiens
ctccgttggcca

SEQ ID NO: 1446194 - DNA, 19 bp, Homo sapiens
ctcctaacaaaagaactaa

SEQ ID NO: 1446195 - DNA, 22 bp, Homo sapiens
ctcctaagcaactaggccttca

SEQ ID NO: 1446196 - DNA, 20 bp, Homo sapiens
ctcctacaagatttagaaaa

SEQ ID NO: 1446197 - DNA, 20 bp, Homo sapiens
ctcctacatatcccttccag

SEQ ID NO: 1446198 - DNA, 12 bp, Homo sapiens
ctcctacctcag

SEQ ID NO: 1446199 - DNA, 13 bp, Homo sapiens
ctcctacctcagc

SEQ ID NO: 1446200 - DNA, 15 bp, Homo sapiens
ctcctacctcagcct

SEQ ID NO: 1446201 - DNA, 16 bp, Homo sapiens
ctcctacctgtctgct

SEQ ID NO: 1446202 - DNA, 22 bp, Homo sapiens
ctcctagaagaaccaaatacct

SEQ ID NO: 1446203 - DNA, 19 bp, Homo sapiens
ctcctagacccaggtggag

SEQ ID NO: 1446204 - DNA, 19 bp, Homo sapiens
ctcctagaggtgggcagct

SEQ ID NO: 1446205 - DNA, 21 bp, Homo sapiens
ctcctagaggtgggcagctgg

SEQ ID NO: 1446206 - DNA, 22 bp, Homo sapiens
ctcctagaggtgggcagctggg

SEQ ID NO: 1446207 - DNA, 20 bp, Homo sapiens
ctcctagggaaaagttcata

SEQ ID NO: 1446208 - DNA, 19 bp, Homo sapiens
ctcctagtttgacctcaca

SEQ ID NO: 1446209 - DNA, 21 bp, Homo sapiens
ctcctataaagggcccacacc

SEQ ID NO: 1446210 - DNA, 20 bp, Homo sapiens
ctcctatccccaggccaggt

SEQ ID NO: 1446211 - DNA, 19 bp, Homo sapiens
ctcctatgtggcagctggg

SEQ ID NO: 1446212 - DNA, 14 bp, Homo sapiens
ctcctcaacccaca

SEQ ID NO: 1446213 - DNA, 15 bp, Homo sapiens
ctcctcaacccacat

SEQ ID NO: 1446214 - DNA, 14 bp, Homo sapiens
ctcctcacccccag

SEQ ID NO: 1446215 - DNA, 21 bp, Homo sapiens
ctcctcacccccagctttgct

SEQ ID NO: 1446216 - DNA, 18 bp, Homo sapiens
ctcctcaccccgtctggg

SEQ ID NO: 1446217 - DNA, 12 bp, Homo sapiens
ctcctcacctca

SEQ ID NO: 1446218 - DNA, 15 bp, Homo sapiens
ctcctcacctcatgc

SEQ ID NO: 1446219 - DNA, 17 bp, Homo sapiens
ctcctcacctcatgccc

SEQ ID NO: 1446220 - DNA, 15 bp, Homo sapiens
ctcctcacctctgga

SEQ ID NO: 1446221 - DNA, 18 bp, Homo sapiens
ctcctcacctctggactg

SEQ ID NO: 1446222 - DNA, 16 bp, Homo sapiens
ctcctcactggaggag

SEQ ID NO: 1446223 - DNA, 20 bp, Homo sapiens
ctcctcagcgagaggcagca

SEQ ID NO: 1446224 - DNA, 15 bp, Homo sapiens
ctcctcaggagagac

SEQ ID NO: 1446225 - DNA, 16 bp, Homo sapiens
ctcctcagggtggggg

SEQ ID NO: 1446226 - DNA, 13 bp, Homo sapiens
ctcctcatctcca

SEQ ID NO: 1446227 - DNA, 18 bp, Homo sapiens
ctcctccaaaggaagtct

SEQ ID NO: 1446228 - DNA, 23 bp, Homo sapiens
ctcctccaaaggaagtctaggag

SEQ ID NO: 1446229 - DNA, 13 bp, Homo sapiens
ctcctccacagtg

SEQ ID NO: 1446230 - DNA, 19 bp, Homo sapiens
ctcctccacagtgctgctt

SEQ ID NO: 1446231 - DNA, 20 bp, Homo sapiens
ctcctccacagtgctgcttc

SEQ ID NO: 1446232 - DNA, 14 bp, Homo sapiens
ctcctccacctcaa

SEQ ID NO: 1446233 - DNA, 15 bp, Homo sapiens
ctcctccacctcaac

SEQ ID NO: 1446234 - DNA, 16 bp, Homo sapiens
ctcctccagcccctgt

SEQ ID NO: 1446235 - DNA, 20 bp, Homo sapiens
ctcctccagggccacgtgcc

SEQ ID NO: 1446236 - DNA, 23 bp, Homo sapiens
ctcctccaggtcggagtgcctgg

SEQ ID NO: 1446237 - DNA, 16 bp, Homo sapiens
ctcctccatgcaggcc

SEQ ID NO: 1446238 - DNA, 22 bp, Homo sapiens
ctcctcccaggcgccccttccc

SEQ ID NO: 1446239 - DNA, 17 bp, Homo sapiens
ctcctcccagtgccttc

SEQ ID NO: 1446240 - DNA, 19 bp, Homo sapiens
ctcctcccagtgccttctg

SEQ ID NO: 1446241 - DNA, 22 bp, Homo sapiens
ctcctccccagctcttctcttc

SEQ ID NO: 1446242 - DNA, 16 bp, Homo sapiens
ctcctcccccggctgg

SEQ ID NO: 1446243 - DNA, 23 bp, Homo sapiens
ctcctccccgctccgtctctgtc

SEQ ID NO: 1446244 - DNA, 15 bp, Homo sapiens
ctcctccccttcctc

SEQ ID NO: 1446245 - DNA, 13 bp, Homo sapiens
ctcctcccgcccc

SEQ ID NO: 1446246 - DNA, 22 bp, Homo sapiens
ctcctccctaatgctcaccttt

SEQ ID NO: 1446247 - DNA, 17 bp, Homo sapiens
ctcctccctcctgggga

SEQ ID NO: 1446248 - DNA, 14 bp, Homo sapiens
ctcctccctgcccc

SEQ ID NO: 1446249 - DNA, 16 bp, Homo sapiens
ctcctccctgcccccc

SEQ ID NO: 1446250 - DNA, 13 bp, Homo sapiens
ctcctccctggct

SEQ ID NO: 1446251 - DNA, 14 bp, Homo sapiens
ctcctcccttcctt

SEQ ID NO: 1446252 - DNA, 22 bp, Homo sapiens
ctcctcccttccttttccctgc

SEQ ID NO: 1446253 - DNA, 15 bp, Homo sapiens
ctcctcctcccccag

SEQ ID NO: 1446254 - DNA, 15 bp, Homo sapiens
ctcctcgaacccact

SEQ ID NO: 1446255 - DNA, 19 bp, Homo sapiens
ctcctcggagagcagcagc

SEQ ID NO: 1446256 - DNA, 20 bp, Homo sapiens
ctcctcggagagcagcagca

SEQ ID NO: 1446257 - DNA, 15 bp, Homo sapiens
ctcctcgggccgagg

SEQ ID NO: 1446258 - DNA, 18 bp, Homo sapiens
ctcctctagctgtggggg

SEQ ID NO: 1446259 - DNA, 19 bp, Homo sapiens
ctcctctagctgtgggggt

SEQ ID NO: 1446260 - DNA, 18 bp, Homo sapiens
ctcctctcacctctccct

SEQ ID NO: 1446261 - DNA, 14 bp, Homo sapiens
ctcctctcagtgtt

SEQ ID NO: 1446262 - DNA, 20 bp, Homo sapiens
ctcctctccattttagccca

SEQ ID NO: 1446263 - DNA, 13 bp, Homo sapiens
ctcctctcccatc

SEQ ID NO: 1446264 - DNA, 14 bp, Homo sapiens
ctcctctccccagc

SEQ ID NO: 1446265 - DNA, 23 bp, Homo sapiens
ctcctctccccagcccagagaca

SEQ ID NO: 1446266 - DNA, 16 bp, Homo sapiens
ctcctctccttgggct

SEQ ID NO: 1446267 - DNA, 23 bp, Homo sapiens
ctcctctccttgggctcctggct

SEQ ID NO: 1446268 - DNA, 14 bp, Homo sapiens
ctcctctctgagac

SEQ ID NO: 1446269 - DNA, 13 bp, Homo sapiens
ctcctctgcactc

SEQ ID NO: 1446270 - DNA, 12 bp, Homo sapiens
ctcctctgccac

SEQ ID NO: 1446271 - DNA, 14 bp, Homo sapiens
ctcctctgtccagg

SEQ ID NO: 1446272 - DNA, 15 bp, Homo sapiens
ctcctctgtccaggg

SEQ ID NO: 1446273 - DNA, 16 bp, Homo sapiens
ctcctcttccatgctg

SEQ ID NO: 1446274 - DNA, 23 bp, Homo sapiens
ctcctcttcccttagcctctccc

SEQ ID NO: 1446275 - DNA, 19 bp, Homo sapiens
ctcctcttctgacgtgcct

SEQ ID NO: 1446276 - DNA, 17 bp, Homo sapiens
ctcctcttgattcctgg

SEQ ID NO: 1446277 - DNA, 18 bp, Homo sapiens
ctcctcttgattcctggt

SEQ ID NO: 1446278 - DNA, 15 bp, Homo sapiens
ctcctcttggagctg

SEQ ID NO: 1446279 - DNA, 21 bp, Homo sapiens
ctcctgaaccgcacagctcag

SEQ ID NO: 1446280 - DNA, 12 bp, Homo sapiens
ctcctgaataaa

SEQ ID NO: 1446281 - DNA, 21 bp, Homo sapiens
ctcctgaccataatcctagcc

SEQ ID NO: 1446282 - DNA, 15 bp, Homo sapiens
ctcctgacctcgtga

SEQ ID NO: 1446283 - DNA, 16 bp, Homo sapiens
ctcctgacctgtcacc

SEQ ID NO: 1446284 - DNA, 18 bp, Homo sapiens
ctcctgagaaggcgagga

SEQ ID NO: 1446285 - DNA, 11 bp, Homo sapiens
ctcctgagctc

SEQ ID NO: 1446286 - DNA, 19 bp, Homo sapiens
ctcctgagtagatgggact

SEQ ID NO: 1446287 - DNA, 17 bp, Homo sapiens
ctcctgagtagctggga

SEQ ID NO: 1446288 - DNA, 21 bp, Homo sapiens
ctcctgatagtcacctgctgg

SEQ ID NO: 1446289 - DNA, 13 bp, Homo sapiens
ctcctgatggcca

SEQ ID NO: 1446290 - DNA, 20 bp, Homo sapiens
ctcctgatggccaagagcat

SEQ ID NO: 1446291 - DNA, 18 bp, Homo sapiens
ctcctgatttctctgaac

SEQ ID NO: 1446292 - DNA, 14 bp, Homo sapiens
ctcctgcacacaga

SEQ ID NO: 1446293 - DNA, 22 bp, Homo sapiens
ctcctgcacttacttgcttatt

SEQ ID NO: 1446294 - DNA, 17 bp, Homo sapiens
ctcctgcaggctggctg

SEQ ID NO: 1446295 - DNA, 19 bp, Homo sapiens
ctcctgcaggctggctgtt

SEQ ID NO: 1446296 - DNA, 21 bp, Homo sapiens
ctcctgcaggctggctgttgg

SEQ ID NO: 1446297 - DNA, 18 bp, Homo sapiens
ctcctgccacatggagcc

SEQ ID NO: 1446298 - DNA, 18 bp, Homo sapiens
ctcctgccaccccttcct

SEQ ID NO: 1446299 - DNA, 19 bp, Homo sapiens
ctcctgccaccccttcctc

SEQ ID NO: 1446300 - DNA, 11 bp, Homo sapiens
ctcctgcccag

SEQ ID NO: 1446301 - DNA, 16 bp, Homo sapiens
ctcctgcccaggagag

SEQ ID NO: 1446302 - DNA, 20 bp, Homo sapiens
ctcctgcccaggagagccag

SEQ ID NO: 1446303 - DNA, 22 bp, Homo sapiens
ctcctgcccaggagagccagcc

SEQ ID NO: 1446304 - DNA, 20 bp, Homo sapiens
ctcctgcccaggagcagctt

SEQ ID NO: 1446305 - DNA, 11 bp, Homo sapiens
ctcctgcccca

SEQ ID NO: 1446306 - DNA, 17 bp, Homo sapiens
ttgctagttctgctgcc

SEQ ID NO: 1446307 - DNA, 15 bp, Homo sapiens
ttgctataatcatta

SEQ ID NO: 1446308 - DNA, 18 bp, Homo sapiens
ttgctataatcattagtt

SEQ ID NO: 1446309 - DNA, 21 bp, Homo sapiens
ttgctatctaatggggaaatg

SEQ ID NO: 1446310 - DNA, 14 bp, Homo sapiens
ttgctatctctatt

SEQ ID NO: 1446311 - DNA, 20 bp, Homo sapiens
ttgctatgagctggggatgt

SEQ ID NO: 1446312 - DNA, 18 bp, Homo sapiens
ttgctatgttactatttt

SEQ ID NO: 1446313 - DNA, 14 bp, Homo sapiens
ttgctattagagca

SEQ ID NO: 1446314 - DNA, 9 bp, Homo sapiens
ttgctattt

SEQ ID NO: 1446315 - DNA, 15 bp, Homo sapiens
ttgctattttatttg

SEQ ID NO: 1446316 - DNA, 18 bp, Homo sapiens
ttgctcaaaattgcttct

SEQ ID NO: 1446317 - DNA, 19 bp, Homo sapiens
ttgctcacagttattacat

SEQ ID NO: 1446318 - DNA, 22 bp, Homo sapiens
ttgctcagcccgcttggccacc

SEQ ID NO: 1446319 - DNA, 15 bp, Homo sapiens
ttgctcagtgtccag

SEQ ID NO: 1446320 - DNA, 20 bp, Homo sapiens
ttgctcagtgtccagcttcc

SEQ ID NO: 1446321 - DNA, 23 bp, Homo sapiens
ttgctcatgcatagtcccagcta

SEQ ID NO: 1446322 - DNA, 21 bp, Homo sapiens
ttgctcccggggactcaagag

SEQ ID NO: 1446323 - DNA, 18 bp, Homo sapiens
ttgctccttttgctcttt

SEQ ID NO: 1446324 - DNA, 15 bp, Homo sapiens
ttgctctaatgatca

SEQ ID NO: 1446325 - DNA, 15 bp, Homo sapiens
ttgctctatgtctgc

SEQ ID NO: 1446326 - DNA, 16 bp, Homo sapiens
ttgctctatgtctgcc

SEQ ID NO: 1446327 - DNA, 16 bp, Homo sapiens
ttgctctcctcatctc

SEQ ID NO: 1446328 - DNA, 15 bp, Homo sapiens
ttgctctggagcagc

SEQ ID NO: 1446329 - DNA, 19 bp, Homo sapiens
ttgctctggaggaagttct

SEQ ID NO: 1446330 - DNA, 15 bp, Homo sapiens
ttgctctgttcacag

SEQ ID NO: 1446331 - DNA, 24 bp, Homo sapiens
ttgctgaactcagcacattcggga

SEQ ID NO: 1446332 - DNA, 23 bp, Homo sapiens
ttgctgaaggctaaattcacagc

SEQ ID NO: 1446333 - DNA, 13 bp, Homo sapiens
ttgctgaattcat

SEQ ID NO: 1446334 - DNA, 19 bp, Homo sapiens
ttgctgaattcatctattt

SEQ ID NO: 1446335 - DNA, 14 bp, Homo sapiens
ttgctgaattctaa

SEQ ID NO: 1446336 - DNA, 14 bp, Homo sapiens
ttgctgaatttcag

SEQ ID NO: 1446337 - DNA, 15 bp, Homo sapiens
ttgctgagaagcaaa

SEQ ID NO: 1446338 - DNA, 15 bp, Homo sapiens
ttgctgagcctctgc

SEQ ID NO: 1446339 - DNA, 12 bp, Homo sapiens
ttgctgaggcac

SEQ ID NO: 1446340 - DNA, 15 bp, Homo sapiens
ttgctgagttgttct

SEQ ID NO: 1446341 - DNA, 21 bp, Homo sapiens
ttgctgcagagaaacttaagc

SEQ ID NO: 1446342 - DNA, 12 bp, Homo sapiens
ttgctgcagctt

SEQ ID NO: 1446343 - DNA, 15 bp, Homo sapiens
ttgctgcatatttga

SEQ ID NO: 1446344 - DNA, 18 bp, Homo sapiens
ttgctgccaaccatacct

SEQ ID NO: 1446345 - DNA, 21 bp, Homo sapiens
ttgctgccaaccataccttcc

SEQ ID NO: 1446346 - DNA, 20 bp, Homo sapiens
ttgctgccactttttaacta

SEQ ID NO: 1446347 - DNA, 23 bp, Homo sapiens
ttgctgccataattctaagttat

SEQ ID NO: 1446348 - DNA, 21 bp, Homo sapiens
ttgctgcctgaagaacagtaa

SEQ ID NO: 1446349 - DNA, 12 bp, Homo sapiens
ttgctgctctgc

SEQ ID NO: 1446350 - DNA, 12 bp, Homo sapiens
ttgctgctcttc

SEQ ID NO: 1446351 - DNA, 15 bp, Homo sapiens
ttgctgctgctacca

SEQ ID NO: 1446352 - DNA, 17 bp, Homo sapiens
ttgctgctgcttcctgt

SEQ ID NO: 1446353 - DNA, 15 bp, Homo sapiens
ttgctgcttggattt

SEQ ID NO: 1446354 - DNA, 21 bp, Homo sapiens
ttgctggattaatgttttgta

SEQ ID NO: 1446355 - DNA, 13 bp, Homo sapiens
ttgctggccccag

SEQ ID NO: 1446356 - DNA, 19 bp, Homo sapiens
ttgctggctctgagaatca

SEQ ID NO: 1446357 - DNA, 11 bp, Homo sapiens
ttgctggctgc

SEQ ID NO: 1446358 - DNA, 21 bp, Homo sapiens
ttgctgggagctgaaaaatca

SEQ ID NO: 1446359 - DNA, 23 bp, Homo sapiens
ttgctgggcatactttctctcta

SEQ ID NO: 1446360 - DNA, 17 bp, Homo sapiens
ttgctgtactcttgctg

SEQ ID NO: 1446361 - DNA, 18 bp, Homo sapiens
ttgctgtattgcccccat

SEQ ID NO: 1446362 - DNA, 12 bp, Homo sapiens
ttgctgtcactg

SEQ ID NO: 1446363 - DNA, 20 bp, Homo sapiens
ttgctgtcacttcttcacct

SEQ ID NO: 1446364 - DNA, 15 bp, Homo sapiens
ttgctgtccaggcag

SEQ ID NO: 1446365 - DNA, 16 bp, Homo sapiens
ttgctgtccaggcagc

SEQ ID NO: 1446366 - DNA, 15 bp, Homo sapiens
ttgctgtcctaggcc

SEQ ID NO: 1446367 - DNA, 23 bp, Homo sapiens
ttgctgtctacagtagctgctac

SEQ ID NO: 1446368 - DNA, 15 bp, Homo sapiens
ttgctgtctttctct

SEQ ID NO: 1446369 - DNA, 20 bp, Homo sapiens
ttgctgtgagcaagaagtca

SEQ ID NO: 1446370 - DNA, 14 bp, Homo sapiens
ttgctgtgaggctg

SEQ ID NO: 1446371 - DNA, 14 bp, Homo sapiens
ttgctgtgcctccc

SEQ ID NO: 1446372 - DNA, 19 bp, Homo sapiens
ttgctgtgcctcccaaaat

SEQ ID NO: 1446373 - DNA, 20 bp, Homo sapiens
ttgctgtgtgaccctgggca

SEQ ID NO: 1446374 - DNA, 16 bp, Homo sapiens
ttgctgttttgttctg

SEQ ID NO: 1446375 - DNA, 23 bp, Homo sapiens
ttgcttaaatttcttatgtgaca

SEQ ID NO: 1446376 - DNA, 13 bp, Homo sapiens
ttgcttacatttt

SEQ ID NO: 1446377 - DNA, 14 bp, Homo sapiens
ttgcttacctctca

SEQ ID NO: 1446378 - DNA, 20 bp, Homo sapiens
ttgcttaggatgtgtgcatg

SEQ ID NO: 1446379 - DNA, 13 bp, Homo sapiens
ttgcttatgacat

SEQ ID NO: 1446380 - DNA, 15 bp, Homo sapiens
ttgcttcataaatga

SEQ ID NO: 1446381 - DNA, 14 bp, Homo sapiens
ttgcttcctcctcc

SEQ ID NO: 1446382 - DNA, 11 bp, Homo sapiens
ttgcttcctga

SEQ ID NO: 1446383 - DNA, 20 bp, Homo sapiens
ttgcttctaaaacaataaag

SEQ ID NO: 1446384 - DNA, 12 bp, Homo sapiens
ttgcttctgtag

SEQ ID NO: 1446385 - DNA, 21 bp, Homo sapiens
ttgcttctgtagtactcctta

SEQ ID NO: 1446386 - DNA, 20 bp, Homo sapiens
ttgcttctttctagaaagag

SEQ ID NO: 1446387 - DNA, 15 bp, Homo sapiens
ttgcttgactctact

SEQ ID NO: 1446388 - DNA, 16 bp, Homo sapiens
ttgcttgcctgatata

SEQ ID NO: 1446389 - DNA, 16 bp, Homo sapiens
ttgcttgcctgcaggg

SEQ ID NO: 1446390 - DNA, 17 bp, Homo sapiens
ttgcttgtactgggaca

SEQ ID NO: 1446391 - DNA, 21 bp, Homo sapiens
ttgcttgttatattaagcaga

SEQ ID NO: 1446392 - DNA, 22 bp, Homo sapiens
ttgctttactgtcaaaataatt

SEQ ID NO: 1446393 - DNA, 14 bp, Homo sapiens
ttgctttctgaaat

SEQ ID NO: 1446394 - DNA, 14 bp, Homo sapiens
ttgctttgccagag

SEQ ID NO: 1446395 - DNA, 16 bp, Homo sapiens
ttgctttgccagagca

SEQ ID NO: 1446396 - DNA, 20 bp, Homo sapiens
ttgctttgggctttgcaggc

SEQ ID NO: 1446397 - DNA, 16 bp, Homo sapiens
ttgcttttcatgtaga

SEQ ID NO: 1446398 - DNA, 18 bp, Homo sapiens
ttgcttttgaaaagttga

SEQ ID NO: 1446399 - DNA, 14 bp, Homo sapiens
ttgcttttgagaga

SEQ ID NO: 1446400 - DNA, 19 bp, Homo sapiens
ttgctttttcacagtcact

SEQ ID NO: 1446401 - DNA, 15 bp, Homo sapiens
ttgcttttttccaaa

SEQ ID NO: 1446402 - DNA, 17 bp, Homo sapiens
ttggaaaaaactctgaa

SEQ ID NO: 1446403 - DNA, 13 bp, Homo sapiens
ttggaaacaaatc

SEQ ID NO: 1446404 - DNA, 15 bp, Homo sapiens
ttggaaacctgccct

SEQ ID NO: 1446405 - DNA, 21 bp, Homo sapiens
ttggaaacctgccctgcctga

SEQ ID NO: 1446406 - DNA, 18 bp, Homo sapiens
ttggaaagagaccagcac

SEQ ID NO: 1446407 - DNA, 20 bp, Homo sapiens
ttggaaagcatcacctcagg

SEQ ID NO: 1446408 - DNA, 22 bp, Homo sapiens
ttggaaagcatcacctcaggcc

SEQ ID NO: 1446409 - DNA, 13 bp, Homo sapiens
ttggaaaggaaaa

SEQ ID NO: 1446410 - DNA, 16 bp, Homo sapiens
ttggaaaggaccaaat

SEQ ID NO: 1446411 - DNA, 16 bp, Homo sapiens
ttggaaagttactgta

SEQ ID NO: 1446412 - DNA, 18 bp, Homo sapiens
ttggaaagttactgtaaa

SEQ ID NO: 1446413 - DNA, 20 bp, Homo sapiens
ttggaaagttactgtaaatg

SEQ ID NO: 1446414 - DNA, 21 bp, Homo sapiens
ttggaaataaagtcagatgga

SEQ ID NO: 1446415 - DNA, 22 bp, Homo sapiens
ttggaaatcagttgtgaataca

SEQ ID NO: 1446416 - DNA, 18 bp, Homo sapiens
ttggaaattcctgtactg

SEQ ID NO: 1446417 - DNA, 15 bp, Homo sapiens
ttggaacaacatgtt

SEQ ID NO: 1446418 - DNA, 18 bp, Homo sapiens
ttggaacaccctggatgc

SEQ ID NO: 1446419 - DNA, 13 bp, Homo sapiens
ttggaacatttct

SEQ ID NO: 1446420 - DNA, 14 bp, Homo sapiens
ttggaaccagactc

SEQ ID NO: 1446421 - DNA, 21 bp, Homo sapiens
ttggaaccgtgtccagcacag

SEQ ID NO: 1446422 - DNA, 14 bp, Homo sapiens
ttggaaccttgttt

SEQ ID NO: 1446423 - DNA, 19 bp, Homo sapiens
ctcctgccctctgctctgc

SEQ ID NO: 1446424 - DNA, 20 bp, Homo sapiens
ctcctgccctctgctctgcc

SEQ ID NO: 1446425 - DNA, 24 bp, Homo sapiens
ctcctgccctctgctctgcctgga

SEQ ID NO: 1446426 - DNA, 15 bp, Homo sapiens
ctcctgccctgtgat

SEQ ID NO: 1446427 - DNA, 21 bp, Homo sapiens
ctcctgccgcagacgggcaca

SEQ ID NO: 1446428 - DNA, 23 bp, Homo sapiens
ctcctgccgcagacgggcacaga

SEQ ID NO: 1446429 - DNA, 16 bp, Homo sapiens
ctcctgccgcagagct

SEQ ID NO: 1446430 - DNA, 17 bp, Homo sapiens
ctcctgcctcagcctcc

SEQ ID NO: 1446431 - DNA, 21 bp, Homo sapiens
ctcctgcctcagcctcctgag

SEQ ID NO: 1446432 - DNA, 22 bp, Homo sapiens
ctcctgcctgagtttccagcct

SEQ ID NO: 1446433 - DNA, 23 bp, Homo sapiens
ctcctgcctttaggccatgggtg

SEQ ID NO: 1446434 - DNA, 16 bp, Homo sapiens
ctcctgctacttcccc

SEQ ID NO: 1446435 - DNA, 11 bp, Homo sapiens
ctcctgctcct

SEQ ID NO: 1446436 - DNA, 13 bp, Homo sapiens
ctcctgctcctcc

SEQ ID NO: 1446437 - DNA, 20 bp, Homo sapiens
ctcctgctcctccctgcccc

SEQ ID NO: 1446438 - DNA, 13 bp, Homo sapiens
ctcctgctctggg

SEQ ID NO: 1446439 - DNA, 17 bp, Homo sapiens
ctcctgctgcacaggcc

SEQ ID NO: 1446440 - DNA, 19 bp, Homo sapiens
ctcctttgtttaataaagg

SEQ ID NO: 1446441 - DNA, 20 bp, Homo sapiens
ctccttttcactttattgct

SEQ ID NO: 1446442 - DNA, 13 bp, Homo sapiens
ctccttttctctt

SEQ ID NO: 1446443 - DNA, 23 bp, Homo sapiens
ctccttttctctttgggtttctt

SEQ ID NO: 1446444 - DNA, 15 bp, Homo sapiens
ctccttttgctgtct

SEQ ID NO: 1446445 - DNA, 18 bp, Homo sapiens
ctccttttgctgtctttc

SEQ ID NO: 1446446 - DNA, 15 bp, Homo sapiens
ctccttttgtcccca

SEQ ID NO: 1446447 - DNA, 20 bp, Homo sapiens
ctccttttgtccccagggcc

SEQ ID NO: 1446448 - DNA, 21 bp, Homo sapiens
ctccttttgtccccagggccc

SEQ ID NO: 1446449 - DNA, 14 bp, Homo sapiens
ctcgaacccactcc

SEQ ID NO: 1446450 - DNA, 17 bp, Homo sapiens
ctcgaacccactccggt

SEQ ID NO: 1446451 - DNA, 20 bp, Homo sapiens
ctcgaactattttcaaagac

SEQ ID NO: 1446452 - DNA, 19 bp, Homo sapiens
ctcgaactcctggcctcaa

SEQ ID NO: 1446453 - DNA, 19 bp, Homo sapiens
ctcgaataaaatctgctgc

SEQ ID NO: 1446454 - DNA, 16 bp, Homo sapiens
ctcgaatctctgtgcc

SEQ ID NO: 1446455 - DNA, 18 bp, Homo sapiens
ctcgaatgtaattggaat

SEQ ID NO: 1446456 - DNA, 19 bp, Homo sapiens
ctcgacagggcctggagcc

SEQ ID NO: 1446457 - DNA, 19 bp, Homo sapiens
ctcgacccagaatggagcc

SEQ ID NO: 1446458 - DNA, 20 bp, Homo sapiens
ctcgacggcacgcacttgcc

SEQ ID NO: 1446459 - DNA, 22 bp, Homo sapiens
ctcgactgtcagtggggcagcc

SEQ ID NO: 1446460 - DNA, 14 bp, Homo sapiens
ctcgagaccatcct

SEQ ID NO: 1446461 - DNA, 20 bp, Homo sapiens
ctcgagaccatcctggcccc

SEQ ID NO: 1446462 - DNA, 12 bp, Homo sapiens
ctcgagtgaatt

SEQ ID NO: 1446463 - DNA, 21 bp, Homo sapiens
ctcgatcaaaaccttccttcc

SEQ ID NO: 1446464 - DNA, 22 bp, Homo sapiens
ctcgatcatatttccccttgga

SEQ ID NO: 1446465 - DNA, 14 bp, Homo sapiens
ctcgatctcctgac

SEQ ID NO: 1446466 - DNA, 16 bp, Homo sapiens
ctcgatgcctgattcg

SEQ ID NO: 1446467 - DNA, 21 bp, Homo sapiens
ctcgcatttgtcaatgacagt

SEQ ID NO: 1446468 - DNA, 19 bp, Homo sapiens
ctcgccacccctccttcct

SEQ ID NO: 1446469 - DNA, 12 bp, Homo sapiens
ctcgccatgccg

SEQ ID NO: 1446470 - DNA, 16 bp, Homo sapiens
ctcgcccagacaccat

SEQ ID NO: 1446471 - DNA, 19 bp, Homo sapiens
ctcgcccctgttttttgta

SEQ ID NO: 1446472 - DNA, 15 bp, Homo sapiens
ctcgcccgcccactg

SEQ ID NO: 1446473 - DNA, 14 bp, Homo sapiens
ctcgccctgtgagg

SEQ ID NO: 1446474 - DNA, 22 bp, Homo sapiens
ctcgccgtgtctcagcctctgc

SEQ ID NO: 1446475 - DNA, 14 bp, Homo sapiens
ctcgcgggcagcgg

SEQ ID NO: 1446476 - DNA, 21 bp, Homo sapiens
ctcgcgggcagcgggccaggc

SEQ ID NO: 1446477 - DNA, 23 bp, Homo sapiens
ctcgcgggcagcgggccaggccc

SEQ ID NO: 1446478 - DNA, 13 bp, Homo sapiens
ctcgctcaggtga

SEQ ID NO: 1446479 - DNA, 21 bp, Homo sapiens
ctcgctccctgtagctctgcc

SEQ ID NO: 1446480 - DNA, 22 bp, Homo sapiens
ctcgctccctgtagctctgcct

SEQ ID NO: 1446481 - DNA, 14 bp, Homo sapiens
ctcgctcccttcaa

SEQ ID NO: 1446482 - DNA, 17 bp, Homo sapiens
ctcgctctcgctctctc

SEQ ID NO: 1446483 - DNA, 13 bp, Homo sapiens
ctcgctctctctc

SEQ ID NO: 1446484 - DNA, 22 bp, Homo sapiens
ctcgctctctctcgctgcgtcc

SEQ ID NO: 1446485 - DNA, 19 bp, Homo sapiens
ctcgctgccctgtggacag

SEQ ID NO: 1446486 - DNA, 12 bp, Homo sapiens
ctcgctgctgct

SEQ ID NO: 1446487 - DNA, 15 bp, Homo sapiens
ctcgctgctgctact

SEQ ID NO: 1446488 - DNA, 18 bp, Homo sapiens
ctcgctggctttctctct

SEQ ID NO: 1446489 - DNA, 20 bp, Homo sapiens
ctcggaaggctggctgggca

SEQ ID NO: 1446490 - DNA, 16 bp, Homo sapiens
ctcggacccaccccaa

SEQ ID NO: 1446491 - DNA, 15 bp, Homo sapiens
ctcggactccatggc

SEQ ID NO: 1446492 - DNA, 12 bp, Homo sapiens
ctcggagaagag

SEQ ID NO: 1446493 - DNA, 14 bp, Homo sapiens
ctcggagcaccctt

SEQ ID NO: 1446494 - DNA, 16 bp, Homo sapiens
ctcggagcctcatccg

SEQ ID NO: 1446495 - DNA, 18 bp, Homo sapiens
ctcggaggtccagctggg

SEQ ID NO: 1446496 - DNA, 23 bp, Homo sapiens
ctcggaggtccagctgggcctcc

SEQ ID NO: 1446497 - DNA, 23 bp, Homo sapiens
ctcggatgaccaaaccagccttc

SEQ ID NO: 1446498 - DNA, 16 bp, Homo sapiens
ctcggccaggcattgg

SEQ ID NO: 1446499 - DNA, 17 bp, Homo sapiens
ctcggccccctccatcg

SEQ ID NO: 1446500 - DNA, 13 bp, Homo sapiens
ctcggctctggag

SEQ ID NO: 1446501 - DNA, 21 bp, Homo sapiens
ctcggcttggatcctgggctg

SEQ ID NO: 1446502 - DNA, 15 bp, Homo sapiens
ctcgggaagcagcca

SEQ ID NO: 1446503 - DNA, 17 bp, Homo sapiens
ctcgggcccacctggcc

SEQ ID NO: 1446504 - DNA, 18 bp, Homo sapiens
ctcgggcccacctggcca

SEQ ID NO: 1446505 - DNA, 14 bp, Homo sapiens
ctcgggccgtaggg

SEQ ID NO: 1446506 - DNA, 23 bp, Homo sapiens
ctcgggccgtaggggctcctgag

SEQ ID NO: 1446507 - DNA, 21 bp, Homo sapiens
ctcgggcgagtcactgcctct

SEQ ID NO: 1446508 - DNA, 18 bp, Homo sapiens
ctcgggctggagcctccg

SEQ ID NO: 1446509 - DNA, 18 bp, Homo sapiens
ctcgggcttgagtgagaa

SEQ ID NO: 1446510 - DNA, 18 bp, Homo sapiens
ctcggggacaccagagct

SEQ ID NO: 1446511 - DNA, 13 bp, Homo sapiens
ctcggggagcctt

SEQ ID NO: 1446512 - DNA, 14 bp, Homo sapiens
ctcggggagcctta

SEQ ID NO: 1446513 - DNA, 20 bp, Homo sapiens
ctcggggcccttggggcctg

SEQ ID NO: 1446514 - DNA, 14 bp, Homo sapiens
ctcgggggcctgtg

SEQ ID NO: 1446515 - DNA, 16 bp, Homo sapiens
ctcgggggcctgtggt

SEQ ID NO: 1446516 - DNA, 17 bp, Homo sapiens
ctcggggtaaaaagtgg

SEQ ID NO: 1446517 - DNA, 21 bp, Homo sapiens
ctcgggtgcgtgtgtttgtat

SEQ ID NO: 1446518 - DNA, 14 bp, Homo sapiens
ctcggtatctggct

SEQ ID NO: 1446519 - DNA, 13 bp, Homo sapiens
ctcggtgctccat

SEQ ID NO: 1446520 - DNA, 19 bp, Homo sapiens
ctcggtgggccagagctga

SEQ ID NO: 1446521 - DNA, 16 bp, Homo sapiens
ctcggtttgccaaaat

SEQ ID NO: 1446522 - DNA, 17 bp, Homo sapiens
ctcgtaatagcttctgt

SEQ ID NO: 1446523 - DNA, 14 bp, Homo sapiens
ctcgtagccatctc

SEQ ID NO: 1446524 - DNA, 18 bp, Homo sapiens
ctcgtcaagagcatgcac

SEQ ID NO: 1446525 - DNA, 19 bp, Homo sapiens
ctcgtccaagggacagccc

SEQ ID NO: 1446526 - DNA, 17 bp, Homo sapiens
ctcgtccacaggggcag

SEQ ID NO: 1446527 - DNA, 15 bp, Homo sapiens
ctcgtccgtctgtct

SEQ ID NO: 1446528 - DNA, 12 bp, Homo sapiens
ctcgtcctcccc

SEQ ID NO: 1446529 - DNA, 16 bp, Homo sapiens
ctcgtcctccccctgc

SEQ ID NO: 1446530 - DNA, 17 bp, Homo sapiens
ctcgtcctccccctgcc

SEQ ID NO: 1446531 - DNA, 18 bp, Homo sapiens
ctcgtcctccccctgcca

SEQ ID NO: 1446532 - DNA, 14 bp, Homo sapiens
ctcgtcctgtccca

SEQ ID NO: 1446533 - DNA, 16 bp, Homo sapiens
ctcgtcttcagctgca

SEQ ID NO: 1446534 - DNA, 17 bp, Homo sapiens
ctcgtcttcagctgcat

SEQ ID NO: 1446535 - DNA, 18 bp, Homo sapiens
ctcgtcttcagctgcatt

SEQ ID NO: 1446536 - DNA, 13 bp, Homo sapiens
ctcgtctttactt

SEQ ID NO: 1446537 - DNA, 14 bp, Homo sapiens
ctcgtgaggggcaa

SEQ ID NO: 1446538 - DNA, 20 bp, Homo sapiens
ctcgtgcattaaaatttctt

SEQ ID NO: 1446539 - DNA, 15 bp, Homo sapiens
ctcgtgccagcagcc

SEQ ID NO: 1446540 - DNA, 17 bp, Homo sapiens
ctcgtgccagcagcctc

SEQ ID NO: 1446541 - DNA, 22 bp, Homo sapiens
ctcgtgccagcagcctcgcaca

SEQ ID NO: 1446542 - DNA, 21 bp, Homo sapiens
ctcgtggactgtgctggtgca

SEQ ID NO: 1446543 - DNA, 16 bp, Homo sapiens
ctcgtggccagcccgg

SEQ ID NO: 1446544 - DNA, 19 bp, Homo sapiens
ttggctgaaattctcctgg

SEQ ID NO: 1446545 - DNA, 20 bp, Homo sapiens
ttggctgaaattctcctgga

SEQ ID NO: 1446546 - DNA, 22 bp, Homo sapiens
ttggctgacccctctggtgtgt

SEQ ID NO: 1446547 - DNA, 14 bp, Homo sapiens
ttggctgcaggtgt

SEQ ID NO: 1446548 - DNA, 22 bp, Homo sapiens
ttggctgcaggtgttctgctga

SEQ ID NO: 1446549 - DNA, 17 bp, Homo sapiens
ttggctgcatttgcctg

SEQ ID NO: 1446550 - DNA, 16 bp, Homo sapiens
ttggctgctcttccag

SEQ ID NO: 1446551 - DNA, 21 bp, Homo sapiens
ttggctgctgcggctgtgggc

SEQ ID NO: 1446552 - DNA, 19 bp, Homo sapiens
ttggctggttaatgggaaa

SEQ ID NO: 1446553 - DNA, 21 bp, Homo sapiens
ttggctgtctgaccagagaat

SEQ ID NO: 1446554 - DNA, 23 bp, Homo sapiens
ttggctgttaagaagtttgttat

SEQ ID NO: 1446555 - DNA, 14 bp, Homo sapiens
ctcgtgtgatttcc

SEQ ID NO: 1446556 - DNA, 18 bp, Homo sapiens
ctcgttaattttcctttg

SEQ ID NO: 1446557 - DNA, 18 bp, Homo sapiens
ctcgttggaagaggaaca

SEQ ID NO: 1446558 - DNA, 13 bp, Homo sapiens
ctctaaaagatcc

SEQ ID NO: 1446559 - DNA, 19 bp, Homo sapiens
ctctaaaatatttatgaag

SEQ ID NO: 1446560 - DNA, 17 bp, Homo sapiens
ctctaaaattataaatg

SEQ ID NO: 1446561 - DNA, 19 bp, Homo sapiens
ctctaaactggcatctgct

SEQ ID NO: 1446562 - DNA, 23 bp, Homo sapiens
ctctaaagaaaaatgcctgtctc

SEQ ID NO: 1446563 - DNA, 13 bp, Homo sapiens
ctctaacatttcc

SEQ ID NO: 1446564 - DNA, 13 bp, Homo sapiens
ctctaacccagtg

SEQ ID NO: 1446565 - DNA, 20 bp, Homo sapiens
ctctaagctggagctcttgg

SEQ ID NO: 1446566 - DNA, 18 bp, Homo sapiens
ctctaataaacactgttt

SEQ ID NO: 1446567 - DNA, 13 bp, Homo sapiens
ctctaatctggat

SEQ ID NO: 1446568 - DNA, 16 bp, Homo sapiens
ctctaatgttgtatca

SEQ ID NO: 1446569 - DNA, 17 bp, Homo sapiens
ctctaattcacagtgct

SEQ ID NO: 1446570 - DNA, 18 bp, Homo sapiens
ctctaattctattaaagt

SEQ ID NO: 1446571 - DNA, 22 bp, Homo sapiens
ctctacaaaaagtaaaaattaa

SEQ ID NO: 1446572 - DNA, 16 bp, Homo sapiens
ctctacaaactcccac

SEQ ID NO: 1446573 - DNA, 14 bp, Homo sapiens
ctctacatttgcag

SEQ ID NO: 1446574 - DNA, 16 bp, Homo sapiens
ctctacccatattaca

SEQ ID NO: 1446575 - DNA, 14 bp, Homo sapiens
ctctaccctcccac

SEQ ID NO: 1446576 - DNA, 13 bp, Homo sapiens
ctctaccctggca

SEQ ID NO: 1446577 - DNA, 12 bp, Homo sapiens
ctctaccctgtc

SEQ ID NO: 1446578 - DNA, 19 bp, Homo sapiens
ctctaccctgtctgtccct

SEQ ID NO: 1446579 - DNA, 12 bp, Homo sapiens
ctctacctccac

SEQ ID NO: 1446580 - DNA, 19 bp, Homo sapiens
ctctactaaaaatacagaa

SEQ ID NO: 1446581 - DNA, 20 bp, Homo sapiens
ctctactaatgcctcttcat

SEQ ID NO: 1446582 - DNA, 20 bp, Homo sapiens
ctctactaccacaaggaaaa

SEQ ID NO: 1446583 - DNA, 19 bp, Homo sapiens
ctctactcctacctcagcc

SEQ ID NO: 1446584 - DNA, 13 bp, Homo sapiens
ctctactgccctc

SEQ ID NO: 1446585 - DNA, 14 bp, Homo sapiens
ctctactgccctcc

SEQ ID NO: 1446586 - DNA, 21 bp, Homo sapiens
ctctactgccctccccttccc

SEQ ID NO: 1446587 - DNA, 18 bp, Homo sapiens
ctctacttaatccaatgg

SEQ ID NO: 1446588 - DNA, 17 bp, Homo sapiens
ctctacttagcatgtcc

SEQ ID NO: 1446589 - DNA, 18 bp, Homo sapiens
ctctagaagccaagggaa

SEQ ID NO: 1446590 - DNA, 16 bp, Homo sapiens
ctctagacactgccac

SEQ ID NO: 1446591 - DNA, 21 bp, Homo sapiens
ctctagagtagaggtataatt

SEQ ID NO: 1446592 - DNA, 15 bp, Homo sapiens
ctctagattcataaa

SEQ ID NO: 1446593 - DNA, 15 bp, Homo sapiens
ctctagatttattag

SEQ ID NO: 1446594 - DNA, 13 bp, Homo sapiens
ctctagcaggcct

SEQ ID NO: 1446595 - DNA, 17 bp, Homo sapiens
ctctagccaggagtctg

SEQ ID NO: 1446596 - DNA, 22 bp, Homo sapiens
ctctagccaggagtctgtgctc

SEQ ID NO: 1446597 - DNA, 23 bp, Homo sapiens
ctctagcccactccctgcctaca

SEQ ID NO: 1446598 - DNA, 15 bp, Homo sapiens
ctctagcctgggcca

SEQ ID NO: 1446599 - DNA, 21 bp, Homo sapiens
ctctagcctgggccagagaag

SEQ ID NO: 1446600 - DNA, 14 bp, Homo sapiens
ctctagctggcagg

SEQ ID NO: 1446601 - DNA, 19 bp, Homo sapiens
ctctagctggcaggacaca

SEQ ID NO: 1446602 - DNA, 16 bp, Homo sapiens
ctctagctgtgggggt

SEQ ID NO: 1446603 - DNA, 17 bp, Homo sapiens
ctctaggcctctccagt

SEQ ID NO: 1446604 - DNA, 12 bp, Homo sapiens
ctctagggtcca

SEQ ID NO: 1446605 - DNA, 23 bp, Homo sapiens
ctctaggtacgatgacagtgttc

SEQ ID NO: 1446606 - DNA, 21 bp, Homo sapiens
ctctagtccccaaggcctctc

SEQ ID NO: 1446607 - DNA, 16 bp, Homo sapiens
ctctagtgggacagcc

SEQ ID NO: 1446608 - DNA, 14 bp, Homo sapiens
ctctagttctagat

SEQ ID NO: 1446609 - DNA, 15 bp, Homo sapiens
ctctagttctttgtt

SEQ ID NO: 1446610 - DNA, 15 bp, Homo sapiens
ctctataccaataaa

SEQ ID NO: 1446611 - DNA, 13 bp, Homo sapiens
ctctatacctgtg

SEQ ID NO: 1446612 - DNA, 22 bp, Homo sapiens
ctctatacttctcctttggaca

SEQ ID NO: 1446613 - DNA, 12 bp, Homo sapiens
ctctatactttg

SEQ ID NO: 1446614 - DNA, 20 bp, Homo sapiens
ctctatactttgttctgttg

SEQ ID NO: 1446615 - DNA, 19 bp, Homo sapiens
ctctatatgtagtgcattt

SEQ ID NO: 1446616 - DNA, 21 bp, Homo sapiens
ctctatattatgtcttctttt

SEQ ID NO: 1446617 - DNA, 22 bp, Homo sapiens
ctctatattatgtcttcttttg

SEQ ID NO: 1446618 - DNA, 12 bp, Homo sapiens
ctctatcttttc

SEQ ID NO: 1446619 - DNA, 21 bp, Homo sapiens
ctctatgacatgaaatgaaaa

SEQ ID NO: 1446620 - DNA, 13 bp, Homo sapiens
ctctatgagtcta

SEQ ID NO: 1446621 - DNA, 14 bp, Homo sapiens
ctctatgagtctag

SEQ ID NO: 1446622 - DNA, 17 bp, Homo sapiens
ctctatgagtctagatg

SEQ ID NO: 1446623 - DNA, 19 bp, Homo sapiens
ctctatgagtctagatgtt

SEQ ID NO: 1446624 - DNA, 15 bp, Homo sapiens
ctctatgtctgcctt

SEQ ID NO: 1446625 - DNA, 14 bp, Homo sapiens
ctctattaaaatgc

SEQ ID NO: 1446626 - DNA, 23 bp, Homo sapiens
ctctattagactttagaaataaa

SEQ ID NO: 1446627 - DNA, 16 bp, Homo sapiens
ctctatttattagcca

SEQ ID NO: 1446628 - DNA, 21 bp, Homo sapiens
ctctatttcctgaacctggaa

SEQ ID NO: 1446629 - DNA, 17 bp, Homo sapiens
ctctatttgagaagttc

SEQ ID NO: 1446630 - DNA, 22 bp, Homo sapiens
ctctatttgagaagttctcaga

SEQ ID NO: 1446631 - DNA, 23 bp, Homo sapiens
ctctatttgagaagttctcagaa

SEQ ID NO: 1446632 - DNA, 14 bp, Homo sapiens
ctctatttgagaat

SEQ ID NO: 1446633 - DNA, 13 bp, Homo sapiens
ctctattttaatt

SEQ ID NO: 1446634 - DNA, 12 bp, Homo sapiens
ctctcaaaacaa

SEQ ID NO: 1446635 - DNA, 21 bp, Homo sapiens
ctctcaaaacaatattacttt

SEQ ID NO: 1446636 - DNA, 16 bp, Homo sapiens
ctctcaaatccctctc

SEQ ID NO: 1446637 - DNA, 18 bp, Homo sapiens
ctctcaaatccctctcca

SEQ ID NO: 1446638 - DNA, 17 bp, Homo sapiens
ctctcaagaccagagac

SEQ ID NO: 1446639 - DNA, 16 bp, Homo sapiens
ctctcaagtagctggg

SEQ ID NO: 1446640 - DNA, 18 bp, Homo sapiens
ctctcaagtgatgagaca

SEQ ID NO: 1446641 - DNA, 14 bp, Homo sapiens
ctctcacacacata

SEQ ID NO: 1446642 - DNA, 21 bp, Homo sapiens
ctctcacacacatagattaat

SEQ ID NO: 1446643 - DNA, 23 bp, Homo sapiens
ctctcaccatttggatcctgtgt

SEQ ID NO: 1446644 - DNA, 13 bp, Homo sapiens
ctctcacctcagc

SEQ ID NO: 1446645 - DNA, 15 bp, Homo sapiens
ctctcacctctccct

SEQ ID NO: 1446646 - DNA, 14 bp, Homo sapiens
ctctcacctggccc

SEQ ID NO: 1446647 - DNA, 21 bp, Homo sapiens
ctctcactgtgttactgcttt

SEQ ID NO: 1446648 - DNA, 12 bp, Homo sapiens
ctctcagaacat

SEQ ID NO: 1446649 - DNA, 14 bp, Homo sapiens
ctctcagcaagtgc

SEQ ID NO: 1446650 - DNA, 22 bp, Homo sapiens
ctctcagcaagtgcccagtgga

SEQ ID NO: 1446651 - DNA, 15 bp, Homo sapiens
ctctcagcatagcct

SEQ ID NO: 1446652 - DNA, 15 bp, Homo sapiens
ctctcagctccaggt

SEQ ID NO: 1446653 - DNA, 15 bp, Homo sapiens
ctctcagctcccagg

SEQ ID NO: 1446654 - DNA, 17 bp, Homo sapiens
ctctcagctcccaggcc

SEQ ID NO: 1446655 - DNA, 18 bp, Homo sapiens
ctctcagctcccaggcca

SEQ ID NO: 1446656 - DNA, 14 bp, Homo sapiens
ctctcagctggcag

SEQ ID NO: 1446657 - DNA, 17 bp, Homo sapiens
ctctcaggagcacaggc

SEQ ID NO: 1446658 - DNA, 20 bp, Homo sapiens
ctctcaggagcacaggcagc

SEQ ID NO: 1446659 - DNA, 18 bp, Homo sapiens
ctctcagtgttttggact

SEQ ID NO: 1446660 - DNA, 16 bp, Homo sapiens
ctctcagttctctccc

SEQ ID NO: 1446661 - DNA, 22 bp, Homo sapiens
ctctcatcggaggcccatgccc

SEQ ID NO: 1446662 - DNA, 17 bp, Homo sapiens
ctctcatctcttagctc

SEQ ID NO: 1446663 - DNA, 15 bp, Homo sapiens
ctctccaaaaatgca

SEQ ID NO: 1446664 - DNA, 21 bp, Homo sapiens
ctctccaaaggcggggtggcg

SEQ ID NO: 1446665 - DNA, 21 bp, Homo sapiens
ctctccaaatattattcaagt

SEQ ID NO: 1446666 - DNA, 19 bp, Homo sapiens
ctctccaaccactgtgcca

SEQ ID NO: 1446667 - DNA, 20 bp, Homo sapiens
ctctccaaccactgtgccac

SEQ ID NO: 1446668 - DNA, 15 bp, Homo sapiens
ttgtatatttgtaca

SEQ ID NO: 1446669 - DNA, 17 bp, Homo sapiens
ttgtatatttgtacaaa

SEQ ID NO: 1446670 - DNA, 24 bp, Homo sapiens
ctctctccagggtgcttagttggc

SEQ ID NO: 1446671 - DNA, 12 bp, Homo sapiens
ctctctccaggt

SEQ ID NO: 1446672 - DNA, 23 bp, Homo sapiens
ttgtgatcagaccataatgttac

SEQ ID NO: 1446673 - DNA, 16 bp, Homo sapiens
ttgtgattctgtttat

SEQ ID NO: 1446674 - DNA, 16 bp, Homo sapiens
ttgtgattggcctgta

SEQ ID NO: 1446675 - DNA, 16 bp, Homo sapiens
ttgtgatttttataat

SEQ ID NO: 1446676 - DNA, 15 bp, Homo sapiens
ttgtgcaaacatgga

SEQ ID NO: 1446677 - DNA, 21 bp, Homo sapiens
ttgtgcaaacatggagaaatc

SEQ ID NO: 1446678 - DNA, 23 bp, Homo sapiens
ttgtgcaaacatggagaaatcta

SEQ ID NO: 1446679 - DNA, 17 bp, Homo sapiens
ttgtgcagtaacttggg

SEQ ID NO: 1446680 - DNA, 21 bp, Homo sapiens
ttgtgccagaggaatcctggc

SEQ ID NO: 1446681 - DNA, 13 bp, Homo sapiens
ttgtgccatctgt

SEQ ID NO: 1446682 - DNA, 18 bp, Homo sapiens
ttgtgcccacccagggaa

SEQ ID NO: 1446683 - DNA, 20 bp, Homo sapiens
ttgtgcccagggttttgccc

SEQ ID NO: 1446684 - DNA, 16 bp, Homo sapiens
ttgtgccccttcactc

SEQ ID NO: 1446685 - DNA, 22 bp, Homo sapiens
ttgtgccctgcccccatctccc

SEQ ID NO: 1446686 - DNA, 12 bp, Homo sapiens
ttgtgccttccc

SEQ ID NO: 1446687 - DNA, 18 bp, Homo sapiens
ttgtgccttcccttctct

SEQ ID NO: 1446688 - DNA, 21 bp, Homo sapiens
ttgtgctcctcttgattcctg

SEQ ID NO: 1446689 - DNA, 14 bp, Homo sapiens
ttgtgctgccattt

SEQ ID NO: 1446690 - DNA, 13 bp, Homo sapiens
ttgtgctgcttct

SEQ ID NO: 1446691 - DNA, 22 bp, Homo sapiens
ttgtgcttgtcattccagagtg

SEQ ID NO: 1446692 - DNA, 14 bp, Homo sapiens
ttgtgctttctagc

SEQ ID NO: 1446693 - DNA, 21 bp, Homo sapiens
ttgtggaaagtagctgctagt

SEQ ID NO: 1446694 - DNA, 22 bp, Homo sapiens
ttgtggaaagtagctgctagtg

SEQ ID NO: 1446695 - DNA, 18 bp, Homo sapiens
ttgtggatataaaatgtg

SEQ ID NO: 1446696 - DNA, 14 bp, Homo sapiens
ttgtggattaatgt

SEQ ID NO: 1446697 - DNA, 20 bp, Homo sapiens
ttgtggccccttttactttt

SEQ ID NO: 1446698 - DNA, 21 bp, Homo sapiens
ttgtggggaagaggggctggg

SEQ ID NO: 1446699 - DNA, 19 bp, Homo sapiens
ttgtgggtttttcatcttt

SEQ ID NO: 1446700 - DNA, 13 bp, Homo sapiens
ttgtggtgtgacc

SEQ ID NO: 1446701 - DNA, 22 bp, Homo sapiens
ttgtggtgtgaccatgttcatt

SEQ ID NO: 1446702 - DNA, 18 bp, Homo sapiens
ttgtggttaaaaacctgc

SEQ ID NO: 1446703 - DNA, 14 bp, Homo sapiens
ttgtggtttggaat

SEQ ID NO: 1446704 - DNA, 16 bp, Homo sapiens
ttgtgtaaaaaatgga

SEQ ID NO: 1446705 - DNA, 18 bp, Homo sapiens
ttgtgtaaaaaatggaaa

SEQ ID NO: 1446706 - DNA, 19 bp, Homo sapiens
ttgtgtaatttaagtgaca

SEQ ID NO: 1446707 - DNA, 15 bp, Homo sapiens
ttgtgtacagttatt

SEQ ID NO: 1446708 - DNA, 19 bp, Homo sapiens
ttgtgtacatagagcaatg

SEQ ID NO: 1446709 - DNA, 20 bp, Homo sapiens
ttgtgtacatagagcaatgt

SEQ ID NO: 1446710 - DNA, 15 bp, Homo sapiens
ttgtgtagccttttt

SEQ ID NO: 1446711 - DNA, 11 bp, Homo sapiens
ttgtgtatgta

SEQ ID NO: 1446712 - DNA, 18 bp, Homo sapiens
ttgtgtcaagacatttct

SEQ ID NO: 1446713 - DNA, 17 bp, Homo sapiens
ttgtgtcataccagaaa

SEQ ID NO: 1446714 - DNA, 18 bp, Homo sapiens
ttgtgtcccatgatccct

SEQ ID NO: 1446715 - DNA, 16 bp, Homo sapiens
ttgtgtccctaatgtg

SEQ ID NO: 1446716 - DNA, 13 bp, Homo sapiens
ttgtgtctgtaca

SEQ ID NO: 1446717 - DNA, 23 bp, Homo sapiens
ttgtgtctgtgccctccaaagag

SEQ ID NO: 1446718 - DNA, 19 bp, Homo sapiens
ttgtgtgaaaaaagaaaat

SEQ ID NO: 1446719 - DNA, 15 bp, Homo sapiens
ttgtgtgaaattgca

SEQ ID NO: 1446720 - DNA, 16 bp, Homo sapiens
ttgtgtgaaattgcat

SEQ ID NO: 1446721 - DNA, 20 bp, Homo sapiens
ttgtgtgagacttaaaacat

SEQ ID NO: 1446722 - DNA, 18 bp, Homo sapiens
ttgtgtgatatttcagaa

SEQ ID NO: 1446723 - DNA, 20 bp, Homo sapiens
ttgtgtgatatttcagaaat

SEQ ID NO: 1446724 - DNA, 18 bp, Homo sapiens
ttgtgtgcgctgcctggc

SEQ ID NO: 1446725 - DNA, 21 bp, Homo sapiens
ttgtgtgcggagtcattttgt

SEQ ID NO: 1446726 - DNA, 13 bp, Homo sapiens
ttgtgtggattct

SEQ ID NO: 1446727 - DNA, 19 bp, Homo sapiens
ttgtgtgtattcagaggca

SEQ ID NO: 1446728 - DNA, 16 bp, Homo sapiens
ttgtgtgtatttgtat

SEQ ID NO: 1446729 - DNA, 23 bp, Homo sapiens
ttgtgtgtatttgtattaataaa

SEQ ID NO: 1446730 - DNA, 19 bp, Homo sapiens
ttgtgtgtcttaattatta

SEQ ID NO: 1446731 - DNA, 16 bp, Homo sapiens
ttgtgtgtgggagtgt

SEQ ID NO: 1446732 - DNA, 15 bp, Homo sapiens
ttgtgtgttatttaa

SEQ ID NO: 1446733 - DNA, 21 bp, Homo sapiens
ttgtgtgttatttaaatgagt

SEQ ID NO: 1446734 - DNA, 17 bp, Homo sapiens
ttgtgtgttgtctcttg

SEQ ID NO: 1446735 - DNA, 20 bp, Homo sapiens
ttgtgttcccatttcagctg

SEQ ID NO: 1446736 - DNA, 11 bp, Homo sapiens
ttgtgttcctg

SEQ ID NO: 1446737 - DNA, 17 bp, Homo sapiens
ttgtgttcctggctgat

SEQ ID NO: 1446738 - DNA, 22 bp, Homo sapiens
ttgtgttctgtttgttaaaact

SEQ ID NO: 1446739 - DNA, 13 bp, Homo sapiens
ttgtgttgaagag

SEQ ID NO: 1446740 - DNA, 11 bp, Homo sapiens
ttgtgttgtca

SEQ ID NO: 1446741 - DNA, 16 bp, Homo sapiens
ttgtgtttattcttga

SEQ ID NO: 1446742 - DNA, 18 bp, Homo sapiens
ttgtgtttattcttgatg

SEQ ID NO: 1446743 - DNA, 20 bp, Homo sapiens
ttgtgtttctcgtgctgcat

SEQ ID NO: 1446744 - DNA, 16 bp, Homo sapiens
ttgtgttttcttgtaa

SEQ ID NO: 1446745 - DNA, 17 bp, Homo sapiens
ttgtgttttttaagata

SEQ ID NO: 1446746 - DNA, 21 bp, Homo sapiens
ttgttaaaaataaatcccatg

SEQ ID NO: 1446747 - DNA, 14 bp, Homo sapiens
ttgttaaaactggc

SEQ ID NO: 1446748 - DNA, 20 bp, Homo sapiens
ttgttaaaactggcatctga

SEQ ID NO: 1446749 - DNA, 15 bp, Homo sapiens
ttgttaaacaaatga

SEQ ID NO: 1446750 - DNA, 22 bp, Homo sapiens
ttgttaagtctaaatatttcct

SEQ ID NO: 1446751 - DNA, 13 bp, Homo sapiens
ttgttaatacaag

SEQ ID NO: 1446752 - DNA, 15 bp, Homo sapiens
ttgttaatacaaggt

SEQ ID NO: 1446753 - DNA, 18 bp, Homo sapiens
ttgttaatacaaggtata

SEQ ID NO: 1446754 - DNA, 18 bp, Homo sapiens
ttgttaatgaaaatgtca

SEQ ID NO: 1446755 - DNA, 21 bp, Homo sapiens
ttgttacaggcaccgagaatg

SEQ ID NO: 1446756 - DNA, 21 bp, Homo sapiens
ttgttacctgtcattttgcac

SEQ ID NO: 1446757 - DNA, 22 bp, Homo sapiens
ttgttacctgtcattttgcact

SEQ ID NO: 1446758 - DNA, 18 bp, Homo sapiens
ttgttactccctgttatt

SEQ ID NO: 1446759 - DNA, 13 bp, Homo sapiens
ttgttactgtcca

SEQ ID NO: 1446760 - DNA, 21 bp, Homo sapiens
ttgttagcccttcagattgtt

SEQ ID NO: 1446761 - DNA, 13 bp, Homo sapiens
ttgttagggctgc

SEQ ID NO: 1446762 - DNA, 19 bp, Homo sapiens
ttgttagggtcagccattt

SEQ ID NO: 1446763 - DNA, 15 bp, Homo sapiens
ttgttagtggacttg

SEQ ID NO: 1446764 - DNA, 20 bp, Homo sapiens
ttgttatatataataaatac

SEQ ID NO: 1446765 - DNA, 19 bp, Homo sapiens
ttgttatggcttaatgaca

SEQ ID NO: 1446766 - DNA, 19 bp, Homo sapiens
ttgttattgatgttgctgt

SEQ ID NO: 1446767 - DNA, 14 bp, Homo sapiens
ttgttattgcctct

SEQ ID NO: 1446768 - DNA, 17 bp, Homo sapiens
ttgttattgtggaagat

SEQ ID NO: 1446769 - DNA, 22 bp, Homo sapiens
ttgttcaataataaatattttt

SEQ ID NO: 1446770 - DNA, 16 bp, Homo sapiens
ttgttcaatgttccat

SEQ ID NO: 1446771 - DNA, 23 bp, Homo sapiens
ttgttcaggaaaaggttgaataa

SEQ ID NO: 1446772 - DNA, 20 bp, Homo sapiens
ttgttcagggagaagatcat

SEQ ID NO: 1446773 - DNA, 16 bp, Homo sapiens
ttgttcatacatattt

SEQ ID NO: 1446774 - DNA, 18 bp, Homo sapiens
ttgttcatacatattttt

SEQ ID NO: 1446775 - DNA, 17 bp, Homo sapiens
ttgttcattttgagtat

SEQ ID NO: 1446776 - DNA, 21 bp, Homo sapiens
ttgttccacaagttaaataaa

SEQ ID NO: 1446777 - DNA, 12 bp, Homo sapiens
ttgttccagctc

SEQ ID NO: 1446778 - DNA, 20 bp, Homo sapiens
ttgttcccctcctccactct

SEQ ID NO: 1446779 - DNA, 23 bp, Homo sapiens
ttgttcccctcctccactctccc

SEQ ID NO: 1446780 - DNA, 13 bp, Homo sapiens
ttgttcccttcct

SEQ ID NO: 1446781 - DNA, 23 bp, Homo sapiens
ttgttcccttcctcttcctgccc

SEQ ID NO: 1446782 - DNA, 19 bp, Homo sapiens
ttgttcctctatactttgt

SEQ ID NO: 1446783 - DNA, 22 bp, Homo sapiens
ttgttctagacttccccatccc

SEQ ID NO: 1446784 - DNA, 23 bp, Homo sapiens
tttaaaattgctatgttactatt

SEQ ID NO: 1446785 - DNA, 13 bp, Homo sapiens
tttaaaatttcat

SEQ ID NO: 1446786 - DNA, 20 bp, Homo sapiens
tttaaaatttcgttgtccaa

SEQ ID NO: 1446787 - DNA, 21 bp, Homo sapiens
tttaaaatttcgttgtccaat

SEQ ID NO: 1446788 - DNA, 12 bp, Homo sapiens
tttaaaatttgt

SEQ ID NO: 1446789 - DNA, 14 bp, Homo sapiens
tttaaacacctcct

SEQ ID NO: 1446790 - DNA, 21 bp, Homo sapiens
tttaaacacttatcttctgga

SEQ ID NO: 1446791 - DNA, 16 bp, Homo sapiens
tttaaacaggcccagc

SEQ ID NO: 1446792 - DNA, 19 bp, Homo sapiens
ttaatgaaatcaaatgtat

SEQ ID NO: 1446793 - DNA, 16 bp, Homo sapiens
ttaatgaagcttttga

SEQ ID NO: 1446794 - DNA, 22 bp, Homo sapiens
ttaatgaatatcaggctattat

SEQ ID NO: 1446795 - DNA, 21 bp, Homo sapiens
ttaatgaatattgatgttaac

SEQ ID NO: 1446796 - DNA, 14 bp, Homo sapiens
ttaatgacaatatt

SEQ ID NO: 1446797 - DNA, 17 bp, Homo sapiens
ttaatgacacaccttgg

SEQ ID NO: 1446798 - DNA, 22 bp, Homo sapiens
ttaatgagatgttattactgtt

SEQ ID NO: 1446799 - DNA, 20 bp, Homo sapiens
ttaatgagtgcacctgcctc

SEQ ID NO: 1446800 - DNA, 23 bp, Homo sapiens
ttaatgataaactcagatctgat

SEQ ID NO: 1446801 - DNA, 16 bp, Homo sapiens
ttaatgataagtaaat

SEQ ID NO: 1446802 - DNA, 17 bp, Homo sapiens
ttaatgataagtaaatg

SEQ ID NO: 1446803 - DNA, 22 bp, Homo sapiens
ttaatgatctcggatgaccaaa

SEQ ID NO: 1446804 - DNA, 16 bp, Homo sapiens
ttaatgcctgcttttt

SEQ ID NO: 1446805 - DNA, 19 bp, Homo sapiens
ttaatgcctgctttttgga

SEQ ID NO: 1446806 - DNA, 16 bp, Homo sapiens
ttaatgctgccttttc

SEQ ID NO: 1446807 - DNA, 19 bp, Homo sapiens
ttaatgctgtttctaagaa

SEQ ID NO: 1446808 - DNA, 23 bp, Homo sapiens
ttaatgctgtttctaagaaaatg

SEQ ID NO: 1446809 - DNA, 19 bp, Homo sapiens
ttaatgcttccagggattt

SEQ ID NO: 1446810 - DNA, 14 bp, Homo sapiens
ttaatggaaagttg

SEQ ID NO: 1446811 - DNA, 21 bp, Homo sapiens
ttaatggcatttctctttaaa

SEQ ID NO: 1446812 - DNA, 19 bp, Homo sapiens
ttaatgggggtagcagctg

SEQ ID NO: 1446813 - DNA, 21 bp, Homo sapiens
ttaatgggggtagcagctgga

SEQ ID NO: 1446814 - DNA, 13 bp, Homo sapiens
ttaatgtaaaatt

SEQ ID NO: 1446815 - DNA, 20 bp, Homo sapiens
ttaatgtatctatttgtaca

SEQ ID NO: 1446816 - DNA, 21 bp, Homo sapiens
ttaatgtatctatttgtacaa

SEQ ID NO: 1446817 - DNA, 18 bp, Homo sapiens
ttaatgtcattgctaaaa

SEQ ID NO: 1446818 - DNA, 11 bp, Homo sapiens
ttaatgtgaag

SEQ ID NO: 1446819 - DNA, 18 bp, Homo sapiens
ttaatgtgaagacatttt

SEQ ID NO: 1446820 - DNA, 15 bp, Homo sapiens
ttaatgtttattcct

SEQ ID NO: 1446821 - DNA, 14 bp, Homo sapiens
ttaatgtttcttaa

SEQ ID NO: 1446822 - DNA, 16 bp, Homo sapiens
ttaatgtttcttaaat

SEQ ID NO: 1446823 - DNA, 17 bp, Homo sapiens
ttaatgttttgtacaat

SEQ ID NO: 1446824 - DNA, 16 bp, Homo sapiens
ttaattaccaacctgt

SEQ ID NO: 1446825 - DNA, 16 bp, Homo sapiens
ttaattactgctataa

SEQ ID NO: 1446826 - DNA, 22 bp, Homo sapiens
ttaattactggaattcttctgc

SEQ ID NO: 1446827 - DNA, 22 bp, Homo sapiens
ttaattcagcactgatttcaca

SEQ ID NO: 1446828 - DNA, 13 bp, Homo sapiens
ttaattctcattt

SEQ ID NO: 1446829 - DNA, 15 bp, Homo sapiens
ttaattcttcacctt

SEQ ID NO: 1446830 - DNA, 19 bp, Homo sapiens
ttaattcttcacctttgta

SEQ ID NO: 1446831 - DNA, 22 bp, Homo sapiens
ttaattcttcacctttgtaaga

SEQ ID NO: 1446832 - DNA, 13 bp, Homo sapiens
ttaattgaaatta

SEQ ID NO: 1446833 - DNA, 13 bp, Homo sapiens
ttaattgctttaa

SEQ ID NO: 1446834 - DNA, 14 bp, Homo sapiens
ttaattgtaaagta

SEQ ID NO: 1446835 - DNA, 14 bp, Homo sapiens
ttaattgtaatctg

SEQ ID NO: 1446836 - DNA, 18 bp, Homo sapiens
ttaattgtggctttatga

SEQ ID NO: 1446837 - DNA, 15 bp, Homo sapiens
ttaattgttcatttt

SEQ ID NO: 1446838 - DNA, 14 bp, Homo sapiens
ttaatttatatgta

SEQ ID NO: 1446839 - DNA, 18 bp, Homo sapiens
ttaatttatgagtttttg

SEQ ID NO: 1446840 - DNA, 20 bp, Homo sapiens
ttaatttatgagtttttgat

SEQ ID NO: 1446841 - DNA, 18 bp, Homo sapiens
ttaatttccaggaaaaaa

SEQ ID NO: 1446842 - DNA, 18 bp, Homo sapiens
ttaatttcctttttgaca

SEQ ID NO: 1446843 - DNA, 19 bp, Homo sapiens
ttaatttcctttttgacac

SEQ ID NO: 1446844 - DNA, 22 bp, Homo sapiens
ttaatttcctttttgacactga

SEQ ID NO: 1446845 - DNA, 18 bp, Homo sapiens
ttaatttgcatctgaaat

SEQ ID NO: 1446846 - DNA, 13 bp, Homo sapiens
ttaattttaaagt

SEQ ID NO: 1446847 - DNA, 16 bp, Homo sapiens
ttaattttaaagtgca

SEQ ID NO: 1446848 - DNA, 19 bp, Homo sapiens
ttaattttaaagtgcaaaa

SEQ ID NO: 1446849 - DNA, 21 bp, Homo sapiens
ttaattttagtttttcattaa

SEQ ID NO: 1446850 - DNA, 17 bp, Homo sapiens
ttaattttattgcaaag

SEQ ID NO: 1446851 - DNA, 13 bp, Homo sapiens
ttaattttgctaa

SEQ ID NO: 1446852 - DNA, 14 bp, Homo sapiens
ttaattttgctaac

SEQ ID NO: 1446853 - DNA, 14 bp, Homo sapiens
ttaattttgtgcat

SEQ ID NO: 1446854 - DNA, 13 bp, Homo sapiens
ttaatttttccaa

SEQ ID NO: 1446855 - DNA, 18 bp, Homo sapiens
ttaatttttccaactact

SEQ ID NO: 1446856 - DNA, 18 bp, Homo sapiens
ttaatttttcctgcatgt

SEQ ID NO: 1446857 - DNA, 19 bp, Homo sapiens
ttacaaaagaaaaaagcaa

SEQ ID NO: 1446858 - DNA, 23 bp, Homo sapiens
ttacaaagggaaagcctctggcc

SEQ ID NO: 1446859 - DNA, 22 bp, Homo sapiens
ttacaaatcagaagtcatcttg

SEQ ID NO: 1446860 - DNA, 18 bp, Homo sapiens
ttacaaatggggcaaaca

SEQ ID NO: 1446861 - DNA, 24 bp, Homo sapiens
ttacaaattataatgtattcatat

SEQ ID NO: 1446862 - DNA, 19 bp, Homo sapiens
ttacaacataatctagttt

SEQ ID NO: 1446863 - DNA, 16 bp, Homo sapiens
ttacaacggagtcaaa

SEQ ID NO: 1446864 - DNA, 19 bp, Homo sapiens
ttacaactgaccaagtttc

SEQ ID NO: 1446865 - DNA, 13 bp, Homo sapiens
ttacaacttgtat

SEQ ID NO: 1446866 - DNA, 18 bp, Homo sapiens
ttacaaggcaatggaaac

SEQ ID NO: 1446867 - DNA, 22 bp, Homo sapiens
ttacaaggcaatggaaactatt

SEQ ID NO: 1446868 - DNA, 12 bp, Homo sapiens
ttacaagtgttc

SEQ ID NO: 1446869 - DNA, 15 bp, Homo sapiens
ttacaagtgttctta

SEQ ID NO: 1446870 - DNA, 23 bp, Homo sapiens
ttacaagtgttcttaggtttact

SEQ ID NO: 1446871 - DNA, 14 bp, Homo sapiens
ttacaataaagttt

SEQ ID NO: 1446872 - DNA, 13 bp, Homo sapiens
ttacaattgtcat

SEQ ID NO: 1446873 - DNA, 21 bp, Homo sapiens
ttacaatttttaataaattga

SEQ ID NO: 1446874 - DNA, 17 bp, Homo sapiens
ttacaattttttatcat

SEQ ID NO: 1446875 - DNA, 15 bp, Homo sapiens
ttacacaagaatcta

SEQ ID NO: 1446876 - DNA, 14 bp, Homo sapiens
ttacacagaaacac

SEQ ID NO: 1446877 - DNA, 19 bp, Homo sapiens
ttacacagaaatgctgctg

SEQ ID NO: 1446878 - DNA, 16 bp, Homo sapiens
ttacacagcccaagag

SEQ ID NO: 1446879 - DNA, 13 bp, Homo sapiens
ttacacattaaac

SEQ ID NO: 1446880 - DNA, 16 bp, Homo sapiens
ttacacattagatttt

SEQ ID NO: 1446881 - DNA, 17 bp, Homo sapiens
ttacaccaactcctaat

SEQ ID NO: 1446882 - DNA, 21 bp, Homo sapiens
ttacaccaccggccccctccc

SEQ ID NO: 1446883 - DNA, 15 bp, Homo sapiens
ttacactctttgtaa

SEQ ID NO: 1446884 - DNA, 13 bp, Homo sapiens
ttacactgaggac

SEQ ID NO: 1446885 - DNA, 17 bp, Homo sapiens
ttacactgcggaagcca

SEQ ID NO: 1446886 - DNA, 18 bp, Homo sapiens
ttacactgcggaagccaa

SEQ ID NO: 1446887 - DNA, 13 bp, Homo sapiens
ttacactgggctg

SEQ ID NO: 1446888 - DNA, 12 bp, Homo sapiens
ttacactggtct

SEQ ID NO: 1446889 - DNA, 17 bp, Homo sapiens
ttacactgttcacaaag

SEQ ID NO: 1446890 - DNA, 15 bp, Homo sapiens
ttacagaaaaatctt

SEQ ID NO: 1446891 - DNA, 19 bp, Homo sapiens
ttacagacgctgctgtcac

SEQ ID NO: 1446892 - DNA, 14 bp, Homo sapiens
ttacagactctgat

SEQ ID NO: 1446893 - DNA, 14 bp, Homo sapiens
ttacagagccttga

SEQ ID NO: 1446894 - DNA, 15 bp, Homo sapiens
ttacagaggacagta

SEQ ID NO: 1446895 - DNA, 17 bp, Homo sapiens
ttacagattgcctcctt

SEQ ID NO: 1446896 - DNA, 19 bp, Homo sapiens
ttacagattgcctccttat

SEQ ID NO: 1446897 - DNA, 22 bp, Homo sapiens
ttacagatttctcactatatat

SEQ ID NO: 1446898 - DNA, 19 bp, Homo sapiens
ttacagcattgtctttgct

SEQ ID NO: 1446899 - DNA, 21 bp, Homo sapiens
ttacagcattgtctttgctgt

SEQ ID NO: 1446900 - DNA, 17 bp, Homo sapiens
ttacagcctcacttgaa

SEQ ID NO: 1446901 - DNA, 14 bp, Homo sapiens
ttacaggaagcttt

SEQ ID NO: 1446902 - DNA, 15 bp, Homo sapiens
ttacaggaagctttt

SEQ ID NO: 1446903 - DNA, 23 bp, Homo sapiens
ttacaggcgtgtgccactacact

SEQ ID NO: 1446904 - DNA, 18 bp, Homo sapiens
ttacagggagctgggaca

SEQ ID NO: 1446905 - DNA, 15 bp, Homo sapiens
ttacaggtgattaac

SEQ ID NO: 1446906 - DNA, 15 bp, Homo sapiens
ttacaggttcttagg

SEQ ID NO: 1446907 - DNA, 21 bp, Homo sapiens
ttacagtacacatccccagaa

SEQ ID NO: 1446908 - DNA, 17 bp, Homo sapiens
ttacagtatgatgaaaa

SEQ ID NO: 1446909 - DNA, 23 bp, Homo sapiens
ctactgatgaaatctgctagaaa

SEQ ID NO: 1446910 - DNA, 18 bp, Homo sapiens
ctactgcaagagccaagt

SEQ ID NO: 1446911 - DNA, 21 bp, Homo sapiens
ctactgcactccagcctgggg

SEQ ID NO: 1446912 - DNA, 23 bp, Homo sapiens
ctactgcactttcccccttcccg

SEQ ID NO: 1446913 - DNA, 22 bp, Homo sapiens
ctactgcagcacctccaggcct

SEQ ID NO: 1446914 - DNA, 13 bp, Homo sapiens
ctactgccctccc

SEQ ID NO: 1446915 - DNA, 14 bp, Homo sapiens
ctactgctcctgtg

SEQ ID NO: 1446916 - DNA, 18 bp, Homo sapiens
ctactgctcctgtggcag

SEQ ID NO: 1446917 - DNA, 20 bp, Homo sapiens
ctactgctgtgaaccctggg

SEQ ID NO: 1446918 - DNA, 17 bp, Homo sapiens
ctactggtcttgtggaa

SEQ ID NO: 1446919 - DNA, 16 bp, Homo sapiens
ctactgtactttgcca

SEQ ID NO: 1446920 - DNA, 20 bp, Homo sapiens
ctactgtccctctcagtgcc

SEQ ID NO: 1446921 - DNA, 23 bp, Homo sapiens
ctactgtccctctcagtgccttc

SEQ ID NO: 1446922 - DNA, 19 bp, Homo sapiens
ctactgtctaagcagtttt

SEQ ID NO: 1446923 - DNA, 15 bp, Homo sapiens
ctactgtgtgccagg

SEQ ID NO: 1446924 - DNA, 14 bp, Homo sapiens
ctactgttctaaag

SEQ ID NO: 1446925 - DNA, 15 bp, Homo sapiens
ctactgttctaaagc

SEQ ID NO: 1446926 - DNA, 17 bp, Homo sapiens
ctacttagcatgtccct

SEQ ID NO: 1446927 - DNA, 22 bp, Homo sapiens
ctacttagcatgtccctaccga

SEQ ID NO: 1446928 - DNA, 22 bp, Homo sapiens
ctacttccccagctctcagtag

SEQ ID NO: 1446929 - DNA, 13 bp, Homo sapiens
ctacttcccttcc

SEQ ID NO: 1446930 - DNA, 20 bp, Homo sapiens
ctacttcctcctccccactt

SEQ ID NO: 1446931 - DNA, 12 bp, Homo sapiens
ctacttctctgt

SEQ ID NO: 1446932 - DNA, 20 bp, Homo sapiens
ctacttctggaagtcatctc

SEQ ID NO: 1446933 - DNA, 16 bp, Homo sapiens
ctacttgggaggctga

SEQ ID NO: 1446934 - DNA, 23 bp, Homo sapiens
ctacttgggaggctgaggcagga

SEQ ID NO: 1446935 - DNA, 14 bp, Homo sapiens
ctacttggtttgtg

SEQ ID NO: 1446936 - DNA, 17 bp, Homo sapiens
ctacttggtttgtgttc

SEQ ID NO: 1446937 - DNA, 18 bp, Homo sapiens
ctactttataactaacat

SEQ ID NO: 1446938 - DNA, 21 bp, Homo sapiens
ctactttcatcttaaactaat

SEQ ID NO: 1446939 - DNA, 19 bp, Homo sapiens
ctactttgactttttgcat

SEQ ID NO: 1446940 - DNA, 21 bp, Homo sapiens
ctactttgcccctttcagtat

SEQ ID NO: 1446941 - DNA, 19 bp, Homo sapiens
ctactttgcttccgccact

SEQ ID NO: 1446942 - DNA, 21 bp, Homo sapiens
ctactttggtttctgtctgta

SEQ ID NO: 1446943 - DNA, 14 bp, Homo sapiens
ctactttgtccttt

SEQ ID NO: 1446944 - DNA, 22 bp, Homo sapiens
ctactttgtcctttttgttatt

SEQ ID NO: 1446945 - DNA, 20 bp, Homo sapiens
ctactttgttaggattttca

SEQ ID NO: 1446946 - DNA, 17 bp, Homo sapiens
ctacttttgcatgaaaa

SEQ ID NO: 1446947 - DNA, 18 bp, Homo sapiens
ctacttttttcattttgt

SEQ ID NO: 1446948 - DNA, 14 bp, Homo sapiens
ctagaaaaataaaa

SEQ ID NO: 1446949 - DNA, 23 bp, Homo sapiens
ctagaaagaaaagaccctgagac

SEQ ID NO: 1446950 - DNA, 19 bp, Homo sapiens
ctagaaatatctttctctt

SEQ ID NO: 1446951 - DNA, 19 bp, Homo sapiens
ctagaacactaactcacca

SEQ ID NO: 1446952 - DNA, 20 bp, Homo sapiens
ctagaacactaactcaccag

SEQ ID NO: 1446953 - DNA, 23 bp, Homo sapiens
ctagaaccaagcttcagagccta

SEQ ID NO: 1446954 - DNA, 17 bp, Homo sapiens
ctagaagaaaagcccat

SEQ ID NO: 1446955 - DNA, 18 bp, Homo sapiens
ctagaagaaaagcccatt

SEQ ID NO: 1446956 - DNA, 19 bp, Homo sapiens
ctagaagaaccaaatacct

SEQ ID NO: 1446957 - DNA, 21 bp, Homo sapiens
ctagaagaaccaaatacctca

SEQ ID NO: 1446958 - DNA, 15 bp, Homo sapiens
ctagaagattagaaa

SEQ ID NO: 1446959 - DNA, 13 bp, Homo sapiens
ctagaagccaagg

SEQ ID NO: 1446960 - DNA, 17 bp, Homo sapiens
ctagaagccacagtgcc

SEQ ID NO: 1446961 - DNA, 17 bp, Homo sapiens
ctagaaggtttgggaac

SEQ ID NO: 1446962 - DNA, 22 bp, Homo sapiens
ctagaagtaagaagaggagcct

SEQ ID NO: 1446963 - DNA, 17 bp, Homo sapiens
ctagaagtctccctgca

SEQ ID NO: 1446964 - DNA, 19 bp, Homo sapiens
ctagaagtctccctgcaca

SEQ ID NO: 1446965 - DNA, 12 bp, Homo sapiens
ctagaatacttt

SEQ ID NO: 1446966 - DNA, 18 bp, Homo sapiens
ctagaatactttttaaaa

SEQ ID NO: 1446967 - DNA, 16 bp, Homo sapiens
ctagaatcccagcagc

SEQ ID NO: 1446968 - DNA, 19 bp, Homo sapiens
ctagaatcccagcagcaga

SEQ ID NO: 1446969 - DNA, 19 bp, Homo sapiens
ctagaatctgcaattcaaa

SEQ ID NO: 1446970 - DNA, 19 bp, Homo sapiens
ctagaatgtaaagttatgt

SEQ ID NO: 1446971 - DNA, 19 bp, Homo sapiens
ctagaatgtcagatttctg

SEQ ID NO: 1446972 - DNA, 18 bp, Homo sapiens
ctagaattagtatgtctg

SEQ ID NO: 1446973 - DNA, 20 bp, Homo sapiens
ctagaattagtatgtctgtt

SEQ ID NO: 1446974 - DNA, 18 bp, Homo sapiens
ctagaattctagtgctgc

SEQ ID NO: 1446975 - DNA, 21 bp, Homo sapiens
ctagaatttatcacacttctg

SEQ ID NO: 1446976 - DNA, 12 bp, Homo sapiens
ctagaatttatt

SEQ ID NO: 1446977 - DNA, 22 bp, Homo sapiens
ctagaatttattcaattcctct

SEQ ID NO: 1446978 - DNA, 12 bp, Homo sapiens
ctagaattttaa

SEQ ID NO: 1446979 - DNA, 14 bp, Homo sapiens
ctagacaaaatcaa

SEQ ID NO: 1446980 - DNA, 15 bp, Homo sapiens
ctagacaacctttct

SEQ ID NO: 1446981 - DNA, 21 bp, Homo sapiens
ctagacaacctttctgtagcc

SEQ ID NO: 1446982 - DNA, 13 bp, Homo sapiens
ctagacactgcca

SEQ ID NO: 1446983 - DNA, 21 bp, Homo sapiens
ctagacatggaggttctaagg

SEQ ID NO: 1446984 - DNA, 20 bp, Homo sapiens
ctagaccagcagacagagcc

SEQ ID NO: 1446985 - DNA, 21 bp, Homo sapiens
ctagaccagcagacagagcca

SEQ ID NO: 1446986 - DNA, 22 bp, Homo sapiens
ctagaccagcagacagagccag

SEQ ID NO: 1446987 - DNA, 23 bp, Homo sapiens
ctagaccagcagacagagccagg

SEQ ID NO: 1446988 - DNA, 15 bp, Homo sapiens
ctagacgcccctccc

SEQ ID NO: 1446989 - DNA, 16 bp, Homo sapiens
ctagactcctcaggag

SEQ ID NO: 1446990 - DNA, 20 bp, Homo sapiens
ctagactcctcaggagagac

SEQ ID NO: 1446991 - DNA, 15 bp, Homo sapiens
ctagactctagacaa

SEQ ID NO: 1446992 - DNA, 14 bp, Homo sapiens
ctagactggagtga

SEQ ID NO: 1446993 - DNA, 13 bp, Homo sapiens
ctagacttcccca

SEQ ID NO: 1446994 - DNA, 16 bp, Homo sapiens
ctagacttccccatcc

SEQ ID NO: 1446995 - DNA, 13 bp, Homo sapiens
ctagagacacatt

SEQ ID NO: 1446996 - DNA, 17 bp, Homo sapiens
ctagagacacattggac

SEQ ID NO: 1446997 - DNA, 22 bp, Homo sapiens
ctagagacagtgatgcctgccc

SEQ ID NO: 1446998 - DNA, 14 bp, Homo sapiens
ctagagagaataaa

SEQ ID NO: 1446999 - DNA, 16 bp, Homo sapiens
ctagagagaataaatt

SEQ ID NO: 1447000 - DNA, 15 bp, Homo sapiens
ctagagagccttaac

SEQ ID NO: 1447001 - DNA, 17 bp, Homo sapiens
ctagagagccttaactt

SEQ ID NO: 1447002 - DNA, 16 bp, Homo sapiens
ctagagcaacccctgt

SEQ ID NO: 1447003 - DNA, 21 bp, Homo sapiens
ctagagcaacccctgtaccca

SEQ ID NO: 1447004 - DNA, 23 bp, Homo sapiens
ctagagcaacccctgtacccagc

SEQ ID NO: 1447005 - DNA, 11 bp, Homo sapiens
ctagagccgag

SEQ ID NO: 1447006 - DNA, 20 bp, Homo sapiens
ctagagccgaggggagagag

SEQ ID NO: 1447007 - DNA, 14 bp, Homo sapiens
ctagaggccaccta

SEQ ID NO: 1447008 - DNA, 17 bp, Homo sapiens
ctagaggccagccccac

SEQ ID NO: 1447009 - DNA, 19 bp, Homo sapiens
ctagaggccagccccaccc

SEQ ID NO: 1447010 - DNA, 20 bp, Homo sapiens
ctagaggccagccccaccca

SEQ ID NO: 1447011 - DNA, 21 bp, Homo sapiens
ctagaggccagccccacccag

SEQ ID NO: 1447012 - DNA, 17 bp, Homo sapiens
ctagaggccagggcagc

SEQ ID NO: 1447013 - DNA, 11 bp, Homo sapiens
ctagaggcctc

SEQ ID NO: 1447014 - DNA, 15 bp, Homo sapiens
ctagaggcctcagtt

SEQ ID NO: 1447015 - DNA, 13 bp, Homo sapiens
ctagaggcctgag

SEQ ID NO: 1447016 - DNA, 15 bp, Homo sapiens
ctagaggcctgagga

SEQ ID NO: 1447017 - DNA, 16 bp, Homo sapiens
ctagaggcctgaggat

SEQ ID NO: 1447018 - DNA, 19 bp, Homo sapiens
ctagaggcgagccaggcaa

SEQ ID NO: 1447019 - DNA, 14 bp, Homo sapiens
ctagagggcccatc

SEQ ID NO: 1447020 - DNA, 22 bp, Homo sapiens
ctagagggcccatcaggcagtg

SEQ ID NO: 1447021 - DNA, 18 bp, Homo sapiens
ctagaggtgggcagctgg

SEQ ID NO: 1447022 - DNA, 22 bp, Homo sapiens
ctagaggtgggcagctgggccc

SEQ ID NO: 1447023 - DNA, 20 bp, Homo sapiens
ctagaggtgttacagaggac

SEQ ID NO: 1447024 - DNA, 23 bp, Homo sapiens
ctagaggtgttacagaggaccct

SEQ ID NO: 1447025 - DNA, 22 bp, Homo sapiens
ttacagtcattggaataaggca

SEQ ID NO: 1447026 - DNA, 16 bp, Homo sapiens
ttacagtgcagacagg

SEQ ID NO: 1447027 - DNA, 18 bp, Homo sapiens
ttacagtgcagacaggcc

SEQ ID NO: 1447028 - DNA, 18 bp, Homo sapiens
ttacagtgcctaaaataa

SEQ ID NO: 1447029 - DNA, 21 bp, Homo sapiens
ttacagttagggttttgcaat

SEQ ID NO: 1447030 - DNA, 19 bp, Homo sapiens
ttacagttctttcctcttt

SEQ ID NO: 1447031 - DNA, 13 bp, Homo sapiens
ttacatacagatt

SEQ ID NO: 1447032 - DNA, 17 bp, Homo sapiens
ttacatactaggtgcct

SEQ ID NO: 1447033 - DNA, 14 bp, Homo sapiens
ttacatcatttttg

SEQ ID NO: 1447034 - DNA, 16 bp, Homo sapiens
ttacatctaatgcttc

SEQ ID NO: 1447035 - DNA, 17 bp, Homo sapiens
ttacatcttttctaatc

SEQ ID NO: 1447036 - DNA, 22 bp, Homo sapiens
ttacatgcagccacttaggaca

SEQ ID NO: 1447037 - DNA, 13 bp, Homo sapiens
ttacatgcatttg

SEQ ID NO: 1447038 - DNA, 16 bp, Homo sapiens
ttacatgctgtatatg

SEQ ID NO: 1447039 - DNA, 20 bp, Homo sapiens
ttacatgtaatttgatgagg

SEQ ID NO: 1447040 - DNA, 16 bp, Homo sapiens
ttacatgtttataaat

SEQ ID NO: 1447041 - DNA, 16 bp, Homo sapiens
ttacattaatgttaat

SEQ ID NO: 1447042 - DNA, 19 bp, Homo sapiens
ttacattattatcaacaat

SEQ ID NO: 1447043 - DNA, 16 bp, Homo sapiens
ttacattcctaactag

SEQ ID NO: 1447044 - DNA, 12 bp, Homo sapiens
ttacattgtaaa

SEQ ID NO: 1447045 - DNA, 13 bp, Homo sapiens
ttacattgtaaat

SEQ ID NO: 1447046 - DNA, 21 bp, Homo sapiens
ttacattgtcctgtagcttta

SEQ ID NO: 1447047 - DNA, 16 bp, Homo sapiens
ttacatttaatacaga

SEQ ID NO: 1447048 - DNA, 20 bp, Homo sapiens
ttacatttgatgcatgtctt

SEQ ID NO: 1447049 - DNA, 14 bp, Homo sapiens
ttacatttgtaatt

SEQ ID NO: 1447050 - DNA, 19 bp, Homo sapiens
ttacatttgtaatttaagg

SEQ ID NO: 1447051 - DNA, 18 bp, Homo sapiens
ttacatttttacaataaa

SEQ ID NO: 1447052 - DNA, 21 bp, Homo sapiens
ttaccaaaaataaatatatct

SEQ ID NO: 1447053 - DNA, 23 bp, Homo sapiens
ttaccaaggatgaattctttcaa

SEQ ID NO: 1447054 - DNA, 12 bp, Homo sapiens
ttaccagcaaga

SEQ ID NO: 1447055 - DNA, 17 bp, Homo sapiens
ttaccaggtttcatttt

SEQ ID NO: 1447056 - DNA, 19 bp, Homo sapiens
ttaccagttgccttttatc

SEQ ID NO: 1447057 - DNA, 16 bp, Homo sapiens
ttaccagtttctttgt

SEQ ID NO: 1447058 - DNA, 21 bp, Homo sapiens
ttaccattaattacatacaga

SEQ ID NO: 1447059 - DNA, 17 bp, Homo sapiens
ttaccattcacaataaa

SEQ ID NO: 1447060 - DNA, 20 bp, Homo sapiens
ttaccatttgtaataaagta

SEQ ID NO: 1447061 - DNA, 16 bp, Homo sapiens
ttaccatttttctgga

SEQ ID NO: 1447062 - DNA, 17 bp, Homo sapiens
ttacccaagtcttctcc

SEQ ID NO: 1447063 - DNA, 16 bp, Homo sapiens
ttacccacctagaaca

SEQ ID NO: 1447064 - DNA, 18 bp, Homo sapiens
ttacccactcggtcccag

SEQ ID NO: 1447065 - DNA, 18 bp, Homo sapiens
ttacccagattgtgtaca

SEQ ID NO: 1447066 - DNA, 23 bp, Homo sapiens
ttacccataaacagcacacctgt

SEQ ID NO: 1447067 - DNA, 14 bp, Homo sapiens
ttaccccttagcct

SEQ ID NO: 1447068 - DNA, 21 bp, Homo sapiens
ttacccggagaaggccgctgc

SEQ ID NO: 1447069 - DNA, 22 bp, Homo sapiens
ttaccctcaggcataggcctgg

SEQ ID NO: 1447070 - DNA, 15 bp, Homo sapiens
ttaccctctttgctg

SEQ ID NO: 1447071 - DNA, 21 bp, Homo sapiens
ttacccttcacctttggtgca

SEQ ID NO: 1447072 - DNA, 16 bp, Homo sapiens
ttaccctttagactgt

SEQ ID NO: 1447073 - DNA, 16 bp, Homo sapiens
ttacccttttccccct

SEQ ID NO: 1447074 - DNA, 22 bp, Homo sapiens
ttaccgtcacactcttcagtga

SEQ ID NO: 1447075 - DNA, 14 bp, Homo sapiens
ttacctaattatta

SEQ ID NO: 1447076 - DNA, 21 bp, Homo sapiens
ttacctaccacagtgtctgta

SEQ ID NO: 1447077 - DNA, 15 bp, Homo sapiens
ttacctagtcttgta

SEQ ID NO: 1447078 - DNA, 15 bp, Homo sapiens
ttacctatctgtgga

SEQ ID NO: 1447079 - DNA, 12 bp, Homo sapiens
ttacctcctgcc

SEQ ID NO: 1447080 - DNA, 13 bp, Homo sapiens
ttacctcctgccc

SEQ ID NO: 1447081 - DNA, 14 bp, Homo sapiens
ttacctcctgccca

SEQ ID NO: 1447082 - DNA, 15 bp, Homo sapiens
ttacctcctgcccag

SEQ ID NO: 1447083 - DNA, 11 bp, Homo sapiens
ttacctctgat

SEQ ID NO: 1447084 - DNA, 15 bp, Homo sapiens
ttacctgaacaggaa

SEQ ID NO: 1447085 - DNA, 18 bp, Homo sapiens
ttacctgagttgaagagg

SEQ ID NO: 1447086 - DNA, 23 bp, Homo sapiens
ttacctgcaggctccatgcacct

SEQ ID NO: 1447087 - DNA, 20 bp, Homo sapiens
ttacctgccaattgctaccg

SEQ ID NO: 1447088 - DNA, 13 bp, Homo sapiens
ttacctgcttctg

SEQ ID NO: 1447089 - DNA, 16 bp, Homo sapiens
ttacctgcttctggtt

SEQ ID NO: 1447090 - DNA, 15 bp, Homo sapiens
ttacctgtatacagt

SEQ ID NO: 1447091 - DNA, 13 bp, Homo sapiens
ttacctgtgaaat

SEQ ID NO: 1447092 - DNA, 20 bp, Homo sapiens
ttacctgttatatatctctt

SEQ ID NO: 1447093 - DNA, 18 bp, Homo sapiens
ttaccttatagttactgt

SEQ ID NO: 1447094 - DNA, 19 bp, Homo sapiens
ttaccttggccgtgaggac

SEQ ID NO: 1447095 - DNA, 15 bp, Homo sapiens
ttaccttgttattta

SEQ ID NO: 1447096 - DNA, 18 bp, Homo sapiens
ttacctttttatttgcat

SEQ ID NO: 1447097 - DNA, 19 bp, Homo sapiens
ttaccttttttttttcttg

SEQ ID NO: 1447098 - DNA, 18 bp, Homo sapiens
ttacgacactttggttta

SEQ ID NO: 1447099 - DNA, 20 bp, Homo sapiens
ttacgctatccagttgcagg

SEQ ID NO: 1447100 - DNA, 13 bp, Homo sapiens
ttacgtaaaacat

SEQ ID NO: 1447101 - DNA, 17 bp, Homo sapiens
ttacgtgtttaaaaaaa

SEQ ID NO: 1447102 - DNA, 18 bp, Homo sapiens
ttactaaaaaaaagatga

SEQ ID NO: 1447103 - DNA, 13 bp, Homo sapiens
ttactaaacattt

SEQ ID NO: 1447104 - DNA, 23 bp, Homo sapiens
ttactaaagaaaatatctgaaat

SEQ ID NO: 1447105 - DNA, 19 bp, Homo sapiens
ttactaaattgtatacatt

SEQ ID NO: 1447106 - DNA, 13 bp, Homo sapiens
ttactaagaagaa

SEQ ID NO: 1447107 - DNA, 22 bp, Homo sapiens
ttactaagaagaaaattgctgt

SEQ ID NO: 1447108 - DNA, 12 bp, Homo sapiens
ttactaatatat

SEQ ID NO: 1447109 - DNA, 17 bp, Homo sapiens
ttactaattatactact

SEQ ID NO: 1447110 - DNA, 22 bp, Homo sapiens
ttactaatttaaagatgctgtc

SEQ ID NO: 1447111 - DNA, 18 bp, Homo sapiens
ttactacagccttaatat

SEQ ID NO: 1447112 - DNA, 23 bp, Homo sapiens
ttactacataattaaattttaat

SEQ ID NO: 1447113 - DNA, 14 bp, Homo sapiens
ttactactgtggaa

SEQ ID NO: 1447114 - DNA, 21 bp, Homo sapiens
ttactagtactatttcttaat

SEQ ID NO: 1447115 - DNA, 21 bp, Homo sapiens
ttactatccatttcttcatgt

SEQ ID NO: 1447116 - DNA, 18 bp, Homo sapiens
ttactatctgttgaaaag

SEQ ID NO: 1447117 - DNA, 20 bp, Homo sapiens
ttactatctgttgaaaaggt

SEQ ID NO: 1447118 - DNA, 13 bp, Homo sapiens
ttactatgcacaa

SEQ ID NO: 1447119 - DNA, 16 bp, Homo sapiens
ttactatgcacaattt

SEQ ID NO: 1447120 - DNA, 14 bp, Homo sapiens
ttactcagccctgg

SEQ ID NO: 1447121 - DNA, 14 bp, Homo sapiens
ttactcaggaagaa

SEQ ID NO: 1447122 - DNA, 12 bp, Homo sapiens
ttactcagtgtt

SEQ ID NO: 1447123 - DNA, 21 bp, Homo sapiens
ttactccacagcggaggagac

SEQ ID NO: 1447124 - DNA, 22 bp, Homo sapiens
ttactccaggttattgcaataa

SEQ ID NO: 1447125 - DNA, 14 bp, Homo sapiens
ttactcccttcctg

SEQ ID NO: 1447126 - DNA, 16 bp, Homo sapiens
ttactcccttcctggc

SEQ ID NO: 1447127 - DNA, 18 bp, Homo sapiens
ttactcccttcctggcct

SEQ ID NO: 1447128 - DNA, 16 bp, Homo sapiens
ttactcgatgtaaggg

SEQ ID NO: 1447129 - DNA, 12 bp, Homo sapiens
ttactctaagat

SEQ ID NO: 1447130 - DNA, 19 bp, Homo sapiens
ttactctaagatcttagat

SEQ ID NO: 1447131 - DNA, 19 bp, Homo sapiens
ttactctcaaaatctttgt

SEQ ID NO: 1447132 - DNA, 16 bp, Homo sapiens
ttactctccaacctgg

SEQ ID NO: 1447133 - DNA, 13 bp, Homo sapiens
ttactctctccga

SEQ ID NO: 1447134 - DNA, 18 bp, Homo sapiens
ttactctgagcccaggcc

SEQ ID NO: 1447135 - DNA, 14 bp, Homo sapiens
ttactctgcctaca

SEQ ID NO: 1447136 - DNA, 18 bp, Homo sapiens
ttactctgcctacagaac

SEQ ID NO: 1447137 - DNA, 20 bp, Homo sapiens
ttactctttttcaataaatt

SEQ ID NO: 1447138 - DNA, 20 bp, Homo sapiens
ttactgaaggtaaaattgaa

SEQ ID NO: 1447139 - DNA, 12 bp, Homo sapiens
ttactgaatgca

SEQ ID NO: 1447140 - DNA, 14 bp, Homo sapiens
ttactgaattgtat

SEQ ID NO: 1447141 - DNA, 14 bp, Homo sapiens
ttactgacatttct

SEQ ID NO: 1447142 - DNA, 16 bp, Homo sapiens
ctagagtagaggtata

SEQ ID NO: 1447143 - DNA, 15 bp, Homo sapiens
ctagagtcctcactc

SEQ ID NO: 1447144 - DNA, 22 bp, Homo sapiens
ctagagtgtagcctaaagggca

SEQ ID NO: 1447145 - DNA, 15 bp, Homo sapiens
ctagagttcggtctg

SEQ ID NO: 1447146 - DNA, 20 bp, Homo sapiens
ctagagtttagtccttactg

SEQ ID NO: 1447147 - DNA, 15 bp, Homo sapiens
ctagagtttatacag

SEQ ID NO: 1447148 - DNA, 23 bp, Homo sapiens
ctagataaaaagatggcctttgc

SEQ ID NO: 1447149 - DNA, 14 bp, Homo sapiens
ctagatatcgactt

SEQ ID NO: 1447150 - DNA, 15 bp, Homo sapiens
ctagatcaaggagcc

SEQ ID NO: 1447151 - DNA, 20 bp, Homo sapiens
ctagatcagatgctccaaga

SEQ ID NO: 1447152 - DNA, 15 bp, Homo sapiens
ctagatcataaggct

SEQ ID NO: 1447153 - DNA, 18 bp, Homo sapiens
ctagatcataaggcttca

SEQ ID NO: 1447154 - DNA, 21 bp, Homo sapiens
ctagatccacacacagaggaa

SEQ ID NO: 1447155 - DNA, 17 bp, Homo sapiens
ctagatcctgcacccca

SEQ ID NO: 1447156 - DNA, 19 bp, Homo sapiens
ctagatcctgcaccccagc

SEQ ID NO: 1447157 - DNA, 22 bp, Homo sapiens
ctagatgattaaataagattct

SEQ ID NO: 1447158 - DNA, 22 bp, Homo sapiens
ctagatgcacgtggggcccact

SEQ ID NO: 1447159 - DNA, 12 bp, Homo sapiens
ctagatgtgttc

SEQ ID NO: 1447160 - DNA, 20 bp, Homo sapiens
ctagatgtttaacaaatcta

SEQ ID NO: 1447161 - DNA, 22 bp, Homo sapiens
ctagatgtttattcttctagag

SEQ ID NO: 1447162 - DNA, 19 bp, Homo sapiens
ctagattaagatctgtgtt

SEQ ID NO: 1447163 - DNA, 22 bp, Homo sapiens
ctagattaagatctgtgtttta

SEQ ID NO: 1447164 - DNA, 23 bp, Homo sapiens
ctagattaggtagactttgctta

SEQ ID NO: 1447165 - DNA, 12 bp, Homo sapiens
ctagattcaaag

SEQ ID NO: 1447166 - DNA, 14 bp, Homo sapiens
ctagattcaaaggt

SEQ ID NO: 1447167 - DNA, 16 bp, Homo sapiens
ctagattcaaaggttc

SEQ ID NO: 1447168 - DNA, 20 bp, Homo sapiens
ctagattcaaaggttctagg

SEQ ID NO: 1447169 - DNA, 21 bp, Homo sapiens
ctagattcaaaggttctaggt

SEQ ID NO: 1447170 - DNA, 16 bp, Homo sapiens
ctagattcactgtctt

SEQ ID NO: 1447171 - DNA, 14 bp, Homo sapiens
ctagattcataaat

SEQ ID NO: 1447172 - DNA, 17 bp, Homo sapiens
ctagattcataaataca

SEQ ID NO: 1447173 - DNA, 22 bp, Homo sapiens
ctagattccattggtccaagat

SEQ ID NO: 1447174 - DNA, 21 bp, Homo sapiens
ctagattgctaaggagctgat

SEQ ID NO: 1447175 - DNA, 12 bp, Homo sapiens
ctagatttatta

SEQ ID NO: 1447176 - DNA, 21 bp, Homo sapiens
ctagatttattagtcctaatt

SEQ ID NO: 1447177 - DNA, 15 bp, Homo sapiens
ctagatttgtccttt

SEQ ID NO: 1447178 - DNA, 22 bp, Homo sapiens
ctagatttgtccttttatttct

SEQ ID NO: 1447179 - DNA, 16 bp, Homo sapiens
ctagcaaaactcacag

SEQ ID NO: 1447180 - DNA, 21 bp, Homo sapiens
ctagcaagaagattctaaaac

SEQ ID NO: 1447181 - DNA, 19 bp, Homo sapiens
ctagcaatctcttcattat

SEQ ID NO: 1447182 - DNA, 23 bp, Homo sapiens
ctagcagagcaggggcagggtga

SEQ ID NO: 1447183 - DNA, 19 bp, Homo sapiens
ctagcagcccaccctgctg

SEQ ID NO: 1447184 - DNA, 14 bp, Homo sapiens
ctagcagctgcagt

SEQ ID NO: 1447185 - DNA, 19 bp, Homo sapiens
ctagcagctgcagtcaaca

SEQ ID NO: 1447186 - DNA, 23 bp, Homo sapiens
ctagcaggcacaggacacctggc

SEQ ID NO: 1447187 - DNA, 14 bp, Homo sapiens
ctagcaggcctaag

SEQ ID NO: 1447188 - DNA, 17 bp, Homo sapiens
ctagcagggaacactaa

SEQ ID NO: 1447189 - DNA, 17 bp, Homo sapiens
ctagcagtgaactattt

SEQ ID NO: 1447190 - DNA, 13 bp, Homo sapiens
ctagcatccctga

SEQ ID NO: 1447191 - DNA, 20 bp, Homo sapiens
ctagccaaaccaggaccctg

SEQ ID NO: 1447192 - DNA, 14 bp, Homo sapiens
ctagccacctccca

SEQ ID NO: 1447193 - DNA, 19 bp, Homo sapiens
ctagccacctcccacccca

SEQ ID NO: 1447194 - DNA, 20 bp, Homo sapiens
ctagccacctcccaccccac

SEQ ID NO: 1447195 - DNA, 21 bp, Homo sapiens
ctagccacctcccaccccact

SEQ ID NO: 1447196 - DNA, 22 bp, Homo sapiens
ctagccagacactctgctctgc

SEQ ID NO: 1447197 - DNA, 19 bp, Homo sapiens
ctagccagagcccttcact

SEQ ID NO: 1447198 - DNA, 19 bp, Homo sapiens
ctagccaggagtctgtgct

SEQ ID NO: 1447199 - DNA, 14 bp, Homo sapiens
ctagcccacccccc

SEQ ID NO: 1447200 - DNA, 18 bp, Homo sapiens
ctagcccagtccctggag

SEQ ID NO: 1447201 - DNA, 22 bp, Homo sapiens
ctagcccatggacttcacataa

SEQ ID NO: 1447202 - DNA, 15 bp, Homo sapiens
ctagccccgagacac

SEQ ID NO: 1447203 - DNA, 18 bp, Homo sapiens
ctagccccgagacaccat

SEQ ID NO: 1447204 - DNA, 13 bp, Homo sapiens
ctagccctggtta

SEQ ID NO: 1447205 - DNA, 19 bp, Homo sapiens
ctagccctggttagctgac

SEQ ID NO: 1447206 - DNA, 15 bp, Homo sapiens
ctagccgacctcagc

SEQ ID NO: 1447207 - DNA, 17 bp, Homo sapiens
ctagccgacctcagcct

SEQ ID NO: 1447208 - DNA, 19 bp, Homo sapiens
ctagccgacctcagccttc

SEQ ID NO: 1447209 - DNA, 23 bp, Homo sapiens
ctagcctaaagtatacaactgcc

SEQ ID NO: 1447210 - DNA, 19 bp, Homo sapiens
ctagcctgcattgagcttg

SEQ ID NO: 1447211 - DNA, 22 bp, Homo sapiens
ctagccttaatcaggtcctcag

SEQ ID NO: 1447212 - DNA, 19 bp, Homo sapiens
ctagccttgaggagtgtga

SEQ ID NO: 1447213 - DNA, 14 bp, Homo sapiens
ctagccttgcttgt

SEQ ID NO: 1447214 - DNA, 12 bp, Homo sapiens
ctagcgctgccg

SEQ ID NO: 1447215 - DNA, 22 bp, Homo sapiens
ctagcgctgccgcaccccagag

SEQ ID NO: 1447216 - DNA, 16 bp, Homo sapiens
ctagcggagcccagcc

SEQ ID NO: 1447217 - DNA, 17 bp, Homo sapiens
ctagcggagcccagcct

SEQ ID NO: 1447218 - DNA, 14 bp, Homo sapiens
ctagctagaaatat

SEQ ID NO: 1447219 - DNA, 16 bp, Homo sapiens
ctagctagaaatatga

SEQ ID NO: 1447220 - DNA, 22 bp, Homo sapiens
ctagctataacaactctatttt

SEQ ID NO: 1447221 - DNA, 14 bp, Homo sapiens
ctagctcaccaggc

SEQ ID NO: 1447222 - DNA, 21 bp, Homo sapiens
ctagctcaccaggcctggcct

SEQ ID NO: 1447223 - DNA, 22 bp, Homo sapiens
ctagctcaccaggcctggcctc

SEQ ID NO: 1447224 - DNA, 22 bp, Homo sapiens
ctagctccacaccctctcccag

SEQ ID NO: 1447225 - DNA, 15 bp, Homo sapiens
ctagctcctcccctt

SEQ ID NO: 1447226 - DNA, 16 bp, Homo sapiens
ctagctctctaggcct

SEQ ID NO: 1447227 - DNA, 21 bp, Homo sapiens
ctagctctctaggcctctcca

SEQ ID NO: 1447228 - DNA, 13 bp, Homo sapiens
ctagctgaccccg

SEQ ID NO: 1447229 - DNA, 22 bp, Homo sapiens
ctagctgaccccgagaagtgct

SEQ ID NO: 1447230 - DNA, 13 bp, Homo sapiens
ctagctgccactt

SEQ ID NO: 1447231 - DNA, 14 bp, Homo sapiens
ctagctggctctgt

SEQ ID NO: 1447232 - DNA, 17 bp, Homo sapiens
ctagctgtatgatttgt

SEQ ID NO: 1447233 - DNA, 16 bp, Homo sapiens
ctagctgtcccatggg

SEQ ID NO: 1447234 - DNA, 13 bp, Homo sapiens
ctagcttctgctt

SEQ ID NO: 1447235 - DNA, 22 bp, Homo sapiens
ctagcttctgcttttctgccct

SEQ ID NO: 1447236 - DNA, 18 bp, Homo sapiens
ctagctttacgctcatca

SEQ ID NO: 1447237 - DNA, 14 bp, Homo sapiens
ctaggaaactcaca

SEQ ID NO: 1447238 - DNA, 18 bp, Homo sapiens
ctaggaagtacgagcccc

SEQ ID NO: 1447239 - DNA, 16 bp, Homo sapiens
ctaggaatcccagagg

SEQ ID NO: 1447240 - DNA, 15 bp, Homo sapiens
ctaggacacagttcc

SEQ ID NO: 1447241 - DNA, 12 bp, Homo sapiens
ctaggactcaga

SEQ ID NO: 1447242 - DNA, 14 bp, Homo sapiens
ctaggactctgagg

SEQ ID NO: 1447243 - DNA, 15 bp, Homo sapiens
ctaggactctgaggc

SEQ ID NO: 1447244 - DNA, 22 bp, Homo sapiens
ctaggactctgaggctctttct

SEQ ID NO: 1447245 - DNA, 13 bp, Homo sapiens
ctaggactgagga

SEQ ID NO: 1447246 - DNA, 23 bp, Homo sapiens
ctaggagacagagccaagcactg

SEQ ID NO: 1447247 - DNA, 16 bp, Homo sapiens
ctaggagccccagctt

SEQ ID NO: 1447248 - DNA, 18 bp, Homo sapiens
ctaggagctggctggcag

SEQ ID NO: 1447249 - DNA, 19 bp, Homo sapiens
ctaggagctgggaggaaaa

SEQ ID NO: 1447250 - DNA, 22 bp, Homo sapiens
ctaggagttgagtacagtgagg

SEQ ID NO: 1447251 - DNA, 20 bp, Homo sapiens
ctaggatacagaaatgcaaa

SEQ ID NO: 1447252 - DNA, 16 bp, Homo sapiens
ctaggatcccactggc

SEQ ID NO: 1447253 - DNA, 16 bp, Homo sapiens
ctaggatgctgcagca

SEQ ID NO: 1447254 - DNA, 18 bp, Homo sapiens
ctaggattgggcctccca

SEQ ID NO: 1447255 - DNA, 13 bp, Homo sapiens
ctaggatttcatg

SEQ ID NO: 1447256 - DNA, 22 bp, Homo sapiens
ctaggcacctccccgctctccc

SEQ ID NO: 1447257 - DNA, 12 bp, Homo sapiens
ctaggcagcctg

SEQ ID NO: 1447258 - DNA, 19 bp, Homo sapiens
ttactgagcttctctgtga

SEQ ID NO: 1447259 - DNA, 11 bp, Homo sapiens
ttactgccttg

SEQ ID NO: 1447260 - DNA, 14 bp, Homo sapiens
ttactgccttgaaa

SEQ ID NO: 1447261 - DNA, 17 bp, Homo sapiens
ttactgctgattcttgt

SEQ ID NO: 1447262 - DNA, 19 bp, Homo sapiens
ttactgcttcccattgagt

SEQ ID NO: 1447263 - DNA, 15 bp, Homo sapiens
ttactgctttgcaaa

SEQ ID NO: 1447264 - DNA, 14 bp, Homo sapiens
ttactgcttttcat

SEQ ID NO: 1447265 - DNA, 15 bp, Homo sapiens
ttactgcttttcatt

SEQ ID NO: 1447266 - DNA, 18 bp, Homo sapiens
ttactggaaactaattgt

SEQ ID NO: 1447267 - DNA, 15 bp, Homo sapiens
ctaggcctctccagt

SEQ ID NO: 1447268 - DNA, 16 bp, Homo sapiens
ctaggcctctccagtt

SEQ ID NO: 1447269 - DNA, 19 bp, Homo sapiens
ctaggcgattttgtctacc

SEQ ID NO: 1447270 - DNA, 11 bp, Homo sapiens
ctaggctggaa

SEQ ID NO: 1447271 - DNA, 15 bp, Homo sapiens
ctaggctggaagagc

SEQ ID NO: 1447272 - DNA, 17 bp, Homo sapiens
ctagggaatctggatta

SEQ ID NO: 1447273 - DNA, 15 bp, Homo sapiens
ctagggagagaccct

SEQ ID NO: 1447274 - DNA, 18 bp, Homo sapiens
ctagggagccatttgaga

SEQ ID NO: 1447275 - DNA, 16 bp, Homo sapiens
ctagggattcaggctg

SEQ ID NO: 1447276 - DNA, 18 bp, Homo sapiens
ctagggattcaggctgct

SEQ ID NO: 1447277 - DNA, 14 bp, Homo sapiens
ctaggggatgaggg

SEQ ID NO: 1447278 - DNA, 17 bp, Homo sapiens
ctaggggtcctcgggat

SEQ ID NO: 1447279 - DNA, 23 bp, Homo sapiens
ctaggggtgcgctcacctgcagc

SEQ ID NO: 1447280 - DNA, 20 bp, Homo sapiens
ctagggtgccttaaaaataa

SEQ ID NO: 1447281 - DNA, 14 bp, Homo sapiens
ctagggtgttttaa

SEQ ID NO: 1447282 - DNA, 15 bp, Homo sapiens
ctaggtaaaatttgt

SEQ ID NO: 1447283 - DNA, 20 bp, Homo sapiens
ctaggtacgatgacagtgtt

SEQ ID NO: 1447284 - DNA, 14 bp, Homo sapiens
ctaggtaggaagag

SEQ ID NO: 1447285 - DNA, 20 bp, Homo sapiens
ctaggtatcattcaactctc

SEQ ID NO: 1447286 - DNA, 17 bp, Homo sapiens
ctaggtctcctcagggt

SEQ ID NO: 1447287 - DNA, 15 bp, Homo sapiens
ctaggtgcccagggc

SEQ ID NO: 1447288 - DNA, 17 bp, Homo sapiens
ctaggtgcccagggcca

SEQ ID NO: 1447289 - DNA, 13 bp, Homo sapiens
ctaggtgtcccca

SEQ ID NO: 1447290 - DNA, 14 bp, Homo sapiens
ctaggtgtccccaa

SEQ ID NO: 1447291 - DNA, 14 bp, Homo sapiens
ctaggtgtggctgt

SEQ ID NO: 1447292 - DNA, 18 bp, Homo sapiens
ctaggttggacagccccc

SEQ ID NO: 1447293 - DNA, 22 bp, Homo sapiens
ctaggttttggagagtttgcct

SEQ ID NO: 1447294 - DNA, 16 bp, Homo sapiens
ctagtaatatatttaa

SEQ ID NO: 1447295 - DNA, 21 bp, Homo sapiens
ctagtaccctatagagagggg

SEQ ID NO: 1447296 - DNA, 18 bp, Homo sapiens
ctagtactctctgctcta

SEQ ID NO: 1447297 - DNA, 16 bp, Homo sapiens
ctagtacttgaaaaag

SEQ ID NO: 1447298 - DNA, 15 bp, Homo sapiens
ctagtagctggcgcc

SEQ ID NO: 1447299 - DNA, 22 bp, Homo sapiens
ctagtaggcagcaaaagaccaa

SEQ ID NO: 1447300 - DNA, 14 bp, Homo sapiens
ctagtcacaaagac

SEQ ID NO: 1447301 - DNA, 14 bp, Homo sapiens
ctagtcactggcag

SEQ ID NO: 1447302 - DNA, 15 bp, Homo sapiens
ctagtcactggcagc

SEQ ID NO: 1447303 - DNA, 17 bp, Homo sapiens
ctagtcactggcagcct

SEQ ID NO: 1447304 - DNA, 19 bp, Homo sapiens
ctagtcactggcagcctgc

SEQ ID NO: 1447305 - DNA, 19 bp, Homo sapiens
ctagtccccaaggcctctc

SEQ ID NO: 1447306 - DNA, 17 bp, Homo sapiens
ctagtccccctgttttc

SEQ ID NO: 1447307 - DNA, 21 bp, Homo sapiens
ctagtccccctgttttctgtt

SEQ ID NO: 1447308 - DNA, 16 bp, Homo sapiens
ctagtcccctttcctc

SEQ ID NO: 1447309 - DNA, 14 bp, Homo sapiens
ctagtcccttcccc

SEQ ID NO: 1447310 - DNA, 20 bp, Homo sapiens
ctagtcccttcccctccctg

SEQ ID NO: 1447311 - DNA, 21 bp, Homo sapiens
ctagtcccttcccctccctgg

SEQ ID NO: 1447312 - DNA, 18 bp, Homo sapiens
ctagtcctatggaaaaaa

SEQ ID NO: 1447313 - DNA, 23 bp, Homo sapiens
ctagtctcctttgcactgagggc

SEQ ID NO: 1447314 - DNA, 23 bp, Homo sapiens
ctagtctctgatttgcaaatgca

SEQ ID NO: 1447315 - DNA, 16 bp, Homo sapiens
ctagtcttgaatttct

SEQ ID NO: 1447316 - DNA, 19 bp, Homo sapiens
ctagtgaccccttccctgt

SEQ ID NO: 1447317 - DNA, 20 bp, Homo sapiens
ctagtgacttgtgtcccatg

SEQ ID NO: 1447318 - DNA, 17 bp, Homo sapiens
ctagtgaggaagacaag

SEQ ID NO: 1447319 - DNA, 16 bp, Homo sapiens
ctagtgagtcagcacc

SEQ ID NO: 1447320 - DNA, 19 bp, Homo sapiens
ctagtgcagctgaaattga

SEQ ID NO: 1447321 - DNA, 13 bp, Homo sapiens
ctagtgccccaga

SEQ ID NO: 1447322 - DNA, 18 bp, Homo sapiens
ctagtgccccagactgag

SEQ ID NO: 1447323 - DNA, 23 bp, Homo sapiens
ctagtgccctccacagccgcagc

SEQ ID NO: 1447324 - DNA, 12 bp, Homo sapiens
ctagtgctgctg

SEQ ID NO: 1447325 - DNA, 12 bp, Homo sapiens
ctagtgctgtaa

SEQ ID NO: 1447326 - DNA, 23 bp, Homo sapiens
ctagtgctgtaatattgtaaata

SEQ ID NO: 1447327 - DNA, 15 bp, Homo sapiens
ctagtggcttcaaaa

SEQ ID NO: 1447328 - DNA, 23 bp, Homo sapiens
ctagtggggtctccctctcctgc

SEQ ID NO: 1447329 - DNA, 20 bp, Homo sapiens
ctagtgggttgacctttaaa

SEQ ID NO: 1447330 - DNA, 15 bp, Homo sapiens
ctagtggtagtatct

SEQ ID NO: 1447331 - DNA, 18 bp, Homo sapiens
ctagtggtagtatctcgt

SEQ ID NO: 1447332 - DNA, 16 bp, Homo sapiens
ctagtgtgagtggcag

SEQ ID NO: 1447333 - DNA, 19 bp, Homo sapiens
ctagtgtgagtggcagcca

SEQ ID NO: 1447334 - DNA, 23 bp, Homo sapiens
ctagtgtgagtggcagccatgcc

SEQ ID NO: 1447335 - DNA, 14 bp, Homo sapiens
ctagtgttgcttgg

SEQ ID NO: 1447336 - DNA, 20 bp, Homo sapiens
ctagttaacctagaagtatt

SEQ ID NO: 1447337 - DNA, 23 bp, Homo sapiens
ctagttaaggtgtgcaaagatct

SEQ ID NO: 1447338 - DNA, 23 bp, Homo sapiens
ctagttaccacattactctgcct

SEQ ID NO: 1447339 - DNA, 18 bp, Homo sapiens
ctagttcatccaatcctc

SEQ ID NO: 1447340 - DNA, 20 bp, Homo sapiens
ctagttcatccaatcctcac

SEQ ID NO: 1447341 - DNA, 20 bp, Homo sapiens
ctagttcctgatgacccagg

SEQ ID NO: 1447342 - DNA, 15 bp, Homo sapiens
ctagttctaatttca

SEQ ID NO: 1447343 - DNA, 22 bp, Homo sapiens
ctagttctcagcttgcagctgg

SEQ ID NO: 1447344 - DNA, 11 bp, Homo sapiens
ctagttctgct

SEQ ID NO: 1447345 - DNA, 17 bp, Homo sapiens
ctagttctgctgccctc

SEQ ID NO: 1447346 - DNA, 21 bp, Homo sapiens
ctagttctgctgccctcttaa

SEQ ID NO: 1447347 - DNA, 13 bp, Homo sapiens
ctagttctttcct

SEQ ID NO: 1447348 - DNA, 21 bp, Homo sapiens
ctagttctttcctccccctgc

SEQ ID NO: 1447349 - DNA, 22 bp, Homo sapiens
ctagttctttgttcatagccca

SEQ ID NO: 1447350 - DNA, 21 bp, Homo sapiens
ctagttgatgtatggtatctt

SEQ ID NO: 1447351 - DNA, 15 bp, Homo sapiens
ctagttggagtgctt

SEQ ID NO: 1447352 - DNA, 19 bp, Homo sapiens
ctagttggagtgcttgttt

SEQ ID NO: 1447353 - DNA, 20 bp, Homo sapiens
ctagttggagtgcttgttta

SEQ ID NO: 1447354 - DNA, 15 bp, Homo sapiens
ctagttgttatcaat

SEQ ID NO: 1447355 - DNA, 14 bp, Homo sapiens
ctagtttacagaaa

SEQ ID NO: 1447356 - DNA, 16 bp, Homo sapiens
ctagtttactgttttg

SEQ ID NO: 1447357 - DNA, 16 bp, Homo sapiens
ctagtttcagtaaata

SEQ ID NO: 1447358 - DNA, 22 bp, Homo sapiens
ctagtttcagtaaataatgaaa

SEQ ID NO: 1447359 - DNA, 23 bp, Homo sapiens
ctagtttgaacaggatatgttca

SEQ ID NO: 1447360 - DNA, 15 bp, Homo sapiens
ctagttttttttgta

SEQ ID NO: 1447361 - DNA, 18 bp, Homo sapiens
ctagttttttttgtaaac

SEQ ID NO: 1447362 - DNA, 19 bp, Homo sapiens
ctagttttttttgtaaact

SEQ ID NO: 1447363 - DNA, 15 bp, Homo sapiens
ctataaaactctgca

SEQ ID NO: 1447364 - DNA, 11 bp, Homo sapiens
ctataaaatag

SEQ ID NO: 1447365 - DNA, 15 bp, Homo sapiens
ctataaaattaaatg

SEQ ID NO: 1447366 - DNA, 22 bp, Homo sapiens
ctataaaattaaatgccttgta

SEQ ID NO: 1447367 - DNA, 13 bp, Homo sapiens
ctataaagagaag

SEQ ID NO: 1447368 - DNA, 14 bp, Homo sapiens
ctataaagcagtat

SEQ ID NO: 1447369 - DNA, 17 bp, Homo sapiens
ctataaatcagtatttt

SEQ ID NO: 1447370 - DNA, 20 bp, Homo sapiens
ctataaatgccagagccaac

SEQ ID NO: 1447371 - DNA, 16 bp, Homo sapiens
ctataaatggtgtttt

SEQ ID NO: 1447372 - DNA, 15 bp, Homo sapiens
ctataacaatcactg

SEQ ID NO: 1447373 - DNA, 13 bp, Homo sapiens
ctataacactgtg

SEQ ID NO: 1447374 - DNA, 19 bp, Homo sapiens
ctataacactgtgaagagc

SEQ ID NO: 1447375 - DNA, 18 bp, Homo sapiens
ctataaccccagctccct

SEQ ID NO: 1447376 - DNA, 13 bp, Homo sapiens
ttagcaaagagtt

SEQ ID NO: 1447377 - DNA, 19 bp, Homo sapiens
ttagcaaagagttaatata

SEQ ID NO: 1447378 - DNA, 20 bp, Homo sapiens
ttagcaaagagttaatatat

SEQ ID NO: 1447379 - DNA, 15 bp, Homo sapiens
ttagcaactagggct

SEQ ID NO: 1447380 - DNA, 17 bp, Homo sapiens
ttagcatctaatttcaa

SEQ ID NO: 1447381 - DNA, 13 bp, Homo sapiens
ttagcatttgtat

SEQ ID NO: 1447382 - DNA, 23 bp, Homo sapiens
ctataagtgagatggtatgaaat

SEQ ID NO: 1447383 - DNA, 12 bp, Homo sapiens
ctataatcatta

SEQ ID NO: 1447384 - DNA, 18 bp, Homo sapiens
ctataatcattagtttta

SEQ ID NO: 1447385 - DNA, 19 bp, Homo sapiens
ctataatcccagcactttg

SEQ ID NO: 1447386 - DNA, 15 bp, Homo sapiens
ctataatcccagcta

SEQ ID NO: 1447387 - DNA, 17 bp, Homo sapiens
ctataatcccagctact

SEQ ID NO: 1447388 - DNA, 14 bp, Homo sapiens
ctataatctgtttt

SEQ ID NO: 1447389 - DNA, 15 bp, Homo sapiens
ctatacaactggaca

SEQ ID NO: 1447390 - DNA, 17 bp, Homo sapiens
ctatacaatgtatgtaa

SEQ ID NO: 1447391 - DNA, 22 bp, Homo sapiens
ctatacaatgtatgtaatttgt

SEQ ID NO: 1447392 - DNA, 13 bp, Homo sapiens
ctatacacacaca

SEQ ID NO: 1447393 - DNA, 15 bp, Homo sapiens
ctatacccacccaga

SEQ ID NO: 1447394 - DNA, 18 bp, Homo sapiens
ctatacctcacaataaga

SEQ ID NO: 1447395 - DNA, 18 bp, Homo sapiens
ctatacttatcacatttt

SEQ ID NO: 1447396 - DNA, 12 bp, Homo sapiens
ctatactttgtt

SEQ ID NO: 1447397 - DNA, 13 bp, Homo sapiens
ctatactttgttc

SEQ ID NO: 1447398 - DNA, 16 bp, Homo sapiens
ctatactttgttctgt

SEQ ID NO: 1447399 - DNA, 19 bp, Homo sapiens
ctatactttgttctgttgt

SEQ ID NO: 1447400 - DNA, 22 bp, Homo sapiens
ctatagactgtaagctccatga

SEQ ID NO: 1447401 - DNA, 15 bp, Homo sapiens
ctatagcttgcagaa

SEQ ID NO: 1447402 - DNA, 21 bp, Homo sapiens
ctatagcttgcagaactgtag

SEQ ID NO: 1447403 - DNA, 19 bp, Homo sapiens
ctataggcagcttctaaga

SEQ ID NO: 1447404 - DNA, 22 bp, Homo sapiens
ctatagggatgaactttttcct

SEQ ID NO: 1447405 - DNA, 14 bp, Homo sapiens
ctatagtcccagct

SEQ ID NO: 1447406 - DNA, 20 bp, Homo sapiens
ctatatagttccttgcctta

SEQ ID NO: 1447407 - DNA, 21 bp, Homo sapiens
ctatatagttccttgccttaa

SEQ ID NO: 1447408 - DNA, 22 bp, Homo sapiens
ctatatagtttattgacaataa

SEQ ID NO: 1447409 - DNA, 15 bp, Homo sapiens
ctatatataaaacgg

SEQ ID NO: 1447410 - DNA, 14 bp, Homo sapiens
ctatatataaagac

SEQ ID NO: 1447411 - DNA, 17 bp, Homo sapiens
ctatatatataaatgta

SEQ ID NO: 1447412 - DNA, 13 bp, Homo sapiens
ctatatatataat

SEQ ID NO: 1447413 - DNA, 14 bp, Homo sapiens
ctatatatatttct

SEQ ID NO: 1447414 - DNA, 13 bp, Homo sapiens
ctatatatttcta

SEQ ID NO: 1447415 - DNA, 14 bp, Homo sapiens
ctatatatttctat

SEQ ID NO: 1447416 - DNA, 19 bp, Homo sapiens
ctatatcagtcgttttagt

SEQ ID NO: 1447417 - DNA, 14 bp, Homo sapiens
ctatatcatatttc

SEQ ID NO: 1447418 - DNA, 19 bp, Homo sapiens
ctatatcatatttctgtgg

SEQ ID NO: 1447419 - DNA, 17 bp, Homo sapiens
ctatatcctgtgactgt

SEQ ID NO: 1447420 - DNA, 18 bp, Homo sapiens
ctatatcgagagtgtgtg

SEQ ID NO: 1447421 - DNA, 15 bp, Homo sapiens
ctatatctatttgag

SEQ ID NO: 1447422 - DNA, 15 bp, Homo sapiens
ctatatctgtatata

SEQ ID NO: 1447423 - DNA, 20 bp, Homo sapiens
ctatatgaatttaaatataa

SEQ ID NO: 1447424 - DNA, 14 bp, Homo sapiens
ctatatgatttagc

SEQ ID NO: 1447425 - DNA, 21 bp, Homo sapiens
ctatatgtagtataaagaaaa

SEQ ID NO: 1447426 - DNA, 17 bp, Homo sapiens
ctatattagatcaaata

SEQ ID NO: 1447427 - DNA, 12 bp, Homo sapiens
ctatattatgtc

SEQ ID NO: 1447428 - DNA, 16 bp, Homo sapiens
ctatattatgtcttct

SEQ ID NO: 1447429 - DNA, 22 bp, Homo sapiens
ctatattgttttcagtgtacat

SEQ ID NO: 1447430 - DNA, 16 bp, Homo sapiens
ctatatttaacaagat

SEQ ID NO: 1447431 - DNA, 13 bp, Homo sapiens
ctatatttacaaa

SEQ ID NO: 1447432 - DNA, 23 bp, Homo sapiens
ctatatttagattgttaaaataa

SEQ ID NO: 1447433 - DNA, 23 bp, Homo sapiens
ctatatttattttcagtatactg

SEQ ID NO: 1447434 - DNA, 13 bp, Homo sapiens
ctatatttcatat

SEQ ID NO: 1447435 - DNA, 16 bp, Homo sapiens
ctatatttcatattga

SEQ ID NO: 1447436 - DNA, 17 bp, Homo sapiens
ctatatttgattatgta

SEQ ID NO: 1447437 - DNA, 22 bp, Homo sapiens
ctatatttgggcctgctccaga

SEQ ID NO: 1447438 - DNA, 14 bp, Homo sapiens
ctatattttcctga

SEQ ID NO: 1447439 - DNA, 21 bp, Homo sapiens
ctatcaaactgaagccagaaa

SEQ ID NO: 1447440 - DNA, 20 bp, Homo sapiens
ctatcaacctaagcaacaga

SEQ ID NO: 1447441 - DNA, 21 bp, Homo sapiens
ctatcaacctaagcaacagaa

SEQ ID NO: 1447442 - DNA, 22 bp, Homo sapiens
ctatcaatcaccgtctgtgttt

SEQ ID NO: 1447443 - DNA, 12 bp, Homo sapiens
ctatcactgtct

SEQ ID NO: 1447444 - DNA, 19 bp, Homo sapiens
ctatcagagttgctgcaaa

SEQ ID NO: 1447445 - DNA, 22 bp, Homo sapiens
ctatcatactactgaaacagat

SEQ ID NO: 1447446 - DNA, 13 bp, Homo sapiens
ctatcatggcata

SEQ ID NO: 1447447 - DNA, 19 bp, Homo sapiens
ctatcattgcttcctcctc

SEQ ID NO: 1447448 - DNA, 12 bp, Homo sapiens
ctatccacccag

SEQ ID NO: 1447449 - DNA, 13 bp, Homo sapiens
ctatccacccagc

SEQ ID NO: 1447450 - DNA, 14 bp, Homo sapiens
ctatccacccagcc

SEQ ID NO: 1447451 - DNA, 17 bp, Homo sapiens
ctatccacccagcccat

SEQ ID NO: 1447452 - DNA, 19 bp, Homo sapiens
ctatccacccagcccattc

SEQ ID NO: 1447453 - DNA, 22 bp, Homo sapiens
ctatccatcatgaccagcaaat

SEQ ID NO: 1447454 - DNA, 21 bp, Homo sapiens
ctatcccaataggcagactgg

SEQ ID NO: 1447455 - DNA, 14 bp, Homo sapiens
ctatccccatccag

SEQ ID NO: 1447456 - DNA, 17 bp, Homo sapiens
ctatccccatctccctg

SEQ ID NO: 1447457 - DNA, 17 bp, Homo sapiens
ctatccgctgccagcct

SEQ ID NO: 1447458 - DNA, 19 bp, Homo sapiens
ctatcctagtcttcacaac

SEQ ID NO: 1447459 - DNA, 18 bp, Homo sapiens
ctatcctgtaaatatatc

SEQ ID NO: 1447460 - DNA, 22 bp, Homo sapiens
ctatccttataggcctgtccct

SEQ ID NO: 1447461 - DNA, 12 bp, Homo sapiens
ctatccttggct

SEQ ID NO: 1447462 - DNA, 16 bp, Homo sapiens
ctatccttttgcctgc

SEQ ID NO: 1447463 - DNA, 22 bp, Homo sapiens
ctatcgccctcctttcccttat

SEQ ID NO: 1447464 - DNA, 14 bp, Homo sapiens
ctatctaaatgttg

SEQ ID NO: 1447465 - DNA, 16 bp, Homo sapiens
ctatctaaccctccca

SEQ ID NO: 1447466 - DNA, 20 bp, Homo sapiens
ctatctaggtggagttgaaa

SEQ ID NO: 1447467 - DNA, 18 bp, Homo sapiens
ctatctagttctaacagt

SEQ ID NO: 1447468 - DNA, 18 bp, Homo sapiens
ctatctcaatcctaattt

SEQ ID NO: 1447469 - DNA, 12 bp, Homo sapiens
ctatctccctgg

SEQ ID NO: 1447470 - DNA, 14 bp, Homo sapiens
ctatctccctggct

SEQ ID NO: 1447471 - DNA, 14 bp, Homo sapiens
ctatctcctgacag

SEQ ID NO: 1447472 - DNA, 17 bp, Homo sapiens
ctatctgtctggtggcc

SEQ ID NO: 1447473 - DNA, 18 bp, Homo sapiens
ctatctgtctggtggccc

SEQ ID NO: 1447474 - DNA, 14 bp, Homo sapiens
ctatcttccaaatg

SEQ ID NO: 1447475 - DNA, 14 bp, Homo sapiens
ctatcttttctgga

SEQ ID NO: 1447476 - DNA, 13 bp, Homo sapiens
ctatgaactacaa

SEQ ID NO: 1447477 - DNA, 16 bp, Homo sapiens
ctatgaagacttaaaa

SEQ ID NO: 1447478 - DNA, 19 bp, Homo sapiens
ctatgaagggacagctgct

SEQ ID NO: 1447479 - DNA, 22 bp, Homo sapiens
ctatgaagggacagctgctggg

SEQ ID NO: 1447480 - DNA, 23 bp, Homo sapiens
ctatgaagggacagctgctggga

SEQ ID NO: 1447481 - DNA, 20 bp, Homo sapiens
ctatgaagttgctgtttatt

SEQ ID NO: 1447482 - DNA, 15 bp, Homo sapiens
ctatgacaaattcaa

SEQ ID NO: 1447483 - DNA, 23 bp, Homo sapiens
ctatgacctaggggtttctgttg

SEQ ID NO: 1447484 - DNA, 17 bp, Homo sapiens
ctatgagaacaagtcac

SEQ ID NO: 1447485 - DNA, 22 bp, Homo sapiens
ctatgagaacaagtcacagctg

SEQ ID NO: 1447486 - DNA, 13 bp, Homo sapiens
ctatgagtctaga

SEQ ID NO: 1447487 - DNA, 23 bp, Homo sapiens
ctatgatattttctgtgcctgaa

SEQ ID NO: 1447488 - DNA, 15 bp, Homo sapiens
ctatgatctcaggag

SEQ ID NO: 1447489 - DNA, 18 bp, Homo sapiens
ctatgatgagaggccagc

SEQ ID NO: 1447490 - DNA, 20 bp, Homo sapiens
ctatgatgagaggccagcac

SEQ ID NO: 1447491 - DNA, 18 bp, Homo sapiens
ctatgatttttttttcca

SEQ ID NO: 1447492 - DNA, 23 bp, Homo sapiens
ctatgcaaaatagacatctttaa

SEQ ID NO: 1447493 - DNA, 13 bp, Homo sapiens
ctatgcacatatg

SEQ ID NO: 1447494 - DNA, 22 bp, Homo sapiens
ctatgcacatatggactctgca

SEQ ID NO: 1447495 - DNA, 13 bp, Homo sapiens
ttagttggctgga

SEQ ID NO: 1447496 - DNA, 17 bp, Homo sapiens
ttagttggctggaaact

SEQ ID NO: 1447497 - DNA, 20 bp, Homo sapiens
ctatgcatatcagttgagct

SEQ ID NO: 1447498 - DNA, 20 bp, Homo sapiens
ctatgcatggtgccccagga

SEQ ID NO: 1447499 - DNA, 23 bp, Homo sapiens
ctatgcatggtgccccaggacca

SEQ ID NO: 1447500 - DNA, 15 bp, Homo sapiens
ctatgccaaagatca

SEQ ID NO: 1447501 - DNA, 18 bp, Homo sapiens
ctatgccaaagatcactt

SEQ ID NO: 1447502 - DNA, 22 bp, Homo sapiens
ctatgccaaagatcacttgttg

SEQ ID NO: 1447503 - DNA, 15 bp, Homo sapiens
ctatgccgtcttctg

SEQ ID NO: 1447504 - DNA, 19 bp, Homo sapiens
ctatgcggaggaaagcaag

SEQ ID NO: 1447505 - DNA, 22 bp, Homo sapiens
ctatgctaaactgtgaaaaatc

SEQ ID NO: 1447506 - DNA, 21 bp, Homo sapiens
ctatggaaaagggtcttcttg

SEQ ID NO: 1447507 - DNA, 14 bp, Homo sapiens
ctatggacaactta

SEQ ID NO: 1447508 - DNA, 14 bp, Homo sapiens
ctatggatggcttc

SEQ ID NO: 1447509 - DNA, 14 bp, Homo sapiens
ctatggcagaaaaa

SEQ ID NO: 1447510 - DNA, 23 bp, Homo sapiens
ctatggcagaaaaaatgtctgta

SEQ ID NO: 1447511 - DNA, 14 bp, Homo sapiens
ctatggctgcctgc

SEQ ID NO: 1447512 - DNA, 13 bp, Homo sapiens
ctatgggagcccc

SEQ ID NO: 1447513 - DNA, 14 bp, Homo sapiens
ctatgggagcccca

SEQ ID NO: 1447514 - DNA, 19 bp, Homo sapiens
ctatgggagccccagggtc

SEQ ID NO: 1447515 - DNA, 13 bp, Homo sapiens
ctatgggcctgcc

SEQ ID NO: 1447516 - DNA, 23 bp, Homo sapiens
ctatggggaaggttatcagtgct

SEQ ID NO: 1447517 - DNA, 14 bp, Homo sapiens
ctatgggttatttt

SEQ ID NO: 1447518 - DNA, 22 bp, Homo sapiens
ctatgggttatttttattaaat

SEQ ID NO: 1447519 - DNA, 17 bp, Homo sapiens
ctatggtcgggagacag

SEQ ID NO: 1447520 - DNA, 21 bp, Homo sapiens
ctatggtgctgccttgcttct

SEQ ID NO: 1447521 - DNA, 15 bp, Homo sapiens
ctatgtaactgcatt

SEQ ID NO: 1447522 - DNA, 21 bp, Homo sapiens
ctatgtaagaattcagaagac

SEQ ID NO: 1447523 - DNA, 16 bp, Homo sapiens
ctatgtatcaatgagt

SEQ ID NO: 1447524 - DNA, 11 bp, Homo sapiens
ctatgtatgtt

SEQ ID NO: 1447525 - DNA, 17 bp, Homo sapiens
ctatgtcaatttgtata

SEQ ID NO: 1447526 - DNA, 23 bp, Homo sapiens
ctatgtcatttttaatgtatcta

SEQ ID NO: 1447527 - DNA, 18 bp, Homo sapiens
ctatgtccaacagagtgg

SEQ ID NO: 1447528 - DNA, 15 bp, Homo sapiens
ctatgtcctaaggac

SEQ ID NO: 1447529 - DNA, 11 bp, Homo sapiens
ctatgtctgaa

SEQ ID NO: 1447530 - DNA, 13 bp, Homo sapiens
ctatgtctgcctt

SEQ ID NO: 1447531 - DNA, 15 bp, Homo sapiens
ctatgtctgccttcg

SEQ ID NO: 1447532 - DNA, 18 bp, Homo sapiens
ctatgtgccagttcctgt

SEQ ID NO: 1447533 - DNA, 19 bp, Homo sapiens
ctatgtgccagttcctgta

SEQ ID NO: 1447534 - DNA, 14 bp, Homo sapiens
ctatgtggcagctg

SEQ ID NO: 1447535 - DNA, 15 bp, Homo sapiens
ctatgtggcagctgg

SEQ ID NO: 1447536 - DNA, 22 bp, Homo sapiens
ctatgtggcagctggggagcag

SEQ ID NO: 1447537 - DNA, 12 bp, Homo sapiens
ctatgttcccca

SEQ ID NO: 1447538 - DNA, 19 bp, Homo sapiens
ctatgttgcctaggctgga

SEQ ID NO: 1447539 - DNA, 19 bp, Homo sapiens
ctatgtttgtgtgatttcc

SEQ ID NO: 1447540 - DNA, 13 bp, Homo sapiens
ctattaaaaaagt

SEQ ID NO: 1447541 - DNA, 16 bp, Homo sapiens
ctattaaaaatagaca

SEQ ID NO: 1447542 - DNA, 19 bp, Homo sapiens
ctattaaagtgctaaggtt

SEQ ID NO: 1447543 - DNA, 20 bp, Homo sapiens
ctattaaagtgctaaggttc

SEQ ID NO: 1447544 - DNA, 17 bp, Homo sapiens
ctattaagattggaaat

SEQ ID NO: 1447545 - DNA, 16 bp, Homo sapiens
ctattaagcagtaaaa

SEQ ID NO: 1447546 - DNA, 20 bp, Homo sapiens
ctattaagcagtaaaaactg

SEQ ID NO: 1447547 - DNA, 16 bp, Homo sapiens
ctattaagtttgaaaa

SEQ ID NO: 1447548 - DNA, 11 bp, Homo sapiens
ctattaatata

SEQ ID NO: 1447549 - DNA, 12 bp, Homo sapiens
ctattaatatat

SEQ ID NO: 1447550 - DNA, 14 bp, Homo sapiens
ctattaatatatgt

SEQ ID NO: 1447551 - DNA, 21 bp, Homo sapiens
ctattaatatatgtattattt

SEQ ID NO: 1447552 - DNA, 21 bp, Homo sapiens
ctattaatatcaactctgaag

SEQ ID NO: 1447553 - DNA, 20 bp, Homo sapiens
ctattaatcaagagaaactt

SEQ ID NO: 1447554 - DNA, 16 bp, Homo sapiens
ctattaatctttcttt

SEQ ID NO: 1447555 - DNA, 16 bp, Homo sapiens
ctattaattactgtgt

SEQ ID NO: 1447556 - DNA, 17 bp, Homo sapiens
ctattaccatgagaaga

SEQ ID NO: 1447557 - DNA, 23 bp, Homo sapiens
ctattacgtgggtgccctctcca

SEQ ID NO: 1447558 - DNA, 20 bp, Homo sapiens
ctattacttttgcaaactgt

SEQ ID NO: 1447559 - DNA, 21 bp, Homo sapiens
ctattaggtgcaatttcaagg

SEQ ID NO: 1447560 - DNA, 21 bp, Homo sapiens
ctattataatttaatgcatgt

SEQ ID NO: 1447561 - DNA, 15 bp, Homo sapiens
ctattatttattgta

SEQ ID NO: 1447562 - DNA, 20 bp, Homo sapiens
ctattattttcactgtagaa

SEQ ID NO: 1447563 - DNA, 19 bp, Homo sapiens
ctattatttttataattgt

SEQ ID NO: 1447564 - DNA, 16 bp, Homo sapiens
ctattcaaacagtctc

SEQ ID NO: 1447565 - DNA, 18 bp, Homo sapiens
ctattcaaacagtctcag

SEQ ID NO: 1447566 - DNA, 22 bp, Homo sapiens
ctattcaagaggaaatgtcaca

SEQ ID NO: 1447567 - DNA, 17 bp, Homo sapiens
ctattcaccctccactt

SEQ ID NO: 1447568 - DNA, 19 bp, Homo sapiens
ctattcaccctccacttcc

SEQ ID NO: 1447569 - DNA, 22 bp, Homo sapiens
ctattcacgccgtaattctttc

SEQ ID NO: 1447570 - DNA, 15 bp, Homo sapiens
ctattcagacaagca

SEQ ID NO: 1447571 - DNA, 19 bp, Homo sapiens
ctattcagtggcgagaaat

SEQ ID NO: 1447572 - DNA, 15 bp, Homo sapiens
ctattccaaaaaggt

SEQ ID NO: 1447573 - DNA, 15 bp, Homo sapiens
ctattccaataaact

SEQ ID NO: 1447574 - DNA, 12 bp, Homo sapiens
ctattccaggaa

SEQ ID NO: 1447575 - DNA, 18 bp, Homo sapiens
ctattctcatgcctcagc

SEQ ID NO: 1447576 - DNA, 17 bp, Homo sapiens
ctattctctaaactggc

SEQ ID NO: 1447577 - DNA, 19 bp, Homo sapiens
ctattcttgatgtaaaatc

SEQ ID NO: 1447578 - DNA, 20 bp, Homo sapiens
ctattgaattcggaactgtc

SEQ ID NO: 1447579 - DNA, 16 bp, Homo sapiens
ctattgacaagtcatt

SEQ ID NO: 1447580 - DNA, 14 bp, Homo sapiens
ctattgacttcaat

SEQ ID NO: 1447581 - DNA, 15 bp, Homo sapiens
ctattgatgtacagt

SEQ ID NO: 1447582 - DNA, 21 bp, Homo sapiens
ctattgatgtacagtctgtca

SEQ ID NO: 1447583 - DNA, 22 bp, Homo sapiens
ctattgcaaaggttccaactgt

SEQ ID NO: 1447584 - DNA, 13 bp, Homo sapiens
ctattgcactcca

SEQ ID NO: 1447585 - DNA, 19 bp, Homo sapiens
ctattgcagagactcattt

SEQ ID NO: 1447586 - DNA, 17 bp, Homo sapiens
ctattgcgctctcaaga

SEQ ID NO: 1447587 - DNA, 14 bp, Homo sapiens
ctattgctcatcag

SEQ ID NO: 1447588 - DNA, 13 bp, Homo sapiens
ctattgggagagg

SEQ ID NO: 1447589 - DNA, 16 bp, Homo sapiens
ctattgttaaacaaat

SEQ ID NO: 1447590 - DNA, 22 bp, Homo sapiens
ctattgtttattctttttaaag

SEQ ID NO: 1447591 - DNA, 15 bp, Homo sapiens
ctatttaaagcctcc

SEQ ID NO: 1447592 - DNA, 11 bp, Homo sapiens
ctatttaagat

SEQ ID NO: 1447593 - DNA, 22 bp, Homo sapiens
ctatttaatatctggcactgtt

SEQ ID NO: 1447594 - DNA, 22 bp, Homo sapiens
ctatttacactattatttccta

SEQ ID NO: 1447595 - DNA, 16 bp, Homo sapiens
ctatttatctgtgttt

SEQ ID NO: 1447596 - DNA, 17 bp, Homo sapiens
ctatttattaaaaacat

SEQ ID NO: 1447597 - DNA, 18 bp, Homo sapiens
ctatttattaaaaacatg

SEQ ID NO: 1447598 - DNA, 21 bp, Homo sapiens
ctatttattaatatttaacat

SEQ ID NO: 1447599 - DNA, 15 bp, Homo sapiens
ctatttattagccaa

SEQ ID NO: 1447600 - DNA, 16 bp, Homo sapiens
ctatttattagccaac

SEQ ID NO: 1447601 - DNA, 15 bp, Homo sapiens
ctatttattcctgtt

SEQ ID NO: 1447602 - DNA, 14 bp, Homo sapiens
ctatttattgactt

SEQ ID NO: 1447603 - DNA, 16 bp, Homo sapiens
ctatttattttcctaa

SEQ ID NO: 1447604 - DNA, 19 bp, Homo sapiens
ctatttattttcctaaaga

SEQ ID NO: 1447605 - DNA, 21 bp, Homo sapiens
ctatttattttcctaaagaga

SEQ ID NO: 1447606 - DNA, 19 bp, Homo sapiens
ctatttcagaagtttaaat

SEQ ID NO: 1447607 - DNA, 19 bp, Homo sapiens
ctatttcagtgttacctgt

SEQ ID NO: 1447608 - DNA, 21 bp, Homo sapiens
ctatttcagtgttacctgtgt

SEQ ID NO: 1447609 - DNA, 15 bp, Homo sapiens
ctatttccactgaac

SEQ ID NO: 1447610 - DNA, 19 bp, Homo sapiens
ctatttcccctcttctgct

SEQ ID NO: 1447611 - DNA, 12 bp, Homo sapiens
ctatttctatgt

SEQ ID NO: 1447612 - DNA, 15 bp, Homo sapiens
ttatgtgcactgcct

SEQ ID NO: 1447613 - DNA, 16 bp, Homo sapiens
ttatgtggaagaactg

SEQ ID NO: 1447614 - DNA, 19 bp, Homo sapiens
ttatgtggctgtaatgaca

SEQ ID NO: 1447615 - DNA, 17 bp, Homo sapiens
ttatgtgggtggcttct

SEQ ID NO: 1447616 - DNA, 13 bp, Homo sapiens
ctatttctgagaa

SEQ ID NO: 1447617 - DNA, 23 bp, Homo sapiens
ctatttctgagaaggtccttaat

SEQ ID NO: 1447618 - DNA, 13 bp, Homo sapiens
ctatttctgtgtc

SEQ ID NO: 1447619 - DNA, 16 bp, Homo sapiens
ctatttctgtgtccag

SEQ ID NO: 1447620 - DNA, 19 bp, Homo sapiens
ctatttgaaatgaattcct

SEQ ID NO: 1447621 - DNA, 17 bp, Homo sapiens
ctatttgagaagttctc

SEQ ID NO: 1447622 - DNA, 14 bp, Homo sapiens
ctatttgtaaatct

SEQ ID NO: 1447623 - DNA, 19 bp, Homo sapiens
ctatttgtaaatctgccac

SEQ ID NO: 1447624 - DNA, 19 bp, Homo sapiens
ctatttgtacaaataaacc

SEQ ID NO: 1447625 - DNA, 22 bp, Homo sapiens
ctatttgtacaaataaacctga

SEQ ID NO: 1447626 - DNA, 15 bp, Homo sapiens
ctatttgtacaattt

SEQ ID NO: 1447627 - DNA, 21 bp, Homo sapiens
ctatttgtacaattttaaagt

SEQ ID NO: 1447628 - DNA, 20 bp, Homo sapiens
ctatttgtgtgtatgctgat

SEQ ID NO: 1447629 - DNA, 19 bp, Homo sapiens
ctattttaaatatccattt

SEQ ID NO: 1447630 - DNA, 11 bp, Homo sapiens
ctattttaaga

SEQ ID NO: 1447631 - DNA, 13 bp, Homo sapiens
ctattttcaaaga

SEQ ID NO: 1447632 - DNA, 23 bp, Homo sapiens
ctattttgggtattaatatatag

SEQ ID NO: 1447633 - DNA, 12 bp, Homo sapiens
ctattttgtaaa

SEQ ID NO: 1447634 - DNA, 19 bp, Homo sapiens
ctattttgtaaactcaaaa

SEQ ID NO: 1447635 - DNA, 12 bp, Homo sapiens
ctatttttatca

SEQ ID NO: 1447636 - DNA, 15 bp, Homo sapiens
ctatttttatcatga

SEQ ID NO: 1447637 - DNA, 19 bp, Homo sapiens
ctatttttatcatgaattc

SEQ ID NO: 1447638 - DNA, 18 bp, Homo sapiens
ctatttttatttatattt

SEQ ID NO: 1447639 - DNA, 22 bp, Homo sapiens
ctatttttgacatggaaatgaa

SEQ ID NO: 1447640 - DNA, 18 bp, Homo sapiens
ctatttttggcagtctga

SEQ ID NO: 1447641 - DNA, 12 bp, Homo sapiens
ctatttttgtat

SEQ ID NO: 1447642 - DNA, 13 bp, Homo sapiens
ctatttttttaga

SEQ ID NO: 1447643 - DNA, 22 bp, Homo sapiens
ctcaaaaaaaaaaaagagagag

SEQ ID NO: 1447644 - DNA, 13 bp, Homo sapiens
ctcaaaaagcaga

SEQ ID NO: 1447645 - DNA, 19 bp, Homo sapiens
ctcaaaacgggtcagtatt

SEQ ID NO: 1447646 - DNA, 13 bp, Homo sapiens
ctcaaaactgcac

SEQ ID NO: 1447647 - DNA, 20 bp, Homo sapiens
ctcaaaagagaaaaacaaaa

SEQ ID NO: 1447648 - DNA, 23 bp, Homo sapiens
ctcaaaaggaaaccaagtggtca

SEQ ID NO: 1447649 - DNA, 23 bp, Homo sapiens
ctcaaaataccatgccatttaaa

SEQ ID NO: 1447650 - DNA, 13 bp, Homo sapiens
ctcaaaatatttg

SEQ ID NO: 1447651 - DNA, 15 bp, Homo sapiens
ctcaaacacagttac

SEQ ID NO: 1447652 - DNA, 21 bp, Homo sapiens
ctcaaacacagttacacttgt

SEQ ID NO: 1447653 - DNA, 13 bp, Homo sapiens
ctcaaacctcctc

SEQ ID NO: 1447654 - DNA, 15 bp, Homo sapiens
ctcaaacctgtttaa

SEQ ID NO: 1447655 - DNA, 20 bp, Homo sapiens
ctcaaactaaattcaaagaa

SEQ ID NO: 1447656 - DNA, 22 bp, Homo sapiens
ctcaaactgaggaatttcacct

SEQ ID NO: 1447657 - DNA, 16 bp, Homo sapiens
ctcaaagaaagtgtat

SEQ ID NO: 1447658 - DNA, 16 bp, Homo sapiens
ctcaaagagattcgaa

SEQ ID NO: 1447659 - DNA, 15 bp, Homo sapiens
ctcaaagcaaaagtg

SEQ ID NO: 1447660 - DNA, 16 bp, Homo sapiens
ctcaaaggagaaaaaa

SEQ ID NO: 1447661 - DNA, 22 bp, Homo sapiens
ctcaaaggagaaaaaaaacctt

SEQ ID NO: 1447662 - DNA, 22 bp, Homo sapiens
ctcaaaggccaggttgctaaga

SEQ ID NO: 1447663 - DNA, 18 bp, Homo sapiens
ctcaaagggagagaaaag

SEQ ID NO: 1447664 - DNA, 23 bp, Homo sapiens
ctcaaaggtttggaaggagcaga

SEQ ID NO: 1447665 - DNA, 15 bp, Homo sapiens
ctcaaatacacattt

SEQ ID NO: 1447666 - DNA, 13 bp, Homo sapiens
ctcaaatctattc

SEQ ID NO: 1447667 - DNA, 22 bp, Homo sapiens
ctcaaatctattcagacaagca

SEQ ID NO: 1447668 - DNA, 14 bp, Homo sapiens
ctcaaatgaatttg

SEQ ID NO: 1447669 - DNA, 20 bp, Homo sapiens
ctcaaatgagtaacatttgc

SEQ ID NO: 1447670 - DNA, 21 bp, Homo sapiens
ctcaaatgagtaacatttgct

SEQ ID NO: 1447671 - DNA, 19 bp, Homo sapiens
ctcaaatgatcctcccacc

SEQ ID NO: 1447672 - DNA, 15 bp, Homo sapiens
ctcaaatgttctaag

SEQ ID NO: 1447673 - DNA, 19 bp, Homo sapiens
ctcaaatgttctaagtttc

SEQ ID NO: 1447674 - DNA, 22 bp, Homo sapiens
ctcaaatgttctaagtttctaa

SEQ ID NO: 1447675 - DNA, 24 bp, Homo sapiens
ctcaaatgttctaagtttctaaga

SEQ ID NO: 1447676 - DNA, 13 bp, Homo sapiens
ctcaaattttttg

SEQ ID NO: 1447677 - DNA, 21 bp, Homo sapiens
ctcaaattttttgactttttt

SEQ ID NO: 1447678 - DNA, 22 bp, Homo sapiens
ctcaacatgtctcctactgagg

SEQ ID NO: 1447679 - DNA, 20 bp, Homo sapiens
ctcaacatgttactgaccag

SEQ ID NO: 1447680 - DNA, 12 bp, Homo sapiens
ctcaaccactgt

SEQ ID NO: 1447681 - DNA, 14 bp, Homo sapiens
ctcaaccactgtgg

SEQ ID NO: 1447682 - DNA, 12 bp, Homo sapiens
ctcaacctaccc

SEQ ID NO: 1447683 - DNA, 13 bp, Homo sapiens
ctcaacctcttct

SEQ ID NO: 1447684 - DNA, 21 bp, Homo sapiens
ctcaacctcttctggctcaaa

SEQ ID NO: 1447685 - DNA, 16 bp, Homo sapiens
ctcaacgcctccccct

SEQ ID NO: 1447686 - DNA, 17 bp, Homo sapiens
ctcaactcacctaatgt

SEQ ID NO: 1447687 - DNA, 14 bp, Homo sapiens
ctcaactccaggat

SEQ ID NO: 1447688 - DNA, 17 bp, Homo sapiens
ctcaactccaggattta

SEQ ID NO: 1447689 - DNA, 13 bp, Homo sapiens
ctcaactgaaggg

SEQ ID NO: 1447690 - DNA, 19 bp, Homo sapiens
ctcaactgagggccaggga

SEQ ID NO: 1447691 - DNA, 13 bp, Homo sapiens
ctcaactgcctac

SEQ ID NO: 1447692 - DNA, 20 bp, Homo sapiens
ctcaagaagacatggagact

SEQ ID NO: 1447693 - DNA, 22 bp, Homo sapiens
ctcaagaagacatggagactcc

SEQ ID NO: 1447694 - DNA, 15 bp, Homo sapiens
ctcaagaatctagaa

SEQ ID NO: 1447695 - DNA, 20 bp, Homo sapiens
ctcaagaatctagaagatgt

SEQ ID NO: 1447696 - DNA, 14 bp, Homo sapiens
ctcaagacaaggct

SEQ ID NO: 1447697 - DNA, 22 bp, Homo sapiens
ctcaagaccaggctgcagcctc

SEQ ID NO: 1447698 - DNA, 23 bp, Homo sapiens
ctcaagaccaggctgcagcctcc

SEQ ID NO: 1447699 - DNA, 24 bp, Homo sapiens
ctcaagaccaggctgcagcctcca

SEQ ID NO: 1447700 - DNA, 21 bp, Homo sapiens
ctcaagactttagcttttcct

SEQ ID NO: 1447701 - DNA, 16 bp, Homo sapiens
ctcaagaggaatctgt

SEQ ID NO: 1447702 - DNA, 17 bp, Homo sapiens
ctcaagaggaatctgtt

SEQ ID NO: 1447703 - DNA, 18 bp, Homo sapiens
ctcaagaggaatctgttt

SEQ ID NO: 1447704 - DNA, 17 bp, Homo sapiens
ctcaagaggcagagttc

SEQ ID NO: 1447705 - DNA, 16 bp, Homo sapiens
ctcaagcaataattgt

SEQ ID NO: 1447706 - DNA, 21 bp, Homo sapiens
ctcaagcaataattgtttcca

SEQ ID NO: 1447707 - DNA, 18 bp, Homo sapiens
ctcaagccaatcccctcc

SEQ ID NO: 1447708 - DNA, 20 bp, Homo sapiens
ctcaagccaatcccctcctt

SEQ ID NO: 1447709 - DNA, 19 bp, Homo sapiens
ctcaagccagactctgcca

SEQ ID NO: 1447710 - DNA, 16 bp, Homo sapiens
ctcaagccagccccct

SEQ ID NO: 1447711 - DNA, 23 bp, Homo sapiens
ctcaagccagccccctccagctc

SEQ ID NO: 1447712 - DNA, 15 bp, Homo sapiens
ctcaagccgcaagct

SEQ ID NO: 1447713 - DNA, 21 bp, Homo sapiens
ctcaagccgcaagctctcagc

SEQ ID NO: 1447714 - DNA, 18 bp, Homo sapiens
ctcaaggatacagggagc

SEQ ID NO: 1447715 - DNA, 16 bp, Homo sapiens
ctcaaggctgtgcagg

SEQ ID NO: 1447716 - DNA, 19 bp, Homo sapiens
ctcaagggaaaggcaagct

SEQ ID NO: 1447717 - DNA, 23 bp, Homo sapiens
ctcaagggaaaggcaagcttgag

SEQ ID NO: 1447718 - DNA, 21 bp, Homo sapiens
ctcaagggctagcatccctga

SEQ ID NO: 1447719 - DNA, 19 bp, Homo sapiens
ctcaagtagaaaagcagtc

SEQ ID NO: 1447720 - DNA, 17 bp, Homo sapiens
ctcaagtcttccctgat

SEQ ID NO: 1447721 - DNA, 13 bp, Homo sapiens
ctcaagttctaag

SEQ ID NO: 1447722 - DNA, 14 bp, Homo sapiens
ctcaagttctaaga

SEQ ID NO: 1447723 - DNA, 19 bp, Homo sapiens
ctcaagttctaagattcta

SEQ ID NO: 1447724 - DNA, 16 bp, Homo sapiens
ctcaatagatctccag

SEQ ID NO: 1447725 - DNA, 18 bp, Homo sapiens
ctcaatattcctgaatga

SEQ ID NO: 1447726 - DNA, 16 bp, Homo sapiens
ttattttaaaatttca

SEQ ID NO: 1447727 - DNA, 21 bp, Homo sapiens
ttattttaatagcctgtcata

SEQ ID NO: 1447728 - DNA, 22 bp, Homo sapiens
ttattttataagaaaaactttt

SEQ ID NO: 1447729 - DNA, 13 bp, Homo sapiens
ttattttctgaat

SEQ ID NO: 1447730 - DNA, 14 bp, Homo sapiens
ttattttctgaatt

SEQ ID NO: 1447731 - DNA, 19 bp, Homo sapiens
ttattttctgttcagatta

SEQ ID NO: 1447732 - DNA, 16 bp, Homo sapiens
ttattttgctttaatt

SEQ ID NO: 1447733 - DNA, 13 bp, Homo sapiens
ttattttggaact

SEQ ID NO: 1447734 - DNA, 23 bp, Homo sapiens
ctcaatgcaaatagtagacattt

SEQ ID NO: 1447735 - DNA, 13 bp, Homo sapiens
ctcaatggactgg

SEQ ID NO: 1447736 - DNA, 22 bp, Homo sapiens
ctcaatgtacatagaccctctt

SEQ ID NO: 1447737 - DNA, 21 bp, Homo sapiens
ctcaatgtgaatcagacccta

SEQ ID NO: 1447738 - DNA, 17 bp, Homo sapiens
ctcaatgtttctggaca

SEQ ID NO: 1447739 - DNA, 22 bp, Homo sapiens
ctcaatttttgtttttgagtac

SEQ ID NO: 1447740 - DNA, 19 bp, Homo sapiens
ctcacaaaaaggcaaatat

SEQ ID NO: 1447741 - DNA, 22 bp, Homo sapiens
ctcacaaaccatgcaaatgcta

SEQ ID NO: 1447742 - DNA, 17 bp, Homo sapiens
ctcacaacttgggttct

SEQ ID NO: 1447743 - DNA, 17 bp, Homo sapiens
ctcacaagcctcttctg

SEQ ID NO: 1447744 - DNA, 19 bp, Homo sapiens
ctcacaaggcccaggagac

SEQ ID NO: 1447745 - DNA, 14 bp, Homo sapiens
ctcacaatttaaaa

SEQ ID NO: 1447746 - DNA, 15 bp, Homo sapiens
ctcacaatttaaaat

SEQ ID NO: 1447747 - DNA, 22 bp, Homo sapiens
ctcacaatttaaaatatttccc

SEQ ID NO: 1447748 - DNA, 11 bp, Homo sapiens
ctcacacacac

SEQ ID NO: 1447749 - DNA, 12 bp, Homo sapiens
ctcacacacaca

SEQ ID NO: 1447750 - DNA, 14 bp, Homo sapiens
ctcacacacacaca

SEQ ID NO: 1447751 - DNA, 15 bp, Homo sapiens
ctcacacccaccgtc

SEQ ID NO: 1447752 - DNA, 13 bp, Homo sapiens
ctcacacccctgt

SEQ ID NO: 1447753 - DNA, 21 bp, Homo sapiens
ctcacaccgcgtctggtgaca

SEQ ID NO: 1447754 - DNA, 22 bp, Homo sapiens
ctcacaccgttcgtacgcccag

SEQ ID NO: 1447755 - DNA, 22 bp, Homo sapiens
ctcacacgtttaatcccagcac

SEQ ID NO: 1447756 - DNA, 23 bp, Homo sapiens
ctcacacgtttaatcccagcact

SEQ ID NO: 1447757 - DNA, 20 bp, Homo sapiens
ctcacactgagaatgtaaga

SEQ ID NO: 1447758 - DNA, 17 bp, Homo sapiens
ctcacagaacccttgga

SEQ ID NO: 1447759 - DNA, 17 bp, Homo sapiens
ctcacagacctggagcc

SEQ ID NO: 1447760 - DNA, 20 bp, Homo sapiens
ctcacagacctggagcccct

SEQ ID NO: 1447761 - DNA, 13 bp, Homo sapiens
ctcacagagaagc

SEQ ID NO: 1447762 - DNA, 17 bp, Homo sapiens
ctcacagagaagctcct

SEQ ID NO: 1447763 - DNA, 20 bp, Homo sapiens
ctcacagagaagctcctgct

SEQ ID NO: 1447764 - DNA, 13 bp, Homo sapiens
ctcacagagtcaa

SEQ ID NO: 1447765 - DNA, 17 bp, Homo sapiens
ctcacagagtcaaggcc

SEQ ID NO: 1447766 - DNA, 16 bp, Homo sapiens
ctcacagctgtaataa

SEQ ID NO: 1447767 - DNA, 14 bp, Homo sapiens
ctcacagcttctcc

SEQ ID NO: 1447768 - DNA, 19 bp, Homo sapiens
ctcacagtctctttaatct

SEQ ID NO: 1447769 - DNA, 22 bp, Homo sapiens
ctcacagtgggagccagggctg

SEQ ID NO: 1447770 - DNA, 17 bp, Homo sapiens
ctcacagtggggccagc

SEQ ID NO: 1447771 - DNA, 16 bp, Homo sapiens
ctcacagttattacat

SEQ ID NO: 1447772 - DNA, 16 bp, Homo sapiens
ctcacagttcctcgcc

SEQ ID NO: 1447773 - DNA, 19 bp, Homo sapiens
ctcacagttcctcgccctg

SEQ ID NO: 1447774 - DNA, 21 bp, Homo sapiens
ctcacatagccaactctccca

SEQ ID NO: 1447775 - DNA, 20 bp, Homo sapiens
ctcacatagcttacaagcca

SEQ ID NO: 1447776 - DNA, 20 bp, Homo sapiens
ctcacatctttcacacttcc

SEQ ID NO: 1447777 - DNA, 15 bp, Homo sapiens
ctcacattgctgtat

SEQ ID NO: 1447778 - DNA, 16 bp, Homo sapiens
ctcacattgctgtatt

SEQ ID NO: 1447779 - DNA, 13 bp, Homo sapiens
ctcacatttgtga

SEQ ID NO: 1447780 - DNA, 14 bp, Homo sapiens
ctcacatttttata

SEQ ID NO: 1447781 - DNA, 17 bp, Homo sapiens
ctcaccactaccagcca

SEQ ID NO: 1447782 - DNA, 20 bp, Homo sapiens
ctcaccactaccagccagcc

SEQ ID NO: 1447783 - DNA, 17 bp, Homo sapiens
ctcaccactgccccctg

SEQ ID NO: 1447784 - DNA, 16 bp, Homo sapiens
ctcaccagccccactg

SEQ ID NO: 1447785 - DNA, 17 bp, Homo sapiens
ctcaccagccccactgc

SEQ ID NO: 1447786 - DNA, 19 bp, Homo sapiens
ctcaccagccccactgcca

SEQ ID NO: 1447787 - DNA, 20 bp, Homo sapiens
ctcaccagccccactgccag

SEQ ID NO: 1447788 - DNA, 22 bp, Homo sapiens
ctcaccagccccactgccagca

SEQ ID NO: 1447789 - DNA, 18 bp, Homo sapiens
ctcaccagccctagctgt

SEQ ID NO: 1447790 - DNA, 13 bp, Homo sapiens
ctcaccaggcctg

SEQ ID NO: 1447791 - DNA, 19 bp, Homo sapiens
ctcaccaggcctggcctct

SEQ ID NO: 1447792 - DNA, 10 bp, Homo sapiens
ctcaccaggg

SEQ ID NO: 1447793 - DNA, 13 bp, Homo sapiens
ctcaccagggtcc

SEQ ID NO: 1447794 - DNA, 16 bp, Homo sapiens
ctcaccatccagtggg

SEQ ID NO: 1447795 - DNA, 19 bp, Homo sapiens
ctcaccatccagtgggccc

SEQ ID NO: 1447796 - DNA, 12 bp, Homo sapiens
ctcacccagtcc

SEQ ID NO: 1447797 - DNA, 21 bp, Homo sapiens
ctcacccatgcaagcagagga

SEQ ID NO: 1447798 - DNA, 22 bp, Homo sapiens
ctcacccatgcaagcagaggac

SEQ ID NO: 1447799 - DNA, 12 bp, Homo sapiens
ctcaccccagga

SEQ ID NO: 1447800 - DNA, 16 bp, Homo sapiens
ctcacccccaggtgtt

SEQ ID NO: 1447801 - DNA, 14 bp, Homo sapiens
ctcacccctagccc

SEQ ID NO: 1447802 - DNA, 17 bp, Homo sapiens
ctcacccctggttctca

SEQ ID NO: 1447803 - DNA, 14 bp, Homo sapiens
ctcacccctgtagg

SEQ ID NO: 1447804 - DNA, 18 bp, Homo sapiens
ctcacccctgtagggaaa

SEQ ID NO: 1447805 - DNA, 17 bp, Homo sapiens
ctcaccctgcccgctcc

SEQ ID NO: 1447806 - DNA, 19 bp, Homo sapiens
ctcaccctgcccgctccca

SEQ ID NO: 1447807 - DNA, 21 bp, Homo sapiens
ctcaccctgccttatcttgca

SEQ ID NO: 1447808 - DNA, 13 bp, Homo sapiens
ctcaccctgggag

SEQ ID NO: 1447809 - DNA, 15 bp, Homo sapiens
ctcaccctgtgaaac

SEQ ID NO: 1447810 - DNA, 12 bp, Homo sapiens
ctcaccgtggat

SEQ ID NO: 1447811 - DNA, 13 bp, Homo sapiens
ctcacctcagagc

SEQ ID NO: 1447812 - DNA, 19 bp, Homo sapiens
ctcacctcagagcagggcc

SEQ ID NO: 1447813 - DNA, 12 bp, Homo sapiens
ctcacctctgag

SEQ ID NO: 1447814 - DNA, 13 bp, Homo sapiens
ctcacctctgcct

SEQ ID NO: 1447815 - DNA, 16 bp, Homo sapiens
ctcacctctgcctcaa

SEQ ID NO: 1447816 - DNA, 23 bp, Homo sapiens
ctcacctgagacctccactccac

SEQ ID NO: 1447817 - DNA, 14 bp, Homo sapiens
ctcacctgcagccc

SEQ ID NO: 1447818 - DNA, 13 bp, Homo sapiens
ctcacctggactt

SEQ ID NO: 1447819 - DNA, 14 bp, Homo sapiens
ctcacctggtcctc

SEQ ID NO: 1447820 - DNA, 23 bp, Homo sapiens
ctcacctgtgtgcccagcacctg

SEQ ID NO: 1447821 - DNA, 16 bp, Homo sapiens
ctcaccttggcaccag

SEQ ID NO: 1447822 - DNA, 19 bp, Homo sapiens
ctcacctttctccactggg

SEQ ID NO: 1447823 - DNA, 20 bp, Homo sapiens
ctcacctttctccactgggt

SEQ ID NO: 1447824 - DNA, 22 bp, Homo sapiens
ctcacctttgttttttgttgga

SEQ ID NO: 1447825 - DNA, 20 bp, Homo sapiens
ctcacgcctatgatcccagc

SEQ ID NO: 1447826 - DNA, 21 bp, Homo sapiens
ctcacgcctgtaatcccagca

SEQ ID NO: 1447827 - DNA, 17 bp, Homo sapiens
ctcacgctcccccgcag

SEQ ID NO: 1447828 - DNA, 18 bp, Homo sapiens
ctcacgctcccccgcagt

SEQ ID NO: 1447829 - DNA, 21 bp, Homo sapiens
ctcacgctcccccgcagtccc

SEQ ID NO: 1447830 - DNA, 21 bp, Homo sapiens
ctcacgtaatgcattgcctgt

SEQ ID NO: 1447831 - DNA, 20 bp, Homo sapiens
ctcacgtatttcacagagca

SEQ ID NO: 1447832 - DNA, 14 bp, Homo sapiens
ctcacgtcaaatgc

SEQ ID NO: 1447833 - DNA, 16 bp, Homo sapiens
ctcacgtccaggttca

SEQ ID NO: 1447834 - DNA, 15 bp, Homo sapiens
ctcacgtcctgagaa

SEQ ID NO: 1447835 - DNA, 12 bp, Homo sapiens
ctcacgtctctg

SEQ ID NO: 1447836 - DNA, 15 bp, Homo sapiens
ctcacgtctctgccg

SEQ ID NO: 1447837 - DNA, 20 bp, Homo sapiens
ctcacgtgcaggacagctct

SEQ ID NO: 1447838 - DNA, 23 bp, Homo sapiens
ctcacgtgcaggacagctcttga

SEQ ID NO: 1447839 - DNA, 22 bp, Homo sapiens
ctcacgtggggagcggtggctg

SEQ ID NO: 1447840 - DNA, 20 bp, Homo sapiens
ctcactaaagcatgaaatgt

SEQ ID NO: 1447841 - DNA, 15 bp, Homo sapiens
ttcaagggaagaaac

SEQ ID NO: 1447842 - DNA, 17 bp, Homo sapiens
ttcaagggacaagtatt

SEQ ID NO: 1447843 - DNA, 24 bp, Homo sapiens
ttcaaggggagccaaaatctcaag

SEQ ID NO: 1447844 - DNA, 15 bp, Homo sapiens
ttcaagggtaatctt

SEQ ID NO: 1447845 - DNA, 16 bp, Homo sapiens
ttcaagtaattgtgaa

SEQ ID NO: 1447846 - DNA, 18 bp, Homo sapiens
ttcaagtgcctagactgt

SEQ ID NO: 1447847 - DNA, 23 bp, Homo sapiens
ttcaagtgcctagactgttactt

SEQ ID NO: 1447848 - DNA, 20 bp, Homo sapiens
ttcaagtgcctcttgttgca

SEQ ID NO: 1447849 - DNA, 18 bp, Homo sapiens
ttcaagtgcttctccagc

SEQ ID NO: 1447850 - DNA, 13 bp, Homo sapiens
ttcaagttaaagt

SEQ ID NO: 1447851 - DNA, 23 bp, Homo sapiens
ttcaagttccaagttgctaatac

SEQ ID NO: 1447852 - DNA, 14 bp, Homo sapiens
ttcaagttttaaag

SEQ ID NO: 1447853 - DNA, 15 bp, Homo sapiens
tgtgtttctaaaact

SEQ ID NO: 1447854 - DNA, 16 bp, Homo sapiens
tgtgtttgaaatcatc

SEQ ID NO: 1447855 - DNA, 14 bp, Homo sapiens
tgtgtttgattggc

SEQ ID NO: 1447856 - DNA, 16 bp, Homo sapiens
tgtgtttgcattgtct

SEQ ID NO: 1447857 - DNA, 23 bp, Homo sapiens
tgtgtttgtttttcaagaaatga

SEQ ID NO: 1447858 - DNA, 12 bp, Homo sapiens
tgtgttttataa

SEQ ID NO: 1447859 - DNA, 20 bp, Homo sapiens
tgtgttttcccaaagcactt

SEQ ID NO: 1447860 - DNA, 22 bp, Homo sapiens
tgtgttttcccaaagcactttt

SEQ ID NO: 1447861 - DNA, 14 bp, Homo sapiens
tgtgttttctccta

SEQ ID NO: 1447862 - DNA, 15 bp, Homo sapiens
tgtgttttgtctgag

SEQ ID NO: 1447863 - DNA, 14 bp, Homo sapiens
tgtgtttttattgt

SEQ ID NO: 1447864 - DNA, 15 bp, Homo sapiens
tgtgtttttctttct

SEQ ID NO: 1447865 - DNA, 16 bp, Homo sapiens
tgtgtttttctttttc

SEQ ID NO: 1447866 - DNA, 13 bp, Homo sapiens
tgtgtttttgaaa

SEQ ID NO: 1447867 - DNA, 16 bp, Homo sapiens
tgtgtttttgggaaga

SEQ ID NO: 1447868 - DNA, 15 bp, Homo sapiens
tgtgttttttaagat

SEQ ID NO: 1447869 - DNA, 17 bp, Homo sapiens
tgtgttttttaagatag

SEQ ID NO: 1447870 - DNA, 23 bp, Homo sapiens
tgttaaaaaaaaaatccatttta

SEQ ID NO: 1447871 - DNA, 18 bp, Homo sapiens
tgttaaaaaatttttgaa

SEQ ID NO: 1447872 - DNA, 16 bp, Homo sapiens
tgttaaaaataaatcc

SEQ ID NO: 1447873 - DNA, 21 bp, Homo sapiens
tgttaaaagatgaaaatattt

SEQ ID NO: 1447874 - DNA, 24 bp, Homo sapiens
tgttaaaaggaaaaataacaacta

SEQ ID NO: 1447875 - DNA, 20 bp, Homo sapiens
tgttaaaatatttgcctttt

SEQ ID NO: 1447876 - DNA, 17 bp, Homo sapiens
tgttaaaatgtacactg

SEQ ID NO: 1447877 - DNA, 16 bp, Homo sapiens
tgttaaacaaatgatt

SEQ ID NO: 1447878 - DNA, 18 bp, Homo sapiens
tgttaaacacgtgtctat

SEQ ID NO: 1447879 - DNA, 12 bp, Homo sapiens
tgttaaagagaa

SEQ ID NO: 1447880 - DNA, 16 bp, Homo sapiens
tgttaaagagaatgag

SEQ ID NO: 1447881 - DNA, 16 bp, Homo sapiens
tgttaaatacaggaaa

SEQ ID NO: 1447882 - DNA, 12 bp, Homo sapiens
tgttaaattcag

SEQ ID NO: 1447883 - DNA, 21 bp, Homo sapiens
tgttaacaagaggggaaaaca

SEQ ID NO: 1447884 - DNA, 21 bp, Homo sapiens
tgttaacatggacatgatctt

SEQ ID NO: 1447885 - DNA, 14 bp, Homo sapiens
tgttaaccaaattt

SEQ ID NO: 1447886 - DNA, 17 bp, Homo sapiens
tgttaactcttgtctat

SEQ ID NO: 1447887 - DNA, 22 bp, Homo sapiens
tgttaagaatgaagttctgcta

SEQ ID NO: 1447888 - DNA, 12 bp, Homo sapiens
tgttaagataac

SEQ ID NO: 1447889 - DNA, 22 bp, Homo sapiens
tgttaagataacttactgtata

SEQ ID NO: 1447890 - DNA, 23 bp, Homo sapiens
tgttaagcagatggaatgctgtg

SEQ ID NO: 1447891 - DNA, 20 bp, Homo sapiens
tgttaagcgtgtctgtattt

SEQ ID NO: 1447892 - DNA, 22 bp, Homo sapiens
tgttaaggtggattgaggccag

SEQ ID NO: 1447893 - DNA, 20 bp, Homo sapiens
tgttaagttacagtttgcac

SEQ ID NO: 1447894 - DNA, 14 bp, Homo sapiens
tgttaatacaaggt

SEQ ID NO: 1447895 - DNA, 14 bp, Homo sapiens
tgttaatacacagt

SEQ ID NO: 1447896 - DNA, 22 bp, Homo sapiens
tgttaatatgcagccatatatg

SEQ ID NO: 1447897 - DNA, 14 bp, Homo sapiens
tgttaatgaaaatg

SEQ ID NO: 1447898 - DNA, 17 bp, Homo sapiens
tgttaatgaaaatgtca

SEQ ID NO: 1447899 - DNA, 15 bp, Homo sapiens
tgttaatgctttctg

SEQ ID NO: 1447900 - DNA, 13 bp, Homo sapiens
tgttaatgctttt

SEQ ID NO: 1447901 - DNA, 20 bp, Homo sapiens
tgttaatggtgcaaatccta

SEQ ID NO: 1447902 - DNA, 18 bp, Homo sapiens
tgttaatgtcattgctaa

SEQ ID NO: 1447903 - DNA, 21 bp, Homo sapiens
tgttaatgtcattgctaaaaa

SEQ ID NO: 1447904 - DNA, 15 bp, Homo sapiens
tgttaattacaccat

SEQ ID NO: 1447905 - DNA, 20 bp, Homo sapiens
tgttaattgcgtagaggcta

SEQ ID NO: 1447906 - DNA, 13 bp, Homo sapiens
tgttaattttgct

SEQ ID NO: 1447907 - DNA, 17 bp, Homo sapiens
cgtggattgcacgtggc

SEQ ID NO: 1447908 - DNA, 17 bp, Homo sapiens
cgtggcacctcttccga

SEQ ID NO: 1447909 - DNA, 21 bp, Homo sapiens
cgtggcatgtggcctgtggcc

SEQ ID NO: 1447910 - DNA, 19 bp, Homo sapiens
cgtggccaacgtggacctg

SEQ ID NO: 1447911 - DNA, 17 bp, Homo sapiens
cgtggccacgggggcag

SEQ ID NO: 1447912 - DNA, 20 bp, Homo sapiens
cgtggccacgggggcagtgt

SEQ ID NO: 1447913 - DNA, 19 bp, Homo sapiens
cgtggccagcccggctggt

SEQ ID NO: 1447914 - DNA, 15 bp, Homo sapiens
cgtggccctgccctc

SEQ ID NO: 1447915 - DNA, 21 bp, Homo sapiens
cgtggcctcccaaagtgctgg

SEQ ID NO: 1447916 - DNA, 23 bp, Homo sapiens
cgtggcctcttgagcagtggctg

SEQ ID NO: 1447917 - DNA, 21 bp, Homo sapiens
cgtggccttccccttttgcct

SEQ ID NO: 1447918 - DNA, 12 bp, Homo sapiens
cgtggctgtggc

SEQ ID NO: 1447919 - DNA, 13 bp, Homo sapiens
cgtggctgtggca

SEQ ID NO: 1447920 - DNA, 16 bp, Homo sapiens
cgtggctgtggcacag

SEQ ID NO: 1447921 - DNA, 20 bp, Homo sapiens
cgtggcttcccgctcagccc

SEQ ID NO: 1447922 - DNA, 18 bp, Homo sapiens
cgtggcttccctgtccca

SEQ ID NO: 1447923 - DNA, 19 bp, Homo sapiens
cgtgggacggtgcccaagc

SEQ ID NO: 1447924 - DNA, 19 bp, Homo sapiens
cgtgggcagtgccacccgc

SEQ ID NO: 1447925 - DNA, 18 bp, Homo sapiens
cgtgggccagtccccgag

SEQ ID NO: 1447926 - DNA, 23 bp, Homo sapiens
cgtgggccagtccccgaggagct

SEQ ID NO: 1447927 - DNA, 20 bp, Homo sapiens
cgtgggctcccgtgttttgt

SEQ ID NO: 1447928 - DNA, 16 bp, Homo sapiens
cgtgggggggcgtgga

SEQ ID NO: 1447929 - DNA, 15 bp, Homo sapiens
cgtggggtgtgctgg

SEQ ID NO: 1447930 - DNA, 18 bp, Homo sapiens
cgtggggtgtgctgggag

SEQ ID NO: 1447931 - DNA, 21 bp, Homo sapiens
cgtgggtcactacagggagaa

SEQ ID NO: 1447932 - DNA, 23 bp, Homo sapiens
cgtgggtgtgtgtagccaaggtc

SEQ ID NO: 1447933 - DNA, 14 bp, Homo sapiens
cgtggtcaccttcg

SEQ ID NO: 1447934 - DNA, 21 bp, Homo sapiens
cgtggtcaccttcgagtagag

SEQ ID NO: 1447935 - DNA, 14 bp, Homo sapiens
cgtggtcagagtgc

SEQ ID NO: 1447936 - DNA, 13 bp, Homo sapiens
cgtggtccagctc

SEQ ID NO: 1447937 - DNA, 15 bp, Homo sapiens
cgtggtccagctctt

SEQ ID NO: 1447938 - DNA, 16 bp, Homo sapiens
cgtggtccctgaggat

SEQ ID NO: 1447939 - DNA, 17 bp, Homo sapiens
cgtggtctccttgcact

SEQ ID NO: 1447940 - DNA, 12 bp, Homo sapiens
cgtggtgaggct

SEQ ID NO: 1447941 - DNA, 14 bp, Homo sapiens
cgtggtgaggctga

SEQ ID NO: 1447942 - DNA, 16 bp, Homo sapiens
cgtggtgggactccag

SEQ ID NO: 1447943 - DNA, 19 bp, Homo sapiens
cgtggtttgcctgaggctg

SEQ ID NO: 1447944 - DNA, 18 bp, Homo sapiens
cgtgtaaccagttataaa

SEQ ID NO: 1447945 - DNA, 20 bp, Homo sapiens
cgtgtaccacctaatgttta

SEQ ID NO: 1447946 - DNA, 20 bp, Homo sapiens
cgtgtagtggaagagcagcc

SEQ ID NO: 1447947 - DNA, 16 bp, Homo sapiens
cgtgtatagtatctgt

SEQ ID NO: 1447948 - DNA, 18 bp, Homo sapiens
cgtgtatagtatctgtat

SEQ ID NO: 1447949 - DNA, 14 bp, Homo sapiens
cgtgtatcctgggg

SEQ ID NO: 1447950 - DNA, 15 bp, Homo sapiens
cgtgtcaagctgctc

SEQ ID NO: 1447951 - DNA, 12 bp, Homo sapiens
cgtgtccagcac

SEQ ID NO: 1447952 - DNA, 16 bp, Homo sapiens
cgtgtccagcacagaa

SEQ ID NO: 1447953 - DNA, 14 bp, Homo sapiens
cgtgtcccaaggag

SEQ ID NO: 1447954 - DNA, 13 bp, Homo sapiens
cgtgtccgtccac

SEQ ID NO: 1447955 - DNA, 18 bp, Homo sapiens
cgtgtccgtccacccttc

SEQ ID NO: 1447956 - DNA, 12 bp, Homo sapiens
cgtgtcctctcc

SEQ ID NO: 1447957 - DNA, 15 bp, Homo sapiens
cgtgtcgtgggtgtg

SEQ ID NO: 1447958 - DNA, 21 bp, Homo sapiens
cgtgtctataatggaaacatt

SEQ ID NO: 1447959 - DNA, 15 bp, Homo sapiens
cgtgtctcagcctct

SEQ ID NO: 1447960 - DNA, 16 bp, Homo sapiens
cgtgtctcagcctctg

SEQ ID NO: 1447961 - DNA, 14 bp, Homo sapiens
cgtgtctctcccac

SEQ ID NO: 1447962 - DNA, 14 bp, Homo sapiens
cgtgtctgtattta

SEQ ID NO: 1447963 - DNA, 23 bp, Homo sapiens
cgtgtgcatagcgtcctgccctg

SEQ ID NO: 1447964 - DNA, 16 bp, Homo sapiens
cgtgtgggtctctggg

SEQ ID NO: 1447965 - DNA, 19 bp, Homo sapiens
cgtgtgtcccagatgctgt

SEQ ID NO: 1447966 - DNA, 13 bp, Homo sapiens
cgtgtgtgacact

SEQ ID NO: 1447967 - DNA, 15 bp, Homo sapiens
cgtgtgtgtatgtgt

SEQ ID NO: 1447968 - DNA, 19 bp, Homo sapiens
cgtgtgtttgtatgtctgt

SEQ ID NO: 1447969 - DNA, 15 bp, Homo sapiens
cgtgttcagcagaac

SEQ ID NO: 1447970 - DNA, 16 bp, Homo sapiens
cgtgttcagcagaacc

SEQ ID NO: 1447971 - DNA, 14 bp, Homo sapiens
cgtgttcaggacac

SEQ ID NO: 1447972 - DNA, 13 bp, Homo sapiens
tgttattcttgtt

SEQ ID NO: 1447973 - DNA, 14 bp, Homo sapiens
tgttattgtggaag

SEQ ID NO: 1447974 - DNA, 18 bp, Homo sapiens
tgttatttaatagctgtg

SEQ ID NO: 1447975 - DNA, 16 bp, Homo sapiens
tgttatttacactggt

SEQ ID NO: 1447976 - DNA, 18 bp, Homo sapiens
tgttatttacactggtct

SEQ ID NO: 1447977 - DNA, 13 bp, Homo sapiens
tgttatttcttcc

SEQ ID NO: 1447978 - DNA, 21 bp, Homo sapiens
tgttatttttgtttcttccaa

SEQ ID NO: 1447979 - DNA, 22 bp, Homo sapiens
tgttatttttttttttttcaca

SEQ ID NO: 1447980 - DNA, 15 bp, Homo sapiens
tgttcaaagctgcct

SEQ ID NO: 1447981 - DNA, 14 bp, Homo sapiens
tgttcaaatattgt

SEQ ID NO: 1447982 - DNA, 23 bp, Homo sapiens
tgttcaagaccagcctgaccaac

SEQ ID NO: 1447983 - DNA, 23 bp, Homo sapiens
tgttcaatgattatttgtattta

SEQ ID NO: 1447984 - DNA, 14 bp, Homo sapiens
tgttcaatgttcca

SEQ ID NO: 1447985 - DNA, 16 bp, Homo sapiens
tgttcaatgtttaatg

SEQ ID NO: 1447986 - DNA, 16 bp, Homo sapiens
tgttcacaaactgtga

SEQ ID NO: 1447987 - DNA, 17 bp, Homo sapiens
tgttcacagaaaaagca

SEQ ID NO: 1447988 - DNA, 16 bp, Homo sapiens
tgttcacagccagact

SEQ ID NO: 1447989 - DNA, 18 bp, Homo sapiens
tgttcacagtctctggaa

SEQ ID NO: 1447990 - DNA, 10 bp, Homo sapiens
tgttcacctt

SEQ ID NO: 1447991 - DNA, 18 bp, Homo sapiens
tgttcaccttcaaaatgt

SEQ ID NO: 1447992 - DNA, 19 bp, Homo sapiens
tgttcacggcagaccagaa

SEQ ID NO: 1447993 - DNA, 15 bp, Homo sapiens
tgttcagaagaaatt

SEQ ID NO: 1447994 - DNA, 18 bp, Homo sapiens
tgttcagaaggttgctct

SEQ ID NO: 1447995 - DNA, 14 bp, Homo sapiens
tgttcagattaaaa

SEQ ID NO: 1447996 - DNA, 13 bp, Homo sapiens
tgttcagcactgt

SEQ ID NO: 1447997 - DNA, 15 bp, Homo sapiens
tgttcagcagaacct

SEQ ID NO: 1447998 - DNA, 18 bp, Homo sapiens
tgttcagcgttttgcaag

SEQ ID NO: 1447999 - DNA, 17 bp, Homo sapiens
tgttcagctctttccaa

SEQ ID NO: 1448000 - DNA, 13 bp, Homo sapiens
tgttcagtaataa

SEQ ID NO: 1448001 - DNA, 15 bp, Homo sapiens
tgttcagtgagatat

SEQ ID NO: 1448002 - DNA, 17 bp, Homo sapiens
tgttcagtgtcccgggc

SEQ ID NO: 1448003 - DNA, 20 bp, Homo sapiens
tgttcatagcccagtagacc

SEQ ID NO: 1448004 - DNA, 19 bp, Homo sapiens
tgttcatatgtacttgttt

SEQ ID NO: 1448005 - DNA, 23 bp, Homo sapiens
tgttcatcctcattgcctcctgt

SEQ ID NO: 1448006 - DNA, 14 bp, Homo sapiens
tgttcatctgtaac

SEQ ID NO: 1448007 - DNA, 13 bp, Homo sapiens
tgttcatgtgatt

SEQ ID NO: 1448008 - DNA, 13 bp, Homo sapiens
tgttcatttcatt

SEQ ID NO: 1448009 - DNA, 22 bp, Homo sapiens
tgttcatttggtgttcctggaa

SEQ ID NO: 1448010 - DNA, 12 bp, Homo sapiens
tgttcattttga

SEQ ID NO: 1448011 - DNA, 15 bp, Homo sapiens
tgttcattttgagta

SEQ ID NO: 1448012 - DNA, 18 bp, Homo sapiens
tgttccaaaccctcctgg

SEQ ID NO: 1448013 - DNA, 23 bp, Homo sapiens
tgttccaacctcctgctctggga

SEQ ID NO: 1448014 - DNA, 18 bp, Homo sapiens
tgttccaccattgctgga

SEQ ID NO: 1448015 - DNA, 21 bp, Homo sapiens
tgttccaccattgctggaaaa

SEQ ID NO: 1448016 - DNA, 11 bp, Homo sapiens
tgttccagact

SEQ ID NO: 1448017 - DNA, 23 bp, Homo sapiens
tgttccagactcaggttccagaa

SEQ ID NO: 1448018 - DNA, 18 bp, Homo sapiens
tgttccccatggccactt

SEQ ID NO: 1448019 - DNA, 15 bp, Homo sapiens
tgttcccctcctcca

SEQ ID NO: 1448020 - DNA, 19 bp, Homo sapiens
tgttcccctcctccactct

SEQ ID NO: 1448021 - DNA, 14 bp, Homo sapiens
tgttccctagagag

SEQ ID NO: 1448022 - DNA, 17 bp, Homo sapiens
tgttccctgcaccctgg

SEQ ID NO: 1448023 - DNA, 13 bp, Homo sapiens
tgttccctggagt

SEQ ID NO: 1448024 - DNA, 22 bp, Homo sapiens
tgttcccttcctcttcctgccc

SEQ ID NO: 1448025 - DNA, 23 bp, Homo sapiens
tgttcccttcctcttcctgccct

SEQ ID NO: 1448026 - DNA, 18 bp, Homo sapiens
tgttcccttgaatttcat

SEQ ID NO: 1448027 - DNA, 16 bp, Homo sapiens
tgttcctaacaaaatg

SEQ ID NO: 1448028 - DNA, 22 bp, Homo sapiens
tgttcctactcacacttcagct

SEQ ID NO: 1448029 - DNA, 16 bp, Homo sapiens
tgttcctatctgcagg

SEQ ID NO: 1448030 - DNA, 17 bp, Homo sapiens
tgttcctcaaggtccat

SEQ ID NO: 1448031 - DNA, 10 bp, Homo sapiens
tgttcctcta

SEQ ID NO: 1448032 - DNA, 19 bp, Homo sapiens
tgttcctctatactttgtt

SEQ ID NO: 1448033 - DNA, 19 bp, Homo sapiens
tgttcctgaatacaagcct

SEQ ID NO: 1448034 - DNA, 21 bp, Homo sapiens
tgttcctgcctccttgatatt

SEQ ID NO: 1448035 - DNA, 15 bp, Homo sapiens
tgttcctgctccatg

SEQ ID NO: 1448036 - DNA, 19 bp, Homo sapiens
tgttcctgctccatgactg

SEQ ID NO: 1448037 - DNA, 12 bp, Homo sapiens
tgttcctgctgt

SEQ ID NO: 1448038 - DNA, 15 bp, Homo sapiens
tgttcctgctgtatt

SEQ ID NO: 1448039 - DNA, 10 bp, Homo sapiens
tgttcctgga

SEQ ID NO: 1448040 - DNA, 11 bp, Homo sapiens
tgttcctggaa

SEQ ID NO: 1448041 - DNA, 14 bp, Homo sapiens
tgttcctggaagca

SEQ ID NO: 1448042 - DNA, 21 bp, Homo sapiens
tgttcgtttccatcatgtctg

SEQ ID NO: 1448043 - DNA, 23 bp, Homo sapiens
tgttcgtttccatcatgtctgta

SEQ ID NO: 1448044 - DNA, 19 bp, Homo sapiens
tgttctaaagctctgacat

SEQ ID NO: 1448045 - DNA, 14 bp, Homo sapiens
tgttctaagatgtg

SEQ ID NO: 1448046 - DNA, 16 bp, Homo sapiens
tgttctaagatgtgat

SEQ ID NO: 1448047 - DNA, 22 bp, Homo sapiens
tgttctaagatgtgatattcta

SEQ ID NO: 1448048 - DNA, 20 bp, Homo sapiens
tgttctaagcaatgcaaatg

SEQ ID NO: 1448049 - DNA, 19 bp, Homo sapiens
tgttctaaggctctgagag

SEQ ID NO: 1448050 - DNA, 23 bp, Homo sapiens
tgttctaaggctctgagagtcta

SEQ ID NO: 1448051 - DNA, 19 bp, Homo sapiens
tgttctaagtttctaagat

SEQ ID NO: 1448052 - DNA, 16 bp, Homo sapiens
tgttctagacttcccc

SEQ ID NO: 1448053 - DNA, 20 bp, Homo sapiens
tgttctagcaagatagtctt

SEQ ID NO: 1448054 - DNA, 22 bp, Homo sapiens
tgttctcacaccaacagtgtga

SEQ ID NO: 1448055 - DNA, 12 bp, Homo sapiens
tgttctcagatt

SEQ ID NO: 1448056 - DNA, 17 bp, Homo sapiens
tgttctcatgaagcagg

SEQ ID NO: 1448057 - DNA, 21 bp, Homo sapiens
tgttctcatgaagcaggaggc

SEQ ID NO: 1448058 - DNA, 20 bp, Homo sapiens
tgttctccattttcaagctg

SEQ ID NO: 1448059 - DNA, 23 bp, Homo sapiens
tgttctcctgtccctccatccca

SEQ ID NO: 1448060 - DNA, 21 bp, Homo sapiens
tgttctccttttcctctctcc

SEQ ID NO: 1448061 - DNA, 17 bp, Homo sapiens
tgttctctgggagaaaa

SEQ ID NO: 1448062 - DNA, 15 bp, Homo sapiens
tgttctgaaacctta

SEQ ID NO: 1448063 - DNA, 18 bp, Homo sapiens
tgttctgaccctgcttca

SEQ ID NO: 1448064 - DNA, 12 bp, Homo sapiens
tgttctgcactg

SEQ ID NO: 1448065 - DNA, 16 bp, Homo sapiens
tgttctgcactgaaaa

SEQ ID NO: 1448066 - DNA, 16 bp, Homo sapiens
tgttctgcatggattc

SEQ ID NO: 1448067 - DNA, 17 bp, Homo sapiens
tgttctgcatggattca

SEQ ID NO: 1448068 - DNA, 23 bp, Homo sapiens
tgttctgcccaatgcctttttga

SEQ ID NO: 1448069 - DNA, 23 bp, Homo sapiens
tgttctgcccacgatcccctccc

SEQ ID NO: 1448070 - DNA, 20 bp, Homo sapiens
tgttctgcgctgtgtacaat

SEQ ID NO: 1448071 - DNA, 17 bp, Homo sapiens
tgttctgctccatacct

SEQ ID NO: 1448072 - DNA, 22 bp, Homo sapiens
tgttctgctccataccttttct

SEQ ID NO: 1448073 - DNA, 12 bp, Homo sapiens
tgttctgctcct

SEQ ID NO: 1448074 - DNA, 14 bp, Homo sapiens
tgttctgctcctgc

SEQ ID NO: 1448075 - DNA, 20 bp, Homo sapiens
tgttctgctcctgcttttct

SEQ ID NO: 1448076 - DNA, 21 bp, Homo sapiens
tgttctgcttcgaagtattca

SEQ ID NO: 1448077 - DNA, 23 bp, Homo sapiens
tgttctggactacacccaagcct

SEQ ID NO: 1448078 - DNA, 18 bp, Homo sapiens
tgttctgtaatggaactg

SEQ ID NO: 1448079 - DNA, 13 bp, Homo sapiens
tgttctgtgtctt

SEQ ID NO: 1448080 - DNA, 13 bp, Homo sapiens
tgttctgttgtct

SEQ ID NO: 1448081 - DNA, 15 bp, Homo sapiens
tgttctgttgtctgc

SEQ ID NO: 1448082 - DNA, 20 bp, Homo sapiens
tgttctgttgtctgcgcctg

SEQ ID NO: 1448083 - DNA, 15 bp, Homo sapiens
tgttctgtttgttaa

SEQ ID NO: 1448084 - DNA, 18 bp, Homo sapiens
tgttcttaaaaaaataaa

SEQ ID NO: 1448085 - DNA, 19 bp, Homo sapiens
tgttcttaaaaaaataaaa

SEQ ID NO: 1448086 - DNA, 14 bp, Homo sapiens
tgttcttaggttta

SEQ ID NO: 1448087 - DNA, 18 bp, Homo sapiens
tgttcttaggtttactgt

SEQ ID NO: 1448088 - DNA, 21 bp, Homo sapiens
tgttcttgcataggctcttaa

SEQ ID NO: 1448089 - DNA, 22 bp, Homo sapiens
cgtgttcaggacacatctattg

SEQ ID NO: 1448090 - DNA, 17 bp, Homo sapiens
cgttaactgtgtatgta

SEQ ID NO: 1448091 - DNA, 19 bp, Homo sapiens
cgttaactgtgtatgtaca

SEQ ID NO: 1448092 - DNA, 14 bp, Homo sapiens
cgttaggcatttcc

SEQ ID NO: 1448093 - DNA, 13 bp, Homo sapiens
cgttagggctgct

SEQ ID NO: 1448094 - DNA, 22 bp, Homo sapiens
cgttatatttgacttgaaaaga

SEQ ID NO: 1448095 - DNA, 12 bp, Homo sapiens
cgttccagctga

SEQ ID NO: 1448096 - DNA, 13 bp, Homo sapiens
cgttccagttccc

SEQ ID NO: 1448097 - DNA, 18 bp, Homo sapiens
cgttccctgtcagaggct

SEQ ID NO: 1448098 - DNA, 13 bp, Homo sapiens
cgttcctggcctt

SEQ ID NO: 1448099 - DNA, 18 bp, Homo sapiens
cgttctaggtaggaagag

SEQ ID NO: 1448100 - DNA, 14 bp, Homo sapiens
cgttctattgtgtg

SEQ ID NO: 1448101 - DNA, 12 bp, Homo sapiens
cgttctcaagaa

SEQ ID NO: 1448102 - DNA, 16 bp, Homo sapiens
cgttctcaagaatcta

SEQ ID NO: 1448103 - DNA, 22 bp, Homo sapiens
cgttctcaagaatctagaagat

SEQ ID NO: 1448104 - DNA, 15 bp, Homo sapiens
cgttctcacacccac

SEQ ID NO: 1448105 - DNA, 19 bp, Homo sapiens
cgttctcctgatgttttgc

SEQ ID NO: 1448106 - DNA, 18 bp, Homo sapiens
cgttctgctgaccaaatg

SEQ ID NO: 1448107 - DNA, 16 bp, Homo sapiens
cgttctgctgcccctg

SEQ ID NO: 1448108 - DNA, 20 bp, Homo sapiens
cgttctgctgcccctgcagt

SEQ ID NO: 1448109 - DNA, 19 bp, Homo sapiens
cgttctggactctgcccca

SEQ ID NO: 1448110 - DNA, 20 bp, Homo sapiens
cgttctgtactgttactggg

SEQ ID NO: 1448111 - DNA, 23 bp, Homo sapiens
cgttctgtactgttactgggccc

SEQ ID NO: 1448112 - DNA, 19 bp, Homo sapiens
cgttctgttacccagggct

SEQ ID NO: 1448113 - DNA, 17 bp, Homo sapiens
cgttctgttccaacctc

SEQ ID NO: 1448114 - DNA, 19 bp, Homo sapiens
cgttgaggatgaggccgct

SEQ ID NO: 1448115 - DNA, 19 bp, Homo sapiens
cgttgcttcccgctgcaca

SEQ ID NO: 1448116 - DNA, 16 bp, Homo sapiens
cgttggagaagcccgt

SEQ ID NO: 1448117 - DNA, 22 bp, Homo sapiens
cgttggagagcagcaggtgctg

SEQ ID NO: 1448118 - DNA, 11 bp, Homo sapiens
cgttggagcca

SEQ ID NO: 1448119 - DNA, 20 bp, Homo sapiens
cgttggagccactcctgtcc

SEQ ID NO: 1448120 - DNA, 17 bp, Homo sapiens
cgttgggagcctagctc

SEQ ID NO: 1448121 - DNA, 14 bp, Homo sapiens
cgttggtttgtgtt

SEQ ID NO: 1448122 - DNA, 17 bp, Homo sapiens
cgttgtctgtggatggt

SEQ ID NO: 1448123 - DNA, 14 bp, Homo sapiens
cgttgtgagctgga

SEQ ID NO: 1448124 - DNA, 21 bp, Homo sapiens
cgtttagtttctagaggcctc

SEQ ID NO: 1448125 - DNA, 16 bp, Homo sapiens
cgtttatgggccttgc

SEQ ID NO: 1448126 - DNA, 12 bp, Homo sapiens
cgtttcagaagg

SEQ ID NO: 1448127 - DNA, 12 bp, Homo sapiens
cgtttctccttt

SEQ ID NO: 1448128 - DNA, 13 bp, Homo sapiens
cgtttctcctttt

SEQ ID NO: 1448129 - DNA, 12 bp, Homo sapiens
cgtttctggaac

SEQ ID NO: 1448130 - DNA, 11 bp, Homo sapiens
cgtttctggcc

SEQ ID NO: 1448131 - DNA, 16 bp, Homo sapiens
cgtttgagaagaaaac

SEQ ID NO: 1448132 - DNA, 19 bp, Homo sapiens
cgtttgcaccgcctgccct

SEQ ID NO: 1448133 - DNA, 21 bp, Homo sapiens
cgtttggaggcccctgggctc

SEQ ID NO: 1448134 - DNA, 22 bp, Homo sapiens
cgtttggaggcccctgggctct

SEQ ID NO: 1448135 - DNA, 17 bp, Homo sapiens
cgtttgtgcagaatctc

SEQ ID NO: 1448136 - DNA, 18 bp, Homo sapiens
cgttttagtgtctgacct

SEQ ID NO: 1448137 - DNA, 15 bp, Homo sapiens
cgttttcttctttcc

SEQ ID NO: 1448138 - DNA, 21 bp, Homo sapiens
cgttttgaagacgtggactcc

SEQ ID NO: 1448139 - DNA, 22 bp, Homo sapiens
cgttttgcaaggtaaaatttta

SEQ ID NO: 1448140 - DNA, 16 bp, Homo sapiens
cgttttttcctcagtg

SEQ ID NO: 1448141 - DNA, 15 bp, Homo sapiens
ctaaaaaaaaaaagg

SEQ ID NO: 1448142 - DNA, 14 bp, Homo sapiens
ctaaaaaaaagatg

SEQ ID NO: 1448143 - DNA, 15 bp, Homo sapiens
ctaaaaaaaagatga

SEQ ID NO: 1448144 - DNA, 17 bp, Homo sapiens
ctaaaaaacagaggcca

SEQ ID NO: 1448145 - DNA, 22 bp, Homo sapiens
ctaaaaaacataaatttcttta

SEQ ID NO: 1448146 - DNA, 16 bp, Homo sapiens
ctaaaaaataactgtg

SEQ ID NO: 1448147 - DNA, 21 bp, Homo sapiens
ctaaaaagaaggaaaatgatc

SEQ ID NO: 1448148 - DNA, 22 bp, Homo sapiens
ctaaaaataaaatgcatttaaa

SEQ ID NO: 1448149 - DNA, 21 bp, Homo sapiens
ctaaaaatacaccgtttagaa

SEQ ID NO: 1448150 - DNA, 23 bp, Homo sapiens
ctaaaaatatacatgtttatgta

SEQ ID NO: 1448151 - DNA, 13 bp, Homo sapiens
ctaaaaatccaga

SEQ ID NO: 1448152 - DNA, 15 bp, Homo sapiens
ctaaaaatgaaaatt

SEQ ID NO: 1448153 - DNA, 11 bp, Homo sapiens
ctaaaaccatt

SEQ ID NO: 1448154 - DNA, 13 bp, Homo sapiens
ctaaaactatggt

SEQ ID NO: 1448155 - DNA, 20 bp, Homo sapiens
ctaaaagatcctttttaaat

SEQ ID NO: 1448156 - DNA, 13 bp, Homo sapiens
ctaaaaggaaaag

SEQ ID NO: 1448157 - DNA, 14 bp, Homo sapiens
ctaaaaggaaaagg

SEQ ID NO: 1448158 - DNA, 22 bp, Homo sapiens
ctaaaaggaaaaggttgttgtt

SEQ ID NO: 1448159 - DNA, 13 bp, Homo sapiens
ctaaaagtaaaca

SEQ ID NO: 1448160 - DNA, 17 bp, Homo sapiens
ctaaaagtactgcattt

SEQ ID NO: 1448161 - DNA, 12 bp, Homo sapiens
ctaaaatcatga

SEQ ID NO: 1448162 - DNA, 17 bp, Homo sapiens
ctaaaatcttatagttc

SEQ ID NO: 1448163 - DNA, 22 bp, Homo sapiens
ctaaaatcttatagttctaggc

SEQ ID NO: 1448164 - DNA, 21 bp, Homo sapiens
ctaaaatgtgatgttctaagg

SEQ ID NO: 1448165 - DNA, 11 bp, Homo sapiens
ctaaaatgtta

SEQ ID NO: 1448166 - DNA, 13 bp, Homo sapiens
ctaaaatgttact

SEQ ID NO: 1448167 - DNA, 16 bp, Homo sapiens
ctaaaattaagtatat

SEQ ID NO: 1448168 - DNA, 12 bp, Homo sapiens
ctaaaattctag

SEQ ID NO: 1448169 - DNA, 21 bp, Homo sapiens
ctaaaattctagtctctgatt

SEQ ID NO: 1448170 - DNA, 17 bp, Homo sapiens
ctaaaattgtatgaaaa

SEQ ID NO: 1448171 - DNA, 22 bp, Homo sapiens
ctaaaattgtatgaaaatcctt

SEQ ID NO: 1448172 - DNA, 13 bp, Homo sapiens
ctaaaatttgaag

SEQ ID NO: 1448173 - DNA, 19 bp, Homo sapiens
ctaaaatttgtaatatttt

SEQ ID NO: 1448174 - DNA, 21 bp, Homo sapiens
ctaaacaaaagcaaagatgca

SEQ ID NO: 1448175 - DNA, 17 bp, Homo sapiens
ctaaacagatataaatg

SEQ ID NO: 1448176 - DNA, 12 bp, Homo sapiens
ctaaacataatt

SEQ ID NO: 1448177 - DNA, 16 bp, Homo sapiens
ctaaacataattgtgg

SEQ ID NO: 1448178 - DNA, 12 bp, Homo sapiens
ctaaacatccat

SEQ ID NO: 1448179 - DNA, 12 bp, Homo sapiens
ctaaacattttt

SEQ ID NO: 1448180 - DNA, 12 bp, Homo sapiens
ctaaacccaatg

SEQ ID NO: 1448181 - DNA, 14 bp, Homo sapiens
ctaaacccaatgac

SEQ ID NO: 1448182 - DNA, 13 bp, Homo sapiens
ctaaacctcagtt

SEQ ID NO: 1448183 - DNA, 17 bp, Homo sapiens
ctaaacctcagttatta

SEQ ID NO: 1448184 - DNA, 20 bp, Homo sapiens
ctaaacgagtcaatcccctc

SEQ ID NO: 1448185 - DNA, 16 bp, Homo sapiens
ctaaacgtggtcacct

SEQ ID NO: 1448186 - DNA, 14 bp, Homo sapiens
ctaaactcatttat

SEQ ID NO: 1448187 - DNA, 22 bp, Homo sapiens
ctaaactcatttataaagctaa

SEQ ID NO: 1448188 - DNA, 16 bp, Homo sapiens
ctaaactccttcctgg

SEQ ID NO: 1448189 - DNA, 22 bp, Homo sapiens
ctaaactccttcctggcctgag

SEQ ID NO: 1448190 - DNA, 20 bp, Homo sapiens
ctaaactggcatctgctcta

SEQ ID NO: 1448191 - DNA, 15 bp, Homo sapiens
ctaaactgtgaaaaa

SEQ ID NO: 1448192 - DNA, 17 bp, Homo sapiens
ctaaactgtgaaaaatc

SEQ ID NO: 1448193 - DNA, 13 bp, Homo sapiens
ctaaacttttgag

SEQ ID NO: 1448194 - DNA, 17 bp, Homo sapiens
ctaaactttttttctgt

SEQ ID NO: 1448195 - DNA, 18 bp, Homo sapiens
ctaaactttttttctgta

SEQ ID NO: 1448196 - DNA, 21 bp, Homo sapiens
ctaaagaaaaatatcttggcc

SEQ ID NO: 1448197 - DNA, 16 bp, Homo sapiens
ctaaagagagaatgta

SEQ ID NO: 1448198 - DNA, 19 bp, Homo sapiens
ctaaagagcccttgcctcc

SEQ ID NO: 1448199 - DNA, 18 bp, Homo sapiens
ctaaagaggctgaaagag

SEQ ID NO: 1448200 - DNA, 18 bp, Homo sapiens
ctaaagatagagtaaaaa

SEQ ID NO: 1448201 - DNA, 19 bp, Homo sapiens
ctaaagatatcagagctct

SEQ ID NO: 1448202 - DNA, 20 bp, Homo sapiens
ctaaagatatcagagctctt

SEQ ID NO: 1448203 - DNA, 18 bp, Homo sapiens
ctaaagatggagtttcta

SEQ ID NO: 1448204 - DNA, 20 bp, Homo sapiens
ctaaagatggagtttctaag

SEQ ID NO: 1448205 - DNA, 21 bp, Homo sapiens
ctaaagatggagtttctaagg

SEQ ID NO: 1448206 - DNA, 14 bp, Homo sapiens
tgttcttgttttta

SEQ ID NO: 1448207 - DNA, 12 bp, Homo sapiens
tgttctttagtt

SEQ ID NO: 1448208 - DNA, 18 bp, Homo sapiens
tgttctttgtgttttagg

SEQ ID NO: 1448209 - DNA, 22 bp, Homo sapiens
tgttcttttaaagactacctgg

SEQ ID NO: 1448210 - DNA, 23 bp, Homo sapiens
tgttgaaaaaaaagtttcagaga

SEQ ID NO: 1448211 - DNA, 15 bp, Homo sapiens
tgttgaaaatacttt

SEQ ID NO: 1448212 - DNA, 20 bp, Homo sapiens
tgttgaaaatggtttcaagt

SEQ ID NO: 1448213 - DNA, 17 bp, Homo sapiens
tgttgaaaatgttcaga

SEQ ID NO: 1448214 - DNA, 12 bp, Homo sapiens
tgttgaacaaaa

SEQ ID NO: 1448215 - DNA, 15 bp, Homo sapiens
tgttgaactgttaga

SEQ ID NO: 1448216 - DNA, 13 bp, Homo sapiens
tgttgaagagcag

SEQ ID NO: 1448217 - DNA, 18 bp, Homo sapiens
tgttgaagagcagctcct

SEQ ID NO: 1448218 - DNA, 19 bp, Homo sapiens
tgttgaattggtgaataaa

SEQ ID NO: 1448219 - DNA, 17 bp, Homo sapiens
tgttgacacatatgaac

SEQ ID NO: 1448220 - DNA, 19 bp, Homo sapiens
tgttgacacatatgaacac

SEQ ID NO: 1448221 - DNA, 17 bp, Homo sapiens
tgttgacctgtgcacct

SEQ ID NO: 1448222 - DNA, 11 bp, Homo sapiens
tgttgactgtg

SEQ ID NO: 1448223 - DNA, 13 bp, Homo sapiens
tgttgactgtgat

SEQ ID NO: 1448224 - DNA, 20 bp, Homo sapiens
tgttgagccccagtgctgga

SEQ ID NO: 1448225 - DNA, 23 bp, Homo sapiens
tgttgagccccagtgctggaagg

SEQ ID NO: 1448226 - DNA, 14 bp, Homo sapiens
tgttgagtaaaaca

SEQ ID NO: 1448227 - DNA, 15 bp, Homo sapiens
tgttgagtaaaacac

SEQ ID NO: 1448228 - DNA, 13 bp, Homo sapiens
tgttgagtgttca

SEQ ID NO: 1448229 - DNA, 13 bp, Homo sapiens
tgttgagttatga

SEQ ID NO: 1448230 - DNA, 14 bp, Homo sapiens
tgttgataatatat

SEQ ID NO: 1448231 - DNA, 15 bp, Homo sapiens
tgttgatcaaccatt

SEQ ID NO: 1448232 - DNA, 17 bp, Homo sapiens
tgttgatcatgtacttt

SEQ ID NO: 1448233 - DNA, 16 bp, Homo sapiens
tgttgatcccaagaca

SEQ ID NO: 1448234 - DNA, 22 bp, Homo sapiens
tgttgattatcttcagcccagg

SEQ ID NO: 1448235 - DNA, 22 bp, Homo sapiens
tgttgatttttactgtgtttta

SEQ ID NO: 1448236 - DNA, 19 bp, Homo sapiens
tgttgcaagatgtgaatta

SEQ ID NO: 1448237 - DNA, 17 bp, Homo sapiens
tgttgcaagtactgctg

SEQ ID NO: 1448238 - DNA, 19 bp, Homo sapiens
tgttgcaagtactgctgta

SEQ ID NO: 1448239 - DNA, 14 bp, Homo sapiens
tgttgcagatgggt

SEQ ID NO: 1448240 - DNA, 18 bp, Homo sapiens
tgttgcagatgggtgata

SEQ ID NO: 1448241 - DNA, 18 bp, Homo sapiens
tgttgcataggttagata

SEQ ID NO: 1448242 - DNA, 17 bp, Homo sapiens
tgttgccaactaagccc

SEQ ID NO: 1448243 - DNA, 20 bp, Homo sapiens
tgttgccaactaagccctcg

SEQ ID NO: 1448244 - DNA, 16 bp, Homo sapiens
tgttgccaagagcccg

SEQ ID NO: 1448245 - DNA, 18 bp, Homo sapiens
tgttgccaagctccaagc

SEQ ID NO: 1448246 - DNA, 17 bp, Homo sapiens
tgttgccacctgttaaa

SEQ ID NO: 1448247 - DNA, 21 bp, Homo sapiens
tgttgccacctgttaaaatgt

SEQ ID NO: 1448248 - DNA, 23 bp, Homo sapiens
tgttgccaggttgcagctgctct

SEQ ID NO: 1448249 - DNA, 15 bp, Homo sapiens
tgttgccatttctct

SEQ ID NO: 1448250 - DNA, 15 bp, Homo sapiens
tgttgcccaggctgg

SEQ ID NO: 1448251 - DNA, 21 bp, Homo sapiens
tgttgcccaggctggagtgca

SEQ ID NO: 1448252 - DNA, 22 bp, Homo sapiens
tgttgcctgcacccttccctct

SEQ ID NO: 1448253 - DNA, 16 bp, Homo sapiens
tgttgctataataaag

SEQ ID NO: 1448254 - DNA, 23 bp, Homo sapiens
tgttgctcaaatctattcagaca

SEQ ID NO: 1448255 - DNA, 14 bp, Homo sapiens
tgttgctcagaagt

SEQ ID NO: 1448256 - DNA, 23 bp, Homo sapiens
tgttgctcagtgtttttgtgaat

SEQ ID NO: 1448257 - DNA, 14 bp, Homo sapiens
tgttgctgtggctc

SEQ ID NO: 1448258 - DNA, 18 bp, Homo sapiens
tgttgcttagatgagggt

SEQ ID NO: 1448259 - DNA, 16 bp, Homo sapiens
tgttgcttagtcactt

SEQ ID NO: 1448260 - DNA, 14 bp, Homo sapiens
tgttgcttggacta

SEQ ID NO: 1448261 - DNA, 19 bp, Homo sapiens
tgttgctttaatatgagct

SEQ ID NO: 1448262 - DNA, 16 bp, Homo sapiens
tgttgctttcttacct

SEQ ID NO: 1448263 - DNA, 22 bp, Homo sapiens
tgttgcttttcaaatgtttgaa

SEQ ID NO: 1448264 - DNA, 15 bp, Homo sapiens
tgttgcttttgaaaa

SEQ ID NO: 1448265 - DNA, 21 bp, Homo sapiens
tgttgcttttgtgaacttttt

SEQ ID NO: 1448266 - DNA, 15 bp, Homo sapiens
tgttggacagctgct

SEQ ID NO: 1448267 - DNA, 17 bp, Homo sapiens
tgttggcatagctctgg

SEQ ID NO: 1448268 - DNA, 13 bp, Homo sapiens
tgttggcccctct

SEQ ID NO: 1448269 - DNA, 16 bp, Homo sapiens
tgttggcccctctgct

SEQ ID NO: 1448270 - DNA, 21 bp, Homo sapiens
tgttggcccctctgctgtcct

SEQ ID NO: 1448271 - DNA, 20 bp, Homo sapiens
tgttggcctccggcctcccc

SEQ ID NO: 1448272 - DNA, 15 bp, Homo sapiens
tgttggctaatgaag

SEQ ID NO: 1448273 - DNA, 13 bp, Homo sapiens
tgttgggaaagga

SEQ ID NO: 1448274 - DNA, 14 bp, Homo sapiens
tgttgggaaagtat

SEQ ID NO: 1448275 - DNA, 20 bp, Homo sapiens
tgttgggacctgctgctcca

SEQ ID NO: 1448276 - DNA, 18 bp, Homo sapiens
tgttgggattcctgaccc

SEQ ID NO: 1448277 - DNA, 17 bp, Homo sapiens
tgttggggttgacattt

SEQ ID NO: 1448278 - DNA, 14 bp, Homo sapiens
tgttggtcatttta

SEQ ID NO: 1448279 - DNA, 23 bp, Homo sapiens
tgttggtgaattttcaaggcctt

SEQ ID NO: 1448280 - DNA, 13 bp, Homo sapiens
tgttgtaaaacaa

SEQ ID NO: 1448281 - DNA, 14 bp, Homo sapiens
tgttgtaaatattt

SEQ ID NO: 1448282 - DNA, 14 bp, Homo sapiens
tgttgtaacctgct

SEQ ID NO: 1448283 - DNA, 15 bp, Homo sapiens
tgttgtaagaattct

SEQ ID NO: 1448284 - DNA, 16 bp, Homo sapiens
tgttgtaagaattctg

SEQ ID NO: 1448285 - DNA, 12 bp, Homo sapiens
tgttgtccaaca

SEQ ID NO: 1448286 - DNA, 17 bp, Homo sapiens
tgttgtccggtttactt

SEQ ID NO: 1448287 - DNA, 22 bp, Homo sapiens
tgttgtctgcgcctgaaaaggg

SEQ ID NO: 1448288 - DNA, 14 bp, Homo sapiens
tgttgtctttttta

SEQ ID NO: 1448289 - DNA, 17 bp, Homo sapiens
tgttgtgaataattaca

SEQ ID NO: 1448290 - DNA, 16 bp, Homo sapiens
tgttgtgcttagaatt

SEQ ID NO: 1448291 - DNA, 12 bp, Homo sapiens
tgttgtgtgtgc

SEQ ID NO: 1448292 - DNA, 14 bp, Homo sapiens
tgttgtgtgtggga

SEQ ID NO: 1448293 - DNA, 15 bp, Homo sapiens
tgttgttaaacacgt

SEQ ID NO: 1448294 - DNA, 18 bp, Homo sapiens
tgttgttaatgaatatca

SEQ ID NO: 1448295 - DNA, 22 bp, Homo sapiens
tgttgttccattttatgcagaa

SEQ ID NO: 1448296 - DNA, 14 bp, Homo sapiens
tgttgttcctggct

SEQ ID NO: 1448297 - DNA, 18 bp, Homo sapiens
tgttgttccttttgaaag

SEQ ID NO: 1448298 - DNA, 14 bp, Homo sapiens
tgttgttctcattg

SEQ ID NO: 1448299 - DNA, 18 bp, Homo sapiens
tgttgttctgcctggaga

SEQ ID NO: 1448300 - DNA, 13 bp, Homo sapiens
tgttgtttgtaaa

SEQ ID NO: 1448301 - DNA, 19 bp, Homo sapiens
tgttgtttgtttttttgcc

SEQ ID NO: 1448302 - DNA, 16 bp, Homo sapiens
tgttgttttgtacaga

SEQ ID NO: 1448303 - DNA, 18 bp, Homo sapiens
tgtttaaaacttcagttt

SEQ ID NO: 1448304 - DNA, 18 bp, Homo sapiens
tgtttaaaagaaatatat

SEQ ID NO: 1448305 - DNA, 14 bp, Homo sapiens
tgtttaaaaggatt

SEQ ID NO: 1448306 - DNA, 20 bp, Homo sapiens
tgtttaaaatgtaatttaaa

SEQ ID NO: 1448307 - DNA, 21 bp, Homo sapiens
tgtttaaagtatatgtgcagt

SEQ ID NO: 1448308 - DNA, 21 bp, Homo sapiens
tgtttaaagtcacatccctgt

SEQ ID NO: 1448309 - DNA, 23 bp, Homo sapiens
tgtttaaataaaatttaatttca

SEQ ID NO: 1448310 - DNA, 14 bp, Homo sapiens
tgtttaaatagcct

SEQ ID NO: 1448311 - DNA, 16 bp, Homo sapiens
tgtttaaatagcctaa

SEQ ID NO: 1448312 - DNA, 20 bp, Homo sapiens
tgtttaaatagcctaaatga

SEQ ID NO: 1448313 - DNA, 13 bp, Homo sapiens
tgtttaaatataa

SEQ ID NO: 1448314 - DNA, 16 bp, Homo sapiens
tgtttaaatataaatg

SEQ ID NO: 1448315 - DNA, 21 bp, Homo sapiens
tgtttaacaaatctaatctct

SEQ ID NO: 1448316 - DNA, 21 bp, Homo sapiens
tgtttaagtgttgtaaatatt

SEQ ID NO: 1448317 - DNA, 12 bp, Homo sapiens
tgtttaataaag

SEQ ID NO: 1448318 - DNA, 20 bp, Homo sapiens
tgtttaatattgagaaagaa

SEQ ID NO: 1448319 - DNA, 21 bp, Homo sapiens
tgtttacaaaaatttctgtaa

SEQ ID NO: 1448320 - DNA, 20 bp, Homo sapiens
tgtttacagcactactctgt

SEQ ID NO: 1448321 - DNA, 18 bp, Homo sapiens
tgtttacaggtttgaatt

SEQ ID NO: 1448322 - DNA, 22 bp, Homo sapiens
tgtttacatcaaagcttcttca

SEQ ID NO: 1448323 - DNA, 23 bp, Homo sapiens
ctaaagatggagtttctaaggtc

SEQ ID NO: 1448324 - DNA, 17 bp, Homo sapiens
ctaaagattctatagtt

SEQ ID NO: 1448325 - DNA, 13 bp, Homo sapiens
ctaaagattttga

SEQ ID NO: 1448326 - DNA, 12 bp, Homo sapiens
ctaaagcacttt

SEQ ID NO: 1448327 - DNA, 14 bp, Homo sapiens
ctaaagcactttgc

SEQ ID NO: 1448328 - DNA, 19 bp, Homo sapiens
ctaaagcagacttttgtgt

SEQ ID NO: 1448329 - DNA, 11 bp, Homo sapiens
ctaaagcagtg

SEQ ID NO: 1448330 - DNA, 19 bp, Homo sapiens
ctaaagcatgaaatgtgaa

SEQ ID NO: 1448331 - DNA, 20 bp, Homo sapiens
ctaaagcatgaaatgtgaat

SEQ ID NO: 1448332 - DNA, 17 bp, Homo sapiens
ctaaagccaaccagcct

SEQ ID NO: 1448333 - DNA, 19 bp, Homo sapiens
ctaaagccaaccagccttt

SEQ ID NO: 1448334 - DNA, 17 bp, Homo sapiens
ctaaagcccaacctcct

SEQ ID NO: 1448335 - DNA, 16 bp, Homo sapiens
ctaaagctatgttaca

SEQ ID NO: 1448336 - DNA, 16 bp, Homo sapiens
ctaaaggcatccttgt

SEQ ID NO: 1448337 - DNA, 17 bp, Homo sapiens
ctaaaggcatccttgtc

SEQ ID NO: 1448338 - DNA, 17 bp, Homo sapiens
ctaaagggcagggccca

SEQ ID NO: 1448339 - DNA, 18 bp, Homo sapiens
ctaaagggcagggcccac

SEQ ID NO: 1448340 - DNA, 21 bp, Homo sapiens
ctaaaggtccacaggtctaga

SEQ ID NO: 1448341 - DNA, 23 bp, Homo sapiens
ctaaaggtccacaggtctagact

SEQ ID NO: 1448342 - DNA, 22 bp, Homo sapiens
ctaaagtcatcatgaactggct

SEQ ID NO: 1448343 - DNA, 11 bp, Homo sapiens
ctaaagttcta

SEQ ID NO: 1448344 - DNA, 13 bp, Homo sapiens
ctaaagttctaag

SEQ ID NO: 1448345 - DNA, 17 bp, Homo sapiens
ctaaagttctaagattc

SEQ ID NO: 1448346 - DNA, 20 bp, Homo sapiens
ctaaagttctaagattctga

SEQ ID NO: 1448347 - DNA, 19 bp, Homo sapiens
ctaaagttgtactttaaaa

SEQ ID NO: 1448348 - DNA, 14 bp, Homo sapiens
ctaaataaaaatat

SEQ ID NO: 1448349 - DNA, 16 bp, Homo sapiens
ctaaataaagatattg

SEQ ID NO: 1448350 - DNA, 23 bp, Homo sapiens
ctaaataaagcttgcaacaaaat

SEQ ID NO: 1448351 - DNA, 22 bp, Homo sapiens
ctaaataaatgtaatagccaaa

SEQ ID NO: 1448352 - DNA, 15 bp, Homo sapiens
ctaaatatacatctg

SEQ ID NO: 1448353 - DNA, 13 bp, Homo sapiens
ctaaatatttcct

SEQ ID NO: 1448354 - DNA, 14 bp, Homo sapiens
ctaaatatttcctt

SEQ ID NO: 1448355 - DNA, 16 bp, Homo sapiens
ctaaatccattttcta

SEQ ID NO: 1448356 - DNA, 23 bp, Homo sapiens
ctaaatccattttctaaactgtt

SEQ ID NO: 1448357 - DNA, 16 bp, Homo sapiens
ctaaatcccaagaaat

SEQ ID NO: 1448358 - DNA, 17 bp, Homo sapiens
ctaaatcccaagaaatg

SEQ ID NO: 1448359 - DNA, 15 bp, Homo sapiens
ctaaatgagctcctg

SEQ ID NO: 1448360 - DNA, 16 bp, Homo sapiens
ctaaatgatggtgctt

SEQ ID NO: 1448361 - DNA, 15 bp, Homo sapiens
ctaaatgctgaaaaa

SEQ ID NO: 1448362 - DNA, 16 bp, Homo sapiens
ctaaatggcctcatgt

SEQ ID NO: 1448363 - DNA, 17 bp, Homo sapiens
ctaaatggcctcatgtg

SEQ ID NO: 1448364 - DNA, 19 bp, Homo sapiens
ctaaatggcctcatgtggc

SEQ ID NO: 1448365 - DNA, 13 bp, Homo sapiens
ctaaatgtaaaat

SEQ ID NO: 1448366 - DNA, 16 bp, Homo sapiens
ctaaatgttggaatgt

SEQ ID NO: 1448367 - DNA, 16 bp, Homo sapiens
ctaaattgattgaatt

SEQ ID NO: 1448368 - DNA, 20 bp, Homo sapiens
ctaaattgattgaattaaat

SEQ ID NO: 1448369 - DNA, 22 bp, Homo sapiens
ctaaattggctccatatcattt

SEQ ID NO: 1448370 - DNA, 15 bp, Homo sapiens
ctaaatttaatgctg

SEQ ID NO: 1448371 - DNA, 23 bp, Homo sapiens
ctaaatttgaatgttaagcagat

SEQ ID NO: 1448372 - DNA, 22 bp, Homo sapiens
ctaaatttgtgctttttaagaa

SEQ ID NO: 1448373 - DNA, 15 bp, Homo sapiens
ctaaattttgttact

SEQ ID NO: 1448374 - DNA, 14 bp, Homo sapiens
ctaaatttttataa

SEQ ID NO: 1448375 - DNA, 21 bp, Homo sapiens
ctaacaataatatttcaagtg

SEQ ID NO: 1448376 - DNA, 17 bp, Homo sapiens
ctaacagataagcaaga

SEQ ID NO: 1448377 - DNA, 16 bp, Homo sapiens
ctaacagtccttgctt

SEQ ID NO: 1448378 - DNA, 23 bp, Homo sapiens
ctaacataaaatctgtgaattaa

SEQ ID NO: 1448379 - DNA, 12 bp, Homo sapiens
ctaacatataat

SEQ ID NO: 1448380 - DNA, 22 bp, Homo sapiens
ctaacatataatgttgttattt

SEQ ID NO: 1448381 - DNA, 17 bp, Homo sapiens
ctaacatgtcctgccta

SEQ ID NO: 1448382 - DNA, 20 bp, Homo sapiens
ctaacatgttatcaaatctg

SEQ ID NO: 1448383 - DNA, 15 bp, Homo sapiens
ctaaccaagctgagt

SEQ ID NO: 1448384 - DNA, 15 bp, Homo sapiens
ctaaccaatgccttt

SEQ ID NO: 1448385 - DNA, 12 bp, Homo sapiens
ctaaccatcccc

SEQ ID NO: 1448386 - DNA, 15 bp, Homo sapiens
ctaaccatccccaac

SEQ ID NO: 1448387 - DNA, 13 bp, Homo sapiens
ctaaccatttata

SEQ ID NO: 1448388 - DNA, 23 bp, Homo sapiens
ctaacccaagacatgacattctt

SEQ ID NO: 1448389 - DNA, 18 bp, Homo sapiens
ctaaccccaacgcacagg

SEQ ID NO: 1448390 - DNA, 22 bp, Homo sapiens
ctaaccccaacgcacaggaaaa

SEQ ID NO: 1448391 - DNA, 14 bp, Homo sapiens
ctaaccccttccag

SEQ ID NO: 1448392 - DNA, 23 bp, Homo sapiens
ctaacctcccttaagcagcaaca

SEQ ID NO: 1448393 - DNA, 19 bp, Homo sapiens
ctaacctcttttctgcatc

SEQ ID NO: 1448394 - DNA, 20 bp, Homo sapiens
ctaacctgttacactgggct

SEQ ID NO: 1448395 - DNA, 22 bp, Homo sapiens
ctaacggtctgttctgtttcaa

SEQ ID NO: 1448396 - DNA, 22 bp, Homo sapiens
ctaactagaattagtatgtctg

SEQ ID NO: 1448397 - DNA, 21 bp, Homo sapiens
ctaactagacaccaaagttct

SEQ ID NO: 1448398 - DNA, 23 bp, Homo sapiens
ctaactagacaccaaagttctaa

SEQ ID NO: 1448399 - DNA, 20 bp, Homo sapiens
ctaactcaaatacacatttg

SEQ ID NO: 1448400 - DNA, 14 bp, Homo sapiens
ctaactcaccagcc

SEQ ID NO: 1448401 - DNA, 17 bp, Homo sapiens
ctaactcagaattattt

SEQ ID NO: 1448402 - DNA, 17 bp, Homo sapiens
ctaactccttaacaact

SEQ ID NO: 1448403 - DNA, 18 bp, Homo sapiens
ctaactcttttctatttt

SEQ ID NO: 1448404 - DNA, 17 bp, Homo sapiens
ctaactggacatgaagg

SEQ ID NO: 1448405 - DNA, 14 bp, Homo sapiens
ctaactggactggt

SEQ ID NO: 1448406 - DNA, 22 bp, Homo sapiens
ctaactgggttaaatattttgc

SEQ ID NO: 1448407 - DNA, 17 bp, Homo sapiens
ctaactgggttacagtg

SEQ ID NO: 1448408 - DNA, 20 bp, Homo sapiens
ctaactgggttacagtgttt

SEQ ID NO: 1448409 - DNA, 17 bp, Homo sapiens
ctaactgtaaatcatgt

SEQ ID NO: 1448410 - DNA, 20 bp, Homo sapiens
ctaactgttcccttatctgt

SEQ ID NO: 1448411 - DNA, 17 bp, Homo sapiens
ctaacttggagccccag

SEQ ID NO: 1448412 - DNA, 21 bp, Homo sapiens
ctaacttggagccccagtgcc

SEQ ID NO: 1448413 - DNA, 15 bp, Homo sapiens
ctaagaagacatttt

SEQ ID NO: 1448414 - DNA, 17 bp, Homo sapiens
ctaagaagacattttgt

SEQ ID NO: 1448415 - DNA, 18 bp, Homo sapiens
ctaagaagacattttgtt

SEQ ID NO: 1448416 - DNA, 19 bp, Homo sapiens
ctaagaagacattttgtta

SEQ ID NO: 1448417 - DNA, 17 bp, Homo sapiens
ctaagaattcaaactgg

SEQ ID NO: 1448418 - DNA, 22 bp, Homo sapiens
ctaagacatgtgaggaggaaaa

SEQ ID NO: 1448419 - DNA, 19 bp, Homo sapiens
ctaagactcaaatgttcta

SEQ ID NO: 1448420 - DNA, 19 bp, Homo sapiens
ctaagacttactctaagat

SEQ ID NO: 1448421 - DNA, 23 bp, Homo sapiens
ctaagacttactctaagatctta

SEQ ID NO: 1448422 - DNA, 18 bp, Homo sapiens
ctaagagaaactgtgtat

SEQ ID NO: 1448423 - DNA, 16 bp, Homo sapiens
ctaagagaagttattt

SEQ ID NO: 1448424 - DNA, 21 bp, Homo sapiens
ctaagagaagttgtaaagtat

SEQ ID NO: 1448425 - DNA, 20 bp, Homo sapiens
ctaagagccatttaggggcc

SEQ ID NO: 1448426 - DNA, 18 bp, Homo sapiens
ctaagaggaaagtacatt

SEQ ID NO: 1448427 - DNA, 19 bp, Homo sapiens
ctaagatagaaagctggac

SEQ ID NO: 1448428 - DNA, 23 bp, Homo sapiens
ctaagatatacttgtttttgtaa

SEQ ID NO: 1448429 - DNA, 14 bp, Homo sapiens
ctaagatcttagat

SEQ ID NO: 1448430 - DNA, 20 bp, Homo sapiens
ctaagatcttagattctctg

SEQ ID NO: 1448431 - DNA, 20 bp, Homo sapiens
ctaagatgaagctgagcttt

SEQ ID NO: 1448432 - DNA, 22 bp, Homo sapiens
ctaagatgagatttgccagcac

SEQ ID NO: 1448433 - DNA, 22 bp, Homo sapiens
ctaagatgtgatattctaagac

SEQ ID NO: 1448434 - DNA, 11 bp, Homo sapiens
ctaagattcta

SEQ ID NO: 1448435 - DNA, 12 bp, Homo sapiens
ctaagattctaa

SEQ ID NO: 1448436 - DNA, 16 bp, Homo sapiens
ctaagattctaaaggt

SEQ ID NO: 1448437 - DNA, 18 bp, Homo sapiens
ctaagattctaaaggtcc

SEQ ID NO: 1448438 - DNA, 15 bp, Homo sapiens
ctaagattctaatga

SEQ ID NO: 1448439 - DNA, 22 bp, Homo sapiens
tgtttacatttgatgcatgtct

SEQ ID NO: 1448440 - DNA, 23 bp, Homo sapiens
tgtttacctttctctctctaagg

SEQ ID NO: 1448441 - DNA, 13 bp, Homo sapiens
tgtttactgcttt

SEQ ID NO: 1448442 - DNA, 19 bp, Homo sapiens
tgtttactgcttttcatta

SEQ ID NO: 1448443 - DNA, 16 bp, Homo sapiens
tgtttacttaaagatt

SEQ ID NO: 1448444 - DNA, 13 bp, Homo sapiens
tgtttagaaacag

SEQ ID NO: 1448445 - DNA, 16 bp, Homo sapiens
tgtttagaaacagaaa

SEQ ID NO: 1448446 - DNA, 14 bp, Homo sapiens
tgtttagagagcct

SEQ ID NO: 1448447 - DNA, 15 bp, Homo sapiens
tgtttagagagcctg

SEQ ID NO: 1448448 - DNA, 18 bp, Homo sapiens
tgtttagagagcctgtca

SEQ ID NO: 1448449 - DNA, 23 bp, Homo sapiens
tgtttagagagcctgtcaccaga

SEQ ID NO: 1448450 - DNA, 13 bp, Homo sapiens
tgtttagagccct

SEQ ID NO: 1448451 - DNA, 18 bp, Homo sapiens
tgtttatatactgggttc

SEQ ID NO: 1448452 - DNA, 17 bp, Homo sapiens
tgtttatatggaagaaa

SEQ ID NO: 1448453 - DNA, 20 bp, Homo sapiens
tgtttatcccttaagaatga

SEQ ID NO: 1448454 - DNA, 23 bp, Homo sapiens
tgtttatggcctcagctgcctca

SEQ ID NO: 1448455 - DNA, 24 bp, Homo sapiens
tgtttatggcctcagctgcctcac

SEQ ID NO: 1448456 - DNA, 15 bp, Homo sapiens
tgtttatgtaaacaa

SEQ ID NO: 1448457 - DNA, 19 bp, Homo sapiens
tgtttatgtgttatgaaca

SEQ ID NO: 1448458 - DNA, 21 bp, Homo sapiens
tgtttatgtgttatgaacatc

SEQ ID NO: 1448459 - DNA, 16 bp, Homo sapiens
tgtttattaacaaatt

SEQ ID NO: 1448460 - DNA, 14 bp, Homo sapiens
tgtttattaatctt

SEQ ID NO: 1448461 - DNA, 17 bp, Homo sapiens
tgtttattaatcttagt

SEQ ID NO: 1448462 - DNA, 14 bp, Homo sapiens
tgtttattacaatt

SEQ ID NO: 1448463 - DNA, 18 bp, Homo sapiens
tgtttattacaattttta

SEQ ID NO: 1448464 - DNA, 13 bp, Homo sapiens
tgtttattcaaac

SEQ ID NO: 1448465 - DNA, 21 bp, Homo sapiens
tgtttattcaaactgaaaagc

SEQ ID NO: 1448466 - DNA, 23 bp, Homo sapiens
tgtttattcttccagaatgctga

SEQ ID NO: 1448467 - DNA, 17 bp, Homo sapiens
tgtttattcttctagag

SEQ ID NO: 1448468 - DNA, 13 bp, Homo sapiens
tgtttattcttga

SEQ ID NO: 1448469 - DNA, 21 bp, Homo sapiens
tgtttattcttgatgaaaagc

SEQ ID NO: 1448470 - DNA, 14 bp, Homo sapiens
tgtttattgttttt

SEQ ID NO: 1448471 - DNA, 16 bp, Homo sapiens
tgtttatttaaggatg

SEQ ID NO: 1448472 - DNA, 13 bp, Homo sapiens
tgtttatttcagg

SEQ ID NO: 1448473 - DNA, 19 bp, Homo sapiens
tgtttcaaaaccatgcctg

SEQ ID NO: 1448474 - DNA, 23 bp, Homo sapiens
tgtttcaaaataagtatttctga

SEQ ID NO: 1448475 - DNA, 18 bp, Homo sapiens
tgtttcaaacacaaatgc

SEQ ID NO: 1448476 - DNA, 16 bp, Homo sapiens
tgtttcaaactgaatt

SEQ ID NO: 1448477 - DNA, 13 bp, Homo sapiens
tgtttcaaagcac

SEQ ID NO: 1448478 - DNA, 15 bp, Homo sapiens
tgtttcaacagaggg

SEQ ID NO: 1448479 - DNA, 10 bp, Homo sapiens
tgtttcaaga

SEQ ID NO: 1448480 - DNA, 16 bp, Homo sapiens
tgtttcaagaacctgg

SEQ ID NO: 1448481 - DNA, 23 bp, Homo sapiens
tgtttcacaccggaaggttttta

SEQ ID NO: 1448482 - DNA, 22 bp, Homo sapiens
tgtttcacagagtgtgctgcta

SEQ ID NO: 1448483 - DNA, 23 bp, Homo sapiens
tgtttcataatgcagaagtattc

SEQ ID NO: 1448484 - DNA, 11 bp, Homo sapiens
tgtttccagaa

SEQ ID NO: 1448485 - DNA, 20 bp, Homo sapiens
tgtttccagacttccttgag

SEQ ID NO: 1448486 - DNA, 21 bp, Homo sapiens
tgtttccagcagaagacaaaa

SEQ ID NO: 1448487 - DNA, 15 bp, Homo sapiens
tgtttccagctgcca

SEQ ID NO: 1448488 - DNA, 20 bp, Homo sapiens
tgtttccattttaaggatat

SEQ ID NO: 1448489 - DNA, 22 bp, Homo sapiens
tgtttcccataattttcttcat

SEQ ID NO: 1448490 - DNA, 21 bp, Homo sapiens
tgtttccctcaagaacaaaca

SEQ ID NO: 1448491 - DNA, 20 bp, Homo sapiens
tgtttccctcgtccgtctgt

SEQ ID NO: 1448492 - DNA, 12 bp, Homo sapiens
tgtttccctgct

SEQ ID NO: 1448493 - DNA, 18 bp, Homo sapiens
tgtttcccttgctttgtt

SEQ ID NO: 1448494 - DNA, 16 bp, Homo sapiens
tgtttcctagctgtgt

SEQ ID NO: 1448495 - DNA, 15 bp, Homo sapiens
tgtttcctcttccaa

SEQ ID NO: 1448496 - DNA, 21 bp, Homo sapiens
tgtttcctgacattgtctcct

SEQ ID NO: 1448497 - DNA, 14 bp, Homo sapiens
tgtttcctggaagc

SEQ ID NO: 1448498 - DNA, 19 bp, Homo sapiens
tgtttcctggaagcagagc

SEQ ID NO: 1448499 - DNA, 14 bp, Homo sapiens
tgtttcctggcaat

SEQ ID NO: 1448500 - DNA, 16 bp, Homo sapiens
tgtttcctttttcaga

SEQ ID NO: 1448501 - DNA, 20 bp, Homo sapiens
tgtttcgcattaagcacaca

SEQ ID NO: 1448502 - DNA, 15 bp, Homo sapiens
tgtttcgtggggagg

SEQ ID NO: 1448503 - DNA, 16 bp, Homo sapiens
tgtttctatactgttt

SEQ ID NO: 1448504 - DNA, 22 bp, Homo sapiens
tgtttctatactgtttgtaata

SEQ ID NO: 1448505 - DNA, 23 bp, Homo sapiens
tgtttctatactgtttgtaatat

SEQ ID NO: 1448506 - DNA, 16 bp, Homo sapiens
tgtttctatctgattt

SEQ ID NO: 1448507 - DNA, 19 bp, Homo sapiens
tgtttctattgacttcaat

SEQ ID NO: 1448508 - DNA, 23 bp, Homo sapiens
tgtttctcaaaagaggttacttt

SEQ ID NO: 1448509 - DNA, 12 bp, Homo sapiens
tgtttctcctta

SEQ ID NO: 1448510 - DNA, 22 bp, Homo sapiens
tgtttctctgttgtaagaatag

SEQ ID NO: 1448511 - DNA, 20 bp, Homo sapiens
tgtttctcttgagctggcct

SEQ ID NO: 1448512 - DNA, 21 bp, Homo sapiens
tgtttctgaaaattccagaaa

SEQ ID NO: 1448513 - DNA, 17 bp, Homo sapiens
tgtttcttcatttctct

SEQ ID NO: 1448514 - DNA, 18 bp, Homo sapiens
tgtttcttgacaagctga

SEQ ID NO: 1448515 - DNA, 21 bp, Homo sapiens
tgtttcttttgtttggtaaat

SEQ ID NO: 1448516 - DNA, 16 bp, Homo sapiens
tgtttgaaaacaaaaa

SEQ ID NO: 1448517 - DNA, 17 bp, Homo sapiens
tgtttgaaatatcatgt

SEQ ID NO: 1448518 - DNA, 18 bp, Homo sapiens
tgtttgaaatatcatgtt

SEQ ID NO: 1448519 - DNA, 21 bp, Homo sapiens
tgtttgacaaagaaacccaag

SEQ ID NO: 1448520 - DNA, 22 bp, Homo sapiens
tgtttgacaaagaaacccaagt

SEQ ID NO: 1448521 - DNA, 22 bp, Homo sapiens
tgtttgaggatatattttcact

SEQ ID NO: 1448522 - DNA, 21 bp, Homo sapiens
tgtttgatataccaaattaaa

SEQ ID NO: 1448523 - DNA, 14 bp, Homo sapiens
tgtttgatgtatgt

SEQ ID NO: 1448524 - DNA, 15 bp, Homo sapiens
tgtttgattggcttt

SEQ ID NO: 1448525 - DNA, 14 bp, Homo sapiens
tgtttgcaagcagg

SEQ ID NO: 1448526 - DNA, 12 bp, Homo sapiens
tgtttgcactgt

SEQ ID NO: 1448527 - DNA, 23 bp, Homo sapiens
tgtttgcactgtgtgctgactga

SEQ ID NO: 1448528 - DNA, 14 bp, Homo sapiens
tgtttgcagctgtg

SEQ ID NO: 1448529 - DNA, 22 bp, Homo sapiens
tgtttgccatactttgtctgaa

SEQ ID NO: 1448530 - DNA, 23 bp, Homo sapiens
tgtttgctctcccggttcttcca

SEQ ID NO: 1448531 - DNA, 20 bp, Homo sapiens
tgtttgctgaacattggaga

SEQ ID NO: 1448532 - DNA, 14 bp, Homo sapiens
tgtttgctgtgaac

SEQ ID NO: 1448533 - DNA, 16 bp, Homo sapiens
tgtttggaaaccacag

SEQ ID NO: 1448534 - DNA, 19 bp, Homo sapiens
tgtttggagacgtttataa

SEQ ID NO: 1448535 - DNA, 17 bp, Homo sapiens
tgtttggcaaggaaagg

SEQ ID NO: 1448536 - DNA, 15 bp, Homo sapiens
tgtttggcacttgta

SEQ ID NO: 1448537 - DNA, 16 bp, Homo sapiens
tgtttggcacttgtat

SEQ ID NO: 1448538 - DNA, 12 bp, Homo sapiens
tgtttggtaaat

SEQ ID NO: 1448539 - DNA, 20 bp, Homo sapiens
tgtttggtgtttgtctgtgt

SEQ ID NO: 1448540 - DNA, 13 bp, Homo sapiens
tgtttggtttcag

SEQ ID NO: 1448541 - DNA, 19 bp, Homo sapiens
tgtttggtttcttcattct

SEQ ID NO: 1448542 - DNA, 21 bp, Homo sapiens
tgtttggtttcttcattcttt

SEQ ID NO: 1448543 - DNA, 24 bp, Homo sapiens
tgtttggttttttgttcttgcgat

SEQ ID NO: 1448544 - DNA, 15 bp, Homo sapiens
tgtttgtaaataaga

SEQ ID NO: 1448545 - DNA, 16 bp, Homo sapiens
tgtttgtaaataagag

SEQ ID NO: 1448546 - DNA, 16 bp, Homo sapiens
tgtttgtaaatgcctc

SEQ ID NO: 1448547 - DNA, 17 bp, Homo sapiens
tgtttgtaaatgcctct

SEQ ID NO: 1448548 - DNA, 16 bp, Homo sapiens
tgtttgtatgtctgtg

SEQ ID NO: 1448549 - DNA, 15 bp, Homo sapiens
tgtttgtattcatgt

SEQ ID NO: 1448550 - DNA, 17 bp, Homo sapiens
tgtttgtcagcatctga

SEQ ID NO: 1448551 - DNA, 18 bp, Homo sapiens
tgtttgtcagcatctgac

SEQ ID NO: 1448552 - DNA, 15 bp, Homo sapiens
tgtttgtctggattg

SEQ ID NO: 1448553 - DNA, 19 bp, Homo sapiens
tgtttgtctgtttgtttca

SEQ ID NO: 1448554 - DNA, 17 bp, Homo sapiens
tgtttgttaaaactggc

SEQ ID NO: 1448555 - DNA, 22 bp, Homo sapiens
tgtcaccaccctgctcatccac

SEQ ID NO: 1448556 - DNA, 21 bp, Homo sapiens
tgtcaccaccttcccagctct

SEQ ID NO: 1448557 - DNA, 23 bp, Homo sapiens
tgtcaccaccttcccagctctcc

SEQ ID NO: 1448558 - DNA, 14 bp, Homo sapiens
tgtcaccagagctt

SEQ ID NO: 1448559 - DNA, 18 bp, Homo sapiens
tgtcacctagaacgtgca

SEQ ID NO: 1448560 - DNA, 13 bp, Homo sapiens
tgtcacctcagct

SEQ ID NO: 1448561 - DNA, 15 bp, Homo sapiens
tgtcacctcagctga

SEQ ID NO: 1448562 - DNA, 19 bp, Homo sapiens
tgtcacgatcacaggcctt

SEQ ID NO: 1448563 - DNA, 15 bp, Homo sapiens
tgtcacgctctggtg

SEQ ID NO: 1448564 - DNA, 22 bp, Homo sapiens
tgtcactactcacagtctcttt

SEQ ID NO: 1448565 - DNA, 13 bp, Homo sapiens
tgtcactcagctg

SEQ ID NO: 1448566 - DNA, 14 bp, Homo sapiens
tgtcacttcttcac

SEQ ID NO: 1448567 - DNA, 16 bp, Homo sapiens
tgtcactttttctgat

SEQ ID NO: 1448568 - DNA, 16 bp, Homo sapiens
tgtcagaaaagagcca

SEQ ID NO: 1448569 - DNA, 21 bp, Homo sapiens
tgtcagaataggaaaacattg

SEQ ID NO: 1448570 - DNA, 14 bp, Homo sapiens
tgtcagactttaaa

SEQ ID NO: 1448571 - DNA, 16 bp, Homo sapiens
tgtcagatattcatat

SEQ ID NO: 1448572 - DNA, 21 bp, Homo sapiens
tgtcagatattttttcagaaa

SEQ ID NO: 1448573 - DNA, 16 bp, Homo sapiens
tgtcagatttctggtt

SEQ ID NO: 1448574 - DNA, 17 bp, Homo sapiens
tgtcagatttctggttg

SEQ ID NO: 1448575 - DNA, 17 bp, Homo sapiens
tgtcagcagctctgaga

SEQ ID NO: 1448576 - DNA, 18 bp, Homo sapiens
tgtcagcagctctgagac

SEQ ID NO: 1448577 - DNA, 10 bp, Homo sapiens
tgtcagcatc

SEQ ID NO: 1448578 - DNA, 11 bp, Homo sapiens
tgtcagcatct

SEQ ID NO: 1448579 - DNA, 23 bp, Homo sapiens
tgtcagcatctgaccatctgtga

SEQ ID NO: 1448580 - DNA, 23 bp, Homo sapiens
tgtcagcatctggctgtctagaa

SEQ ID NO: 1448581 - DNA, 21 bp, Homo sapiens
tgtcagccgagccgggcctgg

SEQ ID NO: 1448582 - DNA, 22 bp, Homo sapiens
tgtcagccgagccgggcctggg

SEQ ID NO: 1448583 - DNA, 23 bp, Homo sapiens
tgtcagcgttctaccaggcaaat

SEQ ID NO: 1448584 - DNA, 20 bp, Homo sapiens
tgtcagctcccctcggagaa

SEQ ID NO: 1448585 - DNA, 15 bp, Homo sapiens
tgtcagctgtgggga

SEQ ID NO: 1448586 - DNA, 17 bp, Homo sapiens
tgtcaggaacagaagga

SEQ ID NO: 1448587 - DNA, 17 bp, Homo sapiens
tgtcaggaagaaatcac

SEQ ID NO: 1448588 - DNA, 12 bp, Homo sapiens
tgtcaggcaggt

SEQ ID NO: 1448589 - DNA, 21 bp, Homo sapiens
tgtcaggcccgtcggagctgc

SEQ ID NO: 1448590 - DNA, 23 bp, Homo sapiens
tgtcaggcccgtcggagctgcct

SEQ ID NO: 1448591 - DNA, 16 bp, Homo sapiens
tgtcaggccctctgcc

SEQ ID NO: 1448592 - DNA, 14 bp, Homo sapiens
tgtcaggccttcag

SEQ ID NO: 1448593 - DNA, 18 bp, Homo sapiens
tgtcagtatgtggaagtg

SEQ ID NO: 1448594 - DNA, 19 bp, Homo sapiens
tgtcagtatgtggaagtgt

SEQ ID NO: 1448595 - DNA, 22 bp, Homo sapiens
tgtcagtatgtggaagtgtggg

SEQ ID NO: 1448596 - DNA, 17 bp, Homo sapiens
tgtcagtatttttgccg

SEQ ID NO: 1448597 - DNA, 19 bp, Homo sapiens
tgtcagtggggcagcctct

SEQ ID NO: 1448598 - DNA, 20 bp, Homo sapiens
tgtcagtgttaaagattttg

SEQ ID NO: 1448599 - DNA, 16 bp, Homo sapiens
tgtcataaagattata

SEQ ID NO: 1448600 - DNA, 19 bp, Homo sapiens
tgtcataaagattataata

SEQ ID NO: 1448601 - DNA, 14 bp, Homo sapiens
tgtcataagaatga

SEQ ID NO: 1448602 - DNA, 20 bp, Homo sapiens
tgtcataagcattactttat

SEQ ID NO: 1448603 - DNA, 13 bp, Homo sapiens
tgtcatactctgt

SEQ ID NO: 1448604 - DNA, 16 bp, Homo sapiens
tgtcatactctgtgta

SEQ ID NO: 1448605 - DNA, 17 bp, Homo sapiens
tgtcatactctgtgtaa

SEQ ID NO: 1448606 - DNA, 18 bp, Homo sapiens
tgtcatactctgtgtaat

SEQ ID NO: 1448607 - DNA, 21 bp, Homo sapiens
tgtcatataaactcatttatc

SEQ ID NO: 1448608 - DNA, 16 bp, Homo sapiens
tgtcatatactgccat

SEQ ID NO: 1448609 - DNA, 16 bp, Homo sapiens
tgtcatatgactgatt

SEQ ID NO: 1448610 - DNA, 19 bp, Homo sapiens
tgtcatatgactgattact

SEQ ID NO: 1448611 - DNA, 16 bp, Homo sapiens
tgtcatcagaagataa

SEQ ID NO: 1448612 - DNA, 19 bp, Homo sapiens
tgtcatccctgatgaatgt

SEQ ID NO: 1448613 - DNA, 19 bp, Homo sapiens
tgtcatcctcaaagaaagt

SEQ ID NO: 1448614 - DNA, 12 bp, Homo sapiens
tgtcatctaaag

SEQ ID NO: 1448615 - DNA, 23 bp, Homo sapiens
tgtcatctttcttctattttatt

SEQ ID NO: 1448616 - DNA, 14 bp, Homo sapiens
tgtcatcttttcaa

SEQ ID NO: 1448617 - DNA, 17 bp, Homo sapiens
tgtcatgcccccctcaa

SEQ ID NO: 1448618 - DNA, 19 bp, Homo sapiens
tgtcatggtcctttctgga

SEQ ID NO: 1448619 - DNA, 20 bp, Homo sapiens
tgtcatggtcctttctggaa

SEQ ID NO: 1448620 - DNA, 15 bp, Homo sapiens
tgtcatgtaccatca

SEQ ID NO: 1448621 - DNA, 19 bp, Homo sapiens
tgtcatgtacttcctgtgt

SEQ ID NO: 1448622 - DNA, 13 bp, Homo sapiens
tgtcatgtgtata

SEQ ID NO: 1448623 - DNA, 19 bp, Homo sapiens
tgtcattcaagcctgtgaa

SEQ ID NO: 1448624 - DNA, 21 bp, Homo sapiens
tgtcattgcacataagcttcc

SEQ ID NO: 1448625 - DNA, 13 bp, Homo sapiens
tgtcattgtctac

SEQ ID NO: 1448626 - DNA, 19 bp, Homo sapiens
tgtcatttttaacagcatg

SEQ ID NO: 1448627 - DNA, 16 bp, Homo sapiens
tgtcatttttaatgta

SEQ ID NO: 1448628 - DNA, 15 bp, Homo sapiens
tgtcatttttgcagt

SEQ ID NO: 1448629 - DNA, 15 bp, Homo sapiens
tgtccaaaactgcct

SEQ ID NO: 1448630 - DNA, 17 bp, Homo sapiens
tgtccaaacgtcctctt

SEQ ID NO: 1448631 - DNA, 17 bp, Homo sapiens
tgtccaaactgcctaag

SEQ ID NO: 1448632 - DNA, 22 bp, Homo sapiens
tgtccaaactgcctaagccctc

SEQ ID NO: 1448633 - DNA, 19 bp, Homo sapiens
tgtccaaagaggctgcccc

SEQ ID NO: 1448634 - DNA, 20 bp, Homo sapiens
tgtccaaagaggctgcccct

SEQ ID NO: 1448635 - DNA, 21 bp, Homo sapiens
tgtccaaagaggctgcccctc

SEQ ID NO: 1448636 - DNA, 14 bp, Homo sapiens
tgtccaacaataaa

SEQ ID NO: 1448637 - DNA, 19 bp, Homo sapiens
tgtccaacatggtaattca

SEQ ID NO: 1448638 - DNA, 20 bp, Homo sapiens
tgtccaacatggtaattcac

SEQ ID NO: 1448639 - DNA, 20 bp, Homo sapiens
tgtccaagggccgtgccctt

SEQ ID NO: 1448640 - DNA, 19 bp, Homo sapiens
tgtccacatccccagagcc

SEQ ID NO: 1448641 - DNA, 17 bp, Homo sapiens
tgtccacatgacctcca

SEQ ID NO: 1448642 - DNA, 14 bp, Homo sapiens
tgtcctgaccaccc

SEQ ID NO: 1448643 - DNA, 15 bp, Homo sapiens
tgtcctgaccaccct

SEQ ID NO: 1448644 - DNA, 14 bp, Homo sapiens
tgtcctgccagctg

SEQ ID NO: 1448645 - DNA, 17 bp, Homo sapiens
tgtcctgcctattatct

SEQ ID NO: 1448646 - DNA, 24 bp, Homo sapiens
tgtcctgcctattatctgtcagct

SEQ ID NO: 1448647 - DNA, 17 bp, Homo sapiens
tgtcctgcctgtctgcc

SEQ ID NO: 1448648 - DNA, 19 bp, Homo sapiens
tgtcctgcctgtctgcccc

SEQ ID NO: 1448649 - DNA, 10 bp, Homo sapiens
tgtcctgctc

SEQ ID NO: 1448650 - DNA, 15 bp, Homo sapiens
tgtcctgctgccctc

SEQ ID NO: 1448651 - DNA, 18 bp, Homo sapiens
tgtcctgctgccctccca

SEQ ID NO: 1448652 - DNA, 12 bp, Homo sapiens
tgtcctggccct

SEQ ID NO: 1448653 - DNA, 19 bp, Homo sapiens
tgtcctggcccttcagtct

SEQ ID NO: 1448654 - DNA, 21 bp, Homo sapiens
tgtcctggcccttcagtctgc

SEQ ID NO: 1448655 - DNA, 23 bp, Homo sapiens
tgtcctgggcatgggtccagggc

SEQ ID NO: 1448656 - DNA, 15 bp, Homo sapiens
tgtcctgggcctgca

SEQ ID NO: 1448657 - DNA, 21 bp, Homo sapiens
tgtcctgggcctgcccctgtg

SEQ ID NO: 1448658 - DNA, 18 bp, Homo sapiens
tgtcctgggcgccctgga

SEQ ID NO: 1448659 - DNA, 16 bp, Homo sapiens
tgtcctggtgctctct

SEQ ID NO: 1448660 - DNA, 19 bp, Homo sapiens
tgtcctggtgctctctgcc

SEQ ID NO: 1448661 - DNA, 23 bp, Homo sapiens
tgtcctggtggctgggcccagca

SEQ ID NO: 1448662 - DNA, 16 bp, Homo sapiens
tgtcctgtacattgtg

SEQ ID NO: 1448663 - DNA, 24 bp, Homo sapiens
tgtcctgtagttgcgtggactctg

SEQ ID NO: 1448664 - DNA, 14 bp, Homo sapiens
tgtcctgtcctgct

SEQ ID NO: 1448665 - DNA, 14 bp, Homo sapiens
tgtcctgtcctggt

SEQ ID NO: 1448666 - DNA, 18 bp, Homo sapiens
tgtcctgtcctttcttgc

SEQ ID NO: 1448667 - DNA, 16 bp, Homo sapiens
tgtccttaacccacct

SEQ ID NO: 1448668 - DNA, 19 bp, Homo sapiens
tgtccttaacccacctctc

SEQ ID NO: 1448669 - DNA, 21 bp, Homo sapiens
tgtccttattcttgtggttaa

SEQ ID NO: 1448670 - DNA, 16 bp, Homo sapiens
tgtccttcagagctct

SEQ ID NO: 1448671 - DNA, 18 bp, Homo sapiens
tgtccttccatcttcaca

SEQ ID NO: 1448672 - DNA, 13 bp, Homo sapiens
tgtccttgcacct

SEQ ID NO: 1448673 - DNA, 14 bp, Homo sapiens
tgtcctttcccttc

SEQ ID NO: 1448674 - DNA, 12 bp, Homo sapiens
tgtcctttcctt

SEQ ID NO: 1448675 - DNA, 13 bp, Homo sapiens
cgcctcaccagcc

SEQ ID NO: 1448676 - DNA, 19 bp, Homo sapiens
cgcctcaccagccccccgc

SEQ ID NO: 1448677 - DNA, 11 bp, Homo sapiens
cgcctcagcct

SEQ ID NO: 1448678 - DNA, 16 bp, Homo sapiens
cgcctccactctagtt

SEQ ID NO: 1448679 - DNA, 14 bp, Homo sapiens
cgcctccaggagcc

SEQ ID NO: 1448680 - DNA, 18 bp, Homo sapiens
cgcctccccacctccagg

SEQ ID NO: 1448681 - DNA, 22 bp, Homo sapiens
cgcctccccctcccccattccc

SEQ ID NO: 1448682 - DNA, 10 bp, Homo sapiens
cgcctccccg

SEQ ID NO: 1448683 - DNA, 14 bp, Homo sapiens
cgcctccgagggac

SEQ ID NO: 1448684 - DNA, 17 bp, Homo sapiens
cgcctcggtatctggct

SEQ ID NO: 1448685 - DNA, 16 bp, Homo sapiens
cgcctcgtgccagcag

SEQ ID NO: 1448686 - DNA, 19 bp, Homo sapiens
cgcctcgtgccagcagcct

SEQ ID NO: 1448687 - DNA, 19 bp, Homo sapiens
cgcctctggccgccacccc

SEQ ID NO: 1448688 - DNA, 15 bp, Homo sapiens
cgcctcttgaccagg

SEQ ID NO: 1448689 - DNA, 17 bp, Homo sapiens
cgcctcttgaccaggct

SEQ ID NO: 1448690 - DNA, 23 bp, Homo sapiens
cgcctgacaaccactggtctgta

SEQ ID NO: 1448691 - DNA, 15 bp, Homo sapiens
cgcctgagctcctgc

SEQ ID NO: 1448692 - DNA, 14 bp, Homo sapiens
cgcctgagtcagtg

SEQ ID NO: 1448693 - DNA, 22 bp, Homo sapiens
cgcctgcactcctcagggcagc

SEQ ID NO: 1448694 - DNA, 17 bp, Homo sapiens
cgcctgcaggctggaga

SEQ ID NO: 1448695 - DNA, 11 bp, Homo sapiens
cgcctgccacc

SEQ ID NO: 1448696 - DNA, 17 bp, Homo sapiens
cgcctgccctcatggcc

SEQ ID NO: 1448697 - DNA, 20 bp, Homo sapiens
cgcctgccctcatggcccct

SEQ ID NO: 1448698 - DNA, 17 bp, Homo sapiens
cgcctgccgtgcatggc

SEQ ID NO: 1448699 - DNA, 19 bp, Homo sapiens
cgcctgcctcctggctcag

SEQ ID NO: 1448700 - DNA, 21 bp, Homo sapiens
cgcctgcctcctggctcaggc

SEQ ID NO: 1448701 - DNA, 13 bp, Homo sapiens
cgcctggcaggtg

SEQ ID NO: 1448702 - DNA, 14 bp, Homo sapiens
cgcctggcaggtgg

SEQ ID NO: 1448703 - DNA, 21 bp, Homo sapiens
cgcctggcagtccgtgggacg

SEQ ID NO: 1448704 - DNA, 14 bp, Homo sapiens
cgcctggccaggag

SEQ ID NO: 1448705 - DNA, 16 bp, Homo sapiens
cgcctggccaggagca

SEQ ID NO: 1448706 - DNA, 10 bp, Homo sapiens
cgcctgggat

SEQ ID NO: 1448707 - DNA, 13 bp, Homo sapiens
cgcctgggcaccg

SEQ ID NO: 1448708 - DNA, 16 bp, Homo sapiens
cgcctgggcaccggga

SEQ ID NO: 1448709 - DNA, 20 bp, Homo sapiens
cgcctgggcaccgggacccc

SEQ ID NO: 1448710 - DNA, 14 bp, Homo sapiens
cgccttaagctgat

SEQ ID NO: 1448711 - DNA, 13 bp, Homo sapiens
cgccttcctcctc

SEQ ID NO: 1448712 - DNA, 17 bp, Homo sapiens
cgccttcctcctccaca

SEQ ID NO: 1448713 - DNA, 12 bp, Homo sapiens
cgccttctcgga

SEQ ID NO: 1448714 - DNA, 16 bp, Homo sapiens
cgccttctcggagctg

SEQ ID NO: 1448715 - DNA, 12 bp, Homo sapiens
cgccttgttctt

SEQ ID NO: 1448716 - DNA, 17 bp, Homo sapiens
cgcctttgtcttgtact

SEQ ID NO: 1448717 - DNA, 14 bp, Homo sapiens
cgcgaccttggccg

SEQ ID NO: 1448718 - DNA, 15 bp, Homo sapiens
cgcgagaggccgagc

SEQ ID NO: 1448719 - DNA, 14 bp, Homo sapiens
cgcgatcccacaca

SEQ ID NO: 1448720 - DNA, 20 bp, Homo sapiens
cgcgatctcagctcactgca

SEQ ID NO: 1448721 - DNA, 12 bp, Homo sapiens
cgcgcaggcctg

SEQ ID NO: 1448722 - DNA, 21 bp, Homo sapiens
cgcgccaaataatgtctctgt

SEQ ID NO: 1448723 - DNA, 23 bp, Homo sapiens
cgcgccaaataatgtctctgtga

SEQ ID NO: 1448724 - DNA, 22 bp, Homo sapiens
cgcgccactacactccagcctg

SEQ ID NO: 1448725 - DNA, 15 bp, Homo sapiens
cgcgccgatgccacc

SEQ ID NO: 1448726 - DNA, 21 bp, Homo sapiens
cgcggaggaggagggaggcca

SEQ ID NO: 1448727 - DNA, 19 bp, Homo sapiens
cgcggccagcgtcccaggg

SEQ ID NO: 1448728 - DNA, 14 bp, Homo sapiens
cgcggccctcagta

SEQ ID NO: 1448729 - DNA, 21 bp, Homo sapiens
cgcgggaggcaccagctctgt

SEQ ID NO: 1448730 - DNA, 15 bp, Homo sapiens
cgcgggcagccaccc

SEQ ID NO: 1448731 - DNA, 15 bp, Homo sapiens
cgcgggcagcgggcc

SEQ ID NO: 1448732 - DNA, 21 bp, Homo sapiens
cgcgggcagcgggccaggccc

SEQ ID NO: 1448733 - DNA, 14 bp, Homo sapiens
cgcgggtcccggcc

SEQ ID NO: 1448734 - DNA, 13 bp, Homo sapiens
cgcgggttctaga

SEQ ID NO: 1448735 - DNA, 15 bp, Homo sapiens
cgcggtgctctggcg

SEQ ID NO: 1448736 - DNA, 20 bp, Homo sapiens
cgcggtgctgactgaggcct

SEQ ID NO: 1448737 - DNA, 13 bp, Homo sapiens
cgcggtggctcac

SEQ ID NO: 1448738 - DNA, 19 bp, Homo sapiens
cgcgtgcacgtggagagct

SEQ ID NO: 1448739 - DNA, 14 bp, Homo sapiens
cgcgtgtgctcctc

SEQ ID NO: 1448740 - DNA, 19 bp, Homo sapiens
cgctaaagagcccttgcct

SEQ ID NO: 1448741 - DNA, 21 bp, Homo sapiens
cgctaaagagcccttgcctcc

SEQ ID NO: 1448742 - DNA, 22 bp, Homo sapiens
cgctaaagagcccttgcctccc

SEQ ID NO: 1448743 - DNA, 14 bp, Homo sapiens
cgctaacaatttct

SEQ ID NO: 1448744 - DNA, 14 bp, Homo sapiens
cgctacctccctcc

SEQ ID NO: 1448745 - DNA, 15 bp, Homo sapiens
cgctacctctctgtc

SEQ ID NO: 1448746 - DNA, 20 bp, Homo sapiens
cgctaggagagactgaaagc

SEQ ID NO: 1448747 - DNA, 19 bp, Homo sapiens
cgctatgggaggcagccga

SEQ ID NO: 1448748 - DNA, 13 bp, Homo sapiens
cgctatgtgactt

SEQ ID NO: 1448749 - DNA, 17 bp, Homo sapiens
cgctcacctcagagcag

SEQ ID NO: 1448750 - DNA, 14 bp, Homo sapiens
cgctcacctgcagc

SEQ ID NO: 1448751 - DNA, 16 bp, Homo sapiens
cgctcacctgcagccc

SEQ ID NO: 1448752 - DNA, 14 bp, Homo sapiens
cgctcactgaactc

SEQ ID NO: 1448753 - DNA, 20 bp, Homo sapiens
cgctcagacggcggccaggc

SEQ ID NO: 1448754 - DNA, 12 bp, Homo sapiens
cgctcagccctc

SEQ ID NO: 1448755 - DNA, 14 bp, Homo sapiens
cgctcaggacccag

SEQ ID NO: 1448756 - DNA, 19 bp, Homo sapiens
cgctcagggccatgctgag

SEQ ID NO: 1448757 - DNA, 16 bp, Homo sapiens
cgctcaggggcctgga

SEQ ID NO: 1448758 - DNA, 15 bp, Homo sapiens
cggagacagtgatct

SEQ ID NO: 1448759 - DNA, 16 bp, Homo sapiens
cggagagaaaaaagaa

SEQ ID NO: 1448760 - DNA, 15 bp, Homo sapiens
cggagagagccaaga

SEQ ID NO: 1448761 - DNA, 17 bp, Homo sapiens
cggagagagccaagacg

SEQ ID NO: 1448762 - DNA, 15 bp, Homo sapiens
cggagagcagcagca

SEQ ID NO: 1448763 - DNA, 19 bp, Homo sapiens
cggagattggacggcctga

SEQ ID NO: 1448764 - DNA, 15 bp, Homo sapiens
cggagcacccttgcc

SEQ ID NO: 1448765 - DNA, 16 bp, Homo sapiens
cggagccaacaagacc

SEQ ID NO: 1448766 - DNA, 23 bp, Homo sapiens
cggagccaatgaacagctcctcc

SEQ ID NO: 1448767 - DNA, 11 bp, Homo sapiens
cggagcccaga

SEQ ID NO: 1448768 - DNA, 18 bp, Homo sapiens
cggagcccctgaaagcct

SEQ ID NO: 1448769 - DNA, 14 bp, Homo sapiens
cggagccggcacct

SEQ ID NO: 1448770 - DNA, 21 bp, Homo sapiens
cggagcctcatccgaggcagg

SEQ ID NO: 1448771 - DNA, 20 bp, Homo sapiens
cggagcgttctctgtcctac

SEQ ID NO: 1448772 - DNA, 11 bp, Homo sapiens
cggagctgcct

SEQ ID NO: 1448773 - DNA, 14 bp, Homo sapiens
cggagctgcctgca

SEQ ID NO: 1448774 - DNA, 19 bp, Homo sapiens
cggagctgctgagtgacag

SEQ ID NO: 1448775 - DNA, 14 bp, Homo sapiens
cggagctggcccag

SEQ ID NO: 1448776 - DNA, 13 bp, Homo sapiens
cggaggagaccag

SEQ ID NO: 1448777 - DNA, 16 bp, Homo sapiens
cggaggagaccagctc

SEQ ID NO: 1448778 - DNA, 22 bp, Homo sapiens
cggaggagaccagctcagaggc

SEQ ID NO: 1448779 - DNA, 16 bp, Homo sapiens
cggaggagcatgcgca

SEQ ID NO: 1448780 - DNA, 13 bp, Homo sapiens
cggaggagctgcc

SEQ ID NO: 1448781 - DNA, 13 bp, Homo sapiens
cggaggaggctgc

SEQ ID NO: 1448782 - DNA, 20 bp, Homo sapiens
cggaggagggatgctgctcc

SEQ ID NO: 1448783 - DNA, 18 bp, Homo sapiens
cggaggatagtatgagcc

SEQ ID NO: 1448784 - DNA, 19 bp, Homo sapiens
cggaggcaaagctggctca

SEQ ID NO: 1448785 - DNA, 22 bp, Homo sapiens
cggaggcatcctacccttttct

SEQ ID NO: 1448786 - DNA, 20 bp, Homo sapiens
cggaggcctgcgaccctggg

SEQ ID NO: 1448787 - DNA, 21 bp, Homo sapiens
cggaggcctgcgaccctgggg

SEQ ID NO: 1448788 - DNA, 22 bp, Homo sapiens
cggaggcctgcgaccctggggg

SEQ ID NO: 1448789 - DNA, 16 bp, Homo sapiens
cggagggatggagaaa

SEQ ID NO: 1448790 - DNA, 17 bp, Homo sapiens
cggagggattcccctaa

SEQ ID NO: 1448791 - DNA, 16 bp, Homo sapiens
cggaggggcctggcag

SEQ ID NO: 1448792 - DNA, 21 bp, Homo sapiens
cggagggggacggggctcagc

SEQ ID NO: 1448793 - DNA, 17 bp, Homo sapiens
cggaggtcactccacca

SEQ ID NO: 1448794 - DNA, 17 bp, Homo sapiens
cggaggtctctgggagc

SEQ ID NO: 1448795 - DNA, 20 bp, Homo sapiens
cggaggtctctgggagccca

SEQ ID NO: 1448796 - DNA, 19 bp, Homo sapiens
tgtctgctgagttggcctg

SEQ ID NO: 1448797 - DNA, 10 bp, Homo sapiens
tgtctgctgc

SEQ ID NO: 1448798 - DNA, 15 bp, Homo sapiens
tgtctgctgccagca

SEQ ID NO: 1448799 - DNA, 18 bp, Homo sapiens
tgtctgctgccagcacag

SEQ ID NO: 1448800 - DNA, 15 bp, Homo sapiens
tgtctgctgctgcct

SEQ ID NO: 1448801 - DNA, 18 bp, Homo sapiens
tgtctgctgctgcctccc

SEQ ID NO: 1448802 - DNA, 16 bp, Homo sapiens
tgtctgcttctctctc

SEQ ID NO: 1448803 - DNA, 20 bp, Homo sapiens
tgtctggagtcccctcctcc

SEQ ID NO: 1448804 - DNA, 22 bp, Homo sapiens
tgtctggagtcccctcctccag

SEQ ID NO: 1448805 - DNA, 13 bp, Homo sapiens
tgtctggatgcac

SEQ ID NO: 1448806 - DNA, 20 bp, Homo sapiens
tgtctggctcggacccaccc

SEQ ID NO: 1448807 - DNA, 21 bp, Homo sapiens
tgtctggctcggacccacccc

SEQ ID NO: 1448808 - DNA, 22 bp, Homo sapiens
tgtctggctcggacccacccca

SEQ ID NO: 1448809 - DNA, 19 bp, Homo sapiens
tgtctggctgaggatttca

SEQ ID NO: 1448810 - DNA, 17 bp, Homo sapiens
tgtctggggtgagggag

SEQ ID NO: 1448811 - DNA, 13 bp, Homo sapiens
tgtctggtggccc

SEQ ID NO: 1448812 - DNA, 16 bp, Homo sapiens
tgtctggtggccccgt

SEQ ID NO: 1448813 - DNA, 21 bp, Homo sapiens
tgtctggtggtggcaccatct

SEQ ID NO: 1448814 - DNA, 12 bp, Homo sapiens
tgtctgtaaata

SEQ ID NO: 1448815 - DNA, 17 bp, Homo sapiens
tgtctgtaaatatgttt

SEQ ID NO: 1448816 - DNA, 13 bp, Homo sapiens
tgtctgtacacgt

SEQ ID NO: 1448817 - DNA, 15 bp, Homo sapiens
tgtctgtacacgtgt

SEQ ID NO: 1448818 - DNA, 21 bp, Homo sapiens
tgtctgtcaaatgtttcctta

SEQ ID NO: 1448819 - DNA, 14 bp, Homo sapiens
tgtctgtcctttat

SEQ ID NO: 1448820 - DNA, 13 bp, Homo sapiens
tgtctgtctgcag

SEQ ID NO: 1448821 - DNA, 18 bp, Homo sapiens
tgtctgtctttgtgggag

SEQ ID NO: 1448822 - DNA, 11 bp, Homo sapiens
tgtctgtgcta

SEQ ID NO: 1448823 - DNA, 13 bp, Homo sapiens
tgtctgtggggag

SEQ ID NO: 1448824 - DNA, 23 bp, Homo sapiens
tgtctgtgtatgtataggggaaa

SEQ ID NO: 1448825 - DNA, 13 bp, Homo sapiens
tgtctgtgtccca

SEQ ID NO: 1448826 - DNA, 13 bp, Homo sapiens
tgtctgttctaca

SEQ ID NO: 1448827 - DNA, 13 bp, Homo sapiens
tgtctgttgcttg

SEQ ID NO: 1448828 - DNA, 20 bp, Homo sapiens
tgtctgtttattaactactg

SEQ ID NO: 1448829 - DNA, 22 bp, Homo sapiens
tgtctgtttgctcaaaattgct

SEQ ID NO: 1448830 - DNA, 16 bp, Homo sapiens
tgtctgtttgtttcaa

SEQ ID NO: 1448831 - DNA, 15 bp, Homo sapiens
tgtctgtttttgtat

SEQ ID NO: 1448832 - DNA, 13 bp, Homo sapiens
tgtcttaaaaggt

SEQ ID NO: 1448833 - DNA, 13 bp, Homo sapiens
tgtcttaagtgtt

SEQ ID NO: 1448834 - DNA, 14 bp, Homo sapiens
tgtcttaagtgttt

SEQ ID NO: 1448835 - DNA, 15 bp, Homo sapiens
tgtcttaagtgtttc

SEQ ID NO: 1448836 - DNA, 14 bp, Homo sapiens
tgtcttaattatta

SEQ ID NO: 1448837 - DNA, 18 bp, Homo sapiens
tgtcttagctctggacgt

SEQ ID NO: 1448838 - DNA, 21 bp, Homo sapiens
tgtcttatgtgaaaaattaac

SEQ ID NO: 1448839 - DNA, 12 bp, Homo sapiens
tgtcttattgca

SEQ ID NO: 1448840 - DNA, 16 bp, Homo sapiens
tgtcttcaaactgtga

SEQ ID NO: 1448841 - DNA, 13 bp, Homo sapiens
tgtcttcagagca

SEQ ID NO: 1448842 - DNA, 22 bp, Homo sapiens
tgtcttcagtctcacagagaag

SEQ ID NO: 1448843 - DNA, 20 bp, Homo sapiens
tgtcttcattttcattacca

SEQ ID NO: 1448844 - DNA, 12 bp, Homo sapiens
tgtcttccataa

SEQ ID NO: 1448845 - DNA, 17 bp, Homo sapiens
tgtcttccataatgtat

SEQ ID NO: 1448846 - DNA, 18 bp, Homo sapiens
tgtcttccattccattgt

SEQ ID NO: 1448847 - DNA, 16 bp, Homo sapiens
tgtcttcctatttcag

SEQ ID NO: 1448848 - DNA, 20 bp, Homo sapiens
tgtcttcctatttcagaagt

SEQ ID NO: 1448849 - DNA, 17 bp, Homo sapiens
tgtcttcctgcattcac

SEQ ID NO: 1448850 - DNA, 16 bp, Homo sapiens
tgtcttctcaggctct

SEQ ID NO: 1448851 - DNA, 21 bp, Homo sapiens
tgtcttctcaggctctgccct

SEQ ID NO: 1448852 - DNA, 12 bp, Homo sapiens
tgtcttctgcct

SEQ ID NO: 1448853 - DNA, 15 bp, Homo sapiens
tgtcttctgcctgtt

SEQ ID NO: 1448854 - DNA, 17 bp, Homo sapiens
tgtcttctgcctgttat

SEQ ID NO: 1448855 - DNA, 16 bp, Homo sapiens
tgtcttcttttgtggt

SEQ ID NO: 1448856 - DNA, 20 bp, Homo sapiens
tgtcttgaatgtcttttgaa

SEQ ID NO: 1448857 - DNA, 18 bp, Homo sapiens
tgtcttgccagccagaag

SEQ ID NO: 1448858 - DNA, 20 bp, Homo sapiens
tgtcttggagtgcatttgac

SEQ ID NO: 1448859 - DNA, 12 bp, Homo sapiens
tgtcttgggcag

SEQ ID NO: 1448860 - DNA, 13 bp, Homo sapiens
tgtcttgggcaga

SEQ ID NO: 1448861 - DNA, 13 bp, Homo sapiens
tgtcttgtacatg

SEQ ID NO: 1448862 - DNA, 20 bp, Homo sapiens
tgtcttgtacatgtgtagcc

SEQ ID NO: 1448863 - DNA, 15 bp, Homo sapiens
tgtcttgtacttctg

SEQ ID NO: 1448864 - DNA, 18 bp, Homo sapiens
tgtcttgtacttctgtgt

SEQ ID NO: 1448865 - DNA, 19 bp, Homo sapiens
tgtctttcagatacatggt

SEQ ID NO: 1448866 - DNA, 19 bp, Homo sapiens
tgtctttcagcattaggct

SEQ ID NO: 1448867 - DNA, 23 bp, Homo sapiens
tgtctttcagcattcagtccgcc

SEQ ID NO: 1448868 - DNA, 15 bp, Homo sapiens
tgtctttctgagcac

SEQ ID NO: 1448869 - DNA, 20 bp, Homo sapiens
tgtcttttaaaatgcaatgt

SEQ ID NO: 1448870 - DNA, 14 bp, Homo sapiens
tgtcttttaatgct

SEQ ID NO: 1448871 - DNA, 16 bp, Homo sapiens
tgtcttttccactcct

SEQ ID NO: 1448872 - DNA, 14 bp, Homo sapiens
tgtcttttgaatat

SEQ ID NO: 1448873 - DNA, 20 bp, Homo sapiens
tgtctttttctggactgaag

SEQ ID NO: 1448874 - DNA, 16 bp, Homo sapiens
cggccccagccagagt

SEQ ID NO: 1448875 - DNA, 22 bp, Homo sapiens
cggccccagccagagttcctgc

SEQ ID NO: 1448876 - DNA, 22 bp, Homo sapiens
cggccccccgcgctcgcccagc

SEQ ID NO: 1448877 - DNA, 19 bp, Homo sapiens
cggccccggccccagccag

SEQ ID NO: 1448878 - DNA, 14 bp, Homo sapiens
cggcccctccccct

SEQ ID NO: 1448879 - DNA, 13 bp, Homo sapiens
cggcccggccagc

SEQ ID NO: 1448880 - DNA, 20 bp, Homo sapiens
cggcccggccagcgggcaca

SEQ ID NO: 1448881 - DNA, 12 bp, Homo sapiens
cggccctaaggg

SEQ ID NO: 1448882 - DNA, 18 bp, Homo sapiens
cggccctaccagcgcccg

SEQ ID NO: 1448883 - DNA, 20 bp, Homo sapiens
cggccctagcattgcacttg

SEQ ID NO: 1448884 - DNA, 21 bp, Homo sapiens
cggccctgctgaagctgctgc

SEQ ID NO: 1448885 - DNA, 22 bp, Homo sapiens
cggccctgctgaagctgctgca

SEQ ID NO: 1448886 - DNA, 11 bp, Homo sapiens
cggccctggct

SEQ ID NO: 1448887 - DNA, 20 bp, Homo sapiens
cggccctgtcagagccgcca

SEQ ID NO: 1448888 - DNA, 20 bp, Homo sapiens
cggcccttctgactgtttat

SEQ ID NO: 1448889 - DNA, 14 bp, Homo sapiens
cggccgaccaggct

SEQ ID NO: 1448890 - DNA, 13 bp, Homo sapiens
cggccgcattccc

SEQ ID NO: 1448891 - DNA, 15 bp, Homo sapiens
cggccgcattccctg

SEQ ID NO: 1448892 - DNA, 16 bp, Homo sapiens
cggccgcattccctga

SEQ ID NO: 1448893 - DNA, 13 bp, Homo sapiens
cggccggccctgg

SEQ ID NO: 1448894 - DNA, 13 bp, Homo sapiens
cggccggcctggc

SEQ ID NO: 1448895 - DNA, 15 bp, Homo sapiens
cggccggcctggcac

SEQ ID NO: 1448896 - DNA, 12 bp, Homo sapiens
cggcctcagggc

SEQ ID NO: 1448897 - DNA, 13 bp, Homo sapiens
cggcctcagggcg

SEQ ID NO: 1448898 - DNA, 22 bp, Homo sapiens
cggcctccactcccccacctga

SEQ ID NO: 1448899 - DNA, 15 bp, Homo sapiens
cggcctccgaggctc

SEQ ID NO: 1448900 - DNA, 18 bp, Homo sapiens
cggcctccgaggctcccc

SEQ ID NO: 1448901 - DNA, 21 bp, Homo sapiens
cggcctccgaggctccccgcc

SEQ ID NO: 1448902 - DNA, 15 bp, Homo sapiens
cggcctccggcgtct

SEQ ID NO: 1448903 - DNA, 23 bp, Homo sapiens
cggcctcctcggagagcagcagc

SEQ ID NO: 1448904 - DNA, 19 bp, Homo sapiens
cggcctgatgctccctccc

SEQ ID NO: 1448905 - DNA, 15 bp, Homo sapiens
cggcctgctcccagc

SEQ ID NO: 1448906 - DNA, 16 bp, Homo sapiens
cggcctggctggtggg

SEQ ID NO: 1448907 - DNA, 19 bp, Homo sapiens
cggcctgtgggtctctgaa

SEQ ID NO: 1448908 - DNA, 21 bp, Homo sapiens
cggcctgtgggtctctgaagg

SEQ ID NO: 1448909 - DNA, 19 bp, Homo sapiens
cggccttgaagacagagca

SEQ ID NO: 1448910 - DNA, 17 bp, Homo sapiens
cggcctttgttgctcag

SEQ ID NO: 1448911 - DNA, 12 bp, Homo sapiens
cggcgcagagcc

SEQ ID NO: 1448912 - DNA, 13 bp, Homo sapiens
cggcgcagagccc

SEQ ID NO: 1448913 - DNA, 13 bp, Homo sapiens
cggcgccaccatc

SEQ ID NO: 1448914 - DNA, 20 bp, Homo sapiens
cggcgcggtggctcacgcct

SEQ ID NO: 1448915 - DNA, 19 bp, Homo sapiens
cggcggcacccaggcctcc

SEQ ID NO: 1448916 - DNA, 18 bp, Homo sapiens
tgtgaccaatacatttgt

SEQ ID NO: 1448917 - DNA, 19 bp, Homo sapiens
tgtgaccacatacgtgtta

SEQ ID NO: 1448918 - DNA, 22 bp, Homo sapiens
tgtgaccacatacgtgttagga

SEQ ID NO: 1448919 - DNA, 13 bp, Homo sapiens
tgtgaccaccacc

SEQ ID NO: 1448920 - DNA, 13 bp, Homo sapiens
tgtgaccactgaa

SEQ ID NO: 1448921 - DNA, 21 bp, Homo sapiens
tgtgaccactgaattcactcc

SEQ ID NO: 1448922 - DNA, 15 bp, Homo sapiens
tgtgacccaccagtg

SEQ ID NO: 1448923 - DNA, 16 bp, Homo sapiens
tgtgacccaccagtgc

SEQ ID NO: 1448924 - DNA, 18 bp, Homo sapiens
tgtgacccaccagtgcct

SEQ ID NO: 1448925 - DNA, 16 bp, Homo sapiens
tgtgacgcgcaagtct

SEQ ID NO: 1448926 - DNA, 16 bp, Homo sapiens
tgtgacgtgcactgtg

SEQ ID NO: 1448927 - DNA, 17 bp, Homo sapiens
tgtgactataaagctgt

SEQ ID NO: 1448928 - DNA, 16 bp, Homo sapiens
tgtgactctagcaagg

SEQ ID NO: 1448929 - DNA, 12 bp, Homo sapiens
tgtgactcttct

SEQ ID NO: 1448930 - DNA, 21 bp, Homo sapiens
tgtgactgaagaagatgagcc

SEQ ID NO: 1448931 - DNA, 22 bp, Homo sapiens
tgtgactgaagaagatgagcct

SEQ ID NO: 1448932 - DNA, 20 bp, Homo sapiens
tgtgactgagcaagactctt

SEQ ID NO: 1448933 - DNA, 13 bp, Homo sapiens
tgtgactggtcag

SEQ ID NO: 1448934 - DNA, 14 bp, Homo sapiens
tgtgacttcactgt

SEQ ID NO: 1448935 - DNA, 18 bp, Homo sapiens
tgtgacttcactgtatat

SEQ ID NO: 1448936 - DNA, 17 bp, Homo sapiens
tgtgacttttgctttaa

SEQ ID NO: 1448937 - DNA, 13 bp, Homo sapiens
tgtgagaagccag

SEQ ID NO: 1448938 - DNA, 19 bp, Homo sapiens
tgtgagacccccacacctc

SEQ ID NO: 1448939 - DNA, 17 bp, Homo sapiens
tgtgagacttaaaacat

SEQ ID NO: 1448940 - DNA, 15 bp, Homo sapiens
tgtgagagagactga

SEQ ID NO: 1448941 - DNA, 22 bp, Homo sapiens
tgtgagatccttcacaggcagt

SEQ ID NO: 1448942 - DNA, 19 bp, Homo sapiens
tgtgagcaagcatttatgt

SEQ ID NO: 1448943 - DNA, 14 bp, Homo sapiens
tgtgagcacatgcg

SEQ ID NO: 1448944 - DNA, 14 bp, Homo sapiens
tgtgagcagggctg

SEQ ID NO: 1448945 - DNA, 18 bp, Homo sapiens
tgtgagcatccttcccag

SEQ ID NO: 1448946 - DNA, 20 bp, Homo sapiens
tgtgagccagagggagctgt

SEQ ID NO: 1448947 - DNA, 14 bp, Homo sapiens
tgtgagccagtcta

SEQ ID NO: 1448948 - DNA, 17 bp, Homo sapiens
tgtgagctcttccctta

SEQ ID NO: 1448949 - DNA, 11 bp, Homo sapiens
tgtgagctgga

SEQ ID NO: 1448950 - DNA, 18 bp, Homo sapiens
tgtgagctggatagactt

SEQ ID NO: 1448951 - DNA, 16 bp, Homo sapiens
tgtgagcttacattga

SEQ ID NO: 1448952 - DNA, 14 bp, Homo sapiens
tgtgaggagctgct

SEQ ID NO: 1448953 - DNA, 18 bp, Homo sapiens
tgtgaggagctgctggct

SEQ ID NO: 1448954 - DNA, 12 bp, Homo sapiens
tgtgaggcaggg

SEQ ID NO: 1448955 - DNA, 23 bp, Homo sapiens
tgtgaggcccatggttgagaaat

SEQ ID NO: 1448956 - DNA, 22 bp, Homo sapiens
tgtgagggaaagagctttccta

SEQ ID NO: 1448957 - DNA, 18 bp, Homo sapiens
tgtgaggggctctctcat

SEQ ID NO: 1448958 - DNA, 23 bp, Homo sapiens
tgtgagtattctcattcttccca

SEQ ID NO: 1448959 - DNA, 17 bp, Homo sapiens
tgtgagtcccagagccc

SEQ ID NO: 1448960 - DNA, 18 bp, Homo sapiens
tgtgagtctttggttcta

SEQ ID NO: 1448961 - DNA, 22 bp, Homo sapiens
tgtgagtctttggttctaagga

SEQ ID NO: 1448962 - DNA, 16 bp, Homo sapiens
tgtgagtgccttttgc

SEQ ID NO: 1448963 - DNA, 22 bp, Homo sapiens
tgtgagtggagttgaggtgtca

SEQ ID NO: 1448964 - DNA, 16 bp, Homo sapiens
tgtgagtggcagccat

SEQ ID NO: 1448965 - DNA, 18 bp, Homo sapiens
tgtgagtggcagccatgc

SEQ ID NO: 1448966 - DNA, 16 bp, Homo sapiens
tgtgagtgtaagtgtg

SEQ ID NO: 1448967 - DNA, 20 bp, Homo sapiens
tgtgagtgtaagtgtgagta

SEQ ID NO: 1448968 - DNA, 19 bp, Homo sapiens
tgtgagttgagtctcctct

SEQ ID NO: 1448969 - DNA, 16 bp, Homo sapiens
tgtgagtttaaagcaa

SEQ ID NO: 1448970 - DNA, 18 bp, Homo sapiens
tgtgataaggatcagaac

SEQ ID NO: 1448971 - DNA, 17 bp, Homo sapiens
tgtgatatgtctgctga

SEQ ID NO: 1448972 - DNA, 19 bp, Homo sapiens
tgtgatattaaatttcaaa

SEQ ID NO: 1448973 - DNA, 16 bp, Homo sapiens
tgtgatatttcagaaa

SEQ ID NO: 1448974 - DNA, 12 bp, Homo sapiens
tgtgatcaactg

SEQ ID NO: 1448975 - DNA, 15 bp, Homo sapiens
tgtgatcagaccata

SEQ ID NO: 1448976 - DNA, 20 bp, Homo sapiens
tgtgatcagtgattttcaaa

SEQ ID NO: 1448977 - DNA, 24 bp, Homo sapiens
tgtgatccagttgttttccatcat

SEQ ID NO: 1448978 - DNA, 20 bp, Homo sapiens
tgtgatgaacatattcatga

SEQ ID NO: 1448979 - DNA, 18 bp, Homo sapiens
tgtgatgaatctacattt

SEQ ID NO: 1448980 - DNA, 17 bp, Homo sapiens
tgtgatgccacacagag

SEQ ID NO: 1448981 - DNA, 19 bp, Homo sapiens
tgtgatgccatatcaagtc

SEQ ID NO: 1448982 - DNA, 16 bp, Homo sapiens
tgtgatgtaaggcact

SEQ ID NO: 1448983 - DNA, 18 bp, Homo sapiens
tgtgatgttctaaggctc

SEQ ID NO: 1448984 - DNA, 22 bp, Homo sapiens
tgtgattaacatctacaatcag

SEQ ID NO: 1448985 - DNA, 23 bp, Homo sapiens
tgtgattagatcacatcttaaat

SEQ ID NO: 1448986 - DNA, 15 bp, Homo sapiens
tgtgattatttcact

SEQ ID NO: 1448987 - DNA, 15 bp, Homo sapiens
tgtgattcaatctgt

SEQ ID NO: 1448988 - DNA, 22 bp, Homo sapiens
tgtgattccactacacctggct

SEQ ID NO: 1448989 - DNA, 12 bp, Homo sapiens
cgggcagccagc

SEQ ID NO: 1448990 - DNA, 22 bp, Homo sapiens
cgggcagtggaggctgctgtga

SEQ ID NO: 1448991 - DNA, 23 bp, Homo sapiens
cgggccacacgtggctggcggcc

SEQ ID NO: 1448992 - DNA, 14 bp, Homo sapiens
cgggccagccaggc

SEQ ID NO: 1448993 - DNA, 14 bp, Homo sapiens
cgggccaggcccgc

SEQ ID NO: 1448994 - DNA, 12 bp, Homo sapiens
cgggccagggtg

SEQ ID NO: 1448995 - DNA, 13 bp, Homo sapiens
cgggccagggtgg

SEQ ID NO: 1448996 - DNA, 13 bp, Homo sapiens
cgggcccacctgg

SEQ ID NO: 1448997 - DNA, 15 bp, Homo sapiens
cgggcccacctggcc

SEQ ID NO: 1448998 - DNA, 16 bp, Homo sapiens
cgggcccacctggcca

SEQ ID NO: 1448999 - DNA, 19 bp, Homo sapiens
cgggcccacctggccacct

SEQ ID NO: 1449000 - DNA, 14 bp, Homo sapiens
cgggcccagaggag

SEQ ID NO: 1449001 - DNA, 15 bp, Homo sapiens
cgggcccagaggagc

SEQ ID NO: 1449002 - DNA, 18 bp, Homo sapiens
cgggcccgttgaggatga

SEQ ID NO: 1449003 - DNA, 18 bp, Homo sapiens
cgggccgaggcccagcgg

SEQ ID NO: 1449004 - DNA, 20 bp, Homo sapiens
cgggccgaggcccagcgggc

SEQ ID NO: 1449005 - DNA, 16 bp, Homo sapiens
cgggccgtaggggctc

SEQ ID NO: 1449006 - DNA, 19 bp, Homo sapiens
cgggcctcccaccgcagcg

SEQ ID NO: 1449007 - DNA, 17 bp, Homo sapiens
cgggcctggccctcact

SEQ ID NO: 1449008 - DNA, 17 bp, Homo sapiens
cgggcgagtcactgcct

SEQ ID NO: 1449009 - DNA, 19 bp, Homo sapiens
cgggcgagtcactgcctct

SEQ ID NO: 1449010 - DNA, 14 bp, Homo sapiens
cgggcgcgggcagc

SEQ ID NO: 1449011 - DNA, 23 bp, Homo sapiens
cgggcgcgggcagccacccaagc

SEQ ID NO: 1449012 - DNA, 14 bp, Homo sapiens
cgggcgcggtggct

SEQ ID NO: 1449013 - DNA, 15 bp, Homo sapiens
cgggcgctgcagcct

SEQ ID NO: 1449014 - DNA, 17 bp, Homo sapiens
cgggcgctgcagcctcc

SEQ ID NO: 1449015 - DNA, 14 bp, Homo sapiens
cgggctccagccat

SEQ ID NO: 1449016 - DNA, 13 bp, Homo sapiens
cgggctcgcccat

SEQ ID NO: 1449017 - DNA, 14 bp, Homo sapiens
cgggctctctgctg

SEQ ID NO: 1449018 - DNA, 15 bp, Homo sapiens
cgggctctctgctgt

SEQ ID NO: 1449019 - DNA, 14 bp, Homo sapiens
cgggctctggccac

SEQ ID NO: 1449020 - DNA, 16 bp, Homo sapiens
cgggctctggccaccc

SEQ ID NO: 1449021 - DNA, 16 bp, Homo sapiens
cgggctgagggcctgc

SEQ ID NO: 1449022 - DNA, 14 bp, Homo sapiens
cgggctggagaaag

SEQ ID NO: 1449023 - DNA, 18 bp, Homo sapiens
cgggctggagaaagagct

SEQ ID NO: 1449024 - DNA, 22 bp, Homo sapiens
cgggctggagaaagagctgcct

SEQ ID NO: 1449025 - DNA, 17 bp, Homo sapiens
cgggcttcccttctccc

SEQ ID NO: 1449026 - DNA, 22 bp, Homo sapiens
cgggcttcccttctccccagcc

SEQ ID NO: 1449027 - DNA, 14 bp, Homo sapiens
cgggcttgcggtgg

SEQ ID NO: 1449028 - DNA, 20 bp, Homo sapiens
cgggctttaatagtcacctt

SEQ ID NO: 1449029 - DNA, 14 bp, Homo sapiens
cggggaactcctgg

SEQ ID NO: 1449030 - DNA, 17 bp, Homo sapiens
cggggaagctgcacatg

SEQ ID NO: 1449031 - DNA, 16 bp, Homo sapiens
cggggacaccagagct

SEQ ID NO: 1449032 - DNA, 21 bp, Homo sapiens
cggggaggcaggggtcctgca

SEQ ID NO: 1449033 - DNA, 19 bp, Homo sapiens
cggggcagcaaagcagctg

SEQ ID NO: 1449034 - DNA, 14 bp, Homo sapiens
cggggcagggcagc

SEQ ID NO: 1449035 - DNA, 21 bp, Homo sapiens
tgtgcatgtgtgtgtctgtct

SEQ ID NO: 1449036 - DNA, 15 bp, Homo sapiens
tgtgcattctggatt

SEQ ID NO: 1449037 - DNA, 22 bp, Homo sapiens
tgtgcatttttgtgaaatgaaa

SEQ ID NO: 1449038 - DNA, 17 bp, Homo sapiens
tgtgccaacctgttctt

SEQ ID NO: 1449039 - DNA, 17 bp, Homo sapiens
tgtgccaagacattaat

SEQ ID NO: 1449040 - DNA, 13 bp, Homo sapiens
tgtgccacacagt

SEQ ID NO: 1449041 - DNA, 17 bp, Homo sapiens
tgtgccaccatgcctca

SEQ ID NO: 1449042 - DNA, 21 bp, Homo sapiens
tgtgccactaaactacattgt

SEQ ID NO: 1449043 - DNA, 22 bp, Homo sapiens
tgtgccagaggaatcctggcag

SEQ ID NO: 1449044 - DNA, 12 bp, Homo sapiens
tgtgccaggctg

SEQ ID NO: 1449045 - DNA, 13 bp, Homo sapiens
tgtgccaggctga

SEQ ID NO: 1449046 - DNA, 18 bp, Homo sapiens
tgtgccatagtcacatgg

SEQ ID NO: 1449047 - DNA, 17 bp, Homo sapiens
tgtgccatggatctgat

SEQ ID NO: 1449048 - DNA, 17 bp, Homo sapiens
tgtgcccacatcccagg

SEQ ID NO: 1449049 - DNA, 20 bp, Homo sapiens
tgtgcccacatcccaggctt

SEQ ID NO: 1449050 - DNA, 17 bp, Homo sapiens
tgtgcccacccagggaa

SEQ ID NO: 1449051 - DNA, 14 bp, Homo sapiens
tgtgcccagcacct

SEQ ID NO: 1449052 - DNA, 16 bp, Homo sapiens
tgtgcccagcacctgg

SEQ ID NO: 1449053 - DNA, 12 bp, Homo sapiens
tgtgcccagcag

SEQ ID NO: 1449054 - DNA, 13 bp, Homo sapiens
tgtgcccagcagg

SEQ ID NO: 1449055 - DNA, 20 bp, Homo sapiens
tgtgcccagcaggcccagca

SEQ ID NO: 1449056 - DNA, 22 bp, Homo sapiens
tgtgcccagcaggcccagcatg

SEQ ID NO: 1449057 - DNA, 16 bp, Homo sapiens
tgtgccccactccagc

SEQ ID NO: 1449058 - DNA, 18 bp, Homo sapiens
tgtgccccactccagcct

SEQ ID NO: 1449059 - DNA, 19 bp, Homo sapiens
tgtgccccactccagcctg

SEQ ID NO: 1449060 - DNA, 20 bp, Homo sapiens
tgtgccccactccagcctgg

SEQ ID NO: 1449061 - DNA, 14 bp, Homo sapiens
tgtgcccgtgtgtg

SEQ ID NO: 1449062 - DNA, 20 bp, Homo sapiens
tgtgcctatagtcccagcta

SEQ ID NO: 1449063 - DNA, 16 bp, Homo sapiens
tgtgcctcaggccagg

SEQ ID NO: 1449064 - DNA, 17 bp, Homo sapiens
tgtgcctcaggccaggg

SEQ ID NO: 1449065 - DNA, 19 bp, Homo sapiens
tgtgcctcaggccagggct

SEQ ID NO: 1449066 - DNA, 17 bp, Homo sapiens
tgtgcctccccccagac

SEQ ID NO: 1449067 - DNA, 18 bp, Homo sapiens
tgtgcctccccccagacc

SEQ ID NO: 1449068 - DNA, 17 bp, Homo sapiens
tgtgcctgctagagcaa

SEQ ID NO: 1449069 - DNA, 15 bp, Homo sapiens
tgtgcctgctcagca

SEQ ID NO: 1449070 - DNA, 13 bp, Homo sapiens
tgtgcctgggccc

SEQ ID NO: 1449071 - DNA, 12 bp, Homo sapiens
tgtgcctggggt

SEQ ID NO: 1449072 - DNA, 15 bp, Homo sapiens
tgtgcctgtgctcct

SEQ ID NO: 1449073 - DNA, 14 bp, Homo sapiens
tgtgcctgtggcag

SEQ ID NO: 1449074 - DNA, 13 bp, Homo sapiens
tgtgcctgtgtgc

SEQ ID NO: 1449075 - DNA, 18 bp, Homo sapiens
tgtgccttaaaaggagag

SEQ ID NO: 1449076 - DNA, 11 bp, Homo sapiens
tgtgccttaag

SEQ ID NO: 1449077 - DNA, 12 bp, Homo sapiens
tgtgccttccct

SEQ ID NO: 1449078 - DNA, 17 bp, Homo sapiens
tgtgccttcccttctct

SEQ ID NO: 1449079 - DNA, 21 bp, Homo sapiens
tgtgccttcccttctctggtc

SEQ ID NO: 1449080 - DNA, 15 bp, Homo sapiens
tgtgccttctttgta

SEQ ID NO: 1449081 - DNA, 12 bp, Homo sapiens
tgtgcctttctt

SEQ ID NO: 1449082 - DNA, 19 bp, Homo sapiens
tgtgcctttctttgcctct

SEQ ID NO: 1449083 - DNA, 21 bp, Homo sapiens
tgtgcctttctttgcctctgc

SEQ ID NO: 1449084 - DNA, 22 bp, Homo sapiens
tgtgcctttctttgcctctgca

SEQ ID NO: 1449085 - DNA, 10 bp, Homo sapiens
tgtgcctttg

SEQ ID NO: 1449086 - DNA, 15 bp, Homo sapiens
tgtgcctttggcctg

SEQ ID NO: 1449087 - DNA, 17 bp, Homo sapiens
tgtgcgctgcctggcca

SEQ ID NO: 1449088 - DNA, 23 bp, Homo sapiens
tgtgcgctgcctggccaggccct

SEQ ID NO: 1449089 - DNA, 14 bp, Homo sapiens
tgtgcgtctctctt

SEQ ID NO: 1449090 - DNA, 18 bp, Homo sapiens
tgtgcgtctctctttctc

SEQ ID NO: 1449091 - DNA, 17 bp, Homo sapiens
tgtgctactgattgttt

SEQ ID NO: 1449092 - DNA, 14 bp, Homo sapiens
tgtgctagaatact

SEQ ID NO: 1449093 - DNA, 18 bp, Homo sapiens
tgtgctagaatacttttt

SEQ ID NO: 1449094 - DNA, 18 bp, Homo sapiens
tgtgctagtcactggcag

SEQ ID NO: 1449095 - DNA, 18 bp, Homo sapiens
tgtgctatactgcatact

SEQ ID NO: 1449096 - DNA, 15 bp, Homo sapiens
tgtgctatgaatttt

SEQ ID NO: 1449097 - DNA, 16 bp, Homo sapiens
tgtgctatttgtacaa

SEQ ID NO: 1449098 - DNA, 17 bp, Homo sapiens
tgtgctatttgtacaaa

SEQ ID NO: 1449099 - DNA, 19 bp, Homo sapiens
tgtgctatttgtacaaata

SEQ ID NO: 1449100 - DNA, 14 bp, Homo sapiens
tgtgctcagccaaa

SEQ ID NO: 1449101 - DNA, 20 bp, Homo sapiens
tgtgctcagccaaatttcct

SEQ ID NO: 1449102 - DNA, 20 bp, Homo sapiens
tgtgctcccctgccacactg

SEQ ID NO: 1449103 - DNA, 14 bp, Homo sapiens
tgtgctcctgccca

SEQ ID NO: 1449104 - DNA, 15 bp, Homo sapiens
tgtgctcctgcccag

SEQ ID NO: 1449105 - DNA, 21 bp, Homo sapiens
cggtctgctttggatgatttt

SEQ ID NO: 1449106 - DNA, 18 bp, Homo sapiens
cggtgaaggtgacagcag

SEQ ID NO: 1449107 - DNA, 16 bp, Homo sapiens
cggtgagaactctgcc

SEQ ID NO: 1449108 - DNA, 16 bp, Homo sapiens
cggtgcacaggcctct

SEQ ID NO: 1449109 - DNA, 22 bp, Homo sapiens
cggtgcacaggcctctgcctgc

SEQ ID NO: 1449110 - DNA, 10 bp, Homo sapiens
cggtgcagct

SEQ ID NO: 1449111 - DNA, 14 bp, Homo sapiens
cggtgccaagggcc

SEQ ID NO: 1449112 - DNA, 14 bp, Homo sapiens
cggtgccatgtctg

SEQ ID NO: 1449113 - DNA, 20 bp, Homo sapiens
cggtgcgcacaccgccagca

SEQ ID NO: 1449114 - DNA, 19 bp, Homo sapiens
cggtgcgtggctgtggcac

SEQ ID NO: 1449115 - DNA, 16 bp, Homo sapiens
cggtgctccatctccg

SEQ ID NO: 1449116 - DNA, 22 bp, Homo sapiens
cggtgctccatctccgcctcca

SEQ ID NO: 1449117 - DNA, 12 bp, Homo sapiens
cggtgctctggc

SEQ ID NO: 1449118 - DNA, 19 bp, Homo sapiens
cggtgctgactgaggcctg

SEQ ID NO: 1449119 - DNA, 14 bp, Homo sapiens
cggtgctgcaggag

SEQ ID NO: 1449120 - DNA, 22 bp, Homo sapiens
cggtgctgggttcccactcccg

SEQ ID NO: 1449121 - DNA, 18 bp, Homo sapiens
cggtgctgtgagggaggg

SEQ ID NO: 1449122 - DNA, 14 bp, Homo sapiens
cggtggcagtaggg

SEQ ID NO: 1449123 - DNA, 20 bp, Homo sapiens
cggtggctcacgcctgtaat

SEQ ID NO: 1449124 - DNA, 20 bp, Homo sapiens
cggtggctcaggcctataac

SEQ ID NO: 1449125 - DNA, 20 bp, Homo sapiens
cggtggctcatgcctgtaat

SEQ ID NO: 1449126 - DNA, 18 bp, Homo sapiens
cggtgggacccccgtggg

SEQ ID NO: 1449127 - DNA, 19 bp, Homo sapiens
cggtgggaccctgtccggc

SEQ ID NO: 1449128 - DNA, 14 bp, Homo sapiens
cggtgggccagagc

SEQ ID NO: 1449129 - DNA, 17 bp, Homo sapiens
cggtggtgcccgtgccc

SEQ ID NO: 1449130 - DNA, 20 bp, Homo sapiens
cggtggtgcccgtgcccgca

SEQ ID NO: 1449131 - DNA, 21 bp, Homo sapiens
cggtggtgcccgtgcccgcag

SEQ ID NO: 1449132 - DNA, 22 bp, Homo sapiens
cggtggtgcccgtgcccgcagg

SEQ ID NO: 1449133 - DNA, 15 bp, Homo sapiens
cggtgtccaccatcc

SEQ ID NO: 1449134 - DNA, 17 bp, Homo sapiens
cggtgtccaccatcccc

SEQ ID NO: 1449135 - DNA, 14 bp, Homo sapiens
cggtgtccccagag

SEQ ID NO: 1449136 - DNA, 15 bp, Homo sapiens
cggtgtgcctgcagc

SEQ ID NO: 1449137 - DNA, 17 bp, Homo sapiens
cggtgtgcctgcagccc

SEQ ID NO: 1449138 - DNA, 20 bp, Homo sapiens
cggtgtgtggccgcctggca

SEQ ID NO: 1449139 - DNA, 14 bp, Homo sapiens
cggttcaccagcct

SEQ ID NO: 1449140 - DNA, 17 bp, Homo sapiens
cggttcagacccctgcc

SEQ ID NO: 1449141 - DNA, 18 bp, Homo sapiens
cggttcctcatctgagag

SEQ ID NO: 1449142 - DNA, 14 bp, Homo sapiens
cggttgttctttcc

SEQ ID NO: 1449143 - DNA, 21 bp, Homo sapiens
cggttgttctttcctcacatt

SEQ ID NO: 1449144 - DNA, 11 bp, Homo sapiens
cggtttctcca

SEQ ID NO: 1449145 - DNA, 13 bp, Homo sapiens
cggtttctgagca

SEQ ID NO: 1449146 - DNA, 20 bp, Homo sapiens
cggtttctgagcataatgct

SEQ ID NO: 1449147 - DNA, 19 bp, Homo sapiens
cggtttggataatcttaaa

SEQ ID NO: 1449148 - DNA, 16 bp, Homo sapiens
cggtttgggctgtctt

SEQ ID NO: 1449149 - DNA, 20 bp, Homo sapiens
cggtttttttctttggctgc

SEQ ID NO: 1449150 - DNA, 13 bp, Homo sapiens
cgtaaagaatttt

SEQ ID NO: 1449151 - DNA, 24 bp, Homo sapiens
cgtaagatacaagtttcagacagg

SEQ ID NO: 1449152 - DNA, 23 bp, Homo sapiens
cgtaagcagtatattagtattat

SEQ ID NO: 1449153 - DNA, 17 bp, Homo sapiens
cgtaattatgtaccatg

SEQ ID NO: 1449154 - DNA, 22 bp, Homo sapiens
cgtaattctttctgtctccctt

SEQ ID NO: 1449155 - DNA, 15 bp, Homo sapiens
tgtggcaactaaacc

SEQ ID NO: 1449156 - DNA, 15 bp, Homo sapiens
tgtggcagaaaagag

SEQ ID NO: 1449157 - DNA, 14 bp, Homo sapiens
tgtggcagagttac

SEQ ID NO: 1449158 - DNA, 15 bp, Homo sapiens
tgtggcagagttaca

SEQ ID NO: 1449159 - DNA, 20 bp, Homo sapiens
tgtggcagagttacagttct

SEQ ID NO: 1449160 - DNA, 13 bp, Homo sapiens
tgtggcagctgcc

SEQ ID NO: 1449161 - DNA, 19 bp, Homo sapiens
tgtggcagctgcccctggc

SEQ ID NO: 1449162 - DNA, 12 bp, Homo sapiens
tgtggcagctgg

SEQ ID NO: 1449163 - DNA, 13 bp, Homo sapiens
tgtggcagctggg

SEQ ID NO: 1449164 - DNA, 17 bp, Homo sapiens
tgtggcaggaggctttg

SEQ ID NO: 1449165 - DNA, 13 bp, Homo sapiens
tgtggcagggggc

SEQ ID NO: 1449166 - DNA, 19 bp, Homo sapiens
tgtggcagtcccttataat

SEQ ID NO: 1449167 - DNA, 19 bp, Homo sapiens
tgtggcagtggccaggcag

SEQ ID NO: 1449168 - DNA, 23 bp, Homo sapiens
tgtggcataaattgcatcactgt

SEQ ID NO: 1449169 - DNA, 17 bp, Homo sapiens
tgtggcatgggtgaaga

SEQ ID NO: 1449170 - DNA, 13 bp, Homo sapiens
tgtggccagagct

SEQ ID NO: 1449171 - DNA, 14 bp, Homo sapiens
tgtggccagagctg

SEQ ID NO: 1449172 - DNA, 14 bp, Homo sapiens
tgtggccatggcct

SEQ ID NO: 1449173 - DNA, 20 bp, Homo sapiens
tgtggcccatcttactggaa

SEQ ID NO: 1449174 - DNA, 12 bp, Homo sapiens
tgtggccccacc

SEQ ID NO: 1449175 - DNA, 13 bp, Homo sapiens
tgtggccctgcca

SEQ ID NO: 1449176 - DNA, 14 bp, Homo sapiens
tgtggccctgccat

SEQ ID NO: 1449177 - DNA, 15 bp, Homo sapiens
tgtggccgaggactt

SEQ ID NO: 1449178 - DNA, 16 bp, Homo sapiens
tgtggccgaggacttt

SEQ ID NO: 1449179 - DNA, 17 bp, Homo sapiens
tgtggccgcctggcagg

SEQ ID NO: 1449180 - DNA, 11 bp, Homo sapiens
tgtggcctcag

SEQ ID NO: 1449181 - DNA, 13 bp, Homo sapiens
tgtggcctgtggc

SEQ ID NO: 1449182 - DNA, 16 bp, Homo sapiens
tgtggcctgtgtccag

SEQ ID NO: 1449183 - DNA, 20 bp, Homo sapiens
tgtggccttccatttatatg

SEQ ID NO: 1449184 - DNA, 21 bp, Homo sapiens
tgtggccttgcccgccagcct

SEQ ID NO: 1449185 - DNA, 21 bp, Homo sapiens
tgtggctcagtgccttcctct

SEQ ID NO: 1449186 - DNA, 16 bp, Homo sapiens
tgtggctccctcctcc

SEQ ID NO: 1449187 - DNA, 20 bp, Homo sapiens
tgtggctcctatctgtgttt

SEQ ID NO: 1449188 - DNA, 13 bp, Homo sapiens
tgtggctcctggg

SEQ ID NO: 1449189 - DNA, 19 bp, Homo sapiens
tgtggctgaaaatgcaaag

SEQ ID NO: 1449190 - DNA, 18 bp, Homo sapiens
tgtggctggaggagctgg

SEQ ID NO: 1449191 - DNA, 18 bp, Homo sapiens
tgtggctgggggcaggag

SEQ ID NO: 1449192 - DNA, 22 bp, Homo sapiens
tgtggcttaccttgattaacat

SEQ ID NO: 1449193 - DNA, 17 bp, Homo sapiens
tgtggctttctttcttt

SEQ ID NO: 1449194 - DNA, 17 bp, Homo sapiens
tgtggctttttgttcag

SEQ ID NO: 1449195 - DNA, 21 bp, Homo sapiens
tgtggctttttgttcagaatt

SEQ ID NO: 1449196 - DNA, 15 bp, Homo sapiens
tgtgggaagaccaaa

SEQ ID NO: 1449197 - DNA, 15 bp, Homo sapiens
tgtgggaagggagag

SEQ ID NO: 1449198 - DNA, 14 bp, Homo sapiens
tgtgggacacctgg

SEQ ID NO: 1449199 - DNA, 18 bp, Homo sapiens
tgtgggaccagtcccaca

SEQ ID NO: 1449200 - DNA, 15 bp, Homo sapiens
tgtgggagacagcag

SEQ ID NO: 1449201 - DNA, 16 bp, Homo sapiens
tgtgggagacagcagc

SEQ ID NO: 1449202 - DNA, 16 bp, Homo sapiens
tgtgggattatgggtc

SEQ ID NO: 1449203 - DNA, 16 bp, Homo sapiens
tgtgggcaggaagtga

SEQ ID NO: 1449204 - DNA, 13 bp, Homo sapiens
tgtgggcagggtt

SEQ ID NO: 1449205 - DNA, 21 bp, Homo sapiens
tgtgggcatttcttgcgagcc

SEQ ID NO: 1449206 - DNA, 17 bp, Homo sapiens
tgtgggcgcccaccctg

SEQ ID NO: 1449207 - DNA, 18 bp, Homo sapiens
tgtgggcgcccaccctgg

SEQ ID NO: 1449208 - DNA, 22 bp, Homo sapiens
tgtgggcgcccaccctgggctc

SEQ ID NO: 1449209 - DNA, 15 bp, Homo sapiens
tgtgggctggttgct

SEQ ID NO: 1449210 - DNA, 22 bp, Homo sapiens
tgtgggctggttgctgtagaaa

SEQ ID NO: 1449211 - DNA, 16 bp, Homo sapiens
tgtggggaacatggct

SEQ ID NO: 1449212 - DNA, 23 bp, Homo sapiens
tgtggggaaccaattgctttgtc

SEQ ID NO: 1449213 - DNA, 16 bp, Homo sapiens
tgtggggcaggagtgc

SEQ ID NO: 1449214 - DNA, 16 bp, Homo sapiens
tgtggggccaggacca

SEQ ID NO: 1449215 - DNA, 22 bp, Homo sapiens
tgtggggccaggaccatggccg

SEQ ID NO: 1449216 - DNA, 13 bp, Homo sapiens
tgtgggggctgca

SEQ ID NO: 1449217 - DNA, 18 bp, Homo sapiens
tgtgggtaagaggagcag

SEQ ID NO: 1449218 - DNA, 20 bp, Homo sapiens
tgtgggtctgtgtgtgtgta

SEQ ID NO: 1449219 - DNA, 14 bp, Homo sapiens
tgtgggttctacag

SEQ ID NO: 1449220 - DNA, 15 bp, Homo sapiens
cgtcggccgaccagg

SEQ ID NO: 1449221 - DNA, 21 bp, Homo sapiens
cgtcggggaggctcctgcctg

SEQ ID NO: 1449222 - DNA, 19 bp, Homo sapiens
cgtcgggggctgaggggca

SEQ ID NO: 1449223 - DNA, 19 bp, Homo sapiens
cgtctactgcaagagccaa

SEQ ID NO: 1449224 - DNA, 21 bp, Homo sapiens
cgtctcattttgtccatgtcc

SEQ ID NO: 1449225 - DNA, 20 bp, Homo sapiens
cgtctccaggggctgcttcc

SEQ ID NO: 1449226 - DNA, 21 bp, Homo sapiens
cgtctccaggggctgcttcct

SEQ ID NO: 1449227 - DNA, 22 bp, Homo sapiens
cgtctccctggtgcctctgtgc

SEQ ID NO: 1449228 - DNA, 21 bp, Homo sapiens
cgtctcccttggcccagagac

SEQ ID NO: 1449229 - DNA, 12 bp, Homo sapiens
cgtctcctccct

SEQ ID NO: 1449230 - DNA, 20 bp, Homo sapiens
cgtctctaatgtctgcagct

SEQ ID NO: 1449231 - DNA, 13 bp, Homo sapiens
cgtctctgtcctc

SEQ ID NO: 1449232 - DNA, 14 bp, Homo sapiens
cgtctctgtcctcg

SEQ ID NO: 1449233 - DNA, 15 bp, Homo sapiens
cgtctgaagcttgac

SEQ ID NO: 1449234 - DNA, 21 bp, Homo sapiens
cgtctgaagcttgactcccaa

SEQ ID NO: 1449235 - DNA, 17 bp, Homo sapiens
cgtctgactccagagtc

SEQ ID NO: 1449236 - DNA, 16 bp, Homo sapiens
cgtctgagctggggtg

SEQ ID NO: 1449237 - DNA, 20 bp, Homo sapiens
cgtctgcctaggagctggct

SEQ ID NO: 1449238 - DNA, 19 bp, Homo sapiens
cgtctgccttggcatcctc

SEQ ID NO: 1449239 - DNA, 12 bp, Homo sapiens
cgtctgctctgg

SEQ ID NO: 1449240 - DNA, 14 bp, Homo sapiens
cgtctggctccctg

SEQ ID NO: 1449241 - DNA, 18 bp, Homo sapiens
cgtctggctccctgcccc

SEQ ID NO: 1449242 - DNA, 17 bp, Homo sapiens
cgtctggggttcagccc

SEQ ID NO: 1449243 - DNA, 19 bp, Homo sapiens
cgtctgtcctcctttctta

SEQ ID NO: 1449244 - DNA, 19 bp, Homo sapiens
cgtctgtctcgatgcctga

SEQ ID NO: 1449245 - DNA, 21 bp, Homo sapiens
cgtcttaagtcagatttttat

SEQ ID NO: 1449246 - DNA, 16 bp, Homo sapiens
cgtcttcagctgcatt

SEQ ID NO: 1449247 - DNA, 21 bp, Homo sapiens
cgtcttgaacgagcagcccag

SEQ ID NO: 1449248 - DNA, 14 bp, Homo sapiens
cgtcttgcccagca

SEQ ID NO: 1449249 - DNA, 16 bp, Homo sapiens
cgtcttgcccagcagc

SEQ ID NO: 1449250 - DNA, 19 bp, Homo sapiens
cgtcttttttctcttccct

SEQ ID NO: 1449251 - DNA, 22 bp, Homo sapiens
cgtgaaaaccaaccctgtgggc

SEQ ID NO: 1449252 - DNA, 16 bp, Homo sapiens
cgtgaaaacggagctg

SEQ ID NO: 1449253 - DNA, 18 bp, Homo sapiens
cgtgaaagaattattttt

SEQ ID NO: 1449254 - DNA, 16 bp, Homo sapiens
cgtgaagagcagtgag

SEQ ID NO: 1449255 - DNA, 13 bp, Homo sapiens
cgtgaagcagtgc

SEQ ID NO: 1449256 - DNA, 17 bp, Homo sapiens
cgtgaagcagtgcctcg

SEQ ID NO: 1449257 - DNA, 21 bp, Homo sapiens
cgtgaagcagtgcctcgaggc

SEQ ID NO: 1449258 - DNA, 22 bp, Homo sapiens
cgtgaagcagtgcctcgaggca

SEQ ID NO: 1449259 - DNA, 17 bp, Homo sapiens
cgtgaagtatactgtat

SEQ ID NO: 1449260 - DNA, 18 bp, Homo sapiens
cgtgaagtcacattccac

SEQ ID NO: 1449261 - DNA, 22 bp, Homo sapiens
cgtgaatatcgagaactgccat

SEQ ID NO: 1449262 - DNA, 17 bp, Homo sapiens
cgtgacccttcagggcc

SEQ ID NO: 1449263 - DNA, 14 bp, Homo sapiens
cgtgactcacccaa

SEQ ID NO: 1449264 - DNA, 20 bp, Homo sapiens
cgtgactgccccaactcctg

SEQ ID NO: 1449265 - DNA, 18 bp, Homo sapiens
cgtgagagaatctgcctg

SEQ ID NO: 1449266 - DNA, 23 bp, Homo sapiens
cgtgagcgccccgcccccacccc

SEQ ID NO: 1449267 - DNA, 15 bp, Homo sapiens
cgtgagctggggact

SEQ ID NO: 1449268 - DNA, 19 bp, Homo sapiens
cgtgagctggggactcagg

SEQ ID NO: 1449269 - DNA, 22 bp, Homo sapiens
cgtgagctggggactcagggac

SEQ ID NO: 1449270 - DNA, 20 bp, Homo sapiens
cgtgaggggcaagctaggcc

SEQ ID NO: 1449271 - DNA, 19 bp, Homo sapiens
cgtgagtgaaccatcatta

SEQ ID NO: 1449272 - DNA, 19 bp, Homo sapiens
cgtgagtgacatagcctca

SEQ ID NO: 1449273 - DNA, 13 bp, Homo sapiens
cgtgatccacccg

SEQ ID NO: 1449274 - DNA, 12 bp, Homo sapiens
tgtgtatgtggg

SEQ ID NO: 1449275 - DNA, 14 bp, Homo sapiens
tgtgtatgtggggg

SEQ ID NO: 1449276 - DNA, 13 bp, Homo sapiens
tgtgtattctgtg

SEQ ID NO: 1449277 - DNA, 23 bp, Homo sapiens
tgtgtattctgtggattctatat

SEQ ID NO: 1449278 - DNA, 19 bp, Homo sapiens
tgtgtatttccagtgcaat

SEQ ID NO: 1449279 - DNA, 16 bp, Homo sapiens
tgtgtatttcttatac

SEQ ID NO: 1449280 - DNA, 11 bp, Homo sapiens
tgtgtatttgc

SEQ ID NO: 1449281 - DNA, 16 bp, Homo sapiens
tgtgtatttgtattaa

SEQ ID NO: 1449282 - DNA, 17 bp, Homo sapiens
tgtgtcaagacatttct

SEQ ID NO: 1449283 - DNA, 16 bp, Homo sapiens
tgtgtcagagcccagc

SEQ ID NO: 1449284 - DNA, 20 bp, Homo sapiens
tgtgtcaggccctctgcctg

SEQ ID NO: 1449285 - DNA, 21 bp, Homo sapiens
tgtgtcaggccctctgcctgc

SEQ ID NO: 1449286 - DNA, 22 bp, Homo sapiens
tgtgtcatgaagaatgtttctg

SEQ ID NO: 1449287 - DNA, 16 bp, Homo sapiens
tgtgtccaaaactgcc

SEQ ID NO: 1449288 - DNA, 14 bp, Homo sapiens
tgtgtccactgaga

SEQ ID NO: 1449289 - DNA, 21 bp, Homo sapiens
tgtgtccactgagactttccc

SEQ ID NO: 1449290 - DNA, 16 bp, Homo sapiens
tgtgtccatgtgaaat

SEQ ID NO: 1449291 - DNA, 16 bp, Homo sapiens
tgtgtcccagatgctg

SEQ ID NO: 1449292 - DNA, 22 bp, Homo sapiens
tgtgtcccagccacgcagggcc

SEQ ID NO: 1449293 - DNA, 19 bp, Homo sapiens
tgtgtcccaggcagggaga

SEQ ID NO: 1449294 - DNA, 19 bp, Homo sapiens
tgtgtcccatgacccaccc

SEQ ID NO: 1449295 - DNA, 21 bp, Homo sapiens
tgtgtcccatgacccacccct

SEQ ID NO: 1449296 - DNA, 20 bp, Homo sapiens
tgtgtccctggacacagctc

SEQ ID NO: 1449297 - DNA, 21 bp, Homo sapiens
tgtgtccctggacacagctct

SEQ ID NO: 1449298 - DNA, 17 bp, Homo sapiens
tgtgtcctccaggagct

SEQ ID NO: 1449299 - DNA, 18 bp, Homo sapiens
tgtgtcctccaggagctt

SEQ ID NO: 1449300 - DNA, 21 bp, Homo sapiens
tgtgtcctccaggagcttctt

SEQ ID NO: 1449301 - DNA, 17 bp, Homo sapiens
tgtgtcctgatggccca

SEQ ID NO: 1449302 - DNA, 15 bp, Homo sapiens
tgtgtcctggtgctc

SEQ ID NO: 1449303 - DNA, 20 bp, Homo sapiens
tgtgtcctggtgctctctgc

SEQ ID NO: 1449304 - DNA, 22 bp, Homo sapiens
tgtgtcctggtgctctctgcca

SEQ ID NO: 1449305 - DNA, 18 bp, Homo sapiens
tgtgtccttgcacctgca

SEQ ID NO: 1449306 - DNA, 20 bp, Homo sapiens
tgtgtccttgcacctgcatc

SEQ ID NO: 1449307 - DNA, 17 bp, Homo sapiens
tgtgtctaagattctag

SEQ ID NO: 1449308 - DNA, 20 bp, Homo sapiens
tgtgtctgcattgttattgt

SEQ ID NO: 1449309 - DNA, 12 bp, Homo sapiens
tgtgtctgccaa

SEQ ID NO: 1449310 - DNA, 15 bp, Homo sapiens
tgtgtctgccaaaca

SEQ ID NO: 1449311 - DNA, 18 bp, Homo sapiens
tgtgtctgccaaacacat

SEQ ID NO: 1449312 - DNA, 14 bp, Homo sapiens
tgtgtctgctcagt

SEQ ID NO: 1449313 - DNA, 22 bp, Homo sapiens
tgtgtctgctgagtaaggaaca

SEQ ID NO: 1449314 - DNA, 22 bp, Homo sapiens
tgtgtctggcgttctcaagaat

SEQ ID NO: 1449315 - DNA, 14 bp, Homo sapiens
tgtgtctgtacacg

SEQ ID NO: 1449316 - DNA, 12 bp, Homo sapiens
tgtgtctgtctt

SEQ ID NO: 1449317 - DNA, 22 bp, Homo sapiens
tgtgtgaaaaaagaaaatggct

SEQ ID NO: 1449318 - DNA, 15 bp, Homo sapiens
tgtgtgaaacaatgt

SEQ ID NO: 1449319 - DNA, 23 bp, Homo sapiens
tgtgtgaaacaatgttgtccaac

SEQ ID NO: 1449320 - DNA, 20 bp, Homo sapiens
tgtgtgaaataccagtgtgg

SEQ ID NO: 1449321 - DNA, 17 bp, Homo sapiens
tgtgtgaattctgcaac

SEQ ID NO: 1449322 - DNA, 14 bp, Homo sapiens
tgtgtgacaattct

SEQ ID NO: 1449323 - DNA, 19 bp, Homo sapiens
tgtgtgagacttaaaacat

SEQ ID NO: 1449324 - DNA, 20 bp, Homo sapiens
tgtgtgagacttaaaacatg

SEQ ID NO: 1449325 - DNA, 17 bp, Homo sapiens
tgtgtgaggagctgctg

SEQ ID NO: 1449326 - DNA, 16 bp, Homo sapiens
tgtgtgagtgtaattc

SEQ ID NO: 1449327 - DNA, 16 bp, Homo sapiens
tgtgtgatatttcaga

SEQ ID NO: 1449328 - DNA, 10 bp, Homo sapiens
tgtgtgattt

SEQ ID NO: 1449329 - DNA, 13 bp, Homo sapiens
tgtgtgatttcct

SEQ ID NO: 1449330 - DNA, 15 bp, Homo sapiens
tgtgtgatttcctaa

SEQ ID NO: 1449331 - DNA, 21 bp, Homo sapiens
tgtgtgatttcctaaacataa

SEQ ID NO: 1449332 - DNA, 12 bp, Homo sapiens
tgtgtgcagcaa

SEQ ID NO: 1449333 - DNA, 16 bp, Homo sapiens
tgtgtgcatgtgagca

SEQ ID NO: 1449334 - DNA, 17 bp, Homo sapiens
tgggccctgggctggaa

SEQ ID NO: 1449335 - DNA, 13 bp, Homo sapiens
tgggccgctgcca

SEQ ID NO: 1449336 - DNA, 14 bp, Homo sapiens
tgggccggctgagt

SEQ ID NO: 1449337 - DNA, 15 bp, Homo sapiens
tgggccgggctgtag

SEQ ID NO: 1449338 - DNA, 18 bp, Homo sapiens
tgggccgtagcttgtctg

SEQ ID NO: 1449339 - DNA, 13 bp, Homo sapiens
tgggcctcaggcg

SEQ ID NO: 1449340 - DNA, 22 bp, Homo sapiens
tgggcctcagtgtgcccatctg

SEQ ID NO: 1449341 - DNA, 14 bp, Homo sapiens
tgggcctcccctgg

SEQ ID NO: 1449342 - DNA, 15 bp, Homo sapiens
tgggcctcccctggg

SEQ ID NO: 1449343 - DNA, 18 bp, Homo sapiens
tgggcctcctctgtccag

SEQ ID NO: 1449344 - DNA, 17 bp, Homo sapiens
tgggcctccttcccatg

SEQ ID NO: 1449345 - DNA, 15 bp, Homo sapiens
tgggcctcggcccct

SEQ ID NO: 1449346 - DNA, 16 bp, Homo sapiens
tgggcctctcctgccc

SEQ ID NO: 1449347 - DNA, 20 bp, Homo sapiens
tgggcctctcctgccctctg

SEQ ID NO: 1449348 - DNA, 21 bp, Homo sapiens
tgggcctctcctgccctctgc

SEQ ID NO: 1449349 - DNA, 23 bp, Homo sapiens
tgggcctgaactcattctcttct

SEQ ID NO: 1449350 - DNA, 11 bp, Homo sapiens
tgggcctgagg

SEQ ID NO: 1449351 - DNA, 12 bp, Homo sapiens
tgggcctgccca

SEQ ID NO: 1449352 - DNA, 20 bp, Homo sapiens
tgggcctgccgggctgaggg

SEQ ID NO: 1449353 - DNA, 13 bp, Homo sapiens
tgggcctggagcc

SEQ ID NO: 1449354 - DNA, 20 bp, Homo sapiens
tgggcctggccagtcttcct

SEQ ID NO: 1449355 - DNA, 13 bp, Homo sapiens
tgggcctggcctg

SEQ ID NO: 1449356 - DNA, 14 bp, Homo sapiens
tgggcctggcctga

SEQ ID NO: 1449357 - DNA, 15 bp, Homo sapiens
tgggcctggcctgag

SEQ ID NO: 1449358 - DNA, 16 bp, Homo sapiens
tgggcctggcctgagc

SEQ ID NO: 1449359 - DNA, 18 bp, Homo sapiens
tgggcctggcctgagctg

SEQ ID NO: 1449360 - DNA, 16 bp, Homo sapiens
tgggcctgtcgtgcca

SEQ ID NO: 1449361 - DNA, 17 bp, Homo sapiens
tgggcctgtcgtgccag

SEQ ID NO: 1449362 - DNA, 18 bp, Homo sapiens
tgggcctgtgcagcagcc

SEQ ID NO: 1449363 - DNA, 19 bp, Homo sapiens
tggggagttaagacctggc

SEQ ID NO: 1449364 - DNA, 20 bp, Homo sapiens
tggggagttaagacctggca

SEQ ID NO: 1449365 - DNA, 13 bp, Homo sapiens
tggggatagagga

SEQ ID NO: 1449366 - DNA, 16 bp, Homo sapiens
tggggatagatgtgtg

SEQ ID NO: 1449367 - DNA, 12 bp, Homo sapiens
tggggcagacac

SEQ ID NO: 1449368 - DNA, 21 bp, Homo sapiens
tggggcagaggggcagccgct

SEQ ID NO: 1449369 - DNA, 13 bp, Homo sapiens
tggggcagcctct

SEQ ID NO: 1449370 - DNA, 15 bp, Homo sapiens
tggggcagctgagca

SEQ ID NO: 1449371 - DNA, 18 bp, Homo sapiens
tggggcagctgagcagct

SEQ ID NO: 1449372 - DNA, 17 bp, Homo sapiens
tggggcaggagtgccag

SEQ ID NO: 1449373 - DNA, 21 bp, Homo sapiens
tggggcaggagtgccaggacc

SEQ ID NO: 1449374 - DNA, 13 bp, Homo sapiens
tggggcagggagc

SEQ ID NO: 1449375 - DNA, 15 bp, Homo sapiens
tggggcatgtgtgcc

SEQ ID NO: 1449376 - DNA, 16 bp, Homo sapiens
tggggcatgtgtgcct

SEQ ID NO: 1449377 - DNA, 13 bp, Homo sapiens
tggggccagatcc

SEQ ID NO: 1449378 - DNA, 15 bp, Homo sapiens
tggggccagatccag

SEQ ID NO: 1449379 - DNA, 21 bp, Homo sapiens
tggggccagatccagcctggg

SEQ ID NO: 1449380 - DNA, 20 bp, Homo sapiens
tggggccattgcttaccttg

SEQ ID NO: 1449381 - DNA, 19 bp, Homo sapiens
tggggcccagtgcatggtg

SEQ ID NO: 1449382 - DNA, 16 bp, Homo sapiens
tggggcccctggccca

SEQ ID NO: 1449383 - DNA, 20 bp, Homo sapiens
tggggccgccacggcctggc

SEQ ID NO: 1449384 - DNA, 15 bp, Homo sapiens
tggggccgctggggt

SEQ ID NO: 1449385 - DNA, 18 bp, Homo sapiens
tggggccggcggggccca

SEQ ID NO: 1449386 - DNA, 15 bp, Homo sapiens
tggggccggggctga

SEQ ID NO: 1449387 - DNA, 18 bp, Homo sapiens
tggggcctacagctttga

SEQ ID NO: 1449388 - DNA, 18 bp, Homo sapiens
tggggcctccagaagctg

SEQ ID NO: 1449389 - DNA, 22 bp, Homo sapiens
tggggcctccagaagctgctcc

SEQ ID NO: 1449390 - DNA, 13 bp, Homo sapiens
tggggcctgactg

SEQ ID NO: 1449391 - DNA, 18 bp, Homo sapiens
tggggcctgactgctcag

SEQ ID NO: 1449392 - DNA, 13 bp, Homo sapiens
tggggcctgccct

SEQ ID NO: 1449393 - DNA, 15 bp, Homo sapiens
tggggcctggacctg

SEQ ID NO: 1449394 - DNA, 19 bp, Homo sapiens
tggggcctggacctgcctc

SEQ ID NO: 1449395 - DNA, 12 bp, Homo sapiens
tggggcctggct

SEQ ID NO: 1449396 - DNA, 14 bp, Homo sapiens
tggggcctggcttg

SEQ ID NO: 1449397 - DNA, 22 bp, Homo sapiens
tggggcctggcttgctccaggg

SEQ ID NO: 1449398 - DNA, 14 bp, Homo sapiens
tggggcctgggagg

SEQ ID NO: 1449399 - DNA, 12 bp, Homo sapiens
tggggcgctccc

SEQ ID NO: 1449400 - DNA, 14 bp, Homo sapiens
tggggcgtggggag

SEQ ID NO: 1449401 - DNA, 20 bp, Homo sapiens
tggggctaaagactgatctc

SEQ ID NO: 1449402 - DNA, 23 bp, Homo sapiens
tggggctaggggaagggctttga

SEQ ID NO: 1449403 - DNA, 17 bp, Homo sapiens
tggggctcacacacctg

SEQ ID NO: 1449404 - DNA, 15 bp, Homo sapiens
tggggctccctctct

SEQ ID NO: 1449405 - DNA, 23 bp, Homo sapiens
tggggctcctttctccagccagc

SEQ ID NO: 1449406 - DNA, 13 bp, Homo sapiens
tggggctcgccat

SEQ ID NO: 1449407 - DNA, 20 bp, Homo sapiens
tggggctcgtggccttcccc

SEQ ID NO: 1449408 - DNA, 15 bp, Homo sapiens
tggggctgagcctga

SEQ ID NO: 1449409 - DNA, 17 bp, Homo sapiens
tggggctgatgaagaag

SEQ ID NO: 1449410 - DNA, 20 bp, Homo sapiens
tggggctgatgaagaagggg

SEQ ID NO: 1449411 - DNA, 14 bp, Homo sapiens
tggggctgattgta

SEQ ID NO: 1449412 - DNA, 20 bp, Homo sapiens
tggggctgcagttggtctcc

SEQ ID NO: 1449413 - DNA, 20 bp, Homo sapiens
tggggctgccggatctgggc

SEQ ID NO: 1449414 - DNA, 20 bp, Homo sapiens
tggggctgcgggacagagga

SEQ ID NO: 1449415 - DNA, 15 bp, Homo sapiens
tggggctgctcctcc

SEQ ID NO: 1449416 - DNA, 16 bp, Homo sapiens
tggggctgctcctcca

SEQ ID NO: 1449417 - DNA, 13 bp, Homo sapiens
tggggctggcatc

SEQ ID NO: 1449418 - DNA, 16 bp, Homo sapiens
tggggctggggtcctc

SEQ ID NO: 1449419 - DNA, 23 bp, Homo sapiens
tggggctgtatttatctctgagg

SEQ ID NO: 1449420 - DNA, 20 bp, Homo sapiens
tggggcttcaccagtctgtc

SEQ ID NO: 1449421 - DNA, 22 bp, Homo sapiens
tggggcttcaccagtctgtcta

SEQ ID NO: 1449422 - DNA, 20 bp, Homo sapiens
tgggggaactcagatccagg

SEQ ID NO: 1449423 - DNA, 14 bp, Homo sapiens
tgggggaagccctg

SEQ ID NO: 1449424 - DNA, 11 bp, Homo sapiens
tgggggagaga

SEQ ID NO: 1449425 - DNA, 16 bp, Homo sapiens
tgggggatctgggcaa

SEQ ID NO: 1449426 - DNA, 13 bp, Homo sapiens
tgggggcagaggg

SEQ ID NO: 1449427 - DNA, 18 bp, Homo sapiens
tgggggcagagggcagag

SEQ ID NO: 1449428 - DNA, 19 bp, Homo sapiens
tgggggcagtgactggcag

SEQ ID NO: 1449429 - DNA, 20 bp, Homo sapiens
tgggggcagtgactggcagg

SEQ ID NO: 1449430 - DNA, 20 bp, Homo sapiens
tgggggcgccctctctgctc

SEQ ID NO: 1449431 - DNA, 14 bp, Homo sapiens
tgggggctgcagca

SEQ ID NO: 1449432 - DNA, 14 bp, Homo sapiens
tgggggctgtcctg

SEQ ID NO: 1449433 - DNA, 20 bp, Homo sapiens
tggggggatggtaagagaaa

SEQ ID NO: 1449434 - DNA, 19 bp, Homo sapiens
tgggggggagggagggcta

SEQ ID NO: 1449435 - DNA, 17 bp, Homo sapiens
tggggggtccagtctgt

SEQ ID NO: 1449436 - DNA, 15 bp, Homo sapiens
tgggggtagagctga

SEQ ID NO: 1449437 - DNA, 17 bp, Homo sapiens
tgggggtcatcagggag

SEQ ID NO: 1449438 - DNA, 13 bp, Homo sapiens
tgggggtcctctc

SEQ ID NO: 1449439 - DNA, 21 bp, Homo sapiens
tgggggtcctctctgagtcaa

SEQ ID NO: 1449440 - DNA, 23 bp, Homo sapiens
tgggggtggggaggcccaaatga

SEQ ID NO: 1449441 - DNA, 16 bp, Homo sapiens
tggggtaagccagagc

SEQ ID NO: 1449442 - DNA, 20 bp, Homo sapiens
tggggtacaggtttggggag

SEQ ID NO: 1449443 - DNA, 16 bp, Homo sapiens
tggggtacatttctct

SEQ ID NO: 1449444 - DNA, 13 bp, Homo sapiens
tggggtagggctg

SEQ ID NO: 1449445 - DNA, 19 bp, Homo sapiens
tggggtataggtctcatct

SEQ ID NO: 1449446 - DNA, 15 bp, Homo sapiens
tggggtccctccacc

SEQ ID NO: 1449447 - DNA, 19 bp, Homo sapiens
tggggtccctccaccccac

SEQ ID NO: 1449448 - DNA, 21 bp, Homo sapiens
tggggtctcacagtgttgccc

SEQ ID NO: 1449449 - DNA, 19 bp, Homo sapiens
tggggtctccctctcctgc

SEQ ID NO: 1449450 - DNA, 16 bp, Homo sapiens
tggggtctgtgactgg

SEQ ID NO: 1449451 - DNA, 18 bp, Homo sapiens
tggggtctgtgactggat

SEQ ID NO: 1449452 - DNA, 19 bp, Homo sapiens
tggggtctgtgactggatc

SEQ ID NO: 1449453 - DNA, 20 bp, Homo sapiens
tggggtctgtgactggatct

SEQ ID NO: 1449454 - DNA, 16 bp, Homo sapiens
tggggtgaacagctgg

SEQ ID NO: 1449455 - DNA, 21 bp, Homo sapiens
cctgtgctggtgtcctgacca

SEQ ID NO: 1449456 - DNA, 21 bp, Homo sapiens
cctgtgctgtcagataccctg

SEQ ID NO: 1449457 - DNA, 13 bp, Homo sapiens
cctgtggacagga

SEQ ID NO: 1449458 - DNA, 22 bp, Homo sapiens
cctgtggacaggatgaggacag

SEQ ID NO: 1449459 - DNA, 23 bp, Homo sapiens
cctgtggacaggatgaggacaga

SEQ ID NO: 1449460 - DNA, 17 bp, Homo sapiens
cctgtggagtccagctc

SEQ ID NO: 1449461 - DNA, 20 bp, Homo sapiens
cctgtggagtccagctctac

SEQ ID NO: 1449462 - DNA, 12 bp, Homo sapiens
cctgtggatatt

SEQ ID NO: 1449463 - DNA, 14 bp, Homo sapiens
cctgtggcacagcc

SEQ ID NO: 1449464 - DNA, 15 bp, Homo sapiens
cctgtggcacagccc

SEQ ID NO: 1449465 - DNA, 22 bp, Homo sapiens
cctgtggcacagccctgagtgt

SEQ ID NO: 1449466 - DNA, 20 bp, Homo sapiens
cctgtggcagaaaagaggag

SEQ ID NO: 1449467 - DNA, 14 bp, Homo sapiens
cctgtggcagctgc

SEQ ID NO: 1449468 - DNA, 17 bp, Homo sapiens
cctgtggcagctgcccc

SEQ ID NO: 1449469 - DNA, 18 bp, Homo sapiens
cctgtggcagctgcccct

SEQ ID NO: 1449470 - DNA, 19 bp, Homo sapiens
cctgtggcagctgcccctg

SEQ ID NO: 1449471 - DNA, 18 bp, Homo sapiens
cctgtggcataaattgca

SEQ ID NO: 1449472 - DNA, 16 bp, Homo sapiens
cctgtggccaactgca

SEQ ID NO: 1449473 - DNA, 17 bp, Homo sapiens
cctgtggccaactgcaa

SEQ ID NO: 1449474 - DNA, 12 bp, Homo sapiens
cctgtggccagg

SEQ ID NO: 1449475 - DNA, 14 bp, Homo sapiens
cctgtggccaggag

SEQ ID NO: 1449476 - DNA, 22 bp, Homo sapiens
cctgtggccccaccctgggccc

SEQ ID NO: 1449477 - DNA, 14 bp, Homo sapiens
cctgtggccctggc

SEQ ID NO: 1449478 - DNA, 14 bp, Homo sapiens
tgggtatcccctgc

SEQ ID NO: 1449479 - DNA, 23 bp, Homo sapiens
tgggtatcccctgcctcctgcca

SEQ ID NO: 1449480 - DNA, 20 bp, Homo sapiens
tgggtatcctgcccagtgtt

SEQ ID NO: 1449481 - DNA, 15 bp, Homo sapiens
tgggtatgctcaggt

SEQ ID NO: 1449482 - DNA, 20 bp, Homo sapiens
tgggtcaacttgacaccact

SEQ ID NO: 1449483 - DNA, 12 bp, Homo sapiens
tgggtcacagga

SEQ ID NO: 1449484 - DNA, 17 bp, Homo sapiens
tgggtcacatccatccc

SEQ ID NO: 1449485 - DNA, 18 bp, Homo sapiens
tgggtcactacagggaga

SEQ ID NO: 1449486 - DNA, 14 bp, Homo sapiens
tgggtcagagaaaa

SEQ ID NO: 1449487 - DNA, 16 bp, Homo sapiens
tgggtcagcccagcac

SEQ ID NO: 1449488 - DNA, 16 bp, Homo sapiens
tgggtccaccatgcag

SEQ ID NO: 1449489 - DNA, 12 bp, Homo sapiens
tgggtccaggaa

SEQ ID NO: 1449490 - DNA, 20 bp, Homo sapiens
tgggtccaggaaggcagctg

SEQ ID NO: 1449491 - DNA, 21 bp, Homo sapiens
tgggtccaggaaggcagctgc

SEQ ID NO: 1449492 - DNA, 22 bp, Homo sapiens
tgggtccaggaaggcagctgct

SEQ ID NO: 1449493 - DNA, 23 bp, Homo sapiens
tgggtccaggaaggcagctgctc

SEQ ID NO: 1449494 - DNA, 21 bp, Homo sapiens
tgggtccagggcctgacaccc

SEQ ID NO: 1449495 - DNA, 16 bp, Homo sapiens
tgggtccattcagatg

SEQ ID NO: 1449496 - DNA, 17 bp, Homo sapiens
tgggtcccccacgtgac

SEQ ID NO: 1449497 - DNA, 23 bp, Homo sapiens
tgggtccccccgagtctccggga

SEQ ID NO: 1449498 - DNA, 11 bp, Homo sapiens
tgggtcctggg

SEQ ID NO: 1449499 - DNA, 14 bp, Homo sapiens
tgggtcctgggcag

SEQ ID NO: 1449500 - DNA, 15 bp, Homo sapiens
tgggtcctgggcagg

SEQ ID NO: 1449501 - DNA, 17 bp, Homo sapiens
tgggtccttgatgccag

SEQ ID NO: 1449502 - DNA, 20 bp, Homo sapiens
tgggtccttgatgccagagg

SEQ ID NO: 1449503 - DNA, 23 bp, Homo sapiens
tgggtctaaggggttggttgagg

SEQ ID NO: 1449504 - DNA, 22 bp, Homo sapiens
tgggtctcgctttgttgcccag

SEQ ID NO: 1449505 - DNA, 15 bp, Homo sapiens
tgggtctgacctggt

SEQ ID NO: 1449506 - DNA, 16 bp, Homo sapiens
tgggtctgacctggtg

SEQ ID NO: 1449507 - DNA, 17 bp, Homo sapiens
tgggtctgacctggtgg

SEQ ID NO: 1449508 - DNA, 13 bp, Homo sapiens
tgggtctgtgtgt

SEQ ID NO: 1449509 - DNA, 15 bp, Homo sapiens
tgggtctgtgtgtgt

SEQ ID NO: 1449510 - DNA, 18 bp, Homo sapiens
tgggtcttggaccagggc

SEQ ID NO: 1449511 - DNA, 22 bp, Homo sapiens
tgggtcttgttttttttttcca

SEQ ID NO: 1449512 - DNA, 15 bp, Homo sapiens
tgggtgaccaggtcc

SEQ ID NO: 1449513 - DNA, 20 bp, Homo sapiens
tgggtgattcctaagccact

SEQ ID NO: 1449514 - DNA, 18 bp, Homo sapiens
tgggtgattcctcccagg

SEQ ID NO: 1449515 - DNA, 20 bp, Homo sapiens
tgggtgattcctcccaggag

SEQ ID NO: 1449516 - DNA, 23 bp, Homo sapiens
tgggtgccccccttgccagacat

SEQ ID NO: 1449517 - DNA, 20 bp, Homo sapiens
tgggtgcccgtatccagagt

SEQ ID NO: 1449518 - DNA, 15 bp, Homo sapiens
tgggtgccctctcca

SEQ ID NO: 1449519 - DNA, 12 bp, Homo sapiens
tgggtgccctga

SEQ ID NO: 1449520 - DNA, 14 bp, Homo sapiens
tgggtgctggctgc

SEQ ID NO: 1449521 - DNA, 18 bp, Homo sapiens
tgggtggaagtgcccagc

SEQ ID NO: 1449522 - DNA, 15 bp, Homo sapiens
tgggtggagaaggga

SEQ ID NO: 1449523 - DNA, 14 bp, Homo sapiens
tgggtggcacctcc

SEQ ID NO: 1449524 - DNA, 23 bp, Homo sapiens
tgggtgggagtgtgtctgctgag

SEQ ID NO: 1449525 - DNA, 16 bp, Homo sapiens
tgggtgggattttgca

SEQ ID NO: 1449526 - DNA, 13 bp, Homo sapiens
tgggtggggctgc

SEQ ID NO: 1449527 - DNA, 14 bp, Homo sapiens
tgggtgggtggtgg

SEQ ID NO: 1449528 - DNA, 14 bp, Homo sapiens
tgggtggtaccctc

SEQ ID NO: 1449529 - DNA, 18 bp, Homo sapiens
tgggtggtaccctctgga

SEQ ID NO: 1449530 - DNA, 23 bp, Homo sapiens
tgggtgtaacaggtctcctctta

SEQ ID NO: 1449531 - DNA, 16 bp, Homo sapiens
tgggtgtattctctgt

SEQ ID NO: 1449532 - DNA, 15 bp, Homo sapiens
tgggtgtcctgcctg

SEQ ID NO: 1449533 - DNA, 13 bp, Homo sapiens
tgggtgtggccag

SEQ ID NO: 1449534 - DNA, 12 bp, Homo sapiens
tgggtgtgtcca

SEQ ID NO: 1449535 - DNA, 15 bp, Homo sapiens
tgggtgttattttta

SEQ ID NO: 1449536 - DNA, 15 bp, Homo sapiens
tgggtgtttcagttt

SEQ ID NO: 1449537 - DNA, 14 bp, Homo sapiens
tgggtgtttccaga

SEQ ID NO: 1449538 - DNA, 15 bp, Homo sapiens
tgggtgtttccagaa

SEQ ID NO: 1449539 - DNA, 17 bp, Homo sapiens
tgggtgtttttcatgtt

SEQ ID NO: 1449540 - DNA, 19 bp, Homo sapiens
tgggtgtttttcatgtttt

SEQ ID NO: 1449541 - DNA, 19 bp, Homo sapiens
tgggttaaatattttgcta

SEQ ID NO: 1449542 - DNA, 15 bp, Homo sapiens
tgggttaacaaatga

SEQ ID NO: 1449543 - DNA, 22 bp, Homo sapiens
tgggttaggcattaatgtttct

SEQ ID NO: 1449544 - DNA, 21 bp, Homo sapiens
tgggttcagaaatgctgcctg

SEQ ID NO: 1449545 - DNA, 22 bp, Homo sapiens
tgggttcagaaatgctgcctgc

SEQ ID NO: 1449546 - DNA, 12 bp, Homo sapiens
tgggttccagag

SEQ ID NO: 1449547 - DNA, 13 bp, Homo sapiens
tgggttcctcttc

SEQ ID NO: 1449548 - DNA, 18 bp, Homo sapiens
tgggttgtgcacatttct

SEQ ID NO: 1449549 - DNA, 16 bp, Homo sapiens
tgggttgttggtctgt

SEQ ID NO: 1449550 - DNA, 15 bp, Homo sapiens
tgggtttctaagcag

SEQ ID NO: 1449551 - DNA, 18 bp, Homo sapiens
tgggtttctcattaaagt

SEQ ID NO: 1449552 - DNA, 17 bp, Homo sapiens
tgggtttctctgtgctc

SEQ ID NO: 1449553 - DNA, 19 bp, Homo sapiens
tgggtttggaccccagctg

SEQ ID NO: 1449554 - DNA, 19 bp, Homo sapiens
tgggttttctatttgaaca

SEQ ID NO: 1449555 - DNA, 18 bp, Homo sapiens
tggtaaaaagatccaggg

SEQ ID NO: 1449556 - DNA, 12 bp, Homo sapiens
tggtaaaaatgc

SEQ ID NO: 1449557 - DNA, 19 bp, Homo sapiens
tggtaaaaatgctgctctc

SEQ ID NO: 1449558 - DNA, 17 bp, Homo sapiens
tggtaaagtagttgatt

SEQ ID NO: 1449559 - DNA, 17 bp, Homo sapiens
tggtaaatactgtgaaa

SEQ ID NO: 1449560 - DNA, 20 bp, Homo sapiens
tggtaaatactgtgaaatac

SEQ ID NO: 1449561 - DNA, 15 bp, Homo sapiens
tggtaaattcagaca

SEQ ID NO: 1449562 - DNA, 21 bp, Homo sapiens
tggtaaattcagacaacatta

SEQ ID NO: 1449563 - DNA, 23 bp, Homo sapiens
tggtaaattcagacaacattatg

SEQ ID NO: 1449564 - DNA, 21 bp, Homo sapiens
tggtaacagttcatgtttgct

SEQ ID NO: 1449565 - DNA, 22 bp, Homo sapiens
tggtaaccaaatattaaagatt

SEQ ID NO: 1449566 - DNA, 16 bp, Homo sapiens
tggtaactgccagcct

SEQ ID NO: 1449567 - DNA, 18 bp, Homo sapiens
tggtaactgccagccttg

SEQ ID NO: 1449568 - DNA, 21 bp, Homo sapiens
tggtaactggaaggccttcca

SEQ ID NO: 1449569 - DNA, 14 bp, Homo sapiens
tggtaacttttgtg

SEQ ID NO: 1449570 - DNA, 17 bp, Homo sapiens
tggtaagcgatttgaaa

SEQ ID NO: 1449571 - DNA, 19 bp, Homo sapiens
tggtaaggcctctggactg

SEQ ID NO: 1449572 - DNA, 21 bp, Homo sapiens
tggtaagggggtccctgtgct

SEQ ID NO: 1449573 - DNA, 20 bp, Homo sapiens
ccttaagcagaacaaatgtg

SEQ ID NO: 1449574 - DNA, 22 bp, Homo sapiens
ccttaagttttagtctttagaa

SEQ ID NO: 1449575 - DNA, 14 bp, Homo sapiens
ccttaataaatatg

SEQ ID NO: 1449576 - DNA, 23 bp, Homo sapiens
ccttaataaatatgtaatataaa

SEQ ID NO: 1449577 - DNA, 19 bp, Homo sapiens
ccttaatattgaggctgca

SEQ ID NO: 1449578 - DNA, 23 bp, Homo sapiens
ccttaatcaggtcctcagagaat

SEQ ID NO: 1449579 - DNA, 23 bp, Homo sapiens
ccttaatctaatctaaaagctct

SEQ ID NO: 1449580 - DNA, 16 bp, Homo sapiens
ccttaatcttgctttc

SEQ ID NO: 1449581 - DNA, 13 bp, Homo sapiens
ccttaatttcctt

SEQ ID NO: 1449582 - DNA, 20 bp, Homo sapiens
ccttaatttcctttttgaca

SEQ ID NO: 1449583 - DNA, 16 bp, Homo sapiens
ccttaatttgcacagt

SEQ ID NO: 1449584 - DNA, 23 bp, Homo sapiens
ccttacaaagggaaagcctctgg

SEQ ID NO: 1449585 - DNA, 14 bp, Homo sapiens
ccttacagaaaatt

SEQ ID NO: 1449586 - DNA, 13 bp, Homo sapiens
ccttacctcctgc

SEQ ID NO: 1449587 - DNA, 14 bp, Homo sapiens
ccttacctcctgcc

SEQ ID NO: 1449588 - DNA, 18 bp, Homo sapiens
ccttacctcctgcccagg

SEQ ID NO: 1449589 - DNA, 14 bp, Homo sapiens
ccttacctttttat

SEQ ID NO: 1449590 - DNA, 18 bp, Homo sapiens
ccttactctgagcccagg

SEQ ID NO: 1449591 - DNA, 22 bp, Homo sapiens
ccttactcttcttgaaatttta

SEQ ID NO: 1449592 - DNA, 23 bp, Homo sapiens
ccttactgacctcacctaggaag

SEQ ID NO: 1449593 - DNA, 18 bp, Homo sapiens
ccttagaacctttcttac

SEQ ID NO: 1449594 - DNA, 19 bp, Homo sapiens
ccttagacccgccaggtca

SEQ ID NO: 1449595 - DNA, 16 bp, Homo sapiens
ccttagagacatcaaa

SEQ ID NO: 1449596 - DNA, 15 bp, Homo sapiens
ccttagccctgtctg

SEQ ID NO: 1449597 - DNA, 13 bp, Homo sapiens
ccttagcctctcc

SEQ ID NO: 1449598 - DNA, 14 bp, Homo sapiens
ccttagcctctccc

SEQ ID NO: 1449599 - DNA, 15 bp, Homo sapiens
ccttagcctctccca

SEQ ID NO: 1449600 - DNA, 15 bp, Homo sapiens
ccttagcgttctgga

SEQ ID NO: 1449601 - DNA, 19 bp, Homo sapiens
ccttagcttagacctcagc

SEQ ID NO: 1449602 - DNA, 16 bp, Homo sapiens
ccttaggtttgacatg

SEQ ID NO: 1449603 - DNA, 14 bp, Homo sapiens
ccttatagttactg

SEQ ID NO: 1449604 - DNA, 21 bp, Homo sapiens
ccttatcacccccttgttgta

SEQ ID NO: 1449605 - DNA, 14 bp, Homo sapiens
ccttatccccactt

SEQ ID NO: 1449606 - DNA, 14 bp, Homo sapiens
ccttatccctctct

SEQ ID NO: 1449607 - DNA, 16 bp, Homo sapiens
ccttatccctctcttc

SEQ ID NO: 1449608 - DNA, 13 bp, Homo sapiens
ccttatctgtttt

SEQ ID NO: 1449609 - DNA, 19 bp, Homo sapiens
ccttatgaccagtgagaac

SEQ ID NO: 1449610 - DNA, 19 bp, Homo sapiens
ccttatgcatgaaatgaat

SEQ ID NO: 1449611 - DNA, 15 bp, Homo sapiens
ccttatgggctgaag

SEQ ID NO: 1449612 - DNA, 19 bp, Homo sapiens
ccttatgggctgaagtgtt

SEQ ID NO: 1449613 - DNA, 14 bp, Homo sapiens
ccttattgcctccc

SEQ ID NO: 1449614 - DNA, 18 bp, Homo sapiens
ccttattgctgtcctgga

SEQ ID NO: 1449615 - DNA, 16 bp, Homo sapiens
ccttattgtacctctc

SEQ ID NO: 1449616 - DNA, 20 bp, Homo sapiens
ccttatttgtctgtaaaaaa

SEQ ID NO: 1449617 - DNA, 18 bp, Homo sapiens
ccttattttcaagaaact

SEQ ID NO: 1449618 - DNA, 20 bp, Homo sapiens
ccttattttgagtaaatatt

SEQ ID NO: 1449619 - DNA, 13 bp, Homo sapiens
ccttcaactgaaa

SEQ ID NO: 1449620 - DNA, 22 bp, Homo sapiens
ccttcaagaatcagaagaaagg

SEQ ID NO: 1449621 - DNA, 23 bp, Homo sapiens
ccttcaaggactgtttcagtgtg

SEQ ID NO: 1449622 - DNA, 14 bp, Homo sapiens
ccttcaagtgccaa

SEQ ID NO: 1449623 - DNA, 15 bp, Homo sapiens
ccttcaagtgccaaa

SEQ ID NO: 1449624 - DNA, 16 bp, Homo sapiens
ccttcaagtgccaaac

SEQ ID NO: 1449625 - DNA, 17 bp, Homo sapiens
ccttcaagttagctcag

SEQ ID NO: 1449626 - DNA, 15 bp, Homo sapiens
ccttcaattcctggg

SEQ ID NO: 1449627 - DNA, 16 bp, Homo sapiens
ccttcaattcctgggc

SEQ ID NO: 1449628 - DNA, 20 bp, Homo sapiens
ccttcaattcctgggcccca

SEQ ID NO: 1449629 - DNA, 18 bp, Homo sapiens
ccttcacaggcagtgcat

SEQ ID NO: 1449630 - DNA, 20 bp, Homo sapiens
ccttcacatcctgtgtttct

SEQ ID NO: 1449631 - DNA, 23 bp, Homo sapiens
ccttcaccaatagtctctctgca

SEQ ID NO: 1449632 - DNA, 13 bp, Homo sapiens
ccttcaccagagc

SEQ ID NO: 1449633 - DNA, 22 bp, Homo sapiens
ccttcaccagagcccatgctca

SEQ ID NO: 1449634 - DNA, 19 bp, Homo sapiens
ccttcacctttggtgcaga

SEQ ID NO: 1449635 - DNA, 16 bp, Homo sapiens
ccttcactggcgcctt

SEQ ID NO: 1449636 - DNA, 18 bp, Homo sapiens
ccttcactggcgccttct

SEQ ID NO: 1449637 - DNA, 22 bp, Homo sapiens
ccttcactgtgctccaacctga

SEQ ID NO: 1449638 - DNA, 20 bp, Homo sapiens
ccttcactgttccctctggc

SEQ ID NO: 1449639 - DNA, 10 bp, Homo sapiens
ccttcagaca

SEQ ID NO: 1449640 - DNA, 11 bp, Homo sapiens
ccttcagacac

SEQ ID NO: 1449641 - DNA, 23 bp, Homo sapiens
ccttcagacacatgctatgttct

SEQ ID NO: 1449642 - DNA, 17 bp, Homo sapiens
ccttcagacaccctcaa

SEQ ID NO: 1449643 - DNA, 20 bp, Homo sapiens
ccttcagacaccctcaacct

SEQ ID NO: 1449644 - DNA, 21 bp, Homo sapiens
ccttcagactttgcttcccat

SEQ ID NO: 1449645 - DNA, 21 bp, Homo sapiens
ccttcagcagcagctcacacc

SEQ ID NO: 1449646 - DNA, 12 bp, Homo sapiens
ccttcagctcca

SEQ ID NO: 1449647 - DNA, 15 bp, Homo sapiens
ccttcagggccagaa

SEQ ID NO: 1449648 - DNA, 12 bp, Homo sapiens
ccttcagtctgc

SEQ ID NO: 1449649 - DNA, 20 bp, Homo sapiens
ccttcagtcttgaatttcta

SEQ ID NO: 1449650 - DNA, 21 bp, Homo sapiens
ccttcagtcttgaatttctaa

SEQ ID NO: 1449651 - DNA, 12 bp, Homo sapiens
ccttcagtgccc

SEQ ID NO: 1449652 - DNA, 16 bp, Homo sapiens
ccttcagtttgtaaag

SEQ ID NO: 1449653 - DNA, 21 bp, Homo sapiens
ccttcataccgcctcgtgcca

SEQ ID NO: 1449654 - DNA, 21 bp, Homo sapiens
ccttcataggcggtcatgtgt

SEQ ID NO: 1449655 - DNA, 18 bp, Homo sapiens
ccttcatccgcctgtggg

SEQ ID NO: 1449656 - DNA, 15 bp, Homo sapiens
ccttcatctccaggg

SEQ ID NO: 1449657 - DNA, 17 bp, Homo sapiens
ccttcatctccagggag

SEQ ID NO: 1449658 - DNA, 16 bp, Homo sapiens
ccttcatggccccagc

SEQ ID NO: 1449659 - DNA, 21 bp, Homo sapiens
ccttcattaccttttttgata

SEQ ID NO: 1449660 - DNA, 18 bp, Homo sapiens
ccttcattccgttaggaa

SEQ ID NO: 1449661 - DNA, 17 bp, Homo sapiens
ccttccaaacctgagaa

SEQ ID NO: 1449662 - DNA, 13 bp, Homo sapiens
ccttccacctcag

SEQ ID NO: 1449663 - DNA, 13 bp, Homo sapiens
ccttccacctgcc

SEQ ID NO: 1449664 - DNA, 20 bp, Homo sapiens
ccttccacggatccatgtag

SEQ ID NO: 1449665 - DNA, 20 bp, Homo sapiens
ccttccagatcactgccaca

SEQ ID NO: 1449666 - DNA, 12 bp, Homo sapiens
ccttccagctcc

SEQ ID NO: 1449667 - DNA, 15 bp, Homo sapiens
ccttccagctcctgt

SEQ ID NO: 1449668 - DNA, 16 bp, Homo sapiens
ccttccagctcctgta

SEQ ID NO: 1449669 - DNA, 13 bp, Homo sapiens
ccttccagctgct

SEQ ID NO: 1449670 - DNA, 13 bp, Homo sapiens
ccttccaggtcag

SEQ ID NO: 1449671 - DNA, 13 bp, Homo sapiens
ccttccaggtggg

SEQ ID NO: 1449672 - DNA, 12 bp, Homo sapiens
ccttccataatt

SEQ ID NO: 1449673 - DNA, 15 bp, Homo sapiens
ccttccataattatg

SEQ ID NO: 1449674 - DNA, 23 bp, Homo sapiens
ccttccatagcctaatccctggg

SEQ ID NO: 1449675 - DNA, 19 bp, Homo sapiens
ccttccatcagcgggtctc

SEQ ID NO: 1449676 - DNA, 12 bp, Homo sapiens
ccttccatccct

SEQ ID NO: 1449677 - DNA, 19 bp, Homo sapiens
ccttccatccctaccccct

SEQ ID NO: 1449678 - DNA, 17 bp, Homo sapiens
ccttccatctcgccacc

SEQ ID NO: 1449679 - DNA, 15 bp, Homo sapiens
ccttccatcttcaca

SEQ ID NO: 1449680 - DNA, 16 bp, Homo sapiens
ccttccatcttgtggg

SEQ ID NO: 1449681 - DNA, 19 bp, Homo sapiens
ccttccatgtgcctttctt

SEQ ID NO: 1449682 - DNA, 13 bp, Homo sapiens
ccttccattccac

SEQ ID NO: 1449683 - DNA, 20 bp, Homo sapiens
ccttccattttcccccacta

SEQ ID NO: 1449684 - DNA, 18 bp, Homo sapiens
ccttcccaatcagcactg

SEQ ID NO: 1449685 - DNA, 19 bp, Homo sapiens
ccttcccaatcagcactga

SEQ ID NO: 1449686 - DNA, 21 bp, Homo sapiens
ccttcccaatcagcactgaaa

SEQ ID NO: 1449687 - DNA, 22 bp, Homo sapiens
ccttcccacccatcgctgtgtg

SEQ ID NO: 1449688 - DNA, 14 bp, Homo sapiens
ccttcccagaccag

SEQ ID NO: 1449689 - DNA, 12 bp, Homo sapiens
ccttcccaggcc

SEQ ID NO: 1449690 - DNA, 13 bp, Homo sapiens
tggtaatagaata

SEQ ID NO: 1449691 - DNA, 17 bp, Homo sapiens
tggtaatctttacctgt

SEQ ID NO: 1449692 - DNA, 12 bp, Homo sapiens
tggtaattcact

SEQ ID NO: 1449693 - DNA, 13 bp, Homo sapiens
tggtaattgtaca

SEQ ID NO: 1449694 - DNA, 13 bp, Homo sapiens
tggtaatttttgt

SEQ ID NO: 1449695 - DNA, 17 bp, Homo sapiens
tggtacagcttctggag

SEQ ID NO: 1449696 - DNA, 20 bp, Homo sapiens
tggtacaggaaggcttgcag

SEQ ID NO: 1449697 - DNA, 21 bp, Homo sapiens
tggtacaggaaggcttgcagt

SEQ ID NO: 1449698 - DNA, 18 bp, Homo sapiens
tggtacatggtgtttgtg

SEQ ID NO: 1449699 - DNA, 13 bp, Homo sapiens
tggtacatgtctt

SEQ ID NO: 1449700 - DNA, 21 bp, Homo sapiens
tggtaccaatcatgaatcttt

SEQ ID NO: 1449701 - DNA, 18 bp, Homo sapiens
tggtacccagccatctgc

SEQ ID NO: 1449702 - DNA, 21 bp, Homo sapiens
tggtacccagccatctgccca

SEQ ID NO: 1449703 - DNA, 22 bp, Homo sapiens
tggtacccagccatctgcccag

SEQ ID NO: 1449704 - DNA, 17 bp, Homo sapiens
tggtactcattaaaaaa

SEQ ID NO: 1449705 - DNA, 17 bp, Homo sapiens
tggtactccctctcagg

SEQ ID NO: 1449706 - DNA, 17 bp, Homo sapiens
tggtacttattactgct

SEQ ID NO: 1449707 - DNA, 18 bp, Homo sapiens
tggcctgggccacacctg

SEQ ID NO: 1449708 - DNA, 16 bp, Homo sapiens
tggcctgggcgacaga

SEQ ID NO: 1449709 - DNA, 15 bp, Homo sapiens
tggcctggtccctgg

SEQ ID NO: 1449710 - DNA, 16 bp, Homo sapiens
tggcctggtccctggt

SEQ ID NO: 1449711 - DNA, 17 bp, Homo sapiens
tggcctggtccctggtc

SEQ ID NO: 1449712 - DNA, 16 bp, Homo sapiens
tggcctgtgctgggcc

SEQ ID NO: 1449713 - DNA, 12 bp, Homo sapiens
tggcctgtggca

SEQ ID NO: 1449714 - DNA, 15 bp, Homo sapiens
tggcctgtggcacag

SEQ ID NO: 1449715 - DNA, 20 bp, Homo sapiens
tggcctgtggcacagccctg

SEQ ID NO: 1449716 - DNA, 13 bp, Homo sapiens
tggcctgtgtcca

SEQ ID NO: 1449717 - DNA, 21 bp, Homo sapiens
tggcctgtgtccagcagctgc

SEQ ID NO: 1449718 - DNA, 22 bp, Homo sapiens
tggcctgtgtccagcagctgcg

SEQ ID NO: 1449719 - DNA, 19 bp, Homo sapiens
tggccttaaaaggggccca

SEQ ID NO: 1449720 - DNA, 23 bp, Homo sapiens
tggccttaaaaggggcccaagcc

SEQ ID NO: 1449721 - DNA, 16 bp, Homo sapiens
tggccttaaagaggga

SEQ ID NO: 1449722 - DNA, 14 bp, Homo sapiens
tggccttaagaact

SEQ ID NO: 1449723 - DNA, 20 bp, Homo sapiens
tggccttaagaactgtgtct

SEQ ID NO: 1449724 - DNA, 23 bp, Homo sapiens
tggccttaagaactgtgtctggc

SEQ ID NO: 1449725 - DNA, 15 bp, Homo sapiens
tggccttacactgaa

SEQ ID NO: 1449726 - DNA, 22 bp, Homo sapiens
tggccttccccttttgcctggc

SEQ ID NO: 1449727 - DNA, 20 bp, Homo sapiens
tggccttgcagctggcccac

SEQ ID NO: 1449728 - DNA, 16 bp, Homo sapiens
tggcctttttcattta

SEQ ID NO: 1449729 - DNA, 22 bp, Homo sapiens
tggcctttttcatttatctata

SEQ ID NO: 1449730 - DNA, 15 bp, Homo sapiens
tggcgactctgcaga

SEQ ID NO: 1449731 - DNA, 19 bp, Homo sapiens
tggcgactctgcagagtca

SEQ ID NO: 1449732 - DNA, 21 bp, Homo sapiens
tggcgcaggtgccatgcctgc

SEQ ID NO: 1449733 - DNA, 16 bp, Homo sapiens
tggcgcaggtgggctg

SEQ ID NO: 1449734 - DNA, 15 bp, Homo sapiens
tggcgccgtctccag

SEQ ID NO: 1449735 - DNA, 22 bp, Homo sapiens
tggcgccttctcggagctggcc

SEQ ID NO: 1449736 - DNA, 15 bp, Homo sapiens
tggcgcgggaggcac

SEQ ID NO: 1449737 - DNA, 19 bp, Homo sapiens
tggcgcgggaggcaccagc

SEQ ID NO: 1449738 - DNA, 20 bp, Homo sapiens
tggcgcgggaggcaccagct

SEQ ID NO: 1449739 - DNA, 16 bp, Homo sapiens
tggcggaggtctctgg

SEQ ID NO: 1449740 - DNA, 14 bp, Homo sapiens
tggcggccccagca

SEQ ID NO: 1449741 - DNA, 15 bp, Homo sapiens
tggcggctactcagc

SEQ ID NO: 1449742 - DNA, 17 bp, Homo sapiens
tggcggctactcagcag

SEQ ID NO: 1449743 - DNA, 21 bp, Homo sapiens
tggcggctactcagcagccct

SEQ ID NO: 1449744 - DNA, 13 bp, Homo sapiens
tggcggcttcctg

SEQ ID NO: 1449745 - DNA, 18 bp, Homo sapiens
tggcggcttcctgtccac

SEQ ID NO: 1449746 - DNA, 14 bp, Homo sapiens
tggcggggaaccct

SEQ ID NO: 1449747 - DNA, 15 bp, Homo sapiens
tggcggggcagcagg

SEQ ID NO: 1449748 - DNA, 14 bp, Homo sapiens
tggcggtggctgcc

SEQ ID NO: 1449749 - DNA, 18 bp, Homo sapiens
tggcgtaatgggcctgcc

SEQ ID NO: 1449750 - DNA, 13 bp, Homo sapiens
cctggccacctga

SEQ ID NO: 1449751 - DNA, 19 bp, Homo sapiens
cctggccaccttgtcctgg

SEQ ID NO: 1449752 - DNA, 18 bp, Homo sapiens
cctggccacgcagccagg

SEQ ID NO: 1449753 - DNA, 20 bp, Homo sapiens
cctggccactaaagcttcag

SEQ ID NO: 1449754 - DNA, 12 bp, Homo sapiens
cctggccagaca

SEQ ID NO: 1449755 - DNA, 14 bp, Homo sapiens
cctggccagacaca

SEQ ID NO: 1449756 - DNA, 15 bp, Homo sapiens
cctggccagacacag

SEQ ID NO: 1449757 - DNA, 12 bp, Homo sapiens
cctggccaggac

SEQ ID NO: 1449758 - DNA, 14 bp, Homo sapiens
cctggccaggagca

SEQ ID NO: 1449759 - DNA, 14 bp, Homo sapiens
cctggccaggcaga

SEQ ID NO: 1449760 - DNA, 22 bp, Homo sapiens
cctggccaggcagatctgtgcc

SEQ ID NO: 1449761 - DNA, 16 bp, Homo sapiens
cctggccagtcctggt

SEQ ID NO: 1449762 - DNA, 15 bp, Homo sapiens
cctggcccagcggcc

SEQ ID NO: 1449763 - DNA, 12 bp, Homo sapiens
cctggccccatg

SEQ ID NO: 1449764 - DNA, 20 bp, Homo sapiens
cctggccccatgtctctcag

SEQ ID NO: 1449765 - DNA, 20 bp, Homo sapiens
cctggcccccaacctcaggg

SEQ ID NO: 1449766 - DNA, 21 bp, Homo sapiens
cctggcccccaccctctgcca

SEQ ID NO: 1449767 - DNA, 15 bp, Homo sapiens
cctggccccgcctgc

SEQ ID NO: 1449768 - DNA, 23 bp, Homo sapiens
cctggccccgggctctggccacc

SEQ ID NO: 1449769 - DNA, 23 bp, Homo sapiens
cctggcccctccagaccctgcct

SEQ ID NO: 1449770 - DNA, 13 bp, Homo sapiens
cctggccctcact

SEQ ID NO: 1449771 - DNA, 14 bp, Homo sapiens
cctggccctcactc

SEQ ID NO: 1449772 - DNA, 13 bp, Homo sapiens
cctggccctccac

SEQ ID NO: 1449773 - DNA, 20 bp, Homo sapiens
cctggccctccactcctcat

SEQ ID NO: 1449774 - DNA, 17 bp, Homo sapiens
cctggccctgcccagcc

SEQ ID NO: 1449775 - DNA, 13 bp, Homo sapiens
cctggccctgcct

SEQ ID NO: 1449776 - DNA, 14 bp, Homo sapiens
cctggccctgcttc

SEQ ID NO: 1449777 - DNA, 18 bp, Homo sapiens
cctggccctgttctcctc

SEQ ID NO: 1449778 - DNA, 12 bp, Homo sapiens
cctggcccttac

SEQ ID NO: 1449779 - DNA, 13 bp, Homo sapiens
cctggcccttcag

SEQ ID NO: 1449780 - DNA, 14 bp, Homo sapiens
cctggcccttcagt

SEQ ID NO: 1449781 - DNA, 20 bp, Homo sapiens
cctggccgccccctgccccc

SEQ ID NO: 1449782 - DNA, 22 bp, Homo sapiens
cctggccgccccctgcccccca

SEQ ID NO: 1449783 - DNA, 17 bp, Homo sapiens
cctggccgttcagcctg

SEQ ID NO: 1449784 - DNA, 23 bp, Homo sapiens
cctggcctatccgctgccagcct

SEQ ID NO: 1449785 - DNA, 15 bp, Homo sapiens
cctggcctcactggc

SEQ ID NO: 1449786 - DNA, 18 bp, Homo sapiens
cctggcctcactggctgg

SEQ ID NO: 1449787 - DNA, 16 bp, Homo sapiens
cctggcctcagttccc

SEQ ID NO: 1449788 - DNA, 22 bp, Homo sapiens
cctggcctcagttcccagctcc

SEQ ID NO: 1449789 - DNA, 17 bp, Homo sapiens
cctggcctcccctgcca

SEQ ID NO: 1449790 - DNA, 19 bp, Homo sapiens
cctggcctcccctgccacc

SEQ ID NO: 1449791 - DNA, 20 bp, Homo sapiens
cctggcctcccctgccacca

SEQ ID NO: 1449792 - DNA, 18 bp, Homo sapiens
cctggcctcccttctcct

SEQ ID NO: 1449793 - DNA, 11 bp, Homo sapiens
cctggcctcct

SEQ ID NO: 1449794 - DNA, 17 bp, Homo sapiens
cctggcctctgggcagt

SEQ ID NO: 1449795 - DNA, 20 bp, Homo sapiens
cctggcctgaactgaggaga

SEQ ID NO: 1449796 - DNA, 12 bp, Homo sapiens
cctggcctgagc

SEQ ID NO: 1449797 - DNA, 17 bp, Homo sapiens
cctggcctgagctgggg

SEQ ID NO: 1449798 - DNA, 14 bp, Homo sapiens
cctggcctgctggg

SEQ ID NO: 1449799 - DNA, 15 bp, Homo sapiens
cctggcctgctggga

SEQ ID NO: 1449800 - DNA, 14 bp, Homo sapiens
cctggcctgggcca

SEQ ID NO: 1449801 - DNA, 15 bp, Homo sapiens
cctggcctggtccct

SEQ ID NO: 1449802 - DNA, 18 bp, Homo sapiens
cctggcctggtccctggt

SEQ ID NO: 1449803 - DNA, 13 bp, Homo sapiens
cctggccttctga

SEQ ID NO: 1449804 - DNA, 21 bp, Homo sapiens
cctggccttgtgtcactggct

SEQ ID NO: 1449805 - DNA, 20 bp, Homo sapiens
cctggcgactgcccctgcct

SEQ ID NO: 1449806 - DNA, 15 bp, Homo sapiens
cctggcgcaggtggg

SEQ ID NO: 1449807 - DNA, 19 bp, Homo sapiens
cctggcgcccctgcccccc

SEQ ID NO: 1449808 - DNA, 16 bp, Homo sapiens
cctggcgtgctcagac

SEQ ID NO: 1449809 - DNA, 17 bp, Homo sapiens
cctggcgtgctcagacc

SEQ ID NO: 1449810 - DNA, 23 bp, Homo sapiens
cctggctacagggcgagactctg

SEQ ID NO: 1449811 - DNA, 16 bp, Homo sapiens
cctggctacttccctt

SEQ ID NO: 1449812 - DNA, 18 bp, Homo sapiens
cctggctacttcccttcc

SEQ ID NO: 1449813 - DNA, 19 bp, Homo sapiens
cctggctacttcccttcct

SEQ ID NO: 1449814 - DNA, 16 bp, Homo sapiens
cctggctcactggcag

SEQ ID NO: 1449815 - DNA, 13 bp, Homo sapiens
cctggctcaggcc

SEQ ID NO: 1449816 - DNA, 22 bp, Homo sapiens
cctggctccactcttgatctct

SEQ ID NO: 1449817 - DNA, 23 bp, Homo sapiens
cctggctcccacaggcccttcct

SEQ ID NO: 1449818 - DNA, 16 bp, Homo sapiens
cctggctcccaggaca

SEQ ID NO: 1449819 - DNA, 14 bp, Homo sapiens
cctggctcccatga

SEQ ID NO: 1449820 - DNA, 13 bp, Homo sapiens
cctggctccccac

SEQ ID NO: 1449821 - DNA, 15 bp, Homo sapiens
cctggctccctcctc

SEQ ID NO: 1449822 - DNA, 21 bp, Homo sapiens
cctggctccgtccaggagcct

SEQ ID NO: 1449823 - DNA, 15 bp, Homo sapiens
cctggctcctgaggg

SEQ ID NO: 1449824 - DNA, 23 bp, Homo sapiens
cctggctcctgaggggcatctgc

SEQ ID NO: 1449825 - DNA, 17 bp, Homo sapiens
tggctgaggccacccag

SEQ ID NO: 1449826 - DNA, 20 bp, Homo sapiens
tggctgaggttcctctgcct

SEQ ID NO: 1449827 - DNA, 19 bp, Homo sapiens
tggctgagtagctctgcct

SEQ ID NO: 1449828 - DNA, 22 bp, Homo sapiens
tggctgatgatccagaacagtg

SEQ ID NO: 1449829 - DNA, 19 bp, Homo sapiens
tggctgcaaataaggacag

SEQ ID NO: 1449830 - DNA, 20 bp, Homo sapiens
tggctgcaaataaggacagc

SEQ ID NO: 1449831 - DNA, 19 bp, Homo sapiens
tggctgcacctttttgcat

SEQ ID NO: 1449832 - DNA, 20 bp, Homo sapiens
tggctgcaggaagaaacttt

SEQ ID NO: 1449833 - DNA, 13 bp, Homo sapiens
tggctgcaggtgt

SEQ ID NO: 1449834 - DNA, 13 bp, Homo sapiens
tggctgcccagga

SEQ ID NO: 1449835 - DNA, 17 bp, Homo sapiens
tggctgccccaacctgc

SEQ ID NO: 1449836 - DNA, 20 bp, Homo sapiens
tggctgccccaacctgctga

SEQ ID NO: 1449837 - DNA, 15 bp, Homo sapiens
tggctgccctggccc

SEQ ID NO: 1449838 - DNA, 15 bp, Homo sapiens
tggctgcctgcatct

SEQ ID NO: 1449839 - DNA, 16 bp, Homo sapiens
tggctgccttctttcc

SEQ ID NO: 1449840 - DNA, 21 bp, Homo sapiens
tggctgcggtgtttggcaatg

SEQ ID NO: 1449841 - DNA, 23 bp, Homo sapiens
tggctgctagattttaatttatt

SEQ ID NO: 1449842 - DNA, 20 bp, Homo sapiens
tggctgctcccagcctcttg

SEQ ID NO: 1449843 - DNA, 14 bp, Homo sapiens
tggctgctgcggct

SEQ ID NO: 1449844 - DNA, 21 bp, Homo sapiens
tggctggaagatcctgcgggt

SEQ ID NO: 1449845 - DNA, 18 bp, Homo sapiens
tggctggaaggggtccag

SEQ ID NO: 1449846 - DNA, 17 bp, Homo sapiens
tggctggaggagctggc

SEQ ID NO: 1449847 - DNA, 19 bp, Homo sapiens
tggctggaggagctggcct

SEQ ID NO: 1449848 - DNA, 20 bp, Homo sapiens
tggctggaggagctggcctg

SEQ ID NO: 1449849 - DNA, 23 bp, Homo sapiens
tggctggcaggcagttctagaag

SEQ ID NO: 1449850 - DNA, 14 bp, Homo sapiens
tggctggcaggtgt

SEQ ID NO: 1449851 - DNA, 15 bp, Homo sapiens
tggctggcaggtgtt

SEQ ID NO: 1449852 - DNA, 23 bp, Homo sapiens
tggctggcaggtgttgggacctg

SEQ ID NO: 1449853 - DNA, 14 bp, Homo sapiens
tggctggcctggta

SEQ ID NO: 1449854 - DNA, 10 bp, Homo sapiens
tggctgggca

SEQ ID NO: 1449855 - DNA, 14 bp, Homo sapiens
tggctgggcccagc

SEQ ID NO: 1449856 - DNA, 12 bp, Homo sapiens
tggctggggccg

SEQ ID NO: 1449857 - DNA, 16 bp, Homo sapiens
tggctggggccgctgg

SEQ ID NO: 1449858 - DNA, 16 bp, Homo sapiens
tggctgggggcaggag

SEQ ID NO: 1449859 - DNA, 17 bp, Homo sapiens
tggctgggggcaggagg

SEQ ID NO: 1449860 - DNA, 22 bp, Homo sapiens
tggctgggtcagggccagactg

SEQ ID NO: 1449861 - DNA, 18 bp, Homo sapiens
tggctgggtccttgggcc

SEQ ID NO: 1449862 - DNA, 20 bp, Homo sapiens
tggctgggtccttgggcctg

SEQ ID NO: 1449863 - DNA, 15 bp, Homo sapiens
tggctgggtgccctc

SEQ ID NO: 1449864 - DNA, 22 bp, Homo sapiens
tggctggtaacagttcatgttt

SEQ ID NO: 1449865 - DNA, 20 bp, Homo sapiens
tgggacctgccaggcagggg

SEQ ID NO: 1449866 - DNA, 23 bp, Homo sapiens
tgggacctgccaggcaggggtgg

SEQ ID NO: 1449867 - DNA, 14 bp, Homo sapiens
tgggacctgctgct

SEQ ID NO: 1449868 - DNA, 21 bp, Homo sapiens
tgggacctgctgctccatgga

SEQ ID NO: 1449869 - DNA, 22 bp, Homo sapiens
tgggacgatcgcccaggctgga

SEQ ID NO: 1449870 - DNA, 14 bp, Homo sapiens
tgggacggtgccca

SEQ ID NO: 1449871 - DNA, 16 bp, Homo sapiens
tgggacgtggtcaggg

SEQ ID NO: 1449872 - DNA, 17 bp, Homo sapiens
tgggactacaggcatgc

SEQ ID NO: 1449873 - DNA, 22 bp, Homo sapiens
tgggactagaggctcagtggtg

SEQ ID NO: 1449874 - DNA, 13 bp, Homo sapiens
tgggactcagcct

SEQ ID NO: 1449875 - DNA, 19 bp, Homo sapiens
tgggactcggtgagccggg

SEQ ID NO: 1449876 - DNA, 23 bp, Homo sapiens
tgggactctcctcctcccctcct

SEQ ID NO: 1449877 - DNA, 14 bp, Homo sapiens
tgggactgaaaggt

SEQ ID NO: 1449878 - DNA, 15 bp, Homo sapiens
tgggactgagccagt

SEQ ID NO: 1449879 - DNA, 20 bp, Homo sapiens
tgggactgagccagtcccag

SEQ ID NO: 1449880 - DNA, 15 bp, Homo sapiens
tgggactgatgtcat

SEQ ID NO: 1449881 - DNA, 13 bp, Homo sapiens
tgggactggagtc

SEQ ID NO: 1449882 - DNA, 18 bp, Homo sapiens
tgggactggagtccctgt

SEQ ID NO: 1449883 - DNA, 23 bp, Homo sapiens
tgggactggccaggtttctgccc

SEQ ID NO: 1449884 - DNA, 14 bp, Homo sapiens
tgggacttctaccc

SEQ ID NO: 1449885 - DNA, 20 bp, Homo sapiens
tgggacttctacccagatgg

SEQ ID NO: 1449886 - DNA, 21 bp, Homo sapiens
tgggacttctacccagatgga

SEQ ID NO: 1449887 - DNA, 23 bp, Homo sapiens
tgggacttctacccagatggaaa

SEQ ID NO: 1449888 - DNA, 21 bp, Homo sapiens
tgggactttgcacctctgctg

SEQ ID NO: 1449889 - DNA, 18 bp, Homo sapiens
tgggacttttctttctta

SEQ ID NO: 1449890 - DNA, 14 bp, Homo sapiens
tgggagaaagcaat

SEQ ID NO: 1449891 - DNA, 14 bp, Homo sapiens
tgggagaacctcag

SEQ ID NO: 1449892 - DNA, 17 bp, Homo sapiens
tgggagaagggcagagt

SEQ ID NO: 1449893 - DNA, 20 bp, Homo sapiens
tgggagaaggtctccaaggg

SEQ ID NO: 1449894 - DNA, 19 bp, Homo sapiens
tgggagaatgtcagtatgt

SEQ ID NO: 1449895 - DNA, 22 bp, Homo sapiens
tgggagaattcttacatgtttt

SEQ ID NO: 1449896 - DNA, 22 bp, Homo sapiens
tgggagacaaaggaggaattta

SEQ ID NO: 1449897 - DNA, 19 bp, Homo sapiens
tgggagacacccaaagggt

SEQ ID NO: 1449898 - DNA, 17 bp, Homo sapiens
tgggagacagcagcctg

SEQ ID NO: 1449899 - DNA, 18 bp, Homo sapiens
tgggagacctgtaatcat

SEQ ID NO: 1449900 - DNA, 14 bp, Homo sapiens
tgggagagactgtg

SEQ ID NO: 1449901 - DNA, 12 bp, Homo sapiens
tgggagagactt

SEQ ID NO: 1449902 - DNA, 13 bp, Homo sapiens
tgggagagttgga

SEQ ID NO: 1449903 - DNA, 23 bp, Homo sapiens
tgggagatatatttttaagataa

SEQ ID NO: 1449904 - DNA, 13 bp, Homo sapiens
tgggagcactgga

SEQ ID NO: 1449905 - DNA, 13 bp, Homo sapiens
tgggagccagcct

SEQ ID NO: 1449906 - DNA, 12 bp, Homo sapiens
tgggagccagct

SEQ ID NO: 1449907 - DNA, 13 bp, Homo sapiens
tgggagccccagg

SEQ ID NO: 1449908 - DNA, 15 bp, Homo sapiens
tgggagccctttgga

SEQ ID NO: 1449909 - DNA, 22 bp, Homo sapiens
tgggagcctgcaaactcactgc

SEQ ID NO: 1449910 - DNA, 17 bp, Homo sapiens
tgggagctgaaccaaag

SEQ ID NO: 1449911 - DNA, 21 bp, Homo sapiens
tgggagctgagctggaagggg

SEQ ID NO: 1449912 - DNA, 16 bp, Homo sapiens
tgggagcttgggaatg

SEQ ID NO: 1449913 - DNA, 20 bp, Homo sapiens
tgggaggaaaagaaaagagg

SEQ ID NO: 1449914 - DNA, 13 bp, Homo sapiens
tgggaggagggag

SEQ ID NO: 1449915 - DNA, 18 bp, Homo sapiens
tgggaggatacagaggag

SEQ ID NO: 1449916 - DNA, 15 bp, Homo sapiens
tgggaggatcatttg

SEQ ID NO: 1449917 - DNA, 13 bp, Homo sapiens
tgggaggcaagaa

SEQ ID NO: 1449918 - DNA, 18 bp, Homo sapiens
tgggaggcaagaggggtg

SEQ ID NO: 1449919 - DNA, 19 bp, Homo sapiens
tgggaggcaagaggggtgg

SEQ ID NO: 1449920 - DNA, 20 bp, Homo sapiens
tgggaggcagaggttgcagt

SEQ ID NO: 1449921 - DNA, 18 bp, Homo sapiens
tgggaggcagccgaggcc

SEQ ID NO: 1449922 - DNA, 20 bp, Homo sapiens
tgggaggcagccgaggcctg

SEQ ID NO: 1449923 - DNA, 12 bp, Homo sapiens
tgggaggccaag

SEQ ID NO: 1449924 - DNA, 17 bp, Homo sapiens
tgggaggccaaggcagg

SEQ ID NO: 1449925 - DNA, 18 bp, Homo sapiens
tgggaggccaaggcaggt

SEQ ID NO: 1449926 - DNA, 19 bp, Homo sapiens
tgggaggccaaggcaggta

SEQ ID NO: 1449927 - DNA, 11 bp, Homo sapiens
tgggaggctga

SEQ ID NO: 1449928 - DNA, 15 bp, Homo sapiens
tgggaggctgaggca

SEQ ID NO: 1449929 - DNA, 16 bp, Homo sapiens
tgggaggctgaggcag

SEQ ID NO: 1449930 - DNA, 17 bp, Homo sapiens
tgggaggggaagggctg

SEQ ID NO: 1449931 - DNA, 18 bp, Homo sapiens
tgggaggggaagggctgg

SEQ ID NO: 1449932 - DNA, 14 bp, Homo sapiens
tgggaggggcaggc

SEQ ID NO: 1449933 - DNA, 15 bp, Homo sapiens
tgggaggggcaggct

SEQ ID NO: 1449934 - DNA, 18 bp, Homo sapiens
tgggaggggcccacagga

SEQ ID NO: 1449935 - DNA, 15 bp, Homo sapiens
tgggagggggtgggg

SEQ ID NO: 1449936 - DNA, 17 bp, Homo sapiens
tgggagggttcccctgg

SEQ ID NO: 1449937 - DNA, 23 bp, Homo sapiens
tgggaggtagaaggggaggacac

SEQ ID NO: 1449938 - DNA, 17 bp, Homo sapiens
tgggaggtcaggaaact

SEQ ID NO: 1449939 - DNA, 13 bp, Homo sapiens
tgggaggtcgagg

SEQ ID NO: 1449940 - DNA, 21 bp, Homo sapiens
tgggaggtgcgtgttcagcag

SEQ ID NO: 1449941 - DNA, 15 bp, Homo sapiens
tgggagtcacacagt

SEQ ID NO: 1449942 - DNA, 19 bp, Homo sapiens
tgggagtgtgggctgccct

SEQ ID NO: 1449943 - DNA, 19 bp, Homo sapiens
tgggagtgtgtctgctgag

SEQ ID NO: 1449944 - DNA, 21 bp, Homo sapiens
cctggggcttctcctgaccca

SEQ ID NO: 1449945 - DNA, 19 bp, Homo sapiens
cctgggggacccctggctc

SEQ ID NO: 1449946 - DNA, 20 bp, Homo sapiens
cctgggggacccctggctct

SEQ ID NO: 1449947 - DNA, 18 bp, Homo sapiens
cctgggggcagtgactgg

SEQ ID NO: 1449948 - DNA, 19 bp, Homo sapiens
cctgggggcagtgactggc

SEQ ID NO: 1449949 - DNA, 20 bp, Homo sapiens
cctgggggcagtgactggca

SEQ ID NO: 1449950 - DNA, 22 bp, Homo sapiens
cctgggggcagtgactggcagg

SEQ ID NO: 1449951 - DNA, 19 bp, Homo sapiens
cctgggggccttgggtgag

SEQ ID NO: 1449952 - DNA, 19 bp, Homo sapiens
cctgggggcttttgccact

SEQ ID NO: 1449953 - DNA, 15 bp, Homo sapiens
cctggggtctgagca

SEQ ID NO: 1449954 - DNA, 15 bp, Homo sapiens
cctggggtgcatctc

SEQ ID NO: 1449955 - DNA, 17 bp, Homo sapiens
cctggggtgcatctcct

SEQ ID NO: 1449956 - DNA, 20 bp, Homo sapiens
cctggggtgttagtggcacc

SEQ ID NO: 1449957 - DNA, 21 bp, Homo sapiens
cctggggtgttagtggcaccg

SEQ ID NO: 1449958 - DNA, 17 bp, Homo sapiens
cctgggtatcccctgcc

SEQ ID NO: 1449959 - DNA, 18 bp, Homo sapiens
cctgggtatcccctgcct

SEQ ID NO: 1449960 - DNA, 23 bp, Homo sapiens
cctgggtatcccctgcctcctgc

SEQ ID NO: 1449961 - DNA, 23 bp, Homo sapiens
cctgggtcaaagtggtacaggaa

SEQ ID NO: 1449962 - DNA, 14 bp, Homo sapiens
cctgggtcctgcct

SEQ ID NO: 1449963 - DNA, 19 bp, Homo sapiens
cctgggtgacagagtgaga

SEQ ID NO: 1449964 - DNA, 16 bp, Homo sapiens
cctgggtgctggctgc

SEQ ID NO: 1449965 - DNA, 17 bp, Homo sapiens
cctgggtgggctctgtg

SEQ ID NO: 1449966 - DNA, 21 bp, Homo sapiens
cctgggtggggctgctcctcc

SEQ ID NO: 1449967 - DNA, 21 bp, Homo sapiens
cctgggtgggtggtggggagg

SEQ ID NO: 1449968 - DNA, 23 bp, Homo sapiens
cctgggtgggtggtggggagggg

SEQ ID NO: 1449969 - DNA, 20 bp, Homo sapiens
cctgggttagggtgtgtgtt

SEQ ID NO: 1449970 - DNA, 23 bp, Homo sapiens
cctggtaaccaaatattaaagat

SEQ ID NO: 1449971 - DNA, 22 bp, Homo sapiens
cctggtaagggggtccctgtgc

SEQ ID NO: 1449972 - DNA, 19 bp, Homo sapiens
cctggtaattcctctccag

SEQ ID NO: 1449973 - DNA, 15 bp, Homo sapiens
cctggtaccctcctg

SEQ ID NO: 1449974 - DNA, 20 bp, Homo sapiens
cctggtactccctctcagga

SEQ ID NO: 1449975 - DNA, 18 bp, Homo sapiens
cctggtatatccaaaagc

SEQ ID NO: 1449976 - DNA, 20 bp, Homo sapiens
cctggtatatccaaaagctt

SEQ ID NO: 1449977 - DNA, 19 bp, Homo sapiens
cctggtcagaaggccagcc

SEQ ID NO: 1449978 - DNA, 14 bp, Homo sapiens
cctggtccagggaa

SEQ ID NO: 1449979 - DNA, 20 bp, Homo sapiens
tggatgacagggcagagcag

SEQ ID NO: 1449980 - DNA, 18 bp, Homo sapiens
tggatgagaaacagctca

SEQ ID NO: 1449981 - DNA, 17 bp, Homo sapiens
tggatgatgtttcgtga

SEQ ID NO: 1449982 - DNA, 21 bp, Homo sapiens
tggatgatttcatcttctgga

SEQ ID NO: 1449983 - DNA, 17 bp, Homo sapiens
tggatgattttttaagc

SEQ ID NO: 1449984 - DNA, 22 bp, Homo sapiens
tggatgattttttaagcagact

SEQ ID NO: 1449985 - DNA, 19 bp, Homo sapiens
tggatgcacagatgccatg

SEQ ID NO: 1449986 - DNA, 19 bp, Homo sapiens
tggatgcatgccctaagag

SEQ ID NO: 1449987 - DNA, 19 bp, Homo sapiens
tggatgccaaggagcccct

SEQ ID NO: 1449988 - DNA, 20 bp, Homo sapiens
tggatgccacagcccagctt

SEQ ID NO: 1449989 - DNA, 20 bp, Homo sapiens
tggatgcctcattatgtcaa

SEQ ID NO: 1449990 - DNA, 17 bp, Homo sapiens
tggatgcgcagtgcctt

SEQ ID NO: 1449991 - DNA, 16 bp, Homo sapiens
tggatgctccagggca

SEQ ID NO: 1449992 - DNA, 15 bp, Homo sapiens
tggatggcaccctgg

SEQ ID NO: 1449993 - DNA, 16 bp, Homo sapiens
tggatggcacctcagg

SEQ ID NO: 1449994 - DNA, 16 bp, Homo sapiens
tggatggccccagcac

SEQ ID NO: 1449995 - DNA, 18 bp, Homo sapiens
tggatggccccagcacag

SEQ ID NO: 1449996 - DNA, 15 bp, Homo sapiens
tggatggccgggctg

SEQ ID NO: 1449997 - DNA, 23 bp, Homo sapiens
tggatggccgggctgctgctgat

SEQ ID NO: 1449998 - DNA, 23 bp, Homo sapiens
tggatggcttgtctatactcctt

SEQ ID NO: 1449999 - DNA, 21 bp, Homo sapiens
tggatgggggaactcagatcc

SEQ ID NO: 1450000 - DNA, 22 bp, Homo sapiens
tggatgggggaactcagatcca

SEQ ID NO: 1450001 - DNA, 17 bp, Homo sapiens
tggatgtctgccaattt

SEQ ID NO: 1450002 - DNA, 20 bp, Homo sapiens
tggatgtctgccaatttttg

SEQ ID NO: 1450003 - DNA, 15 bp, Homo sapiens
tggatgtgttcattc

SEQ ID NO: 1450004 - DNA, 20 bp, Homo sapiens
tggatgttatgaacagctgt

SEQ ID NO: 1450005 - DNA, 12 bp, Homo sapiens
tggatgttctga

SEQ ID NO: 1450006 - DNA, 22 bp, Homo sapiens
tggattataagttctattttac

SEQ ID NO: 1450007 - DNA, 23 bp, Homo sapiens
tggattataagttctattttact

SEQ ID NO: 1450008 - DNA, 13 bp, Homo sapiens
tggattattttct

SEQ ID NO: 1450009 - DNA, 20 bp, Homo sapiens
tggattcacccccctctgct

SEQ ID NO: 1450010 - DNA, 13 bp, Homo sapiens
tggattcatcagc

SEQ ID NO: 1450011 - DNA, 15 bp, Homo sapiens
tggattcatttcctg

SEQ ID NO: 1450012 - DNA, 18 bp, Homo sapiens
tggattcatttcctgccc

SEQ ID NO: 1450013 - DNA, 14 bp, Homo sapiens
tggattccaaacca

SEQ ID NO: 1450014 - DNA, 21 bp, Homo sapiens
tggattctatatttcatattg

SEQ ID NO: 1450015 - DNA, 21 bp, Homo sapiens
tggattctcttagctactgta

SEQ ID NO: 1450016 - DNA, 22 bp, Homo sapiens
tggattctgggaggcaagaaaa

SEQ ID NO: 1450017 - DNA, 13 bp, Homo sapiens
tggattgagggta

SEQ ID NO: 1450018 - DNA, 16 bp, Homo sapiens
tggattgcctctgaaa

SEQ ID NO: 1450019 - DNA, 23 bp, Homo sapiens
tggattggacaggagatcagcag

SEQ ID NO: 1450020 - DNA, 20 bp, Homo sapiens
tggatttaaaagcctgctca

SEQ ID NO: 1450021 - DNA, 15 bp, Homo sapiens
tggatttccactgct

SEQ ID NO: 1450022 - DNA, 21 bp, Homo sapiens
tggatttcctaatactgtcat

SEQ ID NO: 1450023 - DNA, 13 bp, Homo sapiens
tggatttgatgct

SEQ ID NO: 1450024 - DNA, 18 bp, Homo sapiens
tggatttgcctgtgccac

SEQ ID NO: 1450025 - DNA, 19 bp, Homo sapiens
tggatttgctcattgctgt

SEQ ID NO: 1450026 - DNA, 22 bp, Homo sapiens
tggatttggagagaaatatttt

SEQ ID NO: 1450027 - DNA, 21 bp, Homo sapiens
tggatttggcactagccaaag

SEQ ID NO: 1450028 - DNA, 19 bp, Homo sapiens
tggatttgggagctctgct

SEQ ID NO: 1450029 - DNA, 16 bp, Homo sapiens
tggatttgtttaaaag

SEQ ID NO: 1450030 - DNA, 14 bp, Homo sapiens
tggattttcctgaa

SEQ ID NO: 1450031 - DNA, 20 bp, Homo sapiens
tggattttctcataggaagt

SEQ ID NO: 1450032 - DNA, 17 bp, Homo sapiens
tggattttctttctatg

SEQ ID NO: 1450033 - DNA, 20 bp, Homo sapiens
cctgcaggctggctgttggc

SEQ ID NO: 1450034 - DNA, 15 bp, Homo sapiens
cctgcagggccatct

SEQ ID NO: 1450035 - DNA, 20 bp, Homo sapiens
cctgcagggtggtgctggga

SEQ ID NO: 1450036 - DNA, 23 bp, Homo sapiens
cctgcaggtcagttgtaataaat

SEQ ID NO: 1450037 - DNA, 12 bp, Homo sapiens
cctgcagtgcca

SEQ ID NO: 1450038 - DNA, 22 bp, Homo sapiens
cctgcagtgccagctccctcgt

SEQ ID NO: 1450039 - DNA, 15 bp, Homo sapiens
cctgcagtttggccc

SEQ ID NO: 1450040 - DNA, 23 bp, Homo sapiens
cctgcagtttggccctggagcca

SEQ ID NO: 1450041 - DNA, 22 bp, Homo sapiens
cctgcataatgtttctggattt

SEQ ID NO: 1450042 - DNA, 14 bp, Homo sapiens
cctgcatctggggc

SEQ ID NO: 1450043 - DNA, 15 bp, Homo sapiens
cctgcatctggggcc

SEQ ID NO: 1450044 - DNA, 16 bp, Homo sapiens
cctgcatgagctggca

SEQ ID NO: 1450045 - DNA, 16 bp, Homo sapiens
cctgcatgctgaaaca

SEQ ID NO: 1450046 - DNA, 21 bp, Homo sapiens
cctgcatgctgcccagccact

SEQ ID NO: 1450047 - DNA, 10 bp, Homo sapiens
cctgcatgtt

SEQ ID NO: 1450048 - DNA, 17 bp, Homo sapiens
cctgcattcacccagac

SEQ ID NO: 1450049 - DNA, 14 bp, Homo sapiens
cctgcattggcctg

SEQ ID NO: 1450050 - DNA, 15 bp, Homo sapiens
cctgcattggcctgg

SEQ ID NO: 1450051 - DNA, 19 bp, Homo sapiens
cctgcattggcctggcctc

SEQ ID NO: 1450052 - DNA, 15 bp, Homo sapiens
cctgcattttcctct

SEQ ID NO: 1450053 - DNA, 17 bp, Homo sapiens
cctgcattttcctcttg

SEQ ID NO: 1450054 - DNA, 18 bp, Homo sapiens
cctgcattttcctcttgt

SEQ ID NO: 1450055 - DNA, 14 bp, Homo sapiens
cctgccacactgat

SEQ ID NO: 1450056 - DNA, 15 bp, Homo sapiens
cctgccacactgatg

SEQ ID NO: 1450057 - DNA, 23 bp, Homo sapiens
cctgccacactgatggctcaaga

SEQ ID NO: 1450058 - DNA, 16 bp, Homo sapiens
cctgccacatggagcc

SEQ ID NO: 1450059 - DNA, 13 bp, Homo sapiens
cctgccaccaggc

SEQ ID NO: 1450060 - DNA, 16 bp, Homo sapiens
cctgccaccccttcct

SEQ ID NO: 1450061 - DNA, 19 bp, Homo sapiens
cctgccaccccttcctccc

SEQ ID NO: 1450062 - DNA, 13 bp, Homo sapiens
cctgccacctccc

SEQ ID NO: 1450063 - DNA, 14 bp, Homo sapiens
cctgccacctccct

SEQ ID NO: 1450064 - DNA, 18 bp, Homo sapiens
cctgccactcactaggcc

SEQ ID NO: 1450065 - DNA, 22 bp, Homo sapiens
cctgccactcactaggccccca

SEQ ID NO: 1450066 - DNA, 19 bp, Homo sapiens
cctgccactctctgggact

SEQ ID NO: 1450067 - DNA, 23 bp, Homo sapiens
cctgccacttcaacccccagcta

SEQ ID NO: 1450068 - DNA, 18 bp, Homo sapiens
cctgccagagctttgttt

SEQ ID NO: 1450069 - DNA, 11 bp, Homo sapiens
cctgccagcag

SEQ ID NO: 1450070 - DNA, 14 bp, Homo sapiens
cctgccagcagggg

SEQ ID NO: 1450071 - DNA, 14 bp, Homo sapiens
cctgccagctgcac

SEQ ID NO: 1450072 - DNA, 23 bp, Homo sapiens
cctgccagctgcactgatgctgc

SEQ ID NO: 1450073 - DNA, 16 bp, Homo sapiens
cctgccagctgccttc

SEQ ID NO: 1450074 - DNA, 13 bp, Homo sapiens
cctgccaggcagg

SEQ ID NO: 1450075 - DNA, 22 bp, Homo sapiens
cctgccaggcaggggtgggggt

SEQ ID NO: 1450076 - DNA, 15 bp, Homo sapiens
cctgccagggtgagc

SEQ ID NO: 1450077 - DNA, 18 bp, Homo sapiens
cctgccagtgccttacct

SEQ ID NO: 1450078 - DNA, 22 bp, Homo sapiens
cctgccagtgccttacctcctg

SEQ ID NO: 1450079 - DNA, 16 bp, Homo sapiens
cctgccatcttcccag

SEQ ID NO: 1450080 - DNA, 19 bp, Homo sapiens
cctgccatgccaggaacct

SEQ ID NO: 1450081 - DNA, 14 bp, Homo sapiens
cctgccatttaaaa

SEQ ID NO: 1450082 - DNA, 17 bp, Homo sapiens
cctgccatttgcaccct

SEQ ID NO: 1450083 - DNA, 23 bp, Homo sapiens
cctgccatttgcaccctccgcct

SEQ ID NO: 1450084 - DNA, 13 bp, Homo sapiens
cctgcccaatgct

SEQ ID NO: 1450085 - DNA, 19 bp, Homo sapiens
cctgcccacttagccgtcc

SEQ ID NO: 1450086 - DNA, 12 bp, Homo sapiens
cctgcccaggag

SEQ ID NO: 1450087 - DNA, 20 bp, Homo sapiens
cctgcccaggagagccagcc

SEQ ID NO: 1450088 - DNA, 12 bp, Homo sapiens
cctgcccaggca

SEQ ID NO: 1450089 - DNA, 21 bp, Homo sapiens
cctgcccaggcagtctttgct

SEQ ID NO: 1450090 - DNA, 19 bp, Homo sapiens
cctgcccagtcgaccccaa

SEQ ID NO: 1450091 - DNA, 11 bp, Homo sapiens
cctgcccagtg

SEQ ID NO: 1450092 - DNA, 16 bp, Homo sapiens
cctgcccagttgcact

SEQ ID NO: 1450093 - DNA, 16 bp, Homo sapiens
cctgcccatgggagct

SEQ ID NO: 1450094 - DNA, 23 bp, Homo sapiens
cctgccccaagggcccagaccct

SEQ ID NO: 1450095 - DNA, 15 bp, Homo sapiens
cctgccccagaggtc

SEQ ID NO: 1450096 - DNA, 16 bp, Homo sapiens
cctgccccaggcctga

SEQ ID NO: 1450097 - DNA, 15 bp, Homo sapiens
cctgcccccagcccc

SEQ ID NO: 1450098 - DNA, 17 bp, Homo sapiens
cctgccccccagcctct

SEQ ID NO: 1450099 - DNA, 20 bp, Homo sapiens
cctgccccccctaagagaca

SEQ ID NO: 1450100 - DNA, 22 bp, Homo sapiens
cctgccccctcgggggcctgtg

SEQ ID NO: 1450101 - DNA, 19 bp, Homo sapiens
cctgccccgttgcttcccg

SEQ ID NO: 1450102 - DNA, 12 bp, Homo sapiens
cctgcccctagg

SEQ ID NO: 1450103 - DNA, 16 bp, Homo sapiens
cctgcccgcaccctgg

SEQ ID NO: 1450104 - DNA, 19 bp, Homo sapiens
cctgcccgcaccctggcct

SEQ ID NO: 1450105 - DNA, 13 bp, Homo sapiens
cctgcccgctccc

SEQ ID NO: 1450106 - DNA, 15 bp, Homo sapiens
cctgcccgctcccaa

SEQ ID NO: 1450107 - DNA, 22 bp, Homo sapiens
cctgccctcccctgctcccagg

SEQ ID NO: 1450108 - DNA, 15 bp, Homo sapiens
cctgccctcccgcac

SEQ ID NO: 1450109 - DNA, 18 bp, Homo sapiens
cctgccctcccgcacctt

SEQ ID NO: 1450110 - DNA, 15 bp, Homo sapiens
cctgccctcgtggcc

SEQ ID NO: 1450111 - DNA, 19 bp, Homo sapiens
cctgccctcgtggccagcc

SEQ ID NO: 1450112 - DNA, 23 bp, Homo sapiens
cctgccctcgtggccagcccggc

SEQ ID NO: 1450113 - DNA, 17 bp, Homo sapiens
cctgccctctatttatt

SEQ ID NO: 1450114 - DNA, 22 bp, Homo sapiens
cctgccctctgctctgcctgga

SEQ ID NO: 1450115 - DNA, 15 bp, Homo sapiens
cctgccctgccccct

SEQ ID NO: 1450116 - DNA, 15 bp, Homo sapiens
cctgccctgcctgag

SEQ ID NO: 1450117 - DNA, 17 bp, Homo sapiens
cctgccctgggcgagcc

SEQ ID NO: 1450118 - DNA, 12 bp, Homo sapiens
cctgccctggtc

SEQ ID NO: 1450119 - DNA, 21 bp, Homo sapiens
cctgccctgtgatatgtctgc

SEQ ID NO: 1450120 - DNA, 21 bp, Homo sapiens
cctgccctgttgtgtatagat

SEQ ID NO: 1450121 - DNA, 10 bp, Homo sapiens
cctgcccttg

SEQ ID NO: 1450122 - DNA, 15 bp, Homo sapiens
cctgcccttgaaccc

SEQ ID NO: 1450123 - DNA, 18 bp, Homo sapiens
cctgccgacctcgtcctc

SEQ ID NO: 1450124 - DNA, 14 bp, Homo sapiens
cctgccgcagagct

SEQ ID NO: 1450125 - DNA, 17 bp, Homo sapiens
cctgccggaatgaactg

SEQ ID NO: 1450126 - DNA, 19 bp, Homo sapiens
cctgccgggctgagggcct

SEQ ID NO: 1450127 - DNA, 20 bp, Homo sapiens
cctgccgggctgagggcctg

SEQ ID NO: 1450128 - DNA, 21 bp, Homo sapiens
cctgccggtgcacaggcctct

SEQ ID NO: 1450129 - DNA, 23 bp, Homo sapiens
cctgccggtgcacaggcctctgc

SEQ ID NO: 1450130 - DNA, 15 bp, Homo sapiens
cctgccgtgcatggc

SEQ ID NO: 1450131 - DNA, 16 bp, Homo sapiens
cctgccgtgcatggct

SEQ ID NO: 1450132 - DNA, 18 bp, Homo sapiens
cctgccgtgcatggctcc

SEQ ID NO: 1450133 - DNA, 21 bp, Homo sapiens
cctgcctaaattaaattgggc

SEQ ID NO: 1450134 - DNA, 18 bp, Homo sapiens
cctgcctaaggttgtcta

SEQ ID NO: 1450135 - DNA, 20 bp, Homo sapiens
cctgcctacacacacagcct

SEQ ID NO: 1450136 - DNA, 16 bp, Homo sapiens
cctgcctccaccagca

SEQ ID NO: 1450137 - DNA, 17 bp, Homo sapiens
cctgcctccaccagcaa

SEQ ID NO: 1450138 - DNA, 21 bp, Homo sapiens
cctgcctccaccgagccagct

SEQ ID NO: 1450139 - DNA, 15 bp, Homo sapiens
cctgcctccagggct

SEQ ID NO: 1450140 - DNA, 16 bp, Homo sapiens
cctgcctccagggctg

SEQ ID NO: 1450141 - DNA, 20 bp, Homo sapiens
cctgcctccagggctggact

SEQ ID NO: 1450142 - DNA, 20 bp, Homo sapiens
cctgcctcccacttcactgc

SEQ ID NO: 1450143 - DNA, 18 bp, Homo sapiens
cctgcctcccctccgcag

SEQ ID NO: 1450144 - DNA, 16 bp, Homo sapiens
cctgcctcctgccacc

SEQ ID NO: 1450145 - DNA, 19 bp, Homo sapiens
cctgcctcctggctcaggc

SEQ ID NO: 1450146 - DNA, 12 bp, Homo sapiens
cctgcctctgcc

SEQ ID NO: 1450147 - DNA, 21 bp, Homo sapiens
cctgcctctgtgtagccgccc

SEQ ID NO: 1450148 - DNA, 13 bp, Homo sapiens
cctgcctgagccc

SEQ ID NO: 1450149 - DNA, 19 bp, Homo sapiens
cctgcctgagcccaggagc

SEQ ID NO: 1450150 - DNA, 18 bp, Homo sapiens
tggattttctttctatgt

SEQ ID NO: 1450151 - DNA, 19 bp, Homo sapiens
tggattttctttctatgta

SEQ ID NO: 1450152 - DNA, 14 bp, Homo sapiens
tggattttgtattt

SEQ ID NO: 1450153 - DNA, 23 bp, Homo sapiens
tggatttttaaaatgtcaagaca

SEQ ID NO: 1450154 - DNA, 16 bp, Homo sapiens
tggatttttaaattat

SEQ ID NO: 1450155 - DNA, 23 bp, Homo sapiens
tggattttttccattatgttcat

SEQ ID NO: 1450156 - DNA, 20 bp, Homo sapiens
tggcaaaactctacttaatc

SEQ ID NO: 1450157 - DNA, 16 bp, Homo sapiens
tggcaaaccctcccag

SEQ ID NO: 1450158 - DNA, 24 bp, Homo sapiens
tggcaaacgctaaagagcccttgc

SEQ ID NO: 1450159 - DNA, 21 bp, Homo sapiens
tggcaaagggagcagaactga

SEQ ID NO: 1450160 - DNA, 22 bp, Homo sapiens
tggcaaatggaggcttttcact

SEQ ID NO: 1450161 - DNA, 23 bp, Homo sapiens
tggcaaatgtaactgtgccagtt

SEQ ID NO: 1450162 - DNA, 13 bp, Homo sapiens
tggcaacacagag

SEQ ID NO: 1450163 - DNA, 14 bp, Homo sapiens
tggcaacagaagtg

SEQ ID NO: 1450164 - DNA, 20 bp, Homo sapiens
tggcaacagatctggaacct

SEQ ID NO: 1450165 - DNA, 13 bp, Homo sapiens
tggcaacatcttg

SEQ ID NO: 1450166 - DNA, 17 bp, Homo sapiens
tggcaagagtgtggagg

SEQ ID NO: 1450167 - DNA, 19 bp, Homo sapiens
tggcaagagtgtggaggct

SEQ ID NO: 1450168 - DNA, 22 bp, Homo sapiens
tggcaagcagggaaagctccac

SEQ ID NO: 1450169 - DNA, 11 bp, Homo sapiens
tggcaaggaaa

SEQ ID NO: 1450170 - DNA, 19 bp, Homo sapiens
tggcaaggactttgtacat

SEQ ID NO: 1450171 - DNA, 17 bp, Homo sapiens
tggcaagggggtgtcat

SEQ ID NO: 1450172 - DNA, 21 bp, Homo sapiens
tggcaataagatacacagctc

SEQ ID NO: 1450173 - DNA, 15 bp, Homo sapiens
tggcaatattctgta

SEQ ID NO: 1450174 - DNA, 20 bp, Homo sapiens
tggcaatattctgtaactat

SEQ ID NO: 1450175 - DNA, 20 bp, Homo sapiens
tggcaatggatgaactgaaa

SEQ ID NO: 1450176 - DNA, 20 bp, Homo sapiens
tggcaattcctcttcattgt

SEQ ID NO: 1450177 - DNA, 13 bp, Homo sapiens
tggcaattgtcta

SEQ ID NO: 1450178 - DNA, 16 bp, Homo sapiens
tggcaattgtctattt

SEQ ID NO: 1450179 - DNA, 16 bp, Homo sapiens
tggcaatttcctggcc

SEQ ID NO: 1450180 - DNA, 15 bp, Homo sapiens
tggcaattttgtaac

SEQ ID NO: 1450181 - DNA, 17 bp, Homo sapiens
tggcacaatgtatactt

SEQ ID NO: 1450182 - DNA, 22 bp, Homo sapiens
tggcacacacctgtagtcccag

SEQ ID NO: 1450183 - DNA, 17 bp, Homo sapiens
tggcacacgcctgtagt

SEQ ID NO: 1450184 - DNA, 22 bp, Homo sapiens
tggcacagaaacctctactaaa

SEQ ID NO: 1450185 - DNA, 15 bp, Homo sapiens
tggcacagaaggatc

SEQ ID NO: 1450186 - DNA, 21 bp, Homo sapiens
tggcacagacttctggaaggc

SEQ ID NO: 1450187 - DNA, 23 bp, Homo sapiens
tggcacagaggtagtctcactgc

SEQ ID NO: 1450188 - DNA, 16 bp, Homo sapiens
tggcacagccctgagt

SEQ ID NO: 1450189 - DNA, 15 bp, Homo sapiens
tggcacaggactgat

SEQ ID NO: 1450190 - DNA, 21 bp, Homo sapiens
tggcacaggagtgtcctcttc

SEQ ID NO: 1450191 - DNA, 18 bp, Homo sapiens
tggcacagttttctgaga

SEQ ID NO: 1450192 - DNA, 19 bp, Homo sapiens
tggcacagttttctgagaa

SEQ ID NO: 1450193 - DNA, 21 bp, Homo sapiens
tggcaccactgcactccagcc

SEQ ID NO: 1450194 - DNA, 20 bp, Homo sapiens
tggcaccagacacccaggac

SEQ ID NO: 1450195 - DNA, 21 bp, Homo sapiens
tggcaccagacacccaggact

SEQ ID NO: 1450196 - DNA, 20 bp, Homo sapiens
tggcaccagaggtgcttctg

SEQ ID NO: 1450197 - DNA, 18 bp, Homo sapiens
tggcaccagccccctgga

SEQ ID NO: 1450198 - DNA, 17 bp, Homo sapiens
tggcaccatcagcctgt

SEQ ID NO: 1450199 - DNA, 16 bp, Homo sapiens
tggcaccgcctcccca

SEQ ID NO: 1450200 - DNA, 13 bp, Homo sapiens
tggcacctcaggc

SEQ ID NO: 1450201 - DNA, 22 bp, Homo sapiens
tggcacctcaggctgagggccc

SEQ ID NO: 1450202 - DNA, 17 bp, Homo sapiens
tggcacctcctgagaag

SEQ ID NO: 1450203 - DNA, 19 bp, Homo sapiens
tggcacctcctgagaaggc

SEQ ID NO: 1450204 - DNA, 20 bp, Homo sapiens
tggcacgccctactccactg

SEQ ID NO: 1450205 - DNA, 20 bp, Homo sapiens
tggcacggagagaaggccca

SEQ ID NO: 1450206 - DNA, 20 bp, Homo sapiens
tggcacggtggctcaggcct

SEQ ID NO: 1450207 - DNA, 19 bp, Homo sapiens
cctgctcaatccctgagga

SEQ ID NO: 1450208 - DNA, 15 bp, Homo sapiens
cctgctcacctgtgt

SEQ ID NO: 1450209 - DNA, 13 bp, Homo sapiens
cctgctcatccac

SEQ ID NO: 1450210 - DNA, 12 bp, Homo sapiens
cctgctccagaa

SEQ ID NO: 1450211 - DNA, 13 bp, Homo sapiens
cctgctccagaag

SEQ ID NO: 1450212 - DNA, 16 bp, Homo sapiens
cctgctccagaagatg

SEQ ID NO: 1450213 - DNA, 16 bp, Homo sapiens
cctgctccagcagcac

SEQ ID NO: 1450214 - DNA, 20 bp, Homo sapiens
cctgctccagcagcacacct

SEQ ID NO: 1450215 - DNA, 22 bp, Homo sapiens
cctgctccagcagcacacctca

SEQ ID NO: 1450216 - DNA, 13 bp, Homo sapiens
cctgctcccagca

SEQ ID NO: 1450217 - DNA, 16 bp, Homo sapiens
cctgctcccagcagcc

SEQ ID NO: 1450218 - DNA, 20 bp, Homo sapiens
cctgctcccattcctccctc

SEQ ID NO: 1450219 - DNA, 15 bp, Homo sapiens
cctgctccctgtctg

SEQ ID NO: 1450220 - DNA, 19 bp, Homo sapiens
cctgctccctgtctgtgtc

SEQ ID NO: 1450221 - DNA, 20 bp, Homo sapiens
cctgctccctgtctgtgtcc

SEQ ID NO: 1450222 - DNA, 21 bp, Homo sapiens
cctgctccctgtctgtgtccc

SEQ ID NO: 1450223 - DNA, 17 bp, Homo sapiens
cctgctccgtggactgc

SEQ ID NO: 1450224 - DNA, 20 bp, Homo sapiens
cctgctccgtggactgcagt

SEQ ID NO: 1450225 - DNA, 20 bp, Homo sapiens
cctgctcctcacccctgtag

SEQ ID NO: 1450226 - DNA, 14 bp, Homo sapiens
cctgctcctcactg

SEQ ID NO: 1450227 - DNA, 15 bp, Homo sapiens
cctgctcctccctgc

SEQ ID NO: 1450228 - DNA, 17 bp, Homo sapiens
cctgctcctccctggct

SEQ ID NO: 1450229 - DNA, 22 bp, Homo sapiens
cctgctcctccctggctgccct

SEQ ID NO: 1450230 - DNA, 21 bp, Homo sapiens
cctgctctaacacctgcctag

SEQ ID NO: 1450231 - DNA, 19 bp, Homo sapiens
cctgctctccggcgcagac

SEQ ID NO: 1450232 - DNA, 21 bp, Homo sapiens
cctgctctccggcgcagacag

SEQ ID NO: 1450233 - DNA, 12 bp, Homo sapiens
cctgctctctga

SEQ ID NO: 1450234 - DNA, 13 bp, Homo sapiens
cctgctctcttca

SEQ ID NO: 1450235 - DNA, 19 bp, Homo sapiens
cctgctctgggacgtggac

SEQ ID NO: 1450236 - DNA, 23 bp, Homo sapiens
cctgctcttttgtgatgaacata

SEQ ID NO: 1450237 - DNA, 19 bp, Homo sapiens
cctgctgaacacagtgtct

SEQ ID NO: 1450238 - DNA, 18 bp, Homo sapiens
cctgctgaagctgctgca

SEQ ID NO: 1450239 - DNA, 20 bp, Homo sapiens
cctgctgagagacccaagga

SEQ ID NO: 1450240 - DNA, 21 bp, Homo sapiens
cctgctgagagacccaaggag

SEQ ID NO: 1450241 - DNA, 19 bp, Homo sapiens
cctgctgagggaccagcca

SEQ ID NO: 1450242 - DNA, 22 bp, Homo sapiens
cctgctgcaaaggacagtgggc

SEQ ID NO: 1450243 - DNA, 16 bp, Homo sapiens
cctgctgcacaggccc

SEQ ID NO: 1450244 - DNA, 19 bp, Homo sapiens
cctgctgcacaggccctgg

SEQ ID NO: 1450245 - DNA, 11 bp, Homo sapiens
cctgctgcacc

SEQ ID NO: 1450246 - DNA, 20 bp, Homo sapiens
cctgctgcaccctgcgcctc

SEQ ID NO: 1450247 - DNA, 23 bp, Homo sapiens
cctgctgcaccctgcgcctccag

SEQ ID NO: 1450248 - DNA, 14 bp, Homo sapiens
cctgctgccagtgc

SEQ ID NO: 1450249 - DNA, 15 bp, Homo sapiens
cctgctgccagtgca

SEQ ID NO: 1450250 - DNA, 16 bp, Homo sapiens
cctgctgccagtgcag

SEQ ID NO: 1450251 - DNA, 16 bp, Homo sapiens
cctgctgcccagtgca

SEQ ID NO: 1450252 - DNA, 14 bp, Homo sapiens
cctgctgccctccc

SEQ ID NO: 1450253 - DNA, 22 bp, Homo sapiens
cctgctgccctcccacagcctc

SEQ ID NO: 1450254 - DNA, 14 bp, Homo sapiens
cctgctgccttttc

SEQ ID NO: 1450255 - DNA, 15 bp, Homo sapiens
cctgctgccttttct

SEQ ID NO: 1450256 - DNA, 20 bp, Homo sapiens
cctgctgcggaggagctgcc

SEQ ID NO: 1450257 - DNA, 19 bp, Homo sapiens
cctgctgcgtccccactcc

SEQ ID NO: 1450258 - DNA, 20 bp, Homo sapiens
cctgctgcgtccccactccc

SEQ ID NO: 1450259 - DNA, 14 bp, Homo sapiens
cctgctgctggtgc

SEQ ID NO: 1450260 - DNA, 18 bp, Homo sapiens
cctgctgctggtgcacag

SEQ ID NO: 1450261 - DNA, 22 bp, Homo sapiens
cctgctgctgtaactgctgagc

SEQ ID NO: 1450262 - DNA, 12 bp, Homo sapiens
cctgctggaagc

SEQ ID NO: 1450263 - DNA, 12 bp, Homo sapiens
cctgctggaggc

SEQ ID NO: 1450264 - DNA, 15 bp, Homo sapiens
cctgctggaggcctc

SEQ ID NO: 1450265 - DNA, 16 bp, Homo sapiens
cctgctggaggcctca

SEQ ID NO: 1450266 - DNA, 18 bp, Homo sapiens
cctgctggaggcctcagg

SEQ ID NO: 1450267 - DNA, 9 bp, Homo sapiens
cctgctggc

SEQ ID NO: 1450268 - DNA, 14 bp, Homo sapiens
tggcatacaaaata

SEQ ID NO: 1450269 - DNA, 14 bp, Homo sapiens
tggcatagctctgg

SEQ ID NO: 1450270 - DNA, 16 bp, Homo sapiens
tggcatatttttcaca

SEQ ID NO: 1450271 - DNA, 18 bp, Homo sapiens
tggcatcatctcagctca

SEQ ID NO: 1450272 - DNA, 23 bp, Homo sapiens
tggcatcctcttgaataggaaga

SEQ ID NO: 1450273 - DNA, 23 bp, Homo sapiens
tggcatcgcaccattctgactcg

SEQ ID NO: 1450274 - DNA, 15 bp, Homo sapiens
tggcatcttctggag

SEQ ID NO: 1450275 - DNA, 17 bp, Homo sapiens
tggcatcttctggagaa

SEQ ID NO: 1450276 - DNA, 13 bp, Homo sapiens
tggcatcttgcca

SEQ ID NO: 1450277 - DNA, 21 bp, Homo sapiens
tggcatgattagattgcaaag

SEQ ID NO: 1450278 - DNA, 18 bp, Homo sapiens
tggcatgcatggaggact

SEQ ID NO: 1450279 - DNA, 22 bp, Homo sapiens
tggcatggttttgtgccatctg

SEQ ID NO: 1450280 - DNA, 14 bp, Homo sapiens
tggcatgtggcctg

SEQ ID NO: 1450281 - DNA, 15 bp, Homo sapiens
tggcatgtggcctgt

SEQ ID NO: 1450282 - DNA, 16 bp, Homo sapiens
tggcatgtggcctgtg

SEQ ID NO: 1450283 - DNA, 17 bp, Homo sapiens
tggcatgtggcctgtgg

SEQ ID NO: 1450284 - DNA, 17 bp, Homo sapiens
tggcatgttttctttgt

SEQ ID NO: 1450285 - DNA, 22 bp, Homo sapiens
tggcatgttttctttgtttcct

SEQ ID NO: 1450286 - DNA, 19 bp, Homo sapiens
tggcattacagctggagaa

SEQ ID NO: 1450287 - DNA, 23 bp, Homo sapiens
tggcattatgtccactgtgtata

SEQ ID NO: 1450288 - DNA, 15 bp, Homo sapiens
tggcattgatcttaa

SEQ ID NO: 1450289 - DNA, 21 bp, Homo sapiens
tggcattgctgcatatttgac

SEQ ID NO: 1450290 - DNA, 13 bp, Homo sapiens
tggcatttccaaa

SEQ ID NO: 1450291 - DNA, 17 bp, Homo sapiens
tggcatttctctttaaa

SEQ ID NO: 1450292 - DNA, 18 bp, Homo sapiens
tggcatttctctttaaac

SEQ ID NO: 1450293 - DNA, 20 bp, Homo sapiens
tggcatttggtctcaggcag

SEQ ID NO: 1450294 - DNA, 22 bp, Homo sapiens
tggcatttggtctcaggcagca

SEQ ID NO: 1450295 - DNA, 16 bp, Homo sapiens
tggccaaacatcagac

SEQ ID NO: 1450296 - DNA, 23 bp, Homo sapiens
tggccaaacatcagacctgtctt

SEQ ID NO: 1450297 - DNA, 14 bp, Homo sapiens
tggccaaagagcct

SEQ ID NO: 1450298 - DNA, 15 bp, Homo sapiens
tggccaaagagcctt

SEQ ID NO: 1450299 - DNA, 14 bp, Homo sapiens
tggccaaagtgtta

SEQ ID NO: 1450300 - DNA, 16 bp, Homo sapiens
tggccaaataggaggg

SEQ ID NO: 1450301 - DNA, 22 bp, Homo sapiens
tggccaaataggagggagactg

SEQ ID NO: 1450302 - DNA, 14 bp, Homo sapiens
tggccaacatggtg

SEQ ID NO: 1450303 - DNA, 19 bp, Homo sapiens
tggccaacgtggacctgcc

SEQ ID NO: 1450304 - DNA, 13 bp, Homo sapiens
tggccaactgcaa

SEQ ID NO: 1450305 - DNA, 21 bp, Homo sapiens
tggccaactgcaaaaaaagcc

SEQ ID NO: 1450306 - DNA, 16 bp, Homo sapiens
tggccaagaagcagtg

SEQ ID NO: 1450307 - DNA, 21 bp, Homo sapiens
tggccaagaagcagtggcctt

SEQ ID NO: 1450308 - DNA, 14 bp, Homo sapiens
tggccaagagcatc

SEQ ID NO: 1450309 - DNA, 21 bp, Homo sapiens
tggccacaaggaaaaggagga

SEQ ID NO: 1450310 - DNA, 12 bp, Homo sapiens
tggccacagcag

SEQ ID NO: 1450311 - DNA, 15 bp, Homo sapiens
tggccacagccccct

SEQ ID NO: 1450312 - DNA, 16 bp, Homo sapiens
tggccacagccccctt

SEQ ID NO: 1450313 - DNA, 19 bp, Homo sapiens
tggccacagcccccttgcc

SEQ ID NO: 1450314 - DNA, 14 bp, Homo sapiens
tggccaccaggctg

SEQ ID NO: 1450315 - DNA, 17 bp, Homo sapiens
tggccaccccgtgccac

SEQ ID NO: 1450316 - DNA, 18 bp, Homo sapiens
tggccaccccgtgccacc

SEQ ID NO: 1450317 - DNA, 15 bp, Homo sapiens
tggccacctctctcc

SEQ ID NO: 1450318 - DNA, 20 bp, Homo sapiens
tggccacctgaggtgggccc

SEQ ID NO: 1450319 - DNA, 23 bp, Homo sapiens
tggccacctgaggtgggcccagg

SEQ ID NO: 1450320 - DNA, 20 bp, Homo sapiens
tggccactatcacatatgct

SEQ ID NO: 1450321 - DNA, 17 bp, Homo sapiens
tggccactccagacccc

SEQ ID NO: 1450322 - DNA, 17 bp, Homo sapiens
cctggaacttggggagt

SEQ ID NO: 1450323 - DNA, 18 bp, Homo sapiens
cctggaagaacaggcctc

SEQ ID NO: 1450324 - DNA, 23 bp, Homo sapiens
cctggaagcacagcgctgagcat

SEQ ID NO: 1450325 - DNA, 12 bp, Homo sapiens
cctggaagcaga

SEQ ID NO: 1450326 - DNA, 16 bp, Homo sapiens
cctggaagcagagcaa

SEQ ID NO: 1450327 - DNA, 15 bp, Homo sapiens
cctggaagccagctt

SEQ ID NO: 1450328 - DNA, 17 bp, Homo sapiens
cctggaagctggaagac

SEQ ID NO: 1450329 - DNA, 20 bp, Homo sapiens
cctggaagctgtgtccttgc

SEQ ID NO: 1450330 - DNA, 15 bp, Homo sapiens
cctggaaggacacag

SEQ ID NO: 1450331 - DNA, 18 bp, Homo sapiens
cctggaaggacacagtga

SEQ ID NO: 1450332 - DNA, 12 bp, Homo sapiens
cctggaagggcc

SEQ ID NO: 1450333 - DNA, 16 bp, Homo sapiens
cctggaagggccggct

SEQ ID NO: 1450334 - DNA, 16 bp, Homo sapiens
cctggaattcagcacc

SEQ ID NO: 1450335 - DNA, 17 bp, Homo sapiens
cctggaattgccagctg

SEQ ID NO: 1450336 - DNA, 20 bp, Homo sapiens
cctggacaaggtctcttcct

SEQ ID NO: 1450337 - DNA, 11 bp, Homo sapiens
cctggacacag

SEQ ID NO: 1450338 - DNA, 14 bp, Homo sapiens
cctggacacagctc

SEQ ID NO: 1450339 - DNA, 17 bp, Homo sapiens
cctggacacagctcttc

SEQ ID NO: 1450340 - DNA, 19 bp, Homo sapiens
cctggacacagctcttcat

SEQ ID NO: 1450341 - DNA, 17 bp, Homo sapiens
cctggacactcagacct

SEQ ID NO: 1450342 - DNA, 14 bp, Homo sapiens
cctggacaggcagc

SEQ ID NO: 1450343 - DNA, 17 bp, Homo sapiens
cctggacaggcagcctc

SEQ ID NO: 1450344 - DNA, 18 bp, Homo sapiens
cctggacaggcagcctcc

SEQ ID NO: 1450345 - DNA, 19 bp, Homo sapiens
cctggacagtatcccacat

SEQ ID NO: 1450346 - DNA, 13 bp, Homo sapiens
cctggaccaaagg

SEQ ID NO: 1450347 - DNA, 23 bp, Homo sapiens
cctggaccaccagccccagcaag

SEQ ID NO: 1450348 - DNA, 15 bp, Homo sapiens
cctggaccagcctcc

SEQ ID NO: 1450349 - DNA, 13 bp, Homo sapiens
cctggacctgcct

SEQ ID NO: 1450350 - DNA, 22 bp, Homo sapiens
cctggacctgcctcctgcctgc

SEQ ID NO: 1450351 - DNA, 23 bp, Homo sapiens
cctggacctgcctcctgcctgcc

SEQ ID NO: 1450352 - DNA, 19 bp, Homo sapiens
cctggacgaagagcaggcc

SEQ ID NO: 1450353 - DNA, 14 bp, Homo sapiens
cctggactgactgc

SEQ ID NO: 1450354 - DNA, 15 bp, Homo sapiens
cctggactgctacct

SEQ ID NO: 1450355 - DNA, 14 bp, Homo sapiens
cctggactgttttc

SEQ ID NO: 1450356 - DNA, 24 bp, Homo sapiens
cctggacttaagcatctggctcta

SEQ ID NO: 1450357 - DNA, 13 bp, Homo sapiens
cctggactttcct

SEQ ID NO: 1450358 - DNA, 14 bp, Homo sapiens
cctggactttcctg

SEQ ID NO: 1450359 - DNA, 23 bp, Homo sapiens
cctggactttggttctctccagg

SEQ ID NO: 1450360 - DNA, 13 bp, Homo sapiens
cctggagaactag

SEQ ID NO: 1450361 - DNA, 19 bp, Homo sapiens
cctggagaagaatggcttt

SEQ ID NO: 1450362 - DNA, 13 bp, Homo sapiens
cctggagagcccc

SEQ ID NO: 1450363 - DNA, 23 bp, Homo sapiens
cctggagatattataagggagag

SEQ ID NO: 1450364 - DNA, 17 bp, Homo sapiens
cctggagcaggagcccc

SEQ ID NO: 1450365 - DNA, 20 bp, Homo sapiens
cctggagccagcagggctgt

SEQ ID NO: 1450366 - DNA, 12 bp, Homo sapiens
cctggagccagg

SEQ ID NO: 1450367 - DNA, 13 bp, Homo sapiens
cctggagccaggg

SEQ ID NO: 1450368 - DNA, 12 bp, Homo sapiens
cctggagccatc

SEQ ID NO: 1450369 - DNA, 21 bp, Homo sapiens
cctggagcccacaaccttcgg

SEQ ID NO: 1450370 - DNA, 17 bp, Homo sapiens
cctggagcccagaggag

SEQ ID NO: 1450371 - DNA, 13 bp, Homo sapiens
cctggagcccctg

SEQ ID NO: 1450372 - DNA, 16 bp, Homo sapiens
cctggagcccctgggt

SEQ ID NO: 1450373 - DNA, 15 bp, Homo sapiens
cctggagccctgggc

SEQ ID NO: 1450374 - DNA, 13 bp, Homo sapiens
cctggagctgtcc

SEQ ID NO: 1450375 - DNA, 16 bp, Homo sapiens
cctggaggatttcatc

SEQ ID NO: 1450376 - DNA, 14 bp, Homo sapiens
cctggaggcacgca

SEQ ID NO: 1450377 - DNA, 20 bp, Homo sapiens
cctggaggcacgcaccactg

SEQ ID NO: 1450378 - DNA, 22 bp, Homo sapiens
cctggaggcactgaagtgctta

SEQ ID NO: 1450379 - DNA, 12 bp, Homo sapiens
cctggaggccca

SEQ ID NO: 1450380 - DNA, 14 bp, Homo sapiens
cctggaggcccagt

SEQ ID NO: 1450381 - DNA, 16 bp, Homo sapiens
cctggaggcccagttc

SEQ ID NO: 1450382 - DNA, 23 bp, Homo sapiens
cctggaggccccaaccctgtcct

SEQ ID NO: 1450383 - DNA, 22 bp, Homo sapiens
cctggagggacttttaatcagt

SEQ ID NO: 1450384 - DNA, 16 bp, Homo sapiens
cctggaggtctccagg

SEQ ID NO: 1450385 - DNA, 19 bp, Homo sapiens
cctggaggtctggctgagc

SEQ ID NO: 1450386 - DNA, 23 bp, Homo sapiens
cctggagtcccgtccctgcccag

SEQ ID NO: 1450387 - DNA, 15 bp, Homo sapiens
tggcccagtcctctc

SEQ ID NO: 1450388 - DNA, 12 bp, Homo sapiens
tggcccagtgtc

SEQ ID NO: 1450389 - DNA, 23 bp, Homo sapiens
tggcccatagaaacatgacactg

SEQ ID NO: 1450390 - DNA, 24 bp, Homo sapiens
tggcccatagaaacatgacactga

SEQ ID NO: 1450391 - DNA, 19 bp, Homo sapiens
tggcccatgggagccaggc

SEQ ID NO: 1450392 - DNA, 16 bp, Homo sapiens
tggccccaccctgggc

SEQ ID NO: 1450393 - DNA, 16 bp, Homo sapiens
tggccccactttgaag

SEQ ID NO: 1450394 - DNA, 13 bp, Homo sapiens
tggccccagccct

SEQ ID NO: 1450395 - DNA, 22 bp, Homo sapiens
tggccccaggcccacagcgtgg

SEQ ID NO: 1450396 - DNA, 23 bp, Homo sapiens
tggccccatgtctctcagaattc

SEQ ID NO: 1450397 - DNA, 13 bp, Homo sapiens
tggcccccaataa

SEQ ID NO: 1450398 - DNA, 15 bp, Homo sapiens
tggcccccaataaag

SEQ ID NO: 1450399 - DNA, 19 bp, Homo sapiens
tggcccccaataaaggcag

SEQ ID NO: 1450400 - DNA, 21 bp, Homo sapiens
tggcccccaataaaggcagct

SEQ ID NO: 1450401 - DNA, 21 bp, Homo sapiens
tggcccccaggattcccccag

SEQ ID NO: 1450402 - DNA, 13 bp, Homo sapiens
tggcccccagggg

SEQ ID NO: 1450403 - DNA, 21 bp, Homo sapiens
tggcccccaggggcaggactg

SEQ ID NO: 1450404 - DNA, 15 bp, Homo sapiens
tggccccgcctgcct

SEQ ID NO: 1450405 - DNA, 19 bp, Homo sapiens
tggccccgcctgcctgcca

SEQ ID NO: 1450406 - DNA, 18 bp, Homo sapiens
tggccccgctagcggggc

SEQ ID NO: 1450407 - DNA, 19 bp, Homo sapiens
tggccccgggctctggcca

SEQ ID NO: 1450408 - DNA, 21 bp, Homo sapiens
tggccccgggctctggccacc

SEQ ID NO: 1450409 - DNA, 23 bp, Homo sapiens
tggccccgggctctggccaccct

SEQ ID NO: 1450410 - DNA, 15 bp, Homo sapiens
tggcccctactttgt

SEQ ID NO: 1450411 - DNA, 21 bp, Homo sapiens
tggcccctattgagaagtttt

SEQ ID NO: 1450412 - DNA, 15 bp, Homo sapiens
tggcccctctgctgt

SEQ ID NO: 1450413 - DNA, 22 bp, Homo sapiens
tggcccctctgctgtcctgcag

SEQ ID NO: 1450414 - DNA, 20 bp, Homo sapiens
tggcccctgaacaagaattg

SEQ ID NO: 1450415 - DNA, 21 bp, Homo sapiens
tggcccctgctgtctctctgg

SEQ ID NO: 1450416 - DNA, 14 bp, Homo sapiens
tggcccctgtgtga

SEQ ID NO: 1450417 - DNA, 14 bp, Homo sapiens
tggcccgacagcct

SEQ ID NO: 1450418 - DNA, 16 bp, Homo sapiens
tggcccgacagcctgg

SEQ ID NO: 1450419 - DNA, 19 bp, Homo sapiens
tggcccgacagcctggcac

SEQ ID NO: 1450420 - DNA, 16 bp, Homo sapiens
tggcccggccggcctg

SEQ ID NO: 1450421 - DNA, 14 bp, Homo sapiens
tggccctcagtttc

SEQ ID NO: 1450422 - DNA, 20 bp, Homo sapiens
tggccctcttgcgggcctgg

SEQ ID NO: 1450423 - DNA, 17 bp, Homo sapiens
tggccctgacttctgga

SEQ ID NO: 1450424 - DNA, 18 bp, Homo sapiens
tggccctgaggtgtgggg

SEQ ID NO: 1450425 - DNA, 21 bp, Homo sapiens
tggccctgccatcttcccagc

SEQ ID NO: 1450426 - DNA, 14 bp, Homo sapiens
tggccctgcccagc

SEQ ID NO: 1450427 - DNA, 16 bp, Homo sapiens
tggccctgcccagccc

SEQ ID NO: 1450428 - DNA, 21 bp, Homo sapiens
tggccctgccctctccttcct

SEQ ID NO: 1450429 - DNA, 13 bp, Homo sapiens
tggccctgcctca

SEQ ID NO: 1450430 - DNA, 16 bp, Homo sapiens
tggccctggagccagg

SEQ ID NO: 1450431 - DNA, 14 bp, Homo sapiens
tggccctggcctgc

SEQ ID NO: 1450432 - DNA, 16 bp, Homo sapiens
tggccctggcctgctg

SEQ ID NO: 1450433 - DNA, 18 bp, Homo sapiens
tggccctggcctgctggg

SEQ ID NO: 1450434 - DNA, 13 bp, Homo sapiens
tggcccttaagcc

SEQ ID NO: 1450435 - DNA, 23 bp, Homo sapiens
tggcccttacttgcttctctagc

SEQ ID NO: 1450436 - DNA, 16 bp, Homo sapiens
tggcccttcagtctgc

SEQ ID NO: 1450437 - DNA, 13 bp, Homo sapiens
tggaatggaaaag

SEQ ID NO: 1450438 - DNA, 21 bp, Homo sapiens
tggaatggaaaagcaacttca

SEQ ID NO: 1450439 - DNA, 21 bp, Homo sapiens
tggaatggaactactgtactt

SEQ ID NO: 1450440 - DNA, 22 bp, Homo sapiens
tggaatggaactactgtacttt

SEQ ID NO: 1450441 - DNA, 13 bp, Homo sapiens
tggaatggtgttt

SEQ ID NO: 1450442 - DNA, 20 bp, Homo sapiens
tggaatggtgttttgtcaga

SEQ ID NO: 1450443 - DNA, 16 bp, Homo sapiens
tggaatggtttgggaa

SEQ ID NO: 1450444 - DNA, 14 bp, Homo sapiens
tggaatgtaatcaa

SEQ ID NO: 1450445 - DNA, 21 bp, Homo sapiens
tggaatgtggcccctgaacaa

SEQ ID NO: 1450446 - DNA, 14 bp, Homo sapiens
tggaattataaata

SEQ ID NO: 1450447 - DNA, 15 bp, Homo sapiens
tggaattatgtataa

SEQ ID NO: 1450448 - DNA, 16 bp, Homo sapiens
tggaattatgtataac

SEQ ID NO: 1450449 - DNA, 22 bp, Homo sapiens
tggaattattttgaatgtcaca

SEQ ID NO: 1450450 - DNA, 19 bp, Homo sapiens
tggaattcagcaccctggg

SEQ ID NO: 1450451 - DNA, 20 bp, Homo sapiens
tggaattcctctttaacaag

SEQ ID NO: 1450452 - DNA, 13 bp, Homo sapiens
tggaattcttcct

SEQ ID NO: 1450453 - DNA, 16 bp, Homo sapiens
tggaattgcttaccaa

SEQ ID NO: 1450454 - DNA, 18 bp, Homo sapiens
tggaattgcttaccaaag

SEQ ID NO: 1450455 - DNA, 23 bp, Homo sapiens
tggaattgcttaccaaaggatag

SEQ ID NO: 1450456 - DNA, 17 bp, Homo sapiens
tggaattgggagcttgg

SEQ ID NO: 1450457 - DNA, 14 bp, Homo sapiens
tggaatttgcacca

SEQ ID NO: 1450458 - DNA, 23 bp, Homo sapiens
tggaatttttttttcctggaatt

SEQ ID NO: 1450459 - DNA, 22 bp, Homo sapiens
tggacaaatcacatattttaaa

SEQ ID NO: 1450460 - DNA, 23 bp, Homo sapiens
tggacaacttatttaaaaatatt

SEQ ID NO: 1450461 - DNA, 17 bp, Homo sapiens
tggacaagccaacttgt

SEQ ID NO: 1450462 - DNA, 19 bp, Homo sapiens
tggacacaacagcagtctc

SEQ ID NO: 1450463 - DNA, 22 bp, Homo sapiens
tggacacaacagcagtctcctt

SEQ ID NO: 1450464 - DNA, 14 bp, Homo sapiens
tggacacgagccac

SEQ ID NO: 1450465 - DNA, 17 bp, Homo sapiens
tggacacgagccacaag

SEQ ID NO: 1450466 - DNA, 23 bp, Homo sapiens
tggacacgagccacaagctgcac

SEQ ID NO: 1450467 - DNA, 14 bp, Homo sapiens
tggacactttgaaa

SEQ ID NO: 1450468 - DNA, 23 bp, Homo sapiens
tggacactttgaaatgtgtttct

SEQ ID NO: 1450469 - DNA, 24 bp, Homo sapiens
tggacagacagatgttgggaggat

SEQ ID NO: 1450470 - DNA, 12 bp, Homo sapiens
tggacagctgct

SEQ ID NO: 1450471 - DNA, 11 bp, Homo sapiens
tggacagctta

SEQ ID NO: 1450472 - DNA, 22 bp, Homo sapiens
tggacagcttacctagtcttgt

SEQ ID NO: 1450473 - DNA, 18 bp, Homo sapiens
tggacaggagatcagcag

SEQ ID NO: 1450474 - DNA, 19 bp, Homo sapiens
tggacaggatgaggacaga

SEQ ID NO: 1450475 - DNA, 12 bp, Homo sapiens
tggacaggcagc

SEQ ID NO: 1450476 - DNA, 15 bp, Homo sapiens
tggaaaggggagagc

SEQ ID NO: 1450477 - DNA, 22 bp, Homo sapiens
tggaaaggggagagcctgctgg

SEQ ID NO: 1450478 - DNA, 14 bp, Homo sapiens
tggaaaggtcctgc

SEQ ID NO: 1450479 - DNA, 18 bp, Homo sapiens
tggaaaggtcctgctgtg

SEQ ID NO: 1450480 - DNA, 13 bp, Homo sapiens
tggaaagtagctg

SEQ ID NO: 1450481 - DNA, 12 bp, Homo sapiens
tggaaagtcaga

SEQ ID NO: 1450482 - DNA, 18 bp, Homo sapiens
tggaaatacagttgttgg

SEQ ID NO: 1450483 - DNA, 15 bp, Homo sapiens
tggaaatactagatt

SEQ ID NO: 1450484 - DNA, 16 bp, Homo sapiens
tggaaatagcatgaca

SEQ ID NO: 1450485 - DNA, 20 bp, Homo sapiens
tggaaatattaagaaagact

SEQ ID NO: 1450486 - DNA, 23 bp, Homo sapiens
tggaaatcagttgtgaatacatt

SEQ ID NO: 1450487 - DNA, 19 bp, Homo sapiens
tggaaatgatgttggtcca

SEQ ID NO: 1450488 - DNA, 11 bp, Homo sapiens
tggaaatgtag

SEQ ID NO: 1450489 - DNA, 13 bp, Homo sapiens
tggaaatgtctgc

SEQ ID NO: 1450490 - DNA, 18 bp, Homo sapiens
tggaaatgtctgctggta

SEQ ID NO: 1450491 - DNA, 14 bp, Homo sapiens
tggaaattctgaaa

SEQ ID NO: 1450492 - DNA, 18 bp, Homo sapiens
tggaaattctgaaaactg

SEQ ID NO: 1450493 - DNA, 16 bp, Homo sapiens
tggaaattgacgaggg

SEQ ID NO: 1450494 - DNA, 18 bp, Homo sapiens
tggaacaagacagccttc

SEQ ID NO: 1450495 - DNA, 20 bp, Homo sapiens
tggaacaccagcagcactgg

SEQ ID NO: 1450496 - DNA, 15 bp, Homo sapiens
tggaacaccctggat

SEQ ID NO: 1450497 - DNA, 13 bp, Homo sapiens
tggaacacttcga

SEQ ID NO: 1450498 - DNA, 19 bp, Homo sapiens
tggaacagcgggagacctg

SEQ ID NO: 1450499 - DNA, 19 bp, Homo sapiens
tggaacatggctagccttt

SEQ ID NO: 1450500 - DNA, 13 bp, Homo sapiens
tggaacatttctt

SEQ ID NO: 1450501 - DNA, 11 bp, Homo sapiens
tggaaccaatc

SEQ ID NO: 1450502 - DNA, 13 bp, Homo sapiens
tggaaccagactc

SEQ ID NO: 1450503 - DNA, 19 bp, Homo sapiens
tggaaccagactcttgcct

SEQ ID NO: 1450504 - DNA, 15 bp, Homo sapiens
tggaaccagagccac

SEQ ID NO: 1450505 - DNA, 17 bp, Homo sapiens
tggaaccagggaggaga

SEQ ID NO: 1450506 - DNA, 19 bp, Homo sapiens
tggaaccctaaataataaa

SEQ ID NO: 1450507 - DNA, 23 bp, Homo sapiens
tggaacctcagcctggccagaca

SEQ ID NO: 1450508 - DNA, 21 bp, Homo sapiens
tggaacctcattgctaccaca

SEQ ID NO: 1450509 - DNA, 13 bp, Homo sapiens
tggaaccttgttt

SEQ ID NO: 1450510 - DNA, 13 bp, Homo sapiens
cctctgctccctc

SEQ ID NO: 1450511 - DNA, 16 bp, Homo sapiens
cctctgctctgcctgg

SEQ ID NO: 1450512 - DNA, 17 bp, Homo sapiens
cctctgctctgcctgga

SEQ ID NO: 1450513 - DNA, 19 bp, Homo sapiens
cctctgctctgcctggagt

SEQ ID NO: 1450514 - DNA, 12 bp, Homo sapiens
cctctgctgccg

SEQ ID NO: 1450515 - DNA, 13 bp, Homo sapiens
cctctgctgccgg

SEQ ID NO: 1450516 - DNA, 15 bp, Homo sapiens
cctctgctgccggct

SEQ ID NO: 1450517 - DNA, 19 bp, Homo sapiens
cctctgctgctgtccctcc

SEQ ID NO: 1450518 - DNA, 20 bp, Homo sapiens
cctctgctgctgtccctccc

SEQ ID NO: 1450519 - DNA, 22 bp, Homo sapiens
cctctgctttctcctttaattg

SEQ ID NO: 1450520 - DNA, 16 bp, Homo sapiens
cctctggaaagcaaag

SEQ ID NO: 1450521 - DNA, 16 bp, Homo sapiens
cctctggaattgctca

SEQ ID NO: 1450522 - DNA, 12 bp, Homo sapiens
cctctggacagt

SEQ ID NO: 1450523 - DNA, 16 bp, Homo sapiens
cctctggacagttgtg

SEQ ID NO: 1450524 - DNA, 15 bp, Homo sapiens
cctctggacggcagg

SEQ ID NO: 1450525 - DNA, 16 bp, Homo sapiens
cctctggacggcaggc

SEQ ID NO: 1450526 - DNA, 14 bp, Homo sapiens
cctctggactggct

SEQ ID NO: 1450527 - DNA, 20 bp, Homo sapiens
cctctggaggggtgtggctc

SEQ ID NO: 1450528 - DNA, 15 bp, Homo sapiens
cctctggccaggatg

SEQ ID NO: 1450529 - DNA, 12 bp, Homo sapiens
cctctggccctg

SEQ ID NO: 1450530 - DNA, 13 bp, Homo sapiens
cctctggccctgc

SEQ ID NO: 1450531 - DNA, 18 bp, Homo sapiens
cctctggccctgccttct

SEQ ID NO: 1450532 - DNA, 15 bp, Homo sapiens
cctctggccgccacc

SEQ ID NO: 1450533 - DNA, 12 bp, Homo sapiens
cctctggctaga

SEQ ID NO: 1450534 - DNA, 16 bp, Homo sapiens
cctctggctagagccg

SEQ ID NO: 1450535 - DNA, 19 bp, Homo sapiens
cctctggctagagccgagg

SEQ ID NO: 1450536 - DNA, 22 bp, Homo sapiens
cctctggctagaggccagcccc

SEQ ID NO: 1450537 - DNA, 23 bp, Homo sapiens
cctctggctggctaactggaagc

SEQ ID NO: 1450538 - DNA, 13 bp, Homo sapiens
cctctggcttccc

SEQ ID NO: 1450539 - DNA, 14 bp, Homo sapiens
cctctggcttccca

SEQ ID NO: 1450540 - DNA, 22 bp, Homo sapiens
cctctggcttgggcagggtctg

SEQ ID NO: 1450541 - DNA, 12 bp, Homo sapiens
cctctgggactg

SEQ ID NO: 1450542 - DNA, 16 bp, Homo sapiens
cctctgggcagtgtgg

SEQ ID NO: 1450543 - DNA, 21 bp, Homo sapiens
cctctgggcagtgtggcctct

SEQ ID NO: 1450544 - DNA, 15 bp, Homo sapiens
cctctgggcctgttc

SEQ ID NO: 1450545 - DNA, 16 bp, Homo sapiens
cctctgggcctgttct

SEQ ID NO: 1450546 - DNA, 14 bp, Homo sapiens
cctctgggggtcct

SEQ ID NO: 1450547 - DNA, 16 bp, Homo sapiens
cctctgggggtcctct

SEQ ID NO: 1450548 - DNA, 14 bp, Homo sapiens
cctctgggtttcta

SEQ ID NO: 1450549 - DNA, 19 bp, Homo sapiens
cctctggtcgctcctgccc

SEQ ID NO: 1450550 - DNA, 20 bp, Homo sapiens
cctctggtcgctcctgccca

SEQ ID NO: 1450551 - DNA, 20 bp, Homo sapiens
cctctggtggctcctcctag

SEQ ID NO: 1450552 - DNA, 21 bp, Homo sapiens
cctctgtaccgcccggcagcc

SEQ ID NO: 1450553 - DNA, 20 bp, Homo sapiens
cctctgtaggcagcagagag

SEQ ID NO: 1450554 - DNA, 23 bp, Homo sapiens
cctctgtccgcctttacaaggga

SEQ ID NO: 1450555 - DNA, 14 bp, Homo sapiens
cctctgtctaggac

SEQ ID NO: 1450556 - DNA, 14 bp, Homo sapiens
cctctgtctggagc

SEQ ID NO: 1450557 - DNA, 20 bp, Homo sapiens
cctctgtcttcagcaccctc

SEQ ID NO: 1450558 - DNA, 22 bp, Homo sapiens
cctctgtcttgtgaaggcaggg

SEQ ID NO: 1450559 - DNA, 18 bp, Homo sapiens
cctctgtgcacagtggct

SEQ ID NO: 1450560 - DNA, 21 bp, Homo sapiens
cctctgtgccttcttttgatt

SEQ ID NO: 1450561 - DNA, 15 bp, Homo sapiens
cctctgtgctgtgtg

SEQ ID NO: 1450562 - DNA, 21 bp, Homo sapiens
cctctgtgtagccgccctgag

SEQ ID NO: 1450563 - DNA, 18 bp, Homo sapiens
cctctgttcaaagctgcc

SEQ ID NO: 1450564 - DNA, 21 bp, Homo sapiens
cctctgttcacaaactacctc

SEQ ID NO: 1450565 - DNA, 15 bp, Homo sapiens
cctctgttgtcctcc

SEQ ID NO: 1450566 - DNA, 18 bp, Homo sapiens
cctctgttgtcctcccct

SEQ ID NO: 1450567 - DNA, 23 bp, Homo sapiens
cctctgttgtcctccccttgggc

SEQ ID NO: 1450568 - DNA, 21 bp, Homo sapiens
cctctgtttctctttccttgg

SEQ ID NO: 1450569 - DNA, 18 bp, Homo sapiens
cctcttaaaaaataaaaa

SEQ ID NO: 1450570 - DNA, 23 bp, Homo sapiens
cctcttaaattatatatttattt

SEQ ID NO: 1450571 - DNA, 19 bp, Homo sapiens
cctcttaagatctgactgc

SEQ ID NO: 1450572 - DNA, 22 bp, Homo sapiens
cctcttaagatctgactgccaa

SEQ ID NO: 1450573 - DNA, 15 bp, Homo sapiens
cctcttaccttcccg

SEQ ID NO: 1450574 - DNA, 16 bp, Homo sapiens
cctcttattcctaagg

SEQ ID NO: 1450575 - DNA, 13 bp, Homo sapiens
cctcttcaaatta

SEQ ID NO: 1450576 - DNA, 14 bp, Homo sapiens
cctcttccagtctt

SEQ ID NO: 1450577 - DNA, 14 bp, Homo sapiens
cctcttccccagaa

SEQ ID NO: 1450578 - DNA, 15 bp, Homo sapiens
cctcttcccccaaga

SEQ ID NO: 1450579 - DNA, 16 bp, Homo sapiens
cctcttccctctccct

SEQ ID NO: 1450580 - DNA, 15 bp, Homo sapiens
cctcttccctctggg

SEQ ID NO: 1450581 - DNA, 16 bp, Homo sapiens
cctcttccctctgggc

SEQ ID NO: 1450582 - DNA, 17 bp, Homo sapiens
cctcttccctctgggcc

SEQ ID NO: 1450583 - DNA, 19 bp, Homo sapiens
cctcttccctctgggcctg

SEQ ID NO: 1450584 - DNA, 20 bp, Homo sapiens
cctcttccctctgggcctgt

SEQ ID NO: 1450585 - DNA, 20 bp, Homo sapiens
cctcttcccttagcctctcc

SEQ ID NO: 1450586 - DNA, 22 bp, Homo sapiens
cctcttcccttagcctctccca

SEQ ID NO: 1450587 - DNA, 11 bp, Homo sapiens
cctcttcctct

SEQ ID NO: 1450588 - DNA, 19 bp, Homo sapiens
cctcttcctgcccttgaac

SEQ ID NO: 1450589 - DNA, 20 bp, Homo sapiens
cctcttctagatggacccca

SEQ ID NO: 1450590 - DNA, 20 bp, Homo sapiens
cctcttctgacgtgcctttt

SEQ ID NO: 1450591 - DNA, 14 bp, Homo sapiens
cctcttctgctctt

SEQ ID NO: 1450592 - DNA, 21 bp, Homo sapiens
cctcttctgctcttttcctgg

SEQ ID NO: 1450593 - DNA, 23 bp, Homo sapiens
cctcttctggagatggaagcttg

SEQ ID NO: 1450594 - DNA, 16 bp, Homo sapiens
cctcttctgggcctga

SEQ ID NO: 1450595 - DNA, 20 bp, Homo sapiens
cctcttctgtccctgttaga

SEQ ID NO: 1450596 - DNA, 16 bp, Homo sapiens
cctcttcttcttcaga

SEQ ID NO: 1450597 - DNA, 16 bp, Homo sapiens
cctcttctttgtgcct

SEQ ID NO: 1450598 - DNA, 18 bp, Homo sapiens
cctcttctttgtgccttt

SEQ ID NO: 1450599 - DNA, 11 bp, Homo sapiens
cctcttctttt

SEQ ID NO: 1450600 - DNA, 16 bp, Homo sapiens
cctcttgaatttttga

SEQ ID NO: 1450601 - DNA, 13 bp, Homo sapiens
cctcttgaccagg

SEQ ID NO: 1450602 - DNA, 20 bp, Homo sapiens
cctcttgaccaggctgcctc

SEQ ID NO: 1450603 - DNA, 16 bp, Homo sapiens
cctcttgagcagtggc

SEQ ID NO: 1450604 - DNA, 13 bp, Homo sapiens
cctcttgcccatc

SEQ ID NO: 1450605 - DNA, 12 bp, Homo sapiens
cctcttgcccgc

SEQ ID NO: 1450606 - DNA, 17 bp, Homo sapiens
cctcttgctcagagcta

SEQ ID NO: 1450607 - DNA, 14 bp, Homo sapiens
cctcttggagaagt

SEQ ID NO: 1450608 - DNA, 21 bp, Homo sapiens
cctcttggagaagtctcagct

SEQ ID NO: 1450609 - DNA, 22 bp, Homo sapiens
cctcttggagaagtctcagcta

SEQ ID NO: 1450610 - DNA, 21 bp, Homo sapiens
cctcttggctatttctgtgtc

SEQ ID NO: 1450611 - DNA, 22 bp, Homo sapiens
cctcttggctatttctgtgtcc

SEQ ID NO: 1450612 - DNA, 15 bp, Homo sapiens
cctcttggctgcctt

SEQ ID NO: 1450613 - DNA, 21 bp, Homo sapiens
cctcttggtgggtgtggccag

SEQ ID NO: 1450614 - DNA, 23 bp, Homo sapiens
cctcttggtgggtgtggccagca

SEQ ID NO: 1450615 - DNA, 19 bp, Homo sapiens
cctcttgtccctttcccta

SEQ ID NO: 1450616 - DNA, 13 bp, Homo sapiens
cctcttgtcctgg

SEQ ID NO: 1450617 - DNA, 20 bp, Homo sapiens
cctcttgtcctggcccttca

SEQ ID NO: 1450618 - DNA, 13 bp, Homo sapiens
cctcttgtgctca

SEQ ID NO: 1450619 - DNA, 13 bp, Homo sapiens
cctcttgtgtaac

SEQ ID NO: 1450620 - DNA, 18 bp, Homo sapiens
cctcttgttactccctgt

SEQ ID NO: 1450621 - DNA, 12 bp, Homo sapiens
cctcttgttgca

SEQ ID NO: 1450622 - DNA, 17 bp, Homo sapiens
cctcttgttgcagagat

SEQ ID NO: 1450623 - DNA, 15 bp, Homo sapiens
cctctttactccctt

SEQ ID NO: 1450624 - DNA, 19 bp, Homo sapiens
cctctttactcccttcctg

SEQ ID NO: 1450625 - DNA, 23 bp, Homo sapiens
tgctgtgtatatggtatatatac

SEQ ID NO: 1450626 - DNA, 16 bp, Homo sapiens
tgctgtgtgaatccag

SEQ ID NO: 1450627 - DNA, 15 bp, Homo sapiens
tgctgtgtgagtgag

SEQ ID NO: 1450628 - DNA, 15 bp, Homo sapiens
tgctgtgtgcttttt

SEQ ID NO: 1450629 - DNA, 18 bp, Homo sapiens
tgctgtgtgtcccaggca

SEQ ID NO: 1450630 - DNA, 21 bp, Homo sapiens
tgctgtgtgtcccaggcaggg

SEQ ID NO: 1450631 - DNA, 11 bp, Homo sapiens
tgctgtgttaa

SEQ ID NO: 1450632 - DNA, 15 bp, Homo sapiens
tgctgttaaagacat

SEQ ID NO: 1450633 - DNA, 13 bp, Homo sapiens
tgctgttaatatt

SEQ ID NO: 1450634 - DNA, 13 bp, Homo sapiens
tgctgttacatgc

SEQ ID NO: 1450635 - DNA, 12 bp, Homo sapiens
tgctgtttctaa

SEQ ID NO: 1450636 - DNA, 16 bp, Homo sapiens
tgctgtttctaagaaa

SEQ ID NO: 1450637 - DNA, 23 bp, Homo sapiens
tgctgttttaaacattaatagca

SEQ ID NO: 1450638 - DNA, 15 bp, Homo sapiens
tgctgttttatgtca

SEQ ID NO: 1450639 - DNA, 16 bp, Homo sapiens
tgctgttttatgtcat

SEQ ID NO: 1450640 - DNA, 18 bp, Homo sapiens
tgctgttttgatttgtac

SEQ ID NO: 1450641 - DNA, 16 bp, Homo sapiens
tgctgttttgttctgt

SEQ ID NO: 1450642 - DNA, 14 bp, Homo sapiens
tgcttaaaataagc

SEQ ID NO: 1450643 - DNA, 17 bp, Homo sapiens
tgcttaaaataagcagg

SEQ ID NO: 1450644 - DNA, 19 bp, Homo sapiens
tgcttaaacacaagaagga

SEQ ID NO: 1450645 - DNA, 14 bp, Homo sapiens
tgcttaaaccactt

SEQ ID NO: 1450646 - DNA, 17 bp, Homo sapiens
tgcttaaattccaagtc

SEQ ID NO: 1450647 - DNA, 13 bp, Homo sapiens
tgcttaaatttct

SEQ ID NO: 1450648 - DNA, 22 bp, Homo sapiens
tgcttaaatttcttatgtgaca

SEQ ID NO: 1450649 - DNA, 13 bp, Homo sapiens
tgcttaaatttta

SEQ ID NO: 1450650 - DNA, 20 bp, Homo sapiens
tgcttaaggtttgttttcat

SEQ ID NO: 1450651 - DNA, 21 bp, Homo sapiens
tgccctggggctgatctcagg

SEQ ID NO: 1450652 - DNA, 22 bp, Homo sapiens
tgccctggggctgatctcaggg

SEQ ID NO: 1450653 - DNA, 18 bp, Homo sapiens
tgccctgggttcttccac

SEQ ID NO: 1450654 - DNA, 16 bp, Homo sapiens
tgccctggtgctgcca

SEQ ID NO: 1450655 - DNA, 20 bp, Homo sapiens
tgccctggtgctgccacact

SEQ ID NO: 1450656 - DNA, 21 bp, Homo sapiens
tgccctggtgctgccacactt

SEQ ID NO: 1450657 - DNA, 17 bp, Homo sapiens
tgccctgtaacttatct

SEQ ID NO: 1450658 - DNA, 14 bp, Homo sapiens
tgccctgtgtggct

SEQ ID NO: 1450659 - DNA, 15 bp, Homo sapiens
tgcctcgaggcaccg

SEQ ID NO: 1450660 - DNA, 21 bp, Homo sapiens
tgcctcgaggcaccggcgctg

SEQ ID NO: 1450661 - DNA, 14 bp, Homo sapiens
tgcctcgctccctt

SEQ ID NO: 1450662 - DNA, 17 bp, Homo sapiens
tgcctcggactccatgg

SEQ ID NO: 1450663 - DNA, 13 bp, Homo sapiens
tgcctctcagcca

SEQ ID NO: 1450664 - DNA, 21 bp, Homo sapiens
tgcctctcatcaactgaatga

SEQ ID NO: 1450665 - DNA, 13 bp, Homo sapiens
tgcctctcccgca

SEQ ID NO: 1450666 - DNA, 19 bp, Homo sapiens
tgcctctcccgcaccaggc

SEQ ID NO: 1450667 - DNA, 19 bp, Homo sapiens
tgcctctcctccacagccc

SEQ ID NO: 1450668 - DNA, 15 bp, Homo sapiens
tgcctctctaggacc

SEQ ID NO: 1450669 - DNA, 19 bp, Homo sapiens
tgcctctgaaacagaaagt

SEQ ID NO: 1450670 - DNA, 19 bp, Homo sapiens
tgcctctgatatgggactg

SEQ ID NO: 1450671 - DNA, 21 bp, Homo sapiens
tgcctctgatatgggactgag

SEQ ID NO: 1450672 - DNA, 13 bp, Homo sapiens
tgcctctgcagtc

SEQ ID NO: 1450673 - DNA, 14 bp, Homo sapiens
tgcctctgcagtct

SEQ ID NO: 1450674 - DNA, 24 bp, Homo sapiens
tgcctctgcagtctcatttctcat

SEQ ID NO: 1450675 - DNA, 16 bp, Homo sapiens
tgcctctgcctcccaa

SEQ ID NO: 1450676 - DNA, 23 bp, Homo sapiens
tgcctctgcctcccaaagtgctg

SEQ ID NO: 1450677 - DNA, 12 bp, Homo sapiens
tgcctctgctcc

SEQ ID NO: 1450678 - DNA, 14 bp, Homo sapiens
tgcctctgggccat

SEQ ID NO: 1450679 - DNA, 20 bp, Homo sapiens
tgcctctgtccccttctctc

SEQ ID NO: 1450680 - DNA, 12 bp, Homo sapiens
tgcctctgtgca

SEQ ID NO: 1450681 - DNA, 13 bp, Homo sapiens
tgcctctgtgcac

SEQ ID NO: 1450682 - DNA, 12 bp, Homo sapiens
tgcctcttccag

SEQ ID NO: 1450683 - DNA, 16 bp, Homo sapiens
tgcctcttccagtgaa

SEQ ID NO: 1450684 - DNA, 17 bp, Homo sapiens
tgcctcttgttgcagag

SEQ ID NO: 1450685 - DNA, 11 bp, Homo sapiens
tgcctctttcc

SEQ ID NO: 1450686 - DNA, 17 bp, Homo sapiens
tgcctgaacatccttcc

SEQ ID NO: 1450687 - DNA, 16 bp, Homo sapiens
tgcctgaaccttccat

SEQ ID NO: 1450688 - DNA, 23 bp, Homo sapiens
tgcctgaccctacttcttttgct

SEQ ID NO: 1450689 - DNA, 20 bp, Homo sapiens
tgcctgactaatttttgtat

SEQ ID NO: 1450690 - DNA, 16 bp, Homo sapiens
tgcctgactcctgggt

SEQ ID NO: 1450691 - DNA, 21 bp, Homo sapiens
tgcctgactgcccgctcctcg

SEQ ID NO: 1450692 - DNA, 13 bp, Homo sapiens
tgcctgagaggca

SEQ ID NO: 1450693 - DNA, 17 bp, Homo sapiens
tgcctgagaggcaggca

SEQ ID NO: 1450694 - DNA, 18 bp, Homo sapiens
tgcctgagaggcaggcat

SEQ ID NO: 1450695 - DNA, 22 bp, Homo sapiens
tgcctgagcacctcccagcccc

SEQ ID NO: 1450696 - DNA, 16 bp, Homo sapiens
tgcctgagctggggaa

SEQ ID NO: 1450697 - DNA, 23 bp, Homo sapiens
tgcctgaggaggaggacacagca

SEQ ID NO: 1450698 - DNA, 22 bp, Homo sapiens
tgcctgagggcccctctgccca

SEQ ID NO: 1450699 - DNA, 14 bp, Homo sapiens
tgcctgagggtgga

SEQ ID NO: 1450700 - DNA, 15 bp, Homo sapiens
tgcctgatccctgaa

SEQ ID NO: 1450701 - DNA, 16 bp, Homo sapiens
tgcctgatccctgaac

SEQ ID NO: 1450702 - DNA, 22 bp, Homo sapiens
tgcctgatccctgaacccctgg

SEQ ID NO: 1450703 - DNA, 16 bp, Homo sapiens
tgcctgattcatagta

SEQ ID NO: 1450704 - DNA, 20 bp, Homo sapiens
tgcctgattcggacggccaa

SEQ ID NO: 1450705 - DNA, 15 bp, Homo sapiens
tgcctgcaccaggag

SEQ ID NO: 1450706 - DNA, 16 bp, Homo sapiens
tgcctgcaccaggaga

SEQ ID NO: 1450707 - DNA, 20 bp, Homo sapiens
tgcctgcaccaggagacaga

SEQ ID NO: 1450708 - DNA, 21 bp, Homo sapiens
tgcctgcacccttccctcttc

SEQ ID NO: 1450709 - DNA, 22 bp, Homo sapiens
tgcctgcacccttccctcttcc

SEQ ID NO: 1450710 - DNA, 20 bp, Homo sapiens
tgcctgcactccctggcctt

SEQ ID NO: 1450711 - DNA, 22 bp, Homo sapiens
tgcctgcactgagagggcaagg

SEQ ID NO: 1450712 - DNA, 19 bp, Homo sapiens
tgcctgcagaggtctgtgc

SEQ ID NO: 1450713 - DNA, 15 bp, Homo sapiens
tgcctgcagcacatg

SEQ ID NO: 1450714 - DNA, 17 bp, Homo sapiens
tgcctgcagggccatgg

SEQ ID NO: 1450715 - DNA, 22 bp, Homo sapiens
tgcctgcagggccatggctcag

SEQ ID NO: 1450716 - DNA, 15 bp, Homo sapiens
tgcctgcaggggagc

SEQ ID NO: 1450717 - DNA, 15 bp, Homo sapiens
tgcctgccaccttca

SEQ ID NO: 1450718 - DNA, 13 bp, Homo sapiens
tgcctgccactct

SEQ ID NO: 1450719 - DNA, 19 bp, Homo sapiens
tgcctgccactctctggga

SEQ ID NO: 1450720 - DNA, 19 bp, Homo sapiens
tgcctgccagctgcactga

SEQ ID NO: 1450721 - DNA, 17 bp, Homo sapiens
tgcctgccccgccccca

SEQ ID NO: 1450722 - DNA, 21 bp, Homo sapiens
tgcctgcccctaccctggact

SEQ ID NO: 1450723 - DNA, 17 bp, Homo sapiens
tgcctgcccgcaccctg

SEQ ID NO: 1450724 - DNA, 16 bp, Homo sapiens
tgcctgccgcccaaag

SEQ ID NO: 1450725 - DNA, 15 bp, Homo sapiens
tgcctgcctgtctgt

SEQ ID NO: 1450726 - DNA, 13 bp, Homo sapiens
tgcctgctccctg

SEQ ID NO: 1450727 - DNA, 16 bp, Homo sapiens
tgcctgctccctgtct

SEQ ID NO: 1450728 - DNA, 10 bp, Homo sapiens
tgcctgctga

SEQ ID NO: 1450729 - DNA, 13 bp, Homo sapiens
tgcctgctgggga

SEQ ID NO: 1450730 - DNA, 19 bp, Homo sapiens
tgcctgcttggcccggccg

SEQ ID NO: 1450731 - DNA, 18 bp, Homo sapiens
tgcctggaacaccagcag

SEQ ID NO: 1450732 - DNA, 15 bp, Homo sapiens
tgcctggactgacca

SEQ ID NO: 1450733 - DNA, 22 bp, Homo sapiens
tgcctggagacaaggtgctaac

SEQ ID NO: 1450734 - DNA, 22 bp, Homo sapiens
tgcctggatgagaaacagctca

SEQ ID NO: 1450735 - DNA, 18 bp, Homo sapiens
tgcctggatgggggtgca

SEQ ID NO: 1450736 - DNA, 20 bp, Homo sapiens
tgcctggccaggcagatctg

SEQ ID NO: 1450737 - DNA, 15 bp, Homo sapiens
tgcctggccaggccc

SEQ ID NO: 1450738 - DNA, 12 bp, Homo sapiens
tgcctggccccc

SEQ ID NO: 1450739 - DNA, 12 bp, Homo sapiens
tgcctggcctgg

SEQ ID NO: 1450740 - DNA, 14 bp, Homo sapiens
tgcctggcctggct

SEQ ID NO: 1450741 - DNA, 18 bp, Homo sapiens
tgcctggctgtggaggcc

SEQ ID NO: 1450742 - DNA, 19 bp, Homo sapiens
tgcctggctgtggaggcct

SEQ ID NO: 1450743 - DNA, 21 bp, Homo sapiens
tgcctggctgtggaggcctga

SEQ ID NO: 1450744 - DNA, 20 bp, Homo sapiens
tgcctgggatgggctcccac

SEQ ID NO: 1450745 - DNA, 14 bp, Homo sapiens
tgcctgggcccgga

SEQ ID NO: 1450746 - DNA, 22 bp, Homo sapiens
tgcctgggcccggaagggcttt

SEQ ID NO: 1450747 - DNA, 23 bp, Homo sapiens
tgcctgggcctgtgcagcagccc

SEQ ID NO: 1450748 - DNA, 19 bp, Homo sapiens
tgcctgggggagagaggca

SEQ ID NO: 1450749 - DNA, 19 bp, Homo sapiens
tgcctgggtggggctgctc

SEQ ID NO: 1450750 - DNA, 20 bp, Homo sapiens
tgcctggtatatccaaaagc

SEQ ID NO: 1450751 - DNA, 19 bp, Homo sapiens
tgcctggtattttcaacca

SEQ ID NO: 1450752 - DNA, 17 bp, Homo sapiens
tgcctggtctgtctgga

SEQ ID NO: 1450753 - DNA, 18 bp, Homo sapiens
tgcctggtctgtctggat

SEQ ID NO: 1450754 - DNA, 15 bp, Homo sapiens
tgcctggtgcattgc

SEQ ID NO: 1450755 - DNA, 18 bp, Homo sapiens
tgcctggttaatattaat

SEQ ID NO: 1450756 - DNA, 15 bp, Homo sapiens
tgcctgtaacttgag

SEQ ID NO: 1450757 - DNA, 17 bp, Homo sapiens
tgcctgtaatcccagaa

SEQ ID NO: 1450758 - DNA, 19 bp, Homo sapiens
tgcctgtaatcccagaact

SEQ ID NO: 1450759 - DNA, 22 bp, Homo sapiens
tgcctgtagctttcctggtccc

SEQ ID NO: 1450760 - DNA, 14 bp, Homo sapiens
tgcctgtattttcg

SEQ ID NO: 1450761 - DNA, 11 bp, Homo sapiens
tgcctgtctcc

SEQ ID NO: 1450762 - DNA, 16 bp, Homo sapiens
tgcctgtctccatgag

SEQ ID NO: 1450763 - DNA, 14 bp, Homo sapiens
tgcctgtctgcccc

SEQ ID NO: 1450764 - DNA, 16 bp, Homo sapiens
tgcctgtctgccccag

SEQ ID NO: 1450765 - DNA, 18 bp, Homo sapiens
tgcctgtctgtctctcca

SEQ ID NO: 1450766 - DNA, 23 bp, Homo sapiens
tgcctgtgaagaaccctgcaggg

SEQ ID NO: 1450767 - DNA, 16 bp, Homo sapiens
tgcctgtgaagcagtc

SEQ ID NO: 1450768 - DNA, 16 bp, Homo sapiens
tgcctgtgagccagtc

SEQ ID NO: 1450769 - DNA, 14 bp, Homo sapiens
tgcctgtgaggcag

SEQ ID NO: 1450770 - DNA, 16 bp, Homo sapiens
cctccagcctccctgt

SEQ ID NO: 1450771 - DNA, 22 bp, Homo sapiens
cctccagcctccctgtctccag

SEQ ID NO: 1450772 - DNA, 12 bp, Homo sapiens
cctccagcctct

SEQ ID NO: 1450773 - DNA, 23 bp, Homo sapiens
cctccagctaaacaccaacccct

SEQ ID NO: 1450774 - DNA, 16 bp, Homo sapiens
cctccagctcccactc

SEQ ID NO: 1450775 - DNA, 23 bp, Homo sapiens
cctccagctgccccgggatgcga

SEQ ID NO: 1450776 - DNA, 18 bp, Homo sapiens
cctccaggagagagccag

SEQ ID NO: 1450777 - DNA, 15 bp, Homo sapiens
cctccaggagcctac

SEQ ID NO: 1450778 - DNA, 12 bp, Homo sapiens
cctccaggagct

SEQ ID NO: 1450779 - DNA, 19 bp, Homo sapiens
cctccaggagcttcttgtt

SEQ ID NO: 1450780 - DNA, 16 bp, Homo sapiens
cctccaggcccatctc

SEQ ID NO: 1450781 - DNA, 11 bp, Homo sapiens
cctccaggcct

SEQ ID NO: 1450782 - DNA, 13 bp, Homo sapiens
cctccaggcctgc

SEQ ID NO: 1450783 - DNA, 15 bp, Homo sapiens
cctccaggcctgcag

SEQ ID NO: 1450784 - DNA, 22 bp, Homo sapiens
cctcagcgggggccttgaagac

SEQ ID NO: 1450785 - DNA, 17 bp, Homo sapiens
cctcagcgtcctgggct

SEQ ID NO: 1450786 - DNA, 14 bp, Homo sapiens
cctcagctctctgg

SEQ ID NO: 1450787 - DNA, 13 bp, Homo sapiens
cctcagctgccaa

SEQ ID NO: 1450788 - DNA, 17 bp, Homo sapiens
cctcagctgccaagcac

SEQ ID NO: 1450789 - DNA, 13 bp, Homo sapiens
cctcagctgcctc

SEQ ID NO: 1450790 - DNA, 18 bp, Homo sapiens
cctcagctgcctcacttc

SEQ ID NO: 1450791 - DNA, 19 bp, Homo sapiens
cctcagctgcctcacttcc

SEQ ID NO: 1450792 - DNA, 17 bp, Homo sapiens
cctcaggcacacagcta

SEQ ID NO: 1450793 - DNA, 19 bp, Homo sapiens
cctcaggcaggaagggcag

SEQ ID NO: 1450794 - DNA, 22 bp, Homo sapiens
cctcaggcataggcctgggtgc

SEQ ID NO: 1450795 - DNA, 14 bp, Homo sapiens
cctcaggccagggc

SEQ ID NO: 1450796 - DNA, 22 bp, Homo sapiens
cctcaggccagggctcaccagc

SEQ ID NO: 1450797 - DNA, 13 bp, Homo sapiens
cctcaggctctgc

SEQ ID NO: 1450798 - DNA, 14 bp, Homo sapiens
cctcaggctctgca

SEQ ID NO: 1450799 - DNA, 17 bp, Homo sapiens
cctcagggagcagggaa

SEQ ID NO: 1450800 - DNA, 22 bp, Homo sapiens
cctcagggagcagggaaggcct

SEQ ID NO: 1450801 - DNA, 11 bp, Homo sapiens
cctcagggcac

SEQ ID NO: 1450802 - DNA, 15 bp, Homo sapiens
cctcagggctcccag

SEQ ID NO: 1450803 - DNA, 16 bp, Homo sapiens
cctcaggggtggagaa

SEQ ID NO: 1450804 - DNA, 22 bp, Homo sapiens
tctgcaagtatactagggagcc

SEQ ID NO: 1450805 - DNA, 14 bp, Homo sapiens
tctgcaattcaaaa

SEQ ID NO: 1450806 - DNA, 16 bp, Homo sapiens
tctgcaattcaaaagt

SEQ ID NO: 1450807 - DNA, 21 bp, Homo sapiens
tctgcaattcaaaagttccaa

SEQ ID NO: 1450808 - DNA, 22 bp, Homo sapiens
tctgcaattcccctctgctgct

SEQ ID NO: 1450809 - DNA, 12 bp, Homo sapiens
tctgcaatttgt

SEQ ID NO: 1450810 - DNA, 20 bp, Homo sapiens
tctgcaatttgtttaaagaa

SEQ ID NO: 1450811 - DNA, 21 bp, Homo sapiens
tctgcaatttgtttaaagaat

SEQ ID NO: 1450812 - DNA, 20 bp, Homo sapiens
tctgcacatgtcttgtacat

SEQ ID NO: 1450813 - DNA, 21 bp, Homo sapiens
tctgcacatgtcttgtacatg

SEQ ID NO: 1450814 - DNA, 14 bp, Homo sapiens
tctgcacccagaac

SEQ ID NO: 1450815 - DNA, 12 bp, Homo sapiens
tctgcacccagt

SEQ ID NO: 1450816 - DNA, 18 bp, Homo sapiens
tctgcaccccttctctcc

SEQ ID NO: 1450817 - DNA, 19 bp, Homo sapiens
tctgcaccccttctctcct

SEQ ID NO: 1450818 - DNA, 21 bp, Homo sapiens
tctgcaccccttctctcctcc

SEQ ID NO: 1450819 - DNA, 15 bp, Homo sapiens
tctgcacccgcctcg

SEQ ID NO: 1450820 - DNA, 12 bp, Homo sapiens
tctgcaccctcc

SEQ ID NO: 1450821 - DNA, 15 bp, Homo sapiens
tctgcaccctccacc

SEQ ID NO: 1450822 - DNA, 18 bp, Homo sapiens
tctgcaccctccaccctg

SEQ ID NO: 1450823 - DNA, 24 bp, Homo sapiens
tctgcaccctggggcctggacctg

SEQ ID NO: 1450824 - DNA, 14 bp, Homo sapiens
tctgcactactcct

SEQ ID NO: 1450825 - DNA, 21 bp, Homo sapiens
tctgcactactcctctgcagt

SEQ ID NO: 1450826 - DNA, 18 bp, Homo sapiens
tctgcactactgacatgt

SEQ ID NO: 1450827 - DNA, 17 bp, Homo sapiens
tctgcactccatggcca

SEQ ID NO: 1450828 - DNA, 18 bp, Homo sapiens
tctgcactccatggccac

SEQ ID NO: 1450829 - DNA, 19 bp, Homo sapiens
tctgcactccatggccacc

SEQ ID NO: 1450830 - DNA, 21 bp, Homo sapiens
tctgcactccatggccacccc

SEQ ID NO: 1450831 - DNA, 12 bp, Homo sapiens
tctgcactgaaa

SEQ ID NO: 1450832 - DNA, 18 bp, Homo sapiens
tctgcagaagccaaggga

SEQ ID NO: 1450833 - DNA, 23 bp, Homo sapiens
tctgcagacacgccttcccctca

SEQ ID NO: 1450834 - DNA, 19 bp, Homo sapiens
tctgcagatagaaagcatt

SEQ ID NO: 1450835 - DNA, 20 bp, Homo sapiens
tctgcagcatgacctgtgac

SEQ ID NO: 1450836 - DNA, 18 bp, Homo sapiens
tctgcagccagcccagcc

SEQ ID NO: 1450837 - DNA, 13 bp, Homo sapiens
tctgcagcggcag

SEQ ID NO: 1450838 - DNA, 20 bp, Homo sapiens
tctgcagctgacctctgttg

SEQ ID NO: 1450839 - DNA, 18 bp, Homo sapiens
tctgcagctgcttttgca

SEQ ID NO: 1450840 - DNA, 12 bp, Homo sapiens
tctgcagctgtt

SEQ ID NO: 1450841 - DNA, 17 bp, Homo sapiens
tctgcaggccactgtga

SEQ ID NO: 1450842 - DNA, 19 bp, Homo sapiens
tctgcaggtgggctgctga

SEQ ID NO: 1450843 - DNA, 18 bp, Homo sapiens
tctgcatcatctgtagat

SEQ ID NO: 1450844 - DNA, 21 bp, Homo sapiens
tctgcattgttattgtggaag

SEQ ID NO: 1450845 - DNA, 15 bp, Homo sapiens
tctgcattttaacaa

SEQ ID NO: 1450846 - DNA, 14 bp, Homo sapiens
tctgccaaacacat

SEQ ID NO: 1450847 - DNA, 19 bp, Homo sapiens
tctgccaatttttgccttc

SEQ ID NO: 1450848 - DNA, 14 bp, Homo sapiens
tctgccaccctacc

SEQ ID NO: 1450849 - DNA, 18 bp, Homo sapiens
tctgccaccctacctgtt

SEQ ID NO: 1450850 - DNA, 21 bp, Homo sapiens
tctgccaccctacctgttcag

SEQ ID NO: 1450851 - DNA, 15 bp, Homo sapiens
tctgccacctcccct

SEQ ID NO: 1450852 - DNA, 23 bp, Homo sapiens
tctgccacctcccctatccaccc

SEQ ID NO: 1450853 - DNA, 19 bp, Homo sapiens
tctgccactgaggagacag

SEQ ID NO: 1450854 - DNA, 15 bp, Homo sapiens
tctgccagaatactg

SEQ ID NO: 1450855 - DNA, 13 bp, Homo sapiens
tctgccagccaca

SEQ ID NO: 1450856 - DNA, 19 bp, Homo sapiens
tctgccagccagcagccag

SEQ ID NO: 1450857 - DNA, 12 bp, Homo sapiens
tctgccagcgcc

SEQ ID NO: 1450858 - DNA, 12 bp, Homo sapiens
tctgccaggccc

SEQ ID NO: 1450859 - DNA, 14 bp, Homo sapiens
tctgccagggagct

SEQ ID NO: 1450860 - DNA, 19 bp, Homo sapiens
tctgccagtgacagacagg

SEQ ID NO: 1450861 - DNA, 12 bp, Homo sapiens
tctgccatgtgg

SEQ ID NO: 1450862 - DNA, 23 bp, Homo sapiens
tctgccattgggaccctccagtg

SEQ ID NO: 1450863 - DNA, 22 bp, Homo sapiens
tctgcccacctcagcctcccaa

SEQ ID NO: 1450864 - DNA, 22 bp, Homo sapiens
tctgcccagccgggcacagtgg

SEQ ID NO: 1450865 - DNA, 19 bp, Homo sapiens
tctgcccagcttgggccca

SEQ ID NO: 1450866 - DNA, 14 bp, Homo sapiens
tctgcccaggggtg

SEQ ID NO: 1450867 - DNA, 19 bp, Homo sapiens
tctgcccaggggtgccccc

SEQ ID NO: 1450868 - DNA, 22 bp, Homo sapiens
tctgcccaggggtgccccctcc

SEQ ID NO: 1450869 - DNA, 22 bp, Homo sapiens
tccagtcttcctgacactttaa

SEQ ID NO: 1450870 - DNA, 23 bp, Homo sapiens
tccagtcttcctgacactttaat

SEQ ID NO: 1450871 - DNA, 17 bp, Homo sapiens
tccagtgagatagaata

SEQ ID NO: 1450872 - DNA, 22 bp, Homo sapiens
tccagtgcattttgtttctgta

SEQ ID NO: 1450873 - DNA, 16 bp, Homo sapiens
tccagtgctcagctgt

SEQ ID NO: 1450874 - DNA, 19 bp, Homo sapiens
tccagtgctcagctgtggc

SEQ ID NO: 1450875 - DNA, 16 bp, Homo sapiens
tccagtgctggatttg

SEQ ID NO: 1450876 - DNA, 19 bp, Homo sapiens
tccagtgctggatttgatg

SEQ ID NO: 1450877 - DNA, 16 bp, Homo sapiens
tccagtggcagacaaa

SEQ ID NO: 1450878 - DNA, 20 bp, Homo sapiens
tccagtggcagacaaacaga

SEQ ID NO: 1450879 - DNA, 13 bp, Homo sapiens
tccagtgggcccg

SEQ ID NO: 1450880 - DNA, 17 bp, Homo sapiens
tccagtggtcatgctca

SEQ ID NO: 1450881 - DNA, 16 bp, Homo sapiens
tccagtggtgggtaat

SEQ ID NO: 1450882 - DNA, 21 bp, Homo sapiens
tccagtggtgggtaattgtac

SEQ ID NO: 1450883 - DNA, 22 bp, Homo sapiens
tccagtggtgggtaattgtaca

SEQ ID NO: 1450884 - DNA, 16 bp, Homo sapiens
tccagtggtttgagac

SEQ ID NO: 1450885 - DNA, 16 bp, Homo sapiens
tccagtgtctcggagg

SEQ ID NO: 1450886 - DNA, 13 bp, Homo sapiens
tccagtgtgcacc

SEQ ID NO: 1450887 - DNA, 17 bp, Homo sapiens
tccagtgttggctgtgt

SEQ ID NO: 1450888 - DNA, 21 bp, Homo sapiens
tccagtgttggctgtgtgaca

SEQ ID NO: 1450889 - DNA, 18 bp, Homo sapiens
tccagttaattacatcct

SEQ ID NO: 1450890 - DNA, 13 bp, Homo sapiens
tccagttataaga

SEQ ID NO: 1450891 - DNA, 16 bp, Homo sapiens
tccagttcatgagaat

SEQ ID NO: 1450892 - DNA, 19 bp, Homo sapiens
tccagttcatgagaatcta

SEQ ID NO: 1450893 - DNA, 22 bp, Homo sapiens
tccagtttccccatggggctgc

SEQ ID NO: 1450894 - DNA, 12 bp, Homo sapiens
tccagtttccgg

SEQ ID NO: 1450895 - DNA, 19 bp, Homo sapiens
tccagtttgtgtttttcta

SEQ ID NO: 1450896 - DNA, 23 bp, Homo sapiens
tccataaacagactgttaattat

SEQ ID NO: 1450897 - DNA, 24 bp, Homo sapiens
tccataaagtacaaatgaagaaag

SEQ ID NO: 1450898 - DNA, 17 bp, Homo sapiens
tccataaatgtgttcct

SEQ ID NO: 1450899 - DNA, 18 bp, Homo sapiens
tccataatgctactgtct

SEQ ID NO: 1450900 - DNA, 20 bp, Homo sapiens
tccataatgtataaagaaca

SEQ ID NO: 1450901 - DNA, 13 bp, Homo sapiens
tccataccttttc

SEQ ID NO: 1450902 - DNA, 21 bp, Homo sapiens
tccatagcctaatccctgggc

SEQ ID NO: 1450903 - DNA, 22 bp, Homo sapiens
tccatagcctaatccctgggca

SEQ ID NO: 1450904 - DNA, 22 bp, Homo sapiens
tccataggactaccgcaggccc

SEQ ID NO: 1450905 - DNA, 23 bp, Homo sapiens
tccataggactaccgcaggcccg

SEQ ID NO: 1450906 - DNA, 19 bp, Homo sapiens
tccatataagcccttgatt

SEQ ID NO: 1450907 - DNA, 14 bp, Homo sapiens
tccatatcagctct

SEQ ID NO: 1450908 - DNA, 18 bp, Homo sapiens
tccatatttgatttctaa

SEQ ID NO: 1450909 - DNA, 23 bp, Homo sapiens
tccatcaactcccaacttcttcc

SEQ ID NO: 1450910 - DNA, 21 bp, Homo sapiens
tccatcaccatttcttggcat

SEQ ID NO: 1450911 - DNA, 19 bp, Homo sapiens
tccatcacgttagctgtcc

SEQ ID NO: 1450912 - DNA, 22 bp, Homo sapiens
tccatcagcgggtctcctccca

SEQ ID NO: 1450913 - DNA, 18 bp, Homo sapiens
tccatcaggttccatccc

SEQ ID NO: 1450914 - DNA, 18 bp, Homo sapiens
tccatcatcactgtaaag

SEQ ID NO: 1450915 - DNA, 19 bp, Homo sapiens
tccatcatcactgtaaaga

SEQ ID NO: 1450916 - DNA, 14 bp, Homo sapiens
tccatccaccacct

SEQ ID NO: 1450917 - DNA, 21 bp, Homo sapiens
tccatccacctcatcactgga

SEQ ID NO: 1450918 - DNA, 12 bp, Homo sapiens
tccatccatcct

SEQ ID NO: 1450919 - DNA, 14 bp, Homo sapiens
tccatccatccttc

SEQ ID NO: 1450920 - DNA, 15 bp, Homo sapiens
tccatccatctccag

SEQ ID NO: 1450921 - DNA, 12 bp, Homo sapiens
tccatccatctt

SEQ ID NO: 1450922 - DNA, 16 bp, Homo sapiens
tccatccatctttcca

SEQ ID NO: 1450923 - DNA, 17 bp, Homo sapiens
tccatcccaacagccat

SEQ ID NO: 1450924 - DNA, 15 bp, Homo sapiens
tccatcccagcggct

SEQ ID NO: 1450925 - DNA, 14 bp, Homo sapiens
tccatcccatcatc

SEQ ID NO: 1450926 - DNA, 14 bp, Homo sapiens
tccatccctacccc

SEQ ID NO: 1450927 - DNA, 18 bp, Homo sapiens
tccatccctaccccctaa

SEQ ID NO: 1450928 - DNA, 22 bp, Homo sapiens
tccatccctaccccctaagagc

SEQ ID NO: 1450929 - DNA, 12 bp, Homo sapiens
tccatccctcta

SEQ ID NO: 1450930 - DNA, 15 bp, Homo sapiens
tccatccctctaatg

SEQ ID NO: 1450931 - DNA, 21 bp, Homo sapiens
tccatccctgaaatttctcat

SEQ ID NO: 1450932 - DNA, 21 bp, Homo sapiens
tccatctaaaaatatacatgt

SEQ ID NO: 1450933 - DNA, 19 bp, Homo sapiens
tccatctcaaaacaaaaca

SEQ ID NO: 1450934 - DNA, 23 bp, Homo sapiens
tccatctcgccacccctccttcc

SEQ ID NO: 1450935 - DNA, 14 bp, Homo sapiens
tccatctctcatcc

SEQ ID NO: 1450936 - DNA, 16 bp, Homo sapiens
tccatctctcatcctc

SEQ ID NO: 1450937 - DNA, 18 bp, Homo sapiens
tccatctctcatcctcca

SEQ ID NO: 1450938 - DNA, 14 bp, Homo sapiens
tccatctctgactt

SEQ ID NO: 1450939 - DNA, 24 bp, Homo sapiens
tccatctgggcttatatgtacttt

SEQ ID NO: 1450940 - DNA, 18 bp, Homo sapiens
tccatcttggtagttctg

SEQ ID NO: 1450941 - DNA, 18 bp, Homo sapiens
tccatcttgtggggccag

SEQ ID NO: 1450942 - DNA, 20 bp, Homo sapiens
tccatgaagagcttgtgtcc

SEQ ID NO: 1450943 - DNA, 22 bp, Homo sapiens
tccatgaagagcttgtgtcctg

SEQ ID NO: 1450944 - DNA, 15 bp, Homo sapiens
tccatgaaggcagag

SEQ ID NO: 1450945 - DNA, 22 bp, Homo sapiens
tctgacatgtaagaaaatgtta

SEQ ID NO: 1450946 - DNA, 22 bp, Homo sapiens
tctgacatgtttgtgctctgtt

SEQ ID NO: 1450947 - DNA, 22 bp, Homo sapiens
tctgacattatgtggttttaga

SEQ ID NO: 1450948 - DNA, 20 bp, Homo sapiens
tctgaccacttgaggcctga

SEQ ID NO: 1450949 - DNA, 13 bp, Homo sapiens
tctgaccagagaa

SEQ ID NO: 1450950 - DNA, 15 bp, Homo sapiens
tctgaccagagaatg

SEQ ID NO: 1450951 - DNA, 14 bp, Homo sapiens
tctgaccatctgtg

SEQ ID NO: 1450952 - DNA, 22 bp, Homo sapiens
tctgaccatctgtgactataaa

SEQ ID NO: 1450953 - DNA, 17 bp, Homo sapiens
tctgacccactgatctc

SEQ ID NO: 1450954 - DNA, 14 bp, Homo sapiens
tctgacccagtgcc

SEQ ID NO: 1450955 - DNA, 15 bp, Homo sapiens
tctgacccagtgccc

SEQ ID NO: 1450956 - DNA, 22 bp, Homo sapiens
tctgacccagtgcccccactga

SEQ ID NO: 1450957 - DNA, 21 bp, Homo sapiens
tctgacccatagcactcttgt

SEQ ID NO: 1450958 - DNA, 21 bp, Homo sapiens
tctgacctaaaagttgaaaag

SEQ ID NO: 1450959 - DNA, 16 bp, Homo sapiens
tctgacctgcaggcca

SEQ ID NO: 1450960 - DNA, 13 bp, Homo sapiens
tctgacctggtgg

SEQ ID NO: 1450961 - DNA, 23 bp, Homo sapiens
tctgacgtcagcgcaccaaaact

SEQ ID NO: 1450962 - DNA, 20 bp, Homo sapiens
tctgacgtgccttttgcacc

SEQ ID NO: 1450963 - DNA, 23 bp, Homo sapiens
tctgacgtgccttttgcacccct

SEQ ID NO: 1450964 - DNA, 13 bp, Homo sapiens
tctgactaattag

SEQ ID NO: 1450965 - DNA, 15 bp, Homo sapiens
tctgactaattaggc

SEQ ID NO: 1450966 - DNA, 17 bp, Homo sapiens
tctgactagtttaaaga

SEQ ID NO: 1450967 - DNA, 17 bp, Homo sapiens
tctgactccagagtctg

SEQ ID NO: 1450968 - DNA, 16 bp, Homo sapiens
tctgactgccaagcca

SEQ ID NO: 1450969 - DNA, 19 bp, Homo sapiens
tctgactgccaagccagat

SEQ ID NO: 1450970 - DNA, 12 bp, Homo sapiens
tctgactgttta

SEQ ID NO: 1450971 - DNA, 20 bp, Homo sapiens
tctgactgtttatttaagga

SEQ ID NO: 1450972 - DNA, 23 bp, Homo sapiens
tctgactgtttatttaaggatgg

SEQ ID NO: 1450973 - DNA, 14 bp, Homo sapiens
tctgacttctgcct

SEQ ID NO: 1450974 - DNA, 14 bp, Homo sapiens
tctgagaaactcta

SEQ ID NO: 1450975 - DNA, 14 bp, Homo sapiens
tctgagaaagacta

SEQ ID NO: 1450976 - DNA, 20 bp, Homo sapiens
tctgagaaagactattcaaa

SEQ ID NO: 1450977 - DNA, 20 bp, Homo sapiens
tctgagaaggccctgtgccc

SEQ ID NO: 1450978 - DNA, 18 bp, Homo sapiens
tctgagaaggtccttaat

SEQ ID NO: 1450979 - DNA, 19 bp, Homo sapiens
tctgagacccttttctcag

SEQ ID NO: 1450980 - DNA, 14 bp, Homo sapiens
tctgagaggctctc

SEQ ID NO: 1450981 - DNA, 15 bp, Homo sapiens
tctgagaggctctcc

SEQ ID NO: 1450982 - DNA, 17 bp, Homo sapiens
tctgagagtctagattc

SEQ ID NO: 1450983 - DNA, 21 bp, Homo sapiens
tctgagagtctagattctctg

SEQ ID NO: 1450984 - DNA, 22 bp, Homo sapiens
tctgagagtctagattctctgg

SEQ ID NO: 1450985 - DNA, 18 bp, Homo sapiens
tctgagagttggctcagg

SEQ ID NO: 1450986 - DNA, 22 bp, Homo sapiens
tctgagagttggctcaggcaga

SEQ ID NO: 1450987 - DNA, 15 bp, Homo sapiens
tctgagattctaaga

SEQ ID NO: 1450988 - DNA, 15 bp, Homo sapiens
tctgagcacacttta

SEQ ID NO: 1450989 - DNA, 21 bp, Homo sapiens
tctgagcagcctctgccaggc

SEQ ID NO: 1450990 - DNA, 15 bp, Homo sapiens
tctgagccacagtgg

SEQ ID NO: 1450991 - DNA, 20 bp, Homo sapiens
tctgagccagtgctttaatg

SEQ ID NO: 1450992 - DNA, 12 bp, Homo sapiens
tctgagcccagg

SEQ ID NO: 1450993 - DNA, 13 bp, Homo sapiens
tctgagcccaggc

SEQ ID NO: 1450994 - DNA, 15 bp, Homo sapiens
tctgagcccgggctg

SEQ ID NO: 1450995 - DNA, 19 bp, Homo sapiens
tctgagcccgggctgcctg

SEQ ID NO: 1450996 - DNA, 18 bp, Homo sapiens
tctgagcggcgcagagcc

SEQ ID NO: 1450997 - DNA, 21 bp, Homo sapiens
tctgagcggcgcagagccctc

SEQ ID NO: 1450998 - DNA, 20 bp, Homo sapiens
tctgagctccacctctggtg

SEQ ID NO: 1450999 - DNA, 18 bp, Homo sapiens
tctgagctcccacctccc

SEQ ID NO: 1451000 - DNA, 22 bp, Homo sapiens
tctgagctcccacctcccttcc

SEQ ID NO: 1451001 - DNA, 21 bp, Homo sapiens
tctgagcttttcatggaagtg

SEQ ID NO: 1451002 - DNA, 12 bp, Homo sapiens
tctgaggacaga

SEQ ID NO: 1451003 - DNA, 20 bp, Homo sapiens
tctgaggacagagcttgaag

SEQ ID NO: 1451004 - DNA, 21 bp, Homo sapiens
tctgaggacagagcttgaagc

SEQ ID NO: 1451005 - DNA, 16 bp, Homo sapiens
tctgaggagctgttac

SEQ ID NO: 1451006 - DNA, 17 bp, Homo sapiens
tctgagggaggaggcca

SEQ ID NO: 1451007 - DNA, 21 bp, Homo sapiens
tctgagggaggaggccacctc

SEQ ID NO: 1451008 - DNA, 20 bp, Homo sapiens
tctgaggggaggcacctcca

SEQ ID NO: 1451009 - DNA, 23 bp, Homo sapiens
tctgaggggtgggggtgccgctg

SEQ ID NO: 1451010 - DNA, 21 bp, Homo sapiens
tctgaggttggatttgctcat

SEQ ID NO: 1451011 - DNA, 15 bp, Homo sapiens
tctgaggttttattt

SEQ ID NO: 1451012 - DNA, 11 bp, Homo sapiens
tctgagtcaaa

SEQ ID NO: 1451013 - DNA, 14 bp, Homo sapiens
tctgagtcaaatcc

SEQ ID NO: 1451014 - DNA, 15 bp, Homo sapiens
tctgagtcaaatcca

SEQ ID NO: 1451015 - DNA, 14 bp, Homo sapiens
tcgagaagggtgga

SEQ ID NO: 1451016 - DNA, 18 bp, Homo sapiens
tcgagaccaacctgacca

SEQ ID NO: 1451017 - DNA, 16 bp, Homo sapiens
tcgagaccagcctggc

SEQ ID NO: 1451018 - DNA, 17 bp, Homo sapiens
tctactcctacctcagc

SEQ ID NO: 1451019 - DNA, 22 bp, Homo sapiens
tctactcctacctcagcctaga

SEQ ID NO: 1451020 - DNA, 19 bp, Homo sapiens
tctactctgtcttaaatga

SEQ ID NO: 1451021 - DNA, 15 bp, Homo sapiens
tctactctttttgtt

SEQ ID NO: 1451022 - DNA, 22 bp, Homo sapiens
tctactgaattggcttccagat

SEQ ID NO: 1451023 - DNA, 18 bp, Homo sapiens
tctactgaggtgctatgt

SEQ ID NO: 1451024 - DNA, 13 bp, Homo sapiens
tctactgccctcc

SEQ ID NO: 1451025 - DNA, 21 bp, Homo sapiens
tctacttaatccaatgggttt

SEQ ID NO: 1451026 - DNA, 14 bp, Homo sapiens
tctactttattaat

SEQ ID NO: 1451027 - DNA, 21 bp, Homo sapiens
tctactttattaattgttttg

SEQ ID NO: 1451028 - DNA, 17 bp, Homo sapiens
tctactttgattctgat

SEQ ID NO: 1451029 - DNA, 14 bp, Homo sapiens
tctagaaacaaaca

SEQ ID NO: 1451030 - DNA, 14 bp, Homo sapiens
tctagaaatgttca

SEQ ID NO: 1451031 - DNA, 21 bp, Homo sapiens
tctagaaatgttcacaaggta

SEQ ID NO: 1451032 - DNA, 16 bp, Homo sapiens
tctagaacacaggcaa

SEQ ID NO: 1451033 - DNA, 17 bp, Homo sapiens
tctagaacatgcacatt

SEQ ID NO: 1451034 - DNA, 18 bp, Homo sapiens
tctagaacttgaccccct

SEQ ID NO: 1451035 - DNA, 20 bp, Homo sapiens
tctagaagactgtcagcttc

SEQ ID NO: 1451036 - DNA, 21 bp, Homo sapiens
tctagaagccaagggaaaggg

SEQ ID NO: 1451037 - DNA, 22 bp, Homo sapiens
tctagaatctgcaattcaaaag

SEQ ID NO: 1451038 - DNA, 19 bp, Homo sapiens
tctagaattttaagtgctt

SEQ ID NO: 1451039 - DNA, 20 bp, Homo sapiens
tctagacagagttgcttaat

SEQ ID NO: 1451040 - DNA, 15 bp, Homo sapiens
tctagacgcccctcc

SEQ ID NO: 1451041 - DNA, 16 bp, Homo sapiens
tctagactcaaaacct

SEQ ID NO: 1451042 - DNA, 14 bp, Homo sapiens
tctagacttcccca

SEQ ID NO: 1451043 - DNA, 18 bp, Homo sapiens
tctagacttccccatccc

SEQ ID NO: 1451044 - DNA, 12 bp, Homo sapiens
tctagagacaca

SEQ ID NO: 1451045 - DNA, 14 bp, Homo sapiens
tctagagacacatt

SEQ ID NO: 1451046 - DNA, 15 bp, Homo sapiens
tctagagcagggatt

SEQ ID NO: 1451047 - DNA, 18 bp, Homo sapiens
tctagagcagttggccaa

SEQ ID NO: 1451048 - DNA, 21 bp, Homo sapiens
tctagagctggaggctgtggg

SEQ ID NO: 1451049 - DNA, 16 bp, Homo sapiens
tctagaggcctcagtt

SEQ ID NO: 1451050 - DNA, 17 bp, Homo sapiens
tctagagtttagtcctt

SEQ ID NO: 1451051 - DNA, 20 bp, Homo sapiens
tctagagtttatacagtgta

SEQ ID NO: 1451052 - DNA, 22 bp, Homo sapiens
tctagagtttatacagtgtaca

SEQ ID NO: 1451053 - DNA, 23 bp, Homo sapiens
tctagagtttatacagtgtacat

SEQ ID NO: 1451054 - DNA, 15 bp, Homo sapiens
tctagatatcgactt

SEQ ID NO: 1451055 - DNA, 14 bp, Homo sapiens
tctagatgacataa

SEQ ID NO: 1451056 - DNA, 22 bp, Homo sapiens
tctagatgattaaataagattc

SEQ ID NO: 1451057 - DNA, 14 bp, Homo sapiens
tctagatgattttt

SEQ ID NO: 1451058 - DNA, 21 bp, Homo sapiens
tctagatgattttttgaaagt

SEQ ID NO: 1451059 - DNA, 21 bp, Homo sapiens
tctagatgtttattcttctag

SEQ ID NO: 1451060 - DNA, 15 bp, Homo sapiens
tctagattatgtctt

SEQ ID NO: 1451061 - DNA, 18 bp, Homo sapiens
tctagattcaaaggttct

SEQ ID NO: 1451062 - DNA, 14 bp, Homo sapiens
tctagattcataaa

SEQ ID NO: 1451063 - DNA, 14 bp, Homo sapiens
tctagattctctgg

SEQ ID NO: 1451064 - DNA, 20 bp, Homo sapiens
tctagcaaatatgctgttat

SEQ ID NO: 1451065 - DNA, 22 bp, Homo sapiens
tctagcaagaagattctaaaac

SEQ ID NO: 1451066 - DNA, 22 bp, Homo sapiens
tctagcacaatttgcactaaat

SEQ ID NO: 1451067 - DNA, 13 bp, Homo sapiens
tctagcagagtga

SEQ ID NO: 1451068 - DNA, 17 bp, Homo sapiens
tctagcatggcatattt

SEQ ID NO: 1451069 - DNA, 21 bp, Homo sapiens
tctagcatggcatatttttca

SEQ ID NO: 1451070 - DNA, 21 bp, Homo sapiens
tctagccaggagtctgtgctc

SEQ ID NO: 1451071 - DNA, 17 bp, Homo sapiens
tctagccgatggaaaat

SEQ ID NO: 1451072 - DNA, 14 bp, Homo sapiens
tctagcctgggcca

SEQ ID NO: 1451073 - DNA, 20 bp, Homo sapiens
tctagcctgggccagagaag

SEQ ID NO: 1451074 - DNA, 16 bp, Homo sapiens
tctagctagaaatatg

SEQ ID NO: 1451075 - DNA, 14 bp, Homo sapiens
tctagctctctagg

SEQ ID NO: 1451076 - DNA, 15 bp, Homo sapiens
tctagctctctaggc

SEQ ID NO: 1451077 - DNA, 16 bp, Homo sapiens
tctagctctctaggcc

SEQ ID NO: 1451078 - DNA, 20 bp, Homo sapiens
tctagctgcagatgcctctg

SEQ ID NO: 1451079 - DNA, 13 bp, Homo sapiens
tctagctggcagg

SEQ ID NO: 1451080 - DNA, 15 bp, Homo sapiens
tctagctggcaggac

SEQ ID NO: 1451081 - DNA, 17 bp, Homo sapiens
tctagctgtatgatttg

SEQ ID NO: 1451082 - DNA, 20 bp, Homo sapiens
tctaggactgcagtgtggag

SEQ ID NO: 1451083 - DNA, 20 bp, Homo sapiens
tctaggagacagagccaagc

SEQ ID NO: 1451084 - DNA, 23 bp, Homo sapiens
tctaggaggagctagtaggaatg

SEQ ID NO: 1451085 - DNA, 23 bp, Homo sapiens
tctaggatagctaactgtaaatc

SEQ ID NO: 1451086 - DNA, 15 bp, Homo sapiens
tctaggcactgtagt

SEQ ID NO: 1451087 - DNA, 24 bp, Homo sapiens
tctaggcactgtagttctaagact

SEQ ID NO: 1451088 - DNA, 18 bp, Homo sapiens
tctaggcatcccagggga

SEQ ID NO: 1451089 - DNA, 14 bp, Homo sapiens
tctaggcctctcca

SEQ ID NO: 1451090 - DNA, 15 bp, Homo sapiens
tctaggcctctccag

SEQ ID NO: 1451091 - DNA, 19 bp, Homo sapiens
tctaggggtcaggctccat

SEQ ID NO: 1451092 - DNA, 20 bp, Homo sapiens
tctaggtaggggcccacttc

SEQ ID NO: 1451093 - DNA, 18 bp, Homo sapiens
tctaggtctcctcagggt

SEQ ID NO: 1451094 - DNA, 19 bp, Homo sapiens
tctaggtggagttgaaaga

SEQ ID NO: 1451095 - DNA, 15 bp, Homo sapiens
tctagtatgaaatta

SEQ ID NO: 1451096 - DNA, 22 bp, Homo sapiens
tctagtcaactgctgttttatg

SEQ ID NO: 1451097 - DNA, 17 bp, Homo sapiens
tctagtccccaaggcct

SEQ ID NO: 1451098 - DNA, 20 bp, Homo sapiens
tctagtccccaaggcctctc

SEQ ID NO: 1451099 - DNA, 16 bp, Homo sapiens
tctagtctctgatttg

SEQ ID NO: 1451100 - DNA, 15 bp, Homo sapiens
tctagtctgagcttc

SEQ ID NO: 1451101 - DNA, 14 bp, Homo sapiens
tctagtcttggcca

SEQ ID NO: 1451102 - DNA, 22 bp, Homo sapiens
tctagtgaggaagacaagcatt

SEQ ID NO: 1451103 - DNA, 20 bp, Homo sapiens
tctagtgcagctgaaattga

SEQ ID NO: 1451104 - DNA, 13 bp, Homo sapiens
tctagtgctgctg

SEQ ID NO: 1451105 - DNA, 13 bp, Homo sapiens
tctagttctagat

SEQ ID NO: 1451106 - DNA, 15 bp, Homo sapiens
tctagttctttcctc

SEQ ID NO: 1451107 - DNA, 15 bp, Homo sapiens
tctagtttgcaactt

SEQ ID NO: 1451108 - DNA, 15 bp, Homo sapiens
tctagtttgcatact

SEQ ID NO: 1451109 - DNA, 18 bp, Homo sapiens
tctagtttgcattcctga

SEQ ID NO: 1451110 - DNA, 12 bp, Homo sapiens
tctataaaactc

SEQ ID NO: 1451111 - DNA, 14 bp, Homo sapiens
tctataaaatagat

SEQ ID NO: 1451112 - DNA, 19 bp, Homo sapiens
tctataaaatagatataaa

SEQ ID NO: 1451113 - DNA, 20 bp, Homo sapiens
tctataaagaagaacttgca

SEQ ID NO: 1451114 - DNA, 16 bp, Homo sapiens
tctataaatcagtatt

SEQ ID NO: 1451115 - DNA, 17 bp, Homo sapiens
tctataccaataaagtg

SEQ ID NO: 1451116 - DNA, 18 bp, Homo sapiens
tctataccaataaagtga

SEQ ID NO: 1451117 - DNA, 17 bp, Homo sapiens
tctatactgtttgtaat

SEQ ID NO: 1451118 - DNA, 23 bp, Homo sapiens
tctatactttgttctgttgtctg

SEQ ID NO: 1451119 - DNA, 13 bp, Homo sapiens
tctatagactcta

SEQ ID NO: 1451120 - DNA, 15 bp, Homo sapiens
cccagggagctctgg

SEQ ID NO: 1451121 - DNA, 16 bp, Homo sapiens
cccagggagctctggg

SEQ ID NO: 1451122 - DNA, 19 bp, Homo sapiens
cccagggagctctggggac

SEQ ID NO: 1451123 - DNA, 14 bp, Homo sapiens
cccagggcagcctg

SEQ ID NO: 1451124 - DNA, 21 bp, Homo sapiens
cccagggcatcttgctggcta

SEQ ID NO: 1451125 - DNA, 18 bp, Homo sapiens
cccagggccactctgcct

SEQ ID NO: 1451126 - DNA, 17 bp, Homo sapiens
cccagggccagcccacg

SEQ ID NO: 1451127 - DNA, 20 bp, Homo sapiens
cccagggccagggccctgca

SEQ ID NO: 1451128 - DNA, 15 bp, Homo sapiens
cccagggcccagagc

SEQ ID NO: 1451129 - DNA, 19 bp, Homo sapiens
cccagggcccagagcccag

SEQ ID NO: 1451130 - DNA, 20 bp, Homo sapiens
cccagggcccagagcccagc

SEQ ID NO: 1451131 - DNA, 22 bp, Homo sapiens
cccagggcccagagcccagctc

SEQ ID NO: 1451132 - DNA, 14 bp, Homo sapiens
cccagggcccctcc

SEQ ID NO: 1451133 - DNA, 20 bp, Homo sapiens
cccagggcccctccctctgc

SEQ ID NO: 1451134 - DNA, 21 bp, Homo sapiens
cccagggcctagaggtaaccg

SEQ ID NO: 1451135 - DNA, 14 bp, Homo sapiens
cccagggcctccag

SEQ ID NO: 1451136 - DNA, 19 bp, Homo sapiens
cccagggcctccagggccc

SEQ ID NO: 1451137 - DNA, 14 bp, Homo sapiens
cccagggcctgggg

SEQ ID NO: 1451138 - DNA, 23 bp, Homo sapiens
cccagggcctgggggcagtgact

SEQ ID NO: 1451139 - DNA, 15 bp, Homo sapiens
cccagggctcagcct

SEQ ID NO: 1451140 - DNA, 23 bp, Homo sapiens
tctcagaatctaaacgtggtcac

SEQ ID NO: 1451141 - DNA, 14 bp, Homo sapiens
tctcagaattcggt

SEQ ID NO: 1451142 - DNA, 15 bp, Homo sapiens
tctcagagaccagca

SEQ ID NO: 1451143 - DNA, 19 bp, Homo sapiens
tctcagagaccagcactca

SEQ ID NO: 1451144 - DNA, 11 bp, Homo sapiens
tctcagagcac

SEQ ID NO: 1451145 - DNA, 20 bp, Homo sapiens
tctcagaggcctgctgccag

SEQ ID NO: 1451146 - DNA, 19 bp, Homo sapiens
tctcagagtgacagtcata

SEQ ID NO: 1451147 - DNA, 16 bp, Homo sapiens
tctcagataggtgctt

SEQ ID NO: 1451148 - DNA, 22 bp, Homo sapiens
tctcagataggtgcttcccctg

SEQ ID NO: 1451149 - DNA, 17 bp, Homo sapiens
tctcagatatttgcacc

SEQ ID NO: 1451150 - DNA, 14 bp, Homo sapiens
tctcagatccttgt

SEQ ID NO: 1451151 - DNA, 16 bp, Homo sapiens
tctcagatcttgacag

SEQ ID NO: 1451152 - DNA, 18 bp, Homo sapiens
tctcagatgccccaaagt

SEQ ID NO: 1451153 - DNA, 21 bp, Homo sapiens
tctcagatgttgaaactttga

SEQ ID NO: 1451154 - DNA, 18 bp, Homo sapiens
tctcagcatagcctgcct

SEQ ID NO: 1451155 - DNA, 19 bp, Homo sapiens
tctcagcatagcctgcctg

SEQ ID NO: 1451156 - DNA, 15 bp, Homo sapiens
tctcagccaacgagt

SEQ ID NO: 1451157 - DNA, 21 bp, Homo sapiens
tctcagccgcttctgactgct

SEQ ID NO: 1451158 - DNA, 11 bp, Homo sapiens
tctcagcctcc

SEQ ID NO: 1451159 - DNA, 19 bp, Homo sapiens
tctcagcctcccaacccca

SEQ ID NO: 1451160 - DNA, 14 bp, Homo sapiens
tctcagcctcccac

SEQ ID NO: 1451161 - DNA, 14 bp, Homo sapiens
tctcagcctcctga

SEQ ID NO: 1451162 - DNA, 15 bp, Homo sapiens
tctcagctataattc

SEQ ID NO: 1451163 - DNA, 15 bp, Homo sapiens
tctcagctcactgca

SEQ ID NO: 1451164 - DNA, 18 bp, Homo sapiens
tctcagctcactgcaacc

SEQ ID NO: 1451165 - DNA, 16 bp, Homo sapiens
tctcagctccaggtgg

SEQ ID NO: 1451166 - DNA, 15 bp, Homo sapiens
tctcagctcccaggc

SEQ ID NO: 1451167 - DNA, 13 bp, Homo sapiens
tctcagctttgag

SEQ ID NO: 1451168 - DNA, 16 bp, Homo sapiens
tctcaggagatttcat

SEQ ID NO: 1451169 - DNA, 16 bp, Homo sapiens
tctcaggagcacaggc

SEQ ID NO: 1451170 - DNA, 23 bp, Homo sapiens
tctcaggagcacaggcagctgga

SEQ ID NO: 1451171 - DNA, 15 bp, Homo sapiens
tctcaggagcatggg

SEQ ID NO: 1451172 - DNA, 14 bp, Homo sapiens
tctcaggagcttgc

SEQ ID NO: 1451173 - DNA, 13 bp, Homo sapiens
tctcaggatccaa

SEQ ID NO: 1451174 - DNA, 15 bp, Homo sapiens
tctcaggatccaagc

SEQ ID NO: 1451175 - DNA, 16 bp, Homo sapiens
tctcaggatccaagct

SEQ ID NO: 1451176 - DNA, 19 bp, Homo sapiens
tctcaggcagcaccacact

SEQ ID NO: 1451177 - DNA, 18 bp, Homo sapiens
tctcaggccaagcccaat

SEQ ID NO: 1451178 - DNA, 19 bp, Homo sapiens
tctcaggctctgccctgcc

SEQ ID NO: 1451179 - DNA, 16 bp, Homo sapiens
tctcagggaagcccag

SEQ ID NO: 1451180 - DNA, 23 bp, Homo sapiens
tctcagggaagcccagctccagg

SEQ ID NO: 1451181 - DNA, 14 bp, Homo sapiens
tctcagggctcggg

SEQ ID NO: 1451182 - DNA, 18 bp, Homo sapiens
tctcagggtccagaccct

SEQ ID NO: 1451183 - DNA, 15 bp, Homo sapiens
tctcaggtgccactc

SEQ ID NO: 1451184 - DNA, 16 bp, Homo sapiens
tctcaggtgccactcc

SEQ ID NO: 1451185 - DNA, 23 bp, Homo sapiens
tctcaggtgccactccctgagct

SEQ ID NO: 1451186 - DNA, 21 bp, Homo sapiens
tctcaggtttgttttgtgaat

SEQ ID NO: 1451187 - DNA, 24 bp, Homo sapiens
tctcagtctaaggtctcatgctgt

SEQ ID NO: 1451188 - DNA, 18 bp, Homo sapiens
tctcagtgttgagccttt

SEQ ID NO: 1451189 - DNA, 18 bp, Homo sapiens
tctcagttatgtagtttc

SEQ ID NO: 1451190 - DNA, 16 bp, Homo sapiens
tctcagttctctccct

SEQ ID NO: 1451191 - DNA, 18 bp, Homo sapiens
tctcagtttgtgtgtctt

SEQ ID NO: 1451192 - DNA, 16 bp, Homo sapiens
tctcataaaactgtga

SEQ ID NO: 1451193 - DNA, 14 bp, Homo sapiens
tctcataatgcttt

SEQ ID NO: 1451194 - DNA, 16 bp, Homo sapiens
tctcataatttataca

SEQ ID NO: 1451195 - DNA, 22 bp, Homo sapiens
tctcataatttatacaggtcat

SEQ ID NO: 1451196 - DNA, 23 bp, Homo sapiens
tctcataatttatacaggtcata

SEQ ID NO: 1451197 - DNA, 16 bp, Homo sapiens
tctcataccctccctc

SEQ ID NO: 1451198 - DNA, 13 bp, Homo sapiens
tctcatactgtct

SEQ ID NO: 1451199 - DNA, 17 bp, Homo sapiens
tctcataggaattaaat

SEQ ID NO: 1451200 - DNA, 19 bp, Homo sapiens
tctcataggaattaaatgt

SEQ ID NO: 1451201 - DNA, 20 bp, Homo sapiens
tctcatcaacttaaaagtca

SEQ ID NO: 1451202 - DNA, 12 bp, Homo sapiens
tctcatcaggca

SEQ ID NO: 1451203 - DNA, 21 bp, Homo sapiens
tctcatcagtgtcctcttgct

SEQ ID NO: 1451204 - DNA, 16 bp, Homo sapiens
tctcatcatattgtat

SEQ ID NO: 1451205 - DNA, 18 bp, Homo sapiens
tctcatcatattgtatgt

SEQ ID NO: 1451206 - DNA, 14 bp, Homo sapiens
tctcatcctccagt

SEQ ID NO: 1451207 - DNA, 16 bp, Homo sapiens
tctcatcggaggccca

SEQ ID NO: 1451208 - DNA, 13 bp, Homo sapiens
tctcatctcttca

SEQ ID NO: 1451209 - DNA, 14 bp, Homo sapiens
tctcatctcttcag

SEQ ID NO: 1451210 - DNA, 14 bp, Homo sapiens
tctcatgaagcagg

SEQ ID NO: 1451211 - DNA, 17 bp, Homo sapiens
tctcatgagaagccaag

SEQ ID NO: 1451212 - DNA, 18 bp, Homo sapiens
tctcatggaaactggcca

SEQ ID NO: 1451213 - DNA, 16 bp, Homo sapiens
tctcatggaccagtgg

SEQ ID NO: 1451214 - DNA, 14 bp, Homo sapiens
tctcatgtcaatga

SEQ ID NO: 1451215 - DNA, 16 bp, Homo sapiens
tctcattccagaggaa

SEQ ID NO: 1451216 - DNA, 16 bp, Homo sapiens
tctcattccccaggtg

SEQ ID NO: 1451217 - DNA, 14 bp, Homo sapiens
tctcattccgttgt

SEQ ID NO: 1451218 - DNA, 16 bp, Homo sapiens
tctcattcgcctttgt

SEQ ID NO: 1451219 - DNA, 19 bp, Homo sapiens
tctcattcgcctttgtctt

SEQ ID NO: 1451220 - DNA, 12 bp, Homo sapiens
tctcattctgtg

SEQ ID NO: 1451221 - DNA, 16 bp, Homo sapiens
tctcatttcacccctc

SEQ ID NO: 1451222 - DNA, 17 bp, Homo sapiens
tctcatttcacccctcc

SEQ ID NO: 1451223 - DNA, 17 bp, Homo sapiens
tctcatttggtctgcca

SEQ ID NO: 1451224 - DNA, 22 bp, Homo sapiens
tctccaaactgaagcagcctct

SEQ ID NO: 1451225 - DNA, 18 bp, Homo sapiens
tctccaaaggggctgctg

SEQ ID NO: 1451226 - DNA, 20 bp, Homo sapiens
tctccaaaggggctgctggg

SEQ ID NO: 1451227 - DNA, 13 bp, Homo sapiens
tctccaaccactg

SEQ ID NO: 1451228 - DNA, 18 bp, Homo sapiens
tctccaaccccccagcac

SEQ ID NO: 1451229 - DNA, 22 bp, Homo sapiens
tctccaaccccccagcactgag

SEQ ID NO: 1451230 - DNA, 21 bp, Homo sapiens
tctccaagaaactgaatgaat

SEQ ID NO: 1451231 - DNA, 19 bp, Homo sapiens
tctccaagaatggaagcct

SEQ ID NO: 1451232 - DNA, 16 bp, Homo sapiens
tctccaagggcttctg

SEQ ID NO: 1451233 - DNA, 20 bp, Homo sapiens
tctccaagtgccagaggtgg

SEQ ID NO: 1451234 - DNA, 21 bp, Homo sapiens
tctccaagtgccagaggtggg

SEQ ID NO: 1451235 - DNA, 20 bp, Homo sapiens
ccccacaccttccagggccc

SEQ ID NO: 1451236 - DNA, 14 bp, Homo sapiens
ccccacactccact

SEQ ID NO: 1451237 - DNA, 18 bp, Homo sapiens
ccccacactccactctga

SEQ ID NO: 1451238 - DNA, 23 bp, Homo sapiens
ccccaccacgatgtggccctggc

SEQ ID NO: 1451239 - DNA, 16 bp, Homo sapiens
ccccacccaagcttgg

SEQ ID NO: 1451240 - DNA, 13 bp, Homo sapiens
ccccacccaggag

SEQ ID NO: 1451241 - DNA, 14 bp, Homo sapiens
ccccaccccacact

SEQ ID NO: 1451242 - DNA, 16 bp, Homo sapiens
ccccaccccacacttg

SEQ ID NO: 1451243 - DNA, 14 bp, Homo sapiens
ccccaccccatcca

SEQ ID NO: 1451244 - DNA, 14 bp, Homo sapiens
ccccacccccaagg

SEQ ID NO: 1451245 - DNA, 20 bp, Homo sapiens
ccccacccccagctcaatgg

SEQ ID NO: 1451246 - DNA, 12 bp, Homo sapiens
ccccaccccctt

SEQ ID NO: 1451247 - DNA, 21 bp, Homo sapiens
ccccacccccttcagtgccca

SEQ ID NO: 1451248 - DNA, 19 bp, Homo sapiens
ccccacccctaagtgccca

SEQ ID NO: 1451249 - DNA, 20 bp, Homo sapiens
ccccacccctaagtgcccaa

SEQ ID NO: 1451250 - DNA, 21 bp, Homo sapiens
ccccacccctaagtgcccaaa

SEQ ID NO: 1451251 - DNA, 15 bp, Homo sapiens
ccccacccctccacg

SEQ ID NO: 1451252 - DNA, 16 bp, Homo sapiens
ccccacccctccacgt

SEQ ID NO: 1451253 - DNA, 13 bp, Homo sapiens
ccccacccctgcc

SEQ ID NO: 1451254 - DNA, 15 bp, Homo sapiens
ccccaccccttcccc

SEQ ID NO: 1451255 - DNA, 17 bp, Homo sapiens
ccccacccgctcccaca

SEQ ID NO: 1451256 - DNA, 13 bp, Homo sapiens
ccccaccctcagc

SEQ ID NO: 1451257 - DNA, 12 bp, Homo sapiens
ccccaccctcat

SEQ ID NO: 1451258 - DNA, 17 bp, Homo sapiens
ccccaccctccatgctc

SEQ ID NO: 1451259 - DNA, 12 bp, Homo sapiens
ccccaccctggg

SEQ ID NO: 1451260 - DNA, 15 bp, Homo sapiens
ccccaccctgggccc

SEQ ID NO: 1451261 - DNA, 20 bp, Homo sapiens
ccccaccctggtgggccaac

SEQ ID NO: 1451262 - DNA, 22 bp, Homo sapiens
ccccaccggtccagctggcctg

SEQ ID NO: 1451263 - DNA, 20 bp, Homo sapiens
tctcctgccctctgctctgc

SEQ ID NO: 1451264 - DNA, 13 bp, Homo sapiens
tctcctgccctgt

SEQ ID NO: 1451265 - DNA, 14 bp, Homo sapiens
tctcctgccctgtg

SEQ ID NO: 1451266 - DNA, 14 bp, Homo sapiens
tctcctgcctactc

SEQ ID NO: 1451267 - DNA, 15 bp, Homo sapiens
tctcctgcctactca

SEQ ID NO: 1451268 - DNA, 17 bp, Homo sapiens
tctcctgctgccttttc

SEQ ID NO: 1451269 - DNA, 21 bp, Homo sapiens
tctcctgctgccttttctgga

SEQ ID NO: 1451270 - DNA, 16 bp, Homo sapiens
tctcctgcttcctctt

SEQ ID NO: 1451271 - DNA, 12 bp, Homo sapiens
tctcctggacct

SEQ ID NO: 1451272 - DNA, 22 bp, Homo sapiens
tctcctggaccttgacagagca

SEQ ID NO: 1451273 - DNA, 24 bp, Homo sapiens
tctcctggaccttgacagagcagc

SEQ ID NO: 1451274 - DNA, 23 bp, Homo sapiens
tctcctggcctatccgctgccag

SEQ ID NO: 1451275 - DNA, 21 bp, Homo sapiens
tctcctggctttacagacaaa

SEQ ID NO: 1451276 - DNA, 17 bp, Homo sapiens
tctcctgtagccactgg

SEQ ID NO: 1451277 - DNA, 18 bp, Homo sapiens
tctcctgtagccactggc

SEQ ID NO: 1451278 - DNA, 16 bp, Homo sapiens
tctcctgtccaaccta

SEQ ID NO: 1451279 - DNA, 12 bp, Homo sapiens
tctcctgtccct

SEQ ID NO: 1451280 - DNA, 19 bp, Homo sapiens
tctcctgtccctccatccc

SEQ ID NO: 1451281 - DNA, 20 bp, Homo sapiens
tctcctgtctgccctctggg

SEQ ID NO: 1451282 - DNA, 22 bp, Homo sapiens
tctcctgtcttatggtccagaa

SEQ ID NO: 1451283 - DNA, 13 bp, Homo sapiens
tctcctgtgccca

SEQ ID NO: 1451284 - DNA, 15 bp, Homo sapiens
tctcctgtgcccaca

SEQ ID NO: 1451285 - DNA, 16 bp, Homo sapiens
tctcctgtgcccacat

SEQ ID NO: 1451286 - DNA, 17 bp, Homo sapiens
tctcctgtgcccacatc

SEQ ID NO: 1451287 - DNA, 19 bp, Homo sapiens
tctccttactctgagccca

SEQ ID NO: 1451288 - DNA, 20 bp, Homo sapiens
tctccttactctgagcccag

SEQ ID NO: 1451289 - DNA, 23 bp, Homo sapiens
tctccttactctgagcccaggcc

SEQ ID NO: 1451290 - DNA, 18 bp, Homo sapiens
tctccttagttggctgga

SEQ ID NO: 1451291 - DNA, 20 bp, Homo sapiens
tctccttcagccctcacccc

SEQ ID NO: 1451292 - DNA, 21 bp, Homo sapiens
tctccttcccatttctctaca

SEQ ID NO: 1451293 - DNA, 17 bp, Homo sapiens
tctccttcccccagccc

SEQ ID NO: 1451294 - DNA, 21 bp, Homo sapiens
tctccttcccccagcccaata

SEQ ID NO: 1451295 - DNA, 23 bp, Homo sapiens
tctccttcccccagcccaataaa

SEQ ID NO: 1451296 - DNA, 14 bp, Homo sapiens
tctccttcctcttg

SEQ ID NO: 1451297 - DNA, 20 bp, Homo sapiens
tctccttcgtgtctctccca

SEQ ID NO: 1451298 - DNA, 13 bp, Homo sapiens
tctccttctcctt

SEQ ID NO: 1451299 - DNA, 16 bp, Homo sapiens
tctccttggccacaga

SEQ ID NO: 1451300 - DNA, 23 bp, Homo sapiens
tctccttgggctcctggctgcca

SEQ ID NO: 1451301 - DNA, 22 bp, Homo sapiens
tctcctttaattgtaaagtaaa

SEQ ID NO: 1451302 - DNA, 12 bp, Homo sapiens
tctcctttacca

SEQ ID NO: 1451303 - DNA, 16 bp, Homo sapiens
tctcctttcacaacct

SEQ ID NO: 1451304 - DNA, 21 bp, Homo sapiens
tctcctttccttcccaggccc

SEQ ID NO: 1451305 - DNA, 22 bp, Homo sapiens
tctcctttctaagccctgttct

SEQ ID NO: 1451306 - DNA, 13 bp, Homo sapiens
tctcctttctgtg

SEQ ID NO: 1451307 - DNA, 19 bp, Homo sapiens
tctcctttgcactgagggc

SEQ ID NO: 1451308 - DNA, 12 bp, Homo sapiens
tctcctttgctc

SEQ ID NO: 1451309 - DNA, 14 bp, Homo sapiens
tctcctttgctctt

SEQ ID NO: 1451310 - DNA, 17 bp, Homo sapiens
tctcctttgtattctgt

SEQ ID NO: 1451311 - DNA, 19 bp, Homo sapiens
tctccttttcctctctccc

SEQ ID NO: 1451312 - DNA, 14 bp, Homo sapiens
tctccttttgaact

SEQ ID NO: 1451313 - DNA, 17 bp, Homo sapiens
tctccttttgaacttgt

SEQ ID NO: 1451314 - DNA, 23 bp, Homo sapiens
tctccttttgaggcttctccttc

SEQ ID NO: 1451315 - DNA, 22 bp, Homo sapiens
tctcgacggcacgcacttgcct

SEQ ID NO: 1451316 - DNA, 13 bp, Homo sapiens
tctcgatctcctg

SEQ ID NO: 1451317 - DNA, 14 bp, Homo sapiens
tctcgatctcctga

SEQ ID NO: 1451318 - DNA, 22 bp, Homo sapiens
tctcgcagcctgaagcctggat

SEQ ID NO: 1451319 - DNA, 23 bp, Homo sapiens
tctcgcataggacctttccacca

SEQ ID NO: 1451320 - DNA, 21 bp, Homo sapiens
tctcgctgcgtcctcatttcc

SEQ ID NO: 1451321 - DNA, 20 bp, Homo sapiens
tctcgcttcctcagcctcca

SEQ ID NO: 1451322 - DNA, 18 bp, Homo sapiens
tctcggatgacaccctgg

SEQ ID NO: 1451323 - DNA, 19 bp, Homo sapiens
tctcggatgacaccctggc

SEQ ID NO: 1451324 - DNA, 22 bp, Homo sapiens
tctcggatgacaccctggcctg

SEQ ID NO: 1451325 - DNA, 23 bp, Homo sapiens
tctcggatgaccaaaccagcctt

SEQ ID NO: 1451326 - DNA, 15 bp, Homo sapiens
tctcggctcactgca

SEQ ID NO: 1451327 - DNA, 21 bp, Homo sapiens
tctcgggcagccggctctcct

SEQ ID NO: 1451328 - DNA, 20 bp, Homo sapiens
tctcggggcccttggggcct

SEQ ID NO: 1451329 - DNA, 13 bp, Homo sapiens
tctcggggcttgc

SEQ ID NO: 1451330 - DNA, 17 bp, Homo sapiens
tctcggggtccagtgca

SEQ ID NO: 1451331 - DNA, 14 bp, Homo sapiens
tctcgtaatagctt

SEQ ID NO: 1451332 - DNA, 21 bp, Homo sapiens
tctcgtaatagcttctgtgtg

SEQ ID NO: 1451333 - DNA, 14 bp, Homo sapiens
tctcgtctttactt

SEQ ID NO: 1451334 - DNA, 18 bp, Homo sapiens
tctcgtgctgcatccctg

SEQ ID NO: 1451335 - DNA, 21 bp, Homo sapiens
tctctaaaaagaagccacaga

SEQ ID NO: 1451336 - DNA, 14 bp, Homo sapiens
tctctaaaattcta

SEQ ID NO: 1451337 - DNA, 23 bp, Homo sapiens
tctctaaactggcatctgctcta

SEQ ID NO: 1451338 - DNA, 20 bp, Homo sapiens
tctctaactcagaaacatca

SEQ ID NO: 1451339 - DNA, 19 bp, Homo sapiens
tctctaaggagcagcggga

SEQ ID NO: 1451340 - DNA, 17 bp, Homo sapiens
tctctaaggtttacaat

SEQ ID NO: 1451341 - DNA, 15 bp, Homo sapiens
tctctaattctatta

SEQ ID NO: 1451342 - DNA, 20 bp, Homo sapiens
tctctacagacttctccaga

SEQ ID NO: 1451343 - DNA, 16 bp, Homo sapiens
tctctacattaatgtc

SEQ ID NO: 1451344 - DNA, 20 bp, Homo sapiens
tctctacattaatgtcctct

SEQ ID NO: 1451345 - DNA, 16 bp, Homo sapiens
tctctacccatctccc

SEQ ID NO: 1451346 - DNA, 15 bp, Homo sapiens
tctctacctccaccc

SEQ ID NO: 1451347 - DNA, 19 bp, Homo sapiens
tctctactcctacctcagc

SEQ ID NO: 1451348 - DNA, 12 bp, Homo sapiens
tctctactgaaa

SEQ ID NO: 1451349 - DNA, 17 bp, Homo sapiens
tctctggcgacagtttt

SEQ ID NO: 1451350 - DNA, 22 bp, Homo sapiens
tctctggcgacagttttccttc

SEQ ID NO: 1451351 - DNA, 20 bp, Homo sapiens
tctctggctgtaaggctcta

SEQ ID NO: 1451352 - DNA, 23 bp, Homo sapiens
tctctggctgtaaggctctagat

SEQ ID NO: 1451353 - DNA, 23 bp, Homo sapiens
tctctggctgtctgtctgcagtg

SEQ ID NO: 1451354 - DNA, 14 bp, Homo sapiens
tctctggcttctct

SEQ ID NO: 1451355 - DNA, 15 bp, Homo sapiens
tctctggcttctctc

SEQ ID NO: 1451356 - DNA, 20 bp, Homo sapiens
tctctggcttctctcttttc

SEQ ID NO: 1451357 - DNA, 17 bp, Homo sapiens
tctctgggaccactggg

SEQ ID NO: 1451358 - DNA, 14 bp, Homo sapiens
tctctgggagccca

SEQ ID NO: 1451359 - DNA, 15 bp, Homo sapiens
tctctgggagcccag

SEQ ID NO: 1451360 - DNA, 11 bp, Homo sapiens
tctctgggcct

SEQ ID NO: 1451361 - DNA, 14 bp, Homo sapiens
tctctgggcttagg

SEQ ID NO: 1451362 - DNA, 21 bp, Homo sapiens
tctctgtaagtgtagctcaaa

SEQ ID NO: 1451363 - DNA, 16 bp, Homo sapiens
tctctgtacttttcat

SEQ ID NO: 1451364 - DNA, 16 bp, Homo sapiens
tctctgtcccttgctg

SEQ ID NO: 1451365 - DNA, 20 bp, Homo sapiens
tctctgtcccttgctgtatg

SEQ ID NO: 1451366 - DNA, 15 bp, Homo sapiens
tctctgtcctacttc

SEQ ID NO: 1451367 - DNA, 16 bp, Homo sapiens
tctctgtgaacgattt

SEQ ID NO: 1451368 - DNA, 22 bp, Homo sapiens
tctctgtgaacgatttagaaag

SEQ ID NO: 1451369 - DNA, 23 bp, Homo sapiens
tctctgtgaacgatttagaaaga

SEQ ID NO: 1451370 - DNA, 21 bp, Homo sapiens
tctctgtgaagcctctctcct

SEQ ID NO: 1451371 - DNA, 15 bp, Homo sapiens
tctctgtgagaaggt

SEQ ID NO: 1451372 - DNA, 12 bp, Homo sapiens
tctctgtgcctt

SEQ ID NO: 1451373 - DNA, 17 bp, Homo sapiens
tctctgtgccttcgtct

SEQ ID NO: 1451374 - DNA, 14 bp, Homo sapiens
tctctgtgctctga

SEQ ID NO: 1451375 - DNA, 11 bp, Homo sapiens
tctctgtgctt

SEQ ID NO: 1451376 - DNA, 15 bp, Homo sapiens
tctctgtgtctaaga

SEQ ID NO: 1451377 - DNA, 23 bp, Homo sapiens
tctctgtgtctaagattctagat

SEQ ID NO: 1451378 - DNA, 22 bp, Homo sapiens
tctcttaaatgcaagtgcctag

SEQ ID NO: 1451379 - DNA, 16 bp, Homo sapiens
tctcttagaaatactt

SEQ ID NO: 1451380 - DNA, 17 bp, Homo sapiens
tctcttagctcccctcc

SEQ ID NO: 1451381 - DNA, 17 bp, Homo sapiens
tctcttatagaatattt

SEQ ID NO: 1451382 - DNA, 18 bp, Homo sapiens
tctcttatagaatattta

SEQ ID NO: 1451383 - DNA, 17 bp, Homo sapiens
tccttctagtttcccac

SEQ ID NO: 1451384 - DNA, 15 bp, Homo sapiens
tccttctattctagc

SEQ ID NO: 1451385 - DNA, 17 bp, Homo sapiens
tccttctcccctgccgg

SEQ ID NO: 1451386 - DNA, 13 bp, Homo sapiens
tccttctctcact

SEQ ID NO: 1451387 - DNA, 21 bp, Homo sapiens
tccttctctgggtctgatttt

SEQ ID NO: 1451388 - DNA, 23 bp, Homo sapiens
tccttctctgggtctgattttct

SEQ ID NO: 1451389 - DNA, 20 bp, Homo sapiens
tccttctgagctccacctct

SEQ ID NO: 1451390 - DNA, 20 bp, Homo sapiens
tccttctgcctaacttgtaa

SEQ ID NO: 1451391 - DNA, 19 bp, Homo sapiens
tccttcttccacttctcca

SEQ ID NO: 1451392 - DNA, 12 bp, Homo sapiens
tccttctttaaa

SEQ ID NO: 1451393 - DNA, 16 bp, Homo sapiens
tccttgaaaataaaaa

SEQ ID NO: 1451394 - DNA, 20 bp, Homo sapiens
tccttgaaatgagtaaaaac

SEQ ID NO: 1451395 - DNA, 19 bp, Homo sapiens
tccttgaagaactgcaggc

SEQ ID NO: 1451396 - DNA, 20 bp, Homo sapiens
tccttgaagaactgcaggcc

SEQ ID NO: 1451397 - DNA, 23 bp, Homo sapiens
tccttgaagaactgcaggccctg

SEQ ID NO: 1451398 - DNA, 21 bp, Homo sapiens
tccttgagacacggagcccag

SEQ ID NO: 1451399 - DNA, 23 bp, Homo sapiens
tccttgagatgatcgtagacaca

SEQ ID NO: 1451400 - DNA, 16 bp, Homo sapiens
tccttgagtgctcttg

SEQ ID NO: 1451401 - DNA, 15 bp, Homo sapiens
tccttgatgccagag

SEQ ID NO: 1451402 - DNA, 18 bp, Homo sapiens
tccttgatgccagagggc

SEQ ID NO: 1451403 - DNA, 22 bp, Homo sapiens
tccttgatgtacagattttatt

SEQ ID NO: 1451404 - DNA, 21 bp, Homo sapiens
tccttgcacactcccctgcac

SEQ ID NO: 1451405 - DNA, 17 bp, Homo sapiens
tccttgcacctgcatcc

SEQ ID NO: 1451406 - DNA, 17 bp, Homo sapiens
tccttgcaggggccgga

SEQ ID NO: 1451407 - DNA, 21 bp, Homo sapiens
tccttgcaggtgggggttgct

SEQ ID NO: 1451408 - DNA, 15 bp, Homo sapiens
tccttgcatcaattt

SEQ ID NO: 1451409 - DNA, 22 bp, Homo sapiens
tccttgcctgtgacttggactt

SEQ ID NO: 1451410 - DNA, 13 bp, Homo sapiens
tccttgccttaat

SEQ ID NO: 1451411 - DNA, 14 bp, Homo sapiens
tccttgctgcagct

SEQ ID NO: 1451412 - DNA, 20 bp, Homo sapiens
tccttggcatgccttccagc

SEQ ID NO: 1451413 - DNA, 15 bp, Homo sapiens
tccttggccacagac

SEQ ID NO: 1451414 - DNA, 17 bp, Homo sapiens
tccttggccatgcagaa

SEQ ID NO: 1451415 - DNA, 20 bp, Homo sapiens
tccttggctcccattcactc

SEQ ID NO: 1451416 - DNA, 21 bp, Homo sapiens
tccttggctttatgcaaatac

SEQ ID NO: 1451417 - DNA, 20 bp, Homo sapiens
tccttggctttatgcacatt

SEQ ID NO: 1451418 - DNA, 13 bp, Homo sapiens
tccttgggcactt

SEQ ID NO: 1451419 - DNA, 17 bp, Homo sapiens
tccttgggcacttttta

SEQ ID NO: 1451420 - DNA, 13 bp, Homo sapiens
tccttgggccctt

SEQ ID NO: 1451421 - DNA, 16 bp, Homo sapiens
tccttgggcctggcca

SEQ ID NO: 1451422 - DNA, 19 bp, Homo sapiens
tccttgggctcctggctgc

SEQ ID NO: 1451423 - DNA, 23 bp, Homo sapiens
tccttgggctcctggctgccagg

SEQ ID NO: 1451424 - DNA, 18 bp, Homo sapiens
tccttggggcagggcctg

SEQ ID NO: 1451425 - DNA, 20 bp, Homo sapiens
tccttggggccttgtgtgat

SEQ ID NO: 1451426 - DNA, 15 bp, Homo sapiens
tccttggtgctgtgt

SEQ ID NO: 1451427 - DNA, 22 bp, Homo sapiens
tccttggtgctgtgtgccccac

SEQ ID NO: 1451428 - DNA, 15 bp, Homo sapiens
tccttgtatttaaat

SEQ ID NO: 1451429 - DNA, 14 bp, Homo sapiens
tccttgtcaccagc

SEQ ID NO: 1451430 - DNA, 22 bp, Homo sapiens
tccttgtcaccagcaacatctc

SEQ ID NO: 1451431 - DNA, 19 bp, Homo sapiens
tccttgtcttttgagctat

SEQ ID NO: 1451432 - DNA, 23 bp, Homo sapiens
tccttgtgcaaaatatttgacta

SEQ ID NO: 1451433 - DNA, 22 bp, Homo sapiens
tccttgtggttgaaaaccacag

SEQ ID NO: 1451434 - DNA, 14 bp, Homo sapiens
tccttgttgttggt

SEQ ID NO: 1451435 - DNA, 14 bp, Homo sapiens
tccttgtttcaaac

SEQ ID NO: 1451436 - DNA, 19 bp, Homo sapiens
tcctttacattcaactttt

SEQ ID NO: 1451437 - DNA, 17 bp, Homo sapiens
tcctttacctttcagtg

SEQ ID NO: 1451438 - DNA, 14 bp, Homo sapiens
tcctttacgtgttt

SEQ ID NO: 1451439 - DNA, 12 bp, Homo sapiens
tcctttagaaac

SEQ ID NO: 1451440 - DNA, 13 bp, Homo sapiens
tcctttagaaaca

SEQ ID NO: 1451441 - DNA, 16 bp, Homo sapiens
tcctttaggtaagaag

SEQ ID NO: 1451442 - DNA, 14 bp, Homo sapiens
tcctttatgtgaat

SEQ ID NO: 1451443 - DNA, 17 bp, Homo sapiens
tcctttatgtgaatttt

SEQ ID NO: 1451444 - DNA, 20 bp, Homo sapiens
tcctttatgtgaatttttaa

SEQ ID NO: 1451445 - DNA, 16 bp, Homo sapiens
tcctttcacacatctg

SEQ ID NO: 1451446 - DNA, 18 bp, Homo sapiens
tcctttcaggccaaggct

SEQ ID NO: 1451447 - DNA, 17 bp, Homo sapiens
tcctttccaaggcttct

SEQ ID NO: 1451448 - DNA, 12 bp, Homo sapiens
tcctttccactg

SEQ ID NO: 1451449 - DNA, 21 bp, Homo sapiens
tcctttcccaagccttcgggc

SEQ ID NO: 1451450 - DNA, 22 bp, Homo sapiens
tcctttctaacaaaaaaatata

SEQ ID NO: 1451451 - DNA, 23 bp, Homo sapiens
tcctttctcagccgcttctgact

SEQ ID NO: 1451452 - DNA, 17 bp, Homo sapiens
tcctttctccagccagc

SEQ ID NO: 1451453 - DNA, 15 bp, Homo sapiens
tcctttctctgggct

SEQ ID NO: 1451454 - DNA, 20 bp, Homo sapiens
tcctttctttttcttcttcc

SEQ ID NO: 1451455 - DNA, 23 bp, Homo sapiens
tcctttgaacgtgcttctttgta

SEQ ID NO: 1451456 - DNA, 22 bp, Homo sapiens
tcctttgaacttgattgcctat

SEQ ID NO: 1451457 - DNA, 22 bp, Homo sapiens
tcctttggaacaagacagcctt

SEQ ID NO: 1451458 - DNA, 17 bp, Homo sapiens
tcctttgtattctgtct

SEQ ID NO: 1451459 - DNA, 20 bp, Homo sapiens
tcctttgtgtggctgcccca

SEQ ID NO: 1451460 - DNA, 18 bp, Homo sapiens
tcctttgtgtgtgtgtca

SEQ ID NO: 1451461 - DNA, 22 bp, Homo sapiens
tcctttgttttctgactaatta

SEQ ID NO: 1451462 - DNA, 14 bp, Homo sapiens
tccttttagcctag

SEQ ID NO: 1451463 - DNA, 15 bp, Homo sapiens
tccttttagcctagt

SEQ ID NO: 1451464 - DNA, 15 bp, Homo sapiens
tccttttccctgctt

SEQ ID NO: 1451465 - DNA, 11 bp, Homo sapiens
tccttttccta

SEQ ID NO: 1451466 - DNA, 20 bp, Homo sapiens
tccttttcctaattcacaca

SEQ ID NO: 1451467 - DNA, 16 bp, Homo sapiens
tccttttcctatcctt

SEQ ID NO: 1451468 - DNA, 19 bp, Homo sapiens
tccttttccttatttgcct

SEQ ID NO: 1451469 - DNA, 13 bp, Homo sapiens
tccttttctttaa

SEQ ID NO: 1451470 - DNA, 11 bp, Homo sapiens
tccttttgaac

SEQ ID NO: 1451471 - DNA, 18 bp, Homo sapiens
tcctttttaaatgtgaat

SEQ ID NO: 1451472 - DNA, 13 bp, Homo sapiens
tcctttttgttat

SEQ ID NO: 1451473 - DNA, 14 bp, Homo sapiens
tcctttttgttatt

SEQ ID NO: 1451474 - DNA, 14 bp, Homo sapiens
tccttttttaaaag

SEQ ID NO: 1451475 - DNA, 17 bp, Homo sapiens
tccttttttatacagga

SEQ ID NO: 1451476 - DNA, 14 bp, Homo sapiens
tccttttttgtcta

SEQ ID NO: 1451477 - DNA, 21 bp, Homo sapiens
tcgaaaagagtcttccaatta

SEQ ID NO: 1451478 - DNA, 14 bp, Homo sapiens
tcgaaagctctaga

SEQ ID NO: 1451479 - DNA, 16 bp, Homo sapiens
tcgaaaggccttcaga

SEQ ID NO: 1451480 - DNA, 18 bp, Homo sapiens
tcgaaccaaggcagcctc

SEQ ID NO: 1451481 - DNA, 21 bp, Homo sapiens
tcgaaccaaggcagcctccag

SEQ ID NO: 1451482 - DNA, 18 bp, Homo sapiens
tcgaaggctctctctttc

SEQ ID NO: 1451483 - DNA, 16 bp, Homo sapiens
tcgaaggggaggcaca

SEQ ID NO: 1451484 - DNA, 12 bp, Homo sapiens
tcgaagtgctga

SEQ ID NO: 1451485 - DNA, 15 bp, Homo sapiens
tcgaatgtaattgga

SEQ ID NO: 1451486 - DNA, 19 bp, Homo sapiens
tcgaattttatctgtggag

SEQ ID NO: 1451487 - DNA, 15 bp, Homo sapiens
tcgacagggcctgga

SEQ ID NO: 1451488 - DNA, 21 bp, Homo sapiens
tcgacagggcctggagcccca

SEQ ID NO: 1451489 - DNA, 20 bp, Homo sapiens
tcgaccacaccagcctcctg

SEQ ID NO: 1451490 - DNA, 22 bp, Homo sapiens
tcgaccacagcaagccatcatc

SEQ ID NO: 1451491 - DNA, 22 bp, Homo sapiens
tcgacggcacgcacttgcctgt

SEQ ID NO: 1451492 - DNA, 21 bp, Homo sapiens
tcgactactgctcctgtggca

SEQ ID NO: 1451493 - DNA, 14 bp, Homo sapiens
tcgactcaggatcc

SEQ ID NO: 1451494 - DNA, 12 bp, Homo sapiens
tcgactggtcca

SEQ ID NO: 1451495 - DNA, 15 bp, Homo sapiens
tcgactggtccagct

SEQ ID NO: 1451496 - DNA, 16 bp, Homo sapiens
tcgactggtccagctc

SEQ ID NO: 1451497 - DNA, 17 bp, Homo sapiens
tcgactggtccagctct

SEQ ID NO: 1451498 - DNA, 20 bp, Homo sapiens
tcgactggtccagctctgac

SEQ ID NO: 1451499 - DNA, 23 bp, Homo sapiens
tcctgtagttgcgtggactctgc

SEQ ID NO: 1451500 - DNA, 20 bp, Homo sapiens
tcctgtatggtggaagctgg

SEQ ID NO: 1451501 - DNA, 23 bp, Homo sapiens
tcctgtatggtggaagctgggtg

SEQ ID NO: 1451502 - DNA, 13 bp, Homo sapiens
tcctgtatgttgt

SEQ ID NO: 1451503 - DNA, 17 bp, Homo sapiens
tcctgtattcttgtttg

SEQ ID NO: 1451504 - DNA, 18 bp, Homo sapiens
tcctgtattcttgtttga

SEQ ID NO: 1451505 - DNA, 22 bp, Homo sapiens
tcctgtcacctagaacgtgcat

SEQ ID NO: 1451506 - DNA, 21 bp, Homo sapiens
tcctgtccactctcggggccc

SEQ ID NO: 1451507 - DNA, 13 bp, Homo sapiens
tcctgtccagctc

SEQ ID NO: 1451508 - DNA, 14 bp, Homo sapiens
tcctgtccagctcc

SEQ ID NO: 1451509 - DNA, 15 bp, Homo sapiens
tcctgtccagctcca

SEQ ID NO: 1451510 - DNA, 13 bp, Homo sapiens
tcctgtcccagag

SEQ ID NO: 1451511 - DNA, 14 bp, Homo sapiens
tcctgtcccagagg

SEQ ID NO: 1451512 - DNA, 22 bp, Homo sapiens
tcctgtcccgccttcctcctcc

SEQ ID NO: 1451513 - DNA, 18 bp, Homo sapiens
tcctggaaacagcatgaa

SEQ ID NO: 1451514 - DNA, 19 bp, Homo sapiens
tcctggaaaggctcagtct

SEQ ID NO: 1451515 - DNA, 22 bp, Homo sapiens
tcctggaaattgacgaggggtg

SEQ ID NO: 1451516 - DNA, 14 bp, Homo sapiens
tcctggaagcagag

SEQ ID NO: 1451517 - DNA, 16 bp, Homo sapiens
tcctggaagcagagca

SEQ ID NO: 1451518 - DNA, 18 bp, Homo sapiens
tcctggaagcaggtgcta

SEQ ID NO: 1451519 - DNA, 14 bp, Homo sapiens
tcctggaagctgtg

SEQ ID NO: 1451520 - DNA, 17 bp, Homo sapiens
tcctggaaggacacagt

SEQ ID NO: 1451521 - DNA, 19 bp, Homo sapiens
tcctggacactcagacctg

SEQ ID NO: 1451522 - DNA, 14 bp, Homo sapiens
tcctggacctgagt

SEQ ID NO: 1451523 - DNA, 20 bp, Homo sapiens
tcctggaccttgacagagca

SEQ ID NO: 1451524 - DNA, 23 bp, Homo sapiens
tcctggaccttgacagagcagct

SEQ ID NO: 1451525 - DNA, 19 bp, Homo sapiens
tcctggacttacaaaatgc

SEQ ID NO: 1451526 - DNA, 16 bp, Homo sapiens
tcctggagaagcctcg

SEQ ID NO: 1451527 - DNA, 15 bp, Homo sapiens
tcctggagcccagag

SEQ ID NO: 1451528 - DNA, 22 bp, Homo sapiens
tcctggagcccagaggagggca

SEQ ID NO: 1451529 - DNA, 15 bp, Homo sapiens
tcctggagcccgagg

SEQ ID NO: 1451530 - DNA, 21 bp, Homo sapiens
tcctggagcccgaggcaccag

SEQ ID NO: 1451531 - DNA, 15 bp, Homo sapiens
tcctggagctctgtg

SEQ ID NO: 1451532 - DNA, 15 bp, Homo sapiens
tcctggaggcagggg

SEQ ID NO: 1451533 - DNA, 11 bp, Homo sapiens
tcctggagggg

SEQ ID NO: 1451534 - DNA, 16 bp, Homo sapiens
tcctggagttttgatt

SEQ ID NO: 1451535 - DNA, 14 bp, Homo sapiens
tcctggattttctt

SEQ ID NO: 1451536 - DNA, 20 bp, Homo sapiens
tcctggattttctttctatg

SEQ ID NO: 1451537 - DNA, 21 bp, Homo sapiens
tcctggattttctttctatgt

SEQ ID NO: 1451538 - DNA, 11 bp, Homo sapiens
tcctggcagcc

SEQ ID NO: 1451539 - DNA, 14 bp, Homo sapiens
tcctggcagcccag

SEQ ID NO: 1451540 - DNA, 17 bp, Homo sapiens
tcctggcagcccagaga

SEQ ID NO: 1451541 - DNA, 20 bp, Homo sapiens
tcctggccccgggctctggc

SEQ ID NO: 1451542 - DNA, 12 bp, Homo sapiens
tcctggcccctc

SEQ ID NO: 1451543 - DNA, 15 bp, Homo sapiens
tcctggcccttcagt

SEQ ID NO: 1451544 - DNA, 19 bp, Homo sapiens
tcctggcccttcagtctgc

SEQ ID NO: 1451545 - DNA, 22 bp, Homo sapiens
tcctggcctcaagtgatctgcc

SEQ ID NO: 1451546 - DNA, 19 bp, Homo sapiens
tcctggcctcactggctgg

SEQ ID NO: 1451547 - DNA, 20 bp, Homo sapiens
tcctggcctcactggctggg

SEQ ID NO: 1451548 - DNA, 13 bp, Homo sapiens
tcctggcctccct

SEQ ID NO: 1451549 - DNA, 17 bp, Homo sapiens
tcctggcctgagagtca

SEQ ID NO: 1451550 - DNA, 18 bp, Homo sapiens
tcctggccttctgaactc

SEQ ID NO: 1451551 - DNA, 20 bp, Homo sapiens
tcctggctacatcccagcct

SEQ ID NO: 1451552 - DNA, 21 bp, Homo sapiens
tcctggctacatcccagcctg

SEQ ID NO: 1451553 - DNA, 16 bp, Homo sapiens
tcctggctcaggccca

SEQ ID NO: 1451554 - DNA, 14 bp, Homo sapiens
tcctggctcgcagg

SEQ ID NO: 1451555 - DNA, 23 bp, Homo sapiens
tcctggctcggggtaaaaagtgg

SEQ ID NO: 1451556 - DNA, 14 bp, Homo sapiens
tcctggctgccagg

SEQ ID NO: 1451557 - DNA, 15 bp, Homo sapiens
tcctggctgccaggc

SEQ ID NO: 1451558 - DNA, 13 bp, Homo sapiens
tcctggctgtgac

SEQ ID NO: 1451559 - DNA, 22 bp, Homo sapiens
tcctggctgtgacacctggtgc

SEQ ID NO: 1451560 - DNA, 14 bp, Homo sapiens
tcctggctgtgccc

SEQ ID NO: 1451561 - DNA, 19 bp, Homo sapiens
tcctggctgtgcccagcag

SEQ ID NO: 1451562 - DNA, 17 bp, Homo sapiens
tcctgggaaggccacct

SEQ ID NO: 1451563 - DNA, 19 bp, Homo sapiens
tcctgggagaacctcaggc

SEQ ID NO: 1451564 - DNA, 18 bp, Homo sapiens
tcctgggatgtaaaccat

SEQ ID NO: 1451565 - DNA, 19 bp, Homo sapiens
tcctgggcaatcagacacc

SEQ ID NO: 1451566 - DNA, 14 bp, Homo sapiens
tcctgggcaggtgg

SEQ ID NO: 1451567 - DNA, 21 bp, Homo sapiens
tcctgggcaggtgggagctga

SEQ ID NO: 1451568 - DNA, 21 bp, Homo sapiens
tcctgggcatgggtccagggc

SEQ ID NO: 1451569 - DNA, 12 bp, Homo sapiens
tcctgggcctgc

SEQ ID NO: 1451570 - DNA, 14 bp, Homo sapiens
tcctgggcgccctg

SEQ ID NO: 1451571 - DNA, 16 bp, Homo sapiens
tcctgggcgccctgga

SEQ ID NO: 1451572 - DNA, 16 bp, Homo sapiens
tcctgggctatattcc

SEQ ID NO: 1451573 - DNA, 12 bp, Homo sapiens
tcctgggctcag

SEQ ID NO: 1451574 - DNA, 13 bp, Homo sapiens
tcctgggctcagg

SEQ ID NO: 1451575 - DNA, 20 bp, Homo sapiens
tcctgggctgggtggcccct

SEQ ID NO: 1451576 - DNA, 23 bp, Homo sapiens
tcctggggacgaattccactcgt

SEQ ID NO: 1451577 - DNA, 15 bp, Homo sapiens
tcctggggatgtcat

SEQ ID NO: 1451578 - DNA, 13 bp, Homo sapiens
tcctggggcagca

SEQ ID NO: 1451579 - DNA, 18 bp, Homo sapiens
tcctggggccccgctggg

SEQ ID NO: 1451580 - DNA, 21 bp, Homo sapiens
tcctggggcctcggagcctca

SEQ ID NO: 1451581 - DNA, 16 bp, Homo sapiens
tcctggggctctgtgc

SEQ ID NO: 1451582 - DNA, 13 bp, Homo sapiens
tcctgggtcctgc

SEQ ID NO: 1451583 - DNA, 22 bp, Homo sapiens
tcctggtaattcctctccaggc

SEQ ID NO: 1451584 - DNA, 16 bp, Homo sapiens
tcctggtacccagcca

SEQ ID NO: 1451585 - DNA, 17 bp, Homo sapiens
tcctggtacccagccat

SEQ ID NO: 1451586 - DNA, 14 bp, Homo sapiens
tcctggtctgtgaa

SEQ ID NO: 1451587 - DNA, 17 bp, Homo sapiens
tcctggtcttgagatgt

SEQ ID NO: 1451588 - DNA, 20 bp, Homo sapiens
tcctggtcttgagatgtctt

SEQ ID NO: 1451589 - DNA, 13 bp, Homo sapiens
tcctggtcttttt

SEQ ID NO: 1451590 - DNA, 15 bp, Homo sapiens
tcctggtgctctctg

SEQ ID NO: 1451591 - DNA, 16 bp, Homo sapiens
tcctggtgctctctgc

SEQ ID NO: 1451592 - DNA, 18 bp, Homo sapiens
tcctggtgctctctgcca

SEQ ID NO: 1451593 - DNA, 14 bp, Homo sapiens
tcctggtggctggg

SEQ ID NO: 1451594 - DNA, 22 bp, Homo sapiens
tcctggtggctgggcccagcag

SEQ ID NO: 1451595 - DNA, 19 bp, Homo sapiens
tcctggtggggctgagcct

SEQ ID NO: 1451596 - DNA, 20 bp, Homo sapiens
tcctggtgggtcagcccagc

SEQ ID NO: 1451597 - DNA, 23 bp, Homo sapiens
tcctggtgggtcagcccagcacc

SEQ ID NO: 1451598 - DNA, 15 bp, Homo sapiens
tcctggtgtctagtt

SEQ ID NO: 1451599 - DNA, 18 bp, Homo sapiens
tcctggttgttcctgcat

SEQ ID NO: 1451600 - DNA, 15 bp, Homo sapiens
tcctggtttgactca

SEQ ID NO: 1451601 - DNA, 21 bp, Homo sapiens
tcctgtaaagaaacatttcct

SEQ ID NO: 1451602 - DNA, 15 bp, Homo sapiens
tcctgtaaataagag

SEQ ID NO: 1451603 - DNA, 19 bp, Homo sapiens
tcctgtaaatggtgtacat

SEQ ID NO: 1451604 - DNA, 15 bp, Homo sapiens
tcctgtaattcctac

SEQ ID NO: 1451605 - DNA, 16 bp, Homo sapiens
tcctgtaattcctacc

SEQ ID NO: 1451606 - DNA, 16 bp, Homo sapiens
tcctgtacactgaata

SEQ ID NO: 1451607 - DNA, 19 bp, Homo sapiens
tcctgtaggagttctattt

SEQ ID NO: 1451608 - DNA, 22 bp, Homo sapiens
tcctgtagttgcgtggactctg

SEQ ID NO: 1451609 - DNA, 14 bp, Homo sapiens
cccacctacccagc

SEQ ID NO: 1451610 - DNA, 21 bp, Homo sapiens
cccacctagaacactaactca

SEQ ID NO: 1451611 - DNA, 15 bp, Homo sapiens
cccacctagtgcccc

SEQ ID NO: 1451612 - DNA, 14 bp, Homo sapiens
cccacctccaggct

SEQ ID NO: 1451613 - DNA, 16 bp, Homo sapiens
cccacctcggcctccc

SEQ ID NO: 1451614 - DNA, 14 bp, Homo sapiens
cccacctctcctgc

SEQ ID NO: 1451615 - DNA, 16 bp, Homo sapiens
cccacctctcctgccc

SEQ ID NO: 1451616 - DNA, 18 bp, Homo sapiens
cccacctctcctgccctg

SEQ ID NO: 1451617 - DNA, 23 bp, Homo sapiens
cccacctgcccatcacagggttg

SEQ ID NO: 1451618 - DNA, 19 bp, Homo sapiens
cccacctgctgagagaccc

SEQ ID NO: 1451619 - DNA, 12 bp, Homo sapiens
cccacctggcca

SEQ ID NO: 1451620 - DNA, 12 bp, Homo sapiens
cccaccttccca

SEQ ID NO: 1451621 - DNA, 20 bp, Homo sapiens
cccaccttgttggagcctgc

SEQ ID NO: 1451622 - DNA, 21 bp, Homo sapiens
cccaccttgttggagcctgca

SEQ ID NO: 1451623 - DNA, 21 bp, Homo sapiens
cccacctttattaaaatctta

SEQ ID NO: 1451624 - DNA, 17 bp, Homo sapiens
cccacgaacgctcttag

SEQ ID NO: 1451625 - DNA, 13 bp, Homo sapiens
cccacgagtcacc

SEQ ID NO: 1451626 - DNA, 14 bp, Homo sapiens
cccacgagtcacct

SEQ ID NO: 1451627 - DNA, 18 bp, Homo sapiens
cccacgagtcacctgcaa

SEQ ID NO: 1451628 - DNA, 20 bp, Homo sapiens
tcctagggatctgaaatcca

SEQ ID NO: 1451629 - DNA, 21 bp, Homo sapiens
tcctaggtcatgcctcctccc

SEQ ID NO: 1451630 - DNA, 23 bp, Homo sapiens
tcctagtgaaagaggcagcttga

SEQ ID NO: 1451631 - DNA, 23 bp, Homo sapiens
tcctataagatctgtttttggac

SEQ ID NO: 1451632 - DNA, 14 bp, Homo sapiens
tcctataaggagag

SEQ ID NO: 1451633 - DNA, 20 bp, Homo sapiens
tcctataatataataaatat

SEQ ID NO: 1451634 - DNA, 15 bp, Homo sapiens
tcctatatagtttat

SEQ ID NO: 1451635 - DNA, 14 bp, Homo sapiens
tcctatatatttct

SEQ ID NO: 1451636 - DNA, 16 bp, Homo sapiens
tcctatatatttctat

SEQ ID NO: 1451637 - DNA, 17 bp, Homo sapiens
tcctatatatttctatt

SEQ ID NO: 1451638 - DNA, 18 bp, Homo sapiens
tcctatattgttttcagt

SEQ ID NO: 1451639 - DNA, 23 bp, Homo sapiens
tcctatattgttttcagtgtaca

SEQ ID NO: 1451640 - DNA, 20 bp, Homo sapiens
tcctatcaagccagtacgtg

SEQ ID NO: 1451641 - DNA, 13 bp, Homo sapiens
tcctatctgcagg

SEQ ID NO: 1451642 - DNA, 14 bp, Homo sapiens
tcctatctgtgttt

SEQ ID NO: 1451643 - DNA, 17 bp, Homo sapiens
tcctatctgtgttttga

SEQ ID NO: 1451644 - DNA, 18 bp, Homo sapiens
tcctatggacaacttatt

SEQ ID NO: 1451645 - DNA, 19 bp, Homo sapiens
tcctatggacaacttattt

SEQ ID NO: 1451646 - DNA, 24 bp, Homo sapiens
tcctatgtcaatttgtatatcatg

SEQ ID NO: 1451647 - DNA, 14 bp, Homo sapiens
tcctatgtggcagc

SEQ ID NO: 1451648 - DNA, 16 bp, Homo sapiens
tcctatgtggcagctg

SEQ ID NO: 1451649 - DNA, 16 bp, Homo sapiens
tcctattaaaacacag

SEQ ID NO: 1451650 - DNA, 17 bp, Homo sapiens
tcctattaaaacacagc

SEQ ID NO: 1451651 - DNA, 19 bp, Homo sapiens
tcctattaaaacacagctt

SEQ ID NO: 1451652 - DNA, 18 bp, Homo sapiens
tcctattctataaaactc

SEQ ID NO: 1451653 - DNA, 13 bp, Homo sapiens
tcctatttcagaa

SEQ ID NO: 1451654 - DNA, 20 bp, Homo sapiens
tcctatttcagaagtttaaa

SEQ ID NO: 1451655 - DNA, 17 bp, Homo sapiens
tcctatttgcagttact

SEQ ID NO: 1451656 - DNA, 18 bp, Homo sapiens
tcctcaagcaataattgt

SEQ ID NO: 1451657 - DNA, 14 bp, Homo sapiens
tcctcacacccctg

SEQ ID NO: 1451658 - DNA, 13 bp, Homo sapiens
tcctcacccccag

SEQ ID NO: 1451659 - DNA, 20 bp, Homo sapiens
tcctcacccccagctttgct

SEQ ID NO: 1451660 - DNA, 20 bp, Homo sapiens
tcctcaccccgtctggggtt

SEQ ID NO: 1451661 - DNA, 23 bp, Homo sapiens
tcctcacccctcgccacctttca

SEQ ID NO: 1451662 - DNA, 18 bp, Homo sapiens
tcctcacccctgtaggga

SEQ ID NO: 1451663 - DNA, 22 bp, Homo sapiens
tcctgagctgtcgctgcctcca

SEQ ID NO: 1451664 - DNA, 16 bp, Homo sapiens
tcctgaggggcatctg

SEQ ID NO: 1451665 - DNA, 19 bp, Homo sapiens
tcctgaggggcatctgccc

SEQ ID NO: 1451666 - DNA, 16 bp, Homo sapiens
tcctgagtagctggga

SEQ ID NO: 1451667 - DNA, 20 bp, Homo sapiens
tcctgagtagctgggactac

SEQ ID NO: 1451668 - DNA, 19 bp, Homo sapiens
tcctgataaacattaaaca

SEQ ID NO: 1451669 - DNA, 15 bp, Homo sapiens
tcctgataaagcaca

SEQ ID NO: 1451670 - DNA, 21 bp, Homo sapiens
tcctgataaagcacagctgta

SEQ ID NO: 1451671 - DNA, 19 bp, Homo sapiens
tcctgataataattgatca

SEQ ID NO: 1451672 - DNA, 21 bp, Homo sapiens
tcctgatagtcacctgctggt

SEQ ID NO: 1451673 - DNA, 24 bp, Homo sapiens
tcctgatatgatttaaaacatgta

SEQ ID NO: 1451674 - DNA, 13 bp, Homo sapiens
tcctgatcttccc

SEQ ID NO: 1451675 - DNA, 14 bp, Homo sapiens
tcctgatgacccag

SEQ ID NO: 1451676 - DNA, 15 bp, Homo sapiens
tcctgatgacccagg

SEQ ID NO: 1451677 - DNA, 20 bp, Homo sapiens
tcctgatgacccaggctgcc

SEQ ID NO: 1451678 - DNA, 22 bp, Homo sapiens
tcctgatgacccaggctgcctg

SEQ ID NO: 1451679 - DNA, 18 bp, Homo sapiens
tcctgatggagtgtgcag

SEQ ID NO: 1451680 - DNA, 21 bp, Homo sapiens
tcctgatggagtgtgcagaca

SEQ ID NO: 1451681 - DNA, 16 bp, Homo sapiens
tcctgatggccaagag

SEQ ID NO: 1451682 - DNA, 17 bp, Homo sapiens
tcctgatggccaagagc

SEQ ID NO: 1451683 - DNA, 15 bp, Homo sapiens
tcctgattccaaata

SEQ ID NO: 1451684 - DNA, 17 bp, Homo sapiens
tcctgattgtttacagt

SEQ ID NO: 1451685 - DNA, 17 bp, Homo sapiens
tcctgatttctctgaac

SEQ ID NO: 1451686 - DNA, 17 bp, Homo sapiens
tcctgcaaaattttata

SEQ ID NO: 1451687 - DNA, 16 bp, Homo sapiens
tcctgcaacgctgcct

SEQ ID NO: 1451688 - DNA, 17 bp, Homo sapiens
tcctgcaactcaaggac

SEQ ID NO: 1451689 - DNA, 13 bp, Homo sapiens
tcctgcaatgaaa

SEQ ID NO: 1451690 - DNA, 22 bp, Homo sapiens
tcctgcacacagaatgctcagg

SEQ ID NO: 1451691 - DNA, 16 bp, Homo sapiens
tcctgcaccccagcat

SEQ ID NO: 1451692 - DNA, 18 bp, Homo sapiens
tcctgcaccccagcattc

SEQ ID NO: 1451693 - DNA, 21 bp, Homo sapiens
tcctgcaccccagcattccag

SEQ ID NO: 1451694 - DNA, 21 bp, Homo sapiens
tcctgcacttacttgcttatt

SEQ ID NO: 1451695 - DNA, 19 bp, Homo sapiens
tcctgcagcctcctcctga

SEQ ID NO: 1451696 - DNA, 23 bp, Homo sapiens
tcctgcaggaacgagcactggcc

SEQ ID NO: 1451697 - DNA, 12 bp, Homo sapiens
tcctgcaggctg

SEQ ID NO: 1451698 - DNA, 15 bp, Homo sapiens
tcctgcaggctggct

SEQ ID NO: 1451699 - DNA, 20 bp, Homo sapiens
tcctgcaggctggctgttgg

SEQ ID NO: 1451700 - DNA, 24 bp, Homo sapiens
tcctgcagtagaaggtgccgtgag

SEQ ID NO: 1451701 - DNA, 18 bp, Homo sapiens
tcctgcatggtagggaga

SEQ ID NO: 1451702 - DNA, 20 bp, Homo sapiens
tcctgcatggtagggagaga

SEQ ID NO: 1451703 - DNA, 22 bp, Homo sapiens
tcctgcattcacccagacagct

SEQ ID NO: 1451704 - DNA, 17 bp, Homo sapiens
tcctgccaccccttcct

SEQ ID NO: 1451705 - DNA, 10 bp, Homo sapiens
tcctgccagc

SEQ ID NO: 1451706 - DNA, 18 bp, Homo sapiens
tcctgccagctgccttcc

SEQ ID NO: 1451707 - DNA, 15 bp, Homo sapiens
tcctgccatgtttag

SEQ ID NO: 1451708 - DNA, 19 bp, Homo sapiens
tcctgcccaggagagccag

SEQ ID NO: 1451709 - DNA, 13 bp, Homo sapiens
tcctgcccagtgt

SEQ ID NO: 1451710 - DNA, 14 bp, Homo sapiens
tcctgcccagtgtt

SEQ ID NO: 1451711 - DNA, 20 bp, Homo sapiens
tcctgccccaagggcccaga

SEQ ID NO: 1451712 - DNA, 17 bp, Homo sapiens
tcctgccctctgctctg

SEQ ID NO: 1451713 - DNA, 18 bp, Homo sapiens
tcctgccctctgctctgc

SEQ ID NO: 1451714 - DNA, 21 bp, Homo sapiens
tcctgccctctgctctgcctg

SEQ ID NO: 1451715 - DNA, 22 bp, Homo sapiens
tcctgccctgtgatatgtctgc

SEQ ID NO: 1451716 - DNA, 18 bp, Homo sapiens
tcctgccctgttgtgtat

SEQ ID NO: 1451717 - DNA, 19 bp, Homo sapiens
tcctgcccttcctcagttt

SEQ ID NO: 1451718 - DNA, 19 bp, Homo sapiens
tcctgccgcagacgggcac

SEQ ID NO: 1451719 - DNA, 13 bp, Homo sapiens
tcctgccgcagag

SEQ ID NO: 1451720 - DNA, 17 bp, Homo sapiens
tcctgccgcagagctgg

SEQ ID NO: 1451721 - DNA, 23 bp, Homo sapiens
tcctgccggtgggaccctgtccg

SEQ ID NO: 1451722 - DNA, 14 bp, Homo sapiens
tcctgcctcagcct

SEQ ID NO: 1451723 - DNA, 17 bp, Homo sapiens
tcctgcctcagcctccc

SEQ ID NO: 1451724 - DNA, 13 bp, Homo sapiens
tcctgcctggcca

SEQ ID NO: 1451725 - DNA, 16 bp, Homo sapiens
tcctgcctggtcctcc

SEQ ID NO: 1451726 - DNA, 20 bp, Homo sapiens
tcctgcctgtctcctttgca

SEQ ID NO: 1451727 - DNA, 14 bp, Homo sapiens
tcctgcctgtctgc

SEQ ID NO: 1451728 - DNA, 16 bp, Homo sapiens
tcctgcctttaagcca

SEQ ID NO: 1451729 - DNA, 23 bp, Homo sapiens
tcctgcctttaagccaaagaaac

SEQ ID NO: 1451730 - DNA, 21 bp, Homo sapiens
tcctgcggagtgaagaggggc

SEQ ID NO: 1451731 - DNA, 23 bp, Homo sapiens
tcctgcggagtgaagaggggcag

SEQ ID NO: 1451732 - DNA, 19 bp, Homo sapiens
tcctgcgggagtagttgga

SEQ ID NO: 1451733 - DNA, 12 bp, Homo sapiens
tcctgcgggctt

SEQ ID NO: 1451734 - DNA, 23 bp, Homo sapiens
tcctgctacctcccttgcctttc

SEQ ID NO: 1451735 - DNA, 14 bp, Homo sapiens
tcctgctactctgt

SEQ ID NO: 1451736 - DNA, 18 bp, Homo sapiens
tcctgctagctgtagaaa

SEQ ID NO: 1451737 - DNA, 22 bp, Homo sapiens
tcctgctcaactctacccctgc

SEQ ID NO: 1451738 - DNA, 15 bp, Homo sapiens
tcctgctcacctgtg

SEQ ID NO: 1451739 - DNA, 16 bp, Homo sapiens
tcctgctccagcagca

SEQ ID NO: 1451740 - DNA, 17 bp, Homo sapiens
tcctgctccagcagcac

SEQ ID NO: 1451741 - DNA, 19 bp, Homo sapiens
tcctgctccatgactggct

SEQ ID NO: 1451742 - DNA, 20 bp, Homo sapiens
tcctgctccctgtggcactc

SEQ ID NO: 1451743 - DNA, 22 bp, Homo sapiens
tcctgctccgctgcctggaaca

SEQ ID NO: 1451744 - DNA, 13 bp, Homo sapiens
tcctgctccgtgg

SEQ ID NO: 1451745 - DNA, 22 bp, Homo sapiens
tcctgctccgtggactgcagtc

SEQ ID NO: 1451746 - DNA, 10 bp, Homo sapiens
tcctgctcct

SEQ ID NO: 1451747 - DNA, 17 bp, Homo sapiens
tcctgctcctccctgcc

SEQ ID NO: 1451748 - DNA, 21 bp, Homo sapiens
tcctgctctcttcaggaggcc

SEQ ID NO: 1451749 - DNA, 22 bp, Homo sapiens
tcctgctgacctcactgtcctg

SEQ ID NO: 1451750 - DNA, 15 bp, Homo sapiens
tcctgctgcacaggc

SEQ ID NO: 1451751 - DNA, 20 bp, Homo sapiens
ccatgttgtaatgctgcact

SEQ ID NO: 1451752 - DNA, 13 bp, Homo sapiens
ccatgtttagtga

SEQ ID NO: 1451753 - DNA, 21 bp, Homo sapiens
ccatgtttagtgaatgacttt

SEQ ID NO: 1451754 - DNA, 12 bp, Homo sapiens
ccatgtttattg

SEQ ID NO: 1451755 - DNA, 22 bp, Homo sapiens
ccatgtttattgttttttaaag

SEQ ID NO: 1451756 - DNA, 23 bp, Homo sapiens
ccatgtttctcacattgctgtat

SEQ ID NO: 1451757 - DNA, 21 bp, Homo sapiens
ccatgtttgagctcagacccc

SEQ ID NO: 1451758 - DNA, 12 bp, Homo sapiens
ccattaattaca

SEQ ID NO: 1451759 - DNA, 19 bp, Homo sapiens
ccattacaactagatcaag

SEQ ID NO: 1451760 - DNA, 22 bp, Homo sapiens
ccattacagaggtattaaaact

SEQ ID NO: 1451761 - DNA, 19 bp, Homo sapiens
ccattacccagtgccgagg

SEQ ID NO: 1451762 - DNA, 22 bp, Homo sapiens
ccattacctccatccatccttc

SEQ ID NO: 1451763 - DNA, 13 bp, Homo sapiens
ccattacctgtac

SEQ ID NO: 1451764 - DNA, 13 bp, Homo sapiens
ccattactgtgat

SEQ ID NO: 1451765 - DNA, 19 bp, Homo sapiens
ccattagaaaattttgtaa

SEQ ID NO: 1451766 - DNA, 18 bp, Homo sapiens
ccattagataaacacagg

SEQ ID NO: 1451767 - DNA, 20 bp, Homo sapiens
ccattagataaacacaggca

SEQ ID NO: 1451768 - DNA, 17 bp, Homo sapiens
ccattagccagatttgt

SEQ ID NO: 1451769 - DNA, 14 bp, Homo sapiens
ccattaggccagca

SEQ ID NO: 1451770 - DNA, 19 bp, Homo sapiens
ccattatgcaaatggagat

SEQ ID NO: 1451771 - DNA, 13 bp, Homo sapiens
ccattcaattagt

SEQ ID NO: 1451772 - DNA, 22 bp, Homo sapiens
ccattcacatttgatgtacatg

SEQ ID NO: 1451773 - DNA, 20 bp, Homo sapiens
ccattcacttcataatccag

SEQ ID NO: 1451774 - DNA, 19 bp, Homo sapiens
ccattcagaatatcatctt

SEQ ID NO: 1451775 - DNA, 16 bp, Homo sapiens
ccattcatccttccat

SEQ ID NO: 1451776 - DNA, 19 bp, Homo sapiens
ccattcatccttccatcca

SEQ ID NO: 1451777 - DNA, 20 bp, Homo sapiens
ccattcatccttccatccat

SEQ ID NO: 1451778 - DNA, 16 bp, Homo sapiens
ccattcattaattagt

SEQ ID NO: 1451779 - DNA, 21 bp, Homo sapiens
ccattcattaattagttccag

SEQ ID NO: 1451780 - DNA, 15 bp, Homo sapiens
ccattccaaaatatt

SEQ ID NO: 1451781 - DNA, 21 bp, Homo sapiens
ccattccaggcagcctctgtc

SEQ ID NO: 1451782 - DNA, 20 bp, Homo sapiens
ccattccagtacagtattct

SEQ ID NO: 1451783 - DNA, 22 bp, Homo sapiens
ccattccagtcaaatctgggct

SEQ ID NO: 1451784 - DNA, 19 bp, Homo sapiens
ccattccctccatttttct

SEQ ID NO: 1451785 - DNA, 18 bp, Homo sapiens
ccattccctgccttgctg

SEQ ID NO: 1451786 - DNA, 12 bp, Homo sapiens
ccattcctcagg

SEQ ID NO: 1451787 - DNA, 13 bp, Homo sapiens
ccattcctccctc

SEQ ID NO: 1451788 - DNA, 16 bp, Homo sapiens
ccattcctggagcccg

SEQ ID NO: 1451789 - DNA, 24 bp, Homo sapiens
ccattcctggagcccgaggcacca

SEQ ID NO: 1451790 - DNA, 17 bp, Homo sapiens
ccattcgtctgtcccag

SEQ ID NO: 1451791 - DNA, 12 bp, Homo sapiens
ccattctagatc

SEQ ID NO: 1451792 - DNA, 19 bp, Homo sapiens
ccattctagatcctgcacc

SEQ ID NO: 1451793 - DNA, 17 bp, Homo sapiens
ccattctcaagccctgc

SEQ ID NO: 1451794 - DNA, 18 bp, Homo sapiens
ccattctcaagccctgca

SEQ ID NO: 1451795 - DNA, 11 bp, Homo sapiens
ccattctccca

SEQ ID NO: 1451796 - DNA, 12 bp, Homo sapiens
ccattctcccag

SEQ ID NO: 1451797 - DNA, 13 bp, Homo sapiens
ccattctcccagg

SEQ ID NO: 1451798 - DNA, 14 bp, Homo sapiens
ccattctcccaggt

SEQ ID NO: 1451799 - DNA, 12 bp, Homo sapiens
ccattctcctgc

SEQ ID NO: 1451800 - DNA, 15 bp, Homo sapiens
ccattctcctgcctc

SEQ ID NO: 1451801 - DNA, 19 bp, Homo sapiens
ccattctctctcctgtcca

SEQ ID NO: 1451802 - DNA, 16 bp, Homo sapiens
ccattctgaccatttc

SEQ ID NO: 1451803 - DNA, 12 bp, Homo sapiens
ccattctgactc

SEQ ID NO: 1451804 - DNA, 13 bp, Homo sapiens
ccattctgactcg

SEQ ID NO: 1451805 - DNA, 19 bp, Homo sapiens
ccattctgccccagagtgg

SEQ ID NO: 1451806 - DNA, 20 bp, Homo sapiens
ccattctgcctcagcctcct

SEQ ID NO: 1451807 - DNA, 20 bp, Homo sapiens
ccattctgcctccattctga

SEQ ID NO: 1451808 - DNA, 17 bp, Homo sapiens
ccattctgttttccccc

SEQ ID NO: 1451809 - DNA, 19 bp, Homo sapiens
ccattctgttttcccccag

SEQ ID NO: 1451810 - DNA, 19 bp, Homo sapiens
ccattcttcctagttttct

SEQ ID NO: 1451811 - DNA, 20 bp, Homo sapiens
ccattcttcctagttttctc

SEQ ID NO: 1451812 - DNA, 16 bp, Homo sapiens
ccattcttgcttgact

SEQ ID NO: 1451813 - DNA, 11 bp, Homo sapiens
ccattgaaggc

SEQ ID NO: 1451814 - DNA, 21 bp, Homo sapiens
ccattgaaggcttaaacccat

SEQ ID NO: 1451815 - DNA, 16 bp, Homo sapiens
ccattgaccagctctc

SEQ ID NO: 1451816 - DNA, 14 bp, Homo sapiens
ccattgacctcagc

SEQ ID NO: 1451817 - DNA, 21 bp, Homo sapiens
ccattgacctcagctgcacat

SEQ ID NO: 1451818 - DNA, 21 bp, Homo sapiens
tccctcgggaagcagccagct

SEQ ID NO: 1451819 - DNA, 18 bp, Homo sapiens
tccctcgtccacaggggc

SEQ ID NO: 1451820 - DNA, 19 bp, Homo sapiens
tccctctaatgagactgac

SEQ ID NO: 1451821 - DNA, 16 bp, Homo sapiens
tccctctaatttatct

SEQ ID NO: 1451822 - DNA, 13 bp, Homo sapiens
tccctctagtgcc

SEQ ID NO: 1451823 - DNA, 16 bp, Homo sapiens
tccctctcagaggcct

SEQ ID NO: 1451824 - DNA, 18 bp, Homo sapiens
tccctctcagtgccttct

SEQ ID NO: 1451825 - DNA, 20 bp, Homo sapiens
tccctctcctatgtggcagc

SEQ ID NO: 1451826 - DNA, 23 bp, Homo sapiens
tccctctcctatgtggcagctgg

SEQ ID NO: 1451827 - DNA, 12 bp, Homo sapiens
tccctctcctgc

SEQ ID NO: 1451828 - DNA, 13 bp, Homo sapiens
tccctctcctgcc

SEQ ID NO: 1451829 - DNA, 16 bp, Homo sapiens
tccctctcctgcctac

SEQ ID NO: 1451830 - DNA, 20 bp, Homo sapiens
tccctctcgctcccctctgc

SEQ ID NO: 1451831 - DNA, 9 bp, Homo sapiens
tccctctct

SEQ ID NO: 1451832 - DNA, 15 bp, Homo sapiens
tccctctctcatgag

SEQ ID NO: 1451833 - DNA, 21 bp, Homo sapiens
tccctctctcccatttcagga

SEQ ID NO: 1451834 - DNA, 11 bp, Homo sapiens
tccctctctct

SEQ ID NO: 1451835 - DNA, 12 bp, Homo sapiens
tccctctctctt

SEQ ID NO: 1451836 - DNA, 20 bp, Homo sapiens
tccctctctcttctgctcca

SEQ ID NO: 1451837 - DNA, 15 bp, Homo sapiens
tccctctcttcccct

SEQ ID NO: 1451838 - DNA, 11 bp, Homo sapiens
tccctctgccc

SEQ ID NO: 1451839 - DNA, 11 bp, Homo sapiens
tccctctgcct

SEQ ID NO: 1451840 - DNA, 17 bp, Homo sapiens
tccctctggccctgcct

SEQ ID NO: 1451841 - DNA, 18 bp, Homo sapiens
tccctctggccctgcctt

SEQ ID NO: 1451842 - DNA, 12 bp, Homo sapiens
tccctctggctt

SEQ ID NO: 1451843 - DNA, 16 bp, Homo sapiens
tccctctgggcctgtt

SEQ ID NO: 1451844 - DNA, 23 bp, Homo sapiens
tccctctgggcctgttctcttgg

SEQ ID NO: 1451845 - DNA, 14 bp, Homo sapiens
tccctctggtctac

SEQ ID NO: 1451846 - DNA, 22 bp, Homo sapiens
tccctctggtctactctagaag

SEQ ID NO: 1451847 - DNA, 20 bp, Homo sapiens
tccctctgtcatcctcagga

SEQ ID NO: 1451848 - DNA, 20 bp, Homo sapiens
tccctcttcactgtggccac

SEQ ID NO: 1451849 - DNA, 14 bp, Homo sapiens
tccctcttccctct

SEQ ID NO: 1451850 - DNA, 16 bp, Homo sapiens
tccctcttccctctcc

SEQ ID NO: 1451851 - DNA, 18 bp, Homo sapiens
tccctctttggctcccct

SEQ ID NO: 1451852 - DNA, 17 bp, Homo sapiens
tccctgaaaacccagag

SEQ ID NO: 1451853 - DNA, 19 bp, Homo sapiens
tccctgaaaacccagagag

SEQ ID NO: 1451854 - DNA, 20 bp, Homo sapiens
tccctgaaaacccagagagg

SEQ ID NO: 1451855 - DNA, 17 bp, Homo sapiens
tccctgaaaatgttttt

SEQ ID NO: 1451856 - DNA, 18 bp, Homo sapiens
tccctgaacccctggcca

SEQ ID NO: 1451857 - DNA, 23 bp, Homo sapiens
tccctgaacgttttcttctttcc

SEQ ID NO: 1451858 - DNA, 16 bp, Homo sapiens
tccctgaactcccaga

SEQ ID NO: 1451859 - DNA, 17 bp, Homo sapiens
tccctgaactcccagaa

SEQ ID NO: 1451860 - DNA, 14 bp, Homo sapiens
tccctgaacttcct

SEQ ID NO: 1451861 - DNA, 21 bp, Homo sapiens
tccctgaccttagcgttctgg

SEQ ID NO: 1451862 - DNA, 22 bp, Homo sapiens
tccctgaccttagcgttctgga

SEQ ID NO: 1451863 - DNA, 23 bp, Homo sapiens
tccctgaccttagcgttctggac

SEQ ID NO: 1451864 - DNA, 20 bp, Homo sapiens
tccctgactctctgtgacct

SEQ ID NO: 1451865 - DNA, 22 bp, Homo sapiens
tccctgagaaacccaccagcct

SEQ ID NO: 1451866 - DNA, 23 bp, Homo sapiens
ccattttcttattgcgctgctac

SEQ ID NO: 1451867 - DNA, 17 bp, Homo sapiens
ccattttgcaaaatttc

SEQ ID NO: 1451868 - DNA, 21 bp, Homo sapiens
ccattttgcaaaatttccagt

SEQ ID NO: 1451869 - DNA, 16 bp, Homo sapiens
ccattttgcccttcca

SEQ ID NO: 1451870 - DNA, 15 bp, Homo sapiens
ccatttttcctctgt

SEQ ID NO: 1451871 - DNA, 18 bp, Homo sapiens
ccatttttgctgaattca

SEQ ID NO: 1451872 - DNA, 15 bp, Homo sapiens
ccatttttttcttta

SEQ ID NO: 1451873 - DNA, 15 bp, Homo sapiens
cccaaaacccagggc

SEQ ID NO: 1451874 - DNA, 23 bp, Homo sapiens
cccaaaacctcatgacagccaga

SEQ ID NO: 1451875 - DNA, 23 bp, Homo sapiens
cccaaaagtcaaaaggtgcctgt

SEQ ID NO: 1451876 - DNA, 21 bp, Homo sapiens
cccaaacaccagtcacctcgt

SEQ ID NO: 1451877 - DNA, 16 bp, Homo sapiens
cccaaacaccttccag

SEQ ID NO: 1451878 - DNA, 22 bp, Homo sapiens
cccaaacaccttccagctcctg

SEQ ID NO: 1451879 - DNA, 16 bp, Homo sapiens
cccaaacgccctttcc

SEQ ID NO: 1451880 - DNA, 19 bp, Homo sapiens
cccaaacttccaggttcca

SEQ ID NO: 1451881 - DNA, 17 bp, Homo sapiens
cccaaagccactggaag

SEQ ID NO: 1451882 - DNA, 20 bp, Homo sapiens
cccaaagccactggaaggag

SEQ ID NO: 1451883 - DNA, 21 bp, Homo sapiens
cccaaagccactggaaggagc

SEQ ID NO: 1451884 - DNA, 13 bp, Homo sapiens
cccaaagctgagc

SEQ ID NO: 1451885 - DNA, 16 bp, Homo sapiens
cccaaagctttcctgc

SEQ ID NO: 1451886 - DNA, 20 bp, Homo sapiens
cccaaagctttcctgcccca

SEQ ID NO: 1451887 - DNA, 18 bp, Homo sapiens
cccaaaggaacactgaca

SEQ ID NO: 1451888 - DNA, 14 bp, Homo sapiens
cccaaagggcacac

SEQ ID NO: 1451889 - DNA, 19 bp, Homo sapiens
cccaaagtcctctgctcca

SEQ ID NO: 1451890 - DNA, 21 bp, Homo sapiens
cccaaagtcctctgctccagc

SEQ ID NO: 1451891 - DNA, 20 bp, Homo sapiens
cccaaagtgctgagattaca

SEQ ID NO: 1451892 - DNA, 19 bp, Homo sapiens
cccaaagtggggagggaca

SEQ ID NO: 1451893 - DNA, 19 bp, Homo sapiens
cccaaatatgtattttcct

SEQ ID NO: 1451894 - DNA, 17 bp, Homo sapiens
cccaacaaaccatccag

SEQ ID NO: 1451895 - DNA, 22 bp, Homo sapiens
cccaacaacatgaaactgccta

SEQ ID NO: 1451896 - DNA, 17 bp, Homo sapiens
cccaacaccccgcctgc

SEQ ID NO: 1451897 - DNA, 21 bp, Homo sapiens
cccaacactgtgccctggtgg

SEQ ID NO: 1451898 - DNA, 18 bp, Homo sapiens
cccaacagaaggaaggag

SEQ ID NO: 1451899 - DNA, 11 bp, Homo sapiens
cccaacagcac

SEQ ID NO: 1451900 - DNA, 14 bp, Homo sapiens
cccaacagcacttt

SEQ ID NO: 1451901 - DNA, 14 bp, Homo sapiens
cccaacccaaacca

SEQ ID NO: 1451902 - DNA, 16 bp, Homo sapiens
cccaacccaaaccatg

SEQ ID NO: 1451903 - DNA, 13 bp, Homo sapiens
cccaacccccctc

SEQ ID NO: 1451904 - DNA, 20 bp, Homo sapiens
cccaaccctatctcctgaca

SEQ ID NO: 1451905 - DNA, 18 bp, Homo sapiens
cccaacctcaatgccctg

SEQ ID NO: 1451906 - DNA, 21 bp, Homo sapiens
cccaacctcaatgccctgcca

SEQ ID NO: 1451907 - DNA, 16 bp, Homo sapiens
cccaacctcctgacct

SEQ ID NO: 1451908 - DNA, 14 bp, Homo sapiens
cccaacctgctgaa

SEQ ID NO: 1451909 - DNA, 16 bp, Homo sapiens
cccaacggccctgcag

SEQ ID NO: 1451910 - DNA, 13 bp, Homo sapiens
cccaactcctgga

SEQ ID NO: 1451911 - DNA, 14 bp, Homo sapiens
cccaactctcccca

SEQ ID NO: 1451912 - DNA, 19 bp, Homo sapiens
cccaactctccccagtgcc

SEQ ID NO: 1451913 - DNA, 14 bp, Homo sapiens
cccaactctttatc

SEQ ID NO: 1451914 - DNA, 22 bp, Homo sapiens
cccaactgatcctgctccagca

SEQ ID NO: 1451915 - DNA, 17 bp, Homo sapiens
cccaactgtgagcaagg

SEQ ID NO: 1451916 - DNA, 22 bp, Homo sapiens
cccaactgtggtagctccagcg

SEQ ID NO: 1451917 - DNA, 12 bp, Homo sapiens
cccaactgttat

SEQ ID NO: 1451918 - DNA, 19 bp, Homo sapiens
cccaagacagatgccccag

SEQ ID NO: 1451919 - DNA, 23 bp, Homo sapiens
cccaagactgtcattgcccctcc

SEQ ID NO: 1451920 - DNA, 17 bp, Homo sapiens
cccaagagatgaagagt

SEQ ID NO: 1451921 - DNA, 18 bp, Homo sapiens
cccaagaggactgagact

SEQ ID NO: 1451922 - DNA, 23 bp, Homo sapiens
cccaagaggtcaaggctgcagtg

SEQ ID NO: 1451923 - DNA, 20 bp, Homo sapiens
cccaagatgggcatcttttg

SEQ ID NO: 1451924 - DNA, 17 bp, Homo sapiens
cccaagattgagctctc

SEQ ID NO: 1451925 - DNA, 15 bp, Homo sapiens
cccaagcagccagcc

SEQ ID NO: 1451926 - DNA, 16 bp, Homo sapiens
cccaagcagccagcca

SEQ ID NO: 1451927 - DNA, 15 bp, Homo sapiens
cccaagccagaggct

SEQ ID NO: 1451928 - DNA, 16 bp, Homo sapiens
cccaagccagaggctg

SEQ ID NO: 1451929 - DNA, 13 bp, Homo sapiens
cccaagccccatc

SEQ ID NO: 1451930 - DNA, 23 bp, Homo sapiens
cccaagcccgacttgctgttttg

SEQ ID NO: 1451931 - DNA, 21 bp, Homo sapiens
cccaagcgttcctggccttct

SEQ ID NO: 1451932 - DNA, 11 bp, Homo sapiens
cccaagctggc

SEQ ID NO: 1451933 - DNA, 16 bp, Homo sapiens
cccaaggactgagggc

SEQ ID NO: 1451934 - DNA, 20 bp, Homo sapiens
cccaaggactgagggcagtg

SEQ ID NO: 1451935 - DNA, 20 bp, Homo sapiens
cccaaggagccattctgtgt

SEQ ID NO: 1451936 - DNA, 17 bp, Homo sapiens
tccctggtccctcgtcc

SEQ ID NO: 1451937 - DNA, 22 bp, Homo sapiens
tccctggtccctcgtccacagg

SEQ ID NO: 1451938 - DNA, 14 bp, Homo sapiens
tccctggtcccttg

SEQ ID NO: 1451939 - DNA, 19 bp, Homo sapiens
tccctggtcccttggagac

SEQ ID NO: 1451940 - DNA, 17 bp, Homo sapiens
tccctggtccttcactg

SEQ ID NO: 1451941 - DNA, 18 bp, Homo sapiens
tccctggtccttcactgg

SEQ ID NO: 1451942 - DNA, 18 bp, Homo sapiens
tccctggtgcctctgtgc

SEQ ID NO: 1451943 - DNA, 15 bp, Homo sapiens
tccctgtagctcagt

SEQ ID NO: 1451944 - DNA, 16 bp, Homo sapiens
tccctgtagctctgcc

SEQ ID NO: 1451945 - DNA, 13 bp, Homo sapiens
tccctgtcacgct

SEQ ID NO: 1451946 - DNA, 22 bp, Homo sapiens
tccctgtcacgctcatgtcctg

SEQ ID NO: 1451947 - DNA, 13 bp, Homo sapiens
tccctgtcccagt

SEQ ID NO: 1451948 - DNA, 14 bp, Homo sapiens
tccctgtcccagtt

SEQ ID NO: 1451949 - DNA, 21 bp, Homo sapiens
tccctgtccctctagtgcctt

SEQ ID NO: 1451950 - DNA, 15 bp, Homo sapiens
tccctgtcctcctcg

SEQ ID NO: 1451951 - DNA, 15 bp, Homo sapiens
tccctgtctccagct

SEQ ID NO: 1451952 - DNA, 17 bp, Homo sapiens
tccctgtctccagctgc

SEQ ID NO: 1451953 - DNA, 14 bp, Homo sapiens
tccctgtctgtgtc

SEQ ID NO: 1451954 - DNA, 17 bp, Homo sapiens
tccctgtctgtgtccca

SEQ ID NO: 1451955 - DNA, 18 bp, Homo sapiens
tccctgtctgtgtcccag

SEQ ID NO: 1451956 - DNA, 20 bp, Homo sapiens
tccctgtctgtgtcccagcc

SEQ ID NO: 1451957 - DNA, 21 bp, Homo sapiens
tccctgtctgtgtcccagcca

SEQ ID NO: 1451958 - DNA, 16 bp, Homo sapiens
tccctgtgatggccag

SEQ ID NO: 1451959 - DNA, 17 bp, Homo sapiens
tccctgtgatggccagg

SEQ ID NO: 1451960 - DNA, 20 bp, Homo sapiens
tccctgtgatggccaggcca

SEQ ID NO: 1451961 - DNA, 19 bp, Homo sapiens
tccctgtgctgatcctgct

SEQ ID NO: 1451962 - DNA, 21 bp, Homo sapiens
tccctgtggcactcagggagc

SEQ ID NO: 1451963 - DNA, 23 bp, Homo sapiens
tccctgtggggcaggagtgccag

SEQ ID NO: 1451964 - DNA, 15 bp, Homo sapiens
tccctgttccccaga

SEQ ID NO: 1451965 - DNA, 18 bp, Homo sapiens
tccctgttccccagagaa

SEQ ID NO: 1451966 - DNA, 16 bp, Homo sapiens
tccctgttttagtttc

SEQ ID NO: 1451967 - DNA, 19 bp, Homo sapiens
tccctgttttctgagcccg

SEQ ID NO: 1451968 - DNA, 22 bp, Homo sapiens
tccctgttttctgagcccgggc

SEQ ID NO: 1451969 - DNA, 23 bp, Homo sapiens
tccctgttttctgagcccgggct

SEQ ID NO: 1451970 - DNA, 16 bp, Homo sapiens
tcccttaacagttgta

SEQ ID NO: 1451971 - DNA, 22 bp, Homo sapiens
tcccttaacagttgtatttaac

SEQ ID NO: 1451972 - DNA, 19 bp, Homo sapiens
tcccttaagaatgagtttc

SEQ ID NO: 1451973 - DNA, 20 bp, Homo sapiens
tcccttaatattgaggctgc

SEQ ID NO: 1451974 - DNA, 22 bp, Homo sapiens
tcccttaatattgaggctgcag

SEQ ID NO: 1451975 - DNA, 14 bp, Homo sapiens
tcccttacctcaaa

SEQ ID NO: 1451976 - DNA, 15 bp, Homo sapiens
tcccttactttgctg

SEQ ID NO: 1451977 - DNA, 17 bp, Homo sapiens
tcccttagcctctccca

SEQ ID NO: 1451978 - DNA, 20 bp, Homo sapiens
tcccttagcctctcccaccc

SEQ ID NO: 1451979 - DNA, 16 bp, Homo sapiens
tcccttattgcctccc

SEQ ID NO: 1451980 - DNA, 11 bp, Homo sapiens
cccacacctgg

SEQ ID NO: 1451981 - DNA, 13 bp, Homo sapiens
cccacacctggtg

SEQ ID NO: 1451982 - DNA, 19 bp, Homo sapiens
cccacacttgttccagctc

SEQ ID NO: 1451983 - DNA, 12 bp, Homo sapiens
cccacagagaca

SEQ ID NO: 1451984 - DNA, 14 bp, Homo sapiens
cccacagctcagct

SEQ ID NO: 1451985 - DNA, 14 bp, Homo sapiens
cccacagctcccac

SEQ ID NO: 1451986 - DNA, 17 bp, Homo sapiens
cccacagctcccacccc

SEQ ID NO: 1451987 - DNA, 20 bp, Homo sapiens
cccacaggaagcctgcagtc

SEQ ID NO: 1451988 - DNA, 23 bp, Homo sapiens
cccacaggaagcctgcagtcctg

SEQ ID NO: 1451989 - DNA, 17 bp, Homo sapiens
cccacaggaagctcagc

SEQ ID NO: 1451990 - DNA, 20 bp, Homo sapiens
cccacaggaagctcagcctt

SEQ ID NO: 1451991 - DNA, 17 bp, Homo sapiens
cccacaggagggccagc

SEQ ID NO: 1451992 - DNA, 20 bp, Homo sapiens
cccacagttttaataagaac

SEQ ID NO: 1451993 - DNA, 19 bp, Homo sapiens
cccacataaaagccccagc

SEQ ID NO: 1451994 - DNA, 23 bp, Homo sapiens
cccacatacgtgagggggagctg

SEQ ID NO: 1451995 - DNA, 18 bp, Homo sapiens
cccacatccaactccagc

SEQ ID NO: 1451996 - DNA, 18 bp, Homo sapiens
cccacatgaggacatgat

SEQ ID NO: 1451997 - DNA, 14 bp, Homo sapiens
cccacatgtccagc

SEQ ID NO: 1451998 - DNA, 15 bp, Homo sapiens
cccacatgtccagca

SEQ ID NO: 1451999 - DNA, 16 bp, Homo sapiens
cccacatgtgacacat

SEQ ID NO: 1452000 - DNA, 17 bp, Homo sapiens
cccacatgtgtccatcc

SEQ ID NO: 1452001 - DNA, 14 bp, Homo sapiens
cccacattggaccc

SEQ ID NO: 1452002 - DNA, 19 bp, Homo sapiens
cccacatttgggctcaggg

SEQ ID NO: 1452003 - DNA, 15 bp, Homo sapiens
cccaccaactctgca

SEQ ID NO: 1452004 - DNA, 12 bp, Homo sapiens
cccaccaccctg

SEQ ID NO: 1452005 - DNA, 20 bp, Homo sapiens
cccaccacctaggccactcc

SEQ ID NO: 1452006 - DNA, 22 bp, Homo sapiens
cccaccaggctgctcagggctg

SEQ ID NO: 1452007 - DNA, 22 bp, Homo sapiens
cccaccatcaccaccgcctctg

SEQ ID NO: 1452008 - DNA, 13 bp, Homo sapiens
cccaccattccct

SEQ ID NO: 1452009 - DNA, 13 bp, Homo sapiens
cccaccatttatg

SEQ ID NO: 1452010 - DNA, 13 bp, Homo sapiens
cccacccaaaccc

SEQ ID NO: 1452011 - DNA, 15 bp, Homo sapiens
cccacccaagcttgg

SEQ ID NO: 1452012 - DNA, 16 bp, Homo sapiens
cccacccaagcttggc

SEQ ID NO: 1452013 - DNA, 14 bp, Homo sapiens
cccacccaattggc

SEQ ID NO: 1452014 - DNA, 15 bp, Homo sapiens
cccacccacatgact

SEQ ID NO: 1452015 - DNA, 12 bp, Homo sapiens
cccacccacgca

SEQ ID NO: 1452016 - DNA, 12 bp, Homo sapiens
cccacccaggag

SEQ ID NO: 1452017 - DNA, 13 bp, Homo sapiens
cccacccagtcca

SEQ ID NO: 1452018 - DNA, 13 bp, Homo sapiens
cccacccatcttc

SEQ ID NO: 1452019 - DNA, 14 bp, Homo sapiens
cccacccatcttcc

SEQ ID NO: 1452020 - DNA, 15 bp, Homo sapiens
cccacccatcttcct

SEQ ID NO: 1452021 - DNA, 16 bp, Homo sapiens
cccacccatcttcctg

SEQ ID NO: 1452022 - DNA, 14 bp, Homo sapiens
cccaccccacactt

SEQ ID NO: 1452023 - DNA, 15 bp, Homo sapiens
cccaccccaccccct

SEQ ID NO: 1452024 - DNA, 13 bp, Homo sapiens
cccaccccactcc

SEQ ID NO: 1452025 - DNA, 14 bp, Homo sapiens
cccaccccactcca

SEQ ID NO: 1452026 - DNA, 15 bp, Homo sapiens
cccaccccactccag

SEQ ID NO: 1452027 - DNA, 19 bp, Homo sapiens
cccaccccactccagccct

SEQ ID NO: 1452028 - DNA, 20 bp, Homo sapiens
cccaccccactccagccctg

SEQ ID NO: 1452029 - DNA, 19 bp, Homo sapiens
cccacccccaaagacctgc

SEQ ID NO: 1452030 - DNA, 24 bp, Homo sapiens
cccacccccaaagacctgcctgtg

SEQ ID NO: 1452031 - DNA, 14 bp, Homo sapiens
cccacccccaaccc

SEQ ID NO: 1452032 - DNA, 12 bp, Homo sapiens
cccaccccctca

SEQ ID NO: 1452033 - DNA, 19 bp, Homo sapiens
cccaccccctccccaaagc

SEQ ID NO: 1452034 - DNA, 17 bp, Homo sapiens
cccaccccctccccagg

SEQ ID NO: 1452035 - DNA, 13 bp, Homo sapiens
cccaccccctgcc

SEQ ID NO: 1452036 - DNA, 19 bp, Homo sapiens
cccacccccttcagtgccc

SEQ ID NO: 1452037 - DNA, 16 bp, Homo sapiens
cccacccccttctctg

SEQ ID NO: 1452038 - DNA, 23 bp, Homo sapiens
cccaccccctttggtttgacaat

SEQ ID NO: 1452039 - DNA, 17 bp, Homo sapiens
cccaccccggggaccct

SEQ ID NO: 1452040 - DNA, 18 bp, Homo sapiens
cccaccccggggaccctg

SEQ ID NO: 1452041 - DNA, 19 bp, Homo sapiens
cccacccctacagcctgca

SEQ ID NO: 1452042 - DNA, 21 bp, Homo sapiens
cccacccctacagcctgcaca

SEQ ID NO: 1452043 - DNA, 13 bp, Homo sapiens
cccacccctgtgc

SEQ ID NO: 1452044 - DNA, 15 bp, Homo sapiens
cccacccgatgctgc

SEQ ID NO: 1452045 - DNA, 13 bp, Homo sapiens
cccacccgccgcc

SEQ ID NO: 1452046 - DNA, 21 bp, Homo sapiens
cccacccgtcttcaatctctg

SEQ ID NO: 1452047 - DNA, 12 bp, Homo sapiens
cccaccctcagc

SEQ ID NO: 1452048 - DNA, 14 bp, Homo sapiens
cccaccctcagcac

SEQ ID NO: 1452049 - DNA, 21 bp, Homo sapiens
cccaccctcagcaccccttcc

SEQ ID NO: 1452050 - DNA, 19 bp, Homo sapiens
cccaccgcagcgtcccccg

SEQ ID NO: 1452051 - DNA, 18 bp, Homo sapiens
cccaccggtccagctggc

SEQ ID NO: 1452052 - DNA, 21 bp, Homo sapiens
cccaccggtccagctggcctg

SEQ ID NO: 1452053 - DNA, 15 bp, Homo sapiens
cccaccgtccgccct

SEQ ID NO: 1452054 - DNA, 16 bp, Homo sapiens
cccaccgttaggattc

SEQ ID NO: 1452055 - DNA, 14 bp, Homo sapiens
tccgccagcctcct

SEQ ID NO: 1452056 - DNA, 16 bp, Homo sapiens
tccgccaggcgctgca

SEQ ID NO: 1452057 - DNA, 14 bp, Homo sapiens
tccgccctgccact

SEQ ID NO: 1452058 - DNA, 17 bp, Homo sapiens
tccgccctgctcctccc

SEQ ID NO: 1452059 - DNA, 12 bp, Homo sapiens
tccgcctcctgt

SEQ ID NO: 1452060 - DNA, 11 bp, Homo sapiens
tccgcctgcct

SEQ ID NO: 1452061 - DNA, 14 bp, Homo sapiens
tccgcctgcctctg

SEQ ID NO: 1452062 - DNA, 16 bp, Homo sapiens
tccgcctgcctctgcc

SEQ ID NO: 1452063 - DNA, 17 bp, Homo sapiens
tccgcctgcctctgcct

SEQ ID NO: 1452064 - DNA, 12 bp, Homo sapiens
tccgcctgggat

SEQ ID NO: 1452065 - DNA, 12 bp, Homo sapiens
tccgcctgtggg

SEQ ID NO: 1452066 - DNA, 21 bp, Homo sapiens
tccgcctttacaagggagaag

SEQ ID NO: 1452067 - DNA, 16 bp, Homo sapiens
tccgcgccgatgccac

SEQ ID NO: 1452068 - DNA, 20 bp, Homo sapiens
tccgctcatacaggaatgaa

SEQ ID NO: 1452069 - DNA, 12 bp, Homo sapiens
tccgctcccacc

SEQ ID NO: 1452070 - DNA, 17 bp, Homo sapiens
tccgctcccaccgcccc

SEQ ID NO: 1452071 - DNA, 19 bp, Homo sapiens
tccgctgaggggtctcgga

SEQ ID NO: 1452072 - DNA, 14 bp, Homo sapiens
tccgctgccaccac

SEQ ID NO: 1452073 - DNA, 19 bp, Homo sapiens
tccgctgccagccttgagc

SEQ ID NO: 1452074 - DNA, 13 bp, Homo sapiens
tccgctgcctgga

SEQ ID NO: 1452075 - DNA, 18 bp, Homo sapiens
tccgctttgaaagaagca

SEQ ID NO: 1452076 - DNA, 19 bp, Homo sapiens
tccgctttgaaagaagcaa

SEQ ID NO: 1452077 - DNA, 17 bp, Homo sapiens
tccggactggcagaagc

SEQ ID NO: 1452078 - DNA, 16 bp, Homo sapiens
tccggactggtgccct

SEQ ID NO: 1452079 - DNA, 16 bp, Homo sapiens
tccggccatactgcct

SEQ ID NO: 1452080 - DNA, 16 bp, Homo sapiens
tccggcccagtgccac

SEQ ID NO: 1452081 - DNA, 22 bp, Homo sapiens
tccggcccagtgccactgcccc

SEQ ID NO: 1452082 - DNA, 18 bp, Homo sapiens
tccggcctctgcctttgc

SEQ ID NO: 1452083 - DNA, 19 bp, Homo sapiens
tccggcctctgcctttgca

SEQ ID NO: 1452084 - DNA, 22 bp, Homo sapiens
tccggcctgggtgacagagtga

SEQ ID NO: 1452085 - DNA, 23 bp, Homo sapiens
tccggcctgggtgacagagtgag

SEQ ID NO: 1452086 - DNA, 21 bp, Homo sapiens
tccggcttgacctgtttctct

SEQ ID NO: 1452087 - DNA, 20 bp, Homo sapiens
tccgggacacctgggccggg

SEQ ID NO: 1452088 - DNA, 14 bp, Homo sapiens
tccggggtctgtgc

SEQ ID NO: 1452089 - DNA, 16 bp, Homo sapiens
tccggggtctgtgctg

SEQ ID NO: 1452090 - DNA, 20 bp, Homo sapiens
tccggggtctgtgctgtgcc

SEQ ID NO: 1452091 - DNA, 18 bp, Homo sapiens
tccggggtggtggacagg

SEQ ID NO: 1452092 - DNA, 19 bp, Homo sapiens
tccgggtctcgcagcctga

SEQ ID NO: 1452093 - DNA, 23 bp, Homo sapiens
tccgggtctcgcagcctgaagcc

SEQ ID NO: 1452094 - DNA, 16 bp, Homo sapiens
tccgggtgccagggct

SEQ ID NO: 1452095 - DNA, 23 bp, Homo sapiens
tccggtcccaaatgtagcaggtg

SEQ ID NO: 1452096 - DNA, 13 bp, Homo sapiens
tcccacctgacac

SEQ ID NO: 1452097 - DNA, 19 bp, Homo sapiens
tcccacctgacacaccagg

SEQ ID NO: 1452098 - DNA, 19 bp, Homo sapiens
tcccacctgcatctggggc

SEQ ID NO: 1452099 - DNA, 20 bp, Homo sapiens
tcccacctgcatctggggcc

SEQ ID NO: 1452100 - DNA, 12 bp, Homo sapiens
tcccaccttccc

SEQ ID NO: 1452101 - DNA, 15 bp, Homo sapiens
tcccaccttcccacc

SEQ ID NO: 1452102 - DNA, 17 bp, Homo sapiens
tcccaccttggcctccc

SEQ ID NO: 1452103 - DNA, 21 bp, Homo sapiens
tcccacgtctcctcctcgaag

SEQ ID NO: 1452104 - DNA, 14 bp, Homo sapiens
tcccactcaccagc

SEQ ID NO: 1452105 - DNA, 15 bp, Homo sapiens
tcccactcaccagcc

SEQ ID NO: 1452106 - DNA, 15 bp, Homo sapiens
tcccactccctttcc

SEQ ID NO: 1452107 - DNA, 18 bp, Homo sapiens
tcccactccctttccaac

SEQ ID NO: 1452108 - DNA, 20 bp, Homo sapiens
tcccactcctgctgcacagg

SEQ ID NO: 1452109 - DNA, 18 bp, Homo sapiens
tcccactgcactccagcc

SEQ ID NO: 1452110 - DNA, 19 bp, Homo sapiens
tcccactgcactccagcct

SEQ ID NO: 1452111 - DNA, 21 bp, Homo sapiens
tcccactgcactccagcctga

SEQ ID NO: 1452112 - DNA, 12 bp, Homo sapiens
tcccactgccag

SEQ ID NO: 1452113 - DNA, 13 bp, Homo sapiens
tcccactgttctg

SEQ ID NO: 1452114 - DNA, 15 bp, Homo sapiens
tcccactgttctgaa

SEQ ID NO: 1452115 - DNA, 16 bp, Homo sapiens
tcccacttagccgcac

SEQ ID NO: 1452116 - DNA, 17 bp, Homo sapiens
tcccacttggaggcctt

SEQ ID NO: 1452117 - DNA, 19 bp, Homo sapiens
tcccagaattgtatctcat

SEQ ID NO: 1452118 - DNA, 21 bp, Homo sapiens
tcccagacagtggatatgacc

SEQ ID NO: 1452119 - DNA, 22 bp, Homo sapiens
tcccagacagtggatatgaccc

SEQ ID NO: 1452120 - DNA, 13 bp, Homo sapiens
tcccagaccagcc

SEQ ID NO: 1452121 - DNA, 14 bp, Homo sapiens
tcccagaccaggaa

SEQ ID NO: 1452122 - DNA, 16 bp, Homo sapiens
tcccagaccaggaaag

SEQ ID NO: 1452123 - DNA, 16 bp, Homo sapiens
tcccagagcaaaataa

SEQ ID NO: 1452124 - DNA, 17 bp, Homo sapiens
tcccagagcaggaggcc

SEQ ID NO: 1452125 - DNA, 18 bp, Homo sapiens
tcccagagcaggaggccc

SEQ ID NO: 1452126 - DNA, 20 bp, Homo sapiens
tcccagaggagccaccagtt

SEQ ID NO: 1452127 - DNA, 21 bp, Homo sapiens
tcccagaggtgggatcctccc

SEQ ID NO: 1452128 - DNA, 23 bp, Homo sapiens
tcccagaggttatctgcctggcc

SEQ ID NO: 1452129 - DNA, 14 bp, Homo sapiens
tcccagagtcagag

SEQ ID NO: 1452130 - DNA, 17 bp, Homo sapiens
tcccagagtcagaggag

SEQ ID NO: 1452131 - DNA, 20 bp, Homo sapiens
tcccagagtcagaggagaag

SEQ ID NO: 1452132 - DNA, 11 bp, Homo sapiens
tcccagatgcc

SEQ ID NO: 1452133 - DNA, 23 bp, Homo sapiens
tcccagattggctcacactgaga

SEQ ID NO: 1452134 - DNA, 22 bp, Homo sapiens
tcccagcaagacctcatctgtg

SEQ ID NO: 1452135 - DNA, 23 bp, Homo sapiens
tcccagcacatgaaaccttattt

SEQ ID NO: 1452136 - DNA, 13 bp, Homo sapiens
tcccagcactttg

SEQ ID NO: 1452137 - DNA, 22 bp, Homo sapiens
tcccagcactttgagaggctga

SEQ ID NO: 1452138 - DNA, 23 bp, Homo sapiens
tcccagcactttgagaggctgag

SEQ ID NO: 1452139 - DNA, 18 bp, Homo sapiens
tcccagcactttgggagg

SEQ ID NO: 1452140 - DNA, 19 bp, Homo sapiens
tcccagcactttgggaggc

SEQ ID NO: 1452141 - DNA, 22 bp, Homo sapiens
tcccagcactttgggaggcagg

SEQ ID NO: 1452142 - DNA, 23 bp, Homo sapiens
tcccagcactttgggaggcaggg

SEQ ID NO: 1452143 - DNA, 24 bp, Homo sapiens
tcccagcactttgggaggccgagg

SEQ ID NO: 1452144 - DNA, 14 bp, Homo sapiens
tcccagcagcagag

SEQ ID NO: 1452145 - DNA, 13 bp, Homo sapiens
tcccagcagccct

SEQ ID NO: 1452146 - DNA, 23 bp, Homo sapiens
tcccagcagctcaacctaccctg

SEQ ID NO: 1452147 - DNA, 23 bp, Homo sapiens
tcccagcatccctggagcaggag

SEQ ID NO: 1452148 - DNA, 20 bp, Homo sapiens
tcccagccaccccgggctct

SEQ ID NO: 1452149 - DNA, 17 bp, Homo sapiens
tcccagccacgcagggc

SEQ ID NO: 1452150 - DNA, 14 bp, Homo sapiens
tcccagcctggggc

SEQ ID NO: 1452151 - DNA, 15 bp, Homo sapiens
tcccagcctggggct

SEQ ID NO: 1452152 - DNA, 21 bp, Homo sapiens
tcccagcggctggtgcagggc

SEQ ID NO: 1452153 - DNA, 22 bp, Homo sapiens
tcccagctactcaagaggctga

SEQ ID NO: 1452154 - DNA, 14 bp, Homo sapiens
tcccagctactcag

SEQ ID NO: 1452155 - DNA, 19 bp, Homo sapiens
tcccagctactcagaagcc

SEQ ID NO: 1452156 - DNA, 21 bp, Homo sapiens
tcccagctactcagaagcctg

SEQ ID NO: 1452157 - DNA, 23 bp, Homo sapiens
tcccagctactcagaagcctgag

SEQ ID NO: 1452158 - DNA, 16 bp, Homo sapiens
tcccagctactcagga

SEQ ID NO: 1452159 - DNA, 16 bp, Homo sapiens
tcccagctactcggga

SEQ ID NO: 1452160 - DNA, 17 bp, Homo sapiens
tcccagctcacgtcaca

SEQ ID NO: 1452161 - DNA, 18 bp, Homo sapiens
tcccagctctccctctgg

SEQ ID NO: 1452162 - DNA, 19 bp, Homo sapiens
tcccagctgaaggcagtgg

SEQ ID NO: 1452163 - DNA, 14 bp, Homo sapiens
tccccacctccagg

SEQ ID NO: 1452164 - DNA, 17 bp, Homo sapiens
tccccacctccaggctt

SEQ ID NO: 1452165 - DNA, 17 bp, Homo sapiens
tccccacgagggctggc

SEQ ID NO: 1452166 - DNA, 20 bp, Homo sapiens
tccccacgagtcacctgcaa

SEQ ID NO: 1452167 - DNA, 21 bp, Homo sapiens
tccccactcccatctgattta

SEQ ID NO: 1452168 - DNA, 16 bp, Homo sapiens
tccccactcccttggt

SEQ ID NO: 1452169 - DNA, 18 bp, Homo sapiens
tccccacttctgtgccac

SEQ ID NO: 1452170 - DNA, 16 bp, Homo sapiens
tccccagagcccagct

SEQ ID NO: 1452171 - DNA, 20 bp, Homo sapiens
tccccagagcccagctcttg

SEQ ID NO: 1452172 - DNA, 22 bp, Homo sapiens
tccccagagcccagctcttgct

SEQ ID NO: 1452173 - DNA, 15 bp, Homo sapiens
tccccagagctgtgc

SEQ ID NO: 1452174 - DNA, 16 bp, Homo sapiens
tccccagaggctccca

SEQ ID NO: 1452175 - DNA, 20 bp, Homo sapiens
tccccagccccagccccttc

SEQ ID NO: 1452176 - DNA, 17 bp, Homo sapiens
tccccagcccttctgcc

SEQ ID NO: 1452177 - DNA, 19 bp, Homo sapiens
tccccagcggtttccactt

SEQ ID NO: 1452178 - DNA, 20 bp, Homo sapiens
tccccagcggtttccacttg

SEQ ID NO: 1452179 - DNA, 22 bp, Homo sapiens
tccccagcgtcccagtctctgg

SEQ ID NO: 1452180 - DNA, 15 bp, Homo sapiens
tccccagctccccag

SEQ ID NO: 1452181 - DNA, 19 bp, Homo sapiens
tccccagctccccaggact

SEQ ID NO: 1452182 - DNA, 21 bp, Homo sapiens
tccccagctccccaggactca

SEQ ID NO: 1452183 - DNA, 18 bp, Homo sapiens
tccccaggactcaccctc

SEQ ID NO: 1452184 - DNA, 16 bp, Homo sapiens
tccccaggcacctcac

SEQ ID NO: 1452185 - DNA, 14 bp, Homo sapiens
tccccaggccaccc

SEQ ID NO: 1452186 - DNA, 12 bp, Homo sapiens
tccccaggccca

SEQ ID NO: 1452187 - DNA, 18 bp, Homo sapiens
tccccaggcctccagcct

SEQ ID NO: 1452188 - DNA, 21 bp, Homo sapiens
tccccaggcctccagcctctc

SEQ ID NO: 1452189 - DNA, 15 bp, Homo sapiens
tccccagggagctct

SEQ ID NO: 1452190 - DNA, 18 bp, Homo sapiens
tccccagggagctctggg

SEQ ID NO: 1452191 - DNA, 19 bp, Homo sapiens
tccccagggagctctgggg

SEQ ID NO: 1452192 - DNA, 14 bp, Homo sapiens
tccccagggcccct

SEQ ID NO: 1452193 - DNA, 19 bp, Homo sapiens
tccccaggggaaaatgaag

SEQ ID NO: 1452194 - DNA, 23 bp, Homo sapiens
tccccaggggagagggtctggag

SEQ ID NO: 1452195 - DNA, 18 bp, Homo sapiens
tccccaggggtcccagcc

SEQ ID NO: 1452196 - DNA, 22 bp, Homo sapiens
tccccaggggtcccagccaccc

SEQ ID NO: 1452197 - DNA, 23 bp, Homo sapiens
tccccaggtccagctctggaggg

SEQ ID NO: 1452198 - DNA, 20 bp, Homo sapiens
tccccaggtctctccactgc

SEQ ID NO: 1452199 - DNA, 15 bp, Homo sapiens
tccccaggtggctga

SEQ ID NO: 1452200 - DNA, 11 bp, Homo sapiens
tccccagtgcc

SEQ ID NO: 1452201 - DNA, 16 bp, Homo sapiens
tccccagtgcctgcca

SEQ ID NO: 1452202 - DNA, 16 bp, Homo sapiens
tccccagttgccgtct

SEQ ID NO: 1452203 - DNA, 17 bp, Homo sapiens
tccccagtttgcagaaa

SEQ ID NO: 1452204 - DNA, 18 bp, Homo sapiens
tccccataagacaaacac

SEQ ID NO: 1452205 - DNA, 23 bp, Homo sapiens
tccccataagacaaacactgcca

SEQ ID NO: 1452206 - DNA, 19 bp, Homo sapiens
tccccatccagcgagagag

SEQ ID NO: 1452207 - DNA, 22 bp, Homo sapiens
tccccatcccgaagccatcact

SEQ ID NO: 1452208 - DNA, 19 bp, Homo sapiens
tccccatccctgtcatttt

SEQ ID NO: 1452209 - DNA, 22 bp, Homo sapiens
tccccatctccctgcctggccc

SEQ ID NO: 1452210 - DNA, 19 bp, Homo sapiens
tccccattagagtcagcct

SEQ ID NO: 1452211 - DNA, 14 bp, Homo sapiens
tccccattcacaga

SEQ ID NO: 1452212 - DNA, 17 bp, Homo sapiens
tccccattctataaatt

SEQ ID NO: 1452213 - DNA, 17 bp, Homo sapiens
tccccattcttcctagt

SEQ ID NO: 1452214 - DNA, 17 bp, Homo sapiens
tccccatttcccatctg

SEQ ID NO: 1452215 - DNA, 19 bp, Homo sapiens
ccataatagttagccctca

SEQ ID NO: 1452216 - DNA, 20 bp, Homo sapiens
ccataatagttagccctcag

SEQ ID NO: 1452217 - DNA, 14 bp, Homo sapiens
ccataatcctagcc

SEQ ID NO: 1452218 - DNA, 21 bp, Homo sapiens
ccataatgctactgtctcact

SEQ ID NO: 1452219 - DNA, 16 bp, Homo sapiens
ccataatgttctgcta

SEQ ID NO: 1452220 - DNA, 19 bp, Homo sapiens
ccataattgctttgccaaa

SEQ ID NO: 1452221 - DNA, 12 bp, Homo sapiens
ccatacaatgta

SEQ ID NO: 1452222 - DNA, 16 bp, Homo sapiens
ccatacaatgtatgta

SEQ ID NO: 1452223 - DNA, 17 bp, Homo sapiens
ccatacaatgtatgtac

SEQ ID NO: 1452224 - DNA, 17 bp, Homo sapiens
ccatacactttgttgca

SEQ ID NO: 1452225 - DNA, 14 bp, Homo sapiens
ccatacagcctcta

SEQ ID NO: 1452226 - DNA, 12 bp, Homo sapiens
ccatacccagct

SEQ ID NO: 1452227 - DNA, 13 bp, Homo sapiens
ccatacccagcta

SEQ ID NO: 1452228 - DNA, 24 bp, Homo sapiens
ccataccttccttccctgggctgt

SEQ ID NO: 1452229 - DNA, 21 bp, Homo sapiens
ccatactccttgcttcctgat

SEQ ID NO: 1452230 - DNA, 13 bp, Homo sapiens
ccatacttctctc

SEQ ID NO: 1452231 - DNA, 18 bp, Homo sapiens
ccatacttttgagagggg

SEQ ID NO: 1452232 - DNA, 16 bp, Homo sapiens
ccatagaaacatgaca

SEQ ID NO: 1452233 - DNA, 20 bp, Homo sapiens
ccatagacctacagacctgg

SEQ ID NO: 1452234 - DNA, 13 bp, Homo sapiens
ccatagaggccca

SEQ ID NO: 1452235 - DNA, 20 bp, Homo sapiens
ccatagaggcccaggcacca

SEQ ID NO: 1452236 - DNA, 16 bp, Homo sapiens
ccatagatcttctgaa

SEQ ID NO: 1452237 - DNA, 15 bp, Homo sapiens
ccatagcttccatga

SEQ ID NO: 1452238 - DNA, 18 bp, Homo sapiens
ccataggactaccgcagg

SEQ ID NO: 1452239 - DNA, 22 bp, Homo sapiens
ccataggactaccgcaggcccg

SEQ ID NO: 1452240 - DNA, 14 bp, Homo sapiens
ccatagtagtatga

SEQ ID NO: 1452241 - DNA, 15 bp, Homo sapiens
ccatagtggggcctg

SEQ ID NO: 1452242 - DNA, 16 bp, Homo sapiens
ccatataagtttgaag

SEQ ID NO: 1452243 - DNA, 20 bp, Homo sapiens
ccatatcagctctctgcaga

SEQ ID NO: 1452244 - DNA, 19 bp, Homo sapiens
ccatatccatagtgacttt

SEQ ID NO: 1452245 - DNA, 13 bp, Homo sapiens
ccatatcctgcct

SEQ ID NO: 1452246 - DNA, 12 bp, Homo sapiens
ccatatcctggt

SEQ ID NO: 1452247 - DNA, 15 bp, Homo sapiens
ccatatcctggtgcc

SEQ ID NO: 1452248 - DNA, 19 bp, Homo sapiens
ccatatctccttcccctac

SEQ ID NO: 1452249 - DNA, 20 bp, Homo sapiens
ccatatcttctgtttcataa

SEQ ID NO: 1452250 - DNA, 16 bp, Homo sapiens
ccatatgcagaaatag

SEQ ID NO: 1452251 - DNA, 16 bp, Homo sapiens
ccatatgctccaggat

SEQ ID NO: 1452252 - DNA, 21 bp, Homo sapiens
ccatattcagcatttgatttc

SEQ ID NO: 1452253 - DNA, 22 bp, Homo sapiens
ccatattcagtgctgtggcctg

SEQ ID NO: 1452254 - DNA, 18 bp, Homo sapiens
ccatattgtaaaacaggt

SEQ ID NO: 1452255 - DNA, 21 bp, Homo sapiens
ccatattgtgcttcacagtag

SEQ ID NO: 1452256 - DNA, 16 bp, Homo sapiens
ccatattgtgtaattt

SEQ ID NO: 1452257 - DNA, 16 bp, Homo sapiens
ccatatttgatttcta

SEQ ID NO: 1452258 - DNA, 19 bp, Homo sapiens
ccatcaaacctcacatttg

SEQ ID NO: 1452259 - DNA, 20 bp, Homo sapiens
ccatcaaacctcacatttgt

SEQ ID NO: 1452260 - DNA, 14 bp, Homo sapiens
ccatcaagcacttc

SEQ ID NO: 1452261 - DNA, 16 bp, Homo sapiens
ccatcaagcacttccc

SEQ ID NO: 1452262 - DNA, 11 bp, Homo sapiens
ccatcaataaa

SEQ ID NO: 1452263 - DNA, 17 bp, Homo sapiens
ccatcaccaccgcctct

SEQ ID NO: 1452264 - DNA, 13 bp, Homo sapiens
ccatcacccaagc

SEQ ID NO: 1452265 - DNA, 18 bp, Homo sapiens
ccatcactagaagaaaag

SEQ ID NO: 1452266 - DNA, 17 bp, Homo sapiens
ccatcacttctccccgc

SEQ ID NO: 1452267 - DNA, 14 bp, Homo sapiens
ccatcagcacccca

SEQ ID NO: 1452268 - DNA, 23 bp, Homo sapiens
ccatcagcgggtctcctcccagc

SEQ ID NO: 1452269 - DNA, 19 bp, Homo sapiens
ccatcagctgtaagaagag

SEQ ID NO: 1452270 - DNA, 20 bp, Homo sapiens
ccatcagggttctcttagca

SEQ ID NO: 1452271 - DNA, 18 bp, Homo sapiens
ccatcatcactgtaaaga

SEQ ID NO: 1452272 - DNA, 23 bp, Homo sapiens
ccatcatcctttgttctgagcat

SEQ ID NO: 1452273 - DNA, 12 bp, Homo sapiens
ccatcatctctg

SEQ ID NO: 1452274 - DNA, 15 bp, Homo sapiens
ccatcatctctgaag

SEQ ID NO: 1452275 - DNA, 19 bp, Homo sapiens
ccatcattgcacctgcagg

SEQ ID NO: 1452276 - DNA, 13 bp, Homo sapiens
ccatcatttctgg

SEQ ID NO: 1452277 - DNA, 16 bp, Homo sapiens
tccccgcctggccagg

SEQ ID NO: 1452278 - DNA, 17 bp, Homo sapiens
tccccgcctggccagga

SEQ ID NO: 1452279 - DNA, 20 bp, Homo sapiens
tccccgctcaggggcctgga

SEQ ID NO: 1452280 - DNA, 19 bp, Homo sapiens
tccccgctccgtctctgtc

SEQ ID NO: 1452281 - DNA, 14 bp, Homo sapiens
tccccgctctccct

SEQ ID NO: 1452282 - DNA, 16 bp, Homo sapiens
tccccgctgctgtgca

SEQ ID NO: 1452283 - DNA, 20 bp, Homo sapiens
tccccggcaggcctgagaat

SEQ ID NO: 1452284 - DNA, 21 bp, Homo sapiens
tccccggccctaccagcgccc

SEQ ID NO: 1452285 - DNA, 15 bp, Homo sapiens
tccccgggggaggaa

SEQ ID NO: 1452286 - DNA, 22 bp, Homo sapiens
tccccggtcccttgagacctca

SEQ ID NO: 1452287 - DNA, 15 bp, Homo sapiens
tccccgtctcattcc

SEQ ID NO: 1452288 - DNA, 20 bp, Homo sapiens
tccccgtgccccgcctcccc

SEQ ID NO: 1452289 - DNA, 19 bp, Homo sapiens
tccccgtgtcctctccctg

SEQ ID NO: 1452290 - DNA, 15 bp, Homo sapiens
tcccctagctcacca

SEQ ID NO: 1452291 - DNA, 21 bp, Homo sapiens
tcccctatccacccagcccat

SEQ ID NO: 1452292 - DNA, 13 bp, Homo sapiens
tcccctatgctgg

SEQ ID NO: 1452293 - DNA, 24 bp, Homo sapiens
tcccctcaaggacaaagtctccag

SEQ ID NO: 1452294 - DNA, 21 bp, Homo sapiens
tcccctcagccacacccaggc

SEQ ID NO: 1452295 - DNA, 22 bp, Homo sapiens
tcccctcagcgggggccttgaa

SEQ ID NO: 1452296 - DNA, 23 bp, Homo sapiens
tcccctcagcgggggccttgaag

SEQ ID NO: 1452297 - DNA, 12 bp, Homo sapiens
tcccctccaacc

SEQ ID NO: 1452298 - DNA, 22 bp, Homo sapiens
tcccctccaacctggggggcag

SEQ ID NO: 1452299 - DNA, 19 bp, Homo sapiens
tcccctccacagctgcagc

SEQ ID NO: 1452300 - DNA, 15 bp, Homo sapiens
tcccctccaggaaga

SEQ ID NO: 1452301 - DNA, 20 bp, Homo sapiens
tcccctcccaatcctctctc

SEQ ID NO: 1452302 - DNA, 21 bp, Homo sapiens
tcccctcccaatcctctctcc

SEQ ID NO: 1452303 - DNA, 19 bp, Homo sapiens
tcccctcccacccacagcc

SEQ ID NO: 1452304 - DNA, 17 bp, Homo sapiens
tcccctcccatctggga

SEQ ID NO: 1452305 - DNA, 13 bp, Homo sapiens
tcccctccctggc

SEQ ID NO: 1452306 - DNA, 14 bp, Homo sapiens
tcccctccctgggt

SEQ ID NO: 1452307 - DNA, 16 bp, Homo sapiens
tcccctccctgggttc

SEQ ID NO: 1452308 - DNA, 22 bp, Homo sapiens
tcccctccgcagcagggaagct

SEQ ID NO: 1452309 - DNA, 23 bp, Homo sapiens
tcccctccgcagcagggaagctc

SEQ ID NO: 1452310 - DNA, 20 bp, Homo sapiens
tcccctccggactggtgccc

SEQ ID NO: 1452311 - DNA, 13 bp, Homo sapiens
tcccctcctcagt

SEQ ID NO: 1452312 - DNA, 15 bp, Homo sapiens
tcccctcctcttccc

SEQ ID NO: 1452313 - DNA, 14 bp, Homo sapiens
tcccctcctgctgg

SEQ ID NO: 1452314 - DNA, 14 bp, Homo sapiens
tcccctccttctcc

SEQ ID NO: 1452315 - DNA, 19 bp, Homo sapiens
tcccctcgtcctgtcccag

SEQ ID NO: 1452316 - DNA, 23 bp, Homo sapiens
tcccctcgtcctgtcccagaggt

SEQ ID NO: 1452317 - DNA, 13 bp, Homo sapiens
tcccctctcagaa

SEQ ID NO: 1452318 - DNA, 16 bp, Homo sapiens
tcccctctcagaacat

SEQ ID NO: 1452319 - DNA, 23 bp, Homo sapiens
tcccctctcagaacatactgatt

SEQ ID NO: 1452320 - DNA, 19 bp, Homo sapiens
tcccctctcttgcacccgc

SEQ ID NO: 1452321 - DNA, 20 bp, Homo sapiens
tcccctctgcaaccccccag

SEQ ID NO: 1452322 - DNA, 13 bp, Homo sapiens
tcccctctgctgc

SEQ ID NO: 1452323 - DNA, 20 bp, Homo sapiens
tcccctctgctgctgtccct

SEQ ID NO: 1452324 - DNA, 23 bp, Homo sapiens
tcccctctgtgcttcgactactg

SEQ ID NO: 1452325 - DNA, 19 bp, Homo sapiens
tcccctcttcttctttcct

SEQ ID NO: 1452326 - DNA, 14 bp, Homo sapiens
tcccctgcactgta

SEQ ID NO: 1452327 - DNA, 16 bp, Homo sapiens
tcccctgccacactga

SEQ ID NO: 1452328 - DNA, 13 bp, Homo sapiens
tcccctgccacca

SEQ ID NO: 1452329 - DNA, 14 bp, Homo sapiens
tcccctgccaccag

SEQ ID NO: 1452330 - DNA, 13 bp, Homo sapiens
tcccctgccctgg

SEQ ID NO: 1452331 - DNA, 17 bp, Homo sapiens
tcccctgccctggtcca

SEQ ID NO: 1452332 - DNA, 24 bp, Homo sapiens
tcccctgccctggtccagggaagc

SEQ ID NO: 1452333 - DNA, 22 bp, Homo sapiens
tcccctgccggtgcacaggcct

SEQ ID NO: 1452334 - DNA, 12 bp, Homo sapiens
tcccctgcctcc

SEQ ID NO: 1452335 - DNA, 20 bp, Homo sapiens
ccaggccagcctccgagagg

SEQ ID NO: 1452336 - DNA, 14 bp, Homo sapiens
ccaggccagggctc

SEQ ID NO: 1452337 - DNA, 21 bp, Homo sapiens
ccaggccagggctcctgtggc

SEQ ID NO: 1452338 - DNA, 12 bp, Homo sapiens
ccaggccaggtc

SEQ ID NO: 1452339 - DNA, 17 bp, Homo sapiens
ccaggcccaaggctccc

SEQ ID NO: 1452340 - DNA, 19 bp, Homo sapiens
ccaggcccaaggctcccgg

SEQ ID NO: 1452341 - DNA, 12 bp, Homo sapiens
ccaggcccacca

SEQ ID NO: 1452342 - DNA, 23 bp, Homo sapiens
ccaggcccaccatcaccaccgcc

SEQ ID NO: 1452343 - DNA, 23 bp, Homo sapiens
ccaggccccaccggccaggccgc

SEQ ID NO: 1452344 - DNA, 16 bp, Homo sapiens
ccaggcccctgaggac

SEQ ID NO: 1452345 - DNA, 19 bp, Homo sapiens
ccaggcccctgaggactgg

SEQ ID NO: 1452346 - DNA, 23 bp, Homo sapiens
ccaggcccctgaggactggagac

SEQ ID NO: 1452347 - DNA, 22 bp, Homo sapiens
ccaggcccgcaccccggcctca

SEQ ID NO: 1452348 - DNA, 14 bp, Homo sapiens
ccaggccctccatg

SEQ ID NO: 1452349 - DNA, 21 bp, Homo sapiens
ccaggccctccatgggctagt

SEQ ID NO: 1452350 - DNA, 19 bp, Homo sapiens
ccaggccctcctctcccat

SEQ ID NO: 1452351 - DNA, 14 bp, Homo sapiens
ccaggccctgccag

SEQ ID NO: 1452352 - DNA, 15 bp, Homo sapiens
ccaggcccttggctg

SEQ ID NO: 1452353 - DNA, 18 bp, Homo sapiens
ccaggcccttggctgcag

SEQ ID NO: 1452354 - DNA, 19 bp, Homo sapiens
ccaggcccttggctgcagg

SEQ ID NO: 1452355 - DNA, 18 bp, Homo sapiens
ccaggccctttggcttct

SEQ ID NO: 1452356 - DNA, 18 bp, Homo sapiens
ccaggccgcgcccagcag

SEQ ID NO: 1452357 - DNA, 19 bp, Homo sapiens
ccaggccgcgcccagcaga

SEQ ID NO: 1452358 - DNA, 19 bp, Homo sapiens
ccaggccgcgccctttccc

SEQ ID NO: 1452359 - DNA, 17 bp, Homo sapiens
ccaggccggagcccaga

SEQ ID NO: 1452360 - DNA, 23 bp, Homo sapiens
ccaggccgggcttgggccctgca

SEQ ID NO: 1452361 - DNA, 22 bp, Homo sapiens
ccaggccggtgtgggctgtgtc

SEQ ID NO: 1452362 - DNA, 15 bp, Homo sapiens
ccaggccgtcctccc

SEQ ID NO: 1452363 - DNA, 20 bp, Homo sapiens
ccaggccgttccccttggct

SEQ ID NO: 1452364 - DNA, 22 bp, Homo sapiens
ccaggccgttccccttggcttc

SEQ ID NO: 1452365 - DNA, 15 bp, Homo sapiens
ccaggcctccagcct

SEQ ID NO: 1452366 - DNA, 18 bp, Homo sapiens
ccaggcctccctgcagac

SEQ ID NO: 1452367 - DNA, 22 bp, Homo sapiens
ccaggcctctcggtgctccatc

SEQ ID NO: 1452368 - DNA, 13 bp, Homo sapiens
ccaggcctggcct

SEQ ID NO: 1452369 - DNA, 14 bp, Homo sapiens
ccaggcctggcctc

SEQ ID NO: 1452370 - DNA, 15 bp, Homo sapiens
ccaggcctggcctct

SEQ ID NO: 1452371 - DNA, 16 bp, Homo sapiens
ccaggcctggcctctg

SEQ ID NO: 1452372 - DNA, 18 bp, Homo sapiens
ccaggcctgtccaccctg

SEQ ID NO: 1452373 - DNA, 15 bp, Homo sapiens
ccaggccttcatcct

SEQ ID NO: 1452374 - DNA, 19 bp, Homo sapiens
ccaggcgccccttccccct

SEQ ID NO: 1452375 - DNA, 18 bp, Homo sapiens
ccaggcgcggtggctcac

SEQ ID NO: 1452376 - DNA, 18 bp, Homo sapiens
ccaggcgggctcaaggaa

SEQ ID NO: 1452377 - DNA, 16 bp, Homo sapiens
ccaggcgttggtgcca

SEQ ID NO: 1452378 - DNA, 20 bp, Homo sapiens
ccaggcgttggtgccacttc

SEQ ID NO: 1452379 - DNA, 21 bp, Homo sapiens
ccaggctccctttctcttctt

SEQ ID NO: 1452380 - DNA, 20 bp, Homo sapiens
ccaggctcctacctgtctgc

SEQ ID NO: 1452381 - DNA, 23 bp, Homo sapiens
ccaggctcctacctgtctgctgc

SEQ ID NO: 1452382 - DNA, 14 bp, Homo sapiens
ccaggctccttcct

SEQ ID NO: 1452383 - DNA, 22 bp, Homo sapiens
ccaggctccttcctgtcttcct

SEQ ID NO: 1452384 - DNA, 23 bp, Homo sapiens
ccaggctccttcctgtcttcctg

SEQ ID NO: 1452385 - DNA, 22 bp, Homo sapiens
ccaggctcggaggaccctggaa

SEQ ID NO: 1452386 - DNA, 12 bp, Homo sapiens
ccaggctcttcc

SEQ ID NO: 1452387 - DNA, 19 bp, Homo sapiens
ccaggctgaattacagtga

SEQ ID NO: 1452388 - DNA, 15 bp, Homo sapiens
ccaggctgagagcca

SEQ ID NO: 1452389 - DNA, 22 bp, Homo sapiens
ccaggctgagagccagatgcct

SEQ ID NO: 1452390 - DNA, 13 bp, Homo sapiens
ccaggctgagcca

SEQ ID NO: 1452391 - DNA, 17 bp, Homo sapiens
ccaggctgagccatgag

SEQ ID NO: 1452392 - DNA, 19 bp, Homo sapiens
ccaggctgcactgcagtga

SEQ ID NO: 1452393 - DNA, 13 bp, Homo sapiens
ccaggctgccaag

SEQ ID NO: 1452394 - DNA, 15 bp, Homo sapiens
ccaggctgccgtggg

SEQ ID NO: 1452395 - DNA, 13 bp, Homo sapiens
ccaggctgcctcc

SEQ ID NO: 1452396 - DNA, 21 bp, Homo sapiens
ccaggctgcctcggactccat

SEQ ID NO: 1452397 - DNA, 22 bp, Homo sapiens
ccaggctgcctcggactccatg

SEQ ID NO: 1452398 - DNA, 21 bp, Homo sapiens
ccaggctggacaccctctgcc

SEQ ID NO: 1452399 - DNA, 15 bp, Homo sapiens
ccaggctggcgcagc

SEQ ID NO: 1452400 - DNA, 18 bp, Homo sapiens
ccaggctggcgcagccaa

SEQ ID NO: 1452401 - DNA, 22 bp, Homo sapiens
ccaggctggcgcagccaaggcc

SEQ ID NO: 1452402 - DNA, 11 bp, Homo sapiens
ccaggctggga

SEQ ID NO: 1452403 - DNA, 23 bp, Homo sapiens
ccaggctgggctctgcctgtctg

SEQ ID NO: 1452404 - DNA, 17 bp, Homo sapiens
ccaggctggtctaaaac

SEQ ID NO: 1452405 - DNA, 15 bp, Homo sapiens
ccaggctggtctcaa

SEQ ID NO: 1452406 - DNA, 17 bp, Homo sapiens
ccaggcttcctgggtcc

SEQ ID NO: 1452407 - DNA, 14 bp, Homo sapiens
ccaggcttggcctt

SEQ ID NO: 1452408 - DNA, 16 bp, Homo sapiens
ccagggaacagcccca

SEQ ID NO: 1452409 - DNA, 17 bp, Homo sapiens
ccagggaacagccccag

SEQ ID NO: 1452410 - DNA, 17 bp, Homo sapiens
ccagggaagctggccga

SEQ ID NO: 1452411 - DNA, 22 bp, Homo sapiens
ccagggaaggctaagcatggcc

SEQ ID NO: 1452412 - DNA, 18 bp, Homo sapiens
ccagggaatccaagcctc

SEQ ID NO: 1452413 - DNA, 20 bp, Homo sapiens
ccagggacagaggccccagc

SEQ ID NO: 1452414 - DNA, 21 bp, Homo sapiens
ccagggacagaggccccagcc

SEQ ID NO: 1452415 - DNA, 14 bp, Homo sapiens
ccagggacccaggt

SEQ ID NO: 1452416 - DNA, 16 bp, Homo sapiens
ccagggacccaggtgt

SEQ ID NO: 1452417 - DNA, 22 bp, Homo sapiens
tcaaagactgtatttagatctc

SEQ ID NO: 1452418 - DNA, 19 bp, Homo sapiens
tcaaagaggtgaacattaa

SEQ ID NO: 1452419 - DNA, 21 bp, Homo sapiens
tcaaagaggtgaacattaaaa

SEQ ID NO: 1452420 - DNA, 23 bp, Homo sapiens
tcaaagaggtgaacattaaaata

SEQ ID NO: 1452421 - DNA, 22 bp, Homo sapiens
tcaaagatgcattttgagtgtt

SEQ ID NO: 1452422 - DNA, 19 bp, Homo sapiens
tcaaagatgctgtgagtct

SEQ ID NO: 1452423 - DNA, 17 bp, Homo sapiens
tcaaagcaagggctcca

SEQ ID NO: 1452424 - DNA, 18 bp, Homo sapiens
tcaaagcaagggctccag

SEQ ID NO: 1452425 - DNA, 20 bp, Homo sapiens
tcaaagcagaagtctggctt

SEQ ID NO: 1452426 - DNA, 20 bp, Homo sapiens
tcaaagcatggacatttaga

SEQ ID NO: 1452427 - DNA, 22 bp, Homo sapiens
tcaaagcatggacatttagaag

SEQ ID NO: 1452428 - DNA, 18 bp, Homo sapiens
tcaaagccaagtttatat

SEQ ID NO: 1452429 - DNA, 18 bp, Homo sapiens
tcaaagccacattatttc

SEQ ID NO: 1452430 - DNA, 14 bp, Homo sapiens
tcaaagcttgaaga

SEQ ID NO: 1452431 - DNA, 20 bp, Homo sapiens
tcaaagcttgaagatcgtta

SEQ ID NO: 1452432 - DNA, 23 bp, Homo sapiens
tcaaaggagaaaaaaaaccttgt

SEQ ID NO: 1452433 - DNA, 22 bp, Homo sapiens
tcaaaggagagtcacagaacaa

SEQ ID NO: 1452434 - DNA, 17 bp, Homo sapiens
tcaaagggataaagaaa

SEQ ID NO: 1452435 - DNA, 17 bp, Homo sapiens
tcaaagggtgaaaatta

SEQ ID NO: 1452436 - DNA, 19 bp, Homo sapiens
tcaaaggtagccatcatgg

SEQ ID NO: 1452437 - DNA, 18 bp, Homo sapiens
tcaaaggtttggaaggag

SEQ ID NO: 1452438 - DNA, 16 bp, Homo sapiens
tcaaagtaaggctggt

SEQ ID NO: 1452439 - DNA, 19 bp, Homo sapiens
tcaaagtggtacaggaagg

SEQ ID NO: 1452440 - DNA, 13 bp, Homo sapiens
tcaaagtgtatat

SEQ ID NO: 1452441 - DNA, 14 bp, Homo sapiens
tcaaagtgtatatt

SEQ ID NO: 1452442 - DNA, 15 bp, Homo sapiens
tcaaagtgttgctgt

SEQ ID NO: 1452443 - DNA, 22 bp, Homo sapiens
tcaaagtgttgctgtggctcca

SEQ ID NO: 1452444 - DNA, 17 bp, Homo sapiens
tcaaagttgaaaattca

SEQ ID NO: 1452445 - DNA, 12 bp, Homo sapiens
tcaaagtttata

SEQ ID NO: 1452446 - DNA, 15 bp, Homo sapiens
tcaaagtttatatgc

SEQ ID NO: 1452447 - DNA, 14 bp, Homo sapiens
tcaaataaaaataa

SEQ ID NO: 1452448 - DNA, 20 bp, Homo sapiens
tcaaataaaatatcataaag

SEQ ID NO: 1452449 - DNA, 23 bp, Homo sapiens
tcaaataaaatatcataaagcat

SEQ ID NO: 1452450 - DNA, 11 bp, Homo sapiens
tcaaataaact

SEQ ID NO: 1452451 - DNA, 18 bp, Homo sapiens
tcaaataactaaaaggta

SEQ ID NO: 1452452 - DNA, 18 bp, Homo sapiens
tcaaataagtatttataa

SEQ ID NO: 1452453 - DNA, 19 bp, Homo sapiens
tcaaataagtatttataat

SEQ ID NO: 1452454 - DNA, 19 bp, Homo sapiens
tcaaataataccttagaag

SEQ ID NO: 1452455 - DNA, 21 bp, Homo sapiens
tcaaataataccttagaaggt

SEQ ID NO: 1452456 - DNA, 14 bp, Homo sapiens
tcaaatacacattt

SEQ ID NO: 1452457 - DNA, 21 bp, Homo sapiens
tcaaatactcatttttcatta

SEQ ID NO: 1452458 - DNA, 23 bp, Homo sapiens
tcaaataggctattaaaaaagtc

SEQ ID NO: 1452459 - DNA, 20 bp, Homo sapiens
tcaaatatcatttactcttc

SEQ ID NO: 1452460 - DNA, 14 bp, Homo sapiens
tcaggaagctctct

SEQ ID NO: 1452461 - DNA, 18 bp, Homo sapiens
tcaggaatattttccaaa

SEQ ID NO: 1452462 - DNA, 16 bp, Homo sapiens
tcaggaattcagtgcc

SEQ ID NO: 1452463 - DNA, 23 bp, Homo sapiens
tcaggaccactcagttaaggaag

SEQ ID NO: 1452464 - DNA, 14 bp, Homo sapiens
tcaggacccaggcc

SEQ ID NO: 1452465 - DNA, 17 bp, Homo sapiens
tcaggacccaggccctc

SEQ ID NO: 1452466 - DNA, 23 bp, Homo sapiens
tcaggacccaggccctccatggg

SEQ ID NO: 1452467 - DNA, 18 bp, Homo sapiens
tcaggaccccactggaga

SEQ ID NO: 1452468 - DNA, 16 bp, Homo sapiens
tcaggacttgaaagaa

SEQ ID NO: 1452469 - DNA, 17 bp, Homo sapiens
tcaggagaggggcagaa

SEQ ID NO: 1452470 - DNA, 20 bp, Homo sapiens
tcaggagaggggcagaacag

SEQ ID NO: 1452471 - DNA, 17 bp, Homo sapiens
tcaggaggcaggacctt

SEQ ID NO: 1452472 - DNA, 18 bp, Homo sapiens
tcaggaggccctggtgtc

SEQ ID NO: 1452473 - DNA, 21 bp, Homo sapiens
tcaggaggccctggtgtcagg

SEQ ID NO: 1452474 - DNA, 13 bp, Homo sapiens
tcaggaggctgag

SEQ ID NO: 1452475 - DNA, 16 bp, Homo sapiens
tcaggaggctgaggca

SEQ ID NO: 1452476 - DNA, 18 bp, Homo sapiens
tcaggaggctgaggcagg

SEQ ID NO: 1452477 - DNA, 18 bp, Homo sapiens
tcaggaggctgaggggag

SEQ ID NO: 1452478 - DNA, 19 bp, Homo sapiens
tcaggagggtgacgcccag

SEQ ID NO: 1452479 - DNA, 21 bp, Homo sapiens
tcaggagggtgacgcccagct

SEQ ID NO: 1452480 - DNA, 20 bp, Homo sapiens
tcaggagtcccaaggaaagc

SEQ ID NO: 1452481 - DNA, 19 bp, Homo sapiens
tcaggagtctgccacttgt

SEQ ID NO: 1452482 - DNA, 16 bp, Homo sapiens
tcaggagttcaagact

SEQ ID NO: 1452483 - DNA, 17 bp, Homo sapiens
tcaggagttgtttctga

SEQ ID NO: 1452484 - DNA, 14 bp, Homo sapiens
tcaggagtttgaga

SEQ ID NO: 1452485 - DNA, 22 bp, Homo sapiens
tcaggatccaagctaagcactg

SEQ ID NO: 1452486 - DNA, 21 bp, Homo sapiens
tcaggatttaaaaactggaac

SEQ ID NO: 1452487 - DNA, 21 bp, Homo sapiens
tcaggatttcaccagaagtta

SEQ ID NO: 1452488 - DNA, 17 bp, Homo sapiens
tcaggcaaattggggag

SEQ ID NO: 1452489 - DNA, 15 bp, Homo sapiens
tcaggcaagcccctc

SEQ ID NO: 1452490 - DNA, 20 bp, Homo sapiens
tcaggcaagcccctcagccc

SEQ ID NO: 1452491 - DNA, 14 bp, Homo sapiens
tcaggcacacagct

SEQ ID NO: 1452492 - DNA, 15 bp, Homo sapiens
tcaggcactggtggc

SEQ ID NO: 1452493 - DNA, 15 bp, Homo sapiens
tcaggcagacaagag

SEQ ID NO: 1452494 - DNA, 21 bp, Homo sapiens
tcaggcagacaagagctgctg

SEQ ID NO: 1452495 - DNA, 22 bp, Homo sapiens
tcaggcagacaagagctgctgt

SEQ ID NO: 1452496 - DNA, 15 bp, Homo sapiens
tcaggcagcaccaca

SEQ ID NO: 1452497 - DNA, 23 bp, Homo sapiens
tcaggcagcaccacactgggtgc

SEQ ID NO: 1452498 - DNA, 12 bp, Homo sapiens
tcaggcagcctt

SEQ ID NO: 1452499 - DNA, 15 bp, Homo sapiens
tcaggcagccttcat

SEQ ID NO: 1452500 - DNA, 13 bp, Homo sapiens
tcaggcaggaagg

SEQ ID NO: 1452501 - DNA, 21 bp, Homo sapiens
tcaggcaggaagggcaggaag

SEQ ID NO: 1452502 - DNA, 16 bp, Homo sapiens
tcaggcaggtttgcca

SEQ ID NO: 1452503 - DNA, 16 bp, Homo sapiens
tcaggcataggcctgg

SEQ ID NO: 1452504 - DNA, 18 bp, Homo sapiens
tcaggcataggcctgggt

SEQ ID NO: 1452505 - DNA, 19 bp, Homo sapiens
tcaggcataggcctgggtg

SEQ ID NO: 1452506 - DNA, 12 bp, Homo sapiens
tcaggccagccc

SEQ ID NO: 1452507 - DNA, 13 bp, Homo sapiens
tcaggccagccca

SEQ ID NO: 1452508 - DNA, 16 bp, Homo sapiens
tcaggccagcccagcc

SEQ ID NO: 1452509 - DNA, 18 bp, Homo sapiens
tcaggccagcccagccag

SEQ ID NO: 1452510 - DNA, 15 bp, Homo sapiens
tcaggcccaggcact

SEQ ID NO: 1452511 - DNA, 21 bp, Homo sapiens
tcaggccccgggcttcccttc

SEQ ID NO: 1452512 - DNA, 21 bp, Homo sapiens
tcaggcccgtcggagctgcct

SEQ ID NO: 1452513 - DNA, 13 bp, Homo sapiens
tcaggccctctgc

SEQ ID NO: 1452514 - DNA, 19 bp, Homo sapiens
tcaggcccttattttcaag

SEQ ID NO: 1452515 - DNA, 14 bp, Homo sapiens
tcaggcctctgcag

SEQ ID NO: 1452516 - DNA, 17 bp, Homo sapiens
tcaggctaagaccctgt

SEQ ID NO: 1452517 - DNA, 19 bp, Homo sapiens
tcaggctaagaccctgtgt

SEQ ID NO: 1452518 - DNA, 11 bp, Homo sapiens
tcaggctccat

SEQ ID NO: 1452519 - DNA, 20 bp, Homo sapiens
tcaggctccattaggatttg

SEQ ID NO: 1452520 - DNA, 22 bp, Homo sapiens
tcaggctctgcacagacaagca

SEQ ID NO: 1452521 - DNA, 13 bp, Homo sapiens
tcaggctctgccc

SEQ ID NO: 1452522 - DNA, 14 bp, Homo sapiens
tcaggctctgccct

SEQ ID NO: 1452523 - DNA, 15 bp, Homo sapiens
tcaggctcttctcct

SEQ ID NO: 1452524 - DNA, 14 bp, Homo sapiens
tcaggcttccttgg

SEQ ID NO: 1452525 - DNA, 20 bp, Homo sapiens
tcaggctttcactatttcct

SEQ ID NO: 1452526 - DNA, 21 bp, Homo sapiens
tcaggctttcactatttcctt

SEQ ID NO: 1452527 - DNA, 20 bp, Homo sapiens
tcagggaagcccagctccag

SEQ ID NO: 1452528 - DNA, 22 bp, Homo sapiens
tcagggaatttcaggaactaga

SEQ ID NO: 1452529 - DNA, 14 bp, Homo sapiens
tcagggacagcagc

SEQ ID NO: 1452530 - DNA, 15 bp, Homo sapiens
tcagggacagcagcc

SEQ ID NO: 1452531 - DNA, 18 bp, Homo sapiens
tcagggacagcagcctcc

SEQ ID NO: 1452532 - DNA, 18 bp, Homo sapiens
tcagggaccgtccagggg

SEQ ID NO: 1452533 - DNA, 14 bp, Homo sapiens
tcagggagaggtca

SEQ ID NO: 1452534 - DNA, 21 bp, Homo sapiens
tcagggagcagggaaggcctg

SEQ ID NO: 1452535 - DNA, 18 bp, Homo sapiens
tcagggcacgcaggacca

SEQ ID NO: 1452536 - DNA, 18 bp, Homo sapiens
tcagggcagacagccctc

SEQ ID NO: 1452537 - DNA, 11 bp, Homo sapiens
tcagggcaggg

SEQ ID NO: 1452538 - DNA, 16 bp, Homo sapiens
tcagggcagggctctg

SEQ ID NO: 1452539 - DNA, 23 bp, Homo sapiens
tcagggccagaaggagggcagag

SEQ ID NO: 1452540 - DNA, 20 bp, Homo sapiens
tcagggccaggtgcagacct

SEQ ID NO: 1452541 - DNA, 23 bp, Homo sapiens
tcagggccaggtgcagaccttgg

SEQ ID NO: 1452542 - DNA, 14 bp, Homo sapiens
tcagggccatgctg

SEQ ID NO: 1452543 - DNA, 19 bp, Homo sapiens
tcagggccatgctgaggcc

SEQ ID NO: 1452544 - DNA, 14 bp, Homo sapiens
tcagggccccagca

SEQ ID NO: 1452545 - DNA, 16 bp, Homo sapiens
tcagggcgctcagacg

SEQ ID NO: 1452546 - DNA, 23 bp, Homo sapiens
tcagggcgctcagacggcggcca

SEQ ID NO: 1452547 - DNA, 16 bp, Homo sapiens
tcaggggactcagccc

SEQ ID NO: 1452548 - DNA, 19 bp, Homo sapiens
tcaggggcctggaggtctg

SEQ ID NO: 1452549 - DNA, 22 bp, Homo sapiens
tcaggggtcaggtgtcaggccc

SEQ ID NO: 1452550 - DNA, 17 bp, Homo sapiens
tcaggggtgcattctgg

SEQ ID NO: 1452551 - DNA, 18 bp, Homo sapiens
tcagggtcaaagacagaa

SEQ ID NO: 1452552 - DNA, 15 bp, Homo sapiens
tcaggtaatatacct

SEQ ID NO: 1452553 - DNA, 16 bp, Homo sapiens
tcaggtaatatacctg

SEQ ID NO: 1452554 - DNA, 22 bp, Homo sapiens
tcaggtacagaaaacatgttta

SEQ ID NO: 1452555 - DNA, 14 bp, Homo sapiens
tcaggtacggagaa

SEQ ID NO: 1452556 - DNA, 17 bp, Homo sapiens
tcaggtacggagaagaa

SEQ ID NO: 1452557 - DNA, 13 bp, Homo sapiens
tcaggtaggccct

SEQ ID NO: 1452558 - DNA, 17 bp, Homo sapiens
tcaggtaggcccttgtc

SEQ ID NO: 1452559 - DNA, 17 bp, Homo sapiens
tcaggtgatcaaaataa

SEQ ID NO: 1452560 - DNA, 11 bp, Homo sapiens
tcaggtgccac

SEQ ID NO: 1452561 - DNA, 18 bp, Homo sapiens
tcaggtgccttacatctt

SEQ ID NO: 1452562 - DNA, 18 bp, Homo sapiens
tcaggtgcttttgatgtg

SEQ ID NO: 1452563 - DNA, 19 bp, Homo sapiens
tcaggtgcttttgatgtga

SEQ ID NO: 1452564 - DNA, 13 bp, Homo sapiens
tcaggtggccaga

SEQ ID NO: 1452565 - DNA, 23 bp, Homo sapiens
tcaggtggtggctgatgctttga

SEQ ID NO: 1452566 - DNA, 15 bp, Homo sapiens
tcaggtgtcgaggcc

SEQ ID NO: 1452567 - DNA, 13 bp, Homo sapiens
tcaggttccagaa

SEQ ID NO: 1452568 - DNA, 18 bp, Homo sapiens
tcaggttcttagtgtcac

SEQ ID NO: 1452569 - DNA, 14 bp, Homo sapiens
tcaggtttgttttg

SEQ ID NO: 1452570 - DNA, 22 bp, Homo sapiens
tcagtaaacgggaacatgcccc

SEQ ID NO: 1452571 - DNA, 18 bp, Homo sapiens
tcagtaaataactggaaa

SEQ ID NO: 1452572 - DNA, 20 bp, Homo sapiens
tcagtaacataactgcttct

SEQ ID NO: 1452573 - DNA, 19 bp, Homo sapiens
ccactgtggccagagctgg

SEQ ID NO: 1452574 - DNA, 16 bp, Homo sapiens
ccactgtggcgttctg

SEQ ID NO: 1452575 - DNA, 14 bp, Homo sapiens
tcatttatattgca

SEQ ID NO: 1452576 - DNA, 18 bp, Homo sapiens
tcatttattgtttatgta

SEQ ID NO: 1452577 - DNA, 14 bp, Homo sapiens
tcatttcacccctc

SEQ ID NO: 1452578 - DNA, 15 bp, Homo sapiens
tcatttcacccctcc

SEQ ID NO: 1452579 - DNA, 19 bp, Homo sapiens
tcatttcagggtcttggct

SEQ ID NO: 1452580 - DNA, 16 bp, Homo sapiens
tcatttcattcctaac

SEQ ID NO: 1452581 - DNA, 22 bp, Homo sapiens
tcatttcctatgtaactgcatt

SEQ ID NO: 1452582 - DNA, 23 bp, Homo sapiens
tcatttcctgcccttcctcagtt

SEQ ID NO: 1452583 - DNA, 18 bp, Homo sapiens
tcatttctcataattttg

SEQ ID NO: 1452584 - DNA, 22 bp, Homo sapiens
tcatttctcataattttgcaaa

SEQ ID NO: 1452585 - DNA, 12 bp, Homo sapiens
tcatttctctgc

SEQ ID NO: 1452586 - DNA, 16 bp, Homo sapiens
tcatttctctgcatgg

SEQ ID NO: 1452587 - DNA, 13 bp, Homo sapiens
tcatttctgcaga

SEQ ID NO: 1452588 - DNA, 10 bp, Homo sapiens
ccagccaggc

SEQ ID NO: 1452589 - DNA, 16 bp, Homo sapiens
ccagccaggccaacag

SEQ ID NO: 1452590 - DNA, 21 bp, Homo sapiens
ccagccaggcgggctcaagga

SEQ ID NO: 1452591 - DNA, 12 bp, Homo sapiens
ccagccaggctc

SEQ ID NO: 1452592 - DNA, 19 bp, Homo sapiens
ccagccatctgcccagggg

SEQ ID NO: 1452593 - DNA, 21 bp, Homo sapiens
ccagccatctgcccaggggtg

SEQ ID NO: 1452594 - DNA, 19 bp, Homo sapiens
ccagccattaccatggaga

SEQ ID NO: 1452595 - DNA, 12 bp, Homo sapiens
ccagcccagaga

SEQ ID NO: 1452596 - DNA, 22 bp, Homo sapiens
ccagcccagagacatacttgaa

SEQ ID NO: 1452597 - DNA, 23 bp, Homo sapiens
ccagcccagagacatacttgaag

SEQ ID NO: 1452598 - DNA, 13 bp, Homo sapiens
ccagcccagagcc

SEQ ID NO: 1452599 - DNA, 16 bp, Homo sapiens
ccagcccagccaggcc

SEQ ID NO: 1452600 - DNA, 14 bp, Homo sapiens
ccagcccagcccag

SEQ ID NO: 1452601 - DNA, 13 bp, Homo sapiens
ccagcccagctgg

SEQ ID NO: 1452602 - DNA, 17 bp, Homo sapiens
ccagcccagggctcctg

SEQ ID NO: 1452603 - DNA, 21 bp, Homo sapiens
ccagcccagggctcctgcact

SEQ ID NO: 1452604 - DNA, 18 bp, Homo sapiens
ccagcccatggcccccaa

SEQ ID NO: 1452605 - DNA, 22 bp, Homo sapiens
ccagcccatggcccccaataaa

SEQ ID NO: 1452606 - DNA, 21 bp, Homo sapiens
ccagcccattctctctcctgt

SEQ ID NO: 1452607 - DNA, 15 bp, Homo sapiens
ccagccccaagctgg

SEQ ID NO: 1452608 - DNA, 22 bp, Homo sapiens
ccagccccacccctaagtgccc

SEQ ID NO: 1452609 - DNA, 17 bp, Homo sapiens
ccagccccagccccttc

SEQ ID NO: 1452610 - DNA, 20 bp, Homo sapiens
ccagccccctccagctcatg

SEQ ID NO: 1452611 - DNA, 22 bp, Homo sapiens
ccagccccctggatgggcattg

SEQ ID NO: 1452612 - DNA, 16 bp, Homo sapiens
ccagccccgctcccac

SEQ ID NO: 1452613 - DNA, 17 bp, Homo sapiens
ccagcccctcttcccca

SEQ ID NO: 1452614 - DNA, 18 bp, Homo sapiens
ccagcccctcttggagaa

SEQ ID NO: 1452615 - DNA, 16 bp, Homo sapiens
ccagcccgaacaccat

SEQ ID NO: 1452616 - DNA, 17 bp, Homo sapiens
ccagcccgacagtgcca

SEQ ID NO: 1452617 - DNA, 21 bp, Homo sapiens
ccagcccgacagtgccatccc

SEQ ID NO: 1452618 - DNA, 13 bp, Homo sapiens
ccagcccggcctg

SEQ ID NO: 1452619 - DNA, 15 bp, Homo sapiens
ccagcccggcctgct

SEQ ID NO: 1452620 - DNA, 21 bp, Homo sapiens
ccagccctccccatggagcca

SEQ ID NO: 1452621 - DNA, 14 bp, Homo sapiens
ccagccctccctgt

SEQ ID NO: 1452622 - DNA, 15 bp, Homo sapiens
ccagccctccctgtc

SEQ ID NO: 1452623 - DNA, 13 bp, Homo sapiens
ccagccctgctgg

SEQ ID NO: 1452624 - DNA, 22 bp, Homo sapiens
ccagccctgggaaccactccca

SEQ ID NO: 1452625 - DNA, 20 bp, Homo sapiens
ccagccctttgggaggctga

SEQ ID NO: 1452626 - DNA, 14 bp, Homo sapiens
ccagccgctgcagg

SEQ ID NO: 1452627 - DNA, 20 bp, Homo sapiens
ccagccgctgcagggctccc

SEQ ID NO: 1452628 - DNA, 21 bp, Homo sapiens
ccagccgctgcagggctccca

SEQ ID NO: 1452629 - DNA, 22 bp, Homo sapiens
ccagccgctgcagggctcccat

SEQ ID NO: 1452630 - DNA, 14 bp, Homo sapiens
ccagccggcctctc

SEQ ID NO: 1452631 - DNA, 15 bp, Homo sapiens
ccagccgggcacagt

SEQ ID NO: 1452632 - DNA, 14 bp, Homo sapiens
ccagccggtgcctg

SEQ ID NO: 1452633 - DNA, 15 bp, Homo sapiens
ccagccggtgcctgg

SEQ ID NO: 1452634 - DNA, 16 bp, Homo sapiens
ccagccggtgcctggc

SEQ ID NO: 1452635 - DNA, 20 bp, Homo sapiens
ccagccgtgatgctcaggct

SEQ ID NO: 1452636 - DNA, 17 bp, Homo sapiens
ccagcctacaagctggc

SEQ ID NO: 1452637 - DNA, 20 bp, Homo sapiens
ccagcctcagaaggccccag

SEQ ID NO: 1452638 - DNA, 17 bp, Homo sapiens
ccagcctcagtgccact

SEQ ID NO: 1452639 - DNA, 11 bp, Homo sapiens
ccagcctccct

SEQ ID NO: 1452640 - DNA, 17 bp, Homo sapiens
ccagcctccctgaagcc

SEQ ID NO: 1452641 - DNA, 13 bp, Homo sapiens
ccagcctccctgt

SEQ ID NO: 1452642 - DNA, 18 bp, Homo sapiens
ccagcctccctgtctcca

SEQ ID NO: 1452643 - DNA, 18 bp, Homo sapiens
ccagcctccgagagggag

SEQ ID NO: 1452644 - DNA, 23 bp, Homo sapiens
ccagcctcctctggacggcaggc

SEQ ID NO: 1452645 - DNA, 19 bp, Homo sapiens
ccagcctcgttggaagagg

SEQ ID NO: 1452646 - DNA, 20 bp, Homo sapiens
ccagcctcgttggagagcag

SEQ ID NO: 1452647 - DNA, 23 bp, Homo sapiens
ccagcctctcccggctgcctgcc

SEQ ID NO: 1452648 - DNA, 22 bp, Homo sapiens
ccagcctctcttggtttccttc

SEQ ID NO: 1452649 - DNA, 12 bp, Homo sapiens
ccagcctgagca

SEQ ID NO: 1452650 - DNA, 15 bp, Homo sapiens
ccagcctgagtgaca

SEQ ID NO: 1452651 - DNA, 21 bp, Homo sapiens
ccagcctgagtgacagagcga

SEQ ID NO: 1452652 - DNA, 12 bp, Homo sapiens
ccagcctgctga

SEQ ID NO: 1452653 - DNA, 17 bp, Homo sapiens
ccagcctgctgacagac

SEQ ID NO: 1452654 - DNA, 21 bp, Homo sapiens
ccagcctggctctgccccctc

SEQ ID NO: 1452655 - DNA, 19 bp, Homo sapiens
ccagcctgggagcccagag

SEQ ID NO: 1452656 - DNA, 13 bp, Homo sapiens
ccagcctggggct

SEQ ID NO: 1452657 - DNA, 22 bp, Homo sapiens
ccagcctggggctccctctctg

SEQ ID NO: 1452658 - DNA, 21 bp, Homo sapiens
ccagcctgtggttacagtgca

SEQ ID NO: 1452659 - DNA, 18 bp, Homo sapiens
ccagcctgtgtgttctgt

SEQ ID NO: 1452660 - DNA, 15 bp, Homo sapiens
ccagccttcctctgc

SEQ ID NO: 1452661 - DNA, 19 bp, Homo sapiens
ccagccttgagccctggct

SEQ ID NO: 1452662 - DNA, 20 bp, Homo sapiens
ccagccttgagccctggctg

SEQ ID NO: 1452663 - DNA, 21 bp, Homo sapiens
ccagccttgagccctggctgt

SEQ ID NO: 1452664 - DNA, 15 bp, Homo sapiens
ccagccttggaggat

SEQ ID NO: 1452665 - DNA, 21 bp, Homo sapiens
ccagccttggggggtgggggc

SEQ ID NO: 1452666 - DNA, 21 bp, Homo sapiens
ccagcctttctcccaggccag

SEQ ID NO: 1452667 - DNA, 22 bp, Homo sapiens
ccagcctttgggtcctgggcag

SEQ ID NO: 1452668 - DNA, 21 bp, Homo sapiens
ccagcgagagagtttcaaaag

SEQ ID NO: 1452669 - DNA, 14 bp, Homo sapiens
ccagcgatggtgct

SEQ ID NO: 1452670 - DNA, 19 bp, Homo sapiens
ccagcgatttttgaggatt

SEQ ID NO: 1452671 - DNA, 14 bp, Homo sapiens
ccagcgcccccaga

SEQ ID NO: 1452672 - DNA, 19 bp, Homo sapiens
ccagcgcccgctgggctga

SEQ ID NO: 1452673 - DNA, 22 bp, Homo sapiens
ccagcgcctagtggggtctccc

SEQ ID NO: 1452674 - DNA, 14 bp, Homo sapiens
ccagcgcggccagc

SEQ ID NO: 1452675 - DNA, 12 bp, Homo sapiens
ccagcgctctcc

SEQ ID NO: 1452676 - DNA, 13 bp, Homo sapiens
ccagcgctctcct

SEQ ID NO: 1452677 - DNA, 21 bp, Homo sapiens
ccagcggccccccgcacagcc

SEQ ID NO: 1452678 - DNA, 12 bp, Homo sapiens
ccagcggctgct

SEQ ID NO: 1452679 - DNA, 21 bp, Homo sapiens
ccagcggctggtgcagggcct

SEQ ID NO: 1452680 - DNA, 18 bp, Homo sapiens
ccagcgggcacagggcac

SEQ ID NO: 1452681 - DNA, 15 bp, Homo sapiens
ccagcgggcagatgg

SEQ ID NO: 1452682 - DNA, 22 bp, Homo sapiens
ccagcgggcagatgggcggacg

SEQ ID NO: 1452683 - DNA, 17 bp, Homo sapiens
ccagcggtttccacttg

SEQ ID NO: 1452684 - DNA, 20 bp, Homo sapiens
ccagcggtttccacttgtgg

SEQ ID NO: 1452685 - DNA, 23 bp, Homo sapiens
ccagcgtcagctgctccctggca

SEQ ID NO: 1452686 - DNA, 15 bp, Homo sapiens
ccagcgtcccagggt

SEQ ID NO: 1452687 - DNA, 17 bp, Homo sapiens
ccagcgtcccagggtac

SEQ ID NO: 1452688 - DNA, 22 bp, Homo sapiens
ccagcgtctctcctccctcctg

SEQ ID NO: 1452689 - DNA, 17 bp, Homo sapiens
ccagcgtgtggagcaga

SEQ ID NO: 1452690 - DNA, 13 bp, Homo sapiens
ccagctaagaacc

SEQ ID NO: 1452691 - DNA, 23 bp, Homo sapiens
ccagctaataaaccagattccag

SEQ ID NO: 1452692 - DNA, 17 bp, Homo sapiens
ccagctaatctgtaggg

SEQ ID NO: 1452693 - DNA, 22 bp, Homo sapiens
ccagctaatctgtagggctgga

SEQ ID NO: 1452694 - DNA, 15 bp, Homo sapiens
ccagctaatttttgt

SEQ ID NO: 1452695 - DNA, 23 bp, Homo sapiens
ccagctacattcctcagctgcca

SEQ ID NO: 1452696 - DNA, 17 bp, Homo sapiens
ccagctaccaagtcaga

SEQ ID NO: 1452697 - DNA, 21 bp, Homo sapiens
ccagctaccctttttctccag

SEQ ID NO: 1452698 - DNA, 17 bp, Homo sapiens
ccagctacgtgggaggc

SEQ ID NO: 1452699 - DNA, 16 bp, Homo sapiens
ccagctactcagaagc

SEQ ID NO: 1452700 - DNA, 20 bp, Homo sapiens
ccagctactcagaagcctga

SEQ ID NO: 1452701 - DNA, 21 bp, Homo sapiens
ccagctactcagaagcctgag

SEQ ID NO: 1452702 - DNA, 23 bp, Homo sapiens
ccagctactcagaagcctgaggc

SEQ ID NO: 1452703 - DNA, 19 bp, Homo sapiens
ccagctactcaggaggctg

SEQ ID NO: 1452704 - DNA, 14 bp, Homo sapiens
tcatttctgccagc

SEQ ID NO: 1452705 - DNA, 21 bp, Homo sapiens
tcatttggtgttcctggaagc

SEQ ID NO: 1452706 - DNA, 12 bp, Homo sapiens
tcatttgtacaa

SEQ ID NO: 1452707 - DNA, 13 bp, Homo sapiens
tcatttgtacaag

SEQ ID NO: 1452708 - DNA, 17 bp, Homo sapiens
tcatttgtatgtcaaag

SEQ ID NO: 1452709 - DNA, 13 bp, Homo sapiens
tcattttaattat

SEQ ID NO: 1452710 - DNA, 17 bp, Homo sapiens
tcattttactcttatga

SEQ ID NO: 1452711 - DNA, 14 bp, Homo sapiens
tcattttagtgact

SEQ ID NO: 1452712 - DNA, 17 bp, Homo sapiens
tcattttcattaccagg

SEQ ID NO: 1452713 - DNA, 17 bp, Homo sapiens
tcattttcctgacattt

SEQ ID NO: 1452714 - DNA, 16 bp, Homo sapiens
tcattttcttttttaa

SEQ ID NO: 1452715 - DNA, 14 bp, Homo sapiens
tcattttgcactgt

SEQ ID NO: 1452716 - DNA, 14 bp, Homo sapiens
tcattttgggcctt

SEQ ID NO: 1452717 - DNA, 22 bp, Homo sapiens
tcattttggtaaaatacttctt

SEQ ID NO: 1452718 - DNA, 18 bp, Homo sapiens
tcattttggttttgtgtt

SEQ ID NO: 1452719 - DNA, 15 bp, Homo sapiens
tcattttgtccatgt

SEQ ID NO: 1452720 - DNA, 19 bp, Homo sapiens
tcattttgttttgctctga

SEQ ID NO: 1452721 - DNA, 19 bp, Homo sapiens
tcatttttaacagcatgct

SEQ ID NO: 1452722 - DNA, 12 bp, Homo sapiens
tcatttttaatc

SEQ ID NO: 1452723 - DNA, 18 bp, Homo sapiens
tcatttttaatcatgaaa

SEQ ID NO: 1452724 - DNA, 23 bp, Homo sapiens
tcatttttataacctggcaaaat

SEQ ID NO: 1452725 - DNA, 19 bp, Homo sapiens
tcatttttcaatagcacat

SEQ ID NO: 1452726 - DNA, 14 bp, Homo sapiens
tcatttttgtattt

SEQ ID NO: 1452727 - DNA, 13 bp, Homo sapiens
tccaaaaaaagga

SEQ ID NO: 1452728 - DNA, 16 bp, Homo sapiens
tccaaaaaaaggaaaa

SEQ ID NO: 1452729 - DNA, 21 bp, Homo sapiens
tccaaaaaaagggaaggattt

SEQ ID NO: 1452730 - DNA, 22 bp, Homo sapiens
tccaaaaacattttatttttaa

SEQ ID NO: 1452731 - DNA, 22 bp, Homo sapiens
tccaaaaagattttcagaaaat

SEQ ID NO: 1452732 - DNA, 17 bp, Homo sapiens
tccaaaaatgtgtaaga

SEQ ID NO: 1452733 - DNA, 14 bp, Homo sapiens
tccaaaacatttct

SEQ ID NO: 1452734 - DNA, 22 bp, Homo sapiens
tccaaaacatttctggacagta

SEQ ID NO: 1452735 - DNA, 14 bp, Homo sapiens
tccaaaagaagccc

SEQ ID NO: 1452736 - DNA, 15 bp, Homo sapiens
tccaaaagaagcccc

SEQ ID NO: 1452737 - DNA, 19 bp, Homo sapiens
tccaaaagattgctgaaat

SEQ ID NO: 1452738 - DNA, 22 bp, Homo sapiens
tccaaaagattgctgaaatttt

SEQ ID NO: 1452739 - DNA, 19 bp, Homo sapiens
tccaaaatgtgtatttctt

SEQ ID NO: 1452740 - DNA, 16 bp, Homo sapiens
tccaaaccctcctggg

SEQ ID NO: 1452741 - DNA, 22 bp, Homo sapiens
tccaaaccctcctgggaaggcc

SEQ ID NO: 1452742 - DNA, 13 bp, Homo sapiens
tccaaacctccag

SEQ ID NO: 1452743 - DNA, 19 bp, Homo sapiens
tccaaacctccagcctccc

SEQ ID NO: 1452744 - DNA, 22 bp, Homo sapiens
tccaaacctccagcctccctgt

SEQ ID NO: 1452745 - DNA, 14 bp, Homo sapiens
tccaaacctggttc

SEQ ID NO: 1452746 - DNA, 20 bp, Homo sapiens
tccaaacctgtcttggggcc

SEQ ID NO: 1452747 - DNA, 19 bp, Homo sapiens
tccaaactgaagcagcctc

SEQ ID NO: 1452748 - DNA, 13 bp, Homo sapiens
tccaaagaaagtt

SEQ ID NO: 1452749 - DNA, 21 bp, Homo sapiens
tccaaagagggatgtttggaa

SEQ ID NO: 1452750 - DNA, 23 bp, Homo sapiens
tccaaaggaataacctttctgga

SEQ ID NO: 1452751 - DNA, 23 bp, Homo sapiens
tccaaaggaatctccagttttca

SEQ ID NO: 1452752 - DNA, 18 bp, Homo sapiens
tccaaaggggctgctggg

SEQ ID NO: 1452753 - DNA, 21 bp, Homo sapiens
tccaaaggggctgctggggca

SEQ ID NO: 1452754 - DNA, 12 bp, Homo sapiens
tccaaaggttcc

SEQ ID NO: 1452755 - DNA, 13 bp, Homo sapiens
tccaaagtctcta

SEQ ID NO: 1452756 - DNA, 17 bp, Homo sapiens
tccaaagtctctaattc

SEQ ID NO: 1452757 - DNA, 18 bp, Homo sapiens
tccaaagtctctaattct

SEQ ID NO: 1452758 - DNA, 22 bp, Homo sapiens
tccaaataaacattttttaaga

SEQ ID NO: 1452759 - DNA, 19 bp, Homo sapiens
tccaaatattattcaagtg

SEQ ID NO: 1452760 - DNA, 16 bp, Homo sapiens
tccaaatcctggaagg

SEQ ID NO: 1452761 - DNA, 22 bp, Homo sapiens
tccaaatcctggaaggacacag

SEQ ID NO: 1452762 - DNA, 19 bp, Homo sapiens
tccaaatgtcctccagaag

SEQ ID NO: 1452763 - DNA, 22 bp, Homo sapiens
tccaaatgtcctccagaagcct

SEQ ID NO: 1452764 - DNA, 23 bp, Homo sapiens
tccaacaagaatgcattccctga

SEQ ID NO: 1452765 - DNA, 19 bp, Homo sapiens
tccaacaccacagacacac

SEQ ID NO: 1452766 - DNA, 20 bp, Homo sapiens
tccaacaccacagacacaca

SEQ ID NO: 1452767 - DNA, 21 bp, Homo sapiens
tccaacaccacagacacacac

SEQ ID NO: 1452768 - DNA, 22 bp, Homo sapiens
tccaacaccacagacacacaca

SEQ ID NO: 1452769 - DNA, 20 bp, Homo sapiens
tccaacatcacagcccagcc

SEQ ID NO: 1452770 - DNA, 18 bp, Homo sapiens
tccaacatttctcactga

SEQ ID NO: 1452771 - DNA, 21 bp, Homo sapiens
tccaacatttctcactgaaag

SEQ ID NO: 1452772 - DNA, 23 bp, Homo sapiens
tccaaccaaggaatttaaaactg

SEQ ID NO: 1452773 - DNA, 12 bp, Homo sapiens
tccaaccactgt

SEQ ID NO: 1452774 - DNA, 17 bp, Homo sapiens
tccaaccactgtgccac

SEQ ID NO: 1452775 - DNA, 17 bp, Homo sapiens
tccaaccagacctggaa

SEQ ID NO: 1452776 - DNA, 14 bp, Homo sapiens
tccaacccagccac

SEQ ID NO: 1452777 - DNA, 22 bp, Homo sapiens
tccaaccccccagcactgagga

SEQ ID NO: 1452778 - DNA, 23 bp, Homo sapiens
tccaacctaacccctttcctgcg

SEQ ID NO: 1452779 - DNA, 17 bp, Homo sapiens
tccaacctcacttcccg

SEQ ID NO: 1452780 - DNA, 13 bp, Homo sapiens
tccaacctcctgc

SEQ ID NO: 1452781 - DNA, 22 bp, Homo sapiens
tccaacctcctgctctgggacg

SEQ ID NO: 1452782 - DNA, 23 bp, Homo sapiens
tccaacctgaaggtcccctggca

SEQ ID NO: 1452783 - DNA, 14 bp, Homo sapiens
tccaacctggacaa

SEQ ID NO: 1452784 - DNA, 17 bp, Homo sapiens
tccaacctggacaacaa

SEQ ID NO: 1452785 - DNA, 19 bp, Homo sapiens
tccaacgcccctgtggcca

SEQ ID NO: 1452786 - DNA, 22 bp, Homo sapiens
tccaacgccgccttggccttgc

SEQ ID NO: 1452787 - DNA, 16 bp, Homo sapiens
tccaacgtggcccaga

SEQ ID NO: 1452788 - DNA, 13 bp, Homo sapiens
tccaactcaggtt

SEQ ID NO: 1452789 - DNA, 13 bp, Homo sapiens
tccaactccagga

SEQ ID NO: 1452790 - DNA, 19 bp, Homo sapiens
tccaactcctttcagccac

SEQ ID NO: 1452791 - DNA, 15 bp, Homo sapiens
tccaacttcatttga

SEQ ID NO: 1452792 - DNA, 20 bp, Homo sapiens
tccaactttcacagtgaagt

SEQ ID NO: 1452793 - DNA, 17 bp, Homo sapiens
tccaagaaactgaatga

SEQ ID NO: 1452794 - DNA, 18 bp, Homo sapiens
tccaagaactctaaccag

SEQ ID NO: 1452795 - DNA, 20 bp, Homo sapiens
tccaagaactctaaccagtg

SEQ ID NO: 1452796 - DNA, 22 bp, Homo sapiens
tccaagaactctaaccagtgta

SEQ ID NO: 1452797 - DNA, 23 bp, Homo sapiens
tccaagaacttgggataagagtg

SEQ ID NO: 1452798 - DNA, 12 bp, Homo sapiens
tccaagaatcta

SEQ ID NO: 1452799 - DNA, 18 bp, Homo sapiens
tccaagaatctatctgct

SEQ ID NO: 1452800 - DNA, 17 bp, Homo sapiens
tccaagaatggaagcct

SEQ ID NO: 1452801 - DNA, 18 bp, Homo sapiens
tccaagacagaataatga

SEQ ID NO: 1452802 - DNA, 23 bp, Homo sapiens
tccaagactctagagtccaaggt

SEQ ID NO: 1452803 - DNA, 13 bp, Homo sapiens
tccaagaggctgt

SEQ ID NO: 1452804 - DNA, 17 bp, Homo sapiens
tccaagagtctaaagat

SEQ ID NO: 1452805 - DNA, 12 bp, Homo sapiens
tccaagattcta

SEQ ID NO: 1452806 - DNA, 13 bp, Homo sapiens
tccaagattctag

SEQ ID NO: 1452807 - DNA, 17 bp, Homo sapiens
tccaagattctagatga

SEQ ID NO: 1452808 - DNA, 23 bp, Homo sapiens
tccaagcataccaacacgagcag

SEQ ID NO: 1452809 - DNA, 12 bp, Homo sapiens
tccaagcatttc

SEQ ID NO: 1452810 - DNA, 21 bp, Homo sapiens
tccaagcatttcatgaaaaag

SEQ ID NO: 1452811 - DNA, 19 bp, Homo sapiens
tccaagccccatcttctaa

SEQ ID NO: 1452812 - DNA, 23 bp, Homo sapiens
tccaagccccatcttctaaatgg

SEQ ID NO: 1452813 - DNA, 14 bp, Homo sapiens
tccaagcctccaca

SEQ ID NO: 1452814 - DNA, 14 bp, Homo sapiens
tccaagctaagcac

SEQ ID NO: 1452815 - DNA, 22 bp, Homo sapiens
tccaagctaagcactgccactg

SEQ ID NO: 1452816 - DNA, 22 bp, Homo sapiens
tccaaggaaacattttatcatt

SEQ ID NO: 1452817 - DNA, 17 bp, Homo sapiens
tccaagggacagcccac

SEQ ID NO: 1452818 - DNA, 14 bp, Homo sapiens
tccaagggccgtgc

SEQ ID NO: 1452819 - DNA, 18 bp, Homo sapiens
tccaagggccgtgccctt

SEQ ID NO: 1452820 - DNA, 20 bp, Homo sapiens
ccagctactcaggaggctga

SEQ ID NO: 1452821 - DNA, 21 bp, Homo sapiens
ccagctactcaggaggctgag

SEQ ID NO: 1452822 - DNA, 22 bp, Homo sapiens
ccagctactctgtccaggccac

SEQ ID NO: 1452823 - DNA, 15 bp, Homo sapiens
ccagctacttgggag

SEQ ID NO: 1452824 - DNA, 13 bp, Homo sapiens
ccagctcacagtg

SEQ ID NO: 1452825 - DNA, 21 bp, Homo sapiens
ccagctcacgtaatgcattgc

SEQ ID NO: 1452826 - DNA, 19 bp, Homo sapiens
ccagctcagaggcccagga

SEQ ID NO: 1452827 - DNA, 19 bp, Homo sapiens
ccagctcaggacagatgcc

SEQ ID NO: 1452828 - DNA, 20 bp, Homo sapiens
ccagctcaggacagatgcca

SEQ ID NO: 1452829 - DNA, 15 bp, Homo sapiens
ccagctccaacctgc

SEQ ID NO: 1452830 - DNA, 12 bp, Homo sapiens
ccagctccaggg

SEQ ID NO: 1452831 - DNA, 15 bp, Homo sapiens
ccagctccagggcca

SEQ ID NO: 1452832 - DNA, 18 bp, Homo sapiens
ccagctccagggccagat

SEQ ID NO: 1452833 - DNA, 17 bp, Homo sapiens
ccagctcccactccctt

SEQ ID NO: 1452834 - DNA, 17 bp, Homo sapiens
ccagctcccagggtgga

SEQ ID NO: 1452835 - DNA, 12 bp, Homo sapiens
ccagctccccag

SEQ ID NO: 1452836 - DNA, 21 bp, Homo sapiens
ccagctccccccgcccaccca

SEQ ID NO: 1452837 - DNA, 16 bp, Homo sapiens
ccagctccctctattt

SEQ ID NO: 1452838 - DNA, 15 bp, Homo sapiens
ccagctcctgaataa

SEQ ID NO: 1452839 - DNA, 22 bp, Homo sapiens
ccagctccttttgtccccaggg

SEQ ID NO: 1452840 - DNA, 23 bp, Homo sapiens
ccagctccttttgtccccagggc

SEQ ID NO: 1452841 - DNA, 12 bp, Homo sapiens
ccagctcgctgg

SEQ ID NO: 1452842 - DNA, 16 bp, Homo sapiens
ccagctcgctggcttt

SEQ ID NO: 1452843 - DNA, 18 bp, Homo sapiens
ccagctcgctggctttct

SEQ ID NO: 1452844 - DNA, 22 bp, Homo sapiens
ccagctcgctggctttctctct

SEQ ID NO: 1452845 - DNA, 17 bp, Homo sapiens
ccagctcgtgggctggg

SEQ ID NO: 1452846 - DNA, 16 bp, Homo sapiens
ccagctctactaccta

SEQ ID NO: 1452847 - DNA, 18 bp, Homo sapiens
ccagctctccctctggcc

SEQ ID NO: 1452848 - DNA, 20 bp, Homo sapiens
ccagctctccctctggccct

SEQ ID NO: 1452849 - DNA, 16 bp, Homo sapiens
ccagctctctgacgct

SEQ ID NO: 1452850 - DNA, 14 bp, Homo sapiens
ccagctctcttcct

SEQ ID NO: 1452851 - DNA, 16 bp, Homo sapiens
ccagctctcttcctgt

SEQ ID NO: 1452852 - DNA, 16 bp, Homo sapiens
ccagctctgacatccc

SEQ ID NO: 1452853 - DNA, 21 bp, Homo sapiens
ccagctctgacatcccttcct

SEQ ID NO: 1452854 - DNA, 22 bp, Homo sapiens
ccagctctgacatcccttcctg

SEQ ID NO: 1452855 - DNA, 22 bp, Homo sapiens
ccagctctgagacccttttctc

SEQ ID NO: 1452856 - DNA, 18 bp, Homo sapiens
ccagctctggatgaaggc

SEQ ID NO: 1452857 - DNA, 20 bp, Homo sapiens
ccagctctggatgaaggcaa

SEQ ID NO: 1452858 - DNA, 14 bp, Homo sapiens
ccagctctggcttc

SEQ ID NO: 1452859 - DNA, 12 bp, Homo sapiens
ccagctctgtgg

SEQ ID NO: 1452860 - DNA, 13 bp, Homo sapiens
ccagctctgtggc

SEQ ID NO: 1452861 - DNA, 15 bp, Homo sapiens
ccagctctgtggcct

SEQ ID NO: 1452862 - DNA, 19 bp, Homo sapiens
ccagctctgtggcctgtgt

SEQ ID NO: 1452863 - DNA, 20 bp, Homo sapiens
ccagctctgtggcctgtgtc

SEQ ID NO: 1452864 - DNA, 17 bp, Homo sapiens
ccagctcttctcttcct

SEQ ID NO: 1452865 - DNA, 18 bp, Homo sapiens
ccagctcttgctctcttg

SEQ ID NO: 1452866 - DNA, 19 bp, Homo sapiens
ccagctcttgctctcttgt

SEQ ID NO: 1452867 - DNA, 16 bp, Homo sapiens
ccagctgaaggcagtg

SEQ ID NO: 1452868 - DNA, 21 bp, Homo sapiens
ccagctgacatcttgaatcct

SEQ ID NO: 1452869 - DNA, 17 bp, Homo sapiens
ccagctgactaaacttt

SEQ ID NO: 1452870 - DNA, 13 bp, Homo sapiens
ccagctgactgtg

SEQ ID NO: 1452871 - DNA, 16 bp, Homo sapiens
ccagctgactgtggcc

SEQ ID NO: 1452872 - DNA, 20 bp, Homo sapiens
ccagctgactgtggccccct

SEQ ID NO: 1452873 - DNA, 19 bp, Homo sapiens
ccagctgcacctgccagcc

SEQ ID NO: 1452874 - DNA, 20 bp, Homo sapiens
ccagctgcacctgccagcct

SEQ ID NO: 1452875 - DNA, 16 bp, Homo sapiens
ccagctgcagaccatg

SEQ ID NO: 1452876 - DNA, 14 bp, Homo sapiens
ccagctgccaagtg

SEQ ID NO: 1452877 - DNA, 19 bp, Homo sapiens
ccagctgccaagtgctctt

SEQ ID NO: 1452878 - DNA, 16 bp, Homo sapiens
ccagctgccctatggg

SEQ ID NO: 1452879 - DNA, 18 bp, Homo sapiens
ccagctgccgaccagagc

SEQ ID NO: 1452880 - DNA, 12 bp, Homo sapiens
ccagctgccgcc

SEQ ID NO: 1452881 - DNA, 23 bp, Homo sapiens
ccagctgccgcccccggactctg

SEQ ID NO: 1452882 - DNA, 13 bp, Homo sapiens
ccagctgcctggg

SEQ ID NO: 1452883 - DNA, 14 bp, Homo sapiens
ccagctgcctgggc

SEQ ID NO: 1452884 - DNA, 16 bp, Homo sapiens
ccagctgcctgggccc

SEQ ID NO: 1452885 - DNA, 20 bp, Homo sapiens
ccagctgccttcctcatccc

SEQ ID NO: 1452886 - DNA, 19 bp, Homo sapiens
ccagctgcgcttgcttttc

SEQ ID NO: 1452887 - DNA, 21 bp, Homo sapiens
ccagctgcgcttgcttttctg

SEQ ID NO: 1452888 - DNA, 13 bp, Homo sapiens
ccagctgctgtct

SEQ ID NO: 1452889 - DNA, 16 bp, Homo sapiens
ccagctgctgtgcccc

SEQ ID NO: 1452890 - DNA, 12 bp, Homo sapiens
ccagctgctttt

SEQ ID NO: 1452891 - DNA, 15 bp, Homo sapiens
ccagctggcctggac

SEQ ID NO: 1452892 - DNA, 17 bp, Homo sapiens
ccagctgggagcactgg

SEQ ID NO: 1452893 - DNA, 14 bp, Homo sapiens
ccagctgggcccag

SEQ ID NO: 1452894 - DNA, 16 bp, Homo sapiens
ccagctgggcccagca

SEQ ID NO: 1452895 - DNA, 16 bp, Homo sapiens
ccagctgggcctcctg

SEQ ID NO: 1452896 - DNA, 19 bp, Homo sapiens
ccagctgggcctcctgcct

SEQ ID NO: 1452897 - DNA, 15 bp, Homo sapiens
ccagctgggctctgc

SEQ ID NO: 1452898 - DNA, 17 bp, Homo sapiens
ccagctgggctctgcca

SEQ ID NO: 1452899 - DNA, 21 bp, Homo sapiens
ccagctgggctctgccaccct

SEQ ID NO: 1452900 - DNA, 21 bp, Homo sapiens
ccagctggggcgtggggaggg

SEQ ID NO: 1452901 - DNA, 22 bp, Homo sapiens
ccagctggggcgtggggagggc

SEQ ID NO: 1452902 - DNA, 12 bp, Homo sapiens
ccagctggtggc

SEQ ID NO: 1452903 - DNA, 24 bp, Homo sapiens
ccagctggtggccctgtgcctggg

SEQ ID NO: 1452904 - DNA, 15 bp, Homo sapiens
ccagctgtagccatg

SEQ ID NO: 1452905 - DNA, 19 bp, Homo sapiens
ccagctgtagccatggctc

SEQ ID NO: 1452906 - DNA, 22 bp, Homo sapiens
ccagcttaaacccatacaatgt

SEQ ID NO: 1452907 - DNA, 19 bp, Homo sapiens
ccagcttagagttcttctt

SEQ ID NO: 1452908 - DNA, 11 bp, Homo sapiens
ccagcttcagc

SEQ ID NO: 1452909 - DNA, 12 bp, Homo sapiens
ccagcttcagct

SEQ ID NO: 1452910 - DNA, 18 bp, Homo sapiens
ccagcttccaaagcctag

SEQ ID NO: 1452911 - DNA, 21 bp, Homo sapiens
ccagcttcggagggcccctgc

SEQ ID NO: 1452912 - DNA, 14 bp, Homo sapiens
ccagcttgctcttc

SEQ ID NO: 1452913 - DNA, 16 bp, Homo sapiens
ccagcttgctcttcag

SEQ ID NO: 1452914 - DNA, 23 bp, Homo sapiens
ccagcttgctcttcagtgggaga

SEQ ID NO: 1452915 - DNA, 23 bp, Homo sapiens
ccagcttggctcacaaggcccag

SEQ ID NO: 1452916 - DNA, 22 bp, Homo sapiens
ccagcttgggcccagctgggct

SEQ ID NO: 1452917 - DNA, 23 bp, Homo sapiens
ccagcttgggcccagctgggctc

SEQ ID NO: 1452918 - DNA, 12 bp, Homo sapiens
ccaggcagagct

SEQ ID NO: 1452919 - DNA, 21 bp, Homo sapiens
ccaggcagagctgagggccct

SEQ ID NO: 1452920 - DNA, 13 bp, Homo sapiens
ccaggcagatcca

SEQ ID NO: 1452921 - DNA, 15 bp, Homo sapiens
ccaggcagatccagg

SEQ ID NO: 1452922 - DNA, 18 bp, Homo sapiens
ccaggcagatccaggact

SEQ ID NO: 1452923 - DNA, 17 bp, Homo sapiens
ccaggcagctccctcct

SEQ ID NO: 1452924 - DNA, 19 bp, Homo sapiens
ccaggcagctccctcctgc

SEQ ID NO: 1452925 - DNA, 13 bp, Homo sapiens
ccaggcaggccag

SEQ ID NO: 1452926 - DNA, 18 bp, Homo sapiens
ccaggcaggccaggctgc

SEQ ID NO: 1452927 - DNA, 20 bp, Homo sapiens
ccaggcagtcgggggctggc

SEQ ID NO: 1452928 - DNA, 22 bp, Homo sapiens
ccaggcagtcgggggctggcct

SEQ ID NO: 1452929 - DNA, 23 bp, Homo sapiens
ccaggcagtcgggggctggccta

SEQ ID NO: 1452930 - DNA, 21 bp, Homo sapiens
ccaggcatgaaattcttccta

SEQ ID NO: 1452931 - DNA, 15 bp, Homo sapiens
ccaggcattggctca

SEQ ID NO: 1452932 - DNA, 17 bp, Homo sapiens
ccaggccaacagtagcc

SEQ ID NO: 1452933 - DNA, 17 bp, Homo sapiens
ccaggccacctccccag

SEQ ID NO: 1452934 - DNA, 16 bp, Homo sapiens
ccaggccactgtggcc

SEQ ID NO: 1452935 - DNA, 20 bp, Homo sapiens
ccaggccactgtggccagag

SEQ ID NO: 1452936 - DNA, 22 bp, Homo sapiens
ccaggccactgtggccagagct

SEQ ID NO: 1452937 - DNA, 23 bp, Homo sapiens
ccaggccactgtggccagagctg

SEQ ID NO: 1452938 - DNA, 19 bp, Homo sapiens
ccaggccagagggcagtgg

SEQ ID NO: 1452939 - DNA, 17 bp, Homo sapiens
tcacagaggcttcttca

SEQ ID NO: 1452940 - DNA, 12 bp, Homo sapiens
tcacagagtcaa

SEQ ID NO: 1452941 - DNA, 16 bp, Homo sapiens
tcacagagtcaaggcc

SEQ ID NO: 1452942 - DNA, 21 bp, Homo sapiens
tcacagagtcaaggcctgctc

SEQ ID NO: 1452943 - DNA, 19 bp, Homo sapiens
tcacagagtgagactccat

SEQ ID NO: 1452944 - DNA, 23 bp, Homo sapiens
tcacagagtgagactccatctca

SEQ ID NO: 1452945 - DNA, 13 bp, Homo sapiens
tcacagcacagta

SEQ ID NO: 1452946 - DNA, 21 bp, Homo sapiens
tcacagcatggaggaggaggg

SEQ ID NO: 1452947 - DNA, 23 bp, Homo sapiens
tcacagccagactggcacagttt

SEQ ID NO: 1452948 - DNA, 13 bp, Homo sapiens
tcacagcggaggt

SEQ ID NO: 1452949 - DNA, 16 bp, Homo sapiens
tcacagcgtctgctca

SEQ ID NO: 1452950 - DNA, 11 bp, Homo sapiens
tcacagctact

SEQ ID NO: 1452951 - DNA, 11 bp, Homo sapiens
tcacagctcct

SEQ ID NO: 1452952 - DNA, 16 bp, Homo sapiens
tcacagctcctcccac

SEQ ID NO: 1452953 - DNA, 12 bp, Homo sapiens
tcacagctgcag

SEQ ID NO: 1452954 - DNA, 17 bp, Homo sapiens
tcacagctgcagctggg

SEQ ID NO: 1452955 - DNA, 15 bp, Homo sapiens
tcacagcttcagcca

SEQ ID NO: 1452956 - DNA, 16 bp, Homo sapiens
tcacagcttcagccag

SEQ ID NO: 1452957 - DNA, 15 bp, Homo sapiens
tcacagcttctccaa

SEQ ID NO: 1452958 - DNA, 13 bp, Homo sapiens
tcacaggcagtgc

SEQ ID NO: 1452959 - DNA, 17 bp, Homo sapiens
tcacaggcatcaggaat

SEQ ID NO: 1452960 - DNA, 17 bp, Homo sapiens
tcacaggccttgctttt

SEQ ID NO: 1452961 - DNA, 15 bp, Homo sapiens
tcacaggctgagaac

SEQ ID NO: 1452962 - DNA, 16 bp, Homo sapiens
tcacaggctgagaact

SEQ ID NO: 1452963 - DNA, 18 bp, Homo sapiens
tcacaggcttctgagcac

SEQ ID NO: 1452964 - DNA, 15 bp, Homo sapiens
tcacaggggcggggc

SEQ ID NO: 1452965 - DNA, 16 bp, Homo sapiens
tcacagggtgggcctc

SEQ ID NO: 1452966 - DNA, 21 bp, Homo sapiens
tcacagtactttccagcagtc

SEQ ID NO: 1452967 - DNA, 15 bp, Homo sapiens
tcacagtagagccag

SEQ ID NO: 1452968 - DNA, 17 bp, Homo sapiens
tcacagtagagccagct

SEQ ID NO: 1452969 - DNA, 20 bp, Homo sapiens
tcacagtagagccagcttgg

SEQ ID NO: 1452970 - DNA, 16 bp, Homo sapiens
tcacagtccaaccaga

SEQ ID NO: 1452971 - DNA, 20 bp, Homo sapiens
tcacagtccaaccagaaaca

SEQ ID NO: 1452972 - DNA, 14 bp, Homo sapiens
tcacagtgaagtgc

SEQ ID NO: 1452973 - DNA, 16 bp, Homo sapiens
tcacagtgacccttcc

SEQ ID NO: 1452974 - DNA, 17 bp, Homo sapiens
tcacagtgacccttccc

SEQ ID NO: 1452975 - DNA, 18 bp, Homo sapiens
tcacagtgacccttccca

SEQ ID NO: 1452976 - DNA, 20 bp, Homo sapiens
tcacagtgctcttttctcct

SEQ ID NO: 1452977 - DNA, 14 bp, Homo sapiens
tcacagtgttgcat

SEQ ID NO: 1452978 - DNA, 17 bp, Homo sapiens
tcacagtgttgcccagg

SEQ ID NO: 1452979 - DNA, 17 bp, Homo sapiens
tcacagttattacatac

SEQ ID NO: 1452980 - DNA, 16 bp, Homo sapiens
tcacagttcctcgccc

SEQ ID NO: 1452981 - DNA, 17 bp, Homo sapiens
tcacagttcctcgccct

SEQ ID NO: 1452982 - DNA, 15 bp, Homo sapiens
tcacagtttttcctg

SEQ ID NO: 1452983 - DNA, 17 bp, Homo sapiens
tcacagtttttcctgga

SEQ ID NO: 1452984 - DNA, 20 bp, Homo sapiens
tcacataaatggattaatta

SEQ ID NO: 1452985 - DNA, 23 bp, Homo sapiens
tcacataaatggattaattacta

SEQ ID NO: 1452986 - DNA, 19 bp, Homo sapiens
tcacataagctcagaatcc

SEQ ID NO: 1452987 - DNA, 13 bp, Homo sapiens
tcacatactgact

SEQ ID NO: 1452988 - DNA, 15 bp, Homo sapiens
tcacatagatgtccc

SEQ ID NO: 1452989 - DNA, 20 bp, Homo sapiens
tcacatagccaactctccca

SEQ ID NO: 1452990 - DNA, 15 bp, Homo sapiens
tcacatataacatgc

SEQ ID NO: 1452991 - DNA, 14 bp, Homo sapiens
tcacatatctagta

SEQ ID NO: 1452992 - DNA, 14 bp, Homo sapiens
tcacatattttaaa

SEQ ID NO: 1452993 - DNA, 13 bp, Homo sapiens
tcacatcacagga

SEQ ID NO: 1452994 - DNA, 16 bp, Homo sapiens
tcacatcagcaatttc

SEQ ID NO: 1452995 - DNA, 20 bp, Homo sapiens
tcacatcagtgaggagggat

SEQ ID NO: 1452996 - DNA, 24 bp, Homo sapiens
tcacatcagtgaggagggatgtgg

SEQ ID NO: 1452997 - DNA, 14 bp, Homo sapiens
tcacatccatccct

SEQ ID NO: 1452998 - DNA, 19 bp, Homo sapiens
tcacatcctggcctggcac

SEQ ID NO: 1452999 - DNA, 19 bp, Homo sapiens
tcacatcctgtgtttctag

SEQ ID NO: 1453000 - DNA, 17 bp, Homo sapiens
tcacatctttcacactt

SEQ ID NO: 1453001 - DNA, 22 bp, Homo sapiens
tcacatctttcacacttccacc

SEQ ID NO: 1453002 - DNA, 21 bp, Homo sapiens
tcacatgagtcaaaacaaagc

SEQ ID NO: 1453003 - DNA, 17 bp, Homo sapiens
tcacatgagttcttgaa

SEQ ID NO: 1453004 - DNA, 19 bp, Homo sapiens
tcacatgatgaaaaattat

SEQ ID NO: 1453005 - DNA, 15 bp, Homo sapiens
tcacatgccttgcaa

SEQ ID NO: 1453006 - DNA, 18 bp, Homo sapiens
tcacatgctaaagccagg

SEQ ID NO: 1453007 - DNA, 14 bp, Homo sapiens
tcacatgcttgaat

SEQ ID NO: 1453008 - DNA, 16 bp, Homo sapiens
tcacatggcctatgca

SEQ ID NO: 1453009 - DNA, 15 bp, Homo sapiens
tcacatgggacaaag

SEQ ID NO: 1453010 - DNA, 19 bp, Homo sapiens
tcacatggggcctggccca

SEQ ID NO: 1453011 - DNA, 20 bp, Homo sapiens
tcacattaatatttgctgac

SEQ ID NO: 1453012 - DNA, 22 bp, Homo sapiens
tcacattcctctgcccttcctg

SEQ ID NO: 1453013 - DNA, 17 bp, Homo sapiens
tcacattgctgtatttt

SEQ ID NO: 1453014 - DNA, 16 bp, Homo sapiens
tcacatttgatgtaca

SEQ ID NO: 1453015 - DNA, 18 bp, Homo sapiens
tcacatttgatgtacatg

SEQ ID NO: 1453016 - DNA, 21 bp, Homo sapiens
tcacattttattaaacacagg

SEQ ID NO: 1453017 - DNA, 11 bp, Homo sapiens
tcacattttcc

SEQ ID NO: 1453018 - DNA, 22 bp, Homo sapiens
tcacatttttatacctgtttaa

SEQ ID NO: 1453019 - DNA, 16 bp, Homo sapiens
tcaccaaaatttctac

SEQ ID NO: 1453020 - DNA, 20 bp, Homo sapiens
tcaccaaatcagctgctact

SEQ ID NO: 1453021 - DNA, 13 bp, Homo sapiens
tcaccaactttta

SEQ ID NO: 1453022 - DNA, 17 bp, Homo sapiens
tcaccaagcaagtccct

SEQ ID NO: 1453023 - DNA, 20 bp, Homo sapiens
tcaccaagctcacagttcct

SEQ ID NO: 1453024 - DNA, 22 bp, Homo sapiens
tcaccaagctcacagttcctcg

SEQ ID NO: 1453025 - DNA, 21 bp, Homo sapiens
tcaccacagtaagttcctact

SEQ ID NO: 1453026 - DNA, 24 bp, Homo sapiens
tcaccaccaataaatcagaccatg

SEQ ID NO: 1453027 - DNA, 11 bp, Homo sapiens
tcaccaccccc

SEQ ID NO: 1453028 - DNA, 14 bp, Homo sapiens
ccaataaaggcagc

SEQ ID NO: 1453029 - DNA, 19 bp, Homo sapiens
ccaataaaggcagctgcct

SEQ ID NO: 1453030 - DNA, 21 bp, Homo sapiens
ccaataaatgtttgttattta

SEQ ID NO: 1453031 - DNA, 15 bp, Homo sapiens
ccaataaatttgtaa

SEQ ID NO: 1453032 - DNA, 16 bp, Homo sapiens
ccaataaatttgtaac

SEQ ID NO: 1453033 - DNA, 14 bp, Homo sapiens
ccaataacattctt

SEQ ID NO: 1453034 - DNA, 22 bp, Homo sapiens
ccaataataaatgccctcttct

SEQ ID NO: 1453035 - DNA, 23 bp, Homo sapiens
ccaataataaatgccctcttctc

SEQ ID NO: 1453036 - DNA, 13 bp, Homo sapiens
ccaatatattctg

SEQ ID NO: 1453037 - DNA, 22 bp, Homo sapiens
ccaatattaacacgctgcctgg

SEQ ID NO: 1453038 - DNA, 22 bp, Homo sapiens
ccaatcaacagcatgtctactg

SEQ ID NO: 1453039 - DNA, 17 bp, Homo sapiens
ccaatcagcactgaaaa

SEQ ID NO: 1453040 - DNA, 20 bp, Homo sapiens
ccaatcagcttttgttctag

SEQ ID NO: 1453041 - DNA, 14 bp, Homo sapiens
ccaatcattttaat

SEQ ID NO: 1453042 - DNA, 17 bp, Homo sapiens
ccaatcccctccttggg

SEQ ID NO: 1453043 - DNA, 21 bp, Homo sapiens
ccaatcccctccttgggcact

SEQ ID NO: 1453044 - DNA, 14 bp, Homo sapiens
ccaatcctctctcc

SEQ ID NO: 1453045 - DNA, 15 bp, Homo sapiens
ccaatcggactgcca

SEQ ID NO: 1453046 - DNA, 19 bp, Homo sapiens
ccaatcggactgccaaatt

SEQ ID NO: 1453047 - DNA, 15 bp, Homo sapiens
ccaatcgggtccaga

SEQ ID NO: 1453048 - DNA, 19 bp, Homo sapiens
ccaatctattgcttcacca

SEQ ID NO: 1453049 - DNA, 12 bp, Homo sapiens
ccaatgaataat

SEQ ID NO: 1453050 - DNA, 18 bp, Homo sapiens
ccaatgaattattatata

SEQ ID NO: 1453051 - DNA, 17 bp, Homo sapiens
ccaatgacacccatgcc

SEQ ID NO: 1453052 - DNA, 17 bp, Homo sapiens
ccaatgacttccctgct

SEQ ID NO: 1453053 - DNA, 14 bp, Homo sapiens
ccaatgcattggcc

SEQ ID NO: 1453054 - DNA, 19 bp, Homo sapiens
tcagcatttgatttccatg

SEQ ID NO: 1453055 - DNA, 16 bp, Homo sapiens
tcagccaaatgcaggg

SEQ ID NO: 1453056 - DNA, 14 bp, Homo sapiens
tcagccaaatgtaa

SEQ ID NO: 1453057 - DNA, 17 bp, Homo sapiens
tcagccacacccaggca

SEQ ID NO: 1453058 - DNA, 16 bp, Homo sapiens
tcagccacactgggcc

SEQ ID NO: 1453059 - DNA, 15 bp, Homo sapiens
tcagccacagcctga

SEQ ID NO: 1453060 - DNA, 19 bp, Homo sapiens
tcagccacatgccccaggc

SEQ ID NO: 1453061 - DNA, 21 bp, Homo sapiens
tcagccacatgccccaggctc

SEQ ID NO: 1453062 - DNA, 23 bp, Homo sapiens
tcagccaccatcctattgcaaag

SEQ ID NO: 1453063 - DNA, 15 bp, Homo sapiens
tcagccactgggacc

SEQ ID NO: 1453064 - DNA, 18 bp, Homo sapiens
tcagccagtggcacagga

SEQ ID NO: 1453065 - DNA, 16 bp, Homo sapiens
tcagccagtggggatg

SEQ ID NO: 1453066 - DNA, 17 bp, Homo sapiens
tcagccatttccccctc

SEQ ID NO: 1453067 - DNA, 19 bp, Homo sapiens
tcagccatttccccctcct

SEQ ID NO: 1453068 - DNA, 20 bp, Homo sapiens
tcagccatttccccctcctc

SEQ ID NO: 1453069 - DNA, 13 bp, Homo sapiens
tcagcccagcacc

SEQ ID NO: 1453070 - DNA, 16 bp, Homo sapiens
tcagcccagcacctgc

SEQ ID NO: 1453071 - DNA, 19 bp, Homo sapiens
tcagcccagcacctgctcc

SEQ ID NO: 1453072 - DNA, 20 bp, Homo sapiens
tcagcccagcacctgctccc

SEQ ID NO: 1453073 - DNA, 23 bp, Homo sapiens
tcagcccagcacctgctcccagt

SEQ ID NO: 1453074 - DNA, 18 bp, Homo sapiens
tcagccccaccctggcct

SEQ ID NO: 1453075 - DNA, 20 bp, Homo sapiens
tcagccccactgacacccag

SEQ ID NO: 1453076 - DNA, 14 bp, Homo sapiens
tcagcccccaccag

SEQ ID NO: 1453077 - DNA, 16 bp, Homo sapiens
tcagccccgacttcct

SEQ ID NO: 1453078 - DNA, 13 bp, Homo sapiens
tcagcccctcctc

SEQ ID NO: 1453079 - DNA, 17 bp, Homo sapiens
tcagcccctcctctgcc

SEQ ID NO: 1453080 - DNA, 17 bp, Homo sapiens
tcagcccgtttcagaag

SEQ ID NO: 1453081 - DNA, 14 bp, Homo sapiens
tcagccctcagaag

SEQ ID NO: 1453082 - DNA, 13 bp, Homo sapiens
tcagccctccctg

SEQ ID NO: 1453083 - DNA, 16 bp, Homo sapiens
tcagccctccctgccc

SEQ ID NO: 1453084 - DNA, 14 bp, Homo sapiens
tcagccctgcacca

SEQ ID NO: 1453085 - DNA, 16 bp, Homo sapiens
tcagccctggccctgc

SEQ ID NO: 1453086 - DNA, 23 bp, Homo sapiens
tcagccctgggccccaccaccta

SEQ ID NO: 1453087 - DNA, 19 bp, Homo sapiens
tcagccgagccgggcctgg

SEQ ID NO: 1453088 - DNA, 21 bp, Homo sapiens
tcagccgagccgggcctgggg

SEQ ID NO: 1453089 - DNA, 22 bp, Homo sapiens
tcagccgtagggtggcactggg

SEQ ID NO: 1453090 - DNA, 23 bp, Homo sapiens
tcagcctaccgctggccctgccg

SEQ ID NO: 1453091 - DNA, 18 bp, Homo sapiens
tcagcctagccgacctca

SEQ ID NO: 1453092 - DNA, 17 bp, Homo sapiens
tcagcctcatcctgaga

SEQ ID NO: 1453093 - DNA, 18 bp, Homo sapiens
tcagcctccaatgcattg

SEQ ID NO: 1453094 - DNA, 16 bp, Homo sapiens
tcagcctcccaaagtg

SEQ ID NO: 1453095 - DNA, 21 bp, Homo sapiens
tcagcctcccaaccccagggc

SEQ ID NO: 1453096 - DNA, 20 bp, Homo sapiens
tcagcctcccgagtagctgg

SEQ ID NO: 1453097 - DNA, 20 bp, Homo sapiens
tcagcctccctagtagctgg

SEQ ID NO: 1453098 - DNA, 12 bp, Homo sapiens
tcagcctcctga

SEQ ID NO: 1453099 - DNA, 21 bp, Homo sapiens
tcagcctctcaagtagctggg

SEQ ID NO: 1453100 - DNA, 11 bp, Homo sapiens
tcagcctgagt

SEQ ID NO: 1453101 - DNA, 12 bp, Homo sapiens
tcagcctggaag

SEQ ID NO: 1453102 - DNA, 18 bp, Homo sapiens
tcagcctggccagacaca

SEQ ID NO: 1453103 - DNA, 14 bp, Homo sapiens
tcagcctgtaccgg

SEQ ID NO: 1453104 - DNA, 19 bp, Homo sapiens
tcagcctgttccagaagga

SEQ ID NO: 1453105 - DNA, 20 bp, Homo sapiens
tcagcctgttccagaaggag

SEQ ID NO: 1453106 - DNA, 21 bp, Homo sapiens
tcagccttccccttgcccagg

SEQ ID NO: 1453107 - DNA, 22 bp, Homo sapiens
tcagccttccccttgcccaggg

SEQ ID NO: 1453108 - DNA, 14 bp, Homo sapiens
tcagccttctcctc

SEQ ID NO: 1453109 - DNA, 18 bp, Homo sapiens
tcagccttgaaaaacaag

SEQ ID NO: 1453110 - DNA, 21 bp, Homo sapiens
tcagccttgaaaaacaagtct

SEQ ID NO: 1453111 - DNA, 22 bp, Homo sapiens
tcagccttgctgctctgcgtgg

SEQ ID NO: 1453112 - DNA, 14 bp, Homo sapiens
tcagcgagaggcag

SEQ ID NO: 1453113 - DNA, 16 bp, Homo sapiens
tcagcgcaccaaaact

SEQ ID NO: 1453114 - DNA, 18 bp, Homo sapiens
tcagcggggcgagctgag

SEQ ID NO: 1453115 - DNA, 20 bp, Homo sapiens
tcagcgggtctcctcccagc

SEQ ID NO: 1453116 - DNA, 14 bp, Homo sapiens
tcagcgttttgcaa

SEQ ID NO: 1453117 - DNA, 20 bp, Homo sapiens
tcagctactaatgatgtttt

SEQ ID NO: 1453118 - DNA, 14 bp, Homo sapiens
tcagctccaggtgg

SEQ ID NO: 1453119 - DNA, 22 bp, Homo sapiens
tcagctcccaggccaacagtag

SEQ ID NO: 1453120 - DNA, 17 bp, Homo sapiens
tcagctcccctcggaga

SEQ ID NO: 1453121 - DNA, 22 bp, Homo sapiens
tcagctcccctcggagaagagc

SEQ ID NO: 1453122 - DNA, 19 bp, Homo sapiens
tcagctctctgccctgtgt

SEQ ID NO: 1453123 - DNA, 22 bp, Homo sapiens
tcagctctctgggacctcctta

SEQ ID NO: 1453124 - DNA, 13 bp, Homo sapiens
tcagctgaattca

SEQ ID NO: 1453125 - DNA, 19 bp, Homo sapiens
tcagctgagcttgagctcc

SEQ ID NO: 1453126 - DNA, 22 bp, Homo sapiens
tcagctgcaaggtactctggtg

SEQ ID NO: 1453127 - DNA, 22 bp, Homo sapiens
tcagctgcaatccatttatttc

SEQ ID NO: 1453128 - DNA, 15 bp, Homo sapiens
tcagctgcacattcc

SEQ ID NO: 1453129 - DNA, 22 bp, Homo sapiens
tcagctgcacattcctggcccc

SEQ ID NO: 1453130 - DNA, 18 bp, Homo sapiens
tcagctgcattccgcagc

SEQ ID NO: 1453131 - DNA, 20 bp, Homo sapiens
tcagctgcattccgcagccc

SEQ ID NO: 1453132 - DNA, 16 bp, Homo sapiens
tcagctgccaagcact

SEQ ID NO: 1453133 - DNA, 16 bp, Homo sapiens
tcagctgcccatccca

SEQ ID NO: 1453134 - DNA, 19 bp, Homo sapiens
tcagctgcccatcccagtc

SEQ ID NO: 1453135 - DNA, 21 bp, Homo sapiens
tcagctgcccatcccagtccc

SEQ ID NO: 1453136 - DNA, 16 bp, Homo sapiens
tcagctgctgaaacaa

SEQ ID NO: 1453137 - DNA, 20 bp, Homo sapiens
tcagctggcagtgcaatgct

SEQ ID NO: 1453138 - DNA, 22 bp, Homo sapiens
tcagctggctgagacactgaag

SEQ ID NO: 1453139 - DNA, 23 bp, Homo sapiens
tcagctgggtcacatccatccct

SEQ ID NO: 1453140 - DNA, 14 bp, Homo sapiens
tcagctgtggggaa

SEQ ID NO: 1453141 - DNA, 21 bp, Homo sapiens
tcagctgtggggaacacagct

SEQ ID NO: 1453142 - DNA, 15 bp, Homo sapiens
tcagctgtttgtcat

SEQ ID NO: 1453143 - DNA, 17 bp, Homo sapiens
tcagcttaataagtatt

SEQ ID NO: 1453144 - DNA, 16 bp, Homo sapiens
tcagcttatgggatcc

SEQ ID NO: 1453145 - DNA, 19 bp, Homo sapiens
tcagcttcctgctgctggg

SEQ ID NO: 1453146 - DNA, 21 bp, Homo sapiens
tcagcttcgtttattttcaag

SEQ ID NO: 1453147 - DNA, 21 bp, Homo sapiens
tcagcttcttcacaggcactc

SEQ ID NO: 1453148 - DNA, 16 bp, Homo sapiens
tcagcttgtttctata

SEQ ID NO: 1453149 - DNA, 21 bp, Homo sapiens
tcagcttgtttctatactgtt

SEQ ID NO: 1453150 - DNA, 18 bp, Homo sapiens
tcagctttcagagccagt

SEQ ID NO: 1453151 - DNA, 19 bp, Homo sapiens
tcagctttcagagccagtg

SEQ ID NO: 1453152 - DNA, 15 bp, Homo sapiens
tcagctttgataatt

SEQ ID NO: 1453153 - DNA, 17 bp, Homo sapiens
tcagcttttgttctaga

SEQ ID NO: 1453154 - DNA, 18 bp, Homo sapiens
tcagcttttgttgtttat

SEQ ID NO: 1453155 - DNA, 13 bp, Homo sapiens
tcaggaaaaatga

SEQ ID NO: 1453156 - DNA, 14 bp, Homo sapiens
tcaggaaagacgga

SEQ ID NO: 1453157 - DNA, 21 bp, Homo sapiens
tcaggaaatatatatgtgtgt

SEQ ID NO: 1453158 - DNA, 20 bp, Homo sapiens
tcaggaaatcaaatatgcaa

SEQ ID NO: 1453159 - DNA, 21 bp, Homo sapiens
tcaggaaatcaaatatgcaaa

SEQ ID NO: 1453160 - DNA, 16 bp, Homo sapiens
tcaactgtattgggcc

SEQ ID NO: 1453161 - DNA, 12 bp, Homo sapiens
tcaacttaacat

SEQ ID NO: 1453162 - DNA, 15 bp, Homo sapiens
tcaacttaataagat

SEQ ID NO: 1453163 - DNA, 19 bp, Homo sapiens
tcaacttgcatccaactcc

SEQ ID NO: 1453164 - DNA, 13 bp, Homo sapiens
tcaactttgtaaa

SEQ ID NO: 1453165 - DNA, 19 bp, Homo sapiens
tcaactttgtaaaaatctt

SEQ ID NO: 1453166 - DNA, 13 bp, Homo sapiens
tcaagaaacagcc

SEQ ID NO: 1453167 - DNA, 15 bp, Homo sapiens
tcaagaaacagccag

SEQ ID NO: 1453168 - DNA, 18 bp, Homo sapiens
tcaagaaacagccagcaa

SEQ ID NO: 1453169 - DNA, 20 bp, Homo sapiens
tcaagaaactgaggaatttt

SEQ ID NO: 1453170 - DNA, 22 bp, Homo sapiens
tcaagaaatatactctcccaga

SEQ ID NO: 1453171 - DNA, 14 bp, Homo sapiens
tcaagaacaagcaa

SEQ ID NO: 1453172 - DNA, 14 bp, Homo sapiens
tcaagaacctggaa

SEQ ID NO: 1453173 - DNA, 18 bp, Homo sapiens
tcaagaagaaaaaggttt

SEQ ID NO: 1453174 - DNA, 19 bp, Homo sapiens
tcaagaagtcttgaagttg

SEQ ID NO: 1453175 - DNA, 22 bp, Homo sapiens
tcaagaagtgaagaatgcacaa

SEQ ID NO: 1453176 - DNA, 21 bp, Homo sapiens
tcaagaataatcacgctttcc

SEQ ID NO: 1453177 - DNA, 20 bp, Homo sapiens
tcaagaatctagaagatgtg

SEQ ID NO: 1453178 - DNA, 21 bp, Homo sapiens
tcaagaatctagaagatgtgt

SEQ ID NO: 1453179 - DNA, 21 bp, Homo sapiens
tcaagacagattgtgaagatt

SEQ ID NO: 1453180 - DNA, 16 bp, Homo sapiens
tcaagacagggaagga

SEQ ID NO: 1453181 - DNA, 17 bp, Homo sapiens
tcaagacattaaatcta

SEQ ID NO: 1453182 - DNA, 20 bp, Homo sapiens
tcaagacattaaatctatga

SEQ ID NO: 1453183 - DNA, 14 bp, Homo sapiens
tcaagacatttgct

SEQ ID NO: 1453184 - DNA, 15 bp, Homo sapiens
tcaagaccagcctgt

SEQ ID NO: 1453185 - DNA, 19 bp, Homo sapiens
tcaagaccaggctgcagcc

SEQ ID NO: 1453186 - DNA, 16 bp, Homo sapiens
tcaagacgaggggcag

SEQ ID NO: 1453187 - DNA, 16 bp, Homo sapiens
tcaagactgaattcca

SEQ ID NO: 1453188 - DNA, 15 bp, Homo sapiens
tcaagactttagctt

SEQ ID NO: 1453189 - DNA, 11 bp, Homo sapiens
tcaagagaaac

SEQ ID NO: 1453190 - DNA, 21 bp, Homo sapiens
tcaagagatctttctttccaa

SEQ ID NO: 1453191 - DNA, 15 bp, Homo sapiens
tcaagagatttaatt

SEQ ID NO: 1453192 - DNA, 21 bp, Homo sapiens
tcaagagcattgcttttgttt

SEQ ID NO: 1453193 - DNA, 15 bp, Homo sapiens
tcaagagcctcccct

SEQ ID NO: 1453194 - DNA, 12 bp, Homo sapiens
tcaagaggaatc

SEQ ID NO: 1453195 - DNA, 22 bp, Homo sapiens
tcaagaggaatctgtttctctg

SEQ ID NO: 1453196 - DNA, 23 bp, Homo sapiens
tcaagaggaatctgtttctctgc

SEQ ID NO: 1453197 - DNA, 16 bp, Homo sapiens
tcaagaggcagagttc

SEQ ID NO: 1453198 - DNA, 19 bp, Homo sapiens
tcaagagtccggatttcta

SEQ ID NO: 1453199 - DNA, 21 bp, Homo sapiens
tcaagagtccggatttctaac

SEQ ID NO: 1453200 - DNA, 19 bp, Homo sapiens
tcaagatgggggcagggct

SEQ ID NO: 1453201 - DNA, 20 bp, Homo sapiens
tcaagatgggggcagggctg

SEQ ID NO: 1453202 - DNA, 18 bp, Homo sapiens
tcaagatgtcagactggc

SEQ ID NO: 1453203 - DNA, 14 bp, Homo sapiens
tcaagattctaaag

SEQ ID NO: 1453204 - DNA, 16 bp, Homo sapiens
tcaagattctaaagct

SEQ ID NO: 1453205 - DNA, 17 bp, Homo sapiens
tcaagattctaaagctc

SEQ ID NO: 1453206 - DNA, 18 bp, Homo sapiens
tcaagattctaaagctca

SEQ ID NO: 1453207 - DNA, 20 bp, Homo sapiens
tcaagattctaaagctcaat

SEQ ID NO: 1453208 - DNA, 14 bp, Homo sapiens
tcaagcaataattg

SEQ ID NO: 1453209 - DNA, 18 bp, Homo sapiens
tcaagcaataattgtttc

SEQ ID NO: 1453210 - DNA, 18 bp, Homo sapiens
tcaagcacactggaatat

SEQ ID NO: 1453211 - DNA, 20 bp, Homo sapiens
tcaagcacatgtaataaatt

SEQ ID NO: 1453212 - DNA, 15 bp, Homo sapiens
tcaagcacttcccag

SEQ ID NO: 1453213 - DNA, 18 bp, Homo sapiens
tcaagcagcgaccgcccc

SEQ ID NO: 1453214 - DNA, 17 bp, Homo sapiens
tcaagcaggaattatgt

SEQ ID NO: 1453215 - DNA, 22 bp, Homo sapiens
tcaagcagtcgtgcctgtgtcc

SEQ ID NO: 1453216 - DNA, 16 bp, Homo sapiens
tcaagccaatcccctc

SEQ ID NO: 1453217 - DNA, 19 bp, Homo sapiens
tcaagccagccccctccag

SEQ ID NO: 1453218 - DNA, 12 bp, Homo sapiens
tcaagcccaggc

SEQ ID NO: 1453219 - DNA, 23 bp, Homo sapiens
tcaagccccaccacatagcatgc

SEQ ID NO: 1453220 - DNA, 18 bp, Homo sapiens
tcaagccccatttcctca

SEQ ID NO: 1453221 - DNA, 14 bp, Homo sapiens
tcaagcctgcctag

SEQ ID NO: 1453222 - DNA, 15 bp, Homo sapiens
tcaagcctgtgaata

SEQ ID NO: 1453223 - DNA, 18 bp, Homo sapiens
tcaagcctttatggctgc

SEQ ID NO: 1453224 - DNA, 20 bp, Homo sapiens
tcaagcgattctcccgcctc

SEQ ID NO: 1453225 - DNA, 20 bp, Homo sapiens
tcaagcgattctcctgtctc

SEQ ID NO: 1453226 - DNA, 16 bp, Homo sapiens
tcaagctagccagagg

SEQ ID NO: 1453227 - DNA, 22 bp, Homo sapiens
tcaagctattctcatgcctcag

SEQ ID NO: 1453228 - DNA, 16 bp, Homo sapiens
tcaagctctgcaacag

SEQ ID NO: 1453229 - DNA, 19 bp, Homo sapiens
tcaagctgtcccctctgtc

SEQ ID NO: 1453230 - DNA, 20 bp, Homo sapiens
tcaagctgtcccctctgtca

SEQ ID NO: 1453231 - DNA, 17 bp, Homo sapiens
tcaagctttcaaatcct

SEQ ID NO: 1453232 - DNA, 20 bp, Homo sapiens
tcaaggaaaagatcattaaa

SEQ ID NO: 1453233 - DNA, 20 bp, Homo sapiens
tcaaggaaaggctcatttaa

SEQ ID NO: 1453234 - DNA, 20 bp, Homo sapiens
tcaaggaaagggggtcccag

SEQ ID NO: 1453235 - DNA, 21 bp, Homo sapiens
tcaaggaaagggggtcccagt

SEQ ID NO: 1453236 - DNA, 20 bp, Homo sapiens
tcaaggaacagccacaaaat

SEQ ID NO: 1453237 - DNA, 19 bp, Homo sapiens
tcaaggactgaattgtttt

SEQ ID NO: 1453238 - DNA, 19 bp, Homo sapiens
tcaaggagaccatgtatgt

SEQ ID NO: 1453239 - DNA, 15 bp, Homo sapiens
tcaaggagcccagaa

SEQ ID NO: 1453240 - DNA, 13 bp, Homo sapiens
tcaaggccacctc

SEQ ID NO: 1453241 - DNA, 19 bp, Homo sapiens
tcaaggccacctctgcctc

SEQ ID NO: 1453242 - DNA, 13 bp, Homo sapiens
tcaaggcctgctc

SEQ ID NO: 1453243 - DNA, 13 bp, Homo sapiens
tcaaggccttcag

SEQ ID NO: 1453244 - DNA, 16 bp, Homo sapiens
tcaaggccttcagttt

SEQ ID NO: 1453245 - DNA, 23 bp, Homo sapiens
tcaaggcgggagggcctgcagtg

SEQ ID NO: 1453246 - DNA, 12 bp, Homo sapiens
tcaaggctcaga

SEQ ID NO: 1453247 - DNA, 16 bp, Homo sapiens
tcaagggggactgtct

SEQ ID NO: 1453248 - DNA, 21 bp, Homo sapiens
tcaagggtggcaggtcactgt

SEQ ID NO: 1453249 - DNA, 14 bp, Homo sapiens
tcaaggtccattat

SEQ ID NO: 1453250 - DNA, 22 bp, Homo sapiens
tcaaggttactgggagtgtggg

SEQ ID NO: 1453251 - DNA, 22 bp, Homo sapiens
tcaaggtttaaccttaaaatta

SEQ ID NO: 1453252 - DNA, 15 bp, Homo sapiens
tcaaggttttaaaac

SEQ ID NO: 1453253 - DNA, 13 bp, Homo sapiens
tcaaggttttagg

SEQ ID NO: 1453254 - DNA, 22 bp, Homo sapiens
tcaaggttttaggttctaaagt

SEQ ID NO: 1453255 - DNA, 18 bp, Homo sapiens
tcaagtaagaagacatga

SEQ ID NO: 1453256 - DNA, 19 bp, Homo sapiens
tcaagtacccattctgttt

SEQ ID NO: 1453257 - DNA, 23 bp, Homo sapiens
tcaagtactgttttgaagctggg

SEQ ID NO: 1453258 - DNA, 18 bp, Homo sapiens
tcaagtagactactgttc

SEQ ID NO: 1453259 - DNA, 18 bp, Homo sapiens
tcaagtattgagaacctg

SEQ ID NO: 1453260 - DNA, 17 bp, Homo sapiens
tcaagtccatctgacaa

SEQ ID NO: 1453261 - DNA, 19 bp, Homo sapiens
tcaagtccatctgacaaaa

SEQ ID NO: 1453262 - DNA, 14 bp, Homo sapiens
tcaagtctctgctg

SEQ ID NO: 1453263 - DNA, 17 bp, Homo sapiens
tcaagtctctgctggcc

SEQ ID NO: 1453264 - DNA, 12 bp, Homo sapiens
tcaagtcttccc

SEQ ID NO: 1453265 - DNA, 22 bp, Homo sapiens
tcaagtgcatgctctctgcagc

SEQ ID NO: 1453266 - DNA, 11 bp, Homo sapiens
tcaagtgccta

SEQ ID NO: 1453267 - DNA, 17 bp, Homo sapiens
tcaagtgcctcttgttg

SEQ ID NO: 1453268 - DNA, 20 bp, Homo sapiens
tcaagtgttaggtcaataac

SEQ ID NO: 1453269 - DNA, 16 bp, Homo sapiens
tcaagttaacaaggaa

SEQ ID NO: 1453270 - DNA, 15 bp, Homo sapiens
tcaagttagctcagg

SEQ ID NO: 1453271 - DNA, 20 bp, Homo sapiens
tcaagttattcaaatttgta

SEQ ID NO: 1453272 - DNA, 21 bp, Homo sapiens
tcaagttattcaaatttgtac

SEQ ID NO: 1453273 - DNA, 23 bp, Homo sapiens
tcaagttcccaactgagtcatct

SEQ ID NO: 1453274 - DNA, 14 bp, Homo sapiens
tcaagttctaagat

SEQ ID NO: 1453275 - DNA, 21 bp, Homo sapiens
tcaagttgtaacttatattga

SEQ ID NO: 1453276 - DNA, 20 bp, Homo sapiens
ccaagattccggatcctaag

SEQ ID NO: 1453277 - DNA, 22 bp, Homo sapiens
ccaagattctactcttgtcatt

SEQ ID NO: 1453278 - DNA, 13 bp, Homo sapiens
ccaagattctaga

SEQ ID NO: 1453279 - DNA, 19 bp, Homo sapiens
ccaagcaaattaggaacct

SEQ ID NO: 1453280 - DNA, 22 bp, Homo sapiens
ccaagcactcgagaccatcctg

SEQ ID NO: 1453281 - DNA, 12 bp, Homo sapiens
ccaagcactgct

SEQ ID NO: 1453282 - DNA, 14 bp, Homo sapiens
ccaagcactgctca

SEQ ID NO: 1453283 - DNA, 23 bp, Homo sapiens
ccaagcactgctcacgtctctgc

SEQ ID NO: 1453284 - DNA, 11 bp, Homo sapiens
ccaagcagaaa

SEQ ID NO: 1453285 - DNA, 11 bp, Homo sapiens
ccaagcagcca

SEQ ID NO: 1453286 - DNA, 15 bp, Homo sapiens
ccaagcagccagcca

SEQ ID NO: 1453287 - DNA, 18 bp, Homo sapiens
ccaagcagtgcctgccta

SEQ ID NO: 1453288 - DNA, 20 bp, Homo sapiens
ccaagcagtgcctgcctatg

SEQ ID NO: 1453289 - DNA, 13 bp, Homo sapiens
ccaagcatagaga

SEQ ID NO: 1453290 - DNA, 18 bp, Homo sapiens
ccaagcatcaccctggga

SEQ ID NO: 1453291 - DNA, 23 bp, Homo sapiens
ccaagcatcttgggggggtggcc

SEQ ID NO: 1453292 - DNA, 14 bp, Homo sapiens
ccaagcatttcatg

SEQ ID NO: 1453293 - DNA, 16 bp, Homo sapiens
ccaagccagaggctgg

SEQ ID NO: 1453294 - DNA, 19 bp, Homo sapiens
ccaagccagattctcttga

SEQ ID NO: 1453295 - DNA, 13 bp, Homo sapiens
ccaagccccatct

SEQ ID NO: 1453296 - DNA, 19 bp, Homo sapiens
ccaagccccatctcatcct

SEQ ID NO: 1453297 - DNA, 20 bp, Homo sapiens
ccaagccccatctcatcctg

SEQ ID NO: 1453298 - DNA, 22 bp, Homo sapiens
ccaagccccatctcatcctggc

SEQ ID NO: 1453299 - DNA, 22 bp, Homo sapiens
ccaagcccgacttgctgttttg

SEQ ID NO: 1453300 - DNA, 14 bp, Homo sapiens
ccaagccgtggctt

SEQ ID NO: 1453301 - DNA, 14 bp, Homo sapiens
ccaagcctccacag

SEQ ID NO: 1453302 - DNA, 13 bp, Homo sapiens
ccaagcctgacca

SEQ ID NO: 1453303 - DNA, 13 bp, Homo sapiens
ccaagcctgcctc

SEQ ID NO: 1453304 - DNA, 15 bp, Homo sapiens
ccaagcctgctggct

SEQ ID NO: 1453305 - DNA, 21 bp, Homo sapiens
ccaagcgaggtcaacagagaa

SEQ ID NO: 1453306 - DNA, 19 bp, Homo sapiens
ccaagcgttcctggccttc

SEQ ID NO: 1453307 - DNA, 17 bp, Homo sapiens
ccaagctaagcactgcc

SEQ ID NO: 1453308 - DNA, 17 bp, Homo sapiens
ccaagctcacagttcct

SEQ ID NO: 1453309 - DNA, 19 bp, Homo sapiens
ccaagctcacagttcctcg

SEQ ID NO: 1453310 - DNA, 22 bp, Homo sapiens
ccaagctcacagttcctcgccc

SEQ ID NO: 1453311 - DNA, 15 bp, Homo sapiens
ccaagctccaagccc

SEQ ID NO: 1453312 - DNA, 19 bp, Homo sapiens
tcaatcttggtttgtcagt

SEQ ID NO: 1453313 - DNA, 21 bp, Homo sapiens
tcaatgaagccagctcacagt

SEQ ID NO: 1453314 - DNA, 15 bp, Homo sapiens
tcaatgaattatatt

SEQ ID NO: 1453315 - DNA, 18 bp, Homo sapiens
tcaatgcagtttttatca

SEQ ID NO: 1453316 - DNA, 21 bp, Homo sapiens
tcaatgcattgtcttgtggag

SEQ ID NO: 1453317 - DNA, 15 bp, Homo sapiens
tcaatgcatttaaaa

SEQ ID NO: 1453318 - DNA, 22 bp, Homo sapiens
tcaatgcgttttgttgtagatg

SEQ ID NO: 1453319 - DNA, 18 bp, Homo sapiens
tcaatgggaagactcagg

SEQ ID NO: 1453320 - DNA, 12 bp, Homo sapiens
tcaatggtagat

SEQ ID NO: 1453321 - DNA, 11 bp, Homo sapiens
tcaatgtcact

SEQ ID NO: 1453322 - DNA, 19 bp, Homo sapiens
tcaatgtcttaggtcagga

SEQ ID NO: 1453323 - DNA, 12 bp, Homo sapiens
tcaatgtcttcc

SEQ ID NO: 1453324 - DNA, 18 bp, Homo sapiens
tcaatgtggtgatgaaat

SEQ ID NO: 1453325 - DNA, 21 bp, Homo sapiens
tcaatgtttctggacattctc

SEQ ID NO: 1453326 - DNA, 14 bp, Homo sapiens
tcaatgtttttaaa

SEQ ID NO: 1453327 - DNA, 16 bp, Homo sapiens
tcaattaaatgtaggt

SEQ ID NO: 1453328 - DNA, 16 bp, Homo sapiens
tcaattaacatcgtgg

SEQ ID NO: 1453329 - DNA, 13 bp, Homo sapiens
tcaattactggtc

SEQ ID NO: 1453330 - DNA, 18 bp, Homo sapiens
tcaattagtggtcataaa

SEQ ID NO: 1453331 - DNA, 19 bp, Homo sapiens
tcaattagtggtcataaaa

SEQ ID NO: 1453332 - DNA, 20 bp, Homo sapiens
tcaattagtggtcataaaat

SEQ ID NO: 1453333 - DNA, 15 bp, Homo sapiens
tcaattatagtttct

SEQ ID NO: 1453334 - DNA, 21 bp, Homo sapiens
tcaattatattgttagtggac

SEQ ID NO: 1453335 - DNA, 16 bp, Homo sapiens
tcaattcataaaaaca

SEQ ID NO: 1453336 - DNA, 14 bp, Homo sapiens
tcaattgtcacttt

SEQ ID NO: 1453337 - DNA, 15 bp, Homo sapiens
tcaatttctgtgttg

SEQ ID NO: 1453338 - DNA, 16 bp, Homo sapiens
tcaatttgtatatcat

SEQ ID NO: 1453339 - DNA, 13 bp, Homo sapiens
tcaattttatgta

SEQ ID NO: 1453340 - DNA, 16 bp, Homo sapiens
tcaattttatgtattc

SEQ ID NO: 1453341 - DNA, 14 bp, Homo sapiens
tcaattttcattaa

SEQ ID NO: 1453342 - DNA, 18 bp, Homo sapiens
tcaattttcattaaactt

SEQ ID NO: 1453343 - DNA, 22 bp, Homo sapiens
tcaatttttaccacttctgttt

SEQ ID NO: 1453344 - DNA, 12 bp, Homo sapiens
tcaatttttccc

SEQ ID NO: 1453345 - DNA, 18 bp, Homo sapiens
tcaatttttcccagtatt

SEQ ID NO: 1453346 - DNA, 19 bp, Homo sapiens
tcaatttttcccagtattt

SEQ ID NO: 1453347 - DNA, 20 bp, Homo sapiens
tcaatttttcccagtatttt

SEQ ID NO: 1453348 - DNA, 12 bp, Homo sapiens
tcaatttttgtt

SEQ ID NO: 1453349 - DNA, 16 bp, Homo sapiens
tcacaaaaaggcaaat

SEQ ID NO: 1453350 - DNA, 20 bp, Homo sapiens
tcacaaaaaggcaaatattg

SEQ ID NO: 1453351 - DNA, 22 bp, Homo sapiens
tcacaaaattttattcctatat

SEQ ID NO: 1453352 - DNA, 16 bp, Homo sapiens
tcacaaactacctctg

SEQ ID NO: 1453353 - DNA, 13 bp, Homo sapiens
tcacaaactgtga

SEQ ID NO: 1453354 - DNA, 15 bp, Homo sapiens
tcacaaactgtgaaa

SEQ ID NO: 1453355 - DNA, 20 bp, Homo sapiens
tcacaaactgtgaaaatagt

SEQ ID NO: 1453356 - DNA, 22 bp, Homo sapiens
tcacaaatatagttgaacaaga

SEQ ID NO: 1453357 - DNA, 20 bp, Homo sapiens
tcacaaatgtcattgtctac

SEQ ID NO: 1453358 - DNA, 16 bp, Homo sapiens
tcacaaattgatcaag

SEQ ID NO: 1453359 - DNA, 18 bp, Homo sapiens
tcacaaattgatcaagat

SEQ ID NO: 1453360 - DNA, 21 bp, Homo sapiens
tcacaacagattattacctta

SEQ ID NO: 1453361 - DNA, 12 bp, Homo sapiens
tcacaacctctc

SEQ ID NO: 1453362 - DNA, 14 bp, Homo sapiens
tcacaagcacaaag

SEQ ID NO: 1453363 - DNA, 17 bp, Homo sapiens
tcacaagcctcttctga

SEQ ID NO: 1453364 - DNA, 14 bp, Homo sapiens
tcacaaggcccagg

SEQ ID NO: 1453365 - DNA, 15 bp, Homo sapiens
tcacaaggcccagga

SEQ ID NO: 1453366 - DNA, 16 bp, Homo sapiens
tcacaaggcccaggag

SEQ ID NO: 1453367 - DNA, 17 bp, Homo sapiens
tcacaaggcccaggaga

SEQ ID NO: 1453368 - DNA, 20 bp, Homo sapiens
tcacaagtggtgtttattgc

SEQ ID NO: 1453369 - DNA, 21 bp, Homo sapiens
tcacaagtggtgtttattgca

SEQ ID NO: 1453370 - DNA, 14 bp, Homo sapiens
tcacaataaaagct

SEQ ID NO: 1453371 - DNA, 18 bp, Homo sapiens
tcacaataaatgtattca

SEQ ID NO: 1453372 - DNA, 20 bp, Homo sapiens
tcacaatcttggggctgatg

SEQ ID NO: 1453373 - DNA, 18 bp, Homo sapiens
tcacaatgtgaaactgaa

SEQ ID NO: 1453374 - DNA, 19 bp, Homo sapiens
tcacaatgtgaaactgaag

SEQ ID NO: 1453375 - DNA, 16 bp, Homo sapiens
tcacacaatatagttt

SEQ ID NO: 1453376 - DNA, 15 bp, Homo sapiens
tcacacacacacttg

SEQ ID NO: 1453377 - DNA, 20 bp, Homo sapiens
tcacacacaggcaactgagg

SEQ ID NO: 1453378 - DNA, 14 bp, Homo sapiens
tcacacacatagat

SEQ ID NO: 1453379 - DNA, 12 bp, Homo sapiens
tcacacacctgt

SEQ ID NO: 1453380 - DNA, 13 bp, Homo sapiens
tcacacacgtgag

SEQ ID NO: 1453381 - DNA, 17 bp, Homo sapiens
tcacacactcacaattt

SEQ ID NO: 1453382 - DNA, 13 bp, Homo sapiens
tcacacagcccag

SEQ ID NO: 1453383 - DNA, 14 bp, Homo sapiens
tcacacagcccagt

SEQ ID NO: 1453384 - DNA, 17 bp, Homo sapiens
tcacacagggctctttg

SEQ ID NO: 1453385 - DNA, 11 bp, Homo sapiens
tcacacagtgt

SEQ ID NO: 1453386 - DNA, 13 bp, Homo sapiens
tcacacagtgtta

SEQ ID NO: 1453387 - DNA, 19 bp, Homo sapiens
tcacacagtgttagtgctg

SEQ ID NO: 1453388 - DNA, 16 bp, Homo sapiens
tcacacatctgggtgc

SEQ ID NO: 1453389 - DNA, 19 bp, Homo sapiens
tcacacatctgggtgccct

SEQ ID NO: 1453390 - DNA, 15 bp, Homo sapiens
tcacacattacaaca

SEQ ID NO: 1453391 - DNA, 18 bp, Homo sapiens
tcacaccaacagtgtgaa

SEQ ID NO: 1453392 - DNA, 15 bp, Homo sapiens
tcacacccaccgtcc

SEQ ID NO: 1453393 - DNA, 22 bp, Homo sapiens
tcacacccaccgtccgccctgc

SEQ ID NO: 1453394 - DNA, 23 bp, Homo sapiens
tcacacccaccgtccgccctgct

SEQ ID NO: 1453395 - DNA, 15 bp, Homo sapiens
tatttctaactatat

SEQ ID NO: 1453396 - DNA, 24 bp, Homo sapiens
tatttctaattccacaggtcatca

SEQ ID NO: 1453397 - DNA, 17 bp, Homo sapiens
tatttctagcagagtga

SEQ ID NO: 1453398 - DNA, 21 bp, Homo sapiens
tatttctagtccaaaattaca

SEQ ID NO: 1453399 - DNA, 19 bp, Homo sapiens
tatttctagttctttcctc

SEQ ID NO: 1453400 - DNA, 16 bp, Homo sapiens
tatttctatgagaaaa

SEQ ID NO: 1453401 - DNA, 12 bp, Homo sapiens
tatttctatgtc

SEQ ID NO: 1453402 - DNA, 14 bp, Homo sapiens
tatttctatgtcat

SEQ ID NO: 1453403 - DNA, 15 bp, Homo sapiens
tatttctatgtcatt

SEQ ID NO: 1453404 - DNA, 13 bp, Homo sapiens
tatttctattatt

SEQ ID NO: 1453405 - DNA, 14 bp, Homo sapiens
tatttctattatta

SEQ ID NO: 1453406 - DNA, 11 bp, Homo sapiens
tatttctattg

SEQ ID NO: 1453407 - DNA, 13 bp, Homo sapiens
tatttctcaggaa

SEQ ID NO: 1453408 - DNA, 13 bp, Homo sapiens
tatttctgatcta

SEQ ID NO: 1453409 - DNA, 22 bp, Homo sapiens
tatttctgggtcttttgctact

SEQ ID NO: 1453410 - DNA, 15 bp, Homo sapiens
tatttctgtatataa

SEQ ID NO: 1453411 - DNA, 20 bp, Homo sapiens
tatttctgtttcctatttaa

SEQ ID NO: 1453412 - DNA, 21 bp, Homo sapiens
tatttctgtttcctatttaat

SEQ ID NO: 1453413 - DNA, 20 bp, Homo sapiens
tatttcttaacctttgctat

SEQ ID NO: 1453414 - DNA, 18 bp, Homo sapiens
tatttcttatacgctttt

SEQ ID NO: 1453415 - DNA, 14 bp, Homo sapiens
tatttcttctctta

SEQ ID NO: 1453416 - DNA, 22 bp, Homo sapiens
tatttcttctcttatcctctct

SEQ ID NO: 1453417 - DNA, 23 bp, Homo sapiens
tatttcttcttctaagaagacat

SEQ ID NO: 1453418 - DNA, 14 bp, Homo sapiens
tatttcttgtttgt

SEQ ID NO: 1453419 - DNA, 13 bp, Homo sapiens
tatttctttgtta

SEQ ID NO: 1453420 - DNA, 21 bp, Homo sapiens
tatttgaacatgtgccttttc

SEQ ID NO: 1453421 - DNA, 11 bp, Homo sapiens
tatttgaagag

SEQ ID NO: 1453422 - DNA, 15 bp, Homo sapiens
tatttgaatgactaa

SEQ ID NO: 1453423 - DNA, 19 bp, Homo sapiens
tatttgaattttaaatcta

SEQ ID NO: 1453424 - DNA, 21 bp, Homo sapiens
tatttgaattttaaatctaaa

SEQ ID NO: 1453425 - DNA, 16 bp, Homo sapiens
tatttgagactagttt

SEQ ID NO: 1453426 - DNA, 15 bp, Homo sapiens
tatttgagagttcta

SEQ ID NO: 1453427 - DNA, 23 bp, Homo sapiens
tatttgagcatgcacagctgctt

SEQ ID NO: 1453428 - DNA, 16 bp, Homo sapiens
tatttgatttctaatt

SEQ ID NO: 1453429 - DNA, 23 bp, Homo sapiens
tatttgcagttcacctgcactta

SEQ ID NO: 1453430 - DNA, 19 bp, Homo sapiens
tatttgccaataaagcttt

SEQ ID NO: 1453431 - DNA, 23 bp, Homo sapiens
tatttgccaataaagcttttgga

SEQ ID NO: 1453432 - DNA, 15 bp, Homo sapiens
tatttgctaatgtat

SEQ ID NO: 1453433 - DNA, 14 bp, Homo sapiens
tatttgctcagctg

SEQ ID NO: 1453434 - DNA, 19 bp, Homo sapiens
tatttgctgtattgccccc

SEQ ID NO: 1453435 - DNA, 15 bp, Homo sapiens
tatttgctttttgct

SEQ ID NO: 1453436 - DNA, 17 bp, Homo sapiens
tatttggaaataaagtc

SEQ ID NO: 1453437 - DNA, 19 bp, Homo sapiens
tatttggaaataaagtcag

SEQ ID NO: 1453438 - DNA, 16 bp, Homo sapiens
tatttggaattagaac

SEQ ID NO: 1453439 - DNA, 23 bp, Homo sapiens
tatttgggcctgctccagacctg

SEQ ID NO: 1453440 - DNA, 17 bp, Homo sapiens
tatttggtactgtattt

SEQ ID NO: 1453441 - DNA, 23 bp, Homo sapiens
tatttgtaaaagaacagtaaaca

SEQ ID NO: 1453442 - DNA, 22 bp, Homo sapiens
tatttgtaaatttatgtgatgg

SEQ ID NO: 1453443 - DNA, 13 bp, Homo sapiens
tatttgtaattaa

SEQ ID NO: 1453444 - DNA, 15 bp, Homo sapiens
tatttgtaattaaaa

SEQ ID NO: 1453445 - DNA, 15 bp, Homo sapiens
tatttgtacaaataa

SEQ ID NO: 1453446 - DNA, 16 bp, Homo sapiens
tatttgtacaaataaa

SEQ ID NO: 1453447 - DNA, 17 bp, Homo sapiens
tatttgtacaaataaac

SEQ ID NO: 1453448 - DNA, 18 bp, Homo sapiens
tatttgtacaaataaacc

SEQ ID NO: 1453449 - DNA, 17 bp, Homo sapiens
tatttgtactttctgtt

SEQ ID NO: 1453450 - DNA, 20 bp, Homo sapiens
tatttgtactttctgttaaa

SEQ ID NO: 1453451 - DNA, 17 bp, Homo sapiens
tatttgtagctagaata

SEQ ID NO: 1453452 - DNA, 22 bp, Homo sapiens
tatttgtagctagaatatccta

SEQ ID NO: 1453453 - DNA, 22 bp, Homo sapiens
tatttgtataaaagtgtgaaat

SEQ ID NO: 1453454 - DNA, 23 bp, Homo sapiens
tatttgtatagttgcttgcctga

SEQ ID NO: 1453455 - DNA, 20 bp, Homo sapiens
tatttgtattaataaagcat

SEQ ID NO: 1453456 - DNA, 12 bp, Homo sapiens
tatttgtattta

SEQ ID NO: 1453457 - DNA, 17 bp, Homo sapiens
tatttgtatttattctt

SEQ ID NO: 1453458 - DNA, 12 bp, Homo sapiens
tatttgtcttcc

SEQ ID NO: 1453459 - DNA, 16 bp, Homo sapiens
tatttgtcttccgatc

SEQ ID NO: 1453460 - DNA, 22 bp, Homo sapiens
tatttgtcttccgatcaacatt

SEQ ID NO: 1453461 - DNA, 18 bp, Homo sapiens
tatttgtgccgtaattat

SEQ ID NO: 1453462 - DNA, 20 bp, Homo sapiens
tatttgtgccgtaattatgt

SEQ ID NO: 1453463 - DNA, 22 bp, Homo sapiens
tatttgttacttttagttctat

SEQ ID NO: 1453464 - DNA, 18 bp, Homo sapiens
tatttgttctttttctga

SEQ ID NO: 1453465 - DNA, 15 bp, Homo sapiens
tattttaaaatattt

SEQ ID NO: 1453466 - DNA, 22 bp, Homo sapiens
tattttaaaatatttaaacctt

SEQ ID NO: 1453467 - DNA, 12 bp, Homo sapiens
tattttaaatat

SEQ ID NO: 1453468 - DNA, 23 bp, Homo sapiens
tattttaaatataaatagctaat

SEQ ID NO: 1453469 - DNA, 22 bp, Homo sapiens
tattttaaatatccatttatct

SEQ ID NO: 1453470 - DNA, 12 bp, Homo sapiens
tattttaaatct

SEQ ID NO: 1453471 - DNA, 22 bp, Homo sapiens
tattttaaattactatatatgt

SEQ ID NO: 1453472 - DNA, 14 bp, Homo sapiens
tattttaacacttt

SEQ ID NO: 1453473 - DNA, 16 bp, Homo sapiens
tattttaactattttt

SEQ ID NO: 1453474 - DNA, 18 bp, Homo sapiens
tattttaagactgatttt

SEQ ID NO: 1453475 - DNA, 17 bp, Homo sapiens
tattttaaggttgcaca

SEQ ID NO: 1453476 - DNA, 16 bp, Homo sapiens
tattttaatagcctgt

SEQ ID NO: 1453477 - DNA, 14 bp, Homo sapiens
tattttacaatttt

SEQ ID NO: 1453478 - DNA, 23 bp, Homo sapiens
tattttacaattttttatcatgc

SEQ ID NO: 1453479 - DNA, 15 bp, Homo sapiens
tattttacacagaaa

SEQ ID NO: 1453480 - DNA, 18 bp, Homo sapiens
tattttacagctcattaa

SEQ ID NO: 1453481 - DNA, 14 bp, Homo sapiens
tattttaggaaatt

SEQ ID NO: 1453482 - DNA, 13 bp, Homo sapiens
tattttagtatac

SEQ ID NO: 1453483 - DNA, 14 bp, Homo sapiens
tattttataagaaa

SEQ ID NO: 1453484 - DNA, 15 bp, Homo sapiens
tattttataagaaaa

SEQ ID NO: 1453485 - DNA, 22 bp, Homo sapiens
tattttataatgttgtatttaa

SEQ ID NO: 1453486 - DNA, 13 bp, Homo sapiens
tattttatgaaca

SEQ ID NO: 1453487 - DNA, 15 bp, Homo sapiens
tattttatgaacatt

SEQ ID NO: 1453488 - DNA, 19 bp, Homo sapiens
tattttcaacgcagccctg

SEQ ID NO: 1453489 - DNA, 19 bp, Homo sapiens
tattttcagtatactgtgt

SEQ ID NO: 1453490 - DNA, 20 bp, Homo sapiens
tattttcagtatactgtgtg

SEQ ID NO: 1453491 - DNA, 23 bp, Homo sapiens
tattttcagtcccctctctctgg

SEQ ID NO: 1453492 - DNA, 18 bp, Homo sapiens
tattttcatacagcatta

SEQ ID NO: 1453493 - DNA, 18 bp, Homo sapiens
tattttcatttgtacaag

SEQ ID NO: 1453494 - DNA, 16 bp, Homo sapiens
tattttcctaaagaga

SEQ ID NO: 1453495 - DNA, 14 bp, Homo sapiens
tattttcctgatag

SEQ ID NO: 1453496 - DNA, 18 bp, Homo sapiens
tattttcctgatagcata

SEQ ID NO: 1453497 - DNA, 15 bp, Homo sapiens
tattttctacagtgg

SEQ ID NO: 1453498 - DNA, 13 bp, Homo sapiens
tattttcttttta

SEQ ID NO: 1453499 - DNA, 20 bp, Homo sapiens
tattttgaatgcagaaaaca

SEQ ID NO: 1453500 - DNA, 17 bp, Homo sapiens
tattttgaatgtcacaa

SEQ ID NO: 1453501 - DNA, 16 bp, Homo sapiens
tattttgagaaactgc

SEQ ID NO: 1453502 - DNA, 18 bp, Homo sapiens
tattttgcattccagaat

SEQ ID NO: 1453503 - DNA, 19 bp, Homo sapiens
tattttgctaactggttaa

SEQ ID NO: 1453504 - DNA, 22 bp, Homo sapiens
tattttgctaactggttaaaca

SEQ ID NO: 1453505 - DNA, 19 bp, Homo sapiens
tattttgctgagttgttct

SEQ ID NO: 1453506 - DNA, 14 bp, Homo sapiens
tattttgctggaat

SEQ ID NO: 1453507 - DNA, 12 bp, Homo sapiens
tattttgctttg

SEQ ID NO: 1453508 - DNA, 20 bp, Homo sapiens
tattttgtactttgtggaga

SEQ ID NO: 1453509 - DNA, 21 bp, Homo sapiens
tattttgtgatgaatctacat

SEQ ID NO: 1453510 - DNA, 17 bp, Homo sapiens
tattttgtgctcattta

SEQ ID NO: 1453511 - DNA, 23 bp, Homo sapiens
tattttgtgtcctccaggagctt

SEQ ID NO: 1453512 - DNA, 17 bp, Homo sapiens
tattttgtgtgaaattg

SEQ ID NO: 1453513 - DNA, 12 bp, Homo sapiens
tattttgttaaa

SEQ ID NO: 1453514 - DNA, 15 bp, Homo sapiens
tattttgttaaagct

SEQ ID NO: 1453515 - DNA, 24 bp, Homo sapiens
tattttgttttttttgactaaagc

SEQ ID NO: 1453516 - DNA, 15 bp, Homo sapiens
tatttttaaaaagaa

SEQ ID NO: 1453517 - DNA, 15 bp, Homo sapiens
tatttttaaagatag

SEQ ID NO: 1453518 - DNA, 15 bp, Homo sapiens
tatttttaaaggcat

SEQ ID NO: 1453519 - DNA, 12 bp, Homo sapiens
tatttttaacac

SEQ ID NO: 1453520 - DNA, 14 bp, Homo sapiens
tatttttaagataa

SEQ ID NO: 1453521 - DNA, 20 bp, Homo sapiens
tatttttatacaagtaattt

SEQ ID NO: 1453522 - DNA, 23 bp, Homo sapiens
tatttttatattaaagtaaatgg

SEQ ID NO: 1453523 - DNA, 16 bp, Homo sapiens
tatttttatatttcct

SEQ ID NO: 1453524 - DNA, 17 bp, Homo sapiens
tatttttatatttcctt

SEQ ID NO: 1453525 - DNA, 17 bp, Homo sapiens
tatttttatcatgaatt

SEQ ID NO: 1453526 - DNA, 18 bp, Homo sapiens
tatttttatcatgaattc

SEQ ID NO: 1453527 - DNA, 12 bp, Homo sapiens
tatttttatctt

SEQ ID NO: 1453528 - DNA, 15 bp, Homo sapiens
tatttttcacagttt

SEQ ID NO: 1453529 - DNA, 21 bp, Homo sapiens
tatttttccactattaatctt

SEQ ID NO: 1453530 - DNA, 17 bp, Homo sapiens
tatttttctcttgtacc

SEQ ID NO: 1453531 - DNA, 18 bp, Homo sapiens
tatttttgacatggaaat

SEQ ID NO: 1453532 - DNA, 19 bp, Homo sapiens
tatttttggcagtctgaat

SEQ ID NO: 1453533 - DNA, 19 bp, Homo sapiens
tatttttggggcatcctgg

SEQ ID NO: 1453534 - DNA, 20 bp, Homo sapiens
tatttttgtaattttaaata

SEQ ID NO: 1453535 - DNA, 14 bp, Homo sapiens
tatttttgtacata

SEQ ID NO: 1453536 - DNA, 19 bp, Homo sapiens
tatttttgtagcactgaca

SEQ ID NO: 1453537 - DNA, 13 bp, Homo sapiens
tatttttgtattt

SEQ ID NO: 1453538 - DNA, 16 bp, Homo sapiens
tatttttgtgtttcta

SEQ ID NO: 1453539 - DNA, 20 bp, Homo sapiens
tatttttgtttcttccaaag

SEQ ID NO: 1453540 - DNA, 16 bp, Homo sapiens
tattttttaaatcttg

SEQ ID NO: 1453541 - DNA, 17 bp, Homo sapiens
tattttttaaatcttga

SEQ ID NO: 1453542 - DNA, 20 bp, Homo sapiens
tattttttaaatcttgacca

SEQ ID NO: 1453543 - DNA, 12 bp, Homo sapiens
tattttttaatt

SEQ ID NO: 1453544 - DNA, 16 bp, Homo sapiens
tattttttaatttgat

SEQ ID NO: 1453545 - DNA, 14 bp, Homo sapiens
tattttttactaca

SEQ ID NO: 1453546 - DNA, 18 bp, Homo sapiens
tattttttattcagtaaa

SEQ ID NO: 1453547 - DNA, 14 bp, Homo sapiens
tattttttcctttt

SEQ ID NO: 1453548 - DNA, 18 bp, Homo sapiens
tattttttctacacagta

SEQ ID NO: 1453549 - DNA, 14 bp, Homo sapiens
tattttttcttttg

SEQ ID NO: 1453550 - DNA, 21 bp, Homo sapiens
tattttttggacttcaaagca

SEQ ID NO: 1453551 - DNA, 15 bp, Homo sapiens
tatttttttaaaatt

SEQ ID NO: 1453552 - DNA, 17 bp, Homo sapiens
tatttttttaaatcaag

SEQ ID NO: 1453553 - DNA, 16 bp, Homo sapiens
tatttttttaatttaa

SEQ ID NO: 1453554 - DNA, 19 bp, Homo sapiens
tatttttttagattgagaa

SEQ ID NO: 1453555 - DNA, 22 bp, Homo sapiens
tatttttttctagctataacaa

SEQ ID NO: 1453556 - DNA, 19 bp, Homo sapiens
tatttttttttctaagaga

SEQ ID NO: 1453557 - DNA, 21 bp, Homo sapiens
tattttttttttcttcttggg

SEQ ID NO: 1453558 - DNA, 23 bp, Homo sapiens
tatttttttttttccaagacaga

SEQ ID NO: 1453559 - DNA, 16 bp, Homo sapiens
tcaaaaaaaaaaaaga

SEQ ID NO: 1453560 - DNA, 19 bp, Homo sapiens
tcaaaaaaaaaaagattct

SEQ ID NO: 1453561 - DNA, 16 bp, Homo sapiens
tcaaaaaaacactagt

SEQ ID NO: 1453562 - DNA, 16 bp, Homo sapiens
tcaaaaaacctttaca

SEQ ID NO: 1453563 - DNA, 21 bp, Homo sapiens
tcaaaaaactctctcccagga

SEQ ID NO: 1453564 - DNA, 18 bp, Homo sapiens
tcaaaaaatcatgtttat

SEQ ID NO: 1453565 - DNA, 13 bp, Homo sapiens
tcaaaaaatgagc

SEQ ID NO: 1453566 - DNA, 11 bp, Homo sapiens
tcaaaaaatta

SEQ ID NO: 1453567 - DNA, 16 bp, Homo sapiens
tcaaaaaccagccagg

SEQ ID NO: 1453568 - DNA, 17 bp, Homo sapiens
tcaaaaaccagccaggc

SEQ ID NO: 1453569 - DNA, 12 bp, Homo sapiens
tcaaaaagtatt

SEQ ID NO: 1453570 - DNA, 14 bp, Homo sapiens
tcaaaaataaacta

SEQ ID NO: 1453571 - DNA, 15 bp, Homo sapiens
tcaaaaataaactag

SEQ ID NO: 1453572 - DNA, 19 bp, Homo sapiens
tcaaaaataaactagtttc

SEQ ID NO: 1453573 - DNA, 13 bp, Homo sapiens
tcaaaaatataac

SEQ ID NO: 1453574 - DNA, 24 bp, Homo sapiens
tcaaaaatccttatgcatgaaatg

SEQ ID NO: 1453575 - DNA, 20 bp, Homo sapiens
tcaaaacaatattactttgt

SEQ ID NO: 1453576 - DNA, 18 bp, Homo sapiens
tcaaaaccagtgaacttt

SEQ ID NO: 1453577 - DNA, 20 bp, Homo sapiens
tcaaaacctttcaaatatca

SEQ ID NO: 1453578 - DNA, 18 bp, Homo sapiens
tcaaaacggggcagccaa

SEQ ID NO: 1453579 - DNA, 20 bp, Homo sapiens
tcaaaagagaaaaacaaaac

SEQ ID NO: 1453580 - DNA, 15 bp, Homo sapiens
tcaaaagaggttact

SEQ ID NO: 1453581 - DNA, 20 bp, Homo sapiens
tcaaaagaggttactttagt

SEQ ID NO: 1453582 - DNA, 16 bp, Homo sapiens
tcaaaagggaagagtt

SEQ ID NO: 1453583 - DNA, 13 bp, Homo sapiens
tcaaaaggtgcct

SEQ ID NO: 1453584 - DNA, 14 bp, Homo sapiens
tcaaaagttgaaat

SEQ ID NO: 1453585 - DNA, 15 bp, Homo sapiens
tcaaaagttgaaatt

SEQ ID NO: 1453586 - DNA, 23 bp, Homo sapiens
tcaaaataccatgccatttaaag

SEQ ID NO: 1453587 - DNA, 15 bp, Homo sapiens
tcaaaatagttctat

SEQ ID NO: 1453588 - DNA, 17 bp, Homo sapiens
tcaaaatagttctattt

SEQ ID NO: 1453589 - DNA, 20 bp, Homo sapiens
tcaaaatagttctatttcta

SEQ ID NO: 1453590 - DNA, 21 bp, Homo sapiens
tcaaaatagttctatttctat

SEQ ID NO: 1453591 - DNA, 22 bp, Homo sapiens
tcaaaatagttctatttctatc

SEQ ID NO: 1453592 - DNA, 23 bp, Homo sapiens
tcaaaatagttctatttctatct

SEQ ID NO: 1453593 - DNA, 20 bp, Homo sapiens
tcaaaatatattttcagtac

SEQ ID NO: 1453594 - DNA, 14 bp, Homo sapiens
tcaaaatgtctaag

SEQ ID NO: 1453595 - DNA, 20 bp, Homo sapiens
tcaaaatgttatcttctcaa

SEQ ID NO: 1453596 - DNA, 22 bp, Homo sapiens
tcaaacaacctgcccaaagatt

SEQ ID NO: 1453597 - DNA, 20 bp, Homo sapiens
tcaaacacagttacacttgt

SEQ ID NO: 1453598 - DNA, 17 bp, Homo sapiens
tcaaacacttgtgactt

SEQ ID NO: 1453599 - DNA, 18 bp, Homo sapiens
tcaaacacttgtgacttt

SEQ ID NO: 1453600 - DNA, 16 bp, Homo sapiens
tcaaacaggctgtaat

SEQ ID NO: 1453601 - DNA, 22 bp, Homo sapiens
tcaaacagtaatctaggtgtgg

SEQ ID NO: 1453602 - DNA, 20 bp, Homo sapiens
tcaaacagtctcaggaaatc

SEQ ID NO: 1453603 - DNA, 17 bp, Homo sapiens
tcaaacatcagctgaat

SEQ ID NO: 1453604 - DNA, 19 bp, Homo sapiens
tcaaacatcagctgaattc

SEQ ID NO: 1453605 - DNA, 20 bp, Homo sapiens
tcaaacatcagctgaattca

SEQ ID NO: 1453606 - DNA, 15 bp, Homo sapiens
tcaaaccagtcactt

SEQ ID NO: 1453607 - DNA, 15 bp, Homo sapiens
tcaaaccctagcctt

SEQ ID NO: 1453608 - DNA, 18 bp, Homo sapiens
tcaaaccctagccttgct

SEQ ID NO: 1453609 - DNA, 23 bp, Homo sapiens
tcaaacgatgtgcaatacatttt

SEQ ID NO: 1453610 - DNA, 20 bp, Homo sapiens
tcaaacggaggaagcccaca

SEQ ID NO: 1453611 - DNA, 16 bp, Homo sapiens
tcaaactgaagccaga

SEQ ID NO: 1453612 - DNA, 16 bp, Homo sapiens
tcaaactgaatttgtt

SEQ ID NO: 1453613 - DNA, 19 bp, Homo sapiens
tcaaactgaggaatttcac

SEQ ID NO: 1453614 - DNA, 13 bp, Homo sapiens
tcaaactgctcca

SEQ ID NO: 1453615 - DNA, 14 bp, Homo sapiens
tcaaactggggcct

SEQ ID NO: 1453616 - DNA, 14 bp, Homo sapiens
tcaaactgtagaaa

SEQ ID NO: 1453617 - DNA, 17 bp, Homo sapiens
tcaaactgtagaaatga

SEQ ID NO: 1453618 - DNA, 14 bp, Homo sapiens
tcaaacttaaacaa

SEQ ID NO: 1453619 - DNA, 18 bp, Homo sapiens
tcaaacttaaacaaaaaa

SEQ ID NO: 1453620 - DNA, 17 bp, Homo sapiens
tcaaacttactattttg

SEQ ID NO: 1453621 - DNA, 14 bp, Homo sapiens
tcaaagaaagtgta

SEQ ID NO: 1453622 - DNA, 15 bp, Homo sapiens
tcaaagaaatattaa

SEQ ID NO: 1453623 - DNA, 17 bp, Homo sapiens
tcaaagaaattcagaac

SEQ ID NO: 1453624 - DNA, 18 bp, Homo sapiens
tcaaagaaattcagaaca

SEQ ID NO: 1453625 - DNA, 12 bp, Homo sapiens
tcaaagaacaga

SEQ ID NO: 1453626 - DNA, 17 bp, Homo sapiens
tcaaagaattacagtac

SEQ ID NO: 1453627 - DNA, 16 bp, Homo sapiens
tcaaagacagaatggt

SEQ ID NO: 1453628 - DNA, 15 bp, Homo sapiens
tagtaaagtattttt

SEQ ID NO: 1453629 - DNA, 21 bp, Homo sapiens
tagtaagaaatttgcagtttt

SEQ ID NO: 1453630 - DNA, 18 bp, Homo sapiens
tagtaagaagacaaactg

SEQ ID NO: 1453631 - DNA, 22 bp, Homo sapiens
tagtaagattgatatctataaa

SEQ ID NO: 1453632 - DNA, 12 bp, Homo sapiens
tagtaagcatag

SEQ ID NO: 1453633 - DNA, 15 bp, Homo sapiens
tagtaagcatagaaa

SEQ ID NO: 1453634 - DNA, 23 bp, Homo sapiens
tagtaatatatttaaagggaaat

SEQ ID NO: 1453635 - DNA, 15 bp, Homo sapiens
tagtacctgaaaagt

SEQ ID NO: 1453636 - DNA, 14 bp, Homo sapiens
tagtactaagcatt

SEQ ID NO: 1453637 - DNA, 17 bp, Homo sapiens
tagtactatttcttaat

SEQ ID NO: 1453638 - DNA, 18 bp, Homo sapiens
tagtactcaatgtttctg

SEQ ID NO: 1453639 - DNA, 17 bp, Homo sapiens
tagtactcctgcaaaat

SEQ ID NO: 1453640 - DNA, 21 bp, Homo sapiens
tagtactcctgcaaaatttta

SEQ ID NO: 1453641 - DNA, 19 bp, Homo sapiens
tagtactccttaagaacac

SEQ ID NO: 1453642 - DNA, 17 bp, Homo sapiens
tagtactctctgctcta

SEQ ID NO: 1453643 - DNA, 15 bp, Homo sapiens
tagtactgctcttgt

SEQ ID NO: 1453644 - DNA, 15 bp, Homo sapiens
tagtagaaattttac

SEQ ID NO: 1453645 - DNA, 21 bp, Homo sapiens
tagtagacatttgtgtggaaa

SEQ ID NO: 1453646 - DNA, 16 bp, Homo sapiens
tagtagcaatgtgcct

SEQ ID NO: 1453647 - DNA, 19 bp, Homo sapiens
tagtagcaatgtgccttga

SEQ ID NO: 1453648 - DNA, 15 bp, Homo sapiens
tagtaggaatgtaca

SEQ ID NO: 1453649 - DNA, 18 bp, Homo sapiens
tagtagtatgatgataca

SEQ ID NO: 1453650 - DNA, 14 bp, Homo sapiens
tagtagtttttaca

SEQ ID NO: 1453651 - DNA, 17 bp, Homo sapiens
tagtatacgtataaata

SEQ ID NO: 1453652 - DNA, 15 bp, Homo sapiens
tagtatagaagtctg

SEQ ID NO: 1453653 - DNA, 19 bp, Homo sapiens
tagtatagaagtctggaaa

SEQ ID NO: 1453654 - DNA, 15 bp, Homo sapiens
tagtatctaacatgt

SEQ ID NO: 1453655 - DNA, 13 bp, Homo sapiens
tagtatcttcaaa

SEQ ID NO: 1453656 - DNA, 18 bp, Homo sapiens
tagtatcttgaaatcctg

SEQ ID NO: 1453657 - DNA, 13 bp, Homo sapiens
tagtatgaaatta

SEQ ID NO: 1453658 - DNA, 18 bp, Homo sapiens
tagtatgcagttgataag

SEQ ID NO: 1453659 - DNA, 19 bp, Homo sapiens
tagtatgtctgtttttgta

SEQ ID NO: 1453660 - DNA, 13 bp, Homo sapiens
tagtattaaaatc

SEQ ID NO: 1453661 - DNA, 16 bp, Homo sapiens
tagtatttatttatgt

SEQ ID NO: 1453662 - DNA, 14 bp, Homo sapiens
tagtatttctcagg

SEQ ID NO: 1453663 - DNA, 16 bp, Homo sapiens
tagtcaatttctactt

SEQ ID NO: 1453664 - DNA, 21 bp, Homo sapiens
tagtcacatggcctatgcaca

SEQ ID NO: 1453665 - DNA, 13 bp, Homo sapiens
tagtcacctgctg

SEQ ID NO: 1453666 - DNA, 19 bp, Homo sapiens
tagtcactggcagcctgca

SEQ ID NO: 1453667 - DNA, 17 bp, Homo sapiens
tagtcacttatttcata

SEQ ID NO: 1453668 - DNA, 13 bp, Homo sapiens
tagtcagctgcct

SEQ ID NO: 1453669 - DNA, 20 bp, Homo sapiens
tagtcaggagagtgcagatc

SEQ ID NO: 1453670 - DNA, 17 bp, Homo sapiens
tagtcatatattaaaca

SEQ ID NO: 1453671 - DNA, 19 bp, Homo sapiens
tagtcatggggtccctgct

SEQ ID NO: 1453672 - DNA, 20 bp, Homo sapiens
tagtcatggggtccctgctg

SEQ ID NO: 1453673 - DNA, 19 bp, Homo sapiens
tagtccatcaccatttctt

SEQ ID NO: 1453674 - DNA, 21 bp, Homo sapiens
tagtcccagctactcagaagc

SEQ ID NO: 1453675 - DNA, 20 bp, Homo sapiens
tagtcccatttttctcttgc

SEQ ID NO: 1453676 - DNA, 18 bp, Homo sapiens
tagtcccccaaagggcct

SEQ ID NO: 1453677 - DNA, 23 bp, Homo sapiens
tagtcccttcccctccctggctc

SEQ ID NO: 1453678 - DNA, 16 bp, Homo sapiens
tagtcctatggaaaaa

SEQ ID NO: 1453679 - DNA, 12 bp, Homo sapiens
tagtctcaggac

SEQ ID NO: 1453680 - DNA, 16 bp, Homo sapiens
tagtctccctgtgtca

SEQ ID NO: 1453681 - DNA, 18 bp, Homo sapiens
tagtctcctttgcactga

SEQ ID NO: 1453682 - DNA, 20 bp, Homo sapiens
tagtctcctttgcactgagg

SEQ ID NO: 1453683 - DNA, 19 bp, Homo sapiens
tagtctctgatttgcaaat

SEQ ID NO: 1453684 - DNA, 13 bp, Homo sapiens
tagtctctgccct

SEQ ID NO: 1453685 - DNA, 19 bp, Homo sapiens
tagtctctgccctcataga

SEQ ID NO: 1453686 - DNA, 18 bp, Homo sapiens
tagtctgaaactggcttc

SEQ ID NO: 1453687 - DNA, 18 bp, Homo sapiens
tagtctgtgtgaaggtga

SEQ ID NO: 1453688 - DNA, 14 bp, Homo sapiens
tagtcttcagtttc

SEQ ID NO: 1453689 - DNA, 15 bp, Homo sapiens
tagtcttgaatttct

SEQ ID NO: 1453690 - DNA, 11 bp, Homo sapiens
tagtcttggaa

SEQ ID NO: 1453691 - DNA, 15 bp, Homo sapiens
tagtcttttgctttt

SEQ ID NO: 1453692 - DNA, 21 bp, Homo sapiens
tagtcttttgcttttggcaaa

SEQ ID NO: 1453693 - DNA, 17 bp, Homo sapiens
tagtgaaatggctgggg

SEQ ID NO: 1453694 - DNA, 21 bp, Homo sapiens
tagtgacaagtgaagaacact

SEQ ID NO: 1453695 - DNA, 21 bp, Homo sapiens
tagtgacagagcccagcatcc

SEQ ID NO: 1453696 - DNA, 22 bp, Homo sapiens
tagtgaccccttccctgtcctt

SEQ ID NO: 1453697 - DNA, 16 bp, Homo sapiens
tagtgagtcagcacct

SEQ ID NO: 1453698 - DNA, 14 bp, Homo sapiens
tagtgatacactgt

SEQ ID NO: 1453699 - DNA, 22 bp, Homo sapiens
tagtgatacactgtatctaaaa

SEQ ID NO: 1453700 - DNA, 19 bp, Homo sapiens
tagtgatcaaattgtgcag

SEQ ID NO: 1453701 - DNA, 15 bp, Homo sapiens
tagtgatcctgtcct

SEQ ID NO: 1453702 - DNA, 19 bp, Homo sapiens
tagtgatgatggttcacgt

SEQ ID NO: 1453703 - DNA, 18 bp, Homo sapiens
tagtgatggttcccctgt

SEQ ID NO: 1453704 - DNA, 19 bp, Homo sapiens
tagtgcaacatctctgaat

SEQ ID NO: 1453705 - DNA, 18 bp, Homo sapiens
tagtgcaatagtgcaaca

SEQ ID NO: 1453706 - DNA, 19 bp, Homo sapiens
tagtgcaatagtgcaacat

SEQ ID NO: 1453707 - DNA, 15 bp, Homo sapiens
tagtgcagctgaaat

SEQ ID NO: 1453708 - DNA, 17 bp, Homo sapiens
tagtgcagctgaaattg

SEQ ID NO: 1453709 - DNA, 18 bp, Homo sapiens
tagtgcatttttaaactt

SEQ ID NO: 1453710 - DNA, 16 bp, Homo sapiens
tagtgccacccacctt

SEQ ID NO: 1453711 - DNA, 22 bp, Homo sapiens
tagtgccacttaatgtatgtta

SEQ ID NO: 1453712 - DNA, 21 bp, Homo sapiens
tagtgccccagactgagctct

SEQ ID NO: 1453713 - DNA, 18 bp, Homo sapiens
tagtgcctaaaattgtat

SEQ ID NO: 1453714 - DNA, 14 bp, Homo sapiens
tagtgcggacaagt

SEQ ID NO: 1453715 - DNA, 21 bp, Homo sapiens
tagtgctattctgtgttgaac

SEQ ID NO: 1453716 - DNA, 22 bp, Homo sapiens
tagtgctgctgaagatgaatca

SEQ ID NO: 1453717 - DNA, 16 bp, Homo sapiens
tagtgctgtaatattg

SEQ ID NO: 1453718 - DNA, 18 bp, Homo sapiens
tagtggaagagcagcctg

SEQ ID NO: 1453719 - DNA, 14 bp, Homo sapiens
tagtggagccaggt

SEQ ID NO: 1453720 - DNA, 16 bp, Homo sapiens
tagtggggcctgggag

SEQ ID NO: 1453721 - DNA, 13 bp, Homo sapiens
tagtgtaagaact

SEQ ID NO: 1453722 - DNA, 22 bp, Homo sapiens
tagtgtacctcctctcagtgtt

SEQ ID NO: 1453723 - DNA, 14 bp, Homo sapiens
tagtgtcacagaga

SEQ ID NO: 1453724 - DNA, 13 bp, Homo sapiens
tagtgtctgacct

SEQ ID NO: 1453725 - DNA, 21 bp, Homo sapiens
tagtgtgacagtttccaaatt

SEQ ID NO: 1453726 - DNA, 20 bp, Homo sapiens
tagtgtgagtggcagccatg

SEQ ID NO: 1453727 - DNA, 21 bp, Homo sapiens
tagtgtgagtggcagccatgc

SEQ ID NO: 1453728 - DNA, 17 bp, Homo sapiens
cattaatgcctgctttt

SEQ ID NO: 1453729 - DNA, 12 bp, Homo sapiens
cattaatgtttc

SEQ ID NO: 1453730 - DNA, 21 bp, Homo sapiens
cattaattagttccagtttct

SEQ ID NO: 1453731 - DNA, 20 bp, Homo sapiens
cattacaagcctggaaaaaa

SEQ ID NO: 1453732 - DNA, 17 bp, Homo sapiens
cattacaattttctgta

SEQ ID NO: 1453733 - DNA, 14 bp, Homo sapiens
cattacactaaatt

SEQ ID NO: 1453734 - DNA, 21 bp, Homo sapiens
cattacagaggtattaaaact

SEQ ID NO: 1453735 - DNA, 21 bp, Homo sapiens
cattacagtgggtgcccccct

SEQ ID NO: 1453736 - DNA, 22 bp, Homo sapiens
cattacagttctttcctctttc

SEQ ID NO: 1453737 - DNA, 16 bp, Homo sapiens
cattacattattaaac

SEQ ID NO: 1453738 - DNA, 19 bp, Homo sapiens
cattacattgtttaaagaa

SEQ ID NO: 1453739 - DNA, 22 bp, Homo sapiens
cattacctcagtgagaagccag

SEQ ID NO: 1453740 - DNA, 15 bp, Homo sapiens
cattacctccatcca

SEQ ID NO: 1453741 - DNA, 23 bp, Homo sapiens
cattacctccatccatccttcca

SEQ ID NO: 1453742 - DNA, 12 bp, Homo sapiens
cattacctgtac

SEQ ID NO: 1453743 - DNA, 12 bp, Homo sapiens
cattactgtgat

SEQ ID NO: 1453744 - DNA, 16 bp, Homo sapiens
cattactgtgatttct

SEQ ID NO: 1453745 - DNA, 18 bp, Homo sapiens
cattactgtgatttctgg

SEQ ID NO: 1453746 - DNA, 14 bp, Homo sapiens
cattagaaatattt

SEQ ID NO: 1453747 - DNA, 15 bp, Homo sapiens
cattagaaatatttt

SEQ ID NO: 1453748 - DNA, 19 bp, Homo sapiens
cattagagaacatcctggc

SEQ ID NO: 1453749 - DNA, 17 bp, Homo sapiens
cattagagtcaactaca

SEQ ID NO: 1453750 - DNA, 21 bp, Homo sapiens
cattagataaacacaggcagg

SEQ ID NO: 1453751 - DNA, 20 bp, Homo sapiens
cattagataaattactataa

SEQ ID NO: 1453752 - DNA, 18 bp, Homo sapiens
cattagcagtttgctttg

SEQ ID NO: 1453753 - DNA, 18 bp, Homo sapiens
cattagccagatttgtct

SEQ ID NO: 1453754 - DNA, 20 bp, Homo sapiens
cattagcgacagtaggattt

SEQ ID NO: 1453755 - DNA, 19 bp, Homo sapiens
cattaggacaatcagtccc

SEQ ID NO: 1453756 - DNA, 20 bp, Homo sapiens
tatagaatacttttttctag

SEQ ID NO: 1453757 - DNA, 22 bp, Homo sapiens
tatagaatacttttttctagtt

SEQ ID NO: 1453758 - DNA, 20 bp, Homo sapiens
tatagacaaaagaataagac

SEQ ID NO: 1453759 - DNA, 21 bp, Homo sapiens
tatagacaaaagaataagaca

SEQ ID NO: 1453760 - DNA, 23 bp, Homo sapiens
tatagacagtccttaaaaatcac

SEQ ID NO: 1453761 - DNA, 22 bp, Homo sapiens
tatagaccaaagcaaagaaaat

SEQ ID NO: 1453762 - DNA, 18 bp, Homo sapiens
tatagagagggggctctc

SEQ ID NO: 1453763 - DNA, 16 bp, Homo sapiens
tatagagataagataa

SEQ ID NO: 1453764 - DNA, 17 bp, Homo sapiens
tatagagcagaaattct

SEQ ID NO: 1453765 - DNA, 19 bp, Homo sapiens
tatagagcagaaattctgt

SEQ ID NO: 1453766 - DNA, 21 bp, Homo sapiens
tatagaggctagcttctgctt

SEQ ID NO: 1453767 - DNA, 11 bp, Homo sapiens
tatagatacaa

SEQ ID NO: 1453768 - DNA, 22 bp, Homo sapiens
tatagatcactgccctttttga

SEQ ID NO: 1453769 - DNA, 22 bp, Homo sapiens
tatagatgcaagatatttatat

SEQ ID NO: 1453770 - DNA, 12 bp, Homo sapiens
tatagatgtcta

SEQ ID NO: 1453771 - DNA, 15 bp, Homo sapiens
tatagattataactt

SEQ ID NO: 1453772 - DNA, 12 bp, Homo sapiens
tatagatttagc

SEQ ID NO: 1453773 - DNA, 14 bp, Homo sapiens
tatagcaactaatg

SEQ ID NO: 1453774 - DNA, 21 bp, Homo sapiens
tatagcctaagcggctgttta

SEQ ID NO: 1453775 - DNA, 20 bp, Homo sapiens
tatagcctatggcagaaaaa

SEQ ID NO: 1453776 - DNA, 16 bp, Homo sapiens
tatagctacaggaagc

SEQ ID NO: 1453777 - DNA, 22 bp, Homo sapiens
tatagctacaggaagcacccca

SEQ ID NO: 1453778 - DNA, 21 bp, Homo sapiens
tatagctgagactacaagtgt

SEQ ID NO: 1453779 - DNA, 22 bp, Homo sapiens
tatagcttacctgaacaggaat

SEQ ID NO: 1453780 - DNA, 23 bp, Homo sapiens
tataggagaaagcaaaatacatc

SEQ ID NO: 1453781 - DNA, 23 bp, Homo sapiens
tataggcctgtcccttgcctctg

SEQ ID NO: 1453782 - DNA, 19 bp, Homo sapiens
tataggtaaaatctctgaa

SEQ ID NO: 1453783 - DNA, 17 bp, Homo sapiens
tataggtcactcctggg

SEQ ID NO: 1453784 - DNA, 17 bp, Homo sapiens
tataggtcctttagaaa

SEQ ID NO: 1453785 - DNA, 22 bp, Homo sapiens
tatagtaactactttttatact

SEQ ID NO: 1453786 - DNA, 14 bp, Homo sapiens
tatagtaggcatgt

SEQ ID NO: 1453787 - DNA, 13 bp, Homo sapiens
tatagtatctgta

SEQ ID NO: 1453788 - DNA, 19 bp, Homo sapiens
tatagtctaagactatata

SEQ ID NO: 1453789 - DNA, 19 bp, Homo sapiens
tatagtgcaaattcatttt

SEQ ID NO: 1453790 - DNA, 22 bp, Homo sapiens
tatagtgcctaaaattgtatga

SEQ ID NO: 1453791 - DNA, 13 bp, Homo sapiens
tatagttactgtg

SEQ ID NO: 1453792 - DNA, 20 bp, Homo sapiens
tatagttactgtgtaattag

SEQ ID NO: 1453793 - DNA, 22 bp, Homo sapiens
tatagttactgtgtaattagtg

SEQ ID NO: 1453794 - DNA, 17 bp, Homo sapiens
tatagttccttgcctta

SEQ ID NO: 1453795 - DNA, 23 bp, Homo sapiens
tatagttccttgccttaataaat

SEQ ID NO: 1453796 - DNA, 12 bp, Homo sapiens
tatagttctagg

SEQ ID NO: 1453797 - DNA, 15 bp, Homo sapiens
tatagttgaacaaga

SEQ ID NO: 1453798 - DNA, 19 bp, Homo sapiens
tatagtttattgacaataa

SEQ ID NO: 1453799 - DNA, 14 bp, Homo sapiens
tatagtttctgagg

SEQ ID NO: 1453800 - DNA, 22 bp, Homo sapiens
tatagtttctgaggctttatga

SEQ ID NO: 1453801 - DNA, 15 bp, Homo sapiens
tatagttttactttt

SEQ ID NO: 1453802 - DNA, 23 bp, Homo sapiens
tatagttttacttttaaactgtg

SEQ ID NO: 1453803 - DNA, 19 bp, Homo sapiens
tatataaaacggtgctgtg

SEQ ID NO: 1453804 - DNA, 15 bp, Homo sapiens
tatataaaatacata

SEQ ID NO: 1453805 - DNA, 23 bp, Homo sapiens
tatataaagcacagatttgcatt

SEQ ID NO: 1453806 - DNA, 14 bp, Homo sapiens
tatataacatatat

SEQ ID NO: 1453807 - DNA, 18 bp, Homo sapiens
tatataacatatatggaa

SEQ ID NO: 1453808 - DNA, 22 bp, Homo sapiens
tatataaccctaggaatttaga

SEQ ID NO: 1453809 - DNA, 13 bp, Homo sapiens
tatataacttttt

SEQ ID NO: 1453810 - DNA, 18 bp, Homo sapiens
tatataagtattctaaat

SEQ ID NO: 1453811 - DNA, 17 bp, Homo sapiens
tatatacaataacataa

SEQ ID NO: 1453812 - DNA, 22 bp, Homo sapiens
tatatacaataacataatttgt

SEQ ID NO: 1453813 - DNA, 23 bp, Homo sapiens
tatatacagtaactttatgtgta

SEQ ID NO: 1453814 - DNA, 18 bp, Homo sapiens
tatatacatagaaacttt

SEQ ID NO: 1453815 - DNA, 22 bp, Homo sapiens
tatatacatgggtgaattatgt

SEQ ID NO: 1453816 - DNA, 14 bp, Homo sapiens
tatatagtatattt

SEQ ID NO: 1453817 - DNA, 18 bp, Homo sapiens
tatatagtatatttatac

SEQ ID NO: 1453818 - DNA, 21 bp, Homo sapiens
tatatagtatatttatactct

SEQ ID NO: 1453819 - DNA, 23 bp, Homo sapiens
tatatataaagacaacaaaagaa

SEQ ID NO: 1453820 - DNA, 14 bp, Homo sapiens
tatatatacatata

SEQ ID NO: 1453821 - DNA, 15 bp, Homo sapiens
tatatatacatatat

SEQ ID NO: 1453822 - DNA, 17 bp, Homo sapiens
tatatatacatatgtaa

SEQ ID NO: 1453823 - DNA, 12 bp, Homo sapiens
tatatatagaat

SEQ ID NO: 1453824 - DNA, 12 bp, Homo sapiens
tatatatagtaa

SEQ ID NO: 1453825 - DNA, 11 bp, Homo sapiens
tatatatataa

SEQ ID NO: 1453826 - DNA, 14 bp, Homo sapiens
tatatatataaatg

SEQ ID NO: 1453827 - DNA, 12 bp, Homo sapiens
tatatatatcta

SEQ ID NO: 1453828 - DNA, 15 bp, Homo sapiens
tatatatatgcatat

SEQ ID NO: 1453829 - DNA, 13 bp, Homo sapiens
tatatatatgtgt

SEQ ID NO: 1453830 - DNA, 20 bp, Homo sapiens
tatatatctattattcaaaa

SEQ ID NO: 1453831 - DNA, 15 bp, Homo sapiens
tatatatcttttgta

SEQ ID NO: 1453832 - DNA, 16 bp, Homo sapiens
tatatatcttttgtaa

SEQ ID NO: 1453833 - DNA, 19 bp, Homo sapiens
tatatatcttttgtaagac

SEQ ID NO: 1453834 - DNA, 15 bp, Homo sapiens
tatatatgtatatgt

SEQ ID NO: 1453835 - DNA, 20 bp, Homo sapiens
tatatatgtatatgtatata

SEQ ID NO: 1453836 - DNA, 13 bp, Homo sapiens
tatatatgtcaat

SEQ ID NO: 1453837 - DNA, 12 bp, Homo sapiens
tatatatgtgta

SEQ ID NO: 1453838 - DNA, 14 bp, Homo sapiens
tatatatgtgtatg

SEQ ID NO: 1453839 - DNA, 16 bp, Homo sapiens
tatatatgtgtatgta

SEQ ID NO: 1453840 - DNA, 14 bp, Homo sapiens
tatatatgtgtgtg

SEQ ID NO: 1453841 - DNA, 15 bp, Homo sapiens
tatatattatatata

SEQ ID NO: 1453842 - DNA, 16 bp, Homo sapiens
tatcaaatctgtatat

SEQ ID NO: 1453843 - DNA, 22 bp, Homo sapiens
tatcaaatctgtatatgttgta

SEQ ID NO: 1453844 - DNA, 18 bp, Homo sapiens
tatcaacctaagcaacag

SEQ ID NO: 1453845 - DNA, 19 bp, Homo sapiens
tatcaacttagtcaataag

SEQ ID NO: 1453846 - DNA, 18 bp, Homo sapiens
tatcaacttcgctagaaa

SEQ ID NO: 1453847 - DNA, 19 bp, Homo sapiens
tatcaacttcgctagaaaa

SEQ ID NO: 1453848 - DNA, 17 bp, Homo sapiens
tatcaagtggcatgtgc

SEQ ID NO: 1453849 - DNA, 14 bp, Homo sapiens
tatcaatatctaat

SEQ ID NO: 1453850 - DNA, 15 bp, Homo sapiens
tatcaatcagtataa

SEQ ID NO: 1453851 - DNA, 21 bp, Homo sapiens
tatcaatttttcccagtattt

SEQ ID NO: 1453852 - DNA, 16 bp, Homo sapiens
tatcacaaatcttaac

SEQ ID NO: 1453853 - DNA, 14 bp, Homo sapiens
tatcacacaatata

SEQ ID NO: 1453854 - DNA, 15 bp, Homo sapiens
tatcacattttatta

SEQ ID NO: 1453855 - DNA, 17 bp, Homo sapiens
tatcactaatttcttct

SEQ ID NO: 1453856 - DNA, 14 bp, Homo sapiens
tatcactgtctttg

SEQ ID NO: 1453857 - DNA, 16 bp, Homo sapiens
tatcacttaaacttgc

SEQ ID NO: 1453858 - DNA, 14 bp, Homo sapiens
tatcacttatatat

SEQ ID NO: 1453859 - DNA, 18 bp, Homo sapiens
tatcagaagtatatctgt

SEQ ID NO: 1453860 - DNA, 10 bp, Homo sapiens
tatcagaatt

SEQ ID NO: 1453861 - DNA, 17 bp, Homo sapiens
tatcagaattctcagaa

SEQ ID NO: 1453862 - DNA, 14 bp, Homo sapiens
tatcagacaagcac

SEQ ID NO: 1453863 - DNA, 17 bp, Homo sapiens
tatcagacaagcactat

SEQ ID NO: 1453864 - DNA, 15 bp, Homo sapiens
tatcagagctcttaa

SEQ ID NO: 1453865 - DNA, 22 bp, Homo sapiens
tatcagagctcttaatgttgct

SEQ ID NO: 1453866 - DNA, 15 bp, Homo sapiens
tatcagcacgtgtgg

SEQ ID NO: 1453867 - DNA, 11 bp, Homo sapiens
tatcagcacta

SEQ ID NO: 1453868 - DNA, 19 bp, Homo sapiens
tatcagggtataaattata

SEQ ID NO: 1453869 - DNA, 21 bp, Homo sapiens
tatcagtatcacgatttgcag

SEQ ID NO: 1453870 - DNA, 13 bp, Homo sapiens
tatcagtattctg

SEQ ID NO: 1453871 - DNA, 14 bp, Homo sapiens
tatcagtattctga

SEQ ID NO: 1453872 - DNA, 13 bp, Homo sapiens
tatcagtgcttcc

SEQ ID NO: 1453873 - DNA, 18 bp, Homo sapiens
tatcagtgctttgttgat

SEQ ID NO: 1453874 - DNA, 17 bp, Homo sapiens
tatcagtgtaagccctg

SEQ ID NO: 1453875 - DNA, 16 bp, Homo sapiens
tatcagtgtcctttcc

SEQ ID NO: 1453876 - DNA, 18 bp, Homo sapiens
tatcagtgtcctttccag

SEQ ID NO: 1453877 - DNA, 18 bp, Homo sapiens
cattctctcccatcctgg

SEQ ID NO: 1453878 - DNA, 13 bp, Homo sapiens
cattctctgaaga

SEQ ID NO: 1453879 - DNA, 14 bp, Homo sapiens
cattctctttgata

SEQ ID NO: 1453880 - DNA, 15 bp, Homo sapiens
cattctctttgataa

SEQ ID NO: 1453881 - DNA, 19 bp, Homo sapiens
cattctctttgataacaaa

SEQ ID NO: 1453882 - DNA, 22 bp, Homo sapiens
cattctctttgataacaaaaaa

SEQ ID NO: 1453883 - DNA, 13 bp, Homo sapiens
cattctcttttaa

SEQ ID NO: 1453884 - DNA, 14 bp, Homo sapiens
cattctcttttaat

SEQ ID NO: 1453885 - DNA, 12 bp, Homo sapiens
cattctgactcg

SEQ ID NO: 1453886 - DNA, 16 bp, Homo sapiens
cattctgactcggttt

SEQ ID NO: 1453887 - DNA, 21 bp, Homo sapiens
cattctgactcggtttctcca

SEQ ID NO: 1453888 - DNA, 15 bp, Homo sapiens
cattctgagaccaaa

SEQ ID NO: 1453889 - DNA, 15 bp, Homo sapiens
cattctgcattgcta

SEQ ID NO: 1453890 - DNA, 18 bp, Homo sapiens
cattctgccgccccctcc

SEQ ID NO: 1453891 - DNA, 20 bp, Homo sapiens
cattctggggaaacaacatt

SEQ ID NO: 1453892 - DNA, 13 bp, Homo sapiens
cattctgttttcc

SEQ ID NO: 1453893 - DNA, 21 bp, Homo sapiens
cattcttaaaattcaagaaaa

SEQ ID NO: 1453894 - DNA, 18 bp, Homo sapiens
cattcttaacaaactctt

SEQ ID NO: 1453895 - DNA, 21 bp, Homo sapiens
cattcttacaattgcactgct

SEQ ID NO: 1453896 - DNA, 24 bp, Homo sapiens
cattcttacaattgcactgctgtt

SEQ ID NO: 1453897 - DNA, 17 bp, Homo sapiens
cattcttattgacaatt

SEQ ID NO: 1453898 - DNA, 15 bp, Homo sapiens
cattcttattttaga

SEQ ID NO: 1453899 - DNA, 15 bp, Homo sapiens
cattcttccatcatc

SEQ ID NO: 1453900 - DNA, 19 bp, Homo sapiens
cattcttcgacatccgtca

SEQ ID NO: 1453901 - DNA, 18 bp, Homo sapiens
cattcttctgagcactgt

SEQ ID NO: 1453902 - DNA, 19 bp, Homo sapiens
cattcttctgagcactgtt

SEQ ID NO: 1453903 - DNA, 14 bp, Homo sapiens
cattcttgtgggag

SEQ ID NO: 1453904 - DNA, 17 bp, Homo sapiens
cattcttgtgggagaca

SEQ ID NO: 1453905 - DNA, 17 bp, Homo sapiens
cattctttactgcactc

SEQ ID NO: 1453906 - DNA, 20 bp, Homo sapiens
cattctttactgcactcaga

SEQ ID NO: 1453907 - DNA, 15 bp, Homo sapiens
cattctttcagctgt

SEQ ID NO: 1453908 - DNA, 12 bp, Homo sapiens
cattctttggta

SEQ ID NO: 1453909 - DNA, 13 bp, Homo sapiens
cattctttggtaa

SEQ ID NO: 1453910 - DNA, 17 bp, Homo sapiens
cattctttggtaatttt

SEQ ID NO: 1453911 - DNA, 17 bp, Homo sapiens
cattcttttatagagca

SEQ ID NO: 1453912 - DNA, 15 bp, Homo sapiens
cattgaaaacagata

SEQ ID NO: 1453913 - DNA, 20 bp, Homo sapiens
cattgaaaacagatattaca

SEQ ID NO: 1453914 - DNA, 22 bp, Homo sapiens
cattgaaagagaaccagtttca

SEQ ID NO: 1453915 - DNA, 13 bp, Homo sapiens
cattgaaggctta

SEQ ID NO: 1453916 - DNA, 19 bp, Homo sapiens
cattgaagtaatgaatttt

SEQ ID NO: 1453917 - DNA, 19 bp, Homo sapiens
cattgaatggatcaataca

SEQ ID NO: 1453918 - DNA, 19 bp, Homo sapiens
cattgaccaagaactgcat

SEQ ID NO: 1453919 - DNA, 21 bp, Homo sapiens
cattgaccaagaactgcatgg

SEQ ID NO: 1453920 - DNA, 15 bp, Homo sapiens
cattgaccagctctc

SEQ ID NO: 1453921 - DNA, 22 bp, Homo sapiens
cattgaccagctctcttcctgt

SEQ ID NO: 1453922 - DNA, 21 bp, Homo sapiens
cattgaccgtgctggccccag

SEQ ID NO: 1453923 - DNA, 14 bp, Homo sapiens
cattgacctcagct

SEQ ID NO: 1453924 - DNA, 17 bp, Homo sapiens
cattgacctcagctgca

SEQ ID NO: 1453925 - DNA, 18 bp, Homo sapiens
cattgacttttataaagc

SEQ ID NO: 1453926 - DNA, 18 bp, Homo sapiens
cattgagaactgcatatg

SEQ ID NO: 1453927 - DNA, 18 bp, Homo sapiens
cattgagagttttgtctt

SEQ ID NO: 1453928 - DNA, 14 bp, Homo sapiens
cattgagctgtgca

SEQ ID NO: 1453929 - DNA, 9 bp, Homo sapiens
cattgagta

SEQ ID NO: 1453930 - DNA, 10 bp, Homo sapiens
cattgagtat

SEQ ID NO: 1453931 - DNA, 14 bp, Homo sapiens
cattgagtattgtt

SEQ ID NO: 1453932 - DNA, 18 bp, Homo sapiens
cattgagtattgtttaaa

SEQ ID NO: 1453933 - DNA, 15 bp, Homo sapiens
cattgattcagcctg

SEQ ID NO: 1453934 - DNA, 17 bp, Homo sapiens
cattgattgtcagctac

SEQ ID NO: 1453935 - DNA, 21 bp, Homo sapiens
cattgcaacaaaatacattct

SEQ ID NO: 1453936 - DNA, 14 bp, Homo sapiens
cattgcaataaatg

SEQ ID NO: 1453937 - DNA, 19 bp, Homo sapiens
cattgcacataagcttcca

SEQ ID NO: 1453938 - DNA, 17 bp, Homo sapiens
cattgcacctgcaggct

SEQ ID NO: 1453939 - DNA, 17 bp, Homo sapiens
cattgcactccagcctg

SEQ ID NO: 1453940 - DNA, 18 bp, Homo sapiens
cattgcactccagcctgg

SEQ ID NO: 1453941 - DNA, 20 bp, Homo sapiens
cattgcagtttaagagcaga

SEQ ID NO: 1453942 - DNA, 21 bp, Homo sapiens
cattgcccctccgatgctgag

SEQ ID NO: 1453943 - DNA, 14 bp, Homo sapiens
cattgcctggactg

SEQ ID NO: 1453944 - DNA, 16 bp, Homo sapiens
cattgcctggactgac

SEQ ID NO: 1453945 - DNA, 18 bp, Homo sapiens
cattgcctggactgacca

SEQ ID NO: 1453946 - DNA, 16 bp, Homo sapiens
cattgcctgtaacaat

SEQ ID NO: 1453947 - DNA, 19 bp, Homo sapiens
cattgcctgttctgcttcg

SEQ ID NO: 1453948 - DNA, 17 bp, Homo sapiens
cattgccttaactggag

SEQ ID NO: 1453949 - DNA, 21 bp, Homo sapiens
cattgccttctctgcccacag

SEQ ID NO: 1453950 - DNA, 22 bp, Homo sapiens
cattgctaaccactgtctgtcc

SEQ ID NO: 1453951 - DNA, 14 bp, Homo sapiens
cattgctaccacag

SEQ ID NO: 1453952 - DNA, 16 bp, Homo sapiens
cattgctaccacagac

SEQ ID NO: 1453953 - DNA, 15 bp, Homo sapiens
cattgctagataaaa

SEQ ID NO: 1453954 - DNA, 13 bp, Homo sapiens
cattgctcagccc

SEQ ID NO: 1453955 - DNA, 22 bp, Homo sapiens
cattgctcagcccgcttggcca

SEQ ID NO: 1453956 - DNA, 15 bp, Homo sapiens
cattgctcccctgat

SEQ ID NO: 1453957 - DNA, 20 bp, Homo sapiens
cattgctcccctgatagaag

SEQ ID NO: 1453958 - DNA, 18 bp, Homo sapiens
tatcgtttttgtattttc

SEQ ID NO: 1453959 - DNA, 20 bp, Homo sapiens
tatctaatacctctgtgtgc

SEQ ID NO: 1453960 - DNA, 14 bp, Homo sapiens
tatctaatatgaag

SEQ ID NO: 1453961 - DNA, 15 bp, Homo sapiens
tatctaccattgaag

SEQ ID NO: 1453962 - DNA, 22 bp, Homo sapiens
tatctaccccagactagatgta

SEQ ID NO: 1453963 - DNA, 18 bp, Homo sapiens
tatctagaaagaaaagac

SEQ ID NO: 1453964 - DNA, 21 bp, Homo sapiens
tatctagaaagaaaagaccct

SEQ ID NO: 1453965 - DNA, 15 bp, Homo sapiens
tatctagcaagaaga

SEQ ID NO: 1453966 - DNA, 23 bp, Homo sapiens
tatctagcaagaagattctaaaa

SEQ ID NO: 1453967 - DNA, 11 bp, Homo sapiens
tatctagctct

SEQ ID NO: 1453968 - DNA, 17 bp, Homo sapiens
tatctagtatgaaatta

SEQ ID NO: 1453969 - DNA, 18 bp, Homo sapiens
tatctataaaatagatat

SEQ ID NO: 1453970 - DNA, 16 bp, Homo sapiens
tatctatagcaactca

SEQ ID NO: 1453971 - DNA, 16 bp, Homo sapiens
tatctatatatgtgta

SEQ ID NO: 1453972 - DNA, 14 bp, Homo sapiens
tatctatatcatat

SEQ ID NO: 1453973 - DNA, 17 bp, Homo sapiens
tatctatatcatatttc

SEQ ID NO: 1453974 - DNA, 23 bp, Homo sapiens
tatctatatcatatttctgtgga

SEQ ID NO: 1453975 - DNA, 15 bp, Homo sapiens
tatctattaatatat

SEQ ID NO: 1453976 - DNA, 17 bp, Homo sapiens
tatctattaatatatgt

SEQ ID NO: 1453977 - DNA, 18 bp, Homo sapiens
tatctattaatatatgta

SEQ ID NO: 1453978 - DNA, 18 bp, Homo sapiens
tatctatttgtacaattt

SEQ ID NO: 1453979 - DNA, 22 bp, Homo sapiens
tatctcaatgaaccataaattc

SEQ ID NO: 1453980 - DNA, 12 bp, Homo sapiens
tatctcagaaag

SEQ ID NO: 1453981 - DNA, 16 bp, Homo sapiens
tatctcagatatttgc

SEQ ID NO: 1453982 - DNA, 17 bp, Homo sapiens
tatctcagatatttgca

SEQ ID NO: 1453983 - DNA, 21 bp, Homo sapiens
tatctcagtctaaggtctcat

SEQ ID NO: 1453984 - DNA, 13 bp, Homo sapiens
tatctcatactgt

SEQ ID NO: 1453985 - DNA, 16 bp, Homo sapiens
tatctccgttccatct

SEQ ID NO: 1453986 - DNA, 15 bp, Homo sapiens
tatctcgtaatagct

SEQ ID NO: 1453987 - DNA, 20 bp, Homo sapiens
tatctcgtaatagcttctgt

SEQ ID NO: 1453988 - DNA, 16 bp, Homo sapiens
tatctctatttgagaa

SEQ ID NO: 1453989 - DNA, 22 bp, Homo sapiens
tatctctgccaacatgaggaca

SEQ ID NO: 1453990 - DNA, 22 bp, Homo sapiens
tatctctttgatctacttgcct

SEQ ID NO: 1453991 - DNA, 20 bp, Homo sapiens
tatctgaaaatgtatgtgta

SEQ ID NO: 1453992 - DNA, 18 bp, Homo sapiens
tatctgacccactttgta

SEQ ID NO: 1453993 - DNA, 22 bp, Homo sapiens
tatctgacccactttgtaattt

SEQ ID NO: 1453994 - DNA, 23 bp, Homo sapiens
tatctgagggaggaggccacctc

SEQ ID NO: 1453995 - DNA, 19 bp, Homo sapiens
tatctgcaaatagtttcaa

SEQ ID NO: 1453996 - DNA, 16 bp, Homo sapiens
tatgacagctgtccct

SEQ ID NO: 1453997 - DNA, 20 bp, Homo sapiens
tatgacagctgtccctgtca

SEQ ID NO: 1453998 - DNA, 14 bp, Homo sapiens
tatgacccacactg

SEQ ID NO: 1453999 - DNA, 23 bp, Homo sapiens
tatgacccacactgccagaagag

SEQ ID NO: 1454000 - DNA, 22 bp, Homo sapiens
tatgacccacattactttttat

SEQ ID NO: 1454001 - DNA, 13 bp, Homo sapiens
tatgactaaagag

SEQ ID NO: 1454002 - DNA, 19 bp, Homo sapiens
tatgactaaagagagaatg

SEQ ID NO: 1454003 - DNA, 20 bp, Homo sapiens
tatgactaaagagagaatgt

SEQ ID NO: 1454004 - DNA, 22 bp, Homo sapiens
tatgactttttataaaatggct

SEQ ID NO: 1454005 - DNA, 21 bp, Homo sapiens
tatgagaagaaaaatggaaaa

SEQ ID NO: 1454006 - DNA, 22 bp, Homo sapiens
tatgagaagaaaaatggaaaaa

SEQ ID NO: 1454007 - DNA, 19 bp, Homo sapiens
tatgagaatataccttatt

SEQ ID NO: 1454008 - DNA, 15 bp, Homo sapiens
tatgagaggcaatga

SEQ ID NO: 1454009 - DNA, 17 bp, Homo sapiens
tatgagatggttaaaaa

SEQ ID NO: 1454010 - DNA, 21 bp, Homo sapiens
tatgagattggttttcctgtg

SEQ ID NO: 1454011 - DNA, 20 bp, Homo sapiens
tatgagcctgccctcactcc

SEQ ID NO: 1454012 - DNA, 23 bp, Homo sapiens
tatgagctggggatgtctctcat

SEQ ID NO: 1454013 - DNA, 12 bp, Homo sapiens
tatgagcttcaa

SEQ ID NO: 1454014 - DNA, 13 bp, Homo sapiens
tatgagcttcaat

SEQ ID NO: 1454015 - DNA, 15 bp, Homo sapiens
tatgagcttcaatat

SEQ ID NO: 1454016 - DNA, 20 bp, Homo sapiens
tatgagcttcaatataagaa

SEQ ID NO: 1454017 - DNA, 23 bp, Homo sapiens
tatgagcttcaatataagaagca

SEQ ID NO: 1454018 - DNA, 17 bp, Homo sapiens
tatgaggacttgtgtct

SEQ ID NO: 1454019 - DNA, 21 bp, Homo sapiens
tatgagggttgaagacggaaa

SEQ ID NO: 1454020 - DNA, 22 bp, Homo sapiens
tatgagtttttgatagctttat

SEQ ID NO: 1454021 - DNA, 15 bp, Homo sapiens
tatgataaaacactg

SEQ ID NO: 1454022 - DNA, 13 bp, Homo sapiens
tatgatatttctt

SEQ ID NO: 1454023 - DNA, 22 bp, Homo sapiens
tatgatattttctgtgcctgaa

SEQ ID NO: 1454024 - DNA, 17 bp, Homo sapiens
tatgatcacagtgactt

SEQ ID NO: 1454025 - DNA, 18 bp, Homo sapiens
tatgatcaggtaactttc

SEQ ID NO: 1454026 - DNA, 19 bp, Homo sapiens
tatgatcagtactgacttt

SEQ ID NO: 1454027 - DNA, 16 bp, Homo sapiens
tatgatctaataaact

SEQ ID NO: 1454028 - DNA, 17 bp, Homo sapiens
tatgatctaataaactt

SEQ ID NO: 1454029 - DNA, 20 bp, Homo sapiens
tatgatctaataaactttat

SEQ ID NO: 1454030 - DNA, 13 bp, Homo sapiens
tatgatctcagga

SEQ ID NO: 1454031 - DNA, 16 bp, Homo sapiens
tatgatgcatacagtt

SEQ ID NO: 1454032 - DNA, 17 bp, Homo sapiens
tatgatgcatacagttt

SEQ ID NO: 1454033 - DNA, 23 bp, Homo sapiens
tatgatgcatacagttttctagc

SEQ ID NO: 1454034 - DNA, 16 bp, Homo sapiens
tatgatgctaagctga

SEQ ID NO: 1454035 - DNA, 17 bp, Homo sapiens
tatgatgtaatctctct

SEQ ID NO: 1454036 - DNA, 22 bp, Homo sapiens
tatgatgtaatctctctgcagc

SEQ ID NO: 1454037 - DNA, 14 bp, Homo sapiens
tatgattctgcttt

SEQ ID NO: 1454038 - DNA, 19 bp, Homo sapiens
tatgattctgcttttacca

SEQ ID NO: 1454039 - DNA, 14 bp, Homo sapiens
cattgtaaaataat

SEQ ID NO: 1454040 - DNA, 15 bp, Homo sapiens
cattgtactccagcc

SEQ ID NO: 1454041 - DNA, 22 bp, Homo sapiens
cattgtactccagcctgggcaa

SEQ ID NO: 1454042 - DNA, 13 bp, Homo sapiens
cattgtactgttg

SEQ ID NO: 1454043 - DNA, 14 bp, Homo sapiens
cattgtagaaacac

SEQ ID NO: 1454044 - DNA, 15 bp, Homo sapiens
cattgtattagatct

SEQ ID NO: 1454045 - DNA, 16 bp, Homo sapiens
cattgtcctgtagctt

SEQ ID NO: 1454046 - DNA, 13 bp, Homo sapiens
cattgtctaatga

SEQ ID NO: 1454047 - DNA, 16 bp, Homo sapiens
cattgtctaatgacag

SEQ ID NO: 1454048 - DNA, 19 bp, Homo sapiens
cattgtctcctatatattt

SEQ ID NO: 1454049 - DNA, 21 bp, Homo sapiens
cattgtctcctatatatttct

SEQ ID NO: 1454050 - DNA, 13 bp, Homo sapiens
cattgtctttgct

SEQ ID NO: 1454051 - DNA, 18 bp, Homo sapiens
cattgtgactgtgtttgc

SEQ ID NO: 1454052 - DNA, 22 bp, Homo sapiens
cattgtgggatgttcagcactg

SEQ ID NO: 1454053 - DNA, 20 bp, Homo sapiens
cattgttatttaatagctgt

SEQ ID NO: 1454054 - DNA, 16 bp, Homo sapiens
cattgttcccttcctc

SEQ ID NO: 1454055 - DNA, 23 bp, Homo sapiens
cattgttcccttcctcttcctgc

SEQ ID NO: 1454056 - DNA, 19 bp, Homo sapiens
cattgttcttattctggca

SEQ ID NO: 1454057 - DNA, 17 bp, Homo sapiens
cattgttggacatttgg

SEQ ID NO: 1454058 - DNA, 16 bp, Homo sapiens
cattgttgtgtctgtg

SEQ ID NO: 1454059 - DNA, 17 bp, Homo sapiens
cattgtttattaacaaa

SEQ ID NO: 1454060 - DNA, 16 bp, Homo sapiens
cattgtttgctgctat

SEQ ID NO: 1454061 - DNA, 13 bp, Homo sapiens
cattgttttaaag

SEQ ID NO: 1454062 - DNA, 12 bp, Homo sapiens
cattgttttagt

SEQ ID NO: 1454063 - DNA, 23 bp, Homo sapiens
cattgtttttaagaaaaacatgt

SEQ ID NO: 1454064 - DNA, 18 bp, Homo sapiens
catttaaaacagacactg

SEQ ID NO: 1454065 - DNA, 20 bp, Homo sapiens
catttaaaataccactgtaa

SEQ ID NO: 1454066 - DNA, 21 bp, Homo sapiens
catttaaaataccactgtaat

SEQ ID NO: 1454067 - DNA, 22 bp, Homo sapiens
catttaaaataccactgtaatt

SEQ ID NO: 1454068 - DNA, 22 bp, Homo sapiens
catttaaaattgctatgttact

SEQ ID NO: 1454069 - DNA, 16 bp, Homo sapiens
catttaaagctaaatt

SEQ ID NO: 1454070 - DNA, 18 bp, Homo sapiens
catttaaagctaaatttt

SEQ ID NO: 1454071 - DNA, 22 bp, Homo sapiens
catttaaatgtaacttattatt

SEQ ID NO: 1454072 - DNA, 17 bp, Homo sapiens
catttaaatttgatttc

SEQ ID NO: 1454073 - DNA, 18 bp, Homo sapiens
catttaaatttgatttcc

SEQ ID NO: 1454074 - DNA, 15 bp, Homo sapiens
catttaagtatcttg

SEQ ID NO: 1454075 - DNA, 12 bp, Homo sapiens
catttaataaag

SEQ ID NO: 1454076 - DNA, 14 bp, Homo sapiens
catttaataaagat

SEQ ID NO: 1454077 - DNA, 19 bp, Homo sapiens
catttaataaagatgagtt

SEQ ID NO: 1454078 - DNA, 21 bp, Homo sapiens
catttaatggcagctagtgcc

SEQ ID NO: 1454079 - DNA, 18 bp, Homo sapiens
catttacaataaatattc

SEQ ID NO: 1454080 - DNA, 19 bp, Homo sapiens
catttacaataaatattct

SEQ ID NO: 1454081 - DNA, 23 bp, Homo sapiens
catttacaataaatattctgcat

SEQ ID NO: 1454082 - DNA, 17 bp, Homo sapiens
catttactcttcttcat

SEQ ID NO: 1454083 - DNA, 12 bp, Homo sapiens
catttagaaaat

SEQ ID NO: 1454084 - DNA, 15 bp, Homo sapiens
catttagaaaataga

SEQ ID NO: 1454085 - DNA, 16 bp, Homo sapiens
catttagaagaaagat

SEQ ID NO: 1454086 - DNA, 20 bp, Homo sapiens
catttagaagaaagatgttt

SEQ ID NO: 1454087 - DNA, 20 bp, Homo sapiens
catttagaatggtgatttta

SEQ ID NO: 1454088 - DNA, 21 bp, Homo sapiens
catttagagaggaaaagtaac

SEQ ID NO: 1454089 - DNA, 20 bp, Homo sapiens
catttaggagaatagcagag

SEQ ID NO: 1454090 - DNA, 14 bp, Homo sapiens
catttagtaagaat

SEQ ID NO: 1454091 - DNA, 17 bp, Homo sapiens
catttagtgctaaacaa

SEQ ID NO: 1454092 - DNA, 18 bp, Homo sapiens
catttataaagctaaaat

SEQ ID NO: 1454093 - DNA, 21 bp, Homo sapiens
catttataatgtttgctattg

SEQ ID NO: 1454094 - DNA, 19 bp, Homo sapiens
catttatatatatatgtat

SEQ ID NO: 1454095 - DNA, 21 bp, Homo sapiens
catttatatctgcttctagct

SEQ ID NO: 1454096 - DNA, 20 bp, Homo sapiens
catttatcaatcagtataat

SEQ ID NO: 1454097 - DNA, 22 bp, Homo sapiens
catttatctataatttacctaa

SEQ ID NO: 1454098 - DNA, 18 bp, Homo sapiens
catttatttacactcttg

SEQ ID NO: 1454099 - DNA, 15 bp, Homo sapiens
catttattttgagaa

SEQ ID NO: 1454100 - DNA, 19 bp, Homo sapiens
catttattttttacattat

SEQ ID NO: 1454101 - DNA, 22 bp, Homo sapiens
catttcaaaaccaaggaagcag

SEQ ID NO: 1454102 - DNA, 19 bp, Homo sapiens
catttcaaagccctgcctc

SEQ ID NO: 1454103 - DNA, 17 bp, Homo sapiens
catttcaattcctggcc

SEQ ID NO: 1454104 - DNA, 19 bp, Homo sapiens
catttcaattcctggccct

SEQ ID NO: 1454105 - DNA, 19 bp, Homo sapiens
catttcacacataagaaaa

SEQ ID NO: 1454106 - DNA, 17 bp, Homo sapiens
catttcacatgccttgc

SEQ ID NO: 1454107 - DNA, 20 bp, Homo sapiens
catttcacccctccctttct

SEQ ID NO: 1454108 - DNA, 22 bp, Homo sapiens
catttcacccctccctttctcc

SEQ ID NO: 1454109 - DNA, 23 bp, Homo sapiens
catttcacccctccctttctccc

SEQ ID NO: 1454110 - DNA, 24 bp, Homo sapiens
tatggaatacagtgttattttctt

SEQ ID NO: 1454111 - DNA, 22 bp, Homo sapiens
tatggacaacttatttaaaaat

SEQ ID NO: 1454112 - DNA, 21 bp, Homo sapiens
tatggactatctgtctggtgg

SEQ ID NO: 1454113 - DNA, 15 bp, Homo sapiens
tatggactctgcaca

SEQ ID NO: 1454114 - DNA, 13 bp, Homo sapiens
tatggagcctggc

SEQ ID NO: 1454115 - DNA, 18 bp, Homo sapiens
tatggaggattctttccc

SEQ ID NO: 1454116 - DNA, 21 bp, Homo sapiens
tatggaggattctttccccag

SEQ ID NO: 1454117 - DNA, 22 bp, Homo sapiens
tatggaggattctttccccaga

SEQ ID NO: 1454118 - DNA, 19 bp, Homo sapiens
tatggagtagcaaaggact

SEQ ID NO: 1454119 - DNA, 22 bp, Homo sapiens
tatggagtgagtcacctgctcc

SEQ ID NO: 1454120 - DNA, 22 bp, Homo sapiens
tatggcagaaaaaatgtctgta

SEQ ID NO: 1454121 - DNA, 23 bp, Homo sapiens
tatggcagaagggaattgctcag

SEQ ID NO: 1454122 - DNA, 16 bp, Homo sapiens
tatggcagaggtgcaa

SEQ ID NO: 1454123 - DNA, 18 bp, Homo sapiens
tatggcagtccagccagc

SEQ ID NO: 1454124 - DNA, 20 bp, Homo sapiens
tatggcagtccagccagctc

SEQ ID NO: 1454125 - DNA, 18 bp, Homo sapiens
tatggcccagaaacaaca

SEQ ID NO: 1454126 - DNA, 22 bp, Homo sapiens
tatggcccagtgtcaagttgtg

SEQ ID NO: 1454127 - DNA, 21 bp, Homo sapiens
tatggctagacaggaaccctt

SEQ ID NO: 1454128 - DNA, 16 bp, Homo sapiens
tatggctataggtgct

SEQ ID NO: 1454129 - DNA, 18 bp, Homo sapiens
tatggctgtatttgctgt

SEQ ID NO: 1454130 - DNA, 15 bp, Homo sapiens
tatggcttatttcta

SEQ ID NO: 1454131 - DNA, 23 bp, Homo sapiens
tatggcttatttctatgacaaat

SEQ ID NO: 1454132 - DNA, 21 bp, Homo sapiens
tatgggaggcagccgaggcct

SEQ ID NO: 1454133 - DNA, 19 bp, Homo sapiens
tatgggatgtaaacaatgt

SEQ ID NO: 1454134 - DNA, 21 bp, Homo sapiens
tatgggcttccgcacatgccg

SEQ ID NO: 1454135 - DNA, 17 bp, Homo sapiens
tatggggatagatgtgt

SEQ ID NO: 1454136 - DNA, 20 bp, Homo sapiens
tatggggatagatgtgtgga

SEQ ID NO: 1454137 - DNA, 16 bp, Homo sapiens
tatgggggatttcaaa

SEQ ID NO: 1454138 - DNA, 18 bp, Homo sapiens
tatgggtagggtaaatca

SEQ ID NO: 1454139 - DNA, 15 bp, Homo sapiens
tatgggtcacaggaa

SEQ ID NO: 1454140 - DNA, 14 bp, Homo sapiens
tatgggtcctgcaa

SEQ ID NO: 1454141 - DNA, 14 bp, Homo sapiens
tatgggtgaaaata

SEQ ID NO: 1454142 - DNA, 22 bp, Homo sapiens
tatgggttagatgttgccatgt

SEQ ID NO: 1454143 - DNA, 21 bp, Homo sapiens
tatggtaggaactgctgggct

SEQ ID NO: 1454144 - DNA, 13 bp, Homo sapiens
tatggtataatgg

SEQ ID NO: 1454145 - DNA, 17 bp, Homo sapiens
tatggtatatatacata

SEQ ID NO: 1454146 - DNA, 14 bp, Homo sapiens
tatggtatgtagcc

SEQ ID NO: 1454147 - DNA, 22 bp, Homo sapiens
tatggtatgtagccagctgtgc

SEQ ID NO: 1454148 - DNA, 22 bp, Homo sapiens
tatggtcaacacttaagggttt

SEQ ID NO: 1454149 - DNA, 20 bp, Homo sapiens
tatggttacttcttctctta

SEQ ID NO: 1454150 - DNA, 14 bp, Homo sapiens
tatggttctccaag

SEQ ID NO: 1454151 - DNA, 16 bp, Homo sapiens
tatgtaaacaaatctt

SEQ ID NO: 1454152 - DNA, 14 bp, Homo sapiens
tatgtaaacataat

SEQ ID NO: 1454153 - DNA, 21 bp, Homo sapiens
tatgtaaatacaatttgtact

SEQ ID NO: 1454154 - DNA, 16 bp, Homo sapiens
tatgtaagaacacatt

SEQ ID NO: 1454155 - DNA, 15 bp, Homo sapiens
catttgagaaatgca

SEQ ID NO: 1454156 - DNA, 21 bp, Homo sapiens
catttgagggcccagccagga

SEQ ID NO: 1454157 - DNA, 22 bp, Homo sapiens
catttgagggcccagccaggag

SEQ ID NO: 1454158 - DNA, 16 bp, Homo sapiens
catttgatgcatgtct

SEQ ID NO: 1454159 - DNA, 17 bp, Homo sapiens
catttgatgcatgtctt

SEQ ID NO: 1454160 - DNA, 19 bp, Homo sapiens
catttgatgcatgtctttt

SEQ ID NO: 1454161 - DNA, 14 bp, Homo sapiens
catttgatgctaaa

SEQ ID NO: 1454162 - DNA, 18 bp, Homo sapiens
catttgatgtacatgtgt

SEQ ID NO: 1454163 - DNA, 20 bp, Homo sapiens
catttgatgtacatgtgtag

SEQ ID NO: 1454164 - DNA, 22 bp, Homo sapiens
catttgcacaaacttgtgagca

SEQ ID NO: 1454165 - DNA, 20 bp, Homo sapiens
catttgcactggagttctat

SEQ ID NO: 1454166 - DNA, 21 bp, Homo sapiens
catttgcactggagttctatg

SEQ ID NO: 1454167 - DNA, 23 bp, Homo sapiens
catttgcatatcacccttccctg

SEQ ID NO: 1454168 - DNA, 18 bp, Homo sapiens
catttgccaagggaggcg

SEQ ID NO: 1454169 - DNA, 12 bp, Homo sapiens
catttgctcttc

SEQ ID NO: 1454170 - DNA, 19 bp, Homo sapiens
catttgctcttcagatgcc

SEQ ID NO: 1454171 - DNA, 19 bp, Homo sapiens
catttgctctttcatctct

SEQ ID NO: 1454172 - DNA, 17 bp, Homo sapiens
catttgctgaactcagc

SEQ ID NO: 1454173 - DNA, 16 bp, Homo sapiens
catttgctgttttaaa

SEQ ID NO: 1454174 - DNA, 17 bp, Homo sapiens
catttgctttcctctga

SEQ ID NO: 1454175 - DNA, 20 bp, Homo sapiens
catttggagctcttgggtca

SEQ ID NO: 1454176 - DNA, 21 bp, Homo sapiens
catttggcaggggtggctgcc

SEQ ID NO: 1454177 - DNA, 23 bp, Homo sapiens
catttgggagtttttatgagaaa

SEQ ID NO: 1454178 - DNA, 14 bp, Homo sapiens
catttgggctctgg

SEQ ID NO: 1454179 - DNA, 15 bp, Homo sapiens
catttgggctctggt

SEQ ID NO: 1454180 - DNA, 18 bp, Homo sapiens
catttggtagatgttctt

SEQ ID NO: 1454181 - DNA, 20 bp, Homo sapiens
catttggtcaagattttgaa

SEQ ID NO: 1454182 - DNA, 14 bp, Homo sapiens
catttggtctcagg

SEQ ID NO: 1454183 - DNA, 18 bp, Homo sapiens
catttggtctgccagaat

SEQ ID NO: 1454184 - DNA, 18 bp, Homo sapiens
catttggtgttcctggaa

SEQ ID NO: 1454185 - DNA, 19 bp, Homo sapiens
catttggttttacacagga

SEQ ID NO: 1454186 - DNA, 13 bp, Homo sapiens
catttgtaacttt

SEQ ID NO: 1454187 - DNA, 18 bp, Homo sapiens
catttgtaataaagtata

SEQ ID NO: 1454188 - DNA, 20 bp, Homo sapiens
catttgtacaaggtaattgt

SEQ ID NO: 1454189 - DNA, 11 bp, Homo sapiens
catttgtattt

SEQ ID NO: 1454190 - DNA, 18 bp, Homo sapiens
catttgtattttgtgatg

SEQ ID NO: 1454191 - DNA, 20 bp, Homo sapiens
catttgtgctagaaattttc

SEQ ID NO: 1454192 - DNA, 18 bp, Homo sapiens
catttgtgtggaaatcat

SEQ ID NO: 1454193 - DNA, 18 bp, Homo sapiens
catttgttaaaattatca

SEQ ID NO: 1454194 - DNA, 12 bp, Homo sapiens
catttgttcctg

SEQ ID NO: 1454195 - DNA, 14 bp, Homo sapiens
catttgttcctgga

SEQ ID NO: 1454196 - DNA, 20 bp, Homo sapiens
catttgttcctggagttttg

SEQ ID NO: 1454197 - DNA, 16 bp, Homo sapiens
catttgttggaatgaa

SEQ ID NO: 1454198 - DNA, 22 bp, Homo sapiens
catttgtttattttttggaaga

SEQ ID NO: 1454199 - DNA, 13 bp, Homo sapiens
catttgttttagc

SEQ ID NO: 1454200 - DNA, 19 bp, Homo sapiens
catttgttttgcttttgtt

SEQ ID NO: 1454201 - DNA, 21 bp, Homo sapiens
cattttaaaaatagaatacat

SEQ ID NO: 1454202 - DNA, 18 bp, Homo sapiens
cattttaagtttgtagta

SEQ ID NO: 1454203 - DNA, 16 bp, Homo sapiens
cattttaattctctcc

SEQ ID NO: 1454204 - DNA, 14 bp, Homo sapiens
cattttaattttaa

SEQ ID NO: 1454205 - DNA, 18 bp, Homo sapiens
cattttaattttaaagtg

SEQ ID NO: 1454206 - DNA, 13 bp, Homo sapiens
cattttacacagc

SEQ ID NO: 1454207 - DNA, 14 bp, Homo sapiens
cattttagtgactg

SEQ ID NO: 1454208 - DNA, 16 bp, Homo sapiens
cattttagtgactgta

SEQ ID NO: 1454209 - DNA, 16 bp, Homo sapiens
cattttatatttttgt

SEQ ID NO: 1454210 - DNA, 19 bp, Homo sapiens
cattttatatttttgtaca

SEQ ID NO: 1454211 - DNA, 21 bp, Homo sapiens
cattttatatttttgtacata

SEQ ID NO: 1454212 - DNA, 19 bp, Homo sapiens
cattttattaaacacaggg

SEQ ID NO: 1454213 - DNA, 16 bp, Homo sapiens
cattttcaccccaccc

SEQ ID NO: 1454214 - DNA, 19 bp, Homo sapiens
cattttcactgcaatgtca

SEQ ID NO: 1454215 - DNA, 17 bp, Homo sapiens
cattttcagtcttgtag

SEQ ID NO: 1454216 - DNA, 14 bp, Homo sapiens
cattttcattccta

SEQ ID NO: 1454217 - DNA, 21 bp, Homo sapiens
cattttccatatcctggtgcc

SEQ ID NO: 1454218 - DNA, 16 bp, Homo sapiens
cattttcccatcatcc

SEQ ID NO: 1454219 - DNA, 20 bp, Homo sapiens
cattttccccccactctccc

SEQ ID NO: 1454220 - DNA, 22 bp, Homo sapiens
cattttccccccactctcccca

SEQ ID NO: 1454221 - DNA, 22 bp, Homo sapiens
cattttcctcttgtcctggccc

SEQ ID NO: 1454222 - DNA, 19 bp, Homo sapiens
cattttcctgacatttgtt

SEQ ID NO: 1454223 - DNA, 16 bp, Homo sapiens
tatgtggttttagatt

SEQ ID NO: 1454224 - DNA, 14 bp, Homo sapiens
tatgtgtaaaatgt

SEQ ID NO: 1454225 - DNA, 13 bp, Homo sapiens
tatgtgtatgtac

SEQ ID NO: 1454226 - DNA, 12 bp, Homo sapiens
tatgtgtatgtg

SEQ ID NO: 1454227 - DNA, 21 bp, Homo sapiens
tatgtgtgaggagctgctggc

SEQ ID NO: 1454228 - DNA, 13 bp, Homo sapiens
tatgtgtgtgtgt

SEQ ID NO: 1454229 - DNA, 14 bp, Homo sapiens
tatgtgtgtgtgtt

SEQ ID NO: 1454230 - DNA, 16 bp, Homo sapiens
tatgtgtttttcacat

SEQ ID NO: 1454231 - DNA, 19 bp, Homo sapiens
tatgttaacctcagtgtca

SEQ ID NO: 1454232 - DNA, 22 bp, Homo sapiens
tatgttaacctcagtgtcattt

SEQ ID NO: 1454233 - DNA, 16 bp, Homo sapiens
tatgttatacaaggca

SEQ ID NO: 1454234 - DNA, 19 bp, Homo sapiens
tatgttcctaacaaaatga

SEQ ID NO: 1454235 - DNA, 13 bp, Homo sapiens
tatgttctgtctt

SEQ ID NO: 1454236 - DNA, 17 bp, Homo sapiens
tatgttctgtcttccca

SEQ ID NO: 1454237 - DNA, 23 bp, Homo sapiens
tatgttcttagcaataaatgctt

SEQ ID NO: 1454238 - DNA, 15 bp, Homo sapiens
tatgttggtttaatt

SEQ ID NO: 1454239 - DNA, 13 bp, Homo sapiens
tatgttgtatgat

SEQ ID NO: 1454240 - DNA, 19 bp, Homo sapiens
tatgttgtatgattccaat

SEQ ID NO: 1454241 - DNA, 16 bp, Homo sapiens
tatgtttaaaagaaat

SEQ ID NO: 1454242 - DNA, 19 bp, Homo sapiens
tatgtttaaaagaaatata

SEQ ID NO: 1454243 - DNA, 19 bp, Homo sapiens
tatgtttaatctgttatgt

SEQ ID NO: 1454244 - DNA, 15 bp, Homo sapiens
tatgtttattacaat

SEQ ID NO: 1454245 - DNA, 15 bp, Homo sapiens
tatgtttcaaacttt

SEQ ID NO: 1454246 - DNA, 16 bp, Homo sapiens
tatgtttcaaactttg

SEQ ID NO: 1454247 - DNA, 13 bp, Homo sapiens
tatgtttgctgat

SEQ ID NO: 1454248 - DNA, 22 bp, Homo sapiens
tatgtttgctgattatttatga

SEQ ID NO: 1454249 - DNA, 18 bp, Homo sapiens
tatgtttttaatatgcat

SEQ ID NO: 1454250 - DNA, 15 bp, Homo sapiens
tattaaaaaacttca

SEQ ID NO: 1454251 - DNA, 15 bp, Homo sapiens
tattaaaaaagtcta

SEQ ID NO: 1454252 - DNA, 14 bp, Homo sapiens
tattaaaaacatga

SEQ ID NO: 1454253 - DNA, 15 bp, Homo sapiens
tattaaaaataaaat

SEQ ID NO: 1454254 - DNA, 20 bp, Homo sapiens
tattaaaacacaaagtcctt

SEQ ID NO: 1454255 - DNA, 19 bp, Homo sapiens
tattaaaactaaatttcac

SEQ ID NO: 1454256 - DNA, 16 bp, Homo sapiens
tattaaaactcatttt

SEQ ID NO: 1454257 - DNA, 13 bp, Homo sapiens
tattaaaatctta

SEQ ID NO: 1454258 - DNA, 11 bp, Homo sapiens
tattaaaattg

SEQ ID NO: 1454259 - DNA, 13 bp, Homo sapiens
tattaaaattgtt

SEQ ID NO: 1454260 - DNA, 22 bp, Homo sapiens
tattaaagaatccttatctata

SEQ ID NO: 1454261 - DNA, 19 bp, Homo sapiens
tattaaagattctctttaa

SEQ ID NO: 1454262 - DNA, 24 bp, Homo sapiens
tattaaagtgctaaggttctaagg

SEQ ID NO: 1454263 - DNA, 13 bp, Homo sapiens
tattaaatgtatt

SEQ ID NO: 1454264 - DNA, 21 bp, Homo sapiens
tattaaattaaattttgtgtc

SEQ ID NO: 1454265 - DNA, 12 bp, Homo sapiens
tattaaattaca

SEQ ID NO: 1454266 - DNA, 15 bp, Homo sapiens
tattaacgatgtcca

SEQ ID NO: 1454267 - DNA, 17 bp, Homo sapiens
tattaactcaaaagttg

SEQ ID NO: 1454268 - DNA, 19 bp, Homo sapiens
tattaactgctcagtgttt

SEQ ID NO: 1454269 - DNA, 20 bp, Homo sapiens
tattaagaaaggaagcattg

SEQ ID NO: 1454270 - DNA, 21 bp, Homo sapiens
tattaagaaaggaagcattgt

SEQ ID NO: 1454271 - DNA, 20 bp, Homo sapiens
tattaagaagcaataactat

SEQ ID NO: 1454272 - DNA, 18 bp, Homo sapiens
tattaagacagtgtacaa

SEQ ID NO: 1454273 - DNA, 22 bp, Homo sapiens
tattaagattataattgttgca

SEQ ID NO: 1454274 - DNA, 13 bp, Homo sapiens
tattaagcacttt

SEQ ID NO: 1454275 - DNA, 20 bp, Homo sapiens
tattaagcagtaaaaactgt

SEQ ID NO: 1454276 - DNA, 16 bp, Homo sapiens
tattaagcatgacaga

SEQ ID NO: 1454277 - DNA, 20 bp, Homo sapiens
tattaagcatgacagaaaat

SEQ ID NO: 1454278 - DNA, 13 bp, Homo sapiens
tattaagcttttt

SEQ ID NO: 1454279 - DNA, 17 bp, Homo sapiens
tattaaggaaaaaagca

SEQ ID NO: 1454280 - DNA, 17 bp, Homo sapiens
tattaagtgtgccaaat

SEQ ID NO: 1454281 - DNA, 22 bp, Homo sapiens
tattaagtgtgccaaatcagtt

SEQ ID NO: 1454282 - DNA, 14 bp, Homo sapiens
tattaataaaacaa

SEQ ID NO: 1454283 - DNA, 14 bp, Homo sapiens
tattaataaagcat

SEQ ID NO: 1454284 - DNA, 22 bp, Homo sapiens
tattaatattcagggtaaatag

SEQ ID NO: 1454285 - DNA, 13 bp, Homo sapiens
tattaatatttaa

SEQ ID NO: 1454286 - DNA, 20 bp, Homo sapiens
tattaatcatacaaactctc

SEQ ID NO: 1454287 - DNA, 14 bp, Homo sapiens
tattaatcatagat

SEQ ID NO: 1454288 - DNA, 19 bp, Homo sapiens
tattaatcatagattatta

SEQ ID NO: 1454289 - DNA, 14 bp, Homo sapiens
tattaatcttagtg

SEQ ID NO: 1454290 - DNA, 18 bp, Homo sapiens
tattaatcttagtgtatg

SEQ ID NO: 1454291 - DNA, 22 bp, Homo sapiens
tattaatgcctttaaagtatga

SEQ ID NO: 1454292 - DNA, 13 bp, Homo sapiens
tattaattactgt

SEQ ID NO: 1454293 - DNA, 21 bp, Homo sapiens
tattaattgttttgcactttt

SEQ ID NO: 1454294 - DNA, 14 bp, Homo sapiens
tattaattttagtt

SEQ ID NO: 1454295 - DNA, 13 bp, Homo sapiens
tattacaaaacaa

SEQ ID NO: 1454296 - DNA, 22 bp, Homo sapiens
tattaccccctccttcagacac

SEQ ID NO: 1454297 - DNA, 17 bp, Homo sapiens
tattactctcattcttt

SEQ ID NO: 1454298 - DNA, 20 bp, Homo sapiens
tattactctcattctttgaa

SEQ ID NO: 1454299 - DNA, 16 bp, Homo sapiens
tattactgaataatat

SEQ ID NO: 1454300 - DNA, 19 bp, Homo sapiens
tattactgaataatatcaa

SEQ ID NO: 1454301 - DNA, 17 bp, Homo sapiens
tattactgttgcattta

SEQ ID NO: 1454302 - DNA, 20 bp, Homo sapiens
tattactgttgcatttactt

SEQ ID NO: 1454303 - DNA, 23 bp, Homo sapiens
tattacttaggttattttgcttt

SEQ ID NO: 1454304 - DNA, 23 bp, Homo sapiens
tattacttatttttgacagtgtt

SEQ ID NO: 1454305 - DNA, 19 bp, Homo sapiens
tattacttgtaaataaagt

SEQ ID NO: 1454306 - DNA, 16 bp, Homo sapiens
tattagactttagaaa

SEQ ID NO: 1454307 - DNA, 20 bp, Homo sapiens
tattagccagtaccagcttt

SEQ ID NO: 1454308 - DNA, 23 bp, Homo sapiens
tattagctgtattatccattttt

SEQ ID NO: 1454309 - DNA, 16 bp, Homo sapiens
tattagctttactgtt

SEQ ID NO: 1454310 - DNA, 15 bp, Homo sapiens
tattaggttgtcacg

SEQ ID NO: 1454311 - DNA, 22 bp, Homo sapiens
tattagtgattctgatttcagt

SEQ ID NO: 1454312 - DNA, 13 bp, Homo sapiens
tattataaactat

SEQ ID NO: 1454313 - DNA, 14 bp, Homo sapiens
tattataatcttat

SEQ ID NO: 1454314 - DNA, 19 bp, Homo sapiens
tattataatcttataattg

SEQ ID NO: 1454315 - DNA, 15 bp, Homo sapiens
tattataatttaatg

SEQ ID NO: 1454316 - DNA, 19 bp, Homo sapiens
tattataatttttttcaat

SEQ ID NO: 1454317 - DNA, 21 bp, Homo sapiens
tattatacatgtgatacattt

SEQ ID NO: 1454318 - DNA, 15 bp, Homo sapiens
tattatactgtatta

SEQ ID NO: 1454319 - DNA, 19 bp, Homo sapiens
tattatactgtattaagag

SEQ ID NO: 1454320 - DNA, 19 bp, Homo sapiens
tattatagaaaattatttg

SEQ ID NO: 1454321 - DNA, 15 bp, Homo sapiens
tattatagacaaaag

SEQ ID NO: 1454322 - DNA, 18 bp, Homo sapiens
tattatagacaaaagaat

SEQ ID NO: 1454323 - DNA, 16 bp, Homo sapiens
tattatagagcagaaa

SEQ ID NO: 1454324 - DNA, 20 bp, Homo sapiens
tattatagagcagaaattct

SEQ ID NO: 1454325 - DNA, 15 bp, Homo sapiens
tattatatatatcta

SEQ ID NO: 1454326 - DNA, 14 bp, Homo sapiens
tattatattaaaca

SEQ ID NO: 1454327 - DNA, 14 bp, Homo sapiens
tattatatttgaca

SEQ ID NO: 1454328 - DNA, 22 bp, Homo sapiens
tattatcaaagggataaagaaa

SEQ ID NO: 1454329 - DNA, 15 bp, Homo sapiens
tattatcaacaatag

SEQ ID NO: 1454330 - DNA, 22 bp, Homo sapiens
tattatcaagtagactactgtt

SEQ ID NO: 1454331 - DNA, 22 bp, Homo sapiens
tattatcctcctgttctgaaac

SEQ ID NO: 1454332 - DNA, 15 bp, Homo sapiens
tattatcgctttatg

SEQ ID NO: 1454333 - DNA, 19 bp, Homo sapiens
tattatgcattatatcaaa

SEQ ID NO: 1454334 - DNA, 21 bp, Homo sapiens
tattatgccccagttcagaaa

SEQ ID NO: 1454335 - DNA, 15 bp, Homo sapiens
tattatgtagttgtt

SEQ ID NO: 1454336 - DNA, 21 bp, Homo sapiens
tattatgtctcttctgagcta

SEQ ID NO: 1454337 - DNA, 14 bp, Homo sapiens
tattatgtcttctt

SEQ ID NO: 1454338 - DNA, 18 bp, Homo sapiens
ccaaagcttattttgtaa

SEQ ID NO: 1454339 - DNA, 19 bp, Homo sapiens
ccaaagcttattttgtaag

SEQ ID NO: 1454340 - DNA, 18 bp, Homo sapiens
ccaaagctttactactgt

SEQ ID NO: 1454341 - DNA, 15 bp, Homo sapiens
ccaaagctttcctgc

SEQ ID NO: 1454342 - DNA, 20 bp, Homo sapiens
ccaaaggaataacctttctg

SEQ ID NO: 1454343 - DNA, 13 bp, Homo sapiens
ccaaaggcagcta

SEQ ID NO: 1454344 - DNA, 16 bp, Homo sapiens
ccaaaggcagctaaga

SEQ ID NO: 1454345 - DNA, 18 bp, Homo sapiens
ccaaaggcatccaggcca

SEQ ID NO: 1454346 - DNA, 22 bp, Homo sapiens
ccaaaggcatccaggccagggc

SEQ ID NO: 1454347 - DNA, 23 bp, Homo sapiens
ccaaaggcatccaggccagggct

SEQ ID NO: 1454348 - DNA, 13 bp, Homo sapiens
ccaaaggctggtg

SEQ ID NO: 1454349 - DNA, 15 bp, Homo sapiens
ccaaaggctggtggc

SEQ ID NO: 1454350 - DNA, 20 bp, Homo sapiens
ccaaagggaagtgaggccca

SEQ ID NO: 1454351 - DNA, 22 bp, Homo sapiens
ccaaagggaagtgaggcccaag

SEQ ID NO: 1454352 - DNA, 12 bp, Homo sapiens
ccaaagggcagt

SEQ ID NO: 1454353 - DNA, 19 bp, Homo sapiens
ccaaaggggctgctggggc

SEQ ID NO: 1454354 - DNA, 21 bp, Homo sapiens
ccaaagggtgaagctatttat

SEQ ID NO: 1454355 - DNA, 13 bp, Homo sapiens
ccaaagtattttt

SEQ ID NO: 1454356 - DNA, 18 bp, Homo sapiens
ccaaagtctctaattcta

SEQ ID NO: 1454357 - DNA, 22 bp, Homo sapiens
ccaaagtgctgggattacaggg

SEQ ID NO: 1454358 - DNA, 23 bp, Homo sapiens
ccaaagtggggagggacaaggga

SEQ ID NO: 1454359 - DNA, 19 bp, Homo sapiens
ccaaagtgtcttttgacat

SEQ ID NO: 1454360 - DNA, 11 bp, Homo sapiens
ccaaagttcta

SEQ ID NO: 1454361 - DNA, 12 bp, Homo sapiens
ccaaagttctaa

SEQ ID NO: 1454362 - DNA, 20 bp, Homo sapiens
ccaaagttctaataatttct

SEQ ID NO: 1454363 - DNA, 23 bp, Homo sapiens
ccaaagttctaataatttctaat

SEQ ID NO: 1454364 - DNA, 16 bp, Homo sapiens
ccaaataaagataacc

SEQ ID NO: 1454365 - DNA, 19 bp, Homo sapiens
ccaaataaatcatcctcat

SEQ ID NO: 1454366 - DNA, 17 bp, Homo sapiens
ccaaataaattcaataa

SEQ ID NO: 1454367 - DNA, 20 bp, Homo sapiens
ccaaatagccccagactggg

SEQ ID NO: 1454368 - DNA, 19 bp, Homo sapiens
ccaaatatgtattttccta

SEQ ID NO: 1454369 - DNA, 13 bp, Homo sapiens
ccaaatatgtcct

SEQ ID NO: 1454370 - DNA, 18 bp, Homo sapiens
ccaaatattaaagattct

SEQ ID NO: 1454371 - DNA, 15 bp, Homo sapiens
ccaaatcctggaagg

SEQ ID NO: 1454372 - DNA, 20 bp, Homo sapiens
ccaaatctagccagagccct

SEQ ID NO: 1454373 - DNA, 14 bp, Homo sapiens
ccaaatctggaagc

SEQ ID NO: 1454374 - DNA, 13 bp, Homo sapiens
ccaaatctgtcct

SEQ ID NO: 1454375 - DNA, 17 bp, Homo sapiens
ccaaatctgtcctctgt

SEQ ID NO: 1454376 - DNA, 19 bp, Homo sapiens
ccaaatctgtcctctgtag

SEQ ID NO: 1454377 - DNA, 20 bp, Homo sapiens
ccaaatgaccgagccctgga

SEQ ID NO: 1454378 - DNA, 15 bp, Homo sapiens
ccaaatgcaatttga

SEQ ID NO: 1454379 - DNA, 16 bp, Homo sapiens
ccaaatgcaatttgat

SEQ ID NO: 1454380 - DNA, 18 bp, Homo sapiens
ccaaatgcacaagctcag

SEQ ID NO: 1454381 - DNA, 23 bp, Homo sapiens
ccaaatgcagttcattgcagaca

SEQ ID NO: 1454382 - DNA, 18 bp, Homo sapiens
ccaaatgtaattgaataa

SEQ ID NO: 1454383 - DNA, 14 bp, Homo sapiens
ccaaattaaaacaa

SEQ ID NO: 1454384 - DNA, 20 bp, Homo sapiens
ccaaattccttggcatgcct

SEQ ID NO: 1454385 - DNA, 22 bp, Homo sapiens
ccaaattctttcagtggctacc

SEQ ID NO: 1454386 - DNA, 23 bp, Homo sapiens
ccaaatttcatacctatcatctt

SEQ ID NO: 1454387 - DNA, 18 bp, Homo sapiens
ccaaatttcctgtttgaa

SEQ ID NO: 1454388 - DNA, 17 bp, Homo sapiens
ccaaattttctttttat

SEQ ID NO: 1454389 - DNA, 15 bp, Homo sapiens
ccaacaacatgaaac

SEQ ID NO: 1454390 - DNA, 22 bp, Homo sapiens
ccaacaacatgaaactgcctat

SEQ ID NO: 1454391 - DNA, 20 bp, Homo sapiens
tattcccctatctctagaat

SEQ ID NO: 1454392 - DNA, 21 bp, Homo sapiens
tattcccttgtattttgttaa

SEQ ID NO: 1454393 - DNA, 19 bp, Homo sapiens
tattccgatacaaagtgtt

SEQ ID NO: 1454394 - DNA, 19 bp, Homo sapiens
tattcctaacctgtcagaa

SEQ ID NO: 1454395 - DNA, 21 bp, Homo sapiens
tattcctatatagtttattga

SEQ ID NO: 1454396 - DNA, 22 bp, Homo sapiens
tattcctgacctccgccatcca

SEQ ID NO: 1454397 - DNA, 18 bp, Homo sapiens
tattcctgttgctgtctt

SEQ ID NO: 1454398 - DNA, 13 bp, Homo sapiens
tattccttgttct

SEQ ID NO: 1454399 - DNA, 20 bp, Homo sapiens
tattccttttgtgtacagtg

SEQ ID NO: 1454400 - DNA, 22 bp, Homo sapiens
tattctaagccagttttcattt

SEQ ID NO: 1454401 - DNA, 15 bp, Homo sapiens
tattctaataaatat

SEQ ID NO: 1454402 - DNA, 11 bp, Homo sapiens
tattctagaac

SEQ ID NO: 1454403 - DNA, 18 bp, Homo sapiens
tattctagtcaactgctg

SEQ ID NO: 1454404 - DNA, 20 bp, Homo sapiens
tattctagtcaactgctgtt

SEQ ID NO: 1454405 - DNA, 17 bp, Homo sapiens
tattctatatgaattta

SEQ ID NO: 1454406 - DNA, 19 bp, Homo sapiens
tattctatatgaatttaaa

SEQ ID NO: 1454407 - DNA, 19 bp, Homo sapiens
tattctattaactttaatt

SEQ ID NO: 1454408 - DNA, 23 bp, Homo sapiens
tattctcataggagactgcgtca

SEQ ID NO: 1454409 - DNA, 18 bp, Homo sapiens
tattctcattatgttgat

SEQ ID NO: 1454410 - DNA, 13 bp, Homo sapiens
tattctcattctt

SEQ ID NO: 1454411 - DNA, 21 bp, Homo sapiens
tattctcggctcaggttttga

SEQ ID NO: 1454412 - DNA, 19 bp, Homo sapiens
tattctctaaactggcatc

SEQ ID NO: 1454413 - DNA, 22 bp, Homo sapiens
tattctctcacagtgtactcta

SEQ ID NO: 1454414 - DNA, 13 bp, Homo sapiens
tattctcttttca

SEQ ID NO: 1454415 - DNA, 19 bp, Homo sapiens
tattctgacatgtaagaaa

SEQ ID NO: 1454416 - DNA, 12 bp, Homo sapiens
tattctgagcct

SEQ ID NO: 1454417 - DNA, 22 bp, Homo sapiens
tattctgggctcctggaaccaa

SEQ ID NO: 1454418 - DNA, 22 bp, Homo sapiens
tattctgtatccgtgaattgct

SEQ ID NO: 1454419 - DNA, 15 bp, Homo sapiens
tattctgtcttcatc

SEQ ID NO: 1454420 - DNA, 16 bp, Homo sapiens
tattctgtggattcta

SEQ ID NO: 1454421 - DNA, 18 bp, Homo sapiens
tattctgtgttgaacaca

SEQ ID NO: 1454422 - DNA, 12 bp, Homo sapiens
tattctgttgct

SEQ ID NO: 1454423 - DNA, 15 bp, Homo sapiens
tattcttatttaatg

SEQ ID NO: 1454424 - DNA, 12 bp, Homo sapiens
tattcttccaga

SEQ ID NO: 1454425 - DNA, 18 bp, Homo sapiens
tattcttctagagttcag

SEQ ID NO: 1454426 - DNA, 22 bp, Homo sapiens
tattcttgatcagtagtttgca

SEQ ID NO: 1454427 - DNA, 14 bp, Homo sapiens
tattcttgatgtaa

SEQ ID NO: 1454428 - DNA, 18 bp, Homo sapiens
tattcttgctttcacaaa

SEQ ID NO: 1454429 - DNA, 13 bp, Homo sapiens
tattcttggtttt

SEQ ID NO: 1454430 - DNA, 14 bp, Homo sapiens
tattcttggttttc

SEQ ID NO: 1454431 - DNA, 13 bp, Homo sapiens
tattcttgttata

SEQ ID NO: 1454432 - DNA, 18 bp, Homo sapiens
tattcttttcaattatat

SEQ ID NO: 1454433 - DNA, 22 bp, Homo sapiens
tattcttttcaattatattgtt

SEQ ID NO: 1454434 - DNA, 19 bp, Homo sapiens
tattcttttccaagctcct

SEQ ID NO: 1454435 - DNA, 17 bp, Homo sapiens
tattctttttttctcta

SEQ ID NO: 1454436 - DNA, 14 bp, Homo sapiens
tattgaaaacactt

SEQ ID NO: 1454437 - DNA, 19 bp, Homo sapiens
tattgaaaacacttagtat

SEQ ID NO: 1454438 - DNA, 14 bp, Homo sapiens
tattgaaaattgaa

SEQ ID NO: 1454439 - DNA, 21 bp, Homo sapiens
tattgaaagccaacaactctg

SEQ ID NO: 1454440 - DNA, 19 bp, Homo sapiens
tattgaacttttgtactga

SEQ ID NO: 1454441 - DNA, 20 bp, Homo sapiens
tattgaagacaatttgatac

SEQ ID NO: 1454442 - DNA, 16 bp, Homo sapiens
tattgaagttgtttat

SEQ ID NO: 1454443 - DNA, 14 bp, Homo sapiens
tattgaatcttaat

SEQ ID NO: 1454444 - DNA, 13 bp, Homo sapiens
tattgaatgttat

SEQ ID NO: 1454445 - DNA, 17 bp, Homo sapiens
tattgacaacagtttta

SEQ ID NO: 1454446 - DNA, 17 bp, Homo sapiens
tattgacaataatttca

SEQ ID NO: 1454447 - DNA, 18 bp, Homo sapiens
tattgacaataatttcag

SEQ ID NO: 1454448 - DNA, 13 bp, Homo sapiens
tattgacactgaa

SEQ ID NO: 1454449 - DNA, 15 bp, Homo sapiens
tattgacatttgtag

SEQ ID NO: 1454450 - DNA, 17 bp, Homo sapiens
tattgacatttgtagtt

SEQ ID NO: 1454451 - DNA, 14 bp, Homo sapiens
tattgaccattttt

SEQ ID NO: 1454452 - DNA, 13 bp, Homo sapiens
ccaacctgaccaa

SEQ ID NO: 1454453 - DNA, 22 bp, Homo sapiens
ccaacctgaccaacatggagaa

SEQ ID NO: 1454454 - DNA, 17 bp, Homo sapiens
ccaacctgcaaagatct

SEQ ID NO: 1454455 - DNA, 16 bp, Homo sapiens
ccaacctggacttcct

SEQ ID NO: 1454456 - DNA, 14 bp, Homo sapiens
ccaacctggggggc

SEQ ID NO: 1454457 - DNA, 21 bp, Homo sapiens
ccaaccttcacatctgtcacg

SEQ ID NO: 1454458 - DNA, 12 bp, Homo sapiens
ccaaccttccca

SEQ ID NO: 1454459 - DNA, 14 bp, Homo sapiens
ccaacgcccctgtg

SEQ ID NO: 1454460 - DNA, 19 bp, Homo sapiens
ccaacgcccctgtggccaa

SEQ ID NO: 1454461 - DNA, 12 bp, Homo sapiens
ccaacgccgcct

SEQ ID NO: 1454462 - DNA, 21 bp, Homo sapiens
ccaacggccctgcagccagct

SEQ ID NO: 1454463 - DNA, 16 bp, Homo sapiens
ccaacgtcccctccgc

SEQ ID NO: 1454464 - DNA, 17 bp, Homo sapiens
ccaacgtgcaaagccaa

SEQ ID NO: 1454465 - DNA, 21 bp, Homo sapiens
ccaacgtgcaaagccaaggca

SEQ ID NO: 1454466 - DNA, 20 bp, Homo sapiens
ccaactaatgccttactctt

SEQ ID NO: 1454467 - DNA, 22 bp, Homo sapiens
ccaactactaatagaataaagg

SEQ ID NO: 1454468 - DNA, 22 bp, Homo sapiens
ccaactactactggtgatgcct

SEQ ID NO: 1454469 - DNA, 14 bp, Homo sapiens
ccaactcacctgag

SEQ ID NO: 1454470 - DNA, 12 bp, Homo sapiens
ccaactccagga

SEQ ID NO: 1454471 - DNA, 15 bp, Homo sapiens
ccaactcctggaagc

SEQ ID NO: 1454472 - DNA, 19 bp, Homo sapiens
ccaactcctggaagctgtg

SEQ ID NO: 1454473 - DNA, 18 bp, Homo sapiens
ccaactcctttcagccac

SEQ ID NO: 1454474 - DNA, 19 bp, Homo sapiens
ccaactcctttcagccaca

SEQ ID NO: 1454475 - DNA, 12 bp, Homo sapiens
ccaactctcccc

SEQ ID NO: 1454476 - DNA, 23 bp, Homo sapiens
ccaactctccccagtgcctgcca

SEQ ID NO: 1454477 - DNA, 13 bp, Homo sapiens
ccaactctgcact

SEQ ID NO: 1454478 - DNA, 14 bp, Homo sapiens
ccaactctgcactc

SEQ ID NO: 1454479 - DNA, 15 bp, Homo sapiens
ccaactctgcactcc

SEQ ID NO: 1454480 - DNA, 16 bp, Homo sapiens
ccaactctgcactcca

SEQ ID NO: 1454481 - DNA, 20 bp, Homo sapiens
ccaactgcaaaaaaagcctc

SEQ ID NO: 1454482 - DNA, 16 bp, Homo sapiens
ccaactgggcccaaga

SEQ ID NO: 1454483 - DNA, 19 bp, Homo sapiens
ccaactgtggtagctccag

SEQ ID NO: 1454484 - DNA, 13 bp, Homo sapiens
ccaacttgccaca

SEQ ID NO: 1454485 - DNA, 16 bp, Homo sapiens
ccaacttgccacatgt

SEQ ID NO: 1454486 - DNA, 21 bp, Homo sapiens
ccaacttggttctgcttcaat

SEQ ID NO: 1454487 - DNA, 14 bp, Homo sapiens
ccaagaaaatgaag

SEQ ID NO: 1454488 - DNA, 15 bp, Homo sapiens
ccaagaaatggaatc

SEQ ID NO: 1454489 - DNA, 14 bp, Homo sapiens
ccaagaacattatc

SEQ ID NO: 1454490 - DNA, 23 bp, Homo sapiens
ccaagaactctaaccagtgtaca

SEQ ID NO: 1454491 - DNA, 14 bp, Homo sapiens
ccaagaactgcatg

SEQ ID NO: 1454492 - DNA, 18 bp, Homo sapiens
ccaagaagcagtggcctt

SEQ ID NO: 1454493 - DNA, 15 bp, Homo sapiens
ccaagaatacttgaa

SEQ ID NO: 1454494 - DNA, 19 bp, Homo sapiens
ccaagaatccacatttcta

SEQ ID NO: 1454495 - DNA, 21 bp, Homo sapiens
ccaagaatccacatttctaaa

SEQ ID NO: 1454496 - DNA, 20 bp, Homo sapiens
ccaagaatgcaagatttcag

SEQ ID NO: 1454497 - DNA, 12 bp, Homo sapiens
ccaagaatgtac

SEQ ID NO: 1454498 - DNA, 16 bp, Homo sapiens
ccaagacggaggaggg

SEQ ID NO: 1454499 - DNA, 19 bp, Homo sapiens
ccaagacgggatgattgct

SEQ ID NO: 1454500 - DNA, 23 bp, Homo sapiens
ccaagactgtcattgcccctccg

SEQ ID NO: 1454501 - DNA, 17 bp, Homo sapiens
ccaagagatctgtgtgg

SEQ ID NO: 1454502 - DNA, 19 bp, Homo sapiens
ccaagagatctgtgtggct

SEQ ID NO: 1454503 - DNA, 14 bp, Homo sapiens
ccaagagatgaaga

SEQ ID NO: 1454504 - DNA, 17 bp, Homo sapiens
ccaagaggactgagact

SEQ ID NO: 1454505 - DNA, 18 bp, Homo sapiens
ccaagagtccaggaggcc

SEQ ID NO: 1454506 - DNA, 11 bp, Homo sapiens
ccaagagtcta

SEQ ID NO: 1454507 - DNA, 16 bp, Homo sapiens
ccaagatggctgctgc

SEQ ID NO: 1454508 - DNA, 22 bp, Homo sapiens
ccaagatgggcatcttttgtat

SEQ ID NO: 1454509 - DNA, 21 bp, Homo sapiens
ccaagattcacacctgactct

SEQ ID NO: 1454510 - DNA, 16 bp, Homo sapiens
tattgtttctctgaaa

SEQ ID NO: 1454511 - DNA, 16 bp, Homo sapiens
tattgtttggtaaatg

SEQ ID NO: 1454512 - DNA, 17 bp, Homo sapiens
tattgtttggtaaatgt

SEQ ID NO: 1454513 - DNA, 18 bp, Homo sapiens
tattgttttcagtgtaca

SEQ ID NO: 1454514 - DNA, 20 bp, Homo sapiens
tattgttttcagtgtacatg

SEQ ID NO: 1454515 - DNA, 22 bp, Homo sapiens
tattgtttttccttgtatttaa

SEQ ID NO: 1454516 - DNA, 17 bp, Homo sapiens
tatttaaaaataagtca

SEQ ID NO: 1454517 - DNA, 16 bp, Homo sapiens
tatttaaaaatatttc

SEQ ID NO: 1454518 - DNA, 19 bp, Homo sapiens
tatttaaaaatatttcaga

SEQ ID NO: 1454519 - DNA, 15 bp, Homo sapiens
tatttaaaaattgtt

SEQ ID NO: 1454520 - DNA, 23 bp, Homo sapiens
tatttaaaaattgtttcttgaca

SEQ ID NO: 1454521 - DNA, 20 bp, Homo sapiens
tatttaaacctttttcttga

SEQ ID NO: 1454522 - DNA, 24 bp, Homo sapiens
tatttaaactctgttgcaagtgca

SEQ ID NO: 1454523 - DNA, 17 bp, Homo sapiens
tatttaaagatctttta

SEQ ID NO: 1454524 - DNA, 12 bp, Homo sapiens
tatttaaagttg

SEQ ID NO: 1454525 - DNA, 18 bp, Homo sapiens
tatttaaattacaatttt

SEQ ID NO: 1454526 - DNA, 15 bp, Homo sapiens
tatttaacaagatct

SEQ ID NO: 1454527 - DNA, 12 bp, Homo sapiens
tatttaacagaa

SEQ ID NO: 1454528 - DNA, 16 bp, Homo sapiens
tatttaacagaaattg

SEQ ID NO: 1454529 - DNA, 22 bp, Homo sapiens
tatttaactcataatttttgca

SEQ ID NO: 1454530 - DNA, 20 bp, Homo sapiens
tatttaagaaaatacaataa

SEQ ID NO: 1454531 - DNA, 21 bp, Homo sapiens
tatttaagaaaatacaataaa

SEQ ID NO: 1454532 - DNA, 16 bp, Homo sapiens
tatttaagatgtgaaa

SEQ ID NO: 1454533 - DNA, 22 bp, Homo sapiens
tatttaagcctaaagattttga

SEQ ID NO: 1454534 - DNA, 17 bp, Homo sapiens
tatttaaggatggatgg

SEQ ID NO: 1454535 - DNA, 19 bp, Homo sapiens
tatttaaggatggatggca

SEQ ID NO: 1454536 - DNA, 21 bp, Homo sapiens
tatttaaggtagcttcagcta

SEQ ID NO: 1454537 - DNA, 16 bp, Homo sapiens
tatttaagtatatagt

SEQ ID NO: 1454538 - DNA, 22 bp, Homo sapiens
tatttaatatctggcactgtta

SEQ ID NO: 1454539 - DNA, 15 bp, Homo sapiens
tatttaatatgctta

SEQ ID NO: 1454540 - DNA, 14 bp, Homo sapiens
tatttaatatttaa

SEQ ID NO: 1454541 - DNA, 21 bp, Homo sapiens
tatttaatgaaagactgtaca

SEQ ID NO: 1454542 - DNA, 22 bp, Homo sapiens
tatttaatgacacaccttggat

SEQ ID NO: 1454543 - DNA, 14 bp, Homo sapiens
tatttaatgctgtg

SEQ ID NO: 1454544 - DNA, 17 bp, Homo sapiens
tatttaatgttgaacaa

SEQ ID NO: 1454545 - DNA, 17 bp, Homo sapiens
tatttacactggtctaa

SEQ ID NO: 1454546 - DNA, 19 bp, Homo sapiens
tatttacatgctactaaat

SEQ ID NO: 1454547 - DNA, 14 bp, Homo sapiens
tatttacatttaat

SEQ ID NO: 1454548 - DNA, 21 bp, Homo sapiens
tatttacattttatatttttg

SEQ ID NO: 1454549 - DNA, 23 bp, Homo sapiens
tatttacattttatatttttgta

SEQ ID NO: 1454550 - DNA, 13 bp, Homo sapiens
tatttactaacta

SEQ ID NO: 1454551 - DNA, 16 bp, Homo sapiens
tatttactgagcttct

SEQ ID NO: 1454552 - DNA, 21 bp, Homo sapiens
tatttactgagcttctctgtg

SEQ ID NO: 1454553 - DNA, 15 bp, Homo sapiens
tatttacttctgtat

SEQ ID NO: 1454554 - DNA, 18 bp, Homo sapiens
tatttacttcttatacat

SEQ ID NO: 1454555 - DNA, 23 bp, Homo sapiens
tatttacttttaccactatttaa

SEQ ID NO: 1454556 - DNA, 19 bp, Homo sapiens
tatttagacaagagatggg

SEQ ID NO: 1454557 - DNA, 18 bp, Homo sapiens
tatttagatataacacta

SEQ ID NO: 1454558 - DNA, 22 bp, Homo sapiens
tatttagattgttaaaataact

SEQ ID NO: 1454559 - DNA, 22 bp, Homo sapiens
tatttaggcctcttgaattttt

SEQ ID NO: 1454560 - DNA, 19 bp, Homo sapiens
tatttagggccttttctgt

SEQ ID NO: 1454561 - DNA, 19 bp, Homo sapiens
tatttataaactaggtaaa

SEQ ID NO: 1454562 - DNA, 14 bp, Homo sapiens
tatttataacagca

SEQ ID NO: 1454563 - DNA, 20 bp, Homo sapiens
tatttataactcatcataaa

SEQ ID NO: 1454564 - DNA, 18 bp, Homo sapiens
tatttataagtgacttta

SEQ ID NO: 1454565 - DNA, 15 bp, Homo sapiens
tatttataattccta

SEQ ID NO: 1454566 - DNA, 14 bp, Homo sapiens
taggactaccgcag

SEQ ID NO: 1454567 - DNA, 21 bp, Homo sapiens
taggactaccgcaggcccgga

SEQ ID NO: 1454568 - DNA, 23 bp, Homo sapiens
taggactagaagattagaaacta

SEQ ID NO: 1454569 - DNA, 19 bp, Homo sapiens
taggactcaaagtttcaga

SEQ ID NO: 1454570 - DNA, 13 bp, Homo sapiens
taggactgaggag

SEQ ID NO: 1454571 - DNA, 17 bp, Homo sapiens
taggagaaccaaatctg

SEQ ID NO: 1454572 - DNA, 16 bp, Homo sapiens
taggagaagccaggaa

SEQ ID NO: 1454573 - DNA, 12 bp, Homo sapiens
taggagactgcg

SEQ ID NO: 1454574 - DNA, 22 bp, Homo sapiens
taggagagggggcgatatagag

SEQ ID NO: 1454575 - DNA, 22 bp, Homo sapiens
taggagataccaggttgaaaga

SEQ ID NO: 1454576 - DNA, 12 bp, Homo sapiens
taggagatttac

SEQ ID NO: 1454577 - DNA, 14 bp, Homo sapiens
taggagctaaggct

SEQ ID NO: 1454578 - DNA, 21 bp, Homo sapiens
taggagctggatttgggagct

SEQ ID NO: 1454579 - DNA, 19 bp, Homo sapiens
taggagctggctggcaggt

SEQ ID NO: 1454580 - DNA, 24 bp, Homo sapiens
taggaggaaacagttctcactggg

SEQ ID NO: 1454581 - DNA, 14 bp, Homo sapiens
taggaggctgcatg

SEQ ID NO: 1454582 - DNA, 21 bp, Homo sapiens
taggagggaagatttttccat

SEQ ID NO: 1454583 - DNA, 14 bp, Homo sapiens
taggagggagacac

SEQ ID NO: 1454584 - DNA, 19 bp, Homo sapiens
taggagggagactgtggta

SEQ ID NO: 1454585 - DNA, 22 bp, Homo sapiens
taggagttttgttccagaggag

SEQ ID NO: 1454586 - DNA, 21 bp, Homo sapiens
taggatccagtgatccttaca

SEQ ID NO: 1454587 - DNA, 17 bp, Homo sapiens
taggatggttctgtgac

SEQ ID NO: 1454588 - DNA, 19 bp, Homo sapiens
taggattctgttccctggg

SEQ ID NO: 1454589 - DNA, 20 bp, Homo sapiens
taggattggagtatgattta

SEQ ID NO: 1454590 - DNA, 22 bp, Homo sapiens
taggatttaacagtcatttaaa

SEQ ID NO: 1454591 - DNA, 18 bp, Homo sapiens
taggattttgagggtggg

SEQ ID NO: 1454592 - DNA, 20 bp, Homo sapiens
taggcactgtagttctaaga

SEQ ID NO: 1454593 - DNA, 22 bp, Homo sapiens
taggcactgtagttctaagact

SEQ ID NO: 1454594 - DNA, 13 bp, Homo sapiens
taggcagaatgga

SEQ ID NO: 1454595 - DNA, 14 bp, Homo sapiens
taggcagcagagag

SEQ ID NO: 1454596 - DNA, 16 bp, Homo sapiens
taggcagcctgcaggg

SEQ ID NO: 1454597 - DNA, 14 bp, Homo sapiens
taggcatgtaaaca

SEQ ID NO: 1454598 - DNA, 19 bp, Homo sapiens
taggcattaatgtttctat

SEQ ID NO: 1454599 - DNA, 13 bp, Homo sapiens
taggcattctgga

SEQ ID NO: 1454600 - DNA, 17 bp, Homo sapiens
taggcattgcaggacct

SEQ ID NO: 1454601 - DNA, 20 bp, Homo sapiens
taggcccattgtcctccttt

SEQ ID NO: 1454602 - DNA, 13 bp, Homo sapiens
taggccccagagg

SEQ ID NO: 1454603 - DNA, 16 bp, Homo sapiens
taggccccagaggccc

SEQ ID NO: 1454604 - DNA, 14 bp, Homo sapiens
taggcccccacttg

SEQ ID NO: 1454605 - DNA, 13 bp, Homo sapiens
taggcccttgtcc

SEQ ID NO: 1454606 - DNA, 20 bp, Homo sapiens
taggcccttgtcctgccagc

SEQ ID NO: 1454607 - DNA, 23 bp, Homo sapiens
taggcccttgtcctgccagctgc

SEQ ID NO: 1454608 - DNA, 14 bp, Homo sapiens
taggcctctctgcc

SEQ ID NO: 1454609 - DNA, 15 bp, Homo sapiens
taggcctctctgcct

SEQ ID NO: 1454610 - DNA, 18 bp, Homo sapiens
taggcctcttgaattttt

SEQ ID NO: 1454611 - DNA, 13 bp, Homo sapiens
taggcctgggtgc

SEQ ID NO: 1454612 - DNA, 19 bp, Homo sapiens
taggcctgggtgctggctg

SEQ ID NO: 1454613 - DNA, 19 bp, Homo sapiens
taggcctgtcccttgcctc

SEQ ID NO: 1454614 - DNA, 15 bp, Homo sapiens
taggccttaacacac

SEQ ID NO: 1454615 - DNA, 19 bp, Homo sapiens
taggcggtcatgtgtgcat

SEQ ID NO: 1454616 - DNA, 15 bp, Homo sapiens
taggctaaaaggtct

SEQ ID NO: 1454617 - DNA, 17 bp, Homo sapiens
taggctattaaaaaagt

SEQ ID NO: 1454618 - DNA, 15 bp, Homo sapiens
taggctattcacaac

SEQ ID NO: 1454619 - DNA, 20 bp, Homo sapiens
taggctatttgtaaatctgc

SEQ ID NO: 1454620 - DNA, 20 bp, Homo sapiens
taggctcttaagcagcatgg

SEQ ID NO: 1454621 - DNA, 16 bp, Homo sapiens
taggctggtggccttg

SEQ ID NO: 1454622 - DNA, 19 bp, Homo sapiens
taggctgtaatcaagaaaa

SEQ ID NO: 1454623 - DNA, 17 bp, Homo sapiens
taggctgtctgcgaaga

SEQ ID NO: 1454624 - DNA, 18 bp, Homo sapiens
taggcttagtttgtgtgt

SEQ ID NO: 1454625 - DNA, 15 bp, Homo sapiens
taggcttttctgcct

SEQ ID NO: 1454626 - DNA, 19 bp, Homo sapiens
tagggaaaccttggagagg

SEQ ID NO: 1454627 - DNA, 16 bp, Homo sapiens
tagggaaatgaaagaa

SEQ ID NO: 1454628 - DNA, 19 bp, Homo sapiens
tagggactacccatagaca

SEQ ID NO: 1454629 - DNA, 21 bp, Homo sapiens
tagggactgccaggctgtttc

SEQ ID NO: 1454630 - DNA, 18 bp, Homo sapiens
tagggagagagaagcagg

SEQ ID NO: 1454631 - DNA, 18 bp, Homo sapiens
tagggagtacctgctgcc

SEQ ID NO: 1454632 - DNA, 19 bp, Homo sapiens
tagggagtggttcctgtgg

SEQ ID NO: 1454633 - DNA, 12 bp, Homo sapiens
tagggatctgaa

SEQ ID NO: 1454634 - DNA, 22 bp, Homo sapiens
tagggatctgaaatccataaac

SEQ ID NO: 1454635 - DNA, 21 bp, Homo sapiens
tagggatgcggatcctgctgg

SEQ ID NO: 1454636 - DNA, 13 bp, Homo sapiens
tagggcagcttgc

SEQ ID NO: 1454637 - DNA, 15 bp, Homo sapiens
tagggcagcttgccc

SEQ ID NO: 1454638 - DNA, 22 bp, Homo sapiens
tagggcaggagtgagaggtctc

SEQ ID NO: 1454639 - DNA, 18 bp, Homo sapiens
tagggcatttgagaaatg

SEQ ID NO: 1454640 - DNA, 15 bp, Homo sapiens
taggggagggcaggc

SEQ ID NO: 1454641 - DNA, 18 bp, Homo sapiens
taggggccacctcctccc

SEQ ID NO: 1454642 - DNA, 15 bp, Homo sapiens
taggggctgaagacg

SEQ ID NO: 1454643 - DNA, 20 bp, Homo sapiens
taggggtgcgctcacctgca

SEQ ID NO: 1454644 - DNA, 13 bp, Homo sapiens
tagggtaaatcag

SEQ ID NO: 1454645 - DNA, 13 bp, Homo sapiens
tagggtaagaaga

SEQ ID NO: 1454646 - DNA, 18 bp, Homo sapiens
tagggtcagccattttta

SEQ ID NO: 1454647 - DNA, 23 bp, Homo sapiens
tagggtcaggcggggtgctgtgg

SEQ ID NO: 1454648 - DNA, 15 bp, Homo sapiens
tagggtctcttcagg

SEQ ID NO: 1454649 - DNA, 20 bp, Homo sapiens
tagggtggcactgggagggg

SEQ ID NO: 1454650 - DNA, 12 bp, Homo sapiens
tagggtggccct

SEQ ID NO: 1454651 - DNA, 12 bp, Homo sapiens
taggtaaatcta

SEQ ID NO: 1454652 - DNA, 16 bp, Homo sapiens
taggtaaatctagagt

SEQ ID NO: 1454653 - DNA, 23 bp, Homo sapiens
taggtaaatctagagtttataca

SEQ ID NO: 1454654 - DNA, 14 bp, Homo sapiens
taggtaatgattat

SEQ ID NO: 1454655 - DNA, 20 bp, Homo sapiens
taggtagaagtgagcaaaaa

SEQ ID NO: 1454656 - DNA, 16 bp, Homo sapiens
taggtagactttgctt

SEQ ID NO: 1454657 - DNA, 13 bp, Homo sapiens
taggtagcacagc

SEQ ID NO: 1454658 - DNA, 15 bp, Homo sapiens
taggtatgaataagt

SEQ ID NO: 1454659 - DNA, 23 bp, Homo sapiens
taggtcaataacactgtatttta

SEQ ID NO: 1454660 - DNA, 12 bp, Homo sapiens
taggtcactggc

SEQ ID NO: 1454661 - DNA, 14 bp, Homo sapiens
taggtcactggctc

SEQ ID NO: 1454662 - DNA, 19 bp, Homo sapiens
taggtcactggctctccaa

SEQ ID NO: 1454663 - DNA, 20 bp, Homo sapiens
taggtcaggagttgtgtcta

SEQ ID NO: 1454664 - DNA, 16 bp, Homo sapiens
taggtcctttagaaac

SEQ ID NO: 1454665 - DNA, 20 bp, Homo sapiens
taggtctcctcagggtgggg

SEQ ID NO: 1454666 - DNA, 16 bp, Homo sapiens
taggtgcccagggcca

SEQ ID NO: 1454667 - DNA, 17 bp, Homo sapiens
taggtgcccagggccag

SEQ ID NO: 1454668 - DNA, 22 bp, Homo sapiens
taggtgctacaaaaacacagca

SEQ ID NO: 1454669 - DNA, 23 bp, Homo sapiens
taggtgctacaaaaacacagcaa

SEQ ID NO: 1454670 - DNA, 20 bp, Homo sapiens
taggttaaaaaaaaaagtca

SEQ ID NO: 1454671 - DNA, 13 bp, Homo sapiens
taggttctaaagt

SEQ ID NO: 1454672 - DNA, 15 bp, Homo sapiens
gttatctgcctggcc

SEQ ID NO: 1454673 - DNA, 18 bp, Homo sapiens
gttatctgcctggcctgg

SEQ ID NO: 1454674 - DNA, 21 bp, Homo sapiens
gttatctgcctggcctggctc

SEQ ID NO: 1454675 - DNA, 19 bp, Homo sapiens
gttatcttctcaagttcta

SEQ ID NO: 1454676 - DNA, 20 bp, Homo sapiens
gttatgaaattcaccccctt

SEQ ID NO: 1454677 - DNA, 23 bp, Homo sapiens
gttatgaacagctgtgtctgcca

SEQ ID NO: 1454678 - DNA, 23 bp, Homo sapiens
gttatgataacaccagtgggaat

SEQ ID NO: 1454679 - DNA, 19 bp, Homo sapiens
gttatgcctctgacagtcc

SEQ ID NO: 1454680 - DNA, 13 bp, Homo sapiens
gttatgctgtcat

SEQ ID NO: 1454681 - DNA, 16 bp, Homo sapiens
gttatggtgatgactt

SEQ ID NO: 1454682 - DNA, 17 bp, Homo sapiens
gttatgtactagtgttc

SEQ ID NO: 1454683 - DNA, 15 bp, Homo sapiens
gttatgtatttaaag

SEQ ID NO: 1454684 - DNA, 18 bp, Homo sapiens
gttatgtgggtggcttct

SEQ ID NO: 1454685 - DNA, 22 bp, Homo sapiens
gttatgtttgcactttgtatat

SEQ ID NO: 1454686 - DNA, 14 bp, Homo sapiens
gttattacttgtaa

SEQ ID NO: 1454687 - DNA, 13 bp, Homo sapiens
gttattagatgtt

SEQ ID NO: 1454688 - DNA, 23 bp, Homo sapiens
gttattatagagcagaaattctg

SEQ ID NO: 1454689 - DNA, 15 bp, Homo sapiens
gttattatatttgac

SEQ ID NO: 1454690 - DNA, 18 bp, Homo sapiens
gttattatatttgacatg

SEQ ID NO: 1454691 - DNA, 15 bp, Homo sapiens
gttattcaaatttga

SEQ ID NO: 1454692 - DNA, 16 bp, Homo sapiens
gttattcaaatttgat

SEQ ID NO: 1454693 - DNA, 18 bp, Homo sapiens
gttattcaaatttgtaca

SEQ ID NO: 1454694 - DNA, 16 bp, Homo sapiens
gttattcttgttatac

SEQ ID NO: 1454695 - DNA, 18 bp, Homo sapiens
gttattgcaataaagtat

SEQ ID NO: 1454696 - DNA, 14 bp, Homo sapiens
gttattggactcca

SEQ ID NO: 1454697 - DNA, 17 bp, Homo sapiens
gttattggactccaggc

SEQ ID NO: 1454698 - DNA, 13 bp, Homo sapiens
gttatttaaagaa

SEQ ID NO: 1454699 - DNA, 11 bp, Homo sapiens
gttatttaaat

SEQ ID NO: 1454700 - DNA, 13 bp, Homo sapiens
gttatttaaatga

SEQ ID NO: 1454701 - DNA, 17 bp, Homo sapiens
gttatttaatagctgtg

SEQ ID NO: 1454702 - DNA, 21 bp, Homo sapiens
gttatttaatagctgtgatca

SEQ ID NO: 1454703 - DNA, 17 bp, Homo sapiens
gttatttacactggtct

SEQ ID NO: 1454704 - DNA, 18 bp, Homo sapiens
gttatttacactggtcta

SEQ ID NO: 1454705 - DNA, 19 bp, Homo sapiens
gttatttacactggtctaa

SEQ ID NO: 1454706 - DNA, 22 bp, Homo sapiens
gttatttacactggtctaatgt

SEQ ID NO: 1454707 - DNA, 14 bp, Homo sapiens
gttatttactttta

SEQ ID NO: 1454708 - DNA, 13 bp, Homo sapiens
gttatttcttccc

SEQ ID NO: 1454709 - DNA, 15 bp, Homo sapiens
gttatttcttccctg

SEQ ID NO: 1454710 - DNA, 14 bp, Homo sapiens
gttatttcttgttt

SEQ ID NO: 1454711 - DNA, 22 bp, Homo sapiens
gttattttatatctgagcaagg

SEQ ID NO: 1454712 - DNA, 14 bp, Homo sapiens
gttattttattatt

SEQ ID NO: 1454713 - DNA, 12 bp, Homo sapiens
gttattttctac

SEQ ID NO: 1454714 - DNA, 20 bp, Homo sapiens
gttattttctacagtggttt

SEQ ID NO: 1454715 - DNA, 17 bp, Homo sapiens
gttatttttattaaatg

SEQ ID NO: 1454716 - DNA, 20 bp, Homo sapiens
gttatttttattaaatgtat

SEQ ID NO: 1454717 - DNA, 23 bp, Homo sapiens
gttatttttatttatttaaattt

SEQ ID NO: 1454718 - DNA, 19 bp, Homo sapiens
gttatttttctcttgtacc

SEQ ID NO: 1454719 - DNA, 15 bp, Homo sapiens
gttatttttgtacat

SEQ ID NO: 1454720 - DNA, 22 bp, Homo sapiens
gttatttttgtttcttccaaag

SEQ ID NO: 1454721 - DNA, 16 bp, Homo sapiens
gttattttttaattat

SEQ ID NO: 1454722 - DNA, 14 bp, Homo sapiens
gttcaaaatgtctg

SEQ ID NO: 1454723 - DNA, 19 bp, Homo sapiens
gttcaaagactgtgaacag

SEQ ID NO: 1454724 - DNA, 19 bp, Homo sapiens
gttcaaagatgcattttga

SEQ ID NO: 1454725 - DNA, 14 bp, Homo sapiens
gttcaaagctgcct

SEQ ID NO: 1454726 - DNA, 23 bp, Homo sapiens
gttcaaagtgtatatttattcat

SEQ ID NO: 1454727 - DNA, 13 bp, Homo sapiens
gttcaagaaataa

SEQ ID NO: 1454728 - DNA, 16 bp, Homo sapiens
gttcaagaccagcctg

SEQ ID NO: 1454729 - DNA, 14 bp, Homo sapiens
gttcaagcacactg

SEQ ID NO: 1454730 - DNA, 13 bp, Homo sapiens
gttcaagcccagg

SEQ ID NO: 1454731 - DNA, 15 bp, Homo sapiens
gttcaagcccaggct

SEQ ID NO: 1454732 - DNA, 20 bp, Homo sapiens
gttcaagcctgtgggagtag

SEQ ID NO: 1454733 - DNA, 23 bp, Homo sapiens
gttcaataaagcactgagcaagt

SEQ ID NO: 1454734 - DNA, 20 bp, Homo sapiens
gttcaatgcaaagtaaaaaa

SEQ ID NO: 1454735 - DNA, 15 bp, Homo sapiens
gttcacaaactgtga

SEQ ID NO: 1454736 - DNA, 16 bp, Homo sapiens
gttcacaaactgtgaa

SEQ ID NO: 1454737 - DNA, 17 bp, Homo sapiens
gttcacaaggtacccca

SEQ ID NO: 1454738 - DNA, 15 bp, Homo sapiens
gttcacacagcccag

SEQ ID NO: 1454739 - DNA, 19 bp, Homo sapiens
gttcacacagcccagttcc

SEQ ID NO: 1454740 - DNA, 11 bp, Homo sapiens
gttcaccagcc

SEQ ID NO: 1454741 - DNA, 12 bp, Homo sapiens
gttcaccagcct

SEQ ID NO: 1454742 - DNA, 18 bp, Homo sapiens
gttcacgtaagatacaag

SEQ ID NO: 1454743 - DNA, 16 bp, Homo sapiens
gttcacttgccatgca

SEQ ID NO: 1454744 - DNA, 17 bp, Homo sapiens
gttcacttgccatgcag

SEQ ID NO: 1454745 - DNA, 17 bp, Homo sapiens
gttcagaaatgctgcct

SEQ ID NO: 1454746 - DNA, 18 bp, Homo sapiens
gttcagaaatgctgcctg

SEQ ID NO: 1454747 - DNA, 19 bp, Homo sapiens
gttcagaaatgctgcctgc

SEQ ID NO: 1454748 - DNA, 18 bp, Homo sapiens
gttcagaaatttggcatt

SEQ ID NO: 1454749 - DNA, 14 bp, Homo sapiens
gttcagacacctgt

SEQ ID NO: 1454750 - DNA, 17 bp, Homo sapiens
gttcagagactcagggc

SEQ ID NO: 1454751 - DNA, 19 bp, Homo sapiens
gttcagagtccttaaaatg

SEQ ID NO: 1454752 - DNA, 14 bp, Homo sapiens
gttcagattaaaaa

SEQ ID NO: 1454753 - DNA, 16 bp, Homo sapiens
gttcagcaccacccta

SEQ ID NO: 1454754 - DNA, 15 bp, Homo sapiens
gttcagcagaacctg

SEQ ID NO: 1454755 - DNA, 19 bp, Homo sapiens
gttcagcatggcatccaag

SEQ ID NO: 1454756 - DNA, 12 bp, Homo sapiens
gttcagccaagg

SEQ ID NO: 1454757 - DNA, 15 bp, Homo sapiens
gttcagccaaggttt

SEQ ID NO: 1454758 - DNA, 23 bp, Homo sapiens
gttcagccaccctgaggcctctg

SEQ ID NO: 1454759 - DNA, 19 bp, Homo sapiens
gttcagcccctcctctgcc

SEQ ID NO: 1454760 - DNA, 20 bp, Homo sapiens
gttcagcccctcctctgcca

SEQ ID NO: 1454761 - DNA, 12 bp, Homo sapiens
gttcagcctgtc

SEQ ID NO: 1454762 - DNA, 15 bp, Homo sapiens
gttcagcctgtctcc

SEQ ID NO: 1454763 - DNA, 21 bp, Homo sapiens
gttcaggagtcccaaggaaag

SEQ ID NO: 1454764 - DNA, 20 bp, Homo sapiens
gttcagggaccgtccagggg

SEQ ID NO: 1454765 - DNA, 18 bp, Homo sapiens
gttcaggggactcagccc

SEQ ID NO: 1454766 - DNA, 19 bp, Homo sapiens
gttcaggggactcagccct

SEQ ID NO: 1454767 - DNA, 9 bp, Homo sapiens
gttcataca

SEQ ID NO: 1454768 - DNA, 14 bp, Homo sapiens
taacattatttata

SEQ ID NO: 1454769 - DNA, 15 bp, Homo sapiens
taacattcagttccc

SEQ ID NO: 1454770 - DNA, 18 bp, Homo sapiens
taacattccaagactcta

SEQ ID NO: 1454771 - DNA, 16 bp, Homo sapiens
taacattcccactgcc

SEQ ID NO: 1454772 - DNA, 23 bp, Homo sapiens
taacattcctcatgaatgtaaat

SEQ ID NO: 1454773 - DNA, 16 bp, Homo sapiens
taacattcgatctcat

SEQ ID NO: 1454774 - DNA, 23 bp, Homo sapiens
taacattcgatctcattcagtat

SEQ ID NO: 1454775 - DNA, 20 bp, Homo sapiens
taacattgaccaagaactgc

SEQ ID NO: 1454776 - DNA, 20 bp, Homo sapiens
taacattgcataaacacttt

SEQ ID NO: 1454777 - DNA, 12 bp, Homo sapiens
taacatttctgt

SEQ ID NO: 1454778 - DNA, 14 bp, Homo sapiens
taaccaaaaaatgt

SEQ ID NO: 1454779 - DNA, 15 bp, Homo sapiens
taaccaaatattaaa

SEQ ID NO: 1454780 - DNA, 11 bp, Homo sapiens
taaccaagctg

SEQ ID NO: 1454781 - DNA, 16 bp, Homo sapiens
taaccaagctgagttt

SEQ ID NO: 1454782 - DNA, 19 bp, Homo sapiens
taaccaagctgagtttcct

SEQ ID NO: 1454783 - DNA, 12 bp, Homo sapiens
taaccaagttcc

SEQ ID NO: 1454784 - DNA, 23 bp, Homo sapiens
taaccacaaagcacagtttgaac

SEQ ID NO: 1454785 - DNA, 13 bp, Homo sapiens
taaccacggaaaa

SEQ ID NO: 1454786 - DNA, 22 bp, Homo sapiens
taaccagccacagtacatatgt

SEQ ID NO: 1454787 - DNA, 16 bp, Homo sapiens
taaccaggatggtctc

SEQ ID NO: 1454788 - DNA, 14 bp, Homo sapiens
taaccataagattt

SEQ ID NO: 1454789 - DNA, 18 bp, Homo sapiens
taaccataagatttactg

SEQ ID NO: 1454790 - DNA, 16 bp, Homo sapiens
taaccatccccaactc

SEQ ID NO: 1454791 - DNA, 17 bp, Homo sapiens
taaccatccccaactcc

SEQ ID NO: 1454792 - DNA, 17 bp, Homo sapiens
taaccatggtgcttgtt

SEQ ID NO: 1454793 - DNA, 14 bp, Homo sapiens
taacccaatgcctg

SEQ ID NO: 1454794 - DNA, 14 bp, Homo sapiens
taacccacctctcc

SEQ ID NO: 1454795 - DNA, 21 bp, Homo sapiens
taacccattccagtacagtat

SEQ ID NO: 1454796 - DNA, 19 bp, Homo sapiens
taaccccagctccctagga

SEQ ID NO: 1454797 - DNA, 18 bp, Homo sapiens
taacccctcctggctgtg

SEQ ID NO: 1454798 - DNA, 12 bp, Homo sapiens
taacccctttcc

SEQ ID NO: 1454799 - DNA, 18 bp, Homo sapiens
taacccttcatcttcctg

SEQ ID NO: 1454800 - DNA, 19 bp, Homo sapiens
taacccttcatcttcctgt

SEQ ID NO: 1454801 - DNA, 17 bp, Homo sapiens
taacctagaagtatttt

SEQ ID NO: 1454802 - DNA, 19 bp, Homo sapiens
taacctagttaaagaaagg

SEQ ID NO: 1454803 - DNA, 20 bp, Homo sapiens
taacctagttaaagaaagga

SEQ ID NO: 1454804 - DNA, 20 bp, Homo sapiens
taacctgttacactgggctg

SEQ ID NO: 1454805 - DNA, 22 bp, Homo sapiens
taacctgttacactgggctggg

SEQ ID NO: 1454806 - DNA, 22 bp, Homo sapiens
taaccttgaatgctgccagtgt

SEQ ID NO: 1454807 - DNA, 23 bp, Homo sapiens
taacgaataaaggtcccatgctc

SEQ ID NO: 1454808 - DNA, 14 bp, Homo sapiens
taacgacttcaggg

SEQ ID NO: 1454809 - DNA, 23 bp, Homo sapiens
taacgacttcagggcagggctct

SEQ ID NO: 1454810 - DNA, 12 bp, Homo sapiens
taacggctccag

SEQ ID NO: 1454811 - DNA, 14 bp, Homo sapiens
taacggtgctaaaa

SEQ ID NO: 1454812 - DNA, 20 bp, Homo sapiens
taacggtttaattctgtctt

SEQ ID NO: 1454813 - DNA, 17 bp, Homo sapiens
taacgtgatgtgccact

SEQ ID NO: 1454814 - DNA, 22 bp, Homo sapiens
taacgtgtatctttaagaaaaa

SEQ ID NO: 1454815 - DNA, 16 bp, Homo sapiens
taacgttgagcccctg

SEQ ID NO: 1454816 - DNA, 15 bp, Homo sapiens
taactaaaaggtatg

SEQ ID NO: 1454817 - DNA, 14 bp, Homo sapiens
taactaaaattaag

SEQ ID NO: 1454818 - DNA, 19 bp, Homo sapiens
taactaaaattaagtatat

SEQ ID NO: 1454819 - DNA, 15 bp, Homo sapiens
taactaactggcagg

SEQ ID NO: 1454820 - DNA, 19 bp, Homo sapiens
taactaatgctaagaaatg

SEQ ID NO: 1454821 - DNA, 14 bp, Homo sapiens
taactaattttgtt

SEQ ID NO: 1454822 - DNA, 16 bp, Homo sapiens
taactaattttgttga

SEQ ID NO: 1454823 - DNA, 18 bp, Homo sapiens
taactacaaagctttgct

SEQ ID NO: 1454824 - DNA, 19 bp, Homo sapiens
taactacaaagctttgcta

SEQ ID NO: 1454825 - DNA, 16 bp, Homo sapiens
cagtaggtccaagggc

SEQ ID NO: 1454826 - DNA, 17 bp, Homo sapiens
cagtaggtcccggccag

SEQ ID NO: 1454827 - DNA, 19 bp, Homo sapiens
cagtaggtcccggccagct

SEQ ID NO: 1454828 - DNA, 23 bp, Homo sapiens
cagtaggtcccggccagctctgg

SEQ ID NO: 1454829 - DNA, 20 bp, Homo sapiens
cagtagtttgagaccagcct

SEQ ID NO: 1454830 - DNA, 21 bp, Homo sapiens
cagtagtttgcatttcagaaa

SEQ ID NO: 1454831 - DNA, 12 bp, Homo sapiens
cagtataattct

SEQ ID NO: 1454832 - DNA, 20 bp, Homo sapiens
cagtataattctgtactgat

SEQ ID NO: 1454833 - DNA, 14 bp, Homo sapiens
cagtatactgtgtg

SEQ ID NO: 1454834 - DNA, 16 bp, Homo sapiens
cagtatattagtatta

SEQ ID NO: 1454835 - DNA, 15 bp, Homo sapiens
cagtatcatattatt

SEQ ID NO: 1454836 - DNA, 16 bp, Homo sapiens
cagtatccactttgca

SEQ ID NO: 1454837 - DNA, 14 bp, Homo sapiens
cagtatcccacatc

SEQ ID NO: 1454838 - DNA, 16 bp, Homo sapiens
cagtatcccacatcca

SEQ ID NO: 1454839 - DNA, 16 bp, Homo sapiens
cagtatctatatatgt

SEQ ID NO: 1454840 - DNA, 18 bp, Homo sapiens
cagtatctatatatgtgt

SEQ ID NO: 1454841 - DNA, 16 bp, Homo sapiens
cagtatgagaagaaaa

SEQ ID NO: 1454842 - DNA, 19 bp, Homo sapiens
cagtatgatgaaaataatt

SEQ ID NO: 1454843 - DNA, 20 bp, Homo sapiens
cagtatgatgaaaataattt

SEQ ID NO: 1454844 - DNA, 21 bp, Homo sapiens
cagtatgatgaaaataatttt

SEQ ID NO: 1454845 - DNA, 23 bp, Homo sapiens
cagtatgatgaaaataattttcc

SEQ ID NO: 1454846 - DNA, 22 bp, Homo sapiens
cagtatgatggcaggagaatca

SEQ ID NO: 1454847 - DNA, 15 bp, Homo sapiens
cagtatgatttataa

SEQ ID NO: 1454848 - DNA, 19 bp, Homo sapiens
cagtatgctttccctgagg

SEQ ID NO: 1454849 - DNA, 23 bp, Homo sapiens
cagtatgctttccctgaggaatg

SEQ ID NO: 1454850 - DNA, 21 bp, Homo sapiens
cagtatgtccccataagacaa

SEQ ID NO: 1454851 - DNA, 15 bp, Homo sapiens
cagtatgtgggatat

SEQ ID NO: 1454852 - DNA, 21 bp, Homo sapiens
cagtattatagacaaaagaat

SEQ ID NO: 1454853 - DNA, 19 bp, Homo sapiens
cagtattatgcatatataa

SEQ ID NO: 1454854 - DNA, 16 bp, Homo sapiens
cagtattctgacatgt

SEQ ID NO: 1454855 - DNA, 20 bp, Homo sapiens
cagtattgccccctctcact

SEQ ID NO: 1454856 - DNA, 16 bp, Homo sapiens
cagtatttagaagcca

SEQ ID NO: 1454857 - DNA, 17 bp, Homo sapiens
cagtatttagaagccaa

SEQ ID NO: 1454858 - DNA, 12 bp, Homo sapiens
cagtatttgtaa

SEQ ID NO: 1454859 - DNA, 13 bp, Homo sapiens
cagtatttgtaat

SEQ ID NO: 1454860 - DNA, 14 bp, Homo sapiens
cagtatttgtaatt

SEQ ID NO: 1454861 - DNA, 18 bp, Homo sapiens
cagtatttgtaattaaaa

SEQ ID NO: 1454862 - DNA, 22 bp, Homo sapiens
cagtattttaaatgaagtgatt

SEQ ID NO: 1454863 - DNA, 14 bp, Homo sapiens
cagtattttgtgtc

SEQ ID NO: 1454864 - DNA, 21 bp, Homo sapiens
cagtatttttatacggaaaaa

SEQ ID NO: 1454865 - DNA, 18 bp, Homo sapiens
cagtatttttttttaatt

SEQ ID NO: 1454866 - DNA, 20 bp, Homo sapiens
cagtatttttttttaatttt

SEQ ID NO: 1454867 - DNA, 16 bp, Homo sapiens
cagtcaaatctgggct

SEQ ID NO: 1454868 - DNA, 12 bp, Homo sapiens
cagtcacactgt

SEQ ID NO: 1454869 - DNA, 20 bp, Homo sapiens
cagtcacactgtggccagta

SEQ ID NO: 1454870 - DNA, 21 bp, Homo sapiens
cagtcacactgttactccaca

SEQ ID NO: 1454871 - DNA, 22 bp, Homo sapiens
cagtcacactgttactccacag

SEQ ID NO: 1454872 - DNA, 16 bp, Homo sapiens
cagtcagaaggacggc

SEQ ID NO: 1454873 - DNA, 22 bp, Homo sapiens
cagtcagccctgattgtgccag

SEQ ID NO: 1454874 - DNA, 14 bp, Homo sapiens
cagtcagctgtggg

SEQ ID NO: 1454875 - DNA, 20 bp, Homo sapiens
cagtcaggctgcagaggcac

SEQ ID NO: 1454876 - DNA, 13 bp, Homo sapiens
cagtcagggacag

SEQ ID NO: 1454877 - DNA, 22 bp, Homo sapiens
cagtcagggacagcagcctccc

SEQ ID NO: 1454878 - DNA, 17 bp, Homo sapiens
cagtcagtgcaaatgtc

SEQ ID NO: 1454879 - DNA, 18 bp, Homo sapiens
cagtcagtgcaaatgtca

SEQ ID NO: 1454880 - DNA, 19 bp, Homo sapiens
cagtcagtggagcctgggt

SEQ ID NO: 1454881 - DNA, 15 bp, Homo sapiens
cagtcagttcccgga

SEQ ID NO: 1454882 - DNA, 17 bp, Homo sapiens
gttcattttgagctgaa

SEQ ID NO: 1454883 - DNA, 15 bp, Homo sapiens
gttccaaaccctcct

SEQ ID NO: 1454884 - DNA, 17 bp, Homo sapiens
gttccaaaccctcctgg

SEQ ID NO: 1454885 - DNA, 19 bp, Homo sapiens
gttccaacctcctgctctg

SEQ ID NO: 1454886 - DNA, 14 bp, Homo sapiens
gttccaagagtcta

SEQ ID NO: 1454887 - DNA, 18 bp, Homo sapiens
gttccaccattgctggaa

SEQ ID NO: 1454888 - DNA, 21 bp, Homo sapiens
gttccaccccaagagaactcg

SEQ ID NO: 1454889 - DNA, 20 bp, Homo sapiens
gttccacgtccccctggggc

SEQ ID NO: 1454890 - DNA, 21 bp, Homo sapiens
gttccacgtccccctggggct

SEQ ID NO: 1454891 - DNA, 21 bp, Homo sapiens
gttccagaacagccctcggcc

SEQ ID NO: 1454892 - DNA, 24 bp, Homo sapiens
gttccagaacagccctcggcctcc

SEQ ID NO: 1454893 - DNA, 13 bp, Homo sapiens
gttccagaggagc

SEQ ID NO: 1454894 - DNA, 19 bp, Homo sapiens
gttccagaggtattcctct

SEQ ID NO: 1454895 - DNA, 12 bp, Homo sapiens
gttccagctctt

SEQ ID NO: 1454896 - DNA, 14 bp, Homo sapiens
gttccagctctttg

SEQ ID NO: 1454897 - DNA, 16 bp, Homo sapiens
gttccagctctttgaa

SEQ ID NO: 1454898 - DNA, 21 bp, Homo sapiens
gttccaggcctgatcttgcct

SEQ ID NO: 1454899 - DNA, 19 bp, Homo sapiens
gttccagggtccctctgtg

SEQ ID NO: 1454900 - DNA, 20 bp, Homo sapiens
gttccagggtccctctgtgt

SEQ ID NO: 1454901 - DNA, 18 bp, Homo sapiens
gttccagtttctccttga

SEQ ID NO: 1454902 - DNA, 13 bp, Homo sapiens
gttccatccacca

SEQ ID NO: 1454903 - DNA, 19 bp, Homo sapiens
gttccatccaccaccttgc

SEQ ID NO: 1454904 - DNA, 15 bp, Homo sapiens
gttccatgcctgagg

SEQ ID NO: 1454905 - DNA, 20 bp, Homo sapiens
gttccatgcctgagggtgga

SEQ ID NO: 1454906 - DNA, 22 bp, Homo sapiens
gttccattgaagccgactctgg

SEQ ID NO: 1454907 - DNA, 15 bp, Homo sapiens
gttcccaataaaagt

SEQ ID NO: 1454908 - DNA, 15 bp, Homo sapiens
gttcccactcccggc

SEQ ID NO: 1454909 - DNA, 16 bp, Homo sapiens
gttcccatttcagctg

SEQ ID NO: 1454910 - DNA, 13 bp, Homo sapiens
gttcccccagcaa

SEQ ID NO: 1454911 - DNA, 19 bp, Homo sapiens
gttcccccagtacctccaa

SEQ ID NO: 1454912 - DNA, 19 bp, Homo sapiens
gttccccgcaacccacagc

SEQ ID NO: 1454913 - DNA, 21 bp, Homo sapiens
gttccccgcaacccacagctc

SEQ ID NO: 1454914 - DNA, 22 bp, Homo sapiens
gttccccgcaacccacagctca

SEQ ID NO: 1454915 - DNA, 15 bp, Homo sapiens
gttcccctgttcact

SEQ ID NO: 1454916 - DNA, 20 bp, Homo sapiens
gttcccggagcacagccctg

SEQ ID NO: 1454917 - DNA, 22 bp, Homo sapiens
gttcccggagcacagccctggg

SEQ ID NO: 1454918 - DNA, 14 bp, Homo sapiens
gttcccgtttctcc

SEQ ID NO: 1454919 - DNA, 13 bp, Homo sapiens
gttccctagagag

SEQ ID NO: 1454920 - DNA, 20 bp, Homo sapiens
gttccctagagagaataaat

SEQ ID NO: 1454921 - DNA, 16 bp, Homo sapiens
gttccctctggcttcc

SEQ ID NO: 1454922 - DNA, 18 bp, Homo sapiens
gttccctctggcttccca

SEQ ID NO: 1454923 - DNA, 19 bp, Homo sapiens
gttccctgaaaacccagag

SEQ ID NO: 1454924 - DNA, 20 bp, Homo sapiens
gttccctgaaaacccagaga

SEQ ID NO: 1454925 - DNA, 21 bp, Homo sapiens
gttccctgaaaacccagagag

SEQ ID NO: 1454926 - DNA, 11 bp, Homo sapiens
gttccctgcac

SEQ ID NO: 1454927 - DNA, 15 bp, Homo sapiens
gttccctgcaccctg

SEQ ID NO: 1454928 - DNA, 17 bp, Homo sapiens
gttccctgcaccctgga

SEQ ID NO: 1454929 - DNA, 16 bp, Homo sapiens
gttccctgtcagaggc

SEQ ID NO: 1454930 - DNA, 21 bp, Homo sapiens
gttcccttcctcttcctgccc

SEQ ID NO: 1454931 - DNA, 23 bp, Homo sapiens
gttcccttcctcttcctgccctt

SEQ ID NO: 1454932 - DNA, 12 bp, Homo sapiens
gttcccttgaat

SEQ ID NO: 1454933 - DNA, 12 bp, Homo sapiens
gttcccttggcc

SEQ ID NO: 1454934 - DNA, 15 bp, Homo sapiens
gttcccttggcctca

SEQ ID NO: 1454935 - DNA, 19 bp, Homo sapiens
gttcccttggcctcagaat

SEQ ID NO: 1454936 - DNA, 17 bp, Homo sapiens
gttccgccaggcgctgc

SEQ ID NO: 1454937 - DNA, 15 bp, Homo sapiens
gttcctcaaattttt

SEQ ID NO: 1454938 - DNA, 20 bp, Homo sapiens
gttcctcaaattttttgact

SEQ ID NO: 1454939 - DNA, 20 bp, Homo sapiens
gttcctcatctgagaggctc

SEQ ID NO: 1454940 - DNA, 21 bp, Homo sapiens
gttcctcatctgagaggctct

SEQ ID NO: 1454941 - DNA, 23 bp, Homo sapiens
gttcctcctacttacaacccagg

SEQ ID NO: 1454942 - DNA, 17 bp, Homo sapiens
gttcctcggtgggccag

SEQ ID NO: 1454943 - DNA, 19 bp, Homo sapiens
gttcctcggtgggccagag

SEQ ID NO: 1454944 - DNA, 20 bp, Homo sapiens
gttcctcggtgggccagagc

SEQ ID NO: 1454945 - DNA, 17 bp, Homo sapiens
gttcctctatactttgt

SEQ ID NO: 1454946 - DNA, 19 bp, Homo sapiens
gttcctctatactttgttc

SEQ ID NO: 1454947 - DNA, 12 bp, Homo sapiens
gttcctctgcct

SEQ ID NO: 1454948 - DNA, 13 bp, Homo sapiens
gttcctctgcctg

SEQ ID NO: 1454949 - DNA, 12 bp, Homo sapiens
gttcctctgggt

SEQ ID NO: 1454950 - DNA, 18 bp, Homo sapiens
gttcctctgggtttctaa

SEQ ID NO: 1454951 - DNA, 19 bp, Homo sapiens
gttcctctgggtttctaag

SEQ ID NO: 1454952 - DNA, 21 bp, Homo sapiens
gttcctgaattctatttgctg

SEQ ID NO: 1454953 - DNA, 19 bp, Homo sapiens
gttcctgatgacccaggct

SEQ ID NO: 1454954 - DNA, 22 bp, Homo sapiens
gttcctgatgacccaggctgcc

SEQ ID NO: 1454955 - DNA, 19 bp, Homo sapiens
gttcctgcggagtgaagag

SEQ ID NO: 1454956 - DNA, 20 bp, Homo sapiens
gttcctgcggagtgaagagg

SEQ ID NO: 1454957 - DNA, 19 bp, Homo sapiens
gttcctgctgtcctggtgg

SEQ ID NO: 1454958 - DNA, 12 bp, Homo sapiens
gttcctggaagc

SEQ ID NO: 1454959 - DNA, 14 bp, Homo sapiens
gttcctggaagcag

SEQ ID NO: 1454960 - DNA, 15 bp, Homo sapiens
gttcctggctgatga

SEQ ID NO: 1454961 - DNA, 14 bp, Homo sapiens
gttcctgtggctcc

SEQ ID NO: 1454962 - DNA, 16 bp, Homo sapiens
gttcctgtggctccct

SEQ ID NO: 1454963 - DNA, 14 bp, Homo sapiens
gttccttactgcag

SEQ ID NO: 1454964 - DNA, 13 bp, Homo sapiens
gttccttagacct

SEQ ID NO: 1454965 - DNA, 16 bp, Homo sapiens
gttccttccagattgt

SEQ ID NO: 1454966 - DNA, 15 bp, Homo sapiens
gttccttccctggga

SEQ ID NO: 1454967 - DNA, 22 bp, Homo sapiens
gttcctttcatctctctacctc

SEQ ID NO: 1454968 - DNA, 17 bp, Homo sapiens
gttcctttctctgggct

SEQ ID NO: 1454969 - DNA, 18 bp, Homo sapiens
gttcctttctctgggctt

SEQ ID NO: 1454970 - DNA, 16 bp, Homo sapiens
gttcctttttaaatgt

SEQ ID NO: 1454971 - DNA, 23 bp, Homo sapiens
gttcctttttaaatgtgaatttt

SEQ ID NO: 1454972 - DNA, 19 bp, Homo sapiens
gttccttttttgtatatta

SEQ ID NO: 1454973 - DNA, 16 bp, Homo sapiens
gttcgagaccagcctg

SEQ ID NO: 1454974 - DNA, 16 bp, Homo sapiens
gttcgagactccatct

SEQ ID NO: 1454975 - DNA, 14 bp, Homo sapiens
caggctgagaactc

SEQ ID NO: 1454976 - DNA, 23 bp, Homo sapiens
caggctgagaactcgttcacctc

SEQ ID NO: 1454977 - DNA, 12 bp, Homo sapiens
caggctgagcca

SEQ ID NO: 1454978 - DNA, 15 bp, Homo sapiens
caggctgagtgagcc

SEQ ID NO: 1454979 - DNA, 21 bp, Homo sapiens
caggctgcacctctggctaga

SEQ ID NO: 1454980 - DNA, 13 bp, Homo sapiens
caggctgcactgc

SEQ ID NO: 1454981 - DNA, 14 bp, Homo sapiens
caggctgcactgca

SEQ ID NO: 1454982 - DNA, 17 bp, Homo sapiens
caggctgcactgcagtg

SEQ ID NO: 1454983 - DNA, 20 bp, Homo sapiens
caggctgcactgcagtgatg

SEQ ID NO: 1454984 - DNA, 16 bp, Homo sapiens
caggctgcagcctcca

SEQ ID NO: 1454985 - DNA, 20 bp, Homo sapiens
caggctgcctcctgccctta

SEQ ID NO: 1454986 - DNA, 20 bp, Homo sapiens
caggctgcctcggactccat

SEQ ID NO: 1454987 - DNA, 19 bp, Homo sapiens
caggctggacaccctctgc

SEQ ID NO: 1454988 - DNA, 20 bp, Homo sapiens
caggctggacaccctctgcc

SEQ ID NO: 1454989 - DNA, 15 bp, Homo sapiens
caggctggagactgg

SEQ ID NO: 1454990 - DNA, 17 bp, Homo sapiens
caggctggcgcagccaa

SEQ ID NO: 1454991 - DNA, 21 bp, Homo sapiens
caggctggcgcagccaaggcc

SEQ ID NO: 1454992 - DNA, 18 bp, Homo sapiens
caggctgggaactcatct

SEQ ID NO: 1454993 - DNA, 11 bp, Homo sapiens
caggctgggcc

SEQ ID NO: 1454994 - DNA, 12 bp, Homo sapiens
caggctgggcca

SEQ ID NO: 1454995 - DNA, 22 bp, Homo sapiens
caggctgggccatgtccaaaga

SEQ ID NO: 1454996 - DNA, 18 bp, Homo sapiens
caggctgggctctgcctg

SEQ ID NO: 1454997 - DNA, 15 bp, Homo sapiens
caggcttcaccctga

SEQ ID NO: 1454998 - DNA, 22 bp, Homo sapiens
caggcttcaccctgaatggttc

SEQ ID NO: 1454999 - DNA, 13 bp, Homo sapiens
caggcttcctggt

SEQ ID NO: 1455000 - DNA, 21 bp, Homo sapiens
gttctatccccaagctggcca

SEQ ID NO: 1455001 - DNA, 22 bp, Homo sapiens
gttctatttctatctgcaaata

SEQ ID NO: 1455002 - DNA, 20 bp, Homo sapiens
gttctattttattaattttc

SEQ ID NO: 1455003 - DNA, 17 bp, Homo sapiens
gttctcaagaatctaga

SEQ ID NO: 1455004 - DNA, 18 bp, Homo sapiens
gttctcacaccaacagtg

SEQ ID NO: 1455005 - DNA, 16 bp, Homo sapiens
gttctcacacccaccg

SEQ ID NO: 1455006 - DNA, 17 bp, Homo sapiens
gttctcagatcttgaca

SEQ ID NO: 1455007 - DNA, 18 bp, Homo sapiens
gttctcagcttgcagctg

SEQ ID NO: 1455008 - DNA, 19 bp, Homo sapiens
gttctcagcttgcagctgg

SEQ ID NO: 1455009 - DNA, 14 bp, Homo sapiens
gttctcatgaagca

SEQ ID NO: 1455010 - DNA, 19 bp, Homo sapiens
gttctcatgggtggcactc

SEQ ID NO: 1455011 - DNA, 15 bp, Homo sapiens
gttctcatttgatca

SEQ ID NO: 1455012 - DNA, 19 bp, Homo sapiens
gttctccaagaaactgaat

SEQ ID NO: 1455013 - DNA, 20 bp, Homo sapiens
gttctccagcttcagctcaa

SEQ ID NO: 1455014 - DNA, 19 bp, Homo sapiens
gttctccgttagctcctgt

SEQ ID NO: 1455015 - DNA, 18 bp, Homo sapiens
gttctccttttcctctct

SEQ ID NO: 1455016 - DNA, 22 bp, Homo sapiens
gttctccttttcctctctcccg

SEQ ID NO: 1455017 - DNA, 17 bp, Homo sapiens
gttctccttttgaactt

SEQ ID NO: 1455018 - DNA, 21 bp, Homo sapiens
gttctccttttgaacttgtca

SEQ ID NO: 1455019 - DNA, 12 bp, Homo sapiens
gttctctgcttg

SEQ ID NO: 1455020 - DNA, 13 bp, Homo sapiens
gttctctgtccta

SEQ ID NO: 1455021 - DNA, 18 bp, Homo sapiens
gttctgaataatttctta

SEQ ID NO: 1455022 - DNA, 15 bp, Homo sapiens
gttctgcactgaaaa

SEQ ID NO: 1455023 - DNA, 16 bp, Homo sapiens
gttctgcactgaaaag

SEQ ID NO: 1455024 - DNA, 15 bp, Homo sapiens
gttctgccctgcctg

SEQ ID NO: 1455025 - DNA, 23 bp, Homo sapiens
gttctgccctgcctgaggaggag

SEQ ID NO: 1455026 - DNA, 12 bp, Homo sapiens
gttctgcctgga

SEQ ID NO: 1455027 - DNA, 14 bp, Homo sapiens
gttctgctccatac

SEQ ID NO: 1455028 - DNA, 21 bp, Homo sapiens
gttctgctccataccttttct

SEQ ID NO: 1455029 - DNA, 13 bp, Homo sapiens
gttctgctcctgc

SEQ ID NO: 1455030 - DNA, 15 bp, Homo sapiens
gttctgctcctgctt

SEQ ID NO: 1455031 - DNA, 16 bp, Homo sapiens
gttctgctgaccaaat

SEQ ID NO: 1455032 - DNA, 22 bp, Homo sapiens
gttctgctgaccaaatggccag

SEQ ID NO: 1455033 - DNA, 14 bp, Homo sapiens
gttctgctggcctg

SEQ ID NO: 1455034 - DNA, 16 bp, Homo sapiens
gttctgctggcctgga

SEQ ID NO: 1455035 - DNA, 19 bp, Homo sapiens
gttctgctggcctggatct

SEQ ID NO: 1455036 - DNA, 21 bp, Homo sapiens
gttctgctttctgcctctcct

SEQ ID NO: 1455037 - DNA, 11 bp, Homo sapiens
gttctggaaat

SEQ ID NO: 1455038 - DNA, 23 bp, Homo sapiens
gttctggactacacccaagcctg

SEQ ID NO: 1455039 - DNA, 16 bp, Homo sapiens
gttctggactctgccc

SEQ ID NO: 1455040 - DNA, 13 bp, Homo sapiens
gttctggccagaa

SEQ ID NO: 1455041 - DNA, 20 bp, Homo sapiens
gttctggctgccccaacctg

SEQ ID NO: 1455042 - DNA, 14 bp, Homo sapiens
gttctggggggacc

SEQ ID NO: 1455043 - DNA, 19 bp, Homo sapiens
gttctggggggacccagtg

SEQ ID NO: 1455044 - DNA, 20 bp, Homo sapiens
gttctggggggacccagtgc

SEQ ID NO: 1455045 - DNA, 19 bp, Homo sapiens
gttctggttcctcctggta

SEQ ID NO: 1455046 - DNA, 17 bp, Homo sapiens
gttctgtctagactggc

SEQ ID NO: 1455047 - DNA, 14 bp, Homo sapiens
gttctgtcttccca

SEQ ID NO: 1455048 - DNA, 15 bp, Homo sapiens
gttctgtgcctcccc

SEQ ID NO: 1455049 - DNA, 18 bp, Homo sapiens
gttctgtgcctcccccca

SEQ ID NO: 1455050 - DNA, 22 bp, Homo sapiens
gttctgtgtctttcacagctcc

SEQ ID NO: 1455051 - DNA, 22 bp, Homo sapiens
gttctgttccaacctcctgctc

SEQ ID NO: 1455052 - DNA, 23 bp, Homo sapiens
gttctgttccaacctcctgctct

SEQ ID NO: 1455053 - DNA, 16 bp, Homo sapiens
gttctgttgatcccac

SEQ ID NO: 1455054 - DNA, 13 bp, Homo sapiens
gttctgtttcaag

SEQ ID NO: 1455055 - DNA, 18 bp, Homo sapiens
gttctgtttcaaggcact

SEQ ID NO: 1455056 - DNA, 15 bp, Homo sapiens
gttctgtttggcact

SEQ ID NO: 1455057 - DNA, 17 bp, Homo sapiens
gttctgtttgttaaaac

SEQ ID NO: 1455058 - DNA, 14 bp, Homo sapiens
gttctgtttgttat

SEQ ID NO: 1455059 - DNA, 20 bp, Homo sapiens
gttcttaaaaaaataaaata

SEQ ID NO: 1455060 - DNA, 20 bp, Homo sapiens
gttcttagagtgtagctgta

SEQ ID NO: 1455061 - DNA, 18 bp, Homo sapiens
gttcttagctttgaaact

SEQ ID NO: 1455062 - DNA, 16 bp, Homo sapiens
gttcttaggtttactg

SEQ ID NO: 1455063 - DNA, 17 bp, Homo sapiens
gttcttaggtttactgt

SEQ ID NO: 1455064 - DNA, 22 bp, Homo sapiens
gttcttaggtttactgtgaaga

SEQ ID NO: 1455065 - DNA, 17 bp, Homo sapiens
gttcttagtttgcagtt

SEQ ID NO: 1455066 - DNA, 18 bp, Homo sapiens
gttcttcaactcctgggc

SEQ ID NO: 1455067 - DNA, 11 bp, Homo sapiens
gttcttcatga

SEQ ID NO: 1455068 - DNA, 21 bp, Homo sapiens
gttcttctgttctgcagacac

SEQ ID NO: 1455069 - DNA, 17 bp, Homo sapiens
gttcttcttattttgtg

SEQ ID NO: 1455070 - DNA, 13 bp, Homo sapiens
gttcttctttctt

SEQ ID NO: 1455071 - DNA, 13 bp, Homo sapiens
gttcttgatgtca

SEQ ID NO: 1455072 - DNA, 23 bp, Homo sapiens
gttcttgggcctcaggctctgca

SEQ ID NO: 1455073 - DNA, 16 bp, Homo sapiens
gttcttgttttatata

SEQ ID NO: 1455074 - DNA, 20 bp, Homo sapiens
gttctttcctctttctgctc

SEQ ID NO: 1455075 - DNA, 15 bp, Homo sapiens
gttctttctgggggg

SEQ ID NO: 1455076 - DNA, 13 bp, Homo sapiens
gttctttggaagc

SEQ ID NO: 1455077 - DNA, 13 bp, Homo sapiens
gttctttttctga

SEQ ID NO: 1455078 - DNA, 22 bp, Homo sapiens
gttctttttctgaactccattt

SEQ ID NO: 1455079 - DNA, 19 bp, Homo sapiens
gttgaaaaaggaaatattc

SEQ ID NO: 1455080 - DNA, 17 bp, Homo sapiens
gttgaaaagactccaaa

SEQ ID NO: 1455081 - DNA, 16 bp, Homo sapiens
gttgaaaagcacacac

SEQ ID NO: 1455082 - DNA, 19 bp, Homo sapiens
gttgaagagacagagacaa

SEQ ID NO: 1455083 - DNA, 22 bp, Homo sapiens
gttgaagggaggtggcaagagt

SEQ ID NO: 1455084 - DNA, 13 bp, Homo sapiens
gttgaataaaagt

SEQ ID NO: 1455085 - DNA, 20 bp, Homo sapiens
gttgaattttttttaacatt

SEQ ID NO: 1455086 - DNA, 15 bp, Homo sapiens
gttgacaacctagaa

SEQ ID NO: 1455087 - DNA, 16 bp, Homo sapiens
gttgacaactgtgact

SEQ ID NO: 1455088 - DNA, 19 bp, Homo sapiens
gttgacacagttgtagggt

SEQ ID NO: 1455089 - DNA, 19 bp, Homo sapiens
gttgacacatatgaacaca

SEQ ID NO: 1455090 - DNA, 18 bp, Homo sapiens
gttgtagcatttaaaatg

SEQ ID NO: 1455091 - DNA, 18 bp, Homo sapiens
gttgtatcatactcttct

SEQ ID NO: 1455092 - DNA, 21 bp, Homo sapiens
gttgtattgatcaatgcatgt

SEQ ID NO: 1455093 - DNA, 16 bp, Homo sapiens
gttgtatttaacagaa

SEQ ID NO: 1455094 - DNA, 15 bp, Homo sapiens
gttgtcaaagaagct

SEQ ID NO: 1455095 - DNA, 22 bp, Homo sapiens
gttgtcaagtctctgctggccc

SEQ ID NO: 1455096 - DNA, 17 bp, Homo sapiens
gttgtcaatattaaata

SEQ ID NO: 1455097 - DNA, 23 bp, Homo sapiens
gttgtcacctctctctgaggaca

SEQ ID NO: 1455098 - DNA, 22 bp, Homo sapiens
gttgtccaattgttgacagttc

SEQ ID NO: 1455099 - DNA, 19 bp, Homo sapiens
gttgtccggtttactttaa

SEQ ID NO: 1455100 - DNA, 23 bp, Homo sapiens
gttgtcctatggacaacttattt

SEQ ID NO: 1455101 - DNA, 18 bp, Homo sapiens
gttgtcgagatctcagga

SEQ ID NO: 1455102 - DNA, 15 bp, Homo sapiens
gttgtctaaaaataa

SEQ ID NO: 1455103 - DNA, 14 bp, Homo sapiens
gttgtctacattaa

SEQ ID NO: 1455104 - DNA, 22 bp, Homo sapiens
gttgtctattctgagccttgag

SEQ ID NO: 1455105 - DNA, 16 bp, Homo sapiens
gttgtcttatgtgaaa

SEQ ID NO: 1455106 - DNA, 13 bp, Homo sapiens
gttgtgagctgga

SEQ ID NO: 1455107 - DNA, 20 bp, Homo sapiens
gttgtgcaacggccagggtt

SEQ ID NO: 1455108 - DNA, 17 bp, Homo sapiens
gttgtggatatcagggt

SEQ ID NO: 1455109 - DNA, 14 bp, Homo sapiens
gttgtggatgctcc

SEQ ID NO: 1455110 - DNA, 14 bp, Homo sapiens
gttgtggttaatct

SEQ ID NO: 1455111 - DNA, 22 bp, Homo sapiens
gttgtgtctgtgccctccaaag

SEQ ID NO: 1455112 - DNA, 23 bp, Homo sapiens
gttgtgtctgtgccctccaaaga

SEQ ID NO: 1455113 - DNA, 12 bp, Homo sapiens
gttgtgtgtggg

SEQ ID NO: 1455114 - DNA, 12 bp, Homo sapiens
gttgtgttcctg

SEQ ID NO: 1455115 - DNA, 14 bp, Homo sapiens
gttgtgttcctggc

SEQ ID NO: 1455116 - DNA, 18 bp, Homo sapiens
gttgtgttgagatccagt

SEQ ID NO: 1455117 - DNA, 16 bp, Homo sapiens
gttgtgttttttaaga

SEQ ID NO: 1455118 - DNA, 21 bp, Homo sapiens
gttgttaaaacatttaatatt

SEQ ID NO: 1455119 - DNA, 11 bp, Homo sapiens
gtttgcctgtg

SEQ ID NO: 1455120 - DNA, 21 bp, Homo sapiens
gtttgcgggggtctgagtcta

SEQ ID NO: 1455121 - DNA, 20 bp, Homo sapiens
gtttgctgaacattggagaa

SEQ ID NO: 1455122 - DNA, 15 bp, Homo sapiens
gtttgctgattattt

SEQ ID NO: 1455123 - DNA, 17 bp, Homo sapiens
gtttgctgattatttat

SEQ ID NO: 1455124 - DNA, 13 bp, Homo sapiens
gtttgctgtgaac

SEQ ID NO: 1455125 - DNA, 14 bp, Homo sapiens
gtttgctgttgctg

SEQ ID NO: 1455126 - DNA, 19 bp, Homo sapiens
gtttggaaataaactgtgc

SEQ ID NO: 1455127 - DNA, 16 bp, Homo sapiens
gtttggaaggagcaga

SEQ ID NO: 1455128 - DNA, 15 bp, Homo sapiens
gtttggaatattaaa

SEQ ID NO: 1455129 - DNA, 18 bp, Homo sapiens
gtttggactgatttgtgg

SEQ ID NO: 1455130 - DNA, 21 bp, Homo sapiens
gtttggactgcagaagcaagg

SEQ ID NO: 1455131 - DNA, 19 bp, Homo sapiens
gtttggaggcccctgggct

SEQ ID NO: 1455132 - DNA, 21 bp, Homo sapiens
gtttggcacttgtatttaatt

SEQ ID NO: 1455133 - DNA, 12 bp, Homo sapiens
gtttggccctgg

SEQ ID NO: 1455134 - DNA, 18 bp, Homo sapiens
gtttggccctggagccag

SEQ ID NO: 1455135 - DNA, 21 bp, Homo sapiens
gtttggctggcttgtttgatt

SEQ ID NO: 1455136 - DNA, 14 bp, Homo sapiens
gtttggcttcctcc

SEQ ID NO: 1455137 - DNA, 15 bp, Homo sapiens
gtttgggaaagatgg

SEQ ID NO: 1455138 - DNA, 21 bp, Homo sapiens
gtttgggaagagcttagaaac

SEQ ID NO: 1455139 - DNA, 14 bp, Homo sapiens
gtttgggctgtctt

SEQ ID NO: 1455140 - DNA, 15 bp, Homo sapiens
gtttggggactcagg

SEQ ID NO: 1455141 - DNA, 16 bp, Homo sapiens
gtttggggactcagga

SEQ ID NO: 1455142 - DNA, 20 bp, Homo sapiens
gtttggggagcagagacact

SEQ ID NO: 1455143 - DNA, 22 bp, Homo sapiens
gtttgggggcgccctctctgct

SEQ ID NO: 1455144 - DNA, 19 bp, Homo sapiens
gtttgggtaaaatactttt

SEQ ID NO: 1455145 - DNA, 20 bp, Homo sapiens
gtttgggtaaaatactttta

SEQ ID NO: 1455146 - DNA, 19 bp, Homo sapiens
gtttgggttgttggtctgt

SEQ ID NO: 1455147 - DNA, 16 bp, Homo sapiens
gtttggtaaatgtttc

SEQ ID NO: 1455148 - DNA, 16 bp, Homo sapiens
gtttggtccagcctgg

SEQ ID NO: 1455149 - DNA, 22 bp, Homo sapiens
gtttggtgggggtagagctgat

SEQ ID NO: 1455150 - DNA, 18 bp, Homo sapiens
gtttggttagaggaaggc

SEQ ID NO: 1455151 - DNA, 14 bp, Homo sapiens
gtttgtaaatgcct

SEQ ID NO: 1455152 - DNA, 23 bp, Homo sapiens
gtttgtaatatacagtttttgta

SEQ ID NO: 1455153 - DNA, 19 bp, Homo sapiens
gtttgtatgagatggttaa

SEQ ID NO: 1455154 - DNA, 14 bp, Homo sapiens
caggcttcctggtg

SEQ ID NO: 1455155 - DNA, 22 bp, Homo sapiens
caggcttcctggtgagaactga

SEQ ID NO: 1455156 - DNA, 19 bp, Homo sapiens
caggcttctgtcaatttca

SEQ ID NO: 1455157 - DNA, 17 bp, Homo sapiens
caggcttggagggaagg

SEQ ID NO: 1455158 - DNA, 11 bp, Homo sapiens
caggcttgggg

SEQ ID NO: 1455159 - DNA, 23 bp, Homo sapiens
caggcttgtcactagcagctgca

SEQ ID NO: 1455160 - DNA, 15 bp, Homo sapiens
cagggaaaataggca

SEQ ID NO: 1455161 - DNA, 17 bp, Homo sapiens
cagggaaaattgcccca

SEQ ID NO: 1455162 - DNA, 17 bp, Homo sapiens
cagggaagagggcagta

SEQ ID NO: 1455163 - DNA, 14 bp, Homo sapiens
cagggaagctcttt

SEQ ID NO: 1455164 - DNA, 18 bp, Homo sapiens
cagggaaggacaggaccc

SEQ ID NO: 1455165 - DNA, 15 bp, Homo sapiens
cagggaaggcctgac

SEQ ID NO: 1455166 - DNA, 16 bp, Homo sapiens
cagggaaggcctgact

SEQ ID NO: 1455167 - DNA, 23 bp, Homo sapiens
cagggaaggcctgacttctgctg

SEQ ID NO: 1455168 - DNA, 23 bp, Homo sapiens
cagggaaggctaagcatggcctg

SEQ ID NO: 1455169 - DNA, 16 bp, Homo sapiens
cagggaaggtgctgaa

SEQ ID NO: 1455170 - DNA, 23 bp, Homo sapiens
cagggaatttcaggaactagaga

SEQ ID NO: 1455171 - DNA, 14 bp, Homo sapiens
cagggacagaggcc

SEQ ID NO: 1455172 - DNA, 16 bp, Homo sapiens
cagggacagaggcccc

SEQ ID NO: 1455173 - DNA, 21 bp, Homo sapiens
cagggacagaggccccagcct

SEQ ID NO: 1455174 - DNA, 15 bp, Homo sapiens
cagggacagcagcct

SEQ ID NO: 1455175 - DNA, 18 bp, Homo sapiens
cagggacagcagcctccc

SEQ ID NO: 1455176 - DNA, 23 bp, Homo sapiens
cagggacatgccctgtgtggctg

SEQ ID NO: 1455177 - DNA, 22 bp, Homo sapiens
cagggaccagggccaccgcagg

SEQ ID NO: 1455178 - DNA, 16 bp, Homo sapiens
cagggacccaggtgtg

SEQ ID NO: 1455179 - DNA, 18 bp, Homo sapiens
cagggacccaggtgtgcc

SEQ ID NO: 1455180 - DNA, 22 bp, Homo sapiens
cagggacccggggtctcctgga

SEQ ID NO: 1455181 - DNA, 15 bp, Homo sapiens
cagggaccgtccagg

SEQ ID NO: 1455182 - DNA, 18 bp, Homo sapiens
cagggaccgtccagggga

SEQ ID NO: 1455183 - DNA, 16 bp, Homo sapiens
cagggacctgagagca

SEQ ID NO: 1455184 - DNA, 21 bp, Homo sapiens
cagggacctttggagaccatt

SEQ ID NO: 1455185 - DNA, 21 bp, Homo sapiens
cagggacttcaggatcaagtc

SEQ ID NO: 1455186 - DNA, 16 bp, Homo sapiens
cagggacttgtttaga

SEQ ID NO: 1455187 - DNA, 20 bp, Homo sapiens
cagggacttgtttagagagc

SEQ ID NO: 1455188 - DNA, 23 bp, Homo sapiens
cagggagaaaatccaggtcatgc

SEQ ID NO: 1455189 - DNA, 16 bp, Homo sapiens
cagggagcaagacaga

SEQ ID NO: 1455190 - DNA, 19 bp, Homo sapiens
cagggagcaagacagagac

SEQ ID NO: 1455191 - DNA, 16 bp, Homo sapiens
cagggagcactgttca

SEQ ID NO: 1455192 - DNA, 15 bp, Homo sapiens
cagggagcagccccc

SEQ ID NO: 1455193 - DNA, 14 bp, Homo sapiens
cagggagcagggaa

SEQ ID NO: 1455194 - DNA, 18 bp, Homo sapiens
cagggagcagggaaggcc

SEQ ID NO: 1455195 - DNA, 20 bp, Homo sapiens
cagggagcagggaaggcctg

SEQ ID NO: 1455196 - DNA, 18 bp, Homo sapiens
cagggagccggcggcctc

SEQ ID NO: 1455197 - DNA, 20 bp, Homo sapiens
cagggagctatgagagatgt

SEQ ID NO: 1455198 - DNA, 19 bp, Homo sapiens
cagggagctctggggacag

SEQ ID NO: 1455199 - DNA, 16 bp, Homo sapiens
cagggagctgggcccg

SEQ ID NO: 1455200 - DNA, 22 bp, Homo sapiens
cagggagctgggcccgacatgg

SEQ ID NO: 1455201 - DNA, 15 bp, Homo sapiens
cagggaggagaggaa

SEQ ID NO: 1455202 - DNA, 22 bp, Homo sapiens
cagggaggagaggggaagggcc

SEQ ID NO: 1455203 - DNA, 18 bp, Homo sapiens
cagggaggaggtggcagc

SEQ ID NO: 1455204 - DNA, 21 bp, Homo sapiens
cagggaggaggtggcagccct

SEQ ID NO: 1455205 - DNA, 20 bp, Homo sapiens
cagggaggcaacactgctgt

SEQ ID NO: 1455206 - DNA, 19 bp, Homo sapiens
cagggaggggactatttat

SEQ ID NO: 1455207 - DNA, 21 bp, Homo sapiens
cagggaggggccggccctgtg

SEQ ID NO: 1455208 - DNA, 22 bp, Homo sapiens
cagggaggggccggccctgtgt

SEQ ID NO: 1455209 - DNA, 14 bp, Homo sapiens
cagggaggtggctg

SEQ ID NO: 1455210 - DNA, 13 bp, Homo sapiens
cagggagtcccct

SEQ ID NO: 1455211 - DNA, 22 bp, Homo sapiens
cagggagtcccctccccggccc

SEQ ID NO: 1455212 - DNA, 20 bp, Homo sapiens
cagggagtgtagtaaagccg

SEQ ID NO: 1455213 - DNA, 17 bp, Homo sapiens
cagggagtgtctgcagt

SEQ ID NO: 1455214 - DNA, 18 bp, Homo sapiens
cagggataacaaagaacc

SEQ ID NO: 1455215 - DNA, 20 bp, Homo sapiens
cagggatccagggacacttt

SEQ ID NO: 1455216 - DNA, 17 bp, Homo sapiens
cagggatgatggcagag

SEQ ID NO: 1455217 - DNA, 14 bp, Homo sapiens
cagggatggagatg

SEQ ID NO: 1455218 - DNA, 17 bp, Homo sapiens
cagggatgggcagccca

SEQ ID NO: 1455219 - DNA, 19 bp, Homo sapiens
cagggatgggcagcccaac

SEQ ID NO: 1455220 - DNA, 17 bp, Homo sapiens
cagggattaacctctgc

SEQ ID NO: 1455221 - DNA, 22 bp, Homo sapiens
cagggattgattttaaaatgta

SEQ ID NO: 1455222 - DNA, 16 bp, Homo sapiens
cagggattgctgccac

SEQ ID NO: 1455223 - DNA, 17 bp, Homo sapiens
cagggatttagcccatg

SEQ ID NO: 1455224 - DNA, 20 bp, Homo sapiens
cagggcaaatgacatgcact

SEQ ID NO: 1455225 - DNA, 21 bp, Homo sapiens
cagggcaaatgacatgcactg

SEQ ID NO: 1455226 - DNA, 22 bp, Homo sapiens
cagggcaaatgacatgcactga

SEQ ID NO: 1455227 - DNA, 15 bp, Homo sapiens
cagggcaacaagccc

SEQ ID NO: 1455228 - DNA, 20 bp, Homo sapiens
cagggcaaggacacagcgcg

SEQ ID NO: 1455229 - DNA, 21 bp, Homo sapiens
cagggcaaggacacagcgcgg

SEQ ID NO: 1455230 - DNA, 22 bp, Homo sapiens
cagggcaagggttaaggcctga

SEQ ID NO: 1455231 - DNA, 13 bp, Homo sapiens
cagggcaccagag

SEQ ID NO: 1455232 - DNA, 18 bp, Homo sapiens
cagggcaccagaggccga

SEQ ID NO: 1455233 - DNA, 12 bp, Homo sapiens
caggggagccag

SEQ ID NO: 1455234 - DNA, 17 bp, Homo sapiens
caggggagccagctgct

SEQ ID NO: 1455235 - DNA, 19 bp, Homo sapiens
caggggagccagctgcttg

SEQ ID NO: 1455236 - DNA, 20 bp, Homo sapiens
caggggagccagctgcttga

SEQ ID NO: 1455237 - DNA, 16 bp, Homo sapiens
caggggaggaaaaaag

SEQ ID NO: 1455238 - DNA, 17 bp, Homo sapiens
caggggaggagcctgtg

SEQ ID NO: 1455239 - DNA, 18 bp, Homo sapiens
caggggagtcccgtcagg

SEQ ID NO: 1455240 - DNA, 13 bp, Homo sapiens
caggggcaccttc

SEQ ID NO: 1455241 - DNA, 13 bp, Homo sapiens
caggggcagcaag

SEQ ID NO: 1455242 - DNA, 20 bp, Homo sapiens
caggggcagcaaggccttgg

SEQ ID NO: 1455243 - DNA, 17 bp, Homo sapiens
caggggcagccacacca

SEQ ID NO: 1455244 - DNA, 22 bp, Homo sapiens
caggggcagccacaccactgcc

SEQ ID NO: 1455245 - DNA, 23 bp, Homo sapiens
caggggcagccacaccactgcca

SEQ ID NO: 1455246 - DNA, 12 bp, Homo sapiens
caggggcaggcc

SEQ ID NO: 1455247 - DNA, 22 bp, Homo sapiens
caggggcatgtattggcctgga

SEQ ID NO: 1455248 - DNA, 13 bp, Homo sapiens
caggggcctggag

SEQ ID NO: 1455249 - DNA, 23 bp, Homo sapiens
caggggcctggagatcctcctgc

SEQ ID NO: 1455250 - DNA, 14 bp, Homo sapiens
caggggcctggagg

SEQ ID NO: 1455251 - DNA, 19 bp, Homo sapiens
caggggcctggaggtctgg

SEQ ID NO: 1455252 - DNA, 23 bp, Homo sapiens
caggggcctggaggtctggctga

SEQ ID NO: 1455253 - DNA, 15 bp, Homo sapiens
caggggcggggcagg

SEQ ID NO: 1455254 - DNA, 17 bp, Homo sapiens
caggggcggggcaggaa

SEQ ID NO: 1455255 - DNA, 19 bp, Homo sapiens
caggggcggggcaggaatg

SEQ ID NO: 1455256 - DNA, 16 bp, Homo sapiens
caggggctgcttcctc

SEQ ID NO: 1455257 - DNA, 18 bp, Homo sapiens
caggggctgcttcctcct

SEQ ID NO: 1455258 - DNA, 19 bp, Homo sapiens
caggggctgcttcctcctg

SEQ ID NO: 1455259 - DNA, 20 bp, Homo sapiens
caggggctgcttcctcctgg

SEQ ID NO: 1455260 - DNA, 22 bp, Homo sapiens
caggggctgcttcctcctggaa

SEQ ID NO: 1455261 - DNA, 18 bp, Homo sapiens
caggggctggtgggacag

SEQ ID NO: 1455262 - DNA, 14 bp, Homo sapiens
caggggcttgagaa

SEQ ID NO: 1455263 - DNA, 16 bp, Homo sapiens
caggggcttgagaagg

SEQ ID NO: 1455264 - DNA, 19 bp, Homo sapiens
cagggggaaggtggggtcc

SEQ ID NO: 1455265 - DNA, 16 bp, Homo sapiens
cagggggagaaggaag

SEQ ID NO: 1455266 - DNA, 17 bp, Homo sapiens
cagggggagaaggaaga

SEQ ID NO: 1455267 - DNA, 19 bp, Homo sapiens
cagggggccccgccagggc

SEQ ID NO: 1455268 - DNA, 21 bp, Homo sapiens
cagggggccccgccagggctg

SEQ ID NO: 1455269 - DNA, 23 bp, Homo sapiens
cagggggccccgccagggctggg

SEQ ID NO: 1455270 - DNA, 20 bp, Homo sapiens
cagggggcccgaacagggac

SEQ ID NO: 1455271 - DNA, 15 bp, Homo sapiens
cagggggccctgccc

SEQ ID NO: 1455272 - DNA, 23 bp, Homo sapiens
cagggggccctgccccaccccat

SEQ ID NO: 1455273 - DNA, 14 bp, Homo sapiens
gtttttacattcaa

SEQ ID NO: 1455274 - DNA, 22 bp, Homo sapiens
gtttttacctaccacagtgtct

SEQ ID NO: 1455275 - DNA, 19 bp, Homo sapiens
gtttttagagcttccaaat

SEQ ID NO: 1455276 - DNA, 23 bp, Homo sapiens
gtttttattgctcgcccagacac

SEQ ID NO: 1455277 - DNA, 13 bp, Homo sapiens
gtttttcatgttt

SEQ ID NO: 1455278 - DNA, 15 bp, Homo sapiens
gtttttcatttgttt

SEQ ID NO: 1455279 - DNA, 17 bp, Homo sapiens
gtttttcatttgttttg

SEQ ID NO: 1455280 - DNA, 17 bp, Homo sapiens
gtttttccactactgct

SEQ ID NO: 1455281 - DNA, 14 bp, Homo sapiens
gtttttcctggaat

SEQ ID NO: 1455282 - DNA, 19 bp, Homo sapiens
gtttttccttgtatttaaa

SEQ ID NO: 1455283 - DNA, 17 bp, Homo sapiens
gtttttctgccagggag

SEQ ID NO: 1455284 - DNA, 23 bp, Homo sapiens
gtttttgatcaaaaactatttgg

SEQ ID NO: 1455285 - DNA, 13 bp, Homo sapiens
gtttttggctctt

SEQ ID NO: 1455286 - DNA, 15 bp, Homo sapiens
gtttttgtaaagaaa

SEQ ID NO: 1455287 - DNA, 19 bp, Homo sapiens
gtttttgtaaagaaaaata

SEQ ID NO: 1455288 - DNA, 20 bp, Homo sapiens
gtttttgtaaagaaaaatat

SEQ ID NO: 1455289 - DNA, 21 bp, Homo sapiens
gtttttgtaaagaaaaatatt

SEQ ID NO: 1455290 - DNA, 15 bp, Homo sapiens
gtttttgtaaagatt

SEQ ID NO: 1455291 - DNA, 16 bp, Homo sapiens
gttttttagttgaatt

SEQ ID NO: 1455292 - DNA, 16 bp, Homo sapiens
gttttttccacgcagc

SEQ ID NO: 1455293 - DNA, 16 bp, Homo sapiens
gttttttcctttgctc

SEQ ID NO: 1455294 - DNA, 14 bp, Homo sapiens
gttttttgccacag

SEQ ID NO: 1455295 - DNA, 13 bp, Homo sapiens
gttttttgcctaa

SEQ ID NO: 1455296 - DNA, 9 bp, Homo sapiens
gttttttgg

SEQ ID NO: 1455297 - DNA, 10 bp, Homo sapiens
gttttttggt

SEQ ID NO: 1455298 - DNA, 21 bp, Homo sapiens
gtttttttaaaaaaagctaaa

SEQ ID NO: 1455299 - DNA, 21 bp, Homo sapiens
gtttttttcctcatgtaacat

SEQ ID NO: 1455300 - DNA, 16 bp, Homo sapiens
gtttttttctttggct

SEQ ID NO: 1455301 - DNA, 13 bp, Homo sapiens
gttttttttaaaa

SEQ ID NO: 1455302 - DNA, 20 bp, Homo sapiens
gttttttttaaataaaagca

SEQ ID NO: 1455303 - DNA, 17 bp, Homo sapiens
gttttttttgtttgcct

SEQ ID NO: 1455304 - DNA, 21 bp, Homo sapiens
gttttttttttttttttggct

SEQ ID NO: 1455305 - DNA, 23 bp, Homo sapiens
gttttttttttttttttttggag

SEQ ID NO: 1455306 - DNA, 22 bp, Homo sapiens
taaaaaaaaaaaccaaaactgt

SEQ ID NO: 1455307 - DNA, 15 bp, Homo sapiens
taaaaaaaaaagtca

SEQ ID NO: 1455308 - DNA, 16 bp, Homo sapiens
taaaaaaaaaagtcac

SEQ ID NO: 1455309 - DNA, 12 bp, Homo sapiens
taaaaaaaagaa

SEQ ID NO: 1455310 - DNA, 21 bp, Homo sapiens
taaaaaaactggatatttcaa

SEQ ID NO: 1455311 - DNA, 15 bp, Homo sapiens
taaaaaaagcaaaaa

SEQ ID NO: 1455312 - DNA, 21 bp, Homo sapiens
taaaaaaagcaaaaatgacaa

SEQ ID NO: 1455313 - DNA, 16 bp, Homo sapiens
taaaaaaagctaaatt

SEQ ID NO: 1455314 - DNA, 21 bp, Homo sapiens
taaaaaaatttttataaatta

SEQ ID NO: 1455315 - DNA, 14 bp, Homo sapiens
taaaaaacaaagaa

SEQ ID NO: 1455316 - DNA, 15 bp, Homo sapiens
taaaaaactctttgg

SEQ ID NO: 1455317 - DNA, 15 bp, Homo sapiens
taaaaaacttgtaaa

SEQ ID NO: 1455318 - DNA, 12 bp, Homo sapiens
taaaaaagcata

SEQ ID NO: 1455319 - DNA, 14 bp, Homo sapiens
taaaaaagccttcc

SEQ ID NO: 1455320 - DNA, 18 bp, Homo sapiens
taaaaaagctcttttaat

SEQ ID NO: 1455321 - DNA, 15 bp, Homo sapiens
taaaaaataactgtg

SEQ ID NO: 1455322 - DNA, 21 bp, Homo sapiens
taaaaaataactgtgcactat

SEQ ID NO: 1455323 - DNA, 17 bp, Homo sapiens
taaaaaatactctgcta

SEQ ID NO: 1455324 - DNA, 13 bp, Homo sapiens
taaaaaatatttt

SEQ ID NO: 1455325 - DNA, 15 bp, Homo sapiens
taaaaaatggaaaaa

SEQ ID NO: 1455326 - DNA, 15 bp, Homo sapiens
taaaaaatggaaaga

SEQ ID NO: 1455327 - DNA, 19 bp, Homo sapiens
taaaaaatggttcagaatt

SEQ ID NO: 1455328 - DNA, 11 bp, Homo sapiens
taaaaaatgta

SEQ ID NO: 1455329 - DNA, 14 bp, Homo sapiens
taaaaaatgtaaca

SEQ ID NO: 1455330 - DNA, 11 bp, Homo sapiens
taaaaaatgtc

SEQ ID NO: 1455331 - DNA, 17 bp, Homo sapiens
taaaaacaaacaaacaa

SEQ ID NO: 1455332 - DNA, 19 bp, Homo sapiens
taaaaacaactttataccc

SEQ ID NO: 1455333 - DNA, 17 bp, Homo sapiens
taaaaacagcagctcat

SEQ ID NO: 1455334 - DNA, 18 bp, Homo sapiens
taaaaacagcagctcata

SEQ ID NO: 1455335 - DNA, 22 bp, Homo sapiens
taaaaacagcattgctttctga

SEQ ID NO: 1455336 - DNA, 17 bp, Homo sapiens
taaaaactgactcctta

SEQ ID NO: 1455337 - DNA, 21 bp, Homo sapiens
taaaaagaaaaaaatggaaaa

SEQ ID NO: 1455338 - DNA, 17 bp, Homo sapiens
taaaaagaaaacaaaac

SEQ ID NO: 1455339 - DNA, 23 bp, Homo sapiens
taaaaagaaaagataaagatgat

SEQ ID NO: 1455340 - DNA, 16 bp, Homo sapiens
taaaaagaaacaagat

SEQ ID NO: 1455341 - DNA, 13 bp, Homo sapiens
taaaaagaaaggc

SEQ ID NO: 1455342 - DNA, 16 bp, Homo sapiens
taaaaagaaatccagt

SEQ ID NO: 1455343 - DNA, 17 bp, Homo sapiens
taaaaagagtaatttca

SEQ ID NO: 1455344 - DNA, 14 bp, Homo sapiens
taaaaagatcactt

SEQ ID NO: 1455345 - DNA, 23 bp, Homo sapiens
taaaaagatccagggatggagat

SEQ ID NO: 1455346 - DNA, 20 bp, Homo sapiens
taaaaagattgaagtatttt

SEQ ID NO: 1455347 - DNA, 15 bp, Homo sapiens
taaaaagcagaattt

SEQ ID NO: 1455348 - DNA, 22 bp, Homo sapiens
caggtagatcgcttgagcccag

SEQ ID NO: 1455349 - DNA, 23 bp, Homo sapiens
caggtaggcccttgtcctgccag

SEQ ID NO: 1455350 - DNA, 16 bp, Homo sapiens
caggtagggaaataat

SEQ ID NO: 1455351 - DNA, 20 bp, Homo sapiens
caggtagtattacaccaccg

SEQ ID NO: 1455352 - DNA, 22 bp, Homo sapiens
caggtataaacacaccctctgt

SEQ ID NO: 1455353 - DNA, 16 bp, Homo sapiens
caggtcaataaactta

SEQ ID NO: 1455354 - DNA, 12 bp, Homo sapiens
caggtcactgtc

SEQ ID NO: 1455355 - DNA, 16 bp, Homo sapiens
caggtcactgtcactg

SEQ ID NO: 1455356 - DNA, 17 bp, Homo sapiens
caggtcactgtcactgc

SEQ ID NO: 1455357 - DNA, 19 bp, Homo sapiens
caggtcactgtcactgccg

SEQ ID NO: 1455358 - DNA, 23 bp, Homo sapiens
caggtcagcctcctctccctagt

SEQ ID NO: 1455359 - DNA, 12 bp, Homo sapiens
caggtcatcaga

SEQ ID NO: 1455360 - DNA, 16 bp, Homo sapiens
caggtcatcagatgcc

SEQ ID NO: 1455361 - DNA, 14 bp, Homo sapiens
caggtccagctctg

SEQ ID NO: 1455362 - DNA, 23 bp, Homo sapiens
caggtccagctctggaggggagg

SEQ ID NO: 1455363 - DNA, 22 bp, Homo sapiens
caggtcccccgactgcctgtct

SEQ ID NO: 1455364 - DNA, 23 bp, Homo sapiens
caggtcccccgactgcctgtctc

SEQ ID NO: 1455365 - DNA, 21 bp, Homo sapiens
caggtccctggaccagcctcc

SEQ ID NO: 1455366 - DNA, 20 bp, Homo sapiens
caggtcctcagagaatttct

SEQ ID NO: 1455367 - DNA, 23 bp, Homo sapiens
caggtcctgctccgctgcctgga

SEQ ID NO: 1455368 - DNA, 20 bp, Homo sapiens
caggtcctggtgggtcagcc

SEQ ID NO: 1455369 - DNA, 22 bp, Homo sapiens
caggtcctggtgggtcagccca

SEQ ID NO: 1455370 - DNA, 19 bp, Homo sapiens
caggtcggagtgcctggag

SEQ ID NO: 1455371 - DNA, 20 bp, Homo sapiens
caggtcggagtgcctggagt

SEQ ID NO: 1455372 - DNA, 22 bp, Homo sapiens
caggtcggagtgcctggagtca

SEQ ID NO: 1455373 - DNA, 13 bp, Homo sapiens
caggtctcctctt

SEQ ID NO: 1455374 - DNA, 15 bp, Homo sapiens
caggtctctccactg

SEQ ID NO: 1455375 - DNA, 17 bp, Homo sapiens
caggtctctccactgct

SEQ ID NO: 1455376 - DNA, 19 bp, Homo sapiens
caggtctctccactgctct

SEQ ID NO: 1455377 - DNA, 16 bp, Homo sapiens
caggtctcttctgggc

SEQ ID NO: 1455378 - DNA, 16 bp, Homo sapiens
caggtctgcaagggcc

SEQ ID NO: 1455379 - DNA, 19 bp, Homo sapiens
caggtctgcaagggcccag

SEQ ID NO: 1455380 - DNA, 20 bp, Homo sapiens
caggtctgcaagggcccaga

SEQ ID NO: 1455381 - DNA, 22 bp, Homo sapiens
caggtctgcaagggcccagagt

SEQ ID NO: 1455382 - DNA, 19 bp, Homo sapiens
caggtcttgactcatggca

SEQ ID NO: 1455383 - DNA, 22 bp, Homo sapiens
caggtcttgactcatggcagct

SEQ ID NO: 1455384 - DNA, 14 bp, Homo sapiens
caggtgaacttttt

SEQ ID NO: 1455385 - DNA, 17 bp, Homo sapiens
caggtgacgatttagct

SEQ ID NO: 1455386 - DNA, 22 bp, Homo sapiens
caggtgacgatttagctgtggc

SEQ ID NO: 1455387 - DNA, 14 bp, Homo sapiens
caggtgaggcccaa

SEQ ID NO: 1455388 - DNA, 21 bp, Homo sapiens
caggtgattggaccaggccat

SEQ ID NO: 1455389 - DNA, 20 bp, Homo sapiens
caggtgcaatctactggaaa

SEQ ID NO: 1455390 - DNA, 16 bp, Homo sapiens
caggtgcagaccttgg

SEQ ID NO: 1455391 - DNA, 14 bp, Homo sapiens
taaaacacagcttt

SEQ ID NO: 1455392 - DNA, 15 bp, Homo sapiens
taaaacactcatccc

SEQ ID NO: 1455393 - DNA, 19 bp, Homo sapiens
taaaacagaatcttctggg

SEQ ID NO: 1455394 - DNA, 19 bp, Homo sapiens
taaaacagacactggcatg

SEQ ID NO: 1455395 - DNA, 17 bp, Homo sapiens
taaaacaggcaaagttt

SEQ ID NO: 1455396 - DNA, 22 bp, Homo sapiens
taaaacaggtagaattatctaa

SEQ ID NO: 1455397 - DNA, 13 bp, Homo sapiens
taaaacatgcacg

SEQ ID NO: 1455398 - DNA, 19 bp, Homo sapiens
taaaacattttatttcttt

SEQ ID NO: 1455399 - DNA, 15 bp, Homo sapiens
taaaaccacagcagt

SEQ ID NO: 1455400 - DNA, 19 bp, Homo sapiens
taaaaccatcctgtttgaa

SEQ ID NO: 1455401 - DNA, 19 bp, Homo sapiens
taaaacccatttaaatttt

SEQ ID NO: 1455402 - DNA, 18 bp, Homo sapiens
taaaaccctttaaatgta

SEQ ID NO: 1455403 - DNA, 21 bp, Homo sapiens
taaaaccgaaggtgaaaaaaa

SEQ ID NO: 1455404 - DNA, 23 bp, Homo sapiens
taaaacggtgctgtgagggaggg

SEQ ID NO: 1455405 - DNA, 19 bp, Homo sapiens
taaaactcagaatataaca

SEQ ID NO: 1455406 - DNA, 22 bp, Homo sapiens
taaaactcagaatataacatgt

SEQ ID NO: 1455407 - DNA, 20 bp, Homo sapiens
taaaactgcgaggacatcaa

SEQ ID NO: 1455408 - DNA, 21 bp, Homo sapiens
taaaactgcgaggacatcaaa

SEQ ID NO: 1455409 - DNA, 22 bp, Homo sapiens
taaaactgcgaggacatcaaag

SEQ ID NO: 1455410 - DNA, 23 bp, Homo sapiens
taaaactgcgaggacatcaaagt

SEQ ID NO: 1455411 - DNA, 21 bp, Homo sapiens
taaaactgcttttttttttcc

SEQ ID NO: 1455412 - DNA, 19 bp, Homo sapiens
taaaactggcatctgacac

SEQ ID NO: 1455413 - DNA, 20 bp, Homo sapiens
taaaactgggtcatcatttg

SEQ ID NO: 1455414 - DNA, 13 bp, Homo sapiens
taaaactgtactt

SEQ ID NO: 1455415 - DNA, 15 bp, Homo sapiens
taaaacttaaaaaca

SEQ ID NO: 1455416 - DNA, 20 bp, Homo sapiens
taaaacttgatgtgttatct

SEQ ID NO: 1455417 - DNA, 13 bp, Homo sapiens
taaaacttgctgc

SEQ ID NO: 1455418 - DNA, 13 bp, Homo sapiens
taaaactttcctc

SEQ ID NO: 1455419 - DNA, 15 bp, Homo sapiens
taaaactttgctgcc

SEQ ID NO: 1455420 - DNA, 17 bp, Homo sapiens
taaaagaaaccctgcac

SEQ ID NO: 1455421 - DNA, 21 bp, Homo sapiens
taaaagaacaatgacaaacac

SEQ ID NO: 1455422 - DNA, 21 bp, Homo sapiens
taaaagaagaaatagttctgt

SEQ ID NO: 1455423 - DNA, 16 bp, Homo sapiens
taaaagaatattttaa

SEQ ID NO: 1455424 - DNA, 19 bp, Homo sapiens
taaaagaatttttttgtct

SEQ ID NO: 1455425 - DNA, 16 bp, Homo sapiens
taaaagactgcagctg

SEQ ID NO: 1455426 - DNA, 16 bp, Homo sapiens
taaaagagctcagaca

SEQ ID NO: 1455427 - DNA, 14 bp, Homo sapiens
taaaagatgaaaat

SEQ ID NO: 1455428 - DNA, 22 bp, Homo sapiens
taaaagatgaagttttatacac

SEQ ID NO: 1455429 - DNA, 14 bp, Homo sapiens
taaaagatgcagag

SEQ ID NO: 1455430 - DNA, 12 bp, Homo sapiens
taaaagattcat

SEQ ID NO: 1455431 - DNA, 16 bp, Homo sapiens
taaaagcaaaagagaa

SEQ ID NO: 1455432 - DNA, 14 bp, Homo sapiens
taaaagcaaatcat

SEQ ID NO: 1455433 - DNA, 15 bp, Homo sapiens
taaaagcaaatcatt

SEQ ID NO: 1455434 - DNA, 20 bp, Homo sapiens
taaaagcaaatcatttgttt

SEQ ID NO: 1455435 - DNA, 21 bp, Homo sapiens
taaaagcaaatcatttgttta

SEQ ID NO: 1455436 - DNA, 15 bp, Homo sapiens
taaaagcaattctga

SEQ ID NO: 1455437 - DNA, 16 bp, Homo sapiens
taaaagcaattctgac

SEQ ID NO: 1455438 - DNA, 18 bp, Homo sapiens
taaaagcaattctgactg

SEQ ID NO: 1455439 - DNA, 22 bp, Homo sapiens
taaaagcagaaaataaaggaag

SEQ ID NO: 1455440 - DNA, 11 bp, Homo sapiens
taaaagcagca

SEQ ID NO: 1455441 - DNA, 15 bp, Homo sapiens
taaaagcataaatgc

SEQ ID NO: 1455442 - DNA, 17 bp, Homo sapiens
taaaagcataaatgcaa

SEQ ID NO: 1455443 - DNA, 14 bp, Homo sapiens
taaaagccccagct

SEQ ID NO: 1455444 - DNA, 14 bp, Homo sapiens
taaaaggaaaaata

SEQ ID NO: 1455445 - DNA, 15 bp, Homo sapiens
taaaaggaaaaataa

SEQ ID NO: 1455446 - DNA, 15 bp, Homo sapiens
taaaaggaaaaggtt

SEQ ID NO: 1455447 - DNA, 15 bp, Homo sapiens
taaaaggaaagaaaa

SEQ ID NO: 1455448 - DNA, 15 bp, Homo sapiens
taaaaggatgtataa

SEQ ID NO: 1455449 - DNA, 16 bp, Homo sapiens
taaaaggatgtataaa

SEQ ID NO: 1455450 - DNA, 12 bp, Homo sapiens
taaaaggggccc

SEQ ID NO: 1455451 - DNA, 20 bp, Homo sapiens
taaaaggggcccaagcccca

SEQ ID NO: 1455452 - DNA, 12 bp, Homo sapiens
taaaaggtgacc

SEQ ID NO: 1455453 - DNA, 15 bp, Homo sapiens
taaaaggttgccaaa

SEQ ID NO: 1455454 - DNA, 14 bp, Homo sapiens
taaaagtaaacatt

SEQ ID NO: 1455455 - DNA, 19 bp, Homo sapiens
taaaagtagaagcatgttt

SEQ ID NO: 1455456 - DNA, 14 bp, Homo sapiens
taaaagtatagata

SEQ ID NO: 1455457 - DNA, 22 bp, Homo sapiens
taaaagtatagatacaaaacct

SEQ ID NO: 1455458 - DNA, 14 bp, Homo sapiens
taaaagtctatttt

SEQ ID NO: 1455459 - DNA, 14 bp, Homo sapiens
taaaagtgaagtga

SEQ ID NO: 1455460 - DNA, 20 bp, Homo sapiens
taaaagtgaagtgaatctga

SEQ ID NO: 1455461 - DNA, 17 bp, Homo sapiens
taaaagtggtctctgct

SEQ ID NO: 1455462 - DNA, 17 bp, Homo sapiens
taaacagtgtcttctta

SEQ ID NO: 1455463 - DNA, 20 bp, Homo sapiens
taaacataattcttgtatat

SEQ ID NO: 1455464 - DNA, 21 bp, Homo sapiens
taaacataattgtggattata

SEQ ID NO: 1455465 - DNA, 19 bp, Homo sapiens
taaacatagtcagctctga

SEQ ID NO: 1455466 - DNA, 19 bp, Homo sapiens
taaacatatttttatactt

SEQ ID NO: 1455467 - DNA, 16 bp, Homo sapiens
taaacatgagaataaa

SEQ ID NO: 1455468 - DNA, 17 bp, Homo sapiens
taaacattaagtaaatg

SEQ ID NO: 1455469 - DNA, 21 bp, Homo sapiens
taaacattaatagcagccttt

SEQ ID NO: 1455470 - DNA, 22 bp, Homo sapiens
taaacattaatagcagcctttc

SEQ ID NO: 1455471 - DNA, 14 bp, Homo sapiens
taaacattaatatt

SEQ ID NO: 1455472 - DNA, 19 bp, Homo sapiens
taaacattaattttgtgca

SEQ ID NO: 1455473 - DNA, 22 bp, Homo sapiens
taaacattaattttgtgcattc

SEQ ID NO: 1455474 - DNA, 23 bp, Homo sapiens
taaacattaattttgtgcattct

SEQ ID NO: 1455475 - DNA, 17 bp, Homo sapiens
taaacatttgttcctgg

SEQ ID NO: 1455476 - DNA, 11 bp, Homo sapiens
taaacattttc

SEQ ID NO: 1455477 - DNA, 20 bp, Homo sapiens
taaacatttttcacatctct

SEQ ID NO: 1455478 - DNA, 18 bp, Homo sapiens
taaaccaatgaagaagac

SEQ ID NO: 1455479 - DNA, 21 bp, Homo sapiens
taaaccaatgaagaagacaaa

SEQ ID NO: 1455480 - DNA, 22 bp, Homo sapiens
taaaccacctcagaaaggattt

SEQ ID NO: 1455481 - DNA, 13 bp, Homo sapiens
taaaccactgaaa

SEQ ID NO: 1455482 - DNA, 14 bp, Homo sapiens
taaaccactgtgcg

SEQ ID NO: 1455483 - DNA, 22 bp, Homo sapiens
taaaccacttaaacgaagagtt

SEQ ID NO: 1455484 - DNA, 18 bp, Homo sapiens
taaacctaatattcaatg

SEQ ID NO: 1455485 - DNA, 18 bp, Homo sapiens
taaacctcctgcctccca

SEQ ID NO: 1455486 - DNA, 23 bp, Homo sapiens
taaacctttttcttgatcttaaa

SEQ ID NO: 1455487 - DNA, 16 bp, Homo sapiens
taaacggtttttatta

SEQ ID NO: 1455488 - DNA, 19 bp, Homo sapiens
taaactaaaaaaaaaaagg

SEQ ID NO: 1455489 - DNA, 20 bp, Homo sapiens
taaactaaaaaaaaaaaggc

SEQ ID NO: 1455490 - DNA, 18 bp, Homo sapiens
taaactaaaatctgttac

SEQ ID NO: 1455491 - DNA, 23 bp, Homo sapiens
taaactacaaagtaaaatgaaca

SEQ ID NO: 1455492 - DNA, 15 bp, Homo sapiens
taaactagtttccag

SEQ ID NO: 1455493 - DNA, 17 bp, Homo sapiens
taaactagtttccagtg

SEQ ID NO: 1455494 - DNA, 20 bp, Homo sapiens
taaactatcttggtgaattt

SEQ ID NO: 1455495 - DNA, 21 bp, Homo sapiens
taaactatcttggtgaatttt

SEQ ID NO: 1455496 - DNA, 21 bp, Homo sapiens
taaactattagagtatttccc

SEQ ID NO: 1455497 - DNA, 22 bp, Homo sapiens
taaactattagagtatttccct

SEQ ID NO: 1455498 - DNA, 17 bp, Homo sapiens
taaactattggaaagta

SEQ ID NO: 1455499 - DNA, 22 bp, Homo sapiens
taaactcaaaatatttgtacat

SEQ ID NO: 1455500 - DNA, 19 bp, Homo sapiens
taaactcagatctgatcaa

SEQ ID NO: 1455501 - DNA, 16 bp, Homo sapiens
taaactccttcctggc

SEQ ID NO: 1455502 - DNA, 20 bp, Homo sapiens
taaactccttcctggcctga

SEQ ID NO: 1455503 - DNA, 21 bp, Homo sapiens
taaactgactttttcccccca

SEQ ID NO: 1455504 - DNA, 12 bp, Homo sapiens
taaactgtatta

SEQ ID NO: 1455505 - DNA, 18 bp, Homo sapiens
taaactgtgtacataact

SEQ ID NO: 1455506 - DNA, 12 bp, Homo sapiens
taaactgtgttt

SEQ ID NO: 1455507 - DNA, 22 bp, Homo sapiens
taaactgtgttttagtgtaaaa

SEQ ID NO: 1455508 - DNA, 14 bp, Homo sapiens
taaactgttttcat

SEQ ID NO: 1455509 - DNA, 15 bp, Homo sapiens
taaactgttttcatg

SEQ ID NO: 1455510 - DNA, 15 bp, Homo sapiens
taaacttacaaactt

SEQ ID NO: 1455511 - DNA, 17 bp, Homo sapiens
taaacttagaggaaaat

SEQ ID NO: 1455512 - DNA, 14 bp, Homo sapiens
taaacttcacctac

SEQ ID NO: 1455513 - DNA, 23 bp, Homo sapiens
taaacttctgcaacaagcatgca

SEQ ID NO: 1455514 - DNA, 15 bp, Homo sapiens
taaacttgaaatata

SEQ ID NO: 1455515 - DNA, 21 bp, Homo sapiens
taaacttgaaatatataatat

SEQ ID NO: 1455516 - DNA, 22 bp, Homo sapiens
taaacttggaagggggagacag

SEQ ID NO: 1455517 - DNA, 23 bp, Homo sapiens
taaactttattttttaaaaatga

SEQ ID NO: 1455518 - DNA, 16 bp, Homo sapiens
taaacttttaattcat

SEQ ID NO: 1455519 - DNA, 17 bp, Homo sapiens
taaagaaaaatatttaa

SEQ ID NO: 1455520 - DNA, 16 bp, Homo sapiens
taaagaaaaatgcctg

SEQ ID NO: 1455521 - DNA, 19 bp, Homo sapiens
taaagaaaatatctgaaat

SEQ ID NO: 1455522 - DNA, 14 bp, Homo sapiens
taaagaaacagctt

SEQ ID NO: 1455523 - DNA, 19 bp, Homo sapiens
taaagaaacagctttcaag

SEQ ID NO: 1455524 - DNA, 14 bp, Homo sapiens
taaagaaacatggt

SEQ ID NO: 1455525 - DNA, 13 bp, Homo sapiens
taaagaaaggaaa

SEQ ID NO: 1455526 - DNA, 15 bp, Homo sapiens
taaagaaaggaaaag

SEQ ID NO: 1455527 - DNA, 22 bp, Homo sapiens
taaagaaaggaaaagaaaacaa

SEQ ID NO: 1455528 - DNA, 16 bp, Homo sapiens
taaagaaagtgtattt

SEQ ID NO: 1455529 - DNA, 20 bp, Homo sapiens
taaagaaagtgtatttggaa

SEQ ID NO: 1455530 - DNA, 23 bp, Homo sapiens
taaagaaagtgtatttggaaata

SEQ ID NO: 1455531 - DNA, 17 bp, Homo sapiens
taaagaactccttattt

SEQ ID NO: 1455532 - DNA, 23 bp, Homo sapiens
taaagaactccttattttgtatt

SEQ ID NO: 1455533 - DNA, 17 bp, Homo sapiens
taaagaagaaaataacc

SEQ ID NO: 1455534 - DNA, 21 bp, Homo sapiens
taaagaatccttatctataaa

SEQ ID NO: 1455535 - DNA, 17 bp, Homo sapiens
taaagaattaatgactt

SEQ ID NO: 1455536 - DNA, 14 bp, Homo sapiens
taaagaattacttg

SEQ ID NO: 1455537 - DNA, 22 bp, Homo sapiens
taaagacaaagacaaattctgt

SEQ ID NO: 1455538 - DNA, 18 bp, Homo sapiens
taaagacaacaaaagaaa

SEQ ID NO: 1455539 - DNA, 10 bp, Homo sapiens
taaagacaag

SEQ ID NO: 1455540 - DNA, 15 bp, Homo sapiens
taaagacacctggtt

SEQ ID NO: 1455541 - DNA, 23 bp, Homo sapiens
taaagacaggttacgaagacaaa

SEQ ID NO: 1455542 - DNA, 19 bp, Homo sapiens
taaagaccctcctattcta

SEQ ID NO: 1455543 - DNA, 12 bp, Homo sapiens
taaagagaatga

SEQ ID NO: 1455544 - DNA, 13 bp, Homo sapiens
taaagagaatgag

SEQ ID NO: 1455545 - DNA, 18 bp, Homo sapiens
taaagaggcatcttttct

SEQ ID NO: 1455546 - DNA, 18 bp, Homo sapiens
taaagagtctagattcaa

SEQ ID NO: 1455547 - DNA, 23 bp, Homo sapiens
taaagagtctagattcaaaggtt

SEQ ID NO: 1455548 - DNA, 12 bp, Homo sapiens
taaagagttctt

SEQ ID NO: 1455549 - DNA, 20 bp, Homo sapiens
taaagatatcagagctctta

SEQ ID NO: 1455550 - DNA, 15 bp, Homo sapiens
taaagatatttccaa

SEQ ID NO: 1455551 - DNA, 16 bp, Homo sapiens
taaagatatttccaag

SEQ ID NO: 1455552 - DNA, 13 bp, Homo sapiens
taaagatgatcta

SEQ ID NO: 1455553 - DNA, 22 bp, Homo sapiens
taaagatgcaaggaccaggact

SEQ ID NO: 1455554 - DNA, 17 bp, Homo sapiens
taaagatggagtttcta

SEQ ID NO: 1455555 - DNA, 19 bp, Homo sapiens
taaagatggagtttctaag

SEQ ID NO: 1455556 - DNA, 16 bp, Homo sapiens
taaagatgtgaaaact

SEQ ID NO: 1455557 - DNA, 22 bp, Homo sapiens
taaagattataatatgtgcctt

SEQ ID NO: 1455558 - DNA, 17 bp, Homo sapiens
taaagattctctttaaa

SEQ ID NO: 1455559 - DNA, 20 bp, Homo sapiens
taaagattctctttaaaaaa

SEQ ID NO: 1455560 - DNA, 23 bp, Homo sapiens
taaagattctctttaaaaaagac

SEQ ID NO: 1455561 - DNA, 15 bp, Homo sapiens
taaagatttatcaaa

SEQ ID NO: 1455562 - DNA, 22 bp, Homo sapiens
taaagatttctagtaggcagca

SEQ ID NO: 1455563 - DNA, 15 bp, Homo sapiens
taaagatttctgttc

SEQ ID NO: 1455564 - DNA, 21 bp, Homo sapiens
taaagcaaagtcacttctcca

SEQ ID NO: 1455565 - DNA, 23 bp, Homo sapiens
taaagcaataatggtcccatcca

SEQ ID NO: 1455566 - DNA, 16 bp, Homo sapiens
taaagcatcctcctcc

SEQ ID NO: 1455567 - DNA, 14 bp, Homo sapiens
taaagcatgaaatg

SEQ ID NO: 1455568 - DNA, 16 bp, Homo sapiens
taaagcatgaaatgtg

SEQ ID NO: 1455569 - DNA, 17 bp, Homo sapiens
taaagcatgaaatgtga

SEQ ID NO: 1455570 - DNA, 21 bp, Homo sapiens
taaagcatgaaatgtgaattt

SEQ ID NO: 1455571 - DNA, 23 bp, Homo sapiens
taaagccagttagatagaagaat

SEQ ID NO: 1455572 - DNA, 18 bp, Homo sapiens
taaagcccataaggccag

SEQ ID NO: 1455573 - DNA, 17 bp, Homo sapiens
taaagcctatttttcaa

SEQ ID NO: 1455574 - DNA, 16 bp, Homo sapiens
taaagccttctggatc

SEQ ID NO: 1455575 - DNA, 19 bp, Homo sapiens
taaatattctatatgaatt

SEQ ID NO: 1455576 - DNA, 14 bp, Homo sapiens
taaatattctgcat

SEQ ID NO: 1455577 - DNA, 12 bp, Homo sapiens
taaatatttcct

SEQ ID NO: 1455578 - DNA, 13 bp, Homo sapiens
taaatatttcctt

SEQ ID NO: 1455579 - DNA, 14 bp, Homo sapiens
taaatatttcctta

SEQ ID NO: 1455580 - DNA, 15 bp, Homo sapiens
taaatatttccttaa

SEQ ID NO: 1455581 - DNA, 13 bp, Homo sapiens
taaatattttcta

SEQ ID NO: 1455582 - DNA, 13 bp, Homo sapiens
taaatattttgct

SEQ ID NO: 1455583 - DNA, 14 bp, Homo sapiens
taaatattttgcta

SEQ ID NO: 1455584 - DNA, 15 bp, Homo sapiens
taaatattttgctaa

SEQ ID NO: 1455585 - DNA, 18 bp, Homo sapiens
taaatatttttttaacct

SEQ ID NO: 1455586 - DNA, 17 bp, Homo sapiens
taaatcacttcattgtt

SEQ ID NO: 1455587 - DNA, 20 bp, Homo sapiens
taaatcacttcattgtttta

SEQ ID NO: 1455588 - DNA, 14 bp, Homo sapiens
taaatcagaaagta

SEQ ID NO: 1455589 - DNA, 17 bp, Homo sapiens
taaatcagaaagtaaca

SEQ ID NO: 1455590 - DNA, 17 bp, Homo sapiens
taaatcagtaagaggtg

SEQ ID NO: 1455591 - DNA, 15 bp, Homo sapiens
taaatcatgttttga

SEQ ID NO: 1455592 - DNA, 13 bp, Homo sapiens
taaatccaaagaa

SEQ ID NO: 1455593 - DNA, 19 bp, Homo sapiens
taaatccacccatgttatc

SEQ ID NO: 1455594 - DNA, 14 bp, Homo sapiens
taaatccattttct

SEQ ID NO: 1455595 - DNA, 19 bp, Homo sapiens
taaatccattttctaaact

SEQ ID NO: 1455596 - DNA, 23 bp, Homo sapiens
taaatccgacttgaatattcctg

SEQ ID NO: 1455597 - DNA, 17 bp, Homo sapiens
taaatcctgagctcaaa

SEQ ID NO: 1455598 - DNA, 15 bp, Homo sapiens
taaatccttaacatt

SEQ ID NO: 1455599 - DNA, 19 bp, Homo sapiens
taaatcgtactacagaaat

SEQ ID NO: 1455600 - DNA, 15 bp, Homo sapiens
taaatctaaatctat

SEQ ID NO: 1455601 - DNA, 23 bp, Homo sapiens
taaatctagagtttatacagtgt

SEQ ID NO: 1455602 - DNA, 19 bp, Homo sapiens
taaatctaggatgtgatga

SEQ ID NO: 1455603 - DNA, 20 bp, Homo sapiens
taaatctatgaagtatataa

SEQ ID NO: 1455604 - DNA, 21 bp, Homo sapiens
taaatctatgaagtatataat

SEQ ID NO: 1455605 - DNA, 18 bp, Homo sapiens
taaatctatttattaata

SEQ ID NO: 1455606 - DNA, 15 bp, Homo sapiens
taaatctcttctttg

SEQ ID NO: 1455607 - DNA, 14 bp, Homo sapiens
taaatctgtctgat

SEQ ID NO: 1455608 - DNA, 17 bp, Homo sapiens
taaatctgtctgattct

SEQ ID NO: 1455609 - DNA, 13 bp, Homo sapiens
taaatctgtgatg

SEQ ID NO: 1455610 - DNA, 16 bp, Homo sapiens
taaatcttaaacaatg

SEQ ID NO: 1455611 - DNA, 22 bp, Homo sapiens
taaatcttaaacaatgtataaa

SEQ ID NO: 1455612 - DNA, 21 bp, Homo sapiens
taaatctttttgcttctactt

SEQ ID NO: 1455613 - DNA, 17 bp, Homo sapiens
taaatgaagcagcttta

SEQ ID NO: 1455614 - DNA, 14 bp, Homo sapiens
taaatgaatgaata

SEQ ID NO: 1455615 - DNA, 12 bp, Homo sapiens
taaatgaatgtt

SEQ ID NO: 1455616 - DNA, 13 bp, Homo sapiens
taaatgacttttc

SEQ ID NO: 1455617 - DNA, 19 bp, Homo sapiens
taaatgagaagtacttggt

SEQ ID NO: 1455618 - DNA, 18 bp, Homo sapiens
taaatgagctatgtatta

SEQ ID NO: 1455619 - DNA, 14 bp, Homo sapiens
taaatgagctcctg

SEQ ID NO: 1455620 - DNA, 16 bp, Homo sapiens
taaatgagctcctgcg

SEQ ID NO: 1455621 - DNA, 15 bp, Homo sapiens
taaatgatggtgctt

SEQ ID NO: 1455622 - DNA, 16 bp, Homo sapiens
taaatgattatattca

SEQ ID NO: 1455623 - DNA, 14 bp, Homo sapiens
taaatgattcaaaa

SEQ ID NO: 1455624 - DNA, 19 bp, Homo sapiens
taaatgcaatattaatgcc

SEQ ID NO: 1455625 - DNA, 19 bp, Homo sapiens
taaatgcaccaagaaagct

SEQ ID NO: 1455626 - DNA, 19 bp, Homo sapiens
taaatgcagttacaaatta

SEQ ID NO: 1455627 - DNA, 17 bp, Homo sapiens
taaatgcagttttaaga

SEQ ID NO: 1455628 - DNA, 19 bp, Homo sapiens
gtggggtaggttgggagaa

SEQ ID NO: 1455629 - DNA, 21 bp, Homo sapiens
gtggggtctccctctcctgcc

SEQ ID NO: 1455630 - DNA, 19 bp, Homo sapiens
gtggggtgtgctgggagct

SEQ ID NO: 1455631 - DNA, 20 bp, Homo sapiens
gtggggttgggggacagcct

SEQ ID NO: 1455632 - DNA, 13 bp, Homo sapiens
gtgggtaagagga

SEQ ID NO: 1455633 - DNA, 17 bp, Homo sapiens
gtgggtaagaggagcag

SEQ ID NO: 1455634 - DNA, 20 bp, Homo sapiens
gtgggtagatcacgagatca

SEQ ID NO: 1455635 - DNA, 15 bp, Homo sapiens
gtgggtcagcccagc

SEQ ID NO: 1455636 - DNA, 22 bp, Homo sapiens
gtgggtcagcccagcacctgct

SEQ ID NO: 1455637 - DNA, 18 bp, Homo sapiens
gtgggtccaggaaggcag

SEQ ID NO: 1455638 - DNA, 18 bp, Homo sapiens
gtgggtcccgcactctgc

SEQ ID NO: 1455639 - DNA, 13 bp, Homo sapiens
gtgggtctctgaa

SEQ ID NO: 1455640 - DNA, 14 bp, Homo sapiens
gtgggtctctggaa

SEQ ID NO: 1455641 - DNA, 13 bp, Homo sapiens
gtgggtgaccagg

SEQ ID NO: 1455642 - DNA, 17 bp, Homo sapiens
gtgggtgattcctccca

SEQ ID NO: 1455643 - DNA, 14 bp, Homo sapiens
gtgggtgccctctc

SEQ ID NO: 1455644 - DNA, 14 bp, Homo sapiens
gtgggtggagaagg

SEQ ID NO: 1455645 - DNA, 15 bp, Homo sapiens
gtgggtggagtcagg

SEQ ID NO: 1455646 - DNA, 18 bp, Homo sapiens
gtgggtgggaggggccca

SEQ ID NO: 1455647 - DNA, 16 bp, Homo sapiens
gtgggttttcttccca

SEQ ID NO: 1455648 - DNA, 20 bp, Homo sapiens
gtggtaaagtagttgattca

SEQ ID NO: 1455649 - DNA, 12 bp, Homo sapiens
gtggtaatctac

SEQ ID NO: 1455650 - DNA, 14 bp, Homo sapiens
gtggtaatttttgt

SEQ ID NO: 1455651 - DNA, 15 bp, Homo sapiens
gtggtaatttttgta

SEQ ID NO: 1455652 - DNA, 13 bp, Homo sapiens
gtggtagagaagc

SEQ ID NO: 1455653 - DNA, 14 bp, Homo sapiens
gtggtagctccagc

SEQ ID NO: 1455654 - DNA, 15 bp, Homo sapiens
gtggtagtacccagg

SEQ ID NO: 1455655 - DNA, 22 bp, Homo sapiens
gtggtatacatgtgtacatata

SEQ ID NO: 1455656 - DNA, 23 bp, Homo sapiens
gtggtatacatgtgtacatatat

SEQ ID NO: 1455657 - DNA, 16 bp, Homo sapiens
gtggtatcctgtgaca

SEQ ID NO: 1455658 - DNA, 12 bp, Homo sapiens
gtggtatgaggg

SEQ ID NO: 1455659 - DNA, 15 bp, Homo sapiens
gtggtatgagggggt

SEQ ID NO: 1455660 - DNA, 14 bp, Homo sapiens
gtggtatgtctctt

SEQ ID NO: 1455661 - DNA, 22 bp, Homo sapiens
gtggtcacagcggaggtgtgga

SEQ ID NO: 1455662 - DNA, 13 bp, Homo sapiens
gtggtcaccttcg

SEQ ID NO: 1455663 - DNA, 12 bp, Homo sapiens
gtggtcatgctc

SEQ ID NO: 1455664 - DNA, 17 bp, Homo sapiens
gtggtcatgctcagcct

SEQ ID NO: 1455665 - DNA, 18 bp, Homo sapiens
gtggtcatgctcagcctt

SEQ ID NO: 1455666 - DNA, 18 bp, Homo sapiens
gtggtccagcgtcactcc

SEQ ID NO: 1455667 - DNA, 13 bp, Homo sapiens
gtggtccagctct

SEQ ID NO: 1455668 - DNA, 12 bp, Homo sapiens
gtggtcctgact

SEQ ID NO: 1455669 - DNA, 14 bp, Homo sapiens
gtggtctctgctgg

SEQ ID NO: 1455670 - DNA, 15 bp, Homo sapiens
gtggtctctgctggg

SEQ ID NO: 1455671 - DNA, 19 bp, Homo sapiens
gtggtctgttggcaggctg

SEQ ID NO: 1455672 - DNA, 20 bp, Homo sapiens
gtggtctgttggcaggctgg

SEQ ID NO: 1455673 - DNA, 21 bp, Homo sapiens
gtggtctgttggcaggctggc

SEQ ID NO: 1455674 - DNA, 23 bp, Homo sapiens
gtggtgagcagaagtggagctgg

SEQ ID NO: 1455675 - DNA, 14 bp, Homo sapiens
gtggtgaggggctt

SEQ ID NO: 1455676 - DNA, 19 bp, Homo sapiens
gtggtgaggggctttctct

SEQ ID NO: 1455677 - DNA, 22 bp, Homo sapiens
gtggtgccatccccagggggca

SEQ ID NO: 1455678 - DNA, 14 bp, Homo sapiens
gtggtggagccagg

SEQ ID NO: 1455679 - DNA, 18 bp, Homo sapiens
gtggtgggacagggaccc

SEQ ID NO: 1455680 - DNA, 12 bp, Homo sapiens
gtggtggggagg

SEQ ID NO: 1455681 - DNA, 15 bp, Homo sapiens
gtggtggggctgccg

SEQ ID NO: 1455682 - DNA, 14 bp, Homo sapiens
gtggtgtcctgaag

SEQ ID NO: 1455683 - DNA, 20 bp, Homo sapiens
gtggtgtcctgaagctgctg

SEQ ID NO: 1455684 - DNA, 21 bp, Homo sapiens
gtggtgtgaccatgttcatta

SEQ ID NO: 1455685 - DNA, 14 bp, Homo sapiens
gtggtgtggagaag

SEQ ID NO: 1455686 - DNA, 22 bp, Homo sapiens
gtggtgtggagaagccacaggc

SEQ ID NO: 1455687 - DNA, 21 bp, Homo sapiens
gtggtgtgtccctggacacag

SEQ ID NO: 1455688 - DNA, 18 bp, Homo sapiens
gtggttaaggccagggcc

SEQ ID NO: 1455689 - DNA, 20 bp, Homo sapiens
gtggttattggactccaggc

SEQ ID NO: 1455690 - DNA, 22 bp, Homo sapiens
gtggttattggactccaggcct

SEQ ID NO: 1455691 - DNA, 19 bp, Homo sapiens
gtggttcaagcacactgga

SEQ ID NO: 1455692 - DNA, 18 bp, Homo sapiens
gtggttcgtgctgtgctc

SEQ ID NO: 1455693 - DNA, 13 bp, Homo sapiens
gtggttgcctggg

SEQ ID NO: 1455694 - DNA, 15 bp, Homo sapiens
gtggtttcagatgtg

SEQ ID NO: 1455695 - DNA, 16 bp, Homo sapiens
gtggtttgagacactg

SEQ ID NO: 1455696 - DNA, 16 bp, Homo sapiens
gtggtttgtggacgag

SEQ ID NO: 1455697 - DNA, 20 bp, Homo sapiens
gtggttttatactgaaggaa

SEQ ID NO: 1455698 - DNA, 20 bp, Homo sapiens
gtggttttcccctccctggg

SEQ ID NO: 1455699 - DNA, 21 bp, Homo sapiens
gtggttttcccctccctgggt

SEQ ID NO: 1455700 - DNA, 15 bp, Homo sapiens
gtgtaaaaaatggaa

SEQ ID NO: 1455701 - DNA, 17 bp, Homo sapiens
gtgtaaaaagcctcctt

SEQ ID NO: 1455702 - DNA, 23 bp, Homo sapiens
gtgtaaaaagcctccttgtgcaa

SEQ ID NO: 1455703 - DNA, 15 bp, Homo sapiens
gtgtaaaatgtgaag

SEQ ID NO: 1455704 - DNA, 11 bp, Homo sapiens
gtgtaaaattg

SEQ ID NO: 1455705 - DNA, 23 bp, Homo sapiens
gtgtaacaattgtgtagcctttt

SEQ ID NO: 1455706 - DNA, 15 bp, Homo sapiens
gtgtaacatccaagc

SEQ ID NO: 1455707 - DNA, 18 bp, Homo sapiens
gtgtaactggcagttttc

SEQ ID NO: 1455708 - DNA, 23 bp, Homo sapiens
gtgtaactgtcagccgggccctg

SEQ ID NO: 1455709 - DNA, 15 bp, Homo sapiens
gtgtaacttgcttaa

SEQ ID NO: 1455710 - DNA, 21 bp, Homo sapiens
gtgtaacttgcttaaatttct

SEQ ID NO: 1455711 - DNA, 15 bp, Homo sapiens
gtgtaagaactgtac

SEQ ID NO: 1455712 - DNA, 23 bp, Homo sapiens
gtgtaagaactgtacattgtgag

SEQ ID NO: 1455713 - DNA, 16 bp, Homo sapiens
gtgtaatctctgatta

SEQ ID NO: 1455714 - DNA, 15 bp, Homo sapiens
gtgtaatggatcaaa

SEQ ID NO: 1455715 - DNA, 20 bp, Homo sapiens
gtgtaatttaaaattgtgat

SEQ ID NO: 1455716 - DNA, 19 bp, Homo sapiens
gtgtaatttaagtgacaca

SEQ ID NO: 1455717 - DNA, 20 bp, Homo sapiens
gtgtaatttaagtgacacag

SEQ ID NO: 1455718 - DNA, 19 bp, Homo sapiens
gtgtacacgtctggacccc

SEQ ID NO: 1455719 - DNA, 13 bp, Homo sapiens
gtgtacagtgaat

SEQ ID NO: 1455720 - DNA, 20 bp, Homo sapiens
gtgtacagtgaattgtcttt

SEQ ID NO: 1455721 - DNA, 14 bp, Homo sapiens
gtgtacataactga

SEQ ID NO: 1455722 - DNA, 20 bp, Homo sapiens
gtgtacatagagcaatgttg

SEQ ID NO: 1455723 - DNA, 16 bp, Homo sapiens
gtgtacatatatgtat

SEQ ID NO: 1455724 - DNA, 19 bp, Homo sapiens
gtgtacatatatgtataat

SEQ ID NO: 1455725 - DNA, 17 bp, Homo sapiens
gtgtacatgtacatagt

SEQ ID NO: 1455726 - DNA, 23 bp, Homo sapiens
gtgtactgattcaagaacaagca

SEQ ID NO: 1455727 - DNA, 23 bp, Homo sapiens
gtgtacttcccgggccagggctg

SEQ ID NO: 1455728 - DNA, 14 bp, Homo sapiens
gtgtagccaaggtc

SEQ ID NO: 1455729 - DNA, 16 bp, Homo sapiens
gtgtagccccttttct

SEQ ID NO: 1455730 - DNA, 15 bp, Homo sapiens
gtgtagccgccctga

SEQ ID NO: 1455731 - DNA, 20 bp, Homo sapiens
gtgtagcctaaagggcaggg

SEQ ID NO: 1455732 - DNA, 22 bp, Homo sapiens
gtgtagcctaaagggcagggcc

SEQ ID NO: 1455733 - DNA, 16 bp, Homo sapiens
gtgtagctgtgaaatc

SEQ ID NO: 1455734 - DNA, 20 bp, Homo sapiens
gtgtaggggccacctcctcc

SEQ ID NO: 1455735 - DNA, 23 bp, Homo sapiens
gtgtagtggaagagcagcctgat

SEQ ID NO: 1455736 - DNA, 14 bp, Homo sapiens
gtgtataaaaataa

SEQ ID NO: 1455737 - DNA, 14 bp, Homo sapiens
gtgtatacatgcca

SEQ ID NO: 1455738 - DNA, 18 bp, Homo sapiens
gtgtatagaagtagatta

SEQ ID NO: 1455739 - DNA, 17 bp, Homo sapiens
gtgtatagcttacctga

SEQ ID NO: 1455740 - DNA, 14 bp, Homo sapiens
gtgtatagtgccta

SEQ ID NO: 1455741 - DNA, 21 bp, Homo sapiens
gtgtatagtgttcacaaactg

SEQ ID NO: 1455742 - DNA, 13 bp, Homo sapiens
gtgtatcctgggg

SEQ ID NO: 1455743 - DNA, 22 bp, Homo sapiens
gtgtggagaagccacaggcctg

SEQ ID NO: 1455744 - DNA, 14 bp, Homo sapiens
gtgtggcagtggtt

SEQ ID NO: 1455745 - DNA, 14 bp, Homo sapiens
gtgtggccctgcca

SEQ ID NO: 1455746 - DNA, 18 bp, Homo sapiens
gtgtggccgcctggcagg

SEQ ID NO: 1455747 - DNA, 11 bp, Homo sapiens
gtgtggcctct

SEQ ID NO: 1455748 - DNA, 14 bp, Homo sapiens
gtgtggctgggacc

SEQ ID NO: 1455749 - DNA, 13 bp, Homo sapiens
gtgtgggaaggga

SEQ ID NO: 1455750 - DNA, 17 bp, Homo sapiens
gtgtggggggctggggg

SEQ ID NO: 1455751 - DNA, 14 bp, Homo sapiens
gtgtggggtggggt

SEQ ID NO: 1455752 - DNA, 20 bp, Homo sapiens
gtgtggtatgagggggtggt

SEQ ID NO: 1455753 - DNA, 21 bp, Homo sapiens
gtgtggtctctgccccagcct

SEQ ID NO: 1455754 - DNA, 14 bp, Homo sapiens
gtgtggtggctcat

SEQ ID NO: 1455755 - DNA, 16 bp, Homo sapiens
gtgtgtatatttgtaa

SEQ ID NO: 1455756 - DNA, 23 bp, Homo sapiens
gtgtgtatttgtattaataaagc

SEQ ID NO: 1455757 - DNA, 16 bp, Homo sapiens
caggcaacctcccatc

SEQ ID NO: 1455758 - DNA, 21 bp, Homo sapiens
caggcaacgtgcgtgtctctg

SEQ ID NO: 1455759 - DNA, 15 bp, Homo sapiens
caggcaactgaggca

SEQ ID NO: 1455760 - DNA, 16 bp, Homo sapiens
caggcaactgaggcag

SEQ ID NO: 1455761 - DNA, 17 bp, Homo sapiens
caggcaactgaggcaga

SEQ ID NO: 1455762 - DNA, 17 bp, Homo sapiens
caggcaagcccctcagc

SEQ ID NO: 1455763 - DNA, 18 bp, Homo sapiens
caggcaagcccctcagcc

SEQ ID NO: 1455764 - DNA, 23 bp, Homo sapiens
caggcaagcccctcagcccttgc

SEQ ID NO: 1455765 - DNA, 14 bp, Homo sapiens
caggcacacagcta

SEQ ID NO: 1455766 - DNA, 16 bp, Homo sapiens
caggcacacagggccc

SEQ ID NO: 1455767 - DNA, 15 bp, Homo sapiens
caggcacacttcttc

SEQ ID NO: 1455768 - DNA, 17 bp, Homo sapiens
caggcacagcagctgca

SEQ ID NO: 1455769 - DNA, 13 bp, Homo sapiens
caggcacagctga

SEQ ID NO: 1455770 - DNA, 15 bp, Homo sapiens
caggcacagctgagt

SEQ ID NO: 1455771 - DNA, 14 bp, Homo sapiens
caggcacaggacac

SEQ ID NO: 1455772 - DNA, 13 bp, Homo sapiens
caggcacagggcc

SEQ ID NO: 1455773 - DNA, 14 bp, Homo sapiens
caggcacagggccc

SEQ ID NO: 1455774 - DNA, 18 bp, Homo sapiens
caggcacagggcccgcag

SEQ ID NO: 1455775 - DNA, 13 bp, Homo sapiens
caggcaccaccag

SEQ ID NO: 1455776 - DNA, 15 bp, Homo sapiens
caggcaccaccagga

SEQ ID NO: 1455777 - DNA, 18 bp, Homo sapiens
caggcaccaccaggagca

SEQ ID NO: 1455778 - DNA, 19 bp, Homo sapiens
caggcaccaccaggagcag

SEQ ID NO: 1455779 - DNA, 20 bp, Homo sapiens
caggcaccaccaggagcagc

SEQ ID NO: 1455780 - DNA, 21 bp, Homo sapiens
caggcaccaccaggagcagca

SEQ ID NO: 1455781 - DNA, 23 bp, Homo sapiens
caggcacccatgtgggcgcccac

SEQ ID NO: 1455782 - DNA, 14 bp, Homo sapiens
caggcacctcttcc

SEQ ID NO: 1455783 - DNA, 15 bp, Homo sapiens
caggcacctcttcct

SEQ ID NO: 1455784 - DNA, 12 bp, Homo sapiens
caggcacctggc

SEQ ID NO: 1455785 - DNA, 13 bp, Homo sapiens
caggcacctggcc

SEQ ID NO: 1455786 - DNA, 14 bp, Homo sapiens
caggcacctggcct

SEQ ID NO: 1455787 - DNA, 16 bp, Homo sapiens
caggcacctggcctgc

SEQ ID NO: 1455788 - DNA, 18 bp, Homo sapiens
caggcacctggcctgctg

SEQ ID NO: 1455789 - DNA, 22 bp, Homo sapiens
caggcacctggcctgctgggaa

SEQ ID NO: 1455790 - DNA, 17 bp, Homo sapiens
caggcacgaacccacct

SEQ ID NO: 1455791 - DNA, 17 bp, Homo sapiens
caggcacgggtggtccc

SEQ ID NO: 1455792 - DNA, 20 bp, Homo sapiens
caggcacgggtggtccccgt

SEQ ID NO: 1455793 - DNA, 19 bp, Homo sapiens
caggcactgcccttttcag

SEQ ID NO: 1455794 - DNA, 17 bp, Homo sapiens
caggcagacaagagctg

SEQ ID NO: 1455795 - DNA, 22 bp, Homo sapiens
caggcagacaagagctgctgtc

SEQ ID NO: 1455796 - DNA, 15 bp, Homo sapiens
caggcagagaatcat

SEQ ID NO: 1455797 - DNA, 23 bp, Homo sapiens
caggcagagaatcatacttagca

SEQ ID NO: 1455798 - DNA, 21 bp, Homo sapiens
caggcagagctgagggccctg

SEQ ID NO: 1455799 - DNA, 17 bp, Homo sapiens
caggcagataagttgga

SEQ ID NO: 1455800 - DNA, 16 bp, Homo sapiens
caggcagatctgtgcc

SEQ ID NO: 1455801 - DNA, 12 bp, Homo sapiens
caggcagcacca

SEQ ID NO: 1455802 - DNA, 15 bp, Homo sapiens
caggcagcaccacac

SEQ ID NO: 1455803 - DNA, 18 bp, Homo sapiens
caggcagcaccacactgg

SEQ ID NO: 1455804 - DNA, 17 bp, Homo sapiens
caggcagcctcctttgt

SEQ ID NO: 1455805 - DNA, 19 bp, Homo sapiens
caggcagcctcctttgtgt

SEQ ID NO: 1455806 - DNA, 16 bp, Homo sapiens
caggcagcctctgtca

SEQ ID NO: 1455807 - DNA, 13 bp, Homo sapiens
caggcagccttga

SEQ ID NO: 1455808 - DNA, 15 bp, Homo sapiens
caggcagctccctcc

SEQ ID NO: 1455809 - DNA, 22 bp, Homo sapiens
caggcagctccctcctgcacac

SEQ ID NO: 1455810 - DNA, 15 bp, Homo sapiens
caggcagctggatga

SEQ ID NO: 1455811 - DNA, 18 bp, Homo sapiens
caggcaggaagggcagga

SEQ ID NO: 1455812 - DNA, 17 bp, Homo sapiens
caggcagggagtgtctg

SEQ ID NO: 1455813 - DNA, 19 bp, Homo sapiens
caggcagggagtgtctgca

SEQ ID NO: 1455814 - DNA, 17 bp, Homo sapiens
caggcagggctgggcca

SEQ ID NO: 1455815 - DNA, 22 bp, Homo sapiens
caggcagggctgggccaggtct

SEQ ID NO: 1455816 - DNA, 14 bp, Homo sapiens
caggcaggtctgca

SEQ ID NO: 1455817 - DNA, 13 bp, Homo sapiens
caggcaggtggac

SEQ ID NO: 1455818 - DNA, 18 bp, Homo sapiens
caggcaggtttgccagtg

SEQ ID NO: 1455819 - DNA, 20 bp, Homo sapiens
caggcagtcgggggctggcc

SEQ ID NO: 1455820 - DNA, 24 bp, Homo sapiens
caggcagtcgggggctggcctagg

SEQ ID NO: 1455821 - DNA, 19 bp, Homo sapiens
caggcatagaggcttctcc

SEQ ID NO: 1455822 - DNA, 21 bp, Homo sapiens
caggcatagaggcttctccgc

SEQ ID NO: 1455823 - DNA, 13 bp, Homo sapiens
caggcatcaggaa

SEQ ID NO: 1455824 - DNA, 19 bp, Homo sapiens
caggcatctacacagcctg

SEQ ID NO: 1455825 - DNA, 21 bp, Homo sapiens
caggcatctacacagcctgga

SEQ ID NO: 1455826 - DNA, 23 bp, Homo sapiens
caggcatctacacagcctggact

SEQ ID NO: 1455827 - DNA, 20 bp, Homo sapiens
caggcatgaaattcttccta

SEQ ID NO: 1455828 - DNA, 19 bp, Homo sapiens
caggcatgaatcactgtgc

SEQ ID NO: 1455829 - DNA, 22 bp, Homo sapiens
caggcatgaatcactgtgctca

SEQ ID NO: 1455830 - DNA, 14 bp, Homo sapiens
caggcatggccctg

SEQ ID NO: 1455831 - DNA, 18 bp, Homo sapiens
caggcatggccctgggcg

SEQ ID NO: 1455832 - DNA, 22 bp, Homo sapiens
caggcatggtcccttaaggcac

SEQ ID NO: 1455833 - DNA, 15 bp, Homo sapiens
caggcattcctgaag

SEQ ID NO: 1455834 - DNA, 18 bp, Homo sapiens
caggcattggctcagccc

SEQ ID NO: 1455835 - DNA, 21 bp, Homo sapiens
caggcattggctcagcccgct

SEQ ID NO: 1455836 - DNA, 13 bp, Homo sapiens
caggcatttgttc

SEQ ID NO: 1455837 - DNA, 16 bp, Homo sapiens
caggccaacagcacct

SEQ ID NO: 1455838 - DNA, 21 bp, Homo sapiens
caggccaagagcagaggcagc

SEQ ID NO: 1455839 - DNA, 19 bp, Homo sapiens
caggccaaggccttctcct

SEQ ID NO: 1455840 - DNA, 17 bp, Homo sapiens
caggccaatgttgctga

SEQ ID NO: 1455841 - DNA, 18 bp, Homo sapiens
caggccaatgttgctgat

SEQ ID NO: 1455842 - DNA, 23 bp, Homo sapiens
caggccaccatattcagtgctgt

SEQ ID NO: 1455843 - DNA, 11 bp, Homo sapiens
caggccacctc

SEQ ID NO: 1455844 - DNA, 20 bp, Homo sapiens
caggccacctccccagcatt

SEQ ID NO: 1455845 - DNA, 15 bp, Homo sapiens
caggccactgtggcc

SEQ ID NO: 1455846 - DNA, 16 bp, Homo sapiens
caggccagagggcagt

SEQ ID NO: 1455847 - DNA, 16 bp, Homo sapiens
caggccagcccagcca

SEQ ID NO: 1455848 - DNA, 11 bp, Homo sapiens
caggccagcct

SEQ ID NO: 1455849 - DNA, 23 bp, Homo sapiens
caggccagcctccgagagggaga

SEQ ID NO: 1455850 - DNA, 16 bp, Homo sapiens
caggccaggctgcctc

SEQ ID NO: 1455851 - DNA, 13 bp, Homo sapiens
caggccagggctc

SEQ ID NO: 1455852 - DNA, 22 bp, Homo sapiens
caggccagggctcaccagctgg

SEQ ID NO: 1455853 - DNA, 14 bp, Homo sapiens
caggccagggctcc

SEQ ID NO: 1455854 - DNA, 16 bp, Homo sapiens
caggccagggctcctg

SEQ ID NO: 1455855 - DNA, 21 bp, Homo sapiens
caggccagggctcctgtggca

SEQ ID NO: 1455856 - DNA, 16 bp, Homo sapiens
caggccaggtgcagtg

SEQ ID NO: 1455857 - DNA, 13 bp, Homo sapiens
caggcccactccc

SEQ ID NO: 1455858 - DNA, 21 bp, Homo sapiens
gttaaaaaggccaaagataaa

SEQ ID NO: 1455859 - DNA, 11 bp, Homo sapiens
gttaaaaataa

SEQ ID NO: 1455860 - DNA, 23 bp, Homo sapiens
gttaaaactgtacatttaaaatt

SEQ ID NO: 1455861 - DNA, 20 bp, Homo sapiens
gttaaaagactgcagctgct

SEQ ID NO: 1455862 - DNA, 23 bp, Homo sapiens
gttaaaagttatttgttcattat

SEQ ID NO: 1455863 - DNA, 13 bp, Homo sapiens
gttaaacaaatga

SEQ ID NO: 1455864 - DNA, 19 bp, Homo sapiens
gttaaactattagagtatt

SEQ ID NO: 1455865 - DNA, 14 bp, Homo sapiens
gttaaactgtgaag

SEQ ID NO: 1455866 - DNA, 18 bp, Homo sapiens
gttaaaggcaatggtttg

SEQ ID NO: 1455867 - DNA, 17 bp, Homo sapiens
gttaaatattttgctaa

SEQ ID NO: 1455868 - DNA, 18 bp, Homo sapiens
gttaaatgtaatataatg

SEQ ID NO: 1455869 - DNA, 19 bp, Homo sapiens
gttaaattcagtaatgcag

SEQ ID NO: 1455870 - DNA, 14 bp, Homo sapiens
gttaacaatgatat

SEQ ID NO: 1455871 - DNA, 23 bp, Homo sapiens
gttaacatctagcctaaagtata

SEQ ID NO: 1455872 - DNA, 24 bp, Homo sapiens
gttaacattccaagactctagagt

SEQ ID NO: 1455873 - DNA, 18 bp, Homo sapiens
gttaacattgaccaagaa

SEQ ID NO: 1455874 - DNA, 21 bp, Homo sapiens
gttaacattgaccaagaactg

SEQ ID NO: 1455875 - DNA, 16 bp, Homo sapiens
gttaaccaaattttga

SEQ ID NO: 1455876 - DNA, 19 bp, Homo sapiens
gttaaccaaattttgagca

SEQ ID NO: 1455877 - DNA, 22 bp, Homo sapiens
gttaacccttcatcttcctgtg

SEQ ID NO: 1455878 - DNA, 15 bp, Homo sapiens
gttaacttgaagaaa

SEQ ID NO: 1455879 - DNA, 16 bp, Homo sapiens
gttaacttggtcagag

SEQ ID NO: 1455880 - DNA, 14 bp, Homo sapiens
gttaacttgtatat

SEQ ID NO: 1455881 - DNA, 14 bp, Homo sapiens
gttaagaaaataaa

SEQ ID NO: 1455882 - DNA, 17 bp, Homo sapiens
gttaagaagtttgttat

SEQ ID NO: 1455883 - DNA, 17 bp, Homo sapiens
gttaagaatgaagttct

SEQ ID NO: 1455884 - DNA, 21 bp, Homo sapiens
gttaagaatgaagttctgcta

SEQ ID NO: 1455885 - DNA, 12 bp, Homo sapiens
gttaaggcctga

SEQ ID NO: 1455886 - DNA, 14 bp, Homo sapiens
gttaagtatgtgta

SEQ ID NO: 1455887 - DNA, 22 bp, Homo sapiens
gttaagtctaaatatttcctta

SEQ ID NO: 1455888 - DNA, 16 bp, Homo sapiens
gttaagtctcctgtct

SEQ ID NO: 1455889 - DNA, 21 bp, Homo sapiens
gttaagtctcctgtcttatgg

SEQ ID NO: 1455890 - DNA, 20 bp, Homo sapiens
gttaatacacagtactttat

SEQ ID NO: 1455891 - DNA, 13 bp, Homo sapiens
gttaataccagct

SEQ ID NO: 1455892 - DNA, 12 bp, Homo sapiens
gttaatcttagg

SEQ ID NO: 1455893 - DNA, 17 bp, Homo sapiens
gttaatgaaaatgtcag

SEQ ID NO: 1455894 - DNA, 13 bp, Homo sapiens
gttaatgagccat

SEQ ID NO: 1455895 - DNA, 13 bp, Homo sapiens
gttaatgctttct

SEQ ID NO: 1455896 - DNA, 17 bp, Homo sapiens
gttaatgtcattgctaa

SEQ ID NO: 1455897 - DNA, 22 bp, Homo sapiens
gttaatgtcattgctaaaaaat

SEQ ID NO: 1455898 - DNA, 19 bp, Homo sapiens
gttaattccaattatatga

SEQ ID NO: 1455899 - DNA, 19 bp, Homo sapiens
gttaattgcgtagaggcta

SEQ ID NO: 1455900 - DNA, 21 bp, Homo sapiens
gttaattttgctaactgggtt

SEQ ID NO: 1455901 - DNA, 14 bp, Homo sapiens
gttaatttttccaa

SEQ ID NO: 1455902 - DNA, 19 bp, Homo sapiens
gttaatttttcctgcatgt

SEQ ID NO: 1455903 - DNA, 14 bp, Homo sapiens
gttacaaactgcaa

SEQ ID NO: 1455904 - DNA, 21 bp, Homo sapiens
gttacaaactgcaatagagac

SEQ ID NO: 1455905 - DNA, 17 bp, Homo sapiens
gttacaaattataatgt

SEQ ID NO: 1455906 - DNA, 20 bp, Homo sapiens
gttacaaattataatgtatt

SEQ ID NO: 1455907 - DNA, 20 bp, Homo sapiens
gttacaataaagtttacaag

SEQ ID NO: 1455908 - DNA, 16 bp, Homo sapiens
gttacacagcccaaga

SEQ ID NO: 1455909 - DNA, 16 bp, Homo sapiens
gttacacattaaacag

SEQ ID NO: 1455910 - DNA, 22 bp, Homo sapiens
gttacaccctttcttgacaaaa

SEQ ID NO: 1455911 - DNA, 16 bp, Homo sapiens
gttacactaaaaggtg

SEQ ID NO: 1455912 - DNA, 13 bp, Homo sapiens
gttacagagacct

SEQ ID NO: 1455913 - DNA, 22 bp, Homo sapiens
gttacagagacctatgtaagaa

SEQ ID NO: 1455914 - DNA, 17 bp, Homo sapiens
gttacagctctgtagtt

SEQ ID NO: 1455915 - DNA, 22 bp, Homo sapiens
gttacaggcaccgagaatgttg

SEQ ID NO: 1455916 - DNA, 22 bp, Homo sapiens
gttacagggaagtggtctcccc

SEQ ID NO: 1455917 - DNA, 13 bp, Homo sapiens
gttacagttctgt

SEQ ID NO: 1455918 - DNA, 19 bp, Homo sapiens
gttacataaggatgacttt

SEQ ID NO: 1455919 - DNA, 22 bp, Homo sapiens
gttacataaggatgactttttt

SEQ ID NO: 1455920 - DNA, 17 bp, Homo sapiens
gttacccactgccatgc

SEQ ID NO: 1455921 - DNA, 15 bp, Homo sapiens
gttacccaggctgga

SEQ ID NO: 1455922 - DNA, 20 bp, Homo sapiens
gttacccaggctggagtgca

SEQ ID NO: 1455923 - DNA, 14 bp, Homo sapiens
gttacctgtgtgct

SEQ ID NO: 1455924 - DNA, 18 bp, Homo sapiens
gttacctgttagctccct

SEQ ID NO: 1455925 - DNA, 20 bp, Homo sapiens
gttaccttatagttactgtg

SEQ ID NO: 1455926 - DNA, 22 bp, Homo sapiens
gttaccttatagttactgtgta

SEQ ID NO: 1455927 - DNA, 14 bp, Homo sapiens
gttacgaagacaaa

SEQ ID NO: 1455928 - DNA, 18 bp, Homo sapiens
gttacgtagcctaaggct

SEQ ID NO: 1455929 - DNA, 19 bp, Homo sapiens
gttactccattactgtgat

SEQ ID NO: 1455930 - DNA, 20 bp, Homo sapiens
gttactccattactgtgatt

SEQ ID NO: 1455931 - DNA, 17 bp, Homo sapiens
gttactctccaacctgg

SEQ ID NO: 1455932 - DNA, 12 bp, Homo sapiens
gttactgctttg

SEQ ID NO: 1455933 - DNA, 14 bp, Homo sapiens
gttactgtaaaatg

SEQ ID NO: 1455934 - DNA, 17 bp, Homo sapiens
gttactgtaaaatgcaa

SEQ ID NO: 1455935 - DNA, 19 bp, Homo sapiens
gttactgtaaaatgcaaaa

SEQ ID NO: 1455936 - DNA, 13 bp, Homo sapiens
gttacttcctatc

SEQ ID NO: 1455937 - DNA, 21 bp, Homo sapiens
gttagaaaatgacttatttct

SEQ ID NO: 1455938 - DNA, 18 bp, Homo sapiens
gttagaagaagaggaaga

SEQ ID NO: 1455939 - DNA, 17 bp, Homo sapiens
gttagaatcaaatactc

SEQ ID NO: 1455940 - DNA, 22 bp, Homo sapiens
gttagacgccttccaggtcagg

SEQ ID NO: 1455941 - DNA, 23 bp, Homo sapiens
gttagactgacttgtttgtcttc

SEQ ID NO: 1455942 - DNA, 15 bp, Homo sapiens
gttagagaataaatt

SEQ ID NO: 1455943 - DNA, 22 bp, Homo sapiens
gttagaggttttaaagtgatta

SEQ ID NO: 1455944 - DNA, 21 bp, Homo sapiens
gttagatatagagtcattgta

SEQ ID NO: 1455945 - DNA, 15 bp, Homo sapiens
gttagcaaactttgt

SEQ ID NO: 1455946 - DNA, 15 bp, Homo sapiens
gttagcatccaggct

SEQ ID NO: 1455947 - DNA, 16 bp, Homo sapiens
gttagcatccaggctg

SEQ ID NO: 1455948 - DNA, 16 bp, Homo sapiens
gttagccccagaaaat

SEQ ID NO: 1455949 - DNA, 14 bp, Homo sapiens
gttagccccaggga

SEQ ID NO: 1455950 - DNA, 22 bp, Homo sapiens
gttagccccagggatcactggc

SEQ ID NO: 1455951 - DNA, 13 bp, Homo sapiens
gttagccctcagt

SEQ ID NO: 1455952 - DNA, 20 bp, Homo sapiens
gttagctcaggaggcttgga

SEQ ID NO: 1455953 - DNA, 18 bp, Homo sapiens
gttagctccctgtggggc

SEQ ID NO: 1455954 - DNA, 21 bp, Homo sapiens
gttagctccctgtggggcagg

SEQ ID NO: 1455955 - DNA, 14 bp, Homo sapiens
gttagctcctgtgg

SEQ ID NO: 1455956 - DNA, 15 bp, Homo sapiens
gttagctcctgtggc

SEQ ID NO: 1455957 - DNA, 17 bp, Homo sapiens
gttagctgaagaattga

SEQ ID NO: 1455958 - DNA, 17 bp, Homo sapiens
gttaggaggctgcatgc

SEQ ID NO: 1455959 - DNA, 19 bp, Homo sapiens
gttaggaggctgcatgctc

SEQ ID NO: 1455960 - DNA, 23 bp, Homo sapiens
gttaggaggctgcatgctctgga

SEQ ID NO: 1455961 - DNA, 13 bp, Homo sapiens
gttaggaggtcct

SEQ ID NO: 1455962 - DNA, 23 bp, Homo sapiens
gttaggatttaacagtcatttaa

SEQ ID NO: 1455963 - DNA, 19 bp, Homo sapiens
gttagggagagagaagcag

SEQ ID NO: 1455964 - DNA, 20 bp, Homo sapiens
gttagggctgcttttcttaa

SEQ ID NO: 1455965 - DNA, 23 bp, Homo sapiens
gttagggtgctctggaagagagg

SEQ ID NO: 1455966 - DNA, 14 bp, Homo sapiens
gttagtatcttttg

SEQ ID NO: 1455967 - DNA, 17 bp, Homo sapiens
gttagtatcttttgata

SEQ ID NO: 1455968 - DNA, 18 bp, Homo sapiens
gttagtatcttttgatat

SEQ ID NO: 1455969 - DNA, 13 bp, Homo sapiens
gttagtggcaccg

SEQ ID NO: 1455970 - DNA, 15 bp, Homo sapiens
gttagtgggcaggtg

SEQ ID NO: 1455971 - DNA, 17 bp, Homo sapiens
gttagttaccttatagt

SEQ ID NO: 1455972 - DNA, 19 bp, Homo sapiens
gtggagggtttgcactcca

SEQ ID NO: 1455973 - DNA, 19 bp, Homo sapiens
gtggaggttgcagtgagct

SEQ ID NO: 1455974 - DNA, 22 bp, Homo sapiens
gtggagtcaggcttctcttgct

SEQ ID NO: 1455975 - DNA, 18 bp, Homo sapiens
gtggagtctgagtctgag

SEQ ID NO: 1455976 - DNA, 17 bp, Homo sapiens
gtggataactagccaga

SEQ ID NO: 1455977 - DNA, 12 bp, Homo sapiens
gtggataatcag

SEQ ID NO: 1455978 - DNA, 16 bp, Homo sapiens
gtggatataaaatgtg

SEQ ID NO: 1455979 - DNA, 15 bp, Homo sapiens
gtggatatcagggta

SEQ ID NO: 1455980 - DNA, 14 bp, Homo sapiens
gtggatattgttac

SEQ ID NO: 1455981 - DNA, 21 bp, Homo sapiens
gtggatcacacctcagtggga

SEQ ID NO: 1455982 - DNA, 22 bp, Homo sapiens
gtggatcacacctcagtgggaa

SEQ ID NO: 1455983 - DNA, 14 bp, Homo sapiens
gtggatcacagagg

SEQ ID NO: 1455984 - DNA, 13 bp, Homo sapiens
gtggatcacctga

SEQ ID NO: 1455985 - DNA, 15 bp, Homo sapiens
gtggatcacctgagg

SEQ ID NO: 1455986 - DNA, 14 bp, Homo sapiens
gtggatctccttcc

SEQ ID NO: 1455987 - DNA, 17 bp, Homo sapiens
gtggatctccttccctt

SEQ ID NO: 1455988 - DNA, 21 bp, Homo sapiens
gtggatctccttcccttctct

SEQ ID NO: 1455989 - DNA, 23 bp, Homo sapiens
gtggatctccttcccttctcttg

SEQ ID NO: 1455990 - DNA, 17 bp, Homo sapiens
gtggatgacagggcaga

SEQ ID NO: 1455991 - DNA, 19 bp, Homo sapiens
gtggatggccccagcacag

SEQ ID NO: 1455992 - DNA, 15 bp, Homo sapiens
gtggatgggaatttg

SEQ ID NO: 1455993 - DNA, 16 bp, Homo sapiens
gtggatgggaatttgt

SEQ ID NO: 1455994 - DNA, 22 bp, Homo sapiens
gtggatgggaatttgtcagcgt

SEQ ID NO: 1455995 - DNA, 17 bp, Homo sapiens
gtggatgttatgaacag

SEQ ID NO: 1455996 - DNA, 18 bp, Homo sapiens
gtggattaatgtcaatgt

SEQ ID NO: 1455997 - DNA, 17 bp, Homo sapiens
gtggattccagtgcatg

SEQ ID NO: 1455998 - DNA, 14 bp, Homo sapiens
gtggattggctttg

SEQ ID NO: 1455999 - DNA, 22 bp, Homo sapiens
gtggattgtttaaagaagctct

SEQ ID NO: 1456000 - DNA, 21 bp, Homo sapiens
gtggatttgtacttgctcctt

SEQ ID NO: 1456001 - DNA, 18 bp, Homo sapiens
gtggattttgtttaaaaa

SEQ ID NO: 1456002 - DNA, 14 bp, Homo sapiens
gtggcacagccctg

SEQ ID NO: 1456003 - DNA, 16 bp, Homo sapiens
gtggcacctcctgaga

SEQ ID NO: 1456004 - DNA, 17 bp, Homo sapiens
gtggcacctcctgagaa

SEQ ID NO: 1456005 - DNA, 19 bp, Homo sapiens
gtggcacggagagaaggcc

SEQ ID NO: 1456006 - DNA, 18 bp, Homo sapiens
gtggcacgtattgctgtg

SEQ ID NO: 1456007 - DNA, 19 bp, Homo sapiens
gtggcactgggagggggtg

SEQ ID NO: 1456008 - DNA, 21 bp, Homo sapiens
gtggcactggtaggttgggac

SEQ ID NO: 1456009 - DNA, 22 bp, Homo sapiens
gtggcactggtaggttgggaca

SEQ ID NO: 1456010 - DNA, 18 bp, Homo sapiens
gtggcagaaaagaggaga

SEQ ID NO: 1456011 - DNA, 20 bp, Homo sapiens
gtggcagaaaagaggagacc

SEQ ID NO: 1456012 - DNA, 15 bp, Homo sapiens
gtggcagagttacag

SEQ ID NO: 1456013 - DNA, 19 bp, Homo sapiens
gtggcagattttacaaaag

SEQ ID NO: 1456014 - DNA, 19 bp, Homo sapiens
gtggcagcaacggcacagc

SEQ ID NO: 1456015 - DNA, 12 bp, Homo sapiens
gtggcagcagcc

SEQ ID NO: 1456016 - DNA, 19 bp, Homo sapiens
gtggcagccatgcctcatg

SEQ ID NO: 1456017 - DNA, 20 bp, Homo sapiens
gtggcagccatgcctcatgc

SEQ ID NO: 1456018 - DNA, 12 bp, Homo sapiens
gtggcagccctg

SEQ ID NO: 1456019 - DNA, 14 bp, Homo sapiens
gtggcagccctgta

SEQ ID NO: 1456020 - DNA, 20 bp, Homo sapiens
gtggcagccgtcccaggcca

SEQ ID NO: 1456021 - DNA, 12 bp, Homo sapiens
gtggcagctggg

SEQ ID NO: 1456022 - DNA, 18 bp, Homo sapiens
gtggcaggggacaggagt

SEQ ID NO: 1456023 - DNA, 16 bp, Homo sapiens
gtggcaggggagcagg

SEQ ID NO: 1456024 - DNA, 20 bp, Homo sapiens
gtggcaggtcactgtcactg

SEQ ID NO: 1456025 - DNA, 21 bp, Homo sapiens
gtggcaggtgggctgcctgct

SEQ ID NO: 1456026 - DNA, 14 bp, Homo sapiens
gtggcagtggccag

SEQ ID NO: 1456027 - DNA, 19 bp, Homo sapiens
gtggcatcatctcagctca

SEQ ID NO: 1456028 - DNA, 16 bp, Homo sapiens
gtggcatgtgctgtga

SEQ ID NO: 1456029 - DNA, 14 bp, Homo sapiens
gtggcatgtggcct

SEQ ID NO: 1456030 - DNA, 17 bp, Homo sapiens
gtggcatgtggcctgtg

SEQ ID NO: 1456031 - DNA, 19 bp, Homo sapiens
gtggcatgttgatttctat

SEQ ID NO: 1456032 - DNA, 21 bp, Homo sapiens
gtggcatttcaattcctggcc

SEQ ID NO: 1456033 - DNA, 23 bp, Homo sapiens
gtggcatttcaattcctggccct

SEQ ID NO: 1456034 - DNA, 14 bp, Homo sapiens
gtggcatttccaaa

SEQ ID NO: 1456035 - DNA, 15 bp, Homo sapiens
gtggcatttccaaac

SEQ ID NO: 1456036 - DNA, 16 bp, Homo sapiens
gtggcatttccaaaca

SEQ ID NO: 1456037 - DNA, 21 bp, Homo sapiens
gtggccaaataggagggagac

SEQ ID NO: 1456038 - DNA, 22 bp, Homo sapiens
gtggccaaataggagggagact

SEQ ID NO: 1456039 - DNA, 22 bp, Homo sapiens
gtggccaagaagcagtggcctt

SEQ ID NO: 1456040 - DNA, 23 bp, Homo sapiens
gtggccaagaagcagtggcctta

SEQ ID NO: 1456041 - DNA, 13 bp, Homo sapiens
gtggccaccagta

SEQ ID NO: 1456042 - DNA, 22 bp, Homo sapiens
gtggccacgggggcagtgtgag

SEQ ID NO: 1456043 - DNA, 20 bp, Homo sapiens
gtggccagaagagcttgtca

SEQ ID NO: 1456044 - DNA, 11 bp, Homo sapiens
gtggccagagc

SEQ ID NO: 1456045 - DNA, 22 bp, Homo sapiens
gtggccagagctggaaggcagg

SEQ ID NO: 1456046 - DNA, 19 bp, Homo sapiens
gtggccagaggtgtcaccc

SEQ ID NO: 1456047 - DNA, 15 bp, Homo sapiens
gtggccagcccggct

SEQ ID NO: 1456048 - DNA, 13 bp, Homo sapiens
gtggcccagagcc

SEQ ID NO: 1456049 - DNA, 12 bp, Homo sapiens
gtggccccaccc

SEQ ID NO: 1456050 - DNA, 23 bp, Homo sapiens
gtggccctgccctctccttcctt

SEQ ID NO: 1456051 - DNA, 20 bp, Homo sapiens
gtggccctgtgcctgggccc

SEQ ID NO: 1456052 - DNA, 11 bp, Homo sapiens
gtggcccttgc

SEQ ID NO: 1456053 - DNA, 16 bp, Homo sapiens
gtggccgcacgcctct

SEQ ID NO: 1456054 - DNA, 18 bp, Homo sapiens
gtggccgcacgcctctcc

SEQ ID NO: 1456055 - DNA, 15 bp, Homo sapiens
gtggccgcctggcag

SEQ ID NO: 1456056 - DNA, 19 bp, Homo sapiens
gtggccgcctggcaggtgg

SEQ ID NO: 1456057 - DNA, 18 bp, Homo sapiens
gtggccgtctcctccctc

SEQ ID NO: 1456058 - DNA, 14 bp, Homo sapiens
gtggcctctgcctg

SEQ ID NO: 1456059 - DNA, 21 bp, Homo sapiens
gtggcctcttgagcagtggct

SEQ ID NO: 1456060 - DNA, 23 bp, Homo sapiens
gtggcctcttggctatttctgtg

SEQ ID NO: 1456061 - DNA, 22 bp, Homo sapiens
gtggcctgctaaggctcctcct

SEQ ID NO: 1456062 - DNA, 13 bp, Homo sapiens
gtggcctggccag

SEQ ID NO: 1456063 - DNA, 15 bp, Homo sapiens
gtggcctggtccctg

SEQ ID NO: 1456064 - DNA, 16 bp, Homo sapiens
gtggcctgtggcctgt

SEQ ID NO: 1456065 - DNA, 16 bp, Homo sapiens
gtggcctgtgtccagc

SEQ ID NO: 1456066 - DNA, 17 bp, Homo sapiens
gtggcctgtgtccagca

SEQ ID NO: 1456067 - DNA, 20 bp, Homo sapiens
gtggcctgtgtccagcagct

SEQ ID NO: 1456068 - DNA, 22 bp, Homo sapiens
gtggcctgtgtccagcagctgc

SEQ ID NO: 1456069 - DNA, 23 bp, Homo sapiens
gtggcctgtgtccagcagctgcg

SEQ ID NO: 1456070 - DNA, 15 bp, Homo sapiens
gtggcctgttcccta

SEQ ID NO: 1456071 - DNA, 21 bp, Homo sapiens
gtggccttccccttttgcctg

SEQ ID NO: 1456072 - DNA, 12 bp, Homo sapiens
gtggccttgccc

SEQ ID NO: 1456073 - DNA, 23 bp, Homo sapiens
gtggccttgcccgccagcctcag

SEQ ID NO: 1456074 - DNA, 24 bp, Homo sapiens
gtggcgcaatctcggctcactgca

SEQ ID NO: 1456075 - DNA, 14 bp, Homo sapiens
gtggcgcaggtgcc

SEQ ID NO: 1456076 - DNA, 22 bp, Homo sapiens
gtggcgcaggtgccatgcctgc

SEQ ID NO: 1456077 - DNA, 22 bp, Homo sapiens
gtggcgccgtctccaggggctg

SEQ ID NO: 1456078 - DNA, 15 bp, Homo sapiens
gtggcggggcagcag

SEQ ID NO: 1456079 - DNA, 13 bp, Homo sapiens
gtggcggtggacc

SEQ ID NO: 1456080 - DNA, 16 bp, Homo sapiens
gtggcgtgagaggcaa

SEQ ID NO: 1456081 - DNA, 20 bp, Homo sapiens
gtggcgtgagaggcaatgac

SEQ ID NO: 1456082 - DNA, 12 bp, Homo sapiens
gtggctaggcag

SEQ ID NO: 1456083 - DNA, 17 bp, Homo sapiens
gtggctagtcagagaga

SEQ ID NO: 1456084 - DNA, 19 bp, Homo sapiens
gtggctagtcagagagagt

SEQ ID NO: 1456085 - DNA, 23 bp, Homo sapiens
gtggctagtggggtgaacagctg

SEQ ID NO: 1456086 - DNA, 14 bp, Homo sapiens
gtggctcatgcctg

SEQ ID NO: 1456087 - DNA, 17 bp, Homo sapiens
gtggctcattcttttca

SEQ ID NO: 1456088 - DNA, 17 bp, Homo sapiens
caggaacgagcactggc

SEQ ID NO: 1456089 - DNA, 18 bp, Homo sapiens
caggaacgagcactggcc

SEQ ID NO: 1456090 - DNA, 20 bp, Homo sapiens
caggaacgagcactggccag

SEQ ID NO: 1456091 - DNA, 14 bp, Homo sapiens
caggaactgggctg

SEQ ID NO: 1456092 - DNA, 18 bp, Homo sapiens
caggaactgggctgggcc

SEQ ID NO: 1456093 - DNA, 21 bp, Homo sapiens
caggaagaaatcacagaatca

SEQ ID NO: 1456094 - DNA, 12 bp, Homo sapiens
caggaagaggcc

SEQ ID NO: 1456095 - DNA, 14 bp, Homo sapiens
caggaagcacccca

SEQ ID NO: 1456096 - DNA, 15 bp, Homo sapiens
caggaagcaccccat

SEQ ID NO: 1456097 - DNA, 17 bp, Homo sapiens
caggaagcaccccatgc

SEQ ID NO: 1456098 - DNA, 17 bp, Homo sapiens
caggaagccaggctgag

SEQ ID NO: 1456099 - DNA, 15 bp, Homo sapiens
caggaagctcagcct

SEQ ID NO: 1456100 - DNA, 16 bp, Homo sapiens
caggaagctcagcctt

SEQ ID NO: 1456101 - DNA, 19 bp, Homo sapiens
caggaagctctcttaaaat

SEQ ID NO: 1456102 - DNA, 14 bp, Homo sapiens
caggaagctggcag

SEQ ID NO: 1456103 - DNA, 18 bp, Homo sapiens
caggaaggacaggaagct

SEQ ID NO: 1456104 - DNA, 20 bp, Homo sapiens
caggaaggacaggaagctgg

SEQ ID NO: 1456105 - DNA, 12 bp, Homo sapiens
caggaaggagag

SEQ ID NO: 1456106 - DNA, 14 bp, Homo sapiens
caggaaggagagcc

SEQ ID NO: 1456107 - DNA, 15 bp, Homo sapiens
caggaaggagagcct

SEQ ID NO: 1456108 - DNA, 12 bp, Homo sapiens
caggaaggcagc

SEQ ID NO: 1456109 - DNA, 15 bp, Homo sapiens
caggaaggcagctgc

SEQ ID NO: 1456110 - DNA, 18 bp, Homo sapiens
caggaaggcagctgctct

SEQ ID NO: 1456111 - DNA, 19 bp, Homo sapiens
caggaaggcagctgctctt

SEQ ID NO: 1456112 - DNA, 21 bp, Homo sapiens
caggaagggcaggaaggagag

SEQ ID NO: 1456113 - DNA, 22 bp, Homo sapiens
caggaagggcctacagcccatt

SEQ ID NO: 1456114 - DNA, 21 bp, Homo sapiens
caggaaggtagcccagcactg
